United States Patent 11,369,692 (MATERIALS AND METHODS FOR TREATMENT OF DUCHENNE MUSCULAR DYSTROPHY) - sequence listing, part 26

SEQ ID NO: 855522 - DNA, 22 bp, Artificial Sequence
  chemically synthesized
taacttttggtgaatagattca

SEQ ID NO: 855523 - DNA, 22 bp, Artificial Sequence
  chemically synthesized
attataacttttggtgaataga

SEQ ID NO: 855524 - DNA, 22 bp, Artificial Sequence
  chemically synthesized
tgattataacttttggtgaata

SEQ ID NO: 855525 - DNA, 22 bp, Artificial Sequence
  chemically synthesized
tgactgaatctattcaccaaaa

SEQ ID NO: 855526 - DNA, 22 bp, Artificial Sequence
  chemically synthesized
gactgaatctattcaccaaaag

SEQ ID NO: 855527 - DNA, 22 bp, Artificial Sequence
  chemically synthesized
actgaatctattcaccaaaagt

SEQ ID NO: 855528 - DNA, 22 bp, Artificial Sequence
  chemically synthesized
aatctattcaccaaaagttata

SEQ ID NO: 855529 - DNA, 22 bp, Artificial Sequence
  chemically synthesized
cagaataattctgattataact

SEQ ID NO: 855530 - DNA, 22 bp, Artificial Sequence
  chemically synthesized
ttcaccaaaagttataatcaga

SEQ ID NO: 855531 - DNA, 22 bp, Artificial Sequence
  chemically synthesized
gctacagaataattctgattat

SEQ ID NO: 855532 - DNA, 22 bp, Artificial Sequence
  chemically synthesized
accaaaagttataatcagaatt

SEQ ID NO: 855533 - DNA, 22 bp, Artificial Sequence
  chemically synthesized
aattagctacagaataattctg

SEQ ID NO: 855534 - DNA, 22 bp, Artificial Sequence
  chemically synthesized
gaattagctacagaataattct

SEQ ID NO: 855535 - DNA, 22 bp, Artificial Sequence
  chemically synthesized
taatcagaattattctgtagct

SEQ ID NO: 855536 - DNA, 22 bp, Artificial Sequence
  chemically synthesized
tacacaaaaagcatttgaatta

SEQ ID NO: 855537 - DNA, 22 bp, Artificial Sequence
  chemically synthesized
ttctgtagctaattcaaatgct

SEQ ID NO: 855538 - DNA, 22 bp, Artificial Sequence
  chemically synthesized
tctatacacaaaaagcatttga

SEQ ID NO: 855539 - DNA, 22 bp, Artificial Sequence
  chemically synthesized
tgtagctaattcaaatgctttt

SEQ ID NO: 855540 - DNA, 22 bp, Artificial Sequence
  chemically synthesized
tgtctatacacaaaaagcattt

SEQ ID NO: 855541 - DNA, 22 bp, Artificial Sequence
  chemically synthesized
tagctaattcaaatgctttttg

SEQ ID NO: 855542 - DNA, 22 bp, Artificial Sequence
  chemically synthesized
aaactctgtctatacacaaaaa

SEQ ID NO: 855543 - DNA, 22 bp, Artificial Sequence
  chemically synthesized
aaaactctgtctatacacaaaa

SEQ ID NO: 855544 - DNA, 22 bp, Artificial Sequence
  chemically synthesized
attcaaatgctttttgtgtata

SEQ ID NO: 855545 - DNA, 22 bp, Artificial Sequence
  chemically synthesized
taaaactctgtctatacacaaa

SEQ ID NO: 855546 - DNA, 22 bp, Artificial Sequence
  chemically synthesized
ttaaaactctgtctatacacaa

SEQ ID NO: 855547 - DNA, 22 bp, Artificial Sequence
  chemically synthesized
tttaaaactctgtctatacaca

SEQ ID NO: 855548 - DNA, 22 bp, Artificial Sequence
  chemically synthesized
aaatgctttttgtgtatagaca

SEQ ID NO: 855549 - DNA, 22 bp, Artificial Sequence
  chemically synthesized
tgattttttaaaactctgtcta

SEQ ID NO: 855550 - DNA, 22 bp, Artificial Sequence
  chemically synthesized
tttgtgtatagacagagtttta

SEQ ID NO: 855551 - DNA, 22 bp, Artificial Sequence
  chemically synthesized
ttgtgtatagacagagttttaa

SEQ ID NO: 855552 - DNA, 22 bp, Artificial Sequence
  chemically synthesized
tgtgtatagacagagttttaaa

SEQ ID NO: 855553 - DNA, 22 bp, Artificial Sequence
  chemically synthesized
gtgtatagacagagttttaaaa

SEQ ID NO: 855554 - DNA, 22 bp, Artificial Sequence
  chemically synthesized
aaaattatgattttttaaaact

SEQ ID NO: 855555 - DNA, 22 bp, Artificial Sequence
  chemically synthesized
tgtatagacagagttttaaaaa

SEQ ID NO: 855556 - DNA, 22 bp, Artificial Sequence
  chemically synthesized
aaaaattatgattttttaaaac

SEQ ID NO: 855557 - DNA, 22 bp, Artificial Sequence
  chemically synthesized
aggtcaaagtacttaaaaatta

SEQ ID NO: 855558 - DNA, 22 bp, Artificial Sequence
  chemically synthesized
taaaaaatcataatttttaagt

SEQ ID NO: 855559 - DNA, 22 bp, Artificial Sequence
  chemically synthesized
aaaaaatcataatttttaagta

SEQ ID NO: 855560 - DNA, 22 bp, Artificial Sequence
  chemically synthesized
ttaaggtcaaagtacttaaaaa

SEQ ID NO: 855561 - DNA, 22 bp, Artificial Sequence
  chemically synthesized
aaaaatcataatttttaagtac

SEQ ID NO: 855562 - DNA, 22 bp, Artificial Sequence
  chemically synthesized
ttgttaaggtcaaagtacttaa

SEQ ID NO: 855563 - DNA, 22 bp, Artificial Sequence
  chemically synthesized
ttgttgttaaggtcaaagtact

SEQ ID NO: 855564 - DNA, 22 bp, Artificial Sequence
  chemically synthesized
ttgttgttgttaaggtcaaagt

SEQ ID NO: 855565 - DNA, 22 bp, Artificial Sequence
  chemically synthesized
gttgttgttgttaaggtcaaag

SEQ ID NO: 855566 - DNA, 22 bp, Artificial Sequence
  chemically synthesized
tgttgttgttgttaaggtcaaa

SEQ ID NO: 855567 - DNA, 22 bp, Artificial Sequence
  chemically synthesized
ttgttgttgttgttaaggtcaa

SEQ ID NO: 855568 - DNA, 22 bp, Artificial Sequence
  chemically synthesized
ttaagtactttgaccttaacaa

SEQ ID NO: 855569 - DNA, 22 bp, Artificial Sequence
  chemically synthesized
taagtactttgaccttaacaac

SEQ ID NO: 855570 - DNA, 22 bp, Artificial Sequence
  chemically synthesized
atttttgttgttgttgttaagg

SEQ ID NO: 855571 - DNA, 22 bp, Artificial Sequence
  chemically synthesized
aagtactttgaccttaacaaca

SEQ ID NO: 855572 - DNA, 22 bp, Artificial Sequence
  chemically synthesized
aatttttgttgttgttgttaag

SEQ ID NO: 855573 - DNA, 22 bp, Artificial Sequence
  chemically synthesized
agtactttgaccttaacaacaa

SEQ ID NO: 855574 - DNA, 22 bp, Artificial Sequence
  chemically synthesized
tgaccttaacaacaacaacaaa

SEQ ID NO: 855575 - DNA, 22 bp, Artificial Sequence
  chemically synthesized
gaccttaacaacaacaacaaaa

SEQ ID NO: 855576 - DNA, 22 bp, Artificial Sequence
  chemically synthesized
aatgagtttaatttttgttgtt

SEQ ID NO: 855577 - DNA, 22 bp, Artificial Sequence
  chemically synthesized
accttaacaacaacaacaaaaa

SEQ ID NO: 855578 - DNA, 22 bp, Artificial Sequence
  chemically synthesized
gaatgagtttaatttttgttgt

SEQ ID NO: 855579 - DNA, 22 bp, Artificial Sequence
  chemically synthesized
cttgaatgagtttaatttttgt

SEQ ID NO: 855580 - DNA, 22 bp, Artificial Sequence
  chemically synthesized
aacaacaacaacaaaaattaaa

SEQ ID NO: 855581 - DNA, 22 bp, Artificial Sequence
  chemically synthesized
acaacaacaacaaaaattaaac

SEQ ID NO: 855582 - DNA, 22 bp, Artificial Sequence
  chemically synthesized
aatgggacataattacttgaat

SEQ ID NO: 855583 - DNA, 22 bp, Artificial Sequence
  chemically synthesized
aaatgggacataattacttgaa

SEQ ID NO: 855584 - DNA, 22 bp, Artificial Sequence
  chemically synthesized
aactcattcaagtaattatgtc

SEQ ID NO: 855585 - DNA, 22 bp, Artificial Sequence
  chemically synthesized
attcaagtaattatgtcccatt

SEQ ID NO: 855586 - DNA, 22 bp, Artificial Sequence
  chemically synthesized
aagtaattatgtcccatttaaa

SEQ ID NO: 855587 - DNA, 22 bp, Artificial Sequence
  chemically synthesized
gtgggtatagtgtatatttaaa

SEQ ID NO: 855588 - DNA, 22 bp, Artificial Sequence
  chemically synthesized
agtgggtatagtgtatatttaa

SEQ ID NO: 855589 - DNA, 22 bp, Artificial Sequence
  chemically synthesized
tagtgggtatagtgtatattta

SEQ ID NO: 855590 - DNA, 22 bp, Artificial Sequence
  chemically synthesized
tgtcccatttaaatatacacta

SEQ ID NO: 855591 - DNA, 22 bp, Artificial Sequence
  chemically synthesized
aatgagcagttttagtgggtat

SEQ ID NO: 855592 - DNA, 22 bp, Artificial Sequence
  chemically synthesized
aaatatacactatacccactaa

SEQ ID NO: 855593 - DNA, 22 bp, Artificial Sequence
  chemically synthesized
aatatacactatacccactaaa

SEQ ID NO: 855594 - DNA, 22 bp, Artificial Sequence
  chemically synthesized
aaaattgaatgagcagttttag

SEQ ID NO: 855595 - DNA, 22 bp, Artificial Sequence
  chemically synthesized
tctaaaaattgaatgagcagtt

SEQ ID NO: 855596 - DNA, 22 bp, Artificial Sequence
  chemically synthesized
tacccactaaaactgctcattc

SEQ ID NO: 855597 - DNA, 22 bp, Artificial Sequence
  chemically synthesized
attatctaaaaattgaatgagc

SEQ ID NO: 855598 - DNA, 22 bp, Artificial Sequence
  chemically synthesized
cattatctaaaaattgaatgag

SEQ ID NO: 855599 - DNA, 22 bp, Artificial Sequence
  chemically synthesized
aaactgctcattcaatttttag

SEQ ID NO: 855600 - DNA, 22 bp, Artificial Sequence
  chemically synthesized
ggagatttcattatctaaaaat

SEQ ID NO: 855601 - DNA, 22 bp, Artificial Sequence
  chemically synthesized
ctcattcaatttttagataatg

SEQ ID NO: 855602 - DNA, 22 bp, Artificial Sequence
  chemically synthesized
cctgggagatttcattatctaa

SEQ ID NO: 855603 - DNA, 22 bp, Artificial Sequence
  chemically synthesized
attcaatttttagataatgaaa

SEQ ID NO: 855604 - DNA, 22 bp, Artificial Sequence
  chemically synthesized
ttacctgggagatttcattatc

SEQ ID NO: 855605 - DNA, 22 bp, Artificial Sequence
  chemically synthesized
aatttttagataatgaaatctc

SEQ ID NO: 855606 - DNA, 22 bp, Artificial Sequence
  chemically synthesized
cactgttacctgggagatttca

SEQ ID NO: 855607 - DNA, 22 bp, Artificial Sequence
  chemically synthesized
ttagataatgaaatctcccagg

SEQ ID NO: 855608 - DNA, 22 bp, Artificial Sequence
  chemically synthesized
tagataatgaaatctcccaggt

SEQ ID NO: 855609 - DNA, 22 bp, Artificial Sequence
  chemically synthesized
agataatgaaatctcccaggta

SEQ ID NO: 855610 - DNA, 22 bp, Artificial Sequence
  chemically synthesized
gataatgaaatctcccaggtaa

SEQ ID NO: 855611 - DNA, 22 bp, Artificial Sequence
  chemically synthesized
accacacattgcactgttacct

SEQ ID NO: 855612 - DNA, 22 bp, Artificial Sequence
  chemically synthesized
aaccacacattgcactgttacc

SEQ ID NO: 855613 - DNA, 22 bp, Artificial Sequence
  chemically synthesized
taaccacacattgcactgttac

SEQ ID NO: 855614 - DNA, 22 bp, Artificial Sequence
  chemically synthesized
ttaaccacacattgcactgtta

SEQ ID NO: 855615 - DNA, 22 bp, Artificial Sequence
  chemically synthesized
atttttaaccacacattgcact

SEQ ID NO: 855616 - DNA, 22 bp, Artificial Sequence
  chemically synthesized
ccaggtaacagtgcaatgtgtg

SEQ ID NO: 855617 - DNA, 22 bp, Artificial Sequence
  chemically synthesized
aagattaatttttaaccacaca

SEQ ID NO: 855618 - DNA, 22 bp, Artificial Sequence
  chemically synthesized
ttcaagattaatttttaaccac

SEQ ID NO: 855619 - DNA, 22 bp, Artificial Sequence
  chemically synthesized
aaaattaatcttgaacaatgct

SEQ ID NO: 855620 - DNA, 22 bp, Artificial Sequence
  chemically synthesized
gacaagatgataatagcattgt

SEQ ID NO: 855621 - DNA, 22 bp, Artificial Sequence
  chemically synthesized
atcttgaacaatgctattatca

SEQ ID NO: 855622 - DNA, 22 bp, Artificial Sequence
  chemically synthesized
gccaatctggacaagatgataa

SEQ ID NO: 855623 - DNA, 22 bp, Artificial Sequence
  chemically synthesized
gaacaatgctattatcatcttg

SEQ ID NO: 855624 - DNA, 22 bp, Artificial Sequence
  chemically synthesized
aacaatgctattatcatcttgt

SEQ ID NO: 855625 - DNA, 22 bp, Artificial Sequence
  chemically synthesized
agacaaattggccaatctggac

SEQ ID NO: 855626 - DNA, 22 bp, Artificial Sequence
  chemically synthesized
ttatcatcttgtccagattggc

SEQ ID NO: 855627 - DNA, 22 bp, Artificial Sequence
  chemically synthesized
tcatcttgtccagattggccaa

SEQ ID NO: 855628 - DNA, 22 bp, Artificial Sequence
  chemically synthesized
gggttgagacaaattggccaat

SEQ ID NO: 855629 - DNA, 22 bp, Artificial Sequence
  chemically synthesized
gtccagattggccaatttgtct

SEQ ID NO: 855630 - DNA, 22 bp, Artificial Sequence
  chemically synthesized
tccagattggccaatttgtctc

SEQ ID NO: 855631 - DNA, 22 bp, Artificial Sequence
  chemically synthesized
cagattggggttgagacaaatt

SEQ ID NO: 855632 - DNA, 22 bp, Artificial Sequence
  chemically synthesized
ccagattggggttgagacaaat

SEQ ID NO: 855633 - DNA, 22 bp, Artificial Sequence
  chemically synthesized
tccagattggggttgagacaaa

SEQ ID NO: 855634 - DNA, 22 bp, Artificial Sequence
  chemically synthesized
gccaatttgtctcaaccccaat

SEQ ID NO: 855635 - DNA, 22 bp, Artificial Sequence
  chemically synthesized
cagtaagacctttccagattgg

SEQ ID NO: 855636 - DNA, 22 bp, Artificial Sequence
  chemically synthesized
gtctcaaccccaatctggaaag

SEQ ID NO: 855637 - DNA, 22 bp, Artificial Sequence
  chemically synthesized
tctcaaccccaatctggaaagg

SEQ ID NO: 855638 - DNA, 22 bp, Artificial Sequence
  chemically synthesized
tcctccagtaagacctttccag

SEQ ID NO: 855639 - DNA, 22 bp, Artificial Sequence
  chemically synthesized
atcctccagtaagacctttcca

SEQ ID NO: 855640 - DNA, 22 bp, Artificial Sequence
  chemically synthesized
tatcctccagtaagacctttcc

SEQ ID NO: 855641 - DNA, 22 bp, Artificial Sequence
  chemically synthesized
aaccccaatctggaaaggtctt

SEQ ID NO: 855642 - DNA, 22 bp, Artificial Sequence
  chemically synthesized
gcaaaggcattttatcctccag

SEQ ID NO: 855643 - DNA, 22 bp, Artificial Sequence
  chemically synthesized
gaaaggtcttactggaggataa

SEQ ID NO: 855644 - DNA, 22 bp, Artificial Sequence
  chemically synthesized
agttggcaaaggcattttatcc

SEQ ID NO: 855645 - DNA, 22 bp, Artificial Sequence
  chemically synthesized
actggaggataaaatgcctttg

SEQ ID NO: 855646 - DNA, 22 bp, Artificial Sequence
  chemically synthesized
ctggaggataaaatgcctttgc

SEQ ID NO: 855647 - DNA, 22 bp, Artificial Sequence
  chemically synthesized
gaggataaaatgcctttgccaa

SEQ ID NO: 855648 - DNA, 22 bp, Artificial Sequence
  chemically synthesized
aataaagaattgagttggcaaa

SEQ ID NO: 855649 - DNA, 22 bp, Artificial Sequence
  chemically synthesized
tattgaataaagaattgagttg

SEQ ID NO: 855650 - DNA, 22 bp, Artificial Sequence
  chemically synthesized
gtattgaataaagaattgagtt

SEQ ID NO: 855651 - DNA, 22 bp, Artificial Sequence
  chemically synthesized
cacttgtattgaataaagaatt

SEQ ID NO: 855652 - DNA, 22 bp, Artificial Sequence
  chemically synthesized
tgccaactcaattctttattca

SEQ ID NO: 855653 - DNA, 22 bp, Artificial Sequence
  chemically synthesized
gccaactcaattctttattcaa

SEQ ID NO: 855654 - DNA, 22 bp, Artificial Sequence
  chemically synthesized
ccaactcaattctttattcaat

SEQ ID NO: 855655 - DNA, 22 bp, Artificial Sequence
  chemically synthesized
aaccactgcacttgtattgaat

SEQ ID NO: 855656 - DNA, 22 bp, Artificial Sequence
  chemically synthesized
aattctttattcaatacaagtg

SEQ ID NO: 855657 - DNA, 22 bp, Artificial Sequence
  chemically synthesized
tttattcaatacaagtgcagtg

SEQ ID NO: 855658 - DNA, 22 bp, Artificial Sequence
  chemically synthesized
tattcaatacaagtgcagtggt

SEQ ID NO: 855659 - DNA, 22 bp, Artificial Sequence
  chemically synthesized
attcaatacaagtgcagtggtt

SEQ ID NO: 855660 - DNA, 22 bp, Artificial Sequence
  chemically synthesized
ttcaatacaagtgcagtggttg

SEQ ID NO: 855661 - DNA, 22 bp, Artificial Sequence
  chemically synthesized
accacaaaatctcaaccactgc

SEQ ID NO: 855662 - DNA, 22 bp, Artificial Sequence
  chemically synthesized
aatacaagtgcagtggttgaga

SEQ ID NO: 855663 - DNA, 22 bp, Artificial Sequence
  chemically synthesized
aggataattcaccacaaaatct

SEQ ID NO: 855664 - DNA, 22 bp, Artificial Sequence
  chemically synthesized
gccaggtgttcaggataattca

SEQ ID NO: 855665 - DNA, 22 bp, Artificial Sequence
  chemically synthesized
agattttgtggtgaattatcct

SEQ ID NO: 855666 - DNA, 22 bp, Artificial Sequence
  chemically synthesized
ggccaggtgttcaggataattc

SEQ ID NO: 855667 - DNA, 22 bp, Artificial Sequence
  chemically synthesized
cgtttggccaggtgttcaggat

SEQ ID NO: 855668 - DNA, 22 bp, Artificial Sequence
  chemically synthesized
tgtggtgaattatcctgaacac

SEQ ID NO: 855669 - DNA, 22 bp, Artificial Sequence
  chemically synthesized
gtggtgaattatcctgaacacc

SEQ ID NO: 855670 - DNA, 22 bp, Artificial Sequence
  chemically synthesized
tggtgaattatcctgaacacct

SEQ ID NO: 855671 - DNA, 22 bp, Artificial Sequence
  chemically synthesized
aattccgtttggccaggtgttc

SEQ ID NO: 855672 - DNA, 22 bp, Artificial Sequence
  chemically synthesized
caattccgtttggccaggtgtt

SEQ ID NO: 855673 - DNA, 22 bp, Artificial Sequence
  chemically synthesized
tcaattccgtttggccaggtgt

SEQ ID NO: 855674 - DNA, 22 bp, Artificial Sequence
  chemically synthesized
ttcaattccgtttggccaggtg

SEQ ID NO: 855675 - DNA, 22 bp, Artificial Sequence
  chemically synthesized
tttcaattccgtttggccaggt

SEQ ID NO: 855676 - DNA, 22 bp, Artificial Sequence
  chemically synthesized
ttttcaattccgtttggccagg

SEQ ID NO: 855677 - DNA, 22 bp, Artificial Sequence
  chemically synthesized
tttttcaattccgtttggccag

SEQ ID NO: 855678 - DNA, 22 bp, Artificial Sequence
  chemically synthesized
ttttttcaattccgtttggcca

SEQ ID NO: 855679 - DNA, 22 bp, Artificial Sequence
  chemically synthesized
tcctgaacacctggccaaacgg

SEQ ID NO: 855680 - DNA, 22 bp, Artificial Sequence
  chemically synthesized
aacacctggccaaacggaattg

SEQ ID NO: 855681 - DNA, 22 bp, Artificial Sequence
  chemically synthesized
tagtcttttttttcaattccgt

SEQ ID NO: 855682 - DNA, 22 bp, Artificial Sequence
  chemically synthesized
attgtagtcttttttttcaatt

SEQ ID NO: 855683 - DNA, 22 bp, Artificial Sequence
  chemically synthesized
gccaaacggaattgaaaaaaaa

SEQ ID NO: 855684 - DNA, 22 bp, Artificial Sequence
  chemically synthesized
agttaattgtagtctttttttt

SEQ ID NO: 855685 - DNA, 22 bp, Artificial Sequence
  chemically synthesized
tgctgagttaattgtagtcttt

SEQ ID NO: 855686 - DNA, 22 bp, Artificial Sequence
  chemically synthesized
cctgtgctgagttaattgtagt

SEQ ID NO: 855687 - DNA, 22 bp, Artificial Sequence
  chemically synthesized
aaaaaaaagactacaattaact

SEQ ID NO: 855688 - DNA, 22 bp, Artificial Sequence
  chemically synthesized
attgcctgtgctgagttaattg

SEQ ID NO: 855689 - DNA, 22 bp, Artificial Sequence
  chemically synthesized
gtgtctgattgcctgtgctgag

SEQ ID NO: 855690 - DNA, 22 bp, Artificial Sequence
  chemically synthesized
caattaactcagcacaggcaat

SEQ ID NO: 855691 - DNA, 22 bp, Artificial Sequence
  chemically synthesized
ataatactggtgtctgattgcc

SEQ ID NO: 855692 - DNA, 22 bp, Artificial Sequence
  chemically synthesized
cataatactggtgtctgattgc

SEQ ID NO: 855693 - DNA, 22 bp, Artificial Sequence
  chemically synthesized
actcagcacaggcaatcagaca

SEQ ID NO: 855694 - DNA, 22 bp, Artificial Sequence
  chemically synthesized
tcataatactggtgtctgattg

SEQ ID NO: 855695 - DNA, 22 bp, Artificial Sequence
  chemically synthesized
ttcataatactggtgtctgatt

SEQ ID NO: 855696 - DNA, 22 bp, Artificial Sequence
  chemically synthesized
agcacaggcaatcagacaccag

SEQ ID NO: 855697 - DNA, 22 bp, Artificial Sequence
  chemically synthesized
tttttcataatactggtgtctg

SEQ ID NO: 855698 - DNA, 22 bp, Artificial Sequence
  chemically synthesized
gatggccatatgatattatttt

SEQ ID NO: 855699 - DNA, 22 bp, Artificial Sequence
  chemically synthesized
agatggccatatgatattattt

SEQ ID NO: 855700 - DNA, 22 bp, Artificial Sequence
  chemically synthesized
tgaaaaataatatcatatggcc

SEQ ID NO: 855701 - DNA, 22 bp, Artificial Sequence
  chemically synthesized
tcaacaaatagaatttagatgg

SEQ ID NO: 855702 - DNA, 22 bp, Artificial Sequence
  chemically synthesized
ctatcaacaaatagaatttaga

SEQ ID NO: 855703 - DNA, 22 bp, Artificial Sequence
  chemically synthesized
gtgttgctatcaacaaatagaa

SEQ ID NO: 855704 - DNA, 22 bp, Artificial Sequence
  chemically synthesized
aattctatttgttgatagcaac

SEQ ID NO: 855705 - DNA, 22 bp, Artificial Sequence
  chemically synthesized
tatttgttgatagcaacactag

SEQ ID NO: 855706 - DNA, 22 bp, Artificial Sequence
  chemically synthesized
ccagcagtggagactagtgttg

SEQ ID NO: 855707 - DNA, 22 bp, Artificial Sequence
  chemically synthesized
tttgttgatagcaacactagtc

SEQ ID NO: 855708 - DNA, 22 bp, Artificial Sequence
  chemically synthesized
gttgatagcaacactagtctcc

SEQ ID NO: 855709 - DNA, 22 bp, Artificial Sequence
  chemically synthesized
ttgatagcaacactagtctcca

SEQ ID NO: 855710 - DNA, 22 bp, Artificial Sequence
  chemically synthesized
atagcaacactagtctccactg

SEQ ID NO: 855711 - DNA, 22 bp, Artificial Sequence
  chemically synthesized
gtctccactgctgggaacctct

SEQ ID NO: 855712 - DNA, 22 bp, Artificial Sequence
  chemically synthesized
cactgctgggaacctctcttca

SEQ ID NO: 855713 - DNA, 22 bp, Artificial Sequence
  chemically synthesized
ctgggaacctctcttcatattt

SEQ ID NO: 855714 - DNA, 22 bp, Artificial Sequence
  chemically synthesized
ggaacctctcttcatatttccc

SEQ ID NO: 855715 - DNA, 22 bp, Artificial Sequence
  chemically synthesized
tcttcatatttccccctccacc

SEQ ID NO: 855716 - DNA, 22 bp, Artificial Sequence
  chemically synthesized
ttcatatttccccctccacctt

SEQ ID NO: 855717 - DNA, 22 bp, Artificial Sequence
  chemically synthesized
catatttccccctccacctttc

SEQ ID NO: 855718 - DNA, 22 bp, Artificial Sequence
  chemically synthesized
atatttccccctccacctttct

SEQ ID NO: 855719 - DNA, 22 bp, Artificial Sequence
  chemically synthesized
ccccctccacctttctccctcc

SEQ ID NO: 855720 - DNA, 22 bp, Artificial Sequence
  chemically synthesized
cccctccacctttctccctcct

SEQ ID NO: 855721 - DNA, 22 bp, Artificial Sequence
  chemically synthesized
cacctttctccctcctgtctcc

SEQ ID NO: 855722 - DNA, 22 bp, Artificial Sequence
  chemically synthesized
tctccctcctgtctcccaccat

SEQ ID NO: 855723 - DNA, 22 bp, Artificial Sequence
  chemically synthesized
ctccctcctgtctcccaccatc

SEQ ID NO: 855724 - DNA, 22 bp, Artificial Sequence
  chemically synthesized
tccctcctgtctcccaccatcc

SEQ ID NO: 855725 - DNA, 22 bp, Artificial Sequence
  chemically synthesized
cctcctgtctcccaccatccct

SEQ ID NO: 855726 - DNA, 22 bp, Artificial Sequence
  chemically synthesized
ctgtctcccaccatccctcttc

SEQ ID NO: 855727 - DNA, 22 bp, Artificial Sequence
  chemically synthesized
tctcccaccatccctcttccat

SEQ ID NO: 855728 - DNA, 22 bp, Artificial Sequence
  chemically synthesized
ccaccatccctcttccatttcc

SEQ ID NO: 855729 - DNA, 22 bp, Artificial Sequence
  chemically synthesized
ttccatttcctcctttcctcac

SEQ ID NO: 855730 - DNA, 22 bp, Artificial Sequence
  chemically synthesized
ccatttcctcctttcctcactc

SEQ ID NO: 855731 - DNA, 22 bp, Artificial Sequence
  chemically synthesized
catttcctcctttcctcactcc

SEQ ID NO: 855732 - DNA, 22 bp, Artificial Sequence
  chemically synthesized
aagaggacaaaagaggagtgag

SEQ ID NO: 855733 - DNA, 22 bp, Artificial Sequence
  chemically synthesized
cctcctttcctcactcctcttt

SEQ ID NO: 855734 - DNA, 22 bp, Artificial Sequence
  chemically synthesized
ctcctttcctcactcctctttt

SEQ ID NO: 855735 - DNA, 22 bp, Artificial Sequence
  chemically synthesized
ctttcctcactcctcttttgtc

SEQ ID NO: 855736 - DNA, 22 bp, Artificial Sequence
  chemically synthesized
tcctcactcctcttttgtcctc

SEQ ID NO: 855737 - DNA, 22 bp, Artificial Sequence
  chemically synthesized
cctcactcctcttttgtcctct

SEQ ID NO: 855738 - DNA, 22 bp, Artificial Sequence
  chemically synthesized
ctcactcctcttttgtcctctt

SEQ ID NO: 855739 - DNA, 22 bp, Artificial Sequence
  chemically synthesized
actcctcttttgtcctctttaa

SEQ ID NO: 855740 - DNA, 22 bp, Artificial Sequence
  chemically synthesized
ctcttttgtcctctttaatatt

SEQ ID NO: 855741 - DNA, 22 bp, Artificial Sequence
  chemically synthesized
ttttgtcctctttaatattcct

SEQ ID NO: 855742 - DNA, 22 bp, Artificial Sequence
  chemically synthesized
ttgtcctctttaatattccttt

SEQ ID NO: 855743 - DNA, 22 bp, Artificial Sequence
  chemically synthesized
tgtcctctttaatattcctttc

SEQ ID NO: 855744 - DNA, 22 bp, Artificial Sequence
  chemically synthesized
gtcctctttaatattcctttct

SEQ ID NO: 855745 - DNA, 22 bp, Artificial Sequence
  chemically synthesized
tcctctttaatattcctttctt

SEQ ID NO: 855746 - DNA, 22 bp, Artificial Sequence
  chemically synthesized
tttaatattcctttcttgtctt

SEQ ID NO: 855747 - DNA, 22 bp, Artificial Sequence
  chemically synthesized
taatattcctttcttgtctttt

SEQ ID NO: 855748 - DNA, 22 bp, Artificial Sequence
  chemically synthesized
aatattcctttcttgtcttttt

SEQ ID NO: 855749 - DNA, 22 bp, Artificial Sequence
  chemically synthesized
atattcctttcttgtctttttt

SEQ ID NO: 855750 - DNA, 22 bp, Artificial Sequence
  chemically synthesized
ctttcttgtctttttttctttc

SEQ ID NO: 855751 - DNA, 22 bp, Artificial Sequence
  chemically synthesized
tcttgtctttttttctttcctt

SEQ ID NO: 855752 - DNA, 22 bp, Artificial Sequence
  chemically synthesized
cttgtctttttttctttccttg

SEQ ID NO: 855753 - DNA, 22 bp, Artificial Sequence
  chemically synthesized
ttgtctttttttctttccttgc

SEQ ID NO: 855754 - DNA, 22 bp, Artificial Sequence
  chemically synthesized
gtctttttttctttccttgcta

SEQ ID NO: 855755 - DNA, 22 bp, Artificial Sequence
  chemically synthesized
tctttttttctttccttgctac

SEQ ID NO: 855756 - DNA, 22 bp, Artificial Sequence
  chemically synthesized
tttttctttccttgctaccttt

SEQ ID NO: 855757 - DNA, 22 bp, Artificial Sequence
  chemically synthesized
ttttctttccttgctacctttc

SEQ ID NO: 855758 - DNA, 22 bp, Artificial Sequence
  chemically synthesized
tttctttccttgctacctttct

SEQ ID NO: 855759 - DNA, 22 bp, Artificial Sequence
  chemically synthesized
ttctttccttgctacctttctt

SEQ ID NO: 855760 - DNA, 22 bp, Artificial Sequence
  chemically synthesized
tctttccttgctacctttcttt

SEQ ID NO: 855761 - DNA, 22 bp, Artificial Sequence
  chemically synthesized
ctttccttgctacctttctttt

SEQ ID NO: 855762 - DNA, 22 bp, Artificial Sequence
  chemically synthesized
tttccttgctacctttcttttg

SEQ ID NO: 855763 - DNA, 22 bp, Artificial Sequence
  chemically synthesized
tccttgctacctttcttttgtc

SEQ ID NO: 855764 - DNA, 22 bp, Artificial Sequence
  chemically synthesized
ccttgctacctttcttttgtct

SEQ ID NO: 855765 - DNA, 22 bp, Artificial Sequence
  chemically synthesized
cttgctacctttcttttgtctt

SEQ ID NO: 855766 - DNA, 22 bp, Artificial Sequence
  chemically synthesized
gctacctttcttttgtcttttc

SEQ ID NO: 855767 - DNA, 22 bp, Artificial Sequence
  chemically synthesized
ctacctttcttttgtcttttct

SEQ ID NO: 855768 - DNA, 22 bp, Artificial Sequence
  chemically synthesized
cctttcttttgtcttttctctc

SEQ ID NO: 855769 - DNA, 22 bp, Artificial Sequence
  chemically synthesized
tcttttgtcttttctctctcct

SEQ ID NO: 855770 - DNA, 22 bp, Artificial Sequence
  chemically synthesized
cttttgtcttttctctctcctt

SEQ ID NO: 855771 - DNA, 22 bp, Artificial Sequence
  chemically synthesized
ttttgtcttttctctctccttc

SEQ ID NO: 855772 - DNA, 22 bp, Artificial Sequence
  chemically synthesized
ttgtcttttctctctccttccc

SEQ ID NO: 855773 - DNA, 22 bp, Artificial Sequence
  chemically synthesized
tgtcttttctctctccttcccc

SEQ ID NO: 855774 - DNA, 22 bp, Artificial Sequence
  chemically synthesized
gtcttttctctctccttcccct

SEQ ID NO: 855775 - DNA, 22 bp, Artificial Sequence
  chemically synthesized
tcttttctctctccttcccctt

SEQ ID NO: 855776 - DNA, 22 bp, Artificial Sequence
  chemically synthesized
ttctctctccttcccctttttc

SEQ ID NO: 855777 - DNA, 22 bp, Artificial Sequence
  chemically synthesized
tctctctccttcccctttttcc

SEQ ID NO: 855778 - DNA, 22 bp, Artificial Sequence
  chemically synthesized
ctctctccttcccctttttcct

SEQ ID NO: 855779 - DNA, 22 bp, Artificial Sequence
  chemically synthesized
tctctccttcccctttttcctg

SEQ ID NO: 855780 - DNA, 22 bp, Artificial Sequence
  chemically synthesized
tctccttcccctttttcctgct

SEQ ID NO: 855781 - DNA, 22 bp, Artificial Sequence
  chemically synthesized
tccttcccctttttcctgcttt

SEQ ID NO: 855782 - DNA, 22 bp, Artificial Sequence
  chemically synthesized
cttcccctttttcctgctttcc

SEQ ID NO: 855783 - DNA, 22 bp, Artificial Sequence
  chemically synthesized
cccctttttcctgctttccttc

SEQ ID NO: 855784 - DNA, 22 bp, Artificial Sequence
  chemically synthesized
ccctttttcctgctttccttcc

SEQ ID NO: 855785 - DNA, 22 bp, Artificial Sequence
  chemically synthesized
tttcctgctttccttcctctct

SEQ ID NO: 855786 - DNA, 22 bp, Artificial Sequence
  chemically synthesized
ttcctgctttccttcctctctt

SEQ ID NO: 855787 - DNA, 22 bp, Artificial Sequence
  chemically synthesized
tcctgctttccttcctctcttc

SEQ ID NO: 855788 - DNA, 22 bp, Artificial Sequence
  chemically synthesized
cctgctttccttcctctcttcc

SEQ ID NO: 855789 - DNA, 22 bp, Artificial Sequence
  chemically synthesized
ctgctttccttcctctcttcct

SEQ ID NO: 855790 - DNA, 22 bp, Artificial Sequence
  chemically synthesized
ctttccttcctctcttccttct

SEQ ID NO: 855791 - DNA, 22 bp, Artificial Sequence
  chemically synthesized
tccttcctctcttccttctttt

SEQ ID NO: 855792 - DNA, 22 bp, Artificial Sequence
  chemically synthesized
ccttcctctcttccttcttttt

SEQ ID NO: 855793 - DNA, 22 bp, Artificial Sequence
  chemically synthesized
cttcctctcttccttctttttt

SEQ ID NO: 855794 - DNA, 22 bp, Artificial Sequence
  chemically synthesized
cctctcttccttctttttttcc

SEQ ID NO: 855795 - DNA, 22 bp, Artificial Sequence
  chemically synthesized
ctctcttccttctttttttccc

SEQ ID NO: 855796 - DNA, 22 bp, Artificial Sequence
  chemically synthesized
tcttccttctttttttcccttt

SEQ ID NO: 855797 - DNA, 22 bp, Artificial Sequence
  chemically synthesized
ttccttctttttttccctttcc

SEQ ID NO: 855798 - DNA, 22 bp, Artificial Sequence
  chemically synthesized
ccttctttttttccctttcctc

SEQ ID NO: 855799 - DNA, 22 bp, Artificial Sequence
  chemically synthesized
cttctttttttccctttcctcc

SEQ ID NO: 855800 - DNA, 22 bp, Artificial Sequence
  chemically synthesized
ctttttttccctttcctcctcc

SEQ ID NO: 855801 - DNA, 22 bp, Artificial Sequence
  chemically synthesized
tttttttccctttcctcctcct

SEQ ID NO: 855802 - DNA, 22 bp, Artificial Sequence
  chemically synthesized
tttttccctttcctcctccttc

SEQ ID NO: 855803 - DNA, 22 bp, Artificial Sequence
  chemically synthesized
ttttccctttcctcctccttcc

SEQ ID NO: 855804 - DNA, 22 bp, Artificial Sequence
  chemically synthesized
tttccctttcctcctccttcct

SEQ ID NO: 855805 - DNA, 22 bp, Artificial Sequence
  chemically synthesized
ttccctttcctcctccttcctt

SEQ ID NO: 855806 - DNA, 22 bp, Artificial Sequence
  chemically synthesized
tccctttcctcctccttccttc

SEQ ID NO: 855807 - DNA, 22 bp, Artificial Sequence
  chemically synthesized
ccctttcctcctccttccttcc

SEQ ID NO: 855808 - DNA, 22 bp, Artificial Sequence
  chemically synthesized
cctttcctcctccttccttccc

SEQ ID NO: 855809 - DNA, 22 bp, Artificial Sequence
  chemically synthesized
tcctcctccttccttccctttc

SEQ ID NO: 855810 - DNA, 22 bp, Artificial Sequence
  chemically synthesized
cctcctccttccttccctttct

SEQ ID NO: 855811 - DNA, 22 bp, Artificial Sequence
  chemically synthesized
ctcctccttccttccctttctt

SEQ ID NO: 855812 - DNA, 22 bp, Artificial Sequence
  chemically synthesized
ctccttccttccctttctttcc

SEQ ID NO: 855813 - DNA, 22 bp, Artificial Sequence
  chemically synthesized
cttccttccctttctttcctcc

SEQ ID NO: 855814 - DNA, 22 bp, Artificial Sequence
  chemically synthesized
ccttccctttctttcctccctt

SEQ ID NO: 855815 - DNA, 22 bp, Artificial Sequence
  chemically synthesized
cttccctttctttcctcccttc

SEQ ID NO: 855816 - DNA, 22 bp, Artificial Sequence
  chemically synthesized
ccctttctttcctcccttcttt

SEQ ID NO: 855817 - DNA, 22 bp, Artificial Sequence
  chemically synthesized
cctttctttcctcccttctttg

SEQ ID NO: 855818 - DNA, 22 bp, Artificial Sequence
  chemically synthesized
tctttcctcccttctttgttct

SEQ ID NO: 855819 - DNA, 22 bp, Artificial Sequence
  chemically synthesized
ctttcctcccttctttgttctc

SEQ ID NO: 855820 - DNA, 22 bp, Artificial Sequence
  chemically synthesized
tttcctcccttctttgttctct

SEQ ID NO: 855821 - DNA, 22 bp, Artificial Sequence
  chemically synthesized
aggaaaggaaggagagaacaaa

SEQ ID NO: 855822 - DNA, 22 bp, Artificial Sequence
  chemically synthesized
aaggaaaggaaggagagaacaa

SEQ ID NO: 855823 - DNA, 22 bp, Artificial Sequence
  chemically synthesized
tcctcccttctttgttctctcc

SEQ ID NO: 855824 - DNA, 22 bp, Artificial Sequence
  chemically synthesized
cctcccttctttgttctctcct

SEQ ID NO: 855825 - DNA, 22 bp, Artificial Sequence
  chemically synthesized
ctcccttctttgttctctcctt

SEQ ID NO: 855826 - DNA, 22 bp, Artificial Sequence
  chemically synthesized
ccttctttgttctctccttcct

SEQ ID NO: 855827 - DNA, 22 bp, Artificial Sequence
  chemically synthesized
acccttaaggaaaggaaggaga

SEQ ID NO: 855828 - DNA, 22 bp, Artificial Sequence
  chemically synthesized
ctttgttctctccttcctttcc

SEQ ID NO: 855829 - DNA, 22 bp, Artificial Sequence
  chemically synthesized
tttgttctctccttcctttcct

SEQ ID NO: 855830 - DNA, 22 bp, Artificial Sequence
  chemically synthesized
aatctgacccttaaggaaagga

SEQ ID NO: 855831 - DNA, 22 bp, Artificial Sequence
  chemically synthesized
tgttctctccttcctttcctta

SEQ ID NO: 855832 - DNA, 22 bp, Artificial Sequence
  chemically synthesized
gttctctccttcctttccttaa

SEQ ID NO: 855833 - DNA, 22 bp, Artificial Sequence
  chemically synthesized
ttctctccttcctttccttaag

SEQ ID NO: 855834 - DNA, 22 bp, Artificial Sequence
  chemically synthesized
ctaaatctgacccttaaggaaa

SEQ ID NO: 855835 - DNA, 22 bp, Artificial Sequence
  chemically synthesized
tctccttcctttccttaagggt

SEQ ID NO: 855836 - DNA, 22 bp, Artificial Sequence
  chemically synthesized
tccttcctttccttaagggtca

SEQ ID NO: 855837 - DNA, 22 bp, Artificial Sequence
  chemically synthesized
cttcctttccttaagggtcaga

SEQ ID NO: 855838 - DNA, 22 bp, Artificial Sequence
  chemically synthesized
cctttccttaagggtcagattt

SEQ ID NO: 855839 - DNA, 22 bp, Artificial Sequence
  chemically synthesized
agagtgattactaaatctgacc

SEQ ID NO: 855840 - DNA, 22 bp, Artificial Sequence
  chemically synthesized
ctttccttaagggtcagattta

SEQ ID NO: 855841 - DNA, 22 bp, Artificial Sequence
  chemically synthesized
gagagtgattactaaatctgac

SEQ ID NO: 855842 - DNA, 22 bp, Artificial Sequence
  chemically synthesized
tgagagtgattactaaatctga

SEQ ID NO: 855843 - DNA, 22 bp, Artificial Sequence
  chemically synthesized
tccttaagggtcagatttagta

SEQ ID NO: 855844 - DNA, 22 bp, Artificial Sequence
  chemically synthesized
ccttaagggtcagatttagtaa

SEQ ID NO: 855845 - DNA, 22 bp, Artificial Sequence
  chemically synthesized
ctttgagagtgattactaaatc

SEQ ID NO: 855846 - DNA, 22 bp, Artificial Sequence
  chemically synthesized
cttaagggtcagatttagtaat

SEQ ID NO: 855847 - DNA, 22 bp, Artificial Sequence
  chemically synthesized
gctttgagagtgattactaaat

SEQ ID NO: 855848 - DNA, 22 bp, Artificial Sequence
  chemically synthesized
tgctttgagagtgattactaaa

SEQ ID NO: 855849 - DNA, 22 bp, Artificial Sequence
  chemically synthesized
aagggtcagatttagtaatcac

SEQ ID NO: 855850 - DNA, 22 bp, Artificial Sequence
  chemically synthesized
agggtcagatttagtaatcact

SEQ ID NO: 855851 - DNA, 22 bp, Artificial Sequence
  chemically synthesized
ggttttgctttgagagtgatta

SEQ ID NO: 855852 - DNA, 22 bp, Artificial Sequence
  chemically synthesized
agtaatcactctcaaagcaaaa

SEQ ID NO: 855853 - DNA, 22 bp, Artificial Sequence
  chemically synthesized
gtaatcactctcaaagcaaaac

SEQ ID NO: 855854 - DNA, 22 bp, Artificial Sequence
  chemically synthesized
tcaaagcaaaacccaggacata

SEQ ID NO: 855855 - DNA, 22 bp, Artificial Sequence
  chemically synthesized
aaagcaaaacccaggacatatt

SEQ ID NO: 855856 - DNA, 22 bp, Artificial Sequence
  chemically synthesized
tcaaatgaagggaaaaatatgt

SEQ ID NO: 855857 - DNA, 22 bp, Artificial Sequence
  chemically synthesized
acataatctatcaaatgaaggg

SEQ ID NO: 855858 - DNA, 22 bp, Artificial Sequence
  chemically synthesized
gacataatctatcaaatgaagg

SEQ ID NO: 855859 - DNA, 22 bp, Artificial Sequence
  chemically synthesized
tgacataatctatcaaatgaag

SEQ ID NO: 855860 - DNA, 22 bp, Artificial Sequence
  chemically synthesized
ttgacataatctatcaaatgaa

SEQ ID NO: 855861 - DNA, 22 bp, Artificial Sequence
  chemically synthesized
tttgacataatctatcaaatga

SEQ ID NO: 855862 - DNA, 22 bp, Artificial Sequence
  chemically synthesized
ttttgacataatctatcaaatg

SEQ ID NO: 855863 - DNA, 22 bp, Artificial Sequence
  chemically synthesized
ttttttgacataatctatcaaa

SEQ ID NO: 855864 - DNA, 22 bp, Artificial Sequence
  chemically synthesized
cttttttgacataatctatcaa

SEQ ID NO: 855865 - DNA, 22 bp, Artificial Sequence
  chemically synthesized
tcttttttgacataatctatca

SEQ ID NO: 855866 - DNA, 22 bp, Artificial Sequence
  chemically synthesized
ttcccttcatttgatagattat

SEQ ID NO: 855867 - DNA, 22 bp, Artificial Sequence
  chemically synthesized
tcccttcatttgatagattatg

SEQ ID NO: 855868 - DNA, 22 bp, Artificial Sequence
  chemically synthesized
cccttcatttgatagattatgt

SEQ ID NO: 855869 - DNA, 22 bp, Artificial Sequence
  chemically synthesized
ccttcatttgatagattatgtc

SEQ ID NO: 855870 - DNA, 22 bp, Artificial Sequence
  chemically synthesized
gcagttttcttttttgacataa

SEQ ID NO: 855871 - DNA, 22 bp, Artificial Sequence
  chemically synthesized
catttgatagattatgtcaaaa

SEQ ID NO: 855872 - DNA, 22 bp, Artificial Sequence
  chemically synthesized
atttgatagattatgtcaaaaa

SEQ ID NO: 855873 - DNA, 22 bp, Artificial Sequence
  chemically synthesized
gatagattatgtcaaaaaagaa

SEQ ID NO: 855874 - DNA, 22 bp, Artificial Sequence
  chemically synthesized
atagattatgtcaaaaaagaaa

SEQ ID NO: 855875 - DNA, 22 bp, Artificial Sequence
  chemically synthesized
acaagaattagcagttttcttt

SEQ ID NO: 855876 - DNA, 22 bp, Artificial Sequence
  chemically synthesized
gacaagaattagcagttttctt

SEQ ID NO: 855877 - DNA, 22 bp, Artificial Sequence
  chemically synthesized
tgtcaaaaaagaaaactgctaa

SEQ ID NO: 855878 - DNA, 22 bp, Artificial Sequence
  chemically synthesized
aaacaacaatatttgacaagaa

SEQ ID NO: 855879 - DNA, 22 bp, Artificial Sequence
  chemically synthesized
tgaaacaacaatatttgacaag

SEQ ID NO: 855880 - DNA, 22 bp, Artificial Sequence
  chemically synthesized
ctctgaaacaacaatatttgac

SEQ ID NO: 855881 - DNA, 22 bp, Artificial Sequence
  chemically synthesized
ctaattcttgtcaaatattgtt

SEQ ID NO: 855882 - DNA, 22 bp, Artificial Sequence
  chemically synthesized
attcttgtcaaatattgttgtt

SEQ ID NO: 855883 - DNA, 22 bp, Artificial Sequence
  chemically synthesized
ttgtcaaatattgttgtttcag

SEQ ID NO: 855884 - DNA, 22 bp, Artificial Sequence
  chemically synthesized
gtcaaatattgttgtttcagag

SEQ ID NO: 855885 - DNA, 22 bp, Artificial Sequence
  chemically synthesized
tcaaatattgttgtttcagagc

SEQ ID NO: 855886 - DNA, 22 bp, Artificial Sequence
  chemically synthesized
ttgtttcagagcaattttactt

SEQ ID NO: 855887 - DNA, 22 bp, Artificial Sequence
  chemically synthesized
atcacataaacataagtaaaat

SEQ ID NO: 855888 - DNA, 22 bp, Artificial Sequence
  chemically synthesized
catcacataaacataagtaaaa

SEQ ID NO: 855889 - DNA, 22 bp, Artificial Sequence
  chemically synthesized
tttcagagcaattttacttatg

SEQ ID NO: 855890 - DNA, 22 bp, Artificial Sequence
  chemically synthesized
tttcatcacataaacataagta

SEQ ID NO: 855891 - DNA, 22 bp, Artificial Sequence
  chemically synthesized
cagagcaattttacttatgttt

SEQ ID NO: 855892 - DNA, 22 bp, Artificial Sequence
  chemically synthesized
agagcaattttacttatgttta

SEQ ID NO: 855893 - DNA, 22 bp, Artificial Sequence
  chemically synthesized
tgtttcatcacataaacataag

SEQ ID NO: 855894 - DNA, 22 bp, Artificial Sequence
  chemically synthesized
ctgtttcatcacataaacataa

SEQ ID NO: 855895 - DNA, 22 bp, Artificial Sequence
  chemically synthesized
tctgtttcatcacataaacata

SEQ ID NO: 855896 - DNA, 22 bp, Artificial Sequence
  chemically synthesized
ttctgtttcatcacataaacat

SEQ ID NO: 855897 - DNA, 22 bp, Artificial Sequence
  chemically synthesized
tttctgtttcatcacataaaca

SEQ ID NO: 855898 - DNA, 22 bp, Artificial Sequence
  chemically synthesized
tacttatgtttatgtgatgaaa

SEQ ID NO: 855899 - DNA, 22 bp, Artificial Sequence
  chemically synthesized
acttatgtttatgtgatgaaac

SEQ ID NO: 855900 - DNA, 22 bp, Artificial Sequence
  chemically synthesized
cttatgtttatgtgatgaaaca

SEQ ID NO: 855901 - DNA, 22 bp, Artificial Sequence
  chemically synthesized
aaaaatgctttttctgtttcat

SEQ ID NO: 855902 - DNA, 22 bp, Artificial Sequence
  chemically synthesized
atgtttatgtgatgaaacagaa

SEQ ID NO: 855903 - DNA, 22 bp, Artificial Sequence
  chemically synthesized
tgtttatgtgatgaaacagaaa

SEQ ID NO: 855904 - DNA, 22 bp, Artificial Sequence
  chemically synthesized
attaaaaaatgctttttctgtt

SEQ ID NO: 855905 - DNA, 22 bp, Artificial Sequence
  chemically synthesized
atgtgatgaaacagaaaaagca

SEQ ID NO: 855906 - DNA, 22 bp, Artificial Sequence
  chemically synthesized
tgtgatgaaacagaaaaagcat

SEQ ID NO: 855907 - DNA, 22 bp, Artificial Sequence
  chemically synthesized
gtgtcggagaaatctgattaaa

SEQ ID NO: 855908 - DNA, 22 bp, Artificial Sequence
  chemically synthesized
agtgtcggagaaatctgattaa

SEQ ID NO: 855909 - DNA, 22 bp, Artificial Sequence
  chemically synthesized
tagcttagtgtcggagaaatct

SEQ ID NO: 855910 - DNA, 22 bp, Artificial Sequence
  chemically synthesized
atagcttagtgtcggagaaatc

SEQ ID NO: 855911 - DNA, 22 bp, Artificial Sequence
  chemically synthesized
tatagcttagtgtcggagaaat

SEQ ID NO: 855912 - DNA, 22 bp, Artificial Sequence
  chemically synthesized
tttaatcagatttctccgacac

SEQ ID NO: 855913 - DNA, 22 bp, Artificial Sequence
  chemically synthesized
ttaatcagatttctccgacact

SEQ ID NO: 855914 - DNA, 22 bp, Artificial Sequence
  chemically synthesized
taatcagatttctccgacacta

SEQ ID NO: 855915 - DNA, 22 bp, Artificial Sequence
  chemically synthesized
tactttatagcttagtgtcgga

SEQ ID NO: 855916 - DNA, 22 bp, Artificial Sequence
  chemically synthesized
aatcagatttctccgacactaa

SEQ ID NO: 855917 - DNA, 22 bp, Artificial Sequence
  chemically synthesized
gtactttatagcttagtgtcgg

SEQ ID NO: 855918 - DNA, 22 bp, Artificial Sequence
  chemically synthesized
atcagatttctccgacactaag

SEQ ID NO: 855919 - DNA, 22 bp, Artificial Sequence
  chemically synthesized
ctccgacactaagctataaagt

SEQ ID NO: 855920 - DNA, 22 bp, Artificial Sequence
  chemically synthesized
tccgacactaagctataaagta

SEQ ID NO: 855921 - DNA, 22 bp, Artificial Sequence
  chemically synthesized
cgacactaagctataaagtaca

SEQ ID NO: 855922 - DNA, 22 bp, Artificial Sequence
  chemically synthesized
agctataaagtacaaatcatcc

SEQ ID NO: 855923 - DNA, 22 bp, Artificial Sequence
  chemically synthesized
tgaatcaatagcagtggatgat

SEQ ID NO: 855924 - DNA, 22 bp, Artificial Sequence
  chemically synthesized
taaagtacaaatcatccactgc

SEQ ID NO: 855925 - DNA, 22 bp, Artificial Sequence
  chemically synthesized
gaattgtgaatcaatagcagtg

SEQ ID NO: 855926 - DNA, 22 bp, Artificial Sequence
  chemically synthesized
tagaattgtgaatcaatagcag

SEQ ID NO: 855927 - DNA, 22 bp, Artificial Sequence
  chemically synthesized
ctagaattgtgaatcaatagca

SEQ ID NO: 855928 - DNA, 22 bp, Artificial Sequence
  chemically synthesized
atttctagaattgtgaatcaat

SEQ ID NO: 855929 - DNA, 22 bp, Artificial Sequence
  chemically synthesized
aatttctagaattgtgaatcaa

SEQ ID NO: 855930 - DNA, 22 bp, Artificial Sequence
  chemically synthesized
aaagtttaatttctagaattgt

SEQ ID NO: 855931 - DNA, 22 bp, Artificial Sequence
  chemically synthesized
ctattgattcacaattctagaa

SEQ ID NO: 855932 - DNA, 22 bp, Artificial Sequence
  chemically synthesized
ttgattcacaattctagaaatt

SEQ ID NO: 855933 - DNA, 22 bp, Artificial Sequence
  chemically synthesized
attcacaattctagaaattaaa

SEQ ID NO: 855934 - DNA, 22 bp, Artificial Sequence
  chemically synthesized
acaattctagaaattaaacttt

SEQ ID NO: 855935 - DNA, 22 bp, Artificial Sequence
  chemically synthesized
tagaaattaaactttgaacttc

SEQ ID NO: 855936 - DNA, 22 bp, Artificial Sequence
  chemically synthesized
gaaattaaactttgaacttcat

SEQ ID NO: 855937 - DNA, 22 bp, Artificial Sequence
  chemically synthesized
gaagtaaagcacacatgaagtt

SEQ ID NO: 855938 - DNA, 22 bp, Artificial Sequence
  chemically synthesized
agaagtaaagcacacatgaagt

SEQ ID NO: 855939 - DNA, 22 bp, Artificial Sequence
  chemically synthesized
tagaagtaaagcacacatgaag

SEQ ID NO: 855940 - DNA, 22 bp, Artificial Sequence
  chemically synthesized
aactttgaacttcatgtgtgct

SEQ ID NO: 855941 - DNA, 22 bp, Artificial Sequence
  chemically synthesized
agcctttagaagtaaagcacac

SEQ ID NO: 855942 - DNA, 22 bp, Artificial Sequence
  chemically synthesized
tgaacttcatgtgtgctttact

SEQ ID NO: 855943 - DNA, 22 bp, Artificial Sequence
  chemically synthesized
gaacttcatgtgtgctttactt

SEQ ID NO: 855944 - DNA, 22 bp, Artificial Sequence
  chemically synthesized
aacttcatgtgtgctttacttc

SEQ ID NO: 855945 - DNA, 22 bp, Artificial Sequence
  chemically synthesized
catgtgtgctttacttctaaag

SEQ ID NO: 855946 - DNA, 22 bp, Artificial Sequence
  chemically synthesized
atgtgtgctttacttctaaagg

SEQ ID NO: 855947 - DNA, 22 bp, Artificial Sequence
  chemically synthesized
tacttctaaaggcttaatttgc

SEQ ID NO: 855948 - DNA, 22 bp, Artificial Sequence
  chemically synthesized
acttctaaaggcttaatttgca

SEQ ID NO: 855949 - DNA, 22 bp, Artificial Sequence
  chemically synthesized
cttctaaaggcttaatttgcat

SEQ ID NO: 855950 - DNA, 22 bp, Artificial Sequence
  chemically synthesized
ctaaaggcttaatttgcatatt

SEQ ID NO: 855951 - DNA, 22 bp, Artificial Sequence
  chemically synthesized
taaaggcttaatttgcatattt

SEQ ID NO: 855952 - DNA, 22 bp, Artificial Sequence
  chemically synthesized
aaggcttaatttgcatatttca

SEQ ID NO: 855953 - DNA, 22 bp, Artificial Sequence
  chemically synthesized
gaagaatagagatgtgaaatat

SEQ ID NO: 855954 - DNA, 22 bp, Artificial Sequence
  chemically synthesized
agaagaatagagatgtgaaata

SEQ ID NO: 855955 - DNA, 22 bp, Artificial Sequence
  chemically synthesized
tagaagaatagagatgtgaaat

SEQ ID NO: 855956 - DNA, 22 bp, Artificial Sequence
  chemically synthesized
ttagaagaatagagatgtgaaa

SEQ ID NO: 855957 - DNA, 22 bp, Artificial Sequence
  chemically synthesized
aatttgcatatttcacatctct

SEQ ID NO: 855958 - DNA, 22 bp, Artificial Sequence
  chemically synthesized
atttgcatatttcacatctcta

SEQ ID NO: 855959 - DNA, 22 bp, Artificial Sequence
  chemically synthesized
tcttttagaagaatagagatgt

SEQ ID NO: 855960 - DNA, 22 bp, Artificial Sequence
  chemically synthesized
gcatatttcacatctctattct

SEQ ID NO: 855961 - DNA, 22 bp, Artificial Sequence
  chemically synthesized
catatttcacatctctattctt

SEQ ID NO: 855962 - DNA, 22 bp, Artificial Sequence
  chemically synthesized
cacatctctattcttctaaaag

SEQ ID NO: 855963 - DNA, 22 bp, Artificial Sequence
  chemically synthesized
acatctctattcttctaaaaga

SEQ ID NO: 855964 - DNA, 22 bp, Artificial Sequence
  chemically synthesized
tattcttctaaaagataatggt

SEQ ID NO: 855965 - DNA, 22 bp, Artificial Sequence
  chemically synthesized
ttcttctaaaagataatggtat

SEQ ID NO: 855966 - DNA, 22 bp, Artificial Sequence
  chemically synthesized
gacagtagaaaatataccatta

SEQ ID NO: 855967 - DNA, 22 bp, Artificial Sequence
  chemically synthesized
agacagtagaaaatataccatt

SEQ ID NO: 855968 - DNA, 22 bp, Artificial Sequence
  chemically synthesized
ttctaaaagataatggtatatt

SEQ ID NO: 855969 - DNA, 22 bp, Artificial Sequence
  chemically synthesized
tagacagtagaaaatataccat

SEQ ID NO: 855970 - DNA, 22 bp, Artificial Sequence
  chemically synthesized
ctaaaagataatggtatatttt

SEQ ID NO: 855971 - DNA, 22 bp, Artificial Sequence
  chemically synthesized
taaaagataatggtatattttc

SEQ ID NO: 855972 - DNA, 22 bp, Artificial Sequence
  chemically synthesized
attttagacagtagaaaatata

SEQ ID NO: 855973 - DNA, 22 bp, Artificial Sequence
  chemically synthesized
aaagataatggtatattttcta

SEQ ID NO: 855974 - DNA, 22 bp, Artificial Sequence
  chemically synthesized
cattttagacagtagaaaatat

SEQ ID NO: 855975 - DNA, 22 bp, Artificial Sequence
  chemically synthesized
cttcattttagacagtagaaaa

SEQ ID NO: 855976 - DNA, 22 bp, Artificial Sequence
  chemically synthesized
agcaaatctgcttcattttaga

SEQ ID NO: 855977 - DNA, 22 bp, Artificial Sequence
  chemically synthesized
tctactgtctaaaatgaagcag

SEQ ID NO: 855978 - DNA, 22 bp, Artificial Sequence
  chemically synthesized
ctactgtctaaaatgaagcaga

SEQ ID NO: 855979 - DNA, 22 bp, Artificial Sequence
  chemically synthesized
tactgtctaaaatgaagcagat

SEQ ID NO: 855980 - DNA, 22 bp, Artificial Sequence
  chemically synthesized
ctgtctaaaatgaagcagattt

SEQ ID NO: 855981 - DNA, 22 bp, Artificial Sequence
  chemically synthesized
aaaaaattaagcaaatctgctt

SEQ ID NO: 855982 - DNA, 22 bp, Artificial Sequence
  chemically synthesized
aaaaaaattaagcaaatctgct

SEQ ID NO: 855983 - DNA, 22 bp, Artificial Sequence
  chemically synthesized
tctaaaatgaagcagatttgct

SEQ ID NO: 855984 - DNA, 22 bp, Artificial Sequence
  chemically synthesized
aaatgaagcagatttgcttaat

SEQ ID NO: 855985 - DNA, 22 bp, Artificial Sequence
  chemically synthesized
agaatacagccatttaaaaaaa

SEQ ID NO: 855986 - DNA, 22 bp, Artificial Sequence
  chemically synthesized
aagaatacagccatttaaaaaa

SEQ ID NO: 855987 - DNA, 22 bp, Artificial Sequence
  chemically synthesized
taagaatacagccatttaaaaa

SEQ ID NO: 855988 - DNA, 22 bp, Artificial Sequence
  chemically synthesized
gcttaatttttttaaatggctg

SEQ ID NO: 855989 - DNA, 22 bp, Artificial Sequence
  chemically synthesized
cttaatttttttaaatggctgt

SEQ ID NO: 855990 - DNA, 22 bp, Artificial Sequence
  chemically synthesized
agttttaagaatacagccattt

SEQ ID NO: 855991 - DNA, 22 bp, Artificial Sequence
  chemically synthesized
aagttttaagaatacagccatt

SEQ ID NO: 855992 - DNA, 22 bp, Artificial Sequence
  chemically synthesized
taagttttaagaatacagccat

SEQ ID NO: 855993 - DNA, 22 bp, Artificial Sequence
  chemically synthesized
aatttttttaaatggctgtatt

SEQ ID NO: 855994 - DNA, 22 bp, Artificial Sequence
  chemically synthesized
ttaagttttaagaatacagcca

SEQ ID NO: 855995 - DNA, 22 bp, Artificial Sequence
  chemically synthesized
atttttttaaatggctgtattc

SEQ ID NO: 855996 - DNA, 22 bp, Artificial Sequence
  chemically synthesized
tttaagttttaagaatacagcc

SEQ ID NO: 855997 - DNA, 22 bp, Artificial Sequence
  chemically synthesized
ttttaagttttaagaatacagc

SEQ ID NO: 855998 - DNA, 22 bp, Artificial Sequence
  chemically synthesized
ttttaaatggctgtattcttaa

SEQ ID NO: 855999 - DNA, 22 bp, Artificial Sequence
  chemically synthesized
tttaaatggctgtattcttaaa

SEQ ID NO: 856000 - DNA, 22 bp, Artificial Sequence
  chemically synthesized
atttttttaagttttaagaata

SEQ ID NO: 856001 - DNA, 22 bp, Artificial Sequence
  chemically synthesized
ttaaatggctgtattcttaaaa

SEQ ID NO: 856002 - DNA, 22 bp, Artificial Sequence
  chemically synthesized
aatttttttaagttttaagaat

SEQ ID NO: 856003 - DNA, 22 bp, Artificial Sequence
  chemically synthesized
taaatggctgtattcttaaaac

SEQ ID NO: 856004 - DNA, 22 bp, Artificial Sequence
  chemically synthesized
taatttttttaagttttaagaa

SEQ ID NO: 856005 - DNA, 22 bp, Artificial Sequence
  chemically synthesized
aaatggctgtattcttaaaact

SEQ ID NO: 856006 - DNA, 22 bp, Artificial Sequence
  chemically synthesized
aatggctgtattcttaaaactt

SEQ ID NO: 856007 - DNA, 22 bp, Artificial Sequence
  chemically synthesized
caactttaatttttttaagttt

SEQ ID NO: 856008 - DNA, 22 bp, Artificial Sequence
  chemically synthesized
tattcttaaaacttaaaaaaat

SEQ ID NO: 856009 - DNA, 22 bp, Artificial Sequence
  chemically synthesized
caattacaactttaattttttt

SEQ ID NO: 856010 - DNA, 22 bp, Artificial Sequence
  chemically synthesized
ttaaaacttaaaaaaattaaag

SEQ ID NO: 856011 - DNA, 22 bp, Artificial Sequence
  chemically synthesized
aaaacttaaaaaaattaaagtt

SEQ ID NO: 856012 - DNA, 22 bp, Artificial Sequence
  chemically synthesized
aaacttaaaaaaattaaagttg

SEQ ID NO: 856013 - DNA, 22 bp, Artificial Sequence
  chemically synthesized
aaaaaaattaaagttgtaattg

SEQ ID NO: 856014 - DNA, 22 bp, Artificial Sequence
  chemically synthesized
aaaaaattaaagttgtaattgt

SEQ ID NO: 856015 - DNA, 22 bp, Artificial Sequence
  chemically synthesized
agtgaaaaaaatggaagctaca

SEQ ID NO: 856016 - DNA, 22 bp, Artificial Sequence
  chemically synthesized
aagttgtaattgtagcttccat

SEQ ID NO: 856017 - DNA, 22 bp, Artificial Sequence
  chemically synthesized
tattcagtgaaaaaaatggaag

SEQ ID NO: 856018 - DNA, 22 bp, Artificial Sequence
  chemically synthesized
taattgtagcttccattttttt

SEQ ID NO: 856019 - DNA, 22 bp, Artificial Sequence
  chemically synthesized
tagcttccatttttttcactga

SEQ ID NO: 856020 - DNA, 22 bp, Artificial Sequence
  chemically synthesized
agtgaattatattcagtgaaaa

SEQ ID NO: 856021 - DNA, 22 bp, Artificial Sequence
  chemically synthesized
ctaagtgaattatattcagtga

SEQ ID NO: 856022 - DNA, 22 bp, Artificial Sequence
  chemically synthesized
actaagtgaattatattcagtg

SEQ ID NO: 856023 - DNA, 22 bp, Artificial Sequence
  chemically synthesized
tactaagtgaattatattcagt

SEQ ID NO: 856024 - DNA, 22 bp, Artificial Sequence
  chemically synthesized
ccatttttttcactgaatataa

SEQ ID NO: 856025 - DNA, 22 bp, Artificial Sequence
  chemically synthesized
ttactaagtgaattatattcag

SEQ ID NO: 856026 - DNA, 22 bp, Artificial Sequence
  chemically synthesized
catttttttcactgaatataat

SEQ ID NO: 856027 - DNA, 22 bp, Artificial Sequence
  chemically synthesized
ttttcactgaatataattcact

SEQ ID NO: 856028 - DNA, 22 bp, Artificial Sequence
  chemically synthesized
tttcactgaatataattcactt

SEQ ID NO: 856029 - DNA, 22 bp, Artificial Sequence
  chemically synthesized
ttcactgaatataattcactta

SEQ ID NO: 856030 - DNA, 22 bp, Artificial Sequence
  chemically synthesized
tcactgaatataattcacttag

SEQ ID NO: 856031 - DNA, 22 bp, Artificial Sequence
  chemically synthesized
cactgaatataattcacttagt

SEQ ID NO: 856032 - DNA, 22 bp, Artificial Sequence
  chemically synthesized
actgaatataattcacttagta

SEQ ID NO: 856033 - DNA, 22 bp, Artificial Sequence
  chemically synthesized
aatataattcacttagtaaaaa

SEQ ID NO: 856034 - DNA, 22 bp, Artificial Sequence
  chemically synthesized
aaataaaaataatttttactaa

SEQ ID NO: 856035 - DNA, 22 bp, Artificial Sequence
  chemically synthesized
gaaataaaaataatttttacta

SEQ ID NO: 856036 - DNA, 22 bp, Artificial Sequence
  chemically synthesized
tgaaataaaaataatttttact

SEQ ID NO: 856037 - DNA, 22 bp, Artificial Sequence
  chemically synthesized
cattttgaaataaaaataattt

SEQ ID NO: 856038 - DNA, 22 bp, Artificial Sequence
  chemically synthesized
ccattttgaaataaaaataatt

SEQ ID NO: 856039 - DNA, 22 bp, Artificial Sequence
  chemically synthesized
acttagtaaaaattatttttat

SEQ ID NO: 856040 - DNA, 22 bp, Artificial Sequence
  chemically synthesized
cttccattttgaaataaaaata

SEQ ID NO: 856041 - DNA, 22 bp, Artificial Sequence
  chemically synthesized
agtaaaaattatttttatttca

SEQ ID NO: 856042 - DNA, 22 bp, Artificial Sequence
  chemically synthesized
gtaaaaattatttttatttcaa

SEQ ID NO: 856043 - DNA, 22 bp, Artificial Sequence
  chemically synthesized
tttttatttcaaaatggaagca

SEQ ID NO: 856044 - DNA, 22 bp, Artificial Sequence
  chemically synthesized
gaaaatggtgagctgcttccat

SEQ ID NO: 856045 - DNA, 22 bp, Artificial Sequence
  chemically synthesized
agaaaatggtgagctgcttcca

SEQ ID NO: 856046 - DNA, 22 bp, Artificial Sequence
  chemically synthesized
ttatttcaaaatggaagcagct

SEQ ID NO: 856047 - DNA, 22 bp, Artificial Sequence
  chemically synthesized
tagaaaatggtgagctgcttcc

SEQ ID NO: 856048 - DNA, 22 bp, Artificial Sequence
  chemically synthesized
tatttcaaaatggaagcagctc

SEQ ID NO: 856049 - DNA, 22 bp, Artificial Sequence
  chemically synthesized
atttcaaaatggaagcagctca

SEQ ID NO: 856050 - DNA, 22 bp, Artificial Sequence
  chemically synthesized
tttcaaaatggaagcagctcac

SEQ ID NO: 856051 - DNA, 22 bp, Artificial Sequence
  chemically synthesized
ttttagaaaatggtgagctgct

SEQ ID NO: 856052 - DNA, 22 bp, Artificial Sequence
  chemically synthesized
caaaatggaagcagctcaccat

SEQ ID NO: 856053 - DNA, 22 bp, Artificial Sequence
  chemically synthesized
aaaatggaagcagctcaccatt

SEQ ID NO: 856054 - DNA, 22 bp, Artificial Sequence
  chemically synthesized
aagtattattttagaaaatggt

SEQ ID NO: 856055 - DNA, 22 bp, Artificial Sequence
  chemically synthesized
attaaagtattattttagaaaa

SEQ ID NO: 856056 - DNA, 22 bp, Artificial Sequence
  chemically synthesized
gattaaagtattattttagaaa

SEQ ID NO: 856057 - DNA, 22 bp, Artificial Sequence
  chemically synthesized
cttgattaaagtattattttag

SEQ ID NO: 856058 - DNA, 22 bp, Artificial Sequence
  chemically synthesized
accattttctaaaataatactt

SEQ ID NO: 856059 - DNA, 22 bp, Artificial Sequence
  chemically synthesized
gtatgtattgcttgattaaagt

SEQ ID NO: 856060 - DNA, 22 bp, Artificial Sequence
  chemically synthesized
tctaaaataatactttaatcaa

SEQ ID NO: 856061 - DNA, 22 bp, Artificial Sequence
  chemically synthesized
agtatgtattgcttgattaaag

SEQ ID NO: 856062 - DNA, 22 bp, Artificial Sequence
  chemically synthesized
ctaaaataatactttaatcaag

SEQ ID NO: 856063 - DNA, 22 bp, Artificial Sequence
  chemically synthesized
tagtatgtattgcttgattaaa

SEQ ID NO: 856064 - DNA, 22 bp, Artificial Sequence
  chemically synthesized
taaaataatactttaatcaagc

SEQ ID NO: 856065 - DNA, 22 bp, Artificial Sequence
  chemically synthesized
aaataatactttaatcaagcaa

SEQ ID NO: 856066 - DNA, 22 bp, Artificial Sequence
  chemically synthesized
tggtcccctttagtatgtattg

SEQ ID NO: 856067 - DNA, 22 bp, Artificial Sequence
  chemically synthesized
atggtcccctttagtatgtatt

SEQ ID NO: 856068 - DNA, 22 bp, Artificial Sequence
  chemically synthesized
taatcaagcaatacatactaaa

SEQ ID NO: 856069 - DNA, 22 bp, Artificial Sequence
  chemically synthesized
aatcaagcaatacatactaaag

SEQ ID NO: 856070 - DNA, 22 bp, Artificial Sequence
  chemically synthesized
atcaagcaatacatactaaagg

SEQ ID NO: 856071 - DNA, 22 bp, Artificial Sequence
  chemically synthesized
gtgaaaagcttatggtcccctt

SEQ ID NO: 856072 - DNA, 22 bp, Artificial Sequence
  chemically synthesized
ggtgaaaagcttatggtcccct

SEQ ID NO: 856073 - DNA, 22 bp, Artificial Sequence
  chemically synthesized
aaggggaccataagcttttcac

SEQ ID NO: 856074 - DNA, 22 bp, Artificial Sequence
  chemically synthesized
agaaaacatatttggtgaaaag

SEQ ID NO: 856075 - DNA, 22 bp, Artificial Sequence
  chemically synthesized
aactcagaaaacatatttggtg

SEQ ID NO: 856076 - DNA, 22 bp, Artificial Sequence
  chemically synthesized
gaactcagaaaacatatttggt

SEQ ID NO: 856077 - DNA, 22 bp, Artificial Sequence
  chemically synthesized
tgaactcagaaaacatatttgg

SEQ ID NO: 856078 - DNA, 22 bp, Artificial Sequence
  chemically synthesized
gactttgaactcagaaaacata

SEQ ID NO: 856079 - DNA, 22 bp, Artificial Sequence
  chemically synthesized
agactttgaactcagaaaacat

SEQ ID NO: 856080 - DNA, 22 bp, Artificial Sequence
  chemically synthesized
tagactttgaactcagaaaaca

SEQ ID NO: 856081 - DNA, 22 bp, Artificial Sequence
  chemically synthesized
ttcaccaaatatgttttctgag

SEQ ID NO: 856082 - DNA, 22 bp, Artificial Sequence
  chemically synthesized
tcaccaaatatgttttctgagt

SEQ ID NO: 856083 - DNA, 22 bp, Artificial Sequence
  chemically synthesized
caccaaatatgttttctgagtt

SEQ ID NO: 856084 - DNA, 22 bp, Artificial Sequence
  chemically synthesized
accaaatatgttttctgagttc

SEQ ID NO: 856085 - DNA, 22 bp, Artificial Sequence
  chemically synthesized
gctttagactttgaactcagaa

SEQ ID NO: 856086 - DNA, 22 bp, Artificial Sequence
  chemically synthesized
actagctttagactttgaactc

SEQ ID NO: 856087 - DNA, 22 bp, Artificial Sequence
  chemically synthesized
cactagctttagactttgaact

SEQ ID NO: 856088 - DNA, 22 bp, Artificial Sequence
  chemically synthesized
tcactagctttagactttgaac

SEQ ID NO: 856089 - DNA, 22 bp, Artificial Sequence
  chemically synthesized
acctttcactagctttagactt

SEQ ID NO: 856090 - DNA, 22 bp, Artificial Sequence
  chemically synthesized
tctgagttcaaagtctaaagct

SEQ ID NO: 856091 - DNA, 22 bp, Artificial Sequence
  chemically synthesized
ctgagttcaaagtctaaagcta

SEQ ID NO: 856092 - DNA, 22 bp, Artificial Sequence
  chemically synthesized
tgagttcaaagtctaaagctag

SEQ ID NO: 856093 - DNA, 22 bp, Artificial Sequence
  chemically synthesized
agttcaaagtctaaagctagtg

SEQ ID NO: 856094 - DNA, 22 bp, Artificial Sequence
  chemically synthesized
aagtaagctaacctttcactag

SEQ ID NO: 856095 - DNA, 22 bp, Artificial Sequence
  chemically synthesized
aaagtctaaagctagtgaaagg

SEQ ID NO: 856096 - DNA, 22 bp, Artificial Sequence
  chemically synthesized
aagctagtgaaaggttagctta

SEQ ID NO: 856097 - DNA, 22 bp, Artificial Sequence
  chemically synthesized
gtgaaaggttagcttacttgaa

SEQ ID NO: 856098 - DNA, 22 bp, Artificial Sequence
  chemically synthesized
gcttacttgaatgtcatgtcct

SEQ ID NO: 856099 - DNA, 22 bp, Artificial Sequence
  chemically synthesized
acttgaatgtcatgtccttata

SEQ ID NO: 856100 - DNA, 22 bp, Artificial Sequence
  chemically synthesized
ccacagaaggggtataaggaca

SEQ ID NO: 856101 - DNA, 22 bp, Artificial Sequence
  chemically synthesized
cttgaatgtcatgtccttatac

SEQ ID NO: 856102 - DNA, 22 bp, Artificial Sequence
  chemically synthesized
gccacagaaggggtataaggac

SEQ ID NO: 856103 - DNA, 22 bp, Artificial Sequence
  chemically synthesized
gaatgtcatgtccttatacccc

SEQ ID NO: 856104 - DNA, 22 bp, Artificial Sequence
  chemically synthesized
aatgtcatgtccttatacccct

SEQ ID NO: 856105 - DNA, 22 bp, Artificial Sequence
  chemically synthesized
aaatatttgccacagaaggggt

SEQ ID NO: 856106 - DNA, 22 bp, Artificial Sequence
  chemically synthesized
ataccccttctgtggcaaatat

SEQ ID NO: 856107 - DNA, 22 bp, Artificial Sequence
  chemically synthesized
taccccttctgtggcaaatatt

SEQ ID NO: 856108 - DNA, 22 bp, Artificial Sequence
  chemically synthesized
gacgtgcagtaattgaaatatt

SEQ ID NO: 856109 - DNA, 22 bp, Artificial Sequence
  chemically synthesized
agacgtgcagtaattgaaatat

SEQ ID NO: 856110 - DNA, 22 bp, Artificial Sequence
  chemically synthesized
ctgtggcaaatatttcaattac

SEQ ID NO: 856111 - DNA, 22 bp, Artificial Sequence
  chemically synthesized
tgtggcaaatatttcaattact

SEQ ID NO: 856112 - DNA, 22 bp, Artificial Sequence
  chemically synthesized
tggcaaatatttcaattactgc

SEQ ID NO: 856113 - DNA, 22 bp, Artificial Sequence
  chemically synthesized
agaccaaaccttagacgtgcag

SEQ ID NO: 856114 - DNA, 22 bp, Artificial Sequence
  chemically synthesized
caattactgcacgtctaaggtt

SEQ ID NO: 856115 - DNA, 22 bp, Artificial Sequence
  chemically synthesized
aattactgcacgtctaaggttt

SEQ ID NO: 856116 - DNA, 22 bp, Artificial Sequence
  chemically synthesized
tgagattcagaccaaaccttag

SEQ ID NO: 856117 - DNA, 22 bp, Artificial Sequence
  chemically synthesized
ctgcacgtctaaggtttggtct

SEQ ID NO: 856118 - DNA, 22 bp, Artificial Sequence
  chemically synthesized
gttatgagattcagaccaaacc

SEQ ID NO: 856119 - DNA, 22 bp, Artificial Sequence
  chemically synthesized
cacgtctaaggtttggtctgaa

SEQ ID NO: 856120 - DNA, 22 bp, Artificial Sequence
  chemically synthesized
aggtttggtctgaatctcataa

SEQ ID NO: 856121 - DNA, 22 bp, Artificial Sequence
  chemically synthesized
aaggcaaagttagttatgagat

SEQ ID NO: 856122 - DNA, 22 bp, Artificial Sequence
  chemically synthesized
ggtctgaatctcataactaact

SEQ ID NO: 856123 - DNA, 22 bp, Artificial Sequence
  chemically synthesized
gtctgaatctcataactaactt

SEQ ID NO: 856124 - DNA, 22 bp, Artificial Sequence
  chemically synthesized
tgactcaaggcaaagttagtta

SEQ ID NO: 856125 - DNA, 22 bp, Artificial Sequence
  chemically synthesized
atgactcaaggcaaagttagtt

SEQ ID NO: 856126 - DNA, 22 bp, Artificial Sequence
  chemically synthesized
tatgactcaaggcaaagttagt

SEQ ID NO: 856127 - DNA, 22 bp, Artificial Sequence
  chemically synthesized
aatctcataactaactttgcct

SEQ ID NO: 856128 - DNA, 22 bp, Artificial Sequence
  chemically synthesized
ataactaactttgccttgagtc

SEQ ID NO: 856129 - DNA, 22 bp, Artificial Sequence
  chemically synthesized
actttgccttgagtcataaaat

SEQ ID NO: 856130 - DNA, 22 bp, Artificial Sequence
  chemically synthesized
tgccttgagtcataaaatgtct

SEQ ID NO: 856131 - DNA, 22 bp, Artificial Sequence
  chemically synthesized
gccttgagtcataaaatgtctc

SEQ ID NO: 856132 - DNA, 22 bp, Artificial Sequence
  chemically synthesized
ccttgagtcataaaatgtctca

SEQ ID NO: 856133 - DNA, 22 bp, Artificial Sequence
  chemically synthesized
gagtcataaaatgtctcattgc

SEQ ID NO: 856134 - DNA, 22 bp, Artificial Sequence
  chemically synthesized
agtcataaaatgtctcattgca

SEQ ID NO: 856135 - DNA, 22 bp, Artificial Sequence
  chemically synthesized
caaagcaccagaagatagataa

SEQ ID NO: 856136 - DNA, 22 bp, Artificial Sequence
  chemically synthesized
attgcattatcttatctatctt

SEQ ID NO: 856137 - DNA, 22 bp, Artificial Sequence
  chemically synthesized
cattatcttatctatcttctgg

SEQ ID NO: 856138 - DNA, 22 bp, Artificial Sequence
  chemically synthesized
taattccaaagcaccagaagat

SEQ ID NO: 856139 - DNA, 22 bp, Artificial Sequence
  chemically synthesized
tcttatctatcttctggtgctt

SEQ ID NO: 856140 - DNA, 22 bp, Artificial Sequence
  chemically synthesized
atctatcttctggtgctttgga

SEQ ID NO: 856141 - DNA, 22 bp, Artificial Sequence
  chemically synthesized
tctatcttctggtgctttggaa

SEQ ID NO: 856142 - DNA, 22 bp, Artificial Sequence
  chemically synthesized
tcttctggtgctttggaattat

SEQ ID NO: 856143 - DNA, 22 bp, Artificial Sequence
  chemically synthesized
gaatgtgaggattataattcca

SEQ ID NO: 856144 - DNA, 22 bp, Artificial Sequence
  chemically synthesized
ctggtgctttggaattataatc

SEQ ID NO: 856145 - DNA, 22 bp, Artificial Sequence
  chemically synthesized
tggtgctttggaattataatcc

SEQ ID NO: 856146 - DNA, 22 bp, Artificial Sequence
  chemically synthesized
gtgctttggaattataatcctc

SEQ ID NO: 856147 - DNA, 22 bp, Artificial Sequence
  chemically synthesized
aacaaagactggaatgtgagga

SEQ ID NO: 856148 - DNA, 22 bp, Artificial Sequence
  chemically synthesized
tggaattataatcctcacattc

SEQ ID NO: 856149 - DNA, 22 bp, Artificial Sequence
  chemically synthesized
ggaattataatcctcacattcc

SEQ ID NO: 856150 - DNA, 22 bp, Artificial Sequence
  chemically synthesized
gaattataatcctcacattcca

SEQ ID NO: 856151 - DNA, 22 bp, Artificial Sequence
  chemically synthesized
atattcaacaaagactggaatg

SEQ ID NO: 856152 - DNA, 22 bp, Artificial Sequence
  chemically synthesized
catattcaacaaagactggaat

SEQ ID NO: 856153 - DNA, 22 bp, Artificial Sequence
  chemically synthesized
taatcctcacattccagtcttt

SEQ ID NO: 856154 - DNA, 22 bp, Artificial Sequence
  chemically synthesized
acattccagtctttgttgaata

SEQ ID NO: 856155 - DNA, 22 bp, Artificial Sequence
  chemically synthesized
cagtctttgttgaatatgaagt

SEQ ID NO: 856156 - DNA, 22 bp, Artificial Sequence
  chemically synthesized
tgttgaatatgaagtttcctta

SEQ ID NO: 856157 - DNA, 22 bp, Artificial Sequence
  chemically synthesized
gttgaatatgaagtttccttat

SEQ ID NO: 856158 - DNA, 22 bp, Artificial Sequence
  chemically synthesized
ttgaatatgaagtttccttatc

SEQ ID NO: 856159 - DNA, 22 bp, Artificial Sequence
  chemically synthesized
aatatgaagtttccttatcaca

SEQ ID NO: 856160 - DNA, 22 bp, Artificial Sequence
  chemically synthesized
atggataatgtgaatgcaatgt

SEQ ID NO: 856161 - DNA, 22 bp, Artificial Sequence
  chemically synthesized
gatggataatgtgaatgcaatg

SEQ ID NO: 856162 - DNA, 22 bp, Artificial Sequence
  chemically synthesized
ccttatcacattgcattcacat

SEQ ID NO: 856163 - DNA, 22 bp, Artificial Sequence
  chemically synthesized
cttatcacattgcattcacatt

SEQ ID NO: 856164 - DNA, 22 bp, Artificial Sequence
  chemically synthesized
atcacattgcattcacattatc

SEQ ID NO: 856165 - DNA, 22 bp, Artificial Sequence
  chemically synthesized
tcacattgcattcacattatcc

SEQ ID NO: 856166 - DNA, 22 bp, Artificial Sequence
  chemically synthesized
cattcacattatccatcaagct

SEQ ID NO: 856167 - DNA, 22 bp, Artificial Sequence
  chemically synthesized
aataaatgtggatagcttgatg

SEQ ID NO: 856168 - DNA, 22 bp, Artificial Sequence
  chemically synthesized
tcaataaatgtggatagcttga

SEQ ID NO: 856169 - DNA, 22 bp, Artificial Sequence
  chemically synthesized
acattatccatcaagctatcca

SEQ ID NO: 856170 - DNA, 22 bp, Artificial Sequence
  chemically synthesized
gttctcaataaatgtggatagc

SEQ ID NO: 856171 - DNA, 22 bp, Artificial Sequence
  chemically synthesized
tccatcaagctatccacattta

SEQ ID NO: 856172 - DNA, 22 bp, Artificial Sequence
  chemically synthesized
tccacatttattgagaaccaat

SEQ ID NO: 856173 - DNA, 22 bp, Artificial Sequence
  chemically synthesized
accatgacacgtacagtaattg

SEQ ID NO: 856174 - DNA, 22 bp, Artificial Sequence
  chemically synthesized
gaccatgacacgtacagtaatt

SEQ ID NO: 856175 - DNA, 22 bp, Artificial Sequence
  chemically synthesized
attgagaaccaattactgtacg

SEQ ID NO: 856176 - DNA, 22 bp, Artificial Sequence
  chemically synthesized
ttgagaaccaattactgtacgt

SEQ ID NO: 856177 - DNA, 22 bp, Artificial Sequence
  chemically synthesized
tttgaccatgacacgtacagta

SEQ ID NO: 856178 - DNA, 22 bp, Artificial Sequence
  chemically synthesized
gtttgaccatgacacgtacagt

SEQ ID NO: 856179 - DNA, 22 bp, Artificial Sequence
  chemically synthesized
agaaccaattactgtacgtgtc

SEQ ID NO: 856180 - DNA, 22 bp, Artificial Sequence
  chemically synthesized
aaatataaatttgtttgaccat

SEQ ID NO: 856181 - DNA, 22 bp, Artificial Sequence
  chemically synthesized
ctgtacgtgtcatggtcaaaca

SEQ ID NO: 856182 - DNA, 22 bp, Artificial Sequence
  chemically synthesized
tacgtgtcatggtcaaacaaat

SEQ ID NO: 856183 - DNA, 22 bp, Artificial Sequence
  chemically synthesized
atataccaatacctgaaatata

SEQ ID NO: 856184 - DNA, 22 bp, Artificial Sequence
  chemically synthesized
atatttcaggtattggtatatg

SEQ ID NO: 856185 - DNA, 22 bp, Artificial Sequence
  chemically synthesized
tatttcaggtattggtatatga

SEQ ID NO: 856186 - DNA, 22 bp, Artificial Sequence
  chemically synthesized
aaataaagaccattcatatacc

SEQ ID NO: 856187 - DNA, 22 bp, Artificial Sequence
  chemically synthesized
caggtattggtatatgaatggt

SEQ ID NO: 856188 - DNA, 22 bp, Artificial Sequence
  chemically synthesized
aggtattggtatatgaatggtc

SEQ ID NO: 856189 - DNA, 22 bp, Artificial Sequence
  chemically synthesized
gtatatgaatggtctttatttc

SEQ ID NO: 856190 - DNA, 22 bp, Artificial Sequence
  chemically synthesized
acaacgtgtagacctgaaataa

SEQ ID NO: 856191 - DNA, 22 bp, Artificial Sequence
  chemically synthesized
cacaacgtgtagacctgaaata

SEQ ID NO: 856192 - DNA, 22 bp, Artificial Sequence
  chemically synthesized
aacttcacaacgtgtagacctg

SEQ ID NO: 856193 - DNA, 22 bp, Artificial Sequence
  chemically synthesized
ctcaacttcacaacgtgtagac

SEQ ID NO: 856194 - DNA, 22 bp, Artificial Sequence
  chemically synthesized
tatttcaggtctacacgttgtg

SEQ ID NO: 856195 - DNA, 22 bp, Artificial Sequence
  chemically synthesized
atttcaggtctacacgttgtga

SEQ ID NO: 856196 - DNA, 22 bp, Artificial Sequence
  chemically synthesized
atctactcaacttcacaacgtg

SEQ ID NO: 856197 - DNA, 22 bp, Artificial Sequence
  chemically synthesized
tttcaggtctacacgttgtgaa

SEQ ID NO: 856198 - DNA, 22 bp, Artificial Sequence
  chemically synthesized
caggtctacacgttgtgaagtt

SEQ ID NO: 856199 - DNA, 22 bp, Artificial Sequence
  chemically synthesized
aggtctacacgttgtgaagttg

SEQ ID NO: 856200 - DNA, 22 bp, Artificial Sequence
  chemically synthesized
cacgttgtgaagttgagtagat

SEQ ID NO: 856201 - DNA, 22 bp, Artificial Sequence
  chemically synthesized
aagcaacaggttcatctactca

SEQ ID NO: 856202 - DNA, 22 bp, Artificial Sequence
  chemically synthesized
atctaaagcaacaggttcatct

SEQ ID NO: 856203 - DNA, 22 bp, Artificial Sequence
  chemically synthesized
tgaagttgagtagatgaacctg

SEQ ID NO: 856204 - DNA, 22 bp, Artificial Sequence
  chemically synthesized
agtagatgaacctgttgcttta

SEQ ID NO: 856205 - DNA, 22 bp, Artificial Sequence
  chemically synthesized
gatacagctgatctaaagcaac

SEQ ID NO: 856206 - DNA, 22 bp, Artificial Sequence
  chemically synthesized
ttgctttagatcagctgtatcc

SEQ ID NO: 856207 - DNA, 22 bp, Artificial Sequence
  chemically synthesized
ctttagatcagctgtatccaat

SEQ ID NO: 856208 - DNA, 22 bp, Artificial Sequence
  chemically synthesized
tagatcagctgtatccaatctt

SEQ ID NO: 856209 - DNA, 22 bp, Artificial Sequence
  chemically synthesized
agatcagctgtatccaatcttt

SEQ ID NO: 856210 - DNA, 22 bp, Artificial Sequence
  chemically synthesized
gatcagctgtatccaatctttt

SEQ ID NO: 856211 - DNA, 22 bp, Artificial Sequence
  chemically synthesized
cagtgtggcccagggaagccaa

SEQ ID NO: 856212 - DNA, 22 bp, Artificial Sequence
  chemically synthesized
tatccaatcttttggcttccct

SEQ ID NO: 856213 - DNA, 22 bp, Artificial Sequence
  chemically synthesized
ccagtgtggcccagggaagcca

SEQ ID NO: 856214 - DNA, 22 bp, Artificial Sequence
  chemically synthesized
ttccagtgtggcccagggaagc

SEQ ID NO: 856215 - DNA, 22 bp, Artificial Sequence
  chemically synthesized
cttccagtgtggcccagggaag

SEQ ID NO: 856216 - DNA, 22 bp, Artificial Sequence
  chemically synthesized
ttcttccagtgtggcccaggga

SEQ ID NO: 856217 - DNA, 22 bp, Artificial Sequence
  chemically synthesized
ttggcttccctgggccacactg

SEQ ID NO: 856218 - DNA, 22 bp, Artificial Sequence
  chemically synthesized
tggcttccctgggccacactgg

SEQ ID NO: 856219 - DNA, 22 bp, Artificial Sequence
  chemically synthesized
ggcttccctgggccacactgga

SEQ ID NO: 856220 - DNA, 22 bp, Artificial Sequence
  chemically synthesized
gcttccctgggccacactggaa

SEQ ID NO: 856221 - DNA, 22 bp, Artificial Sequence
  chemically synthesized
ccctgggccacactggaagaag

SEQ ID NO: 856222 - DNA, 22 bp, Artificial Sequence
  chemically synthesized
cctgggccacactggaagaaga

SEQ ID NO: 856223 - DNA, 22 bp, Artificial Sequence
  chemically synthesized
ggccacactggaagaagaattg

SEQ ID NO: 856224 - DNA, 22 bp, Artificial Sequence
  chemically synthesized
tgtgtggcccaggacaattctt

SEQ ID NO: 856225 - DNA, 22 bp, Artificial Sequence
  chemically synthesized
atgtgtggcccaggacaattct

SEQ ID NO: 856226 - DNA, 22 bp, Artificial Sequence
  chemically synthesized
tatgtgtggcccaggacaattc

SEQ ID NO: 856227 - DNA, 22 bp, Artificial Sequence
  chemically synthesized
gaagaagaattgtcctgggcca

SEQ ID NO: 856228 - DNA, 22 bp, Artificial Sequence
  chemically synthesized
gtgtattttatgtgtggcccag

SEQ ID NO: 856229 - DNA, 22 bp, Artificial Sequence
  chemically synthesized
gtgttagtgtattttatgtgtg

SEQ ID NO: 856230 - DNA, 22 bp, Artificial Sequence
  chemically synthesized
tcctgggccacacataaaatac

SEQ ID NO: 856231 - DNA, 22 bp, Artificial Sequence
  chemically synthesized
tcattagtgttagtgtatttta

SEQ ID NO: 856232 - DNA, 22 bp, Artificial Sequence
  chemically synthesized
ggccacacataaaatacactaa

SEQ ID NO: 856233 - DNA, 22 bp, Artificial Sequence
  chemically synthesized
atcagctatcattagtgttagt

SEQ ID NO: 856234 - DNA, 22 bp, Artificial Sequence
  chemically synthesized
ctcatcagctatcattagtgtt

SEQ ID NO: 856235 - DNA, 22 bp, Artificial Sequence
  chemically synthesized
gctcatcagctatcattagtgt

SEQ ID NO: 856236 - DNA, 22 bp, Artificial Sequence
  chemically synthesized
tgctcatcagctatcattagtg

SEQ ID NO: 856237 - DNA, 22 bp, Artificial Sequence
  chemically synthesized
ttgctcatcagctatcattagt

SEQ ID NO: 856238 - DNA, 22 bp, Artificial Sequence
  chemically synthesized
tttgctcatcagctatcattag

SEQ ID NO: 856239 - DNA, 22 bp, Artificial Sequence
  chemically synthesized
ttttgctcatcagctatcatta

SEQ ID NO: 856240 - DNA, 22 bp, Artificial Sequence
  chemically synthesized
tttttgctcatcagctatcatt

SEQ ID NO: 856241 - DNA, 22 bp, Artificial Sequence
  chemically synthesized
ttttttgctcatcagctatcat

SEQ ID NO: 856242 - DNA, 22 bp, Artificial Sequence
  chemically synthesized
acactaatgatagctgatgagc

SEQ ID NO: 856243 - DNA, 22 bp, Artificial Sequence
  chemically synthesized
tgacttttttttgctcatcagc

SEQ ID NO: 856244 - DNA, 22 bp, Artificial Sequence
  chemically synthesized
gtgacttttttttgctcatcag

SEQ ID NO: 856245 - DNA, 22 bp, Artificial Sequence
  chemically synthesized
tgtgacttttttttgctcatca

SEQ ID NO: 856246 - DNA, 22 bp, Artificial Sequence
  chemically synthesized
ttgtgacttttttttgctcatc

SEQ ID NO: 856247 - DNA, 22 bp, Artificial Sequence
  chemically synthesized
tttgtgacttttttttgctcat

SEQ ID NO: 856248 - DNA, 22 bp, Artificial Sequence
  chemically synthesized
atgatagctgatgagcaaaaaa

SEQ ID NO: 856249 - DNA, 22 bp, Artificial Sequence
  chemically synthesized
atgagcaaaaaaaagtcacaaa

SEQ ID NO: 856250 - DNA, 22 bp, Artificial Sequence
  chemically synthesized
aaacatgagatactttttgtga

SEQ ID NO: 856251 - DNA, 22 bp, Artificial Sequence
  chemically synthesized
aaaacatgagatactttttgtg

SEQ ID NO: 856252 - DNA, 22 bp, Artificial Sequence
  chemically synthesized
ttaaaacatgagatactttttg

SEQ ID NO: 856253 - DNA, 22 bp, Artificial Sequence
  chemically synthesized
cttaaaacatgagatacttttt

SEQ ID NO: 856254 - DNA, 22 bp, Artificial Sequence
  chemically synthesized
tcttaaaacatgagatactttt

SEQ ID NO: 856255 - DNA, 22 bp, Artificial Sequence
  chemically synthesized
taaactttcttaaaacatgaga

SEQ ID NO: 856256 - DNA, 22 bp, Artificial Sequence
  chemically synthesized
gtaaactttcttaaaacatgag

SEQ ID NO: 856257 - DNA, 22 bp, Artificial Sequence
  chemically synthesized
atgttttaagaaagtttacaaa

SEQ ID NO: 856258 - DNA, 22 bp, Artificial Sequence
  chemically synthesized
taagaaagtttacaaatttgtg

SEQ ID NO: 856259 - DNA, 22 bp, Artificial Sequence
  chemically synthesized
aatgtggcccaacacaaatttg

SEQ ID NO: 856260 - DNA, 22 bp, Artificial Sequence
  chemically synthesized
aagaaagtttacaaatttgtgt

SEQ ID NO: 856261 - DNA, 22 bp, Artificial Sequence
  chemically synthesized
gaatgtggcccaacacaaattt

SEQ ID NO: 856262 - DNA, 22 bp, Artificial Sequence
  chemically synthesized
agaaagtttacaaatttgtgtt

SEQ ID NO: 856263 - DNA, 22 bp, Artificial Sequence
  chemically synthesized
tgaatgtggcccaacacaaatt

SEQ ID NO: 856264 - DNA, 22 bp, Artificial Sequence
  chemically synthesized
acaaatttgtgttgggccacat

SEQ ID NO: 856265 - DNA, 22 bp, Artificial Sequence
  chemically synthesized
caaatttgtgttgggccacatt

SEQ ID NO: 856266 - DNA, 22 bp, Artificial Sequence
  chemically synthesized
gtgttgggccacattcaaagcc

SEQ ID NO: 856267 - DNA, 22 bp, Artificial Sequence
  chemically synthesized
tgttgggccacattcaaagcca

SEQ ID NO: 856268 - DNA, 22 bp, Artificial Sequence
  chemically synthesized
ggccacattcaaagccatcctg

SEQ ID NO: 856269 - DNA, 22 bp, Artificial Sequence
  chemically synthesized
tgagccacatgcgtcccaggat

SEQ ID NO: 856270 - DNA, 22 bp, Artificial Sequence
  chemically synthesized
aaagccatcctgggacgcatgt

SEQ ID NO: 856271 - DNA, 22 bp, Artificial Sequence
  chemically synthesized
atggcctgtgagccacatgcgt

SEQ ID NO: 856272 - DNA, 22 bp, Artificial Sequence
  chemically synthesized
aactcatggcctgtgagccaca

SEQ ID NO: 856273 - DNA, 22 bp, Artificial Sequence
  chemically synthesized
ttcaactcatggcctgtgagcc

SEQ ID NO: 856274 - DNA, 22 bp, Artificial Sequence
  chemically synthesized
gttcaactcatggcctgtgagc

SEQ ID NO: 856275 - DNA, 22 bp, Artificial Sequence
  chemically synthesized
ggacgcatgtggctcacaggcc

SEQ ID NO: 856276 - DNA, 22 bp, Artificial Sequence
  chemically synthesized
aagcaagcttgttcaactcatg

SEQ ID NO: 856277 - DNA, 22 bp, Artificial Sequence
  chemically synthesized
acaggccatgagttgaacaagc

SEQ ID NO: 856278 - DNA, 22 bp, Artificial Sequence
  chemically synthesized
tgatctaaagcaagcttgttca

SEQ ID NO: 856279 - DNA, 22 bp, Artificial Sequence
  chemically synthesized
ttatgatctaaagcaagcttgt

SEQ ID NO: 856280 - DNA, 22 bp, Artificial Sequence
  chemically synthesized
aacaagcttgctttagatcata

SEQ ID NO: 856281 - DNA, 22 bp, Artificial Sequence
  chemically synthesized
taggaggtaattattatgatct

SEQ ID NO: 856282 - DNA, 22 bp, Artificial Sequence
  chemically synthesized
gtaggaggtaattattatgatc

SEQ ID NO: 856283 - DNA, 22 bp, Artificial Sequence
  chemically synthesized
gctttagatcataataattacc

SEQ ID NO: 856284 - DNA, 22 bp, Artificial Sequence
  chemically synthesized
ctttagatcataataattacct

SEQ ID NO: 856285 - DNA, 22 bp, Artificial Sequence
  chemically synthesized
tagatcataataattacctcct

SEQ ID NO: 856286 - DNA, 22 bp, Artificial Sequence
  chemically synthesized
agatcataataattacctccta

SEQ ID NO: 856287 - DNA, 22 bp, Artificial Sequence
  chemically synthesized
gatcataataattacctcctac

SEQ ID NO: 856288 - DNA, 22 bp, Artificial Sequence
  chemically synthesized
cctcctacaaatctcctttatt

SEQ ID NO: 856289 - DNA, 22 bp, Artificial Sequence
  chemically synthesized
gaggatagagcaaataaaggag

SEQ ID NO: 856290 - DNA, 22 bp, Artificial Sequence
  chemically synthesized
ctacaaatctcctttatttgct

SEQ ID NO: 856291 - DNA, 22 bp, Artificial Sequence
  chemically synthesized
caaatctcctttatttgctcta

SEQ ID NO: 856292 - DNA, 22 bp, Artificial Sequence
  chemically synthesized
ctttatttgctctatcctccaa

SEQ ID NO: 856293 - DNA, 22 bp, Artificial Sequence
  chemically synthesized
tatttgctctatcctccaactt

SEQ ID NO: 856294 - DNA, 22 bp, Artificial Sequence
  chemically synthesized
atttgctctatcctccaactta

SEQ ID NO: 856295 - DNA, 22 bp, Artificial Sequence
  chemically synthesized
tttgctctatcctccaacttat

SEQ ID NO: 856296 - DNA, 22 bp, Artificial Sequence
  chemically synthesized
gctctatcctccaacttattct

SEQ ID NO: 856297 - DNA, 22 bp, Artificial Sequence
  chemically synthesized
ctctatcctccaacttattcta

SEQ ID NO: 856298 - DNA, 22 bp, Artificial Sequence
  chemically synthesized
agtcaagaacatgtagaataag

SEQ ID NO: 856299 - DNA, 22 bp, Artificial Sequence
  chemically synthesized
tatcctccaacttattctacat

SEQ ID NO: 856300 - DNA, 22 bp, Artificial Sequence
  chemically synthesized
tcctccaacttattctacatgt

SEQ ID NO: 856301 - DNA, 22 bp, Artificial Sequence
  chemically synthesized
aactcagtcaagaacatgtaga

SEQ ID NO: 856302 - DNA, 22 bp, Artificial Sequence
  chemically synthesized
caacttattctacatgttcttg

SEQ ID NO: 856303 - DNA, 22 bp, Artificial Sequence
  chemically synthesized
tccactgaactcagtcaagaac

SEQ ID NO: 856304 - DNA, 22 bp, Artificial Sequence
  chemically synthesized
attctacatgttcttgactgag

SEQ ID NO: 856305 - DNA, 22 bp, Artificial Sequence
  chemically synthesized
ttctacatgttcttgactgagt

SEQ ID NO: 856306 - DNA, 22 bp, Artificial Sequence
  chemically synthesized
tacatgttcttgactgagttca

SEQ ID NO: 856307 - DNA, 22 bp, Artificial Sequence
  chemically synthesized
catgttcttgactgagttcagt

SEQ ID NO: 856308 - DNA, 22 bp, Artificial Sequence
  chemically synthesized
aacaataattgtccactgaact

SEQ ID NO: 856309 - DNA, 22 bp, Artificial Sequence
  chemically synthesized
ttgactgagttcagtggacaat

SEQ ID NO: 856310 - DNA, 22 bp, Artificial Sequence
  chemically synthesized
gactgagttcagtggacaatta

SEQ ID NO: 856311 - DNA, 22 bp, Artificial Sequence
  chemically synthesized
actgagttcagtggacaattat

SEQ ID NO: 856312 - DNA, 22 bp, Artificial Sequence
  chemically synthesized
accaaccactaaacaataattg

SEQ ID NO: 856313 - DNA, 22 bp, Artificial Sequence
  chemically synthesized
agttcagtggacaattattgtt

SEQ ID NO: 856314 - DNA, 22 bp, Artificial Sequence
  chemically synthesized
tgaccaaccactaaacaataat

SEQ ID NO: 856315 - DNA, 22 bp, Artificial Sequence
  chemically synthesized
agtggacaattattgtttagtg

SEQ ID NO: 856316 - DNA, 22 bp, Artificial Sequence
  chemically synthesized
ttgtttagtggttggtcagaat

SEQ ID NO: 856317 - DNA, 22 bp, Artificial Sequence
  chemically synthesized
tttagtggttggtcagaatcat

SEQ ID NO: 856318 - DNA, 22 bp, Artificial Sequence
  chemically synthesized
agtggttggtcagaatcatttc

SEQ ID NO: 856319 - DNA, 22 bp, Artificial Sequence
  chemically synthesized
gtggttggtcagaatcatttcc

SEQ ID NO: 856320 - DNA, 22 bp, Artificial Sequence
  chemically synthesized
acaatagaagaaggaaatgatt

SEQ ID NO: 856321 - DNA, 22 bp, Artificial Sequence
  chemically synthesized
ttgacaatagaagaaggaaatg

SEQ ID NO: 856322 - DNA, 22 bp, Artificial Sequence
  chemically synthesized
tattgacaatagaagaaggaaa

SEQ ID NO: 856323 - DNA, 22 bp, Artificial Sequence
  chemically synthesized
gtcagaatcatttccttcttct

SEQ ID NO: 856324 - DNA, 22 bp, Artificial Sequence
  chemically synthesized
ggttctattgacaatagaagaa

SEQ ID NO: 856325 - DNA, 22 bp, Artificial Sequence
  chemically synthesized
ccttcttctattgtcaatagaa

SEQ ID NO: 856326 - DNA, 22 bp, Artificial Sequence
  chemically synthesized
cttcttctattgtcaatagaac

SEQ ID NO: 856327 - DNA, 22 bp, Artificial Sequence
  chemically synthesized
aatagaaactgggttctattga

SEQ ID NO: 856328 - DNA, 22 bp, Artificial Sequence
  chemically synthesized
cttctattgtcaatagaaccca

SEQ ID NO: 856329 - DNA, 22 bp, Artificial Sequence
  chemically synthesized
ctgaatagaaactgggttctat

SEQ ID NO: 856330 - DNA, 22 bp, Artificial Sequence
  chemically synthesized
ttctattgtcaatagaacccag

SEQ ID NO: 856331 - DNA, 22 bp, Artificial Sequence
  chemically synthesized
tcctgaatagaaactgggttct

SEQ ID NO: 856332 - DNA, 22 bp, Artificial Sequence
  chemically synthesized
ctattgtcaatagaacccagtt

SEQ ID NO: 856333 - DNA, 22 bp, Artificial Sequence
  chemically synthesized
tattgtcaatagaacccagttt

SEQ ID NO: 856334 - DNA, 22 bp, Artificial Sequence
  chemically synthesized
ttgtcaatagaacccagtttct

SEQ ID NO: 856335 - DNA, 22 bp, Artificial Sequence
  chemically synthesized
tcaatagaacccagtttctatt

SEQ ID NO: 856336 - DNA, 22 bp, Artificial Sequence
  chemically synthesized
gggaaaggcaattctcctgaat

SEQ ID NO: 856337 - DNA, 22 bp, Artificial Sequence
  chemically synthesized
aaaattagggaaaggcaattct

SEQ ID NO: 856338 - DNA, 22 bp, Artificial Sequence
  chemically synthesized
ctattcaggagaattgcctttc

SEQ ID NO: 856339 - DNA, 22 bp, Artificial Sequence
  chemically synthesized
tattcaggagaattgcctttcc

SEQ ID NO: 856340 - DNA, 22 bp, Artificial Sequence
  chemically synthesized
ttcaggagaattgcctttccct

SEQ ID NO: 856341 - DNA, 22 bp, Artificial Sequence
  chemically synthesized
aggagaattgcctttccctaat

SEQ ID NO: 856342 - DNA, 22 bp, Artificial Sequence
  chemically synthesized
ccaaagtctcaaaattagggaa

SEQ ID NO: 856343 - DNA, 22 bp, Artificial Sequence
  chemically synthesized
ctcccaaagtctcaaaattagg

SEQ ID NO: 856344 - DNA, 22 bp, Artificial Sequence
  chemically synthesized
tcctcccaaagtctcaaaatta

SEQ ID NO: 856345 - DNA, 22 bp, Artificial Sequence
  chemically synthesized
cctttccctaattttgagactt

SEQ ID NO: 856346 - DNA, 22 bp, Artificial Sequence
  chemically synthesized
tccctaattttgagactttggg

SEQ ID NO: 856347 - DNA, 22 bp, Artificial Sequence
  chemically synthesized
aatccctctcctcccaaagtct

SEQ ID NO: 856348 - DNA, 22 bp, Artificial Sequence
  chemically synthesized
ccctaattttgagactttggga

SEQ ID NO: 856349 - DNA, 22 bp, Artificial Sequence
  chemically synthesized
aaatccctctcctcccaaagtc

SEQ ID NO: 856350 - DNA, 22 bp, Artificial Sequence
  chemically synthesized
cctaattttgagactttgggag

SEQ ID NO: 856351 - DNA, 22 bp, Artificial Sequence
  chemically synthesized
atttaaatccctctcctcccaa

SEQ ID NO: 856352 - DNA, 22 bp, Artificial Sequence
  chemically synthesized
attttgagactttgggaggaga

SEQ ID NO: 856353 - DNA, 22 bp, Artificial Sequence
  chemically synthesized
gatttaaatccctctcctccca

SEQ ID NO: 856354 - DNA, 22 bp, Artificial Sequence
  chemically synthesized
tgatttaaatccctctcctccc

SEQ ID NO: 856355 - DNA, 22 bp, Artificial Sequence
  chemically synthesized
tgagactttgggaggagaggga

SEQ ID NO: 856356 - DNA, 22 bp, Artificial Sequence
  chemically synthesized
gagactttgggaggagagggat

SEQ ID NO: 856357 - DNA, 22 bp, Artificial Sequence
  chemically synthesized
agactttgggaggagagggatt

SEQ ID NO: 856358 - DNA, 22 bp, Artificial Sequence
  chemically synthesized
tgggaggagagggatttaaatc

SEQ ID NO: 856359 - DNA, 22 bp, Artificial Sequence
  chemically synthesized
gggaggagagggatttaaatca

SEQ ID NO: 856360 - DNA, 22 bp, Artificial Sequence
  chemically synthesized
ggaggagagggatttaaatcaa

SEQ ID NO: 856361 - DNA, 22 bp, Artificial Sequence
  chemically synthesized
gaagggagcagaaaactttgat

SEQ ID NO: 856362 - DNA, 22 bp, Artificial Sequence
  chemically synthesized
aaatcaaagttttctgctccct

SEQ ID NO: 856363 - DNA, 22 bp, Artificial Sequence
  chemically synthesized
aatcaaagttttctgctccctt

SEQ ID NO: 856364 - DNA, 22 bp, Artificial Sequence
  chemically synthesized
atacatgagctagaagggagca

SEQ ID NO: 856365 - DNA, 22 bp, Artificial Sequence
  chemically synthesized
tctgctcccttctagctcatgt

SEQ ID NO: 856366 - DNA, 22 bp, Artificial Sequence
  chemically synthesized
ctgctcccttctagctcatgta

SEQ ID NO: 856367 - DNA, 22 bp, Artificial Sequence
  chemically synthesized
tgctcccttctagctcatgtat

SEQ ID NO: 856368 - DNA, 22 bp, Artificial Sequence
  chemically synthesized
ggtcacatgttaatacatgagc

SEQ ID NO: 856369 - DNA, 22 bp, Artificial Sequence
  chemically synthesized
gggtcacatgttaatacatgag

SEQ ID NO: 856370 - DNA, 22 bp, Artificial Sequence
  chemically synthesized
ctcccttctagctcatgtatta

SEQ ID NO: 856371 - DNA, 22 bp, Artificial Sequence
  chemically synthesized
tttgggtcacatgttaatacat

SEQ ID NO: 856372 - DNA, 22 bp, Artificial Sequence
  chemically synthesized
ccttctagctcatgtattaaca

SEQ ID NO: 856373 - DNA, 22 bp, Artificial Sequence
  chemically synthesized
gtttgggtcacatgttaataca

SEQ ID NO: 856374 - DNA, 22 bp, Artificial Sequence
  chemically synthesized
ctagctcatgtattaacatgtg

SEQ ID NO: 856375 - DNA, 22 bp, Artificial Sequence
  chemically synthesized
tagctcatgtattaacatgtga

SEQ ID NO: 856376 - DNA, 22 bp, Artificial Sequence
  chemically synthesized
accttgtttgggtcacatgtta

SEQ ID NO: 856377 - DNA, 22 bp, Artificial Sequence
  chemically synthesized
gctcatgtattaacatgtgacc

SEQ ID NO: 856378 - DNA, 22 bp, Artificial Sequence
  chemically synthesized
atgtattaacatgtgacccaaa

SEQ ID NO: 856379 - DNA, 22 bp, Artificial Sequence
  chemically synthesized
acatgtgacccaaacaaggtga

SEQ ID NO: 856380 - DNA, 22 bp, Artificial Sequence
  chemically synthesized
aaagagagtccagttcaccttg

SEQ ID NO: 856381 - DNA, 22 bp, Artificial Sequence
  chemically synthesized
aaaagagagtccagttcacctt

SEQ ID NO: 856382 - DNA, 22 bp, Artificial Sequence
  chemically synthesized
aagtcttaaaagagagtccagt

SEQ ID NO: 856383 - DNA, 22 bp, Artificial Sequence
  chemically synthesized
aaagtcttaaaagagagtccag

SEQ ID NO: 856384 - DNA, 22 bp, Artificial Sequence
  chemically synthesized
taaagtcttaaaagagagtcca

SEQ ID NO: 856385 - DNA, 22 bp, Artificial Sequence
  chemically synthesized
aaattttaaagtcttaaaagag

SEQ ID NO: 856386 - DNA, 22 bp, Artificial Sequence
  chemically synthesized
ttcaaattttaaagtcttaaaa

SEQ ID NO: 856387 - DNA, 22 bp, Artificial Sequence
  chemically synthesized
tgttcaaattttaaagtcttaa

SEQ ID NO: 856388 - DNA, 22 bp, Artificial Sequence
  chemically synthesized
gactctcttttaagactttaaa

SEQ ID NO: 856389 - DNA, 22 bp, Artificial Sequence
  chemically synthesized
tcttttaagactttaaaatttg

SEQ ID NO: 856390 - DNA, 22 bp, Artificial Sequence
  chemically synthesized
ttttaagactttaaaatttgaa

SEQ ID NO: 856391 - DNA, 22 bp, Artificial Sequence
  chemically synthesized
tgtgtaactctgttcaaatttt

SEQ ID NO: 856392 - DNA, 22 bp, Artificial Sequence
  chemically synthesized
ttaagactttaaaatttgaaca

SEQ ID NO: 856393 - DNA, 22 bp, Artificial Sequence
  chemically synthesized
taagactttaaaatttgaacag

SEQ ID NO: 856394 - DNA, 22 bp, Artificial Sequence
  chemically synthesized
aagactttaaaatttgaacaga

SEQ ID NO: 856395 - DNA, 22 bp, Artificial Sequence
  chemically synthesized
agactttaaaatttgaacagag

SEQ ID NO: 856396 - DNA, 22 bp, Artificial Sequence
  chemically synthesized
catcctgtgtgtaactctgttc

SEQ ID NO: 856397 - DNA, 22 bp, Artificial Sequence
  chemically synthesized
tccatcctgtgtgtaactctgt

SEQ ID NO: 856398 - DNA, 22 bp, Artificial Sequence
  chemically synthesized
ctccatcctgtgtgtaactctg

SEQ ID NO: 856399 - DNA, 22 bp, Artificial Sequence
  chemically synthesized
taaaatttgaacagagttacac

SEQ ID NO: 856400 - DNA, 22 bp, Artificial Sequence
  chemically synthesized
tctccatcctgtgtgtaactct

SEQ ID NO: 856401 - DNA, 22 bp, Artificial Sequence
  chemically synthesized
aaaatttgaacagagttacaca

SEQ ID NO: 856402 - DNA, 22 bp, Artificial Sequence
  chemically synthesized
ttctccatcctgtgtgtaactc

SEQ ID NO: 856403 - DNA, 22 bp, Artificial Sequence
  chemically synthesized
aaatttgaacagagttacacac

SEQ ID NO: 856404 - DNA, 22 bp, Artificial Sequence
  chemically synthesized
ttttctccatcctgtgtgtaac

SEQ ID NO: 856405 - DNA, 22 bp, Artificial Sequence
  chemically synthesized
tcttttctccatcctgtgtgta

SEQ ID NO: 856406 - DNA, 22 bp, Artificial Sequence
  chemically synthesized
gaacagagttacacacaggatg

SEQ ID NO: 856407 - DNA, 22 bp, Artificial Sequence
  chemically synthesized
aacagagttacacacaggatgg

SEQ ID NO: 856408 - DNA, 22 bp, Artificial Sequence
  chemically synthesized
tgatactctcttttctccatcc

SEQ ID NO: 856409 - DNA, 22 bp, Artificial Sequence
  chemically synthesized
gtgatactctcttttctccatc

SEQ ID NO: 856410 - DNA, 22 bp, Artificial Sequence
  chemically synthesized
tttgtgatactctcttttctcc

SEQ ID NO: 856411 - DNA, 22 bp, Artificial Sequence
  chemically synthesized
cacacaggatggagaaaagaga

SEQ ID NO: 856412 - DNA, 22 bp, Artificial Sequence
  chemically synthesized
cagtctgtttgtgatactctct

SEQ ID NO: 856413 - DNA, 22 bp, Artificial Sequence
  chemically synthesized
gcaagaagtattccagtctgtt

SEQ ID NO: 856414 - DNA, 22 bp, Artificial Sequence
  chemically synthesized
ggcatgtggctagcaagaagta

SEQ ID NO: 856415 - DNA, 22 bp, Artificial Sequence
  chemically synthesized
tgggcatgtggctagcaagaag

SEQ ID NO: 856416 - DNA, 22 bp, Artificial Sequence
  chemically synthesized
ctgggcatgtggctagcaagaa

SEQ ID NO: 856417 - DNA, 22 bp, Artificial Sequence
  chemically synthesized
tctgggcatgtggctagcaaga

SEQ ID NO: 856418 - DNA, 22 bp, Artificial Sequence
  chemically synthesized
gaatacttcttgctagccacat

SEQ ID NO: 856419 - DNA, 22 bp, Artificial Sequence
  chemically synthesized
agcatgcctttctgggcatgtg

SEQ ID NO: 856420 - DNA, 22 bp, Artificial Sequence
  chemically synthesized
cttgctagccacatgcccagaa

SEQ ID NO: 856421 - DNA, 22 bp, Artificial Sequence
  chemically synthesized
ttgctagccacatgcccagaaa

SEQ ID NO: 856422 - DNA, 22 bp, Artificial Sequence
  chemically synthesized
gctagccacatgcccagaaagg

SEQ ID NO: 856423 - DNA, 22 bp, Artificial Sequence
  chemically synthesized
ctagccacatgcccagaaaggc

SEQ ID NO: 856424 - DNA, 22 bp, Artificial Sequence
  chemically synthesized
gccacatgcccagaaaggcatg

SEQ ID NO: 856425 - DNA, 22 bp, Artificial Sequence
  chemically synthesized
caaaaggaaaaagaatctgagc

SEQ ID NO: 856426 - DNA, 22 bp, Artificial Sequence
  chemically synthesized
acaaaaggaaaaagaatctgag

SEQ ID NO: 856427 - DNA, 22 bp, Artificial Sequence
  chemically synthesized
gaacaaaacttacaaaaggaaa

SEQ ID NO: 856428 - DNA, 22 bp, Artificial Sequence
  chemically synthesized
agattctttttccttttgtaag

SEQ ID NO: 856429 - DNA, 22 bp, Artificial Sequence
  chemically synthesized
tttttccttttgtaagttttgt

SEQ ID NO: 856430 - DNA, 22 bp, Artificial Sequence
  chemically synthesized
tttccttttgtaagttttgttc

SEQ ID NO: 856431 - DNA, 22 bp, Artificial Sequence
  chemically synthesized
ttccttttgtaagttttgttcc

SEQ ID NO: 856432 - DNA, 22 bp, Artificial Sequence
  chemically synthesized
tccttttgtaagttttgttcca

SEQ ID NO: 856433 - DNA, 22 bp, Artificial Sequence
  chemically synthesized
gcacaaaggcattggaacaaaa

SEQ ID NO: 856434 - DNA, 22 bp, Artificial Sequence
  chemically synthesized
ccttttgtaagttttgttccaa

SEQ ID NO: 856435 - DNA, 22 bp, Artificial Sequence
  chemically synthesized
cttttgtaagttttgttccaat

SEQ ID NO: 856436 - DNA, 22 bp, Artificial Sequence
  chemically synthesized
ttgtaagttttgttccaatgcc

SEQ ID NO: 856437 - DNA, 22 bp, Artificial Sequence
  chemically synthesized
tgtaagttttgttccaatgcct

SEQ ID NO: 856438 - DNA, 22 bp, Artificial Sequence
  chemically synthesized
taattagcacaaaggcattgga

SEQ ID NO: 856439 - DNA, 22 bp, Artificial Sequence
  chemically synthesized
gtaagttttgttccaatgcctt

SEQ ID NO: 856440 - DNA, 22 bp, Artificial Sequence
  chemically synthesized
taagttttgttccaatgccttt

SEQ ID NO: 856441 - DNA, 22 bp, Artificial Sequence
  chemically synthesized
tgttccaatgcctttgtgctaa

SEQ ID NO: 856442 - DNA, 22 bp, Artificial Sequence
  chemically synthesized
gttccaatgcctttgtgctaat

SEQ ID NO: 856443 - DNA, 22 bp, Artificial Sequence
  chemically synthesized
ttccaatgcctttgtgctaatt

SEQ ID NO: 856444 - DNA, 22 bp, Artificial Sequence
  chemically synthesized
caatgcctttgtgctaattaca

SEQ ID NO: 856445 - DNA, 22 bp, Artificial Sequence
  chemically synthesized
tgtgctaattacagcacattta

SEQ ID NO: 856446 - DNA, 22 bp, Artificial Sequence
  chemically synthesized
gtgctaattacagcacatttac

SEQ ID NO: 856447 - DNA, 22 bp, Artificial Sequence
  chemically synthesized
tgctaattacagcacatttact

SEQ ID NO: 856448 - DNA, 22 bp, Artificial Sequence
  chemically synthesized
aatcaggcagaaagtaaatgtg

SEQ ID NO: 856449 - DNA, 22 bp, Artificial Sequence
  chemically synthesized
attaaatcaggcagaaagtaaa

SEQ ID NO: 856450 - DNA, 22 bp, Artificial Sequence
  chemically synthesized
attacagcacatttactttctg

SEQ ID NO: 856451 - DNA, 22 bp, Artificial Sequence
  chemically synthesized
tgattaaatcaggcagaaagta

SEQ ID NO: 856452 - DNA, 22 bp, Artificial Sequence
  chemically synthesized
tctgattaaatcaggcagaaag

SEQ ID NO: 856453 - DNA, 22 bp, Artificial Sequence
  chemically synthesized
cagcacatttactttctgcctg

SEQ ID NO: 856454 - DNA, 22 bp, Artificial Sequence
  chemically synthesized
actttctgcctgatttaatcag

SEQ ID NO: 856455 - DNA, 22 bp, Artificial Sequence
  chemically synthesized
ctttctgcctgatttaatcaga

SEQ ID NO: 856456 - DNA, 22 bp, Artificial Sequence
  chemically synthesized
tctgcctgatttaatcagagaa

SEQ ID NO: 856457 - DNA, 22 bp, Artificial Sequence
  chemically synthesized
ctgcctgatttaatcagagaat

SEQ ID NO: 856458 - DNA, 22 bp, Artificial Sequence
  chemically synthesized
tgcctgatttaatcagagaatg

SEQ ID NO: 856459 - DNA, 22 bp, Artificial Sequence
  chemically synthesized
cctgatttaatcagagaatgat

SEQ ID NO: 856460 - DNA, 22 bp, Artificial Sequence
  chemically synthesized
atttaatcagagaatgatttct

SEQ ID NO: 856461 - DNA, 22 bp, Artificial Sequence
  chemically synthesized
gatgcaagcaacagaaatcatt

SEQ ID NO: 856462 - DNA, 22 bp, Artificial Sequence
  chemically synthesized
tggatgcaagcaacagaaatca

SEQ ID NO: 856463 - DNA, 22 bp, Artificial Sequence
  chemically synthesized
aatcagagaatgatttctgttg

SEQ ID NO: 856464 - DNA, 22 bp, Artificial Sequence
  chemically synthesized
tctggatgcaagcaacagaaat

SEQ ID NO: 856465 - DNA, 22 bp, Artificial Sequence
  chemically synthesized
atcagagaatgatttctgttgc

SEQ ID NO: 856466 - DNA, 22 bp, Artificial Sequence
  chemically synthesized
gagctctctggatgcaagcaac

SEQ ID NO: 856467 - DNA, 22 bp, Artificial Sequence
  chemically synthesized
tcaattagagctctctggatgc

SEQ ID NO: 856468 - DNA, 22 bp, Artificial Sequence
  chemically synthesized
ctgttgcttgcatccagagagc

SEQ ID NO: 856469 - DNA, 22 bp, Artificial Sequence
  chemically synthesized
tgttgcttgcatccagagagct

SEQ ID NO: 856470 - DNA, 22 bp, Artificial Sequence
  chemically synthesized
cctatcaattagagctctctgg

SEQ ID NO: 856471 - DNA, 22 bp, Artificial Sequence
  chemically synthesized
ttgcttgcatccagagagctct

SEQ ID NO: 856472 - DNA, 22 bp, Artificial Sequence
  chemically synthesized
gttgcctatcaattagagctct

SEQ ID NO: 856473 - DNA, 22 bp, Artificial Sequence
  chemically synthesized
cttgcatccagagagctctaat

SEQ ID NO: 856474 - DNA, 22 bp, Artificial Sequence
  chemically synthesized
agttgcctatcaattagagctc

SEQ ID NO: 856475 - DNA, 22 bp, Artificial Sequence
  chemically synthesized
gcatccagagagctctaattga

SEQ ID NO: 856476 - DNA, 22 bp, Artificial Sequence
  chemically synthesized
catccagagagctctaattgat

SEQ ID NO: 856477 - DNA, 22 bp, Artificial Sequence
  chemically synthesized
taattgataggcaactaaacta

SEQ ID NO: 856478 - DNA, 22 bp, Artificial Sequence
  chemically synthesized
attgataggcaactaaactata

SEQ ID NO: 856479 - DNA, 22 bp, Artificial Sequence
  chemically synthesized
ataggcaactaaactatatgtg

SEQ ID NO: 856480 - DNA, 22 bp, Artificial Sequence
  chemically synthesized
taaacaggaaaataaaatcatc

SEQ ID NO: 856481 - DNA, 22 bp, Artificial Sequence
  chemically synthesized
aactatatgtgatgattttatt

SEQ ID NO: 856482 - DNA, 22 bp, Artificial Sequence
  chemically synthesized
tatgtgatgattttattttcct

SEQ ID NO: 856483 - DNA, 22 bp, Artificial Sequence
  chemically synthesized
aaaggattgtaaacaggaaaat

SEQ ID NO: 856484 - DNA, 22 bp, Artificial Sequence
  chemically synthesized
tgaaaggattgtaaacaggaaa

SEQ ID NO: 856485 - DNA, 22 bp, Artificial Sequence
  chemically synthesized
tattttcctgtttacaatcctt

SEQ ID NO: 856486 - DNA, 22 bp, Artificial Sequence
  chemically synthesized
attttcctgtttacaatccttt

SEQ ID NO: 856487 - DNA, 22 bp, Artificial Sequence
  chemically synthesized
ttttcctgtttacaatcctttc

SEQ ID NO: 856488 - DNA, 22 bp, Artificial Sequence
  chemically synthesized
tcctgtttacaatcctttcaga

SEQ ID NO: 856489 - DNA, 22 bp, Artificial Sequence
  chemically synthesized
cctgtttacaatcctttcagag

SEQ ID NO: 856490 - DNA, 22 bp, Artificial Sequence
  chemically synthesized
ctgtttacaatcctttcagagt

SEQ ID NO: 856491 - DNA, 22 bp, Artificial Sequence
  chemically synthesized
caggcagtggcaactctgaaag

SEQ ID NO: 856492 - DNA, 22 bp, Artificial Sequence
  chemically synthesized
tttacaatcctttcagagttgc

SEQ ID NO: 856493 - DNA, 22 bp, Artificial Sequence
  chemically synthesized
acaatcctttcagagttgccac

SEQ ID NO: 856494 - DNA, 22 bp, Artificial Sequence
  chemically synthesized
caatcctttcagagttgccact

SEQ ID NO: 856495 - DNA, 22 bp, Artificial Sequence
  chemically synthesized
atgatggcctacaggcagtggc

SEQ ID NO: 856496 - DNA, 22 bp, Artificial Sequence
  chemically synthesized
gatgatggcctacaggcagtgg

SEQ ID NO: 856497 - DNA, 22 bp, Artificial Sequence
  chemically synthesized
tgatgatggcctacaggcagtg

SEQ ID NO: 856498 - DNA, 22 bp, Artificial Sequence
  chemically synthesized
tcagagttgccactgcctgtag

SEQ ID NO: 856499 - DNA, 22 bp, Artificial Sequence
  chemically synthesized
cagagttgccactgcctgtagg

SEQ ID NO: 856500 - DNA, 22 bp, Artificial Sequence
  chemically synthesized
agagttgccactgcctgtaggc

SEQ ID NO: 856501 - DNA, 22 bp, Artificial Sequence
  chemically synthesized
aggaattttgatgatggcctac

SEQ ID NO: 856502 - DNA, 22 bp, Artificial Sequence
  chemically synthesized
ccactgcctgtaggccatcatc

SEQ ID NO: 856503 - DNA, 22 bp, Artificial Sequence
  chemically synthesized
ccagactgaggaattttgatga

SEQ ID NO: 856504 - DNA, 22 bp, Artificial Sequence
  chemically synthesized
cctgtaggccatcatcaaaatt

SEQ ID NO: 856505 - DNA, 22 bp, Artificial Sequence
  chemically synthesized
ttgccagactgaggaattttga

SEQ ID NO: 856506 - DNA, 22 bp, Artificial Sequence
  chemically synthesized
gttgccagactgaggaattttg

SEQ ID NO: 856507 - DNA, 22 bp, Artificial Sequence
  chemically synthesized
taggccatcatcaaaattcctc

SEQ ID NO: 856508 - DNA, 22 bp, Artificial Sequence
  chemically synthesized
tgttgccagactgaggaatttt

SEQ ID NO: 856509 - DNA, 22 bp, Artificial Sequence
  chemically synthesized
aataatgggaatcctttgttgc

SEQ ID NO: 856510 - DNA, 22 bp, Artificial Sequence
  chemically synthesized
ctcagtctggcaacaaaggatt

SEQ ID NO: 856511 - DNA, 22 bp, Artificial Sequence
  chemically synthesized
agtctggcaacaaaggattccc

SEQ ID NO: 856512 - DNA, 22 bp, Artificial Sequence
  chemically synthesized
gggctaaataatgggaatcctt

SEQ ID NO: 856513 - DNA, 22 bp, Artificial Sequence
  chemically synthesized
gcaacaaaggattcccattatt

SEQ ID NO: 856514 - DNA, 22 bp, Artificial Sequence
  chemically synthesized
aatagagaggactggggctaaa

SEQ ID NO: 856515 - DNA, 22 bp, Artificial Sequence
  chemically synthesized
ccattatttagccccagtcctc

SEQ ID NO: 856516 - DNA, 22 bp, Artificial Sequence
  chemically synthesized
atgaggttgaatagagaggact

SEQ ID NO: 856517 - DNA, 22 bp, Artificial Sequence
  chemically synthesized
tttagccccagtcctctctatt

SEQ ID NO: 856518 - DNA, 22 bp, Artificial Sequence
  chemically synthesized
agccccagtcctctctattcaa

SEQ ID NO: 856519 - DNA, 22 bp, Artificial Sequence
  chemically synthesized
gccccagtcctctctattcaac

SEQ ID NO: 856520 - DNA, 22 bp, Artificial Sequence
  chemically synthesized
tctattcaacctcatcaatttc

SEQ ID NO: 856521 - DNA, 22 bp, Artificial Sequence
  chemically synthesized
tattcaacctcatcaatttctt

SEQ ID NO: 856522 - DNA, 22 bp, Artificial Sequence
  chemically synthesized
ttcaacctcatcaatttcttcc

SEQ ID NO: 856523 - DNA, 22 bp, Artificial Sequence
  chemically synthesized
agggtatatgatgaggaagaaa

SEQ ID NO: 856524 - DNA, 22 bp, Artificial Sequence
  chemically synthesized
aacctcatcaatttcttcctca

SEQ ID NO: 856525 - DNA, 22 bp, Artificial Sequence
  chemically synthesized
aagttaagggtatatgatgagg

SEQ ID NO: 856526 - DNA, 22 bp, Artificial Sequence
  chemically synthesized
atcaatttcttcctcatcatat

SEQ ID NO: 856527 - DNA, 22 bp, Artificial Sequence
  chemically synthesized
cttcctcatcatatacccttaa

SEQ ID NO: 856528 - DNA, 22 bp, Artificial Sequence
  chemically synthesized
ttcctcatcatatacccttaac

SEQ ID NO: 856529 - DNA, 22 bp, Artificial Sequence
  chemically synthesized
catatggctgaagttaagggta

SEQ ID NO: 856530 - DNA, 22 bp, Artificial Sequence
  chemically synthesized
cctcatcatatacccttaactt

SEQ ID NO: 856531 - DNA, 22 bp, Artificial Sequence
  chemically synthesized
ctcatcatatacccttaacttc

SEQ ID NO: 856532 - DNA, 22 bp, Artificial Sequence
  chemically synthesized
atcatatacccttaacttcagc

SEQ ID NO: 856533 - DNA, 22 bp, Artificial Sequence
  chemically synthesized
tgattccatatggctgaagtta

SEQ ID NO: 856534 - DNA, 22 bp, Artificial Sequence
  chemically synthesized
aacttcagccatatggaatcac

SEQ ID NO: 856535 - DNA, 22 bp, Artificial Sequence
  chemically synthesized
acttcagccatatggaatcaca

SEQ ID NO: 856536 - DNA, 22 bp, Artificial Sequence
  chemically synthesized
cagccatatggaatcacaattc

SEQ ID NO: 856537 - DNA, 22 bp, Artificial Sequence
  chemically synthesized
agccatatggaatcacaattcc

SEQ ID NO: 856538 - DNA, 22 bp, Artificial Sequence
  chemically synthesized
aggtggaaaaaaaacagagtat

SEQ ID NO: 856539 - DNA, 22 bp, Artificial Sequence
  chemically synthesized
actgaggtggaaaaaaaacaga

SEQ ID NO: 856540 - DNA, 22 bp, Artificial Sequence
  chemically synthesized
ctctgatatactctgttttttt

SEQ ID NO: 856541 - DNA, 22 bp, Artificial Sequence
  chemically synthesized
cactgaggtggaaaaaaaacag

SEQ ID NO: 856542 - DNA, 22 bp, Artificial Sequence
  chemically synthesized
tcactgaggtggaaaaaaaaca

SEQ ID NO: 856543 - DNA, 22 bp, Artificial Sequence
  chemically synthesized
ttcactgaggtggaaaaaaaac

SEQ ID NO: 856544 - DNA, 22 bp, Artificial Sequence
  chemically synthesized
tgatatactctgttttttttcc

SEQ ID NO: 856545 - DNA, 22 bp, Artificial Sequence
  chemically synthesized
atatactctgttttttttccac

SEQ ID NO: 856546 - DNA, 22 bp, Artificial Sequence
  chemically synthesized
tgcttttcactgaggtggaaaa

SEQ ID NO: 856547 - DNA, 22 bp, Artificial Sequence
  chemically synthesized
tgttttttttccacctcagtga

SEQ ID NO: 856548 - DNA, 22 bp, Artificial Sequence
  chemically synthesized
ttttttttccacctcagtgaaa

SEQ ID NO: 856549 - DNA, 22 bp, Artificial Sequence
  chemically synthesized
tttttccacctcagtgaaaagc

SEQ ID NO: 856550 - DNA, 22 bp, Artificial Sequence
  chemically synthesized
ttttccacctcagtgaaaagca

SEQ ID NO: 856551 - DNA, 22 bp, Artificial Sequence
  chemically synthesized
tttccacctcagtgaaaagcac

SEQ ID NO: 856552 - DNA, 22 bp, Artificial Sequence
  chemically synthesized
ttccacctcagtgaaaagcaca

SEQ ID NO: 856553 - DNA, 22 bp, Artificial Sequence
  chemically synthesized
tccacctcagtgaaaagcacag

SEQ ID NO: 856554 - DNA, 22 bp, Artificial Sequence
  chemically synthesized
ccacctcagtgaaaagcacagt

SEQ ID NO: 856555 - DNA, 22 bp, Artificial Sequence
  chemically synthesized
cacctcagtgaaaagcacagtc

SEQ ID NO: 856556 - DNA, 22 bp, Artificial Sequence
  chemically synthesized
agtgaaaagcacagtctgttcc

SEQ ID NO: 856557 - DNA, 22 bp, Artificial Sequence
  chemically synthesized
ttccctctgcctggattgccct

SEQ ID NO: 856558 - DNA, 22 bp, Artificial Sequence
  chemically synthesized
gataaaacgagaagggcaatcc

SEQ ID NO: 856559 - DNA, 22 bp, Artificial Sequence
  chemically synthesized
cctctgcctggattgcccttct

SEQ ID NO: 856560 - DNA, 22 bp, Artificial Sequence
  chemically synthesized
gctagataaaacgagaagggca

SEQ ID NO: 856561 - DNA, 22 bp, Artificial Sequence
  chemically synthesized
tgcctggattgcccttctcgtt

SEQ ID NO: 856562 - DNA, 22 bp, Artificial Sequence
  chemically synthesized
cctagctagataaaacgagaag

SEQ ID NO: 856563 - DNA, 22 bp, Artificial Sequence
  chemically synthesized
cctggattgcccttctcgtttt

SEQ ID NO: 856564 - DNA, 22 bp, Artificial Sequence
  chemically synthesized
gattgcccttctcgttttatct

SEQ ID NO: 856565 - DNA, 22 bp, Artificial Sequence
  chemically synthesized
gaattacctagctagataaaac

SEQ ID NO: 856566 - DNA, 22 bp, Artificial Sequence
  chemically synthesized
cccttctcgttttatctagcta

SEQ ID NO: 856567 - DNA, 22 bp, Artificial Sequence
  chemically synthesized
ctcgttttatctagctaggtaa

SEQ ID NO: 856568 - DNA, 22 bp, Artificial Sequence
  chemically synthesized
tcgttttatctagctaggtaat

SEQ ID NO: 856569 - DNA, 22 bp, Artificial Sequence
  chemically synthesized
gttttatctagctaggtaattc

SEQ ID NO: 856570 - DNA, 22 bp, Artificial Sequence
  chemically synthesized
aagaatgagttggaattaccta

SEQ ID NO: 856571 - DNA, 22 bp, Artificial Sequence
  chemically synthesized
tatctagctaggtaattccaac

SEQ ID NO: 856572 - DNA, 22 bp, Artificial Sequence
  chemically synthesized
atctagctaggtaattccaact

SEQ ID NO: 856573 - DNA, 22 bp, Artificial Sequence
  chemically synthesized
tctagctaggtaattccaactc

SEQ ID NO: 856574 - DNA, 22 bp, Artificial Sequence
  chemically synthesized
gctaggtaattccaactcattc

SEQ ID NO: 856575 - DNA, 22 bp, Artificial Sequence
  chemically synthesized
agccaggcattaaagaatgagt

SEQ ID NO: 856576 - DNA, 22 bp, Artificial Sequence
  chemically synthesized
aagccaggcattaaagaatgag

SEQ ID NO: 856577 - DNA, 22 bp, Artificial Sequence
  chemically synthesized
ggtaattccaactcattcttta

SEQ ID NO: 856578 - DNA, 22 bp, Artificial Sequence
  chemically synthesized
caactcattctttaatgcctgg

SEQ ID NO: 856579 - DNA, 22 bp, Artificial Sequence
  chemically synthesized
attctttaatgcctggcttaag

SEQ ID NO: 856580 - DNA, 22 bp, Artificial Sequence
  chemically synthesized
aagaaggaaaaacttaagccag

SEQ ID NO: 856581 - DNA, 22 bp, Artificial Sequence
  chemically synthesized
ctgaagaaggaaaaacttaagc

SEQ ID NO: 856582 - DNA, 22 bp, Artificial Sequence
  chemically synthesized
tttaatgcctggcttaagtttt

SEQ ID NO: 856583 - DNA, 22 bp, Artificial Sequence
  chemically synthesized
taatgcctggcttaagtttttc

SEQ ID NO: 856584 - DNA, 22 bp, Artificial Sequence
  chemically synthesized
aatgcctggcttaagtttttcc

SEQ ID NO: 856585 - DNA, 22 bp, Artificial Sequence
  chemically synthesized
atgcctggcttaagtttttcct

SEQ ID NO: 856586 - DNA, 22 bp, Artificial Sequence
  chemically synthesized
gtgagatattcctgaagaagga

SEQ ID NO: 856587 - DNA, 22 bp, Artificial Sequence
  chemically synthesized
gcttaagtttttccttcttcag

SEQ ID NO: 856588 - DNA, 22 bp, Artificial Sequence
  chemically synthesized
aagtttttccttcttcaggaat

SEQ ID NO: 856589 - DNA, 22 bp, Artificial Sequence
  chemically synthesized
agtttttccttcttcaggaata

SEQ ID NO: 856590 - DNA, 22 bp, Artificial Sequence
  chemically synthesized
ttccttcttcaggaatatctca

SEQ ID NO: 856591 - DNA, 22 bp, Artificial Sequence
  chemically synthesized
tccttcttcaggaatatctcac

SEQ ID NO: 856592 - DNA, 22 bp, Artificial Sequence
  chemically synthesized
ccttcttcaggaatatctcact

SEQ ID NO: 856593 - DNA, 22 bp, Artificial Sequence
  chemically synthesized
cttcttcaggaatatctcacta

SEQ ID NO: 856594 - DNA, 22 bp, Artificial Sequence
  chemically synthesized
cttcaggaatatctcactagca

SEQ ID NO: 856595 - DNA, 22 bp, Artificial Sequence
  chemically synthesized
ttcaggaatatctcactagcat

SEQ ID NO: 856596 - DNA, 22 bp, Artificial Sequence
  chemically synthesized
caggaatatctcactagcatcc

SEQ ID NO: 856597 - DNA, 22 bp, Artificial Sequence
  chemically synthesized
aggaatatctcactagcatcca

SEQ ID NO: 856598 - DNA, 22 bp, Artificial Sequence
  chemically synthesized
agccaggagagagaatggatgc

SEQ ID NO: 856599 - DNA, 22 bp, Artificial Sequence
  chemically synthesized
actagcatccattctctctcct

SEQ ID NO: 856600 - DNA, 22 bp, Artificial Sequence
  chemically synthesized
agggaaaactaagccaggagag

SEQ ID NO: 856601 - DNA, 22 bp, Artificial Sequence
  chemically synthesized
gcatccattctctctcctggct

SEQ ID NO: 856602 - DNA, 22 bp, Artificial Sequence
  chemically synthesized
cagggaaaactaagccaggaga

SEQ ID NO: 856603 - DNA, 22 bp, Artificial Sequence
  chemically synthesized
ttcagggaaaactaagccagga

SEQ ID NO: 856604 - DNA, 22 bp, Artificial Sequence
  chemically synthesized
cttcagggaaaactaagccagg

SEQ ID NO: 856605 - DNA, 22 bp, Artificial Sequence
  chemically synthesized
tcttcagggaaaactaagccag

SEQ ID NO: 856606 - DNA, 22 bp, Artificial Sequence
  chemically synthesized
tctctcctggcttagttttccc

SEQ ID NO: 856607 - DNA, 22 bp, Artificial Sequence
  chemically synthesized
gggctttcttcagggaaaacta

SEQ ID NO: 856608 - DNA, 22 bp, Artificial Sequence
  chemically synthesized
tctcctggcttagttttccctg

SEQ ID NO: 856609 - DNA, 22 bp, Artificial Sequence
  chemically synthesized
ttggggctttcttcagggaaaa

SEQ ID NO: 856610 - DNA, 22 bp, Artificial Sequence
  chemically synthesized
tcctggcttagttttccctgaa

SEQ ID NO: 856611 - DNA, 22 bp, Artificial Sequence
  chemically synthesized
ctggcttagttttccctgaaga

SEQ ID NO: 856612 - DNA, 22 bp, Artificial Sequence
  chemically synthesized
gcttagttttccctgaagaaag

SEQ ID NO: 856613 - DNA, 22 bp, Artificial Sequence
  chemically synthesized
agttttccctgaagaaagcccc

SEQ ID NO: 856614 - DNA, 22 bp, Artificial Sequence
  chemically synthesized
gttttccctgaagaaagcccca

SEQ ID NO: 856615 - DNA, 22 bp, Artificial Sequence
  chemically synthesized
tgtgggtgatgctgttggggct

SEQ ID NO: 856616 - DNA, 22 bp, Artificial Sequence
  chemically synthesized
tccctgaagaaagccccaacag

SEQ ID NO: 856617 - DNA, 22 bp, Artificial Sequence
  chemically synthesized
ccctgaagaaagccccaacagc

SEQ ID NO: 856618 - DNA, 22 bp, Artificial Sequence
  chemically synthesized
cctgaagaaagccccaacagca

SEQ ID NO: 856619 - DNA, 22 bp, Artificial Sequence
  chemically synthesized
atattgtgtgggtgatgctgtt

SEQ ID NO: 856620 - DNA, 22 bp, Artificial Sequence
  chemically synthesized
aagaaagccccaacagcatcac

SEQ ID NO: 856621 - DNA, 22 bp, Artificial Sequence
  chemically synthesized
tgatattgtgtgggtgatgctg

SEQ ID NO: 856622 - DNA, 22 bp, Artificial Sequence
  chemically synthesized
tctgatattgtgtgggtgatgc

SEQ ID NO: 856623 - DNA, 22 bp, Artificial Sequence
  chemically synthesized
ctctgatattgtgtgggtgatg

SEQ ID NO: 856624 - DNA, 22 bp, Artificial Sequence
  chemically synthesized
aacttctctgatattgtgtggg

SEQ ID NO: 856625 - DNA, 22 bp, Artificial Sequence
  chemically synthesized
caacttctctgatattgtgtgg

SEQ ID NO: 856626 - DNA, 22 bp, Artificial Sequence
  chemically synthesized
tcaacttctctgatattgtgtg

SEQ ID NO: 856627 - DNA, 22 bp, Artificial Sequence
  chemically synthesized
atagttttcaacttctctgata

SEQ ID NO: 856628 - DNA, 22 bp, Artificial Sequence
  chemically synthesized
aacctcatagttttcaacttct

SEQ ID NO: 856629 - DNA, 22 bp, Artificial Sequence
  chemically synthesized
aaacctcatagttttcaacttc

SEQ ID NO: 856630 - DNA, 22 bp, Artificial Sequence
  chemically synthesized
ccttaaacctcatagttttcaa

SEQ ID NO: 856631 - DNA, 22 bp, Artificial Sequence
  chemically synthesized
tcccttaaacctcatagttttc

SEQ ID NO: 856632 - DNA, 22 bp, Artificial Sequence
  chemically synthesized
cagagtcctctcccttaaacct

SEQ ID NO: 856633 - DNA, 22 bp, Artificial Sequence
  chemically synthesized
aaaactatgaggtttaagggag

SEQ ID NO: 856634 - DNA, 22 bp, Artificial Sequence
  chemically synthesized
gttccagagtcctctcccttaa

SEQ ID NO: 856635 - DNA, 22 bp, Artificial Sequence
  chemically synthesized
ggttccagagtcctctccctta

SEQ ID NO: 856636 - DNA, 22 bp, Artificial Sequence
  chemically synthesized
tgaggtttaagggagaggactc

SEQ ID NO: 856637 - DNA, 22 bp, Artificial Sequence
  chemically synthesized
aggcagtttggttccagagtcc

SEQ ID NO: 856638 - DNA, 22 bp, Artificial Sequence
  chemically synthesized
aagggagaggactctggaacca

SEQ ID NO: 856639 - DNA, 22 bp, Artificial Sequence
  chemically synthesized
agggagaggactctggaaccaa

SEQ ID NO: 856640 - DNA, 22 bp, Artificial Sequence
  chemically synthesized
tggaaccaaactgcctgagttc

SEQ ID NO: 856641 - DNA, 22 bp, Artificial Sequence
  chemically synthesized
gaaccaaactgcctgagttcac

SEQ ID NO: 856642 - DNA, 22 bp, Artificial Sequence
  chemically synthesized
cctgagttcacatctcatcatt

SEQ ID NO: 856643 - DNA, 22 bp, Artificial Sequence
  chemically synthesized
agttcacatctcatcattgtct

SEQ ID NO: 856644 - DNA, 22 bp, Artificial Sequence
  chemically synthesized
agatcgaggaagaaagacaatg

SEQ ID NO: 856645 - DNA, 22 bp, Artificial Sequence
  chemically synthesized
acatctcatcattgtctttctt

SEQ ID NO: 856646 - DNA, 22 bp, Artificial Sequence
  chemically synthesized
cctgagatcgaggaagaaagac

SEQ ID NO: 856647 - DNA, 22 bp, Artificial Sequence
  chemically synthesized
atcattgtctttcttcctcgat

SEQ ID NO: 856648 - DNA, 22 bp, Artificial Sequence
  chemically synthesized
tctttcttcctcgatctcaggc

SEQ ID NO: 856649 - DNA, 22 bp, Artificial Sequence
  chemically synthesized
tcttcctcgatctcaggcaggt

SEQ ID NO: 856650 - DNA, 22 bp, Artificial Sequence
  chemically synthesized
cttcctcgatctcaggcaggtt

SEQ ID NO: 856651 - DNA, 22 bp, Artificial Sequence
  chemically synthesized
ttcctcgatctcaggcaggtta

SEQ ID NO: 856652 - DNA, 22 bp, Artificial Sequence
  chemically synthesized
cctcgatctcaggcaggttatt

SEQ ID NO: 856653 - DNA, 22 bp, Artificial Sequence
  chemically synthesized
ctcgatctcaggcaggttatta

SEQ ID NO: 856654 - DNA, 22 bp, Artificial Sequence
  chemically synthesized
gatctcaggcaggttattatcc

SEQ ID NO: 856655 - DNA, 22 bp, Artificial Sequence
  chemically synthesized
aggcaggttattatccttactg

SEQ ID NO: 856656 - DNA, 22 bp, Artificial Sequence
  chemically synthesized
tgaggtagatagagaggcacag

SEQ ID NO: 856657 - DNA, 22 bp, Artificial Sequence
  chemically synthesized
ttatccttactgtgcctctcta

SEQ ID NO: 856658 - DNA, 22 bp, Artificial Sequence
  chemically synthesized
ctgtgaggtagatagagaggca

SEQ ID NO: 856659 - DNA, 22 bp, Artificial Sequence
  chemically synthesized
tccttactgtgcctctctatct

SEQ ID NO: 856660 - DNA, 22 bp, Artificial Sequence
  chemically synthesized
actgtgcctctctatctacctc

SEQ ID NO: 856661 - DNA, 22 bp, Artificial Sequence
  chemically synthesized
caacattactgtgaggtagata

SEQ ID NO: 856662 - DNA, 22 bp, Artificial Sequence
  chemically synthesized
ctgtgcctctctatctacctca

SEQ ID NO: 856663 - DNA, 22 bp, Artificial Sequence
  chemically synthesized
acaacattactgtgaggtagat

SEQ ID NO: 856664 - DNA, 22 bp, Artificial Sequence
  chemically synthesized
tgcctctctatctacctcacag

SEQ ID NO: 856665 - DNA, 22 bp, Artificial Sequence
  chemically synthesized
atgcttacaacattactgtgag

SEQ ID NO: 856666 - DNA, 22 bp, Artificial Sequence
  chemically synthesized
aatgcttacaacattactgtga

SEQ ID NO: 856667 - DNA, 22 bp, Artificial Sequence
  chemically synthesized
taatgcttacaacattactgtg

SEQ ID NO: 856668 - DNA, 22 bp, Artificial Sequence
  chemically synthesized
tctatctacctcacagtaatgt

SEQ ID NO: 856669 - DNA, 22 bp, Artificial Sequence
  chemically synthesized
tttaatgcttacaacattactg

SEQ ID NO: 856670 - DNA, 22 bp, Artificial Sequence
  chemically synthesized
tatctacctcacagtaatgttg

SEQ ID NO: 856671 - DNA, 22 bp, Artificial Sequence
  chemically synthesized
tctacctcacagtaatgttgta

SEQ ID NO: 856672 - DNA, 22 bp, Artificial Sequence
  chemically synthesized
cctcacagtaatgttgtaagca

SEQ ID NO: 856673 - DNA, 22 bp, Artificial Sequence
  chemically synthesized
acgtgaattctttaatgcttac

SEQ ID NO: 856674 - DNA, 22 bp, Artificial Sequence
  chemically synthesized
acagtaatgttgtaagcattaa

SEQ ID NO: 856675 - DNA, 22 bp, Artificial Sequence
  chemically synthesized
cacgtgaattctttaatgctta

SEQ ID NO: 856676 - DNA, 22 bp, Artificial Sequence
  chemically synthesized
agtacttcacgtgaattcttta

SEQ ID NO: 856677 - DNA, 22 bp, Artificial Sequence
  chemically synthesized
taagcattaaagaattcacgtg

SEQ ID NO: 856678 - DNA, 22 bp, Artificial Sequence
  chemically synthesized
atctaagtacttcacgtgaatt

SEQ ID NO: 856679 - DNA, 22 bp, Artificial Sequence
  chemically synthesized
aagaattcacgtgaagtactta

SEQ ID NO: 856680 - DNA, 22 bp, Artificial Sequence
  chemically synthesized
acgtgaagtacttagatcaatg

SEQ ID NO: 856681 - DNA, 22 bp, Artificial Sequence
  chemically synthesized
acacatatgatatgccagtcat

SEQ ID NO: 856682 - DNA, 22 bp, Artificial Sequence
  chemically synthesized
agatcaatgactggcatatcat

SEQ ID NO: 856683 - DNA, 22 bp, Artificial Sequence
  chemically synthesized
gatcaatgactggcatatcata

SEQ ID NO: 856684 - DNA, 22 bp, Artificial Sequence
  chemically synthesized
ggataatagctaacacatatga

SEQ ID NO: 856685 - DNA, 22 bp, Artificial Sequence
  chemically synthesized
aggataatagctaacacatatg

SEQ ID NO: 856686 - DNA, 22 bp, Artificial Sequence
  chemically synthesized
taggataatagctaacacatat

SEQ ID NO: 856687 - DNA, 22 bp, Artificial Sequence
  chemically synthesized
gcatatcatatgtgttagctat

SEQ ID NO: 856688 - DNA, 22 bp, Artificial Sequence
  chemically synthesized
tgatagagataaattttaggat

SEQ ID NO: 856689 - DNA, 22 bp, Artificial Sequence
  chemically synthesized
gctattatcctaaaatttatct

SEQ ID NO: 856690 - DNA, 22 bp, Artificial Sequence
  chemically synthesized
ttatcctaaaatttatctctat

SEQ ID NO: 856691 - DNA, 22 bp, Artificial Sequence
  chemically synthesized
tcctaaaatttatctctatcat

SEQ ID NO: 856692 - DNA, 22 bp, Artificial Sequence
  chemically synthesized
aaatttatctctatcatagtgt

SEQ ID NO: 856693 - DNA, 22 bp, Artificial Sequence
  chemically synthesized
aaggaagaaaataataacacta

SEQ ID NO: 856694 - DNA, 22 bp, Artificial Sequence
  chemically synthesized
atctctatcatagtgttattat

SEQ ID NO: 856695 - DNA, 22 bp, Artificial Sequence
  chemically synthesized
tctctatcatagtgttattatt

SEQ ID NO: 856696 - DNA, 22 bp, Artificial Sequence
  chemically synthesized
tatcatagtgttattattttct

SEQ ID NO: 856697 - DNA, 22 bp, Artificial Sequence
  chemically synthesized
tcatagtgttattattttcttc

SEQ ID NO: 856698 - DNA, 22 bp, Artificial Sequence
  chemically synthesized
ttattttcttccttcaacctct

SEQ ID NO: 856699 - DNA, 22 bp, Artificial Sequence
  chemically synthesized
ttttcttccttcaacctctttt

SEQ ID NO: 856700 - DNA, 22 bp, Artificial Sequence
  chemically synthesized
tcttccttcaacctcttttacc

SEQ ID NO: 856701 - DNA, 22 bp, Artificial Sequence
  chemically synthesized
cttccttcaacctcttttacct

SEQ ID NO: 856702 - DNA, 22 bp, Artificial Sequence
  chemically synthesized
ttccttcaacctcttttacctg

SEQ ID NO: 856703 - DNA, 22 bp, Artificial Sequence
  chemically synthesized
ccttcaacctcttttacctgca

SEQ ID NO: 856704 - DNA, 22 bp, Artificial Sequence
  chemically synthesized
cttcaacctcttttacctgcac

SEQ ID NO: 856705 - DNA, 22 bp, Artificial Sequence
  chemically synthesized
tacaacatagaatgtgcaggta

SEQ ID NO: 856706 - DNA, 22 bp, Artificial Sequence
  chemically synthesized
caacctcttttacctgcacatt

SEQ ID NO: 856707 - DNA, 22 bp, Artificial Sequence
  chemically synthesized
aacctcttttacctgcacattc

SEQ ID NO: 856708 - DNA, 22 bp, Artificial Sequence
  chemically synthesized
ttttacctgcacattctatgtt

SEQ ID NO: 856709 - DNA, 22 bp, Artificial Sequence
  chemically synthesized
ttacctgcacattctatgttgt

SEQ ID NO: 856710 - DNA, 22 bp, Artificial Sequence
  chemically synthesized
tacctgcacattctatgttgta

SEQ ID NO: 856711 - DNA, 22 bp, Artificial Sequence
  chemically synthesized
acctgcacattctatgttgtac

SEQ ID NO: 856712 - DNA, 22 bp, Artificial Sequence
  chemically synthesized
cctgcacattctatgttgtaca

SEQ ID NO: 856713 - DNA, 22 bp, Artificial Sequence
  chemically synthesized
ggaaacataaagttgtacaaca

SEQ ID NO: 856714 - DNA, 22 bp, Artificial Sequence
  chemically synthesized
cacattctatgttgtacaactt

SEQ ID NO: 856715 - DNA, 22 bp, Artificial Sequence
  chemically synthesized
agtacctgggaaacataaagtt

SEQ ID NO: 856716 - DNA, 22 bp, Artificial Sequence
  chemically synthesized
tatgttgtacaactttatgttt

SEQ ID NO: 856717 - DNA, 22 bp, Artificial Sequence
  chemically synthesized
tgttgtacaactttatgtttcc

SEQ ID NO: 856718 - DNA, 22 bp, Artificial Sequence
  chemically synthesized
ccactaagtacctgggaaacat

SEQ ID NO: 856719 - DNA, 22 bp, Artificial Sequence
  chemically synthesized
tacaactttatgtttcccaggt

SEQ ID NO: 856720 - DNA, 22 bp, Artificial Sequence
  chemically synthesized
agctgccactaagtacctggga

SEQ ID NO: 856721 - DNA, 22 bp, Artificial Sequence
  chemically synthesized
ttgagctgccactaagtacctg

SEQ ID NO: 856722 - DNA, 22 bp, Artificial Sequence
  chemically synthesized
tattgagctgccactaagtacc

SEQ ID NO: 856723 - DNA, 22 bp, Artificial Sequence
  chemically synthesized
tatgtttcccaggtacttagtg

SEQ ID NO: 856724 - DNA, 22 bp, Artificial Sequence
  chemically synthesized
ctattgagctgccactaagtac

SEQ ID NO: 856725 - DNA, 22 bp, Artificial Sequence
  chemically synthesized
atgtttcccaggtacttagtgg

SEQ ID NO: 856726 - DNA, 22 bp, Artificial Sequence
  chemically synthesized
tgtttcccaggtacttagtggc

SEQ ID NO: 856727 - DNA, 22 bp, Artificial Sequence
  chemically synthesized
cccaggtacttagtggcagctc

SEQ ID NO: 856728 - DNA, 22 bp, Artificial Sequence
  chemically synthesized
ccaggtacttagtggcagctca

SEQ ID NO: 856729 - DNA, 22 bp, Artificial Sequence
  chemically synthesized
accaacttctattgagctgcca

SEQ ID NO: 856730 - DNA, 22 bp, Artificial Sequence
  chemically synthesized
aaccaacttctattgagctgcc

SEQ ID NO: 856731 - DNA, 22 bp, Artificial Sequence
  chemically synthesized
taaccaacttctattgagctgc

SEQ ID NO: 856732 - DNA, 22 bp, Artificial Sequence
  chemically synthesized
ttttaaccaacttctattgagc

SEQ ID NO: 856733 - DNA, 22 bp, Artificial Sequence
  chemically synthesized
ttattttaaccaacttctattg

SEQ ID NO: 856734 - DNA, 22 bp, Artificial Sequence
  chemically synthesized
attattttaaccaacttctatt

SEQ ID NO: 856735 - DNA, 22 bp, Artificial Sequence
  chemically synthesized
agtggcagctcaatagaagttg

SEQ ID NO: 856736 - DNA, 22 bp, Artificial Sequence
  chemically synthesized
tattattttaaccaacttctat

SEQ ID NO: 856737 - DNA, 22 bp, Artificial Sequence
  chemically synthesized
gtggcagctcaatagaagttgg

SEQ ID NO: 856738 - DNA, 22 bp, Artificial Sequence
  chemically synthesized
ttattattttaaccaacttcta

SEQ ID NO: 856739 - DNA, 22 bp, Artificial Sequence
  chemically synthesized
tccatttttattattttaacca

SEQ ID NO: 856740 - DNA, 22 bp, Artificial Sequence
  chemically synthesized
aatagaagttggttaaaataat

SEQ ID NO: 856741 - DNA, 22 bp, Artificial Sequence
  chemically synthesized
acacctatccatttttattatt

SEQ ID NO: 856742 - DNA, 22 bp, Artificial Sequence
  chemically synthesized
ctaacacctatccatttttatt

SEQ ID NO: 856743 - DNA, 22 bp, Artificial Sequence
  chemically synthesized
actaacacctatccatttttat

SEQ ID NO: 856744 - DNA, 22 bp, Artificial Sequence
  chemically synthesized
tactaacacctatccattttta

SEQ ID NO: 856745 - DNA, 22 bp, Artificial Sequence
  chemically synthesized
gttaaaataataaaaatggata

SEQ ID NO: 856746 - DNA, 22 bp, Artificial Sequence
  chemically synthesized
aaataataaaaatggataggtg

SEQ ID NO: 856747 - DNA, 22 bp, Artificial Sequence
  chemically synthesized
aaaaaaactttactaacaccta

SEQ ID NO: 856748 - DNA, 22 bp, Artificial Sequence
  chemically synthesized
taaactgaaaaaaactttacta

SEQ ID NO: 856749 - DNA, 22 bp, Artificial Sequence
  chemically synthesized
ataaactgaaaaaaactttact

SEQ ID NO: 856750 - DNA, 22 bp, Artificial Sequence
  chemically synthesized
tataaactgaaaaaaactttac

SEQ ID NO: 856751 - DNA, 22 bp, Artificial Sequence
  chemically synthesized
caaaagggctttataaactgaa

SEQ ID NO: 856752 - DNA, 22 bp, Artificial Sequence
  chemically synthesized
gtaaagtttttttcagtttata

SEQ ID NO: 856753 - DNA, 22 bp, Artificial Sequence
  chemically synthesized
ttttcagtttataaagcccttt

SEQ ID NO: 856754 - DNA, 22 bp, Artificial Sequence
  chemically synthesized
ggcaaaattccaaaagggcttt

SEQ ID NO: 856755 - DNA, 22 bp, Artificial Sequence
  chemically synthesized
tttcagtttataaagccctttt

SEQ ID NO: 856756 - DNA, 22 bp, Artificial Sequence
  chemically synthesized
ttcagtttataaagcccttttg

SEQ ID NO: 856757 - DNA, 22 bp, Artificial Sequence
  chemically synthesized
tcagtttataaagcccttttgg

SEQ ID NO: 856758 - DNA, 22 bp, Artificial Sequence
  chemically synthesized
cagtttataaagcccttttgga

SEQ ID NO: 856759 - DNA, 22 bp, Artificial Sequence
  chemically synthesized
agtttataaagcccttttggaa

SEQ ID NO: 856760 - DNA, 22 bp, Artificial Sequence
  chemically synthesized
ataaagcccttttggaattttg

SEQ ID NO: 856761 - DNA, 22 bp, Artificial Sequence
  chemically synthesized
taaagcccttttggaattttgc

SEQ ID NO: 856762 - DNA, 22 bp, Artificial Sequence
  chemically synthesized
atgtgtgaaaaattaggcaaaa

SEQ ID NO: 856763 - DNA, 22 bp, Artificial Sequence
  chemically synthesized
gatgtgtgaaaaattaggcaaa

SEQ ID NO: 856764 - DNA, 22 bp, Artificial Sequence
  chemically synthesized
ttggaattttgcctaatttttc

SEQ ID NO: 856765 - DNA, 22 bp, Artificial Sequence
  chemically synthesized
tggaattttgcctaatttttca

SEQ ID NO: 856766 - DNA, 22 bp, Artificial Sequence
  chemically synthesized
atgtttgatgtgtgaaaaatta

SEQ ID NO: 856767 - DNA, 22 bp, Artificial Sequence
  chemically synthesized
ggaattttgcctaatttttcac

SEQ ID NO: 856768 - DNA, 22 bp, Artificial Sequence
  chemically synthesized
aatgtttgatgtgtgaaaaatt

SEQ ID NO: 856769 - DNA, 22 bp, Artificial Sequence
  chemically synthesized
gaattttgcctaatttttcaca

SEQ ID NO: 856770 - DNA, 22 bp, Artificial Sequence
  chemically synthesized
taatgtttgatgtgtgaaaaat

SEQ ID NO: 856771 - DNA, 22 bp, Artificial Sequence
  chemically synthesized
tgcctaatttttcacacatcaa

SEQ ID NO: 856772 - DNA, 22 bp, Artificial Sequence
  chemically synthesized
gcctaatttttcacacatcaaa

SEQ ID NO: 856773 - DNA, 22 bp, Artificial Sequence
  chemically synthesized
cctaatttttcacacatcaaac

SEQ ID NO: 856774 - DNA, 22 bp, Artificial Sequence
  chemically synthesized
atttttcacacatcaaacatta

SEQ ID NO: 856775 - DNA, 22 bp, Artificial Sequence
  chemically synthesized
ttcacacatcaaacattaaagt

SEQ ID NO: 856776 - DNA, 22 bp, Artificial Sequence
  chemically synthesized
tcacacatcaaacattaaagtt

SEQ ID NO: 856777 - DNA, 22 bp, Artificial Sequence
  chemically synthesized
cacacatcaaacattaaagttg

SEQ ID NO: 856778 - DNA, 22 bp, Artificial Sequence
  chemically synthesized
acacatcaaacattaaagttgg

SEQ ID NO: 856779 - DNA, 22 bp, Artificial Sequence
  chemically synthesized
aataaagcaatcccaactttaa

SEQ ID NO: 856780 - DNA, 22 bp, Artificial Sequence
  chemically synthesized
aaataaagcaatcccaacttta

SEQ ID NO: 856781 - DNA, 22 bp, Artificial Sequence
  chemically synthesized
taaataaagcaatcccaacttt

SEQ ID NO: 856782 - DNA, 22 bp, Artificial Sequence
  chemically synthesized
tgtaaagttttaaataaagcaa

SEQ ID NO: 856783 - DNA, 22 bp, Artificial Sequence
  chemically synthesized
atgtaaagttttaaataaagca

SEQ ID NO: 856784 - DNA, 22 bp, Artificial Sequence
  chemically synthesized
tatgtaaagttttaaataaagc

SEQ ID NO: 856785 - DNA, 22 bp, Artificial Sequence
  chemically synthesized
aagttgggattgctttatttaa

SEQ ID NO: 856786 - DNA, 22 bp, Artificial Sequence
  chemically synthesized
ggattgctttatttaaaacttt

SEQ ID NO: 856787 - DNA, 22 bp, Artificial Sequence
  chemically synthesized
ctttatttaaaactttacataa

SEQ ID NO: 856788 - DNA, 22 bp, Artificial Sequence
  chemically synthesized
tatttaaaactttacataaaat

SEQ ID NO: 856789 - DNA, 22 bp, Artificial Sequence
  chemically synthesized
atttaaaactttacataaaatt

SEQ ID NO: 856790 - DNA, 22 bp, Artificial Sequence
  chemically synthesized
tttaaaactttacataaaattg

SEQ ID NO: 856791 - DNA, 22 bp, Artificial Sequence
  chemically synthesized
aggaaatcaatatcaattttat

SEQ ID NO: 856792 - DNA, 22 bp, Artificial Sequence
  chemically synthesized
caggaaatcaatatcaatttta

SEQ ID NO: 856793 - DNA, 22 bp, Artificial Sequence
  chemically synthesized
aaaactttacataaaattgata

SEQ ID NO: 856794 - DNA, 22 bp, Artificial Sequence
  chemically synthesized
aaactttacataaaattgatat

SEQ ID NO: 856795 - DNA, 22 bp, Artificial Sequence
  chemically synthesized
taatttcaggaaatcaatatca

SEQ ID NO: 856796 - DNA, 22 bp, Artificial Sequence
  chemically synthesized
tacataaaattgatattgattt

SEQ ID NO: 856797 - DNA, 22 bp, Artificial Sequence
  chemically synthesized
acataaaattgatattgatttc

SEQ ID NO: 856798 - DNA, 22 bp, Artificial Sequence
  chemically synthesized
ttataatttcaggaaatcaata

SEQ ID NO: 856799 - DNA, 22 bp, Artificial Sequence
  chemically synthesized
cataaaattgatattgatttcc

SEQ ID NO: 856800 - DNA, 22 bp, Artificial Sequence
  chemically synthesized
gttataatttcaggaaatcaat

SEQ ID NO: 856801 - DNA, 22 bp, Artificial Sequence
  chemically synthesized
tgttataatttcaggaaatcaa

SEQ ID NO: 856802 - DNA, 22 bp, Artificial Sequence
  chemically synthesized
atattgatttcctgaaattata

SEQ ID NO: 856803 - DNA, 22 bp, Artificial Sequence
  chemically synthesized
atttcctgaaattataacaaaa

SEQ ID NO: 856804 - DNA, 22 bp, Artificial Sequence
  chemically synthesized
cctgaaattataacaaaatcct

SEQ ID NO: 856805 - DNA, 22 bp, Artificial Sequence
  chemically synthesized
ctgaaattataacaaaatcctc

SEQ ID NO: 856806 - DNA, 22 bp, Artificial Sequence
  chemically synthesized
aaattataacaaaatcctcccc

SEQ ID NO: 856807 - DNA, 22 bp, Artificial Sequence
  chemically synthesized
taacaaaatcctccccatactt

SEQ ID NO: 856808 - DNA, 22 bp, Artificial Sequence
  chemically synthesized
cccatacttacttatccttctt

SEQ ID NO: 856809 - DNA, 22 bp, Artificial Sequence
  chemically synthesized
acttatccttcttatttcccct

SEQ ID NO: 856810 - DNA, 22 bp, Artificial Sequence
  chemically synthesized
cttatccttcttatttcccctc

SEQ ID NO: 856811 - DNA, 22 bp, Artificial Sequence
  chemically synthesized
atccttcttatttcccctctca

SEQ ID NO: 856812 - DNA, 22 bp, Artificial Sequence
  chemically synthesized
aacaaatgtgtgtgagagggga

SEQ ID NO: 856813 - DNA, 22 bp, Artificial Sequence
  chemically synthesized
tccttcttatttcccctctcac

SEQ ID NO: 856814 - DNA, 22 bp, Artificial Sequence
  chemically synthesized
cttatttcccctctcacacaca

SEQ ID NO: 856815 - DNA, 22 bp, Artificial Sequence
  chemically synthesized
ttatttcccctctcacacacat

SEQ ID NO: 856816 - DNA, 22 bp, Artificial Sequence
  chemically synthesized
atttcccctctcacacacattt

SEQ ID NO: 856817 - DNA, 22 bp, Artificial Sequence
  chemically synthesized
tttcccctctcacacacatttg

SEQ ID NO: 856818 - DNA, 22 bp, Artificial Sequence
  chemically synthesized
aataatcattaaacaaatgtgt

SEQ ID NO: 856819 - DNA, 22 bp, Artificial Sequence
  chemically synthesized
cccctctcacacacatttgttt

SEQ ID NO: 856820 - DNA, 22 bp, Artificial Sequence
  chemically synthesized
ccctctcacacacatttgttta

SEQ ID NO: 856821 - DNA, 22 bp, Artificial Sequence
  chemically synthesized
tcacacacatttgtttaatgat

SEQ ID NO: 856822 - DNA, 22 bp, Artificial Sequence
  chemically synthesized
acacacatttgtttaatgatta

SEQ ID NO: 856823 - DNA, 22 bp, Artificial Sequence
  chemically synthesized
tcggtaaaatggccctaaataa

SEQ ID NO: 856824 - DNA, 22 bp, Artificial Sequence
  chemically synthesized
gtttaatgattatttagggcca

SEQ ID NO: 856825 - DNA, 22 bp, Artificial Sequence
  chemically synthesized
tttaatgattatttagggccat

SEQ ID NO: 856826 - DNA, 22 bp, Artificial Sequence
  chemically synthesized
aatgattatttagggccatttt

SEQ ID NO: 856827 - DNA, 22 bp, Artificial Sequence
  chemically synthesized
atgattatttagggccatttta

SEQ ID NO: 856828 - DNA, 22 bp, Artificial Sequence
  chemically synthesized
aatcaccaaattgtcggtaaaa

SEQ ID NO: 856829 - DNA, 22 bp, Artificial Sequence
  chemically synthesized
tttagggccattttaccgacaa

SEQ ID NO: 856830 - DNA, 22 bp, Artificial Sequence
  chemically synthesized
agggccattttaccgacaattt

SEQ ID NO: 856831 - DNA, 22 bp, Artificial Sequence
  chemically synthesized
gggccattttaccgacaatttg

SEQ ID NO: 856832 - DNA, 22 bp, Artificial Sequence
  chemically synthesized
tagcctcaatcaccaaattgtc

SEQ ID NO: 856833 - DNA, 22 bp, Artificial Sequence
  chemically synthesized
atagcctcaatcaccaaattgt

SEQ ID NO: 856834 - DNA, 22 bp, Artificial Sequence
  chemically synthesized
tatagcctcaatcaccaaattg

SEQ ID NO: 856835 - DNA, 22 bp, Artificial Sequence
  chemically synthesized
ttatagcctcaatcaccaaatt

SEQ ID NO: 856836 - DNA, 22 bp, Artificial Sequence
  chemically synthesized
gcttttatagcctcaatcacca

SEQ ID NO: 856837 - DNA, 22 bp, Artificial Sequence
  chemically synthesized
taccgacaatttggtgattgag

SEQ ID NO: 856838 - DNA, 22 bp, Artificial Sequence
  chemically synthesized
ggcttttatagcctcaatcacc

SEQ ID NO: 856839 - DNA, 22 bp, Artificial Sequence
  chemically synthesized
accgacaatttggtgattgagg

SEQ ID NO: 856840 - DNA, 22 bp, Artificial Sequence
  chemically synthesized
ccgacaatttggtgattgaggc

SEQ ID NO: 856841 - DNA, 22 bp, Artificial Sequence
  chemically synthesized
ttggcttttatagcctcaatca

SEQ ID NO: 856842 - DNA, 22 bp, Artificial Sequence
  chemically synthesized
tcagttcttggcttttatagcc

SEQ ID NO: 856843 - DNA, 22 bp, Artificial Sequence
  chemically synthesized
ggtgattgaggctataaaagcc

SEQ ID NO: 856844 - DNA, 22 bp, Artificial Sequence
  chemically synthesized
gtgattgaggctataaaagcca

SEQ ID NO: 856845 - DNA, 22 bp, Artificial Sequence
  chemically synthesized
aagacattgtcagttcttggct

SEQ ID NO: 856846 - DNA, 22 bp, Artificial Sequence
  chemically synthesized
aaagacattgtcagttcttggc

SEQ ID NO: 856847 - DNA, 22 bp, Artificial Sequence
  chemically synthesized
aggctataaaagccaagaactg

SEQ ID NO: 856848 - DNA, 22 bp, Artificial Sequence
  chemically synthesized
ttaaagacattgtcagttcttg

SEQ ID NO: 856849 - DNA, 22 bp, Artificial Sequence
  chemically synthesized
taaaagccaagaactgacaatg

SEQ ID NO: 856850 - DNA, 22 bp, Artificial Sequence
  chemically synthesized
aaaaataattcttaaagacatt

SEQ ID NO: 856851 - DNA, 22 bp, Artificial Sequence
  chemically synthesized
tattaaaaaataattcttaaag

SEQ ID NO: 856852 - DNA, 22 bp, Artificial Sequence
  chemically synthesized
atattaaaaaataattcttaaa

SEQ ID NO: 856853 - DNA, 22 bp, Artificial Sequence
  chemically synthesized
ttatattaaaaaataattctta

SEQ ID NO: 856854 - DNA, 22 bp, Artificial Sequence
  chemically synthesized
acaatgtctttaagaattattt

SEQ ID NO: 856855 - DNA, 22 bp, Artificial Sequence
  chemically synthesized
ctcttatattaaaaaataattc

SEQ ID NO: 856856 - DNA, 22 bp, Artificial Sequence
  chemically synthesized
cctcttatattaaaaaataatt

SEQ ID NO: 856857 - DNA, 22 bp, Artificial Sequence
  chemically synthesized
ttcctcttatattaaaaaataa

SEQ ID NO: 856858 - DNA, 22 bp, Artificial Sequence
  chemically synthesized
cctcttcctcttatattaaaaa

SEQ ID NO: 856859 - DNA, 22 bp, Artificial Sequence
  chemically synthesized
taagaattattttttaatataa

SEQ ID NO: 856860 - DNA, 22 bp, Artificial Sequence
  chemically synthesized
aagaattattttttaatataag

SEQ ID NO: 856861 - DNA, 22 bp, Artificial Sequence
  chemically synthesized
agaattattttttaatataaga

SEQ ID NO: 856862 - DNA, 22 bp, Artificial Sequence
  chemically synthesized
cctgcctcttcctcttatatta

SEQ ID NO: 856863 - DNA, 22 bp, Artificial Sequence
  chemically synthesized
gcctgcctcttcctcttatatt

SEQ ID NO: 856864 - DNA, 22 bp, Artificial Sequence
  chemically synthesized
tgcctgcctcttcctcttatat

SEQ ID NO: 856865 - DNA, 22 bp, Artificial Sequence
  chemically synthesized
ttttttaatataagaggaagag

SEQ ID NO: 856866 - DNA, 22 bp, Artificial Sequence
  chemically synthesized
tttaatataagaggaagaggca

SEQ ID NO: 856867 - DNA, 22 bp, Artificial Sequence
  chemically synthesized
ttaatataagaggaagaggcag

SEQ ID NO: 856868 - DNA, 22 bp, Artificial Sequence
  chemically synthesized
taatataagaggaagaggcagg

SEQ ID NO: 856869 - DNA, 22 bp, Artificial Sequence
  chemically synthesized
aatataagaggaagaggcaggc

SEQ ID NO: 856870 - DNA, 22 bp, Artificial Sequence
  chemically synthesized
atataagaggaagaggcaggca

SEQ ID NO: 856871 - DNA, 22 bp, Artificial Sequence
  chemically synthesized
aatagggggatgctttgcctgc

SEQ ID NO: 856872 - DNA, 22 bp, Artificial Sequence
  chemically synthesized
ctgaatagggggatgctttgcc

SEQ ID NO: 856873 - DNA, 22 bp, Artificial Sequence
  chemically synthesized
gctgaatagggggatgctttgc

SEQ ID NO: 856874 - DNA, 22 bp, Artificial Sequence
  chemically synthesized
cttgctgaatagggggatgctt

SEQ ID NO: 856875 - DNA, 22 bp, Artificial Sequence
  chemically synthesized
gcttgctgaatagggggatgct

SEQ ID NO: 856876 - DNA, 22 bp, Artificial Sequence
  chemically synthesized
ttgcttgctgaatagggggatg

SEQ ID NO: 856877 - DNA, 22 bp, Artificial Sequence
  chemically synthesized
tcttgcttgctgaataggggga

SEQ ID NO: 856878 - DNA, 22 bp, Artificial Sequence
  chemically synthesized
ctcttgcttgctgaataggggg

SEQ ID NO: 856879 - DNA, 22 bp, Artificial Sequence
  chemically synthesized
ccttctcttgcttgctgaatag

SEQ ID NO: 856880 - DNA, 22 bp, Artificial Sequence
  chemically synthesized
atctcccttctcttgcttgctg

SEQ ID NO: 856881 - DNA, 22 bp, Artificial Sequence
  chemically synthesized
ttcagcaagcaagagaagggag

SEQ ID NO: 856882 - DNA, 22 bp, Artificial Sequence
  chemically synthesized
taaaaaaatctaatctcccttc

SEQ ID NO: 856883 - DNA, 22 bp, Artificial Sequence
  chemically synthesized
agcaagcaagagaagggagatt

SEQ ID NO: 856884 - DNA, 22 bp, Artificial Sequence
  chemically synthesized
ataaaaaaatctaatctccctt

SEQ ID NO: 856885 - DNA, 22 bp, Artificial Sequence
  chemically synthesized
catatttataaaaaaatctaat

SEQ ID NO: 856886 - DNA, 22 bp, Artificial Sequence
  chemically synthesized
atatattacatatttataaaaa

SEQ ID NO: 856887 - DNA, 22 bp, Artificial Sequence
  chemically synthesized
gatttttttataaatatgtaat

SEQ ID NO: 856888 - DNA, 22 bp, Artificial Sequence
  chemically synthesized
ttttataaatatgtaatatatg

SEQ ID NO: 856889 - DNA, 22 bp, Artificial Sequence
  chemically synthesized
tttataaatatgtaatatatga

SEQ ID NO: 856890 - DNA, 22 bp, Artificial Sequence
  chemically synthesized
ttataaatatgtaatatatgaa

SEQ ID NO: 856891 - DNA, 22 bp, Artificial Sequence
  chemically synthesized
tataaatatgtaatatatgaac

SEQ ID NO: 856892 - DNA, 22 bp, Artificial Sequence
  chemically synthesized
ataaatatgtaatatatgaaca

SEQ ID NO: 856893 - DNA, 22 bp, Artificial Sequence
  chemically synthesized
taaatatgtaatatatgaacat

SEQ ID NO: 856894 - DNA, 22 bp, Artificial Sequence
  chemically synthesized
tatataatgatatgtaatgttc

SEQ ID NO: 856895 - DNA, 22 bp, Artificial Sequence
  chemically synthesized
catatcattatatataatatgc

SEQ ID NO: 856896 - DNA, 22 bp, Artificial Sequence
  chemically synthesized
aaatagtatatatagcatatta

SEQ ID NO: 856897 - DNA, 22 bp, Artificial Sequence
  chemically synthesized
aaaatagtatatatagcatatt

SEQ ID NO: 856898 - DNA, 22 bp, Artificial Sequence
  chemically synthesized
taaaatagtatatatagcatat

SEQ ID NO: 856899 - DNA, 22 bp, Artificial Sequence
  chemically synthesized
ttaaaatagtatatatagcata

SEQ ID NO: 856900 - DNA, 22 bp, Artificial Sequence
  chemically synthesized
tatataatatgctatatatact

SEQ ID NO: 856901 - DNA, 22 bp, Artificial Sequence
  chemically synthesized
tatatactattttaaaaatatt

SEQ ID NO: 856902 - DNA, 22 bp, Artificial Sequence
  chemically synthesized
tatatggtatatataaaaatat

SEQ ID NO: 856903 - DNA, 22 bp, Artificial Sequence
  chemically synthesized
ttttaaaaatatttttatatat

SEQ ID NO: 856904 - DNA, 22 bp, Artificial Sequence
  chemically synthesized
taaaaatatttttatatatacc

SEQ ID NO: 856905 - DNA, 22 bp, Artificial Sequence
  chemically synthesized
taaattatatatggtatatata

SEQ ID NO: 856906 - DNA, 22 bp, Artificial Sequence
  chemically synthesized
aaaaatatttttatatatacca

SEQ ID NO: 856907 - DNA, 22 bp, Artificial Sequence
  chemically synthesized
ataaattatatatggtatatat

SEQ ID NO: 856908 - DNA, 22 bp, Artificial Sequence
  chemically synthesized
aaaatatttttatatataccat

SEQ ID NO: 856909 - DNA, 22 bp, Artificial Sequence
  chemically synthesized
ttatatataccatatataattt

SEQ ID NO: 856910 - DNA, 22 bp, Artificial Sequence
  chemically synthesized
tatatataccatatataattta

SEQ ID NO: 856911 - DNA, 22 bp, Artificial Sequence
  chemically synthesized
atatataccatatataatttat

SEQ ID NO: 856912 - DNA, 22 bp, Artificial Sequence
  chemically synthesized
tatataccatatataatttata

SEQ ID NO: 856913 - DNA, 22 bp, Artificial Sequence
  chemically synthesized
agacacaaaaatacaggattta

SEQ ID NO: 856914 - DNA, 22 bp, Artificial Sequence
  chemically synthesized
tgagacacaaaaatacaggatt

SEQ ID NO: 856915 - DNA, 22 bp, Artificial Sequence
  chemically synthesized
ctgagacacaaaaatacaggat

SEQ ID NO: 856916 - DNA, 22 bp, Artificial Sequence
  chemically synthesized
ataaatcctgtatttttgtgtc

SEQ ID NO: 856917 - DNA, 22 bp, Artificial Sequence
  chemically synthesized
taaatcctgtatttttgtgtct

SEQ ID NO: 856918 - DNA, 22 bp, Artificial Sequence
  chemically synthesized
tatttttgtgtctcagaaatgg

SEQ ID NO: 856919 - DNA, 22 bp, Artificial Sequence
  chemically synthesized
ttgtgtctcagaaatggctttt

SEQ ID NO: 856920 - DNA, 22 bp, Artificial Sequence
  chemically synthesized
gggggaaaaatcaaaagccatt

SEQ ID NO: 856921 - DNA, 22 bp, Artificial Sequence
  chemically synthesized
tgtgtctcagaaatggcttttg

SEQ ID NO: 856922 - DNA, 22 bp, Artificial Sequence
  chemically synthesized
agggggaaaaatcaaaagccat

SEQ ID NO: 856923 - DNA, 22 bp, Artificial Sequence
  chemically synthesized
gtgtctcagaaatggcttttga

SEQ ID NO: 856924 - DNA, 22 bp, Artificial Sequence
  chemically synthesized
tgtctcagaaatggcttttgat

SEQ ID NO: 856925 - DNA, 22 bp, Artificial Sequence
  chemically synthesized
agaaatggcttttgatttttcc

SEQ ID NO: 856926 - DNA, 22 bp, Artificial Sequence
  chemically synthesized
agaaaaaaaaaaatttaggggg

SEQ ID NO: 856927 - DNA, 22 bp, Artificial Sequence
  chemically synthesized
ttgatttttccccctaaatttt

SEQ ID NO: 856928 - DNA, 22 bp, Artificial Sequence
  chemically synthesized
tgatttttccccctaaattttt

SEQ ID NO: 856929 - DNA, 22 bp, Artificial Sequence
  chemically synthesized
gatttttccccctaaatttttt

SEQ ID NO: 856930 - DNA, 22 bp, Artificial Sequence
  chemically synthesized
atttttccccctaaattttttt

SEQ ID NO: 856931 - DNA, 22 bp, Artificial Sequence
  chemically synthesized
catctcagaaaaaaaaaaattt

SEQ ID NO: 856932 - DNA, 22 bp, Artificial Sequence
  chemically synthesized
ttccccctaaattttttttttt

SEQ ID NO: 856933 - DNA, 22 bp, Artificial Sequence
  chemically synthesized
tccccctaaatttttttttttc

SEQ ID NO: 856934 - DNA, 22 bp, Artificial Sequence
  chemically synthesized
ccccctaaatttttttttttct

SEQ ID NO: 856935 - DNA, 22 bp, Artificial Sequence
  chemically synthesized
cccctaaatttttttttttctg

SEQ ID NO: 856936 - DNA, 22 bp, Artificial Sequence
  chemically synthesized
aatttttttttttctgagatgg

SEQ ID NO: 856937 - DNA, 22 bp, Artificial Sequence
  chemically synthesized
ttttttttctgagatggagtct

SEQ ID NO: 856938 - DNA, 22 bp, Artificial Sequence
  chemically synthesized
agtgacagagtgagactccatc

SEQ ID NO: 856939 - DNA, 22 bp, Artificial Sequence
  chemically synthesized
tttttttctgagatggagtctc

SEQ ID NO: 856940 - DNA, 22 bp, Artificial Sequence
  chemically synthesized
ttttttctgagatggagtctca

SEQ ID NO: 856941 - DNA, 22 bp, Artificial Sequence
  chemically synthesized
tttttctgagatggagtctcac

SEQ ID NO: 856942 - DNA, 22 bp, Artificial Sequence
  chemically synthesized
ttttctgagatggagtctcact

SEQ ID NO: 856943 - DNA, 22 bp, Artificial Sequence
  chemically synthesized
tttctgagatggagtctcactc

SEQ ID NO: 856944 - DNA, 22 bp, Artificial Sequence
  chemically synthesized
ttctgagatggagtctcactct

SEQ ID NO: 856945 - DNA, 22 bp, Artificial Sequence
  chemically synthesized
tctgagatggagtctcactctg

SEQ ID NO: 856946 - DNA, 22 bp, Artificial Sequence
  chemically synthesized
cagactgagtgacagagtgaga

SEQ ID NO: 856947 - DNA, 22 bp, Artificial Sequence
  chemically synthesized
ctgagatggagtctcactctgt

SEQ ID NO: 856948 - DNA, 22 bp, Artificial Sequence
  chemically synthesized
tgagatggagtctcactctgtc

SEQ ID NO: 856949 - DNA, 22 bp, Artificial Sequence
  chemically synthesized
agatggagtctcactctgtcac

SEQ ID NO: 856950 - DNA, 22 bp, Artificial Sequence
  chemically synthesized
cactccagactgagtgacagag

SEQ ID NO: 856951 - DNA, 22 bp, Artificial Sequence
  chemically synthesized
actctgtcactcagtctggagt

SEQ ID NO: 856952 - DNA, 22 bp, Artificial Sequence
  chemically synthesized
agatcacaccattgcactccag

SEQ ID NO: 856953 - DNA, 22 bp, Artificial Sequence
  chemically synthesized
tgtcactcagtctggagtgcaa

SEQ ID NO: 856954 - DNA, 22 bp, Artificial Sequence
  chemically synthesized
tcactcagtctggagtgcaatg

SEQ ID NO: 856955 - DNA, 22 bp, Artificial Sequence
  chemically synthesized
agctgagatcacaccattgcac

SEQ ID NO: 856956 - DNA, 22 bp, Artificial Sequence
  chemically synthesized
agtctggagtgcaatggtgtga

SEQ ID NO: 856957 - DNA, 22 bp, Artificial Sequence
  chemically synthesized
cattgagctgagatcacaccat

SEQ ID NO: 856958 - DNA, 22 bp, Artificial Sequence
  chemically synthesized
gagtgcaatggtgtgatctcag

SEQ ID NO: 856959 - DNA, 22 bp, Artificial Sequence
  chemically synthesized
gaccagaggttccattgagctg

SEQ ID NO: 856960 - DNA, 22 bp, Artificial Sequence
  chemically synthesized
aatcctggaccagaggttccat

SEQ ID NO: 856961 - DNA, 22 bp, Artificial Sequence
  chemically synthesized
gaatcctggaccagaggttcca

SEQ ID NO: 856962 - DNA, 22 bp, Artificial Sequence
  chemically synthesized
agctcaatggaacctctggtcc

SEQ ID NO: 856963 - DNA, 22 bp, Artificial Sequence
  chemically synthesized
aatggaacctctggtccaggat

SEQ ID NO: 856964 - DNA, 22 bp, Artificial Sequence
  chemically synthesized
aggcaggagaatcacttgaatc

SEQ ID NO: 856965 - DNA, 22 bp, Artificial Sequence
  chemically synthesized
tggtccaggattcaagtgattc

SEQ ID NO: 856966 - DNA, 22 bp, Artificial Sequence
  chemically synthesized
gtccaggattcaagtgattctc

SEQ ID NO: 856967 - DNA, 22 bp, Artificial Sequence
  chemically synthesized
gggaggctgaggcaggagaatc

SEQ ID NO: 856968 - DNA, 22 bp, Artificial Sequence
  chemically synthesized
ctagggaggctgaggcaggaga

SEQ ID NO: 856969 - DNA, 22 bp, Artificial Sequence
  chemically synthesized
aagtgattctcctgcctcagcc

SEQ ID NO: 856970 - DNA, 22 bp, Artificial Sequence
  chemically synthesized
taatcccagctactagggaggc

SEQ ID NO: 856971 - DNA, 22 bp, Artificial Sequence
  chemically synthesized
tcctgcctcagcctccctagta

SEQ ID NO: 856972 - DNA, 22 bp, Artificial Sequence
  chemically synthesized
ctgcctcagcctccctagtagc

SEQ ID NO: 856973 - DNA, 22 bp, Artificial Sequence
  chemically synthesized
cctcagcctccctagtagctgg

SEQ ID NO: 856974 - DNA, 22 bp, Artificial Sequence
  chemically synthesized
agcctccctagtagctgggatt

SEQ ID NO: 856975 - DNA, 22 bp, Artificial Sequence
  chemically synthesized
cctagtagctgggattataggc

SEQ ID NO: 856976 - DNA, 22 bp, Artificial Sequence
  chemically synthesized
gtgtggtggcccatgcctataa

SEQ ID NO: 856977 - DNA, 22 bp, Artificial Sequence
  chemically synthesized
gtagctgggattataggcatgg

SEQ ID NO: 856978 - DNA, 22 bp, Artificial Sequence
  chemically synthesized
gctggtgtggtggcccatgcct

SEQ ID NO: 856979 - DNA, 22 bp, Artificial Sequence
  chemically synthesized
ggattataggcatgggccacca

SEQ ID NO: 856980 - DNA, 22 bp, Artificial Sequence
  chemically synthesized
taggcatgggccaccacaccag

SEQ ID NO: 856981 - DNA, 22 bp, Artificial Sequence
  chemically synthesized
aaaataaaaaaattagctggtg

SEQ ID NO: 856982 - DNA, 22 bp, Artificial Sequence
  chemically synthesized
ctgaaaataaaaaaattagctg

SEQ ID NO: 856983 - DNA, 22 bp, Artificial Sequence
  chemically synthesized
tactgaaaataaaaaaattagc

SEQ ID NO: 856984 - DNA, 22 bp, Artificial Sequence
  chemically synthesized
atttttttattttcagtagaga

SEQ ID NO: 856985 - DNA, 22 bp, Artificial Sequence
  chemically synthesized
ttttattttcagtagagatggg

SEQ ID NO: 856986 - DNA, 22 bp, Artificial Sequence
  chemically synthesized
tttattttcagtagagatgggg

SEQ ID NO: 856987 - DNA, 22 bp, Artificial Sequence
  chemically synthesized
ttattttcagtagagatggggt

SEQ ID NO: 856988 - DNA, 22 bp, Artificial Sequence
  chemically synthesized
tattttcagtagagatggggtt

SEQ ID NO: 856989 - DNA, 22 bp, Artificial Sequence
  chemically synthesized
attttcagtagagatggggttt

SEQ ID NO: 856990 - DNA, 22 bp, Artificial Sequence
  chemically synthesized
gtcaacatggccaaaccccatc

SEQ ID NO: 856991 - DNA, 22 bp, Artificial Sequence
  chemically synthesized
ttttcagtagagatggggtttg

SEQ ID NO: 856992 - DNA, 22 bp, Artificial Sequence
  chemically synthesized
tcagtagagatggggtttggcc

SEQ ID NO: 856993 - DNA, 22 bp, Artificial Sequence
  chemically synthesized
cagtagagatggggtttggcca

SEQ ID NO: 856994 - DNA, 22 bp, Artificial Sequence
  chemically synthesized
agtagagatggggtttggccat

SEQ ID NO: 856995 - DNA, 22 bp, Artificial Sequence
  chemically synthesized
agaccagcctggtcaacatggc

SEQ ID NO: 856996 - DNA, 22 bp, Artificial Sequence
  chemically synthesized
gagaccagcctggtcaacatgg

SEQ ID NO: 856997 - DNA, 22 bp, Artificial Sequence
  chemically synthesized
ggccatgttgaccaggctggtc

SEQ ID NO: 856998 - DNA, 22 bp, Artificial Sequence
  chemically synthesized
gccatgttgaccaggctggtct

SEQ ID NO: 856999 - DNA, 22 bp, Artificial Sequence
  chemically synthesized
aggtcaggagtttgagaccagc

SEQ ID NO: 857000 - DNA, 22 bp, Artificial Sequence
  chemically synthesized
gaggtcaggagtttgagaccag

SEQ ID NO: 857001 - DNA, 22 bp, Artificial Sequence
  chemically synthesized
accaggctggtctcaaactcct

SEQ ID NO: 857002 - DNA, 22 bp, Artificial Sequence
  chemically synthesized
gtctcaaactcctgacctcaag

SEQ ID NO: 857003 - DNA, 22 bp, Artificial Sequence
  chemically synthesized
aggcaggtggatcacttgaggt

SEQ ID NO: 857004 - DNA, 22 bp, Artificial Sequence
  chemically synthesized
aaactcctgacctcaagtgatc

SEQ ID NO: 857005 - DNA, 22 bp, Artificial Sequence
  chemically synthesized
ggaggctgaggcaggtggatca

SEQ ID NO: 857006 - DNA, 22 bp, Artificial Sequence
  chemically synthesized
ctgacctcaagtgatccacctg

SEQ ID NO: 857007 - DNA, 22 bp, Artificial Sequence
  chemically synthesized
gggaggctgaggcaggtggatc

SEQ ID NO: 857008 - DNA, 22 bp, Artificial Sequence
  chemically synthesized
tgggaggctgaggcaggtggat

SEQ ID NO: 857009 - DNA, 22 bp, Artificial Sequence
  chemically synthesized
acctcaagtgatccacctgcct

SEQ ID NO: 857010 - DNA, 22 bp, Artificial Sequence
  chemically synthesized
aagtgatccacctgcctcagcc

SEQ ID NO: 857011 - DNA, 22 bp, Artificial Sequence
  chemically synthesized
ccagcgctttgggaggctgagg

SEQ ID NO: 857012 - DNA, 22 bp, Artificial Sequence
  chemically synthesized
cactcccagcgctttgggaggc

SEQ ID NO: 857013 - DNA, 22 bp, Artificial Sequence
  chemically synthesized
cctcagcctcccaaagcgctgg

SEQ ID NO: 857014 - DNA, 22 bp, Artificial Sequence
  chemically synthesized
acgcctgcactcccagcgcttt

SEQ ID NO: 857015 - DNA, 22 bp, Artificial Sequence
  chemically synthesized
cacgcctgcactcccagcgctt

SEQ ID NO: 857016 - DNA, 22 bp, Artificial Sequence
  chemically synthesized
agcctcccaaagcgctgggagt

SEQ ID NO: 857017 - DNA, 22 bp, Artificial Sequence
  chemically synthesized
ccaaagcgctgggagtgcaggc

SEQ ID NO: 857018 - DNA, 22 bp, Artificial Sequence
  chemically synthesized
ggagtgcaggcgtgaaacattg

SEQ ID NO: 857019 - DNA, 22 bp, Artificial Sequence
  chemically synthesized
atgtagagggccaggtgcaatg

SEQ ID NO: 857020 - DNA, 22 bp, Artificial Sequence
  chemically synthesized
cacctggccctctacattagtt

SEQ ID NO: 857021 - DNA, 22 bp, Artificial Sequence
  chemically synthesized
aatataggtcaaaaactaatgt

SEQ ID NO: 857022 - DNA, 22 bp, Artificial Sequence
  chemically synthesized
aaatataggtcaaaaactaatg

SEQ ID NO: 857023 - DNA, 22 bp, Artificial Sequence
  chemically synthesized
taaatataggtcaaaaactaat

SEQ ID NO: 857024 - DNA, 22 bp, Artificial Sequence
  chemically synthesized
gccctctacattagtttttgac

SEQ ID NO: 857025 - DNA, 22 bp, Artificial Sequence
  chemically synthesized
tacattagtttttgacctatat

SEQ ID NO: 857026 - DNA, 22 bp, Artificial Sequence
  chemically synthesized
cattagtttttgacctatattt

SEQ ID NO: 857027 - DNA, 22 bp, Artificial Sequence
  chemically synthesized
acagagatcgtctttaaatata

SEQ ID NO: 857028 - DNA, 22 bp, Artificial Sequence
  chemically synthesized
gtttttgacctatatttaaaga

SEQ ID NO: 857029 - DNA, 22 bp, Artificial Sequence
  chemically synthesized
ttgacctatatttaaagacgat

SEQ ID NO: 857030 - DNA, 22 bp, Artificial Sequence
  chemically synthesized
tgacctatatttaaagacgatc

SEQ ID NO: 857031 - DNA, 22 bp, Artificial Sequence
  chemically synthesized
gacctatatttaaagacgatct

SEQ ID NO: 857032 - DNA, 22 bp, Artificial Sequence
  chemically synthesized
acctatatttaaagacgatctc

SEQ ID NO: 857033 - DNA, 22 bp, Artificial Sequence
  chemically synthesized
atgccccctcacagagatcgtc

SEQ ID NO: 857034 - DNA, 22 bp, Artificial Sequence
  chemically synthesized
gatgccccctcacagagatcgt

SEQ ID NO: 857035 - DNA, 22 bp, Artificial Sequence
  chemically synthesized
tatttaaagacgatctctgtga

SEQ ID NO: 857036 - DNA, 22 bp, Artificial Sequence
  chemically synthesized
atttgatgccccctcacagaga

SEQ ID NO: 857037 - DNA, 22 bp, Artificial Sequence
  chemically synthesized
ctgatttgatgccccctcacag

SEQ ID NO: 857038 - DNA, 22 bp, Artificial Sequence
  chemically synthesized
aaagacgatctctgtgaggggg

SEQ ID NO: 857039 - DNA, 22 bp, Artificial Sequence
  chemically synthesized
aagacgatctctgtgagggggc

SEQ ID NO: 857040 - DNA, 22 bp, Artificial Sequence
  chemically synthesized
agaaaggactactgatttgatg

SEQ ID NO: 857041 - DNA, 22 bp, Artificial Sequence
  chemically synthesized
cagaaaggactactgatttgat

SEQ ID NO: 857042 - DNA, 22 bp, Artificial Sequence
  chemically synthesized
tgtgagggggcatcaaatcagt

SEQ ID NO: 857043 - DNA, 22 bp, Artificial Sequence
  chemically synthesized
tcagaaaggactactgatttga

SEQ ID NO: 857044 - DNA, 22 bp, Artificial Sequence
  chemically synthesized
ttcagaaaggactactgatttg

SEQ ID NO: 857045 - DNA, 22 bp, Artificial Sequence
  chemically synthesized
tgagggggcatcaaatcagtag

SEQ ID NO: 857046 - DNA, 22 bp, Artificial Sequence
  chemically synthesized
aataaatgtgtccttttcagaa

SEQ ID NO: 857047 - DNA, 22 bp, Artificial Sequence
  chemically synthesized
taaataaatgtgtccttttcag

SEQ ID NO: 857048 - DNA, 22 bp, Artificial Sequence
  chemically synthesized
tctaaataaatgtgtccttttc

SEQ ID NO: 857049 - DNA, 22 bp, Artificial Sequence
  chemically synthesized
cagagttctctaaataaatgtg

SEQ ID NO: 857050 - DNA, 22 bp, Artificial Sequence
  chemically synthesized
tctgaaaaggacacatttattt

SEQ ID NO: 857051 - DNA, 22 bp, Artificial Sequence
  chemically synthesized
ctgaaaaggacacatttattta

SEQ ID NO: 857052 - DNA, 22 bp, Artificial Sequence
  chemically synthesized
tgaaaaggacacatttatttag

SEQ ID NO: 857053 - DNA, 22 bp, Artificial Sequence
  chemically synthesized
aaaaggacacatttatttagag

SEQ ID NO: 857054 - DNA, 22 bp, Artificial Sequence
  chemically synthesized
agtagtctccagagttctctaa

SEQ ID NO: 857055 - DNA, 22 bp, Artificial Sequence
  chemically synthesized
atgtgctcagtagtctccagag

SEQ ID NO: 857056 - DNA, 22 bp, Artificial Sequence
  chemically synthesized
atttagagaactctggagacta

SEQ ID NO: 857057 - DNA, 22 bp, Artificial Sequence
  chemically synthesized
tttagagaactctggagactac

SEQ ID NO: 857058 - DNA, 22 bp, Artificial Sequence
  chemically synthesized
agagaactctggagactactga

SEQ ID NO: 857059 - DNA, 22 bp, Artificial Sequence
  chemically synthesized
gagaactctggagactactgag

SEQ ID NO: 857060 - DNA, 22 bp, Artificial Sequence
  chemically synthesized
gggaagccattgatgtgctcag

SEQ ID NO: 857061 - DNA, 22 bp, Artificial Sequence
  chemically synthesized
agggaagccattgatgtgctca

SEQ ID NO: 857062 - DNA, 22 bp, Artificial Sequence
  chemically synthesized
tggagactactgagcacatcaa

SEQ ID NO: 857063 - DNA, 22 bp, Artificial Sequence
  chemically synthesized
gagactactgagcacatcaatg

SEQ ID NO: 857064 - DNA, 22 bp, Artificial Sequence
  chemically synthesized
ctgagcacatcaatggcttccc

SEQ ID NO: 857065 - DNA, 22 bp, Artificial Sequence
  chemically synthesized
agcacatcaatggcttccctaa

SEQ ID NO: 857066 - DNA, 22 bp, Artificial Sequence
  chemically synthesized
tgagtccagcatttagggaagc

SEQ ID NO: 857067 - DNA, 22 bp, Artificial Sequence
  chemically synthesized
gtgagtccagcatttagggaag

SEQ ID NO: 857068 - DNA, 22 bp, Artificial Sequence
  chemically synthesized
tgacgggtttgtgagtccagca

SEQ ID NO: 857069 - DNA, 22 bp, Artificial Sequence
  chemically synthesized
gtgacgggtttgtgagtccagc

SEQ ID NO: 857070 - DNA, 22 bp, Artificial Sequence
  chemically synthesized
cttgtgacgggtttgtgagtcc

SEQ ID NO: 857071 - DNA, 22 bp, Artificial Sequence
  chemically synthesized
ccctaaatgctggactcacaaa

SEQ ID NO: 857072 - DNA, 22 bp, Artificial Sequence
  chemically synthesized
ccttgtgacgggtttgtgagtc

SEQ ID NO: 857073 - DNA, 22 bp, Artificial Sequence
  chemically synthesized
cctaaatgctggactcacaaac

SEQ ID NO: 857074 - DNA, 22 bp, Artificial Sequence
  chemically synthesized
aatgctggactcacaaacccgt

SEQ ID NO: 857075 - DNA, 22 bp, Artificial Sequence
  chemically synthesized
gactcacaaacccgtcacaagg

SEQ ID NO: 857076 - DNA, 22 bp, Artificial Sequence
  chemically synthesized
acaaacccgtcacaaggaagtg

SEQ ID NO: 857077 - DNA, 22 bp, Artificial Sequence
  chemically synthesized
ggagagaaagtccacacttcct

SEQ ID NO: 857078 - DNA, 22 bp, Artificial Sequence
  chemically synthesized
ccagataatagattgggagaga

SEQ ID NO: 857079 - DNA, 22 bp, Artificial Sequence
  chemically synthesized
cagaagttaccagataatagat

SEQ ID NO: 857080 - DNA, 22 bp, Artificial Sequence
  chemically synthesized
tctctcccaatctattatctgg

SEQ ID NO: 857081 - DNA, 22 bp, Artificial Sequence
  chemically synthesized
ctgcagaagttaccagataata

SEQ ID NO: 857082 - DNA, 22 bp, Artificial Sequence
  chemically synthesized
ctctcccaatctattatctggt

SEQ ID NO: 857083 - DNA, 22 bp, Artificial Sequence
  chemically synthesized
cctgcagaagttaccagataat

SEQ ID NO: 857084 - DNA, 22 bp, Artificial Sequence
  chemically synthesized
tctcccaatctattatctggta

SEQ ID NO: 857085 - DNA, 22 bp, Artificial Sequence
  chemically synthesized
tcccaatctattatctggtaac

SEQ ID NO: 857086 - DNA, 22 bp, Artificial Sequence
  chemically synthesized
ccaatctattatctggtaactt

SEQ ID NO: 857087 - DNA, 22 bp, Artificial Sequence
  chemically synthesized
acatagcttcctgcagaagtta

SEQ ID NO: 857088 - DNA, 22 bp, Artificial Sequence
  chemically synthesized
ttatctggtaacttctgcagga

SEQ ID NO: 857089 - DNA, 22 bp, Artificial Sequence
  chemically synthesized
ccattgacatagcttcctgcag

SEQ ID NO: 857090 - DNA, 22 bp, Artificial Sequence
  chemically synthesized
tctggtaacttctgcaggaagc

SEQ ID NO: 857091 - DNA, 22 bp, Artificial Sequence
  chemically synthesized
gtaacttctgcaggaagctatg

SEQ ID NO: 857092 - DNA, 22 bp, Artificial Sequence
  chemically synthesized
gtctaccattgacatagcttcc

SEQ ID NO: 857093 - DNA, 22 bp, Artificial Sequence
  chemically synthesized
ctgcaggaagctatgtcaatgg

SEQ ID NO: 857094 - DNA, 22 bp, Artificial Sequence
  chemically synthesized
tagcctagtctaccattgacat

SEQ ID NO: 857095 - DNA, 22 bp, Artificial Sequence
  chemically synthesized
tgcaggaagctatgtcaatggt

SEQ ID NO: 857096 - DNA, 22 bp, Artificial Sequence
  chemically synthesized
tgtagcctagtctaccattgac

SEQ ID NO: 857097 - DNA, 22 bp, Artificial Sequence
  chemically synthesized
caggaagctatgtcaatggtag

SEQ ID NO: 857098 - DNA, 22 bp, Artificial Sequence
  chemically synthesized
ctgtagcctagtctaccattga

SEQ ID NO: 857099 - DNA, 22 bp, Artificial Sequence
  chemically synthesized
cgcttctgtagcctagtctacc

SEQ ID NO: 857100 - DNA, 22 bp, Artificial Sequence
  chemically synthesized
ccgcttctgtagcctagtctac

SEQ ID NO: 857101 - DNA, 22 bp, Artificial Sequence
  chemically synthesized
tttccgcttctgtagcctagtc

SEQ ID NO: 857102 - DNA, 22 bp, Artificial Sequence
  chemically synthesized
tgtcaatggtagactaggctac

SEQ ID NO: 857103 - DNA, 22 bp, Artificial Sequence
  chemically synthesized
gtttccgcttctgtagcctagt

SEQ ID NO: 857104 - DNA, 22 bp, Artificial Sequence
  chemically synthesized
ggctacagaagcggaaacaagc

SEQ ID NO: 857105 - DNA, 22 bp, Artificial Sequence
  chemically synthesized
tatggaaatgagagcttgtttc

SEQ ID NO: 857106 - DNA, 22 bp, Artificial Sequence
  chemically synthesized
cagaagcggaaacaagctctca

SEQ ID NO: 857107 - DNA, 22 bp, Artificial Sequence
  chemically synthesized
tatatcacatcataatattata

SEQ ID NO: 857108 - DNA, 22 bp, Artificial Sequence
  chemically synthesized
tcatttccatataatattatga

SEQ ID NO: 857109 - DNA, 22 bp, Artificial Sequence
  chemically synthesized
atttccatataatattatgatg

SEQ ID NO: 857110 - DNA, 22 bp, Artificial Sequence
  chemically synthesized
ccatataatattatgatgtgat

SEQ ID NO: 857111 - DNA, 22 bp, Artificial Sequence
  chemically synthesized
tgcaaactgtatatcacatcat

SEQ ID NO: 857112 - DNA, 22 bp, Artificial Sequence
  chemically synthesized
catataatattatgatgtgata

SEQ ID NO: 857113 - DNA, 22 bp, Artificial Sequence
  chemically synthesized
tattatgcaaactgtatatcac

SEQ ID NO: 857114 - DNA, 22 bp, Artificial Sequence
  chemically synthesized
gtattatgcaaactgtatatca

SEQ ID NO: 857115 - DNA, 22 bp, Artificial Sequence
  chemically synthesized
tgatgtgatatacagtttgcat

SEQ ID NO: 857116 - DNA, 22 bp, Artificial Sequence
  chemically synthesized
accaatgatggcatttgtatta

SEQ ID NO: 857117 - DNA, 22 bp, Artificial Sequence
  chemically synthesized
gaaatctaaccaatgatggcat

SEQ ID NO: 857118 - DNA, 22 bp, Artificial Sequence
  chemically synthesized
gcataatacaaatgccatcatt

SEQ ID NO: 857119 - DNA, 22 bp, Artificial Sequence
  chemically synthesized
cataatacaaatgccatcattg

SEQ ID NO: 857120 - DNA, 22 bp, Artificial Sequence
  chemically synthesized
tagaaatctaaccaatgatggc

SEQ ID NO: 857121 - DNA, 22 bp, Artificial Sequence
  chemically synthesized
caccacgaactctagaaatcta

SEQ ID NO: 857122 - DNA, 22 bp, Artificial Sequence
  chemically synthesized
gttccaccacgaactctagaaa

SEQ ID NO: 857123 - DNA, 22 bp, Artificial Sequence
  chemically synthesized
ggttccaccacgaactctagaa

SEQ ID NO: 857124 - DNA, 22 bp, Artificial Sequence
  chemically synthesized
gttagatttctagagttcgtgg

SEQ ID NO: 857125 - DNA, 22 bp, Artificial Sequence
  chemically synthesized
tatttggttccaccacgaactc

SEQ ID NO: 857126 - DNA, 22 bp, Artificial Sequence
  chemically synthesized
gatttctagagttcgtggtgga

SEQ ID NO: 857127 - DNA, 22 bp, Artificial Sequence
  chemically synthesized
gtaattatatttggttccacca

SEQ ID NO: 857128 - DNA, 22 bp, Artificial Sequence
  chemically synthesized
ctagagttcgtggtggaaccaa

SEQ ID NO: 857129 - DNA, 22 bp, Artificial Sequence
  chemically synthesized
tagagttcgtggtggaaccaaa

SEQ ID NO: 857130 - DNA, 22 bp, Artificial Sequence
  chemically synthesized
gagttcgtggtggaaccaaata

SEQ ID NO: 857131 - DNA, 22 bp, Artificial Sequence
  chemically synthesized
gtggtggaaccaaatataatta

SEQ ID NO: 857132 - DNA, 22 bp, Artificial Sequence
  chemically synthesized
aacaaatgttagtaattatatt

SEQ ID NO: 857133 - DNA, 22 bp, Artificial Sequence
  chemically synthesized
gtattgaacaaatgttagtaat

SEQ ID NO: 857134 - DNA, 22 bp, Artificial Sequence
  chemically synthesized
ctagtattgaacaaatgttagt

SEQ ID NO: 857135 - DNA, 22 bp, Artificial Sequence
  chemically synthesized
ctgctagtattgaacaaatgtt

SEQ ID NO: 857136 - DNA, 22 bp, Artificial Sequence
  chemically synthesized
actgctagtattgaacaaatgt

SEQ ID NO: 857137 - DNA, 22 bp, Artificial Sequence
  chemically synthesized
cttactgctagtattgaacaaa

SEQ ID NO: 857138 - DNA, 22 bp, Artificial Sequence
  chemically synthesized
ctgcttactgctagtattgaac

SEQ ID NO: 857139 - DNA, 22 bp, Artificial Sequence
  chemically synthesized
actgcttactgctagtattgaa

SEQ ID NO: 857140 - DNA, 22 bp, Artificial Sequence
  chemically synthesized
ctaacatttgttcaatactagc

SEQ ID NO: 857141 - DNA, 22 bp, Artificial Sequence
  chemically synthesized
cttactgcttactgctagtatt

SEQ ID NO: 857142 - DNA, 22 bp, Artificial Sequence
  chemically synthesized
gcttactgcttactgctagtat

SEQ ID NO: 857143 - DNA, 22 bp, Artificial Sequence
  chemically synthesized
acatttgttcaatactagcagt

SEQ ID NO: 857144 - DNA, 22 bp, Artificial Sequence
  chemically synthesized
ccttgcttactgcttactgcta

SEQ ID NO: 857145 - DNA, 22 bp, Artificial Sequence
  chemically synthesized
gccttgcttactgcttactgct

SEQ ID NO: 857146 - DNA, 22 bp, Artificial Sequence
  chemically synthesized
tgccttgcttactgcttactgc

SEQ ID NO: 857147 - DNA, 22 bp, Artificial Sequence
  chemically synthesized
gttcaatactagcagtaagcag

SEQ ID NO: 857148 - DNA, 22 bp, Artificial Sequence
  chemically synthesized
ttcaatactagcagtaagcagt

SEQ ID NO: 857149 - DNA, 22 bp, Artificial Sequence
  chemically synthesized
aatactagcagtaagcagtaag

SEQ ID NO: 857150 - DNA, 22 bp, Artificial Sequence
  chemically synthesized
ccactttgccttgcttactgct

SEQ ID NO: 857151 - DNA, 22 bp, Artificial Sequence
  chemically synthesized
cccactttgccttgcttactgc

SEQ ID NO: 857152 - DNA, 22 bp, Artificial Sequence
  chemically synthesized
gcagtaagcagtaagcaaggca

SEQ ID NO: 857153 - DNA, 22 bp, Artificial Sequence
  chemically synthesized
gtacatgaaaaatgcttcccac

SEQ ID NO: 857154 - DNA, 22 bp, Artificial Sequence
  chemically synthesized
gttggtacatgaaaaatgcttc

SEQ ID NO: 857155 - DNA, 22 bp, Artificial Sequence
  chemically synthesized
agttggttggtacatgaaaaat

SEQ ID NO: 857156 - DNA, 22 bp, Artificial Sequence
  chemically synthesized
tcatcaggattaagttggttgg

SEQ ID NO: 857157 - DNA, 22 bp, Artificial Sequence
  chemically synthesized
gtcatcaggattaagttggttg

SEQ ID NO: 857158 - DNA, 22 bp, Artificial Sequence
  chemically synthesized
ttcatgtaccaaccaacttaat

SEQ ID NO: 857159 - DNA, 22 bp, Artificial Sequence
  chemically synthesized
tcatgtaccaaccaacttaatc

SEQ ID NO: 857160 - DNA, 22 bp, Artificial Sequence
  chemically synthesized
catgtaccaaccaacttaatcc

SEQ ID NO: 857161 - DNA, 22 bp, Artificial Sequence
  chemically synthesized
atgtaccaaccaacttaatcct

SEQ ID NO: 857162 - DNA, 22 bp, Artificial Sequence
  chemically synthesized
cagtttgtcatcaggattaagt

SEQ ID NO: 857163 - DNA, 22 bp, Artificial Sequence
  chemically synthesized
gcagtttgtcatcaggattaag

SEQ ID NO: 857164 - DNA, 22 bp, Artificial Sequence
  chemically synthesized
ccttgcagtttgtcatcaggat

SEQ ID NO: 857165 - DNA, 22 bp, Artificial Sequence
  chemically synthesized
tctgccttgcagtttgtcatca

SEQ ID NO: 857166 - DNA, 22 bp, Artificial Sequence
  chemically synthesized
tactatctgccttgcagtttgt

SEQ ID NO: 857167 - DNA, 22 bp, Artificial Sequence
  chemically synthesized
aatcctgatgacaaactgcaag

SEQ ID NO: 857168 - DNA, 22 bp, Artificial Sequence
  chemically synthesized
atcctgatgacaaactgcaagg

SEQ ID NO: 857169 - DNA, 22 bp, Artificial Sequence
  chemically synthesized
atgacaaactgcaaggcagata

SEQ ID NO: 857170 - DNA, 22 bp, Artificial Sequence
  chemically synthesized
taaaatggggatagttgtacta

SEQ ID NO: 857171 - DNA, 22 bp, Artificial Sequence
  chemically synthesized
caaggcagatagtacaactatc

SEQ ID NO: 857172 - DNA, 22 bp, Artificial Sequence
  chemically synthesized
gctataaaatggggatagttgt

SEQ ID NO: 857173 - DNA, 22 bp, Artificial Sequence
  chemically synthesized
tctagctataaaatggggatag

SEQ ID NO: 857174 - DNA, 22 bp, Artificial Sequence
  chemically synthesized
atctagctataaaatggggata

SEQ ID NO: 857175 - DNA, 22 bp, Artificial Sequence
  chemically synthesized
agcccaagtttatctagctata

SEQ ID NO: 857176 - DNA, 22 bp, Artificial Sequence
  chemically synthesized
tccccattttatagctagataa

SEQ ID NO: 857177 - DNA, 22 bp, Artificial Sequence
  chemically synthesized
cctgagcccaagtttatctagc

SEQ ID NO: 857178 - DNA, 22 bp, Artificial Sequence
  chemically synthesized
cctacctgagcccaagtttatc

SEQ ID NO: 857179 - DNA, 22 bp, Artificial Sequence
  chemically synthesized
tgcctacctgagcccaagttta

SEQ ID NO: 857180 - DNA, 22 bp, Artificial Sequence
  chemically synthesized
tatagctagataaacttgggct

SEQ ID NO: 857181 - DNA, 22 bp, Artificial Sequence
  chemically synthesized
atagctagataaacttgggctc

SEQ ID NO: 857182 - DNA, 22 bp, Artificial Sequence
  chemically synthesized
ttctgcctacctgagcccaagt

SEQ ID NO: 857183 - DNA, 22 bp, Artificial Sequence
  chemically synthesized
tagctagataaacttgggctca

SEQ ID NO: 857184 - DNA, 22 bp, Artificial Sequence
  chemically synthesized
gataaacttgggctcaggtagg

SEQ ID NO: 857185 - DNA, 22 bp, Artificial Sequence
  chemically synthesized
agtaagttattctgcctacctg

SEQ ID NO: 857186 - DNA, 22 bp, Artificial Sequence
  chemically synthesized
gagtaagttattctgcctacct

SEQ ID NO: 857187 - DNA, 22 bp, Artificial Sequence
  chemically synthesized
gggctcaggtaggcagaataac

SEQ ID NO: 857188 - DNA, 22 bp, Artificial Sequence
  chemically synthesized
ggctcaggtaggcagaataact

SEQ ID NO: 857189 - DNA, 22 bp, Artificial Sequence
  chemically synthesized
tgtgaccttgagtaagttattc

SEQ ID NO: 857190 - DNA, 22 bp, Artificial Sequence
  chemically synthesized
aggtaggcagaataacttactc

SEQ ID NO: 857191 - DNA, 22 bp, Artificial Sequence
  chemically synthesized
ccaagctgtgtgaccttgagta

SEQ ID NO: 857192 - DNA, 22 bp, Artificial Sequence
  chemically synthesized
gctcccaagctgtgtgaccttg

SEQ ID NO: 857193 - DNA, 22 bp, Artificial Sequence
  chemically synthesized
ggctcccaagctgtgtgacctt

SEQ ID NO: 857194 - DNA, 22 bp, Artificial Sequence
  chemically synthesized
aaagcttggctcccaagctgtg

SEQ ID NO: 857195 - DNA, 22 bp, Artificial Sequence
  chemically synthesized
actcaaggtcacacagcttggg

SEQ ID NO: 857196 - DNA, 22 bp, Artificial Sequence
  chemically synthesized
ctcaaggtcacacagcttggga

SEQ ID NO: 857197 - DNA, 22 bp, Artificial Sequence
  chemically synthesized
aaggtcacacagcttgggagcc

SEQ ID NO: 857198 - DNA, 22 bp, Artificial Sequence
  chemically synthesized
ggttcaaagcttggctcccaag

SEQ ID NO: 857199 - DNA, 22 bp, Artificial Sequence
  chemically synthesized
tctgggttcaaagcttggctcc

SEQ ID NO: 857200 - DNA, 22 bp, Artificial Sequence
  chemically synthesized
cattgtctgggttcaaagcttg

SEQ ID NO: 857201 - DNA, 22 bp, Artificial Sequence
  chemically synthesized
gggagccaagctttgaacccag

SEQ ID NO: 857202 - DNA, 22 bp, Artificial Sequence
  chemically synthesized
aagttacattgtctgggttcaa

SEQ ID NO: 857203 - DNA, 22 bp, Artificial Sequence
  chemically synthesized
ggagccaagctttgaacccaga

SEQ ID NO: 857204 - DNA, 22 bp, Artificial Sequence
  chemically synthesized
gaagttacattgtctgggttca

SEQ ID NO: 857205 - DNA, 22 bp, Artificial Sequence
  chemically synthesized
tgaagttacattgtctgggttc

SEQ ID NO: 857206 - DNA, 22 bp, Artificial Sequence
  chemically synthesized
tgaacccagacaatgtaacttc

SEQ ID NO: 857207 - DNA, 22 bp, Artificial Sequence
  chemically synthesized
gaacccagacaatgtaacttca

SEQ ID NO: 857208 - DNA, 22 bp, Artificial Sequence
  chemically synthesized
aagcccaggttttgaagttaca

SEQ ID NO: 857209 - DNA, 22 bp, Artificial Sequence
  chemically synthesized
aacccagacaatgtaacttcaa

SEQ ID NO: 857210 - DNA, 22 bp, Artificial Sequence
  chemically synthesized
aaagcccaggttttgaagttac

SEQ ID NO: 857211 - DNA, 22 bp, Artificial Sequence
  chemically synthesized
taatgtttaaagcccaggtttt

SEQ ID NO: 857212 - DNA, 22 bp, Artificial Sequence
  chemically synthesized
ataatgtttaaagcccaggttt

SEQ ID NO: 857213 - DNA, 22 bp, Artificial Sequence
  chemically synthesized
tataatgtttaaagcccaggtt

SEQ ID NO: 857214 - DNA, 22 bp, Artificial Sequence
  chemically synthesized
caaaacctgggctttaaacatt

SEQ ID NO: 857215 - DNA, 22 bp, Artificial Sequence
  chemically synthesized
aaaacctgggctttaaacatta

SEQ ID NO: 857216 - DNA, 22 bp, Artificial Sequence
  chemically synthesized
ggctttaaacattataaaatat

SEQ ID NO: 857217 - DNA, 22 bp, Artificial Sequence
  chemically synthesized
ccaaaggaaacaatattttata

SEQ ID NO: 857218 - DNA, 22 bp, Artificial Sequence
  chemically synthesized
accaaaggaaacaatattttat

SEQ ID NO: 857219 - DNA, 22 bp, Artificial Sequence
  chemically synthesized
tttaccaaaggaaacaatattt

SEQ ID NO: 857220 - DNA, 22 bp, Artificial Sequence
  chemically synthesized
taaacattataaaatattgttt

SEQ ID NO: 857221 - DNA, 22 bp, Artificial Sequence
  chemically synthesized
atttaccaaaggaaacaatatt

SEQ ID NO: 857222 - DNA, 22 bp, Artificial Sequence
  chemically synthesized
aaacattataaaatattgtttc

SEQ ID NO: 857223 - DNA, 22 bp, Artificial Sequence
  chemically synthesized
tatttaccaaaggaaacaatat

SEQ ID NO: 857224 - DNA, 22 bp, Artificial Sequence
  chemically synthesized
aacattataaaatattgtttcc

SEQ ID NO: 857225 - DNA, 22 bp, Artificial Sequence
  chemically synthesized
ttatttaccaaaggaaacaata

SEQ ID NO: 857226 - DNA, 22 bp, Artificial Sequence
  chemically synthesized
taaaatattgtttcctttggta

SEQ ID NO: 857227 - DNA, 22 bp, Artificial Sequence
  chemically synthesized
ccaggacttttatttaccaaag

SEQ ID NO: 857228 - DNA, 22 bp, Artificial Sequence
  chemically synthesized
tttcctttggtaaataaaagtc

SEQ ID NO: 857229 - DNA, 22 bp, Artificial Sequence
  chemically synthesized
tataatactcccaggactttta

SEQ ID NO: 857230 - DNA, 22 bp, Artificial Sequence
  chemically synthesized
cctttggtaaataaaagtcctg

SEQ ID NO: 857231 - DNA, 22 bp, Artificial Sequence
  chemically synthesized
ctttggtaaataaaagtcctgg

SEQ ID NO: 857232 - DNA, 22 bp, Artificial Sequence
  chemically synthesized
tggtaaataaaagtcctgggag

SEQ ID NO: 857233 - DNA, 22 bp, Artificial Sequence
  chemically synthesized
agttatataatactcccaggac

SEQ ID NO: 857234 - DNA, 22 bp, Artificial Sequence
  chemically synthesized
ggtaaataaaagtcctgggagt

SEQ ID NO: 857235 - DNA, 22 bp, Artificial Sequence
  chemically synthesized
gtaaataaaagtcctgggagta

SEQ ID NO: 857236 - DNA, 22 bp, Artificial Sequence
  chemically synthesized
caataccatattgagttatata

SEQ ID NO: 857237 - DNA, 22 bp, Artificial Sequence
  chemically synthesized
acaataccatattgagttatat

SEQ ID NO: 857238 - DNA, 22 bp, Artificial Sequence
  chemically synthesized
tacaataccatattgagttata

SEQ ID NO: 857239 - DNA, 22 bp, Artificial Sequence
  chemically synthesized
ttacaataccatattgagttat

SEQ ID NO: 857240 - DNA, 22 bp, Artificial Sequence
  chemically synthesized
ggagtattatataactcaatat

SEQ ID NO: 857241 - DNA, 22 bp, Artificial Sequence
  chemically synthesized
ttttacaataccatattgagtt

SEQ ID NO: 857242 - DNA, 22 bp, Artificial Sequence
  chemically synthesized
tataactcaatatggtattgta

SEQ ID NO: 857243 - DNA, 22 bp, Artificial Sequence
  chemically synthesized
aatatggtattgtaaaagaacg

SEQ ID NO: 857244 - DNA, 22 bp, Artificial Sequence
  chemically synthesized
atacatacagaaacaagaggta

SEQ ID NO: 857245 - DNA, 22 bp, Artificial Sequence
  chemically synthesized
taaaagaacgtacctcttgttt

SEQ ID NO: 857246 - DNA, 22 bp, Artificial Sequence
  chemically synthesized
tgtactgatacatacagaaaca

SEQ ID NO: 857247 - DNA, 22 bp, Artificial Sequence
  chemically synthesized
ctatgtactgatacatacagaa

SEQ ID NO: 857248 - DNA, 22 bp, Artificial Sequence
  chemically synthesized
tggttgctatgtactgatacat

SEQ ID NO: 857249 - DNA, 22 bp, Artificial Sequence
  chemically synthesized
atggttgctatgtactgataca

SEQ ID NO: 857250 - DNA, 22 bp, Artificial Sequence
  chemically synthesized
ttgtttctgtatgtatcagtac

SEQ ID NO: 857251 - DNA, 22 bp, Artificial Sequence
  chemically synthesized
tatggttgctatgtactgatac

SEQ ID NO: 857252 - DNA, 22 bp, Artificial Sequence
  chemically synthesized
gtttctgtatgtatcagtacat

SEQ ID NO: 857253 - DNA, 22 bp, Artificial Sequence
  chemically synthesized
tttctgtatgtatcagtacata

SEQ ID NO: 857254 - DNA, 22 bp, Artificial Sequence
  chemically synthesized
ctgtatgtatcagtacatagca

SEQ ID NO: 857255 - DNA, 22 bp, Artificial Sequence
  chemically synthesized
tgtatgtatcagtacatagcaa

SEQ ID NO: 857256 - DNA, 22 bp, Artificial Sequence
  chemically synthesized
agcattttatggttgctatgta

SEQ ID NO: 857257 - DNA, 22 bp, Artificial Sequence
  chemically synthesized
tatgtatcagtacatagcaacc

SEQ ID NO: 857258 - DNA, 22 bp, Artificial Sequence
  chemically synthesized
tgctgagcattttatggttgct

SEQ ID NO: 857259 - DNA, 22 bp, Artificial Sequence
  chemically synthesized
tgtcagacactatgctgagcat

SEQ ID NO: 857260 - DNA, 22 bp, Artificial Sequence
  chemically synthesized
agcatagtgtctgacatagact

SEQ ID NO: 857261 - DNA, 22 bp, Artificial Sequence
  chemically synthesized
tatgtagatgtagatgtagtct

SEQ ID NO: 857262 - DNA, 22 bp, Artificial Sequence
  chemically synthesized
gtatgtagatgtagatgtagtc

SEQ ID NO: 857263 - DNA, 22 bp, Artificial Sequence
  chemically synthesized
acatagactacatctacatcta

SEQ ID NO: 857264 - DNA, 22 bp, Artificial Sequence
  chemically synthesized
gtgatttgtatgtagatgtaga

SEQ ID NO: 857265 - DNA, 22 bp, Artificial Sequence
  chemically synthesized
agtgatttgtatgtagatgtag

SEQ ID NO: 857266 - DNA, 22 bp, Artificial Sequence
  chemically synthesized
tttagtgatttgtatgtagatg

SEQ ID NO: 857267 - DNA, 22 bp, Artificial Sequence
  chemically synthesized
ctatttagtgatttgtatgtag

SEQ ID NO: 857268 - DNA, 22 bp, Artificial Sequence
  chemically synthesized
catctacatctacatacaaatc

SEQ ID NO: 857269 - DNA, 22 bp, Artificial Sequence
  chemically synthesized
cagttactatttagtgatttgt

SEQ ID NO: 857270 - DNA, 22 bp, Artificial Sequence
  chemically synthesized
catctacatacaaatcactaaa

SEQ ID NO: 857271 - DNA, 22 bp, Artificial Sequence
  chemically synthesized
taactgcagttactatttagtg

SEQ ID NO: 857272 - DNA, 22 bp, Artificial Sequence
  chemically synthesized
catacaaatcactaaatagtaa

SEQ ID NO: 857273 - DNA, 22 bp, Artificial Sequence
  chemically synthesized
cggtaataactgtaactgcagt

SEQ ID NO: 857274 - DNA, 22 bp, Artificial Sequence
  chemically synthesized
ctgcggtaataactgtaactgc

SEQ ID NO: 857275 - DNA, 22 bp, Artificial Sequence
  chemically synthesized
aatagtaactgcagttacagtt

SEQ ID NO: 857276 - DNA, 22 bp, Artificial Sequence
  chemically synthesized
ttgctgcggtaataactgtaac

SEQ ID NO: 857277 - DNA, 22 bp, Artificial Sequence
  chemically synthesized
cagttacagttattaccgcagc

SEQ ID NO: 857278 - DNA, 22 bp, Artificial Sequence
  chemically synthesized
cagttattaccgcagcaatagt

SEQ ID NO: 857279 - DNA, 22 bp, Artificial Sequence
  chemically synthesized
caagcaatacatactattgctg

SEQ ID NO: 857280 - DNA, 22 bp, Artificial Sequence
  chemically synthesized
ttaccgcagcaatagtatgtat

SEQ ID NO: 857281 - DNA, 22 bp, Artificial Sequence
  chemically synthesized
ccgcagcaatagtatgtattgc

SEQ ID NO: 857282 - DNA, 22 bp, Artificial Sequence
  chemically synthesized
cttgcagtacatatattacttg

SEQ ID NO: 857283 - DNA, 22 bp, Artificial Sequence
  chemically synthesized
gcagtacatatattacttgcta

SEQ ID NO: 857284 - DNA, 22 bp, Artificial Sequence
  chemically synthesized
cagtacatatattacttgctac

SEQ ID NO: 857285 - DNA, 22 bp, Artificial Sequence
  chemically synthesized
cagagagtatacgtagcaagta

SEQ ID NO: 857286 - DNA, 22 bp, Artificial Sequence
  chemically synthesized
ctgcagagagtatacgtagcaa

SEQ ID NO: 857287 - DNA, 22 bp, Artificial Sequence
  chemically synthesized
ctactgcagagagtatacgtag

SEQ ID NO: 857288 - DNA, 22 bp, Artificial Sequence
  chemically synthesized
gctactgcagagagtatacgta

SEQ ID NO: 857289 - DNA, 22 bp, Artificial Sequence
  chemically synthesized
cttgctactgcagagagtatac

SEQ ID NO: 857290 - DNA, 22 bp, Artificial Sequence
  chemically synthesized
ttacttgctactgcagagagta

SEQ ID NO: 857291 - DNA, 22 bp, Artificial Sequence
  chemically synthesized
cttgctacgtatactctctgca

SEQ ID NO: 857292 - DNA, 22 bp, Artificial Sequence
  chemically synthesized
gctacgtatactctctgcagta

SEQ ID NO: 857293 - DNA, 22 bp, Artificial Sequence
  chemically synthesized
ctacgtatactctctgcagtag

SEQ ID NO: 857294 - DNA, 22 bp, Artificial Sequence
  chemically synthesized
tgttattacttgctactgcaga

SEQ ID NO: 857295 - DNA, 22 bp, Artificial Sequence
  chemically synthesized
gtgttattacttgctactgcag

SEQ ID NO: 857296 - DNA, 22 bp, Artificial Sequence
  chemically synthesized
cgtatactctctgcagtagcaa

SEQ ID NO: 857297 - DNA, 22 bp, Artificial Sequence
  chemically synthesized
agcttgtgttattacttgctac

SEQ ID NO: 857298 - DNA, 22 bp, Artificial Sequence
  chemically synthesized
ctaagcttgtgttattacttgc

SEQ ID NO: 857299 - DNA, 22 bp, Artificial Sequence
  chemically synthesized
tctgcagtagcaagtaataaca

SEQ ID NO: 857300 - DNA, 22 bp, Artificial Sequence
  chemically synthesized
attcctaagcttgtgttattac

SEQ ID NO: 857301 - DNA, 22 bp, Artificial Sequence
  chemically synthesized
tgcagtagcaagtaataacaca

SEQ ID NO: 857302 - DNA, 22 bp, Artificial Sequence
  chemically synthesized
gattcctaagcttgtgttatta

SEQ ID NO: 857303 - DNA, 22 bp, Artificial Sequence
  chemically synthesized
cagtagcaagtaataacacaag

SEQ ID NO: 857304 - DNA, 22 bp, Artificial Sequence
  chemically synthesized
aaatccaagtccatttgattcc

SEQ ID NO: 857305 - DNA, 22 bp, Artificial Sequence
  chemically synthesized
aggaatcaaatggacttggatt

SEQ ID NO: 857306 - DNA, 22 bp, Artificial Sequence
  chemically synthesized
ggaatcaaatggacttggattt

SEQ ID NO: 857307 - DNA, 22 bp, Artificial Sequence
  chemically synthesized
ccagtaagtagcagaacaagga

SEQ ID NO: 857308 - DNA, 22 bp, Artificial Sequence
  chemically synthesized
ggatttgaatccttgttctgct

SEQ ID NO: 857309 - DNA, 22 bp, Artificial Sequence
  chemically synthesized
gatttgaatccttgttctgcta

SEQ ID NO: 857310 - DNA, 22 bp, Artificial Sequence
  chemically synthesized
gaatccttgttctgctacttac

SEQ ID NO: 857311 - DNA, 22 bp, Artificial Sequence
  chemically synthesized
aatccttgttctgctacttact

SEQ ID NO: 857312 - DNA, 22 bp, Artificial Sequence
  chemically synthesized
atagatgtcaaattcccagtaa

SEQ ID NO: 857313 - DNA, 22 bp, Artificial Sequence
  chemically synthesized
gttctgctacttactgggaatt

SEQ ID NO: 857314 - DNA, 22 bp, Artificial Sequence
  chemically synthesized
ttctgctacttactgggaattt

SEQ ID NO: 857315 - DNA, 22 bp, Artificial Sequence
  chemically synthesized
tgctacttactgggaatttgac

SEQ ID NO: 857316 - DNA, 22 bp, Artificial Sequence
  chemically synthesized
aggctcatagatgtcaaattcc

SEQ ID NO: 857317 - DNA, 22 bp, Artificial Sequence
  chemically synthesized
ctacttactgggaatttgacat

SEQ ID NO: 857318 - DNA, 22 bp, Artificial Sequence
  chemically synthesized
cttactgggaatttgacatcta

SEQ ID NO: 857319 - DNA, 22 bp, Artificial Sequence
  chemically synthesized
actgggaatttgacatctatga

SEQ ID NO: 857320 - DNA, 22 bp, Artificial Sequence
  chemically synthesized
ctgggaatttgacatctatgag

SEQ ID NO: 857321 - DNA, 22 bp, Artificial Sequence
  chemically synthesized
ggaatttgacatctatgagcct

SEQ ID NO: 857322 - DNA, 22 bp, Artificial Sequence
  chemically synthesized
agaaaaagtaactgaggctcat

SEQ ID NO: 857323 - DNA, 22 bp, Artificial Sequence
  chemically synthesized
cagaaaaagtaactgaggctca

SEQ ID NO: 857324 - DNA, 22 bp, Artificial Sequence
  chemically synthesized
tcagaaaaagtaactgaggctc

SEQ ID NO: 857325 - DNA, 22 bp, Artificial Sequence
  chemically synthesized
ttcagaaaaagtaactgaggct

SEQ ID NO: 857326 - DNA, 22 bp, Artificial Sequence
  chemically synthesized
gacatctatgagcctcagttac

SEQ ID NO: 857327 - DNA, 22 bp, Artificial Sequence
  chemically synthesized
acatctatgagcctcagttact

SEQ ID NO: 857328 - DNA, 22 bp, Artificial Sequence
  chemically synthesized
tgagcctcagttactttttctg

SEQ ID NO: 857329 - DNA, 22 bp, Artificial Sequence
  chemically synthesized
tagccacatttttcagaaaaag

SEQ ID NO: 857330 - DNA, 22 bp, Artificial Sequence
  chemically synthesized
agttactttttctgaaaaatgt

SEQ ID NO: 857331 - DNA, 22 bp, Artificial Sequence
  chemically synthesized
ctttttctgaaaaatgtggcta

SEQ ID NO: 857332 - DNA, 22 bp, Artificial Sequence
  chemically synthesized
aaaaaagtaattatagccacat

SEQ ID NO: 857333 - DNA, 22 bp, Artificial Sequence
  chemically synthesized
aaaaaaagtaattatagccaca

SEQ ID NO: 857334 - DNA, 22 bp, Artificial Sequence
  chemically synthesized
tttctgaaaaatgtggctataa

SEQ ID NO: 857335 - DNA, 22 bp, Artificial Sequence
  chemically synthesized
taaaaaaagtaattatagccac

SEQ ID NO: 857336 - DNA, 22 bp, Artificial Sequence
  chemically synthesized
ttctgaaaaatgtggctataat

SEQ ID NO: 857337 - DNA, 22 bp, Artificial Sequence
  chemically synthesized
tctgaaaaatgtggctataatt

SEQ ID NO: 857338 - DNA, 22 bp, Artificial Sequence
  chemically synthesized
ctgaaaaatgtggctataatta

SEQ ID NO: 857339 - DNA, 22 bp, Artificial Sequence
  chemically synthesized
ctttaaaaaaagtaattatagc

SEQ ID NO: 857340 - DNA, 22 bp, Artificial Sequence
  chemically synthesized
tgaaaaatgtggctataattac

SEQ ID NO: 857341 - DNA, 22 bp, Artificial Sequence
  chemically synthesized
tgctttaaaaaaagtaattata

SEQ ID NO: 857342 - DNA, 22 bp, Artificial Sequence
  chemically synthesized
aaaaatgtggctataattactt

SEQ ID NO: 857343 - DNA, 22 bp, Artificial Sequence
  chemically synthesized
ctgctttaaaaaaagtaattat

SEQ ID NO: 857344 - DNA, 22 bp, Artificial Sequence
  chemically synthesized
cttctgctttaaaaaaagtaat

SEQ ID NO: 857345 - DNA, 22 bp, Artificial Sequence
  chemically synthesized
acttctgctttaaaaaaagtaa

SEQ ID NO: 857346 - DNA, 22 bp, Artificial Sequence
  chemically synthesized
tacttctgctttaaaaaaagta

SEQ ID NO: 857347 - DNA, 22 bp, Artificial Sequence
  chemically synthesized
ttttacttctgctttaaaaaaa

SEQ ID NO: 857348 - DNA, 22 bp, Artificial Sequence
  chemically synthesized
gttttacttctgctttaaaaaa

SEQ ID NO: 857349 - DNA, 22 bp, Artificial Sequence
  chemically synthesized
taattactttttttaaagcaga

SEQ ID NO: 857350 - DNA, 22 bp, Artificial Sequence
  chemically synthesized
aaatttgttttacttctgcttt

SEQ ID NO: 857351 - DNA, 22 bp, Artificial Sequence
  chemically synthesized
ctttttttaaagcagaagtaaa

SEQ ID NO: 857352 - DNA, 22 bp, Artificial Sequence
  chemically synthesized
tttttaaagcagaagtaaaaca

SEQ ID NO: 857353 - DNA, 22 bp, Artificial Sequence
  chemically synthesized
ttttaaagcagaagtaaaacaa

SEQ ID NO: 857354 - DNA, 22 bp, Artificial Sequence
  chemically synthesized
tttaaagcagaagtaaaacaaa

SEQ ID NO: 857355 - DNA, 22 bp, Artificial Sequence
  chemically synthesized
ttaaagcagaagtaaaacaaat

SEQ ID NO: 857356 - DNA, 22 bp, Artificial Sequence
  chemically synthesized
taaagcagaagtaaaacaaatt

SEQ ID NO: 857357 - DNA, 22 bp, Artificial Sequence
  chemically synthesized
aaagcagaagtaaaacaaattt

SEQ ID NO: 857358 - DNA, 22 bp, Artificial Sequence
  chemically synthesized
aagcagaagtaaaacaaatttt

SEQ ID NO: 857359 - DNA, 22 bp, Artificial Sequence
  chemically synthesized
catatatgtacctaaaatttgt

SEQ ID NO: 857360 - DNA, 22 bp, Artificial Sequence
  chemically synthesized
taggtacatatatgtagtattt

SEQ ID NO: 857361 - DNA, 22 bp, Artificial Sequence
  chemically synthesized
aggtacatatatgtagtattta

SEQ ID NO: 857362 - DNA, 22 bp, Artificial Sequence
  chemically synthesized
ggtacatatatgtagtatttac

SEQ ID NO: 857363 - DNA, 22 bp, Artificial Sequence
  chemically synthesized
tggatatggatgtatataaata

SEQ ID NO: 857364 - DNA, 22 bp, Artificial Sequence
  chemically synthesized
acatatatttatatacatccat

SEQ ID NO: 857365 - DNA, 22 bp, Artificial Sequence
  chemically synthesized
catatatttatatacatccata

SEQ ID NO: 857366 - DNA, 22 bp, Artificial Sequence
  chemically synthesized
acaatatagttatggatatgga

SEQ ID NO: 857367 - DNA, 22 bp, Artificial Sequence
  chemically synthesized
atatacatccatatccataact

SEQ ID NO: 857368 - DNA, 22 bp, Artificial Sequence
  chemically synthesized
tatacatccatatccataacta

SEQ ID NO: 857369 - DNA, 22 bp, Artificial Sequence
  chemically synthesized
acattcacaatatagttatgga

SEQ ID NO: 857370 - DNA, 22 bp, Artificial Sequence
  chemically synthesized
tattgtgaatgtgaatgtgtac

SEQ ID NO: 857371 - DNA, 22 bp, Artificial Sequence
  chemically synthesized
tgaatgtgaatgtgtactctgt

SEQ ID NO: 857372 - DNA, 22 bp, Artificial Sequence
  chemically synthesized
agtacagagcatacagagtaca

SEQ ID NO: 857373 - DNA, 22 bp, Artificial Sequence
  chemically synthesized
tgagtacagagcatacagagta

SEQ ID NO: 857374 - DNA, 22 bp, Artificial Sequence
  chemically synthesized
ttctgagtacagagcatacaga

SEQ ID NO: 857375 - DNA, 22 bp, Artificial Sequence
  chemically synthesized
ctattctgagtacagagcatac

SEQ ID NO: 857376 - DNA, 22 bp, Artificial Sequence
  chemically synthesized
cctattctgagtacagagcata

SEQ ID NO: 857377 - DNA, 22 bp, Artificial Sequence
  chemically synthesized
gtttcctattctgagtacagag

SEQ ID NO: 857378 - DNA, 22 bp, Artificial Sequence
  chemically synthesized
cgtttcctattctgagtacaga

SEQ ID NO: 857379 - DNA, 22 bp, Artificial Sequence
  chemically synthesized
tgtatgctctgtactcagaata

SEQ ID NO: 857380 - DNA, 22 bp, Artificial Sequence
  chemically synthesized
gatcttcgtttcctattctgag

SEQ ID NO: 857381 - DNA, 22 bp, Artificial Sequence
  chemically synthesized
tatgctctgtactcagaatagg

SEQ ID NO: 857382 - DNA, 22 bp, Artificial Sequence
  chemically synthesized
tggatcttcgtttcctattctg

SEQ ID NO: 857383 - DNA, 22 bp, Artificial Sequence
  chemically synthesized
tgtactcagaataggaaacgaa

SEQ ID NO: 857384 - DNA, 22 bp, Artificial Sequence
  chemically synthesized
tactcagaataggaaacgaaga

SEQ ID NO: 857385 - DNA, 22 bp, Artificial Sequence
  chemically synthesized
agaataggaaacgaagatccag

SEQ ID NO: 857386 - DNA, 22 bp, Artificial Sequence
  chemically synthesized
tggtcaagccatctctggatct

SEQ ID NO: 857387 - DNA, 22 bp, Artificial Sequence
  chemically synthesized
caaatgatgattgtggtcaagc

SEQ ID NO: 857388 - DNA, 22 bp, Artificial Sequence
  chemically synthesized
gcaaatgatgattgtggtcaag

SEQ ID NO: 857389 - DNA, 22 bp, Artificial Sequence
  chemically synthesized
agtgccatttgcaaatgatgat

SEQ ID NO: 857390 - DNA, 22 bp, Artificial Sequence
  chemically synthesized
gaccacaatcatcatttgcaaa

SEQ ID NO: 857391 - DNA, 22 bp, Artificial Sequence
  chemically synthesized
aattcagtgccatttgcaaatg

SEQ ID NO: 857392 - DNA, 22 bp, Artificial Sequence
  chemically synthesized
accacaatcatcatttgcaaat

SEQ ID NO: 857393 - DNA, 22 bp, Artificial Sequence
  chemically synthesized
aatacagaagacctgaattcag

SEQ ID NO: 857394 - DNA, 22 bp, Artificial Sequence
  chemically synthesized
gaatacagaagacctgaattca

SEQ ID NO: 857395 - DNA, 22 bp, Artificial Sequence
  chemically synthesized
gcaaatggcactgaattcaggt

SEQ ID NO: 857396 - DNA, 22 bp, Artificial Sequence
  chemically synthesized
caaatggcactgaattcaggtc

SEQ ID NO: 857397 - DNA, 22 bp, Artificial Sequence
  chemically synthesized
agcttgaatacagaagacctga

SEQ ID NO: 857398 - DNA, 22 bp, Artificial Sequence
  chemically synthesized
gagcttgaatacagaagacctg

SEQ ID NO: 857399 - DNA, 22 bp, Artificial Sequence
  chemically synthesized
aattcaggtcttctgtattcaa

SEQ ID NO: 857400 - DNA, 22 bp, Artificial Sequence
  chemically synthesized
aaggccttgagcttgaatacag

SEQ ID NO: 857401 - DNA, 22 bp, Artificial Sequence
  chemically synthesized
aaaggccttgagcttgaataca

SEQ ID NO: 857402 - DNA, 22 bp, Artificial Sequence
  chemically synthesized
aggtcttctgtattcaagctca

SEQ ID NO: 857403 - DNA, 22 bp, Artificial Sequence
  chemically synthesized
catttaaaggccttgagcttga

SEQ ID NO: 857404 - DNA, 22 bp, Artificial Sequence
  chemically synthesized
ctgtattcaagctcaaggcctt

SEQ ID NO: 857405 - DNA, 22 bp, Artificial Sequence
  chemically synthesized
tgtattcaagctcaaggccttt

SEQ ID NO: 857406 - DNA, 22 bp, Artificial Sequence
  chemically synthesized
tattcaagctcaaggcctttaa

SEQ ID NO: 857407 - DNA, 22 bp, Artificial Sequence
  chemically synthesized
aagctcaaggcctttaaatgca

SEQ ID NO: 857408 - DNA, 22 bp, Artificial Sequence
  chemically synthesized
atagtaaacaacctgcatttaa

SEQ ID NO: 857409 - DNA, 22 bp, Artificial Sequence
  chemically synthesized
gatagtaaacaacctgcattta

SEQ ID NO: 857410 - DNA, 22 bp, Artificial Sequence
  chemically synthesized
aaggcctttaaatgcaggttgt

SEQ ID NO: 857411 - DNA, 22 bp, Artificial Sequence
  chemically synthesized
taaatgcaggttgtttactatc

SEQ ID NO: 857412 - DNA, 22 bp, Artificial Sequence
  chemically synthesized
aaatgcaggttgtttactatca

SEQ ID NO: 857413 - DNA, 22 bp, Artificial Sequence
  chemically synthesized
aatgcaggttgtttactatcaa

SEQ ID NO: 857414 - DNA, 22 bp, Artificial Sequence
  chemically synthesized
cataggaataaaagtaatttga

SEQ ID NO: 857415 - DNA, 22 bp, Artificial Sequence
  chemically synthesized
tttactatcaaattacttttat

SEQ ID NO: 857416 - DNA, 22 bp, Artificial Sequence
  chemically synthesized
actatcaaattacttttattcc

SEQ ID NO: 857417 - DNA, 22 bp, Artificial Sequence
  chemically synthesized
accaattccataggaataaaag

SEQ ID NO: 857418 - DNA, 22 bp, Artificial Sequence
  chemically synthesized
ctatcaaattacttttattcct

SEQ ID NO: 857419 - DNA, 22 bp, Artificial Sequence
  chemically synthesized
caccaattccataggaataaaa

SEQ ID NO: 857420 - DNA, 22 bp, Artificial Sequence
  chemically synthesized
tcaaattacttttattcctatg

SEQ ID NO: 857421 - DNA, 22 bp, Artificial Sequence
  chemically synthesized
cttttattcctatggaattggt

SEQ ID NO: 857422 - DNA, 22 bp, Artificial Sequence
  chemically synthesized
taaaataaacttcaccaattcc

SEQ ID NO: 857423 - DNA, 22 bp, Artificial Sequence
  chemically synthesized
gtaaaataaacttcaccaattc

SEQ ID NO: 857424 - DNA, 22 bp, Artificial Sequence
  chemically synthesized
ttattcctatggaattggtgaa

SEQ ID NO: 857425 - DNA, 22 bp, Artificial Sequence
  chemically synthesized
tgtaaaataaacttcaccaatt

SEQ ID NO: 857426 - DNA, 22 bp, Artificial Sequence
  chemically synthesized
tattcctatggaattggtgaag

SEQ ID NO: 857427 - DNA, 22 bp, Artificial Sequence
  chemically synthesized
attcctatggaattggtgaagt

SEQ ID NO: 857428 - DNA, 22 bp, Artificial Sequence
  chemically synthesized
tttgtaaaataaacttcaccaa

SEQ ID NO: 857429 - DNA, 22 bp, Artificial Sequence
  chemically synthesized
ttcctatggaattggtgaagtt

SEQ ID NO: 857430 - DNA, 22 bp, Artificial Sequence
  chemically synthesized
ctttgtaaaataaacttcacca

SEQ ID NO: 857431 - DNA, 22 bp, Artificial Sequence
  chemically synthesized
ctatggaattggtgaagtttat

SEQ ID NO: 857432 - DNA, 22 bp, Artificial Sequence
  chemically synthesized
tggaattggtgaagtttatttt

SEQ ID NO: 857433 - DNA, 22 bp, Artificial Sequence
  chemically synthesized
gtgaagtttattttacaaagaa

SEQ ID NO: 857434 - DNA, 22 bp, Artificial Sequence
  chemically synthesized
attttacaaagaaattcccctt

SEQ ID NO: 857435 - DNA, 22 bp, Artificial Sequence
  chemically synthesized
ttttacaaagaaattcccctta

SEQ ID NO: 857436 - DNA, 22 bp, Artificial Sequence
  chemically synthesized
tacaaagaaattccccttactc

SEQ ID NO: 857437 - DNA, 22 bp, Artificial Sequence
  chemically synthesized
acaaagaaattccccttactct

SEQ ID NO: 857438 - DNA, 22 bp, Artificial Sequence
  chemically synthesized
caaagaaattccccttactctg

SEQ ID NO: 857439 - DNA, 22 bp, Artificial Sequence
  chemically synthesized
aaaaaacaagaagtgaggcaga

SEQ ID NO: 857440 - DNA, 22 bp, Artificial Sequence
  chemically synthesized
cccttactctgtctgcctcact

SEQ ID NO: 857441 - DNA, 22 bp, Artificial Sequence
  chemically synthesized
gaaaaaacaagaagtgaggcag

SEQ ID NO: 857442 - DNA, 22 bp, Artificial Sequence
  chemically synthesized
tgaaaaaacaagaagtgaggca

SEQ ID NO: 857443 - DNA, 22 bp, Artificial Sequence
  chemically synthesized
ttgaaaaaacaagaagtgaggc

SEQ ID NO: 857444 - DNA, 22 bp, Artificial Sequence
  chemically synthesized
actctgtctgcctcacttcttg

SEQ ID NO: 857445 - DNA, 22 bp, Artificial Sequence
  chemically synthesized
ctctgtctgcctcacttcttgt

SEQ ID NO: 857446 - DNA, 22 bp, Artificial Sequence
  chemically synthesized
ccttttgaaaaaacaagaagtg

SEQ ID NO: 857447 - DNA, 22 bp, Artificial Sequence
  chemically synthesized
tgtctgcctcacttcttgtttt

SEQ ID NO: 857448 - DNA, 22 bp, Artificial Sequence
  chemically synthesized
tctgcctcacttcttgtttttt

SEQ ID NO: 857449 - DNA, 22 bp, Artificial Sequence
  chemically synthesized
aagtactaccttttgaaaaaac

SEQ ID NO: 857450 - DNA, 22 bp, Artificial Sequence
  chemically synthesized
cctcacttcttgttttttcaaa

SEQ ID NO: 857451 - DNA, 22 bp, Artificial Sequence
  chemically synthesized
acttcttgttttttcaaaaggt

SEQ ID NO: 857452 - DNA, 22 bp, Artificial Sequence
  chemically synthesized
ggtattaaagtactaccttttg

SEQ ID NO: 857453 - DNA, 22 bp, Artificial Sequence
  chemically synthesized
aggtattaaagtactacctttt

SEQ ID NO: 857454 - DNA, 22 bp, Artificial Sequence
  chemically synthesized
cttgttttttcaaaaggtagta

SEQ ID NO: 857455 - DNA, 22 bp, Artificial Sequence
  chemically synthesized
ttgttttttcaaaaggtagtac

SEQ ID NO: 857456 - DNA, 22 bp, Artificial Sequence
  chemically synthesized
gttttttcaaaaggtagtactt

SEQ ID NO: 857457 - DNA, 22 bp, Artificial Sequence
  chemically synthesized
ttttttcaaaaggtagtacttt

SEQ ID NO: 857458 - DNA, 22 bp, Artificial Sequence
  chemically synthesized
tttcaaaaggtagtactttaat

SEQ ID NO: 857459 - DNA, 22 bp, Artificial Sequence
  chemically synthesized
ttcaaaaggtagtactttaata

SEQ ID NO: 857460 - DNA, 22 bp, Artificial Sequence
  chemically synthesized
aaggtatttaggtattaaagta

SEQ ID NO: 857461 - DNA, 22 bp, Artificial Sequence
  chemically synthesized
tcaaaaggtagtactttaatac

SEQ ID NO: 857462 - DNA, 22 bp, Artificial Sequence
  chemically synthesized
caaaaggtagtactttaatacc

SEQ ID NO: 857463 - DNA, 22 bp, Artificial Sequence
  chemically synthesized
aaaaggtagtactttaatacct

SEQ ID NO: 857464 - DNA, 22 bp, Artificial Sequence
  chemically synthesized
tgctgaaggtatttaggtatta

SEQ ID NO: 857465 - DNA, 22 bp, Artificial Sequence
  chemically synthesized
taatacctaaataccttcagca

SEQ ID NO: 857466 - DNA, 22 bp, Artificial Sequence
  chemically synthesized
aatacctaaataccttcagcac

SEQ ID NO: 857467 - DNA, 22 bp, Artificial Sequence
  chemically synthesized
atacctaaataccttcagcaca

SEQ ID NO: 857468 - DNA, 22 bp, Artificial Sequence
  chemically synthesized
aagaaatacaaagttgtgctga

SEQ ID NO: 857469 - DNA, 22 bp, Artificial Sequence
  chemically synthesized
taaagaaatacaaagttgtgct

SEQ ID NO: 857470 - DNA, 22 bp, Artificial Sequence
  chemically synthesized
ctaaagaaatacaaagttgtgc

SEQ ID NO: 857471 - DNA, 22 bp, Artificial Sequence
  chemically synthesized
tctaaagaaatacaaagttgtg

SEQ ID NO: 857472 - DNA, 22 bp, Artificial Sequence
  chemically synthesized
aataccttcagcacaactttgt

SEQ ID NO: 857473 - DNA, 22 bp, Artificial Sequence
  chemically synthesized
aagcctttctaaagaaatacaa

SEQ ID NO: 857474 - DNA, 22 bp, Artificial Sequence
  chemically synthesized
caagcctttctaaagaaataca

SEQ ID NO: 857475 - DNA, 22 bp, Artificial Sequence
  chemically synthesized
cagcacaactttgtatttcttt

SEQ ID NO: 857476 - DNA, 22 bp, Artificial Sequence
  chemically synthesized
tcaagcctttctaaagaaatac

SEQ ID NO: 857477 - DNA, 22 bp, Artificial Sequence
  chemically synthesized
agcacaactttgtatttcttta

SEQ ID NO: 857478 - DNA, 22 bp, Artificial Sequence
  chemically synthesized
taacagctttcaagcctttcta

SEQ ID NO: 857479 - DNA, 22 bp, Artificial Sequence
  chemically synthesized
gtaacagctttcaagcctttct

SEQ ID NO: 857480 - DNA, 22 bp, Artificial Sequence
  chemically synthesized
tgtatttctttagaaaggcttg

SEQ ID NO: 857481 - DNA, 22 bp, Artificial Sequence
  chemically synthesized
gtatttctttagaaaggcttga

SEQ ID NO: 857482 - DNA, 22 bp, Artificial Sequence
  chemically synthesized
tatttctttagaaaggcttgaa

SEQ ID NO: 857483 - DNA, 22 bp, Artificial Sequence
  chemically synthesized
acttgtaacagctttcaagcct

SEQ ID NO: 857484 - DNA, 22 bp, Artificial Sequence
  chemically synthesized
cacttgtaacagctttcaagcc

SEQ ID NO: 857485 - DNA, 22 bp, Artificial Sequence
  chemically synthesized
tcacttgtaacagctttcaagc

SEQ ID NO: 857486 - DNA, 22 bp, Artificial Sequence
  chemically synthesized
ttcacttgtaacagctttcaag

SEQ ID NO: 857487 - DNA, 22 bp, Artificial Sequence
  chemically synthesized
ctttagaaaggcttgaaagctg

SEQ ID NO: 857488 - DNA, 22 bp, Artificial Sequence
  chemically synthesized
tttcacttgtaacagctttcaa

SEQ ID NO: 857489 - DNA, 22 bp, Artificial Sequence
  chemically synthesized
tttagaaaggcttgaaagctgt

SEQ ID NO: 857490 - DNA, 22 bp, Artificial Sequence
  chemically synthesized
tagaaaggcttgaaagctgtta

SEQ ID NO: 857491 - DNA, 22 bp, Artificial Sequence
  chemically synthesized
agaaaggcttgaaagctgttac

SEQ ID NO: 857492 - DNA, 22 bp, Artificial Sequence
  chemically synthesized
gaaaggcttgaaagctgttaca

SEQ ID NO: 857493 - DNA, 22 bp, Artificial Sequence
  chemically synthesized
aagttttttcacttgtaacagc

SEQ ID NO: 857494 - DNA, 22 bp, Artificial Sequence
  chemically synthesized
tacattaaagttttttcacttg

SEQ ID NO: 857495 - DNA, 22 bp, Artificial Sequence
  chemically synthesized
gaaagctgttacaagtgaaaaa

SEQ ID NO: 857496 - DNA, 22 bp, Artificial Sequence
  chemically synthesized
aaagctgttacaagtgaaaaaa

SEQ ID NO: 857497 - DNA, 22 bp, Artificial Sequence
  chemically synthesized
ttatacattaaagttttttcac

SEQ ID NO: 857498 - DNA, 22 bp, Artificial Sequence
  chemically synthesized
ttacaagtgaaaaaactttaat

SEQ ID NO: 857499 - DNA, 22 bp, Artificial Sequence
  chemically synthesized
gaattgttatacattaaagttt

SEQ ID NO: 857500 - DNA, 22 bp, Artificial Sequence
  chemically synthesized
caagtgaaaaaactttaatgta

SEQ ID NO: 857501 - DNA, 22 bp, Artificial Sequence
  chemically synthesized
agaaaaataatgttggaattgt

SEQ ID NO: 857502 - DNA, 22 bp, Artificial Sequence
  chemically synthesized
taatgtataacaattccaacat

SEQ ID NO: 857503 - DNA, 22 bp, Artificial Sequence
  chemically synthesized
aatgtataacaattccaacatt

SEQ ID NO: 857504 - DNA, 22 bp, Artificial Sequence
  chemically synthesized
atgtataacaattccaacatta

SEQ ID NO: 857505 - DNA, 22 bp, Artificial Sequence
  chemically synthesized
tgaatgattaagaaaaataatg

SEQ ID NO: 857506 - DNA, 22 bp, Artificial Sequence
  chemically synthesized
gtgaatgattaagaaaaataat

SEQ ID NO: 857507 - DNA, 22 bp, Artificial Sequence
  chemically synthesized
tatttgtgaatgattaagaaaa

SEQ ID NO: 857508 - DNA, 22 bp, Artificial Sequence
  chemically synthesized
atatttgtgaatgattaagaaa

SEQ ID NO: 857509 - DNA, 22 bp, Artificial Sequence
  chemically synthesized
tatatttgtgaatgattaagaa

SEQ ID NO: 857510 - DNA, 22 bp, Artificial Sequence
  chemically synthesized
caacattatttttcttaatcat

SEQ ID NO: 857511 - DNA, 22 bp, Artificial Sequence
  chemically synthesized
ttatatttgtgaatgattaaga

SEQ ID NO: 857512 - DNA, 22 bp, Artificial Sequence
  chemically synthesized
tttttcttaatcattcacaaat

SEQ ID NO: 857513 - DNA, 22 bp, Artificial Sequence
  chemically synthesized
tatatcttttatatttgtgaat

SEQ ID NO: 857514 - DNA, 22 bp, Artificial Sequence
  chemically synthesized
ttcttaatcattcacaaatata

SEQ ID NO: 857515 - DNA, 22 bp, Artificial Sequence
  chemically synthesized
tcttaatcattcacaaatataa

SEQ ID NO: 857516 - DNA, 22 bp, Artificial Sequence
  chemically synthesized
cttaatcattcacaaatataaa

SEQ ID NO: 857517 - DNA, 22 bp, Artificial Sequence
  chemically synthesized
ttaatcattcacaaatataaaa

SEQ ID NO: 857518 - DNA, 22 bp, Artificial Sequence
  chemically synthesized
aatcattcacaaatataaaaga

SEQ ID NO: 857519 - DNA, 22 bp, Artificial Sequence
  chemically synthesized
atcattcacaaatataaaagat

SEQ ID NO: 857520 - DNA, 22 bp, Artificial Sequence
  chemically synthesized
gatcaaatatactatatatctt

SEQ ID NO: 857521 - DNA, 22 bp, Artificial Sequence
  chemically synthesized
acaaatataaaagatatatagt

SEQ ID NO: 857522 - DNA, 22 bp, Artificial Sequence
  chemically synthesized
gctagatcaaatatactatata

SEQ ID NO: 857523 - DNA, 22 bp, Artificial Sequence
  chemically synthesized
cctagctagatcaaatatacta

SEQ ID NO: 857524 - DNA, 22 bp, Artificial Sequence
  chemically synthesized
acctagctagatcaaatatact

SEQ ID NO: 857525 - DNA, 22 bp, Artificial Sequence
  chemically synthesized
atgtaaatatggtttacctagc

SEQ ID NO: 857526 - DNA, 22 bp, Artificial Sequence
  chemically synthesized
gatctagctaggtaaaccatat

SEQ ID NO: 857527 - DNA, 22 bp, Artificial Sequence
  chemically synthesized
atctagctaggtaaaccatatt

SEQ ID NO: 857528 - DNA, 22 bp, Artificial Sequence
  chemically synthesized
gaatacattgatgtaaatatgg

SEQ ID NO: 857529 - DNA, 22 bp, Artificial Sequence
  chemically synthesized
gctaggtaaaccatatttacat

SEQ ID NO: 857530 - DNA, 22 bp, Artificial Sequence
  chemically synthesized
ggtaaaccatatttacatcaat

SEQ ID NO: 857531 - DNA, 22 bp, Artificial Sequence
  chemically synthesized
gaaacattagaatacattgatg

SEQ ID NO: 857532 - DNA, 22 bp, Artificial Sequence
  chemically synthesized
acatcaatgtattctaatgttt

SEQ ID NO: 857533 - DNA, 22 bp, Artificial Sequence
  chemically synthesized
catcaatgtattctaatgtttc

SEQ ID NO: 857534 - DNA, 22 bp, Artificial Sequence
  chemically synthesized
tgacatcaactagaaacattag

SEQ ID NO: 857535 - DNA, 22 bp, Artificial Sequence
  chemically synthesized
gtaaaattatgacatcaactag

SEQ ID NO: 857536 - DNA, 22 bp, Artificial Sequence
  chemically synthesized
ggtaaaattatgacatcaacta

SEQ ID NO: 857537 - DNA, 22 bp, Artificial Sequence
  chemically synthesized
taatgtttctagttgatgtcat

SEQ ID NO: 857538 - DNA, 22 bp, Artificial Sequence
  chemically synthesized
atgtttctagttgatgtcataa

SEQ ID NO: 857539 - DNA, 22 bp, Artificial Sequence
  chemically synthesized
ctagttgatgtcataattttac

SEQ ID NO: 857540 - DNA, 22 bp, Artificial Sequence
  chemically synthesized
tagttgatgtcataattttacc

SEQ ID NO: 857541 - DNA, 22 bp, Artificial Sequence
  chemically synthesized
gttgatgtcataattttaccaa

SEQ ID NO: 857542 - DNA, 22 bp, Artificial Sequence
  chemically synthesized
agtgtaatccatttggtaaaat

SEQ ID NO: 857543 - DNA, 22 bp, Artificial Sequence
  chemically synthesized
atgtcataattttaccaaatgg

SEQ ID NO: 857544 - DNA, 22 bp, Artificial Sequence
  chemically synthesized
agcctcagtgtaatccatttgg

SEQ ID NO: 857545 - DNA, 22 bp, Artificial Sequence
  chemically synthesized
cagcctcagtgtaatccatttg

SEQ ID NO: 857546 - DNA, 22 bp, Artificial Sequence
  chemically synthesized
tcagcctcagtgtaatccattt

SEQ ID NO: 857547 - DNA, 22 bp, Artificial Sequence
  chemically synthesized
ttcagcctcagtgtaatccatt

SEQ ID NO: 857548 - DNA, 22 bp, Artificial Sequence
  chemically synthesized
taccaaatggattacactgagg

SEQ ID NO: 857549 - DNA, 22 bp, Artificial Sequence
  chemically synthesized
accaaatggattacactgaggc

SEQ ID NO: 857550 - DNA, 22 bp, Artificial Sequence
  chemically synthesized
ccaaatggattacactgaggct

SEQ ID NO: 857551 - DNA, 22 bp, Artificial Sequence
  chemically synthesized
atacaaatagtgcatttttcag

SEQ ID NO: 857552 - DNA, 22 bp, Artificial Sequence
  chemically synthesized
aatacaaatagtgcatttttca

SEQ ID NO: 857553 - DNA, 22 bp, Artificial Sequence
  chemically synthesized
taatacaaatagtgcatttttc

SEQ ID NO: 857554 - DNA, 22 bp, Artificial Sequence
  chemically synthesized
ttaatacaaatagtgcattttt

SEQ ID NO: 857555 - DNA, 22 bp, Artificial Sequence
  chemically synthesized
cactgaggctgaaaaatgcact

SEQ ID NO: 857556 - DNA, 22 bp, Artificial Sequence
  chemically synthesized
aggctgaaaaatgcactatttg

SEQ ID NO: 857557 - DNA, 22 bp, Artificial Sequence
  chemically synthesized
aaaaatgcactatttgtattaa

SEQ ID NO: 857558 - DNA, 22 bp, Artificial Sequence
  chemically synthesized
aaatgaacatgtttttaataca

SEQ ID NO: 857559 - DNA, 22 bp, Artificial Sequence
  chemically synthesized
tttgtattaaaaacatgttcat

SEQ ID NO: 857560 - DNA, 22 bp, Artificial Sequence
  chemically synthesized
gtattaaaaacatgttcatttg

SEQ ID NO: 857561 - DNA, 22 bp, Artificial Sequence
  chemically synthesized
tattaaaaacatgttcatttga

SEQ ID NO: 857562 - DNA, 22 bp, Artificial Sequence
  chemically synthesized
tgcaatgccatgttcaaatgaa

SEQ ID NO: 857563 - DNA, 22 bp, Artificial Sequence
  chemically synthesized
atgcaatgccatgttcaaatga

SEQ ID NO: 857564 - DNA, 22 bp, Artificial Sequence
  chemically synthesized
aaaacatgttcatttgaacatg

SEQ ID NO: 857565 - DNA, 22 bp, Artificial Sequence
  chemically synthesized
gcatttatgcaatgccatgttc

SEQ ID NO: 857566 - DNA, 22 bp, Artificial Sequence
  chemically synthesized
aagttggcatttatgcaatgcc

SEQ ID NO: 857567 - DNA, 22 bp, Artificial Sequence
  chemically synthesized
aaagttggcatttatgcaatgc

SEQ ID NO: 857568 - DNA, 22 bp, Artificial Sequence
  chemically synthesized
atttgaacatggcattgcataa

SEQ ID NO: 857569 - DNA, 22 bp, Artificial Sequence
  chemically synthesized
gaacatggcattgcataaatgc

SEQ ID NO: 857570 - DNA, 22 bp, Artificial Sequence
  chemically synthesized
aacatggcattgcataaatgcc

SEQ ID NO: 857571 - DNA, 22 bp, Artificial Sequence
  chemically synthesized
gatcttaaagttggcatttatg

SEQ ID NO: 857572 - DNA, 22 bp, Artificial Sequence
  chemically synthesized
ccctagatcttaaagttggcat

SEQ ID NO: 857573 - DNA, 22 bp, Artificial Sequence
  chemically synthesized
aaattaccctagatcttaaagt

SEQ ID NO: 857574 - DNA, 22 bp, Artificial Sequence
  chemically synthesized
cataaatgccaactttaagatc

SEQ ID NO: 857575 - DNA, 22 bp, Artificial Sequence
  chemically synthesized
aaaattaccctagatcttaaag

SEQ ID NO: 857576 - DNA, 22 bp, Artificial Sequence
  chemically synthesized
taagatctagggtaattttaaa

SEQ ID NO: 857577 - DNA, 22 bp, Artificial Sequence
  chemically synthesized
aagatctagggtaattttaaat

SEQ ID NO: 857578 - DNA, 22 bp, Artificial Sequence
  chemically synthesized
agatctagggtaattttaaata

SEQ ID NO: 857579 - DNA, 22 bp, Artificial Sequence
  chemically synthesized
gggtaattttaaatatcttatg

SEQ ID NO: 857580 - DNA, 22 bp, Artificial Sequence
  chemically synthesized
aaaagagaaaagtaacaaaaca

SEQ ID NO: 857581 - DNA, 22 bp, Artificial Sequence
  chemically synthesized
taaatatcttatgttttgttac

SEQ ID NO: 857582 - DNA, 22 bp, Artificial Sequence
  chemically synthesized
aaaaagagaaaagtaacaaaac

SEQ ID NO: 857583 - DNA, 22 bp, Artificial Sequence
  chemically synthesized
aaatatcttatgttttgttact

SEQ ID NO: 857584 - DNA, 22 bp, Artificial Sequence
  chemically synthesized
aatatcttatgttttgttactt

SEQ ID NO: 857585 - DNA, 22 bp, Artificial Sequence
  chemically synthesized
taacttaaaaagagaaaagtaa

SEQ ID NO: 857586 - DNA, 22 bp, Artificial Sequence
  chemically synthesized
atgttttgttacttttctcttt

SEQ ID NO: 857587 - DNA, 22 bp, Artificial Sequence
  chemically synthesized
tgttttgttacttttctctttt

SEQ ID NO: 857588 - DNA, 22 bp, Artificial Sequence
  chemically synthesized
tgttacttttctctttttaagt

SEQ ID NO: 857589 - DNA, 22 bp, Artificial Sequence
  chemically synthesized
gttacttttctctttttaagtt

SEQ ID NO: 857590 - DNA, 22 bp, Artificial Sequence
  chemically synthesized
aaagagagctataacttaaaaa

SEQ ID NO: 857591 - DNA, 22 bp, Artificial Sequence
  chemically synthesized
ttacttttctctttttaagtta

SEQ ID NO: 857592 - DNA, 22 bp, Artificial Sequence
  chemically synthesized
cttttctctttttaagttatag

SEQ ID NO: 857593 - DNA, 22 bp, Artificial Sequence
  chemically synthesized
ttctctttttaagttatagctc

SEQ ID NO: 857594 - DNA, 22 bp, Artificial Sequence
  chemically synthesized
tctctttttaagttatagctct

SEQ ID NO: 857595 - DNA, 22 bp, Artificial Sequence
  chemically synthesized
ctctttttaagttatagctctc

SEQ ID NO: 857596 - DNA, 22 bp, Artificial Sequence
  chemically synthesized
tctttttaagttatagctctct

SEQ ID NO: 857597 - DNA, 22 bp, Artificial Sequence
  chemically synthesized
tttttaagttatagctctcttt

SEQ ID NO: 857598 - DNA, 22 bp, Artificial Sequence
  chemically synthesized
tttaagttatagctctctttca

SEQ ID NO: 857599 - DNA, 22 bp, Artificial Sequence
  chemically synthesized
ttaagttatagctctctttcaa

SEQ ID NO: 857600 - DNA, 22 bp, Artificial Sequence
  chemically synthesized
taagttatagctctctttcaat

SEQ ID NO: 857601 - DNA, 22 bp, Artificial Sequence
  chemically synthesized
aagttatagctctctttcaatt

SEQ ID NO: 857602 - DNA, 22 bp, Artificial Sequence
  chemically synthesized
agttatagctctctttcaatta

SEQ ID NO: 857603 - DNA, 22 bp, Artificial Sequence
  chemically synthesized
caatgataaggataattgaaag

SEQ ID NO: 857604 - DNA, 22 bp, Artificial Sequence
  chemically synthesized
tccaatgataaggataattgaa

SEQ ID NO: 857605 - DNA, 22 bp, Artificial Sequence
  chemically synthesized
ctccaatgataaggataattga

SEQ ID NO: 857606 - DNA, 22 bp, Artificial Sequence
  chemically synthesized
tagctctctttcaattatcctt

SEQ ID NO: 857607 - DNA, 22 bp, Artificial Sequence
  chemically synthesized
ccttctccaatgataaggataa

SEQ ID NO: 857608 - DNA, 22 bp, Artificial Sequence
  chemically synthesized
gccttctccaatgataaggata

SEQ ID NO: 857609 - DNA, 22 bp, Artificial Sequence
  chemically synthesized
tctttcaattatccttatcatt

SEQ ID NO: 857610 - DNA, 22 bp, Artificial Sequence
  chemically synthesized
tttcaattatccttatcattgg

SEQ ID NO: 857611 - DNA, 22 bp, Artificial Sequence
  chemically synthesized
tcaattatccttatcattggag

SEQ ID NO: 857612 - DNA, 22 bp, Artificial Sequence
  chemically synthesized
caattatccttatcattggaga

SEQ ID NO: 857613 - DNA, 22 bp, Artificial Sequence
  chemically synthesized
aattatccttatcattggagaa

SEQ ID NO: 857614 - DNA, 22 bp, Artificial Sequence
  chemically synthesized
tgccaatttgccttctccaatg

SEQ ID NO: 857615 - DNA, 22 bp, Artificial Sequence
  chemically synthesized
tctgtgccaatttgccttctcc

SEQ ID NO: 857616 - DNA, 22 bp, Artificial Sequence
  chemically synthesized
tccttatcattggagaaggcaa

SEQ ID NO: 857617 - DNA, 22 bp, Artificial Sequence
  chemically synthesized
agttgtctgtgccaatttgcct

SEQ ID NO: 857618 - DNA, 22 bp, Artificial Sequence
  chemically synthesized
atcattggagaaggcaaattgg

SEQ ID NO: 857619 - DNA, 22 bp, Artificial Sequence
  chemically synthesized
tcattggagaaggcaaattggc

SEQ ID NO: 857620 - DNA, 22 bp, Artificial Sequence
  chemically synthesized
taagttgtctgtgccaatttgc

SEQ ID NO: 857621 - DNA, 22 bp, Artificial Sequence
  chemically synthesized
ctaagttgtctgtgccaatttg

SEQ ID NO: 857622 - DNA, 22 bp, Artificial Sequence
  chemically synthesized
ttctaagttgtctgtgccaatt

SEQ ID NO: 857623 - DNA, 22 bp, Artificial Sequence
  chemically synthesized
gagaaggcaaattggcacagac

SEQ ID NO: 857624 - DNA, 22 bp, Artificial Sequence
  chemically synthesized
tccactcttctaagttgtctgt

SEQ ID NO: 857625 - DNA, 22 bp, Artificial Sequence
  chemically synthesized
ttatccactcttctaagttgtc

SEQ ID NO: 857626 - DNA, 22 bp, Artificial Sequence
  chemically synthesized
attattatccactcttctaagt

SEQ ID NO: 857627 - DNA, 22 bp, Artificial Sequence
  chemically synthesized
gcacagacaacttagaagagtg

SEQ ID NO: 857628 - DNA, 22 bp, Artificial Sequence
  chemically synthesized
ggaattgattattatccactct

SEQ ID NO: 857629 - DNA, 22 bp, Artificial Sequence
  chemically synthesized
agaagagtggataataatcaat

SEQ ID NO: 857630 - DNA, 22 bp, Artificial Sequence
  chemically synthesized
gaagagtggataataatcaatt

SEQ ID NO: 857631 - DNA, 22 bp, Artificial Sequence
  chemically synthesized
cagaatcaaatataatagtctg

SEQ ID NO: 857632 - DNA, 22 bp, Artificial Sequence
  chemically synthesized
ccagactattatatttgattct

SEQ ID NO: 857633 - DNA, 22 bp, Artificial Sequence
  chemically synthesized
cgcagcccaacatattgcagaa

SEQ ID NO: 857634 - DNA, 22 bp, Artificial Sequence
  chemically synthesized
ttatatttgattctgcaatatg

SEQ ID NO: 857635 - DNA, 22 bp, Artificial Sequence
  chemically synthesized
tatttgattctgcaatatgttg

SEQ ID NO: 857636 - DNA, 22 bp, Artificial Sequence
  chemically synthesized
gcactacgcagcccaacatatt

SEQ ID NO: 857637 - DNA, 22 bp, Artificial Sequence
  chemically synthesized
ggcactacgcagcccaacatat

SEQ ID NO: 857638 - DNA, 22 bp, Artificial Sequence
  chemically synthesized
tggcactacgcagcccaacata

SEQ ID NO: 857639 - DNA, 22 bp, Artificial Sequence
  chemically synthesized
gattctgcaatatgttgggctg

SEQ ID NO: 857640 - DNA, 22 bp, Artificial Sequence
  chemically synthesized
attctgcaatatgttgggctgc

SEQ ID NO: 857641 - DNA, 22 bp, Artificial Sequence
  chemically synthesized
ttttggcactacgcagcccaac

SEQ ID NO: 857642 - DNA, 22 bp, Artificial Sequence
  chemically synthesized
gttttggcactacgcagcccaa

SEQ ID NO: 857643 - DNA, 22 bp, Artificial Sequence
  chemically synthesized
tgcaatatgttgggctgcgtag

SEQ ID NO: 857644 - DNA, 22 bp, Artificial Sequence
  chemically synthesized
tttgttttggcactacgcagcc

SEQ ID NO: 857645 - DNA, 22 bp, Artificial Sequence
  chemically synthesized
caatatgttgggctgcgtagtg

SEQ ID NO: 857646 - DNA, 22 bp, Artificial Sequence
  chemically synthesized
aactgtttgttttggcactacg

SEQ ID NO: 857647 - DNA, 22 bp, Artificial Sequence
  chemically synthesized
aaactgtttgttttggcactac

SEQ ID NO: 857648 - DNA, 22 bp, Artificial Sequence
  chemically synthesized
catttaaactgtttgttttggc

SEQ ID NO: 857649 - DNA, 22 bp, Artificial Sequence
  chemically synthesized
ggctgcgtagtgccaaaacaaa

SEQ ID NO: 857650 - DNA, 22 bp, Artificial Sequence
  chemically synthesized
acatttaaactgtttgttttgg

SEQ ID NO: 857651 - DNA, 22 bp, Artificial Sequence
  chemically synthesized
tttacatttaaactgtttgttt

SEQ ID NO: 857652 - DNA, 22 bp, Artificial Sequence
  chemically synthesized
cgtagtgccaaaacaaacagtt

SEQ ID NO: 857653 - DNA, 22 bp, Artificial Sequence
  chemically synthesized
agctatttacatttaaactgtt

SEQ ID NO: 857654 - DNA, 22 bp, Artificial Sequence
  chemically synthesized
aactgagctatttacatttaaa

SEQ ID NO: 857655 - DNA, 22 bp, Artificial Sequence
  chemically synthesized
aaatgtaaatagctcagttgag

SEQ ID NO: 857656 - DNA, 22 bp, Artificial Sequence
  chemically synthesized
aatgtaaatagctcagttgagt

SEQ ID NO: 857657 - DNA, 22 bp, Artificial Sequence
  chemically synthesized
taccaaataagtcactcaactg

SEQ ID NO: 857658 - DNA, 22 bp, Artificial Sequence
  chemically synthesized
ataccaaataagtcactcaact

SEQ ID NO: 857659 - DNA, 22 bp, Artificial Sequence
  chemically synthesized
tataccaaataagtcactcaac

SEQ ID NO: 857660 - DNA, 22 bp, Artificial Sequence
  chemically synthesized
ttttataccaaataagtcactc

SEQ ID NO: 857661 - DNA, 22 bp, Artificial Sequence
  chemically synthesized
agttgagtgacttatttggtat

SEQ ID NO: 857662 - DNA, 22 bp, Artificial Sequence
  chemically synthesized
aaaatctattttataccaaata

SEQ ID NO: 857663 - DNA, 22 bp, Artificial Sequence
  chemically synthesized
aaaaatctattttataccaaat

SEQ ID NO: 857664 - DNA, 22 bp, Artificial Sequence
  chemically synthesized
taaaaatctattttataccaaa

SEQ ID NO: 857665 - DNA, 22 bp, Artificial Sequence
  chemically synthesized
agtgacttatttggtataaaat

SEQ ID NO: 857666 - DNA, 22 bp, Artificial Sequence
  chemically synthesized
gtattttaaaaatctattttat

SEQ ID NO: 857667 - DNA, 22 bp, Artificial Sequence
  chemically synthesized
atttggtataaaatagattttt

SEQ ID NO: 857668 - DNA, 22 bp, Artificial Sequence
  chemically synthesized
tttggtataaaatagattttta

SEQ ID NO: 857669 - DNA, 22 bp, Artificial Sequence
  chemically synthesized
ggtataaaatagatttttaaaa

SEQ ID NO: 857670 - DNA, 22 bp, Artificial Sequence
  chemically synthesized
aacaacctggtattttaaaaat

SEQ ID NO: 857671 - DNA, 22 bp, Artificial Sequence
  chemically synthesized
gtataaaatagatttttaaaat

SEQ ID NO: 857672 - DNA, 22 bp, Artificial Sequence
  chemically synthesized
ctaaacaacctggtattttaaa

SEQ ID NO: 857673 - DNA, 22 bp, Artificial Sequence
  chemically synthesized
actaaacaacctggtattttaa

SEQ ID NO: 857674 - DNA, 22 bp, Artificial Sequence
  chemically synthesized
aatttactaaacaacctggtat

SEQ ID NO: 857675 - DNA, 22 bp, Artificial Sequence
  chemically synthesized
agttaaatttactaaacaacct

SEQ ID NO: 857676 - DNA, 22 bp, Artificial Sequence
  chemically synthesized
ttaaaataccaggttgtttagt

SEQ ID NO: 857677 - DNA, 22 bp, Artificial Sequence
  chemically synthesized
taaaataccaggttgtttagta

SEQ ID NO: 857678 - DNA, 22 bp, Artificial Sequence
  chemically synthesized
aaaataccaggttgtttagtaa

SEQ ID NO: 857679 - DNA, 22 bp, Artificial Sequence
  chemically synthesized
tctcagttaaatttactaaaca

SEQ ID NO: 857680 - DNA, 22 bp, Artificial Sequence
  chemically synthesized
aaataccaggttgtttagtaaa

SEQ ID NO: 857681 - DNA, 22 bp, Artificial Sequence
  chemically synthesized
caagaatagttgtctcagttaa

SEQ ID NO: 857682 - DNA, 22 bp, Artificial Sequence
  chemically synthesized
acaagaatagttgtctcagtta

SEQ ID NO: 857683 - DNA, 22 bp, Artificial Sequence
  chemically synthesized
tttagtaaatttaactgagaca

SEQ ID NO: 857684 - DNA, 22 bp, Artificial Sequence
  chemically synthesized
agtaaatttaactgagacaact

SEQ ID NO: 857685 - DNA, 22 bp, Artificial Sequence
  chemically synthesized
gtaaatttaactgagacaacta

SEQ ID NO: 857686 - DNA, 22 bp, Artificial Sequence
  chemically synthesized
aactgagacaactattcttgta

SEQ ID NO: 857687 - DNA, 22 bp, Artificial Sequence
  chemically synthesized
actgagacaactattcttgtaa

SEQ ID NO: 857688 - DNA, 22 bp, Artificial Sequence
  chemically synthesized
agacaactattcttgtaaggtt

SEQ ID NO: 857689 - DNA, 22 bp, Artificial Sequence
  chemically synthesized
ttcttgtaaggtttctgctttt

SEQ ID NO: 857690 - DNA, 22 bp, Artificial Sequence
  chemically synthesized
ttgtaaggtttctgcttttttt

SEQ ID NO: 857691 - DNA, 22 bp, Artificial Sequence
  chemically synthesized
gtaaggtttctgcttttttttt

SEQ ID NO: 857692 - DNA, 22 bp, Artificial Sequence
  chemically synthesized
taaggtttctgctttttttttt

SEQ ID NO: 857693 - DNA, 22 bp, Artificial Sequence
  chemically synthesized
ctgctttttttttttttttttt

SEQ ID NO: 857694 - DNA, 22 bp, Artificial Sequence
  chemically synthesized
tgcttttttttttttttttttt

SEQ ID NO: 857695 - DNA, 22 bp, Artificial Sequence
  chemically synthesized
cttttttttttttttttttttg

SEQ ID NO: 857696 - DNA, 22 bp, Artificial Sequence
  chemically synthesized
aaaaggaaatatacaaaaaaaa

SEQ ID NO: 857697 - DNA, 22 bp, Artificial Sequence
  chemically synthesized
ttttttttttttttttttgtat

SEQ ID NO: 857698 - DNA, 22 bp, Artificial Sequence
  chemically synthesized
tttttttttttttttttgtata

SEQ ID NO: 857699 - DNA, 22 bp, Artificial Sequence
  chemically synthesized
ttttttttttttttttgtatat

SEQ ID NO: 857700 - DNA, 22 bp, Artificial Sequence
  chemically synthesized
tttttttttttttttgtatatt

SEQ ID NO: 857701 - DNA, 22 bp, Artificial Sequence
  chemically synthesized
ttttttttttttttgtatattt

SEQ ID NO: 857702 - DNA, 22 bp, Artificial Sequence
  chemically synthesized
tttttttttttttgtatatttc

SEQ ID NO: 857703 - DNA, 22 bp, Artificial Sequence
  chemically synthesized
ttttttttttttgtatatttcc

SEQ ID NO: 857704 - DNA, 22 bp, Artificial Sequence
  chemically synthesized
tttttttttttgtatatttcct

SEQ ID NO: 857705 - DNA, 22 bp, Artificial Sequence
  chemically synthesized
ttttttttttgtatatttcctt

SEQ ID NO: 857706 - DNA, 22 bp, Artificial Sequence
  chemically synthesized
tttttttttgtatatttccttt

SEQ ID NO: 857707 - DNA, 22 bp, Artificial Sequence
  chemically synthesized
ttttttttgtatatttcctttt

SEQ ID NO: 857708 - DNA, 22 bp, Artificial Sequence
  chemically synthesized
tttttttgtatatttccttttt

SEQ ID NO: 857709 - DNA, 22 bp, Artificial Sequence
  chemically synthesized
ttttttgtatatttccttttta

SEQ ID NO: 857710 - DNA, 22 bp, Artificial Sequence
  chemically synthesized
tttttgtatatttcctttttaa

SEQ ID NO: 857711 - DNA, 22 bp, Artificial Sequence
  chemically synthesized
ttttgtatatttcctttttaat

SEQ ID NO: 857712 - DNA, 22 bp, Artificial Sequence
  chemically synthesized
tttgtatatttcctttttaatg

SEQ ID NO: 857713 - DNA, 22 bp, Artificial Sequence
  chemically synthesized
ttgtatatttcctttttaatgt

SEQ ID NO: 857714 - DNA, 22 bp, Artificial Sequence
  chemically synthesized
tgtatatttcctttttaatgta

SEQ ID NO: 857715 - DNA, 22 bp, Artificial Sequence
  chemically synthesized
gtatatttcctttttaatgtat

SEQ ID NO: 857716 - DNA, 22 bp, Artificial Sequence
  chemically synthesized
tatatttcctttttaatgtatg

SEQ ID NO: 857717 - DNA, 22 bp, Artificial Sequence
  chemically synthesized
cctttttaatgtatggctactt

SEQ ID NO: 857718 - DNA, 22 bp, Artificial Sequence
  chemically synthesized
ctttttaatgtatggctacttt

SEQ ID NO: 857719 - DNA, 22 bp, Artificial Sequence
  chemically synthesized
atgcaaataacaaaagtagcca

SEQ ID NO: 857720 - DNA, 22 bp, Artificial Sequence
  chemically synthesized
tttaatgtatggctacttttgt

SEQ ID NO: 857721 - DNA, 22 bp, Artificial Sequence
  chemically synthesized
ttaatgtatggctacttttgtt

SEQ ID NO: 857722 - DNA, 22 bp, Artificial Sequence
  chemically synthesized
taatgtatggctacttttgtta

SEQ ID NO: 857723 - DNA, 22 bp, Artificial Sequence
  chemically synthesized
aatgtatggctacttttgttat

SEQ ID NO: 857724 - DNA, 22 bp, Artificial Sequence
  chemically synthesized
atgtatggctacttttgttatt

SEQ ID NO: 857725 - DNA, 22 bp, Artificial Sequence
  chemically synthesized
cttttgttatttgcattaattt

SEQ ID NO: 857726 - DNA, 22 bp, Artificial Sequence
  chemically synthesized
ttgttatttgcattaatttata

SEQ ID NO: 857727 - DNA, 22 bp, Artificial Sequence
  chemically synthesized
tgttatttgcattaatttatat

SEQ ID NO: 857728 - DNA, 22 bp, Artificial Sequence
  chemically synthesized
gttatttgcattaatttatatc

SEQ ID NO: 857729 - DNA, 22 bp, Artificial Sequence
  chemically synthesized
agtataatcaaggatataaatt

SEQ ID NO: 857730 - DNA, 22 bp, Artificial Sequence
  chemically synthesized
ttatttgcattaatttatatcc

SEQ ID NO: 857731 - DNA, 22 bp, Artificial Sequence
  chemically synthesized
tttgcattaatttatatccttg

SEQ ID NO: 857732 - DNA, 22 bp, Artificial Sequence
  chemically synthesized
agcctaagtataatcaaggata

SEQ ID NO: 857733 - DNA, 22 bp, Artificial Sequence
  chemically synthesized
gcattaatttatatccttgatt

SEQ ID NO: 857734 - DNA, 22 bp, Artificial Sequence
  chemically synthesized
cattaatttatatccttgatta

SEQ ID NO: 857735 - DNA, 22 bp, Artificial Sequence
  chemically synthesized
ttcagcctaagtataatcaagg

SEQ ID NO: 857736 - DNA, 22 bp, Artificial Sequence
  chemically synthesized
atttatatccttgattatactt

SEQ ID NO: 857737 - DNA, 22 bp, Artificial Sequence
  chemically synthesized
actattcagcctaagtataatc

SEQ ID NO: 857738 - DNA, 22 bp, Artificial Sequence
  chemically synthesized
tcactattcagcctaagtataa

SEQ ID NO: 857739 - DNA, 22 bp, Artificial Sequence
  chemically synthesized
atatccttgattatacttaggc

SEQ ID NO: 857740 - DNA, 22 bp, Artificial Sequence
  chemically synthesized
tatccttgattatacttaggct

SEQ ID NO: 857741 - DNA, 22 bp, Artificial Sequence
  chemically synthesized
ctctcactattcagcctaagta

SEQ ID NO: 857742 - DNA, 22 bp, Artificial Sequence
  chemically synthesized
gattatacttaggctgaatagt

SEQ ID NO: 857743 - DNA, 22 bp, Artificial Sequence
  chemically synthesized
attatacttaggctgaatagtg

SEQ ID NO: 857744 - DNA, 22 bp, Artificial Sequence
  chemically synthesized
tacttaggctgaatagtgagag

SEQ ID NO: 857745 - DNA, 22 bp, Artificial Sequence
  chemically synthesized
agcaaacacattactctcacta

SEQ ID NO: 857746 - DNA, 22 bp, Artificial Sequence
  chemically synthesized
tcagcaaacacattactctcac

SEQ ID NO: 857747 - DNA, 22 bp, Artificial Sequence
  chemically synthesized
aggctgaatagtgagagtaatg

SEQ ID NO: 857748 - DNA, 22 bp, Artificial Sequence
  chemically synthesized
tctcagcaaacacattactctc

SEQ ID NO: 857749 - DNA, 22 bp, Artificial Sequence
  chemically synthesized
ggctgaatagtgagagtaatgt

SEQ ID NO: 857750 - DNA, 22 bp, Artificial Sequence
  chemically synthesized
tctctcagcaaacacattactc

SEQ ID NO: 857751 - DNA, 22 bp, Artificial Sequence
  chemically synthesized
ctctctcagcaaacacattact

SEQ ID NO: 857752 - DNA, 22 bp, Artificial Sequence
  chemically synthesized
aatagtgagagtaatgtgtttg

SEQ ID NO: 857753 - DNA, 22 bp, Artificial Sequence
  chemically synthesized
tttctctctcagcaaacacatt

SEQ ID NO: 857754 - DNA, 22 bp, Artificial Sequence
  chemically synthesized
ggcaactgtttctctctcagca

SEQ ID NO: 857755 - DNA, 22 bp, Artificial Sequence
  chemically synthesized
aggcaactgtttctctctcagc

SEQ ID NO: 857756 - DNA, 22 bp, Artificial Sequence
  chemically synthesized
ttaggcaactgtttctctctca

SEQ ID NO: 857757 - DNA, 22 bp, Artificial Sequence
  chemically synthesized
gctgagagagaaacagttgcct

SEQ ID NO: 857758 - DNA, 22 bp, Artificial Sequence
  chemically synthesized
ccaccagttcttaggcaactgt

SEQ ID NO: 857759 - DNA, 22 bp, Artificial Sequence
  chemically synthesized
ctgagagagaaacagttgccta

SEQ ID NO: 857760 - DNA, 22 bp, Artificial Sequence
  chemically synthesized
cccaccagttcttaggcaactg

SEQ ID NO: 857761 - DNA, 22 bp, Artificial Sequence
  chemically synthesized
agagagaaacagttgcctaaga

SEQ ID NO: 857762 - DNA, 22 bp, Artificial Sequence
  chemically synthesized
gaccatttcccaccagttctta

SEQ ID NO: 857763 - DNA, 22 bp, Artificial Sequence
  chemically synthesized
ctagaccatttcccaccagttc

SEQ ID NO: 857764 - DNA, 22 bp, Artificial Sequence
  chemically synthesized
tcctagaccatttcccaccagt

SEQ ID NO: 857765 - DNA, 22 bp, Artificial Sequence
  chemically synthesized
ctctcctagaccatttcccacc

SEQ ID NO: 857766 - DNA, 22 bp, Artificial Sequence
  chemically synthesized
actctcctagaccatttcccac

SEQ ID NO: 857767 - DNA, 22 bp, Artificial Sequence
  chemically synthesized
cctaagaactggtgggaaatgg

SEQ ID NO: 857768 - DNA, 22 bp, Artificial Sequence
  chemically synthesized
tactctcctagaccatttccca

SEQ ID NO: 857769 - DNA, 22 bp, Artificial Sequence
  chemically synthesized
agaactggtgggaaatggtcta

SEQ ID NO: 857770 - DNA, 22 bp, Artificial Sequence
  chemically synthesized
gtgggaaatggtctaggagagt

SEQ ID NO: 857771 - DNA, 22 bp, Artificial Sequence
  chemically synthesized
caccaatcactttactctccta

SEQ ID NO: 857772 - DNA, 22 bp, Artificial Sequence
  chemically synthesized
ccaccaatcactttactctcct

SEQ ID NO: 857773 - DNA, 22 bp, Artificial Sequence
  chemically synthesized
tccaccaatcactttactctcc

SEQ ID NO: 857774 - DNA, 22 bp, Artificial Sequence
  chemically synthesized
ggagagtaaagtgattggtgga

SEQ ID NO: 857775 - DNA, 22 bp, Artificial Sequence
  chemically synthesized
aaatgaagattttccaccaatc

SEQ ID NO: 857776 - DNA, 22 bp, Artificial Sequence
  chemically synthesized
aaaatgaagattttccaccaat

SEQ ID NO: 857777 - DNA, 22 bp, Artificial Sequence
  chemically synthesized
taaaatgaagattttccaccaa

SEQ ID NO: 857778 - DNA, 22 bp, Artificial Sequence
  chemically synthesized
tttaaaatgaagattttccacc

SEQ ID NO: 857779 - DNA, 22 bp, Artificial Sequence
  chemically synthesized
ctttaaaatgaagattttccac

SEQ ID NO: 857780 - DNA, 22 bp, Artificial Sequence
  chemically synthesized
tctttaaaatgaagattttcca

SEQ ID NO: 857781 - DNA, 22 bp, Artificial Sequence
  chemically synthesized
ttctttaaaatgaagattttcc

SEQ ID NO: 857782 - DNA, 22 bp, Artificial Sequence
  chemically synthesized
gtggaaaatcttcattttaaag

SEQ ID NO: 857783 - DNA, 22 bp, Artificial Sequence
  chemically synthesized
gcagaagtttttctttaaaatg

SEQ ID NO: 857784 - DNA, 22 bp, Artificial Sequence
  chemically synthesized
cattttaaagaaaaacttctgc

SEQ ID NO: 857785 - DNA, 22 bp, Artificial Sequence
  chemically synthesized
attttaaagaaaaacttctgcc

SEQ ID NO: 857786 - DNA, 22 bp, Artificial Sequence
  chemically synthesized
taaagaaaaacttctgccaact

SEQ ID NO: 857787 - DNA, 22 bp, Artificial Sequence
  chemically synthesized
aaagaaaaacttctgccaactt

SEQ ID NO: 857788 - DNA, 22 bp, Artificial Sequence
  chemically synthesized
aagaaaaacttctgccaacttt

SEQ ID NO: 857789 - DNA, 22 bp, Artificial Sequence
  chemically synthesized
ctgccaacttttatcatttttt

SEQ ID NO: 857790 - DNA, 22 bp, Artificial Sequence
  chemically synthesized
tgccaacttttatcattttttc

SEQ ID NO: 857791 - DNA, 22 bp, Artificial Sequence
  chemically synthesized
ccaacttttatcattttttctc

SEQ ID NO: 857792 - DNA, 22 bp, Artificial Sequence
  chemically synthesized
ttatcattttttctcatacctt

SEQ ID NO: 857793 - DNA, 22 bp, Artificial Sequence
  chemically synthesized
tatcattttttctcataccttc

SEQ ID NO: 857794 - DNA, 22 bp, Artificial Sequence
  chemically synthesized
atcattttttctcataccttct

SEQ ID NO: 857795 - DNA, 22 bp, Artificial Sequence
  chemically synthesized
tcattttttctcataccttctg

SEQ ID NO: 857796 - DNA, 22 bp, Artificial Sequence
  chemically synthesized
tttctcataccttctgcttgat

SEQ ID NO: 857797 - DNA, 22 bp, Artificial Sequence
  chemically synthesized
ttctcataccttctgcttgatg

SEQ ID NO: 857798 - DNA, 22 bp, Artificial Sequence
  chemically synthesized
tctcataccttctgcttgatga

SEQ ID NO: 857799 - DNA, 22 bp, Artificial Sequence
  chemically synthesized
ctcataccttctgcttgatgat

SEQ ID NO: 857800 - DNA, 22 bp, Artificial Sequence
  chemically synthesized
tcataccttctgcttgatgatc

SEQ ID NO: 857801 - DNA, 22 bp, Artificial Sequence
  chemically synthesized
ataccttctgcttgatgatcat

SEQ ID NO: 857802 - DNA, 22 bp, Artificial Sequence
  chemically synthesized
aggatatcaacgagatgatcat

SEQ ID NO: 857803 - DNA, 22 bp, Artificial Sequence
  chemically synthesized
gaggatatcaacgagatgatca

SEQ ID NO: 857804 - DNA, 22 bp, Artificial Sequence
  chemically synthesized
ctgcttgatgatcatctcgttg

SEQ ID NO: 857805 - DNA, 22 bp, Artificial Sequence
  chemically synthesized
tgcttgatgatcatctcgttga

SEQ ID NO: 857806 - DNA, 22 bp, Artificial Sequence
  chemically synthesized
cttgatgatcatctcgttgata

SEQ ID NO: 857807 - DNA, 22 bp, Artificial Sequence
  chemically synthesized
gatgatcatctcgttgatatcc

SEQ ID NO: 857808 - DNA, 22 bp, Artificial Sequence
  chemically synthesized
atgatcatctcgttgatatcct

SEQ ID NO: 857809 - DNA, 22 bp, Artificial Sequence
  chemically synthesized
gttgatatcctcaaggtcaccc

SEQ ID NO: 857810 - DNA, 22 bp, Artificial Sequence
  chemically synthesized
atatcctcaaggtcacccacca

SEQ ID NO: 857811 - DNA, 22 bp, Artificial Sequence
  chemically synthesized
taaaatcacagagggtgatggt

SEQ ID NO: 857812 - DNA, 22 bp, Artificial Sequence
  chemically synthesized
aaggtcacccaccatcaccctc

SEQ ID NO: 857813 - DNA, 22 bp, Artificial Sequence
  chemically synthesized
atcaagttataaaatcacagag

SEQ ID NO: 857814 - DNA, 22 bp, Artificial Sequence
  chemically synthesized
gatcaagttataaaatcacaga

SEQ ID NO: 857815 - DNA, 22 bp, Artificial Sequence
  chemically synthesized
cttgatcaagttataaaatcac

SEQ ID NO: 857816 - DNA, 22 bp, Artificial Sequence
  chemically synthesized
tgcttgatcaagttataaaatc

SEQ ID NO: 857817 - DNA, 22 bp, Artificial Sequence
  chemically synthesized
tctgcttgatcaagttataaaa

SEQ ID NO: 857818 - DNA, 22 bp, Artificial Sequence
  chemically synthesized
ctctgcttgatcaagttataaa

SEQ ID NO: 857819 - DNA, 22 bp, Artificial Sequence
  chemically synthesized
tctctgcttgatcaagttataa

SEQ ID NO: 857820 - DNA, 22 bp, Artificial Sequence
  chemically synthesized
gctttctctgcttgatcaagtt

SEQ ID NO: 857821 - DNA, 22 bp, Artificial Sequence
  chemically synthesized
tgtgattttataacttgatcaa

SEQ ID NO: 857822 - DNA, 22 bp, Artificial Sequence
  chemically synthesized
tgattttataacttgatcaagc

SEQ ID NO: 857823 - DNA, 22 bp, Artificial Sequence
  chemically synthesized
ccgactggctttctctgcttga

SEQ ID NO: 857824 - DNA, 22 bp, Artificial Sequence
  chemically synthesized
accgactggctttctctgcttg

SEQ ID NO: 857825 - DNA, 22 bp, Artificial Sequence
  chemically synthesized
tataacttgatcaagcagagaa

SEQ ID NO: 857826 - DNA, 22 bp, Artificial Sequence
  chemically synthesized
ataacttgatcaagcagagaaa

SEQ ID NO: 857827 - DNA, 22 bp, Artificial Sequence
  chemically synthesized
taacttgatcaagcagagaaag

SEQ ID NO: 857828 - DNA, 22 bp, Artificial Sequence
  chemically synthesized
gatcaagcagagaaagccagtc

SEQ ID NO: 857829 - DNA, 22 bp, Artificial Sequence
  chemically synthesized
atcaagcagagaaagccagtcg

SEQ ID NO: 857830 - DNA, 22 bp, Artificial Sequence
  chemically synthesized
gacagaacttaccgactggctt

SEQ ID NO: 857831 - DNA, 22 bp, Artificial Sequence
  chemically synthesized
ggacagaacttaccgactggct

SEQ ID NO: 857832 - DNA, 22 bp, Artificial Sequence
  chemically synthesized
aaccgggcttggacagaactta

SEQ ID NO: 857833 - DNA, 22 bp, Artificial Sequence
  chemically synthesized
caaccgggcttggacagaactt

SEQ ID NO: 857834 - DNA, 22 bp, Artificial Sequence
  chemically synthesized
gcagatttcaaccgggcttgga

SEQ ID NO: 857835 - DNA, 22 bp, Artificial Sequence
  chemically synthesized
tggcagatttcaaccgggcttg

SEQ ID NO: 857836 - DNA, 22 bp, Artificial Sequence
  chemically synthesized
ctctggcagatttcaaccgggc

SEQ ID NO: 857837 - DNA, 22 bp, Artificial Sequence
  chemically synthesized
tgtccaagcccggttgaaatct

SEQ ID NO: 857838 - DNA, 22 bp, Artificial Sequence
  chemically synthesized
tccaagcccggttgaaatctgc

SEQ ID NO: 857839 - DNA, 22 bp, Artificial Sequence
  chemically synthesized
gaggtacctgctctggcagatt

SEQ ID NO: 857840 - DNA, 22 bp, Artificial Sequence
  chemically synthesized
atgttggaggtacctgctctgg

SEQ ID NO: 857841 - DNA, 22 bp, Artificial Sequence
  chemically synthesized
gatgttggaggtacctgctctg

SEQ ID NO: 857842 - DNA, 22 bp, Artificial Sequence
  chemically synthesized
cttgatgttggaggtacctgct

SEQ ID NO: 857843 - DNA, 22 bp, Artificial Sequence
  chemically synthesized
aaatctgccagagcaggtacct

SEQ ID NO: 857844 - DNA, 22 bp, Artificial Sequence
  chemically synthesized
ccttgatgttggaggtacctgc

SEQ ID NO: 857845 - DNA, 22 bp, Artificial Sequence
  chemically synthesized
ccagagcaggtacctccaacat

SEQ ID NO: 857846 - DNA, 22 bp, Artificial Sequence
  chemically synthesized
gaaatgccatcttccttgatgt

SEQ ID NO: 857847 - DNA, 22 bp, Artificial Sequence
  chemically synthesized
caaactagaaatgccatcttcc

SEQ ID NO: 857848 - DNA, 22 bp, Artificial Sequence
  chemically synthesized
caacatcaaggaagatggcatt

SEQ ID NO: 857849 - DNA, 22 bp, Artificial Sequence
  chemically synthesized
ccatctccaaactagaaatgcc

SEQ ID NO: 857850 - DNA, 22 bp, Artificial Sequence
  chemically synthesized
aggaaactgccatctccaaact

SEQ ID NO: 857851 - DNA, 22 bp, Artificial Sequence
  chemically synthesized
ctaaggaaactgccatctccaa

SEQ ID NO: 857852 - DNA, 22 bp, Artificial Sequence
  chemically synthesized
tggttactaaggaaactgccat

SEQ ID NO: 857853 - DNA, 22 bp, Artificial Sequence
  chemically synthesized
ctagtttggagatggcagtttc

SEQ ID NO: 857854 - DNA, 22 bp, Artificial Sequence
  chemically synthesized
tagtttggagatggcagtttcc

SEQ ID NO: 857855 - DNA, 22 bp, Artificial Sequence
  chemically synthesized
gtttggagatggcagtttcctt

SEQ ID NO: 857856 - DNA, 22 bp, Artificial Sequence
  chemically synthesized
ggagatggcagtttccttagta

SEQ ID NO: 857857 - DNA, 22 bp, Artificial Sequence
  chemically synthesized
gagatggcagtttccttagtaa

SEQ ID NO: 857858 - DNA, 22 bp, Artificial Sequence
  chemically synthesized
gtgacacaacctgtggttacta

SEQ ID NO: 857859 - DNA, 22 bp, Artificial Sequence
  chemically synthesized
tggtgacacaacctgtggttac

SEQ ID NO: 857860 - DNA, 22 bp, Artificial Sequence
  chemically synthesized
ctctggtgacacaacctgtggt

SEQ ID NO: 857861 - DNA, 22 bp, Artificial Sequence
  chemically synthesized
ttactctggtgacacaacctgt

SEQ ID NO: 857862 - DNA, 22 bp, Artificial Sequence
  chemically synthesized
ccttagtaaccacaggttgtgt

SEQ ID NO: 857863 - DNA, 22 bp, Artificial Sequence
  chemically synthesized
cttagtaaccacaggttgtgtc

SEQ ID NO: 857864 - DNA, 22 bp, Artificial Sequence
  chemically synthesized
agtaaccacaggttgtgtcacc

SEQ ID NO: 857865 - DNA, 22 bp, Artificial Sequence
  chemically synthesized
gtaaccacaggttgtgtcacca

SEQ ID NO: 857866 - DNA, 22 bp, Artificial Sequence
  chemically synthesized
agactgttactctggtgacaca

SEQ ID NO: 857867 - DNA, 22 bp, Artificial Sequence
  chemically synthesized
ctcagactgttactctggtgac

SEQ ID NO: 857868 - DNA, 22 bp, Artificial Sequence
  chemically synthesized
ctactcagactgttactctggt

SEQ ID NO: 857869 - DNA, 22 bp, Artificial Sequence
  chemically synthesized
gctcctactcagactgttactc

SEQ ID NO: 857870 - DNA, 22 bp, Artificial Sequence
  chemically synthesized
agctcctactcagactgttact

SEQ ID NO: 857871 - DNA, 22 bp, Artificial Sequence
  chemically synthesized
tagctcctactcagactgttac

SEQ ID NO: 857872 - DNA, 22 bp, Artificial Sequence
  chemically synthesized
tgtcaccagagtaacagtctga

SEQ ID NO: 857873 - DNA, 22 bp, Artificial Sequence
  chemically synthesized
caaaaacccaaaatattttagc

SEQ ID NO: 857874 - DNA, 22 bp, Artificial Sequence
  chemically synthesized
gcaaaaacccaaaatattttag

SEQ ID NO: 857875 - DNA, 22 bp, Artificial Sequence
  chemically synthesized
tgcaaaaacccaaaatatttta

SEQ ID NO: 857876 - DNA, 22 bp, Artificial Sequence
  chemically synthesized
ttgcaaaaacccaaaatatttt

SEQ ID NO: 857877 - DNA, 22 bp, Artificial Sequence
  chemically synthesized
tttgcaaaaacccaaaatattt

SEQ ID NO: 857878 - DNA, 22 bp, Artificial Sequence
  chemically synthesized
agtaggagctaaaatattttgg

SEQ ID NO: 857879 - DNA, 22 bp, Artificial Sequence
  chemically synthesized
ctttttgcaaaaacccaaaata

SEQ ID NO: 857880 - DNA, 22 bp, Artificial Sequence
  chemically synthesized
cctttttgcaaaaacccaaaat

SEQ ID NO: 857881 - DNA, 22 bp, Artificial Sequence
  chemically synthesized
tcctttttgcaaaaacccaaaa

SEQ ID NO: 857882 - DNA, 22 bp, Artificial Sequence
  chemically synthesized
ttcctttttgcaaaaacccaaa

SEQ ID NO: 857883 - DNA, 22 bp, Artificial Sequence
  chemically synthesized
tttcctttttgcaaaaacccaa

SEQ ID NO: 857884 - DNA, 22 bp, Artificial Sequence
  chemically synthesized
ttttcctttttgcaaaaaccca

SEQ ID NO: 857885 - DNA, 22 bp, Artificial Sequence
  chemically synthesized
ttttttcctttttgcaaaaacc

SEQ ID NO: 857886 - DNA, 22 bp, Artificial Sequence
  chemically synthesized
cttttttcctttttgcaaaaac

SEQ ID NO: 857887 - DNA, 22 bp, Artificial Sequence
  chemically synthesized
aaatattttgggtttttgcaaa

SEQ ID NO: 857888 - DNA, 22 bp, Artificial Sequence
  chemically synthesized
ttcttttttcctttttgcaaaa

SEQ ID NO: 857889 - DNA, 22 bp, Artificial Sequence
  chemically synthesized
cttcttttttcctttttgcaaa

SEQ ID NO: 857890 - DNA, 22 bp, Artificial Sequence
  chemically synthesized
tcttcttttttcctttttgcaa

SEQ ID NO: 857891 - DNA, 22 bp, Artificial Sequence
  chemically synthesized
ttcttcttttttcctttttgca

SEQ ID NO: 857892 - DNA, 22 bp, Artificial Sequence
  chemically synthesized
tttcttcttttttcctttttgc

SEQ ID NO: 857893 - DNA, 22 bp, Artificial Sequence
  chemically synthesized
tttttcttcttttttccttttt

SEQ ID NO: 857894 - DNA, 22 bp, Artificial Sequence
  chemically synthesized
tgggtttttgcaaaaaggaaaa

SEQ ID NO: 857895 - DNA, 22 bp, Artificial Sequence
  chemically synthesized
ctttttcttcttttttcctttt

SEQ ID NO: 857896 - DNA, 22 bp, Artificial Sequence
  chemically synthesized
gggtttttgcaaaaaggaaaaa

SEQ ID NO: 857897 - DNA, 22 bp, Artificial Sequence
  chemically synthesized
tctttttcttcttttttccttt

SEQ ID NO: 857898 - DNA, 22 bp, Artificial Sequence
  chemically synthesized
ggtttttgcaaaaaggaaaaaa

SEQ ID NO: 857899 - DNA, 22 bp, Artificial Sequence
  chemically synthesized
ttctttttcttcttttttcctt

SEQ ID NO: 857900 - DNA, 22 bp, Artificial Sequence
  chemically synthesized
atttttctttttcttctttttt

SEQ ID NO: 857901 - DNA, 22 bp, Artificial Sequence
  chemically synthesized
ttgcaaaaaggaaaaaagaaga

SEQ ID NO: 857902 - DNA, 22 bp, Artificial Sequence
  chemically synthesized
tgcaaaaaggaaaaaagaagaa

SEQ ID NO: 857903 - DNA, 22 bp, Artificial Sequence
  chemically synthesized
taatttttctttttcttctttt

SEQ ID NO: 857904 - DNA, 22 bp, Artificial Sequence
  chemically synthesized
gcaaaaaggaaaaaagaagaaa

SEQ ID NO: 857905 - DNA, 22 bp, Artificial Sequence
  chemically synthesized
ctaatttttctttttcttcttt

SEQ ID NO: 857906 - DNA, 22 bp, Artificial Sequence
  chemically synthesized
caaaaaggaaaaaagaagaaaa

SEQ ID NO: 857907 - DNA, 22 bp, Artificial Sequence
  chemically synthesized
tgtttctaatttttctttttct

SEQ ID NO: 857908 - DNA, 22 bp, Artificial Sequence
  chemically synthesized
gtgtttctaatttttctttttc

SEQ ID NO: 857909 - DNA, 22 bp, Artificial Sequence
  chemically synthesized
gcttgtgtttctaatttttctt

SEQ ID NO: 857910 - DNA, 22 bp, Artificial Sequence
  chemically synthesized
agcttgtgtttctaatttttct

SEQ ID NO: 857911 - DNA, 22 bp, Artificial Sequence
  chemically synthesized
tagcttgtgtttctaatttttc

SEQ ID NO: 857912 - DNA, 22 bp, Artificial Sequence
  chemically synthesized
tttagcttgtgtttctaatttt

SEQ ID NO: 857913 - DNA, 22 bp, Artificial Sequence
  chemically synthesized
gctctttagcttgtgtttctaa

SEQ ID NO: 857914 - DNA, 22 bp, Artificial Sequence
  chemically synthesized
aaattggctctttagcttgtgt

SEQ ID NO: 857915 - DNA, 22 bp, Artificial Sequence
  chemically synthesized
ttgaaattggctctttagcttg

SEQ ID NO: 857916 - DNA, 22 bp, Artificial Sequence
  chemically synthesized
ttattgaaattggctctttagc

SEQ ID NO: 857917 - DNA, 22 bp, Artificial Sequence
  chemically synthesized
gaaacacaagctaaagagccaa

SEQ ID NO: 857918 - DNA, 22 bp, Artificial Sequence
  chemically synthesized
ttgttattgaaattggctcttt

SEQ ID NO: 857919 - DNA, 22 bp, Artificial Sequence
  chemically synthesized
attgttattgaaattggctctt

SEQ ID NO: 857920 - DNA, 22 bp, Artificial Sequence
  chemically synthesized
acttattgttattgaaattggc

SEQ ID NO: 857921 - DNA, 22 bp, Artificial Sequence
  chemically synthesized
gacttattgttattgaaattgg

SEQ ID NO: 857922 - DNA, 22 bp, Artificial Sequence
  chemically synthesized
aatttgacttattgttattgaa

SEQ ID NO: 857923 - DNA, 22 bp, Artificial Sequence
  chemically synthesized
aagagccaatttcaataacaat

SEQ ID NO: 857924 - DNA, 22 bp, Artificial Sequence
  chemically synthesized
aattaaatttgacttattgtta

SEQ ID NO: 857925 - DNA, 22 bp, Artificial Sequence
  chemically synthesized
caattaaatttgacttattgtt

SEQ ID NO: 857926 - DNA, 22 bp, Artificial Sequence
  chemically synthesized
ttcaattaaatttgacttattg

SEQ ID NO: 857927 - DNA, 22 bp, Artificial Sequence
  chemically synthesized
ctcttcaattaaatttgactta

SEQ ID NO: 857928 - DNA, 22 bp, Artificial Sequence
  chemically synthesized
caataacaataagtcaaattta

SEQ ID NO: 857929 - DNA, 22 bp, Artificial Sequence
  chemically synthesized
ttactcttcaattaaatttgac

SEQ ID NO: 857930 - DNA, 22 bp, Artificial Sequence
  chemically synthesized
aataacaataagtcaaatttaa

SEQ ID NO: 857931 - DNA, 22 bp, Artificial Sequence
  chemically synthesized
aaattgttactcttcaattaaa

SEQ ID NO: 857932 - DNA, 22 bp, Artificial Sequence
  chemically synthesized
gctcaaattgttactcttcaat

SEQ ID NO: 857933 - DNA, 22 bp, Artificial Sequence
  chemically synthesized
ggctcaaattgttactcttcaa

SEQ ID NO: 857934 - DNA, 22 bp, Artificial Sequence
  chemically synthesized
aattgaagagtaacaatttgag

SEQ ID NO: 857935 - DNA, 22 bp, Artificial Sequence
  chemically synthesized
attgaagagtaacaatttgagc

SEQ ID NO: 857936 - DNA, 22 bp, Artificial Sequence
  chemically synthesized
aagagtaacaatttgagccaaa

SEQ ID NO: 857937 - DNA, 22 bp, Artificial Sequence
  chemically synthesized
gagccaaactcttattcatgac

SEQ ID NO: 857938 - DNA, 22 bp, Artificial Sequence
  chemically synthesized
agccaaactcttattcatgaca

SEQ ID NO: 857939 - DNA, 22 bp, Artificial Sequence
  chemically synthesized
gaaaaagatatataatgtcatg

SEQ ID NO: 857940 - DNA, 22 bp, Artificial Sequence
  chemically synthesized
ttagaaaaagatatataatgtc

SEQ ID NO: 857941 - DNA, 22 bp, Artificial Sequence
  chemically synthesized
ttattcatgacattatatatct

SEQ ID NO: 857942 - DNA, 22 bp, Artificial Sequence
  chemically synthesized
attcatgacattatatatcttt

SEQ ID NO: 857943 - DNA, 22 bp, Artificial Sequence
  chemically synthesized
ttcatgacattatatatctttt

SEQ ID NO: 857944 - DNA, 22 bp, Artificial Sequence
  chemically synthesized
atgacattatatatctttttct

SEQ ID NO: 857945 - DNA, 22 bp, Artificial Sequence
  chemically synthesized
aacaaagtatccacattgttag

SEQ ID NO: 857946 - DNA, 22 bp, Artificial Sequence
  chemically synthesized
tatatctttttctaacaatgtg

SEQ ID NO: 857947 - DNA, 22 bp, Artificial Sequence
  chemically synthesized
ctaaacaaagtatccacattgt

SEQ ID NO: 857948 - DNA, 22 bp, Artificial Sequence
  chemically synthesized
tttctaacaatgtggatacttt

SEQ ID NO: 857949 - DNA, 22 bp, Artificial Sequence
  chemically synthesized
ttctaacaatgtggatactttg

SEQ ID NO: 857950 - DNA, 22 bp, Artificial Sequence
  chemically synthesized
tctaacaatgtggatactttgt

SEQ ID NO: 857951 - DNA, 22 bp, Artificial Sequence
  chemically synthesized
ctaacaatgtggatactttgtt

SEQ ID NO: 857952 - DNA, 22 bp, Artificial Sequence
  chemically synthesized
taacaatgtggatactttgttt

SEQ ID NO: 857953 - DNA, 22 bp, Artificial Sequence
  chemically synthesized
ccatgtattgctaaacaaagta

SEQ ID NO: 857954 - DNA, 22 bp, Artificial Sequence
  chemically synthesized
acaatgtggatactttgtttag

SEQ ID NO: 857955 - DNA, 22 bp, Artificial Sequence
  chemically synthesized
taccatgtattgctaaacaaag

SEQ ID NO: 857956 - DNA, 22 bp, Artificial Sequence
  chemically synthesized
ctaccatgtattgctaaacaaa

SEQ ID NO: 857957 - DNA, 22 bp, Artificial Sequence
  chemically synthesized
tctaccatgtattgctaaacaa

SEQ ID NO: 857958 - DNA, 22 bp, Artificial Sequence
  chemically synthesized
attttctaccatgtattgctaa

SEQ ID NO: 857959 - DNA, 22 bp, Artificial Sequence
  chemically synthesized
cattttctaccatgtattgcta

SEQ ID NO: 857960 - DNA, 22 bp, Artificial Sequence
  chemically synthesized
tcattttctaccatgtattgct

SEQ ID NO: 857961 - DNA, 22 bp, Artificial Sequence
  chemically synthesized
ttcattttctaccatgtattgc

SEQ ID NO: 857962 - DNA, 22 bp, Artificial Sequence
  chemically synthesized
tgtttagcaatacatggtagaa

SEQ ID NO: 857963 - DNA, 22 bp, Artificial Sequence
  chemically synthesized
aatcttttcattttctaccatg

SEQ ID NO: 857964 - DNA, 22 bp, Artificial Sequence
  chemically synthesized
gtttagcaatacatggtagaaa

SEQ ID NO: 857965 - DNA, 22 bp, Artificial Sequence
  chemically synthesized
tttagcaatacatggtagaaaa

SEQ ID NO: 857966 - DNA, 22 bp, Artificial Sequence
  chemically synthesized
agcaatacatggtagaaaatga

SEQ ID NO: 857967 - DNA, 22 bp, Artificial Sequence
  chemically synthesized
gcaatacatggtagaaaatgaa

SEQ ID NO: 857968 - DNA, 22 bp, Artificial Sequence
  chemically synthesized
atgaaaaggttgaatcttttca

SEQ ID NO: 857969 - DNA, 22 bp, Artificial Sequence
  chemically synthesized
aatgtatattaatgaaaaggtt

SEQ ID NO: 857970 - DNA, 22 bp, Artificial Sequence
  chemically synthesized
ttaaatgtatattaatgaaaag

SEQ ID NO: 857971 - DNA, 22 bp, Artificial Sequence
  chemically synthesized
aaaaattgttaaatgtatatta

SEQ ID NO: 857972 - DNA, 22 bp, Artificial Sequence
  chemically synthesized
aaccttttcattaatatacatt

SEQ ID NO: 857973 - DNA, 22 bp, Artificial Sequence
  chemically synthesized
aaaaaattgttaaatgtatatt

SEQ ID NO: 857974 - DNA, 22 bp, Artificial Sequence
  chemically synthesized
taaaaaattgttaaatgtatat

SEQ ID NO: 857975 - DNA, 22 bp, Artificial Sequence
  chemically synthesized
ttaaaaaattgttaaatgtata

SEQ ID NO: 857976 - DNA, 22 bp, Artificial Sequence
  chemically synthesized
tttaaaaaattgttaaatgtat

SEQ ID NO: 857977 - DNA, 22 bp, Artificial Sequence
  chemically synthesized
ttcattaatatacatttaacaa

SEQ ID NO: 857978 - DNA, 22 bp, Artificial Sequence
  chemically synthesized
tcattaatatacatttaacaat

SEQ ID NO: 857979 - DNA, 22 bp, Artificial Sequence
  chemically synthesized
cattaatatacatttaacaatt

SEQ ID NO: 857980 - DNA, 22 bp, Artificial Sequence
  chemically synthesized
attaatatacatttaacaattt

SEQ ID NO: 857981 - DNA, 22 bp, Artificial Sequence
  chemically synthesized
atatacatttaacaatttttta

SEQ ID NO: 857982 - DNA, 22 bp, Artificial Sequence
  chemically synthesized
aacaattttttaaaaaacgatt

SEQ ID NO: 857983 - DNA, 22 bp, Artificial Sequence
  chemically synthesized
acaattttttaaaaaacgattt

SEQ ID NO: 857984 - DNA, 22 bp, Artificial Sequence
  chemically synthesized
tttaaaaaacgattttgctcat

SEQ ID NO: 857985 - DNA, 22 bp, Artificial Sequence
  chemically synthesized
ttaaaaaacgattttgctcatt

SEQ ID NO: 857986 - DNA, 22 bp, Artificial Sequence
  chemically synthesized
tccaggcatgagaatgagcaaa

SEQ ID NO: 857987 - DNA, 22 bp, Artificial Sequence
  chemically synthesized
taaaaaacgattttgctcattc

SEQ ID NO: 857988 - DNA, 22 bp, Artificial Sequence
  chemically synthesized
gtccaggcatgagaatgagcaa

SEQ ID NO: 857989 - DNA, 22 bp, Artificial Sequence
  chemically synthesized
aaaaaacgattttgctcattct

SEQ ID NO: 857990 - DNA, 22 bp, Artificial Sequence
  chemically synthesized
aaaaacgattttgctcattctc

SEQ ID NO: 857991 - DNA, 22 bp, Artificial Sequence
  chemically synthesized
cttgtccaggcatgagaatgag

SEQ ID NO: 857992 - DNA, 22 bp, Artificial Sequence
  chemically synthesized
agttacttgtccaggcatgaga

SEQ ID NO: 857993 - DNA, 22 bp, Artificial Sequence
  chemically synthesized
aagttacttgtccaggcatgag

SEQ ID NO: 857994 - DNA, 22 bp, Artificial Sequence
  chemically synthesized
tgctcattctcatgcctggaca

SEQ ID NO: 857995 - DNA, 22 bp, Artificial Sequence
  chemically synthesized
acttaagttacttgtccaggca

SEQ ID NO: 857996 - DNA, 22 bp, Artificial Sequence
  chemically synthesized
gctcattctcatgcctggacaa

SEQ ID NO: 857997 - DNA, 22 bp, Artificial Sequence
  chemically synthesized
aacttaagttacttgtccaggc

SEQ ID NO: 857998 - DNA, 22 bp, Artificial Sequence
  chemically synthesized
ctcattctcatgcctggacaag

SEQ ID NO: 857999 - DNA, 22 bp, Artificial Sequence
  chemically synthesized
tttaacttaagttacttgtcca

SEQ ID NO: 858000 - DNA, 22 bp, Artificial Sequence
  chemically synthesized
attctcatgcctggacaagtaa

SEQ ID NO: 858001 - DNA, 22 bp, Artificial Sequence
  chemically synthesized
atttaacttaagttacttgtcc

SEQ ID NO: 858002 - DNA, 22 bp, Artificial Sequence
  chemically synthesized
tcatgcctggacaagtaactta

SEQ ID NO: 858003 - DNA, 22 bp, Artificial Sequence
  chemically synthesized
atgcctggacaagtaacttaag

SEQ ID NO: 858004 - DNA, 22 bp, Artificial Sequence
  chemically synthesized
agaaggcttatttaacttaagt

SEQ ID NO: 858005 - DNA, 22 bp, Artificial Sequence
  chemically synthesized
ctgagaaggcttatttaactta

SEQ ID NO: 858006 - DNA, 22 bp, Artificial Sequence
  chemically synthesized
gacaagtaacttaagttaaata

SEQ ID NO: 858007 - DNA, 22 bp, Artificial Sequence
  chemically synthesized
ttactgagaaggcttatttaac

SEQ ID NO: 858008 - DNA, 22 bp, Artificial Sequence
  chemically synthesized
aagttaaataagccttctcagt

SEQ ID NO: 858009 - DNA, 22 bp, Artificial Sequence
  chemically synthesized
agttaaataagccttctcagta

SEQ ID NO: 858010 - DNA, 22 bp, Artificial Sequence
  chemically synthesized
aataagccttctcagtaacaat

SEQ ID NO: 858011 - DNA, 22 bp, Artificial Sequence
  chemically synthesized
cacaatgtatatgattgttact

SEQ ID NO: 858012 - DNA, 22 bp, Artificial Sequence
  chemically synthesized
ccacaatgtatatgattgttac

SEQ ID NO: 858013 - DNA, 22 bp, Artificial Sequence
  chemically synthesized
ccacttccacaatgtatatgat

SEQ ID NO: 858014 - DNA, 22 bp, Artificial Sequence
  chemically synthesized
accacttccacaatgtatatga

SEQ ID NO: 858015 - DNA, 22 bp, Artificial Sequence
  chemically synthesized
ctcagtaacaatcatatacatt

SEQ ID NO: 858016 - DNA, 22 bp, Artificial Sequence
  chemically synthesized
taccacttccacaatgtatatg

SEQ ID NO: 858017 - DNA, 22 bp, Artificial Sequence
  chemically synthesized
tcagtaacaatcatatacattg

SEQ ID NO: 858018 - DNA, 22 bp, Artificial Sequence
  chemically synthesized
tttaccacttccacaatgtata

SEQ ID NO: 858019 - DNA, 22 bp, Artificial Sequence
  chemically synthesized
agtaacaatcatatacattgtg

SEQ ID NO: 858020 - DNA, 22 bp, Artificial Sequence
  chemically synthesized
ctttaccacttccacaatgtat

SEQ ID NO: 858021 - DNA, 22 bp, Artificial Sequence
  chemically synthesized
tctttaccacttccacaatgta

SEQ ID NO: 858022 - DNA, 22 bp, Artificial Sequence
  chemically synthesized
ttttctttaccacttccacaat

SEQ ID NO: 858023 - DNA, 22 bp, Artificial Sequence
  chemically synthesized
gttttctttaccacttccacaa

SEQ ID NO: 858024 - DNA, 22 bp, Artificial Sequence
  chemically synthesized
tgttttctttaccacttccaca

SEQ ID NO: 858025 - DNA, 22 bp, Artificial Sequence
  chemically synthesized
ttgttttctttaccacttccac

SEQ ID NO: 858026 - DNA, 22 bp, Artificial Sequence
  chemically synthesized
aaaacttttgttttctttacca

SEQ ID NO: 858027 - DNA, 22 bp, Artificial Sequence
  chemically synthesized
tggaagtggtaaagaaaacaaa

SEQ ID NO: 858028 - DNA, 22 bp, Artificial Sequence
  chemically synthesized
gcaaggtctgaaaacttttgtt

SEQ ID NO: 858029 - DNA, 22 bp, Artificial Sequence
  chemically synthesized
cctggcaaggtctgaaaacttt

SEQ ID NO: 858030 - DNA, 22 bp, Artificial Sequence
  chemically synthesized
ccctggcaaggtctgaaaactt

SEQ ID NO: 858031 - DNA, 22 bp, Artificial Sequence
  chemically synthesized
tttccctggcaaggtctgaaaa

SEQ ID NO: 858032 - DNA, 22 bp, Artificial Sequence
  chemically synthesized
atttccctggcaaggtctgaaa

SEQ ID NO: 858033 - DNA, 22 bp, Artificial Sequence
  chemically synthesized
tcagaccttgccagggaaataa

SEQ ID NO: 858034 - DNA, 22 bp, Artificial Sequence
  chemically synthesized
cagaccttgccagggaaataaa

SEQ ID NO: 858035 - DNA, 22 bp, Artificial Sequence
  chemically synthesized
agaccttgccagggaaataaat

SEQ ID NO: 858036 - DNA, 22 bp, Artificial Sequence
  chemically synthesized
gccagggaaataaattttactt

SEQ ID NO: 858037 - DNA, 22 bp, Artificial Sequence
  chemically synthesized
ccagggaaataaattttactta

SEQ ID NO: 858038 - DNA, 22 bp, Artificial Sequence
  chemically synthesized
aataaaaaaaaaataagtaaaa

SEQ ID NO: 858039 - DNA, 22 bp, Artificial Sequence
  chemically synthesized
gaataaaaaaaaaataagtaaa

SEQ ID NO: 858040 - DNA, 22 bp, Artificial Sequence
  chemically synthesized
ttgaataaaaaaaaaataagta

SEQ ID NO: 858041 - DNA, 22 bp, Artificial Sequence
  chemically synthesized
cttgaataaaaaaaaaataagt

SEQ ID NO: 858042 - DNA, 22 bp, Artificial Sequence
  chemically synthesized
tcttgaataaaaaaaaaataag

SEQ ID NO: 858043 - DNA, 22 bp, Artificial Sequence
  chemically synthesized
ttcttgaataaaaaaaaaataa

SEQ ID NO: 858044 - DNA, 22 bp, Artificial Sequence
  chemically synthesized
tttcttgaataaaaaaaaaata

SEQ ID NO: 858045 - DNA, 22 bp, Artificial Sequence
  chemically synthesized
ttttttcttgaataaaaaaaaa

SEQ ID NO: 858046 - DNA, 22 bp, Artificial Sequence
  chemically synthesized
gttttttcttgaataaaaaaaa

SEQ ID NO: 858047 - DNA, 22 bp, Artificial Sequence
  chemically synthesized
tgttttttcttgaataaaaaaa

SEQ ID NO: 858048 - DNA, 22 bp, Artificial Sequence
  chemically synthesized
tacttattttttttttattcaa

SEQ ID NO: 858049 - DNA, 22 bp, Artificial Sequence
  chemically synthesized
acttattttttttttattcaag

SEQ ID NO: 858050 - DNA, 22 bp, Artificial Sequence
  chemically synthesized
cctttgttttttcttgaataaa

SEQ ID NO: 858051 - DNA, 22 bp, Artificial Sequence
  chemically synthesized
cttattttttttttattcaaga

SEQ ID NO: 858052 - DNA, 22 bp, Artificial Sequence
  chemically synthesized
gcctttgttttttcttgaataa

SEQ ID NO: 858053 - DNA, 22 bp, Artificial Sequence
  chemically synthesized
tgcctttgttttttcttgaata

SEQ ID NO: 858054 - DNA, 22 bp, Artificial Sequence
  chemically synthesized
attttttttttattcaagaaaa

SEQ ID NO: 858055 - DNA, 22 bp, Artificial Sequence
  chemically synthesized
ttttttttttattcaagaaaaa

SEQ ID NO: 858056 - DNA, 22 bp, Artificial Sequence
  chemically synthesized
ttttgcctttgttttttcttga

SEQ ID NO: 858057 - DNA, 22 bp, Artificial Sequence
  chemically synthesized
gttttgcctttgttttttcttg

SEQ ID NO: 858058 - DNA, 22 bp, Artificial Sequence
  chemically synthesized
tttttttattcaagaaaaaaca

SEQ ID NO: 858059 - DNA, 22 bp, Artificial Sequence
  chemically synthesized
ttttttattcaagaaaaaacaa

SEQ ID NO: 858060 - DNA, 22 bp, Artificial Sequence
  chemically synthesized
tttttattcaagaaaaaacaaa

SEQ ID NO: 858061 - DNA, 22 bp, Artificial Sequence
  chemically synthesized
ttttattcaagaaaaaacaaag

SEQ ID NO: 858062 - DNA, 22 bp, Artificial Sequence
  chemically synthesized
tttattcaagaaaaaacaaagg

SEQ ID NO: 858063 - DNA, 22 bp, Artificial Sequence
  chemically synthesized
ttattcaagaaaaaacaaaggc

SEQ ID NO: 858064 - DNA, 22 bp, Artificial Sequence
  chemically synthesized
tattcaagaaaaaacaaaggca

SEQ ID NO: 858065 - DNA, 22 bp, Artificial Sequence
  chemically synthesized
attcaagaaaaaacaaaggcaa

SEQ ID NO: 858066 - DNA, 22 bp, Artificial Sequence
  chemically synthesized
tcccatcttgttttgcctttgt

SEQ ID NO: 858067 - DNA, 22 bp, Artificial Sequence
  chemically synthesized
ttcaagaaaaaacaaaggcaaa

SEQ ID NO: 858068 - DNA, 22 bp, Artificial Sequence
  chemically synthesized
atcccatcttgttttgcctttg

SEQ ID NO: 858069 - DNA, 22 bp, Artificial Sequence
  chemically synthesized
aagaaaaaacaaaggcaaaaca

SEQ ID NO: 858070 - DNA, 22 bp, Artificial Sequence
  chemically synthesized
aatcagaaagaagatcttatcc

SEQ ID NO: 858071 - DNA, 22 bp, Artificial Sequence
  chemically synthesized
aaatcagaaagaagatcttatc

SEQ ID NO: 858072 - DNA, 22 bp, Artificial Sequence
  chemically synthesized
taaatcagaaagaagatcttat

SEQ ID NO: 858073 - DNA, 22 bp, Artificial Sequence
  chemically synthesized
aagggaattttaaatcagaaag

SEQ ID NO: 858074 - DNA, 22 bp, Artificial Sequence
  chemically synthesized
ttcaagggaattttaaatcaga

SEQ ID NO: 858075 - DNA, 22 bp, Artificial Sequence
  chemically synthesized
ctattcaagggaattttaaatc

SEQ ID NO: 858076 - DNA, 22 bp, Artificial Sequence
  chemically synthesized
cctattcaagggaattttaaat

SEQ ID NO: 858077 - DNA, 22 bp, Artificial Sequence
  chemically synthesized
cttcctattcaagggaatttta

SEQ ID NO: 858078 - DNA, 22 bp, Artificial Sequence
  chemically synthesized
acttcctattcaagggaatttt

SEQ ID NO: 858079 - DNA, 22 bp, Artificial Sequence
  chemically synthesized
ctttctgatttaaaattccctt

SEQ ID NO: 858080 - DNA, 22 bp, Artificial Sequence
  chemically synthesized
tttctgatttaaaattcccttg

SEQ ID NO: 858081 - DNA, 22 bp, Artificial Sequence
  chemically synthesized
tctgatttaaaattcccttgaa

SEQ ID NO: 858082 - DNA, 22 bp, Artificial Sequence
  chemically synthesized
atttacttcctattcaagggaa

SEQ ID NO: 858083 - DNA, 22 bp, Artificial Sequence
  chemically synthesized
ctgatttaaaattcccttgaat

SEQ ID NO: 858084 - DNA, 22 bp, Artificial Sequence
  chemically synthesized
tgatttaaaattcccttgaata

SEQ ID NO: 858085 - DNA, 22 bp, Artificial Sequence
  chemically synthesized
atttaaaattcccttgaatagg

SEQ ID NO: 858086 - DNA, 22 bp, Artificial Sequence
  chemically synthesized
aaattaatttacttcctattca

SEQ ID NO: 858087 - DNA, 22 bp, Artificial Sequence
  chemically synthesized
caaattaatttacttcctattc

SEQ ID NO: 858088 - DNA, 22 bp, Artificial Sequence
  chemically synthesized
aaaattcccttgaataggaagt

SEQ ID NO: 858089 - DNA, 22 bp, Artificial Sequence
  chemically synthesized
aaattcccttgaataggaagta

SEQ ID NO: 858090 - DNA, 22 bp, Artificial Sequence
  chemically synthesized
ccttgaataggaagtaaattaa

SEQ ID NO: 858091 - DNA, 22 bp, Artificial Sequence
  chemically synthesized
gggtccagcttcaaattaattt

SEQ ID NO: 858092 - DNA, 22 bp, Artificial Sequence
  chemically synthesized
gaataggaagtaaattaatttg

SEQ ID NO: 858093 - DNA, 22 bp, Artificial Sequence
  chemically synthesized
aataggaagtaaattaatttga

SEQ ID NO: 858094 - DNA, 22 bp, Artificial Sequence
  chemically synthesized
cctagggtccagcttcaaatta

SEQ ID NO: 858095 - DNA, 22 bp, Artificial Sequence
  chemically synthesized
ccctagggtccagcttcaaatt

SEQ ID NO: 858096 - DNA, 22 bp, Artificial Sequence
  chemically synthesized
atttccctagggtccagcttca

SEQ ID NO: 858097 - DNA, 22 bp, Artificial Sequence
  chemically synthesized
gatttccctagggtccagcttc

SEQ ID NO: 858098 - DNA, 22 bp, Artificial Sequence
  chemically synthesized
tgatttccctagggtccagctt

SEQ ID NO: 858099 - DNA, 22 bp, Artificial Sequence
  chemically synthesized
gctttgatttccctagggtcca

SEQ ID NO: 858100 - DNA, 22 bp, Artificial Sequence
  chemically synthesized
atttgaagctggaccctaggga

SEQ ID NO: 858101 - DNA, 22 bp, Artificial Sequence
  chemically synthesized
attggctttgatttccctaggg

SEQ ID NO: 858102 - DNA, 22 bp, Artificial Sequence
  chemically synthesized
cattggctttgatttccctagg

SEQ ID NO: 858103 - DNA, 22 bp, Artificial Sequence
  chemically synthesized
gaagctggaccctagggaaatc

SEQ ID NO: 858104 - DNA, 22 bp, Artificial Sequence
  chemically synthesized
aagctggaccctagggaaatca

SEQ ID NO: 858105 - DNA, 22 bp, Artificial Sequence
  chemically synthesized
gaccctagggaaatcaaagcca

SEQ ID NO: 858106 - DNA, 22 bp, Artificial Sequence
  chemically synthesized
agacaagaacgtttcattggct

SEQ ID NO: 858107 - DNA, 22 bp, Artificial Sequence
  chemically synthesized
gggaaatcaaagccaatgaaac

SEQ ID NO: 858108 - DNA, 22 bp, Artificial Sequence
  chemically synthesized
ccagtataaaatacagagctaa

SEQ ID NO: 858109 - DNA, 22 bp, Artificial Sequence
  chemically synthesized
ctcccagtataaaatacagagc

SEQ ID NO: 858110 - DNA, 22 bp, Artificial Sequence
  chemically synthesized
ttgtcttagctctgtattttat

SEQ ID NO: 858111 - DNA, 22 bp, Artificial Sequence
  chemically synthesized
gtcttagctctgtattttatac

SEQ ID NO: 858112 - DNA, 22 bp, Artificial Sequence
  chemically synthesized
tcttagctctgtattttatact

SEQ ID NO: 858113 - DNA, 22 bp, Artificial Sequence
  chemically synthesized
agctctgtattttatactggga

SEQ ID NO: 858114 - DNA, 22 bp, Artificial Sequence
  chemically synthesized
gctctgtattttatactgggag

SEQ ID NO: 858115 - DNA, 22 bp, Artificial Sequence
  chemically synthesized
tgtattttatactgggagcagt

SEQ ID NO: 858116 - DNA, 22 bp, Artificial Sequence
  chemically synthesized
tattttatactgggagcagttt

SEQ ID NO: 858117 - DNA, 22 bp, Artificial Sequence
  chemically synthesized
tatactgggagcagtttatcat

SEQ ID NO: 858118 - DNA, 22 bp, Artificial Sequence
  chemically synthesized
atactgggagcagtttatcata

SEQ ID NO: 858119 - DNA, 22 bp, Artificial Sequence
  chemically synthesized
tactgggagcagtttatcatat

SEQ ID NO: 858120 - DNA, 22 bp, Artificial Sequence
  chemically synthesized
aaataaaaagaaaaaaatatga

SEQ ID NO: 858121 - DNA, 22 bp, Artificial Sequence
  chemically synthesized
ggagcagtttatcatatttttt

SEQ ID NO: 858122 - DNA, 22 bp, Artificial Sequence
  chemically synthesized
acaatctgaaataaaaagaaaa

SEQ ID NO: 858123 - DNA, 22 bp, Artificial Sequence
  chemically synthesized
atcatatttttttctttttatt

SEQ ID NO: 858124 - DNA, 22 bp, Artificial Sequence
  chemically synthesized
ctaacaatctgaaataaaaaga

SEQ ID NO: 858125 - DNA, 22 bp, Artificial Sequence
  chemically synthesized
tcatatttttttctttttattt

SEQ ID NO: 858126 - DNA, 22 bp, Artificial Sequence
  chemically synthesized
actaacaatctgaaataaaaag

SEQ ID NO: 858127 - DNA, 22 bp, Artificial Sequence
  chemically synthesized
ttttctttttatttcagattgt

SEQ ID NO: 858128 - DNA, 22 bp, Artificial Sequence
  chemically synthesized
gccagtttactaacaatctgaa

SEQ ID NO: 858129 - DNA, 22 bp, Artificial Sequence
  chemically synthesized
tttctttttatttcagattgtt

SEQ ID NO: 858130 - DNA, 22 bp, Artificial Sequence
  chemically synthesized
ttctttttatttcagattgtta

SEQ ID NO: 858131 - DNA, 22 bp, Artificial Sequence
  chemically synthesized
tctttttatttcagattgttag

SEQ ID NO: 858132 - DNA, 22 bp, Artificial Sequence
  chemically synthesized
ctggccagtttactaacaatct

SEQ ID NO: 858133 - DNA, 22 bp, Artificial Sequence
  chemically synthesized
ctttttatttcagattgttagt

SEQ ID NO: 858134 - DNA, 22 bp, Artificial Sequence
  chemically synthesized
tttttatttcagattgttagta

SEQ ID NO: 858135 - DNA, 22 bp, Artificial Sequence
  chemically synthesized
tttatttcagattgttagtaaa

SEQ ID NO: 858136 - DNA, 22 bp, Artificial Sequence
  chemically synthesized
actgctggccagtttactaaca

SEQ ID NO: 858137 - DNA, 22 bp, Artificial Sequence
  chemically synthesized
ttatttcagattgttagtaaac

SEQ ID NO: 858138 - DNA, 22 bp, Artificial Sequence
  chemically synthesized
cactgctggccagtttactaac

SEQ ID NO: 858139 - DNA, 22 bp, Artificial Sequence
  chemically synthesized
tatttcagattgttagtaaact

SEQ ID NO: 858140 - DNA, 22 bp, Artificial Sequence
  chemically synthesized
atttcagattgttagtaaactg

SEQ ID NO: 858141 - DNA, 22 bp, Artificial Sequence
  chemically synthesized
ttcactgctggccagtttacta

SEQ ID NO: 858142 - DNA, 22 bp, Artificial Sequence
  chemically synthesized
tttcagattgttagtaaactgg

SEQ ID NO: 858143 - DNA, 22 bp, Artificial Sequence
  chemically synthesized
cttcactgctggccagtttact

SEQ ID NO: 858144 - DNA, 22 bp, Artificial Sequence
  chemically synthesized
tcttcactgctggccagtttac

SEQ ID NO: 858145 - DNA, 22 bp, Artificial Sequence
  chemically synthesized
ttcttcactgctggccagttta

SEQ ID NO: 858146 - DNA, 22 bp, Artificial Sequence
  chemically synthesized
cagattgttagtaaactggcca

SEQ ID NO: 858147 - DNA, 22 bp, Artificial Sequence
  chemically synthesized
agattgttagtaaactggccag

SEQ ID NO: 858148 - DNA, 22 bp, Artificial Sequence
  chemically synthesized
gtttttcttcactgctggccag

SEQ ID NO: 858149 - DNA, 22 bp, Artificial Sequence
  chemically synthesized
ggtttttcttcactgctggcca

SEQ ID NO: 858150 - DNA, 22 bp, Artificial Sequence
  chemically synthesized
ttagtaaactggccagcagtga

SEQ ID NO: 858151 - DNA, 22 bp, Artificial Sequence
  chemically synthesized
gtaaactggccagcagtgaaga

SEQ ID NO: 858152 - DNA, 22 bp, Artificial Sequence
  chemically synthesized
tatcttggtttttcttcactgc

SEQ ID NO: 858153 - DNA, 22 bp, Artificial Sequence
  chemically synthesized
gccagcagtgaagaaaaaccaa

SEQ ID NO: 858154 - DNA, 22 bp, Artificial Sequence
  chemically synthesized
agaaaatattgtatcttggttt

SEQ ID NO: 858155 - DNA, 22 bp, Artificial Sequence
  chemically synthesized
aagaaaatattgtatcttggtt

SEQ ID NO: 858156 - DNA, 22 bp, Artificial Sequence
  chemically synthesized
taagaaaatattgtatcttggt

SEQ ID NO: 858157 - DNA, 22 bp, Artificial Sequence
  chemically synthesized
ttaagaaaatattgtatcttgg

SEQ ID NO: 858158 - DNA, 22 bp, Artificial Sequence
  chemically synthesized
gcatttttaagaaaatattgta

SEQ ID NO: 858159 - DNA, 22 bp, Artificial Sequence
  chemically synthesized
actcgcatttttaagaaaatat

SEQ ID NO: 858160 - DNA, 22 bp, Artificial Sequence
  chemically synthesized
ctaactcgcatttttaagaaaa

SEQ ID NO: 858161 - DNA, 22 bp, Artificial Sequence
  chemically synthesized
aatagaaaaactactaactcgc

SEQ ID NO: 858162 - DNA, 22 bp, Artificial Sequence
  chemically synthesized
tcttaaaaatgcgagttagtag

SEQ ID NO: 858163 - DNA, 22 bp, Artificial Sequence
  chemically synthesized
cttaaaaatgcgagttagtagt

SEQ ID NO: 858164 - DNA, 22 bp, Artificial Sequence
  chemically synthesized
ttaaaaatgcgagttagtagtt

SEQ ID NO: 858165 - DNA, 22 bp, Artificial Sequence
  chemically synthesized
aaaaatgcgagttagtagtttt

SEQ ID NO: 858166 - DNA, 22 bp, Artificial Sequence
  chemically synthesized
aaaatgcgagttagtagttttt

SEQ ID NO: 858167 - DNA, 22 bp, Artificial Sequence
  chemically synthesized
atgtctaaatagaaaaactact

SEQ ID NO: 858168 - DNA, 22 bp, Artificial Sequence
  chemically synthesized
catgtctaaatagaaaaactac

SEQ ID NO: 858169 - DNA, 22 bp, Artificial Sequence
  chemically synthesized
aaacagtatttcatgtctaaat

SEQ ID NO: 858170 - DNA, 22 bp, Artificial Sequence
  chemically synthesized
gtagtttttctatttagacatg

SEQ ID NO: 858171 - DNA, 22 bp, Artificial Sequence
  chemically synthesized
gaaacagtatttcatgtctaaa

SEQ ID NO: 858172 - DNA, 22 bp, Artificial Sequence
  chemically synthesized
tgaaacagtatttcatgtctaa

SEQ ID NO: 858173 - DNA, 22 bp, Artificial Sequence
  chemically synthesized
ttctatttagacatgaaatact

SEQ ID NO: 858174 - DNA, 22 bp, Artificial Sequence
  chemically synthesized
tctatttagacatgaaatactg

SEQ ID NO: 858175 - DNA, 22 bp, Artificial Sequence
  chemically synthesized
atgactttgaaacagtatttca

SEQ ID NO: 858176 - DNA, 22 bp, Artificial Sequence
  chemically synthesized
ctatttagacatgaaatactgt

SEQ ID NO: 858177 - DNA, 22 bp, Artificial Sequence
  chemically synthesized
aatgactttgaaacagtatttc

SEQ ID NO: 858178 - DNA, 22 bp, Artificial Sequence
  chemically synthesized
tatttagacatgaaatactgtt

SEQ ID NO: 858179 - DNA, 22 bp, Artificial Sequence
  chemically synthesized
tttagacatgaaatactgtttc

SEQ ID NO: 858180 - DNA, 22 bp, Artificial Sequence
  chemically synthesized
tttaatgactttgaaacagtat

SEQ ID NO: 858181 - DNA, 22 bp, Artificial Sequence
  chemically synthesized
atttaatgactttgaaacagta

SEQ ID NO: 858182 - DNA, 22 bp, Artificial Sequence
  chemically synthesized
agacatgaaatactgtttcaaa

SEQ ID NO: 858183 - DNA, 22 bp, Artificial Sequence
  chemically synthesized
gacatgaaatactgtttcaaag

SEQ ID NO: 858184 - DNA, 22 bp, Artificial Sequence
  chemically synthesized
agatttatttaatgactttgaa

SEQ ID NO: 858185 - DNA, 22 bp, Artificial Sequence
  chemically synthesized
atattaagatttatttaatgac

SEQ ID NO: 858186 - DNA, 22 bp, Artificial Sequence
  chemically synthesized
ttcatattaagatttatttaat

SEQ ID NO: 858187 - DNA, 22 bp, Artificial Sequence
  chemically synthesized
tttcaaagtcattaaataaatc

SEQ ID NO: 858188 - DNA, 22 bp, Artificial Sequence
  chemically synthesized
caaagtcattaaataaatctta

SEQ ID NO: 858189 - DNA, 22 bp, Artificial Sequence
  chemically synthesized
aaagtcattaaataaatcttaa

SEQ ID NO: 858190 - DNA, 22 bp, Artificial Sequence
  chemically synthesized
cagtgtccaacactattcatat

SEQ ID NO: 858191 - DNA, 22 bp, Artificial Sequence
  chemically synthesized
aataaatcttaatatgaatagt

SEQ ID NO: 858192 - DNA, 22 bp, Artificial Sequence
  chemically synthesized
tacagtgtccaacactattcat

SEQ ID NO: 858193 - DNA, 22 bp, Artificial Sequence
  chemically synthesized
ctctacagtgtccaacactatt

SEQ ID NO: 858194 - DNA, 22 bp, Artificial Sequence
  chemically synthesized
actctacagtgtccaacactat

SEQ ID NO: 858195 - DNA, 22 bp, Artificial Sequence
  chemically synthesized
acttactctacagtgtccaaca

SEQ ID NO: 858196 - DNA, 22 bp, Artificial Sequence
  chemically synthesized
aatatgaatagtgttggacact

SEQ ID NO: 858197 - DNA, 22 bp, Artificial Sequence
  chemically synthesized
atatgaatagtgttggacactg

SEQ ID NO: 858198 - DNA, 22 bp, Artificial Sequence
  chemically synthesized
ccataggctgacttactctaca

SEQ ID NO: 858199 - DNA, 22 bp, Artificial Sequence
  chemically synthesized
gacactgtagagtaagtcagcc

SEQ ID NO: 858200 - DNA, 22 bp, Artificial Sequence
  chemically synthesized
accattaccataggctgactta

SEQ ID NO: 858201 - DNA, 22 bp, Artificial Sequence
  chemically synthesized
aaccattaccataggctgactt

SEQ ID NO: 858202 - DNA, 22 bp, Artificial Sequence
  chemically synthesized
tagagtaagtcagcctatggta

SEQ ID NO: 858203 - DNA, 22 bp, Artificial Sequence
  chemically synthesized
tgcatcttaaccattaccatag

SEQ ID NO: 858204 - DNA, 22 bp, Artificial Sequence
  chemically synthesized
gtactatgcatcttaaccatta

SEQ ID NO: 858205 - DNA, 22 bp, Artificial Sequence
  chemically synthesized
tagtactatgcatcttaaccat

SEQ ID NO: 858206 - DNA, 22 bp, Artificial Sequence
  chemically synthesized
attctagtactatgcatcttaa

SEQ ID NO: 858207 - DNA, 22 bp, Artificial Sequence
  chemically synthesized
aattctagtactatgcatctta

SEQ ID NO: 858208 - DNA, 22 bp, Artificial Sequence
  chemically synthesized
taattctagtactatgcatctt

SEQ ID NO: 858209 - DNA, 22 bp, Artificial Sequence
  chemically synthesized
tggtaatggttaagatgcatag

SEQ ID NO: 858210 - DNA, 22 bp, Artificial Sequence
  chemically synthesized
ccagacattttaattctagtac

SEQ ID NO: 858211 - DNA, 22 bp, Artificial Sequence
  chemically synthesized
agatgcatagtactagaattaa

SEQ ID NO: 858212 - DNA, 22 bp, Artificial Sequence
  chemically synthesized
tctaccagacattttaattcta

SEQ ID NO: 858213 - DNA, 22 bp, Artificial Sequence
  chemically synthesized
gaattaaaatgtctggtagaca

SEQ ID NO: 858214 - DNA, 22 bp, Artificial Sequence
  chemically synthesized
gggcagagaacaggattgtcta

SEQ ID NO: 858215 - DNA, 22 bp, Artificial Sequence
  chemically synthesized
aaatgtctggtagacaatcctg

SEQ ID NO: 858216 - DNA, 22 bp, Artificial Sequence
  chemically synthesized
ctagggcagagaacaggattgt

SEQ ID NO: 858217 - DNA, 22 bp, Artificial Sequence
  chemically synthesized
gtagacaatcctgttctctgcc

SEQ ID NO: 858218 - DNA, 22 bp, Artificial Sequence
  chemically synthesized
ccaaggtcccagagttcctagg

SEQ ID NO: 858219 - DNA, 22 bp, Artificial Sequence
  chemically synthesized
accaaggtcccagagttcctag

SEQ ID NO: 858220 - DNA, 22 bp, Artificial Sequence
  chemically synthesized
taccaaggtcccagagttccta

SEQ ID NO: 858221 - DNA, 22 bp, Artificial Sequence
  chemically synthesized
ttctctgccctaggaactctgg

SEQ ID NO: 858222 - DNA, 22 bp, Artificial Sequence
  chemically synthesized
tctgccctaggaactctgggac

SEQ ID NO: 858223 - DNA, 22 bp, Artificial Sequence
  chemically synthesized
tgccctaggaactctgggacct

SEQ ID NO: 858224 - DNA, 22 bp, Artificial Sequence
  chemically synthesized
tgtggctttaccaaggtcccag

SEQ ID NO: 858225 - DNA, 22 bp, Artificial Sequence
  chemically synthesized
ccctaggaactctgggaccttg

SEQ ID NO: 858226 - DNA, 22 bp, Artificial Sequence
  chemically synthesized
ggaactctgggaccttggtaaa

SEQ ID NO: 858227 - DNA, 22 bp, Artificial Sequence
  chemically synthesized
gagaggttatgtggctttacca

SEQ ID NO: 858228 - DNA, 22 bp, Artificial Sequence
  chemically synthesized
agagaggttatgtggctttacc

SEQ ID NO: 858229 - DNA, 22 bp, Artificial Sequence
  chemically synthesized
tgggaccttggtaaagccacat

SEQ ID NO: 858230 - DNA, 22 bp, Artificial Sequence
  chemically synthesized
ggaccttggtaaagccacataa

SEQ ID NO: 858231 - DNA, 22 bp, Artificial Sequence
  chemically synthesized
aaacttagagaggttatgtggc

SEQ ID NO: 858232 - DNA, 22 bp, Artificial Sequence
  chemically synthesized
ggtaaagccacataacctctct

SEQ ID NO: 858233 - DNA, 22 bp, Artificial Sequence
  chemically synthesized
gaactgaaacttagagaggtta

SEQ ID NO: 858234 - DNA, 22 bp, Artificial Sequence
  chemically synthesized
gtaaagccacataacctctcta

SEQ ID NO: 858235 - DNA, 22 bp, Artificial Sequence
  chemically synthesized
aacaaatgttagaactgaaact

SEQ ID NO: 858236 - DNA, 22 bp, Artificial Sequence
  chemically synthesized
gtactgaacaaatgttagaact

SEQ ID NO: 858237 - DNA, 22 bp, Artificial Sequence
  chemically synthesized
tctaagtttcagttctaacatt

SEQ ID NO: 858238 - DNA, 22 bp, Artificial Sequence
  chemically synthesized
ctagtactgaacaaatgttaga

SEQ ID NO: 858239 - DNA, 22 bp, Artificial Sequence
  chemically synthesized
taagtttcagttctaacatttg

SEQ ID NO: 858240 - DNA, 22 bp, Artificial Sequence
  chemically synthesized
agtttcagttctaacatttgtt

SEQ ID NO: 858241 - DNA, 22 bp, Artificial Sequence
  chemically synthesized
ttgctagtactgaacaaatgtt

SEQ ID NO: 858242 - DNA, 22 bp, Artificial Sequence
  chemically synthesized
attgctagtactgaacaaatgt

SEQ ID NO: 858243 - DNA, 22 bp, Artificial Sequence
  chemically synthesized
cttattgctagtactgaacaaa

SEQ ID NO: 858244 - DNA, 22 bp, Artificial Sequence
  chemically synthesized
cagttctaacatttgttcagta

SEQ ID NO: 858245 - DNA, 22 bp, Artificial Sequence
  chemically synthesized
agttctaacatttgttcagtac

SEQ ID NO: 858246 - DNA, 22 bp, Artificial Sequence
  chemically synthesized
ctgcttattgctagtactgaac

SEQ ID NO: 858247 - DNA, 22 bp, Artificial Sequence
  chemically synthesized
actgcttattgctagtactgaa

SEQ ID NO: 858248 - DNA, 22 bp, Artificial Sequence
  chemically synthesized
taacatttgttcagtactagca

SEQ ID NO: 858249 - DNA, 22 bp, Artificial Sequence
  chemically synthesized
cttactgcttattgctagtact

SEQ ID NO: 858250 - DNA, 22 bp, Artificial Sequence
  chemically synthesized
gcttactgcttattgctagtac

SEQ ID NO: 858251 - DNA, 22 bp, Artificial Sequence
  chemically synthesized
acatttgttcagtactagcaat

SEQ ID NO: 858252 - DNA, 22 bp, Artificial Sequence
  chemically synthesized
ccttgcttactgcttattgcta

SEQ ID NO: 858253 - DNA, 22 bp, Artificial Sequence
  chemically synthesized
gccttgcttactgcttattgct

SEQ ID NO: 858254 - DNA, 22 bp, Artificial Sequence
  chemically synthesized
tgccttgcttactgcttattgc

SEQ ID NO: 858255 - DNA, 22 bp, Artificial Sequence
  chemically synthesized
gttcagtactagcaataagcag

SEQ ID NO: 858256 - DNA, 22 bp, Artificial Sequence
  chemically synthesized
ttcagtactagcaataagcagt

SEQ ID NO: 858257 - DNA, 22 bp, Artificial Sequence
  chemically synthesized
agtactagcaataagcagtaag

SEQ ID NO: 858258 - DNA, 22 bp, Artificial Sequence
  chemically synthesized
ccactttgccttgcttactgct

SEQ ID NO: 858259 - DNA, 22 bp, Artificial Sequence
  chemically synthesized
cccactttgccttgcttactgc

SEQ ID NO: 858260 - DNA, 22 bp, Artificial Sequence
  chemically synthesized
gcaataagcagtaagcaaggca

SEQ ID NO: 858261 - DNA, 22 bp, Artificial Sequence
  chemically synthesized
aggtaaatacatgaaaaatgct

SEQ ID NO: 858262 - DNA, 22 bp, Artificial Sequence
  chemically synthesized
aaggtaaatacatgaaaaatgc

SEQ ID NO: 858263 - DNA, 22 bp, Artificial Sequence
  chemically synthesized
taaggtaaatacatgaaaaatg

SEQ ID NO: 858264 - DNA, 22 bp, Artificial Sequence
  chemically synthesized
ttaaggtaaatacatgaaaaat

SEQ ID NO: 858265 - DNA, 22 bp, Artificial Sequence
  chemically synthesized
ttttaaggtaaatacatgaaaa

SEQ ID NO: 858266 - DNA, 22 bp, Artificial Sequence
  chemically synthesized
ctcttttaaggtaaatacatga

SEQ ID NO: 858267 - DNA, 22 bp, Artificial Sequence
  chemically synthesized
ttcctcttttaaggtaaataca

SEQ ID NO: 858268 - DNA, 22 bp, Artificial Sequence
  chemically synthesized
ttattcctcttttaaggtaaat

SEQ ID NO: 858269 - DNA, 22 bp, Artificial Sequence
  chemically synthesized
ttattattcctcttttaaggta

SEQ ID NO: 858270 - DNA, 22 bp, Artificial Sequence
  chemically synthesized
ttcatgtatttaccttaaaaga

SEQ ID NO: 858271 - DNA, 22 bp, Artificial Sequence
  chemically synthesized
tcatgtatttaccttaaaagag

SEQ ID NO: 858272 - DNA, 22 bp, Artificial Sequence
  chemically synthesized
catgtatttaccttaaaagagg

SEQ ID NO: 858273 - DNA, 22 bp, Artificial Sequence
  chemically synthesized
atgtatttaccttaaaagagga

SEQ ID NO: 858274 - DNA, 22 bp, Artificial Sequence
  chemically synthesized
ccctgttattattcctctttta

SEQ ID NO: 858275 - DNA, 22 bp, Artificial Sequence
  chemically synthesized
accctgttattattcctctttt

SEQ ID NO: 858276 - DNA, 22 bp, Artificial Sequence
  chemically synthesized
accttaaaagaggaataataac

SEQ ID NO: 858277 - DNA, 22 bp, Artificial Sequence
  chemically synthesized
ccttaaaagaggaataataaca

SEQ ID NO: 858278 - DNA, 22 bp, Artificial Sequence
  chemically synthesized
tgacatttaccctgttattatt

SEQ ID NO: 858279 - DNA, 22 bp, Artificial Sequence
  chemically synthesized
atgacatttaccctgttattat

SEQ ID NO: 858280 - DNA, 22 bp, Artificial Sequence
  chemically synthesized
aaaagaggaataataacagggt

SEQ ID NO: 858281 - DNA, 22 bp, Artificial Sequence
  chemically synthesized
aaagaggaataataacagggta

SEQ ID NO: 858282 - DNA, 22 bp, Artificial Sequence
  chemically synthesized
cccttatgacatttaccctgtt

SEQ ID NO: 858283 - DNA, 22 bp, Artificial Sequence
  chemically synthesized
cacaactgcccttatgacattt

SEQ ID NO: 858284 - DNA, 22 bp, Artificial Sequence
  chemically synthesized
aatctacacaactgcccttatg

SEQ ID NO: 858285 - DNA, 22 bp, Artificial Sequence
  chemically synthesized
actgaatctacacaactgccct

SEQ ID NO: 858286 - DNA, 22 bp, Artificial Sequence
  chemically synthesized
ctcactgaatctacacaactgc

SEQ ID NO: 858287 - DNA, 22 bp, Artificial Sequence
  chemically synthesized
tactactcactgaatctacaca

SEQ ID NO: 858288 - DNA, 22 bp, Artificial Sequence
  chemically synthesized
gtactactcactgaatctacac

SEQ ID NO: 858289 - DNA, 22 bp, Artificial Sequence
  chemically synthesized
cttgtactactcactgaatcta

SEQ ID NO: 858290 - DNA, 22 bp, Artificial Sequence
  chemically synthesized
tgtagattcagtgagtagtaca

SEQ ID NO: 858291 - DNA, 22 bp, Artificial Sequence
  chemically synthesized
tcatacgtgtattgcttgtact

SEQ ID NO: 858292 - DNA, 22 bp, Artificial Sequence
  chemically synthesized
agtgagtagtacaagcaataca

SEQ ID NO: 858293 - DNA, 22 bp, Artificial Sequence
  chemically synthesized
gcattgtcatacgtgtattgct

SEQ ID NO: 858294 - DNA, 22 bp, Artificial Sequence
  chemically synthesized
tggcattgtcatacgtgtattg

SEQ ID NO: 858295 - DNA, 22 bp, Artificial Sequence
  chemically synthesized
ctggcattgtcatacgtgtatt

SEQ ID NO: 858296 - DNA, 22 bp, Artificial Sequence
  chemically synthesized
tctggcattgtcatacgtgtat

SEQ ID NO: 858297 - DNA, 22 bp, Artificial Sequence
  chemically synthesized
tttctggcattgtcatacgtgt

SEQ ID NO: 858298 - DNA, 22 bp, Artificial Sequence
  chemically synthesized
ctctttctggcattgtcatacg

SEQ ID NO: 858299 - DNA, 22 bp, Artificial Sequence
  chemically synthesized
tgctgctctttctggcattgtc

SEQ ID NO: 858300 - DNA, 22 bp, Artificial Sequence
  chemically synthesized
tgatgatgatgattatgctgct

SEQ ID NO: 858301 - DNA, 22 bp, Artificial Sequence
  chemically synthesized
ttgtgatgatgatgattatgct

SEQ ID NO: 858302 - DNA, 22 bp, Artificial Sequence
  chemically synthesized
taataatattattgtgatgatg

SEQ ID NO: 858303 - DNA, 22 bp, Artificial Sequence
  chemically synthesized
tagtgtcaggcgctgtaataat

SEQ ID NO: 858304 - DNA, 22 bp, Artificial Sequence
  chemically synthesized
ctatagtgtcaggcgctgtaat

SEQ ID NO: 858305 - DNA, 22 bp, Artificial Sequence
  chemically synthesized
atcacctactatagtgtcaggc

SEQ ID NO: 858306 - DNA, 22 bp, Artificial Sequence
  chemically synthesized
ttgatcacctactatagtgtca

SEQ ID NO: 858307 - DNA, 22 bp, Artificial Sequence
  chemically synthesized
ttacagcgcctgacactatagt

SEQ ID NO: 858308 - DNA, 22 bp, Artificial Sequence
  chemically synthesized
cagcgcctgacactatagtagg

SEQ ID NO: 858309 - DNA, 22 bp, Artificial Sequence
  chemically synthesized
acactattgatcacctactata

SEQ ID NO: 858310 - DNA, 22 bp, Artificial Sequence
  chemically synthesized
acactatagtaggtgatcaata

SEQ ID NO: 858311 - DNA, 22 bp, Artificial Sequence
  chemically synthesized
tagtaggtgatcaatagtgtta

SEQ ID NO: 858312 - DNA, 22 bp, Artificial Sequence
  chemically synthesized
taaaaacagtaatacctaacac

SEQ ID NO: 858313 - DNA, 22 bp, Artificial Sequence
  chemically synthesized
ataaaaacagtaatacctaaca

SEQ ID NO: 858314 - DNA, 22 bp, Artificial Sequence
  chemically synthesized
gccaggcgtttataaaaacagt

SEQ ID NO: 858315 - DNA, 22 bp, Artificial Sequence
  chemically synthesized
ctagccaggcgtttataaaaac

SEQ ID NO: 858316 - DNA, 22 bp, Artificial Sequence
  chemically synthesized
actagccaggcgtttataaaaa

SEQ ID NO: 858317 - DNA, 22 bp, Artificial Sequence
  chemically synthesized
ggtattactgtttttataaacg

SEQ ID NO: 858318 - DNA, 22 bp, Artificial Sequence
  chemically synthesized
ttactagccaggcgtttataaa

SEQ ID NO: 858319 - DNA, 22 bp, Artificial Sequence
  chemically synthesized
cttactagccaggcgtttataa

SEQ ID NO: 858320 - DNA, 22 bp, Artificial Sequence
  chemically synthesized
tgtttcttactagccaggcgtt

SEQ ID NO: 858321 - DNA, 22 bp, Artificial Sequence
  chemically synthesized
ctgtttttataaacgcctggct

SEQ ID NO: 858322 - DNA, 22 bp, Artificial Sequence
  chemically synthesized
tttttataaacgcctggctagt

SEQ ID NO: 858323 - DNA, 22 bp, Artificial Sequence
  chemically synthesized
ttataaacgcctggctagtaag

SEQ ID NO: 858324 - DNA, 22 bp, Artificial Sequence
  chemically synthesized
atcactgtgtttcttactagcc

SEQ ID NO: 858325 - DNA, 22 bp, Artificial Sequence
  chemically synthesized
tataaacgcctggctagtaaga

SEQ ID NO: 858326 - DNA, 22 bp, Artificial Sequence
  chemically synthesized
ataaacgcctggctagtaagaa

SEQ ID NO: 858327 - DNA, 22 bp, Artificial Sequence
  chemically synthesized
taaacgcctggctagtaagaaa

SEQ ID NO: 858328 - DNA, 22 bp, Artificial Sequence
  chemically synthesized
ttcatcactgtgtttcttacta

SEQ ID NO: 858329 - DNA, 22 bp, Artificial Sequence
  chemically synthesized
gctagtaagaaacacagtgatg

SEQ ID NO: 858330 - DNA, 22 bp, Artificial Sequence
  chemically synthesized
accacagttgttcatcactgtg

SEQ ID NO: 858331 - DNA, 22 bp, Artificial Sequence
  chemically synthesized
tcaccacagttgttcatcactg

SEQ ID NO: 858332 - DNA, 22 bp, Artificial Sequence
  chemically synthesized
ctcaccacagttgttcatcact

SEQ ID NO: 858333 - DNA, 22 bp, Artificial Sequence
  chemically synthesized
gtaagaaacacagtgatgaaca

SEQ ID NO: 858334 - DNA, 22 bp, Artificial Sequence
  chemically synthesized
cagtttctcaccacagttgttc

SEQ ID NO: 858335 - DNA, 22 bp, Artificial Sequence
  chemically synthesized
tctccagtttctcaccacagtt

SEQ ID NO: 858336 - DNA, 22 bp, Artificial Sequence
  chemically synthesized
atctccagtttctcaccacagt

SEQ ID NO: 858337 - DNA, 22 bp, Artificial Sequence
  chemically synthesized
gggccttatctccagtttctca

SEQ ID NO: 858338 - DNA, 22 bp, Artificial Sequence
  chemically synthesized
ggggccttatctccagtttctc

SEQ ID NO: 858339 - DNA, 22 bp, Artificial Sequence
  chemically synthesized
tggggccttatctccagtttct

SEQ ID NO: 858340 - DNA, 22 bp, Artificial Sequence
  chemically synthesized
acattttggggccttatctcca

SEQ ID NO: 858341 - DNA, 22 bp, Artificial Sequence
  chemically synthesized
tggtgagaaactggagataagg

SEQ ID NO: 858342 - DNA, 22 bp, Artificial Sequence
  chemically synthesized
cacattttggggccttatctcc

SEQ ID NO: 858343 - DNA, 22 bp, Artificial Sequence
  chemically synthesized
cccaagtatttcacattttggg

SEQ ID NO: 858344 - DNA, 22 bp, Artificial Sequence
  chemically synthesized
gagataaggccccaaaatgtga

SEQ ID NO: 858345 - DNA, 22 bp, Artificial Sequence
  chemically synthesized
ctccccaagtatttcacatttt

SEQ ID NO: 858346 - DNA, 22 bp, Artificial Sequence
  chemically synthesized
actactccccaagtatttcaca

SEQ ID NO: 858347 - DNA, 22 bp, Artificial Sequence
  chemically synthesized
actgactactccccaagtattt

SEQ ID NO: 858348 - DNA, 22 bp, Artificial Sequence
  chemically synthesized
gactgactactccccaagtatt

SEQ ID NO: 858349 - DNA, 22 bp, Artificial Sequence
  chemically synthesized
tgactgactactccccaagtat

SEQ ID NO: 858350 - DNA, 22 bp, Artificial Sequence
  chemically synthesized
ttgactgactactccccaagta

SEQ ID NO: 858351 - DNA, 22 bp, Artificial Sequence
  chemically synthesized
ggggagtagtcagtcaaaagtc

SEQ ID NO: 858352 - DNA, 22 bp, Artificial Sequence
  chemically synthesized
gggagtagtcagtcaaaagtcc

SEQ ID NO: 858353 - DNA, 22 bp, Artificial Sequence
  chemically synthesized
aatcaatatagggccacacacg

SEQ ID NO: 858354 - DNA, 22 bp, Artificial Sequence
  chemically synthesized
caatcaatatagggccacacac

SEQ ID NO: 858355 - DNA, 22 bp, Artificial Sequence
  chemically synthesized
ttcaatcaatatagggccacac

SEQ ID NO: 858356 - DNA, 22 bp, Artificial Sequence
  chemically synthesized
agccctcttcaatcaatatagg

SEQ ID NO: 858357 - DNA, 22 bp, Artificial Sequence
  chemically synthesized
acaccagcaagttcagccctct

SEQ ID NO: 858358 - DNA, 22 bp, Artificial Sequence
  chemically synthesized
tattgattgaagagggctgaac

SEQ ID NO: 858359 - DNA, 22 bp, Artificial Sequence
  chemically synthesized
attgaagagggctgaacttgct

SEQ ID NO: 858360 - DNA, 22 bp, Artificial Sequence
  chemically synthesized
gtatcaattcacaccagcaagt

SEQ ID NO: 858361 - DNA, 22 bp, Artificial Sequence
  chemically synthesized
aagagggctgaacttgctggtg

SEQ ID NO: 858362 - DNA, 22 bp, Artificial Sequence
  chemically synthesized
agtatcaattcacaccagcaag

SEQ ID NO: 858363 - DNA, 22 bp, Artificial Sequence
  chemically synthesized
gtatttagtatcaattcacacc

SEQ ID NO: 858364 - DNA, 22 bp, Artificial Sequence
  chemically synthesized
aacttgctggtgtgaattgata

SEQ ID NO: 858365 - DNA, 22 bp, Artificial Sequence
  chemically synthesized
tgtgttggtatttagtatcaat

SEQ ID NO: 858366 - DNA, 22 bp, Artificial Sequence
  chemically synthesized
gctggtgtgaattgatactaaa

SEQ ID NO: 858367 - DNA, 22 bp, Artificial Sequence
  chemically synthesized
ctggtgtgaattgatactaaat

SEQ ID NO: 858368 - DNA, 22 bp, Artificial Sequence
  chemically synthesized
gtgtgaattgatactaaatacc

SEQ ID NO: 858369 - DNA, 22 bp, Artificial Sequence
  chemically synthesized
ataacccagctgtgtgttggta

SEQ ID NO: 858370 - DNA, 22 bp, Artificial Sequence
  chemically synthesized
tgataacccagctgtgtgttgg

SEQ ID NO: 858371 - DNA, 22 bp, Artificial Sequence
  chemically synthesized
atactaaataccaacacacagc

SEQ ID NO: 858372 - DNA, 22 bp, Artificial Sequence
  chemically synthesized
acctctgataacccagctgtgt

SEQ ID NO: 858373 - DNA, 22 bp, Artificial Sequence
  chemically synthesized
aataccaacacacagctgggtt

SEQ ID NO: 858374 - DNA, 22 bp, Artificial Sequence
  chemically synthesized
accactcacctctgataaccca

SEQ ID NO: 858375 - DNA, 22 bp, Artificial Sequence
  chemically synthesized
ccctcaccactcacctctgata

SEQ ID NO: 858376 - DNA, 22 bp, Artificial Sequence
  chemically synthesized
cccctcaccactcacctctgat

SEQ ID NO: 858377 - DNA, 22 bp, Artificial Sequence
  chemically synthesized
cttcccctcaccactcacctct

SEQ ID NO: 858378 - DNA, 22 bp, Artificial Sequence
  chemically synthesized
ggttatcagaggtgagtggtga

SEQ ID NO: 858379 - DNA, 22 bp, Artificial Sequence
  chemically synthesized
ggcattccttcccctcaccact

SEQ ID NO: 858380 - DNA, 22 bp, Artificial Sequence
  chemically synthesized
tcagaggtgagtggtgagggga

SEQ ID NO: 858381 - DNA, 22 bp, Artificial Sequence
  chemically synthesized
attaggcattccttcccctcac

SEQ ID NO: 858382 - DNA, 22 bp, Artificial Sequence
  chemically synthesized
gattaggcattccttcccctca

SEQ ID NO: 858383 - DNA, 22 bp, Artificial Sequence
  chemically synthesized
taaacttgattaggcattcctt

SEQ ID NO: 858384 - DNA, 22 bp, Artificial Sequence
  chemically synthesized
tctataaacttgattaggcatt

SEQ ID NO: 858385 - DNA, 22 bp, Artificial Sequence
  chemically synthesized
ttgtctataaacttgattaggc

SEQ ID NO: 858386 - DNA, 22 bp, Artificial Sequence
  chemically synthesized
agtctgttgtctataaacttga

SEQ ID NO: 858387 - DNA, 22 bp, Artificial Sequence
  chemically synthesized
gagtctgttgtctataaacttg

SEQ ID NO: 858388 - DNA, 22 bp, Artificial Sequence
  chemically synthesized
ttgagtctgttgtctataaact

SEQ ID NO: 858389 - DNA, 22 bp, Artificial Sequence
  chemically synthesized
tgctcttgagtctgttgtctat

SEQ ID NO: 858390 - DNA, 22 bp, Artificial Sequence
  chemically synthesized
atcaagtttatagacaacagac

SEQ ID NO: 858391 - DNA, 22 bp, Artificial Sequence
  chemically synthesized
tattatgctcttgagtctgttg

SEQ ID NO: 858392 - DNA, 22 bp, Artificial Sequence
  chemically synthesized
gttatattatgctcttgagtct

SEQ ID NO: 858393 - DNA, 22 bp, Artificial Sequence
  chemically synthesized
tggttatattatgctcttgagt

SEQ ID NO: 858394 - DNA, 22 bp, Artificial Sequence
  chemically synthesized
atagacaacagactcaagagca

SEQ ID NO: 858395 - DNA, 22 bp, Artificial Sequence
  chemically synthesized
ctggttatattatgctcttgag

SEQ ID NO: 858396 - DNA, 22 bp, Artificial Sequence
  chemically synthesized
tagacaacagactcaagagcat

SEQ ID NO: 858397 - DNA, 22 bp, Artificial Sequence
  chemically synthesized
ccaccaatcttctggttatatt

SEQ ID NO: 858398 - DNA, 22 bp, Artificial Sequence
  chemically synthesized
gccaccaatcttctggttatat

SEQ ID NO: 858399 - DNA, 22 bp, Artificial Sequence
  chemically synthesized
tgccaccaatcttctggttata

SEQ ID NO: 858400 - DNA, 22 bp, Artificial Sequence
  chemically synthesized
aagagcataatataaccagaag

SEQ ID NO: 858401 - DNA, 22 bp, Artificial Sequence
  chemically synthesized
catagtccaataattttgccac

SEQ ID NO: 858402 - DNA, 22 bp, Artificial Sequence
  chemically synthesized
caaactacatagtccaataatt

SEQ ID NO: 858403 - DNA, 22 bp, Artificial Sequence
  chemically synthesized
attccaaactacatagtccaat

SEQ ID NO: 858404 - DNA, 22 bp, Artificial Sequence
  chemically synthesized
gtggcaaaattattggactatg

SEQ ID NO: 858405 - DNA, 22 bp, Artificial Sequence
  chemically synthesized
cattccaaactacatagtccaa

SEQ ID NO: 858406 - DNA, 22 bp, Artificial Sequence
  chemically synthesized
tcattccaaactacatagtcca

SEQ ID NO: 858407 - DNA, 22 bp, Artificial Sequence
  chemically synthesized
aaacctttcattccaaactaca

SEQ ID NO: 858408 - DNA, 22 bp, Artificial Sequence
  chemically synthesized
gaaacctttcattccaaactac

SEQ ID NO: 858409 - DNA, 22 bp, Artificial Sequence
  chemically synthesized
ttggactatgtagtttggaatg

SEQ ID NO: 858410 - DNA, 22 bp, Artificial Sequence
  chemically synthesized
cttgaaacctttcattccaaac

SEQ ID NO: 858411 - DNA, 22 bp, Artificial Sequence
  chemically synthesized
ccttgaaacctttcattccaaa

SEQ ID NO: 858412 - DNA, 22 bp, Artificial Sequence
  chemically synthesized
tccttgaaacctttcattccaa

SEQ ID NO: 858413 - DNA, 22 bp, Artificial Sequence
  chemically synthesized
gactatgtagtttggaatgaaa

SEQ ID NO: 858414 - DNA, 22 bp, Artificial Sequence
  chemically synthesized
tgtagtttggaatgaaaggttt

SEQ ID NO: 858415 - DNA, 22 bp, Artificial Sequence
  chemically synthesized
cagctttccttgaaacctttca

SEQ ID NO: 858416 - DNA, 22 bp, Artificial Sequence
  chemically synthesized
gcagctttccttgaaacctttc

SEQ ID NO: 858417 - DNA, 22 bp, Artificial Sequence
  chemically synthesized
tgcagctttccttgaaaccttt

SEQ ID NO: 858418 - DNA, 22 bp, Artificial Sequence
  chemically synthesized
ttgcagctttccttgaaacctt

SEQ ID NO: 858419 - DNA, 22 bp, Artificial Sequence
  chemically synthesized
ggaatgaaaggtttcaaggaaa

SEQ ID NO: 858420 - DNA, 22 bp, Artificial Sequence
  chemically synthesized
gaatgaaaggtttcaaggaaag

SEQ ID NO: 858421 - DNA, 22 bp, Artificial Sequence
  chemically synthesized
agatgtcttttgcagctttcct

SEQ ID NO: 858422 - DNA, 22 bp, Artificial Sequence
  chemically synthesized
ttgagatgtcttttgcagcttt

SEQ ID NO: 858423 - DNA, 22 bp, Artificial Sequence
  chemically synthesized
ctgttgagatgtcttttgcagc

SEQ ID NO: 858424 - DNA, 22 bp, Artificial Sequence
  chemically synthesized
caaggaaagctgcaaaagacat

SEQ ID NO: 858425 - DNA, 22 bp, Artificial Sequence
  chemically synthesized
aaggaaagctgcaaaagacatc

SEQ ID NO: 858426 - DNA, 22 bp, Artificial Sequence
  chemically synthesized
tccagtgtgagtctcctgttga

SEQ ID NO: 858427 - DNA, 22 bp, Artificial Sequence
  chemically synthesized
caaaagacatctcaacaggaga

SEQ ID NO: 858428 - DNA, 22 bp, Artificial Sequence
  chemically synthesized
gttgtccagtgtgagtctcctg

SEQ ID NO: 858429 - DNA, 22 bp, Artificial Sequence
  chemically synthesized
actggttgtccagtgtgagtct

SEQ ID NO: 858430 - DNA, 22 bp, Artificial Sequence
  chemically synthesized
aacaggagactcacactggaca

SEQ ID NO: 858431 - DNA, 22 bp, Artificial Sequence
  chemically synthesized
gaatcgttcactggttgtccag

SEQ ID NO: 858432 - DNA, 22 bp, Artificial Sequence
  chemically synthesized
agaatcgttcactggttgtcca

SEQ ID NO: 858433 - DNA, 22 bp, Artificial Sequence
  chemically synthesized
ttagaatcgttcactggttgtc

SEQ ID NO: 858434 - DNA, 22 bp, Artificial Sequence
  chemically synthesized
acactggacaaccagtgaacga

SEQ ID NO: 858435 - DNA, 22 bp, Artificial Sequence
  chemically synthesized
atattcttagaatcgttcactg

SEQ ID NO: 858436 - DNA, 22 bp, Artificial Sequence
  chemically synthesized
aatattcttagaatcgttcact

SEQ ID NO: 858437 - DNA, 22 bp, Artificial Sequence
  chemically synthesized
taatattcttagaatcgttcac

SEQ ID NO: 858438 - DNA, 22 bp, Artificial Sequence
  chemically synthesized
ttaatattcttagaatcgttca

SEQ ID NO: 858439 - DNA, 22 bp, Artificial Sequence
  chemically synthesized
tttaatattcttagaatcgttc

SEQ ID NO: 858440 - DNA, 22 bp, Artificial Sequence
  chemically synthesized
ttttaatattcttagaatcgtt

SEQ ID NO: 858441 - DNA, 22 bp, Artificial Sequence
  chemically synthesized
gacaaccagtgaacgattctaa

SEQ ID NO: 858442 - DNA, 22 bp, Artificial Sequence
  chemically synthesized
tttttaatattcttagaatcgt

SEQ ID NO: 858443 - DNA, 22 bp, Artificial Sequence
  chemically synthesized
ttttttaatattcttagaatcg

SEQ ID NO: 858444 - DNA, 22 bp, Artificial Sequence
  chemically synthesized
atttttttttaatattcttaga

SEQ ID NO: 858445 - DNA, 22 bp, Artificial Sequence
  chemically synthesized
aatgtctcatttttttttaata

SEQ ID NO: 858446 - DNA, 22 bp, Artificial Sequence
  chemically synthesized
taagaatattaaaaaaaaatga

SEQ ID NO: 858447 - DNA, 22 bp, Artificial Sequence
  chemically synthesized
agaatattaaaaaaaaatgaga

SEQ ID NO: 858448 - DNA, 22 bp, Artificial Sequence
  chemically synthesized
agaatgaaaattcaatgtctca

SEQ ID NO: 858449 - DNA, 22 bp, Artificial Sequence
  chemically synthesized
aaaaaaaatgagacattgaatt

SEQ ID NO: 858450 - DNA, 22 bp, Artificial Sequence
  chemically synthesized
cctcagaatgaaaattcaatgt

SEQ ID NO: 858451 - DNA, 22 bp, Artificial Sequence
  chemically synthesized
gctacctcagaatgaaaattca

SEQ ID NO: 858452 - DNA, 22 bp, Artificial Sequence
  chemically synthesized
atgattggctacctcagaatga

SEQ ID NO: 858453 - DNA, 22 bp, Artificial Sequence
  chemically synthesized
aattttcattctgaggtagcca

SEQ ID NO: 858454 - DNA, 22 bp, Artificial Sequence
  chemically synthesized
tcattctgaggtagccaatcat

SEQ ID NO: 858455 - DNA, 22 bp, Artificial Sequence
  chemically synthesized
cattctgaggtagccaatcatt

SEQ ID NO: 858456 - DNA, 22 bp, Artificial Sequence
  chemically synthesized
attctgaggtagccaatcatta

SEQ ID NO: 858457 - DNA, 22 bp, Artificial Sequence
  chemically synthesized
catagccataaaaattaatgat

SEQ ID NO: 858458 - DNA, 22 bp, Artificial Sequence
  chemically synthesized
tgaggtagccaatcattaattt

SEQ ID NO: 858459 - DNA, 22 bp, Artificial Sequence
  chemically synthesized
aggtagccaatcattaattttt

SEQ ID NO: 858460 - DNA, 22 bp, Artificial Sequence
  chemically synthesized
aaagcacagttacatagccata

SEQ ID NO: 858461 - DNA, 22 bp, Artificial Sequence
  chemically synthesized
aaaagcacagttacatagccat

SEQ ID NO: 858462 - DNA, 22 bp, Artificial Sequence
  chemically synthesized
atttttatggctatgtaactgt

SEQ ID NO: 858463 - DNA, 22 bp, Artificial Sequence
  chemically synthesized
ttatggctatgtaactgtgctt

SEQ ID NO: 858464 - DNA, 22 bp, Artificial Sequence
  chemically synthesized
tatggctatgtaactgtgcttt

SEQ ID NO: 858465 - DNA, 22 bp, Artificial Sequence
  chemically synthesized
atggctatgtaactgtgctttt

SEQ ID NO: 858466 - DNA, 22 bp, Artificial Sequence
  chemically synthesized
tggctatgtaactgtgctttta

SEQ ID NO: 858467 - DNA, 22 bp, Artificial Sequence
  chemically synthesized
atgaggagacaaccttaaaagc

SEQ ID NO: 858468 - DNA, 22 bp, Artificial Sequence
  chemically synthesized
taatgaggagacaaccttaaaa

SEQ ID NO: 858469 - DNA, 22 bp, Artificial Sequence
  chemically synthesized
tgtaactgtgcttttaaggttg

SEQ ID NO: 858470 - DNA, 22 bp, Artificial Sequence
  chemically synthesized
tctaatgaggagacaaccttaa

SEQ ID NO: 858471 - DNA, 22 bp, Artificial Sequence
  chemically synthesized
ctctaatgaggagacaacctta

SEQ ID NO: 858472 - DNA, 22 bp, Artificial Sequence
  chemically synthesized
ttctctaatgaggagacaacct

SEQ ID NO: 858473 - DNA, 22 bp, Artificial Sequence
  chemically synthesized
cttctctaatgaggagacaacc

SEQ ID NO: 858474 - DNA, 22 bp, Artificial Sequence
  chemically synthesized
tgcttttaaggttgtctcctca

SEQ ID NO: 858475 - DNA, 22 bp, Artificial Sequence
  chemically synthesized
atcttcttctctaatgaggaga

SEQ ID NO: 858476 - DNA, 22 bp, Artificial Sequence
  chemically synthesized
ttaaggttgtctcctcattaga

SEQ ID NO: 858477 - DNA, 22 bp, Artificial Sequence
  chemically synthesized
ctcatcttcttctctaatgagg

SEQ ID NO: 858478 - DNA, 22 bp, Artificial Sequence
  chemically synthesized
taaggttgtctcctcattagag

SEQ ID NO: 858479 - DNA, 22 bp, Artificial Sequence
  chemically synthesized
aaggttgtctcctcattagaga

SEQ ID NO: 858480 - DNA, 22 bp, Artificial Sequence
  chemically synthesized
tactcatcttcttctctaatga

SEQ ID NO: 858481 - DNA, 22 bp, Artificial Sequence
  chemically synthesized
aggttgtctcctcattagagaa

SEQ ID NO: 858482 - DNA, 22 bp, Artificial Sequence
  chemically synthesized
cattctactcatcttcttctct

SEQ ID NO: 858483 - DNA, 22 bp, Artificial Sequence
  chemically synthesized
ccattctactcatcttcttctc

SEQ ID NO: 858484 - DNA, 22 bp, Artificial Sequence
  chemically synthesized
tctcctcattagagaagaagat

SEQ ID NO: 858485 - DNA, 22 bp, Artificial Sequence
  chemically synthesized
ttccattctactcatcttcttc

SEQ ID NO: 858486 - DNA, 22 bp, Artificial Sequence
  chemically synthesized
ctcattagagaagaagatgagt

SEQ ID NO: 858487 - DNA, 22 bp, Artificial Sequence
  chemically synthesized
attagagaagaagatgagtaga

SEQ ID NO: 858488 - DNA, 22 bp, Artificial Sequence
  chemically synthesized
gagaagaagatgagtagaatgg

SEQ ID NO: 858489 - DNA, 22 bp, Artificial Sequence
  chemically synthesized
agagacaagaaacattcttcca

SEQ ID NO: 858490 - DNA, 22 bp, Artificial Sequence
  chemically synthesized
gagagacaagaaacattcttcc

SEQ ID NO: 858491 - DNA, 22 bp, Artificial Sequence
  chemically synthesized
agaagcttgagagacaagaaac

SEQ ID NO: 858492 - DNA, 22 bp, Artificial Sequence
  chemically synthesized
gtgtccctgagaagcttgagag

SEQ ID NO: 858493 - DNA, 22 bp, Artificial Sequence
  chemically synthesized
ggtgtccctgagaagcttgaga

SEQ ID NO: 858494 - DNA, 22 bp, Artificial Sequence
  chemically synthesized
ttggtgtccctgagaagcttga

SEQ ID NO: 858495 - DNA, 22 bp, Artificial Sequence
  chemically synthesized
cttgtctctcaagcttctcagg

SEQ ID NO: 858496 - DNA, 22 bp, Artificial Sequence
  chemically synthesized
ttgtctctcaagcttctcaggg

SEQ ID NO: 858497 - DNA, 22 bp, Artificial Sequence
  chemically synthesized
gtctctcaagcttctcagggac

SEQ ID NO: 858498 - DNA, 22 bp, Artificial Sequence
  chemically synthesized
tctctcaagcttctcagggaca

SEQ ID NO: 858499 - DNA, 22 bp, Artificial Sequence
  chemically synthesized
atagaaaactcttggtgtccct

SEQ ID NO: 858500 - DNA, 22 bp, Artificial Sequence
  chemically synthesized
tcaagcttctcagggacaccaa

SEQ ID NO: 858501 - DNA, 22 bp, Artificial Sequence
  chemically synthesized
aagcttctcagggacaccaaga

SEQ ID NO: 858502 - DNA, 22 bp, Artificial Sequence
  chemically synthesized
attcatagaaaactcttggtgt

SEQ ID NO: 858503 - DNA, 22 bp, Artificial Sequence
  chemically synthesized
cattcatagaaaactcttggtg

SEQ ID NO: 858504 - DNA, 22 bp, Artificial Sequence
  chemically synthesized
cttcattcatagaaaactcttg

SEQ ID NO: 858505 - DNA, 22 bp, Artificial Sequence
  chemically synthesized
ctcagggacaccaagagttttc

SEQ ID NO: 858506 - DNA, 22 bp, Artificial Sequence
  chemically synthesized
tcagggacaccaagagttttct

SEQ ID NO: 858507 - DNA, 22 bp, Artificial Sequence
  chemically synthesized
agggacaccaagagttttctat

SEQ ID NO: 858508 - DNA, 22 bp, Artificial Sequence
  chemically synthesized
gttccttcattcatagaaaact

SEQ ID NO: 858509 - DNA, 22 bp, Artificial Sequence
  chemically synthesized
atcaaaattagttccttcattc

SEQ ID NO: 858510 - DNA, 22 bp, Artificial Sequence
  chemically synthesized
cattgatcaaaattagttcctt

SEQ ID NO: 858511 - DNA, 22 bp, Artificial Sequence
  chemically synthesized
tctatgaatgaaggaactaatt

SEQ ID NO: 858512 - DNA, 22 bp, Artificial Sequence
  chemically synthesized
ctatgaatgaaggaactaattt

SEQ ID NO: 858513 - DNA, 22 bp, Artificial Sequence
  chemically synthesized
tatgaatgaaggaactaatttt

SEQ ID NO: 858514 - DNA, 22 bp, Artificial Sequence
  chemically synthesized
tctgcattgatcaaaattagtt

SEQ ID NO: 858515 - DNA, 22 bp, Artificial Sequence
  chemically synthesized
tgaatgaaggaactaattttga

SEQ ID NO: 858516 - DNA, 22 bp, Artificial Sequence
  chemically synthesized
tgtctgcattgatcaaaattag

SEQ ID NO: 858517 - DNA, 22 bp, Artificial Sequence
  chemically synthesized
ctgtctgcattgatcaaaatta

SEQ ID NO: 858518 - DNA, 22 bp, Artificial Sequence
  chemically synthesized
tctgtctgcattgatcaaaatt

SEQ ID NO: 858519 - DNA, 22 bp, Artificial Sequence
  chemically synthesized
ttctgtctgcattgatcaaaat

SEQ ID NO: 858520 - DNA, 22 bp, Artificial Sequence
  chemically synthesized
tttctgtctgcattgatcaaaa

SEQ ID NO: 858521 - DNA, 22 bp, Artificial Sequence
  chemically synthesized
ttttctgtctgcattgatcaaa

SEQ ID NO: 858522 - DNA, 22 bp, Artificial Sequence
  chemically synthesized
tttttttctgtctgcattgatc

SEQ ID NO: 858523 - DNA, 22 bp, Artificial Sequence
  chemically synthesized
attttgatcaatgcagacagaa

SEQ ID NO: 858524 - DNA, 22 bp, Artificial Sequence
  chemically synthesized
aaacactatttttttctgtctg

SEQ ID NO: 858525 - DNA, 22 bp, Artificial Sequence
  chemically synthesized
tgatcaatgcagacagaaaaaa

SEQ ID NO: 858526 - DNA, 22 bp, Artificial Sequence
  chemically synthesized
gatcaatgcagacagaaaaaaa

SEQ ID NO: 858527 - DNA, 22 bp, Artificial Sequence
  chemically synthesized
atcaatgcagacagaaaaaaat

SEQ ID NO: 858528 - DNA, 22 bp, Artificial Sequence
  chemically synthesized
acaattaaaacactattttttt

SEQ ID NO: 858529 - DNA, 22 bp, Artificial Sequence
  chemically synthesized
tgacaattaaaacactattttt

SEQ ID NO: 858530 - DNA, 22 bp, Artificial Sequence
  chemically synthesized
tctgacaattaaaacactattt

SEQ ID NO: 858531 - DNA, 22 bp, Artificial Sequence
  chemically synthesized
tctctgacaattaaaacactat

SEQ ID NO: 858532 - DNA, 22 bp, Artificial Sequence
  chemically synthesized
ttctctctgacaattaaaacac

SEQ ID NO: 858533 - DNA, 22 bp, Artificial Sequence
  chemically synthesized
attctctctgacaattaaaaca

SEQ ID NO: 858534 - DNA, 22 bp, Artificial Sequence
  chemically synthesized
tattctctctgacaattaaaac

SEQ ID NO: 858535 - DNA, 22 bp, Artificial Sequence
  chemically synthesized
ttattctctctgacaattaaaa

SEQ ID NO: 858536 - DNA, 22 bp, Artificial Sequence
  chemically synthesized
tttattctctctgacaattaaa

SEQ ID NO: 858537 - DNA, 22 bp, Artificial Sequence
  chemically synthesized
ttttattctctctgacaattaa

SEQ ID NO: 858538 - DNA, 22 bp, Artificial Sequence
  chemically synthesized
taattgtcagagagaataaaaa

SEQ ID NO: 858539 - DNA, 22 bp, Artificial Sequence
  chemically synthesized
gtgacacaaatttttttattct

SEQ ID NO: 858540 - DNA, 22 bp, Artificial Sequence
  chemically synthesized
aattgtcagagagaataaaaaa

SEQ ID NO: 858541 - DNA, 22 bp, Artificial Sequence
  chemically synthesized
cgtgacacaaatttttttattc

SEQ ID NO: 858542 - DNA, 22 bp, Artificial Sequence
  chemically synthesized
attgtcagagagaataaaaaaa

SEQ ID NO: 858543 - DNA, 22 bp, Artificial Sequence
  chemically synthesized
tttcgtgacacaaattttttta

SEQ ID NO: 858544 - DNA, 22 bp, Artificial Sequence
  chemically synthesized
tcagagagaataaaaaaatttg

SEQ ID NO: 858545 - DNA, 22 bp, Artificial Sequence
  chemically synthesized
aatcattgtttcgtgacacaaa

SEQ ID NO: 858546 - DNA, 22 bp, Artificial Sequence
  chemically synthesized
caatcattgtttcgtgacacaa

SEQ ID NO: 858547 - DNA, 22 bp, Artificial Sequence
  chemically synthesized
tcaatcattgtttcgtgacaca

SEQ ID NO: 858548 - DNA, 22 bp, Artificial Sequence
  chemically synthesized
cctttcaatcattgtttcgtga

SEQ ID NO: 858549 - DNA, 22 bp, Artificial Sequence
  chemically synthesized
ctgcctttcaatcattgtttcg

SEQ ID NO: 858550 - DNA, 22 bp, Artificial Sequence
  chemically synthesized
ttactgcctttcaatcattgtt

SEQ ID NO: 858551 - DNA, 22 bp, Artificial Sequence
  chemically synthesized
gtgtcacgaaacaatgattgaa

SEQ ID NO: 858552 - DNA, 22 bp, Artificial Sequence
  chemically synthesized
tgtcacgaaacaatgattgaaa

SEQ ID NO: 858553 - DNA, 22 bp, Artificial Sequence
  chemically synthesized
actgttactgcctttcaatcat

SEQ ID NO: 858554 - DNA, 22 bp, Artificial Sequence
  chemically synthesized
cctcactgttactgcctttcaa

SEQ ID NO: 858555 - DNA, 22 bp, Artificial Sequence
  chemically synthesized
ttgcctcactgttactgccttt

SEQ ID NO: 858556 - DNA, 22 bp, Artificial Sequence
  chemically synthesized
attgcctcactgttactgcctt

SEQ ID NO: 858557 - DNA, 22 bp, Artificial Sequence
  chemically synthesized
tattgcctcactgttactgcct

SEQ ID NO: 858558 - DNA, 22 bp, Artificial Sequence
  chemically synthesized
tttattgcctcactgttactgc

SEQ ID NO: 858559 - DNA, 22 bp, Artificial Sequence
  chemically synthesized
ctttattgcctcactgttactg

SEQ ID NO: 858560 - DNA, 22 bp, Artificial Sequence
  chemically synthesized
tctttattgcctcactgttact

SEQ ID NO: 858561 - DNA, 22 bp, Artificial Sequence
  chemically synthesized
ttctttattgcctcactgttac

SEQ ID NO: 858562 - DNA, 22 bp, Artificial Sequence
  chemically synthesized
tttctttattgcctcactgtta

SEQ ID NO: 858563 - DNA, 22 bp, Artificial Sequence
  chemically synthesized
aaaggcagtaacagtgaggcaa

SEQ ID NO: 858564 - DNA, 22 bp, Artificial Sequence
  chemically synthesized
agaaacaaaactttttctttat

SEQ ID NO: 858565 - DNA, 22 bp, Artificial Sequence
  chemically synthesized
gagaaacaaaactttttcttta

SEQ ID NO: 858566 - DNA, 22 bp, Artificial Sequence
  chemically synthesized
tgagaaacaaaactttttcttt

SEQ ID NO: 858567 - DNA, 22 bp, Artificial Sequence
  chemically synthesized
agagtagtcagatagctttgag

SEQ ID NO: 858568 - DNA, 22 bp, Artificial Sequence
  chemically synthesized
tgtttctcaaagctatctgact

SEQ ID NO: 858569 - DNA, 22 bp, Artificial Sequence
  chemically synthesized
gtttctcaaagctatctgacta

SEQ ID NO: 858570 - DNA, 22 bp, Artificial Sequence
  chemically synthesized
tttctcaaagctatctgactac

SEQ ID NO: 858571 - DNA, 22 bp, Artificial Sequence
  chemically synthesized
gaaagagcctcagagtagtcag

SEQ ID NO: 858572 - DNA, 22 bp, Artificial Sequence
  chemically synthesized
ctcaaagctatctgactactct

SEQ ID NO: 858573 - DNA, 22 bp, Artificial Sequence
  chemically synthesized
tcaaagctatctgactactctg

SEQ ID NO: 858574 - DNA, 22 bp, Artificial Sequence
  chemically synthesized
tagaaagagcctcagagtagtc

SEQ ID NO: 858575 - DNA, 22 bp, Artificial Sequence
  chemically synthesized
ctagaaagagcctcagagtagt

SEQ ID NO: 858576 - DNA, 22 bp, Artificial Sequence
  chemically synthesized
aaagctatctgactactctgag

SEQ ID NO: 858577 - DNA, 22 bp, Artificial Sequence
  chemically synthesized
tctagaaagagcctcagagtag

SEQ ID NO: 858578 - DNA, 22 bp, Artificial Sequence
  chemically synthesized
tttctagaaagagcctcagagt

SEQ ID NO: 858579 - DNA, 22 bp, Artificial Sequence
  chemically synthesized
attctttctagaaagagcctca

SEQ ID NO: 858580 - DNA, 22 bp, Artificial Sequence
  chemically synthesized
tctgactactctgaggctcttt

SEQ ID NO: 858581 - DNA, 22 bp, Artificial Sequence
  chemically synthesized
aattctttctagaaagagcctc

SEQ ID NO: 858582 - DNA, 22 bp, Artificial Sequence
  chemically synthesized
actactctgaggctctttctag

SEQ ID NO: 858583 - DNA, 22 bp, Artificial Sequence
  chemically synthesized
catttaattctttctagaaaga

SEQ ID NO: 858584 - DNA, 22 bp, Artificial Sequence
  chemically synthesized
ctctgaggctctttctagaaag

SEQ ID NO: 858585 - DNA, 22 bp, Artificial Sequence
  chemically synthesized
cattacatttaattctttctag

SEQ ID NO: 858586 - DNA, 22 bp, Artificial Sequence
  chemically synthesized
tgaggctctttctagaaagaat

SEQ ID NO: 858587 - DNA, 22 bp, Artificial Sequence
  chemically synthesized
acattacatttaattctttcta

SEQ ID NO: 858588 - DNA, 22 bp, Artificial Sequence
  chemically synthesized
tacattacatttaattctttct

SEQ ID NO: 858589 - DNA, 22 bp, Artificial Sequence
  chemically synthesized
aggctctttctagaaagaatta

SEQ ID NO: 858590 - DNA, 22 bp, Artificial Sequence
  chemically synthesized
tttacattacatttaattcttt

SEQ ID NO: 858591 - DNA, 22 bp, Artificial Sequence
  chemically synthesized
ctttacattacatttaattctt

SEQ ID NO: 858592 - DNA, 22 bp, Artificial Sequence
  chemically synthesized
ttctttacattacatttaattc

SEQ ID NO: 858593 - DNA, 22 bp, Artificial Sequence
  chemically synthesized
cttctttacattacatttaatt

SEQ ID NO: 858594 - DNA, 22 bp, Artificial Sequence
  chemically synthesized
tttctagaaagaattaaatgta

SEQ ID NO: 858595 - DNA, 22 bp, Artificial Sequence
  chemically synthesized
tctagaaagaattaaatgtaat

SEQ ID NO: 858596 - DNA, 22 bp, Artificial Sequence
  chemically synthesized
tttcttctttacattacattta

SEQ ID NO: 858597 - DNA, 22 bp, Artificial Sequence
  chemically synthesized
ctagaaagaattaaatgtaatg

SEQ ID NO: 858598 - DNA, 22 bp, Artificial Sequence
  chemically synthesized
tagaaagaattaaatgtaatgt

SEQ ID NO: 858599 - DNA, 22 bp, Artificial Sequence
  chemically synthesized
gaaagaattaaatgtaatgtaa

SEQ ID NO: 858600 - DNA, 22 bp, Artificial Sequence
  chemically synthesized
aatgtaatgtaaagaagaaata

SEQ ID NO: 858601 - DNA, 22 bp, Artificial Sequence
  chemically synthesized
tgacacaaaatgctatttcttc

SEQ ID NO: 858602 - DNA, 22 bp, Artificial Sequence
  chemically synthesized
gactgtgacacaaaatgctatt

SEQ ID NO: 858603 - DNA, 22 bp, Artificial Sequence
  chemically synthesized
ctggactgtgacacaaaatgct

SEQ ID NO: 858604 - DNA, 22 bp, Artificial Sequence
  chemically synthesized
tcctggactgtgacacaaaatg

SEQ ID NO: 858605 - DNA, 22 bp, Artificial Sequence
  chemically synthesized
ctcctggactgtgacacaaaat

SEQ ID NO: 858606 - DNA, 22 bp, Artificial Sequence
  chemically synthesized
ttctcctggactgtgacacaaa

SEQ ID NO: 858607 - DNA, 22 bp, Artificial Sequence
  chemically synthesized
cttctcctggactgtgacacaa

SEQ ID NO: 858608 - DNA, 22 bp, Artificial Sequence
  chemically synthesized
catgatttcttctcctggactg

SEQ ID NO: 858609 - DNA, 22 bp, Artificial Sequence
  chemically synthesized
ccatgatttcttctcctggact

SEQ ID NO: 858610 - DNA, 22 bp, Artificial Sequence
  chemically synthesized
cttccatgatttcttctcctgg

SEQ ID NO: 858611 - DNA, 22 bp, Artificial Sequence
  chemically synthesized
tgtgtcacagtccaggagaaga

SEQ ID NO: 858612 - DNA, 22 bp, Artificial Sequence
  chemically synthesized
gcttccatgatttcttctcctg

SEQ ID NO: 858613 - DNA, 22 bp, Artificial Sequence
  chemically synthesized
gtgtcacagtccaggagaagaa

SEQ ID NO: 858614 - DNA, 22 bp, Artificial Sequence
  chemically synthesized
tgcttccatgatttcttctcct

SEQ ID NO: 858615 - DNA, 22 bp, Artificial Sequence
  chemically synthesized
tgtcacagtccaggagaagaaa

SEQ ID NO: 858616 - DNA, 22 bp, Artificial Sequence
  chemically synthesized
ttgcttccatgatttcttctcc

SEQ ID NO: 858617 - DNA, 22 bp, Artificial Sequence
  chemically synthesized
tttgcttccatgatttcttctc

SEQ ID NO: 858618 - DNA, 22 bp, Artificial Sequence
  chemically synthesized
gatctttttgcttccatgattt

SEQ ID NO: 858619 - DNA, 22 bp, Artificial Sequence
  chemically synthesized
tagatctttttgcttccatgat

SEQ ID NO: 858620 - DNA, 22 bp, Artificial Sequence
  chemically synthesized
ctagatctttttgcttccatga

SEQ ID NO: 858621 - DNA, 22 bp, Artificial Sequence
  chemically synthesized
agatttctagatctttttgctt

SEQ ID NO: 858622 - DNA, 22 bp, Artificial Sequence
  chemically synthesized
aagatttctagatctttttgct

SEQ ID NO: 858623 - DNA, 22 bp, Artificial Sequence
  chemically synthesized
taagatttctagatctttttgc

SEQ ID NO: 858624 - DNA, 22 bp, Artificial Sequence
  chemically synthesized
ttaagatttctagatctttttg

SEQ ID NO: 858625 - DNA, 22 bp, Artificial Sequence
  chemically synthesized
gaatcccttttaagatttctag

SEQ ID NO: 858626 - DNA, 22 bp, Artificial Sequence
  chemically synthesized
ctggaatcccttttaagatttc

SEQ ID NO: 858627 - DNA, 22 bp, Artificial Sequence
  chemically synthesized
cctggaatcccttttaagattt

SEQ ID NO: 858628 - DNA, 22 bp, Artificial Sequence
  chemically synthesized
tcctggaatcccttttaagatt

SEQ ID NO: 858629 - DNA, 22 bp, Artificial Sequence
  chemically synthesized
ctttcctggaatcccttttaag

SEQ ID NO: 858630 - DNA, 22 bp, Artificial Sequence
  chemically synthesized
gctcctttcctggaatcccttt

SEQ ID NO: 858631 - DNA, 22 bp, Artificial Sequence
  chemically synthesized
agctcctttcctggaatccctt

SEQ ID NO: 858632 - DNA, 22 bp, Artificial Sequence
  chemically synthesized
gaaatcttaaaagggattccag

SEQ ID NO: 858633 - DNA, 22 bp, Artificial Sequence
  chemically synthesized
gatatttagctcctttcctgga

SEQ ID NO: 858634 - DNA, 22 bp, Artificial Sequence
  chemically synthesized
tggatatttagctcctttcctg

SEQ ID NO: 858635 - DNA, 22 bp, Artificial Sequence
  chemically synthesized
aaaagggattccaggaaaggag

SEQ ID NO: 858636 - DNA, 22 bp, Artificial Sequence
  chemically synthesized
aaagggattccaggaaaggagc

SEQ ID NO: 858637 - DNA, 22 bp, Artificial Sequence
  chemically synthesized
tctggatatttagctcctttcc

SEQ ID NO: 858638 - DNA, 22 bp, Artificial Sequence
  chemically synthesized
caggaaaggagctaaatatcca

SEQ ID NO: 858639 - DNA, 22 bp, Artificial Sequence
  chemically synthesized
acacatgcatcctctctggata

SEQ ID NO: 858640 - DNA, 22 bp, Artificial Sequence
  chemically synthesized
atcctcacacatgcatcctctc

SEQ ID NO: 858641 - DNA, 22 bp, Artificial Sequence
  chemically synthesized
catcctcacacatgcatcctct

SEQ ID NO: 858642 - DNA, 22 bp, Artificial Sequence
  chemically synthesized
tcatcctcacacatgcatcctc

SEQ ID NO: 858643 - DNA, 22 bp, Artificial Sequence
  chemically synthesized
ttcatcctcacacatgcatcct

SEQ ID NO: 858644 - DNA, 22 bp, Artificial Sequence
  chemically synthesized
aatatccagagaggatgcatgt

SEQ ID NO: 858645 - DNA, 22 bp, Artificial Sequence
  chemically synthesized
ttttcatcctcacacatgcatc

SEQ ID NO: 858646 - DNA, 22 bp, Artificial Sequence
  chemically synthesized
tcttttcatcctcacacatgca

SEQ ID NO: 858647 - DNA, 22 bp, Artificial Sequence
  chemically synthesized
gctctcttttcatcctcacaca

SEQ ID NO: 858648 - DNA, 22 bp, Artificial Sequence
  chemically synthesized
agctctcttttcatcctcacac

SEQ ID NO: 858649 - DNA, 22 bp, Artificial Sequence
  chemically synthesized
atttagctctcttttcatcctc

SEQ ID NO: 858650 - DNA, 22 bp, Artificial Sequence
  chemically synthesized
aatttagctctcttttcatcct

SEQ ID NO: 858651 - DNA, 22 bp, Artificial Sequence
  chemically synthesized
taatttagctctcttttcatcc

SEQ ID NO: 858652 - DNA, 22 bp, Artificial Sequence
  chemically synthesized
cagtgatattttaatttagctc

SEQ ID NO: 858653 - DNA, 22 bp, Artificial Sequence
  chemically synthesized
ctacagtgatattttaatttag

SEQ ID NO: 858654 - DNA, 22 bp, Artificial Sequence
  chemically synthesized
gttcctacagtgatattttaat

SEQ ID NO: 858655 - DNA, 22 bp, Artificial Sequence
  chemically synthesized
cagttagttcctacagtgatat

SEQ ID NO: 858656 - DNA, 22 bp, Artificial Sequence
  chemically synthesized
tgcagttagttcctacagtgat

SEQ ID NO: 858657 - DNA, 22 bp, Artificial Sequence
  chemically synthesized
aattaaaatatcactgtaggaa

SEQ ID NO: 858658 - DNA, 22 bp, Artificial Sequence
  chemically synthesized
gtgttctgcagttagttcctac

SEQ ID NO: 858659 - DNA, 22 bp, Artificial Sequence
  chemically synthesized
aaatatcactgtaggaactaac

SEQ ID NO: 858660 - DNA, 22 bp, Artificial Sequence
  chemically synthesized
ccagtcagcctggtgttctgca

SEQ ID NO: 858661 - DNA, 22 bp, Artificial Sequence
  chemically synthesized
taggaactaactgcagaacacc

SEQ ID NO: 858662 - DNA, 22 bp, Artificial Sequence
  chemically synthesized
gccagtcagcctggtgttctgc

SEQ ID NO: 858663 - DNA, 22 bp, Artificial Sequence
  chemically synthesized
actgcagaacaccaggctgact

SEQ ID NO: 858664 - DNA, 22 bp, Artificial Sequence
  chemically synthesized
catccacatttgccagtcagcc

SEQ ID NO: 858665 - DNA, 22 bp, Artificial Sequence
  chemically synthesized
cagaacaccaggctgactggca

SEQ ID NO: 858666 - DNA, 22 bp, Artificial Sequence
  chemically synthesized
ggaacactccatccacatttgc

SEQ ID NO: 858667 - DNA, 22 bp, Artificial Sequence
  chemically synthesized
aggaacactccatccacatttg

SEQ ID NO: 858668 - DNA, 22 bp, Artificial Sequence
  chemically synthesized
taggaacactccatccacattt

SEQ ID NO: 858669 - DNA, 22 bp, Artificial Sequence
  chemically synthesized
ttttaggaacactccatccaca

SEQ ID NO: 858670 - DNA, 22 bp, Artificial Sequence
  chemically synthesized
actggcaaatgtggatggagtg

SEQ ID NO: 858671 - DNA, 22 bp, Artificial Sequence
  chemically synthesized
gcaaatgtggatggagtgttcc

SEQ ID NO: 858672 - DNA, 22 bp, Artificial Sequence
  chemically synthesized
tgtatctattttaggaacactc

SEQ ID NO: 858673 - DNA, 22 bp, Artificial Sequence
  chemically synthesized
gtgtatctattttaggaacact

SEQ ID NO: 858674 - DNA, 22 bp, Artificial Sequence
  chemically synthesized
agtataccttgtgtatctattt

SEQ ID NO: 858675 - DNA, 22 bp, Artificial Sequence
  chemically synthesized
cctcagtataccttgtgtatct

SEQ ID NO: 858676 - DNA, 22 bp, Artificial Sequence
  chemically synthesized
ctaaaatagatacacaaggtat

SEQ ID NO: 858677 - DNA, 22 bp, Artificial Sequence
  chemically synthesized
tatattgcctcagtataccttg

SEQ ID NO: 858678 - DNA, 22 bp, Artificial Sequence
  chemically synthesized
aaatagatacacaaggtatact

SEQ ID NO: 858679 - DNA, 22 bp, Artificial Sequence
  chemically synthesized
ctgtatattgcctcagtatacc

SEQ ID NO: 858680 - DNA, 22 bp, Artificial Sequence
  chemically synthesized
aattgctgtatattgcctcagt

SEQ ID NO: 858681 - DNA, 22 bp, Artificial Sequence
  chemically synthesized
ctaaattgctgtatattgcctc

SEQ ID NO: 858682 - DNA, 22 bp, Artificial Sequence
  chemically synthesized
aaatcctcctaaattgctgtat

SEQ ID NO: 858683 - DNA, 22 bp, Artificial Sequence
  chemically synthesized
gaaatcctcctaaattgctgta

SEQ ID NO: 858684 - DNA, 22 bp, Artificial Sequence
  chemically synthesized
aggcaatatacagcaatttagg

SEQ ID NO: 858685 - DNA, 22 bp, Artificial Sequence
  chemically synthesized
ccataagcttgaaatcctccta

SEQ ID NO: 858686 - DNA, 22 bp, Artificial Sequence
  chemically synthesized
cccataagcttgaaatcctcct

SEQ ID NO: 858687 - DNA, 22 bp, Artificial Sequence
  chemically synthesized
acacttcccataagcttgaaat

SEQ ID NO: 858688 - DNA, 22 bp, Artificial Sequence
  chemically synthesized
tgacacttcccataagcttgaa

SEQ ID NO: 858689 - DNA, 22 bp, Artificial Sequence
  chemically synthesized
ctgacacttcccataagcttga

SEQ ID NO: 858690 - DNA, 22 bp, Artificial Sequence
  chemically synthesized
tctgacacttcccataagcttg

SEQ ID NO: 858691 - DNA, 22 bp, Artificial Sequence
  chemically synthesized
aggaggatttcaagcttatggg

SEQ ID NO: 858692 - DNA, 22 bp, Artificial Sequence
  chemically synthesized
ggaggatttcaagcttatggga

SEQ ID NO: 858693 - DNA, 22 bp, Artificial Sequence
  chemically synthesized
aaaaagcattttctgacacttc

SEQ ID NO: 858694 - DNA, 22 bp, Artificial Sequence
  chemically synthesized
caagcttatgggaagtgtcaga

SEQ ID NO: 858695 - DNA, 22 bp, Artificial Sequence
  chemically synthesized
aaaaaagcattttctgacactt

SEQ ID NO: 858696 - DNA, 22 bp, Artificial Sequence
  chemically synthesized
aagcttatgggaagtgtcagaa

SEQ ID NO: 858697 - DNA, 22 bp, Artificial Sequence
  chemically synthesized
taaaaaagcattttctgacact

SEQ ID NO: 858698 - DNA, 22 bp, Artificial Sequence
  chemically synthesized
ttaaaaaagcattttctgacac

SEQ ID NO: 858699 - DNA, 22 bp, Artificial Sequence
  chemically synthesized
tttaaaaaagcattttctgaca

SEQ ID NO: 858700 - DNA, 22 bp, Artificial Sequence
  chemically synthesized
atgggaagtgtcagaaaatgct

SEQ ID NO: 858701 - DNA, 22 bp, Artificial Sequence
  chemically synthesized
tgggaagtgtcagaaaatgctt

SEQ ID NO: 858702 - DNA, 22 bp, Artificial Sequence
  chemically synthesized
aataagtcactttttaaaaaag

SEQ ID NO: 858703 - DNA, 22 bp, Artificial Sequence
  chemically synthesized
caataagtcactttttaaaaaa

SEQ ID NO: 858704 - DNA, 22 bp, Artificial Sequence
  chemically synthesized
tcaataagtcactttttaaaaa

SEQ ID NO: 858705 - DNA, 22 bp, Artificial Sequence
  chemically synthesized
agggtcaaattttcaataagtc

SEQ ID NO: 858706 - DNA, 22 bp, Artificial Sequence
  chemically synthesized
ttttaaaaagtgacttattgaa

SEQ ID NO: 858707 - DNA, 22 bp, Artificial Sequence
  chemically synthesized
gagggtcaaattttcaataagt

SEQ ID NO: 858708 - DNA, 22 bp, Artificial Sequence
  chemically synthesized
tttaaaaagtgacttattgaaa

SEQ ID NO: 858709 - DNA, 22 bp, Artificial Sequence
  chemically synthesized
ttaaaaagtgacttattgaaaa

SEQ ID NO: 858710 - DNA, 22 bp, Artificial Sequence
  chemically synthesized
taaaaagtgacttattgaaaat

SEQ ID NO: 858711 - DNA, 22 bp, Artificial Sequence
  chemically synthesized
tttgagggtcaaattttcaata

SEQ ID NO: 858712 - DNA, 22 bp, Artificial Sequence
  chemically synthesized
aaaaagtgacttattgaaaatt

SEQ ID NO: 858713 - DNA, 22 bp, Artificial Sequence
  chemically synthesized
atttgagggtcaaattttcaat

SEQ ID NO: 858714 - DNA, 22 bp, Artificial Sequence
  chemically synthesized
aaaagtgacttattgaaaattt

SEQ ID NO: 858715 - DNA, 22 bp, Artificial Sequence
  chemically synthesized
ttatttgagggtcaaattttca

SEQ ID NO: 858716 - DNA, 22 bp, Artificial Sequence
  chemically synthesized
ctcttatttgagggtcaaattt

SEQ ID NO: 858717 - DNA, 22 bp, Artificial Sequence
  chemically synthesized
tgctcttatttgagggtcaaat

SEQ ID NO: 858718 - DNA, 22 bp, Artificial Sequence
  chemically synthesized
tctctgctcttatttgagggtc

SEQ ID NO: 858719 - DNA, 22 bp, Artificial Sequence
  chemically synthesized
attgaaaatttgaccctcaaat

SEQ ID NO: 858720 - DNA, 22 bp, Artificial Sequence
  chemically synthesized
gtctctgctcttatttgagggt

SEQ ID NO: 858721 - DNA, 22 bp, Artificial Sequence
  chemically synthesized
ttgaaaatttgaccctcaaata

SEQ ID NO: 858722 - DNA, 22 bp, Artificial Sequence
  chemically synthesized
ttgtctctgctcttatttgagg

SEQ ID NO: 858723 - DNA, 22 bp, Artificial Sequence
  chemically synthesized
aaaatttgaccctcaaataaga

SEQ ID NO: 858724 - DNA, 22 bp, Artificial Sequence
  chemically synthesized
gaccctcaaataagagcagaga

SEQ ID NO: 858725 - DNA, 22 bp, Artificial Sequence
  chemically synthesized
accctcaaataagagcagagac

SEQ ID NO: 858726 - DNA, 22 bp, Artificial Sequence
  chemically synthesized
aaataagagcagagacaagaga

SEQ ID NO: 858727 - DNA, 22 bp, Artificial Sequence
  chemically synthesized
gagaaaaaaaaaaaatctcttg

SEQ ID NO: 858728 - DNA, 22 bp, Artificial Sequence
  chemically synthesized
atggtcagaagtaagtctggag

SEQ ID NO: 858729 - DNA, 22 bp, Artificial Sequence
  chemically synthesized
catggtcagaagtaagtctgga

SEQ ID NO: 858730 - DNA, 22 bp, Artificial Sequence
  chemically synthesized
tcatggtcagaagtaagtctgg

SEQ ID NO: 858731 - DNA, 22 bp, Artificial Sequence
  chemically synthesized
tttttttttctccagacttact

SEQ ID NO: 858732 - DNA, 22 bp, Artificial Sequence
  chemically synthesized
ttttttttctccagacttactt

SEQ ID NO: 858733 - DNA, 22 bp, Artificial Sequence
  chemically synthesized
tttcatggtcagaagtaagtct

SEQ ID NO: 858734 - DNA, 22 bp, Artificial Sequence
  chemically synthesized
tttttttctccagacttacttc

SEQ ID NO: 858735 - DNA, 22 bp, Artificial Sequence
  chemically synthesized
ctttcatggtcagaagtaagtc

SEQ ID NO: 858736 - DNA, 22 bp, Artificial Sequence
  chemically synthesized
ttttttctccagacttacttct

SEQ ID NO: 858737 - DNA, 22 bp, Artificial Sequence
  chemically synthesized
tttttctccagacttacttctg

SEQ ID NO: 858738 - DNA, 22 bp, Artificial Sequence
  chemically synthesized
ttttctccagacttacttctga

SEQ ID NO: 858739 - DNA, 22 bp, Artificial Sequence
  chemically synthesized
tttctccagacttacttctgac

SEQ ID NO: 858740 - DNA, 22 bp, Artificial Sequence
  chemically synthesized
ttctccagacttacttctgacc

SEQ ID NO: 858741 - DNA, 22 bp, Artificial Sequence
  chemically synthesized
tctccagacttacttctgacca

SEQ ID NO: 858742 - DNA, 22 bp, Artificial Sequence
  chemically synthesized
ctccagacttacttctgaccat

SEQ ID NO: 858743 - DNA, 22 bp, Artificial Sequence
  chemically synthesized
ggtacttctttcatggtcagaa

SEQ ID NO: 858744 - DNA, 22 bp, Artificial Sequence
  chemically synthesized
tccagacttacttctgaccatg

SEQ ID NO: 858745 - DNA, 22 bp, Artificial Sequence
  chemically synthesized
cagacttacttctgaccatgaa

SEQ ID NO: 858746 - DNA, 22 bp, Artificial Sequence
  chemically synthesized
attaggtacttctttcatggtc

SEQ ID NO: 858747 - DNA, 22 bp, Artificial Sequence
  chemically synthesized
acttctgaccatgaaagaagta

SEQ ID NO: 858748 - DNA, 22 bp, Artificial Sequence
  chemically synthesized
cacctcattaggtacttctttc

SEQ ID NO: 858749 - DNA, 22 bp, Artificial Sequence
  chemically synthesized
cttctgaccatgaaagaagtac

SEQ ID NO: 858750 - DNA, 22 bp, Artificial Sequence
  chemically synthesized
ccacctcattaggtacttcttt

SEQ ID NO: 858751 - DNA, 22 bp, Artificial Sequence
  chemically synthesized
ctgaccatgaaagaagtaccta

SEQ ID NO: 858752 - DNA, 22 bp, Artificial Sequence
  chemically synthesized
tgaccatgaaagaagtacctaa

SEQ ID NO: 858753 - DNA, 22 bp, Artificial Sequence
  chemically synthesized
accatgaaagaagtacctaatg

SEQ ID NO: 858754 - DNA, 22 bp, Artificial Sequence
  chemically synthesized
gtgtgacatgatcatttccacc

SEQ ID NO: 858755 - DNA, 22 bp, Artificial Sequence
  chemically synthesized
agtgtgacatgatcatttccac

SEQ ID NO: 858756 - DNA, 22 bp, Artificial Sequence
  chemically synthesized
aaatttagtgtgacatgatcat

SEQ ID NO: 858757 - DNA, 22 bp, Artificial Sequence
  chemically synthesized
atgaggtggaaatgatcatgtc

SEQ ID NO: 858758 - DNA, 22 bp, Artificial Sequence
  chemically synthesized
ttgaaatttagtgtgacatgat

SEQ ID NO: 858759 - DNA, 22 bp, Artificial Sequence
  chemically synthesized
attgaaatttagtgtgacatga

SEQ ID NO: 858760 - DNA, 22 bp, Artificial Sequence
  chemically synthesized
tattgaaatttagtgtgacatg

SEQ ID NO: 858761 - DNA, 22 bp, Artificial Sequence
  chemically synthesized
actttattgaaatttagtgtga

SEQ ID NO: 858762 - DNA, 22 bp, Artificial Sequence
  chemically synthesized
cactttattgaaatttagtgtg

SEQ ID NO: 858763 - DNA, 22 bp, Artificial Sequence
  chemically synthesized
atccttcactttattgaaattt

SEQ ID NO: 858764 - DNA, 22 bp, Artificial Sequence
  chemically synthesized
ctcatccttcactttattgaaa

SEQ ID NO: 858765 - DNA, 22 bp, Artificial Sequence
  chemically synthesized
gttcctcatccttcactttatt

SEQ ID NO: 858766 - DNA, 22 bp, Artificial Sequence
  chemically synthesized
tagttcctcatccttcacttta

SEQ ID NO: 858767 - DNA, 22 bp, Artificial Sequence
  chemically synthesized
tctagttcctcatccttcactt

SEQ ID NO: 858768 - DNA, 22 bp, Artificial Sequence
  chemically synthesized
aatttcaataaagtgaaggatg

SEQ ID NO: 858769 - DNA, 22 bp, Artificial Sequence
  chemically synthesized
caataaagtgaaggatgaggaa

SEQ ID NO: 858770 - DNA, 22 bp, Artificial Sequence
  chemically synthesized
ataattctctagttcctcatcc

SEQ ID NO: 858771 - DNA, 22 bp, Artificial Sequence
  chemically synthesized
aataaagtgaaggatgaggaac

SEQ ID NO: 858772 - DNA, 22 bp, Artificial Sequence
  chemically synthesized
aagtctgataattctctagttc

SEQ ID NO: 858773 - DNA, 22 bp, Artificial Sequence
  chemically synthesized
ttgaagtctgataattctctag

SEQ ID NO: 858774 - DNA, 22 bp, Artificial Sequence
  chemically synthesized
gttgaagtctgataattctcta

SEQ ID NO: 858775 - DNA, 22 bp, Artificial Sequence
  chemically synthesized
cttgttgaagtctgataattct

SEQ ID NO: 858776 - DNA, 22 bp, Artificial Sequence
  chemically synthesized
gagaattatcagacttcaacaa

SEQ ID NO: 858777 - DNA, 22 bp, Artificial Sequence
  chemically synthesized
aggaaacagtggtctgcttgtt

SEQ ID NO: 858778 - DNA, 22 bp, Artificial Sequence
  chemically synthesized
caggaaacagtggtctgcttgt

SEQ ID NO: 858779 - DNA, 22 bp, Artificial Sequence
  chemically synthesized
tcaggaaacagtggtctgcttg

SEQ ID NO: 858780 - DNA, 22 bp, Artificial Sequence
  chemically synthesized
tcagacttcaacaagcagacca

SEQ ID NO: 858781 - DNA, 22 bp, Artificial Sequence
  chemically synthesized
ttcaggaaacagtggtctgctt

SEQ ID NO: 858782 - DNA, 22 bp, Artificial Sequence
  chemically synthesized
caacaagcagaccactgtttcc

SEQ ID NO: 858783 - DNA, 22 bp, Artificial Sequence
  chemically synthesized
aacaagcagaccactgtttcct

SEQ ID NO: 858784 - DNA, 22 bp, Artificial Sequence
  chemically synthesized
caaacgtgcttttcaggaaaca

SEQ ID NO: 858785 - DNA, 22 bp, Artificial Sequence
  chemically synthesized
ccaaacgtgcttttcaggaaac

SEQ ID NO: 858786 - DNA, 22 bp, Artificial Sequence
  chemically synthesized
tccaaacgtgcttttcaggaaa

SEQ ID NO: 858787 - DNA, 22 bp, Artificial Sequence
  chemically synthesized
ttccaaacgtgcttttcaggaa

SEQ ID NO: 858788 - DNA, 22 bp, Artificial Sequence
  chemically synthesized
tttccaaacgtgcttttcagga

SEQ ID NO: 858789 - DNA, 22 bp, Artificial Sequence
  chemically synthesized
tctttttccaaacgtgcttttc

SEQ ID NO: 858790 - DNA, 22 bp, Artificial Sequence
  chemically synthesized
tgtctttttccaaacgtgcttt

SEQ ID NO: 858791 - DNA, 22 bp, Artificial Sequence
  chemically synthesized
ctgtctttttccaaacgtgctt

SEQ ID NO: 858792 - DNA, 22 bp, Artificial Sequence
  chemically synthesized
tctgtctttttccaaacgtgct

SEQ ID NO: 858793 - DNA, 22 bp, Artificial Sequence
  chemically synthesized
tttcctgaaaagcacgtttgga

SEQ ID NO: 858794 - DNA, 22 bp, Artificial Sequence
  chemically synthesized
ctttctgtctttttccaaacgt

SEQ ID NO: 858795 - DNA, 22 bp, Artificial Sequence
  chemically synthesized
cctttctgtctttttccaaacg

SEQ ID NO: 858796 - DNA, 22 bp, Artificial Sequence
  chemically synthesized
cctgaaaagcacgtttggaaaa

SEQ ID NO: 858797 - DNA, 22 bp, Artificial Sequence
  chemically synthesized
ctgaaaagcacgtttggaaaaa

SEQ ID NO: 858798 - DNA, 22 bp, Artificial Sequence
  chemically synthesized
ttcctttctgtctttttccaaa

SEQ ID NO: 858799 - DNA, 22 bp, Artificial Sequence
  chemically synthesized
cttcctttctgtctttttccaa

SEQ ID NO: 858800 - DNA, 22 bp, Artificial Sequence
  chemically synthesized
aaaagcacgtttggaaaaagac

SEQ ID NO: 858801 - DNA, 22 bp, Artificial Sequence
  chemically synthesized
cttcttcctttctgtctttttc

SEQ ID NO: 858802 - DNA, 22 bp, Artificial Sequence
  chemically synthesized
ccttcttcctttctgtcttttt

SEQ ID NO: 858803 - DNA, 22 bp, Artificial Sequence
  chemically synthesized
tccttcttcctttctgtctttt

SEQ ID NO: 858804 - DNA, 22 bp, Artificial Sequence
  chemically synthesized
tttccttcttcctttctgtctt

SEQ ID NO: 858805 - DNA, 22 bp, Artificial Sequence
  chemically synthesized
ctttccttcttcctttctgtct

SEQ ID NO: 858806 - DNA, 22 bp, Artificial Sequence
  chemically synthesized
ttctttccttcttcctttctgt

SEQ ID NO: 858807 - DNA, 22 bp, Artificial Sequence
  chemically synthesized
cttctttccttcttcctttctg

SEQ ID NO: 858808 - DNA, 22 bp, Artificial Sequence
  chemically synthesized
tcttctttccttcttcctttct

SEQ ID NO: 858809 - DNA, 22 bp, Artificial Sequence
  chemically synthesized
ggaaaaagacagaaaggaagaa

SEQ ID NO: 858810 - DNA, 22 bp, Artificial Sequence
  chemically synthesized
gaaaaagacagaaaggaagaag

SEQ ID NO: 858811 - DNA, 22 bp, Artificial Sequence
  chemically synthesized
actttcttctttccttcttcct

SEQ ID NO: 858812 - DNA, 22 bp, Artificial Sequence
  chemically synthesized
cctgactttcttctttccttct

SEQ ID NO: 858813 - DNA, 22 bp, Artificial Sequence
  chemically synthesized
cctccctgactttcttctttcc

SEQ ID NO: 858814 - DNA, 22 bp, Artificial Sequence
  chemically synthesized
cctccctccctgactttcttct

SEQ ID NO: 858815 - DNA, 22 bp, Artificial Sequence
  chemically synthesized
cctccctccctccctgactttc

SEQ ID NO: 858816 - DNA, 22 bp, Artificial Sequence
  chemically synthesized
ctccctccctccctccctgact

SEQ ID NO: 858817 - DNA, 22 bp, Artificial Sequence
  chemically synthesized
cctccctccctccctccctgac

SEQ ID NO: 858818 - DNA, 22 bp, Artificial Sequence
  chemically synthesized
cttcctccctccctccctccct

SEQ ID NO: 858819 - DNA, 22 bp, Artificial Sequence
  chemically synthesized
cctccttcctccctccctccct

SEQ ID NO: 858820 - DNA, 22 bp, Artificial Sequence
  chemically synthesized
cctccctccttcctccctccct

SEQ ID NO: 858821 - DNA, 22 bp, Artificial Sequence
  chemically synthesized
cctccctccctccttcctccct

SEQ ID NO: 858822 - DNA, 22 bp, Artificial Sequence
  chemically synthesized
cctccctccctccctccttcct

SEQ ID NO: 858823 - DNA, 22 bp, Artificial Sequence
  chemically synthesized
cctccctccctccctccctcct

SEQ ID NO: 858824 - DNA, 22 bp, Artificial Sequence
  chemically synthesized
aatagattccctccctccctcc

SEQ ID NO: 858825 - DNA, 22 bp, Artificial Sequence
  chemically synthesized
caatagattccctccctccctc

SEQ ID NO: 858826 - DNA, 22 bp, Artificial Sequence
  chemically synthesized
tcaatagattccctccctccct

SEQ ID NO: 858827 - DNA, 22 bp, Artificial Sequence
  chemically synthesized
ttcaatagattccctccctccc

SEQ ID NO: 858828 - DNA, 22 bp, Artificial Sequence
  chemically synthesized
cttttcaatagattccctccct

SEQ ID NO: 858829 - DNA, 22 bp, Artificial Sequence
  chemically synthesized
gcttttcaatagattccctccc

SEQ ID NO: 858830 - DNA, 22 bp, Artificial Sequence
  chemically synthesized
ccttgcttttcaatagattccc

SEQ ID NO: 858831 - DNA, 22 bp, Artificial Sequence
  chemically synthesized
gccttgcttttcaatagattcc

SEQ ID NO: 858832 - DNA, 22 bp, Artificial Sequence
  chemically synthesized
tcttgccttgcttttcaataga

SEQ ID NO: 858833 - DNA, 22 bp, Artificial Sequence
  chemically synthesized
gtcttgccttgcttttcaatag

SEQ ID NO: 858834 - DNA, 22 bp, Artificial Sequence
  chemically synthesized
ccttgtcttgccttgcttttca

SEQ ID NO: 858835 - DNA, 22 bp, Artificial Sequence
  chemically synthesized
ctgccttgtcttgccttgcttt

SEQ ID NO: 858836 - DNA, 22 bp, Artificial Sequence
  chemically synthesized
cctgccttgtcttgccttgctt

SEQ ID NO: 858837 - DNA, 22 bp, Artificial Sequence
  chemically synthesized
ccttcctgccttgtcttgcctt

SEQ ID NO: 858838 - DNA, 22 bp, Artificial Sequence
  chemically synthesized
ttgaaaagcaaggcaagacaag

SEQ ID NO: 858839 - DNA, 22 bp, Artificial Sequence
  chemically synthesized
ctgccttcctgccttgtcttgc

SEQ ID NO: 858840 - DNA, 22 bp, Artificial Sequence
  chemically synthesized
cctgccttcctgccttgtcttg

SEQ ID NO: 858841 - DNA, 22 bp, Artificial Sequence
  chemically synthesized
aaaagcaaggcaagacaaggca

SEQ ID NO: 858842 - DNA, 22 bp, Artificial Sequence
  chemically synthesized
cttcctgccttcctgccttgtc

SEQ ID NO: 858843 - DNA, 22 bp, Artificial Sequence
  chemically synthesized
ccttcctgccttcctgccttgt

SEQ ID NO: 858844 - DNA, 22 bp, Artificial Sequence
  chemically synthesized
cttccttcctgccttcctgcct

SEQ ID NO: 858845 - DNA, 22 bp, Artificial Sequence
  chemically synthesized
ccttccttcctgccttcctgcc

SEQ ID NO: 858846 - DNA, 22 bp, Artificial Sequence
  chemically synthesized
acttccttccttcctgccttcc

SEQ ID NO: 858847 - DNA, 22 bp, Artificial Sequence
  chemically synthesized
ctgacttccttccttcctgcct

SEQ ID NO: 858848 - DNA, 22 bp, Artificial Sequence
  chemically synthesized
cctgacttccttccttcctgcc

SEQ ID NO: 858849 - DNA, 22 bp, Artificial Sequence
  chemically synthesized
gcttcctgacttccttccttcc

SEQ ID NO: 858850 - DNA, 22 bp, Artificial Sequence
  chemically synthesized
cctggcttcctgacttccttcc

SEQ ID NO: 858851 - DNA, 22 bp, Artificial Sequence
  chemically synthesized
ctgcctggcttcctgacttcct

SEQ ID NO: 858852 - DNA, 22 bp, Artificial Sequence
  chemically synthesized
actgcctggcttcctgacttcc

SEQ ID NO: 858853 - DNA, 22 bp, Artificial Sequence
  chemically synthesized
ccttactgcctggcttcctgac

SEQ ID NO: 858854 - DNA, 22 bp, Artificial Sequence
  chemically synthesized
cccttactgcctggcttcctga

SEQ ID NO: 858855 - DNA, 22 bp, Artificial Sequence
  chemically synthesized
cttcccttactgcctggcttcc

SEQ ID NO: 858856 - DNA, 22 bp, Artificial Sequence
  chemically synthesized
ccttcccttactgcctggcttc

SEQ ID NO: 858857 - DNA, 22 bp, Artificial Sequence
  chemically synthesized
cttccttcccttactgcctggc

SEQ ID NO: 858858 - DNA, 22 bp, Artificial Sequence
  chemically synthesized
ctccttccttcccttactgcct

SEQ ID NO: 858859 - DNA, 22 bp, Artificial Sequence
  chemically synthesized
cctccttccttcccttactgcc

SEQ ID NO: 858860 - DNA, 22 bp, Artificial Sequence
  chemically synthesized
cttcctccttccttcccttact

SEQ ID NO: 858861 - DNA, 22 bp, Artificial Sequence
  chemically synthesized
caatagattccttcctccttcc

SEQ ID NO: 858862 - DNA, 22 bp, Artificial Sequence
  chemically synthesized
ccaatagattccttcctccttc

SEQ ID NO: 858863 - DNA, 22 bp, Artificial Sequence
  chemically synthesized
aatagacttccaatagattcct

SEQ ID NO: 858864 - DNA, 22 bp, Artificial Sequence
  chemically synthesized
caatagacttccaatagattcc

SEQ ID NO: 858865 - DNA, 22 bp, Artificial Sequence
  chemically synthesized
tcaatagacttccaatagattc

SEQ ID NO: 858866 - DNA, 22 bp, Artificial Sequence
  chemically synthesized
ttcaatagacttccaatagatt

SEQ ID NO: 858867 - DNA, 22 bp, Artificial Sequence
  chemically synthesized
cttttcaatagacttccaatag

SEQ ID NO: 858868 - DNA, 22 bp, Artificial Sequence
  chemically synthesized
gcttttcaatagacttccaata

SEQ ID NO: 858869 - DNA, 22 bp, Artificial Sequence
  chemically synthesized
gccttgcttttcaatagacttc

SEQ ID NO: 858870 - DNA, 22 bp, Artificial Sequence
  chemically synthesized
aggccctggccttgcttttcaa

SEQ ID NO: 858871 - DNA, 22 bp, Artificial Sequence
  chemically synthesized
ttggaagtctattgaaaagcaa

SEQ ID NO: 858872 - DNA, 22 bp, Artificial Sequence
  chemically synthesized
gaagtctattgaaaagcaaggc

SEQ ID NO: 858873 - DNA, 22 bp, Artificial Sequence
  chemically synthesized
agtctcaggccctggccttgct

SEQ ID NO: 858874 - DNA, 22 bp, Artificial Sequence
  chemically synthesized
gagtctcaggccctggccttgc

SEQ ID NO: 858875 - DNA, 22 bp, Artificial Sequence
  chemically synthesized
tgagtctcaggccctggccttg

SEQ ID NO: 858876 - DNA, 22 bp, Artificial Sequence
  chemically synthesized
ttgagtctcaggccctggcctt

SEQ ID NO: 858877 - DNA, 22 bp, Artificial Sequence
  chemically synthesized
tttgagtctcaggccctggcct

SEQ ID NO: 858878 - DNA, 22 bp, Artificial Sequence
  chemically synthesized
ttgaaaagcaaggccagggcct

SEQ ID NO: 858879 - DNA, 22 bp, Artificial Sequence
  chemically synthesized
tttttgagtctcaggccctggc

SEQ ID NO: 858880 - DNA, 22 bp, Artificial Sequence
  chemically synthesized
tctttttgagtctcaggccctg

SEQ ID NO: 858881 - DNA, 22 bp, Artificial Sequence
  chemically synthesized
aaaagcaaggccagggcctgag

SEQ ID NO: 858882 - DNA, 22 bp, Artificial Sequence
  chemically synthesized
tctctttttgagtctcaggccc

SEQ ID NO: 858883 - DNA, 22 bp, Artificial Sequence
  chemically synthesized
gtcatcatgaaccattctctct

SEQ ID NO: 858884 - DNA, 22 bp, Artificial Sequence
  chemically synthesized
agtcatcatgaaccattctctc

SEQ ID NO: 858885 - DNA, 22 bp, Artificial Sequence
  chemically synthesized
agactcaaaaagagagaatggt

SEQ ID NO: 858886 - DNA, 22 bp, Artificial Sequence
  chemically synthesized
aaaaagagagaatggttcatga

SEQ ID NO: 858887 - DNA, 22 bp, Artificial Sequence
  chemically synthesized
tcatcccaatggcatatttagt

SEQ ID NO: 858888 - DNA, 22 bp, Artificial Sequence
  chemically synthesized
atcatcccaatggcatatttag

SEQ ID NO: 858889 - DNA, 22 bp, Artificial Sequence
  chemically synthesized
atttatcatcccaatggcatat

SEQ ID NO: 858890 - DNA, 22 bp, Artificial Sequence
  chemically synthesized
atgatgactaaatatgccattg

SEQ ID NO: 858891 - DNA, 22 bp, Artificial Sequence
  chemically synthesized
agctaatttatcatcccaatgg

SEQ ID NO: 858892 - DNA, 22 bp, Artificial Sequence
  chemically synthesized
cagctaatttatcatcccaatg

SEQ ID NO: 858893 - DNA, 22 bp, Artificial Sequence
  chemically synthesized
aatatgccattgggatgataaa

SEQ ID NO: 858894 - DNA, 22 bp, Artificial Sequence
  chemically synthesized
aatatgcttcagctaatttatc

SEQ ID NO: 858895 - DNA, 22 bp, Artificial Sequence
  chemically synthesized
tgaatatgcttcagctaattta

SEQ ID NO: 858896 - DNA, 22 bp, Artificial Sequence
  chemically synthesized
ggatgataaattagctgaagca

SEQ ID NO: 858897 - DNA, 22 bp, Artificial Sequence
  chemically synthesized
catcatcctctgaatatgcttc

SEQ ID NO: 858898 - DNA, 22 bp, Artificial Sequence
  chemically synthesized
tccatcatcctctgaatatgct

SEQ ID NO: 858899 - DNA, 22 bp, Artificial Sequence
  chemically synthesized
gacctctccatcatcctctgaa

SEQ ID NO: 858900 - DNA, 22 bp, Artificial Sequence
  chemically synthesized
gctgaagcatattcagaggatg

SEQ ID NO: 858901 - DNA, 22 bp, Artificial Sequence
  chemically synthesized
ctagacctctccatcatcctct

SEQ ID NO: 858902 - DNA, 22 bp, Artificial Sequence
  chemically synthesized
aagcatattcagaggatgatgg

SEQ ID NO: 858903 - DNA, 22 bp, Artificial Sequence
  chemically synthesized
agaggatgatggagaggtctag

SEQ ID NO: 858904 - DNA, 22 bp, Artificial Sequence
  chemically synthesized
gcgcagggatggccgcattgct

SEQ ID NO: 858905 - DNA, 22 bp, Artificial Sequence
  chemically synthesized
cccatgactggcgcagggatgg

SEQ ID NO: 858906 - DNA, 22 bp, Artificial Sequence
  chemically synthesized
gcaatgcggccatccctgcgcc

SEQ ID NO: 858907 - DNA, 22 bp, Artificial Sequence
  chemically synthesized
tctgcccatgactggcgcaggg

SEQ ID NO: 858908 - DNA, 22 bp, Artificial Sequence
  chemically synthesized
tagatgagattatctgcccatg

SEQ ID NO: 858909 - DNA, 22 bp, Artificial Sequence
  chemically synthesized
cgccagtcatgggcagataatc

SEQ ID NO: 858910 - DNA, 22 bp, Artificial Sequence
  chemically synthesized
acgggtctatagatgagattat

SEQ ID NO: 858911 - DNA, 22 bp, Artificial Sequence
  chemically synthesized
gcctgacgggtctatagatgag

SEQ ID NO: 858912 - DNA, 22 bp, Artificial Sequence
  chemically synthesized
atctatagacccgtcaggccag

SEQ ID NO: 858913 - DNA, 22 bp, Artificial Sequence
  chemically synthesized
tagacccgtcaggccagtattt

SEQ ID NO: 858914 - DNA, 22 bp, Artificial Sequence
  chemically synthesized
gagaagagaagaccagaaatac

SEQ ID NO: 858915 - DNA, 22 bp, Artificial Sequence
  chemically synthesized
aggtggtgcatgctggagaaga

SEQ ID NO: 858916 - DNA, 22 bp, Artificial Sequence
  chemically synthesized
caggtggtgcatgctggagaag

SEQ ID NO: 858917 - DNA, 22 bp, Artificial Sequence
  chemically synthesized
ctggtcttctcttctccagcat

SEQ ID NO: 858918 - DNA, 22 bp, Artificial Sequence
  chemically synthesized
ttcaggtggtgcatgctggaga

SEQ ID NO: 858919 - DNA, 22 bp, Artificial Sequence
  chemically synthesized
tggtcttctcttctccagcatg

SEQ ID NO: 858920 - DNA, 22 bp, Artificial Sequence
  chemically synthesized
gtcttctcttctccagcatgca

SEQ ID NO: 858921 - DNA, 22 bp, Artificial Sequence
  chemically synthesized
ctcttctccagcatgcaccacc

SEQ ID NO: 858922 - DNA, 22 bp, Artificial Sequence
  chemically synthesized
tcttctccagcatgcaccacct

SEQ ID NO: 858923 - DNA, 22 bp, Artificial Sequence
  chemically synthesized
ttctccagcatgcaccacctga

SEQ ID NO: 858924 - DNA, 22 bp, Artificial Sequence
  chemically synthesized
ctccagcatgcaccacctgaag

SEQ ID NO: 858925 - DNA, 22 bp, Artificial Sequence
  chemically synthesized
tccagcatgcaccacctgaaga

SEQ ID NO: 858926 - DNA, 22 bp, Artificial Sequence
  chemically synthesized
cagcatgcaccacctgaagaac

SEQ ID NO: 858927 - DNA, 22 bp, Artificial Sequence
  chemically synthesized
ccagcagtgtacagatagatgt

SEQ ID NO: 858928 - DNA, 22 bp, Artificial Sequence
  chemically synthesized
cccagcagtgtacagatagatg

SEQ ID NO: 858929 - DNA, 22 bp, Artificial Sequence
  chemically synthesized
tcccagcagtgtacagatagat

SEQ ID NO: 858930 - DNA, 22 bp, Artificial Sequence
  chemically synthesized
cctttcccagcagtgtacagat

SEQ ID NO: 858931 - DNA, 22 bp, Artificial Sequence
  chemically synthesized
aagaacatctatctgtacactg

SEQ ID NO: 858932 - DNA, 22 bp, Artificial Sequence
  chemically synthesized
ccctccctttcccagcagtgta

SEQ ID NO: 858933 - DNA, 22 bp, Artificial Sequence
  chemically synthesized
cccctccctttcccagcagtgt

SEQ ID NO: 858934 - DNA, 22 bp, Artificial Sequence
  chemically synthesized
tctgtacactgctgggaaaggg

SEQ ID NO: 858935 - DNA, 22 bp, Artificial Sequence
  chemically synthesized
ataaggtttcccctccctttcc

SEQ ID NO: 858936 - DNA, 22 bp, Artificial Sequence
  chemically synthesized
tacactgctgggaaagggaggg

SEQ ID NO: 858937 - DNA, 22 bp, Artificial Sequence
  chemically synthesized
ctgggaaagggaggggaaacct

SEQ ID NO: 858938 - DNA, 22 bp, Artificial Sequence
  chemically synthesized
ggaaagggaggggaaaccttat

SEQ ID NO: 858939 - DNA, 22 bp, Artificial Sequence
  chemically synthesized
atcagactttctcactgctcta

SEQ ID NO: 858940 - DNA, 22 bp, Artificial Sequence
  chemically synthesized
tcagactttctcactgctctat

SEQ ID NO: 858941 - DNA, 22 bp, Artificial Sequence
  chemically synthesized
tctcactgctctatctcttgca

SEQ ID NO: 858942 - DNA, 22 bp, Artificial Sequence
  chemically synthesized
ctcactgctctatctcttgcat

SEQ ID NO: 858943 - DNA, 22 bp, Artificial Sequence
  chemically synthesized
tcactgctctatctcttgcatc

SEQ ID NO: 858944 - DNA, 22 bp, Artificial Sequence
  chemically synthesized
actgctctatctcttgcatctt

SEQ ID NO: 858945 - DNA, 22 bp, Artificial Sequence
  chemically synthesized
caggacatgtgcaagatgcaag

SEQ ID NO: 858946 - DNA, 22 bp, Artificial Sequence
  chemically synthesized
ctctatctcttgcatcttgcac

SEQ ID NO: 858947 - DNA, 22 bp, Artificial Sequence
  chemically synthesized
tactccaggacatgtgcaagat

SEQ ID NO: 858948 - DNA, 22 bp, Artificial Sequence
  chemically synthesized
tatctcttgcatcttgcacatg

SEQ ID NO: 858949 - DNA, 22 bp, Artificial Sequence
  chemically synthesized
ctatactccaggacatgtgcaa

SEQ ID NO: 858950 - DNA, 22 bp, Artificial Sequence
  chemically synthesized
tctcttgcatcttgcacatgtc

SEQ ID NO: 858951 - DNA, 22 bp, Artificial Sequence
  chemically synthesized
ttgcatcttgcacatgtcctgg

SEQ ID NO: 858952 - DNA, 22 bp, Artificial Sequence
  chemically synthesized
gcatcttgcacatgtcctggag

SEQ ID NO: 858953 - DNA, 22 bp, Artificial Sequence
  chemically synthesized
catcttgcacatgtcctggagt

SEQ ID NO: 858954 - DNA, 22 bp, Artificial Sequence
  chemically synthesized
agcacctcctatactccaggac

SEQ ID NO: 858955 - DNA, 22 bp, Artificial Sequence
  chemically synthesized
gcacatgtcctggagtatagga

SEQ ID NO: 858956 - DNA, 22 bp, Artificial Sequence
  chemically synthesized
cacatgtcctggagtataggag

SEQ ID NO: 858957 - DNA, 22 bp, Artificial Sequence
  chemically synthesized
aaagggaatcaattgagcacct

SEQ ID NO: 858958 - DNA, 22 bp, Artificial Sequence
  chemically synthesized
gagtataggaggtgctcaattg

SEQ ID NO: 858959 - DNA, 22 bp, Artificial Sequence
  chemically synthesized
gattcaaagggaatcaattgag

SEQ ID NO: 858960 - DNA, 22 bp, Artificial Sequence
  chemically synthesized
agattcaaagggaatcaattga

SEQ ID NO: 858961 - DNA, 22 bp, Artificial Sequence
  chemically synthesized
tagattcaaagggaatcaattg

SEQ ID NO: 858962 - DNA, 22 bp, Artificial Sequence
  chemically synthesized
tttagattcaaagggaatcaat

SEQ ID NO: 858963 - DNA, 22 bp, Artificial Sequence
  chemically synthesized
ctttagattcaaagggaatcaa

SEQ ID NO: 858964 - DNA, 22 bp, Artificial Sequence
  chemically synthesized
tctttagattcaaagggaatca

SEQ ID NO: 858965 - DNA, 22 bp, Artificial Sequence
  chemically synthesized
ttctttagattcaaagggaatc

SEQ ID NO: 858966 - DNA, 22 bp, Artificial Sequence
  chemically synthesized
acttttctttagattcaaaggg

SEQ ID NO: 858967 - DNA, 22 bp, Artificial Sequence
  chemically synthesized
aattgattccctttgaatctaa

SEQ ID NO: 858968 - DNA, 22 bp, Artificial Sequence
  chemically synthesized
cacattgacttttctttagatt

SEQ ID NO: 858969 - DNA, 22 bp, Artificial Sequence
  chemically synthesized
attccctttgaatctaaagaaa

SEQ ID NO: 858970 - DNA, 22 bp, Artificial Sequence
  chemically synthesized
ctgcacattgacttttctttag

SEQ ID NO: 858971 - DNA, 22 bp, Artificial Sequence
  chemically synthesized
actgcacattgacttttcttta

SEQ ID NO: 858972 - DNA, 22 bp, Artificial Sequence
  chemically synthesized
cctttgaatctaaagaaaagtc

SEQ ID NO: 858973 - DNA, 22 bp, Artificial Sequence
  chemically synthesized
tgaatctaaagaaaagtcaatg

SEQ ID NO: 858974 - DNA, 22 bp, Artificial Sequence
  chemically synthesized
gaatctaaagaaaagtcaatgt

SEQ ID NO: 858975 - DNA, 22 bp, Artificial Sequence
  chemically synthesized
aatctaaagaaaagtcaatgtg

SEQ ID NO: 858976 - DNA, 22 bp, Artificial Sequence
  chemically synthesized
aagagcttactgcacattgact

SEQ ID NO: 858977 - DNA, 22 bp, Artificial Sequence
  chemically synthesized
actaaagagcttactgcacatt

SEQ ID NO: 858978 - DNA, 22 bp, Artificial Sequence
  chemically synthesized
aagaaaagtcaatgtgcagtaa

SEQ ID NO: 858979 - DNA, 22 bp, Artificial Sequence
  chemically synthesized
agttcactaaagagcttactgc

SEQ ID NO: 858980 - DNA, 22 bp, Artificial Sequence
  chemically synthesized
taagttcactaaagagcttact

SEQ ID NO: 858981 - DNA, 22 bp, Artificial Sequence
  chemically synthesized
tatgtagaagacctctaagttc

SEQ ID NO: 858982 - DNA, 22 bp, Artificial Sequence
  chemically synthesized
attgtatgtagaagacctctaa

SEQ ID NO: 858983 - DNA, 22 bp, Artificial Sequence
  chemically synthesized
tttagtgaacttagaggtcttc

SEQ ID NO: 858984 - DNA, 22 bp, Artificial Sequence
  chemically synthesized
tagtgaacttagaggtcttcta

SEQ ID NO: 858985 - DNA, 22 bp, Artificial Sequence
  chemically synthesized
agtgaacttagaggtcttctac

SEQ ID NO: 858986 - DNA, 22 bp, Artificial Sequence
  chemically synthesized
gtgaacttagaggtcttctaca

SEQ ID NO: 858987 - DNA, 22 bp, Artificial Sequence
  chemically synthesized
gtactcattgtatgtagaagac

SEQ ID NO: 858988 - DNA, 22 bp, Artificial Sequence
  chemically synthesized
agtactcattgtatgtagaaga

SEQ ID NO: 858989 - DNA, 22 bp, Artificial Sequence
  chemically synthesized
tagtactcattgtatgtagaag

SEQ ID NO: 858990 - DNA, 22 bp, Artificial Sequence
  chemically synthesized
aattttagtactcattgtatgt

SEQ ID NO: 858991 - DNA, 22 bp, Artificial Sequence
  chemically synthesized
agaggtcttctacatacaatga

SEQ ID NO: 858992 - DNA, 22 bp, Artificial Sequence
  chemically synthesized
gaggtcttctacatacaatgag

SEQ ID NO: 858993 - DNA, 22 bp, Artificial Sequence
  chemically synthesized
ttaaattttagtactcattgta

SEQ ID NO: 858994 - DNA, 22 bp, Artificial Sequence
  chemically synthesized
ctacatacaatgagtactaaaa

SEQ ID NO: 858995 - DNA, 22 bp, Artificial Sequence
  chemically synthesized
tacatacaatgagtactaaaat

SEQ ID NO: 858996 - DNA, 22 bp, Artificial Sequence
  chemically synthesized
catacaatgagtactaaaattt

SEQ ID NO: 858997 - DNA, 22 bp, Artificial Sequence
  chemically synthesized
atgggtggctgttaaattttag

SEQ ID NO: 858998 - DNA, 22 bp, Artificial Sequence
  chemically synthesized
taatgggtggctgttaaatttt

SEQ ID NO: 858999 - DNA, 22 bp, Artificial Sequence
  chemically synthesized
cattctaatgggtggctgttaa

SEQ ID NO: 859000 - DNA, 22 bp, Artificial Sequence
  chemically synthesized
ccattctaatgggtggctgtta

SEQ ID NO: 859001 - DNA, 22 bp, Artificial Sequence
  chemically synthesized
ttccattctaatgggtggctgt

SEQ ID NO: 859002 - DNA, 22 bp, Artificial Sequence
  chemically synthesized
aaatttaacagccacccattag

SEQ ID NO: 859003 - DNA, 22 bp, Artificial Sequence
  chemically synthesized
cattcttccattctaatgggtg

SEQ ID NO: 859004 - DNA, 22 bp, Artificial Sequence
  chemically synthesized
gcctccattcttccattctaat

SEQ ID NO: 859005 - DNA, 22 bp, Artificial Sequence
  chemically synthesized
aacagccacccattagaatgga

SEQ ID NO: 859006 - DNA, 22 bp, Artificial Sequence
  chemically synthesized
acagccacccattagaatggaa

SEQ ID NO: 859007 - DNA, 22 bp, Artificial Sequence
  chemically synthesized
tagcctccattcttccattcta

SEQ ID NO: 859008 - DNA, 22 bp, Artificial Sequence
  chemically synthesized
tgttctagcctccattcttcca

SEQ ID NO: 859009 - DNA, 22 bp, Artificial Sequence
  chemically synthesized
gtgttctagcctccattcttcc

SEQ ID NO: 859010 - DNA, 22 bp, Artificial Sequence
  chemically synthesized
tgtgttctagcctccattcttc

SEQ ID NO: 859011 - DNA, 22 bp, Artificial Sequence
  chemically synthesized
gaatggaagaatggaggctaga

SEQ ID NO: 859012 - DNA, 22 bp, Artificial Sequence
  chemically synthesized
ggcatgttttgtgttctagcct

SEQ ID NO: 859013 - DNA, 22 bp, Artificial Sequence
  chemically synthesized
gtaaaaacctaggcatgttttg

SEQ ID NO: 859014 - DNA, 22 bp, Artificial Sequence
  chemically synthesized
actagtaaaaacctaggcatgt

SEQ ID NO: 859015 - DNA, 22 bp, Artificial Sequence
  chemically synthesized
gaacacaaaacatgcctaggtt

SEQ ID NO: 859016 - DNA, 22 bp, Artificial Sequence
  chemically synthesized
aaatcacctaactagtaaaaac

SEQ ID NO: 859017 - DNA, 22 bp, Artificial Sequence
  chemically synthesized
ggtttttactagttaggtgatt

SEQ ID NO: 859018 - DNA, 22 bp, Artificial Sequence
  chemically synthesized
gtgaaaatagctaaaatcacct

SEQ ID NO: 859019 - DNA, 22 bp, Artificial Sequence
  chemically synthesized
tcgtgaaaatagctaaaatcac

SEQ ID NO: 859020 - DNA, 22 bp, Artificial Sequence
  chemically synthesized
ttactagttaggtgattttagc

SEQ ID NO: 859021 - DNA, 22 bp, Artificial Sequence
  chemically synthesized
ctcgtgaaaatagctaaaatca

SEQ ID NO: 859022 - DNA, 22 bp, Artificial Sequence
  chemically synthesized
tactagttaggtgattttagct

SEQ ID NO: 859023 - DNA, 22 bp, Artificial Sequence
  chemically synthesized
actagttaggtgattttagcta

SEQ ID NO: 859024 - DNA, 22 bp, Artificial Sequence
  chemically synthesized
ctagttaggtgattttagctat

SEQ ID NO: 859025 - DNA, 22 bp, Artificial Sequence
  chemically synthesized
tcttctcgtgaaaatagctaaa

SEQ ID NO: 859026 - DNA, 22 bp, Artificial Sequence
  chemically synthesized
gttaggtgattttagctatttt

SEQ ID NO: 859027 - DNA, 22 bp, Artificial Sequence
  chemically synthesized
cattatcttctcgtgaaaatag

SEQ ID NO: 859028 - DNA, 22 bp, Artificial Sequence
  chemically synthesized
ggtgattttagctattttcacg

SEQ ID NO: 859029 - DNA, 22 bp, Artificial Sequence
  chemically synthesized
ctccattatcttctcgtgaaaa

SEQ ID NO: 859030 - DNA, 22 bp, Artificial Sequence
  chemically synthesized
cctccattatcttctcgtgaaa

SEQ ID NO: 859031 - DNA, 22 bp, Artificial Sequence
  chemically synthesized
tagctattttcacgagaagata

SEQ ID NO: 859032 - DNA, 22 bp, Artificial Sequence
  chemically synthesized
agctattttcacgagaagataa

SEQ ID NO: 859033 - DNA, 22 bp, Artificial Sequence
  chemically synthesized
gctattttcacgagaagataat

SEQ ID NO: 859034 - DNA, 22 bp, Artificial Sequence
  chemically synthesized
ttttcacgagaagataatggag

SEQ ID NO: 859035 - DNA, 22 bp, Artificial Sequence
  chemically synthesized
tcacgagaagataatggaggaa

SEQ ID NO: 859036 - DNA, 22 bp, Artificial Sequence
  chemically synthesized
cacgagaagataatggaggaag

SEQ ID NO: 859037 - DNA, 22 bp, Artificial Sequence
  chemically synthesized
caagcagtgggtcttcctccat

SEQ ID NO: 859038 - DNA, 22 bp, Artificial Sequence
  chemically synthesized
acgagaagataatggaggaaga

SEQ ID NO: 859039 - DNA, 22 bp, Artificial Sequence
  chemically synthesized
ctccaagcagtgggtcttcctc

SEQ ID NO: 859040 - DNA, 22 bp, Artificial Sequence
  chemically synthesized
tctgctccaagcagtgggtctt

SEQ ID NO: 859041 - DNA, 22 bp, Artificial Sequence
  chemically synthesized
attgtctgctccaagcagtggg

SEQ ID NO: 859042 - DNA, 22 bp, Artificial Sequence
  chemically synthesized
cattgtctgctccaagcagtgg

SEQ ID NO: 859043 - DNA, 22 bp, Artificial Sequence
  chemically synthesized
tcattgtctgctccaagcagtg

SEQ ID NO: 859044 - DNA, 22 bp, Artificial Sequence
  chemically synthesized
atctttcattgtctgctccaag

SEQ ID NO: 859045 - DNA, 22 bp, Artificial Sequence
  chemically synthesized
gatctttcattgtctgctccaa

SEQ ID NO: 859046 - DNA, 22 bp, Artificial Sequence
  chemically synthesized
atatttgatctttcattgtctg

SEQ ID NO: 859047 - DNA, 22 bp, Artificial Sequence
  chemically synthesized
aatatttgatctttcattgtct

SEQ ID NO: 859048 - DNA, 22 bp, Artificial Sequence
  chemically synthesized
taatatttgatctttcattgtc

SEQ ID NO: 859049 - DNA, 22 bp, Artificial Sequence
  chemically synthesized
tttaatatttgatctttcattg

SEQ ID NO: 859050 - DNA, 22 bp, Artificial Sequence
  chemically synthesized
cttggagcagacaatgaaagat

SEQ ID NO: 859051 - DNA, 22 bp, Artificial Sequence
  chemically synthesized
tctttaatatttgatctttcat

SEQ ID NO: 859052 - DNA, 22 bp, Artificial Sequence
  chemically synthesized
ggagcagacaatgaaagatcaa

SEQ ID NO: 859053 - DNA, 22 bp, Artificial Sequence
  chemically synthesized
tctctttaatatttgatctttc

SEQ ID NO: 859054 - DNA, 22 bp, Artificial Sequence
  chemically synthesized
gagcagacaatgaaagatcaaa

SEQ ID NO: 859055 - DNA, 22 bp, Artificial Sequence
  chemically synthesized
ctctctttaatatttgatcttt

SEQ ID NO: 859056 - DNA, 22 bp, Artificial Sequence
  chemically synthesized
tctctctttaatatttgatctt

SEQ ID NO: 859057 - DNA, 22 bp, Artificial Sequence
  chemically synthesized
tattttctctctttaatatttg

SEQ ID NO: 859058 - DNA, 22 bp, Artificial Sequence
  chemically synthesized
gctgtattttctctctttaata

SEQ ID NO: 859059 - DNA, 22 bp, Artificial Sequence
  chemically synthesized
actggctgtattttctctcttt

SEQ ID NO: 859060 - DNA, 22 bp, Artificial Sequence
  chemically synthesized
aagagagaaaatacagccagtc

SEQ ID NO: 859061 - DNA, 22 bp, Artificial Sequence
  chemically synthesized
ggggcaaataaattgactggct

SEQ ID NO: 859062 - DNA, 22 bp, Artificial Sequence
  chemically synthesized
atttgcccccaaccccacacac

SEQ ID NO: 859063 - DNA, 22 bp, Artificial Sequence
  chemically synthesized
tttgcccccaaccccacacaca

SEQ ID NO: 859064 - DNA, 22 bp, Artificial Sequence
  chemically synthesized
gcccccaaccccacacacatac

SEQ ID NO: 859065 - DNA, 22 bp, Artificial Sequence
  chemically synthesized
cccccaaccccacacacataca

SEQ ID NO: 859066 - DNA, 22 bp, Artificial Sequence
  chemically synthesized
gataggaaaaaaaatgtatgtg

SEQ ID NO: 859067 - DNA, 22 bp, Artificial Sequence
  chemically synthesized
cgataggaaaaaaaatgtatgt

SEQ ID NO: 859068 - DNA, 22 bp, Artificial Sequence
  chemically synthesized
ccttcgataggaaaaaaaatgt

SEQ ID NO: 859069 - DNA, 22 bp, Artificial Sequence
  chemically synthesized
tcccttcgataggaaaaaaaat

SEQ ID NO: 859070 - DNA, 22 bp, Artificial Sequence
  chemically synthesized
ctcccttcgataggaaaaaaaa

SEQ ID NO: 859071 - DNA, 22 bp, Artificial Sequence
  chemically synthesized
tctcccttcgataggaaaaaaa

SEQ ID NO: 859072 - DNA, 22 bp, Artificial Sequence
  chemically synthesized
ttctcccttcgataggaaaaaa

SEQ ID NO: 859073 - DNA, 22 bp, Artificial Sequence
  chemically synthesized
cttttctcccttcgataggaaa

SEQ ID NO: 859074 - DNA, 22 bp, Artificial Sequence
  chemically synthesized
ctgcttttctcccttcgatagg

SEQ ID NO: 859075 - DNA, 22 bp, Artificial Sequence
  chemically synthesized
cctgcttttctcccttcgatag

SEQ ID NO: 859076 - DNA, 22 bp, Artificial Sequence
  chemically synthesized
tttcctgcttttctcccttcga

SEQ ID NO: 859077 - DNA, 22 bp, Artificial Sequence
  chemically synthesized
tttttcctatcgaagggagaaa

SEQ ID NO: 859078 - DNA, 22 bp, Artificial Sequence
  chemically synthesized
ttttcctatcgaagggagaaaa

SEQ ID NO: 859079 - DNA, 22 bp, Artificial Sequence
  chemically synthesized
tttcctatcgaagggagaaaag

SEQ ID NO: 859080 - DNA, 22 bp, Artificial Sequence
  chemically synthesized
ttcctatcgaagggagaaaagc

SEQ ID NO: 859081 - DNA, 22 bp, Artificial Sequence
  chemically synthesized
tcctatcgaagggagaaaagca

SEQ ID NO: 859082 - DNA, 22 bp, Artificial Sequence
  chemically synthesized
agagctatttcctgcttttctc

SEQ ID NO: 859083 - DNA, 22 bp, Artificial Sequence
  chemically synthesized
cctatcgaagggagaaaagcag

SEQ ID NO: 859084 - DNA, 22 bp, Artificial Sequence
  chemically synthesized
ctatcgaagggagaaaagcagg

SEQ ID NO: 859085 - DNA, 22 bp, Artificial Sequence
  chemically synthesized
attcagagctatttcctgcttt

SEQ ID NO: 859086 - DNA, 22 bp, Artificial Sequence
  chemically synthesized
tcgaagggagaaaagcaggaaa

SEQ ID NO: 859087 - DNA, 22 bp, Artificial Sequence
  chemically synthesized
tgattcagagctatttcctgct

SEQ ID NO: 859088 - DNA, 22 bp, Artificial Sequence
  chemically synthesized
ctgattcagagctatttcctgc

SEQ ID NO: 859089 - DNA, 22 bp, Artificial Sequence
  chemically synthesized
tctgattcagagctatttcctg

SEQ ID NO: 859090 - DNA, 22 bp, Artificial Sequence
  chemically synthesized
ctttctgattcagagctatttc

SEQ ID NO: 859091 - DNA, 22 bp, Artificial Sequence
  chemically synthesized
caccctgctttctgattcagag

SEQ ID NO: 859092 - DNA, 22 bp, Artificial Sequence
  chemically synthesized
tacaccctgctttctgattcag

SEQ ID NO: 859093 - DNA, 22 bp, Artificial Sequence
  chemically synthesized
aatattctacaccctgctttct

SEQ ID NO: 859094 - DNA, 22 bp, Artificial Sequence
  chemically synthesized
tgaatcagaaagcagggtgtag

SEQ ID NO: 859095 - DNA, 22 bp, Artificial Sequence
  chemically synthesized
aatcagaaagcagggtgtagaa

SEQ ID NO: 859096 - DNA, 22 bp, Artificial Sequence
  chemically synthesized
gaaagcctaaatattctacacc

SEQ ID NO: 859097 - DNA, 22 bp, Artificial Sequence
  chemically synthesized
gtcctagaaagcctaaatattc

SEQ ID NO: 859098 - DNA, 22 bp, Artificial Sequence
  chemically synthesized
aaatacaacaatctggtcctag

SEQ ID NO: 859099 - DNA, 22 bp, Artificial Sequence
  chemically synthesized
aggctttctaggaccagattgt

SEQ ID NO: 859100 - DNA, 22 bp, Artificial Sequence
  chemically synthesized
ggctttctaggaccagattgtt

SEQ ID NO: 859101 - DNA, 22 bp, Artificial Sequence
  chemically synthesized
tctaggaccagattgttgtatt

SEQ ID NO: 859102 - DNA, 22 bp, Artificial Sequence
  chemically synthesized
ctaggaccagattgttgtattt

SEQ ID NO: 859103 - DNA, 22 bp, Artificial Sequence
  chemically synthesized
taggaccagattgttgtatttg

SEQ ID NO: 859104 - DNA, 22 bp, Artificial Sequence
  chemically synthesized
tagagcaaggattcaaatacaa

SEQ ID NO: 859105 - DNA, 22 bp, Artificial Sequence
  chemically synthesized
ggaccagattgttgtatttgaa

SEQ ID NO: 859106 - DNA, 22 bp, Artificial Sequence
  chemically synthesized
ttgtatttgaatccttgctcta

SEQ ID NO: 859107 - DNA, 22 bp, Artificial Sequence
  chemically synthesized
tatttgaatccttgctctataa

SEQ ID NO: 859108 - DNA, 22 bp, Artificial Sequence
  chemically synthesized
aaaaaaaaaaaaattatagagc

SEQ ID NO: 859109 - DNA, 22 bp, Artificial Sequence
  chemically synthesized
gaatccttgctctataattttt

SEQ ID NO: 859110 - DNA, 22 bp, Artificial Sequence
  chemically synthesized
aatccttgctctataatttttt

SEQ ID NO: 859111 - DNA, 22 bp, Artificial Sequence
  chemically synthesized
cacagctaaaaaaaaaaaaaat

SEQ ID NO: 859112 - DNA, 22 bp, Artificial Sequence
  chemically synthesized
gctctataattttttttttttt

SEQ ID NO: 859113 - DNA, 22 bp, Artificial Sequence
  chemically synthesized
ctctataatttttttttttttt

SEQ ID NO: 859114 - DNA, 22 bp, Artificial Sequence
  chemically synthesized
tagttacacagctaaaaaaaaa

SEQ ID NO: 859115 - DNA, 22 bp, Artificial Sequence
  chemically synthesized
tataattttttttttttttagc

SEQ ID NO: 859116 - DNA, 22 bp, Artificial Sequence
  chemically synthesized
taattttttttttttttagctg

SEQ ID NO: 859117 - DNA, 22 bp, Artificial Sequence
  chemically synthesized
actatagttacacagctaaaaa

SEQ ID NO: 859118 - DNA, 22 bp, Artificial Sequence
  chemically synthesized
tttttttttttagctgtgtaac

SEQ ID NO: 859119 - DNA, 22 bp, Artificial Sequence
  chemically synthesized
ttttttttttagctgtgtaact

SEQ ID NO: 859120 - DNA, 22 bp, Artificial Sequence
  chemically synthesized
tttttttttagctgtgtaacta

SEQ ID NO: 859121 - DNA, 22 bp, Artificial Sequence
  chemically synthesized
ttttttttagctgtgtaactat

SEQ ID NO: 859122 - DNA, 22 bp, Artificial Sequence
  chemically synthesized
agtcatctgactatagttacac

SEQ ID NO: 859123 - DNA, 22 bp, Artificial Sequence
  chemically synthesized
tttttttagctgtgtaactata

SEQ ID NO: 859124 - DNA, 22 bp, Artificial Sequence
  chemically synthesized
ttttttagctgtgtaactatag

SEQ ID NO: 859125 - DNA, 22 bp, Artificial Sequence
  chemically synthesized
tttttagctgtgtaactatagt

SEQ ID NO: 859126 - DNA, 22 bp, Artificial Sequence
  chemically synthesized
ttttagctgtgtaactatagtc

SEQ ID NO: 859127 - DNA, 22 bp, Artificial Sequence
  chemically synthesized
tttagctgtgtaactatagtca

SEQ ID NO: 859128 - DNA, 22 bp, Artificial Sequence
  chemically synthesized
ttagctgtgtaactatagtcag

SEQ ID NO: 859129 - DNA, 22 bp, Artificial Sequence
  chemically synthesized
tagctgtgtaactatagtcaga

SEQ ID NO: 859130 - DNA, 22 bp, Artificial Sequence
  chemically synthesized
agctgtgtaactatagtcagat

SEQ ID NO: 859131 - DNA, 22 bp, Artificial Sequence
  chemically synthesized
gctgtgtaactatagtcagatg

SEQ ID NO: 859132 - DNA, 22 bp, Artificial Sequence
  chemically synthesized
agagaggttaagtcatctgact

SEQ ID NO: 859133 - DNA, 22 bp, Artificial Sequence
  chemically synthesized
tgtaactatagtcagatgactt

SEQ ID NO: 859134 - DNA, 22 bp, Artificial Sequence
  chemically synthesized
tagtcagatgacttaacctctc

SEQ ID NO: 859135 - DNA, 22 bp, Artificial Sequence
  chemically synthesized
cagaggagtaaatggagattca

SEQ ID NO: 859136 - DNA, 22 bp, Artificial Sequence
  chemically synthesized
acagaggagtaaatggagattc

SEQ ID NO: 859137 - DNA, 22 bp, Artificial Sequence
  chemically synthesized
tacagaggagtaaatggagatt

SEQ ID NO: 859138 - DNA, 22 bp, Artificial Sequence
  chemically synthesized
aacctctctgaatctccattta

SEQ ID NO: 859139 - DNA, 22 bp, Artificial Sequence
  chemically synthesized
acctctctgaatctccatttac

SEQ ID NO: 859140 - DNA, 22 bp, Artificial Sequence
  chemically synthesized
tctgaatctccatttactcctc

SEQ ID NO: 859141 - DNA, 22 bp, Artificial Sequence
  chemically synthesized
tgaatctccatttactcctctg

SEQ ID NO: 859142 - DNA, 22 bp, Artificial Sequence
  chemically synthesized
aatctccatttactcctctgta

SEQ ID NO: 859143 - DNA, 22 bp, Artificial Sequence
  chemically synthesized
taatcgccactttacagaggag

SEQ ID NO: 859144 - DNA, 22 bp, Artificial Sequence
  chemically synthesized
ttataatcgccactttacagag

SEQ ID NO: 859145 - DNA, 22 bp, Artificial Sequence
  chemically synthesized
catttactcctctgtaaagtgg

SEQ ID NO: 859146 - DNA, 22 bp, Artificial Sequence
  chemically synthesized
actcctctgtaaagtggcgatt

SEQ ID NO: 859147 - DNA, 22 bp, Artificial Sequence
  chemically synthesized
ctcctctgtaaagtggcgatta

SEQ ID NO: 859148 - DNA, 22 bp, Artificial Sequence
  chemically synthesized
ctctgtaaagtggcgattataa

SEQ ID NO: 859149 - DNA, 22 bp, Artificial Sequence
  chemically synthesized
tgaaggaagtactattataatc

SEQ ID NO: 859150 - DNA, 22 bp, Artificial Sequence
  chemically synthesized
tgtaaagtggcgattataatag

SEQ ID NO: 859151 - DNA, 22 bp, Artificial Sequence
  chemically synthesized
taaagtggcgattataatagta

SEQ ID NO: 859152 - DNA, 22 bp, Artificial Sequence
  chemically synthesized
tctatgaaggaagtactattat

SEQ ID NO: 859153 - DNA, 22 bp, Artificial Sequence
  chemically synthesized
taatagtacttccttcatagac

SEQ ID NO: 859154 - DNA, 22 bp, Artificial Sequence
  chemically synthesized
ggaaaaagtaaggccagttgtc

SEQ ID NO: 859155 - DNA, 22 bp, Artificial Sequence
  chemically synthesized
aggaaaaagtaaggccagttgt

SEQ ID NO: 859156 - DNA, 22 bp, Artificial Sequence
  chemically synthesized
ccttcatagacaactggcctta

SEQ ID NO: 859157 - DNA, 22 bp, Artificial Sequence
  chemically synthesized
tttaggaaaaagtaaggccagt

SEQ ID NO: 859158 - DNA, 22 bp, Artificial Sequence
  chemically synthesized
cttcatagacaactggccttac

SEQ ID NO: 859159 - DNA, 22 bp, Artificial Sequence
  chemically synthesized
catagacaactggccttacttt

SEQ ID NO: 859160 - DNA, 22 bp, Artificial Sequence
  chemically synthesized
tctatttaggaaaaagtaaggc

SEQ ID NO: 859161 - DNA, 22 bp, Artificial Sequence
  chemically synthesized
atagacaactggccttactttt

SEQ ID NO: 859162 - DNA, 22 bp, Artificial Sequence
  chemically synthesized
caagattgtctatttaggaaaa

SEQ ID NO: 859163 - DNA, 22 bp, Artificial Sequence
  chemically synthesized
ccaagattgtctatttaggaaa

SEQ ID NO: 859164 - DNA, 22 bp, Artificial Sequence
  chemically synthesized
tccaagattgtctatttaggaa

SEQ ID NO: 859165 - DNA, 22 bp, Artificial Sequence
  chemically synthesized
ttccaagattgtctatttagga

SEQ ID NO: 859166 - DNA, 22 bp, Artificial Sequence
  chemically synthesized
gccttactttttcctaaataga

SEQ ID NO: 859167 - DNA, 22 bp, Artificial Sequence
  chemically synthesized
cttttccaagattgtctattta

SEQ ID NO: 859168 - DNA, 22 bp, Artificial Sequence
  chemically synthesized
actttttcctaaatagacaatc

SEQ ID NO: 859169 - DNA, 22 bp, Artificial Sequence
  chemically synthesized
ctttttcctaaatagacaatct

SEQ ID NO: 859170 - DNA, 22 bp, Artificial Sequence
  chemically synthesized
tttcctaaatagacaatcttgg

SEQ ID NO: 859171 - DNA, 22 bp, Artificial Sequence
  chemically synthesized
ttcctaaatagacaatcttgga

SEQ ID NO: 859172 - DNA, 22 bp, Artificial Sequence
  chemically synthesized
tcctaaatagacaatcttggaa

SEQ ID NO: 859173 - DNA, 22 bp, Artificial Sequence
  chemically synthesized
cctaaatagacaatcttggaaa

SEQ ID NO: 859174 - DNA, 22 bp, Artificial Sequence
  chemically synthesized
ctaaatagacaatcttggaaaa

SEQ ID NO: 859175 - DNA, 22 bp, Artificial Sequence
  chemically synthesized
aatagacaatcttggaaaagta

SEQ ID NO: 859176 - DNA, 22 bp, Artificial Sequence
  chemically synthesized
caatgtcagtgaacattacttt

SEQ ID NO: 859177 - DNA, 22 bp, Artificial Sequence
  chemically synthesized
ggaaaagtaatgttcactgaca

SEQ ID NO: 859178 - DNA, 22 bp, Artificial Sequence
  chemically synthesized
gaaaagtaatgttcactgacat

SEQ ID NO: 859179 - DNA, 22 bp, Artificial Sequence
  chemically synthesized
aagatgcctccaatgtcagtga

SEQ ID NO: 859180 - DNA, 22 bp, Artificial Sequence
  chemically synthesized
cctcaagatgcctccaatgtca

SEQ ID NO: 859181 - DNA, 22 bp, Artificial Sequence
  chemically synthesized
acctcaagatgcctccaatgtc

SEQ ID NO: 859182 - DNA, 22 bp, Artificial Sequence
  chemically synthesized
cttacctcaagatgcctccaat

SEQ ID NO: 859183 - DNA, 22 bp, Artificial Sequence
  chemically synthesized
actgacattggaggcatcttga

SEQ ID NO: 859184 - DNA, 22 bp, Artificial Sequence
  chemically synthesized
acattggaggcatcttgaggta

SEQ ID NO: 859185 - DNA, 22 bp, Artificial Sequence
  chemically synthesized
gaggcatcttgaggtaaggaat

SEQ ID NO: 859186 - DNA, 22 bp, Artificial Sequence
  chemically synthesized
tagcaggcatagtataattcct

SEQ ID NO: 859187 - DNA, 22 bp, Artificial Sequence
  chemically synthesized
attgtagcaggcatagtataat

SEQ ID NO: 859188 - DNA, 22 bp, Artificial Sequence
  chemically synthesized
gaggtaaggaattatactatgc

SEQ ID NO: 859189 - DNA, 22 bp, Artificial Sequence
  chemically synthesized
aggtaaggaattatactatgcc

SEQ ID NO: 859190 - DNA, 22 bp, Artificial Sequence
  chemically synthesized
agggtcaagatgttcattgtag

SEQ ID NO: 859191 - DNA, 22 bp, Artificial Sequence
  chemically synthesized
tactatgcctgctacaatgaac

SEQ ID NO: 859192 - DNA, 22 bp, Artificial Sequence
  chemically synthesized
gagggtcaagatgttcattgta

SEQ ID NO: 859193 - DNA, 22 bp, Artificial Sequence
  chemically synthesized
tgagggtcaagatgttcattgt

SEQ ID NO: 859194 - DNA, 22 bp, Artificial Sequence
  chemically synthesized
ttgagggtcaagatgttcattg

SEQ ID NO: 859195 - DNA, 22 bp, Artificial Sequence
  chemically synthesized
tgcctgctacaatgaacatctt

SEQ ID NO: 859196 - DNA, 22 bp, Artificial Sequence
  chemically synthesized
ctacaatgaacatcttgaccct

SEQ ID NO: 859197 - DNA, 22 bp, Artificial Sequence
  chemically synthesized
caatgaacatcttgaccctcaa

SEQ ID NO: 859198 - DNA, 22 bp, Artificial Sequence
  chemically synthesized
cacaggtgaaaacttttgaggg

SEQ ID NO: 859199 - DNA, 22 bp, Artificial Sequence
  chemically synthesized
atagttacacaggtgaaaactt

SEQ ID NO: 859200 - DNA, 22 bp, Artificial Sequence
  chemically synthesized
catagttacacaggtgaaaact

SEQ ID NO: 859201 - DNA, 22 bp, Artificial Sequence
  chemically synthesized
tcatagttacacaggtgaaaac

SEQ ID NO: 859202 - DNA, 22 bp, Artificial Sequence
  chemically synthesized
gaccctcaaaagttttcacctg

SEQ ID NO: 859203 - DNA, 22 bp, Artificial Sequence
  chemically synthesized
accctcaaaagttttcacctgt

SEQ ID NO: 859204 - DNA, 22 bp, Artificial Sequence
  chemically synthesized
ttttcatagttacacaggtgaa

SEQ ID NO: 859205 - DNA, 22 bp, Artificial Sequence
  chemically synthesized
aaaagttttcacctgtgtaact

SEQ ID NO: 859206 - DNA, 22 bp, Artificial Sequence
  chemically synthesized
gtactgttttcatagttacaca

SEQ ID NO: 859207 - DNA, 22 bp, Artificial Sequence
  chemically synthesized
gattggtactgttttcatagtt

SEQ ID NO: 859208 - DNA, 22 bp, Artificial Sequence
  chemically synthesized
tcacctgtgtaactatgaaaac

SEQ ID NO: 859209 - DNA, 22 bp, Artificial Sequence
  chemically synthesized
cacctgtgtaactatgaaaaca

SEQ ID NO: 859210 - DNA, 22 bp, Artificial Sequence
  chemically synthesized
acctgtgtaactatgaaaacag

SEQ ID NO: 859211 - DNA, 22 bp, Artificial Sequence
  chemically synthesized
cattagattggtactgttttca

SEQ ID NO: 859212 - DNA, 22 bp, Artificial Sequence
  chemically synthesized
tgtaactatgaaaacagtacca

SEQ ID NO: 859213 - DNA, 22 bp, Artificial Sequence
  chemically synthesized
tgaaaacagtaccaatctaatg

SEQ ID NO: 859214 - DNA, 22 bp, Artificial Sequence
  chemically synthesized
atggaattgtgttacggatttt

SEQ ID NO: 859215 - DNA, 22 bp, Artificial Sequence
  chemically synthesized
catgtatgatgtcataaaatcc

SEQ ID NO: 859216 - DNA, 22 bp, Artificial Sequence
  chemically synthesized
acatgtatgatgtcataaaatc

SEQ ID NO: 859217 - DNA, 22 bp, Artificial Sequence
  chemically synthesized
tgttacggattttatgacatca

SEQ ID NO: 859218 - DNA, 22 bp, Artificial Sequence
  chemically synthesized
cggattttatgacatcatacat

SEQ ID NO: 859219 - DNA, 22 bp, Artificial Sequence
  chemically synthesized
ggaggtgacttacatgtatgat

SEQ ID NO: 859220 - DNA, 22 bp, Artificial Sequence
  chemically synthesized
tatgacatcatacatgtaagtc

SEQ ID NO: 859221 - DNA, 22 bp, Artificial Sequence
  chemically synthesized
atgacatcatacatgtaagtca

SEQ ID NO: 859222 - DNA, 22 bp, Artificial Sequence
  chemically synthesized
tgacatcatacatgtaagtcac

SEQ ID NO: 859223 - DNA, 22 bp, Artificial Sequence
  chemically synthesized
cagtcagaacaatcctaggagg

SEQ ID NO: 859224 - DNA, 22 bp, Artificial Sequence
  chemically synthesized
acagtcagaacaatcctaggag

SEQ ID NO: 859225 - DNA, 22 bp, Artificial Sequence
  chemically synthesized
ctaggattgttctgactgtaag

SEQ ID NO: 859226 - DNA, 22 bp, Artificial Sequence
  chemically synthesized
ggattgttctgactgtaagtac

SEQ ID NO: 859227 - DNA, 22 bp, Artificial Sequence
  chemically synthesized
ttctgactgtaagtacactatg

SEQ ID NO: 859228 - DNA, 22 bp, Artificial Sequence
  chemically synthesized
tgactgtaagtacactatgtgg

SEQ ID NO: 859229 - DNA, 22 bp, Artificial Sequence
  chemically synthesized
actgtaagtacactatgtggat

SEQ ID NO: 859230 - DNA, 22 bp, Artificial Sequence
  chemically synthesized
taagtacactatgtggattttt

SEQ ID NO: 859231 - DNA, 22 bp, Artificial Sequence
  chemically synthesized
tgtggatttttttcttcctctt

SEQ ID NO: 859232 - DNA, 22 bp, Artificial Sequence
  chemically synthesized
tgtgagaaatgcaggaaaaaga

SEQ ID NO: 859233 - DNA, 22 bp, Artificial Sequence
  chemically synthesized
ttttcttcctctttttcctgca

SEQ ID NO: 859234 - DNA, 22 bp, Artificial Sequence
  chemically synthesized
tttcttcctctttttcctgcat

SEQ ID NO: 859235 - DNA, 22 bp, Artificial Sequence
  chemically synthesized
ttcttcctctttttcctgcatt

SEQ ID NO: 859236 - DNA, 22 bp, Artificial Sequence
  chemically synthesized
tcttcctctttttcctgcattt

SEQ ID NO: 859237 - DNA, 22 bp, Artificial Sequence
  chemically synthesized
cttcctctttttcctgcatttc

SEQ ID NO: 859238 - DNA, 22 bp, Artificial Sequence
  chemically synthesized
ttcctctttttcctgcatttct

SEQ ID NO: 859239 - DNA, 22 bp, Artificial Sequence
  chemically synthesized
cctctttttcctgcatttctca

SEQ ID NO: 859240 - DNA, 22 bp, Artificial Sequence
  chemically synthesized
ctctttttcctgcatttctcac

SEQ ID NO: 859241 - DNA, 22 bp, Artificial Sequence
  chemically synthesized
tttttcctgcatttctcacaca

SEQ ID NO: 859242 - DNA, 22 bp, Artificial Sequence
  chemically synthesized
tttcctgcatttctcacacaat

SEQ ID NO: 859243 - DNA, 22 bp, Artificial Sequence
  chemically synthesized
ttcctgcatttctcacacaatg

SEQ ID NO: 859244 - DNA, 22 bp, Artificial Sequence
  chemically synthesized
tcctgcatttctcacacaatgg

SEQ ID NO: 859245 - DNA, 22 bp, Artificial Sequence
  chemically synthesized
cctgcatttctcacacaatggt

SEQ ID NO: 859246 - DNA, 22 bp, Artificial Sequence
  chemically synthesized
ctgcatttctcacacaatggtt

SEQ ID NO: 859247 - DNA, 22 bp, Artificial Sequence
  chemically synthesized
catttctcacacaatggttatt

SEQ ID NO: 859248 - DNA, 22 bp, Artificial Sequence
  chemically synthesized
ctcacacaatggttattggctc

SEQ ID NO: 859249 - DNA, 22 bp, Artificial Sequence
  chemically synthesized
tcacacaatggttattggctcc

SEQ ID NO: 859250 - DNA, 22 bp, Artificial Sequence
  chemically synthesized
acacaatggttattggctcctc

SEQ ID NO: 859251 - DNA, 22 bp, Artificial Sequence
  chemically synthesized
ttggctcctcatgttctacatt

SEQ ID NO: 859252 - DNA, 22 bp, Artificial Sequence
  chemically synthesized
gctcctcatgttctacattcgt

SEQ ID NO: 859253 - DNA, 22 bp, Artificial Sequence
  chemically synthesized
ctcatgttctacattcgtatgg

SEQ ID NO: 859254 - DNA, 22 bp, Artificial Sequence
  chemically synthesized
atgttctacattcgtatgggat

SEQ ID NO: 859255 - DNA, 22 bp, Artificial Sequence
  chemically synthesized
agagtacagagcataaaatccc

SEQ ID NO: 859256 - DNA, 22 bp, Artificial Sequence
  chemically synthesized
tacattcgtatgggattttatg

SEQ ID NO: 859257 - DNA, 22 bp, Artificial Sequence
  chemically synthesized
cattcgtatgggattttatgct

SEQ ID NO: 859258 - DNA, 22 bp, Artificial Sequence
  chemically synthesized
gttcagagtacagagcataaaa

SEQ ID NO: 859259 - DNA, 22 bp, Artificial Sequence
  chemically synthesized
gtatgggattttatgctctgta

SEQ ID NO: 859260 - DNA, 22 bp, Artificial Sequence
  chemically synthesized
gagggtcaaatctggttcagag

SEQ ID NO: 859261 - DNA, 22 bp, Artificial Sequence
  chemically synthesized
tatgctctgtactctgaaccag

SEQ ID NO: 859262 - DNA, 22 bp, Artificial Sequence
  chemically synthesized
atgctctgtactctgaaccaga

SEQ ID NO: 859263 - DNA, 22 bp, Artificial Sequence
  chemically synthesized
tgctctgtactctgaaccagat

SEQ ID NO: 859264 - DNA, 22 bp, Artificial Sequence
  chemically synthesized
tgtactctgaaccagatttgac

SEQ ID NO: 859265 - DNA, 22 bp, Artificial Sequence
  chemically synthesized
tactctgaaccagatttgaccc

SEQ ID NO: 859266 - DNA, 22 bp, Artificial Sequence
  chemically synthesized
tgaaccagatttgaccctccag

SEQ ID NO: 859267 - DNA, 22 bp, Artificial Sequence
  chemically synthesized
aaccagatttgaccctccagac

SEQ ID NO: 859268 - DNA, 22 bp, Artificial Sequence
  chemically synthesized
gaaagaatggagagaggtaagt

SEQ ID NO: 859269 - DNA, 22 bp, Artificial Sequence
  chemically synthesized
gaccctccagacttacctctct

SEQ ID NO: 859270 - DNA, 22 bp, Artificial Sequence
  chemically synthesized
accctccagacttacctctctc

SEQ ID NO: 859271 - DNA, 22 bp, Artificial Sequence
  chemically synthesized
cagacttacctctctccattct

SEQ ID NO: 859272 - DNA, 22 bp, Artificial Sequence
  chemically synthesized
acctctctccattctttccagg

SEQ ID NO: 859273 - DNA, 22 bp, Artificial Sequence
  chemically synthesized
cctctctccattctttccaggc

SEQ ID NO: 859274 - DNA, 22 bp, Artificial Sequence
  chemically synthesized
tctccattctttccaggctcct

SEQ ID NO: 859275 - DNA, 22 bp, Artificial Sequence
  chemically synthesized
tccattctttccaggctcctcc

SEQ ID NO: 859276 - DNA, 22 bp, Artificial Sequence
  chemically synthesized
cattctttccaggctcctccac

SEQ ID NO: 859277 - DNA, 22 bp, Artificial Sequence
  chemically synthesized
tttccaggctcctccacaccca

SEQ ID NO: 859278 - DNA, 22 bp, Artificial Sequence
  chemically synthesized
tccaggctcctccacacccatg

SEQ ID NO: 859279 - DNA, 22 bp, Artificial Sequence
  chemically synthesized
ccaggctcctccacacccatgt

SEQ ID NO: 859280 - DNA, 22 bp, Artificial Sequence
  chemically synthesized
caggctcctccacacccatgtc

SEQ ID NO: 859281 - DNA, 22 bp, Artificial Sequence
  chemically synthesized
atgagagaatgcacaatagaca

SEQ ID NO: 859282 - DNA, 22 bp, Artificial Sequence
  chemically synthesized
ctccacacccatgtctattgtg

SEQ ID NO: 859283 - DNA, 22 bp, Artificial Sequence
  chemically synthesized
cacacccatgtctattgtgcat

SEQ ID NO: 859284 - DNA, 22 bp, Artificial Sequence
  chemically synthesized
tgctcatgagagaatgcacaat

SEQ ID NO: 859285 - DNA, 22 bp, Artificial Sequence
  chemically synthesized
aaatggcctgtgctcatgagag

SEQ ID NO: 859286 - DNA, 22 bp, Artificial Sequence
  chemically synthesized
gaaatggcctgtgctcatgaga

SEQ ID NO: 859287 - DNA, 22 bp, Artificial Sequence
  chemically synthesized
ttgtgcattctctcatgagcac

SEQ ID NO: 859288 - DNA, 22 bp, Artificial Sequence
  chemically synthesized
tgcattctctcatgagcacagg

SEQ ID NO: 859289 - DNA, 22 bp, Artificial Sequence
  chemically synthesized
tctcatgagcacaggccatttc

SEQ ID NO: 859290 - DNA, 22 bp, Artificial Sequence
  chemically synthesized
tcatgagcacaggccatttcaa

SEQ ID NO: 859291 - DNA, 22 bp, Artificial Sequence
  chemically synthesized
atgagcacaggccatttcaaac

SEQ ID NO: 859292 - DNA, 22 bp, Artificial Sequence
  chemically synthesized
caaacctgtgtcctttcatacg

SEQ ID NO: 859293 - DNA, 22 bp, Artificial Sequence
  chemically synthesized
aaacctgtgtcctttcatacgc

SEQ ID NO: 859294 - DNA, 22 bp, Artificial Sequence
  chemically synthesized
aagaagtatagaaagcgtatga

SEQ ID NO: 859295 - DNA, 22 bp, Artificial Sequence
  chemically synthesized
caagaagtatagaaagcgtatg

SEQ ID NO: 859296 - DNA, 22 bp, Artificial Sequence
  chemically synthesized
tcaagaagtatagaaagcgtat

SEQ ID NO: 859297 - DNA, 22 bp, Artificial Sequence
  chemically synthesized
tgtcctttcatacgctttctat

SEQ ID NO: 859298 - DNA, 22 bp, Artificial Sequence
  chemically synthesized
tcatacgctttctatacttctt

SEQ ID NO: 859299 - DNA, 22 bp, Artificial Sequence
  chemically synthesized
catacgctttctatacttcttg

SEQ ID NO: 859300 - DNA, 22 bp, Artificial Sequence
  chemically synthesized
atacgctttctatacttcttga

SEQ ID NO: 859301 - DNA, 22 bp, Artificial Sequence
  chemically synthesized
tctatacttcttgaaaactttt

SEQ ID NO: 859302 - DNA, 22 bp, Artificial Sequence
  chemically synthesized
ctatacttcttgaaaacttttt

SEQ ID NO: 859303 - DNA, 22 bp, Artificial Sequence
  chemically synthesized
gaaacaggagagaaaaagtttt

SEQ ID NO: 859304 - DNA, 22 bp, Artificial Sequence
  chemically synthesized
tatacttcttgaaaactttttc

SEQ ID NO: 859305 - DNA, 22 bp, Artificial Sequence
  chemically synthesized
tacttcttgaaaactttttctc

SEQ ID NO: 859306 - DNA, 22 bp, Artificial Sequence
  chemically synthesized
tctggaaacaggagagaaaaag

SEQ ID NO: 859307 - DNA, 22 bp, Artificial Sequence
  chemically synthesized
gtctggaaacaggagagaaaaa

SEQ ID NO: 859308 - DNA, 22 bp, Artificial Sequence
  chemically synthesized
tgtctggaaacaggagagaaaa

SEQ ID NO: 859309 - DNA, 22 bp, Artificial Sequence
  chemically synthesized
ttgtctggaaacaggagagaaa

SEQ ID NO: 859310 - DNA, 22 bp, Artificial Sequence
  chemically synthesized
cttgaaaactttttctctcctg

SEQ ID NO: 859311 - DNA, 22 bp, Artificial Sequence
  chemically synthesized
ttgaaaactttttctctcctgt

SEQ ID NO: 859312 - DNA, 22 bp, Artificial Sequence
  chemically synthesized
gaaaactttttctctcctgttt

SEQ ID NO: 859313 - DNA, 22 bp, Artificial Sequence
  chemically synthesized
aaaactttttctctcctgtttc

SEQ ID NO: 859314 - DNA, 22 bp, Artificial Sequence
  chemically synthesized
tttctctcctgtttccagacaa

SEQ ID NO: 859315 - DNA, 22 bp, Artificial Sequence
  chemically synthesized
ttctctcctgtttccagacaaa

SEQ ID NO: 859316 - DNA, 22 bp, Artificial Sequence
  chemically synthesized
tctctcctgtttccagacaaaa

SEQ ID NO: 859317 - DNA, 22 bp, Artificial Sequence
  chemically synthesized
ctctcctgtttccagacaaaaa

SEQ ID NO: 859318 - DNA, 22 bp, Artificial Sequence
  chemically synthesized
tctcctgtttccagacaaaaat

SEQ ID NO: 859319 - DNA, 22 bp, Artificial Sequence
  chemically synthesized
aagagaaaatgagatttttgtc

SEQ ID NO: 859320 - DNA, 22 bp, Artificial Sequence
  chemically synthesized
tcctgtttccagacaaaaatct

SEQ ID NO: 859321 - DNA, 22 bp, Artificial Sequence
  chemically synthesized
aaagagaaaatgagatttttgt

SEQ ID NO: 859322 - DNA, 22 bp, Artificial Sequence
  chemically synthesized
ctgtttccagacaaaaatctca

SEQ ID NO: 859323 - DNA, 22 bp, Artificial Sequence
  chemically synthesized
tttccagacaaaaatctcattt

SEQ ID NO: 859324 - DNA, 22 bp, Artificial Sequence
  chemically synthesized
acatttaaagagaaaatgagat

SEQ ID NO: 859325 - DNA, 22 bp, Artificial Sequence
  chemically synthesized
ccagacaaaaatctcattttct

SEQ ID NO: 859326 - DNA, 22 bp, Artificial Sequence
  chemically synthesized
cagacaaaaatctcattttctc

SEQ ID NO: 859327 - DNA, 22 bp, Artificial Sequence
  chemically synthesized
gagttgacatttaaagagaaaa

SEQ ID NO: 859328 - DNA, 22 bp, Artificial Sequence
  chemically synthesized
attttctctttaaatgtcaact

SEQ ID NO: 859329 - DNA, 22 bp, Artificial Sequence
  chemically synthesized
tctctttaaatgtcaactctag

SEQ ID NO: 859330 - DNA, 22 bp, Artificial Sequence
  chemically synthesized
ctctttaaatgtcaactctaga

SEQ ID NO: 859331 - DNA, 22 bp, Artificial Sequence
  chemically synthesized
tctttaaatgtcaactctagat

SEQ ID NO: 859332 - DNA, 22 bp, Artificial Sequence
  chemically synthesized
tttaaatgtcaactctagattt

SEQ ID NO: 859333 - DNA, 22 bp, Artificial Sequence
  chemically synthesized
cccaaaacacagaaatctagag

SEQ ID NO: 859334 - DNA, 22 bp, Artificial Sequence
  chemically synthesized
taaatgtcaactctagatttct

SEQ ID NO: 859335 - DNA, 22 bp, Artificial Sequence
  chemically synthesized
aaatgtcaactctagatttctg

SEQ ID NO: 859336 - DNA, 22 bp, Artificial Sequence
  chemically synthesized
aatgtcaactctagatttctgt

SEQ ID NO: 859337 - DNA, 22 bp, Artificial Sequence
  chemically synthesized
gtcctccccaaaacacagaaat

SEQ ID NO: 859338 - DNA, 22 bp, Artificial Sequence
  chemically synthesized
tggtcctccccaaaacacagaa

SEQ ID NO: 859339 - DNA, 22 bp, Artificial Sequence
  chemically synthesized
ttctggtcctccccaaaacaca

SEQ ID NO: 859340 - DNA, 22 bp, Artificial Sequence
  chemically synthesized
attctggtcctccccaaaacac

SEQ ID NO: 859341 - DNA, 22 bp, Artificial Sequence
  chemically synthesized
ttattctggtcctccccaaaac

SEQ ID NO: 859342 - DNA, 22 bp, Artificial Sequence
  chemically synthesized
tagatttctgtgttttggggag

SEQ ID NO: 859343 - DNA, 22 bp, Artificial Sequence
  chemically synthesized
cttattctggtcctccccaaaa

SEQ ID NO: 859344 - DNA, 22 bp, Artificial Sequence
  chemically synthesized
gatttctgtgttttggggagga

SEQ ID NO: 859345 - DNA, 22 bp, Artificial Sequence
  chemically synthesized
ctgtgttttggggaggaccaga

SEQ ID NO: 859346 - DNA, 22 bp, Artificial Sequence
  chemically synthesized
cacacttcttattctggtcctc

SEQ ID NO: 859347 - DNA, 22 bp, Artificial Sequence
  chemically synthesized
tgtgttttggggaggaccagaa

SEQ ID NO: 859348 - DNA, 22 bp, Artificial Sequence
  chemically synthesized
tgttttggggaggaccagaata

SEQ ID NO: 859349 - DNA, 22 bp, Artificial Sequence
  chemically synthesized
gttacacacttcttattctggt

SEQ ID NO: 859350 - DNA, 22 bp, Artificial Sequence
  chemically synthesized
agttacacacttcttattctgg

SEQ ID NO: 859351 - DNA, 22 bp, Artificial Sequence
  chemically synthesized
tagttacacacttcttattctg

SEQ ID NO: 859352 - DNA, 22 bp, Artificial Sequence
  chemically synthesized
tggggaggaccagaataagaag

SEQ ID NO: 859353 - DNA, 22 bp, Artificial Sequence
  chemically synthesized
ggggaggaccagaataagaagt

SEQ ID NO: 859354 - DNA, 22 bp, Artificial Sequence
  chemically synthesized
gggaggaccagaataagaagtg

SEQ ID NO: 859355 - DNA, 22 bp, Artificial Sequence
  chemically synthesized
atggagatattttagttacaca

SEQ ID NO: 859356 - DNA, 22 bp, Artificial Sequence
  chemically synthesized
ctcatggagatattttagttac

SEQ ID NO: 859357 - DNA, 22 bp, Artificial Sequence
  chemically synthesized
ttcctcatggagatattttagt

SEQ ID NO: 859358 - DNA, 22 bp, Artificial Sequence
  chemically synthesized
tgttcctcatggagatatttta

SEQ ID NO: 859359 - DNA, 22 bp, Artificial Sequence
  chemically synthesized
aaatatctccatgaggaacaga

SEQ ID NO: 859360 - DNA, 22 bp, Artificial Sequence
  chemically synthesized
catgaggaacagaattacacct

SEQ ID NO: 859361 - DNA, 22 bp, Artificial Sequence
  chemically synthesized
ggacccacaagaaaggtgtaat

SEQ ID NO: 859362 - DNA, 22 bp, Artificial Sequence
  chemically synthesized
aggacccacaagaaaggtgtaa

SEQ ID NO: 859363 - DNA, 22 bp, Artificial Sequence
  chemically synthesized
aaaagtgtttaggacccacaag

SEQ ID NO: 859364 - DNA, 22 bp, Artificial Sequence
  chemically synthesized
cacctttcttgtgggtcctaaa

SEQ ID NO: 859365 - DNA, 22 bp, Artificial Sequence
  chemically synthesized
aagactaaaaagtgtttaggac

SEQ ID NO: 859366 - DNA, 22 bp, Artificial Sequence
  chemically synthesized
tcttgtgggtcctaaacacttt

SEQ ID NO: 859367 - DNA, 22 bp, Artificial Sequence
  chemically synthesized
cttgtgggtcctaaacactttt

SEQ ID NO: 859368 - DNA, 22 bp, Artificial Sequence
  chemically synthesized
ttgtgggtcctaaacacttttt

SEQ ID NO: 859369 - DNA, 22 bp, Artificial Sequence
  chemically synthesized
gtgggtcctaaacactttttag

SEQ ID NO: 859370 - DNA, 22 bp, Artificial Sequence
  chemically synthesized
tgggtcctaaacactttttagt

SEQ ID NO: 859371 - DNA, 22 bp, Artificial Sequence
  chemically synthesized
agtaagaaaacgttaaagacta

SEQ ID NO: 859372 - DNA, 22 bp, Artificial Sequence
  chemically synthesized
aagtaagaaaacgttaaagact

SEQ ID NO: 859373 - DNA, 22 bp, Artificial Sequence
  chemically synthesized
aacactttttagtctttaacgt

SEQ ID NO: 859374 - DNA, 22 bp, Artificial Sequence
  chemically synthesized
gatttaagtaagaaaacgttaa

SEQ ID NO: 859375 - DNA, 22 bp, Artificial Sequence
  chemically synthesized
tttagtctttaacgttttctta

SEQ ID NO: 859376 - DNA, 22 bp, Artificial Sequence
  chemically synthesized
ttagtctttaacgttttcttac

SEQ ID NO: 859377 - DNA, 22 bp, Artificial Sequence
  chemically synthesized
tagtctttaacgttttcttact

SEQ ID NO: 859378 - DNA, 22 bp, Artificial Sequence
  chemically synthesized
agtctttaacgttttcttactt

SEQ ID NO: 859379 - DNA, 22 bp, Artificial Sequence
  chemically synthesized
gtctttaacgttttcttactta

SEQ ID NO: 859380 - DNA, 22 bp, Artificial Sequence
  chemically synthesized
gtgataactagatttaagtaag

SEQ ID NO: 859381 - DNA, 22 bp, Artificial Sequence
  chemically synthesized
taacgttttcttacttaaatct

SEQ ID NO: 859382 - DNA, 22 bp, Artificial Sequence
  chemically synthesized
ctagtgataactagatttaagt

SEQ ID NO: 859383 - DNA, 22 bp, Artificial Sequence
  chemically synthesized
aacgttttcttacttaaatcta

SEQ ID NO: 859384 - DNA, 22 bp, Artificial Sequence
  chemically synthesized
cctagtgataactagatttaag

SEQ ID NO: 859385 - DNA, 22 bp, Artificial Sequence
  chemically synthesized
acgttttcttacttaaatctag

SEQ ID NO: 859386 - DNA, 22 bp, Artificial Sequence
  chemically synthesized
tccttcctagtgataactagat

SEQ ID NO: 859387 - DNA, 22 bp, Artificial Sequence
  chemically synthesized
gtccttcctagtgataactaga

SEQ ID NO: 859388 - DNA, 22 bp, Artificial Sequence
  chemically synthesized
tcttacttaaatctagttatca

SEQ ID NO: 859389 - DNA, 22 bp, Artificial Sequence
  chemically synthesized
tgtccttcctagtgataactag

SEQ ID NO: 859390 - DNA, 22 bp, Artificial Sequence
  chemically synthesized
cttacttaaatctagttatcac

SEQ ID NO: 859391 - DNA, 22 bp, Artificial Sequence
  chemically synthesized
ttacttaaatctagttatcact

SEQ ID NO: 859392 - DNA, 22 bp, Artificial Sequence
  chemically synthesized
acttaaatctagttatcactag

SEQ ID NO: 859393 - DNA, 22 bp, Artificial Sequence
  chemically synthesized
cttaaatctagttatcactagg

SEQ ID NO: 859394 - DNA, 22 bp, Artificial Sequence
  chemically synthesized
aaatctagttatcactaggaag

SEQ ID NO: 859395 - DNA, 22 bp, Artificial Sequence
  chemically synthesized
aatctagttatcactaggaagg

SEQ ID NO: 859396 - DNA, 22 bp, Artificial Sequence
  chemically synthesized
gttatcactaggaaggacaaaa

SEQ ID NO: 859397 - DNA, 22 bp, Artificial Sequence
  chemically synthesized
atagtggtgcaagattttgtcc

SEQ ID NO: 859398 - DNA, 22 bp, Artificial Sequence
  chemically synthesized
tcactaggaaggacaaaatctt

SEQ ID NO: 859399 - DNA, 22 bp, Artificial Sequence
  chemically synthesized
ggaaggacaaaatcttgcacca

SEQ ID NO: 859400 - DNA, 22 bp, Artificial Sequence
  chemically synthesized
caaaacctaatagtggtgcaag

SEQ ID NO: 859401 - DNA, 22 bp, Artificial Sequence
  chemically synthesized
aaaatcctccaaaacctaatag

SEQ ID NO: 859402 - DNA, 22 bp, Artificial Sequence
  chemically synthesized
caaaatcctccaaaacctaata

SEQ ID NO: 859403 - DNA, 22 bp, Artificial Sequence
  chemically synthesized
tcaaaatcctccaaaacctaat

SEQ ID NO: 859404 - DNA, 22 bp, Artificial Sequence
  chemically synthesized
gcaccactattaggttttggag

SEQ ID NO: 859405 - DNA, 22 bp, Artificial Sequence
  chemically synthesized
caccactattaggttttggagg

SEQ ID NO: 859406 - DNA, 22 bp, Artificial Sequence
  chemically synthesized
gacactttcaaaatcctccaaa

SEQ ID NO: 859407 - DNA, 22 bp, Artificial Sequence
  chemically synthesized
tagacactttcaaaatcctcca

SEQ ID NO: 859408 - DNA, 22 bp, Artificial Sequence
  chemically synthesized
ttaggttttggaggattttgaa

SEQ ID NO: 859409 - DNA, 22 bp, Artificial Sequence
  chemically synthesized
tcctctagacactttcaaaatc

SEQ ID NO: 859410 - DNA, 22 bp, Artificial Sequence
  chemically synthesized
ggttttggaggattttgaaagt

SEQ ID NO: 859411 - DNA, 22 bp, Artificial Sequence
  chemically synthesized
tggaggattttgaaagtgtcta

SEQ ID NO: 859412 - DNA, 22 bp, Artificial Sequence
  chemically synthesized
tcagctatcctctagacacttt

SEQ ID NO: 859413 - DNA, 22 bp, Artificial Sequence
  chemically synthesized
ggaggattttgaaagtgtctag

SEQ ID NO: 859414 - DNA, 22 bp, Artificial Sequence
  chemically synthesized
gaggattttgaaagtgtctaga

SEQ ID NO: 859415 - DNA, 22 bp, Artificial Sequence
  chemically synthesized
ctatcagctatcctctagacac

SEQ ID NO: 859416 - DNA, 22 bp, Artificial Sequence
  chemically synthesized
aactactatcagctatcctcta

SEQ ID NO: 859417 - DNA, 22 bp, Artificial Sequence
  chemically synthesized
tgaaagtgtctagaggatagct

SEQ ID NO: 859418 - DNA, 22 bp, Artificial Sequence
  chemically synthesized
tcaactactatcagctatcctc

SEQ ID NO: 859419 - DNA, 22 bp, Artificial Sequence
  chemically synthesized
gaaagtgtctagaggatagctg

SEQ ID NO: 859420 - DNA, 22 bp, Artificial Sequence
  chemically synthesized
aaagtgtctagaggatagctga

SEQ ID NO: 859421 - DNA, 22 bp, Artificial Sequence
  chemically synthesized
gaatccaactctcaactactat

SEQ ID NO: 859422 - DNA, 22 bp, Artificial Sequence
  chemically synthesized
gaggatagctgatagtagttga

SEQ ID NO: 859423 - DNA, 22 bp, Artificial Sequence
  chemically synthesized
agaatccaactctcaactacta

SEQ ID NO: 859424 - DNA, 22 bp, Artificial Sequence
  chemically synthesized
tagaatccaactctcaactact

SEQ ID NO: 859425 - DNA, 22 bp, Artificial Sequence
  chemically synthesized
actttagaatccaactctcaac

SEQ ID NO: 859426 - DNA, 22 bp, Artificial Sequence
  chemically synthesized
tgactttagaatccaactctca

SEQ ID NO: 859427 - DNA, 22 bp, Artificial Sequence
  chemically synthesized
ctgactttagaatccaactctc

SEQ ID NO: 859428 - DNA, 22 bp, Artificial Sequence
  chemically synthesized
atagtagttgagagttggattc

SEQ ID NO: 859429 - DNA, 22 bp, Artificial Sequence
  chemically synthesized
agagttggattctaaagtcaga

SEQ ID NO: 859430 - DNA, 22 bp, Artificial Sequence
  chemically synthesized
agacccaaagtttctgacttta

SEQ ID NO: 859431 - DNA, 22 bp, Artificial Sequence
  chemically synthesized
gagacccaaagtttctgacttt

SEQ ID NO: 859432 - DNA, 22 bp, Artificial Sequence
  chemically synthesized
cttgagacccaaagtttctgac

SEQ ID NO: 859433 - DNA, 22 bp, Artificial Sequence
  chemically synthesized
gattctaaagtcagaaactttg

SEQ ID NO: 859434 - DNA, 22 bp, Artificial Sequence
  chemically synthesized
taaagtcagaaactttgggtct

SEQ ID NO: 859435 - DNA, 22 bp, Artificial Sequence
  chemically synthesized
aagtcagaaactttgggtctca

SEQ ID NO: 859436 - DNA, 22 bp, Artificial Sequence
  chemically synthesized
aagtatattccttgagacccaa

SEQ ID NO: 859437 - DNA, 22 bp, Artificial Sequence
  chemically synthesized
aaagtatattccttgagaccca

SEQ ID NO: 859438 - DNA, 22 bp, Artificial Sequence
  chemically synthesized
taaagtatattccttgagaccc

SEQ ID NO: 859439 - DNA, 22 bp, Artificial Sequence
  chemically synthesized
tgttttaaagtatattccttga

SEQ ID NO: 859440 - DNA, 22 bp, Artificial Sequence
  chemically synthesized
atgttttaaagtatattccttg

SEQ ID NO: 859441 - DNA, 22 bp, Artificial Sequence
  chemically synthesized
tatgttttaaagtatattcctt

SEQ ID NO: 859442 - DNA, 22 bp, Artificial Sequence
  chemically synthesized
tttatgttttaaagtatattcc

SEQ ID NO: 859443 - DNA, 22 bp, Artificial Sequence
  chemically synthesized
ctttatgttttaaagtatattc

SEQ ID NO: 859444 - DNA, 22 bp, Artificial Sequence
  chemically synthesized
tgggtctcaaggaatatacttt

SEQ ID NO: 859445 - DNA, 22 bp, Artificial Sequence
  chemically synthesized
gggtctcaaggaatatacttta

SEQ ID NO: 859446 - DNA, 22 bp, Artificial Sequence
  chemically synthesized
ggtctcaaggaatatactttaa

SEQ ID NO: 859447 - DNA, 22 bp, Artificial Sequence
  chemically synthesized
cttctttatgttttaaagtata

SEQ ID NO: 859448 - DNA, 22 bp, Artificial Sequence
  chemically synthesized
gcttctttatgttttaaagtat

SEQ ID NO: 859449 - DNA, 22 bp, Artificial Sequence
  chemically synthesized
ttgcttctttatgttttaaagt

SEQ ID NO: 859450 - DNA, 22 bp, Artificial Sequence
  chemically synthesized
aaggaatatactttaaaacata

SEQ ID NO: 859451 - DNA, 22 bp, Artificial Sequence
  chemically synthesized
gcctcttgcttctttatgtttt

SEQ ID NO: 859452 - DNA, 22 bp, Artificial Sequence
  chemically synthesized
taaaacataaagaagcaagagg

SEQ ID NO: 859453 - DNA, 22 bp, Artificial Sequence
  chemically synthesized
aaaacataaagaagcaagaggc

SEQ ID NO: 859454 - DNA, 22 bp, Artificial Sequence
  chemically synthesized
aaacataaagaagcaagaggct

SEQ ID NO: 859455 - DNA, 22 bp, Artificial Sequence
  chemically synthesized
atgtgagaggtcgatgaagatt

SEQ ID NO: 859456 - DNA, 22 bp, Artificial Sequence
  chemically synthesized
taatgtgagaggtcgatgaaga

SEQ ID NO: 859457 - DNA, 22 bp, Artificial Sequence
  chemically synthesized
atcttcatcgacctctcacatt

SEQ ID NO: 859458 - DNA, 22 bp, Artificial Sequence
  chemically synthesized
aacagaaatggctctaatgtga

SEQ ID NO: 859459 - DNA, 22 bp, Artificial Sequence
  chemically synthesized
catcgacctctcacattagagc

SEQ ID NO: 859460 - DNA, 22 bp, Artificial Sequence
  chemically synthesized
tgaacagaaatggctctaatgt

SEQ ID NO: 859461 - DNA, 22 bp, Artificial Sequence
  chemically synthesized
atcgacctctcacattagagcc

SEQ ID NO: 859462 - DNA, 22 bp, Artificial Sequence
  chemically synthesized
ctgaacagaaatggctctaatg

SEQ ID NO: 859463 - DNA, 22 bp, Artificial Sequence
  chemically synthesized
tctgaacagaaatggctctaat

SEQ ID NO: 859464 - DNA, 22 bp, Artificial Sequence
  chemically synthesized
ttctgaacagaaatggctctaa

SEQ ID NO: 859465 - DNA, 22 bp, Artificial Sequence
  chemically synthesized
tcacattagagccatttctgtt

SEQ ID NO: 859466 - DNA, 22 bp, Artificial Sequence
  chemically synthesized
acattagagccatttctgttca

SEQ ID NO: 859467 - DNA, 22 bp, Artificial Sequence
  chemically synthesized
agtaatgtttttctgaacagaa

SEQ ID NO: 859468 - DNA, 22 bp, Artificial Sequence
  chemically synthesized
aagtaatgtttttctgaacaga

SEQ ID NO: 859469 - DNA, 22 bp, Artificial Sequence
  chemically synthesized
taagtaatgtttttctgaacag

SEQ ID NO: 859470 - DNA, 22 bp, Artificial Sequence
  chemically synthesized
gagccatttctgttcagaaaaa

SEQ ID NO: 859471 - DNA, 22 bp, Artificial Sequence
  chemically synthesized
ctgttcagaaaaacattactta

SEQ ID NO: 859472 - DNA, 22 bp, Artificial Sequence
  chemically synthesized
tgttcagaaaaacattacttaa

SEQ ID NO: 859473 - DNA, 22 bp, Artificial Sequence
  chemically synthesized
ttcagaaaaacattacttaaaa

SEQ ID NO: 859474 - DNA, 22 bp, Artificial Sequence
  chemically synthesized
gaaaacataaaatattttaagt

SEQ ID NO: 859475 - DNA, 22 bp, Artificial Sequence
  chemically synthesized
agaaaaacattacttaaaatat

SEQ ID NO: 859476 - DNA, 22 bp, Artificial Sequence
  chemically synthesized
agaaaacataaaatattttaag

SEQ ID NO: 859477 - DNA, 22 bp, Artificial Sequence
  chemically synthesized
tagaaaacataaaatattttaa

SEQ ID NO: 859478 - DNA, 22 bp, Artificial Sequence
  chemically synthesized
ttagaaaacataaaatatttta

SEQ ID NO: 859479 - DNA, 22 bp, Artificial Sequence
  chemically synthesized
tttagaaaacataaaatatttt

SEQ ID NO: 859480 - DNA, 22 bp, Artificial Sequence
  chemically synthesized
cttaaaatattttatgttttct

SEQ ID NO: 859481 - DNA, 22 bp, Artificial Sequence
  chemically synthesized
aaaatattttatgttttctaaa

SEQ ID NO: 859482 - DNA, 22 bp, Artificial Sequence
  chemically synthesized
aaatattttatgttttctaaaa

SEQ ID NO: 859483 - DNA, 22 bp, Artificial Sequence
  chemically synthesized
aatccagaggcaagtcttttta

SEQ ID NO: 859484 - DNA, 22 bp, Artificial Sequence
  chemically synthesized
tatgttttctaaaaagacttgc

SEQ ID NO: 859485 - DNA, 22 bp, Artificial Sequence
  chemically synthesized
atgttttctaaaaagacttgcc

SEQ ID NO: 859486 - DNA, 22 bp, Artificial Sequence
  chemically synthesized
tgttttctaaaaagacttgcct

SEQ ID NO: 859487 - DNA, 22 bp, Artificial Sequence
  chemically synthesized
tctaaaaagacttgcctctgga

SEQ ID NO: 859488 - DNA, 22 bp, Artificial Sequence
  chemically synthesized
ctaaaaagacttgcctctggat

SEQ ID NO: 859489 - DNA, 22 bp, Artificial Sequence
  chemically synthesized
taaaaagacttgcctctggatt

SEQ ID NO: 859490 - DNA, 22 bp, Artificial Sequence
  chemically synthesized
aaaagacttgcctctggattca

SEQ ID NO: 859491 - DNA, 22 bp, Artificial Sequence
  chemically synthesized
gcctctggattcaggcatgtat

SEQ ID NO: 859492 - DNA, 22 bp, Artificial Sequence
  chemically synthesized
cctctggattcaggcatgtata

SEQ ID NO: 859493 - DNA, 22 bp, Artificial Sequence
  chemically synthesized
tggattcaggcatgtatatatt

SEQ ID NO: 859494 - DNA, 22 bp, Artificial Sequence
  chemically synthesized
aaaaatgaaaaaaatatataca

SEQ ID NO: 859495 - DNA, 22 bp, Artificial Sequence
  chemically synthesized
gattcaggcatgtatatatttt

SEQ ID NO: 859496 - DNA, 22 bp, Artificial Sequence
  chemically synthesized
attaaaaaatgaaaaaaatata

SEQ ID NO: 859497 - DNA, 22 bp, Artificial Sequence
  chemically synthesized
gattaaaaaatgaaaaaaatat

SEQ ID NO: 859498 - DNA, 22 bp, Artificial Sequence
  chemically synthesized
tgattaaaaaatgaaaaaaata

SEQ ID NO: 859499 - DNA, 22 bp, Artificial Sequence
  chemically synthesized
aggcatgtatatatttttttca

SEQ ID NO: 859500 - DNA, 22 bp, Artificial Sequence
  chemically synthesized
aaacactttgattaaaaaatga

SEQ ID NO: 859501 - DNA, 22 bp, Artificial Sequence
  chemically synthesized
gaaacactttgattaaaaaatg

SEQ ID NO: 859502 - DNA, 22 bp, Artificial Sequence
  chemically synthesized
tgaaacactttgattaaaaaat

SEQ ID NO: 859503 - DNA, 22 bp, Artificial Sequence
  chemically synthesized
tcctttgaaacactttgattaa

SEQ ID NO: 859504 - DNA, 22 bp, Artificial Sequence
  chemically synthesized
ttttcattttttaatcaaagtg

SEQ ID NO: 859505 - DNA, 22 bp, Artificial Sequence
  chemically synthesized
tgtcctttgaaacactttgatt

SEQ ID NO: 859506 - DNA, 22 bp, Artificial Sequence
  chemically synthesized
tttcattttttaatcaaagtgt

SEQ ID NO: 859507 - DNA, 22 bp, Artificial Sequence
  chemically synthesized
ctgtcctttgaaacactttgat

SEQ ID NO: 859508 - DNA, 22 bp, Artificial Sequence
  chemically synthesized
ttcattttttaatcaaagtgtt

SEQ ID NO: 859509 - DNA, 22 bp, Artificial Sequence
  chemically synthesized
tcattttttaatcaaagtgttt

SEQ ID NO: 859510 - DNA, 22 bp, Artificial Sequence
  chemically synthesized
cattttttaatcaaagtgtttc

SEQ ID NO: 859511 - DNA, 22 bp, Artificial Sequence
  chemically synthesized
attttttaatcaaagtgtttca

SEQ ID NO: 859512 - DNA, 22 bp, Artificial Sequence
  chemically synthesized
aaaacttctgtcctttgaaaca

SEQ ID NO: 859513 - DNA, 22 bp, Artificial Sequence
  chemically synthesized
tttaatcaaagtgtttcaaagg

SEQ ID NO: 859514 - DNA, 22 bp, Artificial Sequence
  chemically synthesized
caaaacttctgtcctttgaaac

SEQ ID NO: 859515 - DNA, 22 bp, Artificial Sequence
  chemically synthesized
ttaatcaaagtgtttcaaagga

SEQ ID NO: 859516 - DNA, 22 bp, Artificial Sequence
  chemically synthesized
taatcaaagtgtttcaaaggac

SEQ ID NO: 859517 - DNA, 22 bp, Artificial Sequence
  chemically synthesized
aatcaaagtgtttcaaaggaca

SEQ ID NO: 859518 - DNA, 22 bp, Artificial Sequence
  chemically synthesized
atcaaagtgtttcaaaggacag

SEQ ID NO: 859519 - DNA, 22 bp, Artificial Sequence
  chemically synthesized
aggacttcaaaacttctgtcct

SEQ ID NO: 859520 - DNA, 22 bp, Artificial Sequence
  chemically synthesized
caggacttcaaaacttctgtcc

SEQ ID NO: 859521 - DNA, 22 bp, Artificial Sequence
  chemically synthesized
caaaggacagaagttttgaagt

SEQ ID NO: 859522 - DNA, 22 bp, Artificial Sequence
  chemically synthesized
aaaggacagaagttttgaagtc

SEQ ID NO: 859523 - DNA, 22 bp, Artificial Sequence
  chemically synthesized
tgaagtcctgaaattttttttt

SEQ ID NO: 859524 - DNA, 22 bp, Artificial Sequence
  chemically synthesized
gaagtcctgaaatttttttttt

SEQ ID NO: 859525 - DNA, 22 bp, Artificial Sequence
  chemically synthesized
aagtcctgaaattttttttttt

SEQ ID NO: 859526 - DNA, 22 bp, Artificial Sequence
  chemically synthesized
aaaaaaaaaaaaaaaaaaaaaa

SEQ ID NO: 859527 - DNA, 22 bp, Artificial Sequence
  chemically synthesized
tctcaaaaaaaaaaaaaaaaaa

SEQ ID NO: 859528 - DNA, 22 bp, Artificial Sequence
  chemically synthesized
tgtctcaaaaaaaaaaaaaaaa

SEQ ID NO: 859529 - DNA, 22 bp, Artificial Sequence
  chemically synthesized
aaattttttttttttttttttt

SEQ ID NO: 859530 - DNA, 22 bp, Artificial Sequence
  chemically synthesized
tttttttttttttttttttttg

SEQ ID NO: 859531 - DNA, 22 bp, Artificial Sequence
  chemically synthesized
ttttttttttttttttttttga

SEQ ID NO: 859532 - DNA, 22 bp, Artificial Sequence
  chemically synthesized
tttttttttttttttttttgag

SEQ ID NO: 859533 - DNA, 22 bp, Artificial Sequence
  chemically synthesized
ttttttttttttttttttgaga

SEQ ID NO: 859534 - DNA, 22 bp, Artificial Sequence
  chemically synthesized
tttttttttttttttttgagac

SEQ ID NO: 859535 - DNA, 22 bp, Artificial Sequence
  chemically synthesized
ttttttttttttttttgagaca

SEQ ID NO: 859536 - DNA, 22 bp, Artificial Sequence
  chemically synthesized
tttttttttttttttgagacag

SEQ ID NO: 859537 - DNA, 22 bp, Artificial Sequence
  chemically synthesized
ttttttttttttttgagacaga

SEQ ID NO: 859538 - DNA, 22 bp, Artificial Sequence
  chemically synthesized
tttttttttttttgagacagag

SEQ ID NO: 859539 - DNA, 22 bp, Artificial Sequence
  chemically synthesized
ttttttttttttgagacagagt

SEQ ID NO: 859540 - DNA, 22 bp, Artificial Sequence
  chemically synthesized
tttttttttttgagacagagtg

SEQ ID NO: 859541 - DNA, 22 bp, Artificial Sequence
  chemically synthesized
gcaacagagcaacactctgtct

SEQ ID NO: 859542 - DNA, 22 bp, Artificial Sequence
  chemically synthesized
ttttttttttgagacagagtgt

SEQ ID NO: 859543 - DNA, 22 bp, Artificial Sequence
  chemically synthesized
tttttttttgagacagagtgtt

SEQ ID NO: 859544 - DNA, 22 bp, Artificial Sequence
  chemically synthesized
ttttttttgagacagagtgttg

SEQ ID NO: 859545 - DNA, 22 bp, Artificial Sequence
  chemically synthesized
tttttttgagacagagtgttgc

SEQ ID NO: 859546 - DNA, 22 bp, Artificial Sequence
  chemically synthesized
ttttttgagacagagtgttgct

SEQ ID NO: 859547 - DNA, 22 bp, Artificial Sequence
  chemically synthesized
tttttgagacagagtgttgctc

SEQ ID NO: 859548 - DNA, 22 bp, Artificial Sequence
  chemically synthesized
ttttgagacagagtgttgctct

SEQ ID NO: 859549 - DNA, 22 bp, Artificial Sequence
  chemically synthesized
cagcctggcaacagagcaacac

SEQ ID NO: 859550 - DNA, 22 bp, Artificial Sequence
  chemically synthesized
tttgagacagagtgttgctctg

SEQ ID NO: 859551 - DNA, 22 bp, Artificial Sequence
  chemically synthesized
ttgagacagagtgttgctctgt

SEQ ID NO: 859552 - DNA, 22 bp, Artificial Sequence
  chemically synthesized
tgagacagagtgttgctctgtt

SEQ ID NO: 859553 - DNA, 22 bp, Artificial Sequence
  chemically synthesized
gagacagagtgttgctctgttg

SEQ ID NO: 859554 - DNA, 22 bp, Artificial Sequence
  chemically synthesized
agacagagtgttgctctgttgc

SEQ ID NO: 859555 - DNA, 22 bp, Artificial Sequence
  chemically synthesized
cactccagcctggcaacagagc

SEQ ID NO: 859556 - DNA, 22 bp, Artificial Sequence
  chemically synthesized
ctctgttgccaggctggagtgc

SEQ ID NO: 859557 - DNA, 22 bp, Artificial Sequence
  chemically synthesized
agatcacgccactgcactccag

SEQ ID NO: 859558 - DNA, 22 bp, Artificial Sequence
  chemically synthesized
tgttgccaggctggagtgcagt

SEQ ID NO: 859559 - DNA, 22 bp, Artificial Sequence
  chemically synthesized
ttgccaggctggagtgcagtgg

SEQ ID NO: 859560 - DNA, 22 bp, Artificial Sequence
  chemically synthesized
ccaggctggagtgcagtggcgt

SEQ ID NO: 859561 - DNA, 22 bp, Artificial Sequence
  chemically synthesized
cagtgagctgagatcacgccac

SEQ ID NO: 859562 - DNA, 22 bp, Artificial Sequence
  chemically synthesized
gagtgcagtggcgtgatctcag

SEQ ID NO: 859563 - DNA, 22 bp, Artificial Sequence
  chemically synthesized
aacccgcgaggcagagattgca

SEQ ID NO: 859564 - DNA, 22 bp, Artificial Sequence
  chemically synthesized
gaacccgcgaggcagagattgc

SEQ ID NO: 859565 - DNA, 22 bp, Artificial Sequence
  chemically synthesized
agctcactgcaatctctgcctc

SEQ ID NO: 859566 - DNA, 22 bp, Artificial Sequence
  chemically synthesized
actgcaatctctgcctcgcggg

SEQ ID NO: 859567 - DNA, 22 bp, Artificial Sequence
  chemically synthesized
caatctctgcctcgcgggttca

SEQ ID NO: 859568 - DNA, 22 bp, Artificial Sequence
  chemically synthesized
aggcaggggaatcgcttgaacc

SEQ ID NO: 859569 - DNA, 22 bp, Artificial Sequence
  chemically synthesized
tgcctcgcgggttcaagcgatt

SEQ ID NO: 859570 - DNA, 22 bp, Artificial Sequence
  chemically synthesized
cctcgcgggttcaagcgattcc

SEQ ID NO: 859571 - DNA, 22 bp, Artificial Sequence
  chemically synthesized
gcgggttcaagcgattcccctg

SEQ ID NO: 859572 - DNA, 22 bp, Artificial Sequence
  chemically synthesized
aggaggctgaggcaggggaatc

SEQ ID NO: 859573 - DNA, 22 bp, Artificial Sequence
  chemically synthesized
aagcgattcccctgcctcagcc

SEQ ID NO: 859574 - DNA, 22 bp, Artificial Sequence
  chemically synthesized
tagtcccagatactcaggaggc

SEQ ID NO: 859575 - DNA, 22 bp, Artificial Sequence
  chemically synthesized
ccctgcctcagcctcctgagta

SEQ ID NO: 859576 - DNA, 22 bp, Artificial Sequence
  chemically synthesized
cctcagcctcctgagtatctgg

SEQ ID NO: 859577 - DNA, 22 bp, Artificial Sequence
  chemically synthesized
agcctcctgagtatctgggact

SEQ ID NO: 859578 - DNA, 22 bp, Artificial Sequence
  chemically synthesized
ctgagtatctgggactacaggc

SEQ ID NO: 859579 - DNA, 22 bp, Artificial Sequence
  chemically synthesized
agtatctgggactacaggcatt

SEQ ID NO: 859580 - DNA, 22 bp, Artificial Sequence
  chemically synthesized
ggcatggtggcaaatgcctgta

SEQ ID NO: 859581 - DNA, 22 bp, Artificial Sequence
  chemically synthesized
gttgggcatggtggcaaatgcc

SEQ ID NO: 859582 - DNA, 22 bp, Artificial Sequence
  chemically synthesized
ggactacaggcatttgccacca

SEQ ID NO: 859583 - DNA, 22 bp, Artificial Sequence
  chemically synthesized
caggcatttgccaccatgccca

SEQ ID NO: 859584 - DNA, 22 bp, Artificial Sequence
  chemically synthesized
aagtacaaaaaattagttgggc

SEQ ID NO: 859585 - DNA, 22 bp, Artificial Sequence
  chemically synthesized
gccaccatgcccaactaatttt

SEQ ID NO: 859586 - DNA, 22 bp, Artificial Sequence
  chemically synthesized
ccaccatgcccaactaattttt

SEQ ID NO: 859587 - DNA, 22 bp, Artificial Sequence
  chemically synthesized
cactaaagtacaaaaaattagt

SEQ ID NO: 859588 - DNA, 22 bp, Artificial Sequence
  chemically synthesized
attttttgtactttagtggaga

SEQ ID NO: 859589 - DNA, 22 bp, Artificial Sequence
  chemically synthesized
tttgtactttagtggagacggg

SEQ ID NO: 859590 - DNA, 22 bp, Artificial Sequence
  chemically synthesized
ttgtactttagtggagacgggg

SEQ ID NO: 859591 - DNA, 22 bp, Artificial Sequence
  chemically synthesized
tgtactttagtggagacggggt

SEQ ID NO: 859592 - DNA, 22 bp, Artificial Sequence
  chemically synthesized
gtactttagtggagacggggtt

SEQ ID NO: 859593 - DNA, 22 bp, Artificial Sequence
  chemically synthesized
tactttagtggagacggggttt

SEQ ID NO: 859594 - DNA, 22 bp, Artificial Sequence
  chemically synthesized
gccaacatggtgaaaccccgtc

SEQ ID NO: 859595 - DNA, 22 bp, Artificial Sequence
  chemically synthesized
tagtggagacggggtttcacca

SEQ ID NO: 859596 - DNA, 22 bp, Artificial Sequence
  chemically synthesized
agtggagacggggtttcaccat

SEQ ID NO: 859597 - DNA, 22 bp, Artificial Sequence
  chemically synthesized
gtggagacggggtttcaccatg

SEQ ID NO: 859598 - DNA, 22 bp, Artificial Sequence
  chemically synthesized
caccatgttggccaggatggtc

SEQ ID NO: 859599 - DNA, 22 bp, Artificial Sequence
  chemically synthesized
accatgttggccaggatggtct

SEQ ID NO: 859600 - DNA, 22 bp, Artificial Sequence
  chemically synthesized
gccaggatggtctcgatctcct

SEQ ID NO: 859601 - DNA, 22 bp, Artificial Sequence
  chemically synthesized
gatctcctgacctcgtgatctg

SEQ ID NO: 859602 - DNA, 22 bp, Artificial Sequence
  chemically synthesized
ggaggccgaggcaggcagatca

SEQ ID NO: 859603 - DNA, 22 bp, Artificial Sequence
  chemically synthesized
gggaggccgaggcaggcagatc

SEQ ID NO: 859604 - DNA, 22 bp, Artificial Sequence
  chemically synthesized
tgggaggccgaggcaggcagat

SEQ ID NO: 859605 - DNA, 22 bp, Artificial Sequence
  chemically synthesized
ctgacctcgtgatctgcctgcc

SEQ ID NO: 859606 - DNA, 22 bp, Artificial Sequence
  chemically synthesized
acctcgtgatctgcctgcctcg

SEQ ID NO: 859607 - DNA, 22 bp, Artificial Sequence
  chemically synthesized
gtgatctgcctgcctcggcctc

SEQ ID NO: 859608 - DNA, 22 bp, Artificial Sequence
  chemically synthesized
taatcccagcactttgggaggc

SEQ ID NO: 859609 - DNA, 22 bp, Artificial Sequence
  chemically synthesized
cctgcctcggcctcccaaagtg

SEQ ID NO: 859610 - DNA, 22 bp, Artificial Sequence
  chemically synthesized
cctcggcctcccaaagtgctgg

SEQ ID NO: 859611 - DNA, 22 bp, Artificial Sequence
  chemically synthesized
atgcctgtaatcccagcacttt

SEQ ID NO: 859612 - DNA, 22 bp, Artificial Sequence
  chemically synthesized
ggcctcccaaagtgctgggatt

SEQ ID NO: 859613 - DNA, 22 bp, Artificial Sequence
  chemically synthesized
ccaaagtgctgggattacaggc

SEQ ID NO: 859614 - DNA, 22 bp, Artificial Sequence
  chemically synthesized
ggattacaggcatgagccacca

SEQ ID NO: 859615 - DNA, 22 bp, Artificial Sequence
  chemically synthesized
caggcatgagccaccatgcccg

SEQ ID NO: 859616 - DNA, 22 bp, Artificial Sequence
  chemically synthesized
tttatcttattttattgtatat

SEQ ID NO: 859617 - DNA, 22 bp, Artificial Sequence
  chemically synthesized
atcttattttattgtatatatc

SEQ ID NO: 859618 - DNA, 22 bp, Artificial Sequence
  chemically synthesized
tcttattttattgtatatatca

SEQ ID NO: 859619 - DNA, 22 bp, Artificial Sequence
  chemically synthesized
attttattgtatatatcacatt

SEQ ID NO: 859620 - DNA, 22 bp, Artificial Sequence
  chemically synthesized
ttttattgtatatatcacattg

SEQ ID NO: 859621 - DNA, 22 bp, Artificial Sequence
  chemically synthesized
tattgtatatatcacattgatt

SEQ ID NO: 859622 - DNA, 22 bp, Artificial Sequence
  chemically synthesized
attgtatatatcacattgattc

SEQ ID NO: 859623 - DNA, 22 bp, Artificial Sequence
  chemically synthesized
aaagtgcagtaagaatcaatgt

SEQ ID NO: 859624 - DNA, 22 bp, Artificial Sequence
  chemically synthesized
ttgtatatatcacattgattct

SEQ ID NO: 859625 - DNA, 22 bp, Artificial Sequence
  chemically synthesized
tatatatcacattgattcttac

SEQ ID NO: 859626 - DNA, 22 bp, Artificial Sequence
  chemically synthesized
attcttactgcactttcagatg

SEQ ID NO: 859627 - DNA, 22 bp, Artificial Sequence
  chemically synthesized
gataaaggtaaacgcatctgaa

SEQ ID NO: 859628 - DNA, 22 bp, Artificial Sequence
  chemically synthesized
ttactgcactttcagatgcgtt

SEQ ID NO: 859629 - DNA, 22 bp, Artificial Sequence
  chemically synthesized
actgcactttcagatgcgttta

SEQ ID NO: 859630 - DNA, 22 bp, Artificial Sequence
  chemically synthesized
ctgcactttcagatgcgtttac

SEQ ID NO: 859631 - DNA, 22 bp, Artificial Sequence
  chemically synthesized
cactttcagatgcgtttacctt

SEQ ID NO: 859632 - DNA, 22 bp, Artificial Sequence
  chemically synthesized
tcagatgcgtttacctttatct

SEQ ID NO: 859633 - DNA, 22 bp, Artificial Sequence
  chemically synthesized
cagatgcgtttacctttatcta

SEQ ID NO: 859634 - DNA, 22 bp, Artificial Sequence
  chemically synthesized
agatgcgtttacctttatctaa

SEQ ID NO: 859635 - DNA, 22 bp, Artificial Sequence
  chemically synthesized
acctttatctaacacatatgcg

SEQ ID NO: 859636 - DNA, 22 bp, Artificial Sequence
  chemically synthesized
cctttatctaacacatatgcgg

SEQ ID NO: 859637 - DNA, 22 bp, Artificial Sequence
  chemically synthesized
tatctaacacatatgcggttct

SEQ ID NO: 859638 - DNA, 22 bp, Artificial Sequence
  chemically synthesized
atctaacacatatgcggttctt

SEQ ID NO: 859639 - DNA, 22 bp, Artificial Sequence
  chemically synthesized
tctaacacatatgcggttcttt

SEQ ID NO: 859640 - DNA, 22 bp, Artificial Sequence
  chemically synthesized
acacatatgcggttctttcttt

SEQ ID NO: 859641 - DNA, 22 bp, Artificial Sequence
  chemically synthesized
tgacatggtggaaaagaaagaa

SEQ ID NO: 859642 - DNA, 22 bp, Artificial Sequence
  chemically synthesized
gtactatgacatggtggaaaag

SEQ ID NO: 859643 - DNA, 22 bp, Artificial Sequence
  chemically synthesized
tagtactatgacatggtggaaa

SEQ ID NO: 859644 - DNA, 22 bp, Artificial Sequence
  chemically synthesized
ctagtactatgacatggtggaa

SEQ ID NO: 859645 - DNA, 22 bp, Artificial Sequence
  chemically synthesized
tttcttttccaccatgtcatag

SEQ ID NO: 859646 - DNA, 22 bp, Artificial Sequence
  chemically synthesized
tcttttccaccatgtcatagta

SEQ ID NO: 859647 - DNA, 22 bp, Artificial Sequence
  chemically synthesized
cttttccaccatgtcatagtac

SEQ ID NO: 859648 - DNA, 22 bp, Artificial Sequence
  chemically synthesized
catatatttctagtactatgac

SEQ ID NO: 859649 - DNA, 22 bp, Artificial Sequence
  chemically synthesized
ttttccaccatgtcatagtact

SEQ ID NO: 859650 - DNA, 22 bp, Artificial Sequence
  chemically synthesized
gcatatatttctagtactatga

SEQ ID NO: 859651 - DNA, 22 bp, Artificial Sequence
  chemically synthesized
ttccaccatgtcatagtactag

SEQ ID NO: 859652 - DNA, 22 bp, Artificial Sequence
  chemically synthesized
tccaccatgtcatagtactaga

SEQ ID NO: 859653 - DNA, 22 bp, Artificial Sequence
  chemically synthesized
ccaccatgtcatagtactagaa

SEQ ID NO: 859654 - DNA, 22 bp, Artificial Sequence
  chemically synthesized
caccatgtcatagtactagaaa

SEQ ID NO: 859655 - DNA, 22 bp, Artificial Sequence
  chemically synthesized
aaaaaggtgatttgcatatatt

SEQ ID NO: 859656 - DNA, 22 bp, Artificial Sequence
  chemically synthesized
actgaaaaaggtgatttgcata

SEQ ID NO: 859657 - DNA, 22 bp, Artificial Sequence
  chemically synthesized
cactgaaaaaggtgatttgcat

SEQ ID NO: 859658 - DNA, 22 bp, Artificial Sequence
  chemically synthesized
gaaatatatgcaaatcaccttt

SEQ ID NO: 859659 - DNA, 22 bp, Artificial Sequence
  chemically synthesized
cacttcactgaaaaaggtgatt

SEQ ID NO: 859660 - DNA, 22 bp, Artificial Sequence
  chemically synthesized
accagcctacacttcactgaaa

SEQ ID NO: 859661 - DNA, 22 bp, Artificial Sequence
  chemically synthesized
acaaatctgaccagcctacact

SEQ ID NO: 859662 - DNA, 22 bp, Artificial Sequence
  chemically synthesized
tttcagtgaagtgtaggctggt

SEQ ID NO: 859663 - DNA, 22 bp, Artificial Sequence
  chemically synthesized
ttcagtgaagtgtaggctggtc

SEQ ID NO: 859664 - DNA, 22 bp, Artificial Sequence
  chemically synthesized
tcagtgaagtgtaggctggtca

SEQ ID NO: 859665 - DNA, 22 bp, Artificial Sequence
  chemically synthesized
cagtgaagtgtaggctggtcag

SEQ ID NO: 859666 - DNA, 22 bp, Artificial Sequence
  chemically synthesized
agtgaagtgtaggctggtcaga

SEQ ID NO: 859667 - DNA, 22 bp, Artificial Sequence
  chemically synthesized
tacaaaaccactaacaaatctg

SEQ ID NO: 859668 - DNA, 22 bp, Artificial Sequence
  chemically synthesized
agactgtacaaaaccactaaca

SEQ ID NO: 859669 - DNA, 22 bp, Artificial Sequence
  chemically synthesized
ctcagactgtacaaaaccacta

SEQ ID NO: 859670 - DNA, 22 bp, Artificial Sequence
  chemically synthesized
gtcagatttgttagtggttttg

SEQ ID NO: 859671 - DNA, 22 bp, Artificial Sequence
  chemically synthesized
gttagtggttttgtacagtctg

SEQ ID NO: 859672 - DNA, 22 bp, Artificial Sequence
  chemically synthesized
ttagtggttttgtacagtctga

SEQ ID NO: 859673 - DNA, 22 bp, Artificial Sequence
  chemically synthesized
tgaacaggttgctcagactgta

SEQ ID NO: 859674 - DNA, 22 bp, Artificial Sequence
  chemically synthesized
gtggttttgtacagtctgagca

SEQ ID NO: 859675 - DNA, 22 bp, Artificial Sequence
  chemically synthesized
gaactgtgaacaggttgctcag

SEQ ID NO: 859676 - DNA, 22 bp, Artificial Sequence
  chemically synthesized
agaactgtgaacaggttgctca

SEQ ID NO: 859677 - DNA, 22 bp, Artificial Sequence
  chemically synthesized
tgtacagtctgagcaacctgtt

SEQ ID NO: 859678 - DNA, 22 bp, Artificial Sequence
  chemically synthesized
gtacagtctgagcaacctgttc

SEQ ID NO: 859679 - DNA, 22 bp, Artificial Sequence
  chemically synthesized
tacagtctgagcaacctgttca

SEQ ID NO: 859680 - DNA, 22 bp, Artificial Sequence
  chemically synthesized
acccttagaactgtgaacaggt

SEQ ID NO: 859681 - DNA, 22 bp, Artificial Sequence
  chemically synthesized
cctgacccttagaactgtgaac

SEQ ID NO: 859682 - DNA, 22 bp, Artificial Sequence
  chemically synthesized
agcaacctgttcacagttctaa

SEQ ID NO: 859683 - DNA, 22 bp, Artificial Sequence
  chemically synthesized
ttcacagttctaagggtcaggc

SEQ ID NO: 859684 - DNA, 22 bp, Artificial Sequence
  chemically synthesized
acagttctaagggtcaggcagg

SEQ ID NO: 859685 - DNA, 22 bp, Artificial Sequence
  chemically synthesized
gcacaacaatacgaccctgcct

SEQ ID NO: 859686 - DNA, 22 bp, Artificial Sequence
  chemically synthesized
ggcacaacaatacgaccctgcc

SEQ ID NO: 859687 - DNA, 22 bp, Artificial Sequence
  chemically synthesized
taagggtcaggcagggtcgtat

SEQ ID NO: 859688 - DNA, 22 bp, Artificial Sequence
  chemically synthesized
agggtcaggcagggtcgtattg

SEQ ID NO: 859689 - DNA, 22 bp, Artificial Sequence
  chemically synthesized
acaggaaatatccttggcacaa

SEQ ID NO: 859690 - DNA, 22 bp, Artificial Sequence
  chemically synthesized
aacaggaaatatccttggcaca

SEQ ID NO: 859691 - DNA, 22 bp, Artificial Sequence
  chemically synthesized
acttaacaggaaatatccttgg

SEQ ID NO: 859692 - DNA, 22 bp, Artificial Sequence
  chemically synthesized
ttgtgccaaggatatttcctgt

SEQ ID NO: 859693 - DNA, 22 bp, Artificial Sequence
  chemically synthesized
aaatattgacttaacaggaaat

SEQ ID NO: 859694 - DNA, 22 bp, Artificial Sequence
  chemically synthesized
aaaatattgacttaacaggaaa

SEQ ID NO: 859695 - DNA, 22 bp, Artificial Sequence
  chemically synthesized
tgccaaggatatttcctgttaa

SEQ ID NO: 859696 - DNA, 22 bp, Artificial Sequence
  chemically synthesized
taaaatattgacttaacaggaa

SEQ ID NO: 859697 - DNA, 22 bp, Artificial Sequence
  chemically synthesized
ttaaaatattgacttaacagga

SEQ ID NO: 859698 - DNA, 22 bp, Artificial Sequence
  chemically synthesized
agtcttttaaaatattgactta

SEQ ID NO: 859699 - DNA, 22 bp, Artificial Sequence
  chemically synthesized
cagtcttttaaaatattgactt

SEQ ID NO: 859700 - DNA, 22 bp, Artificial Sequence
  chemically synthesized
tcagtcttttaaaatattgact

SEQ ID NO: 859701 - DNA, 22 bp, Artificial Sequence
  chemically synthesized
tttcagtcttttaaaatattga

SEQ ID NO: 859702 - DNA, 22 bp, Artificial Sequence
  chemically synthesized
cctgttaagtcaatattttaaa

SEQ ID NO: 859703 - DNA, 22 bp, Artificial Sequence
  chemically synthesized
ctgttaagtcaatattttaaaa

SEQ ID NO: 859704 - DNA, 22 bp, Artificial Sequence
  chemically synthesized
ttaagtcaatattttaaaagac

SEQ ID NO: 859705 - DNA, 22 bp, Artificial Sequence
  chemically synthesized
agtcaatattttaaaagactga

SEQ ID NO: 859706 - DNA, 22 bp, Artificial Sequence
  chemically synthesized
gcaaaacaaatcctctttcagt

SEQ ID NO: 859707 - DNA, 22 bp, Artificial Sequence
  chemically synthesized
agcaaaacaaatcctctttcag

SEQ ID NO: 859708 - DNA, 22 bp, Artificial Sequence
  chemically synthesized
ttagcaaaacaaatcctctttc

SEQ ID NO: 859709 - DNA, 22 bp, Artificial Sequence
  chemically synthesized
taaaagactgaaagaggatttg

SEQ ID NO: 859710 - DNA, 22 bp, Artificial Sequence
  chemically synthesized
aaaagactgaaagaggatttgt

SEQ ID NO: 859711 - DNA, 22 bp, Artificial Sequence
  chemically synthesized
aaagactgaaagaggatttgtt

SEQ ID NO: 859712 - DNA, 22 bp, Artificial Sequence
  chemically synthesized
aggcactcttagcaaaacaaat

SEQ ID NO: 859713 - DNA, 22 bp, Artificial Sequence
  chemically synthesized
aaagaggatttgttttgctaag

SEQ ID NO: 859714 - DNA, 22 bp, Artificial Sequence
  chemically synthesized
tggattcaggcactcttagcaa

SEQ ID NO: 859715 - DNA, 22 bp, Artificial Sequence
  chemically synthesized
gattatggattcaggcactctt

SEQ ID NO: 859716 - DNA, 22 bp, Artificial Sequence
  chemically synthesized
tagattatggattcaggcactc

SEQ ID NO: 859717 - DNA, 22 bp, Artificial Sequence
  chemically synthesized
gttttgctaagagtgcctgaat

SEQ ID NO: 859718 - DNA, 22 bp, Artificial Sequence
  chemically synthesized
ttttgctaagagtgcctgaatc

SEQ ID NO: 859719 - DNA, 22 bp, Artificial Sequence
  chemically synthesized
gttctagattatggattcaggc

SEQ ID NO: 859720 - DNA, 22 bp, Artificial Sequence
  chemically synthesized
tgctaagagtgcctgaatccat

SEQ ID NO: 859721 - DNA, 22 bp, Artificial Sequence
  chemically synthesized
gctaagagtgcctgaatccata

SEQ ID NO: 859722 - DNA, 22 bp, Artificial Sequence
  chemically synthesized
ctaagagtgcctgaatccataa

SEQ ID NO: 859723 - DNA, 22 bp, Artificial Sequence
  chemically synthesized
agagtgcctgaatccataatct

SEQ ID NO: 859724 - DNA, 22 bp, Artificial Sequence
  chemically synthesized
cccgttcgttctagattatgga

SEQ ID NO: 859725 - DNA, 22 bp, Artificial Sequence
  chemically synthesized
acccgttcgttctagattatgg

SEQ ID NO: 859726 - DNA, 22 bp, Artificial Sequence
  chemically synthesized
tacccgttcgttctagattatg

SEQ ID NO: 859727 - DNA, 22 bp, Artificial Sequence
  chemically synthesized
tttacccgttcgttctagatta

SEQ ID NO: 859728 - DNA, 22 bp, Artificial Sequence
  chemically synthesized
actctttacccgttcgttctag

SEQ ID NO: 859729 - DNA, 22 bp, Artificial Sequence
  chemically synthesized
aatccataatctagaacgaacg

SEQ ID NO: 859730 - DNA, 22 bp, Artificial Sequence
  chemically synthesized
tatatcctaactctttacccgt

SEQ ID NO: 859731 - DNA, 22 bp, Artificial Sequence
  chemically synthesized
atatatcctaactctttacccg

SEQ ID NO: 859732 - DNA, 22 bp, Artificial Sequence
  chemically synthesized
gaacgaacgggtaaagagttag

SEQ ID NO: 859733 - DNA, 22 bp, Artificial Sequence
  chemically synthesized
tgtaataatttatatatcctaa

SEQ ID NO: 859734 - DNA, 22 bp, Artificial Sequence
  chemically synthesized
tatgtaataatttatatatcct

SEQ ID NO: 859735 - DNA, 22 bp, Artificial Sequence
  chemically synthesized
aaaattctatgtaataatttat

SEQ ID NO: 859736 - DNA, 22 bp, Artificial Sequence
  chemically synthesized
ggatatataaattattacatag

SEQ ID NO: 859737 - DNA, 22 bp, Artificial Sequence
  chemically synthesized
ttacatagaattttcaatgatg

SEQ ID NO: 859738 - DNA, 22 bp, Artificial Sequence
  chemically synthesized
catagaattttcaatgatgttc

SEQ ID NO: 859739 - DNA, 22 bp, Artificial Sequence
  chemically synthesized
tcaatgatgttctgggctgggt

SEQ ID NO: 859740 - DNA, 22 bp, Artificial Sequence
  chemically synthesized
caatgatgttctgggctgggtc

SEQ ID NO: 859741 - DNA, 22 bp, Artificial Sequence
  chemically synthesized
aatgatgttctgggctgggtct

SEQ ID NO: 859742 - DNA, 22 bp, Artificial Sequence
  chemically synthesized
gggatgacaacaggagacccag

SEQ ID NO: 859743 - DNA, 22 bp, Artificial Sequence
  chemically synthesized
agggatgacaacaggagaccca

SEQ ID NO: 859744 - DNA, 22 bp, Artificial Sequence
  chemically synthesized
cttagggatgacaacaggagac

SEQ ID NO: 859745 - DNA, 22 bp, Artificial Sequence
  chemically synthesized
tgggctgggtctcctgttgtca

SEQ ID NO: 859746 - DNA, 22 bp, Artificial Sequence
  chemically synthesized
ggctgggtctcctgttgtcatc

SEQ ID NO: 859747 - DNA, 22 bp, Artificial Sequence
  chemically synthesized
ccatgctccttagggatgacaa

SEQ ID NO: 859748 - DNA, 22 bp, Artificial Sequence
  chemically synthesized
cccatgctccttagggatgaca

SEQ ID NO: 859749 - DNA, 22 bp, Artificial Sequence
  chemically synthesized
ggtctcctgttgtcatccctaa

SEQ ID NO: 859750 - DNA, 22 bp, Artificial Sequence
  chemically synthesized
ctgttgtcatccctaaggagca

SEQ ID NO: 859751 - DNA, 22 bp, Artificial Sequence
  chemically synthesized
ttgtcatccctaaggagcatgg

SEQ ID NO: 859752 - DNA, 22 bp, Artificial Sequence
  chemically synthesized
tcatccctaaggagcatgggaa

SEQ ID NO: 859753 - DNA, 22 bp, Artificial Sequence
  chemically synthesized
gaggggaagccatttcccatgc

SEQ ID NO: 859754 - DNA, 22 bp, Artificial Sequence
  chemically synthesized
aggagcatgggaaatggcttcc

SEQ ID NO: 859755 - DNA, 22 bp, Artificial Sequence
  chemically synthesized
cgccagctggaggggaagccat

SEQ ID NO: 859756 - DNA, 22 bp, Artificial Sequence
  chemically synthesized
ccgccagctggaggggaagcca

SEQ ID NO: 859757 - DNA, 22 bp, Artificial Sequence
  chemically synthesized
cccctccagctggcggaaatcc

SEQ ID NO: 859758 - DNA, 22 bp, Artificial Sequence
  chemically synthesized
ccctccagctggcggaaatcct

SEQ ID NO: 859759 - DNA, 22 bp, Artificial Sequence
  chemically synthesized
cagctggcggaaatcctttccc

SEQ ID NO: 859760 - DNA, 22 bp, Artificial Sequence
  chemically synthesized
aatagggtacacgggaaaggat

SEQ ID NO: 859761 - DNA, 22 bp, Artificial Sequence
  chemically synthesized
gcggaaatcctttcccgtgtac

SEQ ID NO: 859762 - DNA, 22 bp, Artificial Sequence
  chemically synthesized
agattaaatagggtacacggga

SEQ ID NO: 859763 - DNA, 22 bp, Artificial Sequence
  chemically synthesized
gggttaagattaaatagggtac

SEQ ID NO: 859764 - DNA, 22 bp, Artificial Sequence
  chemically synthesized
ggggttaagattaaatagggta

SEQ ID NO: 859765 - DNA, 22 bp, Artificial Sequence
  chemically synthesized
tcccgtgtaccctatttaatct

SEQ ID NO: 859766 - DNA, 22 bp, Artificial Sequence
  chemically synthesized
cccgtgtaccctatttaatctt

SEQ ID NO: 859767 - DNA, 22 bp, Artificial Sequence
  chemically synthesized
ccgtgtaccctatttaatctta

SEQ ID NO: 859768 - DNA, 22 bp, Artificial Sequence
  chemically synthesized
tttaatcttaaccccaagtctg

SEQ ID NO: 859769 - DNA, 22 bp, Artificial Sequence
  chemically synthesized
aatcttaaccccaagtctgttc

SEQ ID NO: 859770 - DNA, 22 bp, Artificial Sequence
  chemically synthesized
atcttaaccccaagtctgttca

SEQ ID NO: 859771 - DNA, 22 bp, Artificial Sequence
  chemically synthesized
aaccccaagtctgttcatgcct

SEQ ID NO: 859772 - DNA, 22 bp, Artificial Sequence
  chemically synthesized
accccaagtctgttcatgcctg

SEQ ID NO: 859773 - DNA, 22 bp, Artificial Sequence
  chemically synthesized
ttcatgcctgggcattcacccc

SEQ ID NO: 859774 - DNA, 22 bp, Artificial Sequence
  chemically synthesized
atgcctgggcattcaccccgtt

SEQ ID NO: 859775 - DNA, 22 bp, Artificial Sequence
  chemically synthesized
ggcattcaccccgtttcttatg

SEQ ID NO: 859776 - DNA, 22 bp, Artificial Sequence
  chemically synthesized
taacccaagataggggcataag

SEQ ID NO: 859777 - DNA, 22 bp, Artificial Sequence
  chemically synthesized
gtaacccaagataggggcataa

SEQ ID NO: 859778 - DNA, 22 bp, Artificial Sequence
  chemically synthesized
accccgtttcttatgcccctat

SEQ ID NO: 859779 - DNA, 22 bp, Artificial Sequence
  chemically synthesized
ttgtaacccaagataggggcat

SEQ ID NO: 859780 - DNA, 22 bp, Artificial Sequence
  chemically synthesized
cttgtaacccaagataggggca

SEQ ID NO: 859781 - DNA, 22 bp, Artificial Sequence
  chemically synthesized
cttatgcccctatcttgggtta

SEQ ID NO: 859782 - DNA, 22 bp, Artificial Sequence
  chemically synthesized
ttatgcccctatcttgggttac

SEQ ID NO: 859783 - DNA, 22 bp, Artificial Sequence
  chemically synthesized
atgcccctatcttgggttacaa

SEQ ID NO: 859784 - DNA, 22 bp, Artificial Sequence
  chemically synthesized
tgcccctatcttgggttacaag

SEQ ID NO: 859785 - DNA, 22 bp, Artificial Sequence
  chemically synthesized
ataccagagccagcttcttgta

SEQ ID NO: 859786 - DNA, 22 bp, Artificial Sequence
  chemically synthesized
tcttgggttacaagaagctggc

SEQ ID NO: 859787 - DNA, 22 bp, Artificial Sequence
  chemically synthesized
gggttacaagaagctggctctg

SEQ ID NO: 859788 - DNA, 22 bp, Artificial Sequence
  chemically synthesized
ggttacaagaagctggctctgg

SEQ ID NO: 859789 - DNA, 22 bp, Artificial Sequence
  chemically synthesized
aaccagctaataccagagccag

SEQ ID NO: 859790 - DNA, 22 bp, Artificial Sequence
  chemically synthesized
caagaagctggctctggtatta

SEQ ID NO: 859791 - DNA, 22 bp, Artificial Sequence
  chemically synthesized
agatctgaaccagctaatacca

SEQ ID NO: 859792 - DNA, 22 bp, Artificial Sequence
  chemically synthesized
gctctggtattagctggttcag

SEQ ID NO: 859793 - DNA, 22 bp, Artificial Sequence
  chemically synthesized
gagaggctgagatctgaaccag

SEQ ID NO: 859794 - DNA, 22 bp, Artificial Sequence
  chemically synthesized
tggtattagctggttcagatct

SEQ ID NO: 859795 - DNA, 22 bp, Artificial Sequence
  chemically synthesized
gtattagctggttcagatctca

SEQ ID NO: 859796 - DNA, 22 bp, Artificial Sequence
  chemically synthesized
aggtggttagagaggctgagat

SEQ ID NO: 859797 - DNA, 22 bp, Artificial Sequence
  chemically synthesized
gctggttcagatctcagcctct

SEQ ID NO: 859798 - DNA, 22 bp, Artificial Sequence
  chemically synthesized
tgaggtggttagagaggctgag

SEQ ID NO: 859799 - DNA, 22 bp, Artificial Sequence
  chemically synthesized
gttcagatctcagcctctctaa

SEQ ID NO: 859800 - DNA, 22 bp, Artificial Sequence
  chemically synthesized
gtctctgaggtggttagagagg

SEQ ID NO: 859801 - DNA, 22 bp, Artificial Sequence
  chemically synthesized
agtctctgaggtggttagagag

SEQ ID NO: 859802 - DNA, 22 bp, Artificial Sequence
  chemically synthesized
agatctcagcctctctaaccac

SEQ ID NO: 859803 - DNA, 22 bp, Artificial Sequence
  chemically synthesized
agcctctctaaccacctcagag

SEQ ID NO: 859804 - DNA, 22 bp, Artificial Sequence
  chemically synthesized
agaagaatacccttagtctctg

SEQ ID NO: 859805 - DNA, 22 bp, Artificial Sequence
  chemically synthesized
tctaaccacctcagagactaag

SEQ ID NO: 859806 - DNA, 22 bp, Artificial Sequence
  chemically synthesized
gagaagaatacccttagtctct

SEQ ID NO: 859807 - DNA, 22 bp, Artificial Sequence
  chemically synthesized
taaccacctcagagactaaggg

SEQ ID NO: 859808 - DNA, 22 bp, Artificial Sequence
  chemically synthesized
accacctcagagactaagggta

SEQ ID NO: 859809 - DNA, 22 bp, Artificial Sequence
  chemically synthesized
caatggacttgagaagaatacc

SEQ ID NO: 859810 - DNA, 22 bp, Artificial Sequence
  chemically synthesized
agagactaagggtattcttctc

SEQ ID NO: 859811 - DNA, 22 bp, Artificial Sequence
  chemically synthesized
ctccaatggacttgagaagaat

SEQ ID NO: 859812 - DNA, 22 bp, Artificial Sequence
  chemically synthesized
agggtattcttctcaagtccat

SEQ ID NO: 859813 - DNA, 22 bp, Artificial Sequence
  chemically synthesized
ttctcaagtccattggaggaat

SEQ ID NO: 859814 - DNA, 22 bp, Artificial Sequence
  chemically synthesized
ctcaagtccattggaggaattg

SEQ ID NO: 859815 - DNA, 22 bp, Artificial Sequence
  chemically synthesized
ggcaggaaaagacaattcctcc

SEQ ID NO: 859816 - DNA, 22 bp, Artificial Sequence
  chemically synthesized
tcaagtccattggaggaattgt

SEQ ID NO: 859817 - DNA, 22 bp, Artificial Sequence
  chemically synthesized
aagtccattggaggaattgtct

SEQ ID NO: 859818 - DNA, 22 bp, Artificial Sequence
  chemically synthesized
gaggaattgtcttttcctgcct

SEQ ID NO: 859819 - DNA, 22 bp, Artificial Sequence
  chemically synthesized
agtaaggaccctaggcaggaaa

SEQ ID NO: 859820 - DNA, 22 bp, Artificial Sequence
  chemically synthesized
cagtaaggaccctaggcaggaa

SEQ ID NO: 859821 - DNA, 22 bp, Artificial Sequence
  chemically synthesized
tcagtaaggaccctaggcagga

SEQ ID NO: 859822 - DNA, 22 bp, Artificial Sequence
  chemically synthesized
ttttcagtaaggaccctaggca

SEQ ID NO: 859823 - DNA, 22 bp, Artificial Sequence
  chemically synthesized
tcttttcctgcctagggtcctt

SEQ ID NO: 859824 - DNA, 22 bp, Artificial Sequence
  chemically synthesized
ttcctgcctagggtccttactg

SEQ ID NO: 859825 - DNA, 22 bp, Artificial Sequence
  chemically synthesized
tcctgcctagggtccttactga

SEQ ID NO: 859826 - DNA, 22 bp, Artificial Sequence
  chemically synthesized
cctgcctagggtccttactgaa

SEQ ID NO: 859827 - DNA, 22 bp, Artificial Sequence
  chemically synthesized
ctgcctagggtccttactgaaa

SEQ ID NO: 859828 - DNA, 22 bp, Artificial Sequence
  chemically synthesized
cctagggtccttactgaaaata

SEQ ID NO: 859829 - DNA, 22 bp, Artificial Sequence
  chemically synthesized
gggtccttactgaaaatagtct

SEQ ID NO: 859830 - DNA, 22 bp, Artificial Sequence
  chemically synthesized
atagcataacatcagaaagact

SEQ ID NO: 859831 - DNA, 22 bp, Artificial Sequence
  chemically synthesized
aatagcataacatcagaaagac

SEQ ID NO: 859832 - DNA, 22 bp, Artificial Sequence
  chemically synthesized
taatagcataacatcagaaaga

SEQ ID NO: 859833 - DNA, 22 bp, Artificial Sequence
  chemically synthesized
actgaaaatagtctttctgatg

SEQ ID NO: 859834 - DNA, 22 bp, Artificial Sequence
  chemically synthesized
ctgaaaatagtctttctgatgt

SEQ ID NO: 859835 - DNA, 22 bp, Artificial Sequence
  chemically synthesized
aaaatagtctttctgatgttat

SEQ ID NO: 859836 - DNA, 22 bp, Artificial Sequence
  chemically synthesized
gaggaacctttaatagcataac

SEQ ID NO: 859837 - DNA, 22 bp, Artificial Sequence
  chemically synthesized
ctggaggaacctttaatagcat

SEQ ID NO: 859838 - DNA, 22 bp, Artificial Sequence
  chemically synthesized
tctgatgttatgctattaaagg

SEQ ID NO: 859839 - DNA, 22 bp, Artificial Sequence
  chemically synthesized
ttactggaggaacctttaatag

SEQ ID NO: 859840 - DNA, 22 bp, Artificial Sequence
  chemically synthesized
ctgatgttatgctattaaaggt

SEQ ID NO: 859841 - DNA, 22 bp, Artificial Sequence
  chemically synthesized
tgatgttatgctattaaaggtt

SEQ ID NO: 859842 - DNA, 22 bp, Artificial Sequence
  chemically synthesized
atgttatgctattaaaggttcc

SEQ ID NO: 859843 - DNA, 22 bp, Artificial Sequence
  chemically synthesized
tgctattaaaggttcctccagt

SEQ ID NO: 859844 - DNA, 22 bp, Artificial Sequence
  chemically synthesized
ttaaaggttcctccagtaacag

SEQ ID NO: 859845 - DNA, 22 bp, Artificial Sequence
  chemically synthesized
aaggttcctccagtaacagatt

SEQ ID NO: 859846 - DNA, 22 bp, Artificial Sequence
  chemically synthesized
ctccagtaacagatttgggtgg

SEQ ID NO: 859847 - DNA, 22 bp, Artificial Sequence
  chemically synthesized
cagtaacagatttgggtgggtt

SEQ ID NO: 859848 - DNA, 22 bp, Artificial Sequence
  chemically synthesized
agcaaaaaacaaacaaacaaaa

SEQ ID NO: 859849 - DNA, 22 bp, Artificial Sequence
  chemically synthesized
gggtgggttttgtttgtttgtt

SEQ ID NO: 859850 - DNA, 22 bp, Artificial Sequence
  chemically synthesized
ggtgggttttgtttgtttgttt

SEQ ID NO: 859851 - DNA, 22 bp, Artificial Sequence
  chemically synthesized
gcataaggtgattgagcaaaaa

SEQ ID NO: 859852 - DNA, 22 bp, Artificial Sequence
  chemically synthesized
tgtttgtttgttttttgctcaa

SEQ ID NO: 859853 - DNA, 22 bp, Artificial Sequence
  chemically synthesized
gtttgtttgttttttgctcaat

SEQ ID NO: 859854 - DNA, 22 bp, Artificial Sequence
  chemically synthesized
tggcataaggtgattgagcaaa

SEQ ID NO: 859855 - DNA, 22 bp, Artificial Sequence
  chemically synthesized
tttgtttgttttttgctcaatc

SEQ ID NO: 859856 - DNA, 22 bp, Artificial Sequence
  chemically synthesized
gtttgttttttgctcaatcacc

SEQ ID NO: 859857 - DNA, 22 bp, Artificial Sequence
  chemically synthesized
gttctggcataaggtgattgag

SEQ ID NO: 859858 - DNA, 22 bp, Artificial Sequence
  chemically synthesized
tttgttttttgctcaatcacct

SEQ ID NO: 859859 - DNA, 22 bp, Artificial Sequence
  chemically synthesized
gttttttgctcaatcaccttat

SEQ ID NO: 859860 - DNA, 22 bp, Artificial Sequence
  chemically synthesized
ttttttgctcaatcaccttatg

SEQ ID NO: 859861 - DNA, 22 bp, Artificial Sequence
  chemically synthesized
tttgctcaatcaccttatgcca

SEQ ID NO: 859862 - DNA, 22 bp, Artificial Sequence
  chemically synthesized
ttgctcaatcaccttatgccag

SEQ ID NO: 859863 - DNA, 22 bp, Artificial Sequence
  chemically synthesized
tgctcaatcaccttatgccaga

SEQ ID NO: 859864 - DNA, 22 bp, Artificial Sequence
  chemically synthesized
gctcaatcaccttatgccagaa

SEQ ID NO: 859865 - DNA, 22 bp, Artificial Sequence
  chemically synthesized
taatacatctggttctggcata

SEQ ID NO: 859866 - DNA, 22 bp, Artificial Sequence
  chemically synthesized
ctcaatcaccttatgccagaac

SEQ ID NO: 859867 - DNA, 22 bp, Artificial Sequence
  chemically synthesized
aatcaccttatgccagaaccag

SEQ ID NO: 859868 - DNA, 22 bp, Artificial Sequence
  chemically synthesized
tacattgtaatacatctggttc

SEQ ID NO: 859869 - DNA, 22 bp, Artificial Sequence
  chemically synthesized
gtacattgtaatacatctggtt

SEQ ID NO: 859870 - DNA, 22 bp, Artificial Sequence
  chemically synthesized
tgtacattgtaatacatctggt

SEQ ID NO: 859871 - DNA, 22 bp, Artificial Sequence
  chemically synthesized
atgccagaaccagatgtattac

SEQ ID NO: 859872 - DNA, 22 bp, Artificial Sequence
  chemically synthesized
attttgtacattgtaatacatc

SEQ ID NO: 859873 - DNA, 22 bp, Artificial Sequence
  chemically synthesized
tgccagaaccagatgtattaca

SEQ ID NO: 859874 - DNA, 22 bp, Artificial Sequence
  chemically synthesized
aattttgtacattgtaatacat

SEQ ID NO: 859875 - DNA, 22 bp, Artificial Sequence
  chemically synthesized
gatatacagtttaattttgtac

SEQ ID NO: 859876 - DNA, 22 bp, Artificial Sequence
  chemically synthesized
cctagatatacagtttaatttt

SEQ ID NO: 859877 - DNA, 22 bp, Artificial Sequence
  chemically synthesized
caatgtacaaaattaaactgta

SEQ ID NO: 859878 - DNA, 22 bp, Artificial Sequence
  chemically synthesized
tctacctagatatacagtttaa

SEQ ID NO: 859879 - DNA, 22 bp, Artificial Sequence
  chemically synthesized
tctgtctacctagatatacagt

SEQ ID NO: 859880 - DNA, 22 bp, Artificial Sequence
  chemically synthesized
aactgtatatctaggtagacag

SEQ ID NO: 859881 - DNA, 22 bp, Artificial Sequence
  chemically synthesized
tatatctaggtagacagataga

SEQ ID NO: 859882 - DNA, 22 bp, Artificial Sequence
  chemically synthesized
ggtagacagatagatacacaca

SEQ ID NO: 859883 - DNA, 22 bp, Artificial Sequence
  chemically synthesized
cacacacacacacacacacaca

SEQ ID NO: 859884 - DNA, 22 bp, Artificial Sequence
  chemically synthesized
acacacacacacacacacacac

SEQ ID NO: 859885 - DNA, 22 bp, Artificial Sequence
  chemically synthesized
tacacacacacacacacacaca

SEQ ID NO: 859886 - DNA, 22 bp, Artificial Sequence
  chemically synthesized
tgtgtgtgtgtgtgtgtgtgtg

SEQ ID NO: 859887 - DNA, 22 bp, Artificial Sequence
  chemically synthesized
tttacacacacacacacacaca

SEQ ID NO: 859888 - DNA, 22 bp, Artificial Sequence
  chemically synthesized
tctttacacacacacacacaca

SEQ ID NO: 859889 - DNA, 22 bp, Artificial Sequence
  chemically synthesized
tctctctttacacacacacaca

SEQ ID NO: 859890 - DNA, 22 bp, Artificial Sequence
  chemically synthesized
tctgtctctctttacacacaca

SEQ ID NO: 859891 - DNA, 22 bp, Artificial Sequence
  chemically synthesized
tgtctgtctctctttacacaca

SEQ ID NO: 859892 - DNA, 22 bp, Artificial Sequence
  chemically synthesized
tctctgtctgtctctctttaca

SEQ ID NO: 859893 - DNA, 22 bp, Artificial Sequence
  chemically synthesized
tgtctctgtctgtctctcttta

SEQ ID NO: 859894 - DNA, 22 bp, Artificial Sequence
  chemically synthesized
ctctgtctctgtctgtctctct

SEQ ID NO: 859895 - DNA, 22 bp, Artificial Sequence
  chemically synthesized
gctctgtctctgtctgtctctc

SEQ ID NO: 859896 - DNA, 22 bp, Artificial Sequence
  chemically synthesized
ttgctctgtctctgtctgtctc

SEQ ID NO: 859897 - DNA, 22 bp, Artificial Sequence
  chemically synthesized
tcttgctctgtctctgtctgtc

SEQ ID NO: 859898 - DNA, 22 bp, Artificial Sequence
  chemically synthesized
tctcttgctctgtctctgtctg

SEQ ID NO: 859899 - DNA, 22 bp, Artificial Sequence
  chemically synthesized
tctctcttgctctgtctctgtc

SEQ ID NO: 859900 - DNA, 22 bp, Artificial Sequence
  chemically synthesized
tctctctcttgctctgtctctg

SEQ ID NO: 859901 - DNA, 22 bp, Artificial Sequence
  chemically synthesized
agatgccctctctctctcttgc

SEQ ID NO: 859902 - DNA, 22 bp, Artificial Sequence
  chemically synthesized
ttcagatgccctctctctctct

SEQ ID NO: 859903 - DNA, 22 bp, Artificial Sequence
  chemically synthesized
agactattcagatgccctctct

SEQ ID NO: 859904 - DNA, 22 bp, Artificial Sequence
  chemically synthesized
catagtatgtcctcagactatt

SEQ ID NO: 859905 - DNA, 22 bp, Artificial Sequence
  chemically synthesized
tgctacatagtatgtcctcaga

SEQ ID NO: 859906 - DNA, 22 bp, Artificial Sequence
  chemically synthesized
aatagtctgaggacatactatg

SEQ ID NO: 859907 - DNA, 22 bp, Artificial Sequence
  chemically synthesized
aggacatactatgtagcataat

SEQ ID NO: 859908 - DNA, 22 bp, Artificial Sequence
  chemically synthesized
atgaatgcatgagaaaggtatt

SEQ ID NO: 859909 - DNA, 22 bp, Artificial Sequence
  chemically synthesized
taatgaatgcatgagaaaggta

SEQ ID NO: 859910 - DNA, 22 bp, Artificial Sequence
  chemically synthesized
ctaatgaatgcatgagaaaggt

SEQ ID NO: 859911 - DNA, 22 bp, Artificial Sequence
  chemically synthesized
tgtagcataatacctttctcat

SEQ ID NO: 859912 - DNA, 22 bp, Artificial Sequence
  chemically synthesized
tctaatgaatgcatgagaaagg

SEQ ID NO: 859913 - DNA, 22 bp, Artificial Sequence
  chemically synthesized
attttctaatgaatgcatgaga

SEQ ID NO: 859914 - DNA, 22 bp, Artificial Sequence
  chemically synthesized
aattttctaatgaatgcatgag

SEQ ID NO: 859915 - DNA, 22 bp, Artificial Sequence
  chemically synthesized
taattttctaatgaatgcatga

SEQ ID NO: 859916 - DNA, 22 bp, Artificial Sequence
  chemically synthesized
tctcatgcattcattagaaaat

SEQ ID NO: 859917 - DNA, 22 bp, Artificial Sequence
  chemically synthesized
ctcatgcattcattagaaaatt

SEQ ID NO: 859918 - DNA, 22 bp, Artificial Sequence
  chemically synthesized
tcatgcattcattagaaaatta

SEQ ID NO: 859919 - DNA, 22 bp, Artificial Sequence
  chemically synthesized
gtagagtcattttaattttcta

SEQ ID NO: 859920 - DNA, 22 bp, Artificial Sequence
  chemically synthesized
agtagagtcattttaattttct

SEQ ID NO: 859921 - DNA, 22 bp, Artificial Sequence
  chemically synthesized
atgcattcattagaaaattaaa

SEQ ID NO: 859922 - DNA, 22 bp, Artificial Sequence
  chemically synthesized
tagtagagtcattttaattttc

SEQ ID NO: 859923 - DNA, 22 bp, Artificial Sequence
  chemically synthesized
attagaaaattaaaatgactct

SEQ ID NO: 859924 - DNA, 22 bp, Artificial Sequence
  chemically synthesized
gaaaattaaaatgactctacta

SEQ ID NO: 859925 - DNA, 22 bp, Artificial Sequence
  chemically synthesized
aaatgactctactaaaattgtg

SEQ ID NO: 859926 - DNA, 22 bp, Artificial Sequence
  chemically synthesized
tggagggaaaaccacaatttta

SEQ ID NO: 859927 - DNA, 22 bp, Artificial Sequence
  chemically synthesized
actatggagggaaaaccacaat

SEQ ID NO: 859928 - DNA, 22 bp, Artificial Sequence
  chemically synthesized
aactatggagggaaaaccacaa

SEQ ID NO: 859929 - DNA, 22 bp, Artificial Sequence
  chemically synthesized
cttaactatggagggaaaacca

SEQ ID NO: 859930 - DNA, 22 bp, Artificial Sequence
  chemically synthesized
tactaaaattgtggttttccct

SEQ ID NO: 859931 - DNA, 22 bp, Artificial Sequence
  chemically synthesized
ctaaaattgtggttttccctcc

SEQ ID NO: 859932 - DNA, 22 bp, Artificial Sequence
  chemically synthesized
tctgcttaactatggagggaaa

SEQ ID NO: 859933 - DNA, 22 bp, Artificial Sequence
  chemically synthesized
aaattgtggttttccctccata

SEQ ID NO: 859934 - DNA, 22 bp, Artificial Sequence
  chemically synthesized
tgtctgcttaactatggaggga

SEQ ID NO: 859935 - DNA, 22 bp, Artificial Sequence
  chemically synthesized
ctgtctgcttaactatggaggg

SEQ ID NO: 859936 - DNA, 22 bp, Artificial Sequence
  chemically synthesized
tctgtctgcttaactatggagg

SEQ ID NO: 859937 - DNA, 22 bp, Artificial Sequence
  chemically synthesized
tggttttccctccatagttaag

SEQ ID NO: 859938 - DNA, 22 bp, Artificial Sequence
  chemically synthesized
attttctgtctgcttaactatg

SEQ ID NO: 859939 - DNA, 22 bp, Artificial Sequence
  chemically synthesized
gattttctgtctgcttaactat

SEQ ID NO: 859940 - DNA, 22 bp, Artificial Sequence
  chemically synthesized
tccctccatagttaagcagaca

SEQ ID NO: 859941 - DNA, 22 bp, Artificial Sequence
  chemically synthesized
agcttgattttctgtctgctta

SEQ ID NO: 859942 - DNA, 22 bp, Artificial Sequence
  chemically synthesized
ccctccatagttaagcagacag

SEQ ID NO: 859943 - DNA, 22 bp, Artificial Sequence
  chemically synthesized
gagcttgattttctgtctgctt

SEQ ID NO: 859944 - DNA, 22 bp, Artificial Sequence
  chemically synthesized
cctccatagttaagcagacaga

SEQ ID NO: 859945 - DNA, 22 bp, Artificial Sequence
  chemically synthesized
tgagcttgattttctgtctgct

SEQ ID NO: 859946 - DNA, 22 bp, Artificial Sequence
  chemically synthesized
ttttgagcttgattttctgtct

SEQ ID NO: 859947 - DNA, 22 bp, Artificial Sequence
  chemically synthesized
catagttaagcagacagaaaat

SEQ ID NO: 859948 - DNA, 22 bp, Artificial Sequence
  chemically synthesized
aactattttgagcttgattttc

SEQ ID NO: 859949 - DNA, 22 bp, Artificial Sequence
  chemically synthesized
caactattttgagcttgatttt

SEQ ID NO: 859950 - DNA, 22 bp, Artificial Sequence
  chemically synthesized
agcagacagaaaatcaagctca

SEQ ID NO: 859951 - DNA, 22 bp, Artificial Sequence
  chemically synthesized
atttcaactattttgagcttga

SEQ ID NO: 859952 - DNA, 22 bp, Artificial Sequence
  chemically synthesized
aattcatttcaactattttgag

SEQ ID NO: 859953 - DNA, 22 bp, Artificial Sequence
  chemically synthesized
gtgtgccaaactcaattcattt

SEQ ID NO: 859954 - DNA, 22 bp, Artificial Sequence
  chemically synthesized
aaaatagttgaaatgaattgag

SEQ ID NO: 859955 - DNA, 22 bp, Artificial Sequence
  chemically synthesized
tggtgtgccaaactcaattcat

SEQ ID NO: 859956 - DNA, 22 bp, Artificial Sequence
  chemically synthesized
ccattctggtgtgccaaactca

SEQ ID NO: 859957 - DNA, 22 bp, Artificial Sequence
  chemically synthesized
aaatgaattgagtttggcacac

SEQ ID NO: 859958 - DNA, 22 bp, Artificial Sequence
  chemically synthesized
atgctaccattctggtgtgcca

SEQ ID NO: 859959 - DNA, 22 bp, Artificial Sequence
  chemically synthesized
ttcatgctaccattctggtgtg

SEQ ID NO: 859960 - DNA, 22 bp, Artificial Sequence
  chemically synthesized
ttattcatgctaccattctggt

SEQ ID NO: 859961 - DNA, 22 bp, Artificial Sequence
  chemically synthesized
agtttggcacaccagaatggta

SEQ ID NO: 859962 - DNA, 22 bp, Artificial Sequence
  chemically synthesized
ctgttattcatgctaccattct

SEQ ID NO: 859963 - DNA, 22 bp, Artificial Sequence
  chemically synthesized
ggcacaccagaatggtagcatg

SEQ ID NO: 859964 - DNA, 22 bp, Artificial Sequence
  chemically synthesized
gcacaccagaatggtagcatga

SEQ ID NO: 859965 - DNA, 22 bp, Artificial Sequence
  chemically synthesized
cacctactgttattcatgctac

SEQ ID NO: 859966 - DNA, 22 bp, Artificial Sequence
  chemically synthesized
caatagtatattacacctactg

SEQ ID NO: 859967 - DNA, 22 bp, Artificial Sequence
  chemically synthesized
gcaatagtatattacacctact

SEQ ID NO: 859968 - DNA, 22 bp, Artificial Sequence
  chemically synthesized
tggtttgcaatagtatattaca

SEQ ID NO: 859969 - DNA, 22 bp, Artificial Sequence
  chemically synthesized
agagcaaagctgtggtttgcaa

SEQ ID NO: 859970 - DNA, 22 bp, Artificial Sequence
  chemically synthesized
acaaaatactcagagcaaagct

SEQ ID NO: 859971 - DNA, 22 bp, Artificial Sequence
  chemically synthesized
ttgcaaaccacagctttgctct

SEQ ID NO: 859972 - DNA, 22 bp, Artificial Sequence
  chemically synthesized
caaaccacagctttgctctgag

SEQ ID NO: 859973 - DNA, 22 bp, Artificial Sequence
  chemically synthesized
attaacaaaatactcagagcaa

SEQ ID NO: 859974 - DNA, 22 bp, Artificial Sequence
  chemically synthesized
aattaacaaaatactcagagca

SEQ ID NO: 859975 - DNA, 22 bp, Artificial Sequence
  chemically synthesized
taattaacaaaatactcagagc

SEQ ID NO: 859976 - DNA, 22 bp, Artificial Sequence
  chemically synthesized
ttaattaacaaaatactcagag

SEQ ID NO: 859977 - DNA, 22 bp, Artificial Sequence
  chemically synthesized
tgctctgagtattttgttaatt

SEQ ID NO: 859978 - DNA, 22 bp, Artificial Sequence
  chemically synthesized
gctctgagtattttgttaatta

SEQ ID NO: 859979 - DNA, 22 bp, Artificial Sequence
  chemically synthesized
ctctgagtattttgttaattaa

SEQ ID NO: 859980 - DNA, 22 bp, Artificial Sequence
  chemically synthesized
aagccaacaccttttaattaac

SEQ ID NO: 859981 - DNA, 22 bp, Artificial Sequence
  chemically synthesized
tgagtattttgttaattaaaag

SEQ ID NO: 859982 - DNA, 22 bp, Artificial Sequence
  chemically synthesized
ctaaagccaacaccttttaatt

SEQ ID NO: 859983 - DNA, 22 bp, Artificial Sequence
  chemically synthesized
agtattttgttaattaaaaggt

SEQ ID NO: 859984 - DNA, 22 bp, Artificial Sequence
  chemically synthesized
cctaaagccaacaccttttaat

SEQ ID NO: 859985 - DNA, 22 bp, Artificial Sequence
  chemically synthesized
cttcctaaagccaacacctttt

SEQ ID NO: 859986 - DNA, 22 bp, Artificial Sequence
  chemically synthesized
tgttaattaaaaggtgttggct

SEQ ID NO: 859987 - DNA, 22 bp, Artificial Sequence
  chemically synthesized
gttaattaaaaggtgttggctt

SEQ ID NO: 859988 - DNA, 22 bp, Artificial Sequence
  chemically synthesized
ttaattaaaaggtgttggcttt

SEQ ID NO: 859989 - DNA, 22 bp, Artificial Sequence
  chemically synthesized
attaaaaggtgttggctttagg

SEQ ID NO: 859990 - DNA, 22 bp, Artificial Sequence
  chemically synthesized
aaaggtgttggctttaggaagg

SEQ ID NO: 859991 - DNA, 22 bp, Artificial Sequence
  chemically synthesized
aaaaaaataagagttccttcct

SEQ ID NO: 859992 - DNA, 22 bp, Artificial Sequence
  chemically synthesized
gaaaaaaataagagttccttcc

SEQ ID NO: 859993 - DNA, 22 bp, Artificial Sequence
  chemically synthesized
gctttaggaaggaactcttatt

SEQ ID NO: 859994 - DNA, 22 bp, Artificial Sequence
  chemically synthesized
aaacacttgaaaaaaataagag

SEQ ID NO: 859995 - DNA, 22 bp, Artificial Sequence
  chemically synthesized
caaacacttgaaaaaaataaga

SEQ ID NO: 859996 - DNA, 22 bp, Artificial Sequence
  chemically synthesized
taggaaggaactcttatttttt

SEQ ID NO: 859997 - DNA, 22 bp, Artificial Sequence
  chemically synthesized
aggaaggaactcttattttttt

SEQ ID NO: 859998 - DNA, 22 bp, Artificial Sequence
  chemically synthesized
ttcaaacacttgaaaaaaataa

SEQ ID NO: 859999 - DNA, 22 bp, Artificial Sequence
  chemically synthesized
ggaaggaactcttatttttttc

SEQ ID NO: 860000 - DNA, 22 bp, Artificial Sequence
  chemically synthesized
gagaagtgttcttcaaacactt

SEQ ID NO: 860001 - DNA, 22 bp, Artificial Sequence
  chemically synthesized
ttatttttttcaagtgtttgaa

SEQ ID NO: 860002 - DNA, 22 bp, Artificial Sequence
  chemically synthesized
atttttttcaagtgtttgaaga

SEQ ID NO: 860003 - DNA, 22 bp, Artificial Sequence
  chemically synthesized
tttttttcaagtgtttgaagaa

SEQ ID NO: 860004 - DNA, 22 bp, Artificial Sequence
  chemically synthesized
agactagagaagtgttcttcaa

SEQ ID NO: 860005 - DNA, 22 bp, Artificial Sequence
  chemically synthesized
ttttcaagtgtttgaagaacac

SEQ ID NO: 860006 - DNA, 22 bp, Artificial Sequence
  chemically synthesized
cagactagagaagtgttcttca

SEQ ID NO: 860007 - DNA, 22 bp, Artificial Sequence
  chemically synthesized
tttcaagtgtttgaagaacact

SEQ ID NO: 860008 - DNA, 22 bp, Artificial Sequence
  chemically synthesized
tcagactagagaagtgttcttc

SEQ ID NO: 860009 - DNA, 22 bp, Artificial Sequence
  chemically synthesized
ttcaagtgtttgaagaacactt

SEQ ID NO: 860010 - DNA, 22 bp, Artificial Sequence
  chemically synthesized
tcaagtgtttgaagaacacttc

SEQ ID NO: 860011 - DNA, 22 bp, Artificial Sequence
  chemically synthesized
caagtgtttgaagaacacttct

SEQ ID NO: 860012 - DNA, 22 bp, Artificial Sequence
  chemically synthesized
aagtgtttgaagaacacttctc

SEQ ID NO: 860013 - DNA, 22 bp, Artificial Sequence
  chemically synthesized
aattttcagactagagaagtgt

SEQ ID NO: 860014 - DNA, 22 bp, Artificial Sequence
  chemically synthesized
gaagaacacttctctagtctga

SEQ ID NO: 860015 - DNA, 22 bp, Artificial Sequence
  chemically synthesized
aagaacacttctctagtctgaa

SEQ ID NO: 860016 - DNA, 22 bp, Artificial Sequence
  chemically synthesized
aaaccaattaaattttcagact

SEQ ID NO: 860017 - DNA, 22 bp, Artificial Sequence
  chemically synthesized
ctctagtctgaaaatttaattg

SEQ ID NO: 860018 - DNA, 22 bp, Artificial Sequence
  chemically synthesized
tctagtctgaaaatttaattgg

SEQ ID NO: 860019 - DNA, 22 bp, Artificial Sequence
  chemically synthesized
tagtctgaaaatttaattggtt

SEQ ID NO: 860020 - DNA, 22 bp, Artificial Sequence
  chemically synthesized
gtctgaaaatttaattggtttc

SEQ ID NO: 860021 - DNA, 22 bp, Artificial Sequence
  chemically synthesized
atcatgtacccctgaaaccaat

SEQ ID NO: 860022 - DNA, 22 bp, Artificial Sequence
  chemically synthesized
aaaatttaattggtttcagggg

SEQ ID NO: 860023 - DNA, 22 bp, Artificial Sequence
  chemically synthesized
actaatcatgtacccctgaaac

SEQ ID NO: 860024 - DNA, 22 bp, Artificial Sequence
  chemically synthesized
gtctgactaatcatgtacccct

SEQ ID NO: 860025 - DNA, 22 bp, Artificial Sequence
  chemically synthesized
aattggtttcaggggtacatga

SEQ ID NO: 860026 - DNA, 22 bp, Artificial Sequence
  chemically synthesized
attggtttcaggggtacatgat

SEQ ID NO: 860027 - DNA, 22 bp, Artificial Sequence
  chemically synthesized
ttagtctgactaatcatgtacc

SEQ ID NO: 860028 - DNA, 22 bp, Artificial Sequence
  chemically synthesized
gtttcaggggtacatgattagt

SEQ ID NO: 860029 - DNA, 22 bp, Artificial Sequence
  chemically synthesized
caggggtacatgattagtcaga

SEQ ID NO: 860030 - DNA, 22 bp, Artificial Sequence
  chemically synthesized
aggggtacatgattagtcagac

SEQ ID NO: 860031 - DNA, 22 bp, Artificial Sequence
  chemically synthesized
agtaaagctgttagtctgacta

SEQ ID NO: 860032 - DNA, 22 bp, Artificial Sequence
  chemically synthesized
taagtaaagctgttagtctgac

SEQ ID NO: 860033 - DNA, 22 bp, Artificial Sequence
  chemically synthesized
aagctctaagtaaagctgttag

SEQ ID NO: 860034 - DNA, 22 bp, Artificial Sequence
  chemically synthesized
aaagctctaagtaaagctgtta

SEQ ID NO: 860035 - DNA, 22 bp, Artificial Sequence
  chemically synthesized
taaagctctaagtaaagctgtt

SEQ ID NO: 860036 - DNA, 22 bp, Artificial Sequence
  chemically synthesized
ctttaaagctctaagtaaagct

SEQ ID NO: 860037 - DNA, 22 bp, Artificial Sequence
  chemically synthesized
gtcagactaacagctttactta

SEQ ID NO: 860038 - DNA, 22 bp, Artificial Sequence
  chemically synthesized
gtagctcctttaaagctctaag

SEQ ID NO: 860039 - DNA, 22 bp, Artificial Sequence
  chemically synthesized
agtagctcctttaaagctctaa

SEQ ID NO: 860040 - DNA, 22 bp, Artificial Sequence
  chemically synthesized
acagctttacttagagctttaa

SEQ ID NO: 860041 - DNA, 22 bp, Artificial Sequence
  chemically synthesized
aaagatttagtagctcctttaa

SEQ ID NO: 860042 - DNA, 22 bp, Artificial Sequence
  chemically synthesized
tacttagagctttaaaggagct

SEQ ID NO: 860043 - DNA, 22 bp, Artificial Sequence
  chemically synthesized
aaaagatttagtagctccttta

SEQ ID NO: 860044 - DNA, 22 bp, Artificial Sequence
  chemically synthesized
acttagagctttaaaggagcta

SEQ ID NO: 860045 - DNA, 22 bp, Artificial Sequence
  chemically synthesized
taaaagatttagtagctccttt

SEQ ID NO: 860046 - DNA, 22 bp, Artificial Sequence
  chemically synthesized
cttagagctttaaaggagctac

SEQ ID NO: 860047 - DNA, 22 bp, Artificial Sequence
  chemically synthesized
agagctttaaaggagctactaa

SEQ ID NO: 860048 - DNA, 22 bp, Artificial Sequence
  chemically synthesized
gagctttaaaggagctactaaa

SEQ ID NO: 860049 - DNA, 22 bp, Artificial Sequence
  chemically synthesized
taaaggagctactaaatctttt

SEQ ID NO: 860050 - DNA, 22 bp, Artificial Sequence
  chemically synthesized
tgtgtgtgttttaaaagattta

SEQ ID NO: 860051 - DNA, 22 bp, Artificial Sequence
  chemically synthesized
aaaggagctactaaatctttta

SEQ ID NO: 860052 - DNA, 22 bp, Artificial Sequence
  chemically synthesized
aaggagctactaaatcttttaa

SEQ ID NO: 860053 - DNA, 22 bp, Artificial Sequence
  chemically synthesized
ctaaatcttttaaaacacacac

SEQ ID NO: 860054 - DNA, 22 bp, Artificial Sequence
  chemically synthesized
aatcttttaaaacacacacaca

SEQ ID NO: 860055 - DNA, 22 bp, Artificial Sequence
  chemically synthesized
ttaaaacacacacacaatgtgt

SEQ ID NO: 860056 - DNA, 22 bp, Artificial Sequence
  chemically synthesized
taaaacacacacacaatgtgtt

SEQ ID NO: 860057 - DNA, 22 bp, Artificial Sequence
  chemically synthesized
aaaacacacacacaatgtgttt

SEQ ID NO: 860058 - DNA, 22 bp, Artificial Sequence
  chemically synthesized
aaacacacacacaatgtgtttg

SEQ ID NO: 860059 - DNA, 22 bp, Artificial Sequence
  chemically synthesized
aaaggaaatatgccaaacacat

SEQ ID NO: 860060 - DNA, 22 bp, Artificial Sequence
  chemically synthesized
caaaggaaatatgccaaacaca

SEQ ID NO: 860061 - DNA, 22 bp, Artificial Sequence
  chemically synthesized
ggcatatttcctttgaagtatt

SEQ ID NO: 860062 - DNA, 22 bp, Artificial Sequence
  chemically synthesized
gcatatttcctttgaagtattc

SEQ ID NO: 860063 - DNA, 22 bp, Artificial Sequence
  chemically synthesized
caggaaaaccatgtgtgaatac

SEQ ID NO: 860064 - DNA, 22 bp, Artificial Sequence
  chemically synthesized
cctttgaagtattcacacatgg

SEQ ID NO: 860065 - DNA, 22 bp, Artificial Sequence
  chemically synthesized
ctttgaagtattcacacatggt

SEQ ID NO: 860066 - DNA, 22 bp, Artificial Sequence
  chemically synthesized
tgaattacaggaaaaccatgtg

SEQ ID NO: 860067 - DNA, 22 bp, Artificial Sequence
  chemically synthesized
tgaagtattcacacatggtttt

SEQ ID NO: 860068 - DNA, 22 bp, Artificial Sequence
  chemically synthesized
gaagtattcacacatggttttc

SEQ ID NO: 860069 - DNA, 22 bp, Artificial Sequence
  chemically synthesized
aagtattcacacatggttttcc

SEQ ID NO: 860070 - DNA, 22 bp, Artificial Sequence
  chemically synthesized
acacatggttttcctgtaattc

SEQ ID NO: 860071 - DNA, 22 bp, Artificial Sequence
  chemically synthesized
tcaaccaaaggagacctgtgaa

SEQ ID NO: 860072 - DNA, 22 bp, Artificial Sequence
  chemically synthesized
atcaaccaaaggagacctgtga

SEQ ID NO: 860073 - DNA, 22 bp, Artificial Sequence
  chemically synthesized
ttatcaaccaaaggagacctgt

SEQ ID NO: 860074 - DNA, 22 bp, Artificial Sequence
  chemically synthesized
tcctgtaattcacaggtctcct

SEQ ID NO: 860075 - DNA, 22 bp, Artificial Sequence
  chemically synthesized
cttatcaaccaaaggagacctg

SEQ ID NO: 860076 - DNA, 22 bp, Artificial Sequence
  chemically synthesized
cctgtaattcacaggtctcctt

SEQ ID NO: 860077 - DNA, 22 bp, Artificial Sequence
  chemically synthesized
tcttatcaaccaaaggagacct

SEQ ID NO: 860078 - DNA, 22 bp, Artificial Sequence
  chemically synthesized
ctgtaattcacaggtctccttt

SEQ ID NO: 860079 - DNA, 22 bp, Artificial Sequence
  chemically synthesized
ctttcttatcaaccaaaggaga

SEQ ID NO: 860080 - DNA, 22 bp, Artificial Sequence
  chemically synthesized
taattcacaggtctcctttggt

SEQ ID NO: 860081 - DNA, 22 bp, Artificial Sequence
  chemically synthesized
gctttcttatcaaccaaaggag

SEQ ID NO: 860082 - DNA, 22 bp, Artificial Sequence
  chemically synthesized
ttgctttcttatcaaccaaagg

SEQ ID NO: 860083 - DNA, 22 bp, Artificial Sequence
  chemically synthesized
cttgctttcttatcaaccaaag

SEQ ID NO: 860084 - DNA, 22 bp, Artificial Sequence
  chemically synthesized
acaggtctcctttggttgataa

SEQ ID NO: 860085 - DNA, 22 bp, Artificial Sequence
  chemically synthesized
ctttggttgataagaaagcaag

SEQ ID NO: 860086 - DNA, 22 bp, Artificial Sequence
  chemically synthesized
tggttgataagaaagcaagaag

SEQ ID NO: 860087 - DNA, 22 bp, Artificial Sequence
  chemically synthesized
ggttgataagaaagcaagaagc

SEQ ID NO: 860088 - DNA, 22 bp, Artificial Sequence
  chemically synthesized
gttgataagaaagcaagaagca

SEQ ID NO: 860089 - DNA, 22 bp, Artificial Sequence
  chemically synthesized
gaaatagagtatgtgcttcttg

SEQ ID NO: 860090 - DNA, 22 bp, Artificial Sequence
  chemically synthesized
ataagaaagcaagaagcacata

SEQ ID NO: 860091 - DNA, 22 bp, Artificial Sequence
  chemically synthesized
aacaaagctagaaatagagtat

SEQ ID NO: 860092 - DNA, 22 bp, Artificial Sequence
  chemically synthesized
attcaacaaagctagaaataga

SEQ ID NO: 860093 - DNA, 22 bp, Artificial Sequence
  chemically synthesized
cccacattcattcaacaaagct

SEQ ID NO: 860094 - DNA, 22 bp, Artificial Sequence
  chemically synthesized
tatttctagctttgttgaatga

SEQ ID NO: 860095 - DNA, 22 bp, Artificial Sequence
  chemically synthesized
tttctagctttgttgaatgaat

SEQ ID NO: 860096 - DNA, 22 bp, Artificial Sequence
  chemically synthesized
ctagctttgttgaatgaatgtg

SEQ ID NO: 860097 - DNA, 22 bp, Artificial Sequence
  chemically synthesized
tagctttgttgaatgaatgtgg

SEQ ID NO: 860098 - DNA, 22 bp, Artificial Sequence
  chemically synthesized
gctttgttgaatgaatgtgggt

SEQ ID NO: 860099 - DNA, 22 bp, Artificial Sequence
  chemically synthesized
tgttgaatgaatgtgggtaact

SEQ ID NO: 860100 - DNA, 22 bp, Artificial Sequence
  chemically synthesized
gttgaatgaatgtgggtaactt

SEQ ID NO: 860101 - DNA, 22 bp, Artificial Sequence
  chemically synthesized
ttgaatgaatgtgggtaacttt

SEQ ID NO: 860102 - DNA, 22 bp, Artificial Sequence
  chemically synthesized
aatgaatgtgggtaactttttt

SEQ ID NO: 860103 - DNA, 22 bp, Artificial Sequence
  chemically synthesized
aaatataaaagtgaagcaaaca

SEQ ID NO: 860104 - DNA, 22 bp, Artificial Sequence
  chemically synthesized
caaatataaaagtgaagcaaac

SEQ ID NO: 860105 - DNA, 22 bp, Artificial Sequence
  chemically synthesized
tcaaatataaaagtgaagcaaa

SEQ ID NO: 860106 - DNA, 22 bp, Artificial Sequence
  chemically synthesized
ttcaaatataaaagtgaagcaa

SEQ ID NO: 860107 - DNA, 22 bp, Artificial Sequence
  chemically synthesized
tttttgtttgcttcacttttat

SEQ ID NO: 860108 - DNA, 22 bp, Artificial Sequence
  chemically synthesized
ttttgtttgcttcacttttata

SEQ ID NO: 860109 - DNA, 22 bp, Artificial Sequence
  chemically synthesized
tttgtttgcttcacttttatat

SEQ ID NO: 860110 - DNA, 22 bp, Artificial Sequence
  chemically synthesized
ttgtttgcttcacttttatatt

SEQ ID NO: 860111 - DNA, 22 bp, Artificial Sequence
  chemically synthesized
agtgatttttcaaatataaaag

SEQ ID NO: 860112 - DNA, 22 bp, Artificial Sequence
  chemically synthesized
tgtttgcttcacttttatattt

SEQ ID NO: 860113 - DNA, 22 bp, Artificial Sequence
  chemically synthesized
gtttgcttcacttttatatttg

SEQ ID NO: 860114 - DNA, 22 bp, Artificial Sequence
  chemically synthesized
tttgcttcacttttatatttga

SEQ ID NO: 860115 - DNA, 22 bp, Artificial Sequence
  chemically synthesized
gcttcacttttatatttgaaaa

SEQ ID NO: 860116 - DNA, 22 bp, Artificial Sequence
  chemically synthesized
cttcacttttatatttgaaaaa

SEQ ID NO: 860117 - DNA, 22 bp, Artificial Sequence
  chemically synthesized
taagttgagtgatttttcaaat

SEQ ID NO: 860118 - DNA, 22 bp, Artificial Sequence
  chemically synthesized
gtaagttgagtgatttttcaaa

SEQ ID NO: 860119 - DNA, 22 bp, Artificial Sequence
  chemically synthesized
tgtaagttgagtgatttttcaa

SEQ ID NO: 860120 - DNA, 22 bp, Artificial Sequence
  chemically synthesized
cacttttatatttgaaaaatca

SEQ ID NO: 860121 - DNA, 22 bp, Artificial Sequence
  chemically synthesized
acttttatatttgaaaaatcac

SEQ ID NO: 860122 - DNA, 22 bp, Artificial Sequence
  chemically synthesized
ttttgtaagttgagtgattttt

SEQ ID NO: 860123 - DNA, 22 bp, Artificial Sequence
  chemically synthesized
attttgtaagttgagtgatttt

SEQ ID NO: 860124 - DNA, 22 bp, Artificial Sequence
  chemically synthesized
ttatatttgaaaaatcactcaa

SEQ ID NO: 860125 - DNA, 22 bp, Artificial Sequence
  chemically synthesized
tatatttgaaaaatcactcaac

SEQ ID NO: 860126 - DNA, 22 bp, Artificial Sequence
  chemically synthesized
atatttgaaaaatcactcaact

SEQ ID NO: 860127 - DNA, 22 bp, Artificial Sequence
  chemically synthesized
tatttgaaaaatcactcaactt

SEQ ID NO: 860128 - DNA, 22 bp, Artificial Sequence
  chemically synthesized
gaaaaatcactcaacttacaaa

SEQ ID NO: 860129 - DNA, 22 bp, Artificial Sequence
  chemically synthesized
aaaaatcactcaacttacaaaa

SEQ ID NO: 860130 - DNA, 22 bp, Artificial Sequence
  chemically synthesized
atgtgagcccaataacttattt

SEQ ID NO: 860131 - DNA, 22 bp, Artificial Sequence
  chemically synthesized
ttaatgtgagcccaataactta

SEQ ID NO: 860132 - DNA, 22 bp, Artificial Sequence
  chemically synthesized
aacttacaaaataagttattgg

SEQ ID NO: 860133 - DNA, 22 bp, Artificial Sequence
  chemically synthesized
acaaaataagttattgggctca

SEQ ID NO: 860134 - DNA, 22 bp, Artificial Sequence
  chemically synthesized
caaaataagttattgggctcac

SEQ ID NO: 860135 - DNA, 22 bp, Artificial Sequence
  chemically synthesized
atagaattgttaatgtgagccc

SEQ ID NO: 860136 - DNA, 22 bp, Artificial Sequence
  chemically synthesized
tcatagaattgttaatgtgagc

SEQ ID NO: 860137 - DNA, 22 bp, Artificial Sequence
  chemically synthesized
tctcatagaattgttaatgtga

SEQ ID NO: 860138 - DNA, 22 bp, Artificial Sequence
  chemically synthesized
ttgggctcacattaacaattct

SEQ ID NO: 860139 - DNA, 22 bp, Artificial Sequence
  chemically synthesized
gatattctctcatagaattgtt

SEQ ID NO: 860140 - DNA, 22 bp, Artificial Sequence
  chemically synthesized
agatattctctcatagaattgt

SEQ ID NO: 860141 - DNA, 22 bp, Artificial Sequence
  chemically synthesized
ggctcacattaacaattctatg

SEQ ID NO: 860142 - DNA, 22 bp, Artificial Sequence
  chemically synthesized
tagatattctctcatagaattg

SEQ ID NO: 860143 - DNA, 22 bp, Artificial Sequence
  chemically synthesized
ttagatattctctcatagaatt

SEQ ID NO: 860144 - DNA, 22 bp, Artificial Sequence
  chemically synthesized
tttagatattctctcatagaat

SEQ ID NO: 860145 - DNA, 22 bp, Artificial Sequence
  chemically synthesized
acattaacaattctatgagaga

SEQ ID NO: 860146 - DNA, 22 bp, Artificial Sequence
  chemically synthesized
acaattctatgagagaatatct

SEQ ID NO: 860147 - DNA, 22 bp, Artificial Sequence
  chemically synthesized
acagcactttttagatattctc

SEQ ID NO: 860148 - DNA, 22 bp, Artificial Sequence
  chemically synthesized
tatgagagaatatctaaaaagt

SEQ ID NO: 860149 - DNA, 22 bp, Artificial Sequence
  chemically synthesized
tgagagaatatctaaaaagtgc

SEQ ID NO: 860150 - DNA, 22 bp, Artificial Sequence
  chemically synthesized
aaaagtgctgttagatattccc

SEQ ID NO: 860151 - DNA, 22 bp, Artificial Sequence
  chemically synthesized
acatggaatgataaggaggaag

SEQ ID NO: 860152 - DNA, 22 bp, Artificial Sequence
  chemically synthesized
ttagatattcccttcctcctta

SEQ ID NO: 860153 - DNA, 22 bp, Artificial Sequence
  chemically synthesized
ttgacatggaatgataaggagg

SEQ ID NO: 860154 - DNA, 22 bp, Artificial Sequence
  chemically synthesized
gatattcccttcctccttatca

SEQ ID NO: 860155 - DNA, 22 bp, Artificial Sequence
  chemically synthesized
ctgttgacatggaatgataagg

SEQ ID NO: 860156 - DNA, 22 bp, Artificial Sequence
  chemically synthesized
tcctgttgacatggaatgataa

SEQ ID NO: 860157 - DNA, 22 bp, Artificial Sequence
  chemically synthesized
ccttcctccttatcattccatg

SEQ ID NO: 860158 - DNA, 22 bp, Artificial Sequence
  chemically synthesized
ctctcctgttgacatggaatga

SEQ ID NO: 860159 - DNA, 22 bp, Artificial Sequence
  chemically synthesized
cctccttatcattccatgtcaa

SEQ ID NO: 860160 - DNA, 22 bp, Artificial Sequence
  chemically synthesized
ctccttatcattccatgtcaac

SEQ ID NO: 860161 - DNA, 22 bp, Artificial Sequence
  chemically synthesized
cttatcattccatgtcaacagg

SEQ ID NO: 860162 - DNA, 22 bp, Artificial Sequence
  chemically synthesized
atcattccatgtcaacaggaga

SEQ ID NO: 860163 - DNA, 22 bp, Artificial Sequence
  chemically synthesized
tcattccatgtcaacaggagag

SEQ ID NO: 860164 - DNA, 22 bp, Artificial Sequence
  chemically synthesized
atcacatataacattgctctcc

SEQ ID NO: 860165 - DNA, 22 bp, Artificial Sequence
  chemically synthesized
gatcacatataacattgctctc

SEQ ID NO: 860166 - DNA, 22 bp, Artificial Sequence
  chemically synthesized
catgtcaacaggagagcaatgt

SEQ ID NO: 860167 - DNA, 22 bp, Artificial Sequence
  chemically synthesized
aatagtaatgcaatttgatcac

SEQ ID NO: 860168 - DNA, 22 bp, Artificial Sequence
  chemically synthesized
tatgtgatcaaattgcattact

SEQ ID NO: 860169 - DNA, 22 bp, Artificial Sequence
  chemically synthesized
taccccatagtattaaatagta

SEQ ID NO: 860170 - DNA, 22 bp, Artificial Sequence
  chemically synthesized
ataccccatagtattaaatagt

SEQ ID NO: 860171 - DNA, 22 bp, Artificial Sequence
  chemically synthesized
ttataccccatagtattaaata

SEQ ID NO: 860172 - DNA, 22 bp, Artificial Sequence
  chemically synthesized
cttataccccatagtattaaat

SEQ ID NO: 860173 - DNA, 22 bp, Artificial Sequence
  chemically synthesized
tcttataccccatagtattaaa

SEQ ID NO: 860174 - DNA, 22 bp, Artificial Sequence
  chemically synthesized
cattactatttaatactatggg

SEQ ID NO: 860175 - DNA, 22 bp, Artificial Sequence
  chemically synthesized
acaatctttcttataccccata

SEQ ID NO: 860176 - DNA, 22 bp, Artificial Sequence
  chemically synthesized
ctatttaatactatggggtata

SEQ ID NO: 860177 - DNA, 22 bp, Artificial Sequence
  chemically synthesized
tttaatactatggggtataaga

SEQ ID NO: 860178 - DNA, 22 bp, Artificial Sequence
  chemically synthesized
aatactatggggtataagaaag

SEQ ID NO: 860179 - DNA, 22 bp, Artificial Sequence
  chemically synthesized
atactatggggtataagaaaga

SEQ ID NO: 860180 - DNA, 22 bp, Artificial Sequence
  chemically synthesized
tggggtataagaaagattgtta

SEQ ID NO: 860181 - DNA, 22 bp, Artificial Sequence
  chemically synthesized
gtgagatggaagtcgctaacaa

SEQ ID NO: 860182 - DNA, 22 bp, Artificial Sequence
  chemically synthesized
ctagtgagatggaagtcgctaa

SEQ ID NO: 860183 - DNA, 22 bp, Artificial Sequence
  chemically synthesized
tctactagtgagatggaagtcg

SEQ ID NO: 860184 - DNA, 22 bp, Artificial Sequence
  chemically synthesized
atctactagtgagatggaagtc

SEQ ID NO: 860185 - DNA, 22 bp, Artificial Sequence
  chemically synthesized
tatctactagtgagatggaagt

SEQ ID NO: 860186 - DNA, 22 bp, Artificial Sequence
  chemically synthesized
ttttatctactagtgagatgga

SEQ ID NO: 860187 - DNA, 22 bp, Artificial Sequence
  chemically synthesized
ttagcgacttccatctcactag

SEQ ID NO: 860188 - DNA, 22 bp, Artificial Sequence
  chemically synthesized
gcgacttccatctcactagtag

SEQ ID NO: 860189 - DNA, 22 bp, Artificial Sequence
  chemically synthesized
ccatctcactagtagataaaat

SEQ ID NO: 860190 - DNA, 22 bp, Artificial Sequence
  chemically synthesized
catctcactagtagataaaata

SEQ ID NO: 860191 - DNA, 22 bp, Artificial Sequence
  chemically synthesized
catggaggagagttattttatc

SEQ ID NO: 860192 - DNA, 22 bp, Artificial Sequence
  chemically synthesized
acatggaggagagttattttat

SEQ ID NO: 860193 - DNA, 22 bp, Artificial Sequence
  chemically synthesized
cttacatggaggagagttattt

SEQ ID NO: 860194 - DNA, 22 bp, Artificial Sequence
  chemically synthesized
actagtagataaaataactctc

SEQ ID NO: 860195 - DNA, 22 bp, Artificial Sequence
  chemically synthesized
gtagataaaataactctcctcc

SEQ ID NO: 860196 - DNA, 22 bp, Artificial Sequence
  chemically synthesized
caatgttgcttacatggaggag

SEQ ID NO: 860197 - DNA, 22 bp, Artificial Sequence
  chemically synthesized
tccaatgttgcttacatggagg

SEQ ID NO: 860198 - DNA, 22 bp, Artificial Sequence
  chemically synthesized
tcctccatgtaagcaacattgg

SEQ ID NO: 860199 - DNA, 22 bp, Artificial Sequence
  chemically synthesized
ctccatgtaagcaacattggag

SEQ ID NO: 860200 - DNA, 22 bp, Artificial Sequence
  chemically synthesized
aaaaagaaaatattctccaatg

SEQ ID NO: 860201 - DNA, 22 bp, Artificial Sequence
  chemically synthesized
catgtaagcaacattggagaat

SEQ ID NO: 860202 - DNA, 22 bp, Artificial Sequence
  chemically synthesized
aaatattcaaaaagaaaatatt

SEQ ID NO: 860203 - DNA, 22 bp, Artificial Sequence
  chemically synthesized
caaatattcaaaaagaaaatat

SEQ ID NO: 860204 - DNA, 22 bp, Artificial Sequence
  chemically synthesized
tcaaatattcaaaaagaaaata

SEQ ID NO: 860205 - DNA, 22 bp, Artificial Sequence
  chemically synthesized
gagaatattttctttttgaata

SEQ ID NO: 860206 - DNA, 22 bp, Artificial Sequence
  chemically synthesized
tctttttgaatatttgaaagga

SEQ ID NO: 860207 - DNA, 22 bp, Artificial Sequence
  chemically synthesized
atccaaatgccatcctttcaaa

SEQ ID NO: 860208 - DNA, 22 bp, Artificial Sequence
  chemically synthesized
ctttttgaatatttgaaaggat

SEQ ID NO: 860209 - DNA, 22 bp, Artificial Sequence
  chemically synthesized
tttttgaatatttgaaaggatg

SEQ ID NO: 860210 - DNA, 22 bp, Artificial Sequence
  chemically synthesized
tttgaatatttgaaaggatggc

SEQ ID NO: 860211 - DNA, 22 bp, Artificial Sequence
  chemically synthesized
attaatccaaatgccatccttt

SEQ ID NO: 860212 - DNA, 22 bp, Artificial Sequence
  chemically synthesized
ttgaatatttgaaaggatggca

SEQ ID NO: 860213 - DNA, 22 bp, Artificial Sequence
  chemically synthesized
tgaatatttgaaaggatggcat

SEQ ID NO: 860214 - DNA, 22 bp, Artificial Sequence
  chemically synthesized
gaatatttgaaaggatggcatt

SEQ ID NO: 860215 - DNA, 22 bp, Artificial Sequence
  chemically synthesized
aatatttgaaaggatggcattt

SEQ ID NO: 860216 - DNA, 22 bp, Artificial Sequence
  chemically synthesized
cggaattcattaatccaaatgc

SEQ ID NO: 860217 - DNA, 22 bp, Artificial Sequence
  chemically synthesized
acggaattcattaatccaaatg

SEQ ID NO: 860218 - DNA, 22 bp, Artificial Sequence
  chemically synthesized
gaaaggatggcatttggattaa

SEQ ID NO: 860219 - DNA, 22 bp, Artificial Sequence
  chemically synthesized
ttacggaattcattaatccaaa

SEQ ID NO: 860220 - DNA, 22 bp, Artificial Sequence
  chemically synthesized
aaaggatggcatttggattaat

SEQ ID NO: 860221 - DNA, 22 bp, Artificial Sequence
  chemically synthesized
aattcttacggaattcattaat

SEQ ID NO: 860222 - DNA, 22 bp, Artificial Sequence
  chemically synthesized
gaattcttacggaattcattaa

SEQ ID NO: 860223 - DNA, 22 bp, Artificial Sequence
  chemically synthesized
ttgaattcttacggaattcatt

SEQ ID NO: 860224 - DNA, 22 bp, Artificial Sequence
  chemically synthesized
tcttgaattcttacggaattca

SEQ ID NO: 860225 - DNA, 22 bp, Artificial Sequence
  chemically synthesized
ggattaatgaattccgtaagaa

SEQ ID NO: 860226 - DNA, 22 bp, Artificial Sequence
  chemically synthesized
gattaatgaattccgtaagaat

SEQ ID NO: 860227 - DNA, 22 bp, Artificial Sequence
  chemically synthesized
agaagttctcttgaattcttac

SEQ ID NO: 860228 - DNA, 22 bp, Artificial Sequence
  chemically synthesized
cagaagttctcttgaattctta

SEQ ID NO: 860229 - DNA, 22 bp, Artificial Sequence
  chemically synthesized
atgaattccgtaagaattcaag

SEQ ID NO: 860230 - DNA, 22 bp, Artificial Sequence
  chemically synthesized
ttcagaagttctcttgaattct

SEQ ID NO: 860231 - DNA, 22 bp, Artificial Sequence
  chemically synthesized
cttcagaagttctcttgaattc

SEQ ID NO: 860232 - DNA, 22 bp, Artificial Sequence
  chemically synthesized
tcttcagaagttctcttgaatt

SEQ ID NO: 860233 - DNA, 22 bp, Artificial Sequence
  chemically synthesized
cgtaagaattcaagagaacttc

SEQ ID NO: 860234 - DNA, 22 bp, Artificial Sequence
  chemically synthesized
aaattttcttcagaagttctct

SEQ ID NO: 860235 - DNA, 22 bp, Artificial Sequence
  chemically synthesized
caaattttcttcagaagttctc

SEQ ID NO: 860236 - DNA, 22 bp, Artificial Sequence
  chemically synthesized
aagagaacttctgaagaaaatt

SEQ ID NO: 860237 - DNA, 22 bp, Artificial Sequence
  chemically synthesized
gacatgatttcaaattttcttc

SEQ ID NO: 860238 - DNA, 22 bp, Artificial Sequence
  chemically synthesized
gaatctagacatgatttcaaat

SEQ ID NO: 860239 - DNA, 22 bp, Artificial Sequence
  chemically synthesized
agaatctagacatgatttcaaa

SEQ ID NO: 860240 - DNA, 22 bp, Artificial Sequence
  chemically synthesized
ctgaagaaaatttgaaatcatg

SEQ ID NO: 860241 - DNA, 22 bp, Artificial Sequence
  chemically synthesized
ttagaatctagacatgatttca

SEQ ID NO: 860242 - DNA, 22 bp, Artificial Sequence
  chemically synthesized
tgaagaaaatttgaaatcatgt

SEQ ID NO: 860243 - DNA, 22 bp, Artificial Sequence
  chemically synthesized
cttagaatctagacatgatttc

SEQ ID NO: 860244 - DNA, 22 bp, Artificial Sequence
  chemically synthesized
tcttagaatctagacatgattt

SEQ ID NO: 860245 - DNA, 22 bp, Artificial Sequence
  chemically synthesized
aagaaaatttgaaatcatgtct

SEQ ID NO: 860246 - DNA, 22 bp, Artificial Sequence
  chemically synthesized
tctttcttagaatctagacatg

SEQ ID NO: 860247 - DNA, 22 bp, Artificial Sequence
  chemically synthesized
gaaatcatgtctagattctaag

SEQ ID NO: 860248 - DNA, 22 bp, Artificial Sequence
  chemically synthesized
aaatcatgtctagattctaaga

SEQ ID NO: 860249 - DNA, 22 bp, Artificial Sequence
  chemically synthesized
cacaatagattgtctttcttag

SEQ ID NO: 860250 - DNA, 22 bp, Artificial Sequence
  chemically synthesized
cctacacaatagattgtctttc

SEQ ID NO: 860251 - DNA, 22 bp, Artificial Sequence
  chemically synthesized
acctacacaatagattgtcttt

SEQ ID NO: 860252 - DNA, 22 bp, Artificial Sequence
  chemically synthesized
gattctaagaaagacaatctat

SEQ ID NO: 860253 - DNA, 22 bp, Artificial Sequence
  chemically synthesized
cttacctacacaatagattgtc

SEQ ID NO: 860254 - DNA, 22 bp, Artificial Sequence
  chemically synthesized
ccttacctacacaatagattgt

SEQ ID NO: 860255 - DNA, 22 bp, Artificial Sequence
  chemically synthesized
ttccttacctacacaatagatt

SEQ ID NO: 860256 - DNA, 22 bp, Artificial Sequence
  chemically synthesized
taagaaagacaatctattgtgt

SEQ ID NO: 860257 - DNA, 22 bp, Artificial Sequence
  chemically synthesized
agaaagacaatctattgtgtag

SEQ ID NO: 860258 - DNA, 22 bp, Artificial Sequence
  chemically synthesized
ttgtgtaggtaaggaagaattt

SEQ ID NO: 860259 - DNA, 22 bp, Artificial Sequence
  chemically synthesized
gagggaagacatgaaattcttc

SEQ ID NO: 860260 - DNA, 22 bp, Artificial Sequence
  chemically synthesized
agagggaagacatgaaattctt

SEQ ID NO: 860261 - DNA, 22 bp, Artificial Sequence
  chemically synthesized
tgtaggtaaggaagaatttcat

SEQ ID NO: 860262 - DNA, 22 bp, Artificial Sequence
  chemically synthesized
taaatatttagagggaagacat

SEQ ID NO: 860263 - DNA, 22 bp, Artificial Sequence
  chemically synthesized
catgtcttccctctaaatattt

SEQ ID NO: 860264 - DNA, 22 bp, Artificial Sequence
  chemically synthesized
atgtcttccctctaaatattta

SEQ ID NO: 860265 - DNA, 22 bp, Artificial Sequence
  chemically synthesized
tatgtgcagactgtaaatattt

SEQ ID NO: 860266 - DNA, 22 bp, Artificial Sequence
  chemically synthesized
gtatgtgcagactgtaaatatt

SEQ ID NO: 860267 - DNA, 22 bp, Artificial Sequence
  chemically synthesized
ccctctaaatatttacagtctg

SEQ ID NO: 860268 - DNA, 22 bp, Artificial Sequence
  chemically synthesized
cctctaaatatttacagtctgc

SEQ ID NO: 860269 - DNA, 22 bp, Artificial Sequence
  chemically synthesized
caacttgtatgtgcagactgta

SEQ ID NO: 860270 - DNA, 22 bp, Artificial Sequence
  chemically synthesized
ccaacttgtatgtgcagactgt

SEQ ID NO: 860271 - DNA, 22 bp, Artificial Sequence
  chemically synthesized
tccaacttgtatgtgcagactg

SEQ ID NO: 860272 - DNA, 22 bp, Artificial Sequence
  chemically synthesized
taaatatttacagtctgcacat

SEQ ID NO: 860273 - DNA, 22 bp, Artificial Sequence
  chemically synthesized
aatatttacagtctgcacatac

SEQ ID NO: 860274 - DNA, 22 bp, Artificial Sequence
  chemically synthesized
attttccaacttgtatgtgcag

SEQ ID NO: 860275 - DNA, 22 bp, Artificial Sequence
  chemically synthesized
taattttccaacttgtatgtgc

SEQ ID NO: 860276 - DNA, 22 bp, Artificial Sequence
  chemically synthesized
ctaattttccaacttgtatgtg

SEQ ID NO: 860277 - DNA, 22 bp, Artificial Sequence
  chemically synthesized
tttctaattttccaacttgtat

SEQ ID NO: 860278 - DNA, 22 bp, Artificial Sequence
  chemically synthesized
acagtctgcacatacaagttgg

SEQ ID NO: 860279 - DNA, 22 bp, Artificial Sequence
  chemically synthesized
gtttctaattttccaacttgta

SEQ ID NO: 860280 - DNA, 22 bp, Artificial Sequence
  chemically synthesized
cagtctgcacatacaagttgga

SEQ ID NO: 860281 - DNA, 22 bp, Artificial Sequence
  chemically synthesized
cacatacaagttggaaaattag

SEQ ID NO: 860282 - DNA, 22 bp, Artificial Sequence
  chemically synthesized
atagtgtttgtttctaattttc

SEQ ID NO: 860283 - DNA, 22 bp, Artificial Sequence
  chemically synthesized
tgtgttcatagtgtttgtttct

SEQ ID NO: 860284 - DNA, 22 bp, Artificial Sequence
  chemically synthesized
atgtgttcatagtgtttgtttc

SEQ ID NO: 860285 - DNA, 22 bp, Artificial Sequence
  chemically synthesized
gaaaattagaaacaaacactat

SEQ ID NO: 860286 - DNA, 22 bp, Artificial Sequence
  chemically synthesized
gaaacaaacactatgaacacat

SEQ ID NO: 860287 - DNA, 22 bp, Artificial Sequence
  chemically synthesized
tgaacacataaacacttatttt

SEQ ID NO: 860288 - DNA, 22 bp, Artificial Sequence
  chemically synthesized
gagtgacagaaaagaaagcaga

SEQ ID NO: 860289 - DNA, 22 bp, Artificial Sequence
  chemically synthesized
agagtgacagaaaagaaagcag

SEQ ID NO: 860290 - DNA, 22 bp, Artificial Sequence
  chemically synthesized
tagagtgacagaaaagaaagca

SEQ ID NO: 860291 - DNA, 22 bp, Artificial Sequence
  chemically synthesized
tttagagtgacagaaaagaaag

SEQ ID NO: 860292 - DNA, 22 bp, Artificial Sequence
  chemically synthesized
atttttgtctgctttcttttct

SEQ ID NO: 860293 - DNA, 22 bp, Artificial Sequence
  chemically synthesized
tttttgtctgctttcttttctg

SEQ ID NO: 860294 - DNA, 22 bp, Artificial Sequence
  chemically synthesized
ctctttagagtgacagaaaaga

SEQ ID NO: 860295 - DNA, 22 bp, Artificial Sequence
  chemically synthesized
actctttagagtgacagaaaag

SEQ ID NO: 860296 - DNA, 22 bp, Artificial Sequence
  chemically synthesized
ttgtctgctttcttttctgtca

SEQ ID NO: 860297 - DNA, 22 bp, Artificial Sequence
  chemically synthesized
tgtctgctttcttttctgtcac

SEQ ID NO: 860298 - DNA, 22 bp, Artificial Sequence
  chemically synthesized
gtctgctttcttttctgtcact

SEQ ID NO: 860299 - DNA, 22 bp, Artificial Sequence
  chemically synthesized
tttactctttagagtgacagaa

SEQ ID NO: 860300 - DNA, 22 bp, Artificial Sequence
  chemically synthesized
tctgctttcttttctgtcactc

SEQ ID NO: 860301 - DNA, 22 bp, Artificial Sequence
  chemically synthesized
atttactctttagagtgacaga

SEQ ID NO: 860302 - DNA, 22 bp, Artificial Sequence
  chemically synthesized
tatttactctttagagtgacag

SEQ ID NO: 860303 - DNA, 22 bp, Artificial Sequence
  chemically synthesized
ctttcttttctgtcactctaaa

SEQ ID NO: 860304 - DNA, 22 bp, Artificial Sequence
  chemically synthesized
tcttttctgtcactctaaagag

SEQ ID NO: 860305 - DNA, 22 bp, Artificial Sequence
  chemically synthesized
cttttctgtcactctaaagagt

SEQ ID NO: 860306 - DNA, 22 bp, Artificial Sequence
  chemically synthesized
ttttctgtcactctaaagagta

SEQ ID NO: 860307 - DNA, 22 bp, Artificial Sequence
  chemically synthesized
ttctgtcactctaaagagtaaa

SEQ ID NO: 860308 - DNA, 22 bp, Artificial Sequence
  chemically synthesized
tctgtcactctaaagagtaaat

SEQ ID NO: 860309 - DNA, 22 bp, Artificial Sequence
  chemically synthesized
ctgtcactctaaagagtaaata

SEQ ID NO: 860310 - DNA, 22 bp, Artificial Sequence
  chemically synthesized
tgtcactctaaagagtaaataa

SEQ ID NO: 860311 - DNA, 22 bp, Artificial Sequence
  chemically synthesized
tcactctaaagagtaaataaaa

SEQ ID NO: 860312 - DNA, 22 bp, Artificial Sequence
  chemically synthesized
ggtgtgtcatatattttattta

SEQ ID NO: 860313 - DNA, 22 bp, Artificial Sequence
  chemically synthesized
taaagagtaaataaaatatatg

SEQ ID NO: 860314 - DNA, 22 bp, Artificial Sequence
  chemically synthesized
atgttaggtgtgtcatatattt

SEQ ID NO: 860315 - DNA, 22 bp, Artificial Sequence
  chemically synthesized
aagagtaaataaaatatatgac

SEQ ID NO: 860316 - DNA, 22 bp, Artificial Sequence
  chemically synthesized
ttgatgttaggtgtgtcatata

SEQ ID NO: 860317 - DNA, 22 bp, Artificial Sequence
  chemically synthesized
aaatgagaattattgatgttag

SEQ ID NO: 860318 - DNA, 22 bp, Artificial Sequence
  chemically synthesized
taaaatgagaattattgatgtt

SEQ ID NO: 860319 - DNA, 22 bp, Artificial Sequence
  chemically synthesized
ctaaaatgagaattattgatgt

SEQ ID NO: 860320 - DNA, 22 bp, Artificial Sequence
  chemically synthesized
tctaaaatgagaattattgatg

SEQ ID NO: 860321 - DNA, 22 bp, Artificial Sequence
  chemically synthesized
ttctaaaatgagaattattgat

SEQ ID NO: 860322 - DNA, 22 bp, Artificial Sequence
  chemically synthesized
tttttctaaaatgagaattatt

SEQ ID NO: 860323 - DNA, 22 bp, Artificial Sequence
  chemically synthesized
atttttctaaaatgagaattat

SEQ ID NO: 860324 - DNA, 22 bp, Artificial Sequence
  chemically synthesized
acatcaataattctcattttag

SEQ ID NO: 860325 - DNA, 22 bp, Artificial Sequence
  chemically synthesized
tgtagagtacaagcatttattt

SEQ ID NO: 860326 - DNA, 22 bp, Artificial Sequence
  chemically synthesized
tcattttagaaaaataaatgct

SEQ ID NO: 860327 - DNA, 22 bp, Artificial Sequence
  chemically synthesized
attttagaaaaataaatgcttg

SEQ ID NO: 860328 - DNA, 22 bp, Artificial Sequence
  chemically synthesized
cctatgtagagtacaagcattt

SEQ ID NO: 860329 - DNA, 22 bp, Artificial Sequence
  chemically synthesized
gcctatgtagagtacaagcatt

SEQ ID NO: 860330 - DNA, 22 bp, Artificial Sequence
  chemically synthesized
tagaaaaataaatgcttgtact

SEQ ID NO: 860331 - DNA, 22 bp, Artificial Sequence
  chemically synthesized
agaaaaataaatgcttgtactc

SEQ ID NO: 860332 - DNA, 22 bp, Artificial Sequence
  chemically synthesized
gaaaaataaatgcttgtactct

SEQ ID NO: 860333 - DNA, 22 bp, Artificial Sequence
  chemically synthesized
cggccttgcctatgtagagtac

SEQ ID NO: 860334 - DNA, 22 bp, Artificial Sequence
  chemically synthesized
cagtactccggccttgcctatg

SEQ ID NO: 860335 - DNA, 22 bp, Artificial Sequence
  chemically synthesized
gtactctacataggcaaggccg

SEQ ID NO: 860336 - DNA, 22 bp, Artificial Sequence
  chemically synthesized
tactctacataggcaaggccgg

SEQ ID NO: 860337 - DNA, 22 bp, Artificial Sequence
  chemically synthesized
agttccagtactccggccttgc

SEQ ID NO: 860338 - DNA, 22 bp, Artificial Sequence
  chemically synthesized
gagttccagtactccggccttg

SEQ ID NO: 860339 - DNA, 22 bp, Artificial Sequence
  chemically synthesized
tacataggcaaggccggagtac

SEQ ID NO: 860340 - DNA, 22 bp, Artificial Sequence
  chemically synthesized
cataggcaaggccggagtactg

SEQ ID NO: 860341 - DNA, 22 bp, Artificial Sequence
  chemically synthesized
tcatgaatccttgagttccagt

SEQ ID NO: 860342 - DNA, 22 bp, Artificial Sequence
  chemically synthesized
gaactcaaggattcatgataac

SEQ ID NO: 860343 - DNA, 22 bp, Artificial Sequence
  chemically synthesized
aaggattcatgataaccatttg

SEQ ID NO: 860344 - DNA, 22 bp, Artificial Sequence
  chemically synthesized
aatccagaaatacaaatggtta

SEQ ID NO: 860345 - DNA, 22 bp, Artificial Sequence
  chemically synthesized
aaatccagaaatacaaatggtt

SEQ ID NO: 860346 - DNA, 22 bp, Artificial Sequence
  chemically synthesized
ttaaatccagaaatacaaatgg

SEQ ID NO: 860347 - DNA, 22 bp, Artificial Sequence
  chemically synthesized
cttaaatccagaaatacaaatg

SEQ ID NO: 860348 - DNA, 22 bp, Artificial Sequence
  chemically synthesized
tcttaaatccagaaatacaaat

SEQ ID NO: 860349 - DNA, 22 bp, Artificial Sequence
  chemically synthesized
ttcttaaatccagaaatacaaa

SEQ ID NO: 860350 - DNA, 22 bp, Artificial Sequence
  chemically synthesized
tttcttaaatccagaaatacaa

SEQ ID NO: 860351 - DNA, 22 bp, Artificial Sequence
  chemically synthesized
atgataaccatttgtatttctg

SEQ ID NO: 860352 - DNA, 22 bp, Artificial Sequence
  chemically synthesized
ttttcttaaatccagaaataca

SEQ ID NO: 860353 - DNA, 22 bp, Artificial Sequence
  chemically synthesized
tttttcttaaatccagaaatac

SEQ ID NO: 860354 - DNA, 22 bp, Artificial Sequence
  chemically synthesized
ttttttcttaaatccagaaata

SEQ ID NO: 860355 - DNA, 22 bp, Artificial Sequence
  chemically synthesized
acatttttttttcttaaatcca

SEQ ID NO: 860356 - DNA, 22 bp, Artificial Sequence
  chemically synthesized
aacatttttttttcttaaatcc

SEQ ID NO: 860357 - DNA, 22 bp, Artificial Sequence
  chemically synthesized
gtatttctggatttaagaaaaa

SEQ ID NO: 860358 - DNA, 22 bp, Artificial Sequence
  chemically synthesized
tatttctggatttaagaaaaaa

SEQ ID NO: 860359 - DNA, 22 bp, Artificial Sequence
  chemically synthesized
ccaaacttaacatttttttttc

SEQ ID NO: 860360 - DNA, 22 bp, Artificial Sequence
  chemically synthesized
ctggatttaagaaaaaaaaatg

SEQ ID NO: 860361 - DNA, 22 bp, Artificial Sequence
  chemically synthesized
tggatttaagaaaaaaaaatgt

SEQ ID NO: 860362 - DNA, 22 bp, Artificial Sequence
  chemically synthesized
gatttaagaaaaaaaaatgtta

SEQ ID NO: 860363 - DNA, 22 bp, Artificial Sequence
  chemically synthesized
aagaaaaaaaaatgttaagttt

SEQ ID NO: 860364 - DNA, 22 bp, Artificial Sequence
  chemically synthesized
agaaaaaaaaatgttaagtttg

SEQ ID NO: 860365 - DNA, 22 bp, Artificial Sequence
  chemically synthesized
aaaatccatagctcccaaactt

SEQ ID NO: 860366 - DNA, 22 bp, Artificial Sequence
  chemically synthesized
aaaaatccatagctcccaaact

SEQ ID NO: 860367 - DNA, 22 bp, Artificial Sequence
  chemically synthesized
taaaaatccatagctcccaaac

SEQ ID NO: 860368 - DNA, 22 bp, Artificial Sequence
  chemically synthesized
agctttaaaaatccatagctcc

SEQ ID NO: 860369 - DNA, 22 bp, Artificial Sequence
  chemically synthesized
agtttgggagctatggattttt

SEQ ID NO: 860370 - DNA, 22 bp, Artificial Sequence
  chemically synthesized
gggagctatggatttttaaagc

SEQ ID NO: 860371 - DNA, 22 bp, Artificial Sequence
  chemically synthesized
ggagctatggatttttaaagct

SEQ ID NO: 860372 - DNA, 22 bp, Artificial Sequence
  chemically synthesized
tggatttttaaagcttaatggt

SEQ ID NO: 860373 - DNA, 22 bp, Artificial Sequence
  chemically synthesized
aaatgtaagcaaatagcaccat

SEQ ID NO: 860374 - DNA, 22 bp, Artificial Sequence
  chemically synthesized
ttaaagcttaatggtgctattt

SEQ ID NO: 860375 - DNA, 22 bp, Artificial Sequence
  chemically synthesized
taaagcttaatggtgctatttg

SEQ ID NO: 860376 - DNA, 22 bp, Artificial Sequence
  chemically synthesized
ttaaaatgtaagcaaatagcac

SEQ ID NO: 860377 - DNA, 22 bp, Artificial Sequence
  chemically synthesized
aaagcttaatggtgctatttgc

SEQ ID NO: 860378 - DNA, 22 bp, Artificial Sequence
  chemically synthesized
aagcttaatggtgctatttgct

SEQ ID NO: 860379 - DNA, 22 bp, Artificial Sequence
  chemically synthesized
aatggtgctatttgcttacatt

SEQ ID NO: 860380 - DNA, 22 bp, Artificial Sequence
  chemically synthesized
atggtgctatttgcttacattt

SEQ ID NO: 860381 - DNA, 22 bp, Artificial Sequence
  chemically synthesized
tttgcttacattttaatagatt

SEQ ID NO: 860382 - DNA, 22 bp, Artificial Sequence
  chemically synthesized
atagcaagaaagaatctattaa

SEQ ID NO: 860383 - DNA, 22 bp, Artificial Sequence
  chemically synthesized
aatagcaagaaagaatctatta

SEQ ID NO: 860384 - DNA, 22 bp, Artificial Sequence
  chemically synthesized
taatagcaagaaagaatctatt

SEQ ID NO: 860385 - DNA, 22 bp, Artificial Sequence
  chemically synthesized
gcttacattttaatagattctt

SEQ ID NO: 860386 - DNA, 22 bp, Artificial Sequence
  chemically synthesized
ttaatagcaagaaagaatctat

SEQ ID NO: 860387 - DNA, 22 bp, Artificial Sequence
  chemically synthesized
cttacattttaatagattcttt

SEQ ID NO: 860388 - DNA, 22 bp, Artificial Sequence
  chemically synthesized
acattttaatagattctttctt

SEQ ID NO: 860389 - DNA, 22 bp, Artificial Sequence
  chemically synthesized
cattttaatagattctttcttg

SEQ ID NO: 860390 - DNA, 22 bp, Artificial Sequence
  chemically synthesized
tatttttaatagcaagaaagaa

SEQ ID NO: 860391 - DNA, 22 bp, Artificial Sequence
  chemically synthesized
taatagattctttcttgctatt

SEQ ID NO: 860392 - DNA, 22 bp, Artificial Sequence
  chemically synthesized
gattatatttttaatagcaaga

SEQ ID NO: 860393 - DNA, 22 bp, Artificial Sequence
  chemically synthesized
aatagattctttcttgctatta

SEQ ID NO: 860394 - DNA, 22 bp, Artificial Sequence
  chemically synthesized
ggattatatttttaatagcaag

SEQ ID NO: 860395 - DNA, 22 bp, Artificial Sequence
  chemically synthesized
atagattctttcttgctattaa

SEQ ID NO: 860396 - DNA, 22 bp, Artificial Sequence
  chemically synthesized
tttggattatatttttaatagc

SEQ ID NO: 860397 - DNA, 22 bp, Artificial Sequence
  chemically synthesized
atttggattatatttttaatag

SEQ ID NO: 860398 - DNA, 22 bp, Artificial Sequence
  chemically synthesized
tttcttgctattaaaaatataa

SEQ ID NO: 860399 - DNA, 22 bp, Artificial Sequence
  chemically synthesized
tcttgctattaaaaatataatc

SEQ ID NO: 860400 - DNA, 22 bp, Artificial Sequence
  chemically synthesized
cttgctattaaaaatataatcc

SEQ ID NO: 860401 - DNA, 22 bp, Artificial Sequence
  chemically synthesized
ttgctattaaaaatataatcca

SEQ ID NO: 860402 - DNA, 22 bp, Artificial Sequence
  chemically synthesized
gctattaaaaatataatccaaa

SEQ ID NO: 860403 - DNA, 22 bp, Artificial Sequence
  chemically synthesized
ctattaaaaatataatccaaat

SEQ ID NO: 860404 - DNA, 22 bp, Artificial Sequence
  chemically synthesized
ttaaaaatataatccaaataaa

SEQ ID NO: 860405 - DNA, 22 bp, Artificial Sequence
  chemically synthesized
aaaatataatccaaataaatat

SEQ ID NO: 860406 - DNA, 22 bp, Artificial Sequence
  chemically synthesized
taagtagtagcaaatatttatt

SEQ ID NO: 860407 - DNA, 22 bp, Artificial Sequence
  chemically synthesized
gtaagtagtagcaaatatttat

SEQ ID NO: 860408 - DNA, 22 bp, Artificial Sequence
  chemically synthesized
cttgtaagtagtagcaaatatt

SEQ ID NO: 860409 - DNA, 22 bp, Artificial Sequence
  chemically synthesized
acttgtaagtagtagcaaatat

SEQ ID NO: 860410 - DNA, 22 bp, Artificial Sequence
  chemically synthesized
tcttacttgtaagtagtagcaa

SEQ ID NO: 860411 - DNA, 22 bp, Artificial Sequence
  chemically synthesized
gtggcaattatcttacttgtaa

SEQ ID NO: 860412 - DNA, 22 bp, Artificial Sequence
  chemically synthesized
gctactacttacaagtaagata

SEQ ID NO: 860413 - DNA, 22 bp, Artificial Sequence
  chemically synthesized
ctactacttacaagtaagataa

SEQ ID NO: 860414 - DNA, 22 bp, Artificial Sequence
  chemically synthesized
ctacttacaagtaagataattg

SEQ ID NO: 860415 - DNA, 22 bp, Artificial Sequence
  chemically synthesized
cttacaagtaagataattgcca

SEQ ID NO: 860416 - DNA, 22 bp, Artificial Sequence
  chemically synthesized
acaagtaagataattgccacca

SEQ ID NO: 860417 - DNA, 22 bp, Artificial Sequence
  chemically synthesized
caagtaagataattgccaccaa

SEQ ID NO: 860418 - DNA, 22 bp, Artificial Sequence
  chemically synthesized
agtaaatgatgggggtgatggc

SEQ ID NO: 860419 - DNA, 22 bp, Artificial Sequence
  chemically synthesized
ccaccaacactgccatcacccc

SEQ ID NO: 860420 - DNA, 22 bp, Artificial Sequence
  chemically synthesized
ccatcacccccatcatttactc

SEQ ID NO: 860421 - DNA, 22 bp, Artificial Sequence
  chemically synthesized
gcacataagaatcactgagtaa

SEQ ID NO: 860422 - DNA, 22 bp, Artificial Sequence
  chemically synthesized
cctagcacataagaatcactga

SEQ ID NO: 860423 - DNA, 22 bp, Artificial Sequence
  chemically synthesized
gcctagcacataagaatcactg

SEQ ID NO: 860424 - DNA, 22 bp, Artificial Sequence
  chemically synthesized
actcagtgattcttatgtgcta

SEQ ID NO: 860425 - DNA, 22 bp, Artificial Sequence
  chemically synthesized
ctcagtgattcttatgtgctag

SEQ ID NO: 860426 - DNA, 22 bp, Artificial Sequence
  chemically synthesized
tgaagaaccttgcctagcacat

SEQ ID NO: 860427 - DNA, 22 bp, Artificial Sequence
  chemically synthesized
atgaagaaccttgcctagcaca

SEQ ID NO: 860428 - DNA, 22 bp, Artificial Sequence
  chemically synthesized
agtgattcttatgtgctaggca

SEQ ID NO: 860429 - DNA, 22 bp, Artificial Sequence
  chemically synthesized
ttatgtgctaggcaaggttctt

SEQ ID NO: 860430 - DNA, 22 bp, Artificial Sequence
  chemically synthesized
atgtgctaggcaaggttcttca

SEQ ID NO: 860431 - DNA, 22 bp, Artificial Sequence
  chemically synthesized
tgtgctaggcaaggttcttcat

SEQ ID NO: 860432 - DNA, 22 bp, Artificial Sequence
  chemically synthesized
ggcaaggttcttcataaaccct

SEQ ID NO: 860433 - DNA, 22 bp, Artificial Sequence
  chemically synthesized
gtaaaggtgaaataaaagaggg

SEQ ID NO: 860434 - DNA, 22 bp, Artificial Sequence
  chemically synthesized
ggtaaaggtgaaataaaagagg

SEQ ID NO: 860435 - DNA, 22 bp, Artificial Sequence
  chemically synthesized
ttcataaaccctcttttatttc

SEQ ID NO: 860436 - DNA, 22 bp, Artificial Sequence
  chemically synthesized
cataaaccctcttttatttcac

SEQ ID NO: 860437 - DNA, 22 bp, Artificial Sequence
  chemically synthesized
ataaaccctcttttatttcacc

SEQ ID NO: 860438 - DNA, 22 bp, Artificial Sequence
  chemically synthesized
aagatggtttggtaaaggtgaa

SEQ ID NO: 860439 - DNA, 22 bp, Artificial Sequence
  chemically synthesized
ccctgaagatggtttggtaaag

SEQ ID NO: 860440 - DNA, 22 bp, Artificial Sequence
  chemically synthesized
ttttatttcacctttaccaaac

SEQ ID NO: 860441 - DNA, 22 bp, Artificial Sequence
  chemically synthesized
ttatttcacctttaccaaacca

SEQ ID NO: 860442 - DNA, 22 bp, Artificial Sequence
  chemically synthesized
tatttcacctttaccaaaccat

SEQ ID NO: 860443 - DNA, 22 bp, Artificial Sequence
  chemically synthesized
atttcacctttaccaaaccatc

SEQ ID NO: 860444 - DNA, 22 bp, Artificial Sequence
  chemically synthesized
tttcacctttaccaaaccatct

SEQ ID NO: 860445 - DNA, 22 bp, Artificial Sequence
  chemically synthesized
cacctttaccaaaccatcttca

SEQ ID NO: 860446 - DNA, 22 bp, Artificial Sequence
  chemically synthesized
acctttaccaaaccatcttcag

SEQ ID NO: 860447 - DNA, 22 bp, Artificial Sequence
  chemically synthesized
taccaaaccatcttcagggtag

SEQ ID NO: 860448 - DNA, 22 bp, Artificial Sequence
  chemically synthesized
accaaaccatcttcagggtaga

SEQ ID NO: 860449 - DNA, 22 bp, Artificial Sequence
  chemically synthesized
ccaaaccatcttcagggtagat

SEQ ID NO: 860450 - DNA, 22 bp, Artificial Sequence
  chemically synthesized
gtaaaagggggatgataacatc

SEQ ID NO: 860451 - DNA, 22 bp, Artificial Sequence
  chemically synthesized
ggtaaaagggggatgataacat

SEQ ID NO: 860452 - DNA, 22 bp, Artificial Sequence
  chemically synthesized
cagggtagatgttatcatcccc

SEQ ID NO: 860453 - DNA, 22 bp, Artificial Sequence
  chemically synthesized
ccttggtaaaagggggatgata

SEQ ID NO: 860454 - DNA, 22 bp, Artificial Sequence
  chemically synthesized
agggtagatgttatcatccccc

SEQ ID NO: 860455 - DNA, 22 bp, Artificial Sequence
  chemically synthesized
gttaccttggtaaaagggggat

SEQ ID NO: 860456 - DNA, 22 bp, Artificial Sequence
  chemically synthesized
cgttaccttggtaaaaggggga

SEQ ID NO: 860457 - DNA, 22 bp, Artificial Sequence
  chemically synthesized
tcatcccccttttaccaaggta

SEQ ID NO: 860458 - DNA, 22 bp, Artificial Sequence
  chemically synthesized
aacaagtttcgttaccttggta

SEQ ID NO: 860459 - DNA, 22 bp, Artificial Sequence
  chemically synthesized
ttaccaaggtaacgaaacttgt

SEQ ID NO: 860460 - DNA, 22 bp, Artificial Sequence
  chemically synthesized
taccaaggtaacgaaacttgtt

SEQ ID NO: 860461 - DNA, 22 bp, Artificial Sequence
  chemically synthesized
accaaggtaacgaaacttgttc

SEQ ID NO: 860462 - DNA, 22 bp, Artificial Sequence
  chemically synthesized
atgtgagatcctgaacaagttt

SEQ ID NO: 860463 - DNA, 22 bp, Artificial Sequence
  chemically synthesized
ccaaggtaacgaaacttgttca

SEQ ID NO: 860464 - DNA, 22 bp, Artificial Sequence
  chemically synthesized
ttaatgtgagatcctgaacaag

SEQ ID NO: 860465 - DNA, 22 bp, Artificial Sequence
  chemically synthesized
gttaatgtgagatcctgaacaa

SEQ ID NO: 860466 - DNA, 22 bp, Artificial Sequence
  chemically synthesized
gaaacatcacttgttaatgtga

SEQ ID NO: 860467 - DNA, 22 bp, Artificial Sequence
  chemically synthesized
ggaaacatcacttgttaatgtg

SEQ ID NO: 860468 - DNA, 22 bp, Artificial Sequence
  chemically synthesized
gttcaggatctcacattaacaa

SEQ ID NO: 860469 - DNA, 22 bp, Artificial Sequence
  chemically synthesized
ttcaggatctcacattaacaag

SEQ ID NO: 860470 - DNA, 22 bp, Artificial Sequence
  chemically synthesized
tcttggaaacatcacttgttaa

SEQ ID NO: 860471 - DNA, 22 bp, Artificial Sequence
  chemically synthesized
aggatctcacattaacaagtga

SEQ ID NO: 860472 - DNA, 22 bp, Artificial Sequence
  chemically synthesized
acattaacaagtgatgtttcca

SEQ ID NO: 860473 - DNA, 22 bp, Artificial Sequence
  chemically synthesized
agcacattgtcttggaaacatc

SEQ ID NO: 860474 - DNA, 22 bp, Artificial Sequence
  chemically synthesized
acaagtgatgtttccaagacaa

SEQ ID NO: 860475 - DNA, 22 bp, Artificial Sequence
  chemically synthesized
ccaagacaatgtgcttaaccac

SEQ ID NO: 860476 - DNA, 22 bp, Artificial Sequence
  chemically synthesized
gaaatatgtgcagtggttaagc

SEQ ID NO: 860477 - DNA, 22 bp, Artificial Sequence
  chemically synthesized
caagacaatgtgcttaaccact

SEQ ID NO: 860478 - DNA, 22 bp, Artificial Sequence
  chemically synthesized
agaaatatgtgcagtggttaag

SEQ ID NO: 860479 - DNA, 22 bp, Artificial Sequence
  chemically synthesized
ttagaaatatgtgcagtggtta

SEQ ID NO: 860480 - DNA, 22 bp, Artificial Sequence
  chemically synthesized
tgattcttagaaatatgtgcag

SEQ ID NO: 860481 - DNA, 22 bp, Artificial Sequence
  chemically synthesized
aaccactgcacatatttctaag

SEQ ID NO: 860482 - DNA, 22 bp, Artificial Sequence
  chemically synthesized
accactgcacatatttctaaga

SEQ ID NO: 860483 - DNA, 22 bp, Artificial Sequence
  chemically synthesized
atgtcctatgattcttagaaat

SEQ ID NO: 860484 - DNA, 22 bp, Artificial Sequence
  chemically synthesized
cacatatttctaagaatcatag

SEQ ID NO: 860485 - DNA, 22 bp, Artificial Sequence
  chemically synthesized
ctaagaatcataggacatcagg

SEQ ID NO: 860486 - DNA, 22 bp, Artificial Sequence
  chemically synthesized
taagaatcataggacatcaggt

SEQ ID NO: 860487 - DNA, 22 bp, Artificial Sequence
  chemically synthesized
agaatcataggacatcaggtat

SEQ ID NO: 860488 - DNA, 22 bp, Artificial Sequence
  chemically synthesized
aatgagacatgtaagaaagata

SEQ ID NO: 860489 - DNA, 22 bp, Artificial Sequence
  chemically synthesized
catattgaatgagacatgtaag

SEQ ID NO: 860490 - DNA, 22 bp, Artificial Sequence
  chemically synthesized
gcatattgaatgagacatgtaa

SEQ ID NO: 860491 - DNA, 22 bp, Artificial Sequence
  chemically synthesized
ttgcatattgaatgagacatgt

SEQ ID NO: 860492 - DNA, 22 bp, Artificial Sequence
  chemically synthesized
ataattcttgcatattgaatga

SEQ ID NO: 860493 - DNA, 22 bp, Artificial Sequence
  chemically synthesized
tcttacatgtctcattcaatat

SEQ ID NO: 860494 - DNA, 22 bp, Artificial Sequence
  chemically synthesized
cttacatgtctcattcaatatg

SEQ ID NO: 860495 - DNA, 22 bp, Artificial Sequence
  chemically synthesized
ttacatgtctcattcaatatgc

SEQ ID NO: 860496 - DNA, 22 bp, Artificial Sequence
  chemically synthesized
acatgtctcattcaatatgcaa

SEQ ID NO: 860497 - DNA, 22 bp, Artificial Sequence
  chemically synthesized
catgtctcattcaatatgcaag

SEQ ID NO: 860498 - DNA, 22 bp, Artificial Sequence
  chemically synthesized
agtgattaataattcttgcata

SEQ ID NO: 860499 - DNA, 22 bp, Artificial Sequence
  chemically synthesized
gagtgattaataattcttgcat

SEQ ID NO: 860500 - DNA, 22 bp, Artificial Sequence
  chemically synthesized
attcaatatgcaagaattatta

SEQ ID NO: 860501 - DNA, 22 bp, Artificial Sequence
  chemically synthesized
aatatgcaagaattattaatca

SEQ ID NO: 860502 - DNA, 22 bp, Artificial Sequence
  chemically synthesized
gaagtatttgagtgattaataa

SEQ ID NO: 860503 - DNA, 22 bp, Artificial Sequence
  chemically synthesized
agaagtatttgagtgattaata

SEQ ID NO: 860504 - DNA, 22 bp, Artificial Sequence
  chemically synthesized
ttagaagtatttgagtgattaa

SEQ ID NO: 860505 - DNA, 22 bp, Artificial Sequence
  chemically synthesized
tagctcttagaagtatttgagt

SEQ ID NO: 860506 - DNA, 22 bp, Artificial Sequence
  chemically synthesized
ttaatcactcaaatacttctaa

SEQ ID NO: 860507 - DNA, 22 bp, Artificial Sequence
  chemically synthesized
taagctatagctcttagaagta

SEQ ID NO: 860508 - DNA, 22 bp, Artificial Sequence
  chemically synthesized
atcactcaaatacttctaagag

SEQ ID NO: 860509 - DNA, 22 bp, Artificial Sequence
  chemically synthesized
aaatacttctaagagctatagc

SEQ ID NO: 860510 - DNA, 22 bp, Artificial Sequence
  chemically synthesized
ctaagagctatagcttataata

SEQ ID NO: 860511 - DNA, 22 bp, Artificial Sequence
  chemically synthesized
atggataccatatattataagc

SEQ ID NO: 860512 - DNA, 22 bp, Artificial Sequence
  chemically synthesized
taagagctatagcttataatat

SEQ ID NO: 860513 - DNA, 22 bp, Artificial Sequence
  chemically synthesized
catggataccatatattataag

SEQ ID NO: 860514 - DNA, 22 bp, Artificial Sequence
  chemically synthesized
agagctatagcttataatatat

SEQ ID NO: 860515 - DNA, 22 bp, Artificial Sequence
  chemically synthesized
tagcttataatatatggtatcc

SEQ ID NO: 860516 - DNA, 22 bp, Artificial Sequence
  chemically synthesized
gatatatttcatggataccata

SEQ ID NO: 860517 - DNA, 22 bp, Artificial Sequence
  chemically synthesized
ataatatatggtatccatgaaa

SEQ ID NO: 860518 - DNA, 22 bp, Artificial Sequence
  chemically synthesized
taatatatggtatccatgaaat

SEQ ID NO: 860519 - DNA, 22 bp, Artificial Sequence
  chemically synthesized
aaatggatattagatatatttc

SEQ ID NO: 860520 - DNA, 22 bp, Artificial Sequence
  chemically synthesized
ccaaattaaaatggatattaga

SEQ ID NO: 860521 - DNA, 22 bp, Artificial Sequence
  chemically synthesized
tcccaaattaaaatggatatta

SEQ ID NO: 860522 - DNA, 22 bp, Artificial Sequence
  chemically synthesized
tctcccaaattaaaatggatat

SEQ ID NO: 860523 - DNA, 22 bp, Artificial Sequence
  chemically synthesized
ctctcccaaattaaaatggata

SEQ ID NO: 860524 - DNA, 22 bp, Artificial Sequence
  chemically synthesized
atatccattttaatttgggaga

SEQ ID NO: 860525 - DNA, 22 bp, Artificial Sequence
  chemically synthesized
tatcaaatgatcttctctccca

SEQ ID NO: 860526 - DNA, 22 bp, Artificial Sequence
  chemically synthesized
tagctatatcaaatgatcttct

SEQ ID NO: 860527 - DNA, 22 bp, Artificial Sequence
  chemically synthesized
taatttgggagagaagatcatt

SEQ ID NO: 860528 - DNA, 22 bp, Artificial Sequence
  chemically synthesized
atagctatatcaaatgatcttc

SEQ ID NO: 860529 - DNA, 22 bp, Artificial Sequence
  chemically synthesized
aatttgggagagaagatcattt

SEQ ID NO: 860530 - DNA, 22 bp, Artificial Sequence
  chemically synthesized
tatagctatatcaaatgatctt

SEQ ID NO: 860531 - DNA, 22 bp, Artificial Sequence
  chemically synthesized
atttgggagagaagatcatttg

SEQ ID NO: 860532 - DNA, 22 bp, Artificial Sequence
  chemically synthesized
ttatagctatatcaaatgatct

SEQ ID NO: 860533 - DNA, 22 bp, Artificial Sequence
  chemically synthesized
gggagagaagatcatttgatat

SEQ ID NO: 860534 - DNA, 22 bp, Artificial Sequence
  chemically synthesized
ggagagaagatcatttgatata

SEQ ID NO: 860535 - DNA, 22 bp, Artificial Sequence
  chemically synthesized
caatccatatttttatagctat

SEQ ID NO: 860536 - DNA, 22 bp, Artificial Sequence
  chemically synthesized
ttacaatccatatttttatagc

SEQ ID NO: 860537 - DNA, 22 bp, Artificial Sequence
  chemically synthesized
attgttacaatccatattttta

SEQ ID NO: 860538 - DNA, 22 bp, Artificial Sequence
  chemically synthesized
gattgttacaatccatattttt

SEQ ID NO: 860539 - DNA, 22 bp, Artificial Sequence
  chemically synthesized
gatatagctataaaaatatgga

SEQ ID NO: 860540 - DNA, 22 bp, Artificial Sequence
  chemically synthesized
atatagctataaaaatatggat

SEQ ID NO: 860541 - DNA, 22 bp, Artificial Sequence
  chemically synthesized
taaaaatatggattgtaacaat

SEQ ID NO: 860542 - DNA, 22 bp, Artificial Sequence
  chemically synthesized
tgagtggatgccagatgcgctt

SEQ ID NO: 860543 - DNA, 22 bp, Artificial Sequence
  chemically synthesized
taacaatcaagcgcatctggca

SEQ ID NO: 860544 - DNA, 22 bp, Artificial Sequence
  chemically synthesized
agttgtgagtggatgccagatg

SEQ ID NO: 860545 - DNA, 22 bp, Artificial Sequence
  chemically synthesized
aagttgtgagtggatgccagat

SEQ ID NO: 860546 - DNA, 22 bp, Artificial Sequence
  chemically synthesized
aagggtaatatttaagttgtga

SEQ ID NO: 860547 - DNA, 22 bp, Artificial Sequence
  chemically synthesized
tcaagggtaatatttaagttgt

SEQ ID NO: 860548 - DNA, 22 bp, Artificial Sequence
  chemically synthesized
ctcaagggtaatatttaagttg

SEQ ID NO: 860549 - DNA, 22 bp, Artificial Sequence
  chemically synthesized
gcatccactcacaacttaaata

SEQ ID NO: 860550 - DNA, 22 bp, Artificial Sequence
  chemically synthesized
gagatatttctcaagggtaata

SEQ ID NO: 860551 - DNA, 22 bp, Artificial Sequence
  chemically synthesized
acaacttaaatattacccttga

SEQ ID NO: 860552 - DNA, 22 bp, Artificial Sequence
  chemically synthesized
aaatattacccttgagaaatat

SEQ ID NO: 860553 - DNA, 22 bp, Artificial Sequence
  chemically synthesized
aatattacccttgagaaatatc

SEQ ID NO: 860554 - DNA, 22 bp, Artificial Sequence
  chemically synthesized
aagtcaggttggagatatttct

SEQ ID NO: 860555 - DNA, 22 bp, Artificial Sequence
  chemically synthesized
aaagtcaggttggagatatttc

SEQ ID NO: 860556 - DNA, 22 bp, Artificial Sequence
  chemically synthesized
cccttgagaaatatctccaacc

SEQ ID NO: 860557 - DNA, 22 bp, Artificial Sequence
  chemically synthesized
gagaaatatctccaacctgact

SEQ ID NO: 860558 - DNA, 22 bp, Artificial Sequence
  chemically synthesized
agaaatatctccaacctgactt

SEQ ID NO: 860559 - DNA, 22 bp, Artificial Sequence
  chemically synthesized
gtgaaggaaggatatgtttaaa

SEQ ID NO: 860560 - DNA, 22 bp, Artificial Sequence
  chemically synthesized
caacctgactttaaacatatcc

SEQ ID NO: 860561 - DNA, 22 bp, Artificial Sequence
  chemically synthesized
aagttagtgaaggaaggatatg

SEQ ID NO: 860562 - DNA, 22 bp, Artificial Sequence
  chemically synthesized
ttcaagttagtgaaggaaggat

SEQ ID NO: 860563 - DNA, 22 bp, Artificial Sequence
  chemically synthesized
actttaaacatatccttccttc

SEQ ID NO: 860564 - DNA, 22 bp, Artificial Sequence
  chemically synthesized
tattcaagttagtgaaggaagg

SEQ ID NO: 860565 - DNA, 22 bp, Artificial Sequence
  chemically synthesized
tctattcaagttagtgaaggaa

SEQ ID NO: 860566 - DNA, 22 bp, Artificial Sequence
  chemically synthesized
taaacatatccttccttcacta

SEQ ID NO: 860567 - DNA, 22 bp, Artificial Sequence
  chemically synthesized
ctctattcaagttagtgaagga

SEQ ID NO: 860568 - DNA, 22 bp, Artificial Sequence
  chemically synthesized
aaacatatccttccttcactaa

SEQ ID NO: 860569 - DNA, 22 bp, Artificial Sequence
  chemically synthesized
aacatatccttccttcactaac

SEQ ID NO: 860570 - DNA, 22 bp, Artificial Sequence
  chemically synthesized
tttctctattcaagttagtgaa

SEQ ID NO: 860571 - DNA, 22 bp, Artificial Sequence
  chemically synthesized
ccttcactaacttgaatagaga

SEQ ID NO: 860572 - DNA, 22 bp, Artificial Sequence
  chemically synthesized
cttcactaacttgaatagagaa

SEQ ID NO: 860573 - DNA, 22 bp, Artificial Sequence
  chemically synthesized
cactaacttgaatagagaaata

SEQ ID NO: 860574 - DNA, 22 bp, Artificial Sequence
  chemically synthesized
actaacttgaatagagaaataa

SEQ ID NO: 860575 - DNA, 22 bp, Artificial Sequence
  chemically synthesized
acttgaatagagaaataatcat

SEQ ID NO: 860576 - DNA, 22 bp, Artificial Sequence
  chemically synthesized
aaacaggaaaaggcaatgatta

SEQ ID NO: 860577 - DNA, 22 bp, Artificial Sequence
  chemically synthesized
gaatagagaaataatcattgcc

SEQ ID NO: 860578 - DNA, 22 bp, Artificial Sequence
  chemically synthesized
aatagagaaataatcattgcct

SEQ ID NO: 860579 - DNA, 22 bp, Artificial Sequence
  chemically synthesized
gatgatgccaactaaaacagga

SEQ ID NO: 860580 - DNA, 22 bp, Artificial Sequence
  chemically synthesized
agatgatgccaactaaaacagg

SEQ ID NO: 860581 - DNA, 22 bp, Artificial Sequence
  chemically synthesized
ccttttcctgttttagttggca

SEQ ID NO: 860582 - DNA, 22 bp, Artificial Sequence
  chemically synthesized
ttcctgttttagttggcatcat

SEQ ID NO: 860583 - DNA, 22 bp, Artificial Sequence
  chemically synthesized
tcctgttttagttggcatcatc

SEQ ID NO: 860584 - DNA, 22 bp, Artificial Sequence
  chemically synthesized
cctgttttagttggcatcatct

SEQ ID NO: 860585 - DNA, 22 bp, Artificial Sequence
  chemically synthesized
ctgttttagttggcatcatcta

SEQ ID NO: 860586 - DNA, 22 bp, Artificial Sequence
  chemically synthesized
tagaagggcacttagatgatgc

SEQ ID NO: 860587 - DNA, 22 bp, Artificial Sequence
  chemically synthesized
ttttagttggcatcatctaagt

SEQ ID NO: 860588 - DNA, 22 bp, Artificial Sequence
  chemically synthesized
gttatagaagggcacttagatg

SEQ ID NO: 860589 - DNA, 22 bp, Artificial Sequence
  chemically synthesized
tagttggcatcatctaagtgcc

SEQ ID NO: 860590 - DNA, 22 bp, Artificial Sequence
  chemically synthesized
agttggcatcatctaagtgccc

SEQ ID NO: 860591 - DNA, 22 bp, Artificial Sequence
  chemically synthesized
gttggcatcatctaagtgccct

SEQ ID NO: 860592 - DNA, 22 bp, Artificial Sequence
  chemically synthesized
gcatcatctaagtgcccttcta

SEQ ID NO: 860593 - DNA, 22 bp, Artificial Sequence
  chemically synthesized
atataatgttagttatagaagg

SEQ ID NO: 860594 - DNA, 22 bp, Artificial Sequence
  chemically synthesized
agtgcccttctataactaacat

SEQ ID NO: 860595 - DNA, 22 bp, Artificial Sequence
  chemically synthesized
ctataactaacattatatgaat

SEQ ID NO: 860596 - DNA, 22 bp, Artificial Sequence
  chemically synthesized
tataactaacattatatgaatt

SEQ ID NO: 860597 - DNA, 22 bp, Artificial Sequence
  chemically synthesized
taactaacattatatgaattca

SEQ ID NO: 860598 - DNA, 22 bp, Artificial Sequence
  chemically synthesized
agcgcatgtagatgaattcata

SEQ ID NO: 860599 - DNA, 22 bp, Artificial Sequence
  chemically synthesized
actgagcgcatgtagatgaatt

SEQ ID NO: 860600 - DNA, 22 bp, Artificial Sequence
  chemically synthesized
cactgagcgcatgtagatgaat

SEQ ID NO: 860601 - DNA, 22 bp, Artificial Sequence
  chemically synthesized
acattatatgaattcatctaca

SEQ ID NO: 860602 - DNA, 22 bp, Artificial Sequence
  chemically synthesized
tcactgagcgcatgtagatgaa

SEQ ID NO: 860603 - DNA, 22 bp, Artificial Sequence
  chemically synthesized
ttcactgagcgcatgtagatga

SEQ ID NO: 860604 - DNA, 22 bp, Artificial Sequence
  chemically synthesized
cttttcactgagcgcatgtaga

SEQ ID NO: 860605 - DNA, 22 bp, Artificial Sequence
  chemically synthesized
tatgaattcatctacatgcgct

SEQ ID NO: 860606 - DNA, 22 bp, Artificial Sequence
  chemically synthesized
agaaaccctgcttttcactgag

SEQ ID NO: 860607 - DNA, 22 bp, Artificial Sequence
  chemically synthesized
atctacatgcgctcagtgaaaa

SEQ ID NO: 860608 - DNA, 22 bp, Artificial Sequence
  chemically synthesized
catgcgctcagtgaaaagcagg

SEQ ID NO: 860609 - DNA, 22 bp, Artificial Sequence
  chemically synthesized
agattgagaaaccctgcttttc

SEQ ID NO: 860610 - DNA, 22 bp, Artificial Sequence
  chemically synthesized
agtgaaaagcagggtttctcaa

SEQ ID NO: 860611 - DNA, 22 bp, Artificial Sequence
  chemically synthesized
ggacaaaaatgtcaatagtgct

SEQ ID NO: 860612 - DNA, 22 bp, Artificial Sequence
  chemically synthesized
ctcaatctcagcactattgaca

SEQ ID NO: 860613 - DNA, 22 bp, Artificial Sequence
  chemically synthesized
tcaatctcagcactattgacat

SEQ ID NO: 860614 - DNA, 22 bp, Artificial Sequence
  chemically synthesized
tctgggacaaaaatgtcaatag

SEQ ID NO: 860615 - DNA, 22 bp, Artificial Sequence
  chemically synthesized
aatctcagcactattgacattt

SEQ ID NO: 860616 - DNA, 22 bp, Artificial Sequence
  chemically synthesized
agcactattgacatttttgtcc

SEQ ID NO: 860617 - DNA, 22 bp, Artificial Sequence
  chemically synthesized
acgacaaaaaattatctgggac

SEQ ID NO: 860618 - DNA, 22 bp, Artificial Sequence
  chemically synthesized
ttgacatttttgtcccagataa

SEQ ID NO: 860619 - DNA, 22 bp, Artificial Sequence
  chemically synthesized
acatttttgtcccagataattt

SEQ ID NO: 860620 - DNA, 22 bp, Artificial Sequence
  chemically synthesized
ttgtcccagataattttttgtc

SEQ ID NO: 860621 - DNA, 22 bp, Artificial Sequence
  chemically synthesized
tgtcccagataattttttgtcg

SEQ ID NO: 860622 - DNA, 22 bp, Artificial Sequence
  chemically synthesized
gtcccagataattttttgtcgt

SEQ ID NO: 860623 - DNA, 22 bp, Artificial Sequence
  chemically synthesized
tcccagataattttttgtcgtg

SEQ ID NO: 860624 - DNA, 22 bp, Artificial Sequence
  chemically synthesized
caatgcacaggacagccactca

SEQ ID NO: 860625 - DNA, 22 bp, Artificial Sequence
  chemically synthesized
tttgtcgtgagtggctgtcctg

SEQ ID NO: 860626 - DNA, 22 bp, Artificial Sequence
  chemically synthesized
ttgtcgtgagtggctgtcctgt

SEQ ID NO: 860627 - DNA, 22 bp, Artificial Sequence
  chemically synthesized
atcctacaatgcacaggacagc

SEQ ID NO: 860628 - DNA, 22 bp, Artificial Sequence
  chemically synthesized
tgtcgtgagtggctgtcctgtg

SEQ ID NO: 860629 - DNA, 22 bp, Artificial Sequence
  chemically synthesized
gtcgtgagtggctgtcctgtgc

SEQ ID NO: 860630 - DNA, 22 bp, Artificial Sequence
  chemically synthesized
tgatcctacaatgcacaggaca

SEQ ID NO: 860631 - DNA, 22 bp, Artificial Sequence
  chemically synthesized
tcgtgagtggctgtcctgtgca

SEQ ID NO: 860632 - DNA, 22 bp, Artificial Sequence
  chemically synthesized
acaagcaattctgatcctacaa

SEQ ID NO: 860633 - DNA, 22 bp, Artificial Sequence
  chemically synthesized
tcctgtgcattgtaggatcaga

SEQ ID NO: 860634 - DNA, 22 bp, Artificial Sequence
  chemically synthesized
tgcattgtaggatcagaattgc

SEQ ID NO: 860635 - DNA, 22 bp, Artificial Sequence
  chemically synthesized
gccagagatactgacaagcaat

SEQ ID NO: 860636 - DNA, 22 bp, Artificial Sequence
  chemically synthesized
taggatcagaattgcttgtcag

SEQ ID NO: 860637 - DNA, 22 bp, Artificial Sequence
  chemically synthesized
tggccagagatactgacaagca

SEQ ID NO: 860638 - DNA, 22 bp, Artificial Sequence
  chemically synthesized
ggagggagctctggccagagat

SEQ ID NO: 860639 - DNA, 22 bp, Artificial Sequence
  chemically synthesized
cttgtcagtatctctggccaga

SEQ ID NO: 860640 - DNA, 22 bp, Artificial Sequence
  chemically synthesized
gtcagtatctctggccagagct

SEQ ID NO: 860641 - DNA, 22 bp, Artificial Sequence
  chemically synthesized
tcagtatctctggccagagctc

SEQ ID NO: 860642 - DNA, 22 bp, Artificial Sequence
  chemically synthesized
tacatctaggagggagctctgg

SEQ ID NO: 860643 - DNA, 22 bp, Artificial Sequence
  chemically synthesized
gttgtacatctaggagggagct

SEQ ID NO: 860644 - DNA, 22 bp, Artificial Sequence
  chemically synthesized
ggttgtacatctaggagggagc

SEQ ID NO: 860645 - DNA, 22 bp, Artificial Sequence
  chemically synthesized
tggttgtacatctaggagggag

SEQ ID NO: 860646 - DNA, 22 bp, Artificial Sequence
  chemically synthesized
ttggttgtacatctaggaggga

SEQ ID NO: 860647 - DNA, 22 bp, Artificial Sequence
  chemically synthesized
tggccagagctccctcctagat

SEQ ID NO: 860648 - DNA, 22 bp, Artificial Sequence
  chemically synthesized
gccagagctccctcctagatgt

SEQ ID NO: 860649 - DNA, 22 bp, Artificial Sequence
  chemically synthesized
cctcctagatgtacaaccaaaa

SEQ ID NO: 860650 - DNA, 22 bp, Artificial Sequence
  chemically synthesized
ctagatgtacaaccaaaaatgt

SEQ ID NO: 860651 - DNA, 22 bp, Artificial Sequence
  chemically synthesized
gtaatgtcaggagacatttttg

SEQ ID NO: 860652 - DNA, 22 bp, Artificial Sequence
  chemically synthesized
ggtaatgtcaggagacattttt

SEQ ID NO: 860653 - DNA, 22 bp, Artificial Sequence
  chemically synthesized
gatgtacaaccaaaaatgtctc

SEQ ID NO: 860654 - DNA, 22 bp, Artificial Sequence
  chemically synthesized
aggagacatttggtaatgtcag

SEQ ID NO: 860655 - DNA, 22 bp, Artificial Sequence
  chemically synthesized
ctcaggagacatttggtaatgt

SEQ ID NO: 860656 - DNA, 22 bp, Artificial Sequence
  chemically synthesized
cctcaggagacatttggtaatg

SEQ ID NO: 860657 - DNA, 22 bp, Artificial Sequence
  chemically synthesized
tcctcaggagacatttggtaat

SEQ ID NO: 860658 - DNA, 22 bp, Artificial Sequence
  chemically synthesized
tttcctcaggagacatttggta

SEQ ID NO: 860659 - DNA, 22 bp, Artificial Sequence
  chemically synthesized
ctttcctcaggagacatttggt

SEQ ID NO: 860660 - DNA, 22 bp, Artificial Sequence
  chemically synthesized
tctttcctcaggagacatttgg

SEQ ID NO: 860661 - DNA, 22 bp, Artificial Sequence
  chemically synthesized
ttctttcctcaggagacatttg

SEQ ID NO: 860662 - DNA, 22 bp, Artificial Sequence
  chemically synthesized
ctgacattaccaaatgtctcct

SEQ ID NO: 860663 - DNA, 22 bp, Artificial Sequence
  chemically synthesized
acattaccaaatgtctcctgag

SEQ ID NO: 860664 - DNA, 22 bp, Artificial Sequence
  chemically synthesized
ccaaatgtctcctgaggaaaga

SEQ ID NO: 860665 - DNA, 22 bp, Artificial Sequence
  chemically synthesized
aaccataagcaatttttctttc

SEQ ID NO: 860666 - DNA, 22 bp, Artificial Sequence
  chemically synthesized
ctgaggaaagaaaaattgctta

SEQ ID NO: 860667 - DNA, 22 bp, Artificial Sequence
  chemically synthesized
aggaaagaaaaattgcttatgg

SEQ ID NO: 860668 - DNA, 22 bp, Artificial Sequence
  chemically synthesized
agacatgctcaaccataagcaa

SEQ ID NO: 860669 - DNA, 22 bp, Artificial Sequence
  chemically synthesized
attgagacatgctcaaccataa

SEQ ID NO: 860670 - DNA, 22 bp, Artificial Sequence
  chemically synthesized
aattgagacatgctcaaccata

SEQ ID NO: 860671 - DNA, 22 bp, Artificial Sequence
  chemically synthesized
taattgagacatgctcaaccat

SEQ ID NO: 860672 - DNA, 22 bp, Artificial Sequence
  chemically synthesized
ttaattgagacatgctcaacca

SEQ ID NO: 860673 - DNA, 22 bp, Artificial Sequence
  chemically synthesized
cttatggttgagcatgtctcaa

SEQ ID NO: 860674 - DNA, 22 bp, Artificial Sequence
  chemically synthesized
atggttgagcatgtctcaatta

SEQ ID NO: 860675 - DNA, 22 bp, Artificial Sequence
  chemically synthesized
tggttgagcatgtctcaattaa

SEQ ID NO: 860676 - DNA, 22 bp, Artificial Sequence
  chemically synthesized
agcatgtctcaattaaaaggat

SEQ ID NO: 860677 - DNA, 22 bp, Artificial Sequence
  chemically synthesized
aattaaaaggattttccatctc

SEQ ID NO: 860678 - DNA, 22 bp, Artificial Sequence
  chemically synthesized
aaaggattttccatctctccct

SEQ ID NO: 860679 - DNA, 22 bp, Artificial Sequence
  chemically synthesized
agaggtgggtgggtagggagag

SEQ ID NO: 860680 - DNA, 22 bp, Artificial Sequence
  chemically synthesized
gagaggtgggtgggtagggaga

SEQ ID NO: 860681 - DNA, 22 bp, Artificial Sequence
  chemically synthesized
tttgagaggtgggtgggtaggg

SEQ ID NO: 860682 - DNA, 22 bp, Artificial Sequence
  chemically synthesized
tccatctctccctacccaccca

SEQ ID NO: 860683 - DNA, 22 bp, Artificial Sequence
  chemically synthesized
ccatctctccctacccacccac

SEQ ID NO: 860684 - DNA, 22 bp, Artificial Sequence
  chemically synthesized
catctctccctacccacccacc

SEQ ID NO: 860685 - DNA, 22 bp, Artificial Sequence
  chemically synthesized
agcagctatttgagaggtgggt

SEQ ID NO: 860686 - DNA, 22 bp, Artificial Sequence
  chemically synthesized
taagcagctatttgagaggtgg

SEQ ID NO: 860687 - DNA, 22 bp, Artificial Sequence
  chemically synthesized
tccctacccacccacctctcaa

SEQ ID NO: 860688 - DNA, 22 bp, Artificial Sequence
  chemically synthesized
cctacccacccacctctcaaat

SEQ ID NO: 860689 - DNA, 22 bp, Artificial Sequence
  chemically synthesized
cccacccacctctcaaatagct

SEQ ID NO: 860690 - DNA, 22 bp, Artificial Sequence
  chemically synthesized
cagcacaaattctaagcagcta

SEQ ID NO: 860691 - DNA, 22 bp, Artificial Sequence
  chemically synthesized
ccagcacaaattctaagcagct

SEQ ID NO: 860692 - DNA, 22 bp, Artificial Sequence
  chemically synthesized
tcaaatagctgcttagaatttg

SEQ ID NO: 860693 - DNA, 22 bp, Artificial Sequence
  chemically synthesized
aaatagctgcttagaatttgtg

SEQ ID NO: 860694 - DNA, 22 bp, Artificial Sequence
  chemically synthesized
cttagaatttgtgctggaaatc

SEQ ID NO: 860695 - DNA, 22 bp, Artificial Sequence
  chemically synthesized
gataggcataaatgatttccag

SEQ ID NO: 860696 - DNA, 22 bp, Artificial Sequence
  chemically synthesized
agaatttgtgctggaaatcatt

SEQ ID NO: 860697 - DNA, 22 bp, Artificial Sequence
  chemically synthesized
gaatttgtgctggaaatcattt

SEQ ID NO: 860698 - DNA, 22 bp, Artificial Sequence
  chemically synthesized
gtgctggaaatcatttatgcct

SEQ ID NO: 860699 - DNA, 22 bp, Artificial Sequence
  chemically synthesized
tgctggaaatcatttatgccta

SEQ ID NO: 860700 - DNA, 22 bp, Artificial Sequence
  chemically synthesized
gaaatcatttatgcctatccaa

SEQ ID NO: 860701 - DNA, 22 bp, Artificial Sequence
  chemically synthesized
aggaatgagaaaaaaaaaattg

SEQ ID NO: 860702 - DNA, 22 bp, Artificial Sequence
  chemically synthesized
tgaggaatgagaaaaaaaaaat

SEQ ID NO: 860703 - DNA, 22 bp, Artificial Sequence
  chemically synthesized
atgcctatccaatttttttttt

SEQ ID NO: 860704 - DNA, 22 bp, Artificial Sequence
  chemically synthesized
ctgaggaatgagaaaaaaaaaa

SEQ ID NO: 860705 - DNA, 22 bp, Artificial Sequence
  chemically synthesized
tgcctatccaattttttttttc

SEQ ID NO: 860706 - DNA, 22 bp, Artificial Sequence
  chemically synthesized
cttctgaggaatgagaaaaaaa

SEQ ID NO: 860707 - DNA, 22 bp, Artificial Sequence
  chemically synthesized
tacttctgaggaatgagaaaaa

SEQ ID NO: 860708 - DNA, 22 bp, Artificial Sequence
  chemically synthesized
ctacttctgaggaatgagaaaa

SEQ ID NO: 860709 - DNA, 22 bp, Artificial Sequence
  chemically synthesized
tccaattttttttttctcattc

SEQ ID NO: 860710 - DNA, 22 bp, Artificial Sequence
  chemically synthesized
atttctacttctgaggaatgag

SEQ ID NO: 860711 - DNA, 22 bp, Artificial Sequence
  chemically synthesized
aatttctacttctgaggaatga

SEQ ID NO: 860712 - DNA, 22 bp, Artificial Sequence
  chemically synthesized
ttaatttctacttctgaggaat

SEQ ID NO: 860713 - DNA, 22 bp, Artificial Sequence
  chemically synthesized
tttttttctcattcctcagaag

SEQ ID NO: 860714 - DNA, 22 bp, Artificial Sequence
  chemically synthesized
tcttaatttctacttctgagga

SEQ ID NO: 860715 - DNA, 22 bp, Artificial Sequence
  chemically synthesized
ttttttctcattcctcagaagt

SEQ ID NO: 860716 - DNA, 22 bp, Artificial Sequence
  chemically synthesized
ctcttaatttctacttctgagg

SEQ ID NO: 860717 - DNA, 22 bp, Artificial Sequence
  chemically synthesized
tttttctcattcctcagaagta

SEQ ID NO: 860718 - DNA, 22 bp, Artificial Sequence
  chemically synthesized
ttttctcattcctcagaagtag

SEQ ID NO: 860719 - DNA, 22 bp, Artificial Sequence
  chemically synthesized
tttctcattcctcagaagtaga

SEQ ID NO: 860720 - DNA, 22 bp, Artificial Sequence
  chemically synthesized
ttctcattcctcagaagtagaa

SEQ ID NO: 860721 - DNA, 22 bp, Artificial Sequence
  chemically synthesized
tctcattcctcagaagtagaaa

SEQ ID NO: 860722 - DNA, 22 bp, Artificial Sequence
  chemically synthesized
ctcattcctcagaagtagaaat

SEQ ID NO: 860723 - DNA, 22 bp, Artificial Sequence
  chemically synthesized
tcattcctcagaagtagaaatt

SEQ ID NO: 860724 - DNA, 22 bp, Artificial Sequence
  chemically synthesized
acaatttctcttaatttctact

SEQ ID NO: 860725 - DNA, 22 bp, Artificial Sequence
  chemically synthesized
aacaatttctcttaatttctac

SEQ ID NO: 860726 - DNA, 22 bp, Artificial Sequence
  chemically synthesized
attcctcagaagtagaaattaa

SEQ ID NO: 860727 - DNA, 22 bp, Artificial Sequence
  chemically synthesized
ctcagaagtagaaattaagaga

SEQ ID NO: 860728 - DNA, 22 bp, Artificial Sequence
  chemically synthesized
agaagtagaaattaagagaaat

SEQ ID NO: 860729 - DNA, 22 bp, Artificial Sequence
  chemically synthesized
gaaagagaagcccttaacaatt

SEQ ID NO: 860730 - DNA, 22 bp, Artificial Sequence
  chemically synthesized
agagaaattgttaagggcttct

SEQ ID NO: 860731 - DNA, 22 bp, Artificial Sequence
  chemically synthesized
cccaatatcatgttggaaagag

SEQ ID NO: 860732 - DNA, 22 bp, Artificial Sequence
  chemically synthesized
ttaagggcttctctttccaaca

SEQ ID NO: 860733 - DNA, 22 bp, Artificial Sequence
  chemically synthesized
agggcttctctttccaacatga

SEQ ID NO: 860734 - DNA, 22 bp, Artificial Sequence
  chemically synthesized
agtgcctgcccaatatcatgtt

SEQ ID NO: 860735 - DNA, 22 bp, Artificial Sequence
  chemically synthesized
cagtgcctgcccaatatcatgt

SEQ ID NO: 860736 - DNA, 22 bp, Artificial Sequence
  chemically synthesized
ctctttccaacatgatattggg

SEQ ID NO: 860737 - DNA, 22 bp, Artificial Sequence
  chemically synthesized
tctttccaacatgatattgggc

SEQ ID NO: 860738 - DNA, 22 bp, Artificial Sequence
  chemically synthesized
tttccaacatgatattgggcag

SEQ ID NO: 860739 - DNA, 22 bp, Artificial Sequence
  chemically synthesized
tccaacatgatattgggcaggc

SEQ ID NO: 860740 - DNA, 22 bp, Artificial Sequence
  chemically synthesized
ccaacatgatattgggcaggca

SEQ ID NO: 860741 - DNA, 22 bp, Artificial Sequence
  chemically synthesized
tggatacttcagtgcctgccca

SEQ ID NO: 860742 - DNA, 22 bp, Artificial Sequence
  chemically synthesized
caacatgatattgggcaggcac

SEQ ID NO: 860743 - DNA, 22 bp, Artificial Sequence
  chemically synthesized
atggatacttcagtgcctgccc

SEQ ID NO: 860744 - DNA, 22 bp, Artificial Sequence
  chemically synthesized
cttatggatacttcagtgcctg

SEQ ID NO: 860745 - DNA, 22 bp, Artificial Sequence
  chemically synthesized
acttatggatacttcagtgcct

SEQ ID NO: 860746 - DNA, 22 bp, Artificial Sequence
  chemically synthesized
tggtttacttatggatacttca

SEQ ID NO: 860747 - DNA, 22 bp, Artificial Sequence
  chemically synthesized
gtggtttacttatggatacttc

SEQ ID NO: 860748 - DNA, 22 bp, Artificial Sequence
  chemically synthesized
ggcaggcactgaagtatccata

SEQ ID NO: 860749 - DNA, 22 bp, Artificial Sequence
  chemically synthesized
aagtatccataagtaaaccaca

SEQ ID NO: 860750 - DNA, 22 bp, Artificial Sequence
  chemically synthesized
gcagccataagtttgtggttta

SEQ ID NO: 860751 - DNA, 22 bp, Artificial Sequence
  chemically synthesized
ggcagccataagtttgtggttt

SEQ ID NO: 860752 - DNA, 22 bp, Artificial Sequence
  chemically synthesized
cttggcagccataagtttgtgg

SEQ ID NO: 860753 - DNA, 22 bp, Artificial Sequence
  chemically synthesized
ttccttggcagccataagtttg

SEQ ID NO: 860754 - DNA, 22 bp, Artificial Sequence
  chemically synthesized
ttattccttggcagccataagt

SEQ ID NO: 860755 - DNA, 22 bp, Artificial Sequence
  chemically synthesized
attattccttggcagccataag

SEQ ID NO: 860756 - DNA, 22 bp, Artificial Sequence
  chemically synthesized
tttattattccttggcagccat

SEQ ID NO: 860757 - DNA, 22 bp, Artificial Sequence
  chemically synthesized
tgtaatattatttattattcct

SEQ ID NO: 860758 - DNA, 22 bp, Artificial Sequence
  chemically synthesized
atggctgccaaggaataataaa

SEQ ID NO: 860759 - DNA, 22 bp, Artificial Sequence
  chemically synthesized
tggctgccaaggaataataaat

SEQ ID NO: 860760 - DNA, 22 bp, Artificial Sequence
  chemically synthesized
ctgtgtaatattatttattatt

SEQ ID NO: 860761 - DNA, 22 bp, Artificial Sequence
  chemically synthesized
ccaaggaataataaataatatt

SEQ ID NO: 860762 - DNA, 22 bp, Artificial Sequence
  chemically synthesized
agacagttcctgtgtaatatta

SEQ ID NO: 860763 - DNA, 22 bp, Artificial Sequence
  chemically synthesized
tcactaagacagttcctgtgta

SEQ ID NO: 860764 - DNA, 22 bp, Artificial Sequence
  chemically synthesized
gtcactaagacagttcctgtgt

SEQ ID NO: 860765 - DNA, 22 bp, Artificial Sequence
  chemically synthesized
tgtcactaagacagttcctgtg

SEQ ID NO: 860766 - DNA, 22 bp, Artificial Sequence
  chemically synthesized
ttgtcactaagacagttcctgt

SEQ ID NO: 860767 - DNA, 22 bp, Artificial Sequence
  chemically synthesized
tcatttttgtcactaagacagt

SEQ ID NO: 860768 - DNA, 22 bp, Artificial Sequence
  chemically synthesized
cacaggaactgtcttagtgaca

SEQ ID NO: 860769 - DNA, 22 bp, Artificial Sequence
  chemically synthesized
cagcagagatgttgtcattttt

SEQ ID NO: 860770 - DNA, 22 bp, Artificial Sequence
  chemically synthesized
tcttagtgacaaaaatgacaac

SEQ ID NO: 860771 - DNA, 22 bp, Artificial Sequence
  chemically synthesized
tccagcagagatgttgtcattt

SEQ ID NO: 860772 - DNA, 22 bp, Artificial Sequence
  chemically synthesized
ctctccagcagagatgttgtca

SEQ ID NO: 860773 - DNA, 22 bp, Artificial Sequence
  chemically synthesized
agtgacaaaaatgacaacatct

SEQ ID NO: 860774 - DNA, 22 bp, Artificial Sequence
  chemically synthesized
actctccagcagagatgttgtc

SEQ ID NO: 860775 - DNA, 22 bp, Artificial Sequence
  chemically synthesized
gtgacaaaaatgacaacatctc

SEQ ID NO: 860776 - DNA, 22 bp, Artificial Sequence
  chemically synthesized
tggacatttactctccagcaga

SEQ ID NO: 860777 - DNA, 22 bp, Artificial Sequence
  chemically synthesized
tgctggagagtaaatgtccaca

SEQ ID NO: 860778 - DNA, 22 bp, Artificial Sequence
  chemically synthesized
ctggagagtaaatgtccacaga

SEQ ID NO: 860779 - DNA, 22 bp, Artificial Sequence
  chemically synthesized
gagagtaaatgtccacagattc

SEQ ID NO: 860780 - DNA, 22 bp, Artificial Sequence
  chemically synthesized
acaaaagtgtagatgcaagagg

SEQ ID NO: 860781 - DNA, 22 bp, Artificial Sequence
  chemically synthesized
gacaaaagtgtagatgcaagag

SEQ ID NO: 860782 - DNA, 22 bp, Artificial Sequence
  chemically synthesized
ttgacaaaagtgtagatgcaag

SEQ ID NO: 860783 - DNA, 22 bp, Artificial Sequence
  chemically synthesized
tcctcttgcatctacacttttg

SEQ ID NO: 860784 - DNA, 22 bp, Artificial Sequence
  chemically synthesized
gaatatctcttgacaaaagtgt

SEQ ID NO: 860785 - DNA, 22 bp, Artificial Sequence
  chemically synthesized
ctcttgcatctacacttttgtc

SEQ ID NO: 860786 - DNA, 22 bp, Artificial Sequence
  chemically synthesized
ttgcatctacacttttgtcaag

SEQ ID NO: 860787 - DNA, 22 bp, Artificial Sequence
  chemically synthesized
gcatctacacttttgtcaagag

SEQ ID NO: 860788 - DNA, 22 bp, Artificial Sequence
  chemically synthesized
catctacacttttgtcaagaga

SEQ ID NO: 860789 - DNA, 22 bp, Artificial Sequence
  chemically synthesized
cacttttgtcaagagatattcc

SEQ ID NO: 860790 - DNA, 22 bp, Artificial Sequence
  chemically synthesized
atgggagaatctggaatatctc

SEQ ID NO: 860791 - DNA, 22 bp, Artificial Sequence
  chemically synthesized
aatgggagaatctggaatatct

SEQ ID NO: 860792 - DNA, 22 bp, Artificial Sequence
  chemically synthesized
ttaatgggagaatctggaatat

SEQ ID NO: 860793 - DNA, 22 bp, Artificial Sequence
  chemically synthesized
ttgtcaagagatattccagatt

SEQ ID NO: 860794 - DNA, 22 bp, Artificial Sequence
  chemically synthesized
tgtcaagagatattccagattc

SEQ ID NO: 860795 - DNA, 22 bp, Artificial Sequence
  chemically synthesized
gtcaagagatattccagattct

SEQ ID NO: 860796 - DNA, 22 bp, Artificial Sequence
  chemically synthesized
tcaagagatattccagattctc

SEQ ID NO: 860797 - DNA, 22 bp, Artificial Sequence
  chemically synthesized
tggctcttaatgggagaatctg

SEQ ID NO: 860798 - DNA, 22 bp, Artificial Sequence
  chemically synthesized
cagattctcccattaagagcca

SEQ ID NO: 860799 - DNA, 22 bp, Artificial Sequence
  chemically synthesized
tcccattaagagccatagtctg

SEQ ID NO: 860800 - DNA, 22 bp, Artificial Sequence
  chemically synthesized
ccattaagagccatagtctgtt

SEQ ID NO: 860801 - DNA, 22 bp, Artificial Sequence
  chemically synthesized
aaggagtggagaaacagactat

SEQ ID NO: 860802 - DNA, 22 bp, Artificial Sequence
  chemically synthesized
agagccatagtctgtttctcca

SEQ ID NO: 860803 - DNA, 22 bp, Artificial Sequence
  chemically synthesized
accaatccatattcaaggagtg

SEQ ID NO: 860804 - DNA, 22 bp, Artificial Sequence
  chemically synthesized
gaccaatccatattcaaggagt

SEQ ID NO: 860805 - DNA, 22 bp, Artificial Sequence
  chemically synthesized
tttctccactccttgaatatgg

SEQ ID NO: 860806 - DNA, 22 bp, Artificial Sequence
  chemically synthesized
ctccactccttgaatatggatt

SEQ ID NO: 860807 - DNA, 22 bp, Artificial Sequence
  chemically synthesized
tccactccttgaatatggattg

SEQ ID NO: 860808 - DNA, 22 bp, Artificial Sequence
  chemically synthesized
cactccttgaatatggattggt

SEQ ID NO: 860809 - DNA, 22 bp, Artificial Sequence
  chemically synthesized
cttgaatatggattggtcaagt

SEQ ID NO: 860810 - DNA, 22 bp, Artificial Sequence
  chemically synthesized
gccgaaacaagtgacttgacca

SEQ ID NO: 860811 - DNA, 22 bp, Artificial Sequence
  chemically synthesized
gaatatggattggtcaagtcac

SEQ ID NO: 860812 - DNA, 22 bp, Artificial Sequence
  chemically synthesized
aatatggattggtcaagtcact

SEQ ID NO: 860813 - DNA, 22 bp, Artificial Sequence
  chemically synthesized
attagccgaaacaagtgacttg

SEQ ID NO: 860814 - DNA, 22 bp, Artificial Sequence
  chemically synthesized
atacctcattagccgaaacaag

SEQ ID NO: 860815 - DNA, 22 bp, Artificial Sequence
  chemically synthesized
gtcaagtcacttgtttcggcta

SEQ ID NO: 860816 - DNA, 22 bp, Artificial Sequence
  chemically synthesized
ctgatacctcattagccgaaac

SEQ ID NO: 860817 - DNA, 22 bp, Artificial Sequence
  chemically synthesized
gctgatacctcattagccgaaa

SEQ ID NO: 860818 - DNA, 22 bp, Artificial Sequence
  chemically synthesized
tgtcatgtttgctgatacctca

SEQ ID NO: 860819 - DNA, 22 bp, Artificial Sequence
  chemically synthesized
gtttcggctaatgaggtatcag

SEQ ID NO: 860820 - DNA, 22 bp, Artificial Sequence
  chemically synthesized
atgtcatgtttgctgatacctc

SEQ ID NO: 860821 - DNA, 22 bp, Artificial Sequence
  chemically synthesized
tttcggctaatgaggtatcagc

SEQ ID NO: 860822 - DNA, 22 bp, Artificial Sequence
  chemically synthesized
cttatgtcatgtttgctgatac

SEQ ID NO: 860823 - DNA, 22 bp, Artificial Sequence
  chemically synthesized
cggctaatgaggtatcagcaaa

SEQ ID NO: 860824 - DNA, 22 bp, Artificial Sequence
  chemically synthesized
ggctaatgaggtatcagcaaac

SEQ ID NO: 860825 - DNA, 22 bp, Artificial Sequence
  chemically synthesized
tgcttatgtcatgtttgctgat

SEQ ID NO: 860826 - DNA, 22 bp, Artificial Sequence
  chemically synthesized
atgaggtatcagcaaacatgac

SEQ ID NO: 860827 - DNA, 22 bp, Artificial Sequence
  chemically synthesized
agcctctgcttatgtcatgttt

SEQ ID NO: 860828 - DNA, 22 bp, Artificial Sequence
  chemically synthesized
ttaagcctctgcttatgtcatg

SEQ ID NO: 860829 - DNA, 22 bp, Artificial Sequence
  chemically synthesized
caagcatagcccaacacccaag

SEQ ID NO: 860830 - DNA, 22 bp, Artificial Sequence
  chemically synthesized
aacaatgcttgggtgttgggct

SEQ ID NO: 860831 - DNA, 22 bp, Artificial Sequence
  chemically synthesized
acaatgcttgggtgttgggcta

SEQ ID NO: 860832 - DNA, 22 bp, Artificial Sequence
  chemically synthesized
gggtgttgggctatgcttggaa

SEQ ID NO: 860833 - DNA, 22 bp, Artificial Sequence
  chemically synthesized
ggtgttgggctatgcttggaac

SEQ ID NO: 860834 - DNA, 22 bp, Artificial Sequence
  chemically synthesized
catagcggtggaagagttccaa

SEQ ID NO: 860835 - DNA, 22 bp, Artificial Sequence
  chemically synthesized
ggctatgcttggaactcttcca

SEQ ID NO: 860836 - DNA, 22 bp, Artificial Sequence
  chemically synthesized
tgcttggaactcttccaccgct

SEQ ID NO: 860837 - DNA, 22 bp, Artificial Sequence
  chemically synthesized
gcatagttccatagcggtggaa

SEQ ID NO: 860838 - DNA, 22 bp, Artificial Sequence
  chemically synthesized
ggaactcttccaccgctatgga

SEQ ID NO: 860839 - DNA, 22 bp, Artificial Sequence
  chemically synthesized
gaactcttccaccgctatggaa

SEQ ID NO: 860840 - DNA, 22 bp, Artificial Sequence
  chemically synthesized
atcaggctagcatagttccata

SEQ ID NO: 860841 - DNA, 22 bp, Artificial Sequence
  chemically synthesized
ttccaccgctatggaactatgc

SEQ ID NO: 860842 - DNA, 22 bp, Artificial Sequence
  chemically synthesized
ttcatcaggctagcatagttcc

SEQ ID NO: 860843 - DNA, 22 bp, Artificial Sequence
  chemically synthesized
ccaccgctatggaactatgcta

SEQ ID NO: 860844 - DNA, 22 bp, Artificial Sequence
  chemically synthesized
caccgctatggaactatgctag

SEQ ID NO: 860845 - DNA, 22 bp, Artificial Sequence
  chemically synthesized
taattattcatcaggctagcat

SEQ ID NO: 860846 - DNA, 22 bp, Artificial Sequence
  chemically synthesized
cctgtaattattcatcaggcta

SEQ ID NO: 860847 - DNA, 22 bp, Artificial Sequence
  chemically synthesized
tggaactatgctagcctgatga

SEQ ID NO: 860848 - DNA, 22 bp, Artificial Sequence
  chemically synthesized
gcctgtaattattcatcaggct

SEQ ID NO: 860849 - DNA, 22 bp, Artificial Sequence
  chemically synthesized
tgctagcctgatgaataattac

SEQ ID NO: 860850 - DNA, 22 bp, Artificial Sequence
  chemically synthesized
gcctgatgaataattacaggca

SEQ ID NO: 860851 - DNA, 22 bp, Artificial Sequence
  chemically synthesized
atgaataattacaggcaagtga

SEQ ID NO: 860852 - DNA, 22 bp, Artificial Sequence
  chemically synthesized
agacggtgtgggtgacaggatc

SEQ ID NO: 860853 - DNA, 22 bp, Artificial Sequence
  chemically synthesized
caggcaagtgatcctgtcaccc

SEQ ID NO: 860854 - DNA, 22 bp, Artificial Sequence
  chemically synthesized
taagttgagacggtgtgggtga

SEQ ID NO: 860855 - DNA, 22 bp, Artificial Sequence
  chemically synthesized
gttataagttgagacggtgtgg

SEQ ID NO: 860856 - DNA, 22 bp, Artificial Sequence
  chemically synthesized
ggttataagttgagacggtgtg

SEQ ID NO: 860857 - DNA, 22 bp, Artificial Sequence
  chemically synthesized
tggttataagttgagacggtgt

SEQ ID NO: 860858 - DNA, 22 bp, Artificial Sequence
  chemically synthesized
ttggttataagttgagacggtg

SEQ ID NO: 860859 - DNA, 22 bp, Artificial Sequence
  chemically synthesized
tttggttataagttgagacggt

SEQ ID NO: 860860 - DNA, 22 bp, Artificial Sequence
  chemically synthesized
tcacccacaccgtctcaactta

SEQ ID NO: 860861 - DNA, 22 bp, Artificial Sequence
  chemically synthesized
gtataactttttggttataagt

SEQ ID NO: 860862 - DNA, 22 bp, Artificial Sequence
  chemically synthesized
atatgtctggtataactttttg

SEQ ID NO: 860863 - DNA, 22 bp, Artificial Sequence
  chemically synthesized
aacttataaccaaaaagttata

SEQ ID NO: 860864 - DNA, 22 bp, Artificial Sequence
  chemically synthesized
ataaccaaaaagttataccaga

SEQ ID NO: 860865 - DNA, 22 bp, Artificial Sequence
  chemically synthesized
taaccaaaaagttataccagac

SEQ ID NO: 860866 - DNA, 22 bp, Artificial Sequence
  chemically synthesized
atgaccacatgtggcattcata

SEQ ID NO: 860867 - DNA, 22 bp, Artificial Sequence
  chemically synthesized
taccagacatatgaatgccaca

SEQ ID NO: 860868 - DNA, 22 bp, Artificial Sequence
  chemically synthesized
gtagttgatgaccacatgtggc

SEQ ID NO: 860869 - DNA, 22 bp, Artificial Sequence
  chemically synthesized
gtggtcagctggtagttgatga

SEQ ID NO: 860870 - DNA, 22 bp, Artificial Sequence
  chemically synthesized
atgcactcgtggtcagctggta

SEQ ID NO: 860871 - DNA, 22 bp, Artificial Sequence
  chemically synthesized
attcatgcactcgtggtcagct

SEQ ID NO: 860872 - DNA, 22 bp, Artificial Sequence
  chemically synthesized
tgctcattcatgcactcgtggt

SEQ ID NO: 860873 - DNA, 22 bp, Artificial Sequence
  chemically synthesized
ccagctgaccacgagtgcatga

SEQ ID NO: 860874 - DNA, 22 bp, Artificial Sequence
  chemically synthesized
agctgtgctcattcatgcactc

SEQ ID NO: 860875 - DNA, 22 bp, Artificial Sequence
  chemically synthesized
gactcagctgtgctcattcatg

SEQ ID NO: 860876 - DNA, 22 bp, Artificial Sequence
  chemically synthesized
accacgagtgcatgaatgagca

SEQ ID NO: 860877 - DNA, 22 bp, Artificial Sequence
  chemically synthesized
ctagactcagctgtgctcattc

SEQ ID NO: 860878 - DNA, 22 bp, Artificial Sequence
  chemically synthesized
gctagactcagctgtgctcatt

SEQ ID NO: 860879 - DNA, 22 bp, Artificial Sequence
  chemically synthesized
tgctagactcagctgtgctcat

SEQ ID NO: 860880 - DNA, 22 bp, Artificial Sequence
  chemically synthesized
ttgctagactcagctgtgctca

SEQ ID NO: 860881 - DNA, 22 bp, Artificial Sequence
  chemically synthesized
ttttgctagactcagctgtgct

SEQ ID NO: 860882 - DNA, 22 bp, Artificial Sequence
  chemically synthesized
atcgaggcgattcttttgctag

SEQ ID NO: 860883 - DNA, 22 bp, Artificial Sequence
  chemically synthesized
gttcatcgaggcgattcttttg

SEQ ID NO: 860884 - DNA, 22 bp, Artificial Sequence
  chemically synthesized
ggttcatcgaggcgattctttt

SEQ ID NO: 860885 - DNA, 22 bp, Artificial Sequence
  chemically synthesized
agtctagcaaaagaatcgcctc

SEQ ID NO: 860886 - DNA, 22 bp, Artificial Sequence
  chemically synthesized
gggcttggttcatcgaggcgat

SEQ ID NO: 860887 - DNA, 22 bp, Artificial Sequence
  chemically synthesized
ggggcttggttcatcgaggcga

SEQ ID NO: 860888 - DNA, 22 bp, Artificial Sequence
  chemically synthesized
gcaaaagaatcgcctcgatgaa

SEQ ID NO: 860889 - DNA, 22 bp, Artificial Sequence
  chemically synthesized
cttggggcttggttcatcgagg

SEQ ID NO: 860890 - DNA, 22 bp, Artificial Sequence
  chemically synthesized
tgcttggggcttggttcatcga

SEQ ID NO: 860891 - DNA, 22 bp, Artificial Sequence
  chemically synthesized
attctgcttggggcttggttca

SEQ ID NO: 860892 - DNA, 22 bp, Artificial Sequence
  chemically synthesized
gattctgcttggggcttggttc

SEQ ID NO: 860893 - DNA, 22 bp, Artificial Sequence
  chemically synthesized
ttgattctgcttggggcttggt

SEQ ID NO: 860894 - DNA, 22 bp, Artificial Sequence
  chemically synthesized
gatgaaccaagccccaagcaga

SEQ ID NO: 860895 - DNA, 22 bp, Artificial Sequence
  chemically synthesized
atgattcttgattctgcttggg

SEQ ID NO: 860896 - DNA, 22 bp, Artificial Sequence
  chemically synthesized
gctcatgattcttgattctgct

SEQ ID NO: 860897 - DNA, 22 bp, Artificial Sequence
  chemically synthesized
agctcatgattcttgattctgc

SEQ ID NO: 860898 - DNA, 22 bp, Artificial Sequence
  chemically synthesized
tagctcatgattcttgattctg

SEQ ID NO: 860899 - DNA, 22 bp, Artificial Sequence
  chemically synthesized
ttagctcatgattcttgattct

SEQ ID NO: 860900 - DNA, 22 bp, Artificial Sequence
  chemically synthesized
tttagctcatgattcttgattc

SEQ ID NO: 860901 - DNA, 22 bp, Artificial Sequence
  chemically synthesized
ttttagctcatgattcttgatt

SEQ ID NO: 860902 - DNA, 22 bp, Artificial Sequence
  chemically synthesized
tttttagctcatgattcttgat

SEQ ID NO: 860903 - DNA, 22 bp, Artificial Sequence
  chemically synthesized
ttttttagctcatgattcttga

SEQ ID NO: 860904 - DNA, 22 bp, Artificial Sequence
  chemically synthesized
tttttttagctcatgattcttg

SEQ ID NO: 860905 - DNA, 22 bp, Artificial Sequence
  chemically synthesized
ttttttttagctcatgattctt

SEQ ID NO: 860906 - DNA, 22 bp, Artificial Sequence
  chemically synthesized
tttttttttagctcatgattct

SEQ ID NO: 860907 - DNA, 22 bp, Artificial Sequence
  chemically synthesized
aaataagaatcatttttttttt

SEQ ID NO: 860908 - DNA, 22 bp, Artificial Sequence
  chemically synthesized
aaaataagaatcattttttttt

SEQ ID NO: 860909 - DNA, 22 bp, Artificial Sequence
  chemically synthesized
aaaaaaaaaaatgattcttatt

SEQ ID NO: 860910 - DNA, 22 bp, Artificial Sequence
  chemically synthesized
ccccaaatgtagagacttaaaa

SEQ ID NO: 860911 - DNA, 22 bp, Artificial Sequence
  chemically synthesized
ttattttaagtctctacatttg

SEQ ID NO: 860912 - DNA, 22 bp, Artificial Sequence
  chemically synthesized
attttaagtctctacatttggg

SEQ ID NO: 860913 - DNA, 22 bp, Artificial Sequence
  chemically synthesized
ttttaagtctctacatttgggg

SEQ ID NO: 860914 - DNA, 22 bp, Artificial Sequence
  chemically synthesized
tgtaacaagctaccccaaatgt

SEQ ID NO: 860915 - DNA, 22 bp, Artificial Sequence
  chemically synthesized
taagtctctacatttggggtag

SEQ ID NO: 860916 - DNA, 22 bp, Artificial Sequence
  chemically synthesized
ctgtgtaacaagctaccccaaa

SEQ ID NO: 860917 - DNA, 22 bp, Artificial Sequence
  chemically synthesized
aagtctctacatttggggtagc

SEQ ID NO: 860918 - DNA, 22 bp, Artificial Sequence
  chemically synthesized
agtctctacatttggggtagct

SEQ ID NO: 860919 - DNA, 22 bp, Artificial Sequence
  chemically synthesized
ttgctgtgtaacaagctacccc

SEQ ID NO: 860920 - DNA, 22 bp, Artificial Sequence
  chemically synthesized
tctattgctgtgtaacaagcta

SEQ ID NO: 860921 - DNA, 22 bp, Artificial Sequence
  chemically synthesized
tacatttggggtagcttgttac

SEQ ID NO: 860922 - DNA, 22 bp, Artificial Sequence
  chemically synthesized
catttggggtagcttgttacac

SEQ ID NO: 860923 - DNA, 22 bp, Artificial Sequence
  chemically synthesized
ggggtagcttgttacacagcaa

SEQ ID NO: 860924 - DNA, 22 bp, Artificial Sequence
  chemically synthesized
gggtagcttgttacacagcaat

SEQ ID NO: 860925 - DNA, 22 bp, Artificial Sequence
  chemically synthesized
tgtcagctatctattgctgtgt

SEQ ID NO: 860926 - DNA, 22 bp, Artificial Sequence
  chemically synthesized
gttacacagcaatagatagctg

SEQ ID NO: 860927 - DNA, 22 bp, Artificial Sequence
  chemically synthesized
ttacacagcaatagatagctga

SEQ ID NO: 860928 - DNA, 22 bp, Artificial Sequence
  chemically synthesized
cacagcaatagatagctgacac

SEQ ID NO: 860929 - DNA, 22 bp, Artificial Sequence
  chemically synthesized
acaggtaaaaatggatgctgtg

SEQ ID NO: 860930 - DNA, 22 bp, Artificial Sequence
  chemically synthesized
aacaggtaaaaatggatgctgt

SEQ ID NO: 860931 - DNA, 22 bp, Artificial Sequence
  chemically synthesized
acacagcatccatttttacctg

SEQ ID NO: 860932 - DNA, 22 bp, Artificial Sequence
  chemically synthesized
cgtacaagtgtttaacaggtaa

SEQ ID NO: 860933 - DNA, 22 bp, Artificial Sequence
  chemically synthesized
gcgtacaagtgtttaacaggta

SEQ ID NO: 860934 - DNA, 22 bp, Artificial Sequence
  chemically synthesized
tgcgtacaagtgtttaacaggt

SEQ ID NO: 860935 - DNA, 22 bp, Artificial Sequence
  chemically synthesized
ttttgcgtacaagtgtttaaca

SEQ ID NO: 860936 - DNA, 22 bp, Artificial Sequence
  chemically synthesized
ttacctgttaaacacttgtacg

SEQ ID NO: 860937 - DNA, 22 bp, Artificial Sequence
  chemically synthesized
aatcctgttttgcgtacaagtg

SEQ ID NO: 860938 - DNA, 22 bp, Artificial Sequence
  chemically synthesized
tacctgttaaacacttgtacgc

SEQ ID NO: 860939 - DNA, 22 bp, Artificial Sequence
  chemically synthesized
aaatcctgttttgcgtacaagt

SEQ ID NO: 860940 - DNA, 22 bp, Artificial Sequence
  chemically synthesized
acctgttaaacacttgtacgca

SEQ ID NO: 860941 - DNA, 22 bp, Artificial Sequence
  chemically synthesized
taaatcctgttttgcgtacaag

SEQ ID NO: 860942 - DNA, 22 bp, Artificial Sequence
  chemically synthesized
cctgttaaacacttgtacgcaa

SEQ ID NO: 860943 - DNA, 22 bp, Artificial Sequence
  chemically synthesized
ttaaacacttgtacgcaaaaca

SEQ ID NO: 860944 - DNA, 22 bp, Artificial Sequence
  chemically synthesized
aacacttgtacgcaaaacagga

SEQ ID NO: 860945 - DNA, 22 bp, Artificial Sequence
  chemically synthesized
gtacgcaaaacaggatttaaaa

SEQ ID NO: 860946 - DNA, 22 bp, Artificial Sequence
  chemically synthesized
tacgcaaaacaggatttaaaat

SEQ ID NO: 860947 - DNA, 22 bp, Artificial Sequence
  chemically synthesized
tggtaatgggaagggaatttta

SEQ ID NO: 860948 - DNA, 22 bp, Artificial Sequence
  chemically synthesized
tgtggtaatgggaagggaattt

SEQ ID NO: 860949 - DNA, 22 bp, Artificial Sequence
  chemically synthesized
ctgtggtaatgggaagggaatt

SEQ ID NO: 860950 - DNA, 22 bp, Artificial Sequence
  chemically synthesized
atttctgtggtaatgggaaggg

SEQ ID NO: 860951 - DNA, 22 bp, Artificial Sequence
  chemically synthesized
aatttctgtggtaatgggaagg

SEQ ID NO: 860952 - DNA, 22 bp, Artificial Sequence
  chemically synthesized
taatttctgtggtaatgggaag

SEQ ID NO: 860953 - DNA, 22 bp, Artificial Sequence
  chemically synthesized
ttaatttctgtggtaatgggaa

SEQ ID NO: 860954 - DNA, 22 bp, Artificial Sequence
  chemically synthesized
ttttaatttctgtggtaatggg

SEQ ID NO: 860955 - DNA, 22 bp, Artificial Sequence
  chemically synthesized
aaaattcccttcccattaccac

SEQ ID NO: 860956 - DNA, 22 bp, Artificial Sequence
  chemically synthesized
cttttaatttctgtggtaatgg

SEQ ID NO: 860957 - DNA, 22 bp, Artificial Sequence
  chemically synthesized
aaattcccttcccattaccaca

SEQ ID NO: 860958 - DNA, 22 bp, Artificial Sequence
  chemically synthesized
tcttttaatttctgtggtaatg

SEQ ID NO: 860959 - DNA, 22 bp, Artificial Sequence
  chemically synthesized
ttcttttaatttctgtggtaat

SEQ ID NO: 860960 - DNA, 22 bp, Artificial Sequence
  chemically synthesized
ccttcccattaccacagaaatt

SEQ ID NO: 860961 - DNA, 22 bp, Artificial Sequence
  chemically synthesized
cccattaccacagaaattaaaa

SEQ ID NO: 860962 - DNA, 22 bp, Artificial Sequence
  chemically synthesized
ccattaccacagaaattaaaag

SEQ ID NO: 860963 - DNA, 22 bp, Artificial Sequence
  chemically synthesized
gataagcatttttcttttaatt

SEQ ID NO: 860964 - DNA, 22 bp, Artificial Sequence
  chemically synthesized
ctggataagcatttttctttta

SEQ ID NO: 860965 - DNA, 22 bp, Artificial Sequence
  chemically synthesized
ccacagaaattaaaagaaaaat

SEQ ID NO: 860966 - DNA, 22 bp, Artificial Sequence
  chemically synthesized
tgctggataagcatttttcttt

SEQ ID NO: 860967 - DNA, 22 bp, Artificial Sequence
  chemically synthesized
tctgctggataagcatttttct

SEQ ID NO: 860968 - DNA, 22 bp, Artificial Sequence
  chemically synthesized
tctctgctggataagcattttt

SEQ ID NO: 860969 - DNA, 22 bp, Artificial Sequence
  chemically synthesized
tgttctctctgctggataagca

SEQ ID NO: 860970 - DNA, 22 bp, Artificial Sequence
  chemically synthesized
aaagaaaaatgcttatccagca

SEQ ID NO: 860971 - DNA, 22 bp, Artificial Sequence
  chemically synthesized
cagctgtgttctctctgctgga

SEQ ID NO: 860972 - DNA, 22 bp, Artificial Sequence
  chemically synthesized
ccagctgtgttctctctgctgg

SEQ ID NO: 860973 - DNA, 22 bp, Artificial Sequence
  chemically synthesized
tccagctgtgttctctctgctg

SEQ ID NO: 860974 - DNA, 22 bp, Artificial Sequence
  chemically synthesized
ttccagctgtgttctctctgct

SEQ ID NO: 860975 - DNA, 22 bp, Artificial Sequence
  chemically synthesized
cgtcttttccagctgtgttctc

SEQ ID NO: 860976 - DNA, 22 bp, Artificial Sequence
  chemically synthesized
atccagcagagagaacacagct

SEQ ID NO: 860977 - DNA, 22 bp, Artificial Sequence
  chemically synthesized
tccagcagagagaacacagctg

SEQ ID NO: 860978 - DNA, 22 bp, Artificial Sequence
  chemically synthesized
aagactccgtcttttccagctg

SEQ ID NO: 860979 - DNA, 22 bp, Artificial Sequence
  chemically synthesized
aaagactccgtcttttccagct

SEQ ID NO: 860980 - DNA, 22 bp, Artificial Sequence
  chemically synthesized
acttaaagactccgtcttttcc

SEQ ID NO: 860981 - DNA, 22 bp, Artificial Sequence
  chemically synthesized
aacttaaagactccgtcttttc

SEQ ID NO: 860982 - DNA, 22 bp, Artificial Sequence
  chemically synthesized
taacttaaagactccgtctttt

SEQ ID NO: 860983 - DNA, 22 bp, Artificial Sequence
  chemically synthesized
cacattttaacttaaagactcc

SEQ ID NO: 860984 - DNA, 22 bp, Artificial Sequence
  chemically synthesized
gaaaagacggagtctttaagtt

SEQ ID NO: 860985 - DNA, 22 bp, Artificial Sequence
  chemically synthesized
cattccacattttaacttaaag

SEQ ID NO: 860986 - DNA, 22 bp, Artificial Sequence
  chemically synthesized
tggaattccattccacatttta

SEQ ID NO: 860987 - DNA, 22 bp, Artificial Sequence
  chemically synthesized
tgtggaattccattccacattt

SEQ ID NO: 860988 - DNA, 22 bp, Artificial Sequence
  chemically synthesized
tctgtggaattccattccacat

SEQ ID NO: 860989 - DNA, 22 bp, Artificial Sequence
  chemically synthesized
taagttaaaatgtggaatggaa

SEQ ID NO: 860990 - DNA, 22 bp, Artificial Sequence
  chemically synthesized
aagttaaaatgtggaatggaat

SEQ ID NO: 860991 - DNA, 22 bp, Artificial Sequence
  chemically synthesized
agttaaaatgtggaatggaatt

SEQ ID NO: 860992 - DNA, 22 bp, Artificial Sequence
  chemically synthesized
cattctctgtggaattccattc

SEQ ID NO: 860993 - DNA, 22 bp, Artificial Sequence
  chemically synthesized
ccattctctgtggaattccatt

SEQ ID NO: 860994 - DNA, 22 bp, Artificial Sequence
  chemically synthesized
aaatgtggaatggaattccaca

SEQ ID NO: 860995 - DNA, 22 bp, Artificial Sequence
  chemically synthesized
tgtgaatcttccattctctgtg

SEQ ID NO: 860996 - DNA, 22 bp, Artificial Sequence
  chemically synthesized
cacagagaatggaagattcaca

SEQ ID NO: 860997 - DNA, 22 bp, Artificial Sequence
  chemically synthesized
atagagtgactatgtgaatctt

SEQ ID NO: 860998 - DNA, 22 bp, Artificial Sequence
  chemically synthesized
acctcatagagtgactatgtga

SEQ ID NO: 860999 - DNA, 22 bp, Artificial Sequence
  chemically synthesized
ttgacctcatagagtgactatg

SEQ ID NO: 861000 - DNA, 22 bp, Artificial Sequence
  chemically synthesized
attgacctcatagagtgactat

SEQ ID NO: 861001 - DNA, 22 bp, Artificial Sequence
  chemically synthesized
atttattgacctcatagagtga

SEQ ID NO: 861002 - DNA, 22 bp, Artificial Sequence
  chemically synthesized
cctgatttattgacctcataga

SEQ ID NO: 861003 - DNA, 22 bp, Artificial Sequence
  chemically synthesized
acatagtcactctatgaggtca

SEQ ID NO: 861004 - DNA, 22 bp, Artificial Sequence
  chemically synthesized
gctgcctgatttattgacctca

SEQ ID NO: 861005 - DNA, 22 bp, Artificial Sequence
  chemically synthesized
tatgaggtcaataaatcaggca

SEQ ID NO: 861006 - DNA, 22 bp, Artificial Sequence
  chemically synthesized
tcaaatgctggctgcctgattt

SEQ ID NO: 861007 - DNA, 22 bp, Artificial Sequence
  chemically synthesized
tgaggtcaataaatcaggcagc

SEQ ID NO: 861008 - DNA, 22 bp, Artificial Sequence
  chemically synthesized
aaatatcctgtcaaatgctggc

SEQ ID NO: 861009 - DNA, 22 bp, Artificial Sequence
  chemically synthesized
caaatatcctgtcaaatgctgg

SEQ ID NO: 861010 - DNA, 22 bp, Artificial Sequence
  chemically synthesized
ttcaaatatcctgtcaaatgct

SEQ ID NO: 861011 - DNA, 22 bp, Artificial Sequence
  chemically synthesized
cttcaaatatcctgtcaaatgc

SEQ ID NO: 861012 - DNA, 22 bp, Artificial Sequence
  chemically synthesized
tcttcaaatatcctgtcaaatg

SEQ ID NO: 861013 - DNA, 22 bp, Artificial Sequence
  chemically synthesized
ctttcttcaaatatcctgtcaa

SEQ ID NO: 861014 - DNA, 22 bp, Artificial Sequence
  chemically synthesized
aaagtgttactttcttcaaata

SEQ ID NO: 861015 - DNA, 22 bp, Artificial Sequence
  chemically synthesized
ctaaaagtgttactttcttcaa

SEQ ID NO: 861016 - DNA, 22 bp, Artificial Sequence
  chemically synthesized
gacaggatatttgaagaaagta

SEQ ID NO: 861017 - DNA, 22 bp, Artificial Sequence
  chemically synthesized
tgctaaaagtgttactttcttc

SEQ ID NO: 861018 - DNA, 22 bp, Artificial Sequence
  chemically synthesized
acaggatatttgaagaaagtaa

SEQ ID NO: 861019 - DNA, 22 bp, Artificial Sequence
  chemically synthesized
ctgctaaaagtgttactttctt

SEQ ID NO: 861020 - DNA, 22 bp, Artificial Sequence
  chemically synthesized
gaagaaagtaacacttttagca

SEQ ID NO: 861021 - DNA, 22 bp, Artificial Sequence
  chemically synthesized
atagtgagtttctgctaaaagt

SEQ ID NO: 861022 - DNA, 22 bp, Artificial Sequence
  chemically synthesized
aagaaagtaacacttttagcag

SEQ ID NO: 861023 - DNA, 22 bp, Artificial Sequence
  chemically synthesized
gtgcattaatagtgagtttctg

SEQ ID NO: 861024 - DNA, 22 bp, Artificial Sequence
  chemically synthesized
agtgcattaatagtgagtttct

SEQ ID NO: 861025 - DNA, 22 bp, Artificial Sequence
  chemically synthesized
ttagcagaaactcactattaat

SEQ ID NO: 861026 - DNA, 22 bp, Artificial Sequence
  chemically synthesized
tagcagaaactcactattaatg

SEQ ID NO: 861027 - DNA, 22 bp, Artificial Sequence
  chemically synthesized
agcagaaactcactattaatgc

SEQ ID NO: 861028 - DNA, 22 bp, Artificial Sequence
  chemically synthesized
gcagaaactcactattaatgca

SEQ ID NO: 861029 - DNA, 22 bp, Artificial Sequence
  chemically synthesized
atatacaaaggtcttagtgcat

SEQ ID NO: 861030 - DNA, 22 bp, Artificial Sequence
  chemically synthesized
catatacaaaggtcttagtgca

SEQ ID NO: 861031 - DNA, 22 bp, Artificial Sequence
  chemically synthesized
tcatatacaaaggtcttagtgc

SEQ ID NO: 861032 - DNA, 22 bp, Artificial Sequence
  chemically synthesized
ttcatatacaaaggtcttagtg

SEQ ID NO: 861033 - DNA, 22 bp, Artificial Sequence
  chemically synthesized
tttcatatacaaaggtcttagt

SEQ ID NO: 861034 - DNA, 22 bp, Artificial Sequence
  chemically synthesized
actattaatgcactaagacctt

SEQ ID NO: 861035 - DNA, 22 bp, Artificial Sequence
  chemically synthesized
ttttcatatacaaaggtcttag

SEQ ID NO: 861036 - DNA, 22 bp, Artificial Sequence
  chemically synthesized
cttttttcatatacaaaggtct

SEQ ID NO: 861037 - DNA, 22 bp, Artificial Sequence
  chemically synthesized
ttaatgcactaagacctttgta

SEQ ID NO: 861038 - DNA, 22 bp, Artificial Sequence
  chemically synthesized
tacttttttcatatacaaaggt

SEQ ID NO: 861039 - DNA, 22 bp, Artificial Sequence
  chemically synthesized
atgcactaagacctttgtatat

SEQ ID NO: 861040 - DNA, 22 bp, Artificial Sequence
  chemically synthesized
catactctacttttttcatata

SEQ ID NO: 861041 - DNA, 22 bp, Artificial Sequence
  chemically synthesized
agacctttgtatatgaaaaaag

SEQ ID NO: 861042 - DNA, 22 bp, Artificial Sequence
  chemically synthesized
ttacatactctacttttttcat

SEQ ID NO: 861043 - DNA, 22 bp, Artificial Sequence
  chemically synthesized
ttattacatactctactttttt

SEQ ID NO: 861044 - DNA, 22 bp, Artificial Sequence
  chemically synthesized
attattacatactctacttttt

SEQ ID NO: 861045 - DNA, 22 bp, Artificial Sequence
  chemically synthesized
ttattattacatactctacttt

SEQ ID NO: 861046 - DNA, 22 bp, Artificial Sequence
  chemically synthesized
tgtatatgaaaaaagtagagta

SEQ ID NO: 861047 - DNA, 22 bp, Artificial Sequence
  chemically synthesized
gtatatgaaaaaagtagagtat

SEQ ID NO: 861048 - DNA, 22 bp, Artificial Sequence
  chemically synthesized
tatatgaaaaaagtagagtatg

SEQ ID NO: 861049 - DNA, 22 bp, Artificial Sequence
  chemically synthesized
gctcttattattacatactcta

SEQ ID NO: 861050 - DNA, 22 bp, Artificial Sequence
  chemically synthesized
ggctcttattattacatactct

SEQ ID NO: 861051 - DNA, 22 bp, Artificial Sequence
  chemically synthesized
ttggctcttattattacatact

SEQ ID NO: 861052 - DNA, 22 bp, Artificial Sequence
  chemically synthesized
cttggctcttattattacatac

SEQ ID NO: 861053 - DNA, 22 bp, Artificial Sequence
  chemically synthesized
cttcttggctcttattattaca

SEQ ID NO: 861054 - DNA, 22 bp, Artificial Sequence
  chemically synthesized
cctacttcttggctcttattat

SEQ ID NO: 861055 - DNA, 22 bp, Artificial Sequence
  chemically synthesized
ggctgcctacttcttggctctt

SEQ ID NO: 861056 - DNA, 22 bp, Artificial Sequence
  chemically synthesized
cactgggctgcctacttcttgg

SEQ ID NO: 861057 - DNA, 22 bp, Artificial Sequence
  chemically synthesized
tgcactgggctgcctacttctt

SEQ ID NO: 861058 - DNA, 22 bp, Artificial Sequence
  chemically synthesized
ctgcactgggctgcctacttct

SEQ ID NO: 861059 - DNA, 22 bp, Artificial Sequence
  chemically synthesized
tcttctgcactgggctgcctac

SEQ ID NO: 861060 - DNA, 22 bp, Artificial Sequence
  chemically synthesized
gtcttctgcactgggctgccta

SEQ ID NO: 861061 - DNA, 22 bp, Artificial Sequence
  chemically synthesized
ccttgtcttctgcactgggctg

SEQ ID NO: 861062 - DNA, 22 bp, Artificial Sequence
  chemically synthesized
cccttgtcttctgcactgggct

SEQ ID NO: 861063 - DNA, 22 bp, Artificial Sequence
  chemically synthesized
ttcccttgtcttctgcactggg

SEQ ID NO: 861064 - DNA, 22 bp, Artificial Sequence
  chemically synthesized
cttcccttgtcttctgcactgg

SEQ ID NO: 861065 - DNA, 22 bp, Artificial Sequence
  chemically synthesized
tcttcccttgtcttctgcactg

SEQ ID NO: 861066 - DNA, 22 bp, Artificial Sequence
  chemically synthesized
ttcttcccttgtcttctgcact

SEQ ID NO: 861067 - DNA, 22 bp, Artificial Sequence
  chemically synthesized
tttcttcccttgtcttctgcac

SEQ ID NO: 861068 - DNA, 22 bp, Artificial Sequence
  chemically synthesized
gctttttcttcccttgtcttct

SEQ ID NO: 861069 - DNA, 22 bp, Artificial Sequence
  chemically synthesized
atctggctttttcttcccttgt

SEQ ID NO: 861070 - DNA, 22 bp, Artificial Sequence
  chemically synthesized
catctggctttttcttcccttg

SEQ ID NO: 861071 - DNA, 22 bp, Artificial Sequence
  chemically synthesized
tggtttcatctggctttttctt

SEQ ID NO: 861072 - DNA, 22 bp, Artificial Sequence
  chemically synthesized
ttatggtttcatctggcttttt

SEQ ID NO: 861073 - DNA, 22 bp, Artificial Sequence
  chemically synthesized
attatggtttcatctggctttt

SEQ ID NO: 861074 - DNA, 22 bp, Artificial Sequence
  chemically synthesized
tattatggtttcatctggcttt

SEQ ID NO: 861075 - DNA, 22 bp, Artificial Sequence
  chemically synthesized
atcaatagcgtggtctttatta

SEQ ID NO: 861076 - DNA, 22 bp, Artificial Sequence
  chemically synthesized
catcaatagcgtggtctttatt

SEQ ID NO: 861077 - DNA, 22 bp, Artificial Sequence
  chemically synthesized
atgaccacccttcatcaatagc

SEQ ID NO: 861078 - DNA, 22 bp, Artificial Sequence
  chemically synthesized
caattgatgaccacccttcatc

SEQ ID NO: 861079 - DNA, 22 bp, Artificial Sequence
  chemically synthesized
gcaattgatgaccacccttcat

SEQ ID NO: 861080 - DNA, 22 bp, Artificial Sequence
  chemically synthesized
tgcaattgatgaccacccttca

SEQ ID NO: 861081 - DNA, 22 bp, Artificial Sequence
  chemically synthesized
ttgatgaagggtggtcatcaat

SEQ ID NO: 861082 - DNA, 22 bp, Artificial Sequence
  chemically synthesized
atatcagttttgcaattgatga

SEQ ID NO: 861083 - DNA, 22 bp, Artificial Sequence
  chemically synthesized
atgaagggtggtcatcaattgc

SEQ ID NO: 861084 - DNA, 22 bp, Artificial Sequence
  chemically synthesized
tgatatcagttttgcaattgat

SEQ ID NO: 861085 - DNA, 22 bp, Artificial Sequence
  chemically synthesized
ttctgatatcagttttgcaatt

SEQ ID NO: 861086 - DNA, 22 bp, Artificial Sequence
  chemically synthesized
attctgatatcagttttgcaat

SEQ ID NO: 861087 - DNA, 22 bp, Artificial Sequence
  chemically synthesized
tattctgatatcagttttgcaa

SEQ ID NO: 861088 - DNA, 22 bp, Artificial Sequence
  chemically synthesized
tatggattttattctgatatca

SEQ ID NO: 861089 - DNA, 22 bp, Artificial Sequence
  chemically synthesized
caaaactgatatcagaataaaa

SEQ ID NO: 861090 - DNA, 22 bp, Artificial Sequence
  chemically synthesized
aaatggttatatggattttatt

SEQ ID NO: 861091 - DNA, 22 bp, Artificial Sequence
  chemically synthesized
atatcagaataaaatccatata

SEQ ID NO: 861092 - DNA, 22 bp, Artificial Sequence
  chemically synthesized
tactcaaatggttatatggatt

SEQ ID NO: 861093 - DNA, 22 bp, Artificial Sequence
  chemically synthesized
gttatactcaaatggttatatg

SEQ ID NO: 861094 - DNA, 22 bp, Artificial Sequence
  chemically synthesized
gctggttatactcaaatggtta

SEQ ID NO: 861095 - DNA, 22 bp, Artificial Sequence
  chemically synthesized
tagctggttatactcaaatggt

SEQ ID NO: 861096 - DNA, 22 bp, Artificial Sequence
  chemically synthesized
tctagctggttatactcaaatg

SEQ ID NO: 861097 - DNA, 22 bp, Artificial Sequence
  chemically synthesized
cacaatgttctctagctggtta

SEQ ID NO: 861098 - DNA, 22 bp, Artificial Sequence
  chemically synthesized
gagtataaccagctagagaaca

SEQ ID NO: 861099 - DNA, 22 bp, Artificial Sequence
  chemically synthesized
agtataaccagctagagaacat

SEQ ID NO: 861100 - DNA, 22 bp, Artificial Sequence
  chemically synthesized
taataagaactacacaatgttc

SEQ ID NO: 861101 - DNA, 22 bp, Artificial Sequence
  chemically synthesized
tgtaataagaactacacaatgt

SEQ ID NO: 861102 - DNA, 22 bp, Artificial Sequence
  chemically synthesized
ctgtaataagaactacacaatg

SEQ ID NO: 861103 - DNA, 22 bp, Artificial Sequence
  chemically synthesized
tctgtaataagaactacacaat

SEQ ID NO: 861104 - DNA, 22 bp, Artificial Sequence
  chemically synthesized
gagaacattgtgtagttcttat

SEQ ID NO: 861105 - DNA, 22 bp, Artificial Sequence
  chemically synthesized
tgtagttcttattacagaaaat

SEQ ID NO: 861106 - DNA, 22 bp, Artificial Sequence
  chemically synthesized
gtagaatagcagtgtattttct

SEQ ID NO: 861107 - DNA, 22 bp, Artificial Sequence
  chemically synthesized
ggtagaatagcagtgtattttc

SEQ ID NO: 861108 - DNA, 22 bp, Artificial Sequence
  chemically synthesized
tggtagaatagcagtgtatttt

SEQ ID NO: 861109 - DNA, 22 bp, Artificial Sequence
  chemically synthesized
ttattacagaaaatacactgct

SEQ ID NO: 861110 - DNA, 22 bp, Artificial Sequence
  chemically synthesized
attacagaaaatacactgctat

SEQ ID NO: 861111 - DNA, 22 bp, Artificial Sequence
  chemically synthesized
ttacagaaaatacactgctatt

SEQ ID NO: 861112 - DNA, 22 bp, Artificial Sequence
  chemically synthesized
agaattttggtagaatagcagt

SEQ ID NO: 861113 - DNA, 22 bp, Artificial Sequence
  chemically synthesized
cagaaaatacactgctattcta

SEQ ID NO: 861114 - DNA, 22 bp, Artificial Sequence
  chemically synthesized
aggtgctcagaattttggtaga

SEQ ID NO: 861115 - DNA, 22 bp, Artificial Sequence
  chemically synthesized
aaggtgctcagaattttggtag

SEQ ID NO: 861116 - DNA, 22 bp, Artificial Sequence
  chemically synthesized
taaggtgctcagaattttggta

SEQ ID NO: 861117 - DNA, 22 bp, Artificial Sequence
  chemically synthesized
ttaaggtgctcagaattttggt

SEQ ID NO: 861118 - DNA, 22 bp, Artificial Sequence
  chemically synthesized
tttaaggtgctcagaattttgg

SEQ ID NO: 861119 - DNA, 22 bp, Artificial Sequence
  chemically synthesized
ctattctaccaaaattctgagc

SEQ ID NO: 861120 - DNA, 22 bp, Artificial Sequence
  chemically synthesized
ttctaccaaaattctgagcacc

SEQ ID NO: 861121 - DNA, 22 bp, Artificial Sequence
  chemically synthesized
aggagttttttaaggtgctcag

SEQ ID NO: 861122 - DNA, 22 bp, Artificial Sequence
  chemically synthesized
taccaaaattctgagcacctta

SEQ ID NO: 861123 - DNA, 22 bp, Artificial Sequence
  chemically synthesized
ccaaaattctgagcaccttaaa

SEQ ID NO: 861124 - DNA, 22 bp, Artificial Sequence
  chemically synthesized
attcaggagttttttaaggtgc

SEQ ID NO: 861125 - DNA, 22 bp, Artificial Sequence
  chemically synthesized
aattcaggagttttttaaggtg

SEQ ID NO: 861126 - DNA, 22 bp, Artificial Sequence
  chemically synthesized
tttaattcaggagttttttaag

SEQ ID NO: 861127 - DNA, 22 bp, Artificial Sequence
  chemically synthesized
tgagcaccttaaaaaactcctg

SEQ ID NO: 861128 - DNA, 22 bp, Artificial Sequence
  chemically synthesized
agcaccttaaaaaactcctgaa

SEQ ID NO: 861129 - DNA, 22 bp, Artificial Sequence
  chemically synthesized
aaaaaactcctgaattaaataa

SEQ ID NO: 861130 - DNA, 22 bp, Artificial Sequence
  chemically synthesized
aaaaactcctgaattaaataat

SEQ ID NO: 861131 - DNA, 22 bp, Artificial Sequence
  chemically synthesized
ctgaattaaataatttattctg

SEQ ID NO: 861132 - DNA, 22 bp, Artificial Sequence
  chemically synthesized
aattaaataatttattctgatt

SEQ ID NO: 861133 - DNA, 22 bp, Artificial Sequence
  chemically synthesized
aataaacaaacccaaatcagaa

SEQ ID NO: 861134 - DNA, 22 bp, Artificial Sequence
  chemically synthesized
aataatttattctgatttgggt

SEQ ID NO: 861135 - DNA, 22 bp, Artificial Sequence
  chemically synthesized
aaaaattgaataaacaaaccca

SEQ ID NO: 861136 - DNA, 22 bp, Artificial Sequence
  chemically synthesized
aaaaaattgaataaacaaaccc

SEQ ID NO: 861137 - DNA, 22 bp, Artificial Sequence
  chemically synthesized
taaaaaattgaataaacaaacc

SEQ ID NO: 861138 - DNA, 22 bp, Artificial Sequence
  chemically synthesized
attctgatttgggtttgtttat

SEQ ID NO: 861139 - DNA, 22 bp, Artificial Sequence
  chemically synthesized
ttctgatttgggtttgtttatt

SEQ ID NO: 861140 - DNA, 22 bp, Artificial Sequence
  chemically synthesized
ttttaaaaaattgaataaacaa

SEQ ID NO: 861141 - DNA, 22 bp, Artificial Sequence
  chemically synthesized
tgatttgggtttgtttattcaa

SEQ ID NO: 861142 - DNA, 22 bp, Artificial Sequence
  chemically synthesized
tattttaaaaaattgaataaac

SEQ ID NO: 861143 - DNA, 22 bp, Artificial Sequence
  chemically synthesized
atttgggtttgtttattcaatt

SEQ ID NO: 861144 - DNA, 22 bp, Artificial Sequence
  chemically synthesized
gggtttgtttattcaatttttt

SEQ ID NO: 861145 - DNA, 22 bp, Artificial Sequence
  chemically synthesized
ggtttgtttattcaatttttta

SEQ ID NO: 861146 - DNA, 22 bp, Artificial Sequence
  chemically synthesized
gtttattcaattttttaaaata

SEQ ID NO: 861147 - DNA, 22 bp, Artificial Sequence
  chemically synthesized
tttattcaattttttaaaatag

SEQ ID NO: 861148 - DNA, 22 bp, Artificial Sequence
  chemically synthesized
aggtaggaggaactctatttta

SEQ ID NO: 861149 - DNA, 22 bp, Artificial Sequence
  chemically synthesized
attcaattttttaaaatagagt

SEQ ID NO: 861150 - DNA, 22 bp, Artificial Sequence
  chemically synthesized
ttcaattttttaaaatagagtt

SEQ ID NO: 861151 - DNA, 22 bp, Artificial Sequence
  chemically synthesized
aattttttaaaatagagttcct

SEQ ID NO: 861152 - DNA, 22 bp, Artificial Sequence
  chemically synthesized
acattcaggtaggaggaactct

SEQ ID NO: 861153 - DNA, 22 bp, Artificial Sequence
  chemically synthesized
taacattcaggtaggaggaact

SEQ ID NO: 861154 - DNA, 22 bp, Artificial Sequence
  chemically synthesized
tttaaaatagagttcctcctac

SEQ ID NO: 861155 - DNA, 22 bp, Artificial Sequence
  chemically synthesized
ttaaaatagagttcctcctacc

SEQ ID NO: 861156 - DNA, 22 bp, Artificial Sequence
  chemically synthesized
taaaatagagttcctcctacct

SEQ ID NO: 861157 - DNA, 22 bp, Artificial Sequence
  chemically synthesized
tctctaacattcaggtaggagg

SEQ ID NO: 861158 - DNA, 22 bp, Artificial Sequence
  chemically synthesized
aaaatagagttcctcctacctg

SEQ ID NO: 861159 - DNA, 22 bp, Artificial Sequence
  chemically synthesized
gtctctaacattcaggtaggag

SEQ ID NO: 861160 - DNA, 22 bp, Artificial Sequence
  chemically synthesized
aaatagagttcctcctacctga

SEQ ID NO: 861161 - DNA, 22 bp, Artificial Sequence
  chemically synthesized
cagagtcttgtctctaacattc

SEQ ID NO: 861162 - DNA, 22 bp, Artificial Sequence
  chemically synthesized
ctcctacctgaatgttagagac

SEQ ID NO: 861163 - DNA, 22 bp, Artificial Sequence
  chemically synthesized
actgcagagtcttgtctctaac

SEQ ID NO: 861164 - DNA, 22 bp, Artificial Sequence
  chemically synthesized
cactgcagagtcttgtctctaa

SEQ ID NO: 861165 - DNA, 22 bp, Artificial Sequence
  chemically synthesized
ctacctgaatgttagagacaag

SEQ ID NO: 861166 - DNA, 22 bp, Artificial Sequence
  chemically synthesized
tcactgcagagtcttgtctcta

SEQ ID NO: 861167 - DNA, 22 bp, Artificial Sequence
  chemically synthesized
cctgaatgttagagacaagact

SEQ ID NO: 861168 - DNA, 22 bp, Artificial Sequence
  chemically synthesized
gttttcactgcagagtcttgtc

SEQ ID NO: 861169 - DNA, 22 bp, Artificial Sequence
  chemically synthesized
agttttcactgcagagtcttgt

SEQ ID NO: 861170 - DNA, 22 bp, Artificial Sequence
  chemically synthesized
aatgttagagacaagactctgc

SEQ ID NO: 861171 - DNA, 22 bp, Artificial Sequence
  chemically synthesized
cttagttttcactgcagagtct

SEQ ID NO: 861172 - DNA, 22 bp, Artificial Sequence
  chemically synthesized
gcttagttttcactgcagagtc

SEQ ID NO: 861173 - DNA, 22 bp, Artificial Sequence
  chemically synthesized
tgcttagttttcactgcagagt

SEQ ID NO: 861174 - DNA, 22 bp, Artificial Sequence
  chemically synthesized
gagacaagactctgcagtgaaa

SEQ ID NO: 861175 - DNA, 22 bp, Artificial Sequence
  chemically synthesized
attttgcttagttttcactgca

SEQ ID NO: 861176 - DNA, 22 bp, Artificial Sequence
  chemically synthesized
cctcattttgcttagttttcac

SEQ ID NO: 861177 - DNA, 22 bp, Artificial Sequence
  chemically synthesized
acctcattttgcttagttttca

SEQ ID NO: 861178 - DNA, 22 bp, Artificial Sequence
  chemically synthesized
cttacctcattttgcttagttt

SEQ ID NO: 861179 - DNA, 22 bp, Artificial Sequence
  chemically synthesized
tgcagtgaaaactaagcaaaat

SEQ ID NO: 861180 - DNA, 22 bp, Artificial Sequence
  chemically synthesized
cagtgaaaactaagcaaaatga

SEQ ID NO: 861181 - DNA, 22 bp, Artificial Sequence
  chemically synthesized
tagaaaacactgcttacctcat

SEQ ID NO: 861182 - DNA, 22 bp, Artificial Sequence
  chemically synthesized
tgtagaaaacactgcttacctc

SEQ ID NO: 861183 - DNA, 22 bp, Artificial Sequence
  chemically synthesized
agcaaaatgaggtaagcagtgt

SEQ ID NO: 861184 - DNA, 22 bp, Artificial Sequence
  chemically synthesized
aattctgtagaaaacactgctt

SEQ ID NO: 861185 - DNA, 22 bp, Artificial Sequence
  chemically synthesized
gactgaattctgtagaaaacac

SEQ ID NO: 861186 - DNA, 22 bp, Artificial Sequence
  chemically synthesized
agactgaattctgtagaaaaca

SEQ ID NO: 861187 - DNA, 22 bp, Artificial Sequence
  chemically synthesized
tctacagaattcagtctaaatc

SEQ ID NO: 861188 - DNA, 22 bp, Artificial Sequence
  chemically synthesized
ctacagaattcagtctaaatct

SEQ ID NO: 861189 - DNA, 22 bp, Artificial Sequence
  chemically synthesized
tacagaattcagtctaaatctc

SEQ ID NO: 861190 - DNA, 22 bp, Artificial Sequence
  chemically synthesized
ccaaacaaataagagatttaga

SEQ ID NO: 861191 - DNA, 22 bp, Artificial Sequence
  chemically synthesized
cagaattcagtctaaatctctt

SEQ ID NO: 861192 - DNA, 22 bp, Artificial Sequence
  chemically synthesized
tcccaaacaaataagagattta

SEQ ID NO: 861193 - DNA, 22 bp, Artificial Sequence
  chemically synthesized
agtctaaatctcttatttgttt

SEQ ID NO: 861194 - DNA, 22 bp, Artificial Sequence
  chemically synthesized
aatctcttatttgtttgggaga

SEQ ID NO: 861195 - DNA, 22 bp, Artificial Sequence
  chemically synthesized
aggtgaaaacgtagctctccca

SEQ ID NO: 861196 - DNA, 22 bp, Artificial Sequence
  chemically synthesized
aaggtgaaaacgtagctctccc

SEQ ID NO: 861197 - DNA, 22 bp, Artificial Sequence
  chemically synthesized
ttatttgtttgggagagctacg

SEQ ID NO: 861198 - DNA, 22 bp, Artificial Sequence
  chemically synthesized
cttaaggtgaaaacgtagctct

SEQ ID NO: 861199 - DNA, 22 bp, Artificial Sequence
  chemically synthesized
atttgtttgggagagctacgtt

SEQ ID NO: 861200 - DNA, 22 bp, Artificial Sequence
  chemically synthesized
tttgtttgggagagctacgttt

SEQ ID NO: 861201 - DNA, 22 bp, Artificial Sequence
  chemically synthesized
tgcttaaggtgaaaacgtagct

SEQ ID NO: 861202 - DNA, 22 bp, Artificial Sequence
  chemically synthesized
ctgcttaaggtgaaaacgtagc

SEQ ID NO: 861203 - DNA, 22 bp, Artificial Sequence
  chemically synthesized
tctgcttaaggtgaaaacgtag

SEQ ID NO: 861204 - DNA, 22 bp, Artificial Sequence
  chemically synthesized
gtttgggagagctacgttttca

SEQ ID NO: 861205 - DNA, 22 bp, Artificial Sequence
  chemically synthesized
ttctgcttaaggtgaaaacgta

SEQ ID NO: 861206 - DNA, 22 bp, Artificial Sequence
  chemically synthesized
tttgggagagctacgttttcac

SEQ ID NO: 861207 - DNA, 22 bp, Artificial Sequence
  chemically synthesized
tttttctgcttaaggtgaaaac

SEQ ID NO: 861208 - DNA, 22 bp, Artificial Sequence
  chemically synthesized
gggagagctacgttttcacctt

SEQ ID NO: 861209 - DNA, 22 bp, Artificial Sequence
  chemically synthesized
ggagagctacgttttcacctta

SEQ ID NO: 861210 - DNA, 22 bp, Artificial Sequence
  chemically synthesized
attatttttctgcttaaggtga

SEQ ID NO: 861211 - DNA, 22 bp, Artificial Sequence
  chemically synthesized
cgttttcaccttaagcagaaaa

SEQ ID NO: 861212 - DNA, 22 bp, Artificial Sequence
  chemically synthesized
tcaccttaagcagaaaaataat

SEQ ID NO: 861213 - DNA, 22 bp, Artificial Sequence
  chemically synthesized
caccttaagcagaaaaataatt

SEQ ID NO: 861214 - DNA, 22 bp, Artificial Sequence
  chemically synthesized
accttaagcagaaaaataatta

SEQ ID NO: 861215 - DNA, 22 bp, Artificial Sequence
  chemically synthesized
aaaacacatcactaattatttt

SEQ ID NO: 861216 - DNA, 22 bp, Artificial Sequence
  chemically synthesized
caaaacacatcactaattattt

SEQ ID NO: 861217 - DNA, 22 bp, Artificial Sequence
  chemically synthesized
tcaaaacacatcactaattatt

SEQ ID NO: 861218 - DNA, 22 bp, Artificial Sequence
  chemically synthesized
aagcagaaaaataattagtgat

SEQ ID NO: 861219 - DNA, 22 bp, Artificial Sequence
  chemically synthesized
agcagaaaaataattagtgatg

SEQ ID NO: 861220 - DNA, 22 bp, Artificial Sequence
  chemically synthesized
tataacaactttcaaaacacat

SEQ ID NO: 861221 - DNA, 22 bp, Artificial Sequence
  chemically synthesized
attatataacaactttcaaaac

SEQ ID NO: 861222 - DNA, 22 bp, Artificial Sequence
  chemically synthesized
ttcattatataacaactttcaa

SEQ ID NO: 861223 - DNA, 22 bp, Artificial Sequence
  chemically synthesized
attcattatataacaactttca

SEQ ID NO: 861224 - DNA, 22 bp, Artificial Sequence
  chemically synthesized
gtgatgtgttttgaaagttgtt

SEQ ID NO: 861225 - DNA, 22 bp, Artificial Sequence
  chemically synthesized
tgaaagttgttatataatgaat

SEQ ID NO: 861226 - DNA, 22 bp, Artificial Sequence
  chemically synthesized
gaaagttgttatataatgaata

SEQ ID NO: 861227 - DNA, 22 bp, Artificial Sequence
  chemically synthesized
aaagttgttatataatgaataa

SEQ ID NO: 861228 - DNA, 22 bp, Artificial Sequence
  chemically synthesized
acacatggtagaggatcttatt

SEQ ID NO: 861229 - DNA, 22 bp, Artificial Sequence
  chemically synthesized
ttatataatgaataagatcctc

SEQ ID NO: 861230 - DNA, 22 bp, Artificial Sequence
  chemically synthesized
tataatgaataagatcctctac

SEQ ID NO: 861231 - DNA, 22 bp, Artificial Sequence
  chemically synthesized
tgagggcctgacacatggtaga

SEQ ID NO: 861232 - DNA, 22 bp, Artificial Sequence
  chemically synthesized
gtgagggcctgacacatggtag

SEQ ID NO: 861233 - DNA, 22 bp, Artificial Sequence
  chemically synthesized
taccatgtgtcaggccctcaca

SEQ ID NO: 861234 - DNA, 22 bp, Artificial Sequence
  chemically synthesized
gtggatgaggcttgtgagggcc

SEQ ID NO: 861235 - DNA, 22 bp, Artificial Sequence
  chemically synthesized
ccatgtgtcaggccctcacaag

SEQ ID NO: 861236 - DNA, 22 bp, Artificial Sequence
  chemically synthesized
tggtggatgaggcttgtgaggg

SEQ ID NO: 861237 - DNA, 22 bp, Artificial Sequence
  chemically synthesized
ctctggtggatgaggcttgtga

SEQ ID NO: 861238 - DNA, 22 bp, Artificial Sequence
  chemically synthesized
tcatctcctctggtggatgagg

SEQ ID NO: 861239 - DNA, 22 bp, Artificial Sequence
  chemically synthesized
atcatctcctctggtggatgag

SEQ ID NO: 861240 - DNA, 22 bp, Artificial Sequence
  chemically synthesized
acaagcctcatccaccagagga

SEQ ID NO: 861241 - DNA, 22 bp, Artificial Sequence
  chemically synthesized
aaatagcttatcatctcctctg

SEQ ID NO: 861242 - DNA, 22 bp, Artificial Sequence
  chemically synthesized
tctcaaatagcttatcatctcc

SEQ ID NO: 861243 - DNA, 22 bp, Artificial Sequence
  chemically synthesized
atctcaaatagcttatcatctc

SEQ ID NO: 861244 - DNA, 22 bp, Artificial Sequence
  chemically synthesized
atccaccagaggagatgataag

SEQ ID NO: 861245 - DNA, 22 bp, Artificial Sequence
  chemically synthesized
atacttatctcaaatagcttat

SEQ ID NO: 861246 - DNA, 22 bp, Artificial Sequence
  chemically synthesized
tgatacttatctcaaatagctt

SEQ ID NO: 861247 - DNA, 22 bp, Artificial Sequence
  chemically synthesized
tttgagataagtatcagaatca

SEQ ID NO: 861248 - DNA, 22 bp, Artificial Sequence
  chemically synthesized
gagataagtatcagaatcatct

SEQ ID NO: 861249 - DNA, 22 bp, Artificial Sequence
  chemically synthesized
tgaggaaggaaaagatgattct

SEQ ID NO: 861250 - DNA, 22 bp, Artificial Sequence
  chemically synthesized
agataagtatcagaatcatctt

SEQ ID NO: 861251 - DNA, 22 bp, Artificial Sequence
  chemically synthesized
gtgaggaaggaaaagatgattc

SEQ ID NO: 861252 - DNA, 22 bp, Artificial Sequence
  chemically synthesized
gtcttgtgaggaaggaaaagat

SEQ ID NO: 861253 - DNA, 22 bp, Artificial Sequence
  chemically synthesized
ggtcttgtgaggaaggaaaaga

SEQ ID NO: 861254 - DNA, 22 bp, Artificial Sequence
  chemically synthesized
tggtcttgtgaggaaggaaaag

SEQ ID NO: 861255 - DNA, 22 bp, Artificial Sequence
  chemically synthesized
agacctttggtcttgtgaggaa

SEQ ID NO: 861256 - DNA, 22 bp, Artificial Sequence
  chemically synthesized
cagacctttggtcttgtgagga

SEQ ID NO: 861257 - DNA, 22 bp, Artificial Sequence
  chemically synthesized
tcagacctttggtcttgtgagg

SEQ ID NO: 861258 - DNA, 22 bp, Artificial Sequence
  chemically synthesized
ttcagacctttggtcttgtgag

SEQ ID NO: 861259 - DNA, 22 bp, Artificial Sequence
  chemically synthesized
tttttcagacctttggtcttgt

SEQ ID NO: 861260 - DNA, 22 bp, Artificial Sequence
  chemically synthesized
ttccttcctcacaagaccaaag

SEQ ID NO: 861261 - DNA, 22 bp, Artificial Sequence
  chemically synthesized
tccttcctcacaagaccaaagg

SEQ ID NO: 861262 - DNA, 22 bp, Artificial Sequence
  chemically synthesized
ttatttttcagacctttggtct

SEQ ID NO: 861263 - DNA, 22 bp, Artificial Sequence
  chemically synthesized
ccttcctcacaagaccaaaggt

SEQ ID NO: 861264 - DNA, 22 bp, Artificial Sequence
  chemically synthesized
cttcctcacaagaccaaaggtc

SEQ ID NO: 861265 - DNA, 22 bp, Artificial Sequence
  chemically synthesized
cctcacaagaccaaaggtctga

SEQ ID NO: 861266 - DNA, 22 bp, Artificial Sequence
  chemically synthesized
ctcacaagaccaaaggtctgaa

SEQ ID NO: 861267 - DNA, 22 bp, Artificial Sequence
  chemically synthesized
agaccctgttatttttcagacc

SEQ ID NO: 861268 - DNA, 22 bp, Artificial Sequence
  chemically synthesized
acaagaccaaaggtctgaaaaa

SEQ ID NO: 861269 - DNA, 22 bp, Artificial Sequence
  chemically synthesized
attgagaccctgttatttttca

SEQ ID NO: 861270 - DNA, 22 bp, Artificial Sequence
  chemically synthesized
gattgagaccctgttatttttc

SEQ ID NO: 861271 - DNA, 22 bp, Artificial Sequence
  chemically synthesized
tgattgagaccctgttattttt

SEQ ID NO: 861272 - DNA, 22 bp, Artificial Sequence
  chemically synthesized
aaaaataacagggtctcaatca

SEQ ID NO: 861273 - DNA, 22 bp, Artificial Sequence
  chemically synthesized
tgaaaacaacaacaaattttga

SEQ ID NO: 861274 - DNA, 22 bp, Artificial Sequence
  chemically synthesized
attgtgaaaacaacaacaaatt

SEQ ID NO: 861275 - DNA, 22 bp, Artificial Sequence
  chemically synthesized
taattgtgaaaacaacaacaaa

SEQ ID NO: 861276 - DNA, 22 bp, Artificial Sequence
  chemically synthesized
aatcaaaatttgttgttgtttt

SEQ ID NO: 861277 - DNA, 22 bp, Artificial Sequence
  chemically synthesized
attctaattgtgaaaacaacaa

SEQ ID NO: 861278 - DNA, 22 bp, Artificial Sequence
  chemically synthesized
cacctcattctaattgtgaaaa

SEQ ID NO: 861279 - DNA, 22 bp, Artificial Sequence
  chemically synthesized
gcacctcattctaattgtgaaa

SEQ ID NO: 861280 - DNA, 22 bp, Artificial Sequence
  chemically synthesized
gttgttgttttcacaattagaa

SEQ ID NO: 861281 - DNA, 22 bp, Artificial Sequence
  chemically synthesized
ttgttgttttcacaattagaat

SEQ ID NO: 861282 - DNA, 22 bp, Artificial Sequence
  chemically synthesized
caacttgcacctcattctaatt

SEQ ID NO: 861283 - DNA, 22 bp, Artificial Sequence
  chemically synthesized
ttgttttcacaattagaatgag

SEQ ID NO: 861284 - DNA, 22 bp, Artificial Sequence
  chemically synthesized
ttttcacaattagaatgaggtg

SEQ ID NO: 861285 - DNA, 22 bp, Artificial Sequence
  chemically synthesized
tcacaattagaatgaggtgcaa

SEQ ID NO: 861286 - DNA, 22 bp, Artificial Sequence
  chemically synthesized
gtacattgcaacttgcacctca

SEQ ID NO: 861287 - DNA, 22 bp, Artificial Sequence
  chemically synthesized
cacaattagaatgaggtgcaag

SEQ ID NO: 861288 - DNA, 22 bp, Artificial Sequence
  chemically synthesized
agtacattgcaacttgcacctc

SEQ ID NO: 861289 - DNA, 22 bp, Artificial Sequence
  chemically synthesized
acaattagaatgaggtgcaagt

SEQ ID NO: 861290 - DNA, 22 bp, Artificial Sequence
  chemically synthesized
cttagtacattgcaacttgcac

SEQ ID NO: 861291 - DNA, 22 bp, Artificial Sequence
  chemically synthesized
tgcttagtacattgcaacttgc

SEQ ID NO: 861292 - DNA, 22 bp, Artificial Sequence
  chemically synthesized
gaatgaggtgcaagttgcaatg

SEQ ID NO: 861293 - DNA, 22 bp, Artificial Sequence
  chemically synthesized
aggactctgcttagtacattgc

SEQ ID NO: 861294 - DNA, 22 bp, Artificial Sequence
  chemically synthesized
aaggactctgcttagtacattg

SEQ ID NO: 861295 - DNA, 22 bp, Artificial Sequence
  chemically synthesized
cacttaaggactctgcttagta

SEQ ID NO: 861296 - DNA, 22 bp, Artificial Sequence
  chemically synthesized
caatgtactaagcagagtcctt

SEQ ID NO: 861297 - DNA, 22 bp, Artificial Sequence
  chemically synthesized
agcagagtccttaagtgtaatc

SEQ ID NO: 861298 - DNA, 22 bp, Artificial Sequence
  chemically synthesized
gagagagaacgagattacactt

SEQ ID NO: 861299 - DNA, 22 bp, Artificial Sequence
  chemically synthesized
agagagagaacgagattacact

SEQ ID NO: 861300 - DNA, 22 bp, Artificial Sequence
  chemically synthesized
aagtgtaatctcgttctctctc

SEQ ID NO: 861301 - DNA, 22 bp, Artificial Sequence
  chemically synthesized
agtgtaatctcgttctctctct

SEQ ID NO: 861302 - DNA, 22 bp, Artificial Sequence
  chemically synthesized
gttctctctctaaatatatata

SEQ ID NO: 861303 - DNA, 22 bp, Artificial Sequence
  chemically synthesized
tatatacatatgcatatatata

SEQ ID NO: 861304 - DNA, 22 bp, Artificial Sequence
  chemically synthesized
tctctctaaatatatatatgca

SEQ ID NO: 861305 - DNA, 22 bp, Artificial Sequence
  chemically synthesized
tctctaaatatatatatgcata

SEQ ID NO: 861306 - DNA, 22 bp, Artificial Sequence
  chemically synthesized
gactatatatacatatgcatat

SEQ ID NO: 861307 - DNA, 22 bp, Artificial Sequence
  chemically synthesized
tctaaatatatatatgcatatg

SEQ ID NO: 861308 - DNA, 22 bp, Artificial Sequence
  chemically synthesized
agactatatatacatatgcata

SEQ ID NO: 861309 - DNA, 22 bp, Artificial Sequence
  chemically synthesized
taaatatatatatgcatatgta

SEQ ID NO: 861310 - DNA, 22 bp, Artificial Sequence
  chemically synthesized
aatatatatatgcatatgtata

SEQ ID NO: 861311 - DNA, 22 bp, Artificial Sequence
  chemically synthesized
aatatatatatttagactatat

SEQ ID NO: 861312 - DNA, 22 bp, Artificial Sequence
  chemically synthesized
taaatatatatatttagactat

SEQ ID NO: 861313 - DNA, 22 bp, Artificial Sequence
  chemically synthesized
tctaaatatatatatttagact

SEQ ID NO: 861314 - DNA, 22 bp, Artificial Sequence
  chemically synthesized
tctctaaatatatatatttaga

SEQ ID NO: 861315 - DNA, 22 bp, Artificial Sequence
  chemically synthesized
tctctctctaaatatatatatt

SEQ ID NO: 861316 - DNA, 22 bp, Artificial Sequence
  chemically synthesized
tgtctctctctaaatatatata

SEQ ID NO: 861317 - DNA, 22 bp, Artificial Sequence
  chemically synthesized
tctgtctctctctaaatatata

SEQ ID NO: 861318 - DNA, 22 bp, Artificial Sequence
  chemically synthesized
ctctgtctctctctaaatatat

SEQ ID NO: 861319 - DNA, 22 bp, Artificial Sequence
  chemically synthesized
aatatatatatttagagagaga

SEQ ID NO: 861320 - DNA, 22 bp, Artificial Sequence
  chemically synthesized
tataacttctctgtctctctct

SEQ ID NO: 861321 - DNA, 22 bp, Artificial Sequence
  chemically synthesized
atataacttctctgtctctctc

SEQ ID NO: 861322 - DNA, 22 bp, Artificial Sequence
  chemically synthesized
atttatataacttctctgtctc

SEQ ID NO: 861323 - DNA, 22 bp, Artificial Sequence
  chemically synthesized
tattaatttatataacttctct

SEQ ID NO: 861324 - DNA, 22 bp, Artificial Sequence
  chemically synthesized
agagagagacagagaagttata

SEQ ID NO: 861325 - DNA, 22 bp, Artificial Sequence
  chemically synthesized
gagagagacagagaagttatat

SEQ ID NO: 861326 - DNA, 22 bp, Artificial Sequence
  chemically synthesized
ttatattaatttatataacttc

SEQ ID NO: 861327 - DNA, 22 bp, Artificial Sequence
  chemically synthesized
tgttatattaatttatataact

SEQ ID NO: 861328 - DNA, 22 bp, Artificial Sequence
  chemically synthesized
cataactctgttatattaattt

SEQ ID NO: 861329 - DNA, 22 bp, Artificial Sequence
  chemically synthesized
tataaattaatataacagagtt

SEQ ID NO: 861330 - DNA, 22 bp, Artificial Sequence
  chemically synthesized
taaatcacagttacataactct

SEQ ID NO: 861331 - DNA, 22 bp, Artificial Sequence
  chemically synthesized
atataacagagttatgtaactg

SEQ ID NO: 861332 - DNA, 22 bp, Artificial Sequence
  chemically synthesized
aggaaactgtaaatcacagtta

SEQ ID NO: 861333 - DNA, 22 bp, Artificial Sequence
  chemically synthesized
tgaggaaactgtaaatcacagt

SEQ ID NO: 861334 - DNA, 22 bp, Artificial Sequence
  chemically synthesized
aaactctgaggaaactgtaaat

SEQ ID NO: 861335 - DNA, 22 bp, Artificial Sequence
  chemically synthesized
tgtaactgtgatttacagtttc

SEQ ID NO: 861336 - DNA, 22 bp, Artificial Sequence
  chemically synthesized
gattgaaactctgaggaaactg

SEQ ID NO: 861337 - DNA, 22 bp, Artificial Sequence
  chemically synthesized
tagattgaaactctgaggaaac

SEQ ID NO: 861338 - DNA, 22 bp, Artificial Sequence
  chemically synthesized
tgatttacagtttcctcagagt

SEQ ID NO: 861339 - DNA, 22 bp, Artificial Sequence
  chemically synthesized
acagtttcctcagagtttcaat

SEQ ID NO: 861340 - DNA, 22 bp, Artificial Sequence
  chemically synthesized
atgaagttctagattgaaactc

SEQ ID NO: 861341 - DNA, 22 bp, Artificial Sequence
  chemically synthesized
cagtttcctcagagtttcaatc

SEQ ID NO: 861342 - DNA, 22 bp, Artificial Sequence
  chemically synthesized
actgatgaagttctagattgaa

SEQ ID NO: 861343 - DNA, 22 bp, Artificial Sequence
  chemically synthesized
tcactgatgaagttctagattg

SEQ ID NO: 861344 - DNA, 22 bp, Artificial Sequence
  chemically synthesized
cctcagagtttcaatctagaac

SEQ ID NO: 861345 - DNA, 22 bp, Artificial Sequence
  chemically synthesized
ctcactgatgaagttctagatt

SEQ ID NO: 861346 - DNA, 22 bp, Artificial Sequence
  chemically synthesized
ctcagagtttcaatctagaact

SEQ ID NO: 861347 - DNA, 22 bp, Artificial Sequence
  chemically synthesized
tctcactgatgaagttctagat

SEQ ID NO: 861348 - DNA, 22 bp, Artificial Sequence
  chemically synthesized
ttctcactgatgaagttctaga

SEQ ID NO: 861349 - DNA, 22 bp, Artificial Sequence
  chemically synthesized
tttctcactgatgaagttctag

SEQ ID NO: 861350 - DNA, 22 bp, Artificial Sequence
  chemically synthesized
agagtttcaatctagaacttca

SEQ ID NO: 861351 - DNA, 22 bp, Artificial Sequence
  chemically synthesized
ttttctcactgatgaagttcta

SEQ ID NO: 861352 - DNA, 22 bp, Artificial Sequence
  chemically synthesized
ttttttctcactgatgaagttc

SEQ ID NO: 861353 - DNA, 22 bp, Artificial Sequence
  chemically synthesized
ctcttttttctcactgatgaag

SEQ ID NO: 861354 - DNA, 22 bp, Artificial Sequence
  chemically synthesized
caatctagaacttcatcagtga

SEQ ID NO: 861355 - DNA, 22 bp, Artificial Sequence
  chemically synthesized
aatctagaacttcatcagtgag

SEQ ID NO: 861356 - DNA, 22 bp, Artificial Sequence
  chemically synthesized
atggttcctcttttttctcact

SEQ ID NO: 861357 - DNA, 22 bp, Artificial Sequence
  chemically synthesized
gaacttcatcagtgagaaaaaa

SEQ ID NO: 861358 - DNA, 22 bp, Artificial Sequence
  chemically synthesized
cactaatggttcctcttttttc

SEQ ID NO: 861359 - DNA, 22 bp, Artificial Sequence
  chemically synthesized
catcagtgagaaaaaagaggaa

SEQ ID NO: 861360 - DNA, 22 bp, Artificial Sequence
  chemically synthesized
atcagtgagaaaaaagaggaac

SEQ ID NO: 861361 - DNA, 22 bp, Artificial Sequence
  chemically synthesized
cattgcactaatggttcctctt

SEQ ID NO: 861362 - DNA, 22 bp, Artificial Sequence
  chemically synthesized
acattgcactaatggttcctct

SEQ ID NO: 861363 - DNA, 22 bp, Artificial Sequence
  chemically synthesized
tcgcatttacattgcactaatg

SEQ ID NO: 861364 - DNA, 22 bp, Artificial Sequence
  chemically synthesized
atattgtcgcatttacattgca

SEQ ID NO: 861365 - DNA, 22 bp, Artificial Sequence
  chemically synthesized
aatattgtcgcatttacattgc

SEQ ID NO: 861366 - DNA, 22 bp, Artificial Sequence
  chemically synthesized
tttaatattgtcgcatttacat

SEQ ID NO: 861367 - DNA, 22 bp, Artificial Sequence
  chemically synthesized
agactatttaatattgtcgcat

SEQ ID NO: 861368 - DNA, 22 bp, Artificial Sequence
  chemically synthesized
gtgcaatgtaaatgcgacaata

SEQ ID NO: 861369 - DNA, 22 bp, Artificial Sequence
  chemically synthesized
aagactatttaatattgtcgca

SEQ ID NO: 861370 - DNA, 22 bp, Artificial Sequence
  chemically synthesized
taagactatttaatattgtcgc

SEQ ID NO: 861371 - DNA, 22 bp, Artificial Sequence
  chemically synthesized
cattttaagactatttaatatt

SEQ ID NO: 861372 - DNA, 22 bp, Artificial Sequence
  chemically synthesized
aaccaaaagaatctacatttta

SEQ ID NO: 861373 - DNA, 22 bp, Artificial Sequence
  chemically synthesized
gaaccaaaagaatctacatttt

SEQ ID NO: 861374 - DNA, 22 bp, Artificial Sequence
  chemically synthesized
aatagtcttaaaatgtagattc

SEQ ID NO: 861375 - DNA, 22 bp, Artificial Sequence
  chemically synthesized
atttgaaccaaaagaatctaca

SEQ ID NO: 861376 - DNA, 22 bp, Artificial Sequence
  chemically synthesized
taattgatttgaaccaaaagaa

SEQ ID NO: 861377 - DNA, 22 bp, Artificial Sequence
  chemically synthesized
aaaatgtagattcttttggttc

SEQ ID NO: 861378 - DNA, 22 bp, Artificial Sequence
  chemically synthesized
aaatgtagattcttttggttca

SEQ ID NO: 861379 - DNA, 22 bp, Artificial Sequence
  chemically synthesized
tgcaaatatattataattgatt

SEQ ID NO: 861380 - DNA, 22 bp, Artificial Sequence
  chemically synthesized
gtgcaaatatattataattgat

SEQ ID NO: 861381 - DNA, 22 bp, Artificial Sequence
  chemically synthesized
ttttggttcaaatcaattataa

SEQ ID NO: 861382 - DNA, 22 bp, Artificial Sequence
  chemically synthesized
ttggttcaaatcaattataata

SEQ ID NO: 861383 - DNA, 22 bp, Artificial Sequence
  chemically synthesized
tggttcaaatcaattataatat

SEQ ID NO: 861384 - DNA, 22 bp, Artificial Sequence
  chemically synthesized
ggttcaaatcaattataatata

SEQ ID NO: 861385 - DNA, 22 bp, Artificial Sequence
  chemically synthesized
gttcaaatcaattataatatat

SEQ ID NO: 861386 - DNA, 22 bp, Artificial Sequence
  chemically synthesized
aaatcaattataatatatttgc

SEQ ID NO: 861387 - DNA, 22 bp, Artificial Sequence
  chemically synthesized
tccagatcttgtgcaaatatat

SEQ ID NO: 861388 - DNA, 22 bp, Artificial Sequence
  chemically synthesized
tgctgtccagatcttgtgcaaa

SEQ ID NO: 861389 - DNA, 22 bp, Artificial Sequence
  chemically synthesized
atgctgtccagatcttgtgcaa

SEQ ID NO: 861390 - DNA, 22 bp, Artificial Sequence
  chemically synthesized
tatgctgtccagatcttgtgca

SEQ ID NO: 861391 - DNA, 22 bp, Artificial Sequence
  chemically synthesized
ttatgctgtccagatcttgtgc

SEQ ID NO: 861392 - DNA, 22 bp, Artificial Sequence
  chemically synthesized
taatatatttgcacaagatctg

SEQ ID NO: 861393 - DNA, 22 bp, Artificial Sequence
  chemically synthesized
aaaaggcatttttatgctgtcc

SEQ ID NO: 861394 - DNA, 22 bp, Artificial Sequence
  chemically synthesized
gcacaagatctggacagcataa

SEQ ID NO: 861395 - DNA, 22 bp, Artificial Sequence
  chemically synthesized
cacaagatctggacagcataaa

SEQ ID NO: 861396 - DNA, 22 bp, Artificial Sequence
  chemically synthesized
gacagcataaaaatgccttttt

SEQ ID NO: 861397 - DNA, 22 bp, Artificial Sequence
  chemically synthesized
tttagtcattttctgcattggt

SEQ ID NO: 861398 - DNA, 22 bp, Artificial Sequence
  chemically synthesized
ttagtcattttctgcattggtt

SEQ ID NO: 861399 - DNA, 22 bp, Artificial Sequence
  chemically synthesized
tagtcattttctgcattggttc

SEQ ID NO: 861400 - DNA, 22 bp, Artificial Sequence
  chemically synthesized
agtcattttctgcattggttcc

SEQ ID NO: 861401 - DNA, 22 bp, Artificial Sequence
  chemically synthesized
gtcattttctgcattggttcct

SEQ ID NO: 861402 - DNA, 22 bp, Artificial Sequence
  chemically synthesized
tctgcattggttcctcatcata

SEQ ID NO: 861403 - DNA, 22 bp, Artificial Sequence
  chemically synthesized
ctgcattggttcctcatcatac

SEQ ID NO: 861404 - DNA, 22 bp, Artificial Sequence
  chemically synthesized
tgcattggttcctcatcatacc

SEQ ID NO: 861405 - DNA, 22 bp, Artificial Sequence
  chemically synthesized
tccacaccagagtggtatgatg

SEQ ID NO: 861406 - DNA, 22 bp, Artificial Sequence
  chemically synthesized
cattggttcctcatcataccac

SEQ ID NO: 861407 - DNA, 22 bp, Artificial Sequence
  chemically synthesized
cctatccacaccagagtggtat

SEQ ID NO: 861408 - DNA, 22 bp, Artificial Sequence
  chemically synthesized
ccctatccacaccagagtggta

SEQ ID NO: 861409 - DNA, 22 bp, Artificial Sequence
  chemically synthesized
gttcctcatcataccactctgg

SEQ ID NO: 861410 - DNA, 22 bp, Artificial Sequence
  chemically synthesized
tccctatccacaccagagtggt

SEQ ID NO: 861411 - DNA, 22 bp, Artificial Sequence
  chemically synthesized
ctcatcataccactctggtgtg

SEQ ID NO: 861412 - DNA, 22 bp, Artificial Sequence
  chemically synthesized
atcataccactctggtgtggat

SEQ ID NO: 861413 - DNA, 22 bp, Artificial Sequence
  chemically synthesized
atagtaatcatgttttccctat

SEQ ID NO: 861414 - DNA, 22 bp, Artificial Sequence
  chemically synthesized
tggtgtggatagggaaaacatg

SEQ ID NO: 861415 - DNA, 22 bp, Artificial Sequence
  chemically synthesized
gtgtggatagggaaaacatgat

SEQ ID NO: 861416 - DNA, 22 bp, Artificial Sequence
  chemically synthesized
taaattgatagtaatcatgttt

SEQ ID NO: 861417 - DNA, 22 bp, Artificial Sequence
  chemically synthesized
tataaattgatagtaatcatgt

SEQ ID NO: 861418 - DNA, 22 bp, Artificial Sequence
  chemically synthesized
ccgttctataaattgatagtaa

SEQ ID NO: 861419 - DNA, 22 bp, Artificial Sequence
  chemically synthesized
cccgttctataaattgatagta

SEQ ID NO: 861420 - DNA, 22 bp, Artificial Sequence
  chemically synthesized
gtttcccgttctataaattgat

SEQ ID NO: 861421 - DNA, 22 bp, Artificial Sequence
  chemically synthesized
agtttcccgttctataaattga

SEQ ID NO: 861422 - DNA, 22 bp, Artificial Sequence
  chemically synthesized
aatttagtttcccgttctataa

SEQ ID NO: 861423 - DNA, 22 bp, Artificial Sequence
  chemically synthesized
ctatcaatttatagaacgggaa

SEQ ID NO: 861424 - DNA, 22 bp, Artificial Sequence
  chemically synthesized
tctgaatttagtttcccgttct

SEQ ID NO: 861425 - DNA, 22 bp, Artificial Sequence
  chemically synthesized
atctgaatttagtttcccgttc

SEQ ID NO: 861426 - DNA, 22 bp, Artificial Sequence
  chemically synthesized
tcaatttatagaacgggaaact

SEQ ID NO: 861427 - DNA, 22 bp, Artificial Sequence
  chemically synthesized
atttatctgaatttagtttccc

SEQ ID NO: 861428 - DNA, 22 bp, Artificial Sequence
  chemically synthesized
aatttatctgaatttagtttcc

SEQ ID NO: 861429 - DNA, 22 bp, Artificial Sequence
  chemically synthesized
taatttatctgaatttagtttc

SEQ ID NO: 861430 - DNA, 22 bp, Artificial Sequence
  chemically synthesized
atagaacgggaaactaaattca

SEQ ID NO: 861431 - DNA, 22 bp, Artificial Sequence
  chemically synthesized
tagaacgggaaactaaattcag

SEQ ID NO: 861432 - DNA, 22 bp, Artificial Sequence
  chemically synthesized
aagaagtattttaatttatctg

SEQ ID NO: 861433 - DNA, 22 bp, Artificial Sequence
  chemically synthesized
gaagaagtattttaatttatct

SEQ ID NO: 861434 - DNA, 22 bp, Artificial Sequence
  chemically synthesized
atcttgaagaagtattttaatt

SEQ ID NO: 861435 - DNA, 22 bp, Artificial Sequence
  chemically synthesized
aattcagataaattaaaatact

SEQ ID NO: 861436 - DNA, 22 bp, Artificial Sequence
  chemically synthesized
agataaattaaaatacttcttc

SEQ ID NO: 861437 - DNA, 22 bp, Artificial Sequence
  chemically synthesized
aatgttgatcttgaagaagtat

SEQ ID NO: 861438 - DNA, 22 bp, Artificial Sequence
  chemically synthesized
ctaaatgttgatcttgaagaag

SEQ ID NO: 861439 - DNA, 22 bp, Artificial Sequence
  chemically synthesized
actaaatgttgatcttgaagaa

SEQ ID NO: 861440 - DNA, 22 bp, Artificial Sequence
  chemically synthesized
atttactaaatgttgatcttga

SEQ ID NO: 861441 - DNA, 22 bp, Artificial Sequence
  chemically synthesized
aaatacttcttcaagatcaaca

SEQ ID NO: 861442 - DNA, 22 bp, Artificial Sequence
  chemically synthesized
atctaatttactaaatgttgat

SEQ ID NO: 861443 - DNA, 22 bp, Artificial Sequence
  chemically synthesized
catctaatttactaaatgttga

SEQ ID NO: 861444 - DNA, 22 bp, Artificial Sequence
  chemically synthesized
tcatctaatttactaaatgttg

SEQ ID NO: 861445 - DNA, 22 bp, Artificial Sequence
  chemically synthesized
cttcaagatcaacatttagtaa

SEQ ID NO: 861446 - DNA, 22 bp, Artificial Sequence
  chemically synthesized
ttcaagatcaacatttagtaaa

SEQ ID NO: 861447 - DNA, 22 bp, Artificial Sequence
  chemically synthesized
caagatcaacatttagtaaatt

SEQ ID NO: 861448 - DNA, 22 bp, Artificial Sequence
  chemically synthesized
aagatcaacatttagtaaatta

SEQ ID NO: 861449 - DNA, 22 bp, Artificial Sequence
  chemically synthesized
agaacctttcatctaatttact

SEQ ID NO: 861450 - DNA, 22 bp, Artificial Sequence
  chemically synthesized
tcagaacctttcatctaattta

SEQ ID NO: 861451 - DNA, 22 bp, Artificial Sequence
  chemically synthesized
ctcagaacctttcatctaattt

SEQ ID NO: 861452 - DNA, 22 bp, Artificial Sequence
  chemically synthesized
agtaaattagatgaaaggttct

SEQ ID NO: 861453 - DNA, 22 bp, Artificial Sequence
  chemically synthesized
gtaaattagatgaaaggttctg

SEQ ID NO: 861454 - DNA, 22 bp, Artificial Sequence
  chemically synthesized
aaatacagatttctcagaacct

SEQ ID NO: 861455 - DNA, 22 bp, Artificial Sequence
  chemically synthesized
aaaatacagatttctcagaacc

SEQ ID NO: 861456 - DNA, 22 bp, Artificial Sequence
  chemically synthesized
ttaaaatacagatttctcagaa

SEQ ID NO: 861457 - DNA, 22 bp, Artificial Sequence
  chemically synthesized
cttaaaatacagatttctcaga

SEQ ID NO: 861458 - DNA, 22 bp, Artificial Sequence
  chemically synthesized
gatgaaaggttctgagaaatct

SEQ ID NO: 861459 - DNA, 22 bp, Artificial Sequence
  chemically synthesized
ttcttaaaatacagatttctca

SEQ ID NO: 861460 - DNA, 22 bp, Artificial Sequence
  chemically synthesized
cttcttaaaatacagatttctc

SEQ ID NO: 861461 - DNA, 22 bp, Artificial Sequence
  chemically synthesized
tcttcttaaaatacagatttct

SEQ ID NO: 861462 - DNA, 22 bp, Artificial Sequence
  chemically synthesized
agagcctttcttcttaaaatac

SEQ ID NO: 861463 - DNA, 22 bp, Artificial Sequence
  chemically synthesized
tgagaaatctgtattttaagaa

SEQ ID NO: 861464 - DNA, 22 bp, Artificial Sequence
  chemically synthesized
agaaatctgtattttaagaaga

SEQ ID NO: 861465 - DNA, 22 bp, Artificial Sequence
  chemically synthesized
acctcagagcctttcttcttaa

SEQ ID NO: 861466 - DNA, 22 bp, Artificial Sequence
  chemically synthesized
ctcacctcagagcctttcttct

SEQ ID NO: 861467 - DNA, 22 bp, Artificial Sequence
  chemically synthesized
attactcacctcagagcctttc

SEQ ID NO: 861468 - DNA, 22 bp, Artificial Sequence
  chemically synthesized
tattttaagaagaaaggctctg

SEQ ID NO: 861469 - DNA, 22 bp, Artificial Sequence
  chemically synthesized
ttaattactcacctcagagcct

SEQ ID NO: 861470 - DNA, 22 bp, Artificial Sequence
  chemically synthesized
attaattactcacctcagagcc

SEQ ID NO: 861471 - DNA, 22 bp, Artificial Sequence
  chemically synthesized
taagaagaaaggctctgaggtg

SEQ ID NO: 861472 - DNA, 22 bp, Artificial Sequence
  chemically synthesized
aagaagaaaggctctgaggtga

SEQ ID NO: 861473 - DNA, 22 bp, Artificial Sequence
  chemically synthesized
cttattaattactcacctcaga

SEQ ID NO: 861474 - DNA, 22 bp, Artificial Sequence
  chemically synthesized
agaagaaaggctctgaggtgag

SEQ ID NO: 861475 - DNA, 22 bp, Artificial Sequence
  chemically synthesized
gtgaattccttattaattactc

SEQ ID NO: 861476 - DNA, 22 bp, Artificial Sequence
  chemically synthesized
ggtgaattccttattaattact

SEQ ID NO: 861477 - DNA, 22 bp, Artificial Sequence
  chemically synthesized
tggtgaattccttattaattac

SEQ ID NO: 861478 - DNA, 22 bp, Artificial Sequence
  chemically synthesized
ttggtgaattccttattaatta

SEQ ID NO: 861479 - DNA, 22 bp, Artificial Sequence
  chemically synthesized
tgaggtgagtaattaataagga

SEQ ID NO: 861480 - DNA, 22 bp, Artificial Sequence
  chemically synthesized
tttttggtgaattccttattaa

SEQ ID NO: 861481 - DNA, 22 bp, Artificial Sequence
  chemically synthesized
aggtgagtaattaataaggaat

SEQ ID NO: 861482 - DNA, 22 bp, Artificial Sequence
  chemically synthesized
attgtttttggtgaattcctta

SEQ ID NO: 861483 - DNA, 22 bp, Artificial Sequence
  chemically synthesized
ataaggaattcaccaaaaacaa

SEQ ID NO: 861484 - DNA, 22 bp, Artificial Sequence
  chemically synthesized
aaatcaggttaattgtttttgg

SEQ ID NO: 861485 - DNA, 22 bp, Artificial Sequence
  chemically synthesized
aaaatcaggttaattgtttttg

SEQ ID NO: 861486 - DNA, 22 bp, Artificial Sequence
  chemically synthesized
taaaatcaggttaattgttttt

SEQ ID NO: 861487 - DNA, 22 bp, Artificial Sequence
  chemically synthesized
cccattttaaaatcaggttaat

SEQ ID NO: 861488 - DNA, 22 bp, Artificial Sequence
  chemically synthesized
gcccattttaaaatcaggttaa

SEQ ID NO: 861489 - DNA, 22 bp, Artificial Sequence
  chemically synthesized
accaaaaacaattaacctgatt

SEQ ID NO: 861490 - DNA, 22 bp, Artificial Sequence
  chemically synthesized
aatccttgcccattttaaaatc

SEQ ID NO: 861491 - DNA, 22 bp, Artificial Sequence
  chemically synthesized
aaatccttgcccattttaaaat

SEQ ID NO: 861492 - DNA, 22 bp, Artificial Sequence
  chemically synthesized
tttaaatccttgcccattttaa

SEQ ID NO: 861493 - DNA, 22 bp, Artificial Sequence
  chemically synthesized
acctgattttaaaatgggcaag

SEQ ID NO: 861494 - DNA, 22 bp, Artificial Sequence
  chemically synthesized
attttaaaatgggcaaggattt

SEQ ID NO: 861495 - DNA, 22 bp, Artificial Sequence
  chemically synthesized
gagaaatgtctatttaaatcct

SEQ ID NO: 861496 - DNA, 22 bp, Artificial Sequence
  chemically synthesized
taaaatgggcaaggatttaaat

SEQ ID NO: 861497 - DNA, 22 bp, Artificial Sequence
  chemically synthesized
ggagaaatgtctatttaaatcc

SEQ ID NO: 861498 - DNA, 22 bp, Artificial Sequence
  chemically synthesized
aaaatgggcaaggatttaaata

SEQ ID NO: 861499 - DNA, 22 bp, Artificial Sequence
  chemically synthesized
tggagaaatgtctatttaaatc

SEQ ID NO: 861500 - DNA, 22 bp, Artificial Sequence
  chemically synthesized
aaatgggcaaggatttaaatag

SEQ ID NO: 861501 - DNA, 22 bp, Artificial Sequence
  chemically synthesized
tttggagaaatgtctatttaaa

SEQ ID NO: 861502 - DNA, 22 bp, Artificial Sequence
  chemically synthesized
ctttggagaaatgtctatttaa

SEQ ID NO: 861503 - DNA, 22 bp, Artificial Sequence
  chemically synthesized
tctttggagaaatgtctattta

SEQ ID NO: 861504 - DNA, 22 bp, Artificial Sequence
  chemically synthesized
tgtatatattttctttggagaa

SEQ ID NO: 861505 - DNA, 22 bp, Artificial Sequence
  chemically synthesized
aaatagacatttctccaaagaa

SEQ ID NO: 861506 - DNA, 22 bp, Artificial Sequence
  chemically synthesized
aatagacatttctccaaagaaa

SEQ ID NO: 861507 - DNA, 22 bp, Artificial Sequence
  chemically synthesized
gctgtgtatatattttctttgg

SEQ ID NO: 861508 - DNA, 22 bp, Artificial Sequence
  chemically synthesized
ttggctgtgtatatattttctt

SEQ ID NO: 861509 - DNA, 22 bp, Artificial Sequence
  chemically synthesized
gttggctgtgtatatattttct

SEQ ID NO: 861510 - DNA, 22 bp, Artificial Sequence
  chemically synthesized
ctccaaagaaaatatatacaca

SEQ ID NO: 861511 - DNA, 22 bp, Artificial Sequence
  chemically synthesized
tccaaagaaaatatatacacag

SEQ ID NO: 861512 - DNA, 22 bp, Artificial Sequence
  chemically synthesized
agatgcttgttggctgtgtata

SEQ ID NO: 861513 - DNA, 22 bp, Artificial Sequence
  chemically synthesized
caaagaaaatatatacacagcc

SEQ ID NO: 861514 - DNA, 22 bp, Artificial Sequence
  chemically synthesized
cagatgcttgttggctgtgtat

SEQ ID NO: 861515 - DNA, 22 bp, Artificial Sequence
  chemically synthesized
tcagatgcttgttggctgtgta

SEQ ID NO: 861516 - DNA, 22 bp, Artificial Sequence
  chemically synthesized
agtatgttttcagatgcttgtt

SEQ ID NO: 861517 - DNA, 22 bp, Artificial Sequence
  chemically synthesized
acgatgttgagtatgttttcag

SEQ ID NO: 861518 - DNA, 22 bp, Artificial Sequence
  chemically synthesized
cccgatgattgacgatgttgag

SEQ ID NO: 861519 - DNA, 22 bp, Artificial Sequence
  chemically synthesized
ccccgatgattgacgatgttga

SEQ ID NO: 861520 - DNA, 22 bp, Artificial Sequence
  chemically synthesized
aaaacatactcaacatcgtcaa

SEQ ID NO: 861521 - DNA, 22 bp, Artificial Sequence
  chemically synthesized
catttccccgatgattgacgat

SEQ ID NO: 861522 - DNA, 22 bp, Artificial Sequence
  chemically synthesized
gcatttccccgatgattgacga

SEQ ID NO: 861523 - DNA, 22 bp, Artificial Sequence
  chemically synthesized
atttgcatttccccgatgattg

SEQ ID NO: 861524 - DNA, 22 bp, Artificial Sequence
  chemically synthesized
catttgcatttccccgatgatt

SEQ ID NO: 861525 - DNA, 22 bp, Artificial Sequence
  chemically synthesized
ttcatttgcatttccccgatga

SEQ ID NO: 861526 - DNA, 22 bp, Artificial Sequence
  chemically synthesized
aacatcgtcaatcatcggggaa

SEQ ID NO: 861527 - DNA, 22 bp, Artificial Sequence
  chemically synthesized
gttcttcatttgcatttccccg

SEQ ID NO: 861528 - DNA, 22 bp, Artificial Sequence
  chemically synthesized
cgttcttcatttgcatttcccc

SEQ ID NO: 861529 - DNA, 22 bp, Artificial Sequence
  chemically synthesized
tcgttcttcatttgcatttccc

SEQ ID NO: 861530 - DNA, 22 bp, Artificial Sequence
  chemically synthesized
tggttttcgttcttcatttgca

SEQ ID NO: 861531 - DNA, 22 bp, Artificial Sequence
  chemically synthesized
attgtggttttcgttcttcatt

SEQ ID NO: 861532 - DNA, 22 bp, Artificial Sequence
  chemically synthesized
tgaggtaatatctcattgtggt

SEQ ID NO: 861533 - DNA, 22 bp, Artificial Sequence
  chemically synthesized
atggttgtgaggtaatatctca

SEQ ID NO: 861534 - DNA, 22 bp, Artificial Sequence
  chemically synthesized
tgatcgtggtcatcctcatggt

SEQ ID NO: 861535 - DNA, 22 bp, Artificial Sequence
  chemically synthesized
atgatcgtggtcatcctcatgg

SEQ ID NO: 861536 - DNA, 22 bp, Artificial Sequence
  chemically synthesized
tttatgatcgtggtcatcctca

SEQ ID NO: 861537 - DNA, 22 bp, Artificial Sequence
  chemically synthesized
cctcacaaccatgaggatgacc

SEQ ID NO: 861538 - DNA, 22 bp, Artificial Sequence
  chemically synthesized
tgtttatgatcgtggtcatcct

SEQ ID NO: 861539 - DNA, 22 bp, Artificial Sequence
  chemically synthesized
ctgtttatgatcgtggtcatcc

SEQ ID NO: 861540 - DNA, 22 bp, Artificial Sequence
  chemically synthesized
tctgtttatgatcgtggtcatc

SEQ ID NO: 861541 - DNA, 22 bp, Artificial Sequence
  chemically synthesized
acaaccatgaggatgaccacga

SEQ ID NO: 861542 - DNA, 22 bp, Artificial Sequence
  chemically synthesized
ttttctgtttatgatcgtggtc

SEQ ID NO: 861543 - DNA, 22 bp, Artificial Sequence
  chemically synthesized
ccagcacatgttattttctgtt

SEQ ID NO: 861544 - DNA, 22 bp, Artificial Sequence
  chemically synthesized
gccagcacatgttattttctgt

SEQ ID NO: 861545 - DNA, 22 bp, Artificial Sequence
  chemically synthesized
cacatccttgccagcacatgtt

SEQ ID NO: 861546 - DNA, 22 bp, Artificial Sequence
  chemically synthesized
tccacatccttgccagcacatg

SEQ ID NO: 861547 - DNA, 22 bp, Artificial Sequence
  chemically synthesized
ctccacatccttgccagcacat

SEQ ID NO: 861548 - DNA, 22 bp, Artificial Sequence
  chemically synthesized
agtttctccacatccttgccag

SEQ ID NO: 861549 - DNA, 22 bp, Artificial Sequence
  chemically synthesized
cagtttctccacatccttgcca

SEQ ID NO: 861550 - DNA, 22 bp, Artificial Sequence
  chemically synthesized
gcaaggatgtggagaaactgaa

SEQ ID NO: 861551 - DNA, 22 bp, Artificial Sequence
  chemically synthesized
ccaccaacaatgcagaagtgtt

SEQ ID NO: 861552 - DNA, 22 bp, Artificial Sequence
  chemically synthesized
acattcccaccaacaatgcaga

SEQ ID NO: 861553 - DNA, 22 bp, Artificial Sequence
  chemically synthesized
cacattcccaccaacaatgcag

SEQ ID NO: 861554 - DNA, 22 bp, Artificial Sequence
  chemically synthesized
tcacattcccaccaacaatgca

SEQ ID NO: 861555 - DNA, 22 bp, Artificial Sequence
  chemically synthesized
ttcacattcccaccaacaatgc

SEQ ID NO: 861556 - DNA, 22 bp, Artificial Sequence
  chemically synthesized
aaacacttctgcattgttggtg

SEQ ID NO: 861557 - DNA, 22 bp, Artificial Sequence
  chemically synthesized
caccttttcacattcccaccaa

SEQ ID NO: 861558 - DNA, 22 bp, Artificial Sequence
  chemically synthesized
ctgcattgttggtgggaatgtg

SEQ ID NO: 861559 - DNA, 22 bp, Artificial Sequence
  chemically synthesized
tgcattgttggtgggaatgtga

SEQ ID NO: 861560 - DNA, 22 bp, Artificial Sequence
  chemically synthesized
cattgttggtgggaatgtgaaa

SEQ ID NO: 861561 - DNA, 22 bp, Artificial Sequence
  chemically synthesized
catagtggctacaccttttcac

SEQ ID NO: 861562 - DNA, 22 bp, Artificial Sequence
  chemically synthesized
ttggtgggaatgtgaaaaggtg

SEQ ID NO: 861563 - DNA, 22 bp, Artificial Sequence
  chemically synthesized
ccatagtggctacaccttttca

SEQ ID NO: 861564 - DNA, 22 bp, Artificial Sequence
  chemically synthesized
tccatagtggctacaccttttc

SEQ ID NO: 861565 - DNA, 22 bp, Artificial Sequence
  chemically synthesized
gtgggaatgtgaaaaggtgtag

SEQ ID NO: 861566 - DNA, 22 bp, Artificial Sequence
  chemically synthesized
catacggttttccatagtggct

SEQ ID NO: 861567 - DNA, 22 bp, Artificial Sequence
  chemically synthesized
ccatacggttttccatagtggc

SEQ ID NO: 861568 - DNA, 22 bp, Artificial Sequence
  chemically synthesized
aggaacttccatacggttttcc

SEQ ID NO: 861569 - DNA, 22 bp, Artificial Sequence
  chemically synthesized
gaggaacttccatacggttttc

SEQ ID NO: 861570 - DNA, 22 bp, Artificial Sequence
  chemically synthesized
tgaggaacttccatacggtttt

SEQ ID NO: 861571 - DNA, 22 bp, Artificial Sequence
  chemically synthesized
tgttttgaggaacttccatacg

SEQ ID NO: 861572 - DNA, 22 bp, Artificial Sequence
  chemically synthesized
atgttttgaggaacttccatac

SEQ ID NO: 861573 - DNA, 22 bp, Artificial Sequence
  chemically synthesized
tatgttttgaggaacttccata

SEQ ID NO: 861574 - DNA, 22 bp, Artificial Sequence
  chemically synthesized
ttatgttttgaggaacttccat

SEQ ID NO: 861575 - DNA, 22 bp, Artificial Sequence
  chemically synthesized
tggaaaaccgtatggaagttcc

SEQ ID NO: 861576 - DNA, 22 bp, Artificial Sequence
  chemically synthesized
tttttatgttttgaggaacttc

SEQ ID NO: 861577 - DNA, 22 bp, Artificial Sequence
  chemically synthesized
tatttttatgttttgaggaact

SEQ ID NO: 861578 - DNA, 22 bp, Artificial Sequence
  chemically synthesized
tatgataattctatttttatgt

SEQ ID NO: 861579 - DNA, 22 bp, Artificial Sequence
  chemically synthesized
gattatatgataattctatttt

SEQ ID NO: 861580 - DNA, 22 bp, Artificial Sequence
  chemically synthesized
ctcaaaacataaaaatagaatt

SEQ ID NO: 861581 - DNA, 22 bp, Artificial Sequence
  chemically synthesized
aaaacataaaaatagaattatc

SEQ ID NO: 861582 - DNA, 22 bp, Artificial Sequence
  chemically synthesized
aggactggattatatgataatt

SEQ ID NO: 861583 - DNA, 22 bp, Artificial Sequence
  chemically synthesized
gaggactggattatatgataat

SEQ ID NO: 861584 - DNA, 22 bp, Artificial Sequence
  chemically synthesized
tgaggactggattatatgataa

SEQ ID NO: 861585 - DNA, 22 bp, Artificial Sequence
  chemically synthesized
ttgaggactggattatatgata

SEQ ID NO: 861586 - DNA, 22 bp, Artificial Sequence
  chemically synthesized
tttgaggactggattatatgat

SEQ ID NO: 861587 - DNA, 22 bp, Artificial Sequence
  chemically synthesized
ttttttgaggactggattatat

SEQ ID NO: 861588 - DNA, 22 bp, Artificial Sequence
  chemically synthesized
attttttgaggactggattata

SEQ ID NO: 861589 - DNA, 22 bp, Artificial Sequence
  chemically synthesized
tattttttgaggactggattat

SEQ ID NO: 861590 - DNA, 22 bp, Artificial Sequence
  chemically synthesized
ttattttttgaggactggatta

SEQ ID NO: 861591 - DNA, 22 bp, Artificial Sequence
  chemically synthesized
tttttattttttgaggactgga

SEQ ID NO: 861592 - DNA, 22 bp, Artificial Sequence
  chemically synthesized
tatttttattttttgaggactg

SEQ ID NO: 861593 - DNA, 22 bp, Artificial Sequence
  chemically synthesized
tcatataatccagtcctcaaaa

SEQ ID NO: 861594 - DNA, 22 bp, Artificial Sequence
  chemically synthesized
tatgataattctatttttattt

SEQ ID NO: 861595 - DNA, 22 bp, Artificial Sequence
  chemically synthesized
gattatatgataattctatttt

SEQ ID NO: 861596 - DNA, 22 bp, Artificial Sequence
  chemically synthesized
ctggattatatgataattctat

SEQ ID NO: 861597 - DNA, 22 bp, Artificial Sequence
  chemically synthesized
aaaaaataaaaatagaattatc

SEQ ID NO: 861598 - DNA, 22 bp, Artificial Sequence
  chemically synthesized
tcatataatccagcaatcccat

SEQ ID NO: 861599 - DNA, 22 bp, Artificial Sequence
  chemically synthesized
accgtacacccagaaatgggat

SEQ ID NO: 861600 - DNA, 22 bp, Artificial Sequence
  chemically synthesized
gggactaaccgtacacccagaa

SEQ ID NO: 861601 - DNA, 22 bp, Artificial Sequence
  chemically synthesized
gtaagttggggactaaccgtac

SEQ ID NO: 861602 - DNA, 22 bp, Artificial Sequence
  chemically synthesized
agtaagttggggactaaccgta

SEQ ID NO: 861603 - DNA, 22 bp, Artificial Sequence
  chemically synthesized
ctgggtgtacggttagtcccca

SEQ ID NO: 861604 - DNA, 22 bp, Artificial Sequence
  chemically synthesized
tgggtgtacggttagtccccaa

SEQ ID NO: 861605 - DNA, 22 bp, Artificial Sequence
  chemically synthesized
gaccttagtaagttggggacta

SEQ ID NO: 861606 - DNA, 22 bp, Artificial Sequence
  chemically synthesized
ggtgtacggttagtccccaact

SEQ ID NO: 861607 - DNA, 22 bp, Artificial Sequence
  chemically synthesized
caagttagaccttagtaagttg

SEQ ID NO: 861608 - DNA, 22 bp, Artificial Sequence
  chemically synthesized
gtccccaacttactaaggtcta

SEQ ID NO: 861609 - DNA, 22 bp, Artificial Sequence
  chemically synthesized
taaagtccaaaaattacaagtt

SEQ ID NO: 861610 - DNA, 22 bp, Artificial Sequence
  chemically synthesized
actaaggtctaacttgtaattt

SEQ ID NO: 861611 - DNA, 22 bp, Artificial Sequence
  chemically synthesized
ctaaggtctaacttgtaatttt

SEQ ID NO: 861612 - DNA, 22 bp, Artificial Sequence
  chemically synthesized
aggtctaacttgtaatttttgg

SEQ ID NO: 861613 - DNA, 22 bp, Artificial Sequence
  chemically synthesized
acaccattgtaaagtccaaaaa

SEQ ID NO: 861614 - DNA, 22 bp, Artificial Sequence
  chemically synthesized
cacaccattgtaaagtccaaaa

SEQ ID NO: 861615 - DNA, 22 bp, Artificial Sequence
  chemically synthesized
tcacaccattgtaaagtccaaa

SEQ ID NO: 861616 - DNA, 22 bp, Artificial Sequence
  chemically synthesized
acttgtaatttttggactttac

SEQ ID NO: 861617 - DNA, 22 bp, Artificial Sequence
  chemically synthesized
gtaatttttggactttacaatg

SEQ ID NO: 861618 - DNA, 22 bp, Artificial Sequence
  chemically synthesized
taatttttggactttacaatgg

SEQ ID NO: 861619 - DNA, 22 bp, Artificial Sequence
  chemically synthesized
ttggactttacaatggtgtgaa

SEQ ID NO: 861620 - DNA, 22 bp, Artificial Sequence
  chemically synthesized
tggactttacaatggtgtgaaa

SEQ ID NO: 861621 - DNA, 22 bp, Artificial Sequence
  chemically synthesized
ggactttacaatggtgtgaaag

SEQ ID NO: 861622 - DNA, 22 bp, Artificial Sequence
  chemically synthesized
gactttacaatggtgtgaaagc

SEQ ID NO: 861623 - DNA, 22 bp, Artificial Sequence
  chemically synthesized
atgaatgcatatcgctttcaca

SEQ ID NO: 861624 - DNA, 22 bp, Artificial Sequence
  chemically synthesized
aatgaatgcatatcgctttcac

SEQ ID NO: 861625 - DNA, 22 bp, Artificial Sequence
  chemically synthesized
ttaatgaatgcatatcgctttc

SEQ ID NO: 861626 - DNA, 22 bp, Artificial Sequence
  chemically synthesized
tacaatggtgtgaaagcgatat

SEQ ID NO: 861627 - DNA, 22 bp, Artificial Sequence
  chemically synthesized
cttaatgaatgcatatcgcttt

SEQ ID NO: 861628 - DNA, 22 bp, Artificial Sequence
  chemically synthesized
acaatggtgtgaaagcgatatg

SEQ ID NO: 861629 - DNA, 22 bp, Artificial Sequence
  chemically synthesized
caatggtgtgaaagcgatatgc

SEQ ID NO: 861630 - DNA, 22 bp, Artificial Sequence
  chemically synthesized
aagtatggtttcttaatgaatg

SEQ ID NO: 861631 - DNA, 22 bp, Artificial Sequence
  chemically synthesized
gaagtatggtttcttaatgaat

SEQ ID NO: 861632 - DNA, 22 bp, Artificial Sequence
  chemically synthesized
aaaatttgaagtatggtttctt

SEQ ID NO: 861633 - DNA, 22 bp, Artificial Sequence
  chemically synthesized
attaagaaaccatacttcaaat

SEQ ID NO: 861634 - DNA, 22 bp, Artificial Sequence
  chemically synthesized
agaaaccatacttcaaattttg

SEQ ID NO: 861635 - DNA, 22 bp, Artificial Sequence
  chemically synthesized
gaaaagatcaaaattcaaaatt

SEQ ID NO: 861636 - DNA, 22 bp, Artificial Sequence
  chemically synthesized
gccctagaaaagatcaaaattc

SEQ ID NO: 861637 - DNA, 22 bp, Artificial Sequence
  chemically synthesized
ctagccctagaaaagatcaaaa

SEQ ID NO: 861638 - DNA, 22 bp, Artificial Sequence
  chemically synthesized
caaattttgaattttgatcttt

SEQ ID NO: 861639 - DNA, 22 bp, Artificial Sequence
  chemically synthesized
actagccctagaaaagatcaaa

SEQ ID NO: 861640 - DNA, 22 bp, Artificial Sequence
  chemically synthesized
aaattttgaattttgatctttt

SEQ ID NO: 861641 - DNA, 22 bp, Artificial Sequence
  chemically synthesized
tgaattttgatcttttctaggg

SEQ ID NO: 861642 - DNA, 22 bp, Artificial Sequence
  chemically synthesized
catatttactagccctagaaaa

SEQ ID NO: 861643 - DNA, 22 bp, Artificial Sequence
  chemically synthesized
gaattttgatcttttctagggc

SEQ ID NO: 861644 - DNA, 22 bp, Artificial Sequence
  chemically synthesized
aattttgatcttttctagggct

SEQ ID NO: 861645 - DNA, 22 bp, Artificial Sequence
  chemically synthesized
tgatcttttctagggctagtaa

SEQ ID NO: 861646 - DNA, 22 bp, Artificial Sequence
  chemically synthesized
gatcttttctagggctagtaaa

SEQ ID NO: 861647 - DNA, 22 bp, Artificial Sequence
  chemically synthesized
atcttttctagggctagtaaat

SEQ ID NO: 861648 - DNA, 22 bp, Artificial Sequence
  chemically synthesized
ttctagggctagtaaatatgca

SEQ ID NO: 861649 - DNA, 22 bp, Artificial Sequence
  chemically synthesized
tctagggctagtaaatatgcag

SEQ ID NO: 861650 - DNA, 22 bp, Artificial Sequence
  chemically synthesized
ctagggctagtaaatatgcagt

SEQ ID NO: 861651 - DNA, 22 bp, Artificial Sequence
  chemically synthesized
tagggctagtaaatatgcagta

SEQ ID NO: 861652 - DNA, 22 bp, Artificial Sequence
  chemically synthesized
gggctagtaaatatgcagtatg

SEQ ID NO: 861653 - DNA, 22 bp, Artificial Sequence
  chemically synthesized
gtaaatatgcagtatgatactc

SEQ ID NO: 861654 - DNA, 22 bp, Artificial Sequence
  chemically synthesized
caacccaatatgtcagaagaga

SEQ ID NO: 861655 - DNA, 22 bp, Artificial Sequence
  chemically synthesized
tcttctgacatattgggttgca

SEQ ID NO: 861656 - DNA, 22 bp, Artificial Sequence
  chemically synthesized
ttctgacatattgggttgcagc

SEQ ID NO: 861657 - DNA, 22 bp, Artificial Sequence
  chemically synthesized
ctgacatattgggttgcagcat

SEQ ID NO: 861658 - DNA, 22 bp, Artificial Sequence
  chemically synthesized
atgataaatatcatgctgcaac

SEQ ID NO: 861659 - DNA, 22 bp, Artificial Sequence
  chemically synthesized
tgacatattgggttgcagcatg

SEQ ID NO: 861660 - DNA, 22 bp, Artificial Sequence
  chemically synthesized
acatattgggttgcagcatgat

SEQ ID NO: 861661 - DNA, 22 bp, Artificial Sequence
  chemically synthesized
tcctcatgataaatatcatgct

SEQ ID NO: 861662 - DNA, 22 bp, Artificial Sequence
  chemically synthesized
atcctcatgataaatatcatgc

SEQ ID NO: 861663 - DNA, 22 bp, Artificial Sequence
  chemically synthesized
tttatcctcatgataaatatca

SEQ ID NO: 861664 - DNA, 22 bp, Artificial Sequence
  chemically synthesized
ggttgcagcatgatatttatca

SEQ ID NO: 861665 - DNA, 22 bp, Artificial Sequence
  chemically synthesized
cagcatgatatttatcatgagg

SEQ ID NO: 861666 - DNA, 22 bp, Artificial Sequence
  chemically synthesized
atcatgaggataaataattgat

SEQ ID NO: 861667 - DNA, 22 bp, Artificial Sequence
  chemically synthesized
tcatgaggataaataattgata

SEQ ID NO: 861668 - DNA, 22 bp, Artificial Sequence
  chemically synthesized
caacacagtacatagtagagta

SEQ ID NO: 861669 - DNA, 22 bp, Artificial Sequence
  chemically synthesized
gcaacacagtacatagtagagt

SEQ ID NO: 861670 - DNA, 22 bp, Artificial Sequence
  chemically synthesized
atactctactatgtactgtgtt

SEQ ID NO: 861671 - DNA, 22 bp, Artificial Sequence
  chemically synthesized
ggcaaaatcatcttgcaacaca

SEQ ID NO: 861672 - DNA, 22 bp, Artificial Sequence
  chemically synthesized
tactatgtactgtgttgcaaga

SEQ ID NO: 861673 - DNA, 22 bp, Artificial Sequence
  chemically synthesized
ctatgtactgtgttgcaagatg

SEQ ID NO: 861674 - DNA, 22 bp, Artificial Sequence
  chemically synthesized
tgtactgtgttgcaagatgatt

SEQ ID NO: 861675 - DNA, 22 bp, Artificial Sequence
  chemically synthesized
cagtacatctgggcaaaatcat

SEQ ID NO: 861676 - DNA, 22 bp, Artificial Sequence
  chemically synthesized
tgttgcaagatgattttgccca

SEQ ID NO: 861677 - DNA, 22 bp, Artificial Sequence
  chemically synthesized
caagatgattttgcccagatgt

SEQ ID NO: 861678 - DNA, 22 bp, Artificial Sequence
  chemically synthesized
tcagaacatgtagattacagta

SEQ ID NO: 861679 - DNA, 22 bp, Artificial Sequence
  chemically synthesized
tgcccagatgtactgtaatcta

SEQ ID NO: 861680 - DNA, 22 bp, Artificial Sequence
  chemically synthesized
gcccagatgtactgtaatctac

SEQ ID NO: 861681 - DNA, 22 bp, Artificial Sequence
  chemically synthesized
cccagatgtactgtaatctaca

SEQ ID NO: 861682 - DNA, 22 bp, Artificial Sequence
  chemically synthesized
aatgttatcagaacatgtagat

SEQ ID NO: 861683 - DNA, 22 bp, Artificial Sequence
  chemically synthesized
aaatgttatcagaacatgtaga

SEQ ID NO: 861684 - DNA, 22 bp, Artificial Sequence
  chemically synthesized
taaatgttatcagaacatgtag

SEQ ID NO: 861685 - DNA, 22 bp, Artificial Sequence
  chemically synthesized
taatctacatgttctgataaca

SEQ ID NO: 861686 - DNA, 22 bp, Artificial Sequence
  chemically synthesized
gcatactttaaatgttatcaga

SEQ ID NO: 861687 - DNA, 22 bp, Artificial Sequence
  chemically synthesized
gtctagcatactttaaatgtta

SEQ ID NO: 861688 - DNA, 22 bp, Artificial Sequence
  chemically synthesized
agtctagcatactttaaatgtt

SEQ ID NO: 861689 - DNA, 22 bp, Artificial Sequence
  chemically synthesized
catgttctgataacatttaaag

SEQ ID NO: 861690 - DNA, 22 bp, Artificial Sequence
  chemically synthesized
cttagtctagcatactttaaat

SEQ ID NO: 861691 - DNA, 22 bp, Artificial Sequence
  chemically synthesized
tgataacatttaaagtatgcta

SEQ ID NO: 861692 - DNA, 22 bp, Artificial Sequence
  chemically synthesized
ataacatttaaagtatgctaga

SEQ ID NO: 861693 - DNA, 22 bp, Artificial Sequence
  chemically synthesized
ccaaacatcattgcttagtcta

SEQ ID NO: 861694 - DNA, 22 bp, Artificial Sequence
  chemically synthesized
aaagtatgctagactaagcaat

SEQ ID NO: 861695 - DNA, 22 bp, Artificial Sequence
  chemically synthesized
aagtatgctagactaagcaatg

SEQ ID NO: 861696 - DNA, 22 bp, Artificial Sequence
  chemically synthesized
agctaccaaacatcattgctta

SEQ ID NO: 861697 - DNA, 22 bp, Artificial Sequence
  chemically synthesized
gactaagcaatgatgtttggta

SEQ ID NO: 861698 - DNA, 22 bp, Artificial Sequence
  chemically synthesized
atatgcctaagctaccaaacat

SEQ ID NO: 861699 - DNA, 22 bp, Artificial Sequence
  chemically synthesized
aatatgcctaagctaccaaaca

SEQ ID NO: 861700 - DNA, 22 bp, Artificial Sequence
  chemically synthesized
agcaatgatgtttggtagctta

SEQ ID NO: 861701 - DNA, 22 bp, Artificial Sequence
  chemically synthesized
atttaatatgcctaagctacca

SEQ ID NO: 861702 - DNA, 22 bp, Artificial Sequence
  chemically synthesized
ggtagcttaggcatattaaatt

SEQ ID NO: 861703 - DNA, 22 bp, Artificial Sequence
  chemically synthesized
gtagcttaggcatattaaatta

SEQ ID NO: 861704 - DNA, 22 bp, Artificial Sequence
  chemically synthesized
aggcatattaaattaatttttg

SEQ ID NO: 861705 - DNA, 22 bp, Artificial Sequence
  chemically synthesized
aaaatatcatgtcaaaaattaa

SEQ ID NO: 861706 - DNA, 22 bp, Artificial Sequence
  chemically synthesized
ggcatattaaattaatttttga

SEQ ID NO: 861707 - DNA, 22 bp, Artificial Sequence
  chemically synthesized
aattaatttttgacatgatatt

SEQ ID NO: 861708 - DNA, 22 bp, Artificial Sequence
  chemically synthesized
atttttgacatgatattttcaa

SEQ ID NO: 861709 - DNA, 22 bp, Artificial Sequence
  chemically synthesized
ttgacatgatattttcaactta

SEQ ID NO: 861710 - DNA, 22 bp, Artificial Sequence
  chemically synthesized
tgacatgatattttcaacttat

SEQ ID NO: 861711 - DNA, 22 bp, Artificial Sequence
  chemically synthesized
gacatgatattttcaacttatg

SEQ ID NO: 861712 - DNA, 22 bp, Artificial Sequence
  chemically synthesized
acatgatattttcaacttatga

SEQ ID NO: 861713 - DNA, 22 bp, Artificial Sequence
  chemically synthesized
catcccaatcagcccatcataa

SEQ ID NO: 861714 - DNA, 22 bp, Artificial Sequence
  chemically synthesized
ggattacatcccaatcagccca

SEQ ID NO: 861715 - DNA, 22 bp, Artificial Sequence
  chemically synthesized
tcaacttatgatgggctgattg

SEQ ID NO: 861716 - DNA, 22 bp, Artificial Sequence
  chemically synthesized
caacttatgatgggctgattgg

SEQ ID NO: 861717 - DNA, 22 bp, Artificial Sequence
  chemically synthesized
aacttatgatgggctgattggg

SEQ ID NO: 861718 - DNA, 22 bp, Artificial Sequence
  chemically synthesized
cactgggattacatcccaatca

SEQ ID NO: 861719 - DNA, 22 bp, Artificial Sequence
  chemically synthesized
acactgggattacatcccaatc

SEQ ID NO: 861720 - DNA, 22 bp, Artificial Sequence
  chemically synthesized
atgatgggctgattgggatgta

SEQ ID NO: 861721 - DNA, 22 bp, Artificial Sequence
  chemically synthesized
tgatgggctgattgggatgtaa

SEQ ID NO: 861722 - DNA, 22 bp, Artificial Sequence
  chemically synthesized
atttacactgggattacatccc

SEQ ID NO: 861723 - DNA, 22 bp, Artificial Sequence
  chemically synthesized
attgatttacactgggattaca

SEQ ID NO: 861724 - DNA, 22 bp, Artificial Sequence
  chemically synthesized
attgggatgtaatcccagtgta

SEQ ID NO: 861725 - DNA, 22 bp, Artificial Sequence
  chemically synthesized
ggatgtaatcccagtgtaaatc

SEQ ID NO: 861726 - DNA, 22 bp, Artificial Sequence
  chemically synthesized
gatatacagatgctcattgatt

SEQ ID NO: 861727 - DNA, 22 bp, Artificial Sequence
  chemically synthesized
ggatatacagatgctcattgat

SEQ ID NO: 861728 - DNA, 22 bp, Artificial Sequence
  chemically synthesized
tggatatacagatgctcattga

SEQ ID NO: 861729 - DNA, 22 bp, Artificial Sequence
  chemically synthesized
ttggatatacagatgctcattg

SEQ ID NO: 861730 - DNA, 22 bp, Artificial Sequence
  chemically synthesized
ttttggatatacagatgctcat

SEQ ID NO: 861731 - DNA, 22 bp, Artificial Sequence
  chemically synthesized
attcttttggatatacagatgc

SEQ ID NO: 861732 - DNA, 22 bp, Artificial Sequence
  chemically synthesized
aattcttttggatatacagatg

SEQ ID NO: 861733 - DNA, 22 bp, Artificial Sequence
  chemically synthesized
taattcttttggatatacagat

SEQ ID NO: 861734 - DNA, 22 bp, Artificial Sequence
  chemically synthesized
ttaattcttttggatatacaga

SEQ ID NO: 861735 - DNA, 22 bp, Artificial Sequence
  chemically synthesized
tttttaattcttttggatatac

SEQ ID NO: 861736 - DNA, 22 bp, Artificial Sequence
  chemically synthesized
agatcctgtttttaattctttt

SEQ ID NO: 861737 - DNA, 22 bp, Artificial Sequence
  chemically synthesized
aagatcctgtttttaattcttt

SEQ ID NO: 861738 - DNA, 22 bp, Artificial Sequence
  chemically synthesized
taagatcctgtttttaattctt

SEQ ID NO: 861739 - DNA, 22 bp, Artificial Sequence
  chemically synthesized
tttaagatcctgtttttaattc

SEQ ID NO: 861740 - DNA, 22 bp, Artificial Sequence
  chemically synthesized
tatatccaaaagaattaaaaac

SEQ ID NO: 861741 - DNA, 22 bp, Artificial Sequence
  chemically synthesized
aaaacaggatcttaaagagata

SEQ ID NO: 861742 - DNA, 22 bp, Artificial Sequence
  chemically synthesized
atatgagtgtgcaaatatctct

SEQ ID NO: 861743 - DNA, 22 bp, Artificial Sequence
  chemically synthesized
aaagagatatttgcacactcat

SEQ ID NO: 861744 - DNA, 22 bp, Artificial Sequence
  chemically synthesized
aagagatatttgcacactcata

SEQ ID NO: 861745 - DNA, 22 bp, Artificial Sequence
  chemically synthesized
tgccgcagttaatatgagtgtg

SEQ ID NO: 861746 - DNA, 22 bp, Artificial Sequence
  chemically synthesized
tgaattatgccgcagttaatat

SEQ ID NO: 861747 - DNA, 22 bp, Artificial Sequence
  chemically synthesized
ttgtgaattatgccgcagttaa

SEQ ID NO: 861748 - DNA, 22 bp, Artificial Sequence
  chemically synthesized
gcacactcatattaactgcggc

SEQ ID NO: 861749 - DNA, 22 bp, Artificial Sequence
  chemically synthesized
cacactcatattaactgcggca

SEQ ID NO: 861750 - DNA, 22 bp, Artificial Sequence
  chemically synthesized
gctattgtgaattatgccgcag

SEQ ID NO: 861751 - DNA, 22 bp, Artificial Sequence
  chemically synthesized
ggctattgtgaattatgccgca

SEQ ID NO: 861752 - DNA, 22 bp, Artificial Sequence
  chemically synthesized
tggctattgtgaattatgccgc

SEQ ID NO: 861753 - DNA, 22 bp, Artificial Sequence
  chemically synthesized
ttggctattgtgaattatgccg

SEQ ID NO: 861754 - DNA, 22 bp, Artificial Sequence
  chemically synthesized
atattaactgcggcataattca

SEQ ID NO: 861755 - DNA, 22 bp, Artificial Sequence
  chemically synthesized
aatttttggctattgtgaatta

SEQ ID NO: 861756 - DNA, 22 bp, Artificial Sequence
  chemically synthesized
caatttttggctattgtgaatt

SEQ ID NO: 861757 - DNA, 22 bp, Artificial Sequence
  chemically synthesized
actgcggcataattcacaatag

SEQ ID NO: 861758 - DNA, 22 bp, Artificial Sequence
  chemically synthesized
cttcaatttttggctattgtga

SEQ ID NO: 861759 - DNA, 22 bp, Artificial Sequence
  chemically synthesized
cggcataattcacaatagccaa

SEQ ID NO: 861760 - DNA, 22 bp, Artificial Sequence
  chemically synthesized
gttacttcaatttttggctatt

SEQ ID NO: 861761 - DNA, 22 bp, Artificial Sequence
  chemically synthesized
agttacttcaatttttggctat

SEQ ID NO: 861762 - DNA, 22 bp, Artificial Sequence
  chemically synthesized
tagttacttcaatttttggcta

SEQ ID NO: 861763 - DNA, 22 bp, Artificial Sequence
  chemically synthesized
acaatagccaaaaattgaagta

SEQ ID NO: 861764 - DNA, 22 bp, Artificial Sequence
  chemically synthesized
tcaatcaatggacattttagtt

SEQ ID NO: 861765 - DNA, 22 bp, Artificial Sequence
  chemically synthesized
atcaatcaatggacattttagt

SEQ ID NO: 861766 - DNA, 22 bp, Artificial Sequence
  chemically synthesized
aagtaactaaaatgtccattga

SEQ ID NO: 861767 - DNA, 22 bp, Artificial Sequence
  chemically synthesized
atccgtttatcaatcaatggac

SEQ ID NO: 861768 - DNA, 22 bp, Artificial Sequence
  chemically synthesized
aatccgtttatcaatcaatgga

SEQ ID NO: 861769 - DNA, 22 bp, Artificial Sequence
  chemically synthesized
taatccgtttatcaatcaatgg

SEQ ID NO: 861770 - DNA, 22 bp, Artificial Sequence
  chemically synthesized
ttaatccgtttatcaatcaatg

SEQ ID NO: 861771 - DNA, 22 bp, Artificial Sequence
  chemically synthesized
tttaatccgtttatcaatcaat

SEQ ID NO: 861772 - DNA, 22 bp, Artificial Sequence
  chemically synthesized
aaatgtccattgattgataaac

SEQ ID NO: 861773 - DNA, 22 bp, Artificial Sequence
  chemically synthesized
taccacattttttaatccgttt

SEQ ID NO: 861774 - DNA, 22 bp, Artificial Sequence
  chemically synthesized
attgataaacggattaaaaaat

SEQ ID NO: 861775 - DNA, 22 bp, Artificial Sequence
  chemically synthesized
tgtcctataccacattttttaa

SEQ ID NO: 861776 - DNA, 22 bp, Artificial Sequence
  chemically synthesized
ataaacggattaaaaaatgtgg

SEQ ID NO: 861777 - DNA, 22 bp, Artificial Sequence
  chemically synthesized
cgttgtgtcctataccacattt

SEQ ID NO: 861778 - DNA, 22 bp, Artificial Sequence
  chemically synthesized
aaaaatgtggtataggacacaa

SEQ ID NO: 861779 - DNA, 22 bp, Artificial Sequence
  chemically synthesized
tggccgagtaataatattccgt

SEQ ID NO: 861780 - DNA, 22 bp, Artificial Sequence
  chemically synthesized
gtggccgagtaataatattccg

SEQ ID NO: 861781 - DNA, 22 bp, Artificial Sequence
  chemically synthesized
tgtggccgagtaataatattcc

SEQ ID NO: 861782 - DNA, 22 bp, Artificial Sequence
  chemically synthesized
ttgtggccgagtaataatattc

SEQ ID NO: 861783 - DNA, 22 bp, Artificial Sequence
  chemically synthesized
tttgtggccgagtaataatatt

SEQ ID NO: 861784 - DNA, 22 bp, Artificial Sequence
  chemically synthesized
ttttgtggccgagtaataatat

SEQ ID NO: 861785 - DNA, 22 bp, Artificial Sequence
  chemically synthesized
tttttgtggccgagtaataata

SEQ ID NO: 861786 - DNA, 22 bp, Artificial Sequence
  chemically synthesized
tttttttgtggccgagtaataa

SEQ ID NO: 861787 - DNA, 22 bp, Artificial Sequence
  chemically synthesized
ctttttttgtggccgagtaata

SEQ ID NO: 861788 - DNA, 22 bp, Artificial Sequence
  chemically synthesized
cttctttttttgtggccgagta

SEQ ID NO: 861789 - DNA, 22 bp, Artificial Sequence
  chemically synthesized
ccttctttttttgtggccgagt

SEQ ID NO: 861790 - DNA, 22 bp, Artificial Sequence
  chemically synthesized
ttactcggccacaaaaaaagaa

SEQ ID NO: 861791 - DNA, 22 bp, Artificial Sequence
  chemically synthesized
ctcggccacaaaaaaagaagga

SEQ ID NO: 861792 - DNA, 22 bp, Artificial Sequence
  chemically synthesized
ggccacaaaaaaagaaggaaat

SEQ ID NO: 861793 - DNA, 22 bp, Artificial Sequence
  chemically synthesized
tagcataggaaaggatttcctt

SEQ ID NO: 861794 - DNA, 22 bp, Artificial Sequence
  chemically synthesized
aaggtacacccatgttgtagca

SEQ ID NO: 861795 - DNA, 22 bp, Artificial Sequence
  chemically synthesized
caaggtacacccatgttgtagc

SEQ ID NO: 861796 - DNA, 22 bp, Artificial Sequence
  chemically synthesized
tcctatgctacaacatgggtgt

SEQ ID NO: 861797 - DNA, 22 bp, Artificial Sequence
  chemically synthesized
cctatgctacaacatgggtgta

SEQ ID NO: 861798 - DNA, 22 bp, Artificial Sequence
  chemically synthesized
ctatgctacaacatgggtgtac

SEQ ID NO: 861799 - DNA, 22 bp, Artificial Sequence
  chemically synthesized
tgctacaacatgggtgtacctt

SEQ ID NO: 861800 - DNA, 22 bp, Artificial Sequence
  chemically synthesized
gcataatgtcttcaaggtacac

SEQ ID NO: 861801 - DNA, 22 bp, Artificial Sequence
  chemically synthesized
agcataatgtcttcaaggtaca

SEQ ID NO: 861802 - DNA, 22 bp, Artificial Sequence
  chemically synthesized
caacatgggtgtaccttgaaga

SEQ ID NO: 861803 - DNA, 22 bp, Artificial Sequence
  chemically synthesized
acttagcataatgtcttcaagg

SEQ ID NO: 861804 - DNA, 22 bp, Artificial Sequence
  chemically synthesized
cacttagcataatgtcttcaag

SEQ ID NO: 861805 - DNA, 22 bp, Artificial Sequence
  chemically synthesized
tttcacttagcataatgtcttc

SEQ ID NO: 861806 - DNA, 22 bp, Artificial Sequence
  chemically synthesized
atttcacttagcataatgtctt

SEQ ID NO: 861807 - DNA, 22 bp, Artificial Sequence
  chemically synthesized
gcttatttcacttagcataatg

SEQ ID NO: 861808 - DNA, 22 bp, Artificial Sequence
  chemically synthesized
tgactggcttatttcacttagc

SEQ ID NO: 861809 - DNA, 22 bp, Artificial Sequence
  chemically synthesized
gaagacattatgctaagtgaaa

SEQ ID NO: 861810 - DNA, 22 bp, Artificial Sequence
  chemically synthesized
atgactggcttatttcacttag

SEQ ID NO: 861811 - DNA, 22 bp, Artificial Sequence
  chemically synthesized
aagacattatgctaagtgaaat

SEQ ID NO: 861812 - DNA, 22 bp, Artificial Sequence
  chemically synthesized
tatgactggcttatttcactta

SEQ ID NO: 861813 - DNA, 22 bp, Artificial Sequence
  chemically synthesized
tcattttatgactggcttattt

SEQ ID NO: 861814 - DNA, 22 bp, Artificial Sequence
  chemically synthesized
gtcattttatgactggcttatt

SEQ ID NO: 861815 - DNA, 22 bp, Artificial Sequence
  chemically synthesized
tgctaagtgaaataagccagtc

SEQ ID NO: 861816 - DNA, 22 bp, Artificial Sequence
  chemically synthesized
agtgaaataagccagtcataaa

SEQ ID NO: 861817 - DNA, 22 bp, Artificial Sequence
  chemically synthesized
gatacatcatataaaaggaagc

SEQ ID NO: 861818 - DNA, 22 bp, Artificial Sequence
  chemically synthesized
agatacatcatataaaaggaag

SEQ ID NO: 861819 - DNA, 22 bp, Artificial Sequence
  chemically synthesized
tagatacatcatataaaaggaa

SEQ ID NO: 861820 - DNA, 22 bp, Artificial Sequence
  chemically synthesized
ctttagatacatcatataaaag

SEQ ID NO: 861821 - DNA, 22 bp, Artificial Sequence
  chemically synthesized
catgcttccttttatatgatgt

SEQ ID NO: 861822 - DNA, 22 bp, Artificial Sequence
  chemically synthesized
actactttagatacatcatata

SEQ ID NO: 861823 - DNA, 22 bp, Artificial Sequence
  chemically synthesized
aactactttagatacatcatat

SEQ ID NO: 861824 - DNA, 22 bp, Artificial Sequence
  chemically synthesized
ccttttatatgatgtatctaaa

SEQ ID NO: 861825 - DNA, 22 bp, Artificial Sequence
  chemically synthesized
cttttatatgatgtatctaaag

SEQ ID NO: 861826 - DNA, 22 bp, Artificial Sequence
  chemically synthesized
aagagtttaactactttagata

SEQ ID NO: 861827 - DNA, 22 bp, Artificial Sequence
  chemically synthesized
ttatatgatgtatctaaagtag

SEQ ID NO: 861828 - DNA, 22 bp, Artificial Sequence
  chemically synthesized
taaagagtttaactactttaga

SEQ ID NO: 861829 - DNA, 22 bp, Artificial Sequence
  chemically synthesized
tatatgatgtatctaaagtagt

SEQ ID NO: 861830 - DNA, 22 bp, Artificial Sequence
  chemically synthesized
atatgatgtatctaaagtagtt

SEQ ID NO: 861831 - DNA, 22 bp, Artificial Sequence
  chemically synthesized
tatgatgtatctaaagtagtta

SEQ ID NO: 861832 - DNA, 22 bp, Artificial Sequence
  chemically synthesized
tctctaaagagtttaactactt

SEQ ID NO: 861833 - DNA, 22 bp, Artificial Sequence
  chemically synthesized
tgtctctaaagagtttaactac

SEQ ID NO: 861834 - DNA, 22 bp, Artificial Sequence
  chemically synthesized
ctgtctctaaagagtttaacta

SEQ ID NO: 861835 - DNA, 22 bp, Artificial Sequence
  chemically synthesized
tctgtctctaaagagtttaact

SEQ ID NO: 861836 - DNA, 22 bp, Artificial Sequence
  chemically synthesized
ctttctgtctctaaagagttta

SEQ ID NO: 861837 - DNA, 22 bp, Artificial Sequence
  chemically synthesized
tactttctgtctctaaagagtt

SEQ ID NO: 861838 - DNA, 22 bp, Artificial Sequence
  chemically synthesized
aagtagttaaactctttagaga

SEQ ID NO: 861839 - DNA, 22 bp, Artificial Sequence
  chemically synthesized
aactctttagagacagaaagta

SEQ ID NO: 861840 - DNA, 22 bp, Artificial Sequence
  chemically synthesized
gcaatatgaccactctactttc

SEQ ID NO: 861841 - DNA, 22 bp, Artificial Sequence
  chemically synthesized
tttagagacagaaagtagagtg

SEQ ID NO: 861842 - DNA, 22 bp, Artificial Sequence
  chemically synthesized
tagagacagaaagtagagtggt

SEQ ID NO: 861843 - DNA, 22 bp, Artificial Sequence
  chemically synthesized
agagacagaaagtagagtggtc

SEQ ID NO: 861844 - DNA, 22 bp, Artificial Sequence
  chemically synthesized
gagacagaaagtagagtggtca

SEQ ID NO: 861845 - DNA, 22 bp, Artificial Sequence
  chemically synthesized
taccccagcactggcaatatga

SEQ ID NO: 861846 - DNA, 22 bp, Artificial Sequence
  chemically synthesized
cctgtaccccagcactggcaat

SEQ ID NO: 861847 - DNA, 22 bp, Artificial Sequence
  chemically synthesized
ctccctgtaccccagcactggc

SEQ ID NO: 861848 - DNA, 22 bp, Artificial Sequence
  chemically synthesized
ccattgctccctgtaccccagc

SEQ ID NO: 861849 - DNA, 22 bp, Artificial Sequence
  chemically synthesized
ccagtgctggggtacagggagc

SEQ ID NO: 861850 - DNA, 22 bp, Artificial Sequence
  chemically synthesized
aagagctcccattgctccctgt

SEQ ID NO: 861851 - DNA, 22 bp, Artificial Sequence
  chemically synthesized
gggtacagggagcaatgggagc

SEQ ID NO: 861852 - DNA, 22 bp, Artificial Sequence
  chemically synthesized
caaacccactgaagagctccca

SEQ ID NO: 861853 - DNA, 22 bp, Artificial Sequence
  chemically synthesized
aaatccgaaactccaaacccac

SEQ ID NO: 861854 - DNA, 22 bp, Artificial Sequence
  chemically synthesized
tcaaatccgaaactccaaaccc

SEQ ID NO: 861855 - DNA, 22 bp, Artificial Sequence
  chemically synthesized
atctctcaaatccgaaactcca

SEQ ID NO: 861856 - DNA, 22 bp, Artificial Sequence
  chemically synthesized
ttcagtgggtttggagtttcgg

SEQ ID NO: 861857 - DNA, 22 bp, Artificial Sequence
  chemically synthesized
catctctcaaatccgaaactcc

SEQ ID NO: 861858 - DNA, 22 bp, Artificial Sequence
  chemically synthesized
tcatctctcaaatccgaaactc

SEQ ID NO: 861859 - DNA, 22 bp, Artificial Sequence
  chemically synthesized
cagtgggtttggagtttcggat

SEQ ID NO: 861860 - DNA, 22 bp, Artificial Sequence
  chemically synthesized
agtgggtttggagtttcggatt

SEQ ID NO: 861861 - DNA, 22 bp, Artificial Sequence
  chemically synthesized
gaatgttttcatctctcaaatc

SEQ ID NO: 861862 - DNA, 22 bp, Artificial Sequence
  chemically synthesized
tagaatgttttcatctctcaaa

SEQ ID NO: 861863 - DNA, 22 bp, Artificial Sequence
  chemically synthesized
ggagtttcggatttgagagatg

SEQ ID NO: 861864 - DNA, 22 bp, Artificial Sequence
  chemically synthesized
gagtttcggatttgagagatga

SEQ ID NO: 861865 - DNA, 22 bp, Artificial Sequence
  chemically synthesized
cggatttgagagatgaaaacat

SEQ ID NO: 861866 - DNA, 22 bp, Artificial Sequence
  chemically synthesized
ggatttgagagatgaaaacatt

SEQ ID NO: 861867 - DNA, 22 bp, Artificial Sequence
  chemically synthesized
aacagatctctagaatgttttc

SEQ ID NO: 861868 - DNA, 22 bp, Artificial Sequence
  chemically synthesized
ttcaacagatctctagaatgtt

SEQ ID NO: 861869 - DNA, 22 bp, Artificial Sequence
  chemically synthesized
gagagatgaaaacattctagag

SEQ ID NO: 861870 - DNA, 22 bp, Artificial Sequence
  chemically synthesized
agagatgaaaacattctagaga

SEQ ID NO: 861871 - DNA, 22 bp, Artificial Sequence
  chemically synthesized
ttattcaacagatctctagaat

SEQ ID NO: 861872 - DNA, 22 bp, Artificial Sequence
  chemically synthesized
tacatacattgttattcaacag

SEQ ID NO: 861873 - DNA, 22 bp, Artificial Sequence
  chemically synthesized
actatacatacattgttattca

SEQ ID NO: 861874 - DNA, 22 bp, Artificial Sequence
  chemically synthesized
tagagatctgttgaataacaat

SEQ ID NO: 861875 - DNA, 22 bp, Artificial Sequence
  chemically synthesized
gagatctgttgaataacaatgt

SEQ ID NO: 861876 - DNA, 22 bp, Artificial Sequence
  chemically synthesized
ttgaataacaatgtatgtatag

SEQ ID NO: 861877 - DNA, 22 bp, Artificial Sequence
  chemically synthesized
aataacaatgtatgtatagtta

SEQ ID NO: 861878 - DNA, 22 bp, Artificial Sequence
  chemically synthesized
tgtgtacaaaccagtagtgtta

SEQ ID NO: 861879 - DNA, 22 bp, Artificial Sequence
  chemically synthesized
atgtgtacaaaccagtagtgtt

SEQ ID NO: 861880 - DNA, 22 bp, Artificial Sequence
  chemically synthesized
tatgtgtacaaaccagtagtgt

SEQ ID NO: 861881 - DNA, 22 bp, Artificial Sequence
  chemically synthesized
ttttatgtgtacaaaccagtag

SEQ ID NO: 861882 - DNA, 22 bp, Artificial Sequence
  chemically synthesized
actgttttatgtgtacaaacca

SEQ ID NO: 861883 - DNA, 22 bp, Artificial Sequence
  chemically synthesized
aactgttttatgtgtacaaacc

SEQ ID NO: 861884 - DNA, 22 bp, Artificial Sequence
  chemically synthesized
acactactggtttgtacacata

SEQ ID NO: 861885 - DNA, 22 bp, Artificial Sequence
  chemically synthesized
ccagcttaactgttttatgtgt

SEQ ID NO: 861886 - DNA, 22 bp, Artificial Sequence
  chemically synthesized
gccagcttaactgttttatgtg

SEQ ID NO: 861887 - DNA, 22 bp, Artificial Sequence
  chemically synthesized
tgccagcttaactgttttatgt

SEQ ID NO: 861888 - DNA, 22 bp, Artificial Sequence
  chemically synthesized
ctggtttgtacacataaaacag

SEQ ID NO: 861889 - DNA, 22 bp, Artificial Sequence
  chemically synthesized
gtttgtacacataaaacagtta

SEQ ID NO: 861890 - DNA, 22 bp, Artificial Sequence
  chemically synthesized
gtacacataaaacagttaagct

SEQ ID NO: 861891 - DNA, 22 bp, Artificial Sequence
  chemically synthesized
tacacataaaacagttaagctg

SEQ ID NO: 861892 - DNA, 22 bp, Artificial Sequence
  chemically synthesized
agctggcaaagtttgtattatg

SEQ ID NO: 861893 - DNA, 22 bp, Artificial Sequence
  chemically synthesized
aaaaacaaaacccacataatac

SEQ ID NO: 861894 - DNA, 22 bp, Artificial Sequence
  chemically synthesized
gcaaagtttgtattatgtgggt

SEQ ID NO: 861895 - DNA, 22 bp, Artificial Sequence
  chemically synthesized
gtattatgtgggttttgttttt

SEQ ID NO: 861896 - DNA, 22 bp, Artificial Sequence
  chemically synthesized
tattatgtgggttttgtttttc

SEQ ID NO: 861897 - DNA, 22 bp, Artificial Sequence
  chemically synthesized
aaaaatgtggttgaaaaacaaa

SEQ ID NO: 861898 - DNA, 22 bp, Artificial Sequence
  chemically synthesized
aaaaaatgtggttgaaaaacaa

SEQ ID NO: 861899 - DNA, 22 bp, Artificial Sequence
  chemically synthesized
tgtgggttttgtttttcaacca

SEQ ID NO: 861900 - DNA, 22 bp, Artificial Sequence
  chemically synthesized
aagtataatttaaaaaatgtgg

SEQ ID NO: 861901 - DNA, 22 bp, Artificial Sequence
  chemically synthesized
aaagtataatttaaaaaatgtg

SEQ ID NO: 861902 - DNA, 22 bp, Artificial Sequence
  chemically synthesized
tgtttttcaaccacatttttta

SEQ ID NO: 861903 - DNA, 22 bp, Artificial Sequence
  chemically synthesized
gtttttcaaccacattttttaa

SEQ ID NO: 861904 - DNA, 22 bp, Artificial Sequence
  chemically synthesized
tttttcaaccacattttttaaa

SEQ ID NO: 861905 - DNA, 22 bp, Artificial Sequence
  chemically synthesized
ttcaaccacattttttaaatta

SEQ ID NO: 861906 - DNA, 22 bp, Artificial Sequence
  chemically synthesized
tcaaccacattttttaaattat

SEQ ID NO: 861907 - DNA, 22 bp, Artificial Sequence
  chemically synthesized
caaccacattttttaaattata

SEQ ID NO: 861908 - DNA, 22 bp, Artificial Sequence
  chemically synthesized
aaccacattttttaaattatac

SEQ ID NO: 861909 - DNA, 22 bp, Artificial Sequence
  chemically synthesized
tttaaattatactttaagttct

SEQ ID NO: 861910 - DNA, 22 bp, Artificial Sequence
  chemically synthesized
cacatgtatcccagaacttaaa

SEQ ID NO: 861911 - DNA, 22 bp, Artificial Sequence
  chemically synthesized
ttaaattatactttaagttctg

SEQ ID NO: 861912 - DNA, 22 bp, Artificial Sequence
  chemically synthesized
taaattatactttaagttctgg

SEQ ID NO: 861913 - DNA, 22 bp, Artificial Sequence
  chemically synthesized
tgcacatgtatcccagaactta

SEQ ID NO: 861914 - DNA, 22 bp, Artificial Sequence
  chemically synthesized
aaattatactttaagttctggg

SEQ ID NO: 861915 - DNA, 22 bp, Artificial Sequence
  chemically synthesized
aattatactttaagttctggga

SEQ ID NO: 861916 - DNA, 22 bp, Artificial Sequence
  chemically synthesized
tactttaagttctgggatacat

SEQ ID NO: 861917 - DNA, 22 bp, Artificial Sequence
  chemically synthesized
tacattctgcacatgtatccca

SEQ ID NO: 861918 - DNA, 22 bp, Artificial Sequence
  chemically synthesized
taagttctgggatacatgtgca

SEQ ID NO: 861919 - DNA, 22 bp, Artificial Sequence
  chemically synthesized
aagttctgggatacatgtgcag

SEQ ID NO: 861920 - DNA, 22 bp, Artificial Sequence
  chemically synthesized
agttctgggatacatgtgcaga

SEQ ID NO: 861921 - DNA, 22 bp, Artificial Sequence
  chemically synthesized
tgggatacatgtgcagaatgta

SEQ ID NO: 861922 - DNA, 22 bp, Artificial Sequence
  chemically synthesized
cgtagcaaacctgtacattctg

SEQ ID NO: 861923 - DNA, 22 bp, Artificial Sequence
  chemically synthesized
ggatacatgtgcagaatgtaca

SEQ ID NO: 861924 - DNA, 22 bp, Artificial Sequence
  chemically synthesized
gctacgtaggtatacacgtgcc

SEQ ID NO: 861925 - DNA, 22 bp, Artificial Sequence
  chemically synthesized
ctacgtaggtatacacgtgcca

SEQ ID NO: 861926 - DNA, 22 bp, Artificial Sequence
  chemically synthesized
cgtaggtatacacgtgccatgg

SEQ ID NO: 861927 - DNA, 22 bp, Artificial Sequence
  chemically synthesized
atgggtacagcaaaccaccatg

SEQ ID NO: 861928 - DNA, 22 bp, Artificial Sequence
  chemically synthesized
atgtagatgaagggttgatggg

SEQ ID NO: 861929 - DNA, 22 bp, Artificial Sequence
  chemically synthesized
gctgtacccatcaacccttcat

SEQ ID NO: 861930 - DNA, 22 bp, Artificial Sequence
  chemically synthesized
ctgtacccatcaacccttcatc

SEQ ID NO: 861931 - DNA, 22 bp, Artificial Sequence
  chemically synthesized
tacccatcaacccttcatctac

SEQ ID NO: 861932 - DNA, 22 bp, Artificial Sequence
  chemically synthesized
ggagaaatacctaatgtagatg

SEQ ID NO: 861933 - DNA, 22 bp, Artificial Sequence
  chemically synthesized
catctacattaggtatttctcc

SEQ ID NO: 861934 - DNA, 22 bp, Artificial Sequence
  chemically synthesized
atctacattaggtatttctcct

SEQ ID NO: 861935 - DNA, 22 bp, Artificial Sequence
  chemically synthesized
cattaggtatttctcctaacgt

SEQ ID NO: 861936 - DNA, 22 bp, Artificial Sequence
  chemically synthesized
ggtatttctcctaacgttatcc

SEQ ID NO: 861937 - DNA, 22 bp, Artificial Sequence
  chemically synthesized
gggggcagagggagggataacg

SEQ ID NO: 861938 - DNA, 22 bp, Artificial Sequence
  chemically synthesized
ctcctaacgttatccctccctc

SEQ ID NO: 861939 - DNA, 22 bp, Artificial Sequence
  chemically synthesized
tcctaacgttatccctccctct

SEQ ID NO: 861940 - DNA, 22 bp, Artificial Sequence
  chemically synthesized
ctaacgttatccctccctctgc

SEQ ID NO: 861941 - DNA, 22 bp, Artificial Sequence
  chemically synthesized
ggggattggggggcagagggag

SEQ ID NO: 861942 - DNA, 22 bp, Artificial Sequence
  chemically synthesized
acgttatccctccctctgcccc

SEQ ID NO: 861943 - DNA, 22 bp, Artificial Sequence
  chemically synthesized
tccctccctctgccccccaatc

SEQ ID NO: 861944 - DNA, 22 bp, Artificial Sequence
  chemically synthesized
cctctgccccccaatcccccaa

SEQ ID NO: 861945 - DNA, 22 bp, Artificial Sequence
  chemically synthesized
tgccccccaatcccccaactgg

SEQ ID NO: 861946 - DNA, 22 bp, Artificial Sequence
  chemically synthesized
ccccccaatcccccaactggtg

SEQ ID NO: 861947 - DNA, 22 bp, Artificial Sequence
  chemically synthesized
gtgtgtgatgttcccctccccc

SEQ ID NO: 861948 - DNA, 22 bp, Artificial Sequence
  chemically synthesized
aacgatgagaacacatggagat

SEQ ID NO: 861949 - DNA, 22 bp, Artificial Sequence
  chemically synthesized
ccctcccccatctccatgtgtt

SEQ ID NO: 861950 - DNA, 22 bp, Artificial Sequence
  chemically synthesized
ccccatctccatgtgttctcat

SEQ ID NO: 861951 - DNA, 22 bp, Artificial Sequence
  chemically synthesized
ataagtgggagttgaacgatga

SEQ ID NO: 861952 - DNA, 22 bp, Artificial Sequence
  chemically synthesized
catgtgttctcatcgttcaact

SEQ ID NO: 861953 - DNA, 22 bp, Artificial Sequence
  chemically synthesized
actcataagtgggagttgaacg

SEQ ID NO: 861954 - DNA, 22 bp, Artificial Sequence
  chemically synthesized
tcactcataagtgggagttgaa

SEQ ID NO: 861955 - DNA, 22 bp, Artificial Sequence
  chemically synthesized
tcatcgttcaactcccacttat

SEQ ID NO: 861956 - DNA, 22 bp, Artificial Sequence
  chemically synthesized
atcgttcaactcccacttatga

SEQ ID NO: 861957 - DNA, 22 bp, Artificial Sequence
  chemically synthesized
aactcccacttatgagtgagaa

SEQ ID NO: 861958 - DNA, 22 bp, Artificial Sequence
  chemically synthesized
ccacttatgagtgagaacatgc

SEQ ID NO: 861959 - DNA, 22 bp, Artificial Sequence
  chemically synthesized
atgagtgagaacatgcggtgtt

SEQ ID NO: 861960 - DNA, 22 bp, Artificial Sequence
  chemically synthesized
tgagtgagaacatgcggtgttt

SEQ ID NO: 861961 - DNA, 22 bp, Artificial Sequence
  chemically synthesized
acacaggaacagaaaaccaaac

SEQ ID NO: 861962 - DNA, 22 bp, Artificial Sequence
  chemically synthesized
agcaaactaacacaggaacaga

SEQ ID NO: 861963 - DNA, 22 bp, Artificial Sequence
  chemically synthesized
tcagcaaactaacacaggaaca

SEQ ID NO: 861964 - DNA, 22 bp, Artificial Sequence
  chemically synthesized
ggttttctgttcctgtgttagt

SEQ ID NO: 861965 - DNA, 22 bp, Artificial Sequence
  chemically synthesized
gttttctgttcctgtgttagtt

SEQ ID NO: 861966 - DNA, 22 bp, Artificial Sequence
  chemically synthesized
tctgttcctgtgttagtttgct

SEQ ID NO: 861967 - DNA, 22 bp, Artificial Sequence
  chemically synthesized
ctgttcctgtgttagtttgctg

SEQ ID NO: 861968 - DNA, 22 bp, Artificial Sequence
  chemically synthesized
tgttcctgtgttagtttgctga

SEQ ID NO: 861969 - DNA, 22 bp, Artificial Sequence
  chemically synthesized
gaaaccatcattctcagcaaac

SEQ ID NO: 861970 - DNA, 22 bp, Artificial Sequence
  chemically synthesized
ttcctgtgttagtttgctgaga

SEQ ID NO: 861971 - DNA, 22 bp, Artificial Sequence
  chemically synthesized
ctgtgttagtttgctgagaatg

SEQ ID NO: 861972 - DNA, 22 bp, Artificial Sequence
  chemically synthesized
tgttagtttgctgagaatgatg

SEQ ID NO: 861973 - DNA, 22 bp, Artificial Sequence
  chemically synthesized
gtttgctgagaatgatggtttc

SEQ ID NO: 861974 - DNA, 22 bp, Artificial Sequence
  chemically synthesized
gctgagaatgatggtttccagc

SEQ ID NO: 861975 - DNA, 22 bp, Artificial Sequence
  chemically synthesized
ctgagaatgatggtttccagct

SEQ ID NO: 861976 - DNA, 22 bp, Artificial Sequence
  chemically synthesized
agaatgatggtttccagcttca

SEQ ID NO: 861977 - DNA, 22 bp, Artificial Sequence
  chemically synthesized
taaggacatggatgaagctgga

SEQ ID NO: 861978 - DNA, 22 bp, Artificial Sequence
  chemically synthesized
gtaaggacatggatgaagctgg

SEQ ID NO: 861979 - DNA, 22 bp, Artificial Sequence
  chemically synthesized
tgtaaggacatggatgaagctg

SEQ ID NO: 861980 - DNA, 22 bp, Artificial Sequence
  chemically synthesized
gtgtcctttgtaaggacatgga

SEQ ID NO: 861981 - DNA, 22 bp, Artificial Sequence
  chemically synthesized
ccagcttcatccatgtccttac

SEQ ID NO: 861982 - DNA, 22 bp, Artificial Sequence
  chemically synthesized
cagcttcatccatgtccttaca

SEQ ID NO: 861983 - DNA, 22 bp, Artificial Sequence
  chemically synthesized
catccatgtccttacaaaggac

SEQ ID NO: 861984 - DNA, 22 bp, Artificial Sequence
  chemically synthesized
atccatgtccttacaaaggaca

SEQ ID NO: 861985 - DNA, 22 bp, Artificial Sequence
  chemically synthesized
acaaaggacacgaacgcatcct

SEQ ID NO: 861986 - DNA, 22 bp, Artificial Sequence
  chemically synthesized
caaaggacacgaacgcatcctt

SEQ ID NO: 861987 - DNA, 22 bp, Artificial Sequence
  chemically synthesized
tgcagccataaaaaaggatgcg

SEQ ID NO: 861988 - DNA, 22 bp, Artificial Sequence
  chemically synthesized
ttttatggctgcatagtattct

SEQ ID NO: 861989 - DNA, 22 bp, Artificial Sequence
  chemically synthesized
tttatggctgcatagtattcta

SEQ ID NO: 861990 - DNA, 22 bp, Artificial Sequence
  chemically synthesized
ttatggctgcatagtattctat

SEQ ID NO: 861991 - DNA, 22 bp, Artificial Sequence
  chemically synthesized
tatggctgcatagtattctatg

SEQ ID NO: 861992 - DNA, 22 bp, Artificial Sequence
  chemically synthesized
atggctgcatagtattctatgg

SEQ ID NO: 861993 - DNA, 22 bp, Artificial Sequence
  chemically synthesized
tggctgcatagtattctatggt

SEQ ID NO: 861994 - DNA, 22 bp, Artificial Sequence
  chemically synthesized
catagtattctatggtgtatat

SEQ ID NO: 861995 - DNA, 22 bp, Artificial Sequence
  chemically synthesized
gatacagaaaatgtggcacata

SEQ ID NO: 861996 - DNA, 22 bp, Artificial Sequence
  chemically synthesized
tatggtgtatatgtgccacatt

SEQ ID NO: 861997 - DNA, 22 bp, Artificial Sequence
  chemically synthesized
tggtgtatatgtgccacatttt

SEQ ID NO: 861998 - DNA, 22 bp, Artificial Sequence
  chemically synthesized
tctgtatccagtctattattga

SEQ ID NO: 861999 - DNA, 22 bp, Artificial Sequence
  chemically synthesized
ctgtatccagtctattattgat

SEQ ID NO: 862000 - DNA, 22 bp, Artificial Sequence
  chemically synthesized
tgtatccagtctattattgatg

SEQ ID NO: 862001 - DNA, 22 bp, Artificial Sequence
  chemically synthesized
tatccagtctattattgatgga

SEQ ID NO: 862002 - DNA, 22 bp, Artificial Sequence
  chemically synthesized
gaaccaacccaaatgtccatca

SEQ ID NO: 862003 - DNA, 22 bp, Artificial Sequence
  chemically synthesized
ggaaccaacccaaatgtccatc

SEQ ID NO: 862004 - DNA, 22 bp, Artificial Sequence
  chemically synthesized
ttattgatggacatttgggttg

SEQ ID NO: 862005 - DNA, 22 bp, Artificial Sequence
  chemically synthesized
ttgatggacatttgggttggtt

SEQ ID NO: 862006 - DNA, 22 bp, Artificial Sequence
  chemically synthesized
atggacatttgggttggttcca

SEQ ID NO: 862007 - DNA, 22 bp, Artificial Sequence
  chemically synthesized
caatagcaaagacttggaacca

SEQ ID NO: 862008 - DNA, 22 bp, Artificial Sequence
  chemically synthesized
acaatagcaaagacttggaacc

SEQ ID NO: 862009 - DNA, 22 bp, Artificial Sequence
  chemically synthesized
tttacaatagcaaagacttgga

SEQ ID NO: 862010 - DNA, 22 bp, Artificial Sequence
  chemically synthesized
gggttggttccaagtctttgct

SEQ ID NO: 862011 - DNA, 22 bp, Artificial Sequence
  chemically synthesized
ggttggttccaagtctttgcta

SEQ ID NO: 862012 - DNA, 22 bp, Artificial Sequence
  chemically synthesized
cagcactgtttacaatagcaaa

SEQ ID NO: 862013 - DNA, 22 bp, Artificial Sequence
  chemically synthesized
gttccaagtctttgctattgta

SEQ ID NO: 862014 - DNA, 22 bp, Artificial Sequence
  chemically synthesized
ttgcagcactgtttacaatagc

SEQ ID NO: 862015 - DNA, 22 bp, Artificial Sequence
  chemically synthesized
gttgcagcactgtttacaatag

SEQ ID NO: 862016 - DNA, 22 bp, Artificial Sequence
  chemically synthesized
caagtctttgctattgtaaaca

SEQ ID NO: 862017 - DNA, 22 bp, Artificial Sequence
  chemically synthesized
tgctattgtaaacagtgctgca

SEQ ID NO: 862018 - DNA, 22 bp, Artificial Sequence
  chemically synthesized
gctattgtaaacagtgctgcaa

SEQ ID NO: 862019 - DNA, 22 bp, Artificial Sequence
  chemically synthesized
ctattgtaaacagtgctgcaac

SEQ ID NO: 862020 - DNA, 22 bp, Artificial Sequence
  chemically synthesized
ttgtaaacagtgctgcaacaaa

SEQ ID NO: 862021 - DNA, 22 bp, Artificial Sequence
  chemically synthesized
taaacagtgctgcaacaaacgt

SEQ ID NO: 862022 - DNA, 22 bp, Artificial Sequence
  chemically synthesized
taaagacacatgcacacgtacg

SEQ ID NO: 862023 - DNA, 22 bp, Artificial Sequence
  chemically synthesized
ctgtaaagacacatgcacacgt

SEQ ID NO: 862024 - DNA, 22 bp, Artificial Sequence
  chemically synthesized
caacaaacgtacgtgtgcatgt

SEQ ID NO: 862025 - DNA, 22 bp, Artificial Sequence
  chemically synthesized
tactgtaaagacacatgcacac

SEQ ID NO: 862026 - DNA, 22 bp, Artificial Sequence
  chemically synthesized
taaatcattctactgtaaagac

SEQ ID NO: 862027 - DNA, 22 bp, Artificial Sequence
  chemically synthesized
tacagtagaatgatttataatc

SEQ ID NO: 862028 - DNA, 22 bp, Artificial Sequence
  chemically synthesized
acagtagaatgatttataatcc

SEQ ID NO: 862029 - DNA, 22 bp, Artificial Sequence
  chemically synthesized
cagtagaatgatttataatcct

SEQ ID NO: 862030 - DNA, 22 bp, Artificial Sequence
  chemically synthesized
ggtatatacccaaaggattata

SEQ ID NO: 862031 - DNA, 22 bp, Artificial Sequence
  chemically synthesized
ctgggtatatacccaaaggatt

SEQ ID NO: 862032 - DNA, 22 bp, Artificial Sequence
  chemically synthesized
ataatcctttgggtatataccc

SEQ ID NO: 862033 - DNA, 22 bp, Artificial Sequence
  chemically synthesized
taatcctttgggtatataccca

SEQ ID NO: 862034 - DNA, 22 bp, Artificial Sequence
  chemically synthesized
agccatcccattactgggtata

SEQ ID NO: 862035 - DNA, 22 bp, Artificial Sequence
  chemically synthesized
actcagccatcccattactggg

SEQ ID NO: 862036 - DNA, 22 bp, Artificial Sequence
  chemically synthesized
aactcagccatcccattactgg

SEQ ID NO: 862037 - DNA, 22 bp, Artificial Sequence
  chemically synthesized
tgggtatatacccagtaatggg

SEQ ID NO: 862038 - DNA, 22 bp, Artificial Sequence
  chemically synthesized
gggtatatacccagtaatggga

SEQ ID NO: 862039 - DNA, 22 bp, Artificial Sequence
  chemically synthesized
ggtatatacccagtaatgggat

SEQ ID NO: 862040 - DNA, 22 bp, Artificial Sequence
  chemically synthesized
caaccagaaataccatttaact

SEQ ID NO: 862041 - DNA, 22 bp, Artificial Sequence
  chemically synthesized
aaggatctacaaccagaaatac

SEQ ID NO: 862042 - DNA, 22 bp, Artificial Sequence
  chemically synthesized
agttaaatggtatttctggttg

SEQ ID NO: 862043 - DNA, 22 bp, Artificial Sequence
  chemically synthesized
ctcaaggatctacaaccagaaa

SEQ ID NO: 862044 - DNA, 22 bp, Artificial Sequence
  chemically synthesized
aatggtatttctggttgtagat

SEQ ID NO: 862045 - DNA, 22 bp, Artificial Sequence
  chemically synthesized
ctggttgtagatccttgaggaa

SEQ ID NO: 862046 - DNA, 22 bp, Artificial Sequence
  chemically synthesized
tggttgtagatccttgaggaat

SEQ ID NO: 862047 - DNA, 22 bp, Artificial Sequence
  chemically synthesized
gttgtagatccttgaggaatcg

SEQ ID NO: 862048 - DNA, 22 bp, Artificial Sequence
  chemically synthesized
tggaagaccgtgtggcgattcc

SEQ ID NO: 862049 - DNA, 22 bp, Artificial Sequence
  chemically synthesized
tagatccttgaggaatcgccac

SEQ ID NO: 862050 - DNA, 22 bp, Artificial Sequence
  chemically synthesized
aaccattgtggaagaccgtgtg

SEQ ID NO: 862051 - DNA, 22 bp, Artificial Sequence
  chemically synthesized
caaccattgtggaagaccgtgt

SEQ ID NO: 862052 - DNA, 22 bp, Artificial Sequence
  chemically synthesized
gaggaatcgccacacggtcttc

SEQ ID NO: 862053 - DNA, 22 bp, Artificial Sequence
  chemically synthesized
aggaatcgccacacggtcttcc

SEQ ID NO: 862054 - DNA, 22 bp, Artificial Sequence
  chemically synthesized
cttcaaccattgtggaagaccg

SEQ ID NO: 862055 - DNA, 22 bp, Artificial Sequence
  chemically synthesized
gtgggagtgtgaattacttcaa

SEQ ID NO: 862056 - DNA, 22 bp, Artificial Sequence
  chemically synthesized
ccacaatggttgaagtaattca

SEQ ID NO: 862057 - DNA, 22 bp, Artificial Sequence
  chemically synthesized
ttggtgggagtgtgaattactt

SEQ ID NO: 862058 - DNA, 22 bp, Artificial Sequence
  chemically synthesized
cacaatggttgaagtaattcac

SEQ ID NO: 862059 - DNA, 22 bp, Artificial Sequence
  chemically synthesized
cactgttggtgggagtgtgaat

SEQ ID NO: 862060 - DNA, 22 bp, Artificial Sequence
  chemically synthesized
acactgttggtgggagtgtgaa

SEQ ID NO: 862061 - DNA, 22 bp, Artificial Sequence
  chemically synthesized
tacactgttggtgggagtgtga

SEQ ID NO: 862062 - DNA, 22 bp, Artificial Sequence
  chemically synthesized
ttacactgttggtgggagtgtg

SEQ ID NO: 862063 - DNA, 22 bp, Artificial Sequence
  chemically synthesized
aagtaattcacactcccaccaa

SEQ ID NO: 862064 - DNA, 22 bp, Artificial Sequence
  chemically synthesized
acactcccaccaacagtgtaaa

SEQ ID NO: 862065 - DNA, 22 bp, Artificial Sequence
  chemically synthesized
ccaccaacagtgtaaaagcgtt

SEQ ID NO: 862066 - DNA, 22 bp, Artificial Sequence
  chemically synthesized
gagaggatgtggagaaatagga

SEQ ID NO: 862067 - DNA, 22 bp, Artificial Sequence
  chemically synthesized
ctatttctccacatcctctcca

SEQ ID NO: 862068 - DNA, 22 bp, Artificial Sequence
  chemically synthesized
tttctccacatcctctccagca

SEQ ID NO: 862069 - DNA, 22 bp, Artificial Sequence
  chemically synthesized
ctccacatcctctccagcatct

SEQ ID NO: 862070 - DNA, 22 bp, Artificial Sequence
  chemically synthesized
tccacatcctctccagcatctg

SEQ ID NO: 862071 - DNA, 22 bp, Artificial Sequence
  chemically synthesized
cacatcctctccagcatctgtt

SEQ ID NO: 862072 - DNA, 22 bp, Artificial Sequence
  chemically synthesized
aaaagtcaggaaacaacagatg

SEQ ID NO: 862073 - DNA, 22 bp, Artificial Sequence
  chemically synthesized
tccagcatctgttgtttcctga

SEQ ID NO: 862074 - DNA, 22 bp, Artificial Sequence
  chemically synthesized
cagcatctgttgtttcctgact

SEQ ID NO: 862075 - DNA, 22 bp, Artificial Sequence
  chemically synthesized
gaaaggcgatcattaaaaagtc

SEQ ID NO: 862076 - DNA, 22 bp, Artificial Sequence
  chemically synthesized
ttgtttcctgactttttaatga

SEQ ID NO: 862077 - DNA, 22 bp, Artificial Sequence
  chemically synthesized
tttcctgactttttaatgatcg

SEQ ID NO: 862078 - DNA, 22 bp, Artificial Sequence
  chemically synthesized
cctgactttttaatgatcgcct

SEQ ID NO: 862079 - DNA, 22 bp, Artificial Sequence
  chemically synthesized
ctgactttttaatgatcgcctt

SEQ ID NO: 862080 - DNA, 22 bp, Artificial Sequence
  chemically synthesized
acatcagttagaaaggcgatca

SEQ ID NO: 862081 - DNA, 22 bp, Artificial Sequence
  chemically synthesized
actttttaatgatcgcctttct

SEQ ID NO: 862082 - DNA, 22 bp, Artificial Sequence
  chemically synthesized
tttaatgatcgcctttctaact

SEQ ID NO: 862083 - DNA, 22 bp, Artificial Sequence
  chemically synthesized
ttaatgatcgcctttctaactg

SEQ ID NO: 862084 - DNA, 22 bp, Artificial Sequence
  chemically synthesized
taatgatcgcctttctaactga

SEQ ID NO: 862085 - DNA, 22 bp, Artificial Sequence
  chemically synthesized
aatgatcgcctttctaactgat

SEQ ID NO: 862086 - DNA, 22 bp, Artificial Sequence
  chemically synthesized
atgatcgcctttctaactgatg

SEQ ID NO: 862087 - DNA, 22 bp, Artificial Sequence
  chemically synthesized
tctaactgatgtgagatggtat

SEQ ID NO: 862088 - DNA, 22 bp, Artificial Sequence
  chemically synthesized
ctaactgatgtgagatggtatc

SEQ ID NO: 862089 - DNA, 22 bp, Artificial Sequence
  chemically synthesized
taactgatgtgagatggtatct

SEQ ID NO: 862090 - DNA, 22 bp, Artificial Sequence
  chemically synthesized
actgatgtgagatggtatctca

SEQ ID NO: 862091 - DNA, 22 bp, Artificial Sequence
  chemically synthesized
atgtgagatggtatctcattgc

SEQ ID NO: 862092 - DNA, 22 bp, Artificial Sequence
  chemically synthesized
gagaaatgcaaatcaaaaccgc

SEQ ID NO: 862093 - DNA, 22 bp, Artificial Sequence
  chemically synthesized
gtcattagagaaatgcaaatca

SEQ ID NO: 862094 - DNA, 22 bp, Artificial Sequence
  chemically synthesized
attgcggttttgatttgcattt

SEQ ID NO: 862095 - DNA, 22 bp, Artificial Sequence
  chemically synthesized
cggttttgatttgcatttctct

SEQ ID NO: 862096 - DNA, 22 bp, Artificial Sequence
  chemically synthesized
atcatcactggtcattagagaa

SEQ ID NO: 862097 - DNA, 22 bp, Artificial Sequence
  chemically synthesized
tgatttgcatttctctaatgac

SEQ ID NO: 862098 - DNA, 22 bp, Artificial Sequence
  chemically synthesized
gatttgcatttctctaatgacc

SEQ ID NO: 862099 - DNA, 22 bp, Artificial Sequence
  chemically synthesized
atttgcatttctctaatgacca

SEQ ID NO: 862100 - DNA, 22 bp, Artificial Sequence
  chemically synthesized
gcatttctctaatgaccagtga

SEQ ID NO: 862101 - DNA, 22 bp, Artificial Sequence
  chemically synthesized
catttctctaatgaccagtgat

SEQ ID NO: 862102 - DNA, 22 bp, Artificial Sequence
  chemically synthesized
ctctaatgaccagtgatgatga

SEQ ID NO: 862103 - DNA, 22 bp, Artificial Sequence
  chemically synthesized
tctaatgaccagtgatgatgag

SEQ ID NO: 862104 - DNA, 22 bp, Artificial Sequence
  chemically synthesized
taatgaccagtgatgatgagct

SEQ ID NO: 862105 - DNA, 22 bp, Artificial Sequence
  chemically synthesized
atgaccagtgatgatgagcttt

SEQ ID NO: 862106 - DNA, 22 bp, Artificial Sequence
  chemically synthesized
tgtggccaaaagacacatgaaa

SEQ ID NO: 862107 - DNA, 22 bp, Artificial Sequence
  chemically synthesized
atgtggccaaaagacacatgaa

SEQ ID NO: 862108 - DNA, 22 bp, Artificial Sequence
  chemically synthesized
tttttcatgtgtcttttggcca

SEQ ID NO: 862109 - DNA, 22 bp, Artificial Sequence
  chemically synthesized
ttttcatgtgtcttttggccac

SEQ ID NO: 862110 - DNA, 22 bp, Artificial Sequence
  chemically synthesized
tttcatgtgtcttttggccaca

SEQ ID NO: 862111 - DNA, 22 bp, Artificial Sequence
  chemically synthesized
ttcatgtgtcttttggccacat

SEQ ID NO: 862112 - DNA, 22 bp, Artificial Sequence
  chemically synthesized
tcatgtgtcttttggccacata

SEQ ID NO: 862113 - DNA, 22 bp, Artificial Sequence
  chemically synthesized
catgtgtcttttggccacataa

SEQ ID NO: 862114 - DNA, 22 bp, Artificial Sequence
  chemically synthesized
aaaagaagacatttatgtggcc

SEQ ID NO: 862115 - DNA, 22 bp, Artificial Sequence
  chemically synthesized
atgtgtcttttggccacataaa

SEQ ID NO: 862116 - DNA, 22 bp, Artificial Sequence
  chemically synthesized
tcaaaagaagacatttatgtgg

SEQ ID NO: 862117 - DNA, 22 bp, Artificial Sequence
  chemically synthesized
ctcaaaagaagacatttatgtg

SEQ ID NO: 862118 - DNA, 22 bp, Artificial Sequence
  chemically synthesized
ttctcaaaagaagacatttatg

SEQ ID NO: 862119 - DNA, 22 bp, Artificial Sequence
  chemically synthesized
ttggccacataaatgtcttctt

SEQ ID NO: 862120 - DNA, 22 bp, Artificial Sequence
  chemically synthesized
tggccacataaatgtcttcttt

SEQ ID NO: 862121 - DNA, 22 bp, Artificial Sequence
  chemically synthesized
ggccacataaatgtcttctttt

SEQ ID NO: 862122 - DNA, 22 bp, Artificial Sequence
  chemically synthesized
gccacataaatgtcttcttttg

SEQ ID NO: 862123 - DNA, 22 bp, Artificial Sequence
  chemically synthesized
cttttgagaagagtctgtttat

SEQ ID NO: 862124 - DNA, 22 bp, Artificial Sequence
  chemically synthesized
ttttgagaagagtctgtttata

SEQ ID NO: 862125 - DNA, 22 bp, Artificial Sequence
  chemically synthesized
ttgagaagagtctgtttatatc

SEQ ID NO: 862126 - DNA, 22 bp, Artificial Sequence
  chemically synthesized
tgagaagagtctgtttatatcc

SEQ ID NO: 862127 - DNA, 22 bp, Artificial Sequence
  chemically synthesized
gagaagagtctgtttatatcct

SEQ ID NO: 862128 - DNA, 22 bp, Artificial Sequence
  chemically synthesized
agaagagtctgtttatatcctt

SEQ ID NO: 862129 - DNA, 22 bp, Artificial Sequence
  chemically synthesized
tttatatccttcccccactttt

SEQ ID NO: 862130 - DNA, 22 bp, Artificial Sequence
  chemically synthesized
atatccttcccccactttttga

SEQ ID NO: 862131 - DNA, 22 bp, Artificial Sequence
  chemically synthesized
tatccttcccccactttttgat

SEQ ID NO: 862132 - DNA, 22 bp, Artificial Sequence
  chemically synthesized
cccccactttttgatggggttg

SEQ ID NO: 862133 - DNA, 22 bp, Artificial Sequence
  chemically synthesized
ccccactttttgatggggttgt

SEQ ID NO: 862134 - DNA, 22 bp, Artificial Sequence
  chemically synthesized
caagaaaaaaacaaacaacccc

SEQ ID NO: 862135 - DNA, 22 bp, Artificial Sequence
  chemically synthesized
acaagaaaaaaacaaacaaccc

SEQ ID NO: 862136 - DNA, 22 bp, Artificial Sequence
  chemically synthesized
tttgatggggttgtttgttttt

SEQ ID NO: 862137 - DNA, 22 bp, Artificial Sequence
  chemically synthesized
ttgatggggttgtttgtttttt

SEQ ID NO: 862138 - DNA, 22 bp, Artificial Sequence
  chemically synthesized
tgatggggttgtttgttttttt

SEQ ID NO: 862139 - DNA, 22 bp, Artificial Sequence
  chemically synthesized
gatggggttgtttgtttttttc

SEQ ID NO: 862140 - DNA, 22 bp, Artificial Sequence
  chemically synthesized
atggggttgtttgtttttttct

SEQ ID NO: 862141 - DNA, 22 bp, Artificial Sequence
  chemically synthesized
atcaaatttacaagaaaaaaac

SEQ ID NO: 862142 - DNA, 22 bp, Artificial Sequence
  chemically synthesized
aatcaaatttacaagaaaaaaa

SEQ ID NO: 862143 - DNA, 22 bp, Artificial Sequence
  chemically synthesized
tttgtttttttcttgtaaattt

SEQ ID NO: 862144 - DNA, 22 bp, Artificial Sequence
  chemically synthesized
gtttttttcttgtaaatttgat

SEQ ID NO: 862145 - DNA, 22 bp, Artificial Sequence
  chemically synthesized
tttttttcttgtaaatttgatt

SEQ ID NO: 862146 - DNA, 22 bp, Artificial Sequence
  chemically synthesized
ttttcttgtaaatttgattaaa

SEQ ID NO: 862147 - DNA, 22 bp, Artificial Sequence
  chemically synthesized
tttcttgtaaatttgattaaac

SEQ ID NO: 862148 - DNA, 22 bp, Artificial Sequence
  chemically synthesized
aaataaaatgtggtttaatcaa

SEQ ID NO: 862149 - DNA, 22 bp, Artificial Sequence
  chemically synthesized
ttcttgtaaatttgattaaacc

SEQ ID NO: 862150 - DNA, 22 bp, Artificial Sequence
  chemically synthesized
aaaataaaatgtggtttaatca

SEQ ID NO: 862151 - DNA, 22 bp, Artificial Sequence
  chemically synthesized
tcttgtaaatttgattaaacca

SEQ ID NO: 862152 - DNA, 22 bp, Artificial Sequence
  chemically synthesized
taaaataaaatgtggtttaatc

SEQ ID NO: 862153 - DNA, 22 bp, Artificial Sequence
  chemically synthesized
cttgtaaatttgattaaaccac

SEQ ID NO: 862154 - DNA, 22 bp, Artificial Sequence
  chemically synthesized
ttaaaataaaatgtggtttaat

SEQ ID NO: 862155 - DNA, 22 bp, Artificial Sequence
  chemically synthesized
ttgtaaatttgattaaaccaca

SEQ ID NO: 862156 - DNA, 22 bp, Artificial Sequence
  chemically synthesized
gtaaatttgattaaaccacatt

SEQ ID NO: 862157 - DNA, 22 bp, Artificial Sequence
  chemically synthesized
taaatttgattaaaccacattt

SEQ ID NO: 862158 - DNA, 22 bp, Artificial Sequence
  chemically synthesized
ccttttaaaataaaatgtggtt

SEQ ID NO: 862159 - DNA, 22 bp, Artificial Sequence
  chemically synthesized
gattaaaccacattttatttta

SEQ ID NO: 862160 - DNA, 22 bp, Artificial Sequence
  chemically synthesized
tgaattcccttttaaaataaaa

SEQ ID NO: 862161 - DNA, 22 bp, Artificial Sequence
  chemically synthesized
attaaaccacattttattttaa

SEQ ID NO: 862162 - DNA, 22 bp, Artificial Sequence
  chemically synthesized
aaccacattttattttaaaagg

SEQ ID NO: 862163 - DNA, 22 bp, Artificial Sequence
  chemically synthesized
gtctatgaattcccttttaaaa

SEQ ID NO: 862164 - DNA, 22 bp, Artificial Sequence
  chemically synthesized
acctggtctatgaattcccttt

SEQ ID NO: 862165 - DNA, 22 bp, Artificial Sequence
  chemically synthesized
tattttaaaagggaattcatag

SEQ ID NO: 862166 - DNA, 22 bp, Artificial Sequence
  chemically synthesized
attttaaaagggaattcataga

SEQ ID NO: 862167 - DNA, 22 bp, Artificial Sequence
  chemically synthesized
ttttaaaagggaattcatagac

SEQ ID NO: 862168 - DNA, 22 bp, Artificial Sequence
  chemically synthesized
taaaagggaattcatagaccag

SEQ ID NO: 862169 - DNA, 22 bp, Artificial Sequence
  chemically synthesized
aaaagggaattcatagaccagg

SEQ ID NO: 862170 - DNA, 22 bp, Artificial Sequence
  chemically synthesized
aaagggaattcatagaccaggt

SEQ ID NO: 862171 - DNA, 22 bp, Artificial Sequence
  chemically synthesized
aaaagtccacaattcacctggt

SEQ ID NO: 862172 - DNA, 22 bp, Artificial Sequence
  chemically synthesized
aaaaagtccacaattcacctgg

SEQ ID NO: 862173 - DNA, 22 bp, Artificial Sequence
  chemically synthesized
taaaaagtccacaattcacctg

SEQ ID NO: 862174 - DNA, 22 bp, Artificial Sequence
  chemically synthesized
atagaccaggtgaattgtggac

SEQ ID NO: 862175 - DNA, 22 bp, Artificial Sequence
  chemically synthesized
agaagggaattttaaaaagtcc

SEQ ID NO: 862176 - DNA, 22 bp, Artificial Sequence
  chemically synthesized
actcagaagggaattttaaaaa

SEQ ID NO: 862177 - DNA, 22 bp, Artificial Sequence
  chemically synthesized
aactcagaagggaattttaaaa

SEQ ID NO: 862178 - DNA, 22 bp, Artificial Sequence
  chemically synthesized
cttaactcagaagggaatttta

SEQ ID NO: 862179 - DNA, 22 bp, Artificial Sequence
  chemically synthesized
tggactttttaaaattcccttc

SEQ ID NO: 862180 - DNA, 22 bp, Artificial Sequence
  chemically synthesized
aatctccttaactcagaaggga

SEQ ID NO: 862181 - DNA, 22 bp, Artificial Sequence
  chemically synthesized
aaatctccttaactcagaaggg

SEQ ID NO: 862182 - DNA, 22 bp, Artificial Sequence
  chemically synthesized
taaatctccttaactcagaagg

SEQ ID NO: 862183 - DNA, 22 bp, Artificial Sequence
  chemically synthesized
ttaaatctccttaactcagaag

SEQ ID NO: 862184 - DNA, 22 bp, Artificial Sequence
  chemically synthesized
tttaaaattcccttctgagtta

SEQ ID NO: 862185 - DNA, 22 bp, Artificial Sequence
  chemically synthesized
ttaaaattcccttctgagttaa

SEQ ID NO: 862186 - DNA, 22 bp, Artificial Sequence
  chemically synthesized
ttttaaatctccttaactcaga

SEQ ID NO: 862187 - DNA, 22 bp, Artificial Sequence
  chemically synthesized
taaaattcccttctgagttaag

SEQ ID NO: 862188 - DNA, 22 bp, Artificial Sequence
  chemically synthesized
aaaattcccttctgagttaagg

SEQ ID NO: 862189 - DNA, 22 bp, Artificial Sequence
  chemically synthesized
aaattcccttctgagttaagga

SEQ ID NO: 862190 - DNA, 22 bp, Artificial Sequence
  chemically synthesized
ccttctgagttaaggagattta

SEQ ID NO: 862191 - DNA, 22 bp, Artificial Sequence
  chemically synthesized
aaaaaaatctcttttaaatctc

SEQ ID NO: 862192 - DNA, 22 bp, Artificial Sequence
  chemically synthesized
ctgagttaaggagatttaaaag

SEQ ID NO: 862193 - DNA, 22 bp, Artificial Sequence
  chemically synthesized
tgagttaaggagatttaaaaga

SEQ ID NO: 862194 - DNA, 22 bp, Artificial Sequence
  chemically synthesized
agttaaggagatttaaaagaga

SEQ ID NO: 862195 - DNA, 22 bp, Artificial Sequence
  chemically synthesized
tagtactcaaaaaaatctcttt

SEQ ID NO: 862196 - DNA, 22 bp, Artificial Sequence
  chemically synthesized
aggagatttaaaagagattttt

SEQ ID NO: 862197 - DNA, 22 bp, Artificial Sequence
  chemically synthesized
ttatagtactcaaaaaaatctc

SEQ ID NO: 862198 - DNA, 22 bp, Artificial Sequence
  chemically synthesized
attatagtactcaaaaaaatct

SEQ ID NO: 862199 - DNA, 22 bp, Artificial Sequence
  chemically synthesized
aaaagagatttttttgagtact

SEQ ID NO: 862200 - DNA, 22 bp, Artificial Sequence
  chemically synthesized
aaagagatttttttgagtacta

SEQ ID NO: 862201 - DNA, 22 bp, Artificial Sequence
  chemically synthesized
caggatgatatttattatagta

SEQ ID NO: 862202 - DNA, 22 bp, Artificial Sequence
  chemically synthesized
acaggatgatatttattatagt

SEQ ID NO: 862203 - DNA, 22 bp, Artificial Sequence
  chemically synthesized
ttttgagtactataataaatat

SEQ ID NO: 862204 - DNA, 22 bp, Artificial Sequence
  chemically synthesized
tttgagtactataataaatatc

SEQ ID NO: 862205 - DNA, 22 bp, Artificial Sequence
  chemically synthesized
ttgagtactataataaatatca

SEQ ID NO: 862206 - DNA, 22 bp, Artificial Sequence
  chemically synthesized
gaatttacaggatgatatttat

SEQ ID NO: 862207 - DNA, 22 bp, Artificial Sequence
  chemically synthesized
tgagtactataataaatatcat

SEQ ID NO: 862208 - DNA, 22 bp, Artificial Sequence
  chemically synthesized
gagtactataataaatatcatc

SEQ ID NO: 862209 - DNA, 22 bp, Artificial Sequence
  chemically synthesized
agtactataataaatatcatcc

SEQ ID NO: 862210 - DNA, 22 bp, Artificial Sequence
  chemically synthesized
taataaatatcatcctgtaaat

SEQ ID NO: 862211 - DNA, 22 bp, Artificial Sequence
  chemically synthesized
atatatcagaaccattggaatt

SEQ ID NO: 862212 - DNA, 22 bp, Artificial Sequence
  chemically synthesized
aatatatcagaaccattggaat

SEQ ID NO: 862213 - DNA, 22 bp, Artificial Sequence
  chemically synthesized
ggccttaatatatcagaaccat

SEQ ID NO: 862214 - DNA, 22 bp, Artificial Sequence
  chemically synthesized
taaattccaatggttctgatat

SEQ ID NO: 862215 - DNA, 22 bp, Artificial Sequence
  chemically synthesized
cactgggccttaatatatcaga

SEQ ID NO: 862216 - DNA, 22 bp, Artificial Sequence
  chemically synthesized
ccactgggccttaatatatcag

SEQ ID NO: 862217 - DNA, 22 bp, Artificial Sequence
  chemically synthesized
tccactgggccttaatatatca

SEQ ID NO: 862218 - DNA, 22 bp, Artificial Sequence
  chemically synthesized
caatggttctgatatattaagg

SEQ ID NO: 862219 - DNA, 22 bp, Artificial Sequence
  chemically synthesized
ttttccactgggccttaatata

SEQ ID NO: 862220 - DNA, 22 bp, Artificial Sequence
  chemically synthesized
tgatatattaaggcccagtgga

SEQ ID NO: 862221 - DNA, 22 bp, Artificial Sequence
  chemically synthesized
atatattaaggcccagtggaaa

SEQ ID NO: 862222 - DNA, 22 bp, Artificial Sequence
  chemically synthesized
aggcccagtggaaaataatcga

SEQ ID NO: 862223 - DNA, 22 bp, Artificial Sequence
  chemically synthesized
attttatgtcctcactactcct

SEQ ID NO: 862224 - DNA, 22 bp, Artificial Sequence
  chemically synthesized
ttttatgtcctcactactccta

SEQ ID NO: 862225 - DNA, 22 bp, Artificial Sequence
  chemically synthesized
tatgtcctcactactcctactt

SEQ ID NO: 862226 - DNA, 22 bp, Artificial Sequence
  chemically synthesized
caatgaggatgcaagtaggagt

SEQ ID NO: 862227 - DNA, 22 bp, Artificial Sequence
  chemically synthesized
atgtcctcactactcctacttg

SEQ ID NO: 862228 - DNA, 22 bp, Artificial Sequence
  chemically synthesized
tgtcctcactactcctacttgc

SEQ ID NO: 862229 - DNA, 22 bp, Artificial Sequence
  chemically synthesized
actactcctacttgcatcctca

SEQ ID NO: 862230 - DNA, 22 bp, Artificial Sequence
  chemically synthesized
ctcctacttgcatcctcattgc

SEQ ID NO: 862231 - DNA, 22 bp, Artificial Sequence
  chemically synthesized
ccccacaaatattgcaatgagg

SEQ ID NO: 862232 - DNA, 22 bp, Artificial Sequence
  chemically synthesized
accccacaaatattgcaatgag

SEQ ID NO: 862233 - DNA, 22 bp, Artificial Sequence
  chemically synthesized
ctacttgcatcctcattgcaat

SEQ ID NO: 862234 - DNA, 22 bp, Artificial Sequence
  chemically synthesized
cttaccccacaaatattgcaat

SEQ ID NO: 862235 - DNA, 22 bp, Artificial Sequence
  chemically synthesized
cttgcatcctcattgcaatatt

SEQ ID NO: 862236 - DNA, 22 bp, Artificial Sequence
  chemically synthesized
tgcttaccccacaaatattgca

SEQ ID NO: 862237 - DNA, 22 bp, Artificial Sequence
  chemically synthesized
gcatcctcattgcaatatttgt

SEQ ID NO: 862238 - DNA, 22 bp, Artificial Sequence
  chemically synthesized
catcctcattgcaatatttgtg

SEQ ID NO: 862239 - DNA, 22 bp, Artificial Sequence
  chemically synthesized
gcatattctgcttaccccacaa

SEQ ID NO: 862240 - DNA, 22 bp, Artificial Sequence
  chemically synthesized
attgcaatatttgtggggtaag

SEQ ID NO: 862241 - DNA, 22 bp, Artificial Sequence
  chemically synthesized
caatatttgtggggtaagcaga

SEQ ID NO: 862242 - DNA, 22 bp, Artificial Sequence
  chemically synthesized
cagagaggcactggcatattct

SEQ ID NO: 862243 - DNA, 22 bp, Artificial Sequence
  chemically synthesized
gtggggtaagcagaatatgcca

SEQ ID NO: 862244 - DNA, 22 bp, Artificial Sequence
  chemically synthesized
tggggtaagcagaatatgccag

SEQ ID NO: 862245 - DNA, 22 bp, Artificial Sequence
  chemically synthesized
cagtatccactacagagaggca

SEQ ID NO: 862246 - DNA, 22 bp, Artificial Sequence
  chemically synthesized
atgaagcattacagtatccact

SEQ ID NO: 862247 - DNA, 22 bp, Artificial Sequence
  chemically synthesized
gatgaagcattacagtatccac

SEQ ID NO: 862248 - DNA, 22 bp, Artificial Sequence
  chemically synthesized
tctgtagtggatactgtaatgc

SEQ ID NO: 862249 - DNA, 22 bp, Artificial Sequence
  chemically synthesized
tgtagtggatactgtaatgctt

SEQ ID NO: 862250 - DNA, 22 bp, Artificial Sequence
  chemically synthesized
tagtggatactgtaatgcttca

SEQ ID NO: 862251 - DNA, 22 bp, Artificial Sequence
  chemically synthesized
cagaagaggatcttgatgaagc

SEQ ID NO: 862252 - DNA, 22 bp, Artificial Sequence
  chemically synthesized
taatgcttcatcaagatcctct

SEQ ID NO: 862253 - DNA, 22 bp, Artificial Sequence
  chemically synthesized
catcaagatcctcttctggagt

SEQ ID NO: 862254 - DNA, 22 bp, Artificial Sequence
  chemically synthesized
atcaagatcctcttctggagtc

SEQ ID NO: 862255 - DNA, 22 bp, Artificial Sequence
  chemically synthesized
gtagtgtgggtgcatcgactcc

SEQ ID NO: 862256 - DNA, 22 bp, Artificial Sequence
  chemically synthesized
ttctggagtcgatgcacccaca

SEQ ID NO: 862257 - DNA, 22 bp, Artificial Sequence
  chemically synthesized
ctggagtcgatgcacccacact

SEQ ID NO: 862258 - DNA, 22 bp, Artificial Sequence
  chemically synthesized
tggagtcgatgcacccacacta

SEQ ID NO: 862259 - DNA, 22 bp, Artificial Sequence
  chemically synthesized
ggaataatattggtagtgtggg

SEQ ID NO: 862260 - DNA, 22 bp, Artificial Sequence
  chemically synthesized
gagtcgatgcacccacactacc

SEQ ID NO: 862261 - DNA, 22 bp, Artificial Sequence
  chemically synthesized
ccaatattattcctagtatttg

SEQ ID NO: 862262 - DNA, 22 bp, Artificial Sequence
  chemically synthesized
gagtcaatgcaaccacaccaca

SEQ ID NO: 862263 - DNA, 22 bp, Artificial Sequence
  chemically synthesized
ttcctagtatttgtggtgtggt

SEQ ID NO: 862264 - DNA, 22 bp, Artificial Sequence
  chemically synthesized
tggagtcaatgcaaccacacca

SEQ ID NO: 862265 - DNA, 22 bp, Artificial Sequence
  chemically synthesized
ctagtatttgtggtgtggttgc

SEQ ID NO: 862266 - DNA, 22 bp, Artificial Sequence
  chemically synthesized
ttctggagtcaatgcaaccaca

SEQ ID NO: 862267 - DNA, 22 bp, Artificial Sequence
  chemically synthesized
gtatttgtggtgtggttgcatt

SEQ ID NO: 862268 - DNA, 22 bp, Artificial Sequence
  chemically synthesized
ttattctggagtcaatgcaacc

SEQ ID NO: 862269 - DNA, 22 bp, Artificial Sequence
  chemically synthesized
gtggtgtggttgcattgactcc

SEQ ID NO: 862270 - DNA, 22 bp, Artificial Sequence
  chemically synthesized
tggtgtggttgcattgactcca

SEQ ID NO: 862271 - DNA, 22 bp, Artificial Sequence
  chemically synthesized
tagatattattattctggagtc

SEQ ID NO: 862272 - DNA, 22 bp, Artificial Sequence
  chemically synthesized
gtagatattattattctggagt

SEQ ID NO: 862273 - DNA, 22 bp, Artificial Sequence
  chemically synthesized
tgtagatattattattctggag

SEQ ID NO: 862274 - DNA, 22 bp, Artificial Sequence
  chemically synthesized
ttgtagatattattattctgga

SEQ ID NO: 862275 - DNA, 22 bp, Artificial Sequence
  chemically synthesized
cattgactccagaataataata

SEQ ID NO: 862276 - DNA, 22 bp, Artificial Sequence
  chemically synthesized
tgatccttttgtagatattatt

SEQ ID NO: 862277 - DNA, 22 bp, Artificial Sequence
  chemically synthesized
actccagaataataatatctac

SEQ ID NO: 862278 - DNA, 22 bp, Artificial Sequence
  chemically synthesized
cagaataataatatctacaaaa

SEQ ID NO: 862279 - DNA, 22 bp, Artificial Sequence
  chemically synthesized
caaaaggatcacagctgcattt

SEQ ID NO: 862280 - DNA, 22 bp, Artificial Sequence
  chemically synthesized
gccaagagcaggcaccagggag

SEQ ID NO: 862281 - DNA, 22 bp, Artificial Sequence
  chemically synthesized
cactagccaagagcaggcacca

SEQ ID NO: 862282 - DNA, 22 bp, Artificial Sequence
  chemically synthesized
gcactagccaagagcaggcacc

SEQ ID NO: 862283 - DNA, 22 bp, Artificial Sequence
  chemically synthesized
catttctccctggtgcctgctc

SEQ ID NO: 862284 - DNA, 22 bp, Artificial Sequence
  chemically synthesized
tgcactagccaagagcaggcac

SEQ ID NO: 862285 - DNA, 22 bp, Artificial Sequence
  chemically synthesized
ctccctggtgcctgctcttggc

SEQ ID NO: 862286 - DNA, 22 bp, Artificial Sequence
  chemically synthesized
tccctggtgcctgctcttggct

SEQ ID NO: 862287 - DNA, 22 bp, Artificial Sequence
  chemically synthesized
tatctttgcactagccaagagc

SEQ ID NO: 862288 - DNA, 22 bp, Artificial Sequence
  chemically synthesized
gtatctttgcactagccaagag

SEQ ID NO: 862289 - DNA, 22 bp, Artificial Sequence
  chemically synthesized
cctggtgcctgctcttggctag

SEQ ID NO: 862290 - DNA, 22 bp, Artificial Sequence
  chemically synthesized
tgtatctttgcactagccaaga

SEQ ID NO: 862291 - DNA, 22 bp, Artificial Sequence
  chemically synthesized
ttgtatctttgcactagccaag

SEQ ID NO: 862292 - DNA, 22 bp, Artificial Sequence
  chemically synthesized
gtgcctgctcttggctagtgca

SEQ ID NO: 862293 - DNA, 22 bp, Artificial Sequence
  chemically synthesized
ctcttggctagtgcaaagatac

SEQ ID NO: 862294 - DNA, 22 bp, Artificial Sequence
  chemically synthesized
ttggctagtgcaaagatacaaa

SEQ ID NO: 862295 - DNA, 22 bp, Artificial Sequence
  chemically synthesized
ggctagtgcaaagatacaaaag

SEQ ID NO: 862296 - DNA, 22 bp, Artificial Sequence
  chemically synthesized
gctagtgcaaagatacaaaagt

SEQ ID NO: 862297 - DNA, 22 bp, Artificial Sequence
  chemically synthesized
aggcaaatgggcgagacttttg

SEQ ID NO: 862298 - DNA, 22 bp, Artificial Sequence
  chemically synthesized
gtgcaaagatacaaaagtctcg

SEQ ID NO: 862299 - DNA, 22 bp, Artificial Sequence
  chemically synthesized
ccaaattgaggcaaatgggcga

SEQ ID NO: 862300 - DNA, 22 bp, Artificial Sequence
  chemically synthesized
taccaaattgaggcaaatgggc

SEQ ID NO: 862301 - DNA, 22 bp, Artificial Sequence
  chemically synthesized
agagttctaccaaattgaggca

SEQ ID NO: 862302 - DNA, 22 bp, Artificial Sequence
  chemically synthesized
cagagttctaccaaattgaggc

SEQ ID NO: 862303 - DNA, 22 bp, Artificial Sequence
  chemically synthesized
tcagagttctaccaaattgagg

SEQ ID NO: 862304 - DNA, 22 bp, Artificial Sequence
  chemically synthesized
gcccatttgcctcaatttggta

SEQ ID NO: 862305 - DNA, 22 bp, Artificial Sequence
  chemically synthesized
ggatggtctttcagagttctac

SEQ ID NO: 862306 - DNA, 22 bp, Artificial Sequence
  chemically synthesized
gcctcaatttggtagaactctg

SEQ ID NO: 862307 - DNA, 22 bp, Artificial Sequence
  chemically synthesized
cctcaatttggtagaactctga

SEQ ID NO: 862308 - DNA, 22 bp, Artificial Sequence
  chemically synthesized
aatttggtagaactctgaaaga

SEQ ID NO: 862309 - DNA, 22 bp, Artificial Sequence
  chemically synthesized
gagctgggatggtctttcagag

SEQ ID NO: 862310 - DNA, 22 bp, Artificial Sequence
  chemically synthesized
ggtagaactctgaaagaccatc

SEQ ID NO: 862311 - DNA, 22 bp, Artificial Sequence
  chemically synthesized
gtagaactctgaaagaccatcc

SEQ ID NO: 862312 - DNA, 22 bp, Artificial Sequence
  chemically synthesized
tgaaagaccatcccagctccag

SEQ ID NO: 862313 - DNA, 22 bp, Artificial Sequence
  chemically synthesized
aaagaccatcccagctccagtg

SEQ ID NO: 862314 - DNA, 22 bp, Artificial Sequence
  chemically synthesized
agcccatgtgacagggacactg

SEQ ID NO: 862315 - DNA, 22 bp, Artificial Sequence
  chemically synthesized
cagcccatgtgacagggacact

SEQ ID NO: 862316 - DNA, 22 bp, Artificial Sequence
  chemically synthesized
aggcttcagcccatgtgacagg

SEQ ID NO: 862317 - DNA, 22 bp, Artificial Sequence
  chemically synthesized
ctgaggcttcagcccatgtgac

SEQ ID NO: 862318 - DNA, 22 bp, Artificial Sequence
  chemically synthesized
cagtgtccctgtcacatgggct

SEQ ID NO: 862319 - DNA, 22 bp, Artificial Sequence
  chemically synthesized
ctactgaggcttcagcccatgt

SEQ ID NO: 862320 - DNA, 22 bp, Artificial Sequence
  chemically synthesized
cagttgctactgaggcttcagc

SEQ ID NO: 862321 - DNA, 22 bp, Artificial Sequence
  chemically synthesized
tcacatgggctgaagcctcagt

SEQ ID NO: 862322 - DNA, 22 bp, Artificial Sequence
  chemically synthesized
atccacactgcagttgctactg

SEQ ID NO: 862323 - DNA, 22 bp, Artificial Sequence
  chemically synthesized
aagcctcagtagcaactgcagt

SEQ ID NO: 862324 - DNA, 22 bp, Artificial Sequence
  chemically synthesized
agtagcaactgcagtgtggatg

SEQ ID NO: 862325 - DNA, 22 bp, Artificial Sequence
  chemically synthesized
ggcagagagaaaagctcatcca

SEQ ID NO: 862326 - DNA, 22 bp, Artificial Sequence
  chemically synthesized
cagtgtggatgagcttttctct

SEQ ID NO: 862327 - DNA, 22 bp, Artificial Sequence
  chemically synthesized
ttctctctgcccaatactgcct

SEQ ID NO: 862328 - DNA, 22 bp, Artificial Sequence
  chemically synthesized
tctctctgcccaatactgcctc

SEQ ID NO: 862329 - DNA, 22 bp, Artificial Sequence
  chemically synthesized
ctctctgcccaatactgcctcc

SEQ ID NO: 862330 - DNA, 22 bp, Artificial Sequence
  chemically synthesized
taaggaagtgaaggaggcagta

SEQ ID NO: 862331 - DNA, 22 bp, Artificial Sequence
  chemically synthesized
tctctgcccaatactgcctcct

SEQ ID NO: 862332 - DNA, 22 bp, Artificial Sequence
  chemically synthesized
ataaggaagtgaaggaggcagt

SEQ ID NO: 862333 - DNA, 22 bp, Artificial Sequence
  chemically synthesized
tctgcccaatactgcctccttc

SEQ ID NO: 862334 - DNA, 22 bp, Artificial Sequence
  chemically synthesized
tttataaggaagtgaaggaggc

SEQ ID NO: 862335 - DNA, 22 bp, Artificial Sequence
  chemically synthesized
tgcccaatactgcctccttcac

SEQ ID NO: 862336 - DNA, 22 bp, Artificial Sequence
  chemically synthesized
cccaatactgcctccttcactt

SEQ ID NO: 862337 - DNA, 22 bp, Artificial Sequence
  chemically synthesized
ctatttataaggaagtgaagga

SEQ ID NO: 862338 - DNA, 22 bp, Artificial Sequence
  chemically synthesized
ttgctatttataaggaagtgaa

SEQ ID NO: 862339 - DNA, 22 bp, Artificial Sequence
  chemically synthesized
cctccttcacttccttataaat

SEQ ID NO: 862340 - DNA, 22 bp, Artificial Sequence
  chemically synthesized
agaagtattgttgctatttata

SEQ ID NO: 862341 - DNA, 22 bp, Artificial Sequence
  chemically synthesized
cttcacttccttataaatagca

SEQ ID NO: 862342 - DNA, 22 bp, Artificial Sequence
  chemically synthesized
gagaagtattgttgctatttat

SEQ ID NO: 862343 - DNA, 22 bp, Artificial Sequence
  chemically synthesized
tgagaagtattgttgctattta

SEQ ID NO: 862344 - DNA, 22 bp, Artificial Sequence
  chemically synthesized
cacttccttataaatagcaaca

SEQ ID NO: 862345 - DNA, 22 bp, Artificial Sequence
  chemically synthesized
acttccttataaatagcaacaa

SEQ ID NO: 862346 - DNA, 22 bp, Artificial Sequence
  chemically synthesized
ccttataaatagcaacaatact

SEQ ID NO: 862347 - DNA, 22 bp, Artificial Sequence
  chemically synthesized
cttataaatagcaacaatactt

SEQ ID NO: 862348 - DNA, 22 bp, Artificial Sequence
  chemically synthesized
ataaatagcaacaatacttctc

SEQ ID NO: 862349 - DNA, 22 bp, Artificial Sequence
  chemically synthesized
taaatagcaacaatacttctca

SEQ ID NO: 862350 - DNA, 22 bp, Artificial Sequence
  chemically synthesized
cacacagaaagtattttgagaa

SEQ ID NO: 862351 - DNA, 22 bp, Artificial Sequence
  chemically synthesized
agacaaaaagttgcacacagaa

SEQ ID NO: 862352 - DNA, 22 bp, Artificial Sequence
  chemically synthesized
ctcaaaatactttctgtgtgca

SEQ ID NO: 862353 - DNA, 22 bp, Artificial Sequence
  chemically synthesized
tcaaaatactttctgtgtgcaa

SEQ ID NO: 862354 - DNA, 22 bp, Artificial Sequence
  chemically synthesized
tgagacaaaaagttgcacacag

SEQ ID NO: 862355 - DNA, 22 bp, Artificial Sequence
  chemically synthesized
aaaatactttctgtgtgcaact

SEQ ID NO: 862356 - DNA, 22 bp, Artificial Sequence
  chemically synthesized
tctgtgtgcaactttttgtctc

SEQ ID NO: 862357 - DNA, 22 bp, Artificial Sequence
  chemically synthesized
gcaacagtctctgagacaaaaa

SEQ ID NO: 862358 - DNA, 22 bp, Artificial Sequence
  chemically synthesized
ctgtgtgcaactttttgtctca

SEQ ID NO: 862359 - DNA, 22 bp, Artificial Sequence
  chemically synthesized
ggcaacagtctctgagacaaaa

SEQ ID NO: 862360 - DNA, 22 bp, Artificial Sequence
  chemically synthesized
tgtgtgcaactttttgtctcag

SEQ ID NO: 862361 - DNA, 22 bp, Artificial Sequence
  chemically synthesized
tgtgcaactttttgtctcagag

SEQ ID NO: 862362 - DNA, 22 bp, Artificial Sequence
  chemically synthesized
cttggcaacagtctctgagaca

SEQ ID NO: 862363 - DNA, 22 bp, Artificial Sequence
  chemically synthesized
tttgtctcagagactgttgcca

SEQ ID NO: 862364 - DNA, 22 bp, Artificial Sequence
  chemically synthesized
ttgtctcagagactgttgccaa

SEQ ID NO: 862365 - DNA, 22 bp, Artificial Sequence
  chemically synthesized
tgtctcagagactgttgccaag

SEQ ID NO: 862366 - DNA, 22 bp, Artificial Sequence
  chemically synthesized
gtctcagagactgttgccaagg

SEQ ID NO: 862367 - DNA, 22 bp, Artificial Sequence
  chemically synthesized
tctcagagactgttgccaagga

SEQ ID NO: 862368 - DNA, 22 bp, Artificial Sequence
  chemically synthesized
agagactgttgccaaggaatct

SEQ ID NO: 862369 - DNA, 22 bp, Artificial Sequence
  chemically synthesized
ttgccaaggaatctcatctctg

SEQ ID NO: 862370 - DNA, 22 bp, Artificial Sequence
  chemically synthesized
ccaaggaatctcatctctgaca

SEQ ID NO: 862371 - DNA, 22 bp, Artificial Sequence
  chemically synthesized
cgtaaatagaccagagatacgg

SEQ ID NO: 862372 - DNA, 22 bp, Artificial Sequence
  chemically synthesized
atctctgacaccgtatctctgg

SEQ ID NO: 862373 - DNA, 22 bp, Artificial Sequence
  chemically synthesized
ttacgtaaatagaccagagata

SEQ ID NO: 862374 - DNA, 22 bp, Artificial Sequence
  chemically synthesized
tgacaccgtatctctggtctat

SEQ ID NO: 862375 - DNA, 22 bp, Artificial Sequence
  chemically synthesized
acaccgtatctctggtctattt

SEQ ID NO: 862376 - DNA, 22 bp, Artificial Sequence
  chemically synthesized
aaaacaaactattacgtaaata

SEQ ID NO: 862377 - DNA, 22 bp, Artificial Sequence
  chemically synthesized
tggtctatttacgtaatagttt

SEQ ID NO: 862378 - DNA, 22 bp, Artificial Sequence
  chemically synthesized
tgtattaaaaacaaactattac

SEQ ID NO: 862379 - DNA, 22 bp, Artificial Sequence
  chemically synthesized
gtctatttacgtaatagtttgt

SEQ ID NO: 862380 - DNA, 22 bp, Artificial Sequence
  chemically synthesized
tatgtattaaaaacaaactatt

SEQ ID NO: 862381 - DNA, 22 bp, Artificial Sequence
  chemically synthesized
ctatgtattaaaaacaaactat

SEQ ID NO: 862382 - DNA, 22 bp, Artificial Sequence
  chemically synthesized
cttctatgtattaaaaacaaac

SEQ ID NO: 862383 - DNA, 22 bp, Artificial Sequence
  chemically synthesized
tttacgtaatagtttgttttta

SEQ ID NO: 862384 - DNA, 22 bp, Artificial Sequence
  chemically synthesized
acgtaatagtttgtttttaata

SEQ ID NO: 862385 - DNA, 22 bp, Artificial Sequence
  chemically synthesized
cgtaatagtttgtttttaatac

SEQ ID NO: 862386 - DNA, 22 bp, Artificial Sequence
  chemically synthesized
aaaaaatcatattacttctatg

SEQ ID NO: 862387 - DNA, 22 bp, Artificial Sequence
  chemically synthesized
gtttttaatacatagaagtaat

SEQ ID NO: 862388 - DNA, 22 bp, Artificial Sequence
  chemically synthesized
tttttaatacatagaagtaata

SEQ ID NO: 862389 - DNA, 22 bp, Artificial Sequence
  chemically synthesized
ttaatacatagaagtaatatga

SEQ ID NO: 862390 - DNA, 22 bp, Artificial Sequence
  chemically synthesized
taatacatagaagtaatatgat

SEQ ID NO: 862391 - DNA, 22 bp, Artificial Sequence
  chemically synthesized
aatacatagaagtaatatgatt

SEQ ID NO: 862392 - DNA, 22 bp, Artificial Sequence
  chemically synthesized
atacatagaagtaatatgattt

SEQ ID NO: 862393 - DNA, 22 bp, Artificial Sequence
  chemically synthesized
tcgaatgcctgaaaaaatcata

SEQ ID NO: 862394 - DNA, 22 bp, Artificial Sequence
  chemically synthesized
ctatcgaatgcctgaaaaaatc

SEQ ID NO: 862395 - DNA, 22 bp, Artificial Sequence
  chemically synthesized
tactatcgaatgcctgaaaaaa

SEQ ID NO: 862396 - DNA, 22 bp, Artificial Sequence
  chemically synthesized
aaaaatattctactatcgaatg

SEQ ID NO: 862397 - DNA, 22 bp, Artificial Sequence
  chemically synthesized
aaaaaatattctactatcgaat

SEQ ID NO: 862398 - DNA, 22 bp, Artificial Sequence
  chemically synthesized
taaaaaatattctactatcgaa

SEQ ID NO: 862399 - DNA, 22 bp, Artificial Sequence
  chemically synthesized
tttcaggcattcgatagtagaa

SEQ ID NO: 862400 - DNA, 22 bp, Artificial Sequence
  chemically synthesized
ttcaggcattcgatagtagaat

SEQ ID NO: 862401 - DNA, 22 bp, Artificial Sequence
  chemically synthesized
actttaaaaaatattctactat

SEQ ID NO: 862402 - DNA, 22 bp, Artificial Sequence
  chemically synthesized
tcaggcattcgatagtagaata

SEQ ID NO: 862403 - DNA, 22 bp, Artificial Sequence
  chemically synthesized
caggcattcgatagtagaatat

SEQ ID NO: 862404 - DNA, 22 bp, Artificial Sequence
  chemically synthesized
aggcattcgatagtagaatatt

SEQ ID NO: 862405 - DNA, 22 bp, Artificial Sequence
  chemically synthesized
taattaactttaaaaaatattc

SEQ ID NO: 862406 - DNA, 22 bp, Artificial Sequence
  chemically synthesized
ataattaactttaaaaaatatt

SEQ ID NO: 862407 - DNA, 22 bp, Artificial Sequence
  chemically synthesized
gatagtagaatattttttaaag

SEQ ID NO: 862408 - DNA, 22 bp, Artificial Sequence
  chemically synthesized
gcttataattaactttaaaaaa

SEQ ID NO: 862409 - DNA, 22 bp, Artificial Sequence
  chemically synthesized
tttaaagttaattataagccag

SEQ ID NO: 862410 - DNA, 22 bp, Artificial Sequence
  chemically synthesized
ttaaagttaattataagccagg

SEQ ID NO: 862411 - DNA, 22 bp, Artificial Sequence
  chemically synthesized
taaagttaattataagccaggc

SEQ ID NO: 862412 - DNA, 22 bp, Artificial Sequence
  chemically synthesized
aaagttaattataagccaggcg

SEQ ID NO: 862413 - DNA, 22 bp, Artificial Sequence
  chemically synthesized
aagttaattataagccaggcgc

SEQ ID NO: 862414 - DNA, 22 bp, Artificial Sequence
  chemically synthesized
caggcatgagccacagcgcctg

SEQ ID NO: 862415 - DNA, 22 bp, Artificial Sequence
  chemically synthesized
attataagccaggcgctgtggc

SEQ ID NO: 862416 - DNA, 22 bp, Artificial Sequence
  chemically synthesized
gtattacaggcatgagccacag

SEQ ID NO: 862417 - DNA, 22 bp, Artificial Sequence
  chemically synthesized
taagccaggcgctgtggctcat

SEQ ID NO: 862418 - DNA, 22 bp, Artificial Sequence
  chemically synthesized
ccaaagtgctggtattacaggc

SEQ ID NO: 862419 - DNA, 22 bp, Artificial Sequence
  chemically synthesized
tggctcatgcctgtaataccag

SEQ ID NO: 862420 - DNA, 22 bp, Artificial Sequence
  chemically synthesized
agcctcccaaagtgctggtatt

SEQ ID NO: 862421 - DNA, 22 bp, Artificial Sequence
  chemically synthesized
atgcctgtaataccagcacttt

SEQ ID NO: 862422 - DNA, 22 bp, Artificial Sequence
  chemically synthesized
ccacctcagcctcccaaagtgc

SEQ ID NO: 862423 - DNA, 22 bp, Artificial Sequence
  chemically synthesized
taccacctcagcctcccaaagt

SEQ ID NO: 862424 - DNA, 22 bp, Artificial Sequence
  chemically synthesized
taataccagcactttgggaggc

SEQ ID NO: 862425 - DNA, 22 bp, Artificial Sequence
  chemically synthesized
aggtgttctaccacctcagcct

SEQ ID NO: 862426 - DNA, 22 bp, Artificial Sequence
  chemically synthesized
tgggaggctgaggtggtagaac

SEQ ID NO: 862427 - DNA, 22 bp, Artificial Sequence
  chemically synthesized
cggacctcaggtgttctaccac

SEQ ID NO: 862428 - DNA, 22 bp, Artificial Sequence
  chemically synthesized
gggaggctgaggtggtagaaca

SEQ ID NO: 862429 - DNA, 22 bp, Artificial Sequence
  chemically synthesized
ggaggctgaggtggtagaacac

SEQ ID NO: 862430 - DNA, 22 bp, Artificial Sequence
  chemically synthesized
aactccggacctcaggtgttct

SEQ ID NO: 862431 - DNA, 22 bp, Artificial Sequence
  chemically synthesized
gaactccggacctcaggtgttc

SEQ ID NO: 862432 - DNA, 22 bp, Artificial Sequence
  chemically synthesized
aggtggtagaacacctgaggtc

SEQ ID NO: 862433 - DNA, 22 bp, Artificial Sequence
  chemically synthesized
gccttgaactccggacctcagg

SEQ ID NO: 862434 - DNA, 22 bp, Artificial Sequence
  chemically synthesized
aggtccggagttcaaggccagc

SEQ ID NO: 862435 - DNA, 22 bp, Artificial Sequence
  chemically synthesized
accataatgatcaggctggcct

SEQ ID NO: 862436 - DNA, 22 bp, Artificial Sequence
  chemically synthesized
caccataatgatcaggctggcc

SEQ ID NO: 862437 - DNA, 22 bp, Artificial Sequence
  chemically synthesized
aaggccagcctgatcattatgg

SEQ ID NO: 862438 - DNA, 22 bp, Artificial Sequence
  chemically synthesized
gtagagacagggtttcaccata

SEQ ID NO: 862439 - DNA, 22 bp, Artificial Sequence
  chemically synthesized
agtagagacagggtttcaccat

SEQ ID NO: 862440 - DNA, 22 bp, Artificial Sequence
  chemically synthesized
tagtagagacagggtttcacca

SEQ ID NO: 862441 - DNA, 22 bp, Artificial Sequence
  chemically synthesized
ttagtagagacagggtttcacc

SEQ ID NO: 862442 - DNA, 22 bp, Artificial Sequence
  chemically synthesized
atcattatggtgaaaccctgtc

SEQ ID NO: 862443 - DNA, 22 bp, Artificial Sequence
  chemically synthesized
tacttttagtagagacagggtt

SEQ ID NO: 862444 - DNA, 22 bp, Artificial Sequence
  chemically synthesized
gtacttttagtagagacagggt

SEQ ID NO: 862445 - DNA, 22 bp, Artificial Sequence
  chemically synthesized
tgtacttttagtagagacaggg

SEQ ID NO: 862446 - DNA, 22 bp, Artificial Sequence
  chemically synthesized
tggtgaaaccctgtctctacta

SEQ ID NO: 862447 - DNA, 22 bp, Artificial Sequence
  chemically synthesized
attttgtacttttagtagagac

SEQ ID NO: 862448 - DNA, 22 bp, Artificial Sequence
  chemically synthesized
gctaattttgtacttttagtag

SEQ ID NO: 862449 - DNA, 22 bp, Artificial Sequence
  chemically synthesized
tctctactaaaagtacaaaatt

SEQ ID NO: 862450 - DNA, 22 bp, Artificial Sequence
  chemically synthesized
tactaaaagtacaaaattagcc

SEQ ID NO: 862451 - DNA, 22 bp, Artificial Sequence
  chemically synthesized
ctaaaagtacaaaattagccag

SEQ ID NO: 862452 - DNA, 22 bp, Artificial Sequence
  chemically synthesized
aaagtacaaaattagccaggcg

SEQ ID NO: 862453 - DNA, 22 bp, Artificial Sequence
  chemically synthesized
cagccatgcaccaccacgcctg

SEQ ID NO: 862454 - DNA, 22 bp, Artificial Sequence
  chemically synthesized
ggattacagccatgcaccacca

SEQ ID NO: 862455 - DNA, 22 bp, Artificial Sequence
  chemically synthesized
gccaggcgtggtggtgcatggc

SEQ ID NO: 862456 - DNA, 22 bp, Artificial Sequence
  chemically synthesized
ccaagtagctgggattacagcc

SEQ ID NO: 862457 - DNA, 22 bp, Artificial Sequence
  chemically synthesized
agcctcccaagtagctgggatt

SEQ ID NO: 862458 - DNA, 22 bp, Artificial Sequence
  chemically synthesized
cctcagcctcccaagtagctgg

SEQ ID NO: 862459 - DNA, 22 bp, Artificial Sequence
  chemically synthesized
ctgcctcagcctcccaagtagc

SEQ ID NO: 862460 - DNA, 22 bp, Artificial Sequence
  chemically synthesized
tcctgcctcagcctcccaagta

SEQ ID NO: 862461 - DNA, 22 bp, Artificial Sequence
  chemically synthesized
taatcccagctacttgggaggc

SEQ ID NO: 862462 - DNA, 22 bp, Artificial Sequence
  chemically synthesized
aagtgattctcctgcctcagcc

SEQ ID NO: 862463 - DNA, 22 bp, Artificial Sequence
  chemically synthesized
caagtgattctcctgcctcagc

SEQ ID NO: 862464 - DNA, 22 bp, Artificial Sequence
  chemically synthesized
cttgggaggctgaggcaggaga

SEQ ID NO: 862465 - DNA, 22 bp, Artificial Sequence
  chemically synthesized
gtttcaagtgattctcctgcct

SEQ ID NO: 862466 - DNA, 22 bp, Artificial Sequence
  chemically synthesized
agtttcaagtgattctcctgcc

SEQ ID NO: 862467 - DNA, 22 bp, Artificial Sequence
  chemically synthesized
gggaggctgaggcaggagaatc

SEQ ID NO: 862468 - DNA, 22 bp, Artificial Sequence
  chemically synthesized
ttagtttcaagtgattctcctg

SEQ ID NO: 862469 - DNA, 22 bp, Artificial Sequence
  chemically synthesized
ggaggctgaggcaggagaatca

SEQ ID NO: 862470 - DNA, 22 bp, Artificial Sequence
  chemically synthesized
cacctcttagtttcaagtgatt

SEQ ID NO: 862471 - DNA, 22 bp, Artificial Sequence
  chemically synthesized
aggcaggagaatcacttgaaac

SEQ ID NO: 862472 - DNA, 22 bp, Artificial Sequence
  chemically synthesized
caacctccacctcttagtttca

SEQ ID NO: 862473 - DNA, 22 bp, Artificial Sequence
  chemically synthesized
actgcaacctccacctcttagt

SEQ ID NO: 862474 - DNA, 22 bp, Artificial Sequence
  chemically synthesized
agctcactgcaacctccacctc

SEQ ID NO: 862475 - DNA, 22 bp, Artificial Sequence
  chemically synthesized
gaaactaagaggtggaggttgc

SEQ ID NO: 862476 - DNA, 22 bp, Artificial Sequence
  chemically synthesized
aaactaagaggtggaggttgca

SEQ ID NO: 862477 - DNA, 22 bp, Artificial Sequence
  chemically synthesized
agaggtggaggttgcagtgagc

SEQ ID NO: 862478 - DNA, 22 bp, Artificial Sequence
  chemically synthesized
gagtgcaatggcatgatctcag

SEQ ID NO: 862479 - DNA, 22 bp, Artificial Sequence
  chemically synthesized
cagtgagctgagatcatgccat

SEQ ID NO: 862480 - DNA, 22 bp, Artificial Sequence
  chemically synthesized
ccaggctggagtgcaatggcat

SEQ ID NO: 862481 - DNA, 22 bp, Artificial Sequence
  chemically synthesized
tctcccaggctggagtgcaatg

SEQ ID NO: 862482 - DNA, 22 bp, Artificial Sequence
  chemically synthesized
gtctcccaggctggagtgcaat

SEQ ID NO: 862483 - DNA, 22 bp, Artificial Sequence
  chemically synthesized
tgtctcccaggctggagtgcaa

SEQ ID NO: 862484 - DNA, 22 bp, Artificial Sequence
  chemically synthesized
agatcatgccattgcactccag

SEQ ID NO: 862485 - DNA, 22 bp, Artificial Sequence
  chemically synthesized
ctttgtctcccaggctggagtg

SEQ ID NO: 862486 - DNA, 22 bp, Artificial Sequence
  chemically synthesized
gctttgtctcccaggctggagt

SEQ ID NO: 862487 - DNA, 22 bp, Artificial Sequence
  chemically synthesized
ttgctttgtctcccaggctgga

SEQ ID NO: 862488 - DNA, 22 bp, Artificial Sequence
  chemically synthesized
cactccagcctgggagacaaag

SEQ ID NO: 862489 - DNA, 22 bp, Artificial Sequence
  chemically synthesized
gagaatgattcttgctttgtct

SEQ ID NO: 862490 - DNA, 22 bp, Artificial Sequence
  chemically synthesized
agagaatgattcttgctttgtc

SEQ ID NO: 862491 - DNA, 22 bp, Artificial Sequence
  chemically synthesized
cagcctgggagacaaagcaaga

SEQ ID NO: 862492 - DNA, 22 bp, Artificial Sequence
  chemically synthesized
tttagagaatgattcttgcttt

SEQ ID NO: 862493 - DNA, 22 bp, Artificial Sequence
  chemically synthesized
atttagagaatgattcttgctt

SEQ ID NO: 862494 - DNA, 22 bp, Artificial Sequence
  chemically synthesized
tttatttagagaatgattcttg

SEQ ID NO: 862495 - DNA, 22 bp, Artificial Sequence
  chemically synthesized
atttatttagagaatgattctt

SEQ ID NO: 862496 - DNA, 22 bp, Artificial Sequence
  chemically synthesized
ggagacaaagcaagaatcattc

SEQ ID NO: 862497 - DNA, 22 bp, Artificial Sequence
  chemically synthesized
tttatttatttagagaatgatt

SEQ ID NO: 862498 - DNA, 22 bp, Artificial Sequence
  chemically synthesized
atttatttatttagagaatgat

SEQ ID NO: 862499 - DNA, 22 bp, Artificial Sequence
  chemically synthesized
tatttatttatttagagaatga

SEQ ID NO: 862500 - DNA, 22 bp, Artificial Sequence
  chemically synthesized
ttatttatttatttagagaatg

SEQ ID NO: 862501 - DNA, 22 bp, Artificial Sequence
  chemically synthesized
tttatttatttatttagagaat

SEQ ID NO: 862502 - DNA, 22 bp, Artificial Sequence
  chemically synthesized
actttttatttatttatttaga

SEQ ID NO: 862503 - DNA, 22 bp, Artificial Sequence
  chemically synthesized
tctaaataaataaataaaaagt

SEQ ID NO: 862504 - DNA, 22 bp, Artificial Sequence
  chemically synthesized
taaataaataaataaaaagtta

SEQ ID NO: 862505 - DNA, 22 bp, Artificial Sequence
  chemically synthesized
aataaataaataaaaagttaat

SEQ ID NO: 862506 - DNA, 22 bp, Artificial Sequence
  chemically synthesized
tataacatgtgataccaataaa

SEQ ID NO: 862507 - DNA, 22 bp, Artificial Sequence
  chemically synthesized
aattatataacatgtgatacca

SEQ ID NO: 862508 - DNA, 22 bp, Artificial Sequence
  chemically synthesized
attatttattggtatcacatgt

SEQ ID NO: 862509 - DNA, 22 bp, Artificial Sequence
  chemically synthesized
aattgaattatataacatgtga

SEQ ID NO: 862510 - DNA, 22 bp, Artificial Sequence
  chemically synthesized
tttattggtatcacatgttata

SEQ ID NO: 862511 - DNA, 22 bp, Artificial Sequence
  chemically synthesized
attggtatcacatgttatataa

SEQ ID NO: 862512 - DNA, 22 bp, Artificial Sequence
  chemically synthesized
ttggtatcacatgttatataat

SEQ ID NO: 862513 - DNA, 22 bp, Artificial Sequence
  chemically synthesized
gagcattcaattgaattatata

SEQ ID NO: 862514 - DNA, 22 bp, Artificial Sequence
  chemically synthesized
gtatcacatgttatataattca

SEQ ID NO: 862515 - DNA, 22 bp, Artificial Sequence
  chemically synthesized
agagcattcaattgaattatat

SEQ ID NO: 862516 - DNA, 22 bp, Artificial Sequence
  chemically synthesized
tagagcattcaattgaattata

SEQ ID NO: 862517 - DNA, 22 bp, Artificial Sequence
  chemically synthesized
ttagagcattcaattgaattat

SEQ ID NO: 862518 - DNA, 22 bp, Artificial Sequence
  chemically synthesized
tttagagcattcaattgaatta

SEQ ID NO: 862519 - DNA, 22 bp, Artificial Sequence
  chemically synthesized
tcattttttagagcattcaatt

SEQ ID NO: 862520 - DNA, 22 bp, Artificial Sequence
  chemically synthesized
gtcattttttagagcattcaat

SEQ ID NO: 862521 - DNA, 22 bp, Artificial Sequence
  chemically synthesized
tgtcattttttagagcattcaa

SEQ ID NO: 862522 - DNA, 22 bp, Artificial Sequence
  chemically synthesized
ttgtcattttttagagcattca

SEQ ID NO: 862523 - DNA, 22 bp, Artificial Sequence
  chemically synthesized
tataattcaattgaatgctcta

SEQ ID NO: 862524 - DNA, 22 bp, Artificial Sequence
  chemically synthesized
tttgtcattttttagagcattc

SEQ ID NO: 862525 - DNA, 22 bp, Artificial Sequence
  chemically synthesized
catactttttgtcattttttag

SEQ ID NO: 862526 - DNA, 22 bp, Artificial Sequence
  chemically synthesized
aattgaatgctctaaaaaatga

SEQ ID NO: 862527 - DNA, 22 bp, Artificial Sequence
  chemically synthesized
tgcatactttttgtcatttttt

SEQ ID NO: 862528 - DNA, 22 bp, Artificial Sequence
  chemically synthesized
aatgctctaaaaaatgacaaaa

SEQ ID NO: 862529 - DNA, 22 bp, Artificial Sequence
  chemically synthesized
taaaaaatgacaaaaagtatgc

SEQ ID NO: 862530 - DNA, 22 bp, Artificial Sequence
  chemically synthesized
aaaaatgacaaaaagtatgcag

SEQ ID NO: 862531 - DNA, 22 bp, Artificial Sequence
  chemically synthesized
aacaataaatatgccaacaatc

SEQ ID NO: 862532 - DNA, 22 bp, Artificial Sequence
  chemically synthesized
aaacaataaatatgccaacaat

SEQ ID NO: 862533 - DNA, 22 bp, Artificial Sequence
  chemically synthesized
taagcccttaaacaataaatat

SEQ ID NO: 862534 - DNA, 22 bp, Artificial Sequence
  chemically synthesized
ataagcccttaaacaataaata

SEQ ID NO: 862535 - DNA, 22 bp, Artificial Sequence
  chemically synthesized
tataagcccttaaacaataaat

SEQ ID NO: 862536 - DNA, 22 bp, Artificial Sequence
  chemically synthesized
ctttataagcccttaaacaata

SEQ ID NO: 862537 - DNA, 22 bp, Artificial Sequence
  chemically synthesized
ttggcatatttattgtttaagg

SEQ ID NO: 862538 - DNA, 22 bp, Artificial Sequence
  chemically synthesized
gcatatttattgtttaagggct

SEQ ID NO: 862539 - DNA, 22 bp, Artificial Sequence
  chemically synthesized
attgtttaagggcttataaagt

SEQ ID NO: 862540 - DNA, 22 bp, Artificial Sequence
  chemically synthesized
ttgtttaagggcttataaagta

SEQ ID NO: 862541 - DNA, 22 bp, Artificial Sequence
  chemically synthesized
tttaagggcttataaagtagtt

SEQ ID NO: 862542 - DNA, 22 bp, Artificial Sequence
  chemically synthesized
aagggcttataaagtagtttta

SEQ ID NO: 862543 - DNA, 22 bp, Artificial Sequence
  chemically synthesized
agggcttataaagtagttttac

SEQ ID NO: 862544 - DNA, 22 bp, Artificial Sequence
  chemically synthesized
aaatatacccaaggagtgtaaa

SEQ ID NO: 862545 - DNA, 22 bp, Artificial Sequence
  chemically synthesized
ataaagtagttttacactcctt

SEQ ID NO: 862546 - DNA, 22 bp, Artificial Sequence
  chemically synthesized
taaagtagttttacactccttg

SEQ ID NO: 862547 - DNA, 22 bp, Artificial Sequence
  chemically synthesized
aaactcaaatatacccaaggag

SEQ ID NO: 862548 - DNA, 22 bp, Artificial Sequence
  chemically synthesized
tacactccttgggtatatttga

SEQ ID NO: 862549 - DNA, 22 bp, Artificial Sequence
  chemically synthesized
acactccttgggtatatttgag

SEQ ID NO: 862550 - DNA, 22 bp, Artificial Sequence
  chemically synthesized
cactccttgggtatatttgagt

SEQ ID NO: 862551 - DNA, 22 bp, Artificial Sequence
  chemically synthesized
atgatacattgaaactcaaata

SEQ ID NO: 862552 - DNA, 22 bp, Artificial Sequence
  chemically synthesized
tgatgatacattgaaactcaaa

SEQ ID NO: 862553 - DNA, 22 bp, Artificial Sequence
  chemically synthesized
cttgggtatatttgagtttcaa

SEQ ID NO: 862554 - DNA, 22 bp, Artificial Sequence
  chemically synthesized
gggtatatttgagtttcaatgt

SEQ ID NO: 862555 - DNA, 22 bp, Artificial Sequence
  chemically synthesized
ggtatatttgagtttcaatgta

SEQ ID NO: 862556 - DNA, 22 bp, Artificial Sequence
  chemically synthesized
gagtttcaatgtatcatcagag

SEQ ID NO: 862557 - DNA, 22 bp, Artificial Sequence
  chemically synthesized
agtttcaatgtatcatcagagt

SEQ ID NO: 862558 - DNA, 22 bp, Artificial Sequence
  chemically synthesized
acataagaaacagcaactctga

SEQ ID NO: 862559 - DNA, 22 bp, Artificial Sequence
  chemically synthesized
cacataagaaacagcaactctg

SEQ ID NO: 862560 - DNA, 22 bp, Artificial Sequence
  chemically synthesized
caatgtatcatcagagttgctg

SEQ ID NO: 862561 - DNA, 22 bp, Artificial Sequence
  chemically synthesized
aatgtatcatcagagttgctgt

SEQ ID NO: 862562 - DNA, 22 bp, Artificial Sequence
  chemically synthesized
caggaagtgtgcatatttcaca

SEQ ID NO: 862563 - DNA, 22 bp, Artificial Sequence
  chemically synthesized
ctgtttcttatgtgaaatatgc

SEQ ID NO: 862564 - DNA, 22 bp, Artificial Sequence
  chemically synthesized
gttacaggaagtgtgcatattt

SEQ ID NO: 862565 - DNA, 22 bp, Artificial Sequence
  chemically synthesized
tttcttatgtgaaatatgcaca

SEQ ID NO: 862566 - DNA, 22 bp, Artificial Sequence
  chemically synthesized
agttacaggaagtgtgcatatt

SEQ ID NO: 862567 - DNA, 22 bp, Artificial Sequence
  chemically synthesized
tagttacaggaagtgtgcatat

SEQ ID NO: 862568 - DNA, 22 bp, Artificial Sequence
  chemically synthesized
ttagttacaggaagtgtgcata

SEQ ID NO: 862569 - DNA, 22 bp, Artificial Sequence
  chemically synthesized
cttatgtgaaatatgcacactt

SEQ ID NO: 862570 - DNA, 22 bp, Artificial Sequence
  chemically synthesized
ttatgtgaaatatgcacacttc

SEQ ID NO: 862571 - DNA, 22 bp, Artificial Sequence
  chemically synthesized
atgtgaaatatgcacacttcct

SEQ ID NO: 862572 - DNA, 22 bp, Artificial Sequence
  chemically synthesized
tgtgaaatatgcacacttcctg

SEQ ID NO: 862573 - DNA, 22 bp, Artificial Sequence
  chemically synthesized
atgggtcttttagttacaggaa

SEQ ID NO: 862574 - DNA, 22 bp, Artificial Sequence
  chemically synthesized
tcaagctcatgggtcttttagt

SEQ ID NO: 862575 - DNA, 22 bp, Artificial Sequence
  chemically synthesized
gtcaagctcatgggtcttttag

SEQ ID NO: 862576 - DNA, 22 bp, Artificial Sequence
  chemically synthesized
cctgtaactaaaagacccatga

SEQ ID NO: 862577 - DNA, 22 bp, Artificial Sequence
  chemically synthesized
aatttgtcaagctcatgggtct

SEQ ID NO: 862578 - DNA, 22 bp, Artificial Sequence
  chemically synthesized
ctgtaactaaaagacccatgag

SEQ ID NO: 862579 - DNA, 22 bp, Artificial Sequence
  chemically synthesized
taactaaaagacccatgagctt

SEQ ID NO: 862580 - DNA, 22 bp, Artificial Sequence
  chemically synthesized
agcagttgaatttgtcaagctc

SEQ ID NO: 862581 - DNA, 22 bp, Artificial Sequence
  chemically synthesized
cagcagttgaatttgtcaagct

SEQ ID NO: 862582 - DNA, 22 bp, Artificial Sequence
  chemically synthesized
aaagacccatgagcttgacaaa

SEQ ID NO: 862583 - DNA, 22 bp, Artificial Sequence
  chemically synthesized
aagacttcagcagttgaatttg

SEQ ID NO: 862584 - DNA, 22 bp, Artificial Sequence
  chemically synthesized
gacaaattcaactgctgaagtc

SEQ ID NO: 862585 - DNA, 22 bp, Artificial Sequence
  chemically synthesized
acaaattcaactgctgaagtct

SEQ ID NO: 862586 - DNA, 22 bp, Artificial Sequence
  chemically synthesized
tgaagacggagttcaagacttc

SEQ ID NO: 862587 - DNA, 22 bp, Artificial Sequence
  chemically synthesized
aactgctgaagtcttgaactcc

SEQ ID NO: 862588 - DNA, 22 bp, Artificial Sequence
  chemically synthesized
ctgaagtcttgaactccgtctt

SEQ ID NO: 862589 - DNA, 22 bp, Artificial Sequence
  chemically synthesized
caaggtcattatgaagacggag

SEQ ID NO: 862590 - DNA, 22 bp, Artificial Sequence
  chemically synthesized
ccaaggtcattatgaagacgga

SEQ ID NO: 862591 - DNA, 22 bp, Artificial Sequence
  chemically synthesized
aagtcttgaactccgtcttcat

SEQ ID NO: 862592 - DNA, 22 bp, Artificial Sequence
  chemically synthesized
catttccaaggtcattatgaag

SEQ ID NO: 862593 - DNA, 22 bp, Artificial Sequence
  chemically synthesized
gaactccgtcttcataatgacc

SEQ ID NO: 862594 - DNA, 22 bp, Artificial Sequence
  chemically synthesized
aactccgtcttcataatgacct

SEQ ID NO: 862595 - DNA, 22 bp, Artificial Sequence
  chemically synthesized
cgtcttcataatgaccttggaa

SEQ ID NO: 862596 - DNA, 22 bp, Artificial Sequence
  chemically synthesized
agatagcagttacatttccaag

SEQ ID NO: 862597 - DNA, 22 bp, Artificial Sequence
  chemically synthesized
aagatagcagttacatttccaa

SEQ ID NO: 862598 - DNA, 22 bp, Artificial Sequence
  chemically synthesized
cataatgaccttggaaatgtaa

SEQ ID NO: 862599 - DNA, 22 bp, Artificial Sequence
  chemically synthesized
ataatgaccttggaaatgtaac

SEQ ID NO: 862600 - DNA, 22 bp, Artificial Sequence
  chemically synthesized
aaaccaacttaagatagcagtt

SEQ ID NO: 862601 - DNA, 22 bp, Artificial Sequence
  chemically synthesized
caaaccaacttaagatagcagt

SEQ ID NO: 862602 - DNA, 22 bp, Artificial Sequence
  chemically synthesized
ggaaatgtaactgctatcttaa

SEQ ID NO: 862603 - DNA, 22 bp, Artificial Sequence
  chemically synthesized
gaaatgtaactgctatcttaag

SEQ ID NO: 862604 - DNA, 22 bp, Artificial Sequence
  chemically synthesized
aatacagtcacttcaaaccaac

SEQ ID NO: 862605 - DNA, 22 bp, Artificial Sequence
  chemically synthesized
ctatcttaagttggtttgaagt

SEQ ID NO: 862606 - DNA, 22 bp, Artificial Sequence
  chemically synthesized
gttcaatacagtcacttcaaac

SEQ ID NO: 862607 - DNA, 22 bp, Artificial Sequence
  chemically synthesized
agttcaatacagtcacttcaaa

SEQ ID NO: 862608 - DNA, 22 bp, Artificial Sequence
  chemically synthesized
tcttaagttggtttgaagtgac

SEQ ID NO: 862609 - DNA, 22 bp, Artificial Sequence
  chemically synthesized
aagttggtttgaagtgactgta

SEQ ID NO: 862610 - DNA, 22 bp, Artificial Sequence
  chemically synthesized
agttggtttgaagtgactgtat

SEQ ID NO: 862611 - DNA, 22 bp, Artificial Sequence
  chemically synthesized
aagtttagttcaatacagtcac

SEQ ID NO: 862612 - DNA, 22 bp, Artificial Sequence
  chemically synthesized
gtttgaagtgactgtattgaac

SEQ ID NO: 862613 - DNA, 22 bp, Artificial Sequence
  chemically synthesized
aaactcaagtttagttcaatac

SEQ ID NO: 862614 - DNA, 22 bp, Artificial Sequence
  chemically synthesized
gaagtgactgtattgaactaaa

SEQ ID NO: 862615 - DNA, 22 bp, Artificial Sequence
  chemically synthesized
aagtgactgtattgaactaaac

SEQ ID NO: 862616 - DNA, 22 bp, Artificial Sequence
  chemically synthesized
tattgaactaaacttgagtttt

SEQ ID NO: 862617 - DNA, 22 bp, Artificial Sequence
  chemically synthesized
acccagaacgttaaaactcaag

SEQ ID NO: 862618 - DNA, 22 bp, Artificial Sequence
  chemically synthesized
ctgacccagaacgttaaaactc

SEQ ID NO: 862619 - DNA, 22 bp, Artificial Sequence
  chemically synthesized
actgacccagaacgttaaaact

SEQ ID NO: 862620 - DNA, 22 bp, Artificial Sequence
  chemically synthesized
aactaaacttgagttttaacgt

SEQ ID NO: 862621 - DNA, 22 bp, Artificial Sequence
  chemically synthesized
aacttgagttttaacgttctgg

SEQ ID NO: 862622 - DNA, 22 bp, Artificial Sequence
  chemically synthesized
gagttttaacgttctgggtcag

SEQ ID NO: 862623 - DNA, 22 bp, Artificial Sequence
  chemically synthesized
ataacatgtttactgacccaga

SEQ ID NO: 862624 - DNA, 22 bp, Artificial Sequence
  chemically synthesized
agttttaacgttctgggtcagt

SEQ ID NO: 862625 - DNA, 22 bp, Artificial Sequence
  chemically synthesized
taacgttctgggtcagtaaaca

SEQ ID NO: 862626 - DNA, 22 bp, Artificial Sequence
  chemically synthesized
caattcataacatgtttactga

SEQ ID NO: 862627 - DNA, 22 bp, Artificial Sequence
  chemically synthesized
aacgttctgggtcagtaaacat

SEQ ID NO: 862628 - DNA, 22 bp, Artificial Sequence
  chemically synthesized
acgttctgggtcagtaaacatg

SEQ ID NO: 862629 - DNA, 22 bp, Artificial Sequence
  chemically synthesized
tgggtcagtaaacatgttatga

SEQ ID NO: 862630 - DNA, 22 bp, Artificial Sequence
  chemically synthesized
catacctgcaattcataacatg

SEQ ID NO: 862631 - DNA, 22 bp, Artificial Sequence
  chemically synthesized
ccatacctgcaattcataacat

SEQ ID NO: 862632 - DNA, 22 bp, Artificial Sequence
  chemically synthesized
ggtcagtaaacatgttatgaat

SEQ ID NO: 862633 - DNA, 22 bp, Artificial Sequence
  chemically synthesized
tccatacctgcaattcataaca

SEQ ID NO: 862634 - DNA, 22 bp, Artificial Sequence
  chemically synthesized
gtgtgttttccatacctgcaat

SEQ ID NO: 862635 - DNA, 22 bp, Artificial Sequence
  chemically synthesized
agttagtgtgttttccatacct

SEQ ID NO: 862636 - DNA, 22 bp, Artificial Sequence
  chemically synthesized
cagttagtgtgttttccatacc

SEQ ID NO: 862637 - DNA, 22 bp, Artificial Sequence
  chemically synthesized
tgaattgcaggtatggaaaaca

SEQ ID NO: 862638 - DNA, 22 bp, Artificial Sequence
  chemically synthesized
tttcagttagtgtgttttccat

SEQ ID NO: 862639 - DNA, 22 bp, Artificial Sequence
  chemically synthesized
cactatttcagttagtgtgttt

SEQ ID NO: 862640 - DNA, 22 bp, Artificial Sequence
  chemically synthesized
caggtatggaaaacacactaac

SEQ ID NO: 862641 - DNA, 22 bp, Artificial Sequence
  chemically synthesized
gttccactatttcagttagtgt

SEQ ID NO: 862642 - DNA, 22 bp, Artificial Sequence
  chemically synthesized
atgtagctagttccactatttc

SEQ ID NO: 862643 - DNA, 22 bp, Artificial Sequence
  chemically synthesized
gatgtagctagttccactattt

SEQ ID NO: 862644 - DNA, 22 bp, Artificial Sequence
  chemically synthesized
tgatgtagctagttccactatt

SEQ ID NO: 862645 - DNA, 22 bp, Artificial Sequence
  chemically synthesized
attttgatgtagctagttccac

SEQ ID NO: 862646 - DNA, 22 bp, Artificial Sequence
  chemically synthesized
actgaaatagtggaactagcta

SEQ ID NO: 862647 - DNA, 22 bp, Artificial Sequence
  chemically synthesized
aaatagtggaactagctacatc

SEQ ID NO: 862648 - DNA, 22 bp, Artificial Sequence
  chemically synthesized
aataaaaacataaattgatttt

SEQ ID NO: 862649 - DNA, 22 bp, Artificial Sequence
  chemically synthesized
gctacatcaaaatcaatttatg

SEQ ID NO: 862650 - DNA, 22 bp, Artificial Sequence
  chemically synthesized
caagttaaataaaaacataaat

SEQ ID NO: 862651 - DNA, 22 bp, Artificial Sequence
  chemically synthesized
catcaaaatcaatttatgtttt

SEQ ID NO: 862652 - DNA, 22 bp, Artificial Sequence
  chemically synthesized
tacaagttaaataaaaacataa

SEQ ID NO: 862653 - DNA, 22 bp, Artificial Sequence
  chemically synthesized
ctacaagttaaataaaaacata

SEQ ID NO: 862654 - DNA, 22 bp, Artificial Sequence
  chemically synthesized
tctacaagttaaataaaaacat

SEQ ID NO: 862655 - DNA, 22 bp, Artificial Sequence
  chemically synthesized
atgtttttatttaacttgtaga

SEQ ID NO: 862656 - DNA, 22 bp, Artificial Sequence
  chemically synthesized
tgtttttatttaacttgtagaa

SEQ ID NO: 862657 - DNA, 22 bp, Artificial Sequence
  chemically synthesized
ggcatagtatggttttctacaa

SEQ ID NO: 862658 - DNA, 22 bp, Artificial Sequence
  chemically synthesized
tgggcatagtatggttttctac

SEQ ID NO: 862659 - DNA, 22 bp, Artificial Sequence
  chemically synthesized
ttatttaacttgtagaaaacca

SEQ ID NO: 862660 - DNA, 22 bp, Artificial Sequence
  chemically synthesized
ctgggcatagtatggttttcta

SEQ ID NO: 862661 - DNA, 22 bp, Artificial Sequence
  chemically synthesized
tatttaacttgtagaaaaccat

SEQ ID NO: 862662 - DNA, 22 bp, Artificial Sequence
  chemically synthesized
atttaacttgtagaaaaccata

SEQ ID NO: 862663 - DNA, 22 bp, Artificial Sequence
  chemically synthesized
tttaacttgtagaaaaccatac

SEQ ID NO: 862664 - DNA, 22 bp, Artificial Sequence
  chemically synthesized
aacttgtagaaaaccatactat

SEQ ID NO: 862665 - DNA, 22 bp, Artificial Sequence
  chemically synthesized
acttgtagaaaaccatactatg

SEQ ID NO: 862666 - DNA, 22 bp, Artificial Sequence
  chemically synthesized
tcgcacttctgggcatagtatg

SEQ ID NO: 862667 - DNA, 22 bp, Artificial Sequence
  chemically synthesized
gtagaaaaccatactatgccca

SEQ ID NO: 862668 - DNA, 22 bp, Artificial Sequence
  chemically synthesized
tagaaaaccatactatgcccag

SEQ ID NO: 862669 - DNA, 22 bp, Artificial Sequence
  chemically synthesized
gtagttgtcgcacttctgggca

SEQ ID NO: 862670 - DNA, 22 bp, Artificial Sequence
  chemically synthesized
tatggttggtagttgtcgcact

SEQ ID NO: 862671 - DNA, 22 bp, Artificial Sequence
  chemically synthesized
gtatggttggtagttgtcgcac

SEQ ID NO: 862672 - DNA, 22 bp, Artificial Sequence
  chemically synthesized
tgtatggttggtagttgtcgca

SEQ ID NO: 862673 - DNA, 22 bp, Artificial Sequence
  chemically synthesized
ttgtatggttggtagttgtcgc

SEQ ID NO: 862674 - DNA, 22 bp, Artificial Sequence
  chemically synthesized
tgcccagaagtgcgacaactac

SEQ ID NO: 862675 - DNA, 22 bp, Artificial Sequence
  chemically synthesized
ttttgtatggttggtagttgtc

SEQ ID NO: 862676 - DNA, 22 bp, Artificial Sequence
  chemically synthesized
atctcttttgtatggttggtag

SEQ ID NO: 862677 - DNA, 22 bp, Artificial Sequence
  chemically synthesized
gatctcttttgtatggttggta

SEQ ID NO: 862678 - DNA, 22 bp, Artificial Sequence
  chemically synthesized
tgatctcttttgtatggttggt

SEQ ID NO: 862679 - DNA, 22 bp, Artificial Sequence
  chemically synthesized
attttgatctcttttgtatggt

SEQ ID NO: 862680 - DNA, 22 bp, Artificial Sequence
  chemically synthesized
gattttgatctcttttgtatgg

SEQ ID NO: 862681 - DNA, 22 bp, Artificial Sequence
  chemically synthesized
cccttgattttgatctcttttg

SEQ ID NO: 862682 - DNA, 22 bp, Artificial Sequence
  chemically synthesized
tccccttgattttgatctcttt

SEQ ID NO: 862683 - DNA, 22 bp, Artificial Sequence
  chemically synthesized
ccaaccatacaaaagagatcaa

SEQ ID NO: 862684 - DNA, 22 bp, Artificial Sequence
  chemically synthesized
ctccccttgattttgatctctt

SEQ ID NO: 862685 - DNA, 22 bp, Artificial Sequence
  chemically synthesized
tctccccttgattttgatctct

SEQ ID NO: 862686 - DNA, 22 bp, Artificial Sequence
  chemically synthesized
ttttctccccttgattttgatc

SEQ ID NO: 862687 - DNA, 22 bp, Artificial Sequence
  chemically synthesized
cctgttttctccccttgatttt

SEQ ID NO: 862688 - DNA, 22 bp, Artificial Sequence
  chemically synthesized
cgtaagtgttacctgttttctc

SEQ ID NO: 862689 - DNA, 22 bp, Artificial Sequence
  chemically synthesized
ctacgtaagtgttacctgtttt

SEQ ID NO: 862690 - DNA, 22 bp, Artificial Sequence
  chemically synthesized
cctacgtaagtgttacctgttt

SEQ ID NO: 862691 - DNA, 22 bp, Artificial Sequence
  chemically synthesized
tcctacgtaagtgttacctgtt

SEQ ID NO: 862692 - DNA, 22 bp, Artificial Sequence
  chemically synthesized
ttcctacgtaagtgttacctgt

SEQ ID NO: 862693 - DNA, 22 bp, Artificial Sequence
  chemically synthesized
acaagcaatttttcctacgtaa

SEQ ID NO: 862694 - DNA, 22 bp, Artificial Sequence
  chemically synthesized
taacaagcaatttttcctacgt

SEQ ID NO: 862695 - DNA, 22 bp, Artificial Sequence
  chemically synthesized
ctaacaagcaatttttcctacg

SEQ ID NO: 862696 - DNA, 22 bp, Artificial Sequence
  chemically synthesized
tgcttctaacaagcaatttttc

SEQ ID NO: 862697 - DNA, 22 bp, Artificial Sequence
  chemically synthesized
ttgtgcttctaacaagcaattt

SEQ ID NO: 862698 - DNA, 22 bp, Artificial Sequence
  chemically synthesized
gttgtgcttctaacaagcaatt

SEQ ID NO: 862699 - DNA, 22 bp, Artificial Sequence
  chemically synthesized
acgtaggaaaaattgcttgtta

SEQ ID NO: 862700 - DNA, 22 bp, Artificial Sequence
  chemically synthesized
cgtaggaaaaattgcttgttag

SEQ ID NO: 862701 - DNA, 22 bp, Artificial Sequence
  chemically synthesized
tttgttgtgcttctaacaagca

SEQ ID NO: 862702 - DNA, 22 bp, Artificial Sequence
  chemically synthesized
atttgttgtgcttctaacaagc

SEQ ID NO: 862703 - DNA, 22 bp, Artificial Sequence
  chemically synthesized
tatttgttgtgcttctaacaag

SEQ ID NO: 862704 - DNA, 22 bp, Artificial Sequence
  chemically synthesized
ttatttgttgtgcttctaacaa

SEQ ID NO: 862705 - DNA, 22 bp, Artificial Sequence
  chemically synthesized
cttgttagaagcacaacaaata

SEQ ID NO: 862706 - DNA, 22 bp, Artificial Sequence
  chemically synthesized
gttagaagcacaacaaataaaa

SEQ ID NO: 862707 - DNA, 22 bp, Artificial Sequence
  chemically synthesized
ttagaagcacaacaaataaaaa

SEQ ID NO: 862708 - DNA, 22 bp, Artificial Sequence
  chemically synthesized
gaagcacaacaaataaaaattt

SEQ ID NO: 862709 - DNA, 22 bp, Artificial Sequence
  chemically synthesized
aagaaacaaacaccaaattttt

SEQ ID NO: 862710 - DNA, 22 bp, Artificial Sequence
  chemically synthesized
aaagaaacaaacaccaaatttt

SEQ ID NO: 862711 - DNA, 22 bp, Artificial Sequence
  chemically synthesized
gcagggatgtcttaaagaaaca

SEQ ID NO: 862712 - DNA, 22 bp, Artificial Sequence
  chemically synthesized
ggcagggatgtcttaaagaaac

SEQ ID NO: 862713 - DNA, 22 bp, Artificial Sequence
  chemically synthesized
ggtgtttgtttctttaagacat

SEQ ID NO: 862714 - DNA, 22 bp, Artificial Sequence
  chemically synthesized
gtgtttgtttctttaagacatc

SEQ ID NO: 862715 - DNA, 22 bp, Artificial Sequence
  chemically synthesized
agatggtttggcagggatgtct

SEQ ID NO: 862716 - DNA, 22 bp, Artificial Sequence
  chemically synthesized
gagatggtttggcagggatgtc

SEQ ID NO: 862717 - DNA, 22 bp, Artificial Sequence
  chemically synthesized
gtttctttaagacatccctgcc

SEQ ID NO: 862718 - DNA, 22 bp, Artificial Sequence
  chemically synthesized
tttctttaagacatccctgcca

SEQ ID NO: 862719 - DNA, 22 bp, Artificial Sequence
  chemically synthesized
ctttaagacatccctgccaaac

SEQ ID NO: 862720 - DNA, 22 bp, Artificial Sequence
  chemically synthesized
tttaagacatccctgccaaacc

SEQ ID NO: 862721 - DNA, 22 bp, Artificial Sequence
  chemically synthesized
taagacatccctgccaaaccat

SEQ ID NO: 862722 - DNA, 22 bp, Artificial Sequence
  chemically synthesized
aagacatccctgccaaaccatc

SEQ ID NO: 862723 - DNA, 22 bp, Artificial Sequence
  chemically synthesized
agacatccctgccaaaccatct

SEQ ID NO: 862724 - DNA, 22 bp, Artificial Sequence
  chemically synthesized
aaaaagaatttgagatggtttg

SEQ ID NO: 862725 - DNA, 22 bp, Artificial Sequence
  chemically synthesized
atacgttcaaaaagaatttgag

SEQ ID NO: 862726 - DNA, 22 bp, Artificial Sequence
  chemically synthesized
catacgttcaaaaagaatttga

SEQ ID NO: 862727 - DNA, 22 bp, Artificial Sequence
  chemically synthesized
tcatacgttcaaaaagaatttg

SEQ ID NO: 862728 - DNA, 22 bp, Artificial Sequence
  chemically synthesized
ccaaaccatctcaaattctttt

SEQ ID NO: 862729 - DNA, 22 bp, Artificial Sequence
  chemically synthesized
cctttcatacgttcaaaaagaa

SEQ ID NO: 862730 - DNA, 22 bp, Artificial Sequence
  chemically synthesized
tgattacctttcatacgttcaa

SEQ ID NO: 862731 - DNA, 22 bp, Artificial Sequence
  chemically synthesized
atgattacctttcatacgttca

SEQ ID NO: 862732 - DNA, 22 bp, Artificial Sequence
  chemically synthesized
aaattctttttgaacgtatgaa

SEQ ID NO: 862733 - DNA, 22 bp, Artificial Sequence
  chemically synthesized
tttatgattacctttcatacgt

SEQ ID NO: 862734 - DNA, 22 bp, Artificial Sequence
  chemically synthesized
atttatgattacctttcatacg

SEQ ID NO: 862735 - DNA, 22 bp, Artificial Sequence
  chemically synthesized
tatttatgattacctttcatac

SEQ ID NO: 862736 - DNA, 22 bp, Artificial Sequence
  chemically synthesized
tttttgaacgtatgaaaggtaa

SEQ ID NO: 862737 - DNA, 22 bp, Artificial Sequence
  chemically synthesized
tttgaacgtatgaaaggtaatc

SEQ ID NO: 862738 - DNA, 22 bp, Artificial Sequence
  chemically synthesized
ttgaacgtatgaaaggtaatca

SEQ ID NO: 862739 - DNA, 22 bp, Artificial Sequence
  chemically synthesized
tgaacgtatgaaaggtaatcat

SEQ ID NO: 862740 - DNA, 22 bp, Artificial Sequence
  chemically synthesized
gaacgtatgaaaggtaatcata

SEQ ID NO: 862741 - DNA, 22 bp, Artificial Sequence
  chemically synthesized
aacgtatgaaaggtaatcataa

SEQ ID NO: 862742 - DNA, 22 bp, Artificial Sequence
  chemically synthesized
aaaccatgttttatttatgatt

SEQ ID NO: 862743 - DNA, 22 bp, Artificial Sequence
  chemically synthesized
aaaccactgaaaccatgtttta

SEQ ID NO: 862744 - DNA, 22 bp, Artificial Sequence
  chemically synthesized
aaaaccactgaaaccatgtttt

SEQ ID NO: 862745 - DNA, 22 bp, Artificial Sequence
  chemically synthesized
aatagcataatttaaaaccact

SEQ ID NO: 862746 - DNA, 22 bp, Artificial Sequence
  chemically synthesized
caatagcataatttaaaaccac

SEQ ID NO: 862747 - DNA, 22 bp, Artificial Sequence
  chemically synthesized
tttcaatagcataatttaaaac

SEQ ID NO: 862748 - DNA, 22 bp, Artificial Sequence
  chemically synthesized
ttatttcaatagcataatttaa

SEQ ID NO: 862749 - DNA, 22 bp, Artificial Sequence
  chemically synthesized
cagtggttttaaattatgctat

SEQ ID NO: 862750 - DNA, 22 bp, Artificial Sequence
  chemically synthesized
agtggttttaaattatgctatt

SEQ ID NO: 862751 - DNA, 22 bp, Artificial Sequence
  chemically synthesized
aggaacattgttatttcaatag

SEQ ID NO: 862752 - DNA, 22 bp, Artificial Sequence
  chemically synthesized
tgaggaacattgttatttcaat

SEQ ID NO: 862753 - DNA, 22 bp, Artificial Sequence
  chemically synthesized
taaattatgctattgaaataac

SEQ ID NO: 862754 - DNA, 22 bp, Artificial Sequence
  chemically synthesized
aaattatgctattgaaataaca

SEQ ID NO: 862755 - DNA, 22 bp, Artificial Sequence
  chemically synthesized
aattatgctattgaaataacaa

SEQ ID NO: 862756 - DNA, 22 bp, Artificial Sequence
  chemically synthesized
atgctctgaggaacattgttat

SEQ ID NO: 862757 - DNA, 22 bp, Artificial Sequence
  chemically synthesized
tgctattgaaataacaatgttc

SEQ ID NO: 862758 - DNA, 22 bp, Artificial Sequence
  chemically synthesized
ttgaaataacaatgttcctcag

SEQ ID NO: 862759 - DNA, 22 bp, Artificial Sequence
  chemically synthesized
tcatgctaatgctctgaggaac

SEQ ID NO: 862760 - DNA, 22 bp, Artificial Sequence
  chemically synthesized
aaataacaatgttcctcagagc

SEQ ID NO: 862761 - DNA, 22 bp, Artificial Sequence
  chemically synthesized
ctcagagcattagcatgacagt

SEQ ID NO: 862762 - DNA, 22 bp, Artificial Sequence
  chemically synthesized
agagcattagcatgacagtttt

SEQ ID NO: 862763 - DNA, 22 bp, Artificial Sequence
  chemically synthesized
gcatgacagttttgatgcacat

SEQ ID NO: 862764 - DNA, 22 bp, Artificial Sequence
  chemically synthesized
aagtccaagacaataggaagta

SEQ ID NO: 862765 - DNA, 22 bp, Artificial Sequence
  chemically synthesized
tgatgcacatacttcctattgt

SEQ ID NO: 862766 - DNA, 22 bp, Artificial Sequence
  chemically synthesized
gatgcacatacttcctattgtc

SEQ ID NO: 862767 - DNA, 22 bp, Artificial Sequence
  chemically synthesized
atgcacatacttcctattgtct

SEQ ID NO: 862768 - DNA, 22 bp, Artificial Sequence
  chemically synthesized
agacaatgagattcaagtccaa

SEQ ID NO: 862769 - DNA, 22 bp, Artificial Sequence
  chemically synthesized
cctattgtcttggacttgaatc

SEQ ID NO: 862770 - DNA, 22 bp, Artificial Sequence
  chemically synthesized
ctattgtcttggacttgaatct

SEQ ID NO: 862771 - DNA, 22 bp, Artificial Sequence
  chemically synthesized
ttgtcttggacttgaatctcat

SEQ ID NO: 862772 - DNA, 22 bp, Artificial Sequence
  chemically synthesized
tcttggacttgaatctcattgt

SEQ ID NO: 862773 - DNA, 22 bp, Artificial Sequence
  chemically synthesized
atcaaaaggattaagacaatga

SEQ ID NO: 862774 - DNA, 22 bp, Artificial Sequence
  chemically synthesized
ggacttgaatctcattgtctta

SEQ ID NO: 862775 - DNA, 22 bp, Artificial Sequence
  chemically synthesized
gacttgaatctcattgtcttaa

SEQ ID NO: 862776 - DNA, 22 bp, Artificial Sequence
  chemically synthesized
gaatctcattgtcttaatcctt

SEQ ID NO: 862777 - DNA, 22 bp, Artificial Sequence
  chemically synthesized
aatctcattgtcttaatccttt

SEQ ID NO: 862778 - DNA, 22 bp, Artificial Sequence
  chemically synthesized
aacccattcatcaaaaggatta

SEQ ID NO: 862779 - DNA, 22 bp, Artificial Sequence
  chemically synthesized
aaacccattcatcaaaaggatt

SEQ ID NO: 862780 - DNA, 22 bp, Artificial Sequence
  chemically synthesized
taaacccattcatcaaaaggat

SEQ ID NO: 862781 - DNA, 22 bp, Artificial Sequence
  chemically synthesized
attgtcttaatccttttgatga

SEQ ID NO: 862782 - DNA, 22 bp, Artificial Sequence
  chemically synthesized
attttaaacccattcatcaaaa

SEQ ID NO: 862783 - DNA, 22 bp, Artificial Sequence
  chemically synthesized
aattttaaacccattcatcaaa

SEQ ID NO: 862784 - DNA, 22 bp, Artificial Sequence
  chemically synthesized
tcttaatccttttgatgaatgg

SEQ ID NO: 862785 - DNA, 22 bp, Artificial Sequence
  chemically synthesized
ttaattttaaacccattcatca

SEQ ID NO: 862786 - DNA, 22 bp, Artificial Sequence
  chemically synthesized
aatccttttgatgaatgggttt

SEQ ID NO: 862787 - DNA, 22 bp, Artificial Sequence
  chemically synthesized
atccttttgatgaatgggttta

SEQ ID NO: 862788 - DNA, 22 bp, Artificial Sequence
  chemically synthesized
cactcttaattttaaacccatt

SEQ ID NO: 862789 - DNA, 22 bp, Artificial Sequence
  chemically synthesized
acactcttaattttaaacccat

SEQ ID NO: 862790 - DNA, 22 bp, Artificial Sequence
  chemically synthesized
tacactcttaattttaaaccca

SEQ ID NO: 862791 - DNA, 22 bp, Artificial Sequence
  chemically synthesized
tttacactcttaattttaaacc

SEQ ID NO: 862792 - DNA, 22 bp, Artificial Sequence
  chemically synthesized
ttgatgaatgggtttaaaatta

SEQ ID NO: 862793 - DNA, 22 bp, Artificial Sequence
  chemically synthesized
tgatgaatgggtttaaaattaa

SEQ ID NO: 862794 - DNA, 22 bp, Artificial Sequence
  chemically synthesized
gatgaatgggtttaaaattaag

SEQ ID NO: 862795 - DNA, 22 bp, Artificial Sequence
  chemically synthesized
atgaatgggtttaaaattaaga

SEQ ID NO: 862796 - DNA, 22 bp, Artificial Sequence
  chemically synthesized
catacactctttacactcttaa

SEQ ID NO: 862797 - DNA, 22 bp, Artificial Sequence
  chemically synthesized
ccatacactctttacactctta

SEQ ID NO: 862798 - DNA, 22 bp, Artificial Sequence
  chemically synthesized
tccatacactctttacactctt

SEQ ID NO: 862799 - DNA, 22 bp, Artificial Sequence
  chemically synthesized
ttccatacactctttacactct

SEQ ID NO: 862800 - DNA, 22 bp, Artificial Sequence
  chemically synthesized
aaaattaagagtgtaaagagtg

SEQ ID NO: 862801 - DNA, 22 bp, Artificial Sequence
  chemically synthesized
aaattaagagtgtaaagagtgt

SEQ ID NO: 862802 - DNA, 22 bp, Artificial Sequence
  chemically synthesized
acagcttttccatacactcttt

SEQ ID NO: 862803 - DNA, 22 bp, Artificial Sequence
  chemically synthesized
agagtgtaaagagtgtatggaa

SEQ ID NO: 862804 - DNA, 22 bp, Artificial Sequence
  chemically synthesized
tgggctcacagcttttccatac

SEQ ID NO: 862805 - DNA, 22 bp, Artificial Sequence
  chemically synthesized
ctgtgggctcacagcttttcca

SEQ ID NO: 862806 - DNA, 22 bp, Artificial Sequence
  chemically synthesized
actgtgggctcacagcttttcc

SEQ ID NO: 862807 - DNA, 22 bp, Artificial Sequence
  chemically synthesized
agaaaccatttactgtgggctc

SEQ ID NO: 862808 - DNA, 22 bp, Artificial Sequence
  chemically synthesized
cagaaaccatttactgtgggct

SEQ ID NO: 862809 - DNA, 22 bp, Artificial Sequence
  chemically synthesized
cttcagaaaccatttactgtgg

SEQ ID NO: 862810 - DNA, 22 bp, Artificial Sequence
  chemically synthesized
tacttcagaaaccatttactgt

SEQ ID NO: 862811 - DNA, 22 bp, Artificial Sequence
  chemically synthesized
ctacttcagaaaccatttactg

SEQ ID NO: 862812 - DNA, 22 bp, Artificial Sequence
  chemically synthesized
tgagcccacagtaaatggtttc

SEQ ID NO: 862813 - DNA, 22 bp, Artificial Sequence
  chemically synthesized
gatatgtttctacttcagaaac

SEQ ID NO: 862814 - DNA, 22 bp, Artificial Sequence
  chemically synthesized
aataaacagagttggatatgtt

SEQ ID NO: 862815 - DNA, 22 bp, Artificial Sequence
  chemically synthesized
ctgaagtagaaacatatccaac

SEQ ID NO: 862816 - DNA, 22 bp, Artificial Sequence
  chemically synthesized
tgaataaacagagttggatatg

SEQ ID NO: 862817 - DNA, 22 bp, Artificial Sequence
  chemically synthesized
tgaagtagaaacatatccaact

SEQ ID NO: 862818 - DNA, 22 bp, Artificial Sequence
  chemically synthesized
ctgaataaacagagttggatat

SEQ ID NO: 862819 - DNA, 22 bp, Artificial Sequence
  chemically synthesized
tctgaataaacagagttggata

SEQ ID NO: 862820 - DNA, 22 bp, Artificial Sequence
  chemically synthesized
aagtagaaacatatccaactct

SEQ ID NO: 862821 - DNA, 22 bp, Artificial Sequence
  chemically synthesized
acagatctttctgaataaacag

SEQ ID NO: 862822 - DNA, 22 bp, Artificial Sequence
  chemically synthesized
cacagatctttctgaataaaca

SEQ ID NO: 862823 - DNA, 22 bp, Artificial Sequence
  chemically synthesized
tgtttattcagaaagatctgtg

SEQ ID NO: 862824 - DNA, 22 bp, Artificial Sequence
  chemically synthesized
tttattcagaaagatctgtgaa

SEQ ID NO: 862825 - DNA, 22 bp, Artificial Sequence
  chemically synthesized
taataatacagcttcacagatc

SEQ ID NO: 862826 - DNA, 22 bp, Artificial Sequence
  chemically synthesized
attcagaaagatctgtgaagct

SEQ ID NO: 862827 - DNA, 22 bp, Artificial Sequence
  chemically synthesized
ttcagaaagatctgtgaagctg

SEQ ID NO: 862828 - DNA, 22 bp, Artificial Sequence
  chemically synthesized
agaaagatctgtgaagctgtat

SEQ ID NO: 862829 - DNA, 22 bp, Artificial Sequence
  chemically synthesized
ataatgaagcaactgtaataat

SEQ ID NO: 862830 - DNA, 22 bp, Artificial Sequence
  chemically synthesized
tgaagctgtattattacagttg

SEQ ID NO: 862831 - DNA, 22 bp, Artificial Sequence
  chemically synthesized
tattattacagttgcttcatta

SEQ ID NO: 862832 - DNA, 22 bp, Artificial Sequence
  chemically synthesized
ttacagttgcttcattatgaac

SEQ ID NO: 862833 - DNA, 22 bp, Artificial Sequence
  chemically synthesized
cagttgcttcattatgaactta

SEQ ID NO: 862834 - DNA, 22 bp, Artificial Sequence
  chemically synthesized
taagcagcaaaaataagttcat

SEQ ID NO: 862835 - DNA, 22 bp, Artificial Sequence
  chemically synthesized
gtaagcagcaaaaataagttca

SEQ ID NO: 862836 - DNA, 22 bp, Artificial Sequence
  chemically synthesized
tgtaagcagcaaaaataagttc

SEQ ID NO: 862837 - DNA, 22 bp, Artificial Sequence
  chemically synthesized
cttcattatgaacttatttttg

SEQ ID NO: 862838 - DNA, 22 bp, Artificial Sequence
  chemically synthesized
ccctttgtaagcagcaaaaata

SEQ ID NO: 862839 - DNA, 22 bp, Artificial Sequence
  chemically synthesized
cattatgaacttatttttgctg

SEQ ID NO: 862840 - DNA, 22 bp, Artificial Sequence
  chemically synthesized
cccctttgtaagcagcaaaaat

SEQ ID NO: 862841 - DNA, 22 bp, Artificial Sequence
  chemically synthesized
attatgaacttatttttgctgc

SEQ ID NO: 862842 - DNA, 22 bp, Artificial Sequence
  chemically synthesized
tgaacttatttttgctgcttac

SEQ ID NO: 862843 - DNA, 22 bp, Artificial Sequence
  chemically synthesized
atgggatttcccctttgtaagc

SEQ ID NO: 862844 - DNA, 22 bp, Artificial Sequence
  chemically synthesized
atttttgctgcttacaaagggg

SEQ ID NO: 862845 - DNA, 22 bp, Artificial Sequence
  chemically synthesized
tttttgctgcttacaaagggga

SEQ ID NO: 862846 - DNA, 22 bp, Artificial Sequence
  chemically synthesized
atctgatgggatttcccctttg

SEQ ID NO: 862847 - DNA, 22 bp, Artificial Sequence
  chemically synthesized
ttgctgcttacaaaggggaaat

SEQ ID NO: 862848 - DNA, 22 bp, Artificial Sequence
  chemically synthesized
tgctgcttacaaaggggaaatc

SEQ ID NO: 862849 - DNA, 22 bp, Artificial Sequence
  chemically synthesized
gctgcttacaaaggggaaatcc

SEQ ID NO: 862850 - DNA, 22 bp, Artificial Sequence
  chemically synthesized
ctgcttacaaaggggaaatccc

SEQ ID NO: 862851 - DNA, 22 bp, Artificial Sequence
  chemically synthesized
gccctgatctgatgggatttcc

SEQ ID NO: 862852 - DNA, 22 bp, Artificial Sequence
  chemically synthesized
agccctgatctgatgggatttc

SEQ ID NO: 862853 - DNA, 22 bp, Artificial Sequence
  chemically synthesized
cttacaaaggggaaatcccatc

SEQ ID NO: 862854 - DNA, 22 bp, Artificial Sequence
  chemically synthesized
acaaaggggaaatcccatcaga

SEQ ID NO: 862855 - DNA, 22 bp, Artificial Sequence
  chemically synthesized
tcttagccctgatctgatggga

SEQ ID NO: 862856 - DNA, 22 bp, Artificial Sequence
  chemically synthesized
caaaggggaaatcccatcagat

SEQ ID NO: 862857 - DNA, 22 bp, Artificial Sequence
  chemically synthesized
aaaaggaattatcttagccctg

SEQ ID NO: 862858 - DNA, 22 bp, Artificial Sequence
  chemically synthesized
aaaaaggaattatcttagccct

SEQ ID NO: 862859 - DNA, 22 bp, Artificial Sequence
  chemically synthesized
tttaaaaaggaattatcttagc

SEQ ID NO: 862860 - DNA, 22 bp, Artificial Sequence
  chemically synthesized
attgtttaaaaaggaattatct

SEQ ID NO: 862861 - DNA, 22 bp, Artificial Sequence
  chemically synthesized
ctgattgtttaaaaaggaatta

SEQ ID NO: 862862 - DNA, 22 bp, Artificial Sequence
  chemically synthesized
actgattgtttaaaaaggaatt

SEQ ID NO: 862863 - DNA, 22 bp, Artificial Sequence
  chemically synthesized
agataattcctttttaaacaat

SEQ ID NO: 862864 - DNA, 22 bp, Artificial Sequence
  chemically synthesized
aatatgatttactgattgttta

SEQ ID NO: 862865 - DNA, 22 bp, Artificial Sequence
  chemically synthesized
aaatatgatttactgattgttt

SEQ ID NO: 862866 - DNA, 22 bp, Artificial Sequence
  chemically synthesized
ctttttaaacaatcagtaaatc

SEQ ID NO: 862867 - DNA, 22 bp, Artificial Sequence
  chemically synthesized
tttaaacaatcagtaaatcata

SEQ ID NO: 862868 - DNA, 22 bp, Artificial Sequence
  chemically synthesized
ttaaacaatcagtaaatcatat

SEQ ID NO: 862869 - DNA, 22 bp, Artificial Sequence
  chemically synthesized
taaacaatcagtaaatcatatt

SEQ ID NO: 862870 - DNA, 22 bp, Artificial Sequence
  chemically synthesized
aaacaatcagtaaatcatattt

SEQ ID NO: 862871 - DNA, 22 bp, Artificial Sequence
  chemically synthesized
aacaatcagtaaatcatattta

SEQ ID NO: 862872 - DNA, 22 bp, Artificial Sequence
  chemically synthesized
gtgtaaacaaggtttaaatatg

SEQ ID NO: 862873 - DNA, 22 bp, Artificial Sequence
  chemically synthesized
aaaccttgtttacactagtact

SEQ ID NO: 862874 - DNA, 22 bp, Artificial Sequence
  chemically synthesized
aaccttgtttacactagtactt

SEQ ID NO: 862875 - DNA, 22 bp, Artificial Sequence
  chemically synthesized
gtttacactagtactttttcca

SEQ ID NO: 862876 - DNA, 22 bp, Artificial Sequence
  chemically synthesized
tttacactagtactttttccat

SEQ ID NO: 862877 - DNA, 22 bp, Artificial Sequence
  chemically synthesized
acactagtactttttccatgat

SEQ ID NO: 862878 - DNA, 22 bp, Artificial Sequence
  chemically synthesized
cactagtactttttccatgatg

SEQ ID NO: 862879 - DNA, 22 bp, Artificial Sequence
  chemically synthesized
tgtaaaacaacgccatcatgga

SEQ ID NO: 862880 - DNA, 22 bp, Artificial Sequence
  chemically synthesized
atgtaaaacaacgccatcatgg

SEQ ID NO: 862881 - DNA, 22 bp, Artificial Sequence
  chemically synthesized
tatgtaaaacaacgccatcatg

SEQ ID NO: 862882 - DNA, 22 bp, Artificial Sequence
  chemically synthesized
gtactttttccatgatggcgtt

SEQ ID NO: 862883 - DNA, 22 bp, Artificial Sequence
  chemically synthesized
tttccatgatggcgttgtttta

SEQ ID NO: 862884 - DNA, 22 bp, Artificial Sequence
  chemically synthesized
ttccatgatggcgttgttttac

SEQ ID NO: 862885 - DNA, 22 bp, Artificial Sequence
  chemically synthesized
tccatgatggcgttgttttaca

SEQ ID NO: 862886 - DNA, 22 bp, Artificial Sequence
  chemically synthesized
ccatgatggcgttgttttacat

SEQ ID NO: 862887 - DNA, 22 bp, Artificial Sequence
  chemically synthesized
catgatggcgttgttttacata

SEQ ID NO: 862888 - DNA, 22 bp, Artificial Sequence
  chemically synthesized
aaagcatgtattttatgtaaaa

SEQ ID NO: 862889 - DNA, 22 bp, Artificial Sequence
  chemically synthesized
acaagattgaaagcatgtattt

SEQ ID NO: 862890 - DNA, 22 bp, Artificial Sequence
  chemically synthesized
aacaagattgaaagcatgtatt

SEQ ID NO: 862891 - DNA, 22 bp, Artificial Sequence
  chemically synthesized
ttttacataaaatacatgcttt

SEQ ID NO: 862892 - DNA, 22 bp, Artificial Sequence
  chemically synthesized
tacataaaatacatgctttcaa

SEQ ID NO: 862893 - DNA, 22 bp, Artificial Sequence
  chemically synthesized
acataaaatacatgctttcaat

SEQ ID NO: 862894 - DNA, 22 bp, Artificial Sequence
  chemically synthesized
cataaaatacatgctttcaatc

SEQ ID NO: 862895 - DNA, 22 bp, Artificial Sequence
  chemically synthesized
acaaatttaacaagattgaaag

SEQ ID NO: 862896 - DNA, 22 bp, Artificial Sequence
  chemically synthesized
tcaatcttgttaaatttgttag

SEQ ID NO: 862897 - DNA, 22 bp, Artificial Sequence
  chemically synthesized
caatcttgttaaatttgttagg

SEQ ID NO: 862898 - DNA, 22 bp, Artificial Sequence
  chemically synthesized
aatcttgttaaatttgttagga

SEQ ID NO: 862899 - DNA, 22 bp, Artificial Sequence
  chemically synthesized
ggccacaaaatgagtcctaaca

SEQ ID NO: 862900 - DNA, 22 bp, Artificial Sequence
  chemically synthesized
gttaaatttgttaggactcatt

SEQ ID NO: 862901 - DNA, 22 bp, Artificial Sequence
  chemically synthesized
ttaaatttgttaggactcattt

SEQ ID NO: 862902 - DNA, 22 bp, Artificial Sequence
  chemically synthesized
aatttgttaggactcattttgt

SEQ ID NO: 862903 - DNA, 22 bp, Artificial Sequence
  chemically synthesized
gttaggactcattttgtggcct

SEQ ID NO: 862904 - DNA, 22 bp, Artificial Sequence
  chemically synthesized
ttaggactcattttgtggccta

SEQ ID NO: 862905 - DNA, 22 bp, Artificial Sequence
  chemically synthesized
ggactcattttgtggcctaaca

SEQ ID NO: 862906 - DNA, 22 bp, Artificial Sequence
  chemically synthesized
agggtagatcatatgttaggcc

SEQ ID NO: 862907 - DNA, 22 bp, Artificial Sequence
  chemically synthesized
cagggtagatcatatgttaggc

SEQ ID NO: 862908 - DNA, 22 bp, Artificial Sequence
  chemically synthesized
ttcagggtagatcatatgttag

SEQ ID NO: 862909 - DNA, 22 bp, Artificial Sequence
  chemically synthesized
attttgtggcctaacatatgat

SEQ ID NO: 862910 - DNA, 22 bp, Artificial Sequence
  chemically synthesized
tgtggcctaacatatgatctac

SEQ ID NO: 862911 - DNA, 22 bp, Artificial Sequence
  chemically synthesized
gtggcctaacatatgatctacc

SEQ ID NO: 862912 - DNA, 22 bp, Artificial Sequence
  chemically synthesized
tggcctaacatatgatctaccc

SEQ ID NO: 862913 - DNA, 22 bp, Artificial Sequence
  chemically synthesized
acatatgatctaccctgaagaa

SEQ ID NO: 862914 - DNA, 22 bp, Artificial Sequence
  chemically synthesized
tcaagtgcacaagaaacaattc

SEQ ID NO: 862915 - DNA, 22 bp, Artificial Sequence
  chemically synthesized
atcaagtgcacaagaaacaatt

SEQ ID NO: 862916 - DNA, 22 bp, Artificial Sequence
  chemically synthesized
ttatcaagtgcacaagaaacaa

SEQ ID NO: 862917 - DNA, 22 bp, Artificial Sequence
  chemically synthesized
ccctgaagaattgtttcttgtg

SEQ ID NO: 862918 - DNA, 22 bp, Artificial Sequence
  chemically synthesized
aagaattgtttcttgtgcactt

SEQ ID NO: 862919 - DNA, 22 bp, Artificial Sequence
  chemically synthesized
tttcttgtgcacttgataagaa

SEQ ID NO: 862920 - DNA, 22 bp, Artificial Sequence
  chemically synthesized
cttgtgcacttgataagaatgt

SEQ ID NO: 862921 - DNA, 22 bp, Artificial Sequence
  chemically synthesized
ttgtgcacttgataagaatgta

SEQ ID NO: 862922 - DNA, 22 bp, Artificial Sequence
  chemically synthesized
gtgcacttgataagaatgtata

SEQ ID NO: 862923 - DNA, 22 bp, Artificial Sequence
  chemically synthesized
acagcaggagaatatacattct

SEQ ID NO: 862924 - DNA, 22 bp, Artificial Sequence
  chemically synthesized
tgcacttgataagaatgtatat

SEQ ID NO: 862925 - DNA, 22 bp, Artificial Sequence
  chemically synthesized
atctaacagcaggagaatatac

SEQ ID NO: 862926 - DNA, 22 bp, Artificial Sequence
  chemically synthesized
gataagaatgtatattctcctg

SEQ ID NO: 862927 - DNA, 22 bp, Artificial Sequence
  chemically synthesized
ataagaatgtatattctcctgc

SEQ ID NO: 862928 - DNA, 22 bp, Artificial Sequence
  chemically synthesized
tcctgctgttagatgagatgta

SEQ ID NO: 862929 - DNA, 22 bp, Artificial Sequence
  chemically synthesized
ctgctgttagatgagatgtact

SEQ ID NO: 862930 - DNA, 22 bp, Artificial Sequence
  chemically synthesized
gcagacatatacagtacatctc

SEQ ID NO: 862931 - DNA, 22 bp, Artificial Sequence
  chemically synthesized
ctgttagatgagatgtactgta

SEQ ID NO: 862932 - DNA, 22 bp, Artificial Sequence
  chemically synthesized
ttagatgagatgtactgtatat

SEQ ID NO: 862933 - DNA, 22 bp, Artificial Sequence
  chemically synthesized
gatgagatgtactgtatatgtc

SEQ ID NO: 862934 - DNA, 22 bp, Artificial Sequence
  chemically synthesized
gatcaaatagacctagcagaca

SEQ ID NO: 862935 - DNA, 22 bp, Artificial Sequence
  chemically synthesized
agatcaaatagacctagcagac

SEQ ID NO: 862936 - DNA, 22 bp, Artificial Sequence
  chemically synthesized
tagatcaaatagacctagcaga

SEQ ID NO: 862937 - DNA, 22 bp, Artificial Sequence
  chemically synthesized
tgctttagatcaaatagaccta

SEQ ID NO: 862938 - DNA, 22 bp, Artificial Sequence
  chemically synthesized
tatatgtctgctaggtctattt

SEQ ID NO: 862939 - DNA, 22 bp, Artificial Sequence
  chemically synthesized
atgctttagatcaaatagacct

SEQ ID NO: 862940 - DNA, 22 bp, Artificial Sequence
  chemically synthesized
tatgctttagatcaaatagacc

SEQ ID NO: 862941 - DNA, 22 bp, Artificial Sequence
  chemically synthesized
gactttatgctttagatcaaat

SEQ ID NO: 862942 - DNA, 22 bp, Artificial Sequence
  chemically synthesized
ctaggtctatttgatctaaagc

SEQ ID NO: 862943 - DNA, 22 bp, Artificial Sequence
  chemically synthesized
ggtctatttgatctaaagcata

SEQ ID NO: 862944 - DNA, 22 bp, Artificial Sequence
  chemically synthesized
tttgatctaaagcataaagtcc

SEQ ID NO: 862945 - DNA, 22 bp, Artificial Sequence
  chemically synthesized
gatctaaagcataaagtccaat

SEQ ID NO: 862946 - DNA, 22 bp, Artificial Sequence
  chemically synthesized
atctaaagcataaagtccaatg

SEQ ID NO: 862947 - DNA, 22 bp, Artificial Sequence
  chemically synthesized
aagcataaagtccaatgcattc

SEQ ID NO: 862948 - DNA, 22 bp, Artificial Sequence
  chemically synthesized
aaaaatcaataagaatgcattg

SEQ ID NO: 862949 - DNA, 22 bp, Artificial Sequence
  chemically synthesized
ttattgattttttaatgtggat

SEQ ID NO: 862950 - DNA, 22 bp, Artificial Sequence
  chemically synthesized
attgattttttaatgtggattt

SEQ ID NO: 862951 - DNA, 22 bp, Artificial Sequence
  chemically synthesized
ttgattttttaatgtggatttt

SEQ ID NO: 862952 - DNA, 22 bp, Artificial Sequence
  chemically synthesized
aacaatagacagaaaatccaca

SEQ ID NO: 862953 - DNA, 22 bp, Artificial Sequence
  chemically synthesized
attttttaatgtggattttctg

SEQ ID NO: 862954 - DNA, 22 bp, Artificial Sequence
  chemically synthesized
tttaatgtggattttctgtcta

SEQ ID NO: 862955 - DNA, 22 bp, Artificial Sequence
  chemically synthesized
ttaatgtggattttctgtctat

SEQ ID NO: 862956 - DNA, 22 bp, Artificial Sequence
  chemically synthesized
taatgtggattttctgtctatt

SEQ ID NO: 862957 - DNA, 22 bp, Artificial Sequence
  chemically synthesized
aatgtggattttctgtctattg

SEQ ID NO: 862958 - DNA, 22 bp, Artificial Sequence
  chemically synthesized
ccccaaattcaacaatagacag

SEQ ID NO: 862959 - DNA, 22 bp, Artificial Sequence
  chemically synthesized
atgtggattttctgtctattgt

SEQ ID NO: 862960 - DNA, 22 bp, Artificial Sequence
  chemically synthesized
taccccaaattcaacaatagac

SEQ ID NO: 862961 - DNA, 22 bp, Artificial Sequence
  chemically synthesized
ctaccccaaattcaacaataga

SEQ ID NO: 862962 - DNA, 22 bp, Artificial Sequence
  chemically synthesized
tctgtctattgttgaatttggg

SEQ ID NO: 862963 - DNA, 22 bp, Artificial Sequence
  chemically synthesized
ctgtctattgttgaatttgggg

SEQ ID NO: 862964 - DNA, 22 bp, Artificial Sequence
  chemically synthesized
tgtctattgttgaatttggggt

SEQ ID NO: 862965 - DNA, 22 bp, Artificial Sequence
  chemically synthesized
tctattgttgaatttggggtag

SEQ ID NO: 862966 - DNA, 22 bp, Artificial Sequence
  chemically synthesized
ttgttgaatttggggtagaagt

SEQ ID NO: 862967 - DNA, 22 bp, Artificial Sequence
  chemically synthesized
ttgaatttggggtagaagtccc

SEQ ID NO: 862968 - DNA, 22 bp, Artificial Sequence
  chemically synthesized
aatttggggtagaagtccccta

SEQ ID NO: 862969 - DNA, 22 bp, Artificial Sequence
  chemically synthesized
cagtacaataatagtaggggac

SEQ ID NO: 862970 - DNA, 22 bp, Artificial Sequence
  chemically synthesized
ggggtagaagtcccctactatt

SEQ ID NO: 862971 - DNA, 22 bp, Artificial Sequence
  chemically synthesized
gggtagaagtcccctactatta

SEQ ID NO: 862972 - DNA, 22 bp, Artificial Sequence
  chemically synthesized
ctattattgtactgtagtttgt

SEQ ID NO: 862973 - DNA, 22 bp, Artificial Sequence
  chemically synthesized
ttattgtactgtagtttgtctc

SEQ ID NO: 862974 - DNA, 22 bp, Artificial Sequence
  chemically synthesized
ttgtactgtagtttgtctcttt

SEQ ID NO: 862975 - DNA, 22 bp, Artificial Sequence
  chemically synthesized
tactgtagtttgtctctttctt

SEQ ID NO: 862976 - DNA, 22 bp, Artificial Sequence
  chemically synthesized
tagtttgtctctttctttttat

SEQ ID NO: 862977 - DNA, 22 bp, Artificial Sequence
  chemically synthesized
gtctctttctttttatcacttt

SEQ ID NO: 862978 - DNA, 22 bp, Artificial Sequence
  chemically synthesized
tctctttctttttatcacttta

SEQ ID NO: 862979 - DNA, 22 bp, Artificial Sequence
  chemically synthesized
tttctttttatcactttatatt

SEQ ID NO: 862980 - DNA, 22 bp, Artificial Sequence
  chemically synthesized
aatatataaagcaaatataaag

SEQ ID NO: 862981 - DNA, 22 bp, Artificial Sequence
  chemically synthesized
tctttttatcactttatatttg

SEQ ID NO: 862982 - DNA, 22 bp, Artificial Sequence
  chemically synthesized
ctttttatcactttatatttgc

SEQ ID NO: 862983 - DNA, 22 bp, Artificial Sequence
  chemically synthesized
tttttatcactttatatttgct

SEQ ID NO: 862984 - DNA, 22 bp, Artificial Sequence
  chemically synthesized
tttatcactttatatttgcttt

SEQ ID NO: 862985 - DNA, 22 bp, Artificial Sequence
  chemically synthesized
ttatcactttatatttgcttta

SEQ ID NO: 862986 - DNA, 22 bp, Artificial Sequence
  chemically synthesized
tatcactttatatttgctttat

SEQ ID NO: 862987 - DNA, 22 bp, Artificial Sequence
  chemically synthesized
atcactttatatttgctttata

SEQ ID NO: 862988 - DNA, 22 bp, Artificial Sequence
  chemically synthesized
tcactttatatttgctttatat

SEQ ID NO: 862989 - DNA, 22 bp, Artificial Sequence
  chemically synthesized
gagtacctaaatatataaagca

SEQ ID NO: 862990 - DNA, 22 bp, Artificial Sequence
  chemically synthesized
tatatttgctttatatatttag

SEQ ID NO: 862991 - DNA, 22 bp, Artificial Sequence
  chemically synthesized
atatttgctttatatatttagg

SEQ ID NO: 862992 - DNA, 22 bp, Artificial Sequence
  chemically synthesized
tatttgctttatatatttaggt

SEQ ID NO: 862993 - DNA, 22 bp, Artificial Sequence
  chemically synthesized
gctttatatatttaggtactcc

SEQ ID NO: 862994 - DNA, 22 bp, Artificial Sequence
  chemically synthesized
ctttatatatttaggtactcca

SEQ ID NO: 862995 - DNA, 22 bp, Artificial Sequence
  chemically synthesized
tatatatttaggtactccaatg

SEQ ID NO: 862996 - DNA, 22 bp, Artificial Sequence
  chemically synthesized
atatatttaggtactccaatgt

SEQ ID NO: 862997 - DNA, 22 bp, Artificial Sequence
  chemically synthesized
tatatttaggtactccaatgtt

SEQ ID NO: 862998 - DNA, 22 bp, Artificial Sequence
  chemically synthesized
taaatatatatgcacccaacat

SEQ ID NO: 862999 - DNA, 22 bp, Artificial Sequence
  chemically synthesized
aggtactccaatgttgggtgca

SEQ ID NO: 863000 - DNA, 22 bp, Artificial Sequence
  chemically synthesized
ggtactccaatgttgggtgcat

SEQ ID NO: 863001 - DNA, 22 bp, Artificial Sequence
  chemically synthesized
caatgttgggtgcatatatatt

SEQ ID NO: 863002 - DNA, 22 bp, Artificial Sequence
  chemically synthesized
ggtgcatatatatttacaattg

SEQ ID NO: 863003 - DNA, 22 bp, Artificial Sequence
  chemically synthesized
atcaagaaggtataacaattgt

SEQ ID NO: 863004 - DNA, 22 bp, Artificial Sequence
  chemically synthesized
acaattgttataccttcttgat

SEQ ID NO: 863005 - DNA, 22 bp, Artificial Sequence
  chemically synthesized
caattgttataccttcttgatg

SEQ ID NO: 863006 - DNA, 22 bp, Artificial Sequence
  chemically synthesized
ttataccttcttgatgaattga

SEQ ID NO: 863007 - DNA, 22 bp, Artificial Sequence
  chemically synthesized
taccttcttgatgaattgatcc

SEQ ID NO: 863008 - DNA, 22 bp, Artificial Sequence
  chemically synthesized
aataatgataaaaggatcaatt

SEQ ID NO: 863009 - DNA, 22 bp, Artificial Sequence
  chemically synthesized
cttgatgaattgatccttttat

SEQ ID NO: 863010 - DNA, 22 bp, Artificial Sequence
  chemically synthesized
ttgatgaattgatccttttatc

SEQ ID NO: 863011 - DNA, 22 bp, Artificial Sequence
  chemically synthesized
gatgaattgatccttttatcat

SEQ ID NO: 863012 - DNA, 22 bp, Artificial Sequence
  chemically synthesized
atgaattgatccttttatcatt

SEQ ID NO: 863013 - DNA, 22 bp, Artificial Sequence
  chemically synthesized
atccttttatcattatttaatg

SEQ ID NO: 863014 - DNA, 22 bp, Artificial Sequence
  chemically synthesized
ttatcattatttaatgaccttc

SEQ ID NO: 863015 - DNA, 22 bp, Artificial Sequence
  chemically synthesized
aaaagacacaaagaaggtcatt

SEQ ID NO: 863016 - DNA, 22 bp, Artificial Sequence
  chemically synthesized
tatcattatttaatgaccttct

SEQ ID NO: 863017 - DNA, 22 bp, Artificial Sequence
  chemically synthesized
atcattatttaatgaccttctt

SEQ ID NO: 863018 - DNA, 22 bp, Artificial Sequence
  chemically synthesized
tcattatttaatgaccttcttt

SEQ ID NO: 863019 - DNA, 22 bp, Artificial Sequence
  chemically synthesized
tttaatgaccttctttgtgtct

SEQ ID NO: 863020 - DNA, 22 bp, Artificial Sequence
  chemically synthesized
aatgaccttctttgtgtctttt

SEQ ID NO: 863021 - DNA, 22 bp, Artificial Sequence
  chemically synthesized
atgaccttctttgtgtcttttt

SEQ ID NO: 863022 - DNA, 22 bp, Artificial Sequence
  chemically synthesized
aaaatcaaaaactaaaaagaca

SEQ ID NO: 863023 - DNA, 22 bp, Artificial Sequence
  chemically synthesized
aaaaatcaaaaactaaaaagac

SEQ ID NO: 863024 - DNA, 22 bp, Artificial Sequence
  chemically synthesized
taaaaatcaaaaactaaaaaga

SEQ ID NO: 863025 - DNA, 22 bp, Artificial Sequence
  chemically synthesized
ctttgtgtctttttagtttttg

SEQ ID NO: 863026 - DNA, 22 bp, Artificial Sequence
  chemically synthesized
tttgtgtctttttagtttttga

SEQ ID NO: 863027 - DNA, 22 bp, Artificial Sequence
  chemically synthesized
tgtgtctttttagtttttgatt

SEQ ID NO: 863028 - DNA, 22 bp, Artificial Sequence
  chemically synthesized
gtgtctttttagtttttgattt

SEQ ID NO: 863029 - DNA, 22 bp, Artificial Sequence
  chemically synthesized
tgtctttttagtttttgatttt

SEQ ID NO: 863030 - DNA, 22 bp, Artificial Sequence
  chemically synthesized
gacaaaataggctttaaaaatc

SEQ ID NO: 863031 - DNA, 22 bp, Artificial Sequence
  chemically synthesized
tttagtttttgatttttaaagc

SEQ ID NO: 863032 - DNA, 22 bp, Artificial Sequence
  chemically synthesized
ttagtttttgatttttaaagcc

SEQ ID NO: 863033 - DNA, 22 bp, Artificial Sequence
  chemically synthesized
ttagacaaaataggctttaaaa

SEQ ID NO: 863034 - DNA, 22 bp, Artificial Sequence
  chemically synthesized
tagtttttgatttttaaagcct

SEQ ID NO: 863035 - DNA, 22 bp, Artificial Sequence
  chemically synthesized
agtttttgatttttaaagccta

SEQ ID NO: 863036 - DNA, 22 bp, Artificial Sequence
  chemically synthesized
tattagacaaaataggctttaa

SEQ ID NO: 863037 - DNA, 22 bp, Artificial Sequence
  chemically synthesized
gtttttgatttttaaagcctat

SEQ ID NO: 863038 - DNA, 22 bp, Artificial Sequence
  chemically synthesized
ctattagacaaaataggcttta

SEQ ID NO: 863039 - DNA, 22 bp, Artificial Sequence
  chemically synthesized
ttgatttttaaagcctattttg

SEQ ID NO: 863040 - DNA, 22 bp, Artificial Sequence
  chemically synthesized
tgatttttaaagcctattttgt

SEQ ID NO: 863041 - DNA, 22 bp, Artificial Sequence
  chemically synthesized
gatttttaaagcctattttgtc

SEQ ID NO: 863042 - DNA, 22 bp, Artificial Sequence
  chemically synthesized
atttttaaagcctattttgtct

SEQ ID NO: 863043 - DNA, 22 bp, Artificial Sequence
  chemically synthesized
ttaaagcctattttgtctaata

SEQ ID NO: 863044 - DNA, 22 bp, Artificial Sequence
  chemically synthesized
taaagcctattttgtctaatag

SEQ ID NO: 863045 - DNA, 22 bp, Artificial Sequence
  chemically synthesized
aaagcctattttgtctaataga

SEQ ID NO: 863046 - DNA, 22 bp, Artificial Sequence
  chemically synthesized
aagcctattttgtctaatagaa

SEQ ID NO: 863047 - DNA, 22 bp, Artificial Sequence
  chemically synthesized
ttttgtctaatagaagtatggc

SEQ ID NO: 863048 - DNA, 22 bp, Artificial Sequence
  chemically synthesized
tgtctaatagaagtatggctat

SEQ ID NO: 863049 - DNA, 22 bp, Artificial Sequence
  chemically synthesized
gtctaatagaagtatggctatc

SEQ ID NO: 863050 - DNA, 22 bp, Artificial Sequence
  chemically synthesized
tctaatagaagtatggctatcc

SEQ ID NO: 863051 - DNA, 22 bp, Artificial Sequence
  chemically synthesized
atagaagtatggctatccccat

SEQ ID NO: 863052 - DNA, 22 bp, Artificial Sequence
  chemically synthesized
catgcaaatggaaaccaaaaga

SEQ ID NO: 863053 - DNA, 22 bp, Artificial Sequence
  chemically synthesized
ccatgcaaatggaaaccaaaag

SEQ ID NO: 863054 - DNA, 22 bp, Artificial Sequence
  chemically synthesized
tccccattctcttttggtttcc

SEQ ID NO: 863055 - DNA, 22 bp, Artificial Sequence
  chemically synthesized
gtttccatgcaaatggaaacca

SEQ ID NO: 863056 - DNA, 22 bp, Artificial Sequence
  chemically synthesized
ggtttccatgcaaatggaaacc

SEQ ID NO: 863057 - DNA, 22 bp, Artificial Sequence
  chemically synthesized
tggtttccatgcaaatggaaac

SEQ ID NO: 863058 - DNA, 22 bp, Artificial Sequence
  chemically synthesized
tcttttggtttccatttgcatg

SEQ ID NO: 863059 - DNA, 22 bp, Artificial Sequence
  chemically synthesized
ttttggtttccatttgcatgga

SEQ ID NO: 863060 - DNA, 22 bp, Artificial Sequence
  chemically synthesized
ttggtttccatttgcatggaaa

SEQ ID NO: 863061 - DNA, 22 bp, Artificial Sequence
  chemically synthesized
tggtttccatttgcatggaaac

SEQ ID NO: 863062 - DNA, 22 bp, Artificial Sequence
  chemically synthesized
ggtttccatttgcatggaaacc

SEQ ID NO: 863063 - DNA, 22 bp, Artificial Sequence
  chemically synthesized
gtttccatttgcatggaaacca

SEQ ID NO: 863064 - DNA, 22 bp, Artificial Sequence
  chemically synthesized
ccatttgcatggaaaccaaaat

SEQ ID NO: 863065 - DNA, 22 bp, Artificial Sequence
  chemically synthesized
catttgcatggaaaccaaaata

SEQ ID NO: 863066 - DNA, 22 bp, Artificial Sequence
  chemically synthesized
gcatggaaaccaaaatatcttt

SEQ ID NO: 863067 - DNA, 22 bp, Artificial Sequence
  chemically synthesized
catggaaaccaaaatatctttt

SEQ ID NO: 863068 - DNA, 22 bp, Artificial Sequence
  chemically synthesized
aaatagaagagatagaaaaaga

SEQ ID NO: 863069 - DNA, 22 bp, Artificial Sequence
  chemically synthesized
actgaaatagaagagatagaaa

SEQ ID NO: 863070 - DNA, 22 bp, Artificial Sequence
  chemically synthesized
tttctatctcttctatttcagt

SEQ ID NO: 863071 - DNA, 22 bp, Artificial Sequence
  chemically synthesized
ggacacatgttgactgaaatag

SEQ ID NO: 863072 - DNA, 22 bp, Artificial Sequence
  chemically synthesized
ttctatctcttctatttcagtc

SEQ ID NO: 863073 - DNA, 22 bp, Artificial Sequence
  chemically synthesized
aggacacatgttgactgaaata

SEQ ID NO: 863074 - DNA, 22 bp, Artificial Sequence
  chemically synthesized
tctatctcttctatttcagtca

SEQ ID NO: 863075 - DNA, 22 bp, Artificial Sequence
  chemically synthesized
taggacacatgttgactgaaat

SEQ ID NO: 863076 - DNA, 22 bp, Artificial Sequence
  chemically synthesized
ctatctcttctatttcagtcaa

SEQ ID NO: 863077 - DNA, 22 bp, Artificial Sequence
  chemically synthesized
ttaggacacatgttgactgaaa

SEQ ID NO: 863078 - DNA, 22 bp, Artificial Sequence
  chemically synthesized
tatctcttctatttcagtcaac

SEQ ID NO: 863079 - DNA, 22 bp, Artificial Sequence
  chemically synthesized
tctcttctatttcagtcaacat

SEQ ID NO: 863080 - DNA, 22 bp, Artificial Sequence
  chemically synthesized
ttctatttcagtcaacatgtgt

SEQ ID NO: 863081 - DNA, 22 bp, Artificial Sequence
  chemically synthesized
ctatttcagtcaacatgtgtcc

SEQ ID NO: 863082 - DNA, 22 bp, Artificial Sequence
  chemically synthesized
tatttcagtcaacatgtgtcct

SEQ ID NO: 863083 - DNA, 22 bp, Artificial Sequence
  chemically synthesized
acgtcatcttttaggacacatg

SEQ ID NO: 863084 - DNA, 22 bp, Artificial Sequence
  chemically synthesized
tttcagtcaacatgtgtcctaa

SEQ ID NO: 863085 - DNA, 22 bp, Artificial Sequence
  chemically synthesized
cagtcaacatgtgtcctaaaag

SEQ ID NO: 863086 - DNA, 22 bp, Artificial Sequence
  chemically synthesized
agtcaacatgtgtcctaaaaga

SEQ ID NO: 863087 - DNA, 22 bp, Artificial Sequence
  chemically synthesized
cccataagagactcacgtcatc

SEQ ID NO: 863088 - DNA, 22 bp, Artificial Sequence
  chemically synthesized
catgctgcccataagagactca

SEQ ID NO: 863089 - DNA, 22 bp, Artificial Sequence
  chemically synthesized
aaagatgacgtgagtctcttat

SEQ ID NO: 863090 - DNA, 22 bp, Artificial Sequence
  chemically synthesized
aactacatgctgcccataagag

SEQ ID NO: 863091 - DNA, 22 bp, Artificial Sequence
  chemically synthesized
aaacaacaagactcaactacat

SEQ ID NO: 863092 - DNA, 22 bp, Artificial Sequence
  chemically synthesized
ttatgggcagcatgtagttgag

SEQ ID NO: 863093 - DNA, 22 bp, Artificial Sequence
  chemically synthesized
atgggcagcatgtagttgagtc

SEQ ID NO: 863094 - DNA, 22 bp, Artificial Sequence
  chemically synthesized
tgggcagcatgtagttgagtct

SEQ ID NO: 863095 - DNA, 22 bp, Artificial Sequence
  chemically synthesized
agtcttgttgttttaatccatt

SEQ ID NO: 863096 - DNA, 22 bp, Artificial Sequence
  chemically synthesized
aagatagagtggccaaatggat

SEQ ID NO: 863097 - DNA, 22 bp, Artificial Sequence
  chemically synthesized
gttgttttaatccatttggcca

SEQ ID NO: 863098 - DNA, 22 bp, Artificial Sequence
  chemically synthesized
ttgttttaatccatttggccac

SEQ ID NO: 863099 - DNA, 22 bp, Artificial Sequence
  chemically synthesized
ttttaatccatttggccactct

SEQ ID NO: 863100 - DNA, 22 bp, Artificial Sequence
  chemically synthesized
accagtctaaagatagagtggc

SEQ ID NO: 863101 - DNA, 22 bp, Artificial Sequence
  chemically synthesized
taatccatttggccactctatc

SEQ ID NO: 863102 - DNA, 22 bp, Artificial Sequence
  chemically synthesized
aatccatttggccactctatct

SEQ ID NO: 863103 - DNA, 22 bp, Artificial Sequence
  chemically synthesized
atccatttggccactctatctt

SEQ ID NO: 863104 - DNA, 22 bp, Artificial Sequence
  chemically synthesized
aattcaccagtctaaagataga

SEQ ID NO: 863105 - DNA, 22 bp, Artificial Sequence
  chemically synthesized
ggccactctatctttagactgg

SEQ ID NO: 863106 - DNA, 22 bp, Artificial Sequence
  chemically synthesized
gccactctatctttagactggt

SEQ ID NO: 863107 - DNA, 22 bp, Artificial Sequence
  chemically synthesized
tatctttagactggtgaattta

SEQ ID NO: 863108 - DNA, 22 bp, Artificial Sequence
  chemically synthesized
aatgtaaatggattaaattcac

SEQ ID NO: 863109 - DNA, 22 bp, Artificial Sequence
  chemically synthesized
tctttagactggtgaatttaat

SEQ ID NO: 863110 - DNA, 22 bp, Artificial Sequence
  chemically synthesized
gaatgtaaatggattaaattca

SEQ ID NO: 863111 - DNA, 22 bp, Artificial Sequence
  chemically synthesized
tgaatgtaaatggattaaattc

SEQ ID NO: 863112 - DNA, 22 bp, Artificial Sequence
  chemically synthesized
tagactggtgaatttaatccat

SEQ ID NO: 863113 - DNA, 22 bp, Artificial Sequence
  chemically synthesized
ctttgaatgtaaatggattaaa

SEQ ID NO: 863114 - DNA, 22 bp, Artificial Sequence
  chemically synthesized
agactggtgaatttaatccatt

SEQ ID NO: 863115 - DNA, 22 bp, Artificial Sequence
  chemically synthesized
actttgaatgtaaatggattaa

SEQ ID NO: 863116 - DNA, 22 bp, Artificial Sequence
  chemically synthesized
gactggtgaatttaatccattt

SEQ ID NO: 863117 - DNA, 22 bp, Artificial Sequence
  chemically synthesized
gtgaatttaatccatttacatt

SEQ ID NO: 863118 - DNA, 22 bp, Artificial Sequence
  chemically synthesized
tcaatatttactttgaatgtaa

SEQ ID NO: 863119 - DNA, 22 bp, Artificial Sequence
  chemically synthesized
cctatcaatatttactttgaat

SEQ ID NO: 863120 - DNA, 22 bp, Artificial Sequence
  chemically synthesized
aatccatttacattcaaagtaa

SEQ ID NO: 863121 - DNA, 22 bp, Artificial Sequence
  chemically synthesized
atccatttacattcaaagtaaa

SEQ ID NO: 863122 - DNA, 22 bp, Artificial Sequence
  chemically synthesized
ctacctatcaatatttactttg

SEQ ID NO: 863123 - DNA, 22 bp, Artificial Sequence
  chemically synthesized
acattcaaagtaaatattgata

SEQ ID NO: 863124 - DNA, 22 bp, Artificial Sequence
  chemically synthesized
cattcaaagtaaatattgatag

SEQ ID NO: 863125 - DNA, 22 bp, Artificial Sequence
  chemically synthesized
aaagtaaatattgataggtagg

SEQ ID NO: 863126 - DNA, 22 bp, Artificial Sequence
  chemically synthesized
aatggcagtagtaaattcctac

SEQ ID NO: 863127 - DNA, 22 bp, Artificial Sequence
  chemically synthesized
aaatggcagtagtaaattccta

SEQ ID NO: 863128 - DNA, 22 bp, Artificial Sequence
  chemically synthesized
taaatggcagtagtaaattcct

SEQ ID NO: 863129 - DNA, 22 bp, Artificial Sequence
  chemically synthesized
ttaaatggcagtagtaaattcc

SEQ ID NO: 863130 - DNA, 22 bp, Artificial Sequence
  chemically synthesized
tttaaatggcagtagtaaattc

SEQ ID NO: 863131 - DNA, 22 bp, Artificial Sequence
  chemically synthesized
ataggtaggaatttactactgc

SEQ ID NO: 863132 - DNA, 22 bp, Artificial Sequence
  chemically synthesized
gaaaacaactttttaaatggca

SEQ ID NO: 863133 - DNA, 22 bp, Artificial Sequence
  chemically synthesized
actactgccatttaaaaagttg

SEQ ID NO: 863134 - DNA, 22 bp, Artificial Sequence
  chemically synthesized
ctactgccatttaaaaagttgt

SEQ ID NO: 863135 - DNA, 22 bp, Artificial Sequence
  chemically synthesized
ctgccatttaaaaagttgtttt

SEQ ID NO: 863136 - DNA, 22 bp, Artificial Sequence
  chemically synthesized
caaaacaattagaaaacaactt

SEQ ID NO: 863137 - DNA, 22 bp, Artificial Sequence
  chemically synthesized
ccatttaaaaagttgttttcta

SEQ ID NO: 863138 - DNA, 22 bp, Artificial Sequence
  chemically synthesized
aaaaagttgttttctaattgtt

SEQ ID NO: 863139 - DNA, 22 bp, Artificial Sequence
  chemically synthesized
aaaagttgttttctaattgttt

SEQ ID NO: 863140 - DNA, 22 bp, Artificial Sequence
  chemically synthesized
ttttctaattgttttgtagatc

SEQ ID NO: 863141 - DNA, 22 bp, Artificial Sequence
  chemically synthesized
tctaattgttttgtagatcctt

SEQ ID NO: 863142 - DNA, 22 bp, Artificial Sequence
  chemically synthesized
ctaattgttttgtagatccttt

SEQ ID NO: 863143 - DNA, 22 bp, Artificial Sequence
  chemically synthesized
taattgttttgtagatcctttg

SEQ ID NO: 863144 - DNA, 22 bp, Artificial Sequence
  chemically synthesized
attgttttgtagatcctttgtt

SEQ ID NO: 863145 - DNA, 22 bp, Artificial Sequence
  chemically synthesized
ttttgtagatcctttgttctat

SEQ ID NO: 863146 - DNA, 22 bp, Artificial Sequence
  chemically synthesized
tgtagatcctttgttctatatg

SEQ ID NO: 863147 - DNA, 22 bp, Artificial Sequence
  chemically synthesized
gtagatcctttgttctatatgc

SEQ ID NO: 863148 - DNA, 22 bp, Artificial Sequence
  chemically synthesized
tagatcctttgttctatatgcc

SEQ ID NO: 863149 - DNA, 22 bp, Artificial Sequence
  chemically synthesized
tgttctatatgcctttttttgt

SEQ ID NO: 863150 - DNA, 22 bp, Artificial Sequence
  chemically synthesized
gttctatatgcctttttttgtt

SEQ ID NO: 863151 - DNA, 22 bp, Artificial Sequence
  chemically synthesized
ttctatatgcctttttttgttg

SEQ ID NO: 863152 - DNA, 22 bp, Artificial Sequence
  chemically synthesized
tatatgcctttttttgttgtct

SEQ ID NO: 863153 - DNA, 22 bp, Artificial Sequence
  chemically synthesized
tatgcctttttttgttgtcttc

SEQ ID NO: 863154 - DNA, 22 bp, Artificial Sequence
  chemically synthesized
tttttgttgtcttcttttatgg

SEQ ID NO: 863155 - DNA, 22 bp, Artificial Sequence
  chemically synthesized
ttttgttgtcttcttttatggt

SEQ ID NO: 863156 - DNA, 22 bp, Artificial Sequence
  chemically synthesized
tttgttgtcttcttttatggtt

SEQ ID NO: 863157 - DNA, 22 bp, Artificial Sequence
  chemically synthesized
ttgttgtcttcttttatggttt

SEQ ID NO: 863158 - DNA, 22 bp, Artificial Sequence
  chemically synthesized
agcaaaacagtcaaaccataaa

SEQ ID NO: 863159 - DNA, 22 bp, Artificial Sequence
  chemically synthesized
tgttgtcttcttttatggtttg

SEQ ID NO: 863160 - DNA, 22 bp, Artificial Sequence
  chemically synthesized
gttgtcttcttttatggtttga

SEQ ID NO: 863161 - DNA, 22 bp, Artificial Sequence
  chemically synthesized
ttgtcttcttttatggtttgac

SEQ ID NO: 863162 - DNA, 22 bp, Artificial Sequence
  chemically synthesized
ctgagcaaaacagtcaaaccat

SEQ ID NO: 863163 - DNA, 22 bp, Artificial Sequence
  chemically synthesized
tcttcttttatggtttgactgt

SEQ ID NO: 863164 - DNA, 22 bp, Artificial Sequence
  chemically synthesized
cttttatggtttgactgttttg

SEQ ID NO: 863165 - DNA, 22 bp, Artificial Sequence
  chemically synthesized
ttttatggtttgactgttttgc

SEQ ID NO: 863166 - DNA, 22 bp, Artificial Sequence
  chemically synthesized
ttatggtttgactgttttgctc

SEQ ID NO: 863167 - DNA, 22 bp, Artificial Sequence
  chemically synthesized
tatggtttgactgttttgctca

SEQ ID NO: 863168 - DNA, 22 bp, Artificial Sequence
  chemically synthesized
atggtttgactgttttgctcag

SEQ ID NO: 863169 - DNA, 22 bp, Artificial Sequence
  chemically synthesized
tggtttgactgttttgctcagt

SEQ ID NO: 863170 - DNA, 22 bp, Artificial Sequence
  chemically synthesized
gactgttttgctcagtagtata

SEQ ID NO: 863171 - DNA, 22 bp, Artificial Sequence
  chemically synthesized
actgttttgctcagtagtatac

SEQ ID NO: 863172 - DNA, 22 bp, Artificial Sequence
  chemically synthesized
ttttgctcagtagtatactttg

SEQ ID NO: 863173 - DNA, 22 bp, Artificial Sequence
  chemically synthesized
tgctcagtagtatactttgatt

SEQ ID NO: 863174 - DNA, 22 bp, Artificial Sequence
  chemically synthesized
gctcagtagtatactttgattc

SEQ ID NO: 863175 - DNA, 22 bp, Artificial Sequence
  chemically synthesized
ctcagtagtatactttgattcc

SEQ ID NO: 863176 - DNA, 22 bp, Artificial Sequence
  chemically synthesized
agtagtatactttgattcctta

SEQ ID NO: 863177 - DNA, 22 bp, Artificial Sequence
  chemically synthesized
tgattccttactttttaccttt

SEQ ID NO: 863178 - DNA, 22 bp, Artificial Sequence
  chemically synthesized
gattccttactttttacctttt

SEQ ID NO: 863179 - DNA, 22 bp, Artificial Sequence
  chemically synthesized
tagtagatatacaaaaggtaaa

SEQ ID NO: 863180 - DNA, 22 bp, Artificial Sequence
  chemically synthesized
attccttactttttaccttttg

SEQ ID NO: 863181 - DNA, 22 bp, Artificial Sequence
  chemically synthesized
cttactttttaccttttgtata

SEQ ID NO: 863182 - DNA, 22 bp, Artificial Sequence
  chemically synthesized
actttttaccttttgtatatct

SEQ ID NO: 863183 - DNA, 22 bp, Artificial Sequence
  chemically synthesized
ctttttaccttttgtatatcta

SEQ ID NO: 863184 - DNA, 22 bp, Artificial Sequence
  chemically synthesized
tttaccttttgtatatctacta

SEQ ID NO: 863185 - DNA, 22 bp, Artificial Sequence
  chemically synthesized
ttaccttttgtatatctactat

SEQ ID NO: 863186 - DNA, 22 bp, Artificial Sequence
  chemically synthesized
taccttttgtatatctactata

SEQ ID NO: 863187 - DNA, 22 bp, Artificial Sequence
  chemically synthesized
accttttgtatatctactatag

SEQ ID NO: 863188 - DNA, 22 bp, Artificial Sequence
  chemically synthesized
ccttttgtatatctactatagg

SEQ ID NO: 863189 - DNA, 22 bp, Artificial Sequence
  chemically synthesized
ttgtatatctactataggtttt

SEQ ID NO: 863190 - DNA, 22 bp, Artificial Sequence
  chemically synthesized
tgtatatctactataggttttt

SEQ ID NO: 863191 - DNA, 22 bp, Artificial Sequence
  chemically synthesized
gtatatctactataggtttttg

SEQ ID NO: 863192 - DNA, 22 bp, Artificial Sequence
  chemically synthesized
tagtagcaaaagcaaaaaccta

SEQ ID NO: 863193 - DNA, 22 bp, Artificial Sequence
  chemically synthesized
tatatctactataggtttttgc

SEQ ID NO: 863194 - DNA, 22 bp, Artificial Sequence
  chemically synthesized
ctataggtttttgcttttgcta

SEQ ID NO: 863195 - DNA, 22 bp, Artificial Sequence
  chemically synthesized
taggtttttgcttttgctacta

SEQ ID NO: 863196 - DNA, 22 bp, Artificial Sequence
  chemically synthesized
ttgcttttgctactataggttt

SEQ ID NO: 863197 - DNA, 22 bp, Artificial Sequence
  chemically synthesized
tgcttttgctactataggtttt

SEQ ID NO: 863198 - DNA, 22 bp, Artificial Sequence
  chemically synthesized
gcttttgctactataggttttt

SEQ ID NO: 863199 - DNA, 22 bp, Artificial Sequence
  chemically synthesized
cttttgctactataggtttttg

SEQ ID NO: 863200 - DNA, 22 bp, Artificial Sequence
  chemically synthesized
ttgctactataggtttttgctt

SEQ ID NO: 863201 - DNA, 22 bp, Artificial Sequence
  chemically synthesized
tgctactataggtttttgcttt

SEQ ID NO: 863202 - DNA, 22 bp, Artificial Sequence
  chemically synthesized
gctactataggtttttgctttt

SEQ ID NO: 863203 - DNA, 22 bp, Artificial Sequence
  chemically synthesized
ctactataggtttttgcttttc

SEQ ID NO: 863204 - DNA, 22 bp, Artificial Sequence
  chemically synthesized
cgtaagatgtaaagaaaagcaa

SEQ ID NO: 863205 - DNA, 22 bp, Artificial Sequence
  chemically synthesized
acgtaagatgtaaagaaaagca

SEQ ID NO: 863206 - DNA, 22 bp, Artificial Sequence
  chemically synthesized
ctataggtttttgcttttcttt

SEQ ID NO: 863207 - DNA, 22 bp, Artificial Sequence
  chemically synthesized
taggtttttgcttttctttaca

SEQ ID NO: 863208 - DNA, 22 bp, Artificial Sequence
  chemically synthesized
aaaaacccttacgtaagatgta

SEQ ID NO: 863209 - DNA, 22 bp, Artificial Sequence
  chemically synthesized
ttgcttttctttacatcttacg

SEQ ID NO: 863210 - DNA, 22 bp, Artificial Sequence
  chemically synthesized
aaaaaacccttacgtaagatgt

SEQ ID NO: 863211 - DNA, 22 bp, Artificial Sequence
  chemically synthesized
tgcttttctttacatcttacgt

SEQ ID NO: 863212 - DNA, 22 bp, Artificial Sequence
  chemically synthesized
gcttttctttacatcttacgta

SEQ ID NO: 863213 - DNA, 22 bp, Artificial Sequence
  chemically synthesized
cttttctttacatcttacgtaa

SEQ ID NO: 863214 - DNA, 22 bp, Artificial Sequence
  chemically synthesized
ttctttacatcttacgtaaggg

SEQ ID NO: 863215 - DNA, 22 bp, Artificial Sequence
  chemically synthesized
tctttacatcttacgtaagggt

SEQ ID NO: 863216 - DNA, 22 bp, Artificial Sequence
  chemically synthesized
ccagcttaaaaaacccttacgt

SEQ ID NO: 863217 - DNA, 22 bp, Artificial Sequence
  chemically synthesized
ctttacatcttacgtaagggtt

SEQ ID NO: 863218 - DNA, 22 bp, Artificial Sequence
  chemically synthesized
tttacatcttacgtaagggttt

SEQ ID NO: 863219 - DNA, 22 bp, Artificial Sequence
  chemically synthesized
ttaccagcttaaaaaaccctta

SEQ ID NO: 863220 - DNA, 22 bp, Artificial Sequence
  chemically synthesized
tacatcttacgtaagggttttt

SEQ ID NO: 863221 - DNA, 22 bp, Artificial Sequence
  chemically synthesized
acatcttacgtaagggtttttt

SEQ ID NO: 863222 - DNA, 22 bp, Artificial Sequence
  chemically synthesized
catcttacgtaagggtttttta

SEQ ID NO: 863223 - DNA, 22 bp, Artificial Sequence
  chemically synthesized
agttattaccagcttaaaaaac

SEQ ID NO: 863224 - DNA, 22 bp, Artificial Sequence
  chemically synthesized
acgtaagggttttttaagctgg

SEQ ID NO: 863225 - DNA, 22 bp, Artificial Sequence
  chemically synthesized
cgtaagggttttttaagctggt

SEQ ID NO: 863226 - DNA, 22 bp, Artificial Sequence
  chemically synthesized
tttaagctggtaataacttaac

SEQ ID NO: 863227 - DNA, 22 bp, Artificial Sequence
  chemically synthesized
tatgcaatcaaagttaagttat

SEQ ID NO: 863228 - DNA, 22 bp, Artificial Sequence
  chemically synthesized
ttaagctggtaataacttaact

SEQ ID NO: 863229 - DNA, 22 bp, Artificial Sequence
  chemically synthesized
gtatgcaatcaaagttaagtta

SEQ ID NO: 863230 - DNA, 22 bp, Artificial Sequence
  chemically synthesized
taagctggtaataacttaactt

SEQ ID NO: 863231 - DNA, 22 bp, Artificial Sequence
  chemically synthesized
tgtatgcaatcaaagttaagtt

SEQ ID NO: 863232 - DNA, 22 bp, Artificial Sequence
  chemically synthesized
aagctggtaataacttaacttt

SEQ ID NO: 863233 - DNA, 22 bp, Artificial Sequence
  chemically synthesized
agctggtaataacttaactttg

SEQ ID NO: 863234 - DNA, 22 bp, Artificial Sequence
  chemically synthesized
gtaataacttaactttgattgc

SEQ ID NO: 863235 - DNA, 22 bp, Artificial Sequence
  chemically synthesized
aactttgattgcatacaaaact

SEQ ID NO: 863236 - DNA, 22 bp, Artificial Sequence
  chemically synthesized
actttgattgcatacaaaactc

SEQ ID NO: 863237 - DNA, 22 bp, Artificial Sequence
  chemically synthesized
tgattgcatacaaaactctaca

SEQ ID NO: 863238 - DNA, 22 bp, Artificial Sequence
  chemically synthesized
gggaagtaagcgtgtagagttt

SEQ ID NO: 863239 - DNA, 22 bp, Artificial Sequence
  chemically synthesized
gattgcatacaaaactctacac

SEQ ID NO: 863240 - DNA, 22 bp, Artificial Sequence
  chemically synthesized
attgcatacaaaactctacacg

SEQ ID NO: 863241 - DNA, 22 bp, Artificial Sequence
  chemically synthesized
catacaaaactctacacgctta

SEQ ID NO: 863242 - DNA, 22 bp, Artificial Sequence
  chemically synthesized
caaaatgtggattagggaagta

SEQ ID NO: 863243 - DNA, 22 bp, Artificial Sequence
  chemically synthesized
tacacgcttacttccctaatcc

SEQ ID NO: 863244 - DNA, 22 bp, Artificial Sequence
  chemically synthesized
cacgcttacttccctaatccac

SEQ ID NO: 863245 - DNA, 22 bp, Artificial Sequence
  chemically synthesized
aaattacaaaatgtggattagg

SEQ ID NO: 863246 - DNA, 22 bp, Artificial Sequence
  chemically synthesized
acttccctaatccacattttgt

SEQ ID NO: 863247 - DNA, 22 bp, Artificial Sequence
  chemically synthesized
cttccctaatccacattttgta

SEQ ID NO: 863248 - DNA, 22 bp, Artificial Sequence
  chemically synthesized
tgacattgaaattacaaaatgt

SEQ ID NO: 863249 - DNA, 22 bp, Artificial Sequence
  chemically synthesized
ccctaatccacattttgtaatt

SEQ ID NO: 863250 - DNA, 22 bp, Artificial Sequence
  chemically synthesized
cctaatccacattttgtaattt

SEQ ID NO: 863251 - DNA, 22 bp, Artificial Sequence
  chemically synthesized
atccacattttgtaatttcaat

SEQ ID NO: 863252 - DNA, 22 bp, Artificial Sequence
  chemically synthesized
tgtaatttcaatgtcacaacct

SEQ ID NO: 863253 - DNA, 22 bp, Artificial Sequence
  chemically synthesized
taaagaagatataggttgtgac

SEQ ID NO: 863254 - DNA, 22 bp, Artificial Sequence
  chemically synthesized
gtaatttcaatgtcacaaccta

SEQ ID NO: 863255 - DNA, 22 bp, Artificial Sequence
  chemically synthesized
taatttcaatgtcacaacctat

SEQ ID NO: 863256 - DNA, 22 bp, Artificial Sequence
  chemically synthesized
caatgtcacaacctatatcttc

SEQ ID NO: 863257 - DNA, 22 bp, Artificial Sequence
  chemically synthesized
aatgtcacaacctatatcttct

SEQ ID NO: 863258 - DNA, 22 bp, Artificial Sequence
  chemically synthesized
aaagagacaaattataaagaag

SEQ ID NO: 863259 - DNA, 22 bp, Artificial Sequence
  chemically synthesized
gttaaaagagacaaattataaa

SEQ ID NO: 863260 - DNA, 22 bp, Artificial Sequence
  chemically synthesized
tatcttctttataatttgtctc

SEQ ID NO: 863261 - DNA, 22 bp, Artificial Sequence
  chemically synthesized
caataattggttaaaagagaca

SEQ ID NO: 863262 - DNA, 22 bp, Artificial Sequence
  chemically synthesized
ctttataatttgtctcttttaa

SEQ ID NO: 863263 - DNA, 22 bp, Artificial Sequence
  chemically synthesized
tttataatttgtctcttttaac

SEQ ID NO: 863264 - DNA, 22 bp, Artificial Sequence
  chemically synthesized
tataatttgtctcttttaacca

SEQ ID NO: 863265 - DNA, 22 bp, Artificial Sequence
  chemically synthesized
ataatttgtctcttttaaccaa

SEQ ID NO: 863266 - DNA, 22 bp, Artificial Sequence
  chemically synthesized
tagctacaataattggttaaaa

SEQ ID NO: 863267 - DNA, 22 bp, Artificial Sequence
  chemically synthesized
taatttgtctcttttaaccaat

SEQ ID NO: 863268 - DNA, 22 bp, Artificial Sequence
  chemically synthesized
atagctacaataattggttaaa

SEQ ID NO: 863269 - DNA, 22 bp, Artificial Sequence
  chemically synthesized
gtctcttttaaccaattattgt

SEQ ID NO: 863270 - DNA, 22 bp, Artificial Sequence
  chemically synthesized
tctcttttaaccaattattgta

SEQ ID NO: 863271 - DNA, 22 bp, Artificial Sequence
  chemically synthesized
ttttaaccaattattgtagcta

SEQ ID NO: 863272 - DNA, 22 bp, Artificial Sequence
  chemically synthesized
ttaaccaattattgtagctata

SEQ ID NO: 863273 - DNA, 22 bp, Artificial Sequence
  chemically synthesized
taaccaattattgtagctataa

SEQ ID NO: 863274 - DNA, 22 bp, Artificial Sequence
  chemically synthesized
aaccaattattgtagctataag

SEQ ID NO: 863275 - DNA, 22 bp, Artificial Sequence
  chemically synthesized
accaattattgtagctataagc

SEQ ID NO: 863276 - DNA, 22 bp, Artificial Sequence
  chemically synthesized
acatcccaatgtgcttatagct

SEQ ID NO: 863277 - DNA, 22 bp, Artificial Sequence
  chemically synthesized
tcacatcccaatgtgcttatag

SEQ ID NO: 863278 - DNA, 22 bp, Artificial Sequence
  chemically synthesized
ttgtagctataagcacattggg

SEQ ID NO: 863279 - DNA, 22 bp, Artificial Sequence
  chemically synthesized
tagctataagcacattgggatg

SEQ ID NO: 863280 - DNA, 22 bp, Artificial Sequence
  chemically synthesized
aaaagaactctcacatcccaat

SEQ ID NO: 863281 - DNA, 22 bp, Artificial Sequence
  chemically synthesized
ctaaaaagaactctcacatccc

SEQ ID NO: 863282 - DNA, 22 bp, Artificial Sequence
  chemically synthesized
taagcacattgggatgtgagag

SEQ ID NO: 863283 - DNA, 22 bp, Artificial Sequence
  chemically synthesized
tactaaaaagaactctcacatc

SEQ ID NO: 863284 - DNA, 22 bp, Artificial Sequence
  chemically synthesized
tgtgatctctactaaaaagaac

SEQ ID NO: 863285 - DNA, 22 bp, Artificial Sequence
  chemically synthesized
gtgtgatctctactaaaaagaa

SEQ ID NO: 863286 - DNA, 22 bp, Artificial Sequence
  chemically synthesized
ggatgtgagagttctttttagt

SEQ ID NO: 863287 - DNA, 22 bp, Artificial Sequence
  chemically synthesized
aaatgcaaaatttgtgtgatct

SEQ ID NO: 863288 - DNA, 22 bp, Artificial Sequence
  chemically synthesized
aaaatgcaaaatttgtgtgatc

SEQ ID NO: 863289 - DNA, 22 bp, Artificial Sequence
  chemically synthesized
tttttagtagagatcacacaaa

SEQ ID NO: 863290 - DNA, 22 bp, Artificial Sequence
  chemically synthesized
taaaatgcaaaatttgtgtgat

SEQ ID NO: 863291 - DNA, 22 bp, Artificial Sequence
  chemically synthesized
tttagtagagatcacacaaatt

SEQ ID NO: 863292 - DNA, 22 bp, Artificial Sequence
  chemically synthesized
ttagtagagatcacacaaattt

SEQ ID NO: 863293 - DNA, 22 bp, Artificial Sequence
  chemically synthesized
tagtagagatcacacaaatttt

SEQ ID NO: 863294 - DNA, 22 bp, Artificial Sequence
  chemically synthesized
agtagagatcacacaaattttg

SEQ ID NO: 863295 - DNA, 22 bp, Artificial Sequence
  chemically synthesized
gtagagatcacacaaattttgc

SEQ ID NO: 863296 - DNA, 22 bp, Artificial Sequence
  chemically synthesized
aagtaacattttaaaatgcaaa

SEQ ID NO: 863297 - DNA, 22 bp, Artificial Sequence
  chemically synthesized
caagtaacattttaaaatgcaa

SEQ ID NO: 863298 - DNA, 22 bp, Artificial Sequence
  chemically synthesized
tcaagtaacattttaaaatgca

SEQ ID NO: 863299 - DNA, 22 bp, Artificial Sequence
  chemically synthesized
ttttcaagtaacattttaaaat

SEQ ID NO: 863300 - DNA, 22 bp, Artificial Sequence
  chemically synthesized
attttcaagtaacattttaaaa

SEQ ID NO: 863301 - DNA, 22 bp, Artificial Sequence
  chemically synthesized
tattttcaagtaacattttaaa

SEQ ID NO: 863302 - DNA, 22 bp, Artificial Sequence
  chemically synthesized
tgcattttaaaatgttacttga

SEQ ID NO: 863303 - DNA, 22 bp, Artificial Sequence
  chemically synthesized
aaaattttattttcaagtaaca

SEQ ID NO: 863304 - DNA, 22 bp, Artificial Sequence
  chemically synthesized
gcattttaaaatgttacttgaa

SEQ ID NO: 863305 - DNA, 22 bp, Artificial Sequence
  chemically synthesized
cattttaaaatgttacttgaaa

SEQ ID NO: 863306 - DNA, 22 bp, Artificial Sequence
  chemically synthesized
attgaaaattttattttcaagt

SEQ ID NO: 863307 - DNA, 22 bp, Artificial Sequence
  chemically synthesized
cattgaaaattttattttcaag

SEQ ID NO: 863308 - DNA, 22 bp, Artificial Sequence
  chemically synthesized
taaaatgttacttgaaaataaa

SEQ ID NO: 863309 - DNA, 22 bp, Artificial Sequence
  chemically synthesized
aaaatgttacttgaaaataaaa

SEQ ID NO: 863310 - DNA, 22 bp, Artificial Sequence
  chemically synthesized
aaatgttacttgaaaataaaat

SEQ ID NO: 863311 - DNA, 22 bp, Artificial Sequence
  chemically synthesized
aatataacttcattgaaaattt

SEQ ID NO: 863312 - DNA, 22 bp, Artificial Sequence
  chemically synthesized
aaatataacttcattgaaaatt

SEQ ID NO: 863313 - DNA, 22 bp, Artificial Sequence
  chemically synthesized
cttgaaaataaaattttcaatg

SEQ ID NO: 863314 - DNA, 22 bp, Artificial Sequence
  chemically synthesized
gaaaataaaattttcaatgaag

SEQ ID NO: 863315 - DNA, 22 bp, Artificial Sequence
  chemically synthesized
aaaataaaattttcaatgaagt

SEQ ID NO: 863316 - DNA, 22 bp, Artificial Sequence
  chemically synthesized
aatcttaaatataacttcattg

SEQ ID NO: 863317 - DNA, 22 bp, Artificial Sequence
  chemically synthesized
gaataattgaatcttaaatata

SEQ ID NO: 863318 - DNA, 22 bp, Artificial Sequence
  chemically synthesized
ggaataattgaatcttaaatat

SEQ ID NO: 863319 - DNA, 22 bp, Artificial Sequence
  chemically synthesized
tcaatgaagttatatttaagat

SEQ ID NO: 863320 - DNA, 22 bp, Artificial Sequence
  chemically synthesized
caatgaagttatatttaagatt

SEQ ID NO: 863321 - DNA, 22 bp, Artificial Sequence
  chemically synthesized
aatgaagttatatttaagattc

SEQ ID NO: 863322 - DNA, 22 bp, Artificial Sequence
  chemically synthesized
ccttggaataattgaatcttaa

SEQ ID NO: 863323 - DNA, 22 bp, Artificial Sequence
  chemically synthesized
accttggaataattgaatctta

SEQ ID NO: 863324 - DNA, 22 bp, Artificial Sequence
  chemically synthesized
taccttggaataattgaatctt

SEQ ID NO: 863325 - DNA, 22 bp, Artificial Sequence
  chemically synthesized
actttaccttggaataattgaa

SEQ ID NO: 863326 - DNA, 22 bp, Artificial Sequence
  chemically synthesized
tatttaagattcaattattcca

SEQ ID NO: 863327 - DNA, 22 bp, Artificial Sequence
  chemically synthesized
taattaactttaccttggaata

SEQ ID NO: 863328 - DNA, 22 bp, Artificial Sequence
  chemically synthesized
gtaattaactttaccttggaat

SEQ ID NO: 863329 - DNA, 22 bp, Artificial Sequence
  chemically synthesized
aagattcaattattccaaggta

SEQ ID NO: 863330 - DNA, 22 bp, Artificial Sequence
  chemically synthesized
tgtaattaactttaccttggaa

SEQ ID NO: 863331 - DNA, 22 bp, Artificial Sequence
  chemically synthesized
agattcaattattccaaggtaa

SEQ ID NO: 863332 - DNA, 22 bp, Artificial Sequence
  chemically synthesized
gactttgtaattaactttacct

SEQ ID NO: 863333 - DNA, 22 bp, Artificial Sequence
  chemically synthesized
aattattccaaggtaaagttaa

SEQ ID NO: 863334 - DNA, 22 bp, Artificial Sequence
  chemically synthesized
tggactttgtaattaactttac

SEQ ID NO: 863335 - DNA, 22 bp, Artificial Sequence
  chemically synthesized
ttccaaggtaaagttaattaca

SEQ ID NO: 863336 - DNA, 22 bp, Artificial Sequence
  chemically synthesized
cattctggactttgtaattaac

SEQ ID NO: 863337 - DNA, 22 bp, Artificial Sequence
  chemically synthesized
ccattctggactttgtaattaa

SEQ ID NO: 863338 - DNA, 22 bp, Artificial Sequence
  chemically synthesized
tccattctggactttgtaatta

SEQ ID NO: 863339 - DNA, 22 bp, Artificial Sequence
  chemically synthesized
caaggtaaagttaattacaaag

SEQ ID NO: 863340 - DNA, 22 bp, Artificial Sequence
  chemically synthesized
attacaaagtccagaatggaaa

SEQ ID NO: 863341 - DNA, 22 bp, Artificial Sequence
  chemically synthesized
caaagtccagaatggaaaatca

SEQ ID NO: 863342 - DNA, 22 bp, Artificial Sequence
  chemically synthesized
atgaaaaaaatagcatgatttt

SEQ ID NO: 863343 - DNA, 22 bp, Artificial Sequence
  chemically synthesized
ctaatgaaaaaaatagcatgat

SEQ ID NO: 863344 - DNA, 22 bp, Artificial Sequence
  chemically synthesized
tactaatgaaaaaaatagcatg

SEQ ID NO: 863345 - DNA, 22 bp, Artificial Sequence
  chemically synthesized
ctactaatgaaaaaaatagcat

SEQ ID NO: 863346 - DNA, 22 bp, Artificial Sequence
  chemically synthesized
tctactaatgaaaaaaatagca

SEQ ID NO: 863347 - DNA, 22 bp, Artificial Sequence
  chemically synthesized
ttctactaatgaaaaaaatagc

SEQ ID NO: 863348 - DNA, 22 bp, Artificial Sequence
  chemically synthesized
tttttctactaatgaaaaaaat

SEQ ID NO: 863349 - DNA, 22 bp, Artificial Sequence
  chemically synthesized
ttatttttctactaatgaaaaa

SEQ ID NO: 863350 - DNA, 22 bp, Artificial Sequence
  chemically synthesized
aggattattatttttctactaa

SEQ ID NO: 863351 - DNA, 22 bp, Artificial Sequence
  chemically synthesized
aaggattattatttttctacta

SEQ ID NO: 863352 - DNA, 22 bp, Artificial Sequence
  chemically synthesized
taaggattattatttttctact

SEQ ID NO: 863353 - DNA, 22 bp, Artificial Sequence
  chemically synthesized
tttttttcattagtagaaaaat

SEQ ID NO: 863354 - DNA, 22 bp, Artificial Sequence
  chemically synthesized
ttaaggattattatttttctac

SEQ ID NO: 863355 - DNA, 22 bp, Artificial Sequence
  chemically synthesized
ttttcattagtagaaaaataat

SEQ ID NO: 863356 - DNA, 22 bp, Artificial Sequence
  chemically synthesized
tttcattagtagaaaaataata

SEQ ID NO: 863357 - DNA, 22 bp, Artificial Sequence
  chemically synthesized
ttcattagtagaaaaataataa

SEQ ID NO: 863358 - DNA, 22 bp, Artificial Sequence
  chemically synthesized
tcattagtagaaaaataataat

SEQ ID NO: 863359 - DNA, 22 bp, Artificial Sequence
  chemically synthesized
cattagtagaaaaataataatc

SEQ ID NO: 863360 - DNA, 22 bp, Artificial Sequence
  chemically synthesized
attagtagaaaaataataatcc

SEQ ID NO: 863361 - DNA, 22 bp, Artificial Sequence
  chemically synthesized
gtagaaaaataataatccttaa

SEQ ID NO: 863362 - DNA, 22 bp, Artificial Sequence
  chemically synthesized
ggaaaaaagaaacatcattttt

SEQ ID NO: 863363 - DNA, 22 bp, Artificial Sequence
  chemically synthesized
aggaaaaaagaaacatcatttt

SEQ ID NO: 863364 - DNA, 22 bp, Artificial Sequence
  chemically synthesized
gatatcttaggaaaaaagaaac

SEQ ID NO: 863365 - DNA, 22 bp, Artificial Sequence
  chemically synthesized
aaaaatgatgtttcttttttcc

SEQ ID NO: 863366 - DNA, 22 bp, Artificial Sequence
  chemically synthesized
aaaatgatgtttcttttttcct

SEQ ID NO: 863367 - DNA, 22 bp, Artificial Sequence
  chemically synthesized
tctagatatcttaggaaaaaag

SEQ ID NO: 863368 - DNA, 22 bp, Artificial Sequence
  chemically synthesized
atctagatatcttaggaaaaaa

SEQ ID NO: 863369 - DNA, 22 bp, Artificial Sequence
  chemically synthesized
ttatctagatatcttaggaaaa

SEQ ID NO: 863370 - DNA, 22 bp, Artificial Sequence
  chemically synthesized
gttcttatctagatatcttagg

SEQ ID NO: 863371 - DNA, 22 bp, Artificial Sequence
  chemically synthesized
agttcttatctagatatcttag

SEQ ID NO: 863372 - DNA, 22 bp, Artificial Sequence
  chemically synthesized
tagttcttatctagatatctta

SEQ ID NO: 863373 - DNA, 22 bp, Artificial Sequence
  chemically synthesized
ttagttcttatctagatatctt

SEQ ID NO: 863374 - DNA, 22 bp, Artificial Sequence
  chemically synthesized
cttttttcctaagatatctaga

SEQ ID NO: 863375 - DNA, 22 bp, Artificial Sequence
  chemically synthesized
ttttttcctaagatatctagat

SEQ ID NO: 863376 - DNA, 22 bp, Artificial Sequence
  chemically synthesized
cttttagttcttatctagatat

SEQ ID NO: 863377 - DNA, 22 bp, Artificial Sequence
  chemically synthesized
acttttagttcttatctagata

SEQ ID NO: 863378 - DNA, 22 bp, Artificial Sequence
  chemically synthesized
ttttcctaagatatctagataa

SEQ ID NO: 863379 - DNA, 22 bp, Artificial Sequence
  chemically synthesized
tacttttagttcttatctagat

SEQ ID NO: 863380 - DNA, 22 bp, Artificial Sequence
  chemically synthesized
tttcctaagatatctagataag

SEQ ID NO: 863381 - DNA, 22 bp, Artificial Sequence
  chemically synthesized
ttcctaagatatctagataaga

SEQ ID NO: 863382 - DNA, 22 bp, Artificial Sequence
  chemically synthesized
tcctaagatatctagataagaa

SEQ ID NO: 863383 - DNA, 22 bp, Artificial Sequence
  chemically synthesized
cctaagatatctagataagaac

SEQ ID NO: 863384 - DNA, 22 bp, Artificial Sequence
  chemically synthesized
ctaagatatctagataagaact

SEQ ID NO: 863385 - DNA, 22 bp, Artificial Sequence
  chemically synthesized
agatatctagataagaactaaa

SEQ ID NO: 863386 - DNA, 22 bp, Artificial Sequence
  chemically synthesized
gataagaactaaaagtaaaatg

SEQ ID NO: 863387 - DNA, 22 bp, Artificial Sequence
  chemically synthesized
cagtagaggaaatacattttac

SEQ ID NO: 863388 - DNA, 22 bp, Artificial Sequence
  chemically synthesized
acagtagaggaaatacatttta

SEQ ID NO: 863389 - DNA, 22 bp, Artificial Sequence
  chemically synthesized
tacagtagaggaaatacatttt

SEQ ID NO: 863390 - DNA, 22 bp, Artificial Sequence
  chemically synthesized
taattttacagtagaggaaata

SEQ ID NO: 863391 - DNA, 22 bp, Artificial Sequence
  chemically synthesized
aaagtaaaatgtatttcctcta

SEQ ID NO: 863392 - DNA, 22 bp, Artificial Sequence
  chemically synthesized
atatagattgtaattttacagt

SEQ ID NO: 863393 - DNA, 22 bp, Artificial Sequence
  chemically synthesized
cctctactgtaaaattacaatc

SEQ ID NO: 863394 - DNA, 22 bp, Artificial Sequence
  chemically synthesized
ctctactgtaaaattacaatct

SEQ ID NO: 863395 - DNA, 22 bp, Artificial Sequence
  chemically synthesized
tactgtaaaattacaatctata

SEQ ID NO: 863396 - DNA, 22 bp, Artificial Sequence
  chemically synthesized
ctgtaaaattacaatctatatt

SEQ ID NO: 863397 - DNA, 22 bp, Artificial Sequence
  chemically synthesized
aaataatggattaatatagatt

SEQ ID NO: 863398 - DNA, 22 bp, Artificial Sequence
  chemically synthesized
aaaataatggattaatatagat

SEQ ID NO: 863399 - DNA, 22 bp, Artificial Sequence
  chemically synthesized
taaaataatggattaatataga

SEQ ID NO: 863400 - DNA, 22 bp, Artificial Sequence
  chemically synthesized
taaaattacaatctatattaat

SEQ ID NO: 863401 - DNA, 22 bp, Artificial Sequence
  chemically synthesized
ttttaaaataatggattaatat

SEQ ID NO: 863402 - DNA, 22 bp, Artificial Sequence
  chemically synthesized
gttttaaaataatggattaata

SEQ ID NO: 863403 - DNA, 22 bp, Artificial Sequence
  chemically synthesized
tgttttaaaataatggattaat

SEQ ID NO: 863404 - DNA, 22 bp, Artificial Sequence
  chemically synthesized
ttgttttaaaataatggattaa

SEQ ID NO: 863405 - DNA, 22 bp, Artificial Sequence
  chemically synthesized
tttgttttaaaataatggatta

SEQ ID NO: 863406 - DNA, 22 bp, Artificial Sequence
  chemically synthesized
caatctatattaatccattatt

SEQ ID NO: 863407 - DNA, 22 bp, Artificial Sequence
  chemically synthesized
gtatctttttgttttaaaataa

SEQ ID NO: 863408 - DNA, 22 bp, Artificial Sequence
  chemically synthesized
cgtatctttttgttttaaaata

SEQ ID NO: 863409 - DNA, 22 bp, Artificial Sequence
  chemically synthesized
tattaatccattattttaaaac

SEQ ID NO: 863410 - DNA, 22 bp, Artificial Sequence
  chemically synthesized
ccttcgtatctttttgttttaa

SEQ ID NO: 863411 - DNA, 22 bp, Artificial Sequence
  chemically synthesized
atccattattttaaaacaaaaa

SEQ ID NO: 863412 - DNA, 22 bp, Artificial Sequence
  chemically synthesized
tcccttcgtatctttttgtttt

SEQ ID NO: 863413 - DNA, 22 bp, Artificial Sequence
  chemically synthesized
ctcccttcgtatctttttgttt

SEQ ID NO: 863414 - DNA, 22 bp, Artificial Sequence
  chemically synthesized
tctcccttcgtatctttttgtt

SEQ ID NO: 863415 - DNA, 22 bp, Artificial Sequence
  chemically synthesized
ttttaaaacaaaaagatacgaa

SEQ ID NO: 863416 - DNA, 22 bp, Artificial Sequence
  chemically synthesized
taaaacaaaaagatacgaaggg

SEQ ID NO: 863417 - DNA, 22 bp, Artificial Sequence
  chemically synthesized
aaaacaaaaagatacgaaggga

SEQ ID NO: 863418 - DNA, 22 bp, Artificial Sequence
  chemically synthesized
ataaaaattttctcccttcgta

SEQ ID NO: 863419 - DNA, 22 bp, Artificial Sequence
  chemically synthesized
aaacaaaaagatacgaagggag

SEQ ID NO: 863420 - DNA, 22 bp, Artificial Sequence
  chemically synthesized
gataaaaattttctcccttcgt

SEQ ID NO: 863421 - DNA, 22 bp, Artificial Sequence
  chemically synthesized
taacataacttgataaaaattt

SEQ ID NO: 863422 - DNA, 22 bp, Artificial Sequence
  chemically synthesized
gtaacataacttgataaaaatt

SEQ ID NO: 863423 - DNA, 22 bp, Artificial Sequence
  chemically synthesized
tgtaacataacttgataaaaat

SEQ ID NO: 863424 - DNA, 22 bp, Artificial Sequence
  chemically synthesized
gagattttgtaacataacttga

SEQ ID NO: 863425 - DNA, 22 bp, Artificial Sequence
  chemically synthesized
ttatcaagttatgttacaaaat

SEQ ID NO: 863426 - DNA, 22 bp, Artificial Sequence
  chemically synthesized
tatcaagttatgttacaaaatc

SEQ ID NO: 863427 - DNA, 22 bp, Artificial Sequence
  chemically synthesized
atcaagttatgttacaaaatct

SEQ ID NO: 863428 - DNA, 22 bp, Artificial Sequence
  chemically synthesized
tcaagttatgttacaaaatctc

SEQ ID NO: 863429 - DNA, 22 bp, Artificial Sequence
  chemically synthesized
atgcaataagctagagattttg

SEQ ID NO: 863430 - DNA, 22 bp, Artificial Sequence
  chemically synthesized
catgcaataagctagagatttt

SEQ ID NO: 863431 - DNA, 22 bp, Artificial Sequence
  chemically synthesized
atttcatgcaataagctagaga

SEQ ID NO: 863432 - DNA, 22 bp, Artificial Sequence
  chemically synthesized
aatttcatgcaataagctagag

SEQ ID NO: 863433 - DNA, 22 bp, Artificial Sequence
  chemically synthesized
tgttacaaaatctctagcttat

SEQ ID NO: 863434 - DNA, 22 bp, Artificial Sequence
  chemically synthesized
caaaatctctagcttattgcat

SEQ ID NO: 863435 - DNA, 22 bp, Artificial Sequence
  chemically synthesized
tgtggtttaatttcatgcaata

SEQ ID NO: 863436 - DNA, 22 bp, Artificial Sequence
  chemically synthesized
atgtggtttaatttcatgcaat

SEQ ID NO: 863437 - DNA, 22 bp, Artificial Sequence
  chemically synthesized
tatgtggtttaatttcatgcaa

SEQ ID NO: 863438 - DNA, 22 bp, Artificial Sequence
  chemically synthesized
ttatgtggtttaatttcatgca

SEQ ID NO: 863439 - DNA, 22 bp, Artificial Sequence
  chemically synthesized
ttttatgtggtttaatttcatg

SEQ ID NO: 863440 - DNA, 22 bp, Artificial Sequence
  chemically synthesized
cttttatgtggtttaatttcat

SEQ ID NO: 863441 - DNA, 22 bp, Artificial Sequence
  chemically synthesized
tagcttattgcatgaaattaaa

SEQ ID NO: 863442 - DNA, 22 bp, Artificial Sequence
  chemically synthesized
gcttattgcatgaaattaaacc

SEQ ID NO: 863443 - DNA, 22 bp, Artificial Sequence
  chemically synthesized
tttcttttatgtggtttaattt

SEQ ID NO: 863444 - DNA, 22 bp, Artificial Sequence
  chemically synthesized
ttatttcttttatgtggtttaa

SEQ ID NO: 863445 - DNA, 22 bp, Artificial Sequence
  chemically synthesized
attgcatgaaattaaaccacat

SEQ ID NO: 863446 - DNA, 22 bp, Artificial Sequence
  chemically synthesized
attatttcttttatgtggttta

SEQ ID NO: 863447 - DNA, 22 bp, Artificial Sequence
  chemically synthesized
ttgcatgaaattaaaccacata

SEQ ID NO: 863448 - DNA, 22 bp, Artificial Sequence
  chemically synthesized
catgaaattaaaccacataaaa

SEQ ID NO: 863449 - DNA, 22 bp, Artificial Sequence
  chemically synthesized
ggtttattatttcttttatgtg

SEQ ID NO: 863450 - DNA, 22 bp, Artificial Sequence
  chemically synthesized
agttaggtttattatttctttt

SEQ ID NO: 863451 - DNA, 22 bp, Artificial Sequence
  chemically synthesized
cagttaggtttattatttcttt

SEQ ID NO: 863452 - DNA, 22 bp, Artificial Sequence
  chemically synthesized
aaccacataaaagaaataataa

SEQ ID NO: 863453 - DNA, 22 bp, Artificial Sequence
  chemically synthesized
tttcagttaggtttattatttc

SEQ ID NO: 863454 - DNA, 22 bp, Artificial Sequence
  chemically synthesized
atgttgtttcagttaggtttat

SEQ ID NO: 863455 - DNA, 22 bp, Artificial Sequence
  chemically synthesized
gataggagttaatgttgtttca

SEQ ID NO: 863456 - DNA, 22 bp, Artificial Sequence
  chemically synthesized
actgaaacaacattaactccta

SEQ ID NO: 863457 - DNA, 22 bp, Artificial Sequence
  chemically synthesized
ataaaccctagataggagttaa

SEQ ID NO: 863458 - DNA, 22 bp, Artificial Sequence
  chemically synthesized
gataaaccctagataggagtta

SEQ ID NO: 863459 - DNA, 22 bp, Artificial Sequence
  chemically synthesized
aaacaacattaactcctatcta

SEQ ID NO: 863460 - DNA, 22 bp, Artificial Sequence
  chemically synthesized
tagtttgataaaccctagatag

SEQ ID NO: 863461 - DNA, 22 bp, Artificial Sequence
  chemically synthesized
tgtagtttgataaaccctagat

SEQ ID NO: 863462 - DNA, 22 bp, Artificial Sequence
  chemically synthesized
ctgtagtttgataaaccctaga

SEQ ID NO: 863463 - DNA, 22 bp, Artificial Sequence
  chemically synthesized
tctgtagtttgataaaccctag

SEQ ID NO: 863464 - DNA, 22 bp, Artificial Sequence
  chemically synthesized
ttttctgtagtttgataaaccc

SEQ ID NO: 863465 - DNA, 22 bp, Artificial Sequence
  chemically synthesized
actcctatctagggtttatcaa

SEQ ID NO: 863466 - DNA, 22 bp, Artificial Sequence
  chemically synthesized
tgttttctgtagtttgataaac

SEQ ID NO: 863467 - DNA, 22 bp, Artificial Sequence
  chemically synthesized
ctgttttctgtagtttgataaa

SEQ ID NO: 863468 - DNA, 22 bp, Artificial Sequence
  chemically synthesized
tctgttttctgtagtttgataa

SEQ ID NO: 863469 - DNA, 22 bp, Artificial Sequence
  chemically synthesized
ctatctagggtttatcaaacta

SEQ ID NO: 863470 - DNA, 22 bp, Artificial Sequence
  chemically synthesized
ctttctgttttctgtagtttga

SEQ ID NO: 863471 - DNA, 22 bp, Artificial Sequence
  chemically synthesized
tctagggtttatcaaactacag

SEQ ID NO: 863472 - DNA, 22 bp, Artificial Sequence
  chemically synthesized
cctttctgttttctgtagtttg

SEQ ID NO: 863473 - DNA, 22 bp, Artificial Sequence
  chemically synthesized
tcctttctgttttctgtagttt

SEQ ID NO: 863474 - DNA, 22 bp, Artificial Sequence
  chemically synthesized
gggtttatcaaactacagaaaa

SEQ ID NO: 863475 - DNA, 22 bp, Artificial Sequence
  chemically synthesized
ctttcctttctgttttctgtag

SEQ ID NO: 863476 - DNA, 22 bp, Artificial Sequence
  chemically synthesized
atcaaactacagaaaacagaaa

SEQ ID NO: 863477 - DNA, 22 bp, Artificial Sequence
  chemically synthesized
tcaaactacagaaaacagaaag

SEQ ID NO: 863478 - DNA, 22 bp, Artificial Sequence
  chemically synthesized
aagatgtataattcctttcctt

SEQ ID NO: 863479 - DNA, 22 bp, Artificial Sequence
  chemically synthesized
cagaaaacagaaaggaaaggaa

SEQ ID NO: 863480 - DNA, 22 bp, Artificial Sequence
  chemically synthesized
tcaagatgtataattcctttcc

SEQ ID NO: 863481 - DNA, 22 bp, Artificial Sequence
  chemically synthesized
ctcaagatgtataattcctttc

SEQ ID NO: 863482 - DNA, 22 bp, Artificial Sequence
  chemically synthesized
tgtttctcaagatgtataattc

SEQ ID NO: 863483 - DNA, 22 bp, Artificial Sequence
  chemically synthesized
gtagttatgtttctcaagatgt

SEQ ID NO: 863484 - DNA, 22 bp, Artificial Sequence
  chemically synthesized
agtagttatgtttctcaagatg

SEQ ID NO: 863485 - DNA, 22 bp, Artificial Sequence
  chemically synthesized
tacatcttgagaaacataacta

SEQ ID NO: 863486 - DNA, 22 bp, Artificial Sequence
  chemically synthesized
caccagtatttagtagttatgt

SEQ ID NO: 863487 - DNA, 22 bp, Artificial Sequence
  chemically synthesized
ccaccagtatttagtagttatg

SEQ ID NO: 863488 - DNA, 22 bp, Artificial Sequence
  chemically synthesized
gagaaacataactactaaatac

SEQ ID NO: 863489 - DNA, 22 bp, Artificial Sequence
  chemically synthesized
agaaacataactactaaatact

SEQ ID NO: 863490 - DNA, 22 bp, Artificial Sequence
  chemically synthesized
tgcacatgtatagtttccacca

SEQ ID NO: 863491 - DNA, 22 bp, Artificial Sequence
  chemically synthesized
ctaaatactggtggaaactata

SEQ ID NO: 863492 - DNA, 22 bp, Artificial Sequence
  chemically synthesized
aatactggtggaaactatacat

SEQ ID NO: 863493 - DNA, 22 bp, Artificial Sequence
  chemically synthesized
aaaactatgcacatgtatagtt

SEQ ID NO: 863494 - DNA, 22 bp, Artificial Sequence
  chemically synthesized
gtggaaactatacatgtgcata

SEQ ID NO: 863495 - DNA, 22 bp, Artificial Sequence
  chemically synthesized
ccaattcaaaactatgcacatg

SEQ ID NO: 863496 - DNA, 22 bp, Artificial Sequence
  chemically synthesized
accaattcaaaactatgcacat

SEQ ID NO: 863497 - DNA, 22 bp, Artificial Sequence
  chemically synthesized
taccaattcaaaactatgcaca

SEQ ID NO: 863498 - DNA, 22 bp, Artificial Sequence
  chemically synthesized
tacatgtgcatagttttgaatt

SEQ ID NO: 863499 - DNA, 22 bp, Artificial Sequence
  chemically synthesized
cagggcaaaaatgaagaatttt

SEQ ID NO: 863500 - DNA, 22 bp, Artificial Sequence
  chemically synthesized
acagggcaaaaatgaagaattt

SEQ ID NO: 863501 - DNA, 22 bp, Artificial Sequence
  chemically synthesized
tgaattggtaaaattcttcatt

SEQ ID NO: 863502 - DNA, 22 bp, Artificial Sequence
  chemically synthesized
gaattggtaaaattcttcattt

SEQ ID NO: 863503 - DNA, 22 bp, Artificial Sequence
  chemically synthesized
aattggtaaaattcttcatttt

SEQ ID NO: 863504 - DNA, 22 bp, Artificial Sequence
  chemically synthesized
caccatttacagggcaaaaatg

SEQ ID NO: 863505 - DNA, 22 bp, Artificial Sequence
  chemically synthesized
gtaaaattcttcatttttgccc

SEQ ID NO: 863506 - DNA, 22 bp, Artificial Sequence
  chemically synthesized
ccaccatttacagggcaaaaat

SEQ ID NO: 863507 - DNA, 22 bp, Artificial Sequence
  chemically synthesized
tccaccatttacagggcaaaaa

SEQ ID NO: 863508 - DNA, 22 bp, Artificial Sequence
  chemically synthesized
tttccaccatttacagggcaaa

SEQ ID NO: 863509 - DNA, 22 bp, Artificial Sequence
  chemically synthesized
attctttccaccatttacaggg

SEQ ID NO: 863510 - DNA, 22 bp, Artificial Sequence
  chemically synthesized
cattctttccaccatttacagg

SEQ ID NO: 863511 - DNA, 22 bp, Artificial Sequence
  chemically synthesized
ttcatttttgccctgtaaatgg

SEQ ID NO: 863512 - DNA, 22 bp, Artificial Sequence
  chemically synthesized
tcattctttccaccatttacag

SEQ ID NO: 863513 - DNA, 22 bp, Artificial Sequence
  chemically synthesized
ttcattctttccaccatttaca

SEQ ID NO: 863514 - DNA, 22 bp, Artificial Sequence
  chemically synthesized
catttttgccctgtaaatggtg

SEQ ID NO: 863515 - DNA, 22 bp, Artificial Sequence
  chemically synthesized
tttcattctttccaccatttac

SEQ ID NO: 863516 - DNA, 22 bp, Artificial Sequence
  chemically synthesized
atttttgccctgtaaatggtgg

SEQ ID NO: 863517 - DNA, 22 bp, Artificial Sequence
  chemically synthesized
ttttcattctttccaccattta

SEQ ID NO: 863518 - DNA, 22 bp, Artificial Sequence
  chemically synthesized
ttgccctgtaaatggtggaaag

SEQ ID NO: 863519 - DNA, 22 bp, Artificial Sequence
  chemically synthesized
tgccctgtaaatggtggaaaga

SEQ ID NO: 863520 - DNA, 22 bp, Artificial Sequence
  chemically synthesized
gccctgtaaatggtggaaagaa

SEQ ID NO: 863521 - DNA, 22 bp, Artificial Sequence
  chemically synthesized
ccctgtaaatggtggaaagaat

SEQ ID NO: 863522 - DNA, 22 bp, Artificial Sequence
  chemically synthesized
gtgacttttttcattctttcca

SEQ ID NO: 863523 - DNA, 22 bp, Artificial Sequence
  chemically synthesized
agtgacttttttcattctttcc

SEQ ID NO: 863524 - DNA, 22 bp, Artificial Sequence
  chemically synthesized
tagtgacttttttcattctttc

SEQ ID NO: 863525 - DNA, 22 bp, Artificial Sequence
  chemically synthesized
taaatggtggaaagaatgaaaa

SEQ ID NO: 863526 - DNA, 22 bp, Artificial Sequence
  chemically synthesized
gtacaaaagtaggaaacagagc

SEQ ID NO: 863527 - DNA, 22 bp, Artificial Sequence
  chemically synthesized
aattagtacaaaagtaggaaac

SEQ ID NO: 863528 - DNA, 22 bp, Artificial Sequence
  chemically synthesized
gaattagtacaaaagtaggaaa

SEQ ID NO: 863529 - DNA, 22 bp, Artificial Sequence
  chemically synthesized
tgaattagtacaaaagtaggaa

SEQ ID NO: 863530 - DNA, 22 bp, Artificial Sequence
  chemically synthesized
aagctctgtttcctacttttgt

SEQ ID NO: 863531 - DNA, 22 bp, Artificial Sequence
  chemically synthesized
tgtttcctacttttgtactaat

SEQ ID NO: 863532 - DNA, 22 bp, Artificial Sequence
  chemically synthesized
tttcctacttttgtactaattc

SEQ ID NO: 863533 - DNA, 22 bp, Artificial Sequence
  chemically synthesized
cctacttttgtactaattcaaa

SEQ ID NO: 863534 - DNA, 22 bp, Artificial Sequence
  chemically synthesized
ctacttttgtactaattcaaag

SEQ ID NO: 863535 - DNA, 22 bp, Artificial Sequence
  chemically synthesized
cttttgtactaattcaaaggca

SEQ ID NO: 863536 - DNA, 22 bp, Artificial Sequence
  chemically synthesized
ttgtactaattcaaaggcatga

SEQ ID NO: 863537 - DNA, 22 bp, Artificial Sequence
  chemically synthesized
agtatagcataatcatgccttt

SEQ ID NO: 863538 - DNA, 22 bp, Artificial Sequence
  chemically synthesized
tgtactaattcaaaggcatgat

SEQ ID NO: 863539 - DNA, 22 bp, Artificial Sequence
  chemically synthesized
gtactaattcaaaggcatgatt

SEQ ID NO: 863540 - DNA, 22 bp, Artificial Sequence
  chemically synthesized
tactaattcaaaggcatgatta

SEQ ID NO: 863541 - DNA, 22 bp, Artificial Sequence
  chemically synthesized
ttaagtatagcataatcatgcc

SEQ ID NO: 863542 - DNA, 22 bp, Artificial Sequence
  chemically synthesized
attcaaaggcatgattatgcta

SEQ ID NO: 863543 - DNA, 22 bp, Artificial Sequence
  chemically synthesized
aaaggcatgattatgctatact

SEQ ID NO: 863544 - DNA, 22 bp, Artificial Sequence
  chemically synthesized
agtagaaatagttattaagtat

SEQ ID NO: 863545 - DNA, 22 bp, Artificial Sequence
  chemically synthesized
aagtagaaatagttattaagta

SEQ ID NO: 863546 - DNA, 22 bp, Artificial Sequence
  chemically synthesized
taagtagaaatagttattaagt

SEQ ID NO: 863547 - DNA, 22 bp, Artificial Sequence
  chemically synthesized
ttaagtagaaatagttattaag

SEQ ID NO: 863548 - DNA, 22 bp, Artificial Sequence
  chemically synthesized
tgctatacttaataactatttc

SEQ ID NO: 863549 - DNA, 22 bp, Artificial Sequence
  chemically synthesized
acaatttttaagtagaaatagt

SEQ ID NO: 863550 - DNA, 22 bp, Artificial Sequence
  chemically synthesized
tacttaataactatttctactt

SEQ ID NO: 863551 - DNA, 22 bp, Artificial Sequence
  chemically synthesized
aataactatttctacttaaaaa

SEQ ID NO: 863552 - DNA, 22 bp, Artificial Sequence
  chemically synthesized
ataactatttctacttaaaaat

SEQ ID NO: 863553 - DNA, 22 bp, Artificial Sequence
  chemically synthesized
aaatcacaatgattaacaattt

SEQ ID NO: 863554 - DNA, 22 bp, Artificial Sequence
  chemically synthesized
tttctacttaaaaattgttaat

SEQ ID NO: 863555 - DNA, 22 bp, Artificial Sequence
  chemically synthesized
ctacttaaaaattgttaatcat

SEQ ID NO: 863556 - DNA, 22 bp, Artificial Sequence
  chemically synthesized
tacttaaaaattgttaatcatt

SEQ ID NO: 863557 - DNA, 22 bp, Artificial Sequence
  chemically synthesized
cttaaaaattgttaatcattgt

SEQ ID NO: 863558 - DNA, 22 bp, Artificial Sequence
  chemically synthesized
ggtgttaaaatcacaatgatta

SEQ ID NO: 863559 - DNA, 22 bp, Artificial Sequence
  chemically synthesized
aaaaattgttaatcattgtgat

SEQ ID NO: 863560 - DNA, 22 bp, Artificial Sequence
  chemically synthesized
aaaattgttaatcattgtgatt

SEQ ID NO: 863561 - DNA, 22 bp, Artificial Sequence
  chemically synthesized
ttaatcattgtgattttaacac

SEQ ID NO: 863562 - DNA, 22 bp, Artificial Sequence
  chemically synthesized
atcattgtgattttaacaccta

SEQ ID NO: 863563 - DNA, 22 bp, Artificial Sequence
  chemically synthesized
cacagaaaatatatacattagg

SEQ ID NO: 863564 - DNA, 22 bp, Artificial Sequence
  chemically synthesized
tgattttaacacctaatgtata

SEQ ID NO: 863565 - DNA, 22 bp, Artificial Sequence
  chemically synthesized
tattccacagaaaatatataca

SEQ ID NO: 863566 - DNA, 22 bp, Artificial Sequence
  chemically synthesized
gtattccacagaaaatatatac

SEQ ID NO: 863567 - DNA, 22 bp, Artificial Sequence
  chemically synthesized
taacacctaatgtatatatttt

SEQ ID NO: 863568 - DNA, 22 bp, Artificial Sequence
  chemically synthesized
aacacctaatgtatatattttc

SEQ ID NO: 863569 - DNA, 22 bp, Artificial Sequence
  chemically synthesized
ttgtattccacagaaaatatat

SEQ ID NO: 863570 - DNA, 22 bp, Artificial Sequence
  chemically synthesized
acacctaatgtatatattttct

SEQ ID NO: 863571 - DNA, 22 bp, Artificial Sequence
  chemically synthesized
acgttcttgtattccacagaaa

SEQ ID NO: 863572 - DNA, 22 bp, Artificial Sequence
  chemically synthesized
atgtatatattttctgtggaat

SEQ ID NO: 863573 - DNA, 22 bp, Artificial Sequence
  chemically synthesized
ttcacgttcttgtattccacag

SEQ ID NO: 863574 - DNA, 22 bp, Artificial Sequence
  chemically synthesized
tgttcacgttcttgtattccac

SEQ ID NO: 863575 - DNA, 22 bp, Artificial Sequence
  chemically synthesized
cctctgttcacgttcttgtatt

SEQ ID NO: 863576 - DNA, 22 bp, Artificial Sequence
  chemically synthesized
gcctctgttcacgttcttgtat

SEQ ID NO: 863577 - DNA, 22 bp, Artificial Sequence
  chemically synthesized
tgcctctgttcacgttcttgta

SEQ ID NO: 863578 - DNA, 22 bp, Artificial Sequence
  chemically synthesized
tttgcctctgttcacgttcttg

SEQ ID NO: 863579 - DNA, 22 bp, Artificial Sequence
  chemically synthesized
tctgtggaatacaagaacgtga

SEQ ID NO: 863580 - DNA, 22 bp, Artificial Sequence
  chemically synthesized
ctgtggaatacaagaacgtgaa

SEQ ID NO: 863581 - DNA, 22 bp, Artificial Sequence
  chemically synthesized
tgtggaatacaagaacgtgaac

SEQ ID NO: 863582 - DNA, 22 bp, Artificial Sequence
  chemically synthesized
gctctttgcctctgttcacgtt

SEQ ID NO: 863583 - DNA, 22 bp, Artificial Sequence
  chemically synthesized
tggaatacaagaacgtgaacag

SEQ ID NO: 863584 - DNA, 22 bp, Artificial Sequence
  chemically synthesized
cctagctctttgcctctgttca

SEQ ID NO: 863585 - DNA, 22 bp, Artificial Sequence
  chemically synthesized
tacctagctctttgcctctgtt

SEQ ID NO: 863586 - DNA, 22 bp, Artificial Sequence
  chemically synthesized
ctacctagctctttgcctctgt

SEQ ID NO: 863587 - DNA, 22 bp, Artificial Sequence
  chemically synthesized
tctacctagctctttgcctctg

SEQ ID NO: 863588 - DNA, 22 bp, Artificial Sequence
  chemically synthesized
gtctttctacctagctctttgc

SEQ ID NO: 863589 - DNA, 22 bp, Artificial Sequence
  chemically synthesized
gaaattggtctttctacctagc

SEQ ID NO: 863590 - DNA, 22 bp, Artificial Sequence
  chemically synthesized
ggaaattggtctttctacctag

SEQ ID NO: 863591 - DNA, 22 bp, Artificial Sequence
  chemically synthesized
tggaaattggtctttctaccta

SEQ ID NO: 863592 - DNA, 22 bp, Artificial Sequence
  chemically synthesized
tttggaaattggtctttctacc

SEQ ID NO: 863593 - DNA, 22 bp, Artificial Sequence
  chemically synthesized
tctttggaaattggtctttcta

SEQ ID NO: 863594 - DNA, 22 bp, Artificial Sequence
  chemically synthesized
ctctttggaaattggtctttct

SEQ ID NO: 863595 - DNA, 22 bp, Artificial Sequence
  chemically synthesized
tctctttggaaattggtctttc

SEQ ID NO: 863596 - DNA, 22 bp, Artificial Sequence
  chemically synthesized
ctttctctttggaaattggtct

SEQ ID NO: 863597 - DNA, 22 bp, Artificial Sequence
  chemically synthesized
ggtagaaagaccaatttccaaa

SEQ ID NO: 863598 - DNA, 22 bp, Artificial Sequence
  chemically synthesized
accctactttctctttggaaat

SEQ ID NO: 863599 - DNA, 22 bp, Artificial Sequence
  chemically synthesized
ccaaagagaaagtagggttagt

SEQ ID NO: 863600 - DNA, 22 bp, Artificial Sequence
  chemically synthesized
caaagagaaagtagggttagtt

SEQ ID NO: 863601 - DNA, 22 bp, Artificial Sequence
  chemically synthesized
aatgggaatgtgaggcccccag

SEQ ID NO: 863602 - DNA, 22 bp, Artificial Sequence
  chemically synthesized
gtttactactgggggcctcaca

SEQ ID NO: 863603 - DNA, 22 bp, Artificial Sequence
  chemically synthesized
actactgggggcctcacattcc

SEQ ID NO: 863604 - DNA, 22 bp, Artificial Sequence
  chemically synthesized
ctactgggggcctcacattccc

SEQ ID NO: 863605 - DNA, 22 bp, Artificial Sequence
  chemically synthesized
cgtcagattgaatgggaatgtg

SEQ ID NO: 863606 - DNA, 22 bp, Artificial Sequence
  chemically synthesized
acgtcagattgaatgggaatgt

SEQ ID NO: 863607 - DNA, 22 bp, Artificial Sequence
  chemically synthesized
ctgggggcctcacattcccatt

SEQ ID NO: 863608 - DNA, 22 bp, Artificial Sequence
  chemically synthesized
tacgtcagattgaatgggaatg

SEQ ID NO: 863609 - DNA, 22 bp, Artificial Sequence
  chemically synthesized
ttacgtcagattgaatgggaat

SEQ ID NO: 863610 - DNA, 22 bp, Artificial Sequence
  chemically synthesized
ggggcctcacattcccattcaa

SEQ ID NO: 863611 - DNA, 22 bp, Artificial Sequence
  chemically synthesized
cacttttacgtcagattgaatg

SEQ ID NO: 863612 - DNA, 22 bp, Artificial Sequence
  chemically synthesized
acattcccattcaatctgacgt

SEQ ID NO: 863613 - DNA, 22 bp, Artificial Sequence
  chemically synthesized
aattccacttttacgtcagatt

SEQ ID NO: 863614 - DNA, 22 bp, Artificial Sequence
  chemically synthesized
caattccacttttacgtcagat

SEQ ID NO: 863615 - DNA, 22 bp, Artificial Sequence
  chemically synthesized
ccattcaatctgacgtaaaagt

SEQ ID NO: 863616 - DNA, 22 bp, Artificial Sequence
  chemically synthesized
aatctgacgtaaaagtggaatt

SEQ ID NO: 863617 - DNA, 22 bp, Artificial Sequence
  chemically synthesized
agcccatatgcccttcaattcc

SEQ ID NO: 863618 - DNA, 22 bp, Artificial Sequence
  chemically synthesized
cagcccatatgcccttcaattc

SEQ ID NO: 863619 - DNA, 22 bp, Artificial Sequence
  chemically synthesized
acgtaaaagtggaattgaaggg

SEQ ID NO: 863620 - DNA, 22 bp, Artificial Sequence
  chemically synthesized
ataacttcagcccatatgccct

SEQ ID NO: 863621 - DNA, 22 bp, Artificial Sequence
  chemically synthesized
tgataacttcagcccatatgcc

SEQ ID NO: 863622 - DNA, 22 bp, Artificial Sequence
  chemically synthesized
aagggcatatgggctgaagtta

SEQ ID NO: 863623 - DNA, 22 bp, Artificial Sequence
  chemically synthesized
gcaatacagtctctgataactt

SEQ ID NO: 863624 - DNA, 22 bp, Artificial Sequence
  chemically synthesized
agcaatacagtctctgataact

SEQ ID NO: 863625 - DNA, 22 bp, Artificial Sequence
  chemically synthesized
tagcaatacagtctctgataac

SEQ ID NO: 863626 - DNA, 22 bp, Artificial Sequence
  chemically synthesized
tccattttagcaatacagtctc

SEQ ID NO: 863627 - DNA, 22 bp, Artificial Sequence
  chemically synthesized
aagttatcagagactgtattgc

SEQ ID NO: 863628 - DNA, 22 bp, Artificial Sequence
  chemically synthesized
tcagagactgtattgctaaaat

SEQ ID NO: 863629 - DNA, 22 bp, Artificial Sequence
  chemically synthesized
tcaataggggaagattatccat

SEQ ID NO: 863630 - DNA, 22 bp, Artificial Sequence
  chemically synthesized
tattgctaaaatggataatctt

SEQ ID NO: 863631 - DNA, 22 bp, Artificial Sequence
  chemically synthesized
ctaaaatggataatcttcccct

SEQ ID NO: 863632 - DNA, 22 bp, Artificial Sequence
  chemically synthesized
aaatggataatcttcccctatt

SEQ ID NO: 863633 - DNA, 22 bp, Artificial Sequence
  chemically synthesized
gtagccacaggcccccattgtc

SEQ ID NO: 863634 - DNA, 22 bp, Artificial Sequence
  chemically synthesized
ggtagccacaggcccccattgt

SEQ ID NO: 863635 - DNA, 22 bp, Artificial Sequence
  chemically synthesized
tggtagccacaggcccccattg

SEQ ID NO: 863636 - DNA, 22 bp, Artificial Sequence
  chemically synthesized
cccctattgacaatgggggcct

SEQ ID NO: 863637 - DNA, 22 bp, Artificial Sequence
  chemically synthesized
ccctattgacaatgggggcctg

SEQ ID NO: 863638 - DNA, 22 bp, Artificial Sequence
  chemically synthesized
attttggtagccacaggccccc

SEQ ID NO: 863639 - DNA, 22 bp, Artificial Sequence
  chemically synthesized
ttgacaatgggggcctgtggct

SEQ ID NO: 863640 - DNA, 22 bp, Artificial Sequence
  chemically synthesized
acaatgggggcctgtggctacc

SEQ ID NO: 863641 - DNA, 22 bp, Artificial Sequence
  chemically synthesized
aagtcacctaattttggtagcc

SEQ ID NO: 863642 - DNA, 22 bp, Artificial Sequence
  chemically synthesized
ttcaagtcacctaattttggta

SEQ ID NO: 863643 - DNA, 22 bp, Artificial Sequence
  chemically synthesized
tctgttcaagtcacctaatttt

SEQ ID NO: 863644 - DNA, 22 bp, Artificial Sequence
  chemically synthesized
atctgttcaagtcacctaattt

SEQ ID NO: 863645 - DNA, 22 bp, Artificial Sequence
  chemically synthesized
tatctgttcaagtcacctaatt

SEQ ID NO: 863646 - DNA, 22 bp, Artificial Sequence
  chemically synthesized
tggctaccaaaattaggtgact

SEQ ID NO: 863647 - DNA, 22 bp, Artificial Sequence
  chemically synthesized
tggttttatctgttcaagtcac

SEQ ID NO: 863648 - DNA, 22 bp, Artificial Sequence
  chemically synthesized
ccaaaattaggtgacttgaaca

SEQ ID NO: 863649 - DNA, 22 bp, Artificial Sequence
  chemically synthesized
ttatggttttatctgttcaagt

SEQ ID NO: 863650 - DNA, 22 bp, Artificial Sequence
  chemically synthesized
gttatggttttatctgttcaag

SEQ ID NO: 863651 - DNA, 22 bp, Artificial Sequence
  chemically synthesized
ggtgacttgaacagataaaacc

SEQ ID NO: 863652 - DNA, 22 bp, Artificial Sequence
  chemically synthesized
gaacagataaaaccataacaag

SEQ ID NO: 863653 - DNA, 22 bp, Artificial Sequence
  chemically synthesized
aacagataaaaccataacaagt

SEQ ID NO: 863654 - DNA, 22 bp, Artificial Sequence
  chemically synthesized
aaaatagatgcatgaaaggatc

SEQ ID NO: 863655 - DNA, 22 bp, Artificial Sequence
  chemically synthesized
gaaaatagatgcatgaaaggat

SEQ ID NO: 863656 - DNA, 22 bp, Artificial Sequence
  chemically synthesized
tgaaaatagatgcatgaaagga

SEQ ID NO: 863657 - DNA, 22 bp, Artificial Sequence
  chemically synthesized
ttgaaaatagatgcatgaaagg

SEQ ID NO: 863658 - DNA, 22 bp, Artificial Sequence
  chemically synthesized
ggatcctttcatgcatctattt

SEQ ID NO: 863659 - DNA, 22 bp, Artificial Sequence
  chemically synthesized
tcatgcatctattttcaaaaat

SEQ ID NO: 863660 - DNA, 22 bp, Artificial Sequence
  chemically synthesized
catgcatctattttcaaaaatg

SEQ ID NO: 863661 - DNA, 22 bp, Artificial Sequence
  chemically synthesized
atgcatctattttcaaaaatga

SEQ ID NO: 863662 - DNA, 22 bp, Artificial Sequence
  chemically synthesized
atcaccaaaatatcatttttga

SEQ ID NO: 863663 - DNA, 22 bp, Artificial Sequence
  chemically synthesized
actaatcaccaaaatatcattt

SEQ ID NO: 863664 - DNA, 22 bp, Artificial Sequence
  chemically synthesized
attcactaatcaccaaaatatc

SEQ ID NO: 863665 - DNA, 22 bp, Artificial Sequence
  chemically synthesized
ttttcaaaaatgatattttggt

SEQ ID NO: 863666 - DNA, 22 bp, Artificial Sequence
  chemically synthesized
tcaaaaatgatattttggtgat

SEQ ID NO: 863667 - DNA, 22 bp, Artificial Sequence
  chemically synthesized
caaaaatgatattttggtgatt

SEQ ID NO: 863668 - DNA, 22 bp, Artificial Sequence
  chemically synthesized
aaaaatgatattttggtgatta

SEQ ID NO: 863669 - DNA, 22 bp, Artificial Sequence
  chemically synthesized
tcataataataaatctgattca

SEQ ID NO: 863670 - DNA, 22 bp, Artificial Sequence
  chemically synthesized
atcataataataaatctgattc

SEQ ID NO: 863671 - DNA, 22 bp, Artificial Sequence
  chemically synthesized
tggtgattagtgaatcagattt

SEQ ID NO: 863672 - DNA, 22 bp, Artificial Sequence
  chemically synthesized
tatcataataataaatctgatt

SEQ ID NO: 863673 - DNA, 22 bp, Artificial Sequence
  chemically synthesized
ggtgattagtgaatcagattta

SEQ ID NO: 863674 - DNA, 22 bp, Artificial Sequence
  chemically synthesized
ttatcataataataaatctgat

SEQ ID NO: 863675 - DNA, 22 bp, Artificial Sequence
  chemically synthesized
gtgattagtgaatcagatttat

SEQ ID NO: 863676 - DNA, 22 bp, Artificial Sequence
  chemically synthesized
atttttatcataataataaatc

SEQ ID NO: 863677 - DNA, 22 bp, Artificial Sequence
  chemically synthesized
ctcatttttatcataataataa

SEQ ID NO: 863678 - DNA, 22 bp, Artificial Sequence
  chemically synthesized
gtgaatcagatttattattatg

SEQ ID NO: 863679 - DNA, 22 bp, Artificial Sequence
  chemically synthesized
actcatttttatcataataata

SEQ ID NO: 863680 - DNA, 22 bp, Artificial Sequence
  chemically synthesized
cttactcatttttatcataata

SEQ ID NO: 863681 - DNA, 22 bp, Artificial Sequence
  chemically synthesized
acttactcatttttatcataat

SEQ ID NO: 863682 - DNA, 22 bp, Artificial Sequence
  chemically synthesized
attattatgataaaaatgagta

SEQ ID NO: 863683 - DNA, 22 bp, Artificial Sequence
  chemically synthesized
ttattatgataaaaatgagtaa

SEQ ID NO: 863684 - DNA, 22 bp, Artificial Sequence
  chemically synthesized
taaataatttacttactcattt

SEQ ID NO: 863685 - DNA, 22 bp, Artificial Sequence
  chemically synthesized
ataaataatttacttactcatt

SEQ ID NO: 863686 - DNA, 22 bp, Artificial Sequence
  chemically synthesized
tataaataatttacttactcat

SEQ ID NO: 863687 - DNA, 22 bp, Artificial Sequence
  chemically synthesized
ttatgataaaaatgagtaagta

SEQ ID NO: 863688 - DNA, 22 bp, Artificial Sequence
  chemically synthesized
ttataaataatttacttactca

SEQ ID NO: 863689 - DNA, 22 bp, Artificial Sequence
  chemically synthesized
tgataaaaatgagtaagtaaat

SEQ ID NO: 863690 - DNA, 22 bp, Artificial Sequence
  chemically synthesized
cgtttttataaataatttactt

SEQ ID NO: 863691 - DNA, 22 bp, Artificial Sequence
  chemically synthesized
acgtttttataaataatttact

SEQ ID NO: 863692 - DNA, 22 bp, Artificial Sequence
  chemically synthesized
atagcttacgtttttataaata

SEQ ID NO: 863693 - DNA, 22 bp, Artificial Sequence
  chemically synthesized
gatagcttacgtttttataaat

SEQ ID NO: 863694 - DNA, 22 bp, Artificial Sequence
  chemically synthesized
tgatagcttacgtttttataaa

SEQ ID NO: 863695 - DNA, 22 bp, Artificial Sequence
  chemically synthesized
ttgatagcttacgtttttataa

SEQ ID NO: 863696 - DNA, 22 bp, Artificial Sequence
  chemically synthesized
agtttttgatagcttacgtttt

SEQ ID NO: 863697 - DNA, 22 bp, Artificial Sequence
  chemically synthesized
tttataaaaacgtaagctatca

SEQ ID NO: 863698 - DNA, 22 bp, Artificial Sequence
  chemically synthesized
aaaactaagtttttgatagctt

SEQ ID NO: 863699 - DNA, 22 bp, Artificial Sequence
  chemically synthesized
ataaaaacgtaagctatcaaaa

SEQ ID NO: 863700 - DNA, 22 bp, Artificial Sequence
  chemically synthesized
taaaaacgtaagctatcaaaaa

SEQ ID NO: 863701 - DNA, 22 bp, Artificial Sequence
  chemically synthesized
atggcactgaaaactaagtttt

SEQ ID NO: 863702 - DNA, 22 bp, Artificial Sequence
  chemically synthesized
catggcactgaaaactaagttt

SEQ ID NO: 863703 - DNA, 22 bp, Artificial Sequence
  chemically synthesized
tcatggcactgaaaactaagtt

SEQ ID NO: 863704 - DNA, 22 bp, Artificial Sequence
  chemically synthesized
tattttcatggcactgaaaact

SEQ ID NO: 863705 - DNA, 22 bp, Artificial Sequence
  chemically synthesized
tcaaaaacttagttttcagtgc

SEQ ID NO: 863706 - DNA, 22 bp, Artificial Sequence
  chemically synthesized
taacctatattttcatggcact

SEQ ID NO: 863707 - DNA, 22 bp, Artificial Sequence
  chemically synthesized
ctataacctatattttcatggc

SEQ ID NO: 863708 - DNA, 22 bp, Artificial Sequence
  chemically synthesized
agttttcagtgccatgaaaata

SEQ ID NO: 863709 - DNA, 22 bp, Artificial Sequence
  chemically synthesized
gttttcagtgccatgaaaatat

SEQ ID NO: 863710 - DNA, 22 bp, Artificial Sequence
  chemically synthesized
tcagtgccatgaaaatataggt

SEQ ID NO: 863711 - DNA, 22 bp, Artificial Sequence
  chemically synthesized
cagtgccatgaaaatataggtt

SEQ ID NO: 863712 - DNA, 22 bp, Artificial Sequence
  chemically synthesized
acaagttactataacctatatt

SEQ ID NO: 863713 - DNA, 22 bp, Artificial Sequence
  chemically synthesized
agtgccatgaaaatataggtta

SEQ ID NO: 863714 - DNA, 22 bp, Artificial Sequence
  chemically synthesized
cacaagttactataacctatat

SEQ ID NO: 863715 - DNA, 22 bp, Artificial Sequence
  chemically synthesized
aagatcttcacaagttactata

SEQ ID NO: 863716 - DNA, 22 bp, Artificial Sequence
  chemically synthesized
ctgaagatcttcacaagttact

SEQ ID NO: 863717 - DNA, 22 bp, Artificial Sequence
  chemically synthesized
cctgaagatcttcacaagttac

SEQ ID NO: 863718 - DNA, 22 bp, Artificial Sequence
  chemically synthesized
accttcctgaagatcttcacaa

SEQ ID NO: 863719 - DNA, 22 bp, Artificial Sequence
  chemically synthesized
tagtaacttgtgaagatcttca

SEQ ID NO: 863720 - DNA, 22 bp, Artificial Sequence
  chemically synthesized
gtgaagatcttcaggaaggtta

SEQ ID NO: 863721 - DNA, 22 bp, Artificial Sequence
  chemically synthesized
tgaagatcttcaggaaggttaa

SEQ ID NO: 863722 - DNA, 22 bp, Artificial Sequence
  chemically synthesized
gaatgtacagtataaattaacc

SEQ ID NO: 863723 - DNA, 22 bp, Artificial Sequence
  chemically synthesized
agaatgtacagtataaattaac

SEQ ID NO: 863724 - DNA, 22 bp, Artificial Sequence
  chemically synthesized
caggaaggttaatttatactgt

SEQ ID NO: 863725 - DNA, 22 bp, Artificial Sequence
  chemically synthesized
aggaaggttaatttatactgta

SEQ ID NO: 863726 - DNA, 22 bp, Artificial Sequence
  chemically synthesized
tggtttagaatgtacagtataa

SEQ ID NO: 863727 - DNA, 22 bp, Artificial Sequence
  chemically synthesized
atttatactgtacattctaaac

SEQ ID NO: 863728 - DNA, 22 bp, Artificial Sequence
  chemically synthesized
atactgtacattctaaaccata

SEQ ID NO: 863729 - DNA, 22 bp, Artificial Sequence
  chemically synthesized
tactgtacattctaaaccatag

SEQ ID NO: 863730 - DNA, 22 bp, Artificial Sequence
  chemically synthesized
ccagatgtagcatctatggttt

SEQ ID NO: 863731 - DNA, 22 bp, Artificial Sequence
  chemically synthesized
tacattctaaaccatagatgct

SEQ ID NO: 863732 - DNA, 22 bp, Artificial Sequence
  chemically synthesized
atattaccagatgtagcatcta

SEQ ID NO: 863733 - DNA, 22 bp, Artificial Sequence
  chemically synthesized
aatattaccagatgtagcatct

SEQ ID NO: 863734 - DNA, 22 bp, Artificial Sequence
  chemically synthesized
taaaccatagatgctacatctg

SEQ ID NO: 863735 - DNA, 22 bp, Artificial Sequence
  chemically synthesized
aaccatagatgctacatctggt

SEQ ID NO: 863736 - DNA, 22 bp, Artificial Sequence
  chemically synthesized
ccaacttaatattaccagatgt

SEQ ID NO: 863737 - DNA, 22 bp, Artificial Sequence
  chemically synthesized
cccaacttaatattaccagatg

SEQ ID NO: 863738 - DNA, 22 bp, Artificial Sequence
  chemically synthesized
catctggtaatattaagttggg

SEQ ID NO: 863739 - DNA, 22 bp, Artificial Sequence
  chemically synthesized
ccagataaatcccttcccaact

SEQ ID NO: 863740 - DNA, 22 bp, Artificial Sequence
  chemically synthesized
cccagataaatcccttcccaac

SEQ ID NO: 863741 - DNA, 22 bp, Artificial Sequence
  chemically synthesized
tcccagataaatcccttcccaa

SEQ ID NO: 863742 - DNA, 22 bp, Artificial Sequence
  chemically synthesized
gtaatattaagttgggaaggga

SEQ ID NO: 863743 - DNA, 22 bp, Artificial Sequence
  chemically synthesized
agttgggaagggatttatctgg

SEQ ID NO: 863744 - DNA, 22 bp, Artificial Sequence
  chemically synthesized
ggaagggatttatctgggaaaa

SEQ ID NO: 863745 - DNA, 22 bp, Artificial Sequence
  chemically synthesized
ataaatgatggtgttttcccag

SEQ ID NO: 863746 - DNA, 22 bp, Artificial Sequence
  chemically synthesized
attgataaatgatggtgttttc

SEQ ID NO: 863747 - DNA, 22 bp, Artificial Sequence
  chemically synthesized
aattgataaatgatggtgtttt

SEQ ID NO: 863748 - DNA, 22 bp, Artificial Sequence
  chemically synthesized
gtttaattgataaatgatggtg

SEQ ID NO: 863749 - DNA, 22 bp, Artificial Sequence
  chemically synthesized
atctgggaaaacaccatcattt

SEQ ID NO: 863750 - DNA, 22 bp, Artificial Sequence
  chemically synthesized
ggtttaattgataaatgatggt

SEQ ID NO: 863751 - DNA, 22 bp, Artificial Sequence
  chemically synthesized
tctgggaaaacaccatcattta

SEQ ID NO: 863752 - DNA, 22 bp, Artificial Sequence
  chemically synthesized
ccttggtttaattgataaatga

SEQ ID NO: 863753 - DNA, 22 bp, Artificial Sequence
  chemically synthesized
ggaaaacaccatcatttatcaa

SEQ ID NO: 863754 - DNA, 22 bp, Artificial Sequence
  chemically synthesized
tgccttggtttaattgataaat

SEQ ID NO: 863755 - DNA, 22 bp, Artificial Sequence
  chemically synthesized
ctgccttggtttaattgataaa

SEQ ID NO: 863756 - DNA, 22 bp, Artificial Sequence
  chemically synthesized
tctgccttggtttaattgataa

SEQ ID NO: 863757 - DNA, 22 bp, Artificial Sequence
  chemically synthesized
ttctgccttggtttaattgata

SEQ ID NO: 863758 - DNA, 22 bp, Artificial Sequence
  chemically synthesized
aaccttttctgccttggtttaa

SEQ ID NO: 863759 - DNA, 22 bp, Artificial Sequence
  chemically synthesized
ttcaaccttttctgccttggtt

SEQ ID NO: 863760 - DNA, 22 bp, Artificial Sequence
  chemically synthesized
atcaattaaaccaaggcagaaa

SEQ ID NO: 863761 - DNA, 22 bp, Artificial Sequence
  chemically synthesized
tcaattaaaccaaggcagaaaa

SEQ ID NO: 863762 - DNA, 22 bp, Artificial Sequence
  chemically synthesized
ggcaaactattcaaccttttct

SEQ ID NO: 863763 - DNA, 22 bp, Artificial Sequence
  chemically synthesized
gggcaaactattcaaccttttc

SEQ ID NO: 863764 - DNA, 22 bp, Artificial Sequence
  chemically synthesized
tgggcaaactattcaacctttt

SEQ ID NO: 863765 - DNA, 22 bp, Artificial Sequence
  chemically synthesized
aaccaaggcagaaaaggttgaa

SEQ ID NO: 863766 - DNA, 22 bp, Artificial Sequence
  chemically synthesized
ggggttttgggcaaactattca

SEQ ID NO: 863767 - DNA, 22 bp, Artificial Sequence
  chemically synthesized
gggggttttgggcaaactattc

SEQ ID NO: 863768 - DNA, 22 bp, Artificial Sequence
  chemically synthesized
tggtttgggggttttgggcaaa

SEQ ID NO: 863769 - DNA, 22 bp, Artificial Sequence
  chemically synthesized
gctatggtttgggggttttggg

SEQ ID NO: 863770 - DNA, 22 bp, Artificial Sequence
  chemically synthesized
aatagtttgcccaaaaccccca

SEQ ID NO: 863771 - DNA, 22 bp, Artificial Sequence
  chemically synthesized
ttggctatggtttgggggtttt

SEQ ID NO: 863772 - DNA, 22 bp, Artificial Sequence
  chemically synthesized
gttggctatggtttgggggttt

SEQ ID NO: 863773 - DNA, 22 bp, Artificial Sequence
  chemically synthesized
ttgttggctatggtttgggggt

SEQ ID NO: 863774 - DNA, 22 bp, Artificial Sequence
  chemically synthesized
gcccaaaacccccaaaccatag

SEQ ID NO: 863775 - DNA, 22 bp, Artificial Sequence
  chemically synthesized
atctcttgttggctatggtttg

SEQ ID NO: 863776 - DNA, 22 bp, Artificial Sequence
  chemically synthesized
cccaaaacccccaaaccatagc

SEQ ID NO: 863777 - DNA, 22 bp, Artificial Sequence
  chemically synthesized
gatctcttgttggctatggttt

SEQ ID NO: 863778 - DNA, 22 bp, Artificial Sequence
  chemically synthesized
atttgatctcttgttggctatg

SEQ ID NO: 863779 - DNA, 22 bp, Artificial Sequence
  chemically synthesized
gtcctcatttgatctcttgttg

SEQ ID NO: 863780 - DNA, 22 bp, Artificial Sequence
  chemically synthesized
ggatctagtcctcatttgatct

SEQ ID NO: 863781 - DNA, 22 bp, Artificial Sequence
  chemically synthesized
ataaacctgggatctagtcctc

SEQ ID NO: 863782 - DNA, 22 bp, Artificial Sequence
  chemically synthesized
ggaattaataaacctgggatct

SEQ ID NO: 863783 - DNA, 22 bp, Artificial Sequence
  chemically synthesized
gattgggaattaataaacctgg

SEQ ID NO: 863784 - DNA, 22 bp, Artificial Sequence
  chemically synthesized
gatcccaggtttattaattccc

SEQ ID NO: 863785 - DNA, 22 bp, Artificial Sequence
  chemically synthesized
aaagatcactggattgggaatt

SEQ ID NO: 863786 - DNA, 22 bp, Artificial Sequence
  chemically synthesized
ttaaaagatcactggattggga

SEQ ID NO: 863787 - DNA, 22 bp, Artificial Sequence
  chemically synthesized
attaattcccaatccagtgatc

SEQ ID NO: 863788 - DNA, 22 bp, Artificial Sequence
  chemically synthesized
ttaattcccaatccagtgatct

SEQ ID NO: 863789 - DNA, 22 bp, Artificial Sequence
  chemically synthesized
attcccaatccagtgatctttt

SEQ ID NO: 863790 - DNA, 22 bp, Artificial Sequence
  chemically synthesized
ccaatccagtgatcttttaaca

SEQ ID NO: 863791 - DNA, 22 bp, Artificial Sequence
  chemically synthesized
taaaccaggcactgttaaaaga

SEQ ID NO: 863792 - DNA, 22 bp, Artificial Sequence
  chemically synthesized
atgatattgtaaaccaggcact

SEQ ID NO: 863793 - DNA, 22 bp, Artificial Sequence
  chemically synthesized
ttaacagtgcctggtttacaat

SEQ ID NO: 863794 - DNA, 22 bp, Artificial Sequence
  chemically synthesized
taacagtgcctggtttacaata

SEQ ID NO: 863795 - DNA, 22 bp, Artificial Sequence
  chemically synthesized
aacagtgcctggtttacaatat

SEQ ID NO: 863796 - DNA, 22 bp, Artificial Sequence
  chemically synthesized
acagtgcctggtttacaatatc

SEQ ID NO: 863797 - DNA, 22 bp, Artificial Sequence
  chemically synthesized
agaagcatgctcatgatattgt

SEQ ID NO: 863798 - DNA, 22 bp, Artificial Sequence
  chemically synthesized
cagaagcatgctcatgatattg

SEQ ID NO: 863799 - DNA, 22 bp, Artificial Sequence
  chemically synthesized
atatttcagaagcatgctcatg

SEQ ID NO: 863800 - DNA, 22 bp, Artificial Sequence
  chemically synthesized
gtttacaatatcatgagcatgc

SEQ ID NO: 863801 - DNA, 22 bp, Artificial Sequence
  chemically synthesized
aatatttcagaagcatgctcat

SEQ ID NO: 863802 - DNA, 22 bp, Artificial Sequence
  chemically synthesized
taatatttcagaagcatgctca

SEQ ID NO: 863803 - DNA, 22 bp, Artificial Sequence
  chemically synthesized
ttaatatttcagaagcatgctc

SEQ ID NO: 863804 - DNA, 22 bp, Artificial Sequence
  chemically synthesized
acaatatcatgagcatgcttct

SEQ ID NO: 863805 - DNA, 22 bp, Artificial Sequence
  chemically synthesized
caatatcatgagcatgcttctg

SEQ ID NO: 863806 - DNA, 22 bp, Artificial Sequence
  chemically synthesized
tatagagacgtaacatttttaa

SEQ ID NO: 863807 - DNA, 22 bp, Artificial Sequence
  chemically synthesized
ttatatagagacgtaacatttt

SEQ ID NO: 863808 - DNA, 22 bp, Artificial Sequence
  chemically synthesized
ctgaaatattaaaaatgttacg

SEQ ID NO: 863809 - DNA, 22 bp, Artificial Sequence
  chemically synthesized
tgaaatattaaaaatgttacgt

SEQ ID NO: 863810 - DNA, 22 bp, Artificial Sequence
  chemically synthesized
aaatattaaaaatgttacgtct

SEQ ID NO: 863811 - DNA, 22 bp, Artificial Sequence
  chemically synthesized
aaaatgttacgtctctatataa

SEQ ID NO: 863812 - DNA, 22 bp, Artificial Sequence
  chemically synthesized
gatataaagttattatatagag

SEQ ID NO: 863813 - DNA, 22 bp, Artificial Sequence
  chemically synthesized
cgtctctatataataactttat

SEQ ID NO: 863814 - DNA, 22 bp, Artificial Sequence
  chemically synthesized
cgcatgctagatataaagttat

SEQ ID NO: 863815 - DNA, 22 bp, Artificial Sequence
  chemically synthesized
tatataataactttatatctag

SEQ ID NO: 863816 - DNA, 22 bp, Artificial Sequence
  chemically synthesized
aatctacgcatgctagatataa

SEQ ID NO: 863817 - DNA, 22 bp, Artificial Sequence
  chemically synthesized
tataataactttatatctagca

SEQ ID NO: 863818 - DNA, 22 bp, Artificial Sequence
  chemically synthesized
tcaatctacgcatgctagatat

SEQ ID NO: 863819 - DNA, 22 bp, Artificial Sequence
  chemically synthesized
ctcaatctacgcatgctagata

SEQ ID NO: 863820 - DNA, 22 bp, Artificial Sequence
  chemically synthesized
tctcaatctacgcatgctagat

SEQ ID NO: 863821 - DNA, 22 bp, Artificial Sequence
  chemically synthesized
ttctcaatctacgcatgctaga

SEQ ID NO: 863822 - DNA, 22 bp, Artificial Sequence
  chemically synthesized
tttttctcaatctacgcatgct

SEQ ID NO: 863823 - DNA, 22 bp, Artificial Sequence
  chemically synthesized
tatatctagcatgcgtagattg

SEQ ID NO: 863824 - DNA, 22 bp, Artificial Sequence
  chemically synthesized
atatctagcatgcgtagattga

SEQ ID NO: 863825 - DNA, 22 bp, Artificial Sequence
  chemically synthesized
tcactatttttctcaatctacg

SEQ ID NO: 863826 - DNA, 22 bp, Artificial Sequence
  chemically synthesized
tatctagcatgcgtagattgag

SEQ ID NO: 863827 - DNA, 22 bp, Artificial Sequence
  chemically synthesized
gtcactatttttctcaatctac

SEQ ID NO: 863828 - DNA, 22 bp, Artificial Sequence
  chemically synthesized
tgtcactatttttctcaatcta

SEQ ID NO: 863829 - DNA, 22 bp, Artificial Sequence
  chemically synthesized
attttgtcactatttttctcaa

SEQ ID NO: 863830 - DNA, 22 bp, Artificial Sequence
  chemically synthesized
gcatgcgtagattgagaaaaat

SEQ ID NO: 863831 - DNA, 22 bp, Artificial Sequence
  chemically synthesized
agaataagttgattttgtcact

SEQ ID NO: 863832 - DNA, 22 bp, Artificial Sequence
  chemically synthesized
agaaaaatagtgacaaaatcaa

SEQ ID NO: 863833 - DNA, 22 bp, Artificial Sequence
  chemically synthesized
aattcagaataagttgattttg

SEQ ID NO: 863834 - DNA, 22 bp, Artificial Sequence
  chemically synthesized
ctgaattcagaataagttgatt

SEQ ID NO: 863835 - DNA, 22 bp, Artificial Sequence
  chemically synthesized
caatattactgaattcagaata

SEQ ID NO: 863836 - DNA, 22 bp, Artificial Sequence
  chemically synthesized
tattacaatattactgaattca

SEQ ID NO: 863837 - DNA, 22 bp, Artificial Sequence
  chemically synthesized
attctgaattcagtaatattgt

SEQ ID NO: 863838 - DNA, 22 bp, Artificial Sequence
  chemically synthesized
ttctgaattcagtaatattgta

SEQ ID NO: 863839 - DNA, 22 bp, Artificial Sequence
  chemically synthesized
tgaattcagtaatattgtaata

SEQ ID NO: 863840 - DNA, 22 bp, Artificial Sequence
  chemically synthesized
aattcagtaatattgtaatata

SEQ ID NO: 863841 - DNA, 22 bp, Artificial Sequence
  chemically synthesized
ataaatgcaaaattatattaca

SEQ ID NO: 863842 - DNA, 22 bp, Artificial Sequence
  chemically synthesized
agtaatattgtaatataatttt

SEQ ID NO: 863843 - DNA, 22 bp, Artificial Sequence
  chemically synthesized
caattaataaatgcaaaattat

SEQ ID NO: 863844 - DNA, 22 bp, Artificial Sequence
  chemically synthesized
ctgcaattaataaatgcaaaat

SEQ ID NO: 863845 - DNA, 22 bp, Artificial Sequence
  chemically synthesized
taatataattttgcatttatta

SEQ ID NO: 863846 - DNA, 22 bp, Artificial Sequence
  chemically synthesized
tgcatttattaattgcagtagc

SEQ ID NO: 863847 - DNA, 22 bp, Artificial Sequence
  chemically synthesized
agtgatgtagatgctactgcaa

SEQ ID NO: 863848 - DNA, 22 bp, Artificial Sequence
  chemically synthesized
gcatttattaattgcagtagca

SEQ ID NO: 863849 - DNA, 22 bp, Artificial Sequence
  chemically synthesized
aagtgatgtagatgctactgca

SEQ ID NO: 863850 - DNA, 22 bp, Artificial Sequence
  chemically synthesized
catttattaattgcagtagcat

SEQ ID NO: 863851 - DNA, 22 bp, Artificial Sequence
  chemically synthesized
taagtgatgtagatgctactgc

SEQ ID NO: 863852 - DNA, 22 bp, Artificial Sequence
  chemically synthesized
ttaagtgatgtagatgctactg

SEQ ID NO: 863853 - DNA, 22 bp, Artificial Sequence
  chemically synthesized
tttaagtgatgtagatgctact

SEQ ID NO: 863854 - DNA, 22 bp, Artificial Sequence
  chemically synthesized
attaattgcagtagcatctaca

SEQ ID NO: 863855 - DNA, 22 bp, Artificial Sequence
  chemically synthesized
ttaattgcagtagcatctacat

SEQ ID NO: 863856 - DNA, 22 bp, Artificial Sequence
  chemically synthesized
attgcagtagcatctacatcac

SEQ ID NO: 863857 - DNA, 22 bp, Artificial Sequence
  chemically synthesized
cagtagcatctacatcacttaa

SEQ ID NO: 863858 - DNA, 22 bp, Artificial Sequence
  chemically synthesized
catcacttaaaaaatgtctact

SEQ ID NO: 863859 - DNA, 22 bp, Artificial Sequence
  chemically synthesized
cccacaaacatgtagtagacat

SEQ ID NO: 863860 - DNA, 22 bp, Artificial Sequence
  chemically synthesized
aaaaaatgtctactacatgttt

SEQ ID NO: 863861 - DNA, 22 bp, Artificial Sequence
  chemically synthesized
aaaaatgtctactacatgtttg

SEQ ID NO: 863862 - DNA, 22 bp, Artificial Sequence
  chemically synthesized
ctacatgtttgtgggtaatgca

SEQ ID NO: 863863 - DNA, 22 bp, Artificial Sequence
  chemically synthesized
catgtttgtgggtaatgcatca

SEQ ID NO: 863864 - DNA, 22 bp, Artificial Sequence
  chemically synthesized
tgaatcaaaggagtgatgcatt

SEQ ID NO: 863865 - DNA, 22 bp, Artificial Sequence
  chemically synthesized
tctgtgaatcaaaggagtgatg

SEQ ID NO: 863866 - DNA, 22 bp, Artificial Sequence
  chemically synthesized
gtgggtaatgcatcactccttt

SEQ ID NO: 863867 - DNA, 22 bp, Artificial Sequence
  chemically synthesized
tgggtaatgcatcactcctttg

SEQ ID NO: 863868 - DNA, 22 bp, Artificial Sequence
  chemically synthesized
aagtgttgtctgtgaatcaaag

SEQ ID NO: 863869 - DNA, 22 bp, Artificial Sequence
  chemically synthesized
ctttgattcacagacaacactt

SEQ ID NO: 863870 - DNA, 22 bp, Artificial Sequence
  chemically synthesized
tgattcacagacaacacttgag

SEQ ID NO: 863871 - DNA, 22 bp, Artificial Sequence
  chemically synthesized
gattcacagacaacacttgagg

SEQ ID NO: 863872 - DNA, 22 bp, Artificial Sequence
  chemically synthesized
attcacagacaacacttgaggt

SEQ ID NO: 863873 - DNA, 22 bp, Artificial Sequence
  chemically synthesized
aaatccacaaccacctcaagtg

SEQ ID NO: 863874 - DNA, 22 bp, Artificial Sequence
  chemically synthesized
tcaaatccacaaccacctcaag

SEQ ID NO: 863875 - DNA, 22 bp, Artificial Sequence
  chemically synthesized
acagacaacacttgaggtggtt

SEQ ID NO: 863876 - DNA, 22 bp, Artificial Sequence
  chemically synthesized
aaagaaattctcaaatccacaa

SEQ ID NO: 863877 - DNA, 22 bp, Artificial Sequence
  chemically synthesized
gaggtggttgtggatttgagaa

SEQ ID NO: 863878 - DNA, 22 bp, Artificial Sequence
  chemically synthesized
aggtggttgtggatttgagaat

SEQ ID NO: 863879 - DNA, 22 bp, Artificial Sequence
  chemically synthesized
ccaggaccattgaaagaaattc

SEQ ID NO: 863880 - DNA, 22 bp, Artificial Sequence
  chemically synthesized
cccaggaccattgaaagaaatt

SEQ ID NO: 863881 - DNA, 22 bp, Artificial Sequence
  chemically synthesized
tggatttgagaatttctttcaa

SEQ ID NO: 863882 - DNA, 22 bp, Artificial Sequence
  chemically synthesized
aaatttcccaggaccattgaaa

SEQ ID NO: 863883 - DNA, 22 bp, Artificial Sequence
  chemically synthesized
gagaatttctttcaatggtcct

SEQ ID NO: 863884 - DNA, 22 bp, Artificial Sequence
  chemically synthesized
agaatttctttcaatggtcctg

SEQ ID NO: 863885 - DNA, 22 bp, Artificial Sequence
  chemically synthesized
gatatagctaaaatttcccagg

SEQ ID NO: 863886 - DNA, 22 bp, Artificial Sequence
  chemically synthesized
ctttcaatggtcctgggaaatt

SEQ ID NO: 863887 - DNA, 22 bp, Artificial Sequence
  chemically synthesized
tttcaatggtcctgggaaattt

SEQ ID NO: 863888 - DNA, 22 bp, Artificial Sequence
  chemically synthesized
tcaatggtcctgggaaatttta

SEQ ID NO: 863889 - DNA, 22 bp, Artificial Sequence
  chemically synthesized
caatggtcctgggaaattttag

SEQ ID NO: 863890 - DNA, 22 bp, Artificial Sequence
  chemically synthesized
aatggtcctgggaaattttagc

SEQ ID NO: 863891 - DNA, 22 bp, Artificial Sequence
  chemically synthesized
tgtgctggatatagctaaaatt

SEQ ID NO: 863892 - DNA, 22 bp, Artificial Sequence
  chemically synthesized
aacctgtgtgctggatatagct

SEQ ID NO: 863893 - DNA, 22 bp, Artificial Sequence
  chemically synthesized
tcaacctgtgtgctggatatag

SEQ ID NO: 863894 - DNA, 22 bp, Artificial Sequence
  chemically synthesized
ggaaattttagctatatccagc

SEQ ID NO: 863895 - DNA, 22 bp, Artificial Sequence
  chemically synthesized
tagctatatccagcacacaggt

SEQ ID NO: 863896 - DNA, 22 bp, Artificial Sequence
  chemically synthesized
tagaagttctcaacctgtgtgc

SEQ ID NO: 863897 - DNA, 22 bp, Artificial Sequence
  chemically synthesized
agctatatccagcacacaggtt

SEQ ID NO: 863898 - DNA, 22 bp, Artificial Sequence
  chemically synthesized
gctatatccagcacacaggttg

SEQ ID NO: 863899 - DNA, 22 bp, Artificial Sequence
  chemically synthesized
tatccagcacacaggttgagaa

SEQ ID NO: 863900 - DNA, 22 bp, Artificial Sequence
  chemically synthesized
caaggcagagaccaacattata

SEQ ID NO: 863901 - DNA, 22 bp, Artificial Sequence
  chemically synthesized
agaacttctataatgttggtct

SEQ ID NO: 863902 - DNA, 22 bp, Artificial Sequence
  chemically synthesized
ctataatgttggtctctgcctt

SEQ ID NO: 863903 - DNA, 22 bp, Artificial Sequence
  chemically synthesized
tataatgttggtctctgccttg

SEQ ID NO: 863904 - DNA, 22 bp, Artificial Sequence
  chemically synthesized
agagtaatgttgcaaggcagag

SEQ ID NO: 863905 - DNA, 22 bp, Artificial Sequence
  chemically synthesized
taatgttggtctctgccttgca

SEQ ID NO: 863906 - DNA, 22 bp, Artificial Sequence
  chemically synthesized
gttaagagtaatgttgcaaggc

SEQ ID NO: 863907 - DNA, 22 bp, Artificial Sequence
  chemically synthesized
ggttaagagtaatgttgcaagg

SEQ ID NO: 863908 - DNA, 22 bp, Artificial Sequence
  chemically synthesized
gtctctgccttgcaacattact

SEQ ID NO: 863909 - DNA, 22 bp, Artificial Sequence
  chemically synthesized
aagatatttggttaagagtaat

SEQ ID NO: 863910 - DNA, 22 bp, Artificial Sequence
  chemically synthesized
tgccttgcaacattactcttaa

SEQ ID NO: 863911 - DNA, 22 bp, Artificial Sequence
  chemically synthesized
aaagatatttggttaagagtaa

SEQ ID NO: 863912 - DNA, 22 bp, Artificial Sequence
  chemically synthesized
taaagatatttggttaagagta

SEQ ID NO: 863913 - DNA, 22 bp, Artificial Sequence
  chemically synthesized
ccttgcaacattactcttaacc

SEQ ID NO: 863914 - DNA, 22 bp, Artificial Sequence
  chemically synthesized
ttaaagatatttggttaagagt

SEQ ID NO: 863915 - DNA, 22 bp, Artificial Sequence
  chemically synthesized
gcaacattactcttaaccaaat

SEQ ID NO: 863916 - DNA, 22 bp, Artificial Sequence
  chemically synthesized
caacattactcttaaccaaata

SEQ ID NO: 863917 - DNA, 22 bp, Artificial Sequence
  chemically synthesized
ctcttaaccaaatatctttaaa

SEQ ID NO: 863918 - DNA, 22 bp, Artificial Sequence
  chemically synthesized
ttaaccaaatatctttaaaagt

SEQ ID NO: 863919 - DNA, 22 bp, Artificial Sequence
  chemically synthesized
aaccaaatatctttaaaagtcg

SEQ ID NO: 863920 - DNA, 22 bp, Artificial Sequence
  chemically synthesized
accaaatatctttaaaagtcgt

SEQ ID NO: 863921 - DNA, 22 bp, Artificial Sequence
  chemically synthesized
agagtaaagagtacgactttta

SEQ ID NO: 863922 - DNA, 22 bp, Artificial Sequence
  chemically synthesized
taagagtaaagagtacgacttt

SEQ ID NO: 863923 - DNA, 22 bp, Artificial Sequence
  chemically synthesized
taaaagtcgtactctttactct

SEQ ID NO: 863924 - DNA, 22 bp, Artificial Sequence
  chemically synthesized
aaatcaactctaagagtaaaga

SEQ ID NO: 863925 - DNA, 22 bp, Artificial Sequence
  chemically synthesized
aaaagtcgtactctttactctt

SEQ ID NO: 863926 - DNA, 22 bp, Artificial Sequence
  chemically synthesized
aaagtcgtactctttactctta

SEQ ID NO: 863927 - DNA, 22 bp, Artificial Sequence
  chemically synthesized
tttactcttagagttgatttca

SEQ ID NO: 863928 - DNA, 22 bp, Artificial Sequence
  chemically synthesized
gcaacaatgaaactgaaatcaa

SEQ ID NO: 863929 - DNA, 22 bp, Artificial Sequence
  chemically synthesized
tactcttagagttgatttcagt

SEQ ID NO: 863930 - DNA, 22 bp, Artificial Sequence
  chemically synthesized
ggcaacaatgaaactgaaatca

SEQ ID NO: 863931 - DNA, 22 bp, Artificial Sequence
  chemically synthesized
actcttagagttgatttcagtt

SEQ ID NO: 863932 - DNA, 22 bp, Artificial Sequence
  chemically synthesized
ctcttagagttgatttcagttt

SEQ ID NO: 863933 - DNA, 22 bp, Artificial Sequence
  chemically synthesized
tttggcaacaatgaaactgaaa

SEQ ID NO: 863934 - DNA, 22 bp, Artificial Sequence
  chemically synthesized
ttagagttgatttcagtttcat

SEQ ID NO: 863935 - DNA, 22 bp, Artificial Sequence
  chemically synthesized
agagttgatttcagtttcattg

SEQ ID NO: 863936 - DNA, 22 bp, Artificial Sequence
  chemically synthesized
gagttgatttcagtttcattgt

SEQ ID NO: 863937 - DNA, 22 bp, Artificial Sequence
  chemically synthesized
atttcagtttcattgttgccaa

SEQ ID NO: 863938 - DNA, 22 bp, Artificial Sequence
  chemically synthesized
agatatcattgtttggcaacaa

SEQ ID NO: 863939 - DNA, 22 bp, Artificial Sequence
  chemically synthesized
cagtttcattgttgccaaacaa

SEQ ID NO: 863940 - DNA, 22 bp, Artificial Sequence
  chemically synthesized
agtttcattgttgccaaacaat

SEQ ID NO: 863941 - DNA, 22 bp, Artificial Sequence
  chemically synthesized
cattgttgccaaacaatgatat

SEQ ID NO: 863942 - DNA, 22 bp, Artificial Sequence
  chemically synthesized
attgttgccaaacaatgatatc

SEQ ID NO: 863943 - DNA, 22 bp, Artificial Sequence
  chemically synthesized
tcaaatgattgagatatcattg

SEQ ID NO: 863944 - DNA, 22 bp, Artificial Sequence
  chemically synthesized
ttgccaaacaatgatatctcaa

SEQ ID NO: 863945 - DNA, 22 bp, Artificial Sequence
  chemically synthesized
ccaaacaatgatatctcaatca

SEQ ID NO: 863946 - DNA, 22 bp, Artificial Sequence
  chemically synthesized
tgccacaacccattgtcaaatg

SEQ ID NO: 863947 - DNA, 22 bp, Artificial Sequence
  chemically synthesized
tatctatgccacaacccattgt

SEQ ID NO: 863948 - DNA, 22 bp, Artificial Sequence
  chemically synthesized
atatctatgccacaacccattg

SEQ ID NO: 863949 - DNA, 22 bp, Artificial Sequence
  chemically synthesized
tatatctatgccacaacccatt

SEQ ID NO: 863950 - DNA, 22 bp, Artificial Sequence
  chemically synthesized
aatcatttgacaatgggttgtg

SEQ ID NO: 863951 - DNA, 22 bp, Artificial Sequence
  chemically synthesized
gatattttatatctatgccaca

SEQ ID NO: 863952 - DNA, 22 bp, Artificial Sequence
  chemically synthesized
ggatattttatatctatgccac

SEQ ID NO: 863953 - DNA, 22 bp, Artificial Sequence
  chemically synthesized
gacaatgggttgtggcatagat

SEQ ID NO: 863954 - DNA, 22 bp, Artificial Sequence
  chemically synthesized
acaatgggttgtggcatagata

SEQ ID NO: 863955 - DNA, 22 bp, Artificial Sequence
  chemically synthesized
gacaatttggatattttatatc

SEQ ID NO: 863956 - DNA, 22 bp, Artificial Sequence
  chemically synthesized
agacaatttggatattttatat

SEQ ID NO: 863957 - DNA, 22 bp, Artificial Sequence
  chemically synthesized
tggcatagatataaaatatcca

SEQ ID NO: 863958 - DNA, 22 bp, Artificial Sequence
  chemically synthesized
taaaaaaatataaaaatattta

SEQ ID NO: 863959 - DNA, 22 bp, Artificial Sequence
  chemically synthesized
ataaaaaaatataaaaatattt

SEQ ID NO: 863960 - DNA, 22 bp, Artificial Sequence
  chemically synthesized
atttataaaaaaatataaaaat

SEQ ID NO: 863961 - DNA, 22 bp, Artificial Sequence
  chemically synthesized
taatttataaaaaaatataaaa

SEQ ID NO: 863962 - DNA, 22 bp, Artificial Sequence
  chemically synthesized
tctaaatatttttatatttttt

SEQ ID NO: 863963 - DNA, 22 bp, Artificial Sequence
  chemically synthesized
gttctaatttataaaaaaatat

SEQ ID NO: 863964 - DNA, 22 bp, Artificial Sequence
  chemically synthesized
aatatttttatatttttttata

SEQ ID NO: 863965 - DNA, 22 bp, Artificial Sequence
  chemically synthesized
gttggttctaatttataaaaaa

SEQ ID NO: 863966 - DNA, 22 bp, Artificial Sequence
  chemically synthesized
agttggttctaatttataaaaa

SEQ ID NO: 863967 - DNA, 22 bp, Artificial Sequence
  chemically synthesized
tagttggttctaatttataaaa

SEQ ID NO: 863968 - DNA, 22 bp, Artificial Sequence
  chemically synthesized
ttatatttttttataaattaga

SEQ ID NO: 863969 - DNA, 22 bp, Artificial Sequence
  chemically synthesized
tatatttttttataaattagaa

SEQ ID NO: 863970 - DNA, 22 bp, Artificial Sequence
  chemically synthesized
atatttttttataaattagaac

SEQ ID NO: 863971 - DNA, 22 bp, Artificial Sequence
  chemically synthesized
tatttttttataaattagaacc

SEQ ID NO: 863972 - DNA, 22 bp, Artificial Sequence
  chemically synthesized
acaacctttagttggttctaat

SEQ ID NO: 863973 - DNA, 22 bp, Artificial Sequence
  chemically synthesized
ttttataaattagaaccaacta

SEQ ID NO: 863974 - DNA, 22 bp, Artificial Sequence
  chemically synthesized
tttataaattagaaccaactaa

SEQ ID NO: 863975 - DNA, 22 bp, Artificial Sequence
  chemically synthesized
tattgacaacctttagttggtt

SEQ ID NO: 863976 - DNA, 22 bp, Artificial Sequence
  chemically synthesized
ttataaattagaaccaactaaa

SEQ ID NO: 863977 - DNA, 22 bp, Artificial Sequence
  chemically synthesized
atattgacaacctttagttggt

SEQ ID NO: 863978 - DNA, 22 bp, Artificial Sequence
  chemically synthesized
tataaattagaaccaactaaag

SEQ ID NO: 863979 - DNA, 22 bp, Artificial Sequence
  chemically synthesized
ataaattagaaccaactaaagg

SEQ ID NO: 863980 - DNA, 22 bp, Artificial Sequence
  chemically synthesized
ttatattgacaacctttagttg

SEQ ID NO: 863981 - DNA, 22 bp, Artificial Sequence
  chemically synthesized
taaattagaaccaactaaaggt

SEQ ID NO: 863982 - DNA, 22 bp, Artificial Sequence
  chemically synthesized
gaaccaactaaaggttgtcaat

SEQ ID NO: 863983 - DNA, 22 bp, Artificial Sequence
  chemically synthesized
gaatgcgagagtactcttatat

SEQ ID NO: 863984 - DNA, 22 bp, Artificial Sequence
  chemically synthesized
ggaatgcgagagtactcttata

SEQ ID NO: 863985 - DNA, 22 bp, Artificial Sequence
  chemically synthesized
aaggttgtcaatataagagtac

SEQ ID NO: 863986 - DNA, 22 bp, Artificial Sequence
  chemically synthesized
tggaatgcgagagtactcttat

SEQ ID NO: 863987 - DNA, 22 bp, Artificial Sequence
  chemically synthesized
tcaatataagagtactctcgca

SEQ ID NO: 863988 - DNA, 22 bp, Artificial Sequence
  chemically synthesized
agaaaagcactttggaatgcga

SEQ ID NO: 863989 - DNA, 22 bp, Artificial Sequence
  chemically synthesized
actcagaaaagcactttggaat

SEQ ID NO: 863990 - DNA, 22 bp, Artificial Sequence
  chemically synthesized
tcactcagaaaagcactttgga

SEQ ID NO: 863991 - DNA, 22 bp, Artificial Sequence
  chemically synthesized
tctcactcagaaaagcactttg

SEQ ID NO: 863992 - DNA, 22 bp, Artificial Sequence
  chemically synthesized
tcgcattccaaagtgcttttct

SEQ ID NO: 863993 - DNA, 22 bp, Artificial Sequence
  chemically synthesized
gcattccaaagtgcttttctga

SEQ ID NO: 863994 - DNA, 22 bp, Artificial Sequence
  chemically synthesized
tgcaccctctctcactcagaaa

SEQ ID NO: 863995 - DNA, 22 bp, Artificial Sequence
  chemically synthesized
caaagtgcttttctgagtgaga

SEQ ID NO: 863996 - DNA, 22 bp, Artificial Sequence
  chemically synthesized
actgtgcaccctctctcactca

SEQ ID NO: 863997 - DNA, 22 bp, Artificial Sequence
  chemically synthesized
tgactgtgcaccctctctcact

SEQ ID NO: 863998 - DNA, 22 bp, Artificial Sequence
  chemically synthesized
gttctgactgtgcaccctctct

SEQ ID NO: 863999 - DNA, 22 bp, Artificial Sequence
  chemically synthesized
ttctgagtgagagagggtgcac

SEQ ID NO: 864000 - DNA, 22 bp, Artificial Sequence
  chemically synthesized
tctgagtgagagagggtgcaca

SEQ ID NO: 864001 - DNA, 22 bp, Artificial Sequence
  chemically synthesized
ctgagtgagagagggtgcacag

SEQ ID NO: 864002 - DNA, 22 bp, Artificial Sequence
  chemically synthesized
tgagtgagagagggtgcacagt

SEQ ID NO: 864003 - DNA, 22 bp, Artificial Sequence
  chemically synthesized
agtgagagagggtgcacagtca

SEQ ID NO: 864004 - DNA, 22 bp, Artificial Sequence
  chemically synthesized
aagcacactagttctgactgtg

SEQ ID NO: 864005 - DNA, 22 bp, Artificial Sequence
  chemically synthesized
aatagcaaaattcaagcacact

SEQ ID NO: 864006 - DNA, 22 bp, Artificial Sequence
  chemically synthesized
gtgtgcttgaattttgctattt

SEQ ID NO: 864007 - DNA, 22 bp, Artificial Sequence
  chemically synthesized
gaattttgctatttaacttcat

SEQ ID NO: 864008 - DNA, 22 bp, Artificial Sequence
  chemically synthesized
aattttgctatttaacttcatt

SEQ ID NO: 864009 - DNA, 22 bp, Artificial Sequence
  chemically synthesized
cagatatgtaaaggtgaatgaa

SEQ ID NO: 864010 - DNA, 22 bp, Artificial Sequence
  chemically synthesized
tgctatttaacttcattcacct

SEQ ID NO: 864011 - DNA, 22 bp, Artificial Sequence
  chemically synthesized
gctatttaacttcattcacctt

SEQ ID NO: 864012 - DNA, 22 bp, Artificial Sequence
  chemically synthesized
ctatttaacttcattcaccttt

SEQ ID NO: 864013 - DNA, 22 bp, Artificial Sequence
  chemically synthesized
tttaacttcattcacctttaca

SEQ ID NO: 864014 - DNA, 22 bp, Artificial Sequence
  chemically synthesized
aacttcattcacctttacatat

SEQ ID NO: 864015 - DNA, 22 bp, Artificial Sequence
  chemically synthesized
acttcattcacctttacatatc

SEQ ID NO: 864016 - DNA, 22 bp, Artificial Sequence
  chemically synthesized
atgtcaggggctacagatatgt

SEQ ID NO: 864017 - DNA, 22 bp, Artificial Sequence
  chemically synthesized
cattcacctttacatatctgta

SEQ ID NO: 864018 - DNA, 22 bp, Artificial Sequence
  chemically synthesized
attcacctttacatatctgtag

SEQ ID NO: 864019 - DNA, 22 bp, Artificial Sequence
  chemically synthesized
acctttacatatctgtagcccc

SEQ ID NO: 864020 - DNA, 22 bp, Artificial Sequence
  chemically synthesized
tacatatctgtagcccctgaca

SEQ ID NO: 864021 - DNA, 22 bp, Artificial Sequence
  chemically synthesized
acatatctgtagcccctgacat

SEQ ID NO: 864022 - DNA, 22 bp, Artificial Sequence
  chemically synthesized
catatctgtagcccctgacatg

SEQ ID NO: 864023 - DNA, 22 bp, Artificial Sequence
  chemically synthesized
aagatagatattcatgtcaggg

SEQ ID NO: 864024 - DNA, 22 bp, Artificial Sequence
  chemically synthesized
cctgaagatagatattcatgtc

SEQ ID NO: 864025 - DNA, 22 bp, Artificial Sequence
  chemically synthesized
gcctgaagatagatattcatgt

SEQ ID NO: 864026 - DNA, 22 bp, Artificial Sequence
  chemically synthesized
tagcccctgacatgaatatcta

SEQ ID NO: 864027 - DNA, 22 bp, Artificial Sequence
  chemically synthesized
acttgcctgaagatagatattc

SEQ ID NO: 864028 - DNA, 22 bp, Artificial Sequence
  chemically synthesized
actcacttgcctgaagatagat

SEQ ID NO: 864029 - DNA, 22 bp, Artificial Sequence
  chemically synthesized
acatgaatatctatcttcaggc

SEQ ID NO: 864030 - DNA, 22 bp, Artificial Sequence
  chemically synthesized
gcaatattcactcacttgcctg

SEQ ID NO: 864031 - DNA, 22 bp, Artificial Sequence
  chemically synthesized
tcttcaggcaagtgagtgaata

SEQ ID NO: 864032 - DNA, 22 bp, Artificial Sequence
  chemically synthesized
caggcaagtgagtgaatattgc

SEQ ID NO: 864033 - DNA, 22 bp, Artificial Sequence
  chemically synthesized
aggcaagtgagtgaatattgcc

SEQ ID NO: 864034 - DNA, 22 bp, Artificial Sequence
  chemically synthesized
ccagtatcatcacagatgttgg

SEQ ID NO: 864035 - DNA, 22 bp, Artificial Sequence
  chemically synthesized
tcctaccagtatcatcacagat

SEQ ID NO: 864036 - DNA, 22 bp, Artificial Sequence
  chemically synthesized
ccaacatctgtgatgatactgg

SEQ ID NO: 864037 - DNA, 22 bp, Artificial Sequence
  chemically synthesized
cccccatccctatcctaccagt

SEQ ID NO: 864038 - DNA, 22 bp, Artificial Sequence
  chemically synthesized
gcccccatccctatcctaccag

SEQ ID NO: 864039 - DNA, 22 bp, Artificial Sequence
  chemically synthesized
tgcccccatccctatcctacca

SEQ ID NO: 864040 - DNA, 22 bp, Artificial Sequence
  chemically synthesized
tgatgatactggtaggataggg

SEQ ID NO: 864041 - DNA, 22 bp, Artificial Sequence
  chemically synthesized
ttttgcccccatccctatccta

SEQ ID NO: 864042 - DNA, 22 bp, Artificial Sequence
  chemically synthesized
gttttgcccccatccctatcct

SEQ ID NO: 864043 - DNA, 22 bp, Artificial Sequence
  chemically synthesized
tgttttgcccccatccctatcc

SEQ ID NO: 864044 - DNA, 22 bp, Artificial Sequence
  chemically synthesized
aacctttgttttgcccccatcc

SEQ ID NO: 864045 - DNA, 22 bp, Artificial Sequence
  chemically synthesized
caacctttgttttgcccccatc

SEQ ID NO: 864046 - DNA, 22 bp, Artificial Sequence
  chemically synthesized
tcaacctttgttttgcccccat

SEQ ID NO: 864047 - DNA, 22 bp, Artificial Sequence
  chemically synthesized
gtaggatagggatgggggcaaa

SEQ ID NO: 864048 - DNA, 22 bp, Artificial Sequence
  chemically synthesized
ttcaacctttgttttgccccca

SEQ ID NO: 864049 - DNA, 22 bp, Artificial Sequence
  chemically synthesized
gatatggtcatataggattttt

SEQ ID NO: 864050 - DNA, 22 bp, Artificial Sequence
  chemically synthesized
aggtattggatatggtcatata

SEQ ID NO: 864051 - DNA, 22 bp, Artificial Sequence
  chemically synthesized
aaaaatcctatatgaccatatc

SEQ ID NO: 864052 - DNA, 22 bp, Artificial Sequence
  chemically synthesized
tatgaccatatccaatacctga

SEQ ID NO: 864053 - DNA, 22 bp, Artificial Sequence
  chemically synthesized
taagtaaagtggaagagaattc

SEQ ID NO: 864054 - DNA, 22 bp, Artificial Sequence
  chemically synthesized
tgtaagtaaagtggaagagaat

SEQ ID NO: 864055 - DNA, 22 bp, Artificial Sequence
  chemically synthesized
ctgtaagtaaagtggaagagaa

SEQ ID NO: 864056 - DNA, 22 bp, Artificial Sequence
  chemically synthesized
tctgtaagtaaagtggaagaga

SEQ ID NO: 864057 - DNA, 22 bp, Artificial Sequence
  chemically synthesized
aattctcttccactttacttac

SEQ ID NO: 864058 - DNA, 22 bp, Artificial Sequence
  chemically synthesized
tcttccactttacttacagaaa

SEQ ID NO: 864059 - DNA, 22 bp, Artificial Sequence
  chemically synthesized
ttccactttacttacagaaagt

SEQ ID NO: 864060 - DNA, 22 bp, Artificial Sequence
  chemically synthesized
ccactttacttacagaaagtga

SEQ ID NO: 864061 - DNA, 22 bp, Artificial Sequence
  chemically synthesized
cactttacttacagaaagtgat

SEQ ID NO: 864062 - DNA, 22 bp, Artificial Sequence
  chemically synthesized
gggtaagcagtgggaaatcact

SEQ ID NO: 864063 - DNA, 22 bp, Artificial Sequence
  chemically synthesized
tacttacagaaagtgatttccc

SEQ ID NO: 864064 - DNA, 22 bp, Artificial Sequence
  chemically synthesized
ggggtaagcagtgggaaatcac

SEQ ID NO: 864065 - DNA, 22 bp, Artificial Sequence
  chemically synthesized
acttacagaaagtgatttccca

SEQ ID NO: 864066 - DNA, 22 bp, Artificial Sequence
  chemically synthesized
tggggtaagcagtgggaaatca

SEQ ID NO: 864067 - DNA, 22 bp, Artificial Sequence
  chemically synthesized
cttacagaaagtgatttcccac

SEQ ID NO: 864068 - DNA, 22 bp, Artificial Sequence
  chemically synthesized
ttggggtaagcagtgggaaatc

SEQ ID NO: 864069 - DNA, 22 bp, Artificial Sequence
  chemically synthesized
acagaaagtgatttcccactgc

SEQ ID NO: 864070 - DNA, 22 bp, Artificial Sequence
  chemically synthesized
cagaaagtgatttcccactgct

SEQ ID NO: 864071 - DNA, 22 bp, Artificial Sequence
  chemically synthesized
acacaatgtgtacttttggggt

SEQ ID NO: 864072 - DNA, 22 bp, Artificial Sequence
  chemically synthesized
gacacaatgtgtacttttgggg

SEQ ID NO: 864073 - DNA, 22 bp, Artificial Sequence
  chemically synthesized
cccactgcttaccccaaaagta

SEQ ID NO: 864074 - DNA, 22 bp, Artificial Sequence
  chemically synthesized
ccactgcttaccccaaaagtac

SEQ ID NO: 864075 - DNA, 22 bp, Artificial Sequence
  chemically synthesized
gtttgacacaatgtgtactttt

SEQ ID NO: 864076 - DNA, 22 bp, Artificial Sequence
  chemically synthesized
cttaccccaaaagtacacattg

SEQ ID NO: 864077 - DNA, 22 bp, Artificial Sequence
  chemically synthesized
gctagtttgacacaatgtgtac

SEQ ID NO: 864078 - DNA, 22 bp, Artificial Sequence
  chemically synthesized
accccaaaagtacacattgtgt

SEQ ID NO: 864079 - DNA, 22 bp, Artificial Sequence
  chemically synthesized
ccccaaaagtacacattgtgtc

SEQ ID NO: 864080 - DNA, 22 bp, Artificial Sequence
  chemically synthesized
cataaagagactggctagtttg

SEQ ID NO: 864081 - DNA, 22 bp, Artificial Sequence
  chemically synthesized
ggtattacataaagagactggc

SEQ ID NO: 864082 - DNA, 22 bp, Artificial Sequence
  chemically synthesized
tgtcaaactagccagtctcttt

SEQ ID NO: 864083 - DNA, 22 bp, Artificial Sequence
  chemically synthesized
gccagtctctttatgtaatacc

SEQ ID NO: 864084 - DNA, 22 bp, Artificial Sequence
  chemically synthesized
taaagagtgaaagcatattggg

SEQ ID NO: 864085 - DNA, 22 bp, Artificial Sequence
  chemically synthesized
tttatgtaatacccaatatgct

SEQ ID NO: 864086 - DNA, 22 bp, Artificial Sequence
  chemically synthesized
gtaaagagtgaaagcatattgg

SEQ ID NO: 864087 - DNA, 22 bp, Artificial Sequence
  chemically synthesized
tgtaaagagtgaaagcatattg

SEQ ID NO: 864088 - DNA, 22 bp, Artificial Sequence
  chemically synthesized
tatgtaatacccaatatgcttt

SEQ ID NO: 864089 - DNA, 22 bp, Artificial Sequence
  chemically synthesized
atgtaatacccaatatgctttc

SEQ ID NO: 864090 - DNA, 22 bp, Artificial Sequence
  chemically synthesized
tgtaatacccaatatgctttca

SEQ ID NO: 864091 - DNA, 22 bp, Artificial Sequence
  chemically synthesized
ttttgtaaagagtgaaagcata

SEQ ID NO: 864092 - DNA, 22 bp, Artificial Sequence
  chemically synthesized
attttgtaaagagtgaaagcat

SEQ ID NO: 864093 - DNA, 22 bp, Artificial Sequence
  chemically synthesized
tcactctttacaaaataaattt

SEQ ID NO: 864094 - DNA, 22 bp, Artificial Sequence
  chemically synthesized
cactctttacaaaataaattta

SEQ ID NO: 864095 - DNA, 22 bp, Artificial Sequence
  chemically synthesized
actctttacaaaataaatttat

SEQ ID NO: 864096 - DNA, 22 bp, Artificial Sequence
  chemically synthesized
agaaacaacaaggataaattta

SEQ ID NO: 864097 - DNA, 22 bp, Artificial Sequence
  chemically synthesized
tttacaaaataaatttatcctt

SEQ ID NO: 864098 - DNA, 22 bp, Artificial Sequence
  chemically synthesized
tacaaaataaatttatccttgt

SEQ ID NO: 864099 - DNA, 22 bp, Artificial Sequence
  chemically synthesized
acaaaataaatttatccttgtt

SEQ ID NO: 864100 - DNA, 22 bp, Artificial Sequence
  chemically synthesized
caaaataaatttatccttgttg

SEQ ID NO: 864101 - DNA, 22 bp, Artificial Sequence
  chemically synthesized
atccttgttgtttcttagactt

SEQ ID NO: 864102 - DNA, 22 bp, Artificial Sequence
  chemically synthesized
tccttgttgtttcttagacttt

SEQ ID NO: 864103 - DNA, 22 bp, Artificial Sequence
  chemically synthesized
gttgtttcttagactttttttt

SEQ ID NO: 864104 - DNA, 22 bp, Artificial Sequence
  chemically synthesized
ttgtttcttagacttttttttg

SEQ ID NO: 864105 - DNA, 22 bp, Artificial Sequence
  chemically synthesized
tttcttagacttttttttgcac

SEQ ID NO: 864106 - DNA, 22 bp, Artificial Sequence
  chemically synthesized
cttagacttttttttgcaccca

SEQ ID NO: 864107 - DNA, 22 bp, Artificial Sequence
  chemically synthesized
ttagacttttttttgcacccat

SEQ ID NO: 864108 - DNA, 22 bp, Artificial Sequence
  chemically synthesized
gtaaggaataaaatgggtgcaa

SEQ ID NO: 864109 - DNA, 22 bp, Artificial Sequence
  chemically synthesized
agacttttttttgcacccattt

SEQ ID NO: 864110 - DNA, 22 bp, Artificial Sequence
  chemically synthesized
gacttttttttgcacccatttt

SEQ ID NO: 864111 - DNA, 22 bp, Artificial Sequence
  chemically synthesized
ttttttgcacccattttattcc

SEQ ID NO: 864112 - DNA, 22 bp, Artificial Sequence
  chemically synthesized
tttttgcacccattttattcct

SEQ ID NO: 864113 - DNA, 22 bp, Artificial Sequence
  chemically synthesized
ttttgcacccattttattcctt

SEQ ID NO: 864114 - DNA, 22 bp, Artificial Sequence
  chemically synthesized
tttgcacccattttattcctta

SEQ ID NO: 864115 - DNA, 22 bp, Artificial Sequence
  chemically synthesized
ttgcacccattttattccttac

SEQ ID NO: 864116 - DNA, 22 bp, Artificial Sequence
  chemically synthesized
tgcacccattttattccttact

SEQ ID NO: 864117 - DNA, 22 bp, Artificial Sequence
  chemically synthesized
gcacccattttattccttacta

SEQ ID NO: 864118 - DNA, 22 bp, Artificial Sequence
  chemically synthesized
cacccattttattccttactaa

SEQ ID NO: 864119 - DNA, 22 bp, Artificial Sequence
  chemically synthesized
tgatcgtagacattagtaagga

SEQ ID NO: 864120 - DNA, 22 bp, Artificial Sequence
  chemically synthesized
tattccttactaatgtctacga

SEQ ID NO: 864121 - DNA, 22 bp, Artificial Sequence
  chemically synthesized
attccttactaatgtctacgat

SEQ ID NO: 864122 - DNA, 22 bp, Artificial Sequence
  chemically synthesized
ttccttactaatgtctacgatc

SEQ ID NO: 864123 - DNA, 22 bp, Artificial Sequence
  chemically synthesized
acagaagattgtgatcgtagac

SEQ ID NO: 864124 - DNA, 22 bp, Artificial Sequence
  chemically synthesized
cacagaagattgtgatcgtaga

SEQ ID NO: 864125 - DNA, 22 bp, Artificial Sequence
  chemically synthesized
cttactaatgtctacgatcaca

SEQ ID NO: 864126 - DNA, 22 bp, Artificial Sequence
  chemically synthesized
actaatgtctacgatcacaatc

SEQ ID NO: 864127 - DNA, 22 bp, Artificial Sequence
  chemically synthesized
ctaatgtctacgatcacaatct

SEQ ID NO: 864128 - DNA, 22 bp, Artificial Sequence
  chemically synthesized
atgtctacgatcacaatcttct

SEQ ID NO: 864129 - DNA, 22 bp, Artificial Sequence
  chemically synthesized
tcaacaaagacttcacagaaga

SEQ ID NO: 864130 - DNA, 22 bp, Artificial Sequence
  chemically synthesized
cgatcacaatcttctgtgaagt

SEQ ID NO: 864131 - DNA, 22 bp, Artificial Sequence
  chemically synthesized
gagttgtcaacaaagacttcac

SEQ ID NO: 864132 - DNA, 22 bp, Artificial Sequence
  chemically synthesized
actagagttgtcaacaaagact

SEQ ID NO: 864133 - DNA, 22 bp, Artificial Sequence
  chemically synthesized
ctgtgaagtctttgttgacaac

SEQ ID NO: 864134 - DNA, 22 bp, Artificial Sequence
  chemically synthesized
tgtgaagtctttgttgacaact

SEQ ID NO: 864135 - DNA, 22 bp, Artificial Sequence
  chemically synthesized
tgaagtctttgttgacaactct

SEQ ID NO: 864136 - DNA, 22 bp, Artificial Sequence
  chemically synthesized
tatgggttaactagagttgtca

SEQ ID NO: 864137 - DNA, 22 bp, Artificial Sequence
  chemically synthesized
tgttgacaactctagttaaccc

SEQ ID NO: 864138 - DNA, 22 bp, Artificial Sequence
  chemically synthesized
gttgacaactctagttaaccca

SEQ ID NO: 864139 - DNA, 22 bp, Artificial Sequence
  chemically synthesized
ttgacaactctagttaacccat

SEQ ID NO: 864140 - DNA, 22 bp, Artificial Sequence
  chemically synthesized
gaaagaagactgtatgggttaa

SEQ ID NO: 864141 - DNA, 22 bp, Artificial Sequence
  chemically synthesized
ggaaagaagactgtatgggtta

SEQ ID NO: 864142 - DNA, 22 bp, Artificial Sequence
  chemically synthesized
acaactctagttaacccataca

SEQ ID NO: 864143 - DNA, 22 bp, Artificial Sequence
  chemically synthesized
tagttaacccatacagtcttct

SEQ ID NO: 864144 - DNA, 22 bp, Artificial Sequence
  chemically synthesized
gttaacccatacagtcttcttt

SEQ ID NO: 864145 - DNA, 22 bp, Artificial Sequence
  chemically synthesized
acccatacagtcttctttccaa

SEQ ID NO: 864146 - DNA, 22 bp, Artificial Sequence
  chemically synthesized
aaatcaacataggagtttggaa

SEQ ID NO: 864147 - DNA, 22 bp, Artificial Sequence
  chemically synthesized
ctttccaaactcctatgttgat

SEQ ID NO: 864148 - DNA, 22 bp, Artificial Sequence
  chemically synthesized
tttccaaactcctatgttgatt

SEQ ID NO: 864149 - DNA, 22 bp, Artificial Sequence
  chemically synthesized
tccaaactcctatgttgatttc

SEQ ID NO: 864150 - DNA, 22 bp, Artificial Sequence
  chemically synthesized
ccaaactcctatgttgatttca

SEQ ID NO: 864151 - DNA, 22 bp, Artificial Sequence
  chemically synthesized
caaactcctatgttgatttcag

SEQ ID NO: 864152 - DNA, 22 bp, Artificial Sequence
  chemically synthesized
ctatgttgatttcagtcttaca

SEQ ID NO: 864153 - DNA, 22 bp, Artificial Sequence
  chemically synthesized
tgttgatttcagtcttacatat

SEQ ID NO: 864154 - DNA, 22 bp, Artificial Sequence
  chemically synthesized
atttcagtcttacatatttatt

SEQ ID NO: 864155 - DNA, 22 bp, Artificial Sequence
  chemically synthesized
cagtcttacatatttatttata

SEQ ID NO: 864156 - DNA, 22 bp, Artificial Sequence
  chemically synthesized
agtcttacatatttatttatat

SEQ ID NO: 864157 - DNA, 22 bp, Artificial Sequence
  chemically synthesized
agatagcaaataataatataaa

SEQ ID NO: 864158 - DNA, 22 bp, Artificial Sequence
  chemically synthesized
acatatttatttatattattat

SEQ ID NO: 864159 - DNA, 22 bp, Artificial Sequence
  chemically synthesized
catatttatttatattattatt

SEQ ID NO: 864160 - DNA, 22 bp, Artificial Sequence
  chemically synthesized
caattgagatagcaaataataa

SEQ ID NO: 864161 - DNA, 22 bp, Artificial Sequence
  chemically synthesized
acaattgagatagcaaataata

SEQ ID NO: 864162 - DNA, 22 bp, Artificial Sequence
  chemically synthesized
tacaattgagatagcaaataat

SEQ ID NO: 864163 - DNA, 22 bp, Artificial Sequence
  chemically synthesized
atttatattattatttgctatc

SEQ ID NO: 864164 - DNA, 22 bp, Artificial Sequence
  chemically synthesized
tttatattattatttgctatct

SEQ ID NO: 864165 - DNA, 22 bp, Artificial Sequence
  chemically synthesized
atattattatttgctatctcaa

SEQ ID NO: 864166 - DNA, 22 bp, Artificial Sequence
  chemically synthesized
tattattatttgctatctcaat

SEQ ID NO: 864167 - DNA, 22 bp, Artificial Sequence
  chemically synthesized
tagaattttacaattgagatag

SEQ ID NO: 864168 - DNA, 22 bp, Artificial Sequence
  chemically synthesized
ttatttgctatctcaattgtaa

SEQ ID NO: 864169 - DNA, 22 bp, Artificial Sequence
  chemically synthesized
caattgtagaattttacaattg

SEQ ID NO: 864170 - DNA, 22 bp, Artificial Sequence
  chemically synthesized
ccaattgtagaattttacaatt

SEQ ID NO: 864171 - DNA, 22 bp, Artificial Sequence
  chemically synthesized
tttgctatctcaattgtaaaat

SEQ ID NO: 864172 - DNA, 22 bp, Artificial Sequence
  chemically synthesized
cttccaattgtagaattttaca

SEQ ID NO: 864173 - DNA, 22 bp, Artificial Sequence
  chemically synthesized
gctatctcaattgtaaaattct

SEQ ID NO: 864174 - DNA, 22 bp, Artificial Sequence
  chemically synthesized
ccttccaattgtagaattttac

SEQ ID NO: 864175 - DNA, 22 bp, Artificial Sequence
  chemically synthesized
ctatctcaattgtaaaattcta

SEQ ID NO: 864176 - DNA, 22 bp, Artificial Sequence
  chemically synthesized
tctcaattgtaaaattctacaa

SEQ ID NO: 864177 - DNA, 22 bp, Artificial Sequence
  chemically synthesized
aattgtaaaattctacaattgg

SEQ ID NO: 864178 - DNA, 22 bp, Artificial Sequence
  chemically synthesized
cataatttccttccaattgtag

SEQ ID NO: 864179 - DNA, 22 bp, Artificial Sequence
  chemically synthesized
ccataatttccttccaattgta

SEQ ID NO: 864180 - DNA, 22 bp, Artificial Sequence
  chemically synthesized
taaaattctacaattggaagga

SEQ ID NO: 864181 - DNA, 22 bp, Artificial Sequence
  chemically synthesized
gaatttccataatttccttcca

SEQ ID NO: 864182 - DNA, 22 bp, Artificial Sequence
  chemically synthesized
tacaattggaaggaaattatgg

SEQ ID NO: 864183 - DNA, 22 bp, Artificial Sequence
  chemically synthesized
agcattggaatttccataattt

SEQ ID NO: 864184 - DNA, 22 bp, Artificial Sequence
  chemically synthesized
caattggaaggaaattatggaa

SEQ ID NO: 864185 - DNA, 22 bp, Artificial Sequence
  chemically synthesized
aagttcagcattggaatttcca

SEQ ID NO: 864186 - DNA, 22 bp, Artificial Sequence
  chemically synthesized
gaaggaaattatggaaattcca

SEQ ID NO: 864187 - DNA, 22 bp, Artificial Sequence
  chemically synthesized
aaagttcagcattggaatttcc

SEQ ID NO: 864188 - DNA, 22 bp, Artificial Sequence
  chemically synthesized
taaagttcagcattggaatttc

SEQ ID NO: 864189 - DNA, 22 bp, Artificial Sequence
  chemically synthesized
tggaaattccaatgctgaactt

SEQ ID NO: 864190 - DNA, 22 bp, Artificial Sequence
  chemically synthesized
aaaggagaaagattttaaagtt

SEQ ID NO: 864191 - DNA, 22 bp, Artificial Sequence
  chemically synthesized
caatgctgaactttaaaatctt

SEQ ID NO: 864192 - DNA, 22 bp, Artificial Sequence
  chemically synthesized
caatgctcaaaggagaaagatt

SEQ ID NO: 864193 - DNA, 22 bp, Artificial Sequence
  chemically synthesized
acaatgctcaaaggagaaagat

SEQ ID NO: 864194 - DNA, 22 bp, Artificial Sequence
  chemically synthesized
aactttaaaatctttctccttt

SEQ ID NO: 864195 - DNA, 22 bp, Artificial Sequence
  chemically synthesized
agatttacaatgctcaaaggag

SEQ ID NO: 864196 - DNA, 22 bp, Artificial Sequence
  chemically synthesized
taaaatctttctcctttgagca

SEQ ID NO: 864197 - DNA, 22 bp, Artificial Sequence
  chemically synthesized
aaaatctttctcctttgagcat

SEQ ID NO: 864198 - DNA, 22 bp, Artificial Sequence
  chemically synthesized
aaatctttctcctttgagcatt

SEQ ID NO: 864199 - DNA, 22 bp, Artificial Sequence
  chemically synthesized
agtctaagatttacaatgctca

SEQ ID NO: 864200 - DNA, 22 bp, Artificial Sequence
  chemically synthesized
cagtctaagatttacaatgctc

SEQ ID NO: 864201 - DNA, 22 bp, Artificial Sequence
  chemically synthesized
tctcctttgagcattgtaaatc

SEQ ID NO: 864202 - DNA, 22 bp, Artificial Sequence
  chemically synthesized
ctcctttgagcattgtaaatct

SEQ ID NO: 864203 - DNA, 22 bp, Artificial Sequence
  chemically synthesized
tcctttgagcattgtaaatctt

SEQ ID NO: 864204 - DNA, 22 bp, Artificial Sequence
  chemically synthesized
ctttgagcattgtaaatcttag

SEQ ID NO: 864205 - DNA, 22 bp, Artificial Sequence
  chemically synthesized
tgagcattgtaaatcttagact

SEQ ID NO: 864206 - DNA, 22 bp, Artificial Sequence
  chemically synthesized
gagcattgtaaatcttagactg

SEQ ID NO: 864207 - DNA, 22 bp, Artificial Sequence
  chemically synthesized
agcattgtaaatcttagactga

SEQ ID NO: 864208 - DNA, 22 bp, Artificial Sequence
  chemically synthesized
tatgtaaagcatttcagtctaa

SEQ ID NO: 864209 - DNA, 22 bp, Artificial Sequence
  chemically synthesized
aattatatgtaaagcatttcag

SEQ ID NO: 864210 - DNA, 22 bp, Artificial Sequence
  chemically synthesized
taaatcttagactgaaatgctt

SEQ ID NO: 864211 - DNA, 22 bp, Artificial Sequence
  chemically synthesized
ctaaattatatgtaaagcattt

SEQ ID NO: 864212 - DNA, 22 bp, Artificial Sequence
  chemically synthesized
agactgaaatgctttacatata

SEQ ID NO: 864213 - DNA, 22 bp, Artificial Sequence
  chemically synthesized
gactgaaatgctttacatataa

SEQ ID NO: 864214 - DNA, 22 bp, Artificial Sequence
  chemically synthesized
aacatctactaaattatatgta

SEQ ID NO: 864215 - DNA, 22 bp, Artificial Sequence
  chemically synthesized
aaatgctttacatataatttag

SEQ ID NO: 864216 - DNA, 22 bp, Artificial Sequence
  chemically synthesized
agaatattaaacatctactaaa

SEQ ID NO: 864217 - DNA, 22 bp, Artificial Sequence
  chemically synthesized
gagaatattaaacatctactaa

SEQ ID NO: 864218 - DNA, 22 bp, Artificial Sequence
  chemically synthesized
tacatataatttagtagatgtt

SEQ ID NO: 864219 - DNA, 22 bp, Artificial Sequence
  chemically synthesized
ttgagaatattaaacatctact

SEQ ID NO: 864220 - DNA, 22 bp, Artificial Sequence
  chemically synthesized
acatataatttagtagatgttt

SEQ ID NO: 864221 - DNA, 22 bp, Artificial Sequence
  chemically synthesized
catataatttagtagatgttta

SEQ ID NO: 864222 - DNA, 22 bp, Artificial Sequence
  chemically synthesized
ggcatacctcttgagaatatta

SEQ ID NO: 864223 - DNA, 22 bp, Artificial Sequence
  chemically synthesized
aggcatacctcttgagaatatt

SEQ ID NO: 864224 - DNA, 22 bp, Artificial Sequence
  chemically synthesized
agtagatgtttaatattctcaa

SEQ ID NO: 864225 - DNA, 22 bp, Artificial Sequence
  chemically synthesized
gtagatgtttaatattctcaag

SEQ ID NO: 864226 - DNA, 22 bp, Artificial Sequence
  chemically synthesized
ttaggcatacctcttgagaata

SEQ ID NO: 864227 - DNA, 22 bp, Artificial Sequence
  chemically synthesized
caaagactcttaggcatacctc

SEQ ID NO: 864228 - DNA, 22 bp, Artificial Sequence
  chemically synthesized
aatattctcaagaggtatgcct

SEQ ID NO: 864229 - DNA, 22 bp, Artificial Sequence
  chemically synthesized
gcaaagactcttaggcatacct

SEQ ID NO: 864230 - DNA, 22 bp, Artificial Sequence
  chemically synthesized
atattctcaagaggtatgccta

SEQ ID NO: 864231 - DNA, 22 bp, Artificial Sequence
  chemically synthesized
atttgcaaagactcttaggcat

SEQ ID NO: 864232 - DNA, 22 bp, Artificial Sequence
  chemically synthesized
gatttgcaaagactcttaggca

SEQ ID NO: 864233 - DNA, 22 bp, Artificial Sequence
  chemically synthesized
tgatttgcaaagactcttaggc

SEQ ID NO: 864234 - DNA, 22 bp, Artificial Sequence
  chemically synthesized
tcaagaggtatgcctaagagtc

SEQ ID NO: 864235 - DNA, 22 bp, Artificial Sequence
  chemically synthesized
ttgatttgcaaagactcttagg

SEQ ID NO: 864236 - DNA, 22 bp, Artificial Sequence
  chemically synthesized
tttgatttgcaaagactcttag

SEQ ID NO: 864237 - DNA, 22 bp, Artificial Sequence
  chemically synthesized
aagaggtatgcctaagagtctt

SEQ ID NO: 864238 - DNA, 22 bp, Artificial Sequence
  chemically synthesized
ctttttgatttgcaaagactct

SEQ ID NO: 864239 - DNA, 22 bp, Artificial Sequence
  chemically synthesized
agagtctttgcaaatcaaaaag

SEQ ID NO: 864240 - DNA, 22 bp, Artificial Sequence
  chemically synthesized
tcagatcatataaatctgcttt

SEQ ID NO: 864241 - DNA, 22 bp, Artificial Sequence
  chemically synthesized
tgcaaatcaaaaagcagattta

SEQ ID NO: 864242 - DNA, 22 bp, Artificial Sequence
  chemically synthesized
gcaaatcaaaaagcagatttat

SEQ ID NO: 864243 - DNA, 22 bp, Artificial Sequence
  chemically synthesized
caaatcaaaaagcagatttata

SEQ ID NO: 864244 - DNA, 22 bp, Artificial Sequence
  chemically synthesized
agtaagactatcagatcatata

SEQ ID NO: 864245 - DNA, 22 bp, Artificial Sequence
  chemically synthesized
ctaagtaagactatcagatcat

SEQ ID NO: 864246 - DNA, 22 bp, Artificial Sequence
  chemically synthesized
actcctaagtaagactatcaga

SEQ ID NO: 864247 - DNA, 22 bp, Artificial Sequence
  chemically synthesized
aactcctaagtaagactatcag

SEQ ID NO: 864248 - DNA, 22 bp, Artificial Sequence
  chemically synthesized
atatgatctgatagtcttactt

SEQ ID NO: 864249 - DNA, 22 bp, Artificial Sequence
  chemically synthesized
tatgatctgatagtcttactta

SEQ ID NO: 864250 - DNA, 22 bp, Artificial Sequence
  chemically synthesized
atagtcttacttaggagttaag

SEQ ID NO: 864251 - DNA, 22 bp, Artificial Sequence
  chemically synthesized
ggcagggatgaatcccttaact

SEQ ID NO: 864252 - DNA, 22 bp, Artificial Sequence
  chemically synthesized
ctgggcagggatgaatccctta

SEQ ID NO: 864253 - DNA, 22 bp, Artificial Sequence
  chemically synthesized
acttaggagttaagggattcat

SEQ ID NO: 864254 - DNA, 22 bp, Artificial Sequence
  chemically synthesized
cttaggagttaagggattcatc

SEQ ID NO: 864255 - DNA, 22 bp, Artificial Sequence
  chemically synthesized
aggagttaagggattcatccct

SEQ ID NO: 864256 - DNA, 22 bp, Artificial Sequence
  chemically synthesized
ggagttaagggattcatccctg

SEQ ID NO: 864257 - DNA, 22 bp, Artificial Sequence
  chemically synthesized
ggaaactactgggcagggatga

SEQ ID NO: 864258 - DNA, 22 bp, Artificial Sequence
  chemically synthesized
agggattcatccctgcccagta

SEQ ID NO: 864259 - DNA, 22 bp, Artificial Sequence
  chemically synthesized
atgtactgggaaactactgggc

SEQ ID NO: 864260 - DNA, 22 bp, Artificial Sequence
  chemically synthesized
catgtactgggaaactactggg

SEQ ID NO: 864261 - DNA, 22 bp, Artificial Sequence
  chemically synthesized
atttcatgtactgggaaactac

SEQ ID NO: 864262 - DNA, 22 bp, Artificial Sequence
  chemically synthesized
atccctgcccagtagtttccca

SEQ ID NO: 864263 - DNA, 22 bp, Artificial Sequence
  chemically synthesized
cccagtagtttcccagtacatg

SEQ ID NO: 864264 - DNA, 22 bp, Artificial Sequence
  chemically synthesized
cagtactaatttcatgtactgg

SEQ ID NO: 864265 - DNA, 22 bp, Artificial Sequence
  chemically synthesized
cccagtacatgaaattagtact

SEQ ID NO: 864266 - DNA, 22 bp, Artificial Sequence
  chemically synthesized
ccagtacatgaaattagtactg

SEQ ID NO: 864267 - DNA, 22 bp, Artificial Sequence
  chemically synthesized
acatgtaaggaaggcctccagt

SEQ ID NO: 864268 - DNA, 22 bp, Artificial Sequence
  chemically synthesized
taacatgtaaggaaggcctcca

SEQ ID NO: 864269 - DNA, 22 bp, Artificial Sequence
  chemically synthesized
gtactggaggccttccttacat

SEQ ID NO: 864270 - DNA, 22 bp, Artificial Sequence
  chemically synthesized
ggtggttctaacatgtaaggaa

SEQ ID NO: 864271 - DNA, 22 bp, Artificial Sequence
  chemically synthesized
gaggccttccttacatgttaga

SEQ ID NO: 864272 - DNA, 22 bp, Artificial Sequence
  chemically synthesized
ggtaattgggtggttctaacat

SEQ ID NO: 864273 - DNA, 22 bp, Artificial Sequence
  chemically synthesized
ttgggtaattgggtggttctaa

SEQ ID NO: 864274 - DNA, 22 bp, Artificial Sequence
  chemically synthesized
ccttacatgttagaaccaccca

SEQ ID NO: 864275 - DNA, 22 bp, Artificial Sequence
  chemically synthesized
cttacatgttagaaccacccaa

SEQ ID NO: 864276 - DNA, 22 bp, Artificial Sequence
  chemically synthesized
atcctattgggtaattgggtgg

SEQ ID NO: 864277 - DNA, 22 bp, Artificial Sequence
  chemically synthesized
acatgttagaaccacccaatta

SEQ ID NO: 864278 - DNA, 22 bp, Artificial Sequence
  chemically synthesized
catgttagaaccacccaattac

SEQ ID NO: 864279 - DNA, 22 bp, Artificial Sequence
  chemically synthesized
gaaccacccaattacccaatag

SEQ ID NO: 864280 - DNA, 22 bp, Artificial Sequence
  chemically synthesized
atagcattgatcctattgggta

SEQ ID NO: 864281 - DNA, 22 bp, Artificial Sequence
  chemically synthesized
aatagcattgatcctattgggt

SEQ ID NO: 864282 - DNA, 22 bp, Artificial Sequence
  chemically synthesized
atgtgtttaatagcattgatcc

SEQ ID NO: 864283 - DNA, 22 bp, Artificial Sequence
  chemically synthesized
taatgtgtttaatagcattgat

SEQ ID NO: 864284 - DNA, 22 bp, Artificial Sequence
  chemically synthesized
ctaatgtgtttaatagcattga

SEQ ID NO: 864285 - DNA, 22 bp, Artificial Sequence
  chemically synthesized
cccaataggatcaatgctatta

SEQ ID NO: 864286 - DNA, 22 bp, Artificial Sequence
  chemically synthesized
ttaaacacattagaaatcacta

SEQ ID NO: 864287 - DNA, 22 bp, Artificial Sequence
  chemically synthesized
aacacattagaaatcactacat

SEQ ID NO: 864288 - DNA, 22 bp, Artificial Sequence
  chemically synthesized
aaggtccatgatatgtagtgat

SEQ ID NO: 864289 - DNA, 22 bp, Artificial Sequence
  chemically synthesized
taaaggtccatgatatgtagtg

SEQ ID NO: 864290 - DNA, 22 bp, Artificial Sequence
  chemically synthesized
ctaaaggtccatgatatgtagt

SEQ ID NO: 864291 - DNA, 22 bp, Artificial Sequence
  chemically synthesized
tctaaaggtccatgatatgtag

SEQ ID NO: 864292 - DNA, 22 bp, Artificial Sequence
  chemically synthesized
ctttctaaaggtccatgatatg

SEQ ID NO: 864293 - DNA, 22 bp, Artificial Sequence
  chemically synthesized
gaaatcactacatatcatggac

SEQ ID NO: 864294 - DNA, 22 bp, Artificial Sequence
  chemically synthesized
catatcatggacctttagaaag

SEQ ID NO: 864295 - DNA, 22 bp, Artificial Sequence
  chemically synthesized
atatgaagtgataaaatattgc

SEQ ID NO: 864296 - DNA, 22 bp, Artificial Sequence
  chemically synthesized
tagaaagcaatattttatcact

SEQ ID NO: 864297 - DNA, 22 bp, Artificial Sequence
  chemically synthesized
agaaagcaatattttatcactt

SEQ ID NO: 864298 - DNA, 22 bp, Artificial Sequence
  chemically synthesized
gaaagcaatattttatcacttc

SEQ ID NO: 864299 - DNA, 22 bp, Artificial Sequence
  chemically synthesized
aataactcatatgaagtgataa

SEQ ID NO: 864300 - DNA, 22 bp, Artificial Sequence
  chemically synthesized
agctaaataactcatatgaagt

SEQ ID NO: 864301 - DNA, 22 bp, Artificial Sequence
  chemically synthesized
tcctaagctaaataactcatat

SEQ ID NO: 864302 - DNA, 22 bp, Artificial Sequence
  chemically synthesized
tatcacttcatatgagttattt

SEQ ID NO: 864303 - DNA, 22 bp, Artificial Sequence
  chemically synthesized
atcacttcatatgagttattta

SEQ ID NO: 864304 - DNA, 22 bp, Artificial Sequence
  chemically synthesized
tcacttcatatgagttatttag

SEQ ID NO: 864305 - DNA, 22 bp, Artificial Sequence
  chemically synthesized
catatgagttatttagcttagg

SEQ ID NO: 864306 - DNA, 22 bp, Artificial Sequence
  chemically synthesized
atatgagttatttagcttagga

SEQ ID NO: 864307 - DNA, 22 bp, Artificial Sequence
  chemically synthesized
tttagcttaggacaatgttttg

SEQ ID NO: 864308 - DNA, 22 bp, Artificial Sequence
  chemically synthesized
aataagaaatggcaaaacattg

SEQ ID NO: 864309 - DNA, 22 bp, Artificial Sequence
  chemically synthesized
agcttaggacaatgttttgcca

SEQ ID NO: 864310 - DNA, 22 bp, Artificial Sequence
  chemically synthesized
gcttaggacaatgttttgccat

SEQ ID NO: 864311 - DNA, 22 bp, Artificial Sequence
  chemically synthesized
aggacaatgttttgccatttct

SEQ ID NO: 864312 - DNA, 22 bp, Artificial Sequence
  chemically synthesized
ataatctaaataagaaatggca

SEQ ID NO: 864313 - DNA, 22 bp, Artificial Sequence
  chemically synthesized
ggacaatgttttgccatttctt

SEQ ID NO: 864314 - DNA, 22 bp, Artificial Sequence
  chemically synthesized
tcataatctaaataagaaatgg

SEQ ID NO: 864315 - DNA, 22 bp, Artificial Sequence
  chemically synthesized
ctcataatctaaataagaaatg

SEQ ID NO: 864316 - DNA, 22 bp, Artificial Sequence
  chemically synthesized
tgccatttcttatttagattat

SEQ ID NO: 864317 - DNA, 22 bp, Artificial Sequence
  chemically synthesized
gccatttcttatttagattatg

SEQ ID NO: 864318 - DNA, 22 bp, Artificial Sequence
  chemically synthesized
ccatttcttatttagattatga

SEQ ID NO: 864319 - DNA, 22 bp, Artificial Sequence
  chemically synthesized
cttatttagattatgagaaatg

SEQ ID NO: 864320 - DNA, 22 bp, Artificial Sequence
  chemically synthesized
ttatttagattatgagaaatgt

SEQ ID NO: 864321 - DNA, 22 bp, Artificial Sequence
  chemically synthesized
aaatgagatgtgacatttctca

SEQ ID NO: 864322 - DNA, 22 bp, Artificial Sequence
  chemically synthesized
aaaatgagatgtgacatttctc

SEQ ID NO: 864323 - DNA, 22 bp, Artificial Sequence
  chemically synthesized
atttagattatgagaaatgtca

SEQ ID NO: 864324 - DNA, 22 bp, Artificial Sequence
  chemically synthesized
taaaatgagatgtgacatttct

SEQ ID NO: 864325 - DNA, 22 bp, Artificial Sequence
  chemically synthesized
tttagattatgagaaatgtcac

SEQ ID NO: 864326 - DNA, 22 bp, Artificial Sequence
  chemically synthesized
ttaaaatgagatgtgacatttc

SEQ ID NO: 864327 - DNA, 22 bp, Artificial Sequence
  chemically synthesized
agattatgagaaatgtcacatc

SEQ ID NO: 864328 - DNA, 22 bp, Artificial Sequence
  chemically synthesized
gattatgagaaatgtcacatct

SEQ ID NO: 864329 - DNA, 22 bp, Artificial Sequence
  chemically synthesized
tgagaaatgtcacatctcattt

SEQ ID NO: 864330 - DNA, 22 bp, Artificial Sequence
  chemically synthesized
agaaataatttttaaaatgaga

SEQ ID NO: 864331 - DNA, 22 bp, Artificial Sequence
  chemically synthesized
attttaaaaattatttcttagt

SEQ ID NO: 864332 - DNA, 22 bp, Artificial Sequence
  chemically synthesized
taaaaattatttcttagtatat

SEQ ID NO: 864333 - DNA, 22 bp, Artificial Sequence
  chemically synthesized
aaaaattatttcttagtatatc

SEQ ID NO: 864334 - DNA, 22 bp, Artificial Sequence
  chemically synthesized
aaaattatttcttagtatatca

SEQ ID NO: 864335 - DNA, 22 bp, Artificial Sequence
  chemically synthesized
tttcttagtatatcacatcatt

SEQ ID NO: 864336 - DNA, 22 bp, Artificial Sequence
  chemically synthesized
gtgcagataatcagaatgatgt

SEQ ID NO: 864337 - DNA, 22 bp, Artificial Sequence
  chemically synthesized
cttagtatatcacatcattctg

SEQ ID NO: 864338 - DNA, 22 bp, Artificial Sequence
  chemically synthesized
agtgcagataatcagaatgatg

SEQ ID NO: 864339 - DNA, 22 bp, Artificial Sequence
  chemically synthesized
ttagtatatcacatcattctga

SEQ ID NO: 864340 - DNA, 22 bp, Artificial Sequence
  chemically synthesized
tagtgcagataatcagaatgat

SEQ ID NO: 864341 - DNA, 22 bp, Artificial Sequence
  chemically synthesized
agtatatcacatcattctgatt

SEQ ID NO: 864342 - DNA, 22 bp, Artificial Sequence
  chemically synthesized
gtatatcacatcattctgatta

SEQ ID NO: 864343 - DNA, 22 bp, Artificial Sequence
  chemically synthesized
ctttagtgcagataatcagaat

SEQ ID NO: 864344 - DNA, 22 bp, Artificial Sequence
  chemically synthesized
gctttagtgcagataatcagaa

SEQ ID NO: 864345 - DNA, 22 bp, Artificial Sequence
  chemically synthesized
tgctttagtgcagataatcaga

SEQ ID NO: 864346 - DNA, 22 bp, Artificial Sequence
  chemically synthesized
gaagattttgctttagtgcaga

SEQ ID NO: 864347 - DNA, 22 bp, Artificial Sequence
  chemically synthesized
ggaagattttgctttagtgcag

SEQ ID NO: 864348 - DNA, 22 bp, Artificial Sequence
  chemically synthesized
tgattatctgcactaaagcaaa

SEQ ID NO: 864349 - DNA, 22 bp, Artificial Sequence
  chemically synthesized
tgtttggaagattttgctttag

SEQ ID NO: 864350 - DNA, 22 bp, Artificial Sequence
  chemically synthesized
atgtttggaagattttgcttta

SEQ ID NO: 864351 - DNA, 22 bp, Artificial Sequence
  chemically synthesized
attatctgcactaaagcaaaat

SEQ ID NO: 864352 - DNA, 22 bp, Artificial Sequence
  chemically synthesized
tatgtttggaagattttgcttt

SEQ ID NO: 864353 - DNA, 22 bp, Artificial Sequence
  chemically synthesized
ctttatgtttggaagattttgc

SEQ ID NO: 864354 - DNA, 22 bp, Artificial Sequence
  chemically synthesized
tctgcactaaagcaaaatcttc

SEQ ID NO: 864355 - DNA, 22 bp, Artificial Sequence
  chemically synthesized
cactaaagcaaaatcttccaaa

SEQ ID NO: 864356 - DNA, 22 bp, Artificial Sequence
  chemically synthesized
aaaactcctttatgtttggaag

SEQ ID NO: 864357 - DNA, 22 bp, Artificial Sequence
  chemically synthesized
gaaaactcctttatgtttggaa

SEQ ID NO: 864358 - DNA, 22 bp, Artificial Sequence
  chemically synthesized
tgaaaactcctttatgtttgga

SEQ ID NO: 864359 - DNA, 22 bp, Artificial Sequence
  chemically synthesized
aagcaaaatcttccaaacataa

SEQ ID NO: 864360 - DNA, 22 bp, Artificial Sequence
  chemically synthesized
ccaaacataaaggagttttcaa

SEQ ID NO: 864361 - DNA, 22 bp, Artificial Sequence
  chemically synthesized
caaacataaaggagttttcaaa

SEQ ID NO: 864362 - DNA, 22 bp, Artificial Sequence
  chemically synthesized
atggtagaacatattttgaaaa

SEQ ID NO: 864363 - DNA, 22 bp, Artificial Sequence
  chemically synthesized
taatggtagaacatattttgaa

SEQ ID NO: 864364 - DNA, 22 bp, Artificial Sequence
  chemically synthesized
ctaatggtagaacatattttga

SEQ ID NO: 864365 - DNA, 22 bp, Artificial Sequence
  chemically synthesized
atttctaatggtagaacatatt

SEQ ID NO: 864366 - DNA, 22 bp, Artificial Sequence
  chemically synthesized
tcaaaatatgttctaccattag

SEQ ID NO: 864367 - DNA, 22 bp, Artificial Sequence
  chemically synthesized
caaaatatgttctaccattaga

SEQ ID NO: 864368 - DNA, 22 bp, Artificial Sequence
  chemically synthesized
aaaatatgttctaccattagaa

SEQ ID NO: 864369 - DNA, 22 bp, Artificial Sequence
  chemically synthesized
taccattagaaattagcatgac

SEQ ID NO: 864370 - DNA, 22 bp, Artificial Sequence
  chemically synthesized
ccattagaaattagcatgacgg

SEQ ID NO: 864371 - DNA, 22 bp, Artificial Sequence
  chemically synthesized
aatgaaaatacagccgtcatgc

SEQ ID NO: 864372 - DNA, 22 bp, Artificial Sequence
  chemically synthesized
gaaattagcatgacggctgtat

SEQ ID NO: 864373 - DNA, 22 bp, Artificial Sequence
  chemically synthesized
gcatgacggctgtattttcatt

SEQ ID NO: 864374 - DNA, 22 bp, Artificial Sequence
  chemically synthesized
taaaatatgttaaatgaaaata

SEQ ID NO: 864375 - DNA, 22 bp, Artificial Sequence
  chemically synthesized
gtaaaatatgttaaatgaaaat

SEQ ID NO: 864376 - DNA, 22 bp, Artificial Sequence
  chemically synthesized
tgtaaaatatgttaaatgaaaa

SEQ ID NO: 864377 - DNA, 22 bp, Artificial Sequence
  chemically synthesized
ttgtaaaatatgttaaatgaaa

SEQ ID NO: 864378 - DNA, 22 bp, Artificial Sequence
  chemically synthesized
cttttgtaaaatatgttaaatg

SEQ ID NO: 864379 - DNA, 22 bp, Artificial Sequence
  chemically synthesized
ccttttgtaaaatatgttaaat

SEQ ID NO: 864380 - DNA, 22 bp, Artificial Sequence
  chemically synthesized
tttccttttgtaaaatatgtta

SEQ ID NO: 864381 - DNA, 22 bp, Artificial Sequence
  chemically synthesized
tattttcatttaacatatttta

SEQ ID NO: 864382 - DNA, 22 bp, Artificial Sequence
  chemically synthesized
ttatttccttttgtaaaatatg

SEQ ID NO: 864383 - DNA, 22 bp, Artificial Sequence
  chemically synthesized
tcatttaacatattttacaaaa

SEQ ID NO: 864384 - DNA, 22 bp, Artificial Sequence
  chemically synthesized
catttaacatattttacaaaag

SEQ ID NO: 864385 - DNA, 22 bp, Artificial Sequence
  chemically synthesized
atttaacatattttacaaaagg

SEQ ID NO: 864386 - DNA, 22 bp, Artificial Sequence
  chemically synthesized
atgaacctattatttccttttg

SEQ ID NO: 864387 - DNA, 22 bp, Artificial Sequence
  chemically synthesized
aacatattttacaaaaggaaat

SEQ ID NO: 864388 - DNA, 22 bp, Artificial Sequence
  chemically synthesized
acatattttacaaaaggaaata

SEQ ID NO: 864389 - DNA, 22 bp, Artificial Sequence
  chemically synthesized
attcatgaacctattatttcct

SEQ ID NO: 864390 - DNA, 22 bp, Artificial Sequence
  chemically synthesized
tcattcatgaacctattatttc

SEQ ID NO: 864391 - DNA, 22 bp, Artificial Sequence
  chemically synthesized
ctcattcatgaacctattattt

SEQ ID NO: 864392 - DNA, 22 bp, Artificial Sequence
  chemically synthesized
tctcattcatgaacctattatt

SEQ ID NO: 864393 - DNA, 22 bp, Artificial Sequence
  chemically synthesized
tacaaaaggaaataataggttc

SEQ ID NO: 864394 - DNA, 22 bp, Artificial Sequence
  chemically synthesized
acaaaaggaaataataggttca

SEQ ID NO: 864395 - DNA, 22 bp, Artificial Sequence
  chemically synthesized
caaaaggaaataataggttcat

SEQ ID NO: 864396 - DNA, 22 bp, Artificial Sequence
  chemically synthesized
atgaatgagaaagctgttttct

SEQ ID NO: 864397 - DNA, 22 bp, Artificial Sequence
  chemically synthesized
tcaaagacacgacagaaaacag

SEQ ID NO: 864398 - DNA, 22 bp, Artificial Sequence
  chemically synthesized
agattatcaaagacacgacaga

SEQ ID NO: 864399 - DNA, 22 bp, Artificial Sequence
  chemically synthesized
aattcagattatcaaagacacg

SEQ ID NO: 864400 - DNA, 22 bp, Artificial Sequence
  chemically synthesized
ttttctgtcgtgtctttgataa

SEQ ID NO: 864401 - DNA, 22 bp, Artificial Sequence
  chemically synthesized
gactaaattcagattatcaaag

SEQ ID NO: 864402 - DNA, 22 bp, Artificial Sequence
  chemically synthesized
tctgtcgtgtctttgataatct

SEQ ID NO: 864403 - DNA, 22 bp, Artificial Sequence
  chemically synthesized
ctgtcgtgtctttgataatctg

SEQ ID NO: 864404 - DNA, 22 bp, Artificial Sequence
  chemically synthesized
ttagactaaattcagattatca

SEQ ID NO: 864405 - DNA, 22 bp, Artificial Sequence
  chemically synthesized
tgtcgtgtctttgataatctga

SEQ ID NO: 864406 - DNA, 22 bp, Artificial Sequence
  chemically synthesized
tgttagactaaattcagattat

SEQ ID NO: 864407 - DNA, 22 bp, Artificial Sequence
  chemically synthesized
tcgtgtctttgataatctgaat

SEQ ID NO: 864408 - DNA, 22 bp, Artificial Sequence
  chemically synthesized
ttctgttagactaaattcagat

SEQ ID NO: 864409 - DNA, 22 bp, Artificial Sequence
  chemically synthesized
tgataatctgaatttagtctaa

SEQ ID NO: 864410 - DNA, 22 bp, Artificial Sequence
  chemically synthesized
gataatctgaatttagtctaac

SEQ ID NO: 864411 - DNA, 22 bp, Artificial Sequence
  chemically synthesized
ataatctgaatttagtctaaca

SEQ ID NO: 864412 - DNA, 22 bp, Artificial Sequence
  chemically synthesized
aatgaaagctattctgttagac

SEQ ID NO: 864413 - DNA, 22 bp, Artificial Sequence
  chemically synthesized
aaatgaaagctattctgttaga

SEQ ID NO: 864414 - DNA, 22 bp, Artificial Sequence
  chemically synthesized
aatttagtctaacagaatagct

SEQ ID NO: 864415 - DNA, 22 bp, Artificial Sequence
  chemically synthesized
agtctaacagaatagctttcat

SEQ ID NO: 864416 - DNA, 22 bp, Artificial Sequence
  chemically synthesized
gtctaacagaatagctttcatt

SEQ ID NO: 864417 - DNA, 22 bp, Artificial Sequence
  chemically synthesized
agtaataatacttaaatgaaag

SEQ ID NO: 864418 - DNA, 22 bp, Artificial Sequence
  chemically synthesized
acagaatagctttcatttaagt

SEQ ID NO: 864419 - DNA, 22 bp, Artificial Sequence
  chemically synthesized
ttcagtaataatacttaaatga

SEQ ID NO: 864420 - DNA, 22 bp, Artificial Sequence
  chemically synthesized
gtaattattcagtaataatact

SEQ ID NO: 864421 - DNA, 22 bp, Artificial Sequence
  chemically synthesized
tcatttaagtattattactgaa

SEQ ID NO: 864422 - DNA, 22 bp, Artificial Sequence
  chemically synthesized
agttagtaattattcagtaata

SEQ ID NO: 864423 - DNA, 22 bp, Artificial Sequence
  chemically synthesized
catttaagtattattactgaat

SEQ ID NO: 864424 - DNA, 22 bp, Artificial Sequence
  chemically synthesized
atttaagtattattactgaata

SEQ ID NO: 864425 - DNA, 22 bp, Artificial Sequence
  chemically synthesized
ctaagttagtaattattcagta

SEQ ID NO: 864426 - DNA, 22 bp, Artificial Sequence
  chemically synthesized
actaagttagtaattattcagt

SEQ ID NO: 864427 - DNA, 22 bp, Artificial Sequence
  chemically synthesized
tactaagttagtaattattcag

SEQ ID NO: 864428 - DNA, 22 bp, Artificial Sequence
  chemically synthesized
aagtattattactgaataatta

SEQ ID NO: 864429 - DNA, 22 bp, Artificial Sequence
  chemically synthesized
agtattattactgaataattac

SEQ ID NO: 864430 - DNA, 22 bp, Artificial Sequence
  chemically synthesized
ttactgaataattactaactta

SEQ ID NO: 864431 - DNA, 22 bp, Artificial Sequence
  chemically synthesized
ctgaataattactaacttagta

SEQ ID NO: 864432 - DNA, 22 bp, Artificial Sequence
  chemically synthesized
aataattactaacttagtaaag

SEQ ID NO: 864433 - DNA, 22 bp, Artificial Sequence
  chemically synthesized
agtaggtataaaccctttacta

SEQ ID NO: 864434 - DNA, 22 bp, Artificial Sequence
  chemically synthesized
ctaagtaggtataaacccttta

SEQ ID NO: 864435 - DNA, 22 bp, Artificial Sequence
  chemically synthesized
ctaacttagtaaagggtttata

SEQ ID NO: 864436 - DNA, 22 bp, Artificial Sequence
  chemically synthesized
gttactaagtaggtataaaccc

SEQ ID NO: 864437 - DNA, 22 bp, Artificial Sequence
  chemically synthesized
cgttactaagtaggtataaacc

SEQ ID NO: 864438 - DNA, 22 bp, Artificial Sequence
  chemically synthesized
acttagtaaagggtttatacct

SEQ ID NO: 864439 - DNA, 22 bp, Artificial Sequence
  chemically synthesized
cttcgttactaagtaggtataa

SEQ ID NO: 864440 - DNA, 22 bp, Artificial Sequence
  chemically synthesized
agtaaagggtttatacctactt

SEQ ID NO: 864441 - DNA, 22 bp, Artificial Sequence
  chemically synthesized
gtaaagggtttatacctactta

SEQ ID NO: 864442 - DNA, 22 bp, Artificial Sequence
  chemically synthesized
atacctacttagtaacgaagca

SEQ ID NO: 864443 - DNA, 22 bp, Artificial Sequence
  chemically synthesized
tacctacttagtaacgaagcag

SEQ ID NO: 864444 - DNA, 22 bp, Artificial Sequence
  chemically synthesized
cttagtaacgaagcaggatatt

SEQ ID NO: 864445 - DNA, 22 bp, Artificial Sequence
  chemically synthesized
agtaacgaagcaggatatttcc

SEQ ID NO: 864446 - DNA, 22 bp, Artificial Sequence
  chemically synthesized
gtaacgaagcaggatatttccc

SEQ ID NO: 864447 - DNA, 22 bp, Artificial Sequence
  chemically synthesized
cacaaaggggtcagggaaatat

SEQ ID NO: 864448 - DNA, 22 bp, Artificial Sequence
  chemically synthesized
cgagttccacaaaggggtcagg

SEQ ID NO: 864449 - DNA, 22 bp, Artificial Sequence
  chemically synthesized
ttgcgagttccacaaaggggtc

SEQ ID NO: 864450 - DNA, 22 bp, Artificial Sequence
  chemically synthesized
ccctgacccctttgtggaactc

SEQ ID NO: 864451 - DNA, 22 bp, Artificial Sequence
  chemically synthesized
cctgacccctttgtggaactcg

SEQ ID NO: 864452 - DNA, 22 bp, Artificial Sequence
  chemically synthesized
acccctttgtggaactcgcaac

SEQ ID NO: 864453 - DNA, 22 bp, Artificial Sequence
  chemically synthesized
agtaaataaggcacccctgttg

SEQ ID NO: 864454 - DNA, 22 bp, Artificial Sequence
  chemically synthesized
tgtggaactcgcaacaggggtg

SEQ ID NO: 864455 - DNA, 22 bp, Artificial Sequence
  chemically synthesized
gtggaactcgcaacaggggtgc

SEQ ID NO: 864456 - DNA, 22 bp, Artificial Sequence
  chemically synthesized
tggaactcgcaacaggggtgcc

SEQ ID NO: 864457 - DNA, 22 bp, Artificial Sequence
  chemically synthesized
gcaacaggggtgccttatttac

SEQ ID NO: 864458 - DNA, 22 bp, Artificial Sequence
  chemically synthesized
agagcagtgggctaagtaaata

SEQ ID NO: 864459 - DNA, 22 bp, Artificial Sequence
  chemically synthesized
atttacttagcccactgctctc

SEQ ID NO: 864460 - DNA, 22 bp, Artificial Sequence
  chemically synthesized
cagtgaggagttgagagcagtg

SEQ ID NO: 864461 - DNA, 22 bp, Artificial Sequence
  chemically synthesized
tttacttagcccactgctctca

SEQ ID NO: 864462 - DNA, 22 bp, Artificial Sequence
  chemically synthesized
acttagcccactgctctcaact

SEQ ID NO: 864463 - DNA, 22 bp, Artificial Sequence
  chemically synthesized
cctccagtgaggagttgagagc

SEQ ID NO: 864464 - DNA, 22 bp, Artificial Sequence
  chemically synthesized
cttagcccactgctctcaactc

SEQ ID NO: 864465 - DNA, 22 bp, Artificial Sequence
  chemically synthesized
agcccactgctctcaactcctc

SEQ ID NO: 864466 - DNA, 22 bp, Artificial Sequence
  chemically synthesized
gcccactgctctcaactcctca

SEQ ID NO: 864467 - DNA, 22 bp, Artificial Sequence
  chemically synthesized
cacactccctccagtgaggagt

SEQ ID NO: 864468 - DNA, 22 bp, Artificial Sequence
  chemically synthesized
gcacactccctccagtgaggag

SEQ ID NO: 864469 - DNA, 22 bp, Artificial Sequence
  chemically synthesized
cttgcacactccctccagtgag

SEQ ID NO: 864470 - DNA, 22 bp, Artificial Sequence
  chemically synthesized
gcttgcacactccctccagtga

SEQ ID NO: 864471 - DNA, 22 bp, Artificial Sequence
  chemically synthesized
ctctcaactcctcactggaggg

SEQ ID NO: 864472 - DNA, 22 bp, Artificial Sequence
  chemically synthesized
tcaactcctcactggagggagt

SEQ ID NO: 864473 - DNA, 22 bp, Artificial Sequence
  chemically synthesized
gtttgcttgcacactccctcca

SEQ ID NO: 864474 - DNA, 22 bp, Artificial Sequence
  chemically synthesized
aactcctcactggagggagtgt

SEQ ID NO: 864475 - DNA, 22 bp, Artificial Sequence
  chemically synthesized
ctcactggagggagtgtgcaag

SEQ ID NO: 864476 - DNA, 22 bp, Artificial Sequence
  chemically synthesized
ccacctcgtttgcttgcacact

SEQ ID NO: 864477 - DNA, 22 bp, Artificial Sequence
  chemically synthesized
actggagggagtgtgcaagcaa

SEQ ID NO: 864478 - DNA, 22 bp, Artificial Sequence
  chemically synthesized
cagttcccacctcgtttgcttg

SEQ ID NO: 864479 - DNA, 22 bp, Artificial Sequence
  chemically synthesized
gagggagtgtgcaagcaaacga

SEQ ID NO: 864480 - DNA, 22 bp, Artificial Sequence
  chemically synthesized
atgcactccagttcccacctcg

SEQ ID NO: 864481 - DNA, 22 bp, Artificial Sequence
  chemically synthesized
cagtgctcatgcactccagttc

SEQ ID NO: 864482 - DNA, 22 bp, Artificial Sequence
  chemically synthesized
ctccagtgctcatgcactccag

SEQ ID NO: 864483 - DNA, 22 bp, Artificial Sequence
  chemically synthesized
gatgctgctccagtgctcatgc

SEQ ID NO: 864484 - DNA, 22 bp, Artificial Sequence
  chemically synthesized
cacctagatgctgctccagtgc

SEQ ID NO: 864485 - DNA, 22 bp, Artificial Sequence
  chemically synthesized
gagtgcatgagcactggagcag

SEQ ID NO: 864486 - DNA, 22 bp, Artificial Sequence
  chemically synthesized
gagcagcatctaggtggaggcg

SEQ ID NO: 864487 - DNA, 22 bp, Artificial Sequence
  chemically synthesized
aggggtcgcagacgcctccacc

SEQ ID NO: 864488 - DNA, 22 bp, Artificial Sequence
  chemically synthesized
caggggtcgcagacgcctccac

SEQ ID NO: 864489 - DNA, 22 bp, Artificial Sequence
  chemically synthesized
gggcttcaggggtcgcagacgc

SEQ ID NO: 864490 - DNA, 22 bp, Artificial Sequence
  chemically synthesized
tggggcttcaggggtcgcagac

SEQ ID NO: 864491 - DNA, 22 bp, Artificial Sequence
  chemically synthesized
ggtggaggcgtctgcgacccct

SEQ ID NO: 864492 - DNA, 22 bp, Artificial Sequence
  chemically synthesized
taacacaccctctggggcttca

SEQ ID NO: 864493 - DNA, 22 bp, Artificial Sequence
  chemically synthesized
cgacccctgaagccccagaggg

SEQ ID NO: 864494 - DNA, 22 bp, Artificial Sequence
  chemically synthesized
acagagcactgtaacacaccct

SEQ ID NO: 864495 - DNA, 22 bp, Artificial Sequence
  chemically synthesized
aagccccagagggtgtgttaca

SEQ ID NO: 864496 - DNA, 22 bp, Artificial Sequence
  chemically synthesized
tccgtggatggcagagctaaca

SEQ ID NO: 864497 - DNA, 22 bp, Artificial Sequence
  chemically synthesized
cagtgctctgttagctctgcca

SEQ ID NO: 864498 - DNA, 22 bp, Artificial Sequence
  chemically synthesized
agctgtccgtggatggcagagc

SEQ ID NO: 864499 - DNA, 22 bp, Artificial Sequence
  chemically synthesized
tgttagctctgccatccacgga

SEQ ID NO: 864500 - DNA, 22 bp, Artificial Sequence
  chemically synthesized
acgcctaagctgtccgtggatg

SEQ ID NO: 864501 - DNA, 22 bp, Artificial Sequence
  chemically synthesized
ttagctctgccatccacggaca

SEQ ID NO: 864502 - DNA, 22 bp, Artificial Sequence
  chemically synthesized
ttaacgcctaagctgtccgtgg

SEQ ID NO: 864503 - DNA, 22 bp, Artificial Sequence
  chemically synthesized
gctctgccatccacggacagct

SEQ ID NO: 864504 - DNA, 22 bp, Artificial Sequence
  chemically synthesized
agctgttaacgcctaagctgtc

SEQ ID NO: 864505 - DNA, 22 bp, Artificial Sequence
  chemically synthesized
tgccatccacggacagcttagg

SEQ ID NO: 864506 - DNA, 22 bp, Artificial Sequence
  chemically synthesized
ccatccacggacagcttaggcg

SEQ ID NO: 864507 - DNA, 22 bp, Artificial Sequence
  chemically synthesized
aggcgttaacagctcagtgggc

SEQ ID NO: 864508 - DNA, 22 bp, Artificial Sequence
  chemically synthesized
ggcgttaacagctcagtgggcc

SEQ ID NO: 864509 - DNA, 22 bp, Artificial Sequence
  chemically synthesized
tgaaaagacaaatggcccactg

SEQ ID NO: 864510 - DNA, 22 bp, Artificial Sequence
  chemically synthesized
ctgtgaaaagacaaatggccca

SEQ ID NO: 864511 - DNA, 22 bp, Artificial Sequence
  chemically synthesized
acagctcagtgggccatttgtc

SEQ ID NO: 864512 - DNA, 22 bp, Artificial Sequence
  chemically synthesized
cctcctgtgaaaagacaaatgg

SEQ ID NO: 864513 - DNA, 22 bp, Artificial Sequence
  chemically synthesized
agtgggccatttgtcttttcac

SEQ ID NO: 864514 - DNA, 22 bp, Artificial Sequence
  chemically synthesized
gtggagggcagctgcctcctgt

SEQ ID NO: 864515 - DNA, 22 bp, Artificial Sequence
  chemically synthesized
ctggtggagggcagctgcctcc

SEQ ID NO: 864516 - DNA, 22 bp, Artificial Sequence
  chemically synthesized
gtcttttcacaggaggcagctg

SEQ ID NO: 864517 - DNA, 22 bp, Artificial Sequence
  chemically synthesized
gctggtggagggcagctgcctc

SEQ ID NO: 864518 - DNA, 22 bp, Artificial Sequence
  chemically synthesized
tcttttcacaggaggcagctgc

SEQ ID NO: 864519 - DNA, 22 bp, Artificial Sequence
  chemically synthesized
ttcacaggaggcagctgccctc

SEQ ID NO: 864520 - DNA, 22 bp, Artificial Sequence
  chemically synthesized
cccttgctggtggagggcagct

SEQ ID NO: 864521 - DNA, 22 bp, Artificial Sequence
  chemically synthesized
tcacaggaggcagctgccctcc

SEQ ID NO: 864522 - DNA, 22 bp, Artificial Sequence
  chemically synthesized
gcccttgctggtggagggcagc

SEQ ID NO: 864523 - DNA, 22 bp, Artificial Sequence
  chemically synthesized
cacaggaggcagctgccctcca

SEQ ID NO: 864524 - DNA, 22 bp, Artificial Sequence
  chemically synthesized
tgcccttgctggtggagggcag

SEQ ID NO: 864525 - DNA, 22 bp, Artificial Sequence
  chemically synthesized
acaggaggcagctgccctccac

SEQ ID NO: 864526 - DNA, 22 bp, Artificial Sequence
  chemically synthesized
ccctccaccagcaagggcaaag

SEQ ID NO: 864527 - DNA, 22 bp, Artificial Sequence
  chemically synthesized
caccagcaagggcaaagggcct

SEQ ID NO: 864528 - DNA, 22 bp, Artificial Sequence
  chemically synthesized
aggagccacaagtgtgaataca

SEQ ID NO: 864529 - DNA, 22 bp, Artificial Sequence
  chemically synthesized
ttgtattcacacttgtggctcc

SEQ ID NO: 864530 - DNA, 22 bp, Artificial Sequence
  chemically synthesized
gacaagagctcaggagccacaa

SEQ ID NO: 864531 - DNA, 22 bp, Artificial Sequence
  chemically synthesized
tgtattcacacttgtggctcct

SEQ ID NO: 864532 - DNA, 22 bp, Artificial Sequence
  chemically synthesized
gtattcacacttgtggctcctg

SEQ ID NO: 864533 - DNA, 22 bp, Artificial Sequence
  chemically synthesized
tattcacacttgtggctcctga

SEQ ID NO: 864534 - DNA, 22 bp, Artificial Sequence
  chemically synthesized
gatgctggacaagagctcagga

SEQ ID NO: 864535 - DNA, 22 bp, Artificial Sequence
  chemically synthesized
acacttgtggctcctgagctct

SEQ ID NO: 864536 - DNA, 22 bp, Artificial Sequence
  chemically synthesized
cctagatgctggacaagagctc

SEQ ID NO: 864537 - DNA, 22 bp, Artificial Sequence
  chemically synthesized
ccctagatgctggacaagagct

SEQ ID NO: 864538 - DNA, 22 bp, Artificial Sequence
  chemically synthesized
tccctagatgctggacaagagc

SEQ ID NO: 864539 - DNA, 22 bp, Artificial Sequence
  chemically synthesized
gtggctcctgagctcttgtcca

SEQ ID NO: 864540 - DNA, 22 bp, Artificial Sequence
  chemically synthesized
tggctcctgagctcttgtccag

SEQ ID NO: 864541 - DNA, 22 bp, Artificial Sequence
  chemically synthesized
attttccctagatgctggacaa

SEQ ID NO: 864542 - DNA, 22 bp, Artificial Sequence
  chemically synthesized
ctgagctcttgtccagcatcta

SEQ ID NO: 864543 - DNA, 22 bp, Artificial Sequence
  chemically synthesized
agctcttgtccagcatctaggg

SEQ ID NO: 864544 - DNA, 22 bp, Artificial Sequence
  chemically synthesized
atgtgacctcattttccctaga

SEQ ID NO: 864545 - DNA, 22 bp, Artificial Sequence
  chemically synthesized
ttgtccagcatctagggaaaat

SEQ ID NO: 864546 - DNA, 22 bp, Artificial Sequence
  chemically synthesized
ttcatgtgacctcattttccct

SEQ ID NO: 864547 - DNA, 22 bp, Artificial Sequence
  chemically synthesized
gtccagcatctagggaaaatga

SEQ ID NO: 864548 - DNA, 22 bp, Artificial Sequence
  chemically synthesized
gttcatgtgacctcattttccc

SEQ ID NO: 864549 - DNA, 22 bp, Artificial Sequence
  chemically synthesized
tccagcatctagggaaaatgag

SEQ ID NO: 864550 - DNA, 22 bp, Artificial Sequence
  chemically synthesized
aatttgttcatgtgacctcatt

SEQ ID NO: 864551 - DNA, 22 bp, Artificial Sequence
  chemically synthesized
caatttgttcatgtgacctcat

SEQ ID NO: 864552 - DNA, 22 bp, Artificial Sequence
  chemically synthesized
gggaaaatgaggtcacatgaac

SEQ ID NO: 864553 - DNA, 22 bp, Artificial Sequence
  chemically synthesized
caatccttcaatttgttcatgt

SEQ ID NO: 864554 - DNA, 22 bp, Artificial Sequence
  chemically synthesized
acaatccttcaatttgttcatg

SEQ ID NO: 864555 - DNA, 22 bp, Artificial Sequence
  chemically synthesized
acatttacaatccttcaatttg

SEQ ID NO: 864556 - DNA, 22 bp, Artificial Sequence
  chemically synthesized
aaggattgtaaatgtgagggat

SEQ ID NO: 864557 - DNA, 22 bp, Artificial Sequence
  chemically synthesized
atcggcagtacaatccctcaca

SEQ ID NO: 864558 - DNA, 22 bp, Artificial Sequence
  chemically synthesized
catcggcagtacaatccctcac

SEQ ID NO: 864559 - DNA, 22 bp, Artificial Sequence
  chemically synthesized
tcatcggcagtacaatccctca

SEQ ID NO: 864560 - DNA, 22 bp, Artificial Sequence
  chemically synthesized
taaatgtgagggattgtactgc

SEQ ID NO: 864561 - DNA, 22 bp, Artificial Sequence
  chemically synthesized
agagccactttcatcggcagta

SEQ ID NO: 864562 - DNA, 22 bp, Artificial Sequence
  chemically synthesized
ccactgagagccactttcatcg

SEQ ID NO: 864563 - DNA, 22 bp, Artificial Sequence
  chemically synthesized
cccactgagagccactttcatc

SEQ ID NO: 864564 - DNA, 22 bp, Artificial Sequence
  chemically synthesized
tactgccgatgaaagtggctct

SEQ ID NO: 864565 - DNA, 22 bp, Artificial Sequence
  chemically synthesized
cccttcccactgagagccactt

SEQ ID NO: 864566 - DNA, 22 bp, Artificial Sequence
  chemically synthesized
ccgatgaaagtggctctcagtg

SEQ ID NO: 864567 - DNA, 22 bp, Artificial Sequence
  chemically synthesized
agctccccttcccactgagagc

SEQ ID NO: 864568 - DNA, 22 bp, Artificial Sequence
  chemically synthesized
cagctccccttcccactgagag

SEQ ID NO: 864569 - DNA, 22 bp, Artificial Sequence
  chemically synthesized
tcagctccccttcccactgaga

SEQ ID NO: 864570 - DNA, 22 bp, Artificial Sequence
  chemically synthesized
ttcagctccccttcccactgag

SEQ ID NO: 864571 - DNA, 22 bp, Artificial Sequence
  chemically synthesized
tcagtgggaaggggagctgaaa

SEQ ID NO: 864572 - DNA, 22 bp, Artificial Sequence
  chemically synthesized
agtgggaaggggagctgaaaag

SEQ ID NO: 864573 - DNA, 22 bp, Artificial Sequence
  chemically synthesized
ccacccccatccccttttcagc

SEQ ID NO: 864574 - DNA, 22 bp, Artificial Sequence
  chemically synthesized
gccacccccatccccttttcag

SEQ ID NO: 864575 - DNA, 22 bp, Artificial Sequence
  chemically synthesized
cttgccacccccatcccctttt

SEQ ID NO: 864576 - DNA, 22 bp, Artificial Sequence
  chemically synthesized
aaaaggggatgggggtggcaag

SEQ ID NO: 864577 - DNA, 22 bp, Artificial Sequence
  chemically synthesized
aggggaagattacttgccaccc

SEQ ID NO: 864578 - DNA, 22 bp, Artificial Sequence
  chemically synthesized
caggggaagattacttgccacc

SEQ ID NO: 864579 - DNA, 22 bp, Artificial Sequence
  chemically synthesized
gacttcaggggaagattacttg

SEQ ID NO: 864580 - DNA, 22 bp, Artificial Sequence
  chemically synthesized
gagaagaatccggctggacttc

SEQ ID NO: 864581 - DNA, 22 bp, Artificial Sequence
  chemically synthesized
agagaagaatccggctggactt

SEQ ID NO: 864582 - DNA, 22 bp, Artificial Sequence
  chemically synthesized
tagagaagaatccggctggact

SEQ ID NO: 864583 - DNA, 22 bp, Artificial Sequence
  chemically synthesized
cccctgaagtccagccggattc

SEQ ID NO: 864584 - DNA, 22 bp, Artificial Sequence
  chemically synthesized
ccctgaagtccagccggattct

SEQ ID NO: 864585 - DNA, 22 bp, Artificial Sequence
  chemically synthesized
aagtccagccggattcttctct

SEQ ID NO: 864586 - DNA, 22 bp, Artificial Sequence
  chemically synthesized
atggcataactttagagaagaa

SEQ ID NO: 864587 - DNA, 22 bp, Artificial Sequence
  chemically synthesized
gatggcataactttagagaaga

SEQ ID NO: 864588 - DNA, 22 bp, Artificial Sequence
  chemically synthesized
agagggacaacttgatggcata

SEQ ID NO: 864589 - DNA, 22 bp, Artificial Sequence
  chemically synthesized
ttctctaaagttatgccatcaa

SEQ ID NO: 864590 - DNA, 22 bp, Artificial Sequence
  chemically synthesized
cagagggacaacttgatggcat

SEQ ID NO: 864591 - DNA, 22 bp, Artificial Sequence
  chemically synthesized
ctctaaagttatgccatcaagt

SEQ ID NO: 864592 - DNA, 22 bp, Artificial Sequence
  chemically synthesized
tctaaagttatgccatcaagtt

SEQ ID NO: 864593 - DNA, 22 bp, Artificial Sequence
  chemically synthesized
acttcagagggacaacttgatg

SEQ ID NO: 864594 - DNA, 22 bp, Artificial Sequence
  chemically synthesized
taaagttatgccatcaagttgt

SEQ ID NO: 864595 - DNA, 22 bp, Artificial Sequence
  chemically synthesized
gacttcagagggacaacttgat

SEQ ID NO: 864596 - DNA, 22 bp, Artificial Sequence
  chemically synthesized
aagttatgccatcaagttgtcc

SEQ ID NO: 864597 - DNA, 22 bp, Artificial Sequence
  chemically synthesized
tgccatcaagttgtccctctga

SEQ ID NO: 864598 - DNA, 22 bp, Artificial Sequence
  chemically synthesized
tccctctgaagtcaagctgctt

SEQ ID NO: 864599 - DNA, 22 bp, Artificial Sequence
  chemically synthesized
gacatcagagagaagcagcttg

SEQ ID NO: 864600 - DNA, 22 bp, Artificial Sequence
  chemically synthesized
tgaagtcaagctgcttctctct

SEQ ID NO: 864601 - DNA, 22 bp, Artificial Sequence
  chemically synthesized
cagctggacatcagagagaagc

SEQ ID NO: 864602 - DNA, 22 bp, Artificial Sequence
  chemically synthesized
aagtcaagctgcttctctctga

SEQ ID NO: 864603 - DNA, 22 bp, Artificial Sequence
  chemically synthesized
cttctctctgatgtccagctgt

SEQ ID NO: 864604 - DNA, 22 bp, Artificial Sequence
  chemically synthesized
gtagacaggactacagctggac

SEQ ID NO: 864605 - DNA, 22 bp, Artificial Sequence
  chemically synthesized
ctctctgatgtccagctgtagt

SEQ ID NO: 864606 - DNA, 22 bp, Artificial Sequence
  chemically synthesized
tctctgatgtccagctgtagtc

SEQ ID NO: 864607 - DNA, 22 bp, Artificial Sequence
  chemically synthesized
agctggtagacaggactacagc

SEQ ID NO: 864608 - DNA, 22 bp, Artificial Sequence
  chemically synthesized
tctgatgtccagctgtagtcct

SEQ ID NO: 864609 - DNA, 22 bp, Artificial Sequence
  chemically synthesized
tgatgtccagctgtagtcctgt

SEQ ID NO: 864610 - DNA, 22 bp, Artificial Sequence
  chemically synthesized
atgtccagctgtagtcctgtct

SEQ ID NO: 864611 - DNA, 22 bp, Artificial Sequence
  chemically synthesized
tagtcctgtctaccagctgagt

SEQ ID NO: 864612 - DNA, 22 bp, Artificial Sequence
  chemically synthesized
taaaaaccccagactcagctgg

SEQ ID NO: 864613 - DNA, 22 bp, Artificial Sequence
  chemically synthesized
tgcctataaaaaccccagactc

SEQ ID NO: 864614 - DNA, 22 bp, Artificial Sequence
  chemically synthesized
tctaccagctgagtctggggtt

SEQ ID NO: 864615 - DNA, 22 bp, Artificial Sequence
  chemically synthesized
ccagctgagtctggggttttta

SEQ ID NO: 864616 - DNA, 22 bp, Artificial Sequence
  chemically synthesized
agtctggggtttttataggcac

SEQ ID NO: 864617 - DNA, 22 bp, Artificial Sequence
  chemically synthesized
gggtttttataggcacaggatg

SEQ ID NO: 864618 - DNA, 22 bp, Artificial Sequence
  chemically synthesized
ttataggcacaggatggggtgg

SEQ ID NO: 864619 - DNA, 22 bp, Artificial Sequence
  chemically synthesized
tataggcacaggatggggtggg

SEQ ID NO: 864620 - DNA, 22 bp, Artificial Sequence
  chemically synthesized
ataggcacaggatggggtgggg

SEQ ID NO: 864621 - DNA, 22 bp, Artificial Sequence
  chemically synthesized
taggcacaggatggggtggggt

SEQ ID NO: 864622 - DNA, 22 bp, Artificial Sequence
  chemically synthesized
aaccacccatggccccacccca

SEQ ID NO: 864623 - DNA, 22 bp, Artificial Sequence
  chemically synthesized
taaaccacccatggccccaccc

SEQ ID NO: 864624 - DNA, 22 bp, Artificial Sequence
  chemically synthesized
ctaaaccacccatggccccacc

SEQ ID NO: 864625 - DNA, 22 bp, Artificial Sequence
  chemically synthesized
tctaaaccacccatggccccac

SEQ ID NO: 864626 - DNA, 22 bp, Artificial Sequence
  chemically synthesized
ttctaaaccacccatggcccca

SEQ ID NO: 864627 - DNA, 22 bp, Artificial Sequence
  chemically synthesized
tttctaaaccacccatggcccc

SEQ ID NO: 864628 - DNA, 22 bp, Artificial Sequence
  chemically synthesized
cctttttctaaaccacccatgg

SEQ ID NO: 864629 - DNA, 22 bp, Artificial Sequence
  chemically synthesized
gaatgttgcctttttctaaacc

SEQ ID NO: 864630 - DNA, 22 bp, Artificial Sequence
  chemically synthesized
ctcgaatgttgcctttttctaa

SEQ ID NO: 864631 - DNA, 22 bp, Artificial Sequence
  chemically synthesized
ctgctcgaatgttgcctttttc

SEQ ID NO: 864632 - DNA, 22 bp, Artificial Sequence
  chemically synthesized
cctgctcgaatgttgccttttt

SEQ ID NO: 864633 - DNA, 22 bp, Artificial Sequence
  chemically synthesized
tcctgctcgaatgttgcctttt

SEQ ID NO: 864634 - DNA, 22 bp, Artificial Sequence
  chemically synthesized
agaaaaaggcaacattcgagca

SEQ ID NO: 864635 - DNA, 22 bp, Artificial Sequence
  chemically synthesized
gaaaaaggcaacattcgagcag

SEQ ID NO: 864636 - DNA, 22 bp, Artificial Sequence
  chemically synthesized
tatcccagttttcctgctcgaa

SEQ ID NO: 864637 - DNA, 22 bp, Artificial Sequence
  chemically synthesized
atatcccagttttcctgctcga

SEQ ID NO: 864638 - DNA, 22 bp, Artificial Sequence
  chemically synthesized
aaagtgggaacttatatcccag

SEQ ID NO: 864639 - DNA, 22 bp, Artificial Sequence
  chemically synthesized
gagcaggaaaactgggatataa

SEQ ID NO: 864640 - DNA, 22 bp, Artificial Sequence
  chemically synthesized
aaaccgcagctcaaagtgggaa

SEQ ID NO: 864641 - DNA, 22 bp, Artificial Sequence
  chemically synthesized
ggatataagttcccactttgag

SEQ ID NO: 864642 - DNA, 22 bp, Artificial Sequence
  chemically synthesized
ccactttgagctgcggtttcag

SEQ ID NO: 864643 - DNA, 22 bp, Artificial Sequence
  chemically synthesized
aagccaaaaagcctgaaaccgc

SEQ ID NO: 864644 - DNA, 22 bp, Artificial Sequence
  chemically synthesized
tgagctgcggtttcaggctttt

SEQ ID NO: 864645 - DNA, 22 bp, Artificial Sequence
  chemically synthesized
gagctgcggtttcaggcttttt

SEQ ID NO: 864646 - DNA, 22 bp, Artificial Sequence
  chemically synthesized
agctgcggtttcaggctttttg

SEQ ID NO: 864647 - DNA, 22 bp, Artificial Sequence
  chemically synthesized
cggtttcaggctttttggcttg

SEQ ID NO: 864648 - DNA, 22 bp, Artificial Sequence
  chemically synthesized
caggctttttggcttgagggtg

SEQ ID NO: 864649 - DNA, 22 bp, Artificial Sequence
  chemically synthesized
aggctttttggcttgagggtgg

SEQ ID NO: 864650 - DNA, 22 bp, Artificial Sequence
  chemically synthesized
tttggcttgagggtggggtttt

SEQ ID NO: 864651 - DNA, 22 bp, Artificial Sequence
  chemically synthesized
ttggcttgagggtggggttttc

SEQ ID NO: 864652 - DNA, 22 bp, Artificial Sequence
  chemically synthesized
tggcttgagggtggggttttcg

SEQ ID NO: 864653 - DNA, 22 bp, Artificial Sequence
  chemically synthesized
ggcttgagggtggggttttcgc

SEQ ID NO: 864654 - DNA, 22 bp, Artificial Sequence
  chemically synthesized
gcttgagggtggggttttcgct

SEQ ID NO: 864655 - DNA, 22 bp, Artificial Sequence
  chemically synthesized
gagggtggggttttcgctgggg

SEQ ID NO: 864656 - DNA, 22 bp, Artificial Sequence
  chemically synthesized
agggtggggttttcgctgggga

SEQ ID NO: 864657 - DNA, 22 bp, Artificial Sequence
  chemically synthesized
ggcagaaaagggatggtcccca

SEQ ID NO: 864658 - DNA, 22 bp, Artificial Sequence
  chemically synthesized
taggcagaaaagggatggtccc

SEQ ID NO: 864659 - DNA, 22 bp, Artificial Sequence
  chemically synthesized
tcgctggggaccatcccttttc

SEQ ID NO: 864660 - DNA, 22 bp, Artificial Sequence
  chemically synthesized
cgctggggaccatcccttttct

SEQ ID NO: 864661 - DNA, 22 bp, Artificial Sequence
  chemically synthesized
gctggggaccatcccttttctg

SEQ ID NO: 864662 - DNA, 22 bp, Artificial Sequence
  chemically synthesized
gggaccatcccttttctgccta

SEQ ID NO: 864663 - DNA, 22 bp, Artificial Sequence
  chemically synthesized
ttctgcctagagcttctctgcc

SEQ ID NO: 864664 - DNA, 22 bp, Artificial Sequence
  chemically synthesized
atagcggcaggaggcagagaag

SEQ ID NO: 864665 - DNA, 22 bp, Artificial Sequence
  chemically synthesized
tctgcctagagcttctctgcct

SEQ ID NO: 864666 - DNA, 22 bp, Artificial Sequence
  chemically synthesized
ctgcctagagcttctctgcctc

SEQ ID NO: 864667 - DNA, 22 bp, Artificial Sequence
  chemically synthesized
tgcctagagcttctctgcctcc

SEQ ID NO: 864668 - DNA, 22 bp, Artificial Sequence
  chemically synthesized
cctagagcttctctgcctcctg

SEQ ID NO: 864669 - DNA, 22 bp, Artificial Sequence
  chemically synthesized
gtactgatagcggcaggaggca

SEQ ID NO: 864670 - DNA, 22 bp, Artificial Sequence
  chemically synthesized
tcgtactgatagcggcaggagg

SEQ ID NO: 864671 - DNA, 22 bp, Artificial Sequence
  chemically synthesized
gagcttctctgcctcctgccgc

SEQ ID NO: 864672 - DNA, 22 bp, Artificial Sequence
  chemically synthesized
ctctgcctcctgccgctatcag

SEQ ID NO: 864673 - DNA, 22 bp, Artificial Sequence
  chemically synthesized
tctgcctcctgccgctatcagt

SEQ ID NO: 864674 - DNA, 22 bp, Artificial Sequence
  chemically synthesized
cacaactctcgtactgatagcg

SEQ ID NO: 864675 - DNA, 22 bp, Artificial Sequence
  chemically synthesized
acacaactctcgtactgatagc

SEQ ID NO: 864676 - DNA, 22 bp, Artificial Sequence
  chemically synthesized
tgcctcctgccgctatcagtac

SEQ ID NO: 864677 - DNA, 22 bp, Artificial Sequence
  chemically synthesized
cctcctgccgctatcagtacga

SEQ ID NO: 864678 - DNA, 22 bp, Artificial Sequence
  chemically synthesized
ctgccgctatcagtacgagagt

SEQ ID NO: 864679 - DNA, 22 bp, Artificial Sequence
  chemically synthesized
ccgctatcagtacgagagttgt

SEQ ID NO: 864680 - DNA, 22 bp, Artificial Sequence
  chemically synthesized
tcagtacgagagttgtgtaaat

SEQ ID NO: 864681 - DNA, 22 bp, Artificial Sequence
  chemically synthesized
tatcaatataggcatttacaca

SEQ ID NO: 864682 - DNA, 22 bp, Artificial Sequence
  chemically synthesized
aggagcacctgtatcaatatag

SEQ ID NO: 864683 - DNA, 22 bp, Artificial Sequence
  chemically synthesized
tgtaaatgcctatattgataca

SEQ ID NO: 864684 - DNA, 22 bp, Artificial Sequence
  chemically synthesized
tacgttgaggagcacctgtatc

SEQ ID NO: 864685 - DNA, 22 bp, Artificial Sequence
  chemically synthesized
tattgatacaggtgctcctcaa

SEQ ID NO: 864686 - DNA, 22 bp, Artificial Sequence
  chemically synthesized
atacaggtgctcctcaacgtac

SEQ ID NO: 864687 - DNA, 22 bp, Artificial Sequence
  chemically synthesized
tcaggaaataatcccattgtac

SEQ ID NO: 864688 - DNA, 22 bp, Artificial Sequence
  chemically synthesized
atcaggaaataatcccattgta

SEQ ID NO: 864689 - DNA, 22 bp, Artificial Sequence
  chemically synthesized
ctcaacgtacaatgggattatt

SEQ ID NO: 864690 - DNA, 22 bp, Artificial Sequence
  chemically synthesized
aacgtacaatgggattatttcc

SEQ ID NO: 864691 - DNA, 22 bp, Artificial Sequence
  chemically synthesized
aacgtatgatgggtttatcagg

SEQ ID NO: 864692 - DNA, 22 bp, Artificial Sequence
  chemically synthesized
caacgtatgatgggtttatcag

SEQ ID NO: 864693 - DNA, 22 bp, Artificial Sequence
  chemically synthesized
tcaacgtatgatgggtttatca

SEQ ID NO: 864694 - DNA, 22 bp, Artificial Sequence
  chemically synthesized
tttcctgataaacccatcatac

SEQ ID NO: 864695 - DNA, 22 bp, Artificial Sequence
  chemically synthesized
tgatgttttcaacgtatgatgg

SEQ ID NO: 864696 - DNA, 22 bp, Artificial Sequence
  chemically synthesized
atgatgttttcaacgtatgatg

SEQ ID NO: 864697 - DNA, 22 bp, Artificial Sequence
  chemically synthesized
cctgataaacccatcatacgtt

SEQ ID NO: 864698 - DNA, 22 bp, Artificial Sequence
  chemically synthesized
ctgataaacccatcatacgttg

SEQ ID NO: 864699 - DNA, 22 bp, Artificial Sequence
  chemically synthesized
ataaacccatcatacgttgaaa

SEQ ID NO: 864700 - DNA, 22 bp, Artificial Sequence
  chemically synthesized
aatttatgatgttttcaacgta

SEQ ID NO: 864701 - DNA, 22 bp, Artificial Sequence
  chemically synthesized
caatttatgatgttttcaacgt

SEQ ID NO: 864702 - DNA, 22 bp, Artificial Sequence
  chemically synthesized
tcaatttatgatgttttcaacg

SEQ ID NO: 864703 - DNA, 22 bp, Artificial Sequence
  chemically synthesized
ttcaatttatgatgttttcaac

SEQ ID NO: 864704 - DNA, 22 bp, Artificial Sequence
  chemically synthesized
tgatgggtttttcaatttatga

SEQ ID NO: 864705 - DNA, 22 bp, Artificial Sequence
  chemically synthesized
atgatgggtttttcaatttatg

SEQ ID NO: 864706 - DNA, 22 bp, Artificial Sequence
  chemically synthesized
aaaacatcataaattgaaaaac

SEQ ID NO: 864707 - DNA, 22 bp, Artificial Sequence
  chemically synthesized
aacttatgatgggtttttcaat

SEQ ID NO: 864708 - DNA, 22 bp, Artificial Sequence
  chemically synthesized
caacttatgatgggtttttcaa

SEQ ID NO: 864709 - DNA, 22 bp, Artificial Sequence
  chemically synthesized
tcaacttatgatgggtttttca

SEQ ID NO: 864710 - DNA, 22 bp, Artificial Sequence
  chemically synthesized
tgatgttttcaacttatgatgg

SEQ ID NO: 864711 - DNA, 22 bp, Artificial Sequence
  chemically synthesized
atgatgttttcaacttatgatg

SEQ ID NO: 864712 - DNA, 22 bp, Artificial Sequence
  chemically synthesized
aaaaacccatcataagttgaaa

SEQ ID NO: 864713 - DNA, 22 bp, Artificial Sequence
  chemically synthesized
aatttatgatgttttcaactta

SEQ ID NO: 864714 - DNA, 22 bp, Artificial Sequence
  chemically synthesized
caatttatgatgttttcaactt

SEQ ID NO: 864715 - DNA, 22 bp, Artificial Sequence
  chemically synthesized
tcaatttatgatgttttcaact

SEQ ID NO: 864716 - DNA, 22 bp, Artificial Sequence
  chemically synthesized
ttcaatttatgatgttttcaac

SEQ ID NO: 864717 - DNA, 22 bp, Artificial Sequence
  chemically synthesized
aatgcatttttcaatttatgat

SEQ ID NO: 864718 - DNA, 22 bp, Artificial Sequence
  chemically synthesized
ttaaatgcatttttcaatttat

SEQ ID NO: 864719 - DNA, 22 bp, Artificial Sequence
  chemically synthesized
attaaatgcatttttcaattta

SEQ ID NO: 864720 - DNA, 22 bp, Artificial Sequence
  chemically synthesized
aaaacatcataaattgaaaaat

SEQ ID NO: 864721 - DNA, 22 bp, Artificial Sequence
  chemically synthesized
ggtttattaaatgcatttttca

SEQ ID NO: 864722 - DNA, 22 bp, Artificial Sequence
  chemically synthesized
agtaggttaggtttattaaatg

SEQ ID NO: 864723 - DNA, 22 bp, Artificial Sequence
  chemically synthesized
aaaaatgcatttaataaaccta

SEQ ID NO: 864724 - DNA, 22 bp, Artificial Sequence
  chemically synthesized
agcaatgatgttcagtaggtta

SEQ ID NO: 864725 - DNA, 22 bp, Artificial Sequence
  chemically synthesized
aataaacctaacctactgaaca

SEQ ID NO: 864726 - DNA, 22 bp, Artificial Sequence
  chemically synthesized
ataaacctaacctactgaacat

SEQ ID NO: 864727 - DNA, 22 bp, Artificial Sequence
  chemically synthesized
ggctaagcaatgatgttcagta

SEQ ID NO: 864728 - DNA, 22 bp, Artificial Sequence
  chemically synthesized
acctactgaacatcattgctta

SEQ ID NO: 864729 - DNA, 22 bp, Artificial Sequence
  chemically synthesized
aaggtaggctaggctaagcaat

SEQ ID NO: 864730 - DNA, 22 bp, Artificial Sequence
  chemically synthesized
ctgaacatcattgcttagccta

SEQ ID NO: 864731 - DNA, 22 bp, Artificial Sequence
  chemically synthesized
aacatcattgcttagcctagcc

SEQ ID NO: 864732 - DNA, 22 bp, Artificial Sequence
  chemically synthesized
accatgttgaaggtaggctagg

SEQ ID NO: 864733 - DNA, 22 bp, Artificial Sequence
  chemically synthesized
tgaccatgttgaaggtaggcta

SEQ ID NO: 864734 - DNA, 22 bp, Artificial Sequence
  chemically synthesized
cttagcctagcctaccttcaac

SEQ ID NO: 864735 - DNA, 22 bp, Artificial Sequence
  chemically synthesized
agcctagcctaccttcaacatg

SEQ ID NO: 864736 - DNA, 22 bp, Artificial Sequence
  chemically synthesized
gcctagcctaccttcaacatgg

SEQ ID NO: 864737 - DNA, 22 bp, Artificial Sequence
  chemically synthesized
atgtaagtgttctgaccatgtt

SEQ ID NO: 864738 - DNA, 22 bp, Artificial Sequence
  chemically synthesized
gcctaccttcaacatggtcaga

SEQ ID NO: 864739 - DNA, 22 bp, Artificial Sequence
  chemically synthesized
ccttcaacatggtcagaacact

SEQ ID NO: 864740 - DNA, 22 bp, Artificial Sequence
  chemically synthesized
taggctaatgtaagtgttctga

SEQ ID NO: 864741 - DNA, 22 bp, Artificial Sequence
  chemically synthesized
caacatggtcagaacacttaca

SEQ ID NO: 864742 - DNA, 22 bp, Artificial Sequence
  chemically synthesized
aacatggtcagaacacttacat

SEQ ID NO: 864743 - DNA, 22 bp, Artificial Sequence
  chemically synthesized
cccaactgtaggctaatgtaag

SEQ ID NO: 864744 - DNA, 22 bp, Artificial Sequence
  chemically synthesized
gcccaactgtaggctaatgtaa

SEQ ID NO: 864745 - DNA, 22 bp, Artificial Sequence
  chemically synthesized
tgcccaactgtaggctaatgta

SEQ ID NO: 864746 - DNA, 22 bp, Artificial Sequence
  chemically synthesized
gatgattttgcccaactgtagg

SEQ ID NO: 864747 - DNA, 22 bp, Artificial Sequence
  chemically synthesized
acattagcctacagttgggcaa

SEQ ID NO: 864748 - DNA, 22 bp, Artificial Sequence
  chemically synthesized
tgttagatgattttgcccaact

SEQ ID NO: 864749 - DNA, 22 bp, Artificial Sequence
  chemically synthesized
cattagcctacagttgggcaaa

SEQ ID NO: 864750 - DNA, 22 bp, Artificial Sequence
  chemically synthesized
gtgttagatgattttgcccaac

SEQ ID NO: 864751 - DNA, 22 bp, Artificial Sequence
  chemically synthesized
tgtgttagatgattttgcccaa

SEQ ID NO: 864752 - DNA, 22 bp, Artificial Sequence
  chemically synthesized
gcctacagttgggcaaaatcat

SEQ ID NO: 864753 - DNA, 22 bp, Artificial Sequence
  chemically synthesized
cagttgggcaaaatcatctaac

SEQ ID NO: 864754 - DNA, 22 bp, Artificial Sequence
  chemically synthesized
ataaaataggctttgtgttaga

SEQ ID NO: 864755 - DNA, 22 bp, Artificial Sequence
  chemically synthesized
aataaaataggctttgtgttag

SEQ ID NO: 864756 - DNA, 22 bp, Artificial Sequence
  chemically synthesized
ggcaaaatcatctaacacaaag

SEQ ID NO: 864757 - DNA, 22 bp, Artificial Sequence
  chemically synthesized
taataaaataggctttgtgtta

SEQ ID NO: 864758 - DNA, 22 bp, Artificial Sequence
  chemically synthesized
aacacctttaataaaataggct

SEQ ID NO: 864759 - DNA, 22 bp, Artificial Sequence
  chemically synthesized
acacaaagcctattttattaaa

SEQ ID NO: 864760 - DNA, 22 bp, Artificial Sequence
  chemically synthesized
catgagatgttcaacaccttta

SEQ ID NO: 864761 - DNA, 22 bp, Artificial Sequence
  chemically synthesized
ttttattaaaggtgttgaacat

SEQ ID NO: 864762 - DNA, 22 bp, Artificial Sequence
  chemically synthesized
tattaaaggtgttgaacatctc

SEQ ID NO: 864763 - DNA, 22 bp, Artificial Sequence
  chemically synthesized
aataaattacatgagatgttca

SEQ ID NO: 864764 - DNA, 22 bp, Artificial Sequence
  chemically synthesized
attaaaggtgttgaacatctca

SEQ ID NO: 864765 - DNA, 22 bp, Artificial Sequence
  chemically synthesized
ttaaaggtgttgaacatctcat

SEQ ID NO: 864766 - DNA, 22 bp, Artificial Sequence
  chemically synthesized
aaggtgttgaacatctcatgta

SEQ ID NO: 864767 - DNA, 22 bp, Artificial Sequence
  chemically synthesized
aatacagtattcaataaattac

SEQ ID NO: 864768 - DNA, 22 bp, Artificial Sequence
  chemically synthesized
aacatctcatgtaatttattga

SEQ ID NO: 864769 - DNA, 22 bp, Artificial Sequence
  chemically synthesized
atgttcaatacagtattcaata

SEQ ID NO: 864770 - DNA, 22 bp, Artificial Sequence
  chemically synthesized
catgttcaatacagtattcaat

SEQ ID NO: 864771 - DNA, 22 bp, Artificial Sequence
  chemically synthesized
tcatgttcaatacagtattcaa

SEQ ID NO: 864772 - DNA, 22 bp, Artificial Sequence
  chemically synthesized
ttcatgttcaatacagtattca

SEQ ID NO: 864773 - DNA, 22 bp, Artificial Sequence
  chemically synthesized
atgtaatttattgaatactgta

SEQ ID NO: 864774 - DNA, 22 bp, Artificial Sequence
  chemically synthesized
cttttcatgttcaatacagtat

SEQ ID NO: 864775 - DNA, 22 bp, Artificial Sequence
  chemically synthesized
tgcttttcatgttcaatacagt

SEQ ID NO: 864776 - DNA, 22 bp, Artificial Sequence
  chemically synthesized
ttctgcttttcatgttcaatac

SEQ ID NO: 864777 - DNA, 22 bp, Artificial Sequence
  chemically synthesized
attgaatactgtattgaacatg

SEQ ID NO: 864778 - DNA, 22 bp, Artificial Sequence
  chemically synthesized
ttgaatactgtattgaacatga

SEQ ID NO: 864779 - DNA, 22 bp, Artificial Sequence
  chemically synthesized
aatactgtattgaacatgaaaa

SEQ ID NO: 864780 - DNA, 22 bp, Artificial Sequence
  chemically synthesized
atacaactgttctgcttttcat

SEQ ID NO: 864781 - DNA, 22 bp, Artificial Sequence
  chemically synthesized
tattgaacatgaaaagcagaac

SEQ ID NO: 864782 - DNA, 22 bp, Artificial Sequence
  chemically synthesized
aagtactcatacaactgttctg

SEQ ID NO: 864783 - DNA, 22 bp, Artificial Sequence
  chemically synthesized
aacatgaaaagcagaacagttg

SEQ ID NO: 864784 - DNA, 22 bp, Artificial Sequence
  chemically synthesized
caagtactcatacaactgttct

SEQ ID NO: 864785 - DNA, 22 bp, Artificial Sequence
  chemically synthesized
agtagaaatcatacttcaagta

SEQ ID NO: 864786 - DNA, 22 bp, Artificial Sequence
  chemically synthesized
tatgagtacttgaagtatgatt

SEQ ID NO: 864787 - DNA, 22 bp, Artificial Sequence
  chemically synthesized
gaagtatgatttctactgagtg

SEQ ID NO: 864788 - DNA, 22 bp, Artificial Sequence
  chemically synthesized
aagtatgatttctactgagtgc

SEQ ID NO: 864789 - DNA, 22 bp, Artificial Sequence
  chemically synthesized
caatggtgtgaaagtaatatgc

SEQ ID NO: 864790 - DNA, 22 bp, Artificial Sequence
  chemically synthesized
acaatggtgtgaaagtaatatg

SEQ ID NO: 864791 - DNA, 22 bp, Artificial Sequence
  chemically synthesized
tacaatggtgtgaaagtaatat

SEQ ID NO: 864792 - DNA, 22 bp, Artificial Sequence
  chemically synthesized
ctactgagtgcatattactttc

SEQ ID NO: 864793 - DNA, 22 bp, Artificial Sequence
  chemically synthesized
tactgagtgcatattactttca

SEQ ID NO: 864794 - DNA, 22 bp, Artificial Sequence
  chemically synthesized
ttttacaatggtgtgaaagtaa

SEQ ID NO: 864795 - DNA, 22 bp, Artificial Sequence
  chemically synthesized
ctgagtgcatattactttcaca

SEQ ID NO: 864796 - DNA, 22 bp, Artificial Sequence
  chemically synthesized
attttacaatggtgtgaaagta

SEQ ID NO: 864797 - DNA, 22 bp, Artificial Sequence
  chemically synthesized
tattttacaatggtgtgaaagt

SEQ ID NO: 864798 - DNA, 22 bp, Artificial Sequence
  chemically synthesized
ttattttacaatggtgtgaaag

SEQ ID NO: 864799 - DNA, 22 bp, Artificial Sequence
  chemically synthesized
agtgcatattactttcacacca

SEQ ID NO: 864800 - DNA, 22 bp, Artificial Sequence
  chemically synthesized
ggatatttttattttacaatgg

SEQ ID NO: 864801 - DNA, 22 bp, Artificial Sequence
  chemically synthesized
aggatatttttattttacaatg

SEQ ID NO: 864802 - DNA, 22 bp, Artificial Sequence
  chemically synthesized
ctttcacaccattgtaaaataa

SEQ ID NO: 864803 - DNA, 22 bp, Artificial Sequence
  chemically synthesized
ggcttaggatatttttatttta

SEQ ID NO: 864804 - DNA, 22 bp, Artificial Sequence
  chemically synthesized
tcacaccattgtaaaataaaaa

SEQ ID NO: 864805 - DNA, 22 bp, Artificial Sequence
  chemically synthesized
cacaccattgtaaaataaaaat

SEQ ID NO: 864806 - DNA, 22 bp, Artificial Sequence
  chemically synthesized
acaccattgtaaaataaaaata

SEQ ID NO: 864807 - DNA, 22 bp, Artificial Sequence
  chemically synthesized
caatggttcggcttaggatatt

SEQ ID NO: 864808 - DNA, 22 bp, Artificial Sequence
  chemically synthesized
acaatggttcggcttaggatat

SEQ ID NO: 864809 - DNA, 22 bp, Artificial Sequence
  chemically synthesized
taaaataaaaatatcctaagcc

SEQ ID NO: 864810 - DNA, 22 bp, Artificial Sequence
  chemically synthesized
atttacaatggttcggcttagg

SEQ ID NO: 864811 - DNA, 22 bp, Artificial Sequence
  chemically synthesized
gatttacaatggttcggcttag

SEQ ID NO: 864812 - DNA, 22 bp, Artificial Sequence
  chemically synthesized
tgatttacaatggttcggctta

SEQ ID NO: 864813 - DNA, 22 bp, Artificial Sequence
  chemically synthesized
aaaatgttttgatttacaatgg

SEQ ID NO: 864814 - DNA, 22 bp, Artificial Sequence
  chemically synthesized
agccgaaccattgtaaatcaaa

SEQ ID NO: 864815 - DNA, 22 bp, Artificial Sequence
  chemically synthesized
taaatcaaaacatttttagatt

SEQ ID NO: 864816 - DNA, 22 bp, Artificial Sequence
  chemically synthesized
ttagattgggaccctctgtata

SEQ ID NO: 864817 - DNA, 22 bp, Artificial Sequence
  chemically synthesized
tagattgggaccctctgtatat

SEQ ID NO: 864818 - DNA, 22 bp, Artificial Sequence
  chemically synthesized
agaaataaagaaatatacagag

SEQ ID NO: 864819 - DNA, 22 bp, Artificial Sequence
  chemically synthesized
agattgggaccctctgtatatt

SEQ ID NO: 864820 - DNA, 22 bp, Artificial Sequence
  chemically synthesized
gattgggaccctctgtatattt

SEQ ID NO: 864821 - DNA, 22 bp, Artificial Sequence
  chemically synthesized
ggaccctctgtatatttcttta

SEQ ID NO: 864822 - DNA, 22 bp, Artificial Sequence
  chemically synthesized
tcaagggcctgagaaataaaga

SEQ ID NO: 864823 - DNA, 22 bp, Artificial Sequence
  chemically synthesized
gtcaagggcctgagaaataaag

SEQ ID NO: 864824 - DNA, 22 bp, Artificial Sequence
  chemically synthesized
tgtcaagggcctgagaaataaa

SEQ ID NO: 864825 - DNA, 22 bp, Artificial Sequence
  chemically synthesized
ttgtcaagggcctgagaaataa

SEQ ID NO: 864826 - DNA, 22 bp, Artificial Sequence
  chemically synthesized
tgtatatttctttatttctcag

SEQ ID NO: 864827 - DNA, 22 bp, Artificial Sequence
  chemically synthesized
tatatttctttatttctcaggc

SEQ ID NO: 864828 - DNA, 22 bp, Artificial Sequence
  chemically synthesized
cttttgtcaagggcctgagaaa

SEQ ID NO: 864829 - DNA, 22 bp, Artificial Sequence
  chemically synthesized
tctccttttgtcaagggcctga

SEQ ID NO: 864830 - DNA, 22 bp, Artificial Sequence
  chemically synthesized
ctttatttctcaggcccttgac

SEQ ID NO: 864831 - DNA, 22 bp, Artificial Sequence
  chemically synthesized
tttatttctcaggcccttgaca

SEQ ID NO: 864832 - DNA, 22 bp, Artificial Sequence
  chemically synthesized
aattatctccttttgtcaaggg

SEQ ID NO: 864833 - DNA, 22 bp, Artificial Sequence
  chemically synthesized
tatttctcaggcccttgacaaa

SEQ ID NO: 864834 - DNA, 22 bp, Artificial Sequence
  chemically synthesized
caattatctccttttgtcaagg

SEQ ID NO: 864835 - DNA, 22 bp, Artificial Sequence
  chemically synthesized
atttctcaggcccttgacaaaa

SEQ ID NO: 864836 - DNA, 22 bp, Artificial Sequence
  chemically synthesized
tttctcaggcccttgacaaaag

SEQ ID NO: 864837 - DNA, 22 bp, Artificial Sequence
  chemically synthesized
ctcaggcccttgacaaaaggag

SEQ ID NO: 864838 - DNA, 22 bp, Artificial Sequence
  chemically synthesized
tcaggcccttgacaaaaggaga

SEQ ID NO: 864839 - DNA, 22 bp, Artificial Sequence
  chemically synthesized
aggcccttgacaaaaggagata

SEQ ID NO: 864840 - DNA, 22 bp, Artificial Sequence
  chemically synthesized
gacaaaaggagataattgaagc

SEQ ID NO: 864841 - DNA, 22 bp, Artificial Sequence
  chemically synthesized
acaaaaggagataattgaagca

SEQ ID NO: 864842 - DNA, 22 bp, Artificial Sequence
  chemically synthesized
ataaaaataagaatgcttcaat

SEQ ID NO: 864843 - DNA, 22 bp, Artificial Sequence
  chemically synthesized
aataaaaataagaatgcttcaa

SEQ ID NO: 864844 - DNA, 22 bp, Artificial Sequence
  chemically synthesized
tttaataaaaataagaatgctt

SEQ ID NO: 864845 - DNA, 22 bp, Artificial Sequence
  chemically synthesized
actgtttaataaaaataagaat

SEQ ID NO: 864846 - DNA, 22 bp, Artificial Sequence
  chemically synthesized
aagcattcttatttttattaaa

SEQ ID NO: 864847 - DNA, 22 bp, Artificial Sequence
  chemically synthesized
gcacatatgttcactgtttaat

SEQ ID NO: 864848 - DNA, 22 bp, Artificial Sequence
  chemically synthesized
ttagcacatatgttcactgttt

SEQ ID NO: 864849 - DNA, 22 bp, Artificial Sequence
  chemically synthesized
ttatttttattaaacagtgaac

SEQ ID NO: 864850 - DNA, 22 bp, Artificial Sequence
  chemically synthesized
gttagcacatatgttcactgtt

SEQ ID NO: 864851 - DNA, 22 bp, Artificial Sequence
  chemically synthesized
tgttagcacatatgttcactgt

SEQ ID NO: 864852 - DNA, 22 bp, Artificial Sequence
  chemically synthesized
atttttattaaacagtgaacat

SEQ ID NO: 864853 - DNA, 22 bp, Artificial Sequence
  chemically synthesized
tttttattaaacagtgaacata

SEQ ID NO: 864854 - DNA, 22 bp, Artificial Sequence
  chemically synthesized
ctttgttagcacatatgttcac

SEQ ID NO: 864855 - DNA, 22 bp, Artificial Sequence
  chemically synthesized
cctttgttagcacatatgttca

SEQ ID NO: 864856 - DNA, 22 bp, Artificial Sequence
  chemically synthesized
ttattaaacagtgaacatatgt

SEQ ID NO: 864857 - DNA, 22 bp, Artificial Sequence
  chemically synthesized
tcctttgttagcacatatgttc

SEQ ID NO: 864858 - DNA, 22 bp, Artificial Sequence
  chemically synthesized
tattaaacagtgaacatatgtg

SEQ ID NO: 864859 - DNA, 22 bp, Artificial Sequence
  chemically synthesized
attaaacagtgaacatatgtgc

SEQ ID NO: 864860 - DNA, 22 bp, Artificial Sequence
  chemically synthesized
ttaaacagtgaacatatgtgct

SEQ ID NO: 864861 - DNA, 22 bp, Artificial Sequence
  chemically synthesized
aacagtgaacatatgtgctaac

SEQ ID NO: 864862 - DNA, 22 bp, Artificial Sequence
  chemically synthesized
aatataattttcctttgttagc

SEQ ID NO: 864863 - DNA, 22 bp, Artificial Sequence
  chemically synthesized
tgaatataattttcctttgtta

SEQ ID NO: 864864 - DNA, 22 bp, Artificial Sequence
  chemically synthesized
tctgaatataattttcctttgt

SEQ ID NO: 864865 - DNA, 22 bp, Artificial Sequence
  chemically synthesized
ctctgaatataattttcctttg

SEQ ID NO: 864866 - DNA, 22 bp, Artificial Sequence
  chemically synthesized
atttctctgaatataattttcc

SEQ ID NO: 864867 - DNA, 22 bp, Artificial Sequence
  chemically synthesized
acaaaggaaaattatattcaga

SEQ ID NO: 864868 - DNA, 22 bp, Artificial Sequence
  chemically synthesized
tattcagagaaatcagcacttg

SEQ ID NO: 864869 - DNA, 22 bp, Artificial Sequence
  chemically synthesized
tgtaatacaagggcaagtgctg

SEQ ID NO: 864870 - DNA, 22 bp, Artificial Sequence
  chemically synthesized
ctgtgtaatacaagggcaagtg

SEQ ID NO: 864871 - DNA, 22 bp, Artificial Sequence
  chemically synthesized
agagaaatcagcacttgccctt

SEQ ID NO: 864872 - DNA, 22 bp, Artificial Sequence
  chemically synthesized
cctgtgtaatacaagggcaagt

SEQ ID NO: 864873 - DNA, 22 bp, Artificial Sequence
  chemically synthesized
gcacttcctgtgtaatacaagg

SEQ ID NO: 864874 - DNA, 22 bp, Artificial Sequence
  chemically synthesized
agcacttcctgtgtaatacaag

SEQ ID NO: 864875 - DNA, 22 bp, Artificial Sequence
  chemically synthesized
tagcacttcctgtgtaatacaa

SEQ ID NO: 864876 - DNA, 22 bp, Artificial Sequence
  chemically synthesized
ttagcacttcctgtgtaataca

SEQ ID NO: 864877 - DNA, 22 bp, Artificial Sequence
  chemically synthesized
gcccttgtattacacaggaagt

SEQ ID NO: 864878 - DNA, 22 bp, Artificial Sequence
  chemically synthesized
cccttgtattacacaggaagtg

SEQ ID NO: 864879 - DNA, 22 bp, Artificial Sequence
  chemically synthesized
gtattacacaggaagtgctaaa

SEQ ID NO: 864880 - DNA, 22 bp, Artificial Sequence
  chemically synthesized
aagagtaaagcttttagcactt

SEQ ID NO: 864881 - DNA, 22 bp, Artificial Sequence
  chemically synthesized
tattacacaggaagtgctaaaa

SEQ ID NO: 864882 - DNA, 22 bp, Artificial Sequence
  chemically synthesized
taaagagtaaagcttttagcac

SEQ ID NO: 864883 - DNA, 22 bp, Artificial Sequence
  chemically synthesized
cacaggaagtgctaaaagcttt

SEQ ID NO: 864884 - DNA, 22 bp, Artificial Sequence
  chemically synthesized
actctaaagagtaaagctttta

SEQ ID NO: 864885 - DNA, 22 bp, Artificial Sequence
  chemically synthesized
aactctaaagagtaaagctttt

SEQ ID NO: 864886 - DNA, 22 bp, Artificial Sequence
  chemically synthesized
gcatttaactctaaagagtaaa

SEQ ID NO: 864887 - DNA, 22 bp, Artificial Sequence
  chemically synthesized
agcatttaactctaaagagtaa

SEQ ID NO: 864888 - DNA, 22 bp, Artificial Sequence
  chemically synthesized
ttagcatttaactctaaagagt

SEQ ID NO: 864889 - DNA, 22 bp, Artificial Sequence
  chemically synthesized
cttagcatttaactctaaagag

SEQ ID NO: 864890 - DNA, 22 bp, Artificial Sequence
  chemically synthesized
aaagctttactctttagagtta

SEQ ID NO: 864891 - DNA, 22 bp, Artificial Sequence
  chemically synthesized
aatttcttagcatttaactcta

SEQ ID NO: 864892 - DNA, 22 bp, Artificial Sequence
  chemically synthesized
tactctttagagttaaatgcta

SEQ ID NO: 864893 - DNA, 22 bp, Artificial Sequence
  chemically synthesized
actctttagagttaaatgctaa

SEQ ID NO: 864894 - DNA, 22 bp, Artificial Sequence
  chemically synthesized
ctctttagagttaaatgctaag

SEQ ID NO: 864895 - DNA, 22 bp, Artificial Sequence
  chemically synthesized
tttagagttaaatgctaagaaa

SEQ ID NO: 864896 - DNA, 22 bp, Artificial Sequence
  chemically synthesized
taccaatctaaatttcttagca

SEQ ID NO: 864897 - DNA, 22 bp, Artificial Sequence
  chemically synthesized
tagagttaaatgctaagaaatt

SEQ ID NO: 864898 - DNA, 22 bp, Artificial Sequence
  chemically synthesized
agagttaaatgctaagaaattt

SEQ ID NO: 864899 - DNA, 22 bp, Artificial Sequence
  chemically synthesized
gagttaaatgctaagaaattta

SEQ ID NO: 864900 - DNA, 22 bp, Artificial Sequence
  chemically synthesized
aatgctaagaaatttagattgg

SEQ ID NO: 864901 - DNA, 22 bp, Artificial Sequence
  chemically synthesized
tatgtaacctataccaatctaa

SEQ ID NO: 864902 - DNA, 22 bp, Artificial Sequence
  chemically synthesized
gtatgtaacctataccaatcta

SEQ ID NO: 864903 - DNA, 22 bp, Artificial Sequence
  chemically synthesized
agaaatttagattggtataggt

SEQ ID NO: 864904 - DNA, 22 bp, Artificial Sequence
  chemically synthesized
tcgggaaaacttgtatgtaacc

SEQ ID NO: 864905 - DNA, 22 bp, Artificial Sequence
  chemically synthesized
agattggtataggttacataca

SEQ ID NO: 864906 - DNA, 22 bp, Artificial Sequence
  chemically synthesized
gattggtataggttacatacaa

SEQ ID NO: 864907 - DNA, 22 bp, Artificial Sequence
  chemically synthesized
gtataggttacatacaagtttt

SEQ ID NO: 864908 - DNA, 22 bp, Artificial Sequence
  chemically synthesized
aagatatagaattgtcgggaaa

SEQ ID NO: 864909 - DNA, 22 bp, Artificial Sequence
  chemically synthesized
caagatatagaattgtcgggaa

SEQ ID NO: 864910 - DNA, 22 bp, Artificial Sequence
  chemically synthesized
tcaagatatagaattgtcggga

SEQ ID NO: 864911 - DNA, 22 bp, Artificial Sequence
  chemically synthesized
catacaagttttcccgacaatt

SEQ ID NO: 864912 - DNA, 22 bp, Artificial Sequence
  chemically synthesized
ttcaagatatagaattgtcggg

SEQ ID NO: 864913 - DNA, 22 bp, Artificial Sequence
  chemically synthesized
tttcaagatatagaattgtcgg

SEQ ID NO: 864914 - DNA, 22 bp, Artificial Sequence
  chemically synthesized
ttttcaagatatagaattgtcg

SEQ ID NO: 864915 - DNA, 22 bp, Artificial Sequence
  chemically synthesized
tttttcaagatatagaattgtc

SEQ ID NO: 864916 - DNA, 22 bp, Artificial Sequence
  chemically synthesized
ttttttcaagatatagaattgt

SEQ ID NO: 864917 - DNA, 22 bp, Artificial Sequence
  chemically synthesized
tttttttcaagatatagaattg

SEQ ID NO: 864918 - DNA, 22 bp, Artificial Sequence
  chemically synthesized
gattttttttttcaagatatag

SEQ ID NO: 864919 - DNA, 22 bp, Artificial Sequence
  chemically synthesized
tcccgacaattctatatcttga

SEQ ID NO: 864920 - DNA, 22 bp, Artificial Sequence
  chemically synthesized
cccgacaattctatatcttgaa

SEQ ID NO: 864921 - DNA, 22 bp, Artificial Sequence
  chemically synthesized
ccgacaattctatatcttgaaa

SEQ ID NO: 864922 - DNA, 22 bp, Artificial Sequence
  chemically synthesized
tatatcttgaaaaaaaaaatct

SEQ ID NO: 864923 - DNA, 22 bp, Artificial Sequence
  chemically synthesized
tatcttgaaaaaaaaaatctaa

SEQ ID NO: 864924 - DNA, 22 bp, Artificial Sequence
  chemically synthesized
agataatacaatgttagatttt

SEQ ID NO: 864925 - DNA, 22 bp, Artificial Sequence
  chemically synthesized
gaaaaaaaaaatctaacattgt

SEQ ID NO: 864926 - DNA, 22 bp, Artificial Sequence
  chemically synthesized
aaaaaaaaaatctaacattgta

SEQ ID NO: 864927 - DNA, 22 bp, Artificial Sequence
  chemically synthesized
tagtctcagataatacaatgtt

SEQ ID NO: 864928 - DNA, 22 bp, Artificial Sequence
  chemically synthesized
tgctgtagtctcagataataca

SEQ ID NO: 864929 - DNA, 22 bp, Artificial Sequence
  chemically synthesized
acattgtattatctgagactac

SEQ ID NO: 864930 - DNA, 22 bp, Artificial Sequence
  chemically synthesized
tattatctgagactacagcaca

SEQ ID NO: 864931 - DNA, 22 bp, Artificial Sequence
  chemically synthesized
aaccagtccaactgtgctgtag

SEQ ID NO: 864932 - DNA, 22 bp, Artificial Sequence
  chemically synthesized
tctgagactacagcacagttgg

SEQ ID NO: 864933 - DNA, 22 bp, Artificial Sequence
  chemically synthesized
gtctaaaccagtccaactgtgc

SEQ ID NO: 864934 - DNA, 22 bp, Artificial Sequence
  chemically synthesized
agtctaaaccagtccaactgtg

SEQ ID NO: 864935 - DNA, 22 bp, Artificial Sequence
  chemically synthesized
tagtctaaaccagtccaactgt

SEQ ID NO: 864936 - DNA, 22 bp, Artificial Sequence
  chemically synthesized
agactacagcacagttggactg

SEQ ID NO: 864937 - DNA, 22 bp, Artificial Sequence
  chemically synthesized
gttttagtctaaaccagtccaa

SEQ ID NO: 864938 - DNA, 22 bp, Artificial Sequence
  chemically synthesized
cagcacagttggactggtttag

SEQ ID NO: 864939 - DNA, 22 bp, Artificial Sequence
  chemically synthesized
ccctagttttagtctaaaccag

SEQ ID NO: 864940 - DNA, 22 bp, Artificial Sequence
  chemically synthesized
accctagttttagtctaaacca

SEQ ID NO: 864941 - DNA, 22 bp, Artificial Sequence
  chemically synthesized
ccttaccctagttttagtctaa

SEQ ID NO: 864942 - DNA, 22 bp, Artificial Sequence
  chemically synthesized
cccttaccctagttttagtcta

SEQ ID NO: 864943 - DNA, 22 bp, Artificial Sequence
  chemically synthesized
gactggtttagactaaaactag

SEQ ID NO: 864944 - DNA, 22 bp, Artificial Sequence
  chemically synthesized
gtttagactaaaactagggtaa

SEQ ID NO: 864945 - DNA, 22 bp, Artificial Sequence
  chemically synthesized
acaccacttcccttaccctagt

SEQ ID NO: 864946 - DNA, 22 bp, Artificial Sequence
  chemically synthesized
aacaccacttcccttaccctag

SEQ ID NO: 864947 - DNA, 22 bp, Artificial Sequence
  chemically synthesized
taacaccacttcccttacccta

SEQ ID NO: 864948 - DNA, 22 bp, Artificial Sequence
  chemically synthesized
agactaaaactagggtaaggga

SEQ ID NO: 864949 - DNA, 22 bp, Artificial Sequence
  chemically synthesized
gactaaaactagggtaagggaa

SEQ ID NO: 864950 - DNA, 22 bp, Artificial Sequence
  chemically synthesized
aaactagggtaagggaagtggt

SEQ ID NO: 864951 - DNA, 22 bp, Artificial Sequence
  chemically synthesized
aatcaattttaacaccacttcc

SEQ ID NO: 864952 - DNA, 22 bp, Artificial Sequence
  chemically synthesized
caatcaattttaacaccacttc

SEQ ID NO: 864953 - DNA, 22 bp, Artificial Sequence
  chemically synthesized
gggtaagggaagtggtgttaaa

SEQ ID NO: 864954 - DNA, 22 bp, Artificial Sequence
  chemically synthesized
taatcttcaatcaattttaaca

SEQ ID NO: 864955 - DNA, 22 bp, Artificial Sequence
  chemically synthesized
gacgtatactataatcttcaat

SEQ ID NO: 864956 - DNA, 22 bp, Artificial Sequence
  chemically synthesized
agacgtatactataatcttcaa

SEQ ID NO: 864957 - DNA, 22 bp, Artificial Sequence
  chemically synthesized
tagacgtatactataatcttca

SEQ ID NO: 864958 - DNA, 22 bp, Artificial Sequence
  chemically synthesized
aaattgattgaagattatagta

SEQ ID NO: 864959 - DNA, 22 bp, Artificial Sequence
  chemically synthesized
attgaagattatagtatacgtc

SEQ ID NO: 864960 - DNA, 22 bp, Artificial Sequence
  chemically synthesized
aagattatagtatacgtctaaa

SEQ ID NO: 864961 - DNA, 22 bp, Artificial Sequence
  chemically synthesized
atgatgcccaagattttagacg

SEQ ID NO: 864962 - DNA, 22 bp, Artificial Sequence
  chemically synthesized
ttaatgatgcccaagattttag

SEQ ID NO: 864963 - DNA, 22 bp, Artificial Sequence
  chemically synthesized
attaatgatgcccaagatttta

SEQ ID NO: 864964 - DNA, 22 bp, Artificial Sequence
  chemically synthesized
tagtatacgtctaaaatcttgg

SEQ ID NO: 864965 - DNA, 22 bp, Artificial Sequence
  chemically synthesized
tattaatgatgcccaagatttt

SEQ ID NO: 864966 - DNA, 22 bp, Artificial Sequence
  chemically synthesized
aaatcttgggcatcattaataa

SEQ ID NO: 864967 - DNA, 22 bp, Artificial Sequence
  chemically synthesized
gggcatcattaataaagcccac

SEQ ID NO: 864968 - DNA, 22 bp, Artificial Sequence
  chemically synthesized
ggcatcattaataaagcccact

SEQ ID NO: 864969 - DNA, 22 bp, Artificial Sequence
  chemically synthesized
ataaagcccactctacttggac

SEQ ID NO: 864970 - DNA, 22 bp, Artificial Sequence
  chemically synthesized
tacttggacttattgctctatt

SEQ ID NO: 864971 - DNA, 22 bp, Artificial Sequence
  chemically synthesized
agaaaggatatgaatagagcaa

SEQ ID NO: 864972 - DNA, 22 bp, Artificial Sequence
  chemically synthesized
cagaaaggatatgaatagagca

SEQ ID NO: 864973 - DNA, 22 bp, Artificial Sequence
  chemically synthesized
cttggacttattgctctattca

SEQ ID NO: 864974 - DNA, 22 bp, Artificial Sequence
  chemically synthesized
tcagaaaggatatgaatagagc

SEQ ID NO: 864975 - DNA, 22 bp, Artificial Sequence
  chemically synthesized
ggacttattgctctattcatat

SEQ ID NO: 864976 - DNA, 22 bp, Artificial Sequence
  chemically synthesized
gacttattgctctattcatatc

SEQ ID NO: 864977 - DNA, 22 bp, Artificial Sequence
  chemically synthesized
tctttcagaaaggatatgaata

SEQ ID NO: 864978 - DNA, 22 bp, Artificial Sequence
  chemically synthesized
atctttcagaaaggatatgaat

SEQ ID NO: 864979 - DNA, 22 bp, Artificial Sequence
  chemically synthesized
attgctctattcatatcctttc

SEQ ID NO: 864980 - DNA, 22 bp, Artificial Sequence
  chemically synthesized
ttgctctattcatatcctttct

SEQ ID NO: 864981 - DNA, 22 bp, Artificial Sequence
  chemically synthesized
ctctattcatatcctttctgaa

SEQ ID NO: 864982 - DNA, 22 bp, Artificial Sequence
  chemically synthesized
aggtagtttatctttcagaaag

SEQ ID NO: 864983 - DNA, 22 bp, Artificial Sequence
  chemically synthesized
gaggtagtttatctttcagaaa

SEQ ID NO: 864984 - DNA, 22 bp, Artificial Sequence
  chemically synthesized
tattcatatcctttctgaaaga

SEQ ID NO: 864985 - DNA, 22 bp, Artificial Sequence
  chemically synthesized
tgaggtagtttatctttcagaa

SEQ ID NO: 864986 - DNA, 22 bp, Artificial Sequence
  chemically synthesized
ttcatatcctttctgaaagata

SEQ ID NO: 864987 - DNA, 22 bp, Artificial Sequence
  chemically synthesized
atatcctttctgaaagataaac

SEQ ID NO: 864988 - DNA, 22 bp, Artificial Sequence
  chemically synthesized
aattttgaggtagtttatcttt

SEQ ID NO: 864989 - DNA, 22 bp, Artificial Sequence
  chemically synthesized
ggtcctgaattttgaggtagtt

SEQ ID NO: 864990 - DNA, 22 bp, Artificial Sequence
  chemically synthesized
tctgaaagataaactacctcaa

SEQ ID NO: 864991 - DNA, 22 bp, Artificial Sequence
  chemically synthesized
ctgaaagataaactacctcaaa

SEQ ID NO: 864992 - DNA, 22 bp, Artificial Sequence
  chemically synthesized
tgaaagataaactacctcaaaa

SEQ ID NO: 864993 - DNA, 22 bp, Artificial Sequence
  chemically synthesized
ttgggtcctgaattttgaggta

SEQ ID NO: 864994 - DNA, 22 bp, Artificial Sequence
  chemically synthesized
aaagataaactacctcaaaatt

SEQ ID NO: 864995 - DNA, 22 bp, Artificial Sequence
  chemically synthesized
ctattgggtcctgaattttgag

SEQ ID NO: 864996 - DNA, 22 bp, Artificial Sequence
  chemically synthesized
cctcaaaattcaggacccaata

SEQ ID NO: 864997 - DNA, 22 bp, Artificial Sequence
  chemically synthesized
aaaattcaggacccaatagtaa

SEQ ID NO: 864998 - DNA, 22 bp, Artificial Sequence
  chemically synthesized
cgcaataatagtatattactat

SEQ ID NO: 864999 - DNA, 22 bp, Artificial Sequence
  chemically synthesized
aggacccaatagtaatatacta

SEQ ID NO: 865000 - DNA, 22 bp, Artificial Sequence
  chemically synthesized
atggcatctccgcaataatagt

SEQ ID NO: 865001 - DNA, 22 bp, Artificial Sequence
  chemically synthesized
catggcatctccgcaataatag

SEQ ID NO: 865002 - DNA, 22 bp, Artificial Sequence
  chemically synthesized
ttattgcggagatgccatgaaa

SEQ ID NO: 865003 - DNA, 22 bp, Artificial Sequence
  chemically synthesized
ttgcggagatgccatgaaacat

SEQ ID NO: 865004 - DNA, 22 bp, Artificial Sequence
  chemically synthesized
cggagatgccatgaaacattcc

SEQ ID NO: 865005 - DNA, 22 bp, Artificial Sequence
  chemically synthesized
aatcatcccgatcacagcccca

SEQ ID NO: 865006 - DNA, 22 bp, Artificial Sequence
  chemically synthesized
tcaatcatcccgatcacagccc

SEQ ID NO: 865007 - DNA, 22 bp, Artificial Sequence
  chemically synthesized
ctctcaatcatcccgatcacag

SEQ ID NO: 865008 - DNA, 22 bp, Artificial Sequence
  chemically synthesized
ctggggctgtgatcgggatgat

SEQ ID NO: 865009 - DNA, 22 bp, Artificial Sequence
  chemically synthesized
gcgctcctctcaatcatcccga

SEQ ID NO: 865010 - DNA, 22 bp, Artificial Sequence
  chemically synthesized
agcgctcctctcaatcatcccg

SEQ ID NO: 865011 - DNA, 22 bp, Artificial Sequence
  chemically synthesized
gggctgtgatcgggatgattga

SEQ ID NO: 865012 - DNA, 22 bp, Artificial Sequence
  chemically synthesized
agcatttagcgctcctctcaat

SEQ ID NO: 865013 - DNA, 22 bp, Artificial Sequence
  chemically synthesized
tgatcgggatgattgagaggag

SEQ ID NO: 865014 - DNA, 22 bp, Artificial Sequence
  chemically synthesized
cagcatttagcgctcctctcaa

SEQ ID NO: 865015 - DNA, 22 bp, Artificial Sequence
  chemically synthesized
tcagcatttagcgctcctctca

SEQ ID NO: 865016 - DNA, 22 bp, Artificial Sequence
  chemically synthesized
ttcagcatttagcgctcctctc

SEQ ID NO: 865017 - DNA, 22 bp, Artificial Sequence
  chemically synthesized
agaggagcgctaaatgctgaaa

SEQ ID NO: 865018 - DNA, 22 bp, Artificial Sequence
  chemically synthesized
gtcacatccacttttcagcatt

SEQ ID NO: 865019 - DNA, 22 bp, Artificial Sequence
  chemically synthesized
cctggtcacatccacttttcag

SEQ ID NO: 865020 - DNA, 22 bp, Artificial Sequence
  chemically synthesized
aatgctgaaaagtggatgtgac

SEQ ID NO: 865021 - DNA, 22 bp, Artificial Sequence
  chemically synthesized
agccattccctggtcacatcca

SEQ ID NO: 865022 - DNA, 22 bp, Artificial Sequence
  chemically synthesized
aaaagtggatgtgaccagggaa

SEQ ID NO: 865023 - DNA, 22 bp, Artificial Sequence
  chemically synthesized
gcaaacagctaagccattccct

SEQ ID NO: 865024 - DNA, 22 bp, Artificial Sequence
  chemically synthesized
cactggcaaacagctaagccat

SEQ ID NO: 865025 - DNA, 22 bp, Artificial Sequence
  chemically synthesized
acactggcaaacagctaagcca

SEQ ID NO: 865026 - DNA, 22 bp, Artificial Sequence
  chemically synthesized
tacactggcaaacagctaagcc

SEQ ID NO: 865027 - DNA, 22 bp, Artificial Sequence
  chemically synthesized
ttacactggcaaacagctaagc

SEQ ID NO: 865028 - DNA, 22 bp, Artificial Sequence
  chemically synthesized
tttacactggcaaacagctaag

SEQ ID NO: 865029 - DNA, 22 bp, Artificial Sequence
  chemically synthesized
ttttttacactggcaaacagct

SEQ ID NO: 865030 - DNA, 22 bp, Artificial Sequence
  chemically synthesized
atatcaagttattttttacact

SEQ ID NO: 865031 - DNA, 22 bp, Artificial Sequence
  chemically synthesized
agctgtttgccagtgtaaaaaa

SEQ ID NO: 865032 - DNA, 22 bp, Artificial Sequence
  chemically synthesized
gctgtttgccagtgtaaaaaat

SEQ ID NO: 865033 - DNA, 22 bp, Artificial Sequence
  chemically synthesized
tttgccagtgtaaaaaataact

SEQ ID NO: 865034 - DNA, 22 bp, Artificial Sequence
  chemically synthesized
atgttgatatcaagttattttt

SEQ ID NO: 865035 - DNA, 22 bp, Artificial Sequence
  chemically synthesized
aatgttgatatcaagttatttt

SEQ ID NO: 865036 - DNA, 22 bp, Artificial Sequence
  chemically synthesized
gccagtgtaaaaaataacttga

SEQ ID NO: 865037 - DNA, 22 bp, Artificial Sequence
  chemically synthesized
ccagtgtaaaaaataacttgat

SEQ ID NO: 865038 - DNA, 22 bp, Artificial Sequence
  chemically synthesized
cttaatgttgatatcaagttat

SEQ ID NO: 865039 - DNA, 22 bp, Artificial Sequence
  chemically synthesized
ctgcttaatgttgatatcaagt

SEQ ID NO: 865040 - DNA, 22 bp, Artificial Sequence
  chemically synthesized
agctgctgcttaatgttgatat

SEQ ID NO: 865041 - DNA, 22 bp, Artificial Sequence
  chemically synthesized
cagctgctgcttaatgttgata

SEQ ID NO: 865042 - DNA, 22 bp, Artificial Sequence
  chemically synthesized
ttcagctgctgcttaatgttga

SEQ ID NO: 865043 - DNA, 22 bp, Artificial Sequence
  chemically synthesized
gatatcaacattaagcagcagc

SEQ ID NO: 865044 - DNA, 22 bp, Artificial Sequence
  chemically synthesized
aaagattcttcagctgctgctt

SEQ ID NO: 865045 - DNA, 22 bp, Artificial Sequence
  chemically synthesized
atatcaacattaagcagcagct

SEQ ID NO: 865046 - DNA, 22 bp, Artificial Sequence
  chemically synthesized
ttaaaagattcttcagctgctg

SEQ ID NO: 865047 - DNA, 22 bp, Artificial Sequence
  chemically synthesized
aactattaaaagattcttcagc

SEQ ID NO: 865048 - DNA, 22 bp, Artificial Sequence
  chemically synthesized
agcagcagctgaagaatctttt

SEQ ID NO: 865049 - DNA, 22 bp, Artificial Sequence
  chemically synthesized
gaaaaagtgcctaaactattaa

SEQ ID NO: 865050 - DNA, 22 bp, Artificial Sequence
  chemically synthesized
agaaaaagtgcctaaactatta

SEQ ID NO: 865051 - DNA, 22 bp, Artificial Sequence
  chemically synthesized
aagaatcttttaatagtttagg

SEQ ID NO: 865052 - DNA, 22 bp, Artificial Sequence
  chemically synthesized
aaggatttagaaaaagtgccta

SEQ ID NO: 865053 - DNA, 22 bp, Artificial Sequence
  chemically synthesized
ttaatagtttaggcactttttc

SEQ ID NO: 865054 - DNA, 22 bp, Artificial Sequence
  chemically synthesized
taatagtttaggcactttttct

SEQ ID NO: 865055 - DNA, 22 bp, Artificial Sequence
  chemically synthesized
aatagtttaggcactttttcta

SEQ ID NO: 865056 - DNA, 22 bp, Artificial Sequence
  chemically synthesized
atagtttaggcactttttctaa

SEQ ID NO: 865057 - DNA, 22 bp, Artificial Sequence
  chemically synthesized
aggcactttttctaaatccttc

SEQ ID NO: 865058 - DNA, 22 bp, Artificial Sequence
  chemically synthesized
ggcactttttctaaatccttca

SEQ ID NO: 865059 - DNA, 22 bp, Artificial Sequence
  chemically synthesized
atcggtgaagcataactgaagg

SEQ ID NO: 865060 - DNA, 22 bp, Artificial Sequence
  chemically synthesized
aatcggtgaagcataactgaag

SEQ ID NO: 865061 - DNA, 22 bp, Artificial Sequence
  chemically synthesized
tttctaaatccttcagttatgc

SEQ ID NO: 865062 - DNA, 22 bp, Artificial Sequence
  chemically synthesized
ttctaaatccttcagttatgct

SEQ ID NO: 865063 - DNA, 22 bp, Artificial Sequence
  chemically synthesized
tctaaatccttcagttatgctt

SEQ ID NO: 865064 - DNA, 22 bp, Artificial Sequence
  chemically synthesized
ctaaatccttcagttatgcttc

SEQ ID NO: 865065 - DNA, 22 bp, Artificial Sequence
  chemically synthesized
taaatccttcagttatgcttca

SEQ ID NO: 865066 - DNA, 22 bp, Artificial Sequence
  chemically synthesized
ataatttaatcggtgaagcata

SEQ ID NO: 865067 - DNA, 22 bp, Artificial Sequence
  chemically synthesized
aatccttcagttatgcttcacc

SEQ ID NO: 865068 - DNA, 22 bp, Artificial Sequence
  chemically synthesized
aataatttaatcggtgaagcat

SEQ ID NO: 865069 - DNA, 22 bp, Artificial Sequence
  chemically synthesized
ttaataatttaatcggtgaagc

SEQ ID NO: 865070 - DNA, 22 bp, Artificial Sequence
  chemically synthesized
cagttatgcttcaccgattaaa

SEQ ID NO: 865071 - DNA, 22 bp, Artificial Sequence
  chemically synthesized
agttatgcttcaccgattaaat

SEQ ID NO: 865072 - DNA, 22 bp, Artificial Sequence
  chemically synthesized
tgcttcaccgattaaattatta

SEQ ID NO: 865073 - DNA, 22 bp, Artificial Sequence
  chemically synthesized
gatcagaggttcttaataattt

SEQ ID NO: 865074 - DNA, 22 bp, Artificial Sequence
  chemically synthesized
caccgattaaattattaagaac

SEQ ID NO: 865075 - DNA, 22 bp, Artificial Sequence
  chemically synthesized
accgattaaattattaagaacc

SEQ ID NO: 865076 - DNA, 22 bp, Artificial Sequence
  chemically synthesized
aattattaagaacctctgatct

SEQ ID NO: 865077 - DNA, 22 bp, Artificial Sequence
  chemically synthesized
aaatatgaaatagctagatcag

SEQ ID NO: 865078 - DNA, 22 bp, Artificial Sequence
  chemically synthesized
ttaagaacctctgatctagcta

SEQ ID NO: 865079 - DNA, 22 bp, Artificial Sequence
  chemically synthesized
agaacctctgatctagctattt

SEQ ID NO: 865080 - DNA, 22 bp, Artificial Sequence
  chemically synthesized
acatctaaaatatgaaatagct

SEQ ID NO: 865081 - DNA, 22 bp, Artificial Sequence
  chemically synthesized
actcacatctaaaatatgaaat

SEQ ID NO: 865082 - DNA, 22 bp, Artificial Sequence
  chemically synthesized
cactcacatctaaaatatgaaa

SEQ ID NO: 865083 - DNA, 22 bp, Artificial Sequence
  chemically synthesized
tgatctagctatttcatatttt

SEQ ID NO: 865084 - DNA, 22 bp, Artificial Sequence
  chemically synthesized
atctagctatttcatattttag

SEQ ID NO: 865085 - DNA, 22 bp, Artificial Sequence
  chemically synthesized
gctatttcatattttagatgtg

SEQ ID NO: 865086 - DNA, 22 bp, Artificial Sequence
  chemically synthesized
aaaacatcttcactcacatcta

SEQ ID NO: 865087 - DNA, 22 bp, Artificial Sequence
  chemically synthesized
caaaacatcttcactcacatct

SEQ ID NO: 865088 - DNA, 22 bp, Artificial Sequence
  chemically synthesized
tttcatattttagatgtgagtg

SEQ ID NO: 865089 - DNA, 22 bp, Artificial Sequence
  chemically synthesized
catattttagatgtgagtgaag

SEQ ID NO: 865090 - DNA, 22 bp, Artificial Sequence
  chemically synthesized
atattttagatgtgagtgaaga

SEQ ID NO: 865091 - DNA, 22 bp, Artificial Sequence
  chemically synthesized
tagatgtgagtgaagatgtttt

SEQ ID NO: 865092 - DNA, 22 bp, Artificial Sequence
  chemically synthesized
agatgtgagtgaagatgttttg

SEQ ID NO: 865093 - DNA, 22 bp, Artificial Sequence
  chemically synthesized
gatgtgagtgaagatgttttga

SEQ ID NO: 865094 - DNA, 22 bp, Artificial Sequence
  chemically synthesized
tgaaatcattttcattgttcat

SEQ ID NO: 865095 - DNA, 22 bp, Artificial Sequence
  chemically synthesized
gaaatcattttcattgttcatg

SEQ ID NO: 865096 - DNA, 22 bp, Artificial Sequence
  chemically synthesized
aaatcattttcattgttcatgg

SEQ ID NO: 865097 - DNA, 22 bp, Artificial Sequence
  chemically synthesized
aaaaacaagaaaccatgaacaa

SEQ ID NO: 865098 - DNA, 22 bp, Artificial Sequence
  chemically synthesized
aaaaaacaagaaaccatgaaca

SEQ ID NO: 865099 - DNA, 22 bp, Artificial Sequence
  chemically synthesized
taaaaaacaagaaaccatgaac

SEQ ID NO: 865100 - DNA, 22 bp, Artificial Sequence
  chemically synthesized
attttaaaaaacaagaaaccat

SEQ ID NO: 865101 - DNA, 22 bp, Artificial Sequence
  chemically synthesized
aattttaaaaaacaagaaacca

SEQ ID NO: 865102 - DNA, 22 bp, Artificial Sequence
  chemically synthesized
tcattgttcatggtttcttgtt

SEQ ID NO: 865103 - DNA, 22 bp, Artificial Sequence
  chemically synthesized
cattgttcatggtttcttgttt

SEQ ID NO: 865104 - DNA, 22 bp, Artificial Sequence
  chemically synthesized
attgttcatggtttcttgtttt

SEQ ID NO: 865105 - DNA, 22 bp, Artificial Sequence
  chemically synthesized
ggtttaattttaaaaaacaaga

SEQ ID NO: 865106 - DNA, 22 bp, Artificial Sequence
  chemically synthesized
taggtttaattttaaaaaacaa

SEQ ID NO: 865107 - DNA, 22 bp, Artificial Sequence
  chemically synthesized
ttcatggtttcttgttttttaa

SEQ ID NO: 865108 - DNA, 22 bp, Artificial Sequence
  chemically synthesized
atggtttcttgttttttaaaat

SEQ ID NO: 865109 - DNA, 22 bp, Artificial Sequence
  chemically synthesized
agcgtcctctaggtttaatttt

SEQ ID NO: 865110 - DNA, 22 bp, Artificial Sequence
  chemically synthesized
cttgttttttaaaattaaacct

SEQ ID NO: 865111 - DNA, 22 bp, Artificial Sequence
  chemically synthesized
ttgttttttaaaattaaaccta

SEQ ID NO: 865112 - DNA, 22 bp, Artificial Sequence
  chemically synthesized
tctcagcgtcctctaggtttaa

SEQ ID NO: 865113 - DNA, 22 bp, Artificial Sequence
  chemically synthesized
gttttttaaaattaaacctaga

SEQ ID NO: 865114 - DNA, 22 bp, Artificial Sequence
  chemically synthesized
ttttttaaaattaaacctagag

SEQ ID NO: 865115 - DNA, 22 bp, Artificial Sequence
  chemically synthesized
tttaaaattaaacctagaggac

SEQ ID NO: 865116 - DNA, 22 bp, Artificial Sequence
  chemically synthesized
ttaaaattaaacctagaggacg

SEQ ID NO: 865117 - DNA, 22 bp, Artificial Sequence
  chemically synthesized
taaaattaaacctagaggacgc

SEQ ID NO: 865118 - DNA, 22 bp, Artificial Sequence
  chemically synthesized
aaaattaaacctagaggacgct

SEQ ID NO: 865119 - DNA, 22 bp, Artificial Sequence
  chemically synthesized
aaattaaacctagaggacgctg

SEQ ID NO: 865120 - DNA, 22 bp, Artificial Sequence
  chemically synthesized
ataaaaagagattatctcagcg

SEQ ID NO: 865121 - DNA, 22 bp, Artificial Sequence
  chemically synthesized
aacctagaggacgctgagataa

SEQ ID NO: 865122 - DNA, 22 bp, Artificial Sequence
  chemically synthesized
gaggacgctgagataatctctt

SEQ ID NO: 865123 - DNA, 22 bp, Artificial Sequence
  chemically synthesized
cagacctaataaaaagagatta

SEQ ID NO: 865124 - DNA, 22 bp, Artificial Sequence
  chemically synthesized
tgcagacctaataaaaagagat

SEQ ID NO: 865125 - DNA, 22 bp, Artificial Sequence
  chemically synthesized
ctgcagacctaataaaaagaga

SEQ ID NO: 865126 - DNA, 22 bp, Artificial Sequence
  chemically synthesized
gtttctgcagacctaataaaaa

SEQ ID NO: 865127 - DNA, 22 bp, Artificial Sequence
  chemically synthesized
ggtttctgcagacctaataaaa

SEQ ID NO: 865128 - DNA, 22 bp, Artificial Sequence
  chemically synthesized
agataatctctttttattaggt

SEQ ID NO: 865129 - DNA, 22 bp, Artificial Sequence
  chemically synthesized
ttggtttctgcagacctaataa

SEQ ID NO: 865130 - DNA, 22 bp, Artificial Sequence
  chemically synthesized
gtgtattcttggtttctgcaga

SEQ ID NO: 865131 - DNA, 22 bp, Artificial Sequence
  chemically synthesized
tttttattaggtctgcagaaac

SEQ ID NO: 865132 - DNA, 22 bp, Artificial Sequence
  chemically synthesized
ggtgtattcttggtttctgcag

SEQ ID NO: 865133 - DNA, 22 bp, Artificial Sequence
  chemically synthesized
tttattaggtctgcagaaacca

SEQ ID NO: 865134 - DNA, 22 bp, Artificial Sequence
  chemically synthesized
ttattaggtctgcagaaaccaa

SEQ ID NO: 865135 - DNA, 22 bp, Artificial Sequence
  chemically synthesized
tattaggtctgcagaaaccaag

SEQ ID NO: 865136 - DNA, 22 bp, Artificial Sequence
  chemically synthesized
attaggtctgcagaaaccaaga

SEQ ID NO: 865137 - DNA, 22 bp, Artificial Sequence
  chemically synthesized
ttaggtctgcagaaaccaagaa

SEQ ID NO: 865138 - DNA, 22 bp, Artificial Sequence
  chemically synthesized
agcatttggtgtattcttggtt

SEQ ID NO: 865139 - DNA, 22 bp, Artificial Sequence
  chemically synthesized
ggtctgcagaaaccaagaatac

SEQ ID NO: 865140 - DNA, 22 bp, Artificial Sequence
  chemically synthesized
ttcagcatttggtgtattcttg

SEQ ID NO: 865141 - DNA, 22 bp, Artificial Sequence
  chemically synthesized
cagaaaccaagaatacaccaaa

SEQ ID NO: 865142 - DNA, 22 bp, Artificial Sequence
  chemically synthesized
catgcagctattcagcatttgg

SEQ ID NO: 865143 - DNA, 22 bp, Artificial Sequence
  chemically synthesized
ccatgcagctattcagcatttg

SEQ ID NO: 865144 - DNA, 22 bp, Artificial Sequence
  chemically synthesized
tcaaggcaagtgatacttccat

SEQ ID NO: 865145 - DNA, 22 bp, Artificial Sequence
  chemically synthesized
aatagctgcatggaagtatcac

SEQ ID NO: 865146 - DNA, 22 bp, Artificial Sequence
  chemically synthesized
catggaagtatcacttgccttg

SEQ ID NO: 865147 - DNA, 22 bp, Artificial Sequence
  chemically synthesized
tcataatacaatattgtcaagg

SEQ ID NO: 865148 - DNA, 22 bp, Artificial Sequence
  chemically synthesized
atcataatacaatattgtcaag

SEQ ID NO: 865149 - DNA, 22 bp, Artificial Sequence
  chemically synthesized
gcttatcataatacaatattgt

SEQ ID NO: 865150 - DNA, 22 bp, Artificial Sequence
  chemically synthesized
gccttgacaatattgtattatg

SEQ ID NO: 865151 - DNA, 22 bp, Artificial Sequence
  chemically synthesized
ccttgacaatattgtattatga

SEQ ID NO: 865152 - DNA, 22 bp, Artificial Sequence
  chemically synthesized
gacaatattgtattatgataag

SEQ ID NO: 865153 - DNA, 22 bp, Artificial Sequence
  chemically synthesized
acaatattgtattatgataagc

SEQ ID NO: 865154 - DNA, 22 bp, Artificial Sequence
  chemically synthesized
tattatgataagctagttcctc

SEQ ID NO: 865155 - DNA, 22 bp, Artificial Sequence
  chemically synthesized
aaaaaaaaaaaaagaggaacta

SEQ ID NO: 865156 - DNA, 22 bp, Artificial Sequence
  chemically synthesized
aaaaaaaaaaaaaagaggaact

SEQ ID NO: 865157 - DNA, 22 bp, Artificial Sequence
  chemically synthesized
tgataagctagttcctcttttt

SEQ ID NO: 865158 - DNA, 22 bp, Artificial Sequence
  chemically synthesized
aacttaaaaaaaaaaaaaagag

SEQ ID NO: 865159 - DNA, 22 bp, Artificial Sequence
  chemically synthesized
gttcctctttttttttttttta

SEQ ID NO: 865160 - DNA, 22 bp, Artificial Sequence
  chemically synthesized
tatagctcaacttaaaaaaaaa

SEQ ID NO: 865161 - DNA, 22 bp, Artificial Sequence
  chemically synthesized
ctcttttttttttttttaagtt

SEQ ID NO: 865162 - DNA, 22 bp, Artificial Sequence
  chemically synthesized
ttttttttttttttaagttgag

SEQ ID NO: 865163 - DNA, 22 bp, Artificial Sequence
  chemically synthesized
gaatctatatagctcaacttaa

SEQ ID NO: 865164 - DNA, 22 bp, Artificial Sequence
  chemically synthesized
ttttttttttttaagttgagct

SEQ ID NO: 865165 - DNA, 22 bp, Artificial Sequence
  chemically synthesized
tttttttttttaagttgagcta

SEQ ID NO: 865166 - DNA, 22 bp, Artificial Sequence
  chemically synthesized
ttttttttttaagttgagctat

SEQ ID NO: 865167 - DNA, 22 bp, Artificial Sequence
  chemically synthesized
attggaatctatatagctcaac

SEQ ID NO: 865168 - DNA, 22 bp, Artificial Sequence
  chemically synthesized
tttttttttaagttgagctata

SEQ ID NO: 865169 - DNA, 22 bp, Artificial Sequence
  chemically synthesized
ttttttttaagttgagctatat

SEQ ID NO: 865170 - DNA, 22 bp, Artificial Sequence
  chemically synthesized
tttttttaagttgagctatata

SEQ ID NO: 865171 - DNA, 22 bp, Artificial Sequence
  chemically synthesized
ttttttaagttgagctatatag

SEQ ID NO: 865172 - DNA, 22 bp, Artificial Sequence
  chemically synthesized
tttttaagttgagctatataga

SEQ ID NO: 865173 - DNA, 22 bp, Artificial Sequence
  chemically synthesized
ttttaagttgagctatatagat

SEQ ID NO: 865174 - DNA, 22 bp, Artificial Sequence
  chemically synthesized
tttaagttgagctatatagatt

SEQ ID NO: 865175 - DNA, 22 bp, Artificial Sequence
  chemically synthesized
ttaagttgagctatatagattc

SEQ ID NO: 865176 - DNA, 22 bp, Artificial Sequence
  chemically synthesized
taagttgagctatatagattcc

SEQ ID NO: 865177 - DNA, 22 bp, Artificial Sequence
  chemically synthesized
acaacattaattggaatctata

SEQ ID NO: 865178 - DNA, 22 bp, Artificial Sequence
  chemically synthesized
aagttgagctatatagattcca

SEQ ID NO: 865179 - DNA, 22 bp, Artificial Sequence
  chemically synthesized
aacaacattaattggaatctat

SEQ ID NO: 865180 - DNA, 22 bp, Artificial Sequence
  chemically synthesized
agttgagctatatagattccaa

SEQ ID NO: 865181 - DNA, 22 bp, Artificial Sequence
  chemically synthesized
gtttaacaacattaattggaat

SEQ ID NO: 865182 - DNA, 22 bp, Artificial Sequence
  chemically synthesized
agctatatagattccaattaat

SEQ ID NO: 865183 - DNA, 22 bp, Artificial Sequence
  chemically synthesized
tatagattccaattaatgttgt

SEQ ID NO: 865184 - DNA, 22 bp, Artificial Sequence
  chemically synthesized
aacaattggtttaacaacatta

SEQ ID NO: 865185 - DNA, 22 bp, Artificial Sequence
  chemically synthesized
aaacaattggtttaacaacatt

SEQ ID NO: 865186 - DNA, 22 bp, Artificial Sequence
  chemically synthesized
taaacaattggtttaacaacat

SEQ ID NO: 865187 - DNA, 22 bp, Artificial Sequence
  chemically synthesized
ttaaacaattggtttaacaaca

SEQ ID NO: 865188 - DNA, 22 bp, Artificial Sequence
  chemically synthesized
tttaaacaattggtttaacaac

SEQ ID NO: 865189 - DNA, 22 bp, Artificial Sequence
  chemically synthesized
caattaatgttgttaaaccaat

SEQ ID NO: 865190 - DNA, 22 bp, Artificial Sequence
  chemically synthesized
gccattttttaaacaattggtt

SEQ ID NO: 865191 - DNA, 22 bp, Artificial Sequence
  chemically synthesized
tggccattttttaaacaattgg

SEQ ID NO: 865192 - DNA, 22 bp, Artificial Sequence
  chemically synthesized
atgttgttaaaccaattgttta

SEQ ID NO: 865193 - DNA, 22 bp, Artificial Sequence
  chemically synthesized
ttaaaccaattgtttaaaaaat

SEQ ID NO: 865194 - DNA, 22 bp, Artificial Sequence
  chemically synthesized
aaccaattgtttaaaaaatggc

SEQ ID NO: 865195 - DNA, 22 bp, Artificial Sequence
  chemically synthesized
aaagccagtagaagcctctggc

SEQ ID NO: 865196 - DNA, 22 bp, Artificial Sequence
  chemically synthesized
tttaaaaaatggccagaggctt

SEQ ID NO: 865197 - DNA, 22 bp, Artificial Sequence
  chemically synthesized
aaaaaatggccagaggcttcta

SEQ ID NO: 865198 - DNA, 22 bp, Artificial Sequence
  chemically synthesized
aaaaatggccagaggcttctac

SEQ ID NO: 865199 - DNA, 22 bp, Artificial Sequence
  chemically synthesized
catctaaaagccagtagaagcc

SEQ ID NO: 865200 - DNA, 22 bp, Artificial Sequence
  chemically synthesized
gcctccatctaaaagccagtag

SEQ ID NO: 865201 - DNA, 22 bp, Artificial Sequence
  chemically synthesized
ggcctccatctaaaagccagta

SEQ ID NO: 865202 - DNA, 22 bp, Artificial Sequence
  chemically synthesized
ctactggcttttagatggaggc

SEQ ID NO: 865203 - DNA, 22 bp, Artificial Sequence
  chemically synthesized
tactggcttttagatggaggcc

SEQ ID NO: 865204 - DNA, 22 bp, Artificial Sequence
  chemically synthesized
ctggcttttagatggaggccaa

SEQ ID NO: 865205 - DNA, 22 bp, Artificial Sequence
  chemically synthesized
acgcaatcatatcttggcctcc

SEQ ID NO: 865206 - DNA, 22 bp, Artificial Sequence
  chemically synthesized
gacgcaatcatatcttggcctc

SEQ ID NO: 865207 - DNA, 22 bp, Artificial Sequence
  chemically synthesized
gcttttagatggaggccaagat

SEQ ID NO: 865208 - DNA, 22 bp, Artificial Sequence
  chemically synthesized
tgacgcaatcatatcttggcct

SEQ ID NO: 865209 - DNA, 22 bp, Artificial Sequence
  chemically synthesized
ttagatggaggccaagatatga

SEQ ID NO: 865210 - DNA, 22 bp, Artificial Sequence
  chemically synthesized
tagatggaggccaagatatgat

SEQ ID NO: 865211 - DNA, 22 bp, Artificial Sequence
  chemically synthesized
atctttgacgcaatcatatctt

SEQ ID NO: 865212 - DNA, 22 bp, Artificial Sequence
  chemically synthesized
agatggaggccaagatatgatt

SEQ ID NO: 865213 - DNA, 22 bp, Artificial Sequence
  chemically synthesized
gatctttgacgcaatcatatct

SEQ ID NO: 865214 - DNA, 22 bp, Artificial Sequence
  chemically synthesized
gatggaggccaagatatgattg

SEQ ID NO: 865215 - DNA, 22 bp, Artificial Sequence
  chemically synthesized
tcttgatctttgacgcaatcat

SEQ ID NO: 865216 - DNA, 22 bp, Artificial Sequence
  chemically synthesized
atcttgatctttgacgcaatca

SEQ ID NO: 865217 - DNA, 22 bp, Artificial Sequence
  chemically synthesized
atccttatcttgatctttgacg

SEQ ID NO: 865218 - DNA, 22 bp, Artificial Sequence
  chemically synthesized
tgatccttatcttgatctttga

SEQ ID NO: 865219 - DNA, 22 bp, Artificial Sequence
  chemically synthesized
ctgatccttatcttgatctttg

SEQ ID NO: 865220 - DNA, 22 bp, Artificial Sequence
  chemically synthesized
gtttctgatccttatcttgatc

SEQ ID NO: 865221 - DNA, 22 bp, Artificial Sequence
  chemically synthesized
cgtttctgatccttatcttgat

SEQ ID NO: 865222 - DNA, 22 bp, Artificial Sequence
  chemically synthesized
cgtcaaagatcaagataaggat

SEQ ID NO: 865223 - DNA, 22 bp, Artificial Sequence
  chemically synthesized
aatttcgtttctgatccttatc

SEQ ID NO: 865224 - DNA, 22 bp, Artificial Sequence
  chemically synthesized
ctaaatttcgtttctgatcctt

SEQ ID NO: 865225 - DNA, 22 bp, Artificial Sequence
  chemically synthesized
cctaaatttcgtttctgatcct

SEQ ID NO: 865226 - DNA, 22 bp, Artificial Sequence
  chemically synthesized
ttcctaaatttcgtttctgatc

SEQ ID NO: 865227 - DNA, 22 bp, Artificial Sequence
  chemically synthesized
ggaggctcttcctaaatttcgt

SEQ ID NO: 865228 - DNA, 22 bp, Artificial Sequence
  chemically synthesized
acattgggaggctcttcctaaa

SEQ ID NO: 865229 - DNA, 22 bp, Artificial Sequence
  chemically synthesized
gtcattcacattgggaggctct

SEQ ID NO: 865230 - DNA, 22 bp, Artificial Sequence
  chemically synthesized
agtcattcacattgggaggctc

SEQ ID NO: 865231 - DNA, 22 bp, Artificial Sequence
  chemically synthesized
aggaagagcctcccaatgtgaa

SEQ ID NO: 865232 - DNA, 22 bp, Artificial Sequence
  chemically synthesized
ggaagagcctcccaatgtgaat

SEQ ID NO: 865233 - DNA, 22 bp, Artificial Sequence
  chemically synthesized
atcatatacaatttagtcattc

SEQ ID NO: 865234 - DNA, 22 bp, Artificial Sequence
  chemically synthesized
ccaatgtgaatgactaaattgt

SEQ ID NO: 865235 - DNA, 22 bp, Artificial Sequence
  chemically synthesized
gaaaagttaatcatatacaatt

SEQ ID NO: 865236 - DNA, 22 bp, Artificial Sequence
  chemically synthesized
agaaaagttaatcatatacaat

SEQ ID NO: 865237 - DNA, 22 bp, Artificial Sequence
  chemically synthesized
tagaaaagttaatcatatacaa

SEQ ID NO: 865238 - DNA, 22 bp, Artificial Sequence
  chemically synthesized
ttagaaaagttaatcatataca

SEQ ID NO: 865239 - DNA, 22 bp, Artificial Sequence
  chemically synthesized
aattgtatatgattaacttttc

SEQ ID NO: 865240 - DNA, 22 bp, Artificial Sequence
  chemically synthesized
tatatgattaacttttctaaaa

SEQ ID NO: 865241 - DNA, 22 bp, Artificial Sequence
  chemically synthesized
aatgacaacgagaagtattttt

SEQ ID NO: 865242 - DNA, 22 bp, Artificial Sequence
  chemically synthesized
acttttctaaaaatacttctcg

SEQ ID NO: 865243 - DNA, 22 bp, Artificial Sequence
  chemically synthesized
taaactaaatgacaacgagaag

SEQ ID NO: 865244 - DNA, 22 bp, Artificial Sequence
  chemically synthesized
ttctaaaaatacttctcgttgt

SEQ ID NO: 865245 - DNA, 22 bp, Artificial Sequence
  chemically synthesized
ataaactaaatgacaacgagaa

SEQ ID NO: 865246 - DNA, 22 bp, Artificial Sequence
  chemically synthesized
tctaaaaatacttctcgttgtc

SEQ ID NO: 865247 - DNA, 22 bp, Artificial Sequence
  chemically synthesized
ctaaaaatacttctcgttgtca

SEQ ID NO: 865248 - DNA, 22 bp, Artificial Sequence
  chemically synthesized
taaaaatacttctcgttgtcat

SEQ ID NO: 865249 - DNA, 22 bp, Artificial Sequence
  chemically synthesized
tttataaactaaatgacaacga

SEQ ID NO: 865250 - DNA, 22 bp, Artificial Sequence
  chemically synthesized
aaaatacttctcgttgtcattt

SEQ ID NO: 865251 - DNA, 22 bp, Artificial Sequence
  chemically synthesized
caagctatttataaactaaatg

SEQ ID NO: 865252 - DNA, 22 bp, Artificial Sequence
  chemically synthesized
ctcgttgtcatttagtttataa

SEQ ID NO: 865253 - DNA, 22 bp, Artificial Sequence
  chemically synthesized
tctgcaagctatttataaacta

SEQ ID NO: 865254 - DNA, 22 bp, Artificial Sequence
  chemically synthesized
tcgttgtcatttagtttataaa

SEQ ID NO: 865255 - DNA, 22 bp, Artificial Sequence
  chemically synthesized
gttgtcatttagtttataaata

SEQ ID NO: 865256 - DNA, 22 bp, Artificial Sequence
  chemically synthesized
tcatttagtttataaatagctt

SEQ ID NO: 865257 - DNA, 22 bp, Artificial Sequence
  chemically synthesized
agtttataaatagcttgcagat

SEQ ID NO: 865258 - DNA, 22 bp, Artificial Sequence
  chemically synthesized
gtttataaatagcttgcagata

SEQ ID NO: 865259 - DNA, 22 bp, Artificial Sequence
  chemically synthesized
taggaagacaatattatctgca

SEQ ID NO: 865260 - DNA, 22 bp, Artificial Sequence
  chemically synthesized
ataaatagcttgcagataatat

SEQ ID NO: 865261 - DNA, 22 bp, Artificial Sequence
  chemically synthesized
taaatagcttgcagataatatt

SEQ ID NO: 865262 - DNA, 22 bp, Artificial Sequence
  chemically synthesized
aacgaacctataggaagacaat

SEQ ID NO: 865263 - DNA, 22 bp, Artificial Sequence
  chemically synthesized
gcagataatattgtcttcctat

SEQ ID NO: 865264 - DNA, 22 bp, Artificial Sequence
  chemically synthesized
ttcaacgaacctataggaagac

SEQ ID NO: 865265 - DNA, 22 bp, Artificial Sequence
  chemically synthesized
cagataatattgtcttcctata

SEQ ID NO: 865266 - DNA, 22 bp, Artificial Sequence
  chemically synthesized
gttcaacgaacctataggaaga

SEQ ID NO: 865267 - DNA, 22 bp, Artificial Sequence
  chemically synthesized
atatttgttcaacgaacctata

SEQ ID NO: 865268 - DNA, 22 bp, Artificial Sequence
  chemically synthesized
tcttcctataggttcgttgaac

SEQ ID NO: 865269 - DNA, 22 bp, Artificial Sequence
  chemically synthesized
cctataggttcgttgaacaaat

SEQ ID NO: 865270 - DNA, 22 bp, Artificial Sequence
  chemically synthesized
ctataggttcgttgaacaaata

SEQ ID NO: 865271 - DNA, 22 bp, Artificial Sequence
  chemically synthesized
taggttcgttgaacaaatatta

SEQ ID NO: 865272 - DNA, 22 bp, Artificial Sequence
  chemically synthesized
ggcccaaaggtacccagttaat

SEQ ID NO: 865273 - DNA, 22 bp, Artificial Sequence
  chemically synthesized
gttgaacaaatattaactgggt

SEQ ID NO: 865274 - DNA, 22 bp, Artificial Sequence
  chemically synthesized
aacaaatattaactgggtacct

SEQ ID NO: 865275 - DNA, 22 bp, Artificial Sequence
  chemically synthesized
gggtgacactgggcccaaaggt

SEQ ID NO: 865276 - DNA, 22 bp, Artificial Sequence
  chemically synthesized
actgggtacctttgggcccagt

SEQ ID NO: 865277 - DNA, 22 bp, Artificial Sequence
  chemically synthesized
cattggggtgacactgggccca

SEQ ID NO: 865278 - DNA, 22 bp, Artificial Sequence
  chemically synthesized
ggtacctttgggcccagtgtca

SEQ ID NO: 865279 - DNA, 22 bp, Artificial Sequence
  chemically synthesized
actccattggggtgacactggg

SEQ ID NO: 865280 - DNA, 22 bp, Artificial Sequence
  chemically synthesized
tgggcccagtgtcaccccaatg

SEQ ID NO: 865281 - DNA, 22 bp, Artificial Sequence
  chemically synthesized
gggcccagtgtcaccccaatgg

SEQ ID NO: 865282 - DNA, 22 bp, Artificial Sequence
  chemically synthesized
ggcccagtgtcaccccaatgga

SEQ ID NO: 865283 - DNA, 22 bp, Artificial Sequence
  chemically synthesized
agccaccaacaatattcactcc

SEQ ID NO: 865284 - DNA, 22 bp, Artificial Sequence
  chemically synthesized
aagccaccaacaatattcactc

SEQ ID NO: 865285 - DNA, 22 bp, Artificial Sequence
  chemically synthesized
tttaagccaccaacaatattca

SEQ ID NO: 865286 - DNA, 22 bp, Artificial Sequence
  chemically synthesized
aatggaagttgtttaagccacc

SEQ ID NO: 865287 - DNA, 22 bp, Artificial Sequence
  chemically synthesized
gaatggaagttgtttaagccac

SEQ ID NO: 865288 - DNA, 22 bp, Artificial Sequence
  chemically synthesized
tgaatggaagttgtttaagcca

SEQ ID NO: 865289 - DNA, 22 bp, Artificial Sequence
  chemically synthesized
ttggtggcttaaacaacttcca

SEQ ID NO: 865290 - DNA, 22 bp, Artificial Sequence
  chemically synthesized
gtggcttaaacaacttccattc

SEQ ID NO: 865291 - DNA, 22 bp, Artificial Sequence
  chemically synthesized
aaacaacttccattcaaagata

SEQ ID NO: 865292 - DNA, 22 bp, Artificial Sequence
  chemically synthesized
aacaacttccattcaaagatat

SEQ ID NO: 865293 - DNA, 22 bp, Artificial Sequence
  chemically synthesized
agagtgggtgtagggatatctt

SEQ ID NO: 865294 - DNA, 22 bp, Artificial Sequence
  chemically synthesized
cagagtgggtgtagggatatct

SEQ ID NO: 865295 - DNA, 22 bp, Artificial Sequence
  chemically synthesized
ccattcaaagatatccctacac

SEQ ID NO: 865296 - DNA, 22 bp, Artificial Sequence
  chemically synthesized
cattcaaagatatccctacacc

SEQ ID NO: 865297 - DNA, 22 bp, Artificial Sequence
  chemically synthesized
aaagatatccctacacccactc

SEQ ID NO: 865298 - DNA, 22 bp, Artificial Sequence
  chemically synthesized
gaaagcagaatttcagagtggg

SEQ ID NO: 865299 - DNA, 22 bp, Artificial Sequence
  chemically synthesized
ctagaaagcagaatttcagagt

SEQ ID NO: 865300 - DNA, 22 bp, Artificial Sequence
  chemically synthesized
tcctagaaagcagaatttcaga

SEQ ID NO: 865301 - DNA, 22 bp, Artificial Sequence
  chemically synthesized
cacccactctgaaattctgctt

SEQ ID NO: 865302 - DNA, 22 bp, Artificial Sequence
  chemically synthesized
gaattctcctagaaagcagaat

SEQ ID NO: 865303 - DNA, 22 bp, Artificial Sequence
  chemically synthesized
tgaaattctgctttctaggaga

SEQ ID NO: 865304 - DNA, 22 bp, Artificial Sequence
  chemically synthesized
aaattctgctttctaggagaat

SEQ ID NO: 865305 - DNA, 22 bp, Artificial Sequence
  chemically synthesized
aagacaattggaattctcctag

SEQ ID NO: 865306 - DNA, 22 bp, Artificial Sequence
  chemically synthesized
gaagacaattggaattctccta

SEQ ID NO: 865307 - DNA, 22 bp, Artificial Sequence
  chemically synthesized
tgctttctaggagaattccaat

SEQ ID NO: 865308 - DNA, 22 bp, Artificial Sequence
  chemically synthesized
ctttctaggagaattccaattg

SEQ ID NO: 865309 - DNA, 22 bp, Artificial Sequence
  chemically synthesized
tctaggagaattccaattgtct

SEQ ID NO: 865310 - DNA, 22 bp, Artificial Sequence
  chemically synthesized
ctaggagaattccaattgtctt

SEQ ID NO: 865311 - DNA, 22 bp, Artificial Sequence
  chemically synthesized
cgtagaaacttgaagacaattg

SEQ ID NO: 865312 - DNA, 22 bp, Artificial Sequence
  chemically synthesized
taggagaattccaattgtcttc

SEQ ID NO: 865313 - DNA, 22 bp, Artificial Sequence
  chemically synthesized
ggagaattccaattgtcttcaa

SEQ ID NO: 865314 - DNA, 22 bp, Artificial Sequence
  chemically synthesized
aggatggattccgtagaaactt

SEQ ID NO: 865315 - DNA, 22 bp, Artificial Sequence
  chemically synthesized
caattgtcttcaagtttctacg

SEQ ID NO: 865316 - DNA, 22 bp, Artificial Sequence
  chemically synthesized
tcttcaagtttctacggaatcc

SEQ ID NO: 865317 - DNA, 22 bp, Artificial Sequence
  chemically synthesized
cagaactgaggatggattccgt

SEQ ID NO: 865318 - DNA, 22 bp, Artificial Sequence
  chemically synthesized
caagtttctacggaatccatcc

SEQ ID NO: 865319 - DNA, 22 bp, Artificial Sequence
  chemically synthesized
aagtttctacggaatccatcct

SEQ ID NO: 865320 - DNA, 22 bp, Artificial Sequence
  chemically synthesized
ctacggaatccatcctcagttc

SEQ ID NO: 865321 - DNA, 22 bp, Artificial Sequence
  chemically synthesized
aatccatctccagaactgagga

SEQ ID NO: 865322 - DNA, 22 bp, Artificial Sequence
  chemically synthesized
tacggaatccatcctcagttct

SEQ ID NO: 865323 - DNA, 22 bp, Artificial Sequence
  chemically synthesized
cggaatccatcctcagttctgg

SEQ ID NO: 865324 - DNA, 22 bp, Artificial Sequence
  chemically synthesized
ggtgaatctaaatccatctcca

SEQ ID NO: 865325 - DNA, 22 bp, Artificial Sequence
  chemically synthesized
aggtgaatctaaatccatctcc

SEQ ID NO: 865326 - DNA, 22 bp, Artificial Sequence
  chemically synthesized
agttctggagatggatttagat

SEQ ID NO: 865327 - DNA, 22 bp, Artificial Sequence
  chemically synthesized
tggagatggatttagattcacc

SEQ ID NO: 865328 - DNA, 22 bp, Artificial Sequence
  chemically synthesized
gagatggatttagattcaccta

SEQ ID NO: 865329 - DNA, 22 bp, Artificial Sequence
  chemically synthesized
gaatcgaagatttaggtgaatc

SEQ ID NO: 865330 - DNA, 22 bp, Artificial Sequence
  chemically synthesized
agaatcgaagatttaggtgaat

SEQ ID NO: 865331 - DNA, 22 bp, Artificial Sequence
  chemically synthesized
gcttagaatcgaagatttaggt

SEQ ID NO: 865332 - DNA, 22 bp, Artificial Sequence
  chemically synthesized
actggcttagaatcgaagattt

SEQ ID NO: 865333 - DNA, 22 bp, Artificial Sequence
  chemically synthesized
gactggcttagaatcgaagatt

SEQ ID NO: 865334 - DNA, 22 bp, Artificial Sequence
  chemically synthesized
agattcacctaaatcttcgatt

SEQ ID NO: 865335 - DNA, 22 bp, Artificial Sequence
  chemically synthesized
gattcacctaaatcttcgattc

SEQ ID NO: 865336 - DNA, 22 bp, Artificial Sequence
  chemically synthesized
tcttgactggcttagaatcgaa

SEQ ID NO: 865337 - DNA, 22 bp, Artificial Sequence
  chemically synthesized
acctaaatcttcgattctaagc

SEQ ID NO: 865338 - DNA, 22 bp, Artificial Sequence
  chemically synthesized
aatcttcgattctaagccagtc

SEQ ID NO: 865339 - DNA, 22 bp, Artificial Sequence
  chemically synthesized
cgattctaagccagtcaagata

SEQ ID NO: 865340 - DNA, 22 bp, Artificial Sequence
  chemically synthesized
gattctaagccagtcaagataa

SEQ ID NO: 865341 - DNA, 22 bp, Artificial Sequence
  chemically synthesized
aaccaagaggatgagattatct

SEQ ID NO: 865342 - DNA, 22 bp, Artificial Sequence
  chemically synthesized
taagccagtcaagataatctca

SEQ ID NO: 865343 - DNA, 22 bp, Artificial Sequence
  chemically synthesized
agccagtcaagataatctcatc

SEQ ID NO: 865344 - DNA, 22 bp, Artificial Sequence
  chemically synthesized
ctgaaccaagaggatgagatta

SEQ ID NO: 865345 - DNA, 22 bp, Artificial Sequence
  chemically synthesized
cctgaaccaagaggatgagatt

SEQ ID NO: 865346 - DNA, 22 bp, Artificial Sequence
  chemically synthesized
ttcctgaaccaagaggatgaga

SEQ ID NO: 865347 - DNA, 22 bp, Artificial Sequence
  chemically synthesized
cttcctgaaccaagaggatgag

SEQ ID NO: 865348 - DNA, 22 bp, Artificial Sequence
  chemically synthesized
tcttcctgaaccaagaggatga

SEQ ID NO: 865349 - DNA, 22 bp, Artificial Sequence
  chemically synthesized
ttcttcctgaaccaagaggatg

SEQ ID NO: 865350 - DNA, 22 bp, Artificial Sequence
  chemically synthesized
aacttttcttcctgaaccaaga

SEQ ID NO: 865351 - DNA, 22 bp, Artificial Sequence
  chemically synthesized
aaacttttcttcctgaaccaag

SEQ ID NO: 865352 - DNA, 22 bp, Artificial Sequence
  chemically synthesized
atttaaacttttcttcctgaac

SEQ ID NO: 865353 - DNA, 22 bp, Artificial Sequence
  chemically synthesized
atcctcttggttcaggaagaaa

SEQ ID NO: 865354 - DNA, 22 bp, Artificial Sequence
  chemically synthesized
gttgatttaaacttttcttcct

SEQ ID NO: 865355 - DNA, 22 bp, Artificial Sequence
  chemically synthesized
ttggttcaggaagaaaagttta

SEQ ID NO: 865356 - DNA, 22 bp, Artificial Sequence
  chemically synthesized
ggttcaggaagaaaagtttaaa

SEQ ID NO: 865357 - DNA, 22 bp, Artificial Sequence
  chemically synthesized
gttcaggaagaaaagtttaaat

SEQ ID NO: 865358 - DNA, 22 bp, Artificial Sequence
  chemically synthesized
ataagctggttgatttaaactt

SEQ ID NO: 865359 - DNA, 22 bp, Artificial Sequence
  chemically synthesized
cataagctggttgatttaaact

SEQ ID NO: 865360 - DNA, 22 bp, Artificial Sequence
  chemically synthesized
aggaagaaaagtttaaatcaac

SEQ ID NO: 865361 - DNA, 22 bp, Artificial Sequence
  chemically synthesized
agaatggtttcataagctggtt

SEQ ID NO: 865362 - DNA, 22 bp, Artificial Sequence
  chemically synthesized
aaatcaaccagcttatgaaacc

SEQ ID NO: 865363 - DNA, 22 bp, Artificial Sequence
  chemically synthesized
aatcaaccagcttatgaaacca

SEQ ID NO: 865364 - DNA, 22 bp, Artificial Sequence
  chemically synthesized
aagatgattcagaatggtttca

SEQ ID NO: 865365 - DNA, 22 bp, Artificial Sequence
  chemically synthesized
tactaaagatgattcagaatgg

SEQ ID NO: 865366 - DNA, 22 bp, Artificial Sequence
  chemically synthesized
ttgtactaaagatgattcagaa

SEQ ID NO: 865367 - DNA, 22 bp, Artificial Sequence
  chemically synthesized
atgaaaccattctgaatcatct

SEQ ID NO: 865368 - DNA, 22 bp, Artificial Sequence
  chemically synthesized
ctattgtactaaagatgattca

SEQ ID NO: 865369 - DNA, 22 bp, Artificial Sequence
  chemically synthesized
tgaaaccattctgaatcatctt

SEQ ID NO: 865370 - DNA, 22 bp, Artificial Sequence
  chemically synthesized
atatatatctactattgtacta

SEQ ID NO: 865371 - DNA, 22 bp, Artificial Sequence
  chemically synthesized
tgaatcatctttagtacaatag

SEQ ID NO: 865372 - DNA, 22 bp, Artificial Sequence
  chemically synthesized
aatcatctttagtacaatagta

SEQ ID NO: 865373 - DNA, 22 bp, Artificial Sequence
  chemically synthesized
ggtattcatatatatctactat

SEQ ID NO: 865374 - DNA, 22 bp, Artificial Sequence
  chemically synthesized
tagtacaatagtagatatatat

SEQ ID NO: 865375 - DNA, 22 bp, Artificial Sequence
  chemically synthesized
agtacaatagtagatatatatg

SEQ ID NO: 865376 - DNA, 22 bp, Artificial Sequence
  chemically synthesized
gtacaatagtagatatatatga

SEQ ID NO: 865377 - DNA, 22 bp, Artificial Sequence
  chemically synthesized
gtatatgtattaggtattcata

SEQ ID NO: 865378 - DNA, 22 bp, Artificial Sequence
  chemically synthesized
tatcattagtatatgtattagg

SEQ ID NO: 865379 - DNA, 22 bp, Artificial Sequence
  chemically synthesized
ctgtatcattagtatatgtatt

SEQ ID NO: 865380 - DNA, 22 bp, Artificial Sequence
  chemically synthesized
tgtatctactgtatcattagta

SEQ ID NO: 865381 - DNA, 22 bp, Artificial Sequence
  chemically synthesized
attgtgtatctactgtatcatt

SEQ ID NO: 865382 - DNA, 22 bp, Artificial Sequence
  chemically synthesized
atacatatactaatgatacagt

SEQ ID NO: 865383 - DNA, 22 bp, Artificial Sequence
  chemically synthesized
aattgtgtatctactgtatcat

SEQ ID NO: 865384 - DNA, 22 bp, Artificial Sequence
  chemically synthesized
taattgtgtatctactgtatca

SEQ ID NO: 865385 - DNA, 22 bp, Artificial Sequence
  chemically synthesized
atgatacagtagatacacaatt

SEQ ID NO: 865386 - DNA, 22 bp, Artificial Sequence
  chemically synthesized
agataagaacaatcaaaatttt

SEQ ID NO: 865387 - DNA, 22 bp, Artificial Sequence
  chemically synthesized
accctcagataagaacaatcaa

SEQ ID NO: 865388 - DNA, 22 bp, Artificial Sequence
  chemically synthesized
caccctcagataagaacaatca

SEQ ID NO: 865389 - DNA, 22 bp, Artificial Sequence
  chemically synthesized
aaattttgattgttcttatctg

SEQ ID NO: 865390 - DNA, 22 bp, Artificial Sequence
  chemically synthesized
agagatttcaccctcagataag

SEQ ID NO: 865391 - DNA, 22 bp, Artificial Sequence
  chemically synthesized
tgattgttcttatctgagggtg

SEQ ID NO: 865392 - DNA, 22 bp, Artificial Sequence
  chemically synthesized
gattgttcttatctgagggtga

SEQ ID NO: 865393 - DNA, 22 bp, Artificial Sequence
  chemically synthesized
attgttcttatctgagggtgaa

SEQ ID NO: 865394 - DNA, 22 bp, Artificial Sequence
  chemically synthesized
acagattcagagatttcaccct

SEQ ID NO: 865395 - DNA, 22 bp, Artificial Sequence
  chemically synthesized
ttcttatctgagggtgaaatct

SEQ ID NO: 865396 - DNA, 22 bp, Artificial Sequence
  chemically synthesized
cctcacagattcagagatttca

SEQ ID NO: 865397 - DNA, 22 bp, Artificial Sequence
  chemically synthesized
ttatctgagggtgaaatctctg

SEQ ID NO: 865398 - DNA, 22 bp, Artificial Sequence
  chemically synthesized
acctcacagattcagagatttc

SEQ ID NO: 865399 - DNA, 22 bp, Artificial Sequence
  chemically synthesized
atctgagggtgaaatctctgaa

SEQ ID NO: 865400 - DNA, 22 bp, Artificial Sequence
  chemically synthesized
tctgagggtgaaatctctgaat

SEQ ID NO: 865401 - DNA, 22 bp, Artificial Sequence
  chemically synthesized
agggtgaaatctctgaatctgt

SEQ ID NO: 865402 - DNA, 22 bp, Artificial Sequence
  chemically synthesized
tgaatctgtgaggtaagtgttt

SEQ ID NO: 865403 - DNA, 22 bp, Artificial Sequence
  chemically synthesized
cagtgagagacataaacactta

SEQ ID NO: 865404 - DNA, 22 bp, Artificial Sequence
  chemically synthesized
aatctgtgaggtaagtgtttat

SEQ ID NO: 865405 - DNA, 22 bp, Artificial Sequence
  chemically synthesized
ttacagtgagagacataaacac

SEQ ID NO: 865406 - DNA, 22 bp, Artificial Sequence
  chemically synthesized
gttacagtgagagacataaaca

SEQ ID NO: 865407 - DNA, 22 bp, Artificial Sequence
  chemically synthesized
ttgttacagtgagagacataaa

SEQ ID NO: 865408 - DNA, 22 bp, Artificial Sequence
  chemically synthesized
tgaggtaagtgtttatgtctct

SEQ ID NO: 865409 - DNA, 22 bp, Artificial Sequence
  chemically synthesized
cttgttacagtgagagacataa

SEQ ID NO: 865410 - DNA, 22 bp, Artificial Sequence
  chemically synthesized
atgtctctcactgtaacaagaa

SEQ ID NO: 865411 - DNA, 22 bp, Artificial Sequence
  chemically synthesized
tgtctctcactgtaacaagaaa

SEQ ID NO: 865412 - DNA, 22 bp, Artificial Sequence
  chemically synthesized
tcactgtaacaagaaattatgt

SEQ ID NO: 865413 - DNA, 22 bp, Artificial Sequence
  chemically synthesized
actgtaacaagaaattatgtta

SEQ ID NO: 865414 - DNA, 22 bp, Artificial Sequence
  chemically synthesized
ccagcaacaaatgggtaacata

SEQ ID NO: 865415 - DNA, 22 bp, Artificial Sequence
  chemically synthesized
taacaagaaattatgttaccca

SEQ ID NO: 865416 - DNA, 22 bp, Artificial Sequence
  chemically synthesized
caagatgactgccagcaacaaa

SEQ ID NO: 865417 - DNA, 22 bp, Artificial Sequence
  chemically synthesized
tgttacccatttgttgctggca

SEQ ID NO: 865418 - DNA, 22 bp, Artificial Sequence
  chemically synthesized
caggttccaagatgactgccag

SEQ ID NO: 865419 - DNA, 22 bp, Artificial Sequence
  chemically synthesized
cccatttgttgctggcagtcat

SEQ ID NO: 865420 - DNA, 22 bp, Artificial Sequence
  chemically synthesized
ccctccaggttccaagatgact

SEQ ID NO: 865421 - DNA, 22 bp, Artificial Sequence
  chemically synthesized
gttgctggcagtcatcttggaa

SEQ ID NO: 865422 - DNA, 22 bp, Artificial Sequence
  chemically synthesized
ttgctggcagtcatcttggaac

SEQ ID NO: 865423 - DNA, 22 bp, Artificial Sequence
  chemically synthesized
gttgccctccaggttccaagat

SEQ ID NO: 865424 - DNA, 22 bp, Artificial Sequence
  chemically synthesized
ctggcagtcatcttggaacctg

SEQ ID NO: 865425 - DNA, 22 bp, Artificial Sequence
  chemically synthesized
actagttgccctccaggttcca

SEQ ID NO: 865426 - DNA, 22 bp, Artificial Sequence
  chemically synthesized
gcagtcatcttggaacctggag

SEQ ID NO: 865427 - DNA, 22 bp, Artificial Sequence
  chemically synthesized
ctcactagttgccctccaggtt

SEQ ID NO: 865428 - DNA, 22 bp, Artificial Sequence
  chemically synthesized
acctcctcactagttgccctcc

SEQ ID NO: 865429 - DNA, 22 bp, Artificial Sequence
  chemically synthesized
gacctcctcactagttgccctc

SEQ ID NO: 865430 - DNA, 22 bp, Artificial Sequence
  chemically synthesized
tgacctcctcactagttgccct

SEQ ID NO: 865431 - DNA, 22 bp, Artificial Sequence
  chemically synthesized
ggaacctggagggcaactagtg

SEQ ID NO: 865432 - DNA, 22 bp, Artificial Sequence
  chemically synthesized
gaacctggagggcaactagtga

SEQ ID NO: 865433 - DNA, 22 bp, Artificial Sequence
  chemically synthesized
cgtcagctttgacctcctcact

SEQ ID NO: 865434 - DNA, 22 bp, Artificial Sequence
  chemically synthesized
gagggcaactagtgaggaggtc

SEQ ID NO: 865435 - DNA, 22 bp, Artificial Sequence
  chemically synthesized
tgcgtcagctttgacctcctca

SEQ ID NO: 865436 - DNA, 22 bp, Artificial Sequence
  chemically synthesized
tctgcgtcagctttgacctcct

SEQ ID NO: 865437 - DNA, 22 bp, Artificial Sequence
  chemically synthesized
ctctgcgtcagctttgacctcc

SEQ ID NO: 865438 - DNA, 22 bp, Artificial Sequence
  chemically synthesized
tctctgcgtcagctttgacctc

SEQ ID NO: 865439 - DNA, 22 bp, Artificial Sequence
  chemically synthesized
ttctctgcgtcagctttgacct

SEQ ID NO: 865440 - DNA, 22 bp, Artificial Sequence
  chemically synthesized
tttctctgcgtcagctttgacc

SEQ ID NO: 865441 - DNA, 22 bp, Artificial Sequence
  chemically synthesized
ttttctctgcgtcagctttgac

SEQ ID NO: 865442 - DNA, 22 bp, Artificial Sequence
  chemically synthesized
gtgaggaggtcaaagctgacgc

SEQ ID NO: 865443 - DNA, 22 bp, Artificial Sequence
  chemically synthesized
atttttttctctgcgtcagctt

SEQ ID NO: 865444 - DNA, 22 bp, Artificial Sequence
  chemically synthesized
tcctgatttttttctctgcgtc

SEQ ID NO: 865445 - DNA, 22 bp, Artificial Sequence
  chemically synthesized
gtcctgatttttttctctgcgt

SEQ ID NO: 865446 - DNA, 22 bp, Artificial Sequence
  chemically synthesized
tgtcctgatttttttctctgcg

SEQ ID NO: 865447 - DNA, 22 bp, Artificial Sequence
  chemically synthesized
tttgtcctgatttttttctctg

SEQ ID NO: 865448 - DNA, 22 bp, Artificial Sequence
  chemically synthesized
ctttgtcctgatttttttctct

SEQ ID NO: 865449 - DNA, 22 bp, Artificial Sequence
  chemically synthesized
tctttgtcctgatttttttctc

SEQ ID NO: 865450 - DNA, 22 bp, Artificial Sequence
  chemically synthesized
tgactttctttgtcctgatttt

SEQ ID NO: 865451 - DNA, 22 bp, Artificial Sequence
  chemically synthesized
acgcagagaaaaaaatcaggac

SEQ ID NO: 865452 - DNA, 22 bp, Artificial Sequence
  chemically synthesized
tatgactttctttgtcctgatt

SEQ ID NO: 865453 - DNA, 22 bp, Artificial Sequence
  chemically synthesized
tctatgactttctttgtcctga

SEQ ID NO: 865454 - DNA, 22 bp, Artificial Sequence
  chemically synthesized
ctctatgactttctttgtcctg

SEQ ID NO: 865455 - DNA, 22 bp, Artificial Sequence
  chemically synthesized
tctctatgactttctttgtcct

SEQ ID NO: 865456 - DNA, 22 bp, Artificial Sequence
  chemically synthesized
tttctctatgactttctttgtc

SEQ ID NO: 865457 - DNA, 22 bp, Artificial Sequence
  chemically synthesized
tcactctttctctatgactttc

SEQ ID NO: 865458 - DNA, 22 bp, Artificial Sequence
  chemically synthesized
tgtcactctttctctatgactt

SEQ ID NO: 865459 - DNA, 22 bp, Artificial Sequence
  chemically synthesized
cagatgaagtacaagcagagct

SEQ ID NO: 865460 - DNA, 22 bp, Artificial Sequence
  chemically synthesized
gctccagatgaagtacaagcag

SEQ ID NO: 865461 - DNA, 22 bp, Artificial Sequence
  chemically synthesized
aagctggctccagatgaagtac

SEQ ID NO: 865462 - DNA, 22 bp, Artificial Sequence
  chemically synthesized
tgcttgtacttcatctggagcc

SEQ ID NO: 865463 - DNA, 22 bp, Artificial Sequence
  chemically synthesized
agaggttaaagctggctccaga

SEQ ID NO: 865464 - DNA, 22 bp, Artificial Sequence
  chemically synthesized
cttgtacttcatctggagccag

SEQ ID NO: 865465 - DNA, 22 bp, Artificial Sequence
  chemically synthesized
gtacttcatctggagccagctt

SEQ ID NO: 865466 - DNA, 22 bp, Artificial Sequence
  chemically synthesized
tacttcatctggagccagcttt

SEQ ID NO: 865467 - DNA, 22 bp, Artificial Sequence
  chemically synthesized
gaagttcagaggttaaagctgg

SEQ ID NO: 865468 - DNA, 22 bp, Artificial Sequence
  chemically synthesized
catctggagccagctttaacct

SEQ ID NO: 865469 - DNA, 22 bp, Artificial Sequence
  chemically synthesized
atctggagccagctttaacctc

SEQ ID NO: 865470 - DNA, 22 bp, Artificial Sequence
  chemically synthesized
gagccagctttaacctctgaac

SEQ ID NO: 865471 - DNA, 22 bp, Artificial Sequence
  chemically synthesized
acataactggaagttcagaggt

SEQ ID NO: 865472 - DNA, 22 bp, Artificial Sequence
  chemically synthesized
aactcacataactggaagttca

SEQ ID NO: 865473 - DNA, 22 bp, Artificial Sequence
  chemically synthesized
taacctctgaacttccagttat

SEQ ID NO: 865474 - DNA, 22 bp, Artificial Sequence
  chemically synthesized
aacctctgaacttccagttatg

SEQ ID NO: 865475 - DNA, 22 bp, Artificial Sequence
  chemically synthesized
acctctgaacttccagttatgt

SEQ ID NO: 865476 - DNA, 22 bp, Artificial Sequence
  chemically synthesized
tgaacttccagttatgtgagtt

SEQ ID NO: 865477 - DNA, 22 bp, Artificial Sequence
  chemically synthesized
aacttccagttatgtgagttga

SEQ ID NO: 865478 - DNA, 22 bp, Artificial Sequence
  chemically synthesized
aaaaataagaataattcaactc

SEQ ID NO: 865479 - DNA, 22 bp, Artificial Sequence
  chemically synthesized
caaaaataagaataattcaact

SEQ ID NO: 865480 - DNA, 22 bp, Artificial Sequence
  chemically synthesized
ccagttatgtgagttgaattat

SEQ ID NO: 865481 - DNA, 22 bp, Artificial Sequence
  chemically synthesized
cagttatgtgagttgaattatt

SEQ ID NO: 865482 - DNA, 22 bp, Artificial Sequence
  chemically synthesized
tgtgagttgaattattcttatt

SEQ ID NO: 865483 - DNA, 22 bp, Artificial Sequence
  chemically synthesized
aaagtggcttcaaaaataagaa

SEQ ID NO: 865484 - DNA, 22 bp, Artificial Sequence
  chemically synthesized
caaagtggcttcaaaaataaga

SEQ ID NO: 865485 - DNA, 22 bp, Artificial Sequence
  chemically synthesized
tcaaagtggcttcaaaaataag

SEQ ID NO: 865486 - DNA, 22 bp, Artificial Sequence
  chemically synthesized
aattattcttatttttgaagcc

SEQ ID NO: 865487 - DNA, 22 bp, Artificial Sequence
  chemically synthesized
ttcttatttttgaagccacttt

SEQ ID NO: 865488 - DNA, 22 bp, Artificial Sequence
  chemically synthesized
ttatttttgaagccactttgaa

SEQ ID NO: 865489 - DNA, 22 bp, Artificial Sequence
  chemically synthesized
atttttgaagccactttgaaag

SEQ ID NO: 865490 - DNA, 22 bp, Artificial Sequence
  chemically synthesized
tttttgaagccactttgaaagt

SEQ ID NO: 865491 - DNA, 22 bp, Artificial Sequence
  chemically synthesized
ttgaagccactttgaaagtgca

SEQ ID NO: 865492 - DNA, 22 bp, Artificial Sequence
  chemically synthesized
caagaaagagaatgcactttca

SEQ ID NO: 865493 - DNA, 22 bp, Artificial Sequence
  chemically synthesized
tgaagccactttgaaagtgcat

SEQ ID NO: 865494 - DNA, 22 bp, Artificial Sequence
  chemically synthesized
gaagccactttgaaagtgcatt

SEQ ID NO: 865495 - DNA, 22 bp, Artificial Sequence
  chemically synthesized
aagccactttgaaagtgcattc

SEQ ID NO: 865496 - DNA, 22 bp, Artificial Sequence
  chemically synthesized
ggctgcaagaaagagaatgcac

SEQ ID NO: 865497 - DNA, 22 bp, Artificial Sequence
  chemically synthesized
gggctgcaagaaagagaatgca

SEQ ID NO: 865498 - DNA, 22 bp, Artificial Sequence
  chemically synthesized
tgggctgcaagaaagagaatgc

SEQ ID NO: 865499 - DNA, 22 bp, Artificial Sequence
  chemically synthesized
tgaaagtgcattctctttcttg

SEQ ID NO: 865500 - DNA, 22 bp, Artificial Sequence
  chemically synthesized
gaaagtgcattctctttcttgc

SEQ ID NO: 865501 - DNA, 22 bp, Artificial Sequence
  chemically synthesized
aaagtgcattctctttcttgca

SEQ ID NO: 865502 - DNA, 22 bp, Artificial Sequence
  chemically synthesized
agatgctttgggctgcaagaaa

SEQ ID NO: 865503 - DNA, 22 bp, Artificial Sequence
  chemically synthesized
atagttaagatgctttgggctg

SEQ ID NO: 865504 - DNA, 22 bp, Artificial Sequence
  chemically synthesized
aatagttaagatgctttgggct

SEQ ID NO: 865505 - DNA, 22 bp, Artificial Sequence
  chemically synthesized
tctttcttgcagcccaaagcat

SEQ ID NO: 865506 - DNA, 22 bp, Artificial Sequence
  chemically synthesized
tttcttgcagcccaaagcatct

SEQ ID NO: 865507 - DNA, 22 bp, Artificial Sequence
  chemically synthesized
tcttgcagcccaaagcatctta

SEQ ID NO: 865508 - DNA, 22 bp, Artificial Sequence
  chemically synthesized
cttgcagcccaaagcatcttaa

SEQ ID NO: 865509 - DNA, 22 bp, Artificial Sequence
  chemically synthesized
ttgcagcccaaagcatcttaac

SEQ ID NO: 865510 - DNA, 22 bp, Artificial Sequence
  chemically synthesized
gcagcccaaagcatcttaacta

SEQ ID NO: 865511 - DNA, 22 bp, Artificial Sequence
  chemically synthesized
cagcccaaagcatcttaactat

SEQ ID NO: 865512 - DNA, 22 bp, Artificial Sequence
  chemically synthesized
gtgacatatttaatagttaaga

SEQ ID NO: 865513 - DNA, 22 bp, Artificial Sequence
  chemically synthesized
ccctggtgacatatttaatagt

SEQ ID NO: 865514 - DNA, 22 bp, Artificial Sequence
  chemically synthesized
tgttaccctggtgacatattta

SEQ ID NO: 865515 - DNA, 22 bp, Artificial Sequence
  chemically synthesized
atgttaccctggtgacatattt

SEQ ID NO: 865516 - DNA, 22 bp, Artificial Sequence
  chemically synthesized
aactattaaatatgtcaccagg

SEQ ID NO: 865517 - DNA, 22 bp, Artificial Sequence
  chemically synthesized
actattaaatatgtcaccaggg

SEQ ID NO: 865518 - DNA, 22 bp, Artificial Sequence
  chemically synthesized
gcatatttatgttaccctggtg

SEQ ID NO: 865519 - DNA, 22 bp, Artificial Sequence
  chemically synthesized
ttaaatatgtcaccagggtaac

SEQ ID NO: 865520 - DNA, 22 bp, Artificial Sequence
  chemically synthesized
ttggcatatttatgttaccctg

SEQ ID NO: 865521 - DNA, 22 bp, Artificial Sequence
  chemically synthesized
aatatgtcaccagggtaacata

SEQ ID NO: 865522 - DNA, 22 bp, Artificial Sequence
  chemically synthesized
attgttggcatatttatgttac

SEQ ID NO: 865523 - DNA, 22 bp, Artificial Sequence
  chemically synthesized
agattaattgttggcatattta

SEQ ID NO: 865524 - DNA, 22 bp, Artificial Sequence
  chemically synthesized
ctgagattaattgttggcatat

SEQ ID NO: 865525 - DNA, 22 bp, Artificial Sequence
  chemically synthesized
actgagattaattgttggcata

SEQ ID NO: 865526 - DNA, 22 bp, Artificial Sequence
  chemically synthesized
tactgagattaattgttggcat

SEQ ID NO: 865527 - DNA, 22 bp, Artificial Sequence
  chemically synthesized
agcaagtatcataatattttac

SEQ ID NO: 865528 - DNA, 22 bp, Artificial Sequence
  chemically synthesized
cagcaagtatcataatatttta

SEQ ID NO: 865529 - DNA, 22 bp, Artificial Sequence
  chemically synthesized
tttcagcaagtatcataatatt

SEQ ID NO: 865530 - DNA, 22 bp, Artificial Sequence
  chemically synthesized
atctcagtaaaatattatgata

SEQ ID NO: 865531 - DNA, 22 bp, Artificial Sequence
  chemically synthesized
ctatttcagcaagtatcataat

SEQ ID NO: 865532 - DNA, 22 bp, Artificial Sequence
  chemically synthesized
ctcctatttcagcaagtatcat

SEQ ID NO: 865533 - DNA, 22 bp, Artificial Sequence
  chemically synthesized
agtaaaatattatgatacttgc

SEQ ID NO: 865534 - DNA, 22 bp, Artificial Sequence
  chemically synthesized
actcctatttcagcaagtatca

SEQ ID NO: 865535 - DNA, 22 bp, Artificial Sequence
  chemically synthesized
aaatttactcctatttcagcaa

SEQ ID NO: 865536 - DNA, 22 bp, Artificial Sequence
  chemically synthesized
aaaatttactcctatttcagca

SEQ ID NO: 865537 - DNA, 22 bp, Artificial Sequence
  chemically synthesized
taaaatttactcctatttcagc

SEQ ID NO: 865538 - DNA, 22 bp, Artificial Sequence
  chemically synthesized
tgatacttgctgaaataggagt

SEQ ID NO: 865539 - DNA, 22 bp, Artificial Sequence
  chemically synthesized
tcattttaaaatttactcctat

SEQ ID NO: 865540 - DNA, 22 bp, Artificial Sequence
  chemically synthesized
gctgaaataggagtaaatttta

SEQ ID NO: 865541 - DNA, 22 bp, Artificial Sequence
  chemically synthesized
ctgaaataggagtaaattttaa

SEQ ID NO: 865542 - DNA, 22 bp, Artificial Sequence
  chemically synthesized
catattatcattttaaaattta

SEQ ID NO: 865543 - DNA, 22 bp, Artificial Sequence
  chemically synthesized
tccatattatcattttaaaatt

SEQ ID NO: 865544 - DNA, 22 bp, Artificial Sequence
  chemically synthesized
aaataggagtaaattttaaaat

SEQ ID NO: 865545 - DNA, 22 bp, Artificial Sequence
  chemically synthesized
tctccatattatcattttaaaa

SEQ ID NO: 865546 - DNA, 22 bp, Artificial Sequence
  chemically synthesized
tctctccatattatcattttaa

SEQ ID NO: 865547 - DNA, 22 bp, Artificial Sequence
  chemically synthesized
ctctctccatattatcatttta

SEQ ID NO: 865548 - DNA, 22 bp, Artificial Sequence
  chemically synthesized
taaaatgataatatggagagag

SEQ ID NO: 865549 - DNA, 22 bp, Artificial Sequence
  chemically synthesized
aaaatgataatatggagagaga

SEQ ID NO: 865550 - DNA, 22 bp, Artificial Sequence
  chemically synthesized
aaatgataatatggagagagaa

SEQ ID NO: 865551 - DNA, 22 bp, Artificial Sequence
  chemically synthesized
caggggaatgcatgtgcttctc

SEQ ID NO: 865552 - DNA, 22 bp, Artificial Sequence
  chemically synthesized
gtcctccaggggaatgcatgtg

SEQ ID NO: 865553 - DNA, 22 bp, Artificial Sequence
  chemically synthesized
agtcctccaggggaatgcatgt

SEQ ID NO: 865554 - DNA, 22 bp, Artificial Sequence
  chemically synthesized
cttagtcctccaggggaatgca

SEQ ID NO: 865555 - DNA, 22 bp, Artificial Sequence
  chemically synthesized
ctacttagtcctccaggggaat

SEQ ID NO: 865556 - DNA, 22 bp, Artificial Sequence
  chemically synthesized
cctacttagtcctccaggggaa

SEQ ID NO: 865557 - DNA, 22 bp, Artificial Sequence
  chemically synthesized
tcctacttagtcctccagggga

SEQ ID NO: 865558 - DNA, 22 bp, Artificial Sequence
  chemically synthesized
ttcctacttagtcctccagggg

SEQ ID NO: 865559 - DNA, 22 bp, Artificial Sequence
  chemically synthesized
tttcctacttagtcctccaggg

SEQ ID NO: 865560 - DNA, 22 bp, Artificial Sequence
  chemically synthesized
ttttcctacttagtcctccagg

SEQ ID NO: 865561 - DNA, 22 bp, Artificial Sequence
  chemically synthesized
ccctggaggactaagtaggaaa

SEQ ID NO: 865562 - DNA, 22 bp, Artificial Sequence
  chemically synthesized
tgtaagtaccttttttcctact

SEQ ID NO: 865563 - DNA, 22 bp, Artificial Sequence
  chemically synthesized
gtgtaagtaccttttttcctac

SEQ ID NO: 865564 - DNA, 22 bp, Artificial Sequence
  chemically synthesized
gaggactaagtaggaaaaaagg

SEQ ID NO: 865565 - DNA, 22 bp, Artificial Sequence
  chemically synthesized
tttgtgtaagtaccttttttcc

SEQ ID NO: 865566 - DNA, 22 bp, Artificial Sequence
  chemically synthesized
agtaggaaaaaaggtacttaca

SEQ ID NO: 865567 - DNA, 22 bp, Artificial Sequence
  chemically synthesized
taatattatttgtgtaagtacc

SEQ ID NO: 865568 - DNA, 22 bp, Artificial Sequence
  chemically synthesized
ataatattatttgtgtaagtac

SEQ ID NO: 865569 - DNA, 22 bp, Artificial Sequence
  chemically synthesized
agtttataatattatttgtgta

SEQ ID NO: 865570 - DNA, 22 bp, Artificial Sequence
  chemically synthesized
tcagtttataatattatttgtg

SEQ ID NO: 865571 - DNA, 22 bp, Artificial Sequence
  chemically synthesized
cattctcagtttataatattat

SEQ ID NO: 865572 - DNA, 22 bp, Artificial Sequence
  chemically synthesized
acacaaataatattataaactg

SEQ ID NO: 865573 - DNA, 22 bp, Artificial Sequence
  chemically synthesized
ccattacattctcagtttataa

SEQ ID NO: 865574 - DNA, 22 bp, Artificial Sequence
  chemically synthesized
cacaaataatattataaactga

SEQ ID NO: 865575 - DNA, 22 bp, Artificial Sequence
  chemically synthesized
accattacattctcagtttata

SEQ ID NO: 865576 - DNA, 22 bp, Artificial Sequence
  chemically synthesized
gtaaacttaccattacattctc

SEQ ID NO: 865577 - DNA, 22 bp, Artificial Sequence
  chemically synthesized
ggtaaacttaccattacattct

SEQ ID NO: 865578 - DNA, 22 bp, Artificial Sequence
  chemically synthesized
tggtaaacttaccattacattc

SEQ ID NO: 865579 - DNA, 22 bp, Artificial Sequence
  chemically synthesized
tttggtaaacttaccattacat

SEQ ID NO: 865580 - DNA, 22 bp, Artificial Sequence
  chemically synthesized
taaactgagaatgtaatggtaa

SEQ ID NO: 865581 - DNA, 22 bp, Artificial Sequence
  chemically synthesized
agaatgtaatggtaagtttacc

SEQ ID NO: 865582 - DNA, 22 bp, Artificial Sequence
  chemically synthesized
tcataataggctctttggtaaa

SEQ ID NO: 865583 - DNA, 22 bp, Artificial Sequence
  chemically synthesized
gtcataataggctctttggtaa

SEQ ID NO: 865584 - DNA, 22 bp, Artificial Sequence
  chemically synthesized
gaaatacatttgtcataatagg

SEQ ID NO: 865585 - DNA, 22 bp, Artificial Sequence
  chemically synthesized
accaaagagcctattatgacaa

SEQ ID NO: 865586 - DNA, 22 bp, Artificial Sequence
  chemically synthesized
ctagaaatacatttgtcataat

SEQ ID NO: 865587 - DNA, 22 bp, Artificial Sequence
  chemically synthesized
ccaaagagcctattatgacaaa

SEQ ID NO: 865588 - DNA, 22 bp, Artificial Sequence
  chemically synthesized
gctagaaatacatttgtcataa

SEQ ID NO: 865589 - DNA, 22 bp, Artificial Sequence
  chemically synthesized
tgctagaaatacatttgtcata

SEQ ID NO: 865590 - DNA, 22 bp, Artificial Sequence
  chemically synthesized
ttgctagaaatacatttgtcat

SEQ ID NO: 865591 - DNA, 22 bp, Artificial Sequence
  chemically synthesized
cttttgctagaaatacatttgt

SEQ ID NO: 865592 - DNA, 22 bp, Artificial Sequence
  chemically synthesized
ccttttgctagaaatacatttg

SEQ ID NO: 865593 - DNA, 22 bp, Artificial Sequence
  chemically synthesized
ttccttttgctagaaatacatt

SEQ ID NO: 865594 - DNA, 22 bp, Artificial Sequence
  chemically synthesized
ttatgacaaatgtatttctagc

SEQ ID NO: 865595 - DNA, 22 bp, Artificial Sequence
  chemically synthesized
tgacaaatgtatttctagcaaa

SEQ ID NO: 865596 - DNA, 22 bp, Artificial Sequence
  chemically synthesized
acatatattcttccttttgcta

SEQ ID NO: 865597 - DNA, 22 bp, Artificial Sequence
  chemically synthesized
aacatatattcttccttttgct

SEQ ID NO: 865598 - DNA, 22 bp, Artificial Sequence
  chemically synthesized
taacatatattcttccttttgc

SEQ ID NO: 865599 - DNA, 22 bp, Artificial Sequence
  chemically synthesized
tactttaacatatattcttcct

SEQ ID NO: 865600 - DNA, 22 bp, Artificial Sequence
  chemically synthesized
atactttaacatatattcttcc

SEQ ID NO: 865601 - DNA, 22 bp, Artificial Sequence
  chemically synthesized
tatactttaacatatattcttc

SEQ ID NO: 865602 - DNA, 22 bp, Artificial Sequence
  chemically synthesized
ctagcaaaaggaagaatatatg

SEQ ID NO: 865603 - DNA, 22 bp, Artificial Sequence
  chemically synthesized
tagcaaaaggaagaatatatgt

SEQ ID NO: 865604 - DNA, 22 bp, Artificial Sequence
  chemically synthesized
cctttatactttaacatatatt

SEQ ID NO: 865605 - DNA, 22 bp, Artificial Sequence
  chemically synthesized
gcaaaaggaagaatatatgtta

SEQ ID NO: 865606 - DNA, 22 bp, Artificial Sequence
  chemically synthesized
ctgcctttatactttaacatat

SEQ ID NO: 865607 - DNA, 22 bp, Artificial Sequence
  chemically synthesized
atcaccaattgctgcctttata

SEQ ID NO: 865608 - DNA, 22 bp, Artificial Sequence
  chemically synthesized
cctaatcaccaattgctgcctt

SEQ ID NO: 865609 - DNA, 22 bp, Artificial Sequence
  chemically synthesized
aagtataaaggcagcaattggt

SEQ ID NO: 865610 - DNA, 22 bp, Artificial Sequence
  chemically synthesized
taactccctaatcaccaattgc

SEQ ID NO: 865611 - DNA, 22 bp, Artificial Sequence
  chemically synthesized
gtaactccctaatcaccaattg

SEQ ID NO: 865612 - DNA, 22 bp, Artificial Sequence
  chemically synthesized
tttgtaactccctaatcaccaa

SEQ ID NO: 865613 - DNA, 22 bp, Artificial Sequence
  chemically synthesized
aactatttgtaactccctaatc

SEQ ID NO: 865614 - DNA, 22 bp, Artificial Sequence
  chemically synthesized
gtgattagggagttacaaatag

SEQ ID NO: 865615 - DNA, 22 bp, Artificial Sequence
  chemically synthesized
gggagttacaaatagtttagta

SEQ ID NO: 865616 - DNA, 22 bp, Artificial Sequence
  chemically synthesized
aaaaatcaagtaatactaaact

SEQ ID NO: 865617 - DNA, 22 bp, Artificial Sequence
  chemically synthesized
gaaaaatcaagtaatactaaac

SEQ ID NO: 865618 - DNA, 22 bp, Artificial Sequence
  chemically synthesized
ttgaaaaatcaagtaatactaa

SEQ ID NO: 865619 - DNA, 22 bp, Artificial Sequence
  chemically synthesized
tcttgaaaaatcaagtaatact

SEQ ID NO: 865620 - DNA, 22 bp, Artificial Sequence
  chemically synthesized
caaatagtttagtattacttga

SEQ ID NO: 865621 - DNA, 22 bp, Artificial Sequence
  chemically synthesized
tctcttgaaaaatcaagtaata

SEQ ID NO: 865622 - DNA, 22 bp, Artificial Sequence
  chemically synthesized
ctctctcttgaaaaatcaagta

SEQ ID NO: 865623 - DNA, 22 bp, Artificial Sequence
  chemically synthesized
cctcctctctcttgaaaaatca

SEQ ID NO: 865624 - DNA, 22 bp, Artificial Sequence
  chemically synthesized
ccctcctctctcttgaaaaatc

SEQ ID NO: 865625 - DNA, 22 bp, Artificial Sequence
  chemically synthesized
agtattacttgatttttcaaga

SEQ ID NO: 865626 - DNA, 22 bp, Artificial Sequence
  chemically synthesized
gtattacttgatttttcaagag

SEQ ID NO: 865627 - DNA, 22 bp, Artificial Sequence
  chemically synthesized
catcttccctcctctctcttga

SEQ ID NO: 865628 - DNA, 22 bp, Artificial Sequence
  chemically synthesized
cttgatttttcaagagagagga

SEQ ID NO: 865629 - DNA, 22 bp, Artificial Sequence
  chemically synthesized
ctacatcttccctcctctctct

SEQ ID NO: 865630 - DNA, 22 bp, Artificial Sequence
  chemically synthesized
cctacatcttccctcctctctc

SEQ ID NO: 865631 - DNA, 22 bp, Artificial Sequence
  chemically synthesized
gatttttcaagagagaggaggg

SEQ ID NO: 865632 - DNA, 22 bp, Artificial Sequence
  chemically synthesized
atttttcaagagagaggaggga

SEQ ID NO: 865633 - DNA, 22 bp, Artificial Sequence
  chemically synthesized
ttcaagagagaggagggaagat

SEQ ID NO: 865634 - DNA, 22 bp, Artificial Sequence
  chemically synthesized
tcaagagagaggagggaagatg

SEQ ID NO: 865635 - DNA, 22 bp, Artificial Sequence
  chemically synthesized
gggtatttcctacatcttccct

SEQ ID NO: 865636 - DNA, 22 bp, Artificial Sequence
  chemically synthesized
caagagagaggagggaagatgt

SEQ ID NO: 865637 - DNA, 22 bp, Artificial Sequence
  chemically synthesized
aagagagaggagggaagatgta

SEQ ID NO: 865638 - DNA, 22 bp, Artificial Sequence
  chemically synthesized
tctagggtatttcctacatctt

SEQ ID NO: 865639 - DNA, 22 bp, Artificial Sequence
  chemically synthesized
gtctatctagggtatttcctac

SEQ ID NO: 865640 - DNA, 22 bp, Artificial Sequence
  chemically synthesized
ctagtctatctagggtatttcc

SEQ ID NO: 865641 - DNA, 22 bp, Artificial Sequence
  chemically synthesized
gtacctactagtctatctaggg

SEQ ID NO: 865642 - DNA, 22 bp, Artificial Sequence
  chemically synthesized
ggtacctactagtctatctagg

SEQ ID NO: 865643 - DNA, 22 bp, Artificial Sequence
  chemically synthesized
atggatttggtacctactagtc

SEQ ID NO: 865644 - DNA, 22 bp, Artificial Sequence
  chemically synthesized
gatagactagtaggtaccaaat

SEQ ID NO: 865645 - DNA, 22 bp, Artificial Sequence
  chemically synthesized
gtacacaaggccgttcatggat

SEQ ID NO: 865646 - DNA, 22 bp, Artificial Sequence
  chemically synthesized
gtaggtaccaaatccatgaacg

SEQ ID NO: 865647 - DNA, 22 bp, Artificial Sequence
  chemically synthesized
ggtacacaaggccgttcatgga

SEQ ID NO: 865648 - DNA, 22 bp, Artificial Sequence
  chemically synthesized
agcttggtacacaaggccgttc

SEQ ID NO: 865649 - DNA, 22 bp, Artificial Sequence
  chemically synthesized
cagcttggtacacaaggccgtt

SEQ ID NO: 865650 - DNA, 22 bp, Artificial Sequence
  chemically synthesized
tcagcttggtacacaaggccgt

SEQ ID NO: 865651 - DNA, 22 bp, Artificial Sequence
  chemically synthesized
ttcagcttggtacacaaggccg

SEQ ID NO: 865652 - DNA, 22 bp, Artificial Sequence
  chemically synthesized
aatttttcagcttggtacacaa

SEQ ID NO: 865653 - DNA, 22 bp, Artificial Sequence
  chemically synthesized
ggataaaagctaaatttttcag

SEQ ID NO: 865654 - DNA, 22 bp, Artificial Sequence
  chemically synthesized
gtgtaccaagctgaaaaattta

SEQ ID NO: 865655 - DNA, 22 bp, Artificial Sequence
  chemically synthesized
taggataaaagctaaatttttc

SEQ ID NO: 865656 - DNA, 22 bp, Artificial Sequence
  chemically synthesized
tgtaccaagctgaaaaatttag

SEQ ID NO: 865657 - DNA, 22 bp, Artificial Sequence
  chemically synthesized
ctaggataaaagctaaattttt

SEQ ID NO: 865658 - DNA, 22 bp, Artificial Sequence
  chemically synthesized
ttctaggataaaagctaaattt

SEQ ID NO: 865659 - DNA, 22 bp, Artificial Sequence
  chemically synthesized
tcttctaggataaaagctaaat

SEQ ID NO: 865660 - DNA, 22 bp, Artificial Sequence
  chemically synthesized
ctcttctaggataaaagctaaa

SEQ ID NO: 865661 - DNA, 22 bp, Artificial Sequence
  chemically synthesized
tctcttctaggataaaagctaa

SEQ ID NO: 865662 - DNA, 22 bp, Artificial Sequence
  chemically synthesized
tttctcttctaggataaaagct

SEQ ID NO: 865663 - DNA, 22 bp, Artificial Sequence
  chemically synthesized
tctttctcttctaggataaaag

SEQ ID NO: 865664 - DNA, 22 bp, Artificial Sequence
  chemically synthesized
aaaaatttagcttttatcctag

SEQ ID NO: 865665 - DNA, 22 bp, Artificial Sequence
  chemically synthesized
agcttttatcctagaagagaaa

SEQ ID NO: 865666 - DNA, 22 bp, Artificial Sequence
  chemically synthesized
gcttttatcctagaagagaaag

SEQ ID NO: 865667 - DNA, 22 bp, Artificial Sequence
  chemically synthesized
tataatagttctctttctcttc

SEQ ID NO: 865668 - DNA, 22 bp, Artificial Sequence
  chemically synthesized
ttatcctagaagagaaagagaa

SEQ ID NO: 865669 - DNA, 22 bp, Artificial Sequence
  chemically synthesized
tatcctagaagagaaagagaac

SEQ ID NO: 865670 - DNA, 22 bp, Artificial Sequence
  chemically synthesized
atcctagaagagaaagagaact

SEQ ID NO: 865671 - DNA, 22 bp, Artificial Sequence
  chemically synthesized
tcctagaagagaaagagaacta

SEQ ID NO: 865672 - DNA, 22 bp, Artificial Sequence
  chemically synthesized
gtaaaggttgtataatagttct

SEQ ID NO: 865673 - DNA, 22 bp, Artificial Sequence
  chemically synthesized
gaagagaaagagaactattata

SEQ ID NO: 865674 - DNA, 22 bp, Artificial Sequence
  chemically synthesized
ttatacaacctttactaataca

SEQ ID NO: 865675 - DNA, 22 bp, Artificial Sequence
  chemically synthesized
tacaacctttactaatacatta

SEQ ID NO: 865676 - DNA, 22 bp, Artificial Sequence
  chemically synthesized
acatgccaatcataatgtatta

SEQ ID NO: 865677 - DNA, 22 bp, Artificial Sequence
  chemically synthesized
aacatgccaatcataatgtatt

SEQ ID NO: 865678 - DNA, 22 bp, Artificial Sequence
  chemically synthesized
taacatgccaatcataatgtat

SEQ ID NO: 865679 - DNA, 22 bp, Artificial Sequence
  chemically synthesized
ttaacatgccaatcataatgta

SEQ ID NO: 865680 - DNA, 22 bp, Artificial Sequence
  chemically synthesized
tttaacatgccaatcataatgt

SEQ ID NO: 865681 - DNA, 22 bp, Artificial Sequence
  chemically synthesized
tactaatacattatgattggca

SEQ ID NO: 865682 - DNA, 22 bp, Artificial Sequence
  chemically synthesized
cactttttaacatgccaatcat

SEQ ID NO: 865683 - DNA, 22 bp, Artificial Sequence
  chemically synthesized
actaatacattatgattggcat

SEQ ID NO: 865684 - DNA, 22 bp, Artificial Sequence
  chemically synthesized
ctaatacattatgattggcatg

SEQ ID NO: 865685 - DNA, 22 bp, Artificial Sequence
  chemically synthesized
atacattatgattggcatgtta

SEQ ID NO: 865686 - DNA, 22 bp, Artificial Sequence
  chemically synthesized
aaactacactttttaacatgcc

SEQ ID NO: 865687 - DNA, 22 bp, Artificial Sequence
  chemically synthesized
tgattggcatgttaaaaagtgt

SEQ ID NO: 865688 - DNA, 22 bp, Artificial Sequence
  chemically synthesized
caaatccattaaaactacactt

SEQ ID NO: 865689 - DNA, 22 bp, Artificial Sequence
  chemically synthesized
gcatgttaaaaagtgtagtttt

SEQ ID NO: 865690 - DNA, 22 bp, Artificial Sequence
  chemically synthesized
tacactgcaaatccattaaaac

SEQ ID NO: 865691 - DNA, 22 bp, Artificial Sequence
  chemically synthesized
gtacactgcaaatccattaaaa

SEQ ID NO: 865692 - DNA, 22 bp, Artificial Sequence
  chemically synthesized
aaaagtgtagttttaatggatt

SEQ ID NO: 865693 - DNA, 22 bp, Artificial Sequence
  chemically synthesized
atcttgtacactgcaaatccat

SEQ ID NO: 865694 - DNA, 22 bp, Artificial Sequence
  chemically synthesized
agctcatcttgtacactgcaaa

SEQ ID NO: 865695 - DNA, 22 bp, Artificial Sequence
  chemically synthesized
tcagctcatcttgtacactgca

SEQ ID NO: 865696 - DNA, 22 bp, Artificial Sequence
  chemically synthesized
taatggatttgcagtgtacaag

SEQ ID NO: 865697 - DNA, 22 bp, Artificial Sequence
  chemically synthesized
aatggatttgcagtgtacaaga

SEQ ID NO: 865698 - DNA, 22 bp, Artificial Sequence
  chemically synthesized
tctctcagctcatcttgtacac

SEQ ID NO: 865699 - DNA, 22 bp, Artificial Sequence
  chemically synthesized
atggatttgcagtgtacaagat

SEQ ID NO: 865700 - DNA, 22 bp, Artificial Sequence
  chemically synthesized
tgtctctcagctcatcttgtac

SEQ ID NO: 865701 - DNA, 22 bp, Artificial Sequence
  chemically synthesized
ctgtctctcagctcatcttgta

SEQ ID NO: 865702 - DNA, 22 bp, Artificial Sequence
  chemically synthesized
tctgtctctcagctcatcttgt

SEQ ID NO: 865703 - DNA, 22 bp, Artificial Sequence
  chemically synthesized
ttctgtctctcagctcatcttg

SEQ ID NO: 865704 - DNA, 22 bp, Artificial Sequence
  chemically synthesized
gcagtgtacaagatgagctgag

SEQ ID NO: 865705 - DNA, 22 bp, Artificial Sequence
  chemically synthesized
gtttttctgtctctcagctcat

SEQ ID NO: 865706 - DNA, 22 bp, Artificial Sequence
  chemically synthesized
cagtgtacaagatgagctgaga

SEQ ID NO: 865707 - DNA, 22 bp, Artificial Sequence
  chemically synthesized
actagtttttctgtctctcagc

SEQ ID NO: 865708 - DNA, 22 bp, Artificial Sequence
  chemically synthesized
cactagtttttctgtctctcag

SEQ ID NO: 865709 - DNA, 22 bp, Artificial Sequence
  chemically synthesized
ttcactagtttttctgtctctc

SEQ ID NO: 865710 - DNA, 22 bp, Artificial Sequence
  chemically synthesized
caaaacctcttcactagttttt

SEQ ID NO: 865711 - DNA, 22 bp, Artificial Sequence
  chemically synthesized
tacaaaacctcttcactagttt

SEQ ID NO: 865712 - DNA, 22 bp, Artificial Sequence
  chemically synthesized
ctacaaaacctcttcactagtt

SEQ ID NO: 865713 - DNA, 22 bp, Artificial Sequence
  chemically synthesized
agagacagaaaaactagtgaag

SEQ ID NO: 865714 - DNA, 22 bp, Artificial Sequence
  chemically synthesized
agatagcatcttctacaaaacc

SEQ ID NO: 865715 - DNA, 22 bp, Artificial Sequence
  chemically synthesized
attcagatagcatcttctacaa

SEQ ID NO: 865716 - DNA, 22 bp, Artificial Sequence
  chemically synthesized
gtgaagaggttttgtagaagat

SEQ ID NO: 865717 - DNA, 22 bp, Artificial Sequence
  chemically synthesized
attcattcagatagcatcttct

SEQ ID NO: 865718 - DNA, 22 bp, Artificial Sequence
  chemically synthesized
tcattcattcagatagcatctt

SEQ ID NO: 865719 - DNA, 22 bp, Artificial Sequence
  chemically synthesized
ctcattcattcagatagcatct

SEQ ID NO: 865720 - DNA, 22 bp, Artificial Sequence
  chemically synthesized
tctcattcattcagatagcatc

SEQ ID NO: 865721 - DNA, 22 bp, Artificial Sequence
  chemically synthesized
ttttctcattcattcagatagc

SEQ ID NO: 865722 - DNA, 22 bp, Artificial Sequence
  chemically synthesized
gttttctcattcattcagatag

SEQ ID NO: 865723 - DNA, 22 bp, Artificial Sequence
  chemically synthesized
tgtagaagatgctatctgaatg

SEQ ID NO: 865724 - DNA, 22 bp, Artificial Sequence
  chemically synthesized
tgttttctcattcattcagata

SEQ ID NO: 865725 - DNA, 22 bp, Artificial Sequence
  chemically synthesized
gtagaagatgctatctgaatga

SEQ ID NO: 865726 - DNA, 22 bp, Artificial Sequence
  chemically synthesized
tagaagatgctatctgaatgaa

SEQ ID NO: 865727 - DNA, 22 bp, Artificial Sequence
  chemically synthesized
caattttgttttctcattcatt

SEQ ID NO: 865728 - DNA, 22 bp, Artificial Sequence
  chemically synthesized
gcactgcaattttgttttctca

SEQ ID NO: 865729 - DNA, 22 bp, Artificial Sequence
  chemically synthesized
agcactgcaattttgttttctc

SEQ ID NO: 865730 - DNA, 22 bp, Artificial Sequence
  chemically synthesized
tctgaatgaatgagaaaacaaa

SEQ ID NO: 865731 - DNA, 22 bp, Artificial Sequence
  chemically synthesized
tttagcactgcaattttgtttt

SEQ ID NO: 865732 - DNA, 22 bp, Artificial Sequence
  chemically synthesized
atttagcactgcaattttgttt

SEQ ID NO: 865733 - DNA, 22 bp, Artificial Sequence
  chemically synthesized
aatgaatgagaaaacaaaattg

SEQ ID NO: 865734 - DNA, 22 bp, Artificial Sequence
  chemically synthesized
ttatttagcactgcaattttgt

SEQ ID NO: 865735 - DNA, 22 bp, Artificial Sequence
  chemically synthesized
tctcttatttagcactgcaatt

SEQ ID NO: 865736 - DNA, 22 bp, Artificial Sequence
  chemically synthesized
atctcttatttagcactgcaat

SEQ ID NO: 865737 - DNA, 22 bp, Artificial Sequence
  chemically synthesized
ttatctcttatttagcactgca

SEQ ID NO: 865738 - DNA, 22 bp, Artificial Sequence
  chemically synthesized
cttatctcttatttagcactgc

SEQ ID NO: 865739 - DNA, 22 bp, Artificial Sequence
  chemically synthesized
aaatttcttatctcttatttag

SEQ ID NO: 865740 - DNA, 22 bp, Artificial Sequence
  chemically synthesized
gaaatttcttatctcttattta

SEQ ID NO: 865741 - DNA, 22 bp, Artificial Sequence
  chemically synthesized
cagtgctaaataagagataaga

SEQ ID NO: 865742 - DNA, 22 bp, Artificial Sequence
  chemically synthesized
aataagagataagaaatttcaa

SEQ ID NO: 865743 - DNA, 22 bp, Artificial Sequence
  chemically synthesized
agacaaataagcttgaaatttc

SEQ ID NO: 865744 - DNA, 22 bp, Artificial Sequence
  chemically synthesized
ttaagacaaataagcttgaaat

SEQ ID NO: 865745 - DNA, 22 bp, Artificial Sequence
  chemically synthesized
gttaagacaaataagcttgaaa

SEQ ID NO: 865746 - DNA, 22 bp, Artificial Sequence
  chemically synthesized
gatcttgttaagacaaataagc

SEQ ID NO: 865747 - DNA, 22 bp, Artificial Sequence
  chemically synthesized
cgatcttgttaagacaaataag

SEQ ID NO: 865748 - DNA, 22 bp, Artificial Sequence
  chemically synthesized
tcgatcttgttaagacaaataa

SEQ ID NO: 865749 - DNA, 22 bp, Artificial Sequence
  chemically synthesized
caagcttatttgtcttaacaag

SEQ ID NO: 865750 - DNA, 22 bp, Artificial Sequence
  chemically synthesized
aagcttatttgtcttaacaaga

SEQ ID NO: 865751 - DNA, 22 bp, Artificial Sequence
  chemically synthesized
ccaatcctttcgatcttgttaa

SEQ ID NO: 865752 - DNA, 22 bp, Artificial Sequence
  chemically synthesized
atttgtcttaacaagatcgaaa

SEQ ID NO: 865753 - DNA, 22 bp, Artificial Sequence
  chemically synthesized
tttgtcttaacaagatcgaaag

SEQ ID NO: 865754 - DNA, 22 bp, Artificial Sequence
  chemically synthesized
gtcttaacaagatcgaaaggat

SEQ ID NO: 865755 - DNA, 22 bp, Artificial Sequence
  chemically synthesized
tcttaacaagatcgaaaggatt

SEQ ID NO: 865756 - DNA, 22 bp, Artificial Sequence
  chemically synthesized
aacaagatcgaaaggattggta

SEQ ID NO: 865757 - DNA, 22 bp, Artificial Sequence
  chemically synthesized
acaagatcgaaaggattggtaa

SEQ ID NO: 865758 - DNA, 22 bp, Artificial Sequence
  chemically synthesized
agccccacgataaattaccaat

SEQ ID NO: 865759 - DNA, 22 bp, Artificial Sequence
  chemically synthesized
atattaagccccacgataaatt

SEQ ID NO: 865760 - DNA, 22 bp, Artificial Sequence
  chemically synthesized
aatattaagccccacgataaat

SEQ ID NO: 865761 - DNA, 22 bp, Artificial Sequence
  chemically synthesized
cttaatattaagccccacgata

SEQ ID NO: 865762 - DNA, 22 bp, Artificial Sequence
  chemically synthesized
ttccttaatattaagccccacg

SEQ ID NO: 865763 - DNA, 22 bp, Artificial Sequence
  chemically synthesized
attccttaatattaagccccac

SEQ ID NO: 865764 - DNA, 22 bp, Artificial Sequence
  chemically synthesized
tattccttaatattaagcccca

SEQ ID NO: 865765 - DNA, 22 bp, Artificial Sequence
  chemically synthesized
gtaatttatcgtggggcttaat

SEQ ID NO: 865766 - DNA, 22 bp, Artificial Sequence
  chemically synthesized
tttattccttaatattaagccc

SEQ ID NO: 865767 - DNA, 22 bp, Artificial Sequence
  chemically synthesized
ctttattccttaatattaagcc

SEQ ID NO: 865768 - DNA, 22 bp, Artificial Sequence
  chemically synthesized
tctttattccttaatattaagc

SEQ ID NO: 865769 - DNA, 22 bp, Artificial Sequence
  chemically synthesized
atcgtggggcttaatattaagg

SEQ ID NO: 865770 - DNA, 22 bp, Artificial Sequence
  chemically synthesized
tcgtggggcttaatattaagga

SEQ ID NO: 865771 - DNA, 22 bp, Artificial Sequence
  chemically synthesized
gcactttctttattccttaata

SEQ ID NO: 865772 - DNA, 22 bp, Artificial Sequence
  chemically synthesized
tggcactttctttattccttaa

SEQ ID NO: 865773 - DNA, 22 bp, Artificial Sequence
  chemically synthesized
ctggcactttctttattcctta

SEQ ID NO: 865774 - DNA, 22 bp, Artificial Sequence
  chemically synthesized
tctggcactttctttattcctt

SEQ ID NO: 865775 - DNA, 22 bp, Artificial Sequence
  chemically synthesized
ttctggcactttctttattcct

SEQ ID NO: 865776 - DNA, 22 bp, Artificial Sequence
  chemically synthesized
aatattaaggaataaagaaagt

SEQ ID NO: 865777 - DNA, 22 bp, Artificial Sequence
  chemically synthesized
atattaaggaataaagaaagtg

SEQ ID NO: 865778 - DNA, 22 bp, Artificial Sequence
  chemically synthesized
aggaataaagaaagtgccagaa

SEQ ID NO: 865779 - DNA, 22 bp, Artificial Sequence
  chemically synthesized
aaaatcaggaagtttttctggc

SEQ ID NO: 865780 - DNA, 22 bp, Artificial Sequence
  chemically synthesized
gccatgttaaaaatcaggaagt

SEQ ID NO: 865781 - DNA, 22 bp, Artificial Sequence
  chemically synthesized
atggactggccatgttaaaaat

SEQ ID NO: 865782 - DNA, 22 bp, Artificial Sequence
  chemically synthesized
cctgatttttaacatggccagt

SEQ ID NO: 865783 - DNA, 22 bp, Artificial Sequence
  chemically synthesized
ctgatttttaacatggccagtc

SEQ ID NO: 865784 - DNA, 22 bp, Artificial Sequence
  chemically synthesized
atttttaacatggccagtccat

SEQ ID NO: 865785 - DNA, 22 bp, Artificial Sequence
  chemically synthesized
ttaacatggccagtccattaga

SEQ ID NO: 865786 - DNA, 22 bp, Artificial Sequence
  chemically synthesized
tgaatgacacaatctaatggac

SEQ ID NO: 865787 - DNA, 22 bp, Artificial Sequence
  chemically synthesized
taacatggccagtccattagat

SEQ ID NO: 865788 - DNA, 22 bp, Artificial Sequence
  chemically synthesized
gtgaatgacacaatctaatgga

SEQ ID NO: 865789 - DNA, 22 bp, Artificial Sequence
  chemically synthesized
aacatggccagtccattagatt

SEQ ID NO: 865790 - DNA, 22 bp, Artificial Sequence
  chemically synthesized
tgtgaatgacacaatctaatgg

SEQ ID NO: 865791 - DNA, 22 bp, Artificial Sequence
  chemically synthesized
acatggccagtccattagattg

SEQ ID NO: 865792 - DNA, 22 bp, Artificial Sequence
  chemically synthesized
ttgtgaatgacacaatctaatg

SEQ ID NO: 865793 - DNA, 22 bp, Artificial Sequence
  chemically synthesized
tttttgtgaatgacacaatcta

SEQ ID NO: 865794 - DNA, 22 bp, Artificial Sequence
  chemically synthesized
cctatttttgtgaatgacacaa

SEQ ID NO: 865795 - DNA, 22 bp, Artificial Sequence
  chemically synthesized
tattccctatttttgtgaatga

SEQ ID NO: 865796 - DNA, 22 bp, Artificial Sequence
  chemically synthesized
ctatattccctatttttgtgaa

SEQ ID NO: 865797 - DNA, 22 bp, Artificial Sequence
  chemically synthesized
actatattccctatttttgtga

SEQ ID NO: 865798 - DNA, 22 bp, Artificial Sequence
  chemically synthesized
gattgtgtcattcacaaaaata

SEQ ID NO: 865799 - DNA, 22 bp, Artificial Sequence
  chemically synthesized
ttactatattccctatttttgt

SEQ ID NO: 865800 - DNA, 22 bp, Artificial Sequence
  chemically synthesized
ctcttactatattccctatttt

SEQ ID NO: 865801 - DNA, 22 bp, Artificial Sequence
  chemically synthesized
tgtcattcacaaaaatagggaa

SEQ ID NO: 865802 - DNA, 22 bp, Artificial Sequence
  chemically synthesized
ttcctcttactatattccctat

SEQ ID NO: 865803 - DNA, 22 bp, Artificial Sequence
  chemically synthesized
acaaaaatagggaatatagtaa

SEQ ID NO: 865804 - DNA, 22 bp, Artificial Sequence
  chemically synthesized
aaaatctattcctcttactata

SEQ ID NO: 865805 - DNA, 22 bp, Artificial Sequence
  chemically synthesized
tgaaaatctattcctcttacta

SEQ ID NO: 865806 - DNA, 22 bp, Artificial Sequence
  chemically synthesized
ctgaaaatctattcctcttact

SEQ ID NO: 865807 - DNA, 22 bp, Artificial Sequence
  chemically synthesized
tctgaaaatctattcctcttac

SEQ ID NO: 865808 - DNA, 22 bp, Artificial Sequence
  chemically synthesized
ttttctgaaaatctattcctct

SEQ ID NO: 865809 - DNA, 22 bp, Artificial Sequence
  chemically synthesized
tcattattttctgaaaatctat

SEQ ID NO: 865810 - DNA, 22 bp, Artificial Sequence
  chemically synthesized
atgttatcattattttctgaaa

SEQ ID NO: 865811 - DNA, 22 bp, Artificial Sequence
  chemically synthesized
tcagaaaataatgataacatca

SEQ ID NO: 865812 - DNA, 22 bp, Artificial Sequence
  chemically synthesized
cagaaaataatgataacatcaa

SEQ ID NO: 865813 - DNA, 22 bp, Artificial Sequence
  chemically synthesized
agaaaataatgataacatcaat

SEQ ID NO: 865814 - DNA, 22 bp, Artificial Sequence
  chemically synthesized
aggatatgtaaaattgatgtta

SEQ ID NO: 865815 - DNA, 22 bp, Artificial Sequence
  chemically synthesized
actcaggatatgtaaaattgat

SEQ ID NO: 865816 - DNA, 22 bp, Artificial Sequence
  chemically synthesized
taactcaggatatgtaaaattg

SEQ ID NO: 865817 - DNA, 22 bp, Artificial Sequence
  chemically synthesized
ctaactcaggatatgtaaaatt

SEQ ID NO: 865818 - DNA, 22 bp, Artificial Sequence
  chemically synthesized
cacaggtatttctaactcagga

SEQ ID NO: 865819 - DNA, 22 bp, Artificial Sequence
  chemically synthesized
tacatatcctgagttagaaata

SEQ ID NO: 865820 - DNA, 22 bp, Artificial Sequence
  chemically synthesized
acatatcctgagttagaaatac

SEQ ID NO: 865821 - DNA, 22 bp, Artificial Sequence
  chemically synthesized
catatcctgagttagaaatacc

SEQ ID NO: 865822 - DNA, 22 bp, Artificial Sequence
  chemically synthesized
ccacgtagatgttccacaggta

SEQ ID NO: 865823 - DNA, 22 bp, Artificial Sequence
  chemically synthesized
agttagaaatacctgtggaaca

SEQ ID NO: 865824 - DNA, 22 bp, Artificial Sequence
  chemically synthesized
gaaatacctgtggaacatctac

SEQ ID NO: 865825 - DNA, 22 bp, Artificial Sequence
  chemically synthesized
acaagctaccacgtagatgttc

SEQ ID NO: 865826 - DNA, 22 bp, Artificial Sequence
  chemically synthesized
ctgacaagctaccacgtagatg

SEQ ID NO: 865827 - DNA, 22 bp, Artificial Sequence
  chemically synthesized
acctgctgacaagctaccacgt

SEQ ID NO: 865828 - DNA, 22 bp, Artificial Sequence
  chemically synthesized
cacctgctgacaagctaccacg

SEQ ID NO: 865829 - DNA, 22 bp, Artificial Sequence
  chemically synthesized
tggaacatctacgtggtagctt

SEQ ID NO: 865830 - DNA, 22 bp, Artificial Sequence
  chemically synthesized
tcacctgctgacaagctaccac

SEQ ID NO: 865831 - DNA, 22 bp, Artificial Sequence
  chemically synthesized
atattttcacctgctgacaagc

SEQ ID NO: 865832 - DNA, 22 bp, Artificial Sequence
  chemically synthesized
cgtggtagcttgtcagcaggtg

SEQ ID NO: 865833 - DNA, 22 bp, Artificial Sequence
  chemically synthesized
caaactcatattttcacctgct

SEQ ID NO: 865834 - DNA, 22 bp, Artificial Sequence
  chemically synthesized
aattccaaactcatattttcac

SEQ ID NO: 865835 - DNA, 22 bp, Artificial Sequence
  chemically synthesized
caattccaaactcatattttca

SEQ ID NO: 865836 - DNA, 22 bp, Artificial Sequence
  chemically synthesized
ttcaattccaaactcatatttt

SEQ ID NO: 865837 - DNA, 22 bp, Artificial Sequence
  chemically synthesized
gtcagcaggtgaaaatatgagt

SEQ ID NO: 865838 - DNA, 22 bp, Artificial Sequence
  chemically synthesized
tcagcaggtgaaaatatgagtt

SEQ ID NO: 865839 - DNA, 22 bp, Artificial Sequence
  chemically synthesized
tcttcaattccaaactcatatt

SEQ ID NO: 865840 - DNA, 22 bp, Artificial Sequence
  chemically synthesized
tctcttcaattccaaactcata

SEQ ID NO: 865841 - DNA, 22 bp, Artificial Sequence
  chemically synthesized
ctctcttcaattccaaactcat

SEQ ID NO: 865842 - DNA, 22 bp, Artificial Sequence
  chemically synthesized
aggcttctctcttcaattccaa

SEQ ID NO: 865843 - DNA, 22 bp, Artificial Sequence
  chemically synthesized
gttcaggcttctctcttcaatt

SEQ ID NO: 865844 - DNA, 22 bp, Artificial Sequence
  chemically synthesized
tagttcaggcttctctcttcaa

SEQ ID NO: 865845 - DNA, 22 bp, Artificial Sequence
  chemically synthesized
tctctagttcaggcttctctct

SEQ ID NO: 865846 - DNA, 22 bp, Artificial Sequence
  chemically synthesized
ggaattgaagagagaagcctga

SEQ ID NO: 865847 - DNA, 22 bp, Artificial Sequence
  chemically synthesized
gaattgaagagagaagcctgaa

SEQ ID NO: 865848 - DNA, 22 bp, Artificial Sequence
  chemically synthesized
aagagagaagcctgaactagag

SEQ ID NO: 865849 - DNA, 22 bp, Artificial Sequence
  chemically synthesized
tgccaatgattatctctagttc

SEQ ID NO: 865850 - DNA, 22 bp, Artificial Sequence
  chemically synthesized
aaactatgccaatgattatctc

SEQ ID NO: 865851 - DNA, 22 bp, Artificial Sequence
  chemically synthesized
ctgaaactatgccaatgattat

SEQ ID NO: 865852 - DNA, 22 bp, Artificial Sequence
  chemically synthesized
aactagagataatcattggcat

SEQ ID NO: 865853 - DNA, 22 bp, Artificial Sequence
  chemically synthesized
agactactgaaactatgccaat

SEQ ID NO: 865854 - DNA, 22 bp, Artificial Sequence
  chemically synthesized
gagataatcattggcatagttt

SEQ ID NO: 865855 - DNA, 22 bp, Artificial Sequence
  chemically synthesized
agattaagactactgaaactat

SEQ ID NO: 865856 - DNA, 22 bp, Artificial Sequence
  chemically synthesized
gagaatctaagattaagactac

SEQ ID NO: 865857 - DNA, 22 bp, Artificial Sequence
  chemically synthesized
gcatagtttcagtagtcttaat

SEQ ID NO: 865858 - DNA, 22 bp, Artificial Sequence
  chemically synthesized
ttagagaatctaagattaagac

SEQ ID NO: 865859 - DNA, 22 bp, Artificial Sequence
  chemically synthesized
attagagaatctaagattaaga

SEQ ID NO: 865860 - DNA, 22 bp, Artificial Sequence
  chemically synthesized
catttattagagaatctaagat

SEQ ID NO: 865861 - DNA, 22 bp, Artificial Sequence
  chemically synthesized
cagtagtcttaatcttagattc

SEQ ID NO: 865862 - DNA, 22 bp, Artificial Sequence
  chemically synthesized
agtagtcttaatcttagattct

SEQ ID NO: 865863 - DNA, 22 bp, Artificial Sequence
  chemically synthesized
ccaattccatttattagagaat

SEQ ID NO: 865864 - DNA, 22 bp, Artificial Sequence
  chemically synthesized
ctaccaattccatttattagag

SEQ ID NO: 865865 - DNA, 22 bp, Artificial Sequence
  chemically synthesized
aatcttagattctctaataaat

SEQ ID NO: 865866 - DNA, 22 bp, Artificial Sequence
  chemically synthesized
actaccaattccatttattaga

SEQ ID NO: 865867 - DNA, 22 bp, Artificial Sequence
  chemically synthesized
atcttagattctctaataaatg

SEQ ID NO: 865868 - DNA, 22 bp, Artificial Sequence
  chemically synthesized
tactaccaattccatttattag

SEQ ID NO: 865869 - DNA, 22 bp, Artificial Sequence
  chemically synthesized
agattctctaataaatggaatt

SEQ ID NO: 865870 - DNA, 22 bp, Artificial Sequence
  chemically synthesized
gattctctaataaatggaattg

SEQ ID NO: 865871 - DNA, 22 bp, Artificial Sequence
  chemically synthesized
aaataattttactaccaattcc

SEQ ID NO: 865872 - DNA, 22 bp, Artificial Sequence
  chemically synthesized
tctaataaatggaattggtagt

SEQ ID NO: 865873 - DNA, 22 bp, Artificial Sequence
  chemically synthesized
taataaatggaattggtagtaa

SEQ ID NO: 865874 - DNA, 22 bp, Artificial Sequence
  chemically synthesized
attcaaataattttactaccaa

SEQ ID NO: 865875 - DNA, 22 bp, Artificial Sequence
  chemically synthesized
aattcaaataattttactacca

SEQ ID NO: 865876 - DNA, 22 bp, Artificial Sequence
  chemically synthesized
ataaatggaattggtagtaaaa

SEQ ID NO: 865877 - DNA, 22 bp, Artificial Sequence
  chemically synthesized
tcttaattcaaataattttact

SEQ ID NO: 865878 - DNA, 22 bp, Artificial Sequence
  chemically synthesized
tagcattatcttaattcaaata

SEQ ID NO: 865879 - DNA, 22 bp, Artificial Sequence
  chemically synthesized
gtagtaaaattatttgaattaa

SEQ ID NO: 865880 - DNA, 22 bp, Artificial Sequence
  chemically synthesized
aactatagcattatcttaattc

SEQ ID NO: 865881 - DNA, 22 bp, Artificial Sequence
  chemically synthesized
tttgaattaagataatgctata

SEQ ID NO: 865882 - DNA, 22 bp, Artificial Sequence
  chemically synthesized
gaattaagataatgctatagtt

SEQ ID NO: 865883 - DNA, 22 bp, Artificial Sequence
  chemically synthesized
aattaagataatgctatagttc

SEQ ID NO: 865884 - DNA, 22 bp, Artificial Sequence
  chemically synthesized
gaggggacaacatctgaactat

SEQ ID NO: 865885 - DNA, 22 bp, Artificial Sequence
  chemically synthesized
ggaggggacaacatctgaacta

SEQ ID NO: 865886 - DNA, 22 bp, Artificial Sequence
  chemically synthesized
agataatgctatagttcagatg

SEQ ID NO: 865887 - DNA, 22 bp, Artificial Sequence
  chemically synthesized
tagttcagatgttgtcccctcc

SEQ ID NO: 865888 - DNA, 22 bp, Artificial Sequence
  chemically synthesized
aacatgagatttggaggggaca

SEQ ID NO: 865889 - DNA, 22 bp, Artificial Sequence
  chemically synthesized
caacatgagatttggaggggac

SEQ ID NO: 865890 - DNA, 22 bp, Artificial Sequence
  chemically synthesized
agatgttgtcccctccaaatct

SEQ ID NO: 865891 - DNA, 22 bp, Artificial Sequence
  chemically synthesized
aggatcaaatttcaacatgaga

SEQ ID NO: 865892 - DNA, 22 bp, Artificial Sequence
  chemically synthesized
tcccctccaaatctcatgttga

SEQ ID NO: 865893 - DNA, 22 bp, Artificial Sequence
  chemically synthesized
caaatctcatgttgaaatttga

SEQ ID NO: 865894 - DNA, 22 bp, Artificial Sequence
  chemically synthesized
caatattgaggatcaaatttca

SEQ ID NO: 865895 - DNA, 22 bp, Artificial Sequence
  chemically synthesized
atgttgaaatttgatcctcaat

SEQ ID NO: 865896 - DNA, 22 bp, Artificial Sequence
  chemically synthesized
agccccacctccaatattgagg

SEQ ID NO: 865897 - DNA, 22 bp, Artificial Sequence
  chemically synthesized
aaatttgatcctcaatattgga

SEQ ID NO: 865898 - DNA, 22 bp, Artificial Sequence
  chemically synthesized
ccgttaagccccacctccaata

SEQ ID NO: 865899 - DNA, 22 bp, Artificial Sequence
  chemically synthesized
cccgttaagccccacctccaat

SEQ ID NO: 865900 - DNA, 22 bp, Artificial Sequence
  chemically synthesized
gatcctcaatattggaggtggg

SEQ ID NO: 865901 - DNA, 22 bp, Artificial Sequence
  chemically synthesized
atcctcaatattggaggtgggg

SEQ ID NO: 865902 - DNA, 22 bp, Artificial Sequence
  chemically synthesized
aatattggaggtggggcttaac

SEQ ID NO: 865903 - DNA, 22 bp, Artificial Sequence
  chemically synthesized
gaggtggggcttaacgggaagt

SEQ ID NO: 865904 - DNA, 22 bp, Artificial Sequence
  chemically synthesized
aacgggaagtgtggggtcatgg

SEQ ID NO: 865905 - DNA, 22 bp, Artificial Sequence
  chemically synthesized
acgggaagtgtggggtcatggg

SEQ ID NO: 865906 - DNA, 22 bp, Artificial Sequence
  chemically synthesized
aagaaggatccacccccatgac

SEQ ID NO: 865907 - DNA, 22 bp, Artificial Sequence
  chemically synthesized
agccattcaagaaggatccacc

SEQ ID NO: 865908 - DNA, 22 bp, Artificial Sequence
  chemically synthesized
cccccaggaagggcattaagcc

SEQ ID NO: 865909 - DNA, 22 bp, Artificial Sequence
  chemically synthesized
cttgaatggcttaatgcccttc

SEQ ID NO: 865910 - DNA, 22 bp, Artificial Sequence
  chemically synthesized
ttgaatggcttaatgcccttcc

SEQ ID NO: 865911 - DNA, 22 bp, Artificial Sequence
  chemically synthesized
aacctgcccccaggaagggcat

SEQ ID NO: 865912 - DNA, 22 bp, Artificial Sequence
  chemically synthesized
gaatggcttaatgcccttcctg

SEQ ID NO: 865913 - DNA, 22 bp, Artificial Sequence
  chemically synthesized
aatggcttaatgcccttcctgg

SEQ ID NO: 865914 - DNA, 22 bp, Artificial Sequence
  chemically synthesized
aatgcccttcctgggggcaggt

SEQ ID NO: 865915 - DNA, 22 bp, Artificial Sequence
  chemically synthesized
atgcccttcctgggggcaggtt

SEQ ID NO: 865916 - DNA, 22 bp, Artificial Sequence
  chemically synthesized
acagaatgagcagtcactcaac

SEQ ID NO: 865917 - DNA, 22 bp, Artificial Sequence
  chemically synthesized
cctgggggcaggttgagtgact

SEQ ID NO: 865918 - DNA, 22 bp, Artificial Sequence
  chemically synthesized
ctgggggcaggttgagtgactg

SEQ ID NO: 865919 - DNA, 22 bp, Artificial Sequence
  chemically synthesized
ggggcaggttgagtgactgctc

SEQ ID NO: 865920 - DNA, 22 bp, Artificial Sequence
  chemically synthesized
cagaacctaacagaatgagcag

SEQ ID NO: 865921 - DNA, 22 bp, Artificial Sequence
  chemically synthesized
gcagaacctaacagaatgagca

SEQ ID NO: 865922 - DNA, 22 bp, Artificial Sequence
  chemically synthesized
ttgcagaacctaacagaatgag

SEQ ID NO: 865923 - DNA, 22 bp, Artificial Sequence
  chemically synthesized
agtgactgctcattctgttagg

SEQ ID NO: 865924 - DNA, 22 bp, Artificial Sequence
  chemically synthesized
gctcttgcagaacctaacagaa

SEQ ID NO: 865925 - DNA, 22 bp, Artificial Sequence
  chemically synthesized
gcaactagctcttgcagaacct

SEQ ID NO: 865926 - DNA, 22 bp, Artificial Sequence
  chemically synthesized
ctcattctgttaggttctgcaa

SEQ ID NO: 865927 - DNA, 22 bp, Artificial Sequence
  chemically synthesized
ggcaactagctcttgcagaacc

SEQ ID NO: 865928 - DNA, 22 bp, Artificial Sequence
  chemically synthesized
attctgttaggttctgcaagag

SEQ ID NO: 865929 - DNA, 22 bp, Artificial Sequence
  chemically synthesized
tttggcaactagctcttgcaga

SEQ ID NO: 865930 - DNA, 22 bp, Artificial Sequence
  chemically synthesized
ttatttggcaactagctcttgc

SEQ ID NO: 865931 - DNA, 22 bp, Artificial Sequence
  chemically synthesized
tgttaggttctgcaagagctag

SEQ ID NO: 865932 - DNA, 22 bp, Artificial Sequence
  chemically synthesized
ttaggttctgcaagagctagtt

SEQ ID NO: 865933 - DNA, 22 bp, Artificial Sequence
  chemically synthesized
ggttctgcaagagctagttgcc

SEQ ID NO: 865934 - DNA, 22 bp, Artificial Sequence
  chemically synthesized
tgcaagagctagttgccaaata

SEQ ID NO: 865935 - DNA, 22 bp, Artificial Sequence
  chemically synthesized
caagagctagttgccaaataac

SEQ ID NO: 865936 - DNA, 22 bp, Artificial Sequence
  chemically synthesized
gttgccaaataacagcctggca

SEQ ID NO: 865937 - DNA, 22 bp, Artificial Sequence
  chemically synthesized
ccaaataacagcctggcacttc

SEQ ID NO: 865938 - DNA, 22 bp, Artificial Sequence
  chemically synthesized
gagagcataaacaagagagaga

SEQ ID NO: 865939 - DNA, 22 bp, Artificial Sequence
  chemically synthesized
gcacttcccctctctctcttgt

SEQ ID NO: 865940 - DNA, 22 bp, Artificial Sequence
  chemically synthesized
cccctctctctcttgtttatgc

SEQ ID NO: 865941 - DNA, 22 bp, Artificial Sequence
  chemically synthesized
ccctctctctcttgtttatgct

SEQ ID NO: 865942 - DNA, 22 bp, Artificial Sequence
  chemically synthesized
tctctcttgtttatgctctcta

SEQ ID NO: 865943 - DNA, 22 bp, Artificial Sequence
  chemically synthesized
tctcttgtttatgctctctaac

SEQ ID NO: 865944 - DNA, 22 bp, Artificial Sequence
  chemically synthesized
tcttgtttatgctctctaacca

SEQ ID NO: 865945 - DNA, 22 bp, Artificial Sequence
  chemically synthesized
ttgtttatgctctctaaccatg

SEQ ID NO: 865946 - DNA, 22 bp, Artificial Sequence
  chemically synthesized
gtttatgctctctaaccatgtg

SEQ ID NO: 865947 - DNA, 22 bp, Artificial Sequence
  chemically synthesized
gtgtgtagagatcacatggtta

SEQ ID NO: 865948 - DNA, 22 bp, Artificial Sequence
  chemically synthesized
tttatgctctctaaccatgtga

SEQ ID NO: 865949 - DNA, 22 bp, Artificial Sequence
  chemically synthesized
atgctctctaaccatgtgatct

SEQ ID NO: 865950 - DNA, 22 bp, Artificial Sequence
  chemically synthesized
tgctctctaaccatgtgatctc

SEQ ID NO: 865951 - DNA, 22 bp, Artificial Sequence
  chemically synthesized
tctaaccatgtgatctctacac

SEQ ID NO: 865952 - DNA, 22 bp, Artificial Sequence
  chemically synthesized
taaccatgtgatctctacacac

SEQ ID NO: 865953 - DNA, 22 bp, Artificial Sequence
  chemically synthesized
accatgtgatctctacacacca

SEQ ID NO: 865954 - DNA, 22 bp, Artificial Sequence
  chemically synthesized
atggtgaagggcaaaggggagc

SEQ ID NO: 865955 - DNA, 22 bp, Artificial Sequence
  chemically synthesized
tacacaccagctcccctttgcc

SEQ ID NO: 865956 - DNA, 22 bp, Artificial Sequence
  chemically synthesized
cacaccagctcccctttgccct

SEQ ID NO: 865957 - DNA, 22 bp, Artificial Sequence
  chemically synthesized
cattcatggtgaagggcaaagg

SEQ ID NO: 865958 - DNA, 22 bp, Artificial Sequence
  chemically synthesized
ccattcatggtgaagggcaaag

SEQ ID NO: 865959 - DNA, 22 bp, Artificial Sequence
  chemically synthesized
ttccattcatggtgaagggcaa

SEQ ID NO: 865960 - DNA, 22 bp, Artificial Sequence
  chemically synthesized
cttccattcatggtgaagggca

SEQ ID NO: 865961 - DNA, 22 bp, Artificial Sequence
  chemically synthesized
aggcttcttccattcatggtga

SEQ ID NO: 865962 - DNA, 22 bp, Artificial Sequence
  chemically synthesized
ccctttgcccttcaccatgaat

SEQ ID NO: 865963 - DNA, 22 bp, Artificial Sequence
  chemically synthesized
tgcccttcaccatgaatggaag

SEQ ID NO: 865964 - DNA, 22 bp, Artificial Sequence
  chemically synthesized
gcccttcaccatgaatggaaga

SEQ ID NO: 865965 - DNA, 22 bp, Artificial Sequence
  chemically synthesized
cccttcaccatgaatggaagaa

SEQ ID NO: 865966 - DNA, 22 bp, Artificial Sequence
  chemically synthesized
atgagggcctcaggcttcttcc

SEQ ID NO: 865967 - DNA, 22 bp, Artificial Sequence
  chemically synthesized
caccatgaatggaagaagcctg

SEQ ID NO: 865968 - DNA, 22 bp, Artificial Sequence
  chemically synthesized
tcatgagggcctcaggcttctt

SEQ ID NO: 865969 - DNA, 22 bp, Artificial Sequence
  chemically synthesized
accatgaatggaagaagcctga

SEQ ID NO: 865970 - DNA, 22 bp, Artificial Sequence
  chemically synthesized
ctcatgagggcctcaggcttct

SEQ ID NO: 865971 - DNA, 22 bp, Artificial Sequence
  chemically synthesized
ccaacttctcatgagggcctca

SEQ ID NO: 865972 - DNA, 22 bp, Artificial Sequence
  chemically synthesized
aggccctcatgagaagttggta

SEQ ID NO: 865973 - DNA, 22 bp, Artificial Sequence
  chemically synthesized
atgagaagttggtagtggtgcc

SEQ ID NO: 865974 - DNA, 22 bp, Artificial Sequence
  chemically synthesized
tacaaaaaagcatggcaccact

SEQ ID NO: 865975 - DNA, 22 bp, Artificial Sequence
  chemically synthesized
caggctgtacaaaaaagcatgg

SEQ ID NO: 865976 - DNA, 22 bp, Artificial Sequence
  chemically synthesized
tgcaggctgtacaaaaaagcat

SEQ ID NO: 865977 - DNA, 22 bp, Artificial Sequence
  chemically synthesized
gtagtggtgccatgcttttttg

SEQ ID NO: 865978 - DNA, 22 bp, Artificial Sequence
  chemically synthesized
atggttctgcaggctgtacaaa

SEQ ID NO: 865979 - DNA, 22 bp, Artificial Sequence
  chemically synthesized
gctcatggttctgcaggctgta

SEQ ID NO: 865980 - DNA, 22 bp, Artificial Sequence
  chemically synthesized
ggctcatggttctgcaggctgt

SEQ ID NO: 865981 - DNA, 22 bp, Artificial Sequence
  chemically synthesized
tttggctcatggttctgcaggc

SEQ ID NO: 865982 - DNA, 22 bp, Artificial Sequence
  chemically synthesized
atttggctcatggttctgcagg

SEQ ID NO: 865983 - DNA, 22 bp, Artificial Sequence
  chemically synthesized
ttttgtacagcctgcagaacca

SEQ ID NO: 865984 - DNA, 22 bp, Artificial Sequence
  chemically synthesized
tttgtacagcctgcagaaccat

SEQ ID NO: 865985 - DNA, 22 bp, Artificial Sequence
  chemically synthesized
ttgtacagcctgcagaaccatg

SEQ ID NO: 865986 - DNA, 22 bp, Artificial Sequence
  chemically synthesized
tgtacagcctgcagaaccatga

SEQ ID NO: 865987 - DNA, 22 bp, Artificial Sequence
  chemically synthesized
gtacagcctgcagaaccatgag

SEQ ID NO: 865988 - DNA, 22 bp, Artificial Sequence
  chemically synthesized
tacagcctgcagaaccatgagc

SEQ ID NO: 865989 - DNA, 22 bp, Artificial Sequence
  chemically synthesized
cagaaccatgagccaaataaac

SEQ ID NO: 865990 - DNA, 22 bp, Artificial Sequence
  chemically synthesized
taaagaatggaaggtttatttg

SEQ ID NO: 865991 - DNA, 22 bp, Artificial Sequence
  chemically synthesized
ataaagaatggaaggtttattt

SEQ ID NO: 865992 - DNA, 22 bp, Artificial Sequence
  chemically synthesized
ggcaatttataaagaatggaag

SEQ ID NO: 865993 - DNA, 22 bp, Artificial Sequence
  chemically synthesized
ccattctttataaattgcccag

SEQ ID NO: 865994 - DNA, 22 bp, Artificial Sequence
  chemically synthesized
cattctttataaattgcccagt

SEQ ID NO: 865995 - DNA, 22 bp, Artificial Sequence
  chemically synthesized
taaaggaatgccagagactggg

SEQ ID NO: 865996 - DNA, 22 bp, Artificial Sequence
  chemically synthesized
tttataaattgcccagtctctg

SEQ ID NO: 865997 - DNA, 22 bp, Artificial Sequence
  chemically synthesized
tataaattgcccagtctctggc

SEQ ID NO: 865998 - DNA, 22 bp, Artificial Sequence
  chemically synthesized
ctataaaggaatgccagagact

SEQ ID NO: 865999 - DNA, 22 bp, Artificial Sequence
  chemically synthesized
ataaattgcccagtctctggca

SEQ ID NO: 866000 - DNA, 22 bp, Artificial Sequence
  chemically synthesized
taaattgcccagtctctggcat

SEQ ID NO: 866001 - DNA, 22 bp, Artificial Sequence
  chemically synthesized
cccagtctctggcattccttta

SEQ ID NO: 866002 - DNA, 22 bp, Artificial Sequence
  chemically synthesized
atgtatgttgctataaaggaat

SEQ ID NO: 866003 - DNA, 22 bp, Artificial Sequence
  chemically synthesized
ttcatgtatgttgctataaagg

SEQ ID NO: 866004 - DNA, 22 bp, Artificial Sequence
  chemically synthesized
gttcatgtatgttgctataaag

SEQ ID NO: 866005 - DNA, 22 bp, Artificial Sequence
  chemically synthesized
tgttcatgtatgttgctataaa

SEQ ID NO: 866006 - DNA, 22 bp, Artificial Sequence
  chemically synthesized
tggcattcctttatagcaacat

SEQ ID NO: 866007 - DNA, 22 bp, Artificial Sequence
  chemically synthesized
tctttgttcatgtatgttgcta

SEQ ID NO: 866008 - DNA, 22 bp, Artificial Sequence
  chemically synthesized
gcattcctttatagcaacatac

SEQ ID NO: 866009 - DNA, 22 bp, Artificial Sequence
  chemically synthesized
ctttatagcaacatacatgaac

SEQ ID NO: 866010 - DNA, 22 bp, Artificial Sequence
  chemically synthesized
ccatctgtctttgttcatgtat

SEQ ID NO: 866011 - DNA, 22 bp, Artificial Sequence
  chemically synthesized
accatctgtctttgttcatgta

SEQ ID NO: 866012 - DNA, 22 bp, Artificial Sequence
  chemically synthesized
tatagcaacatacatgaacaaa

SEQ ID NO: 866013 - DNA, 22 bp, Artificial Sequence
  chemically synthesized
atagcaacatacatgaacaaag

SEQ ID NO: 866014 - DNA, 22 bp, Artificial Sequence
  chemically synthesized
tagcaacatacatgaacaaaga

SEQ ID NO: 866015 - DNA, 22 bp, Artificial Sequence
  chemically synthesized
tggcaaacagcacataacggaa

SEQ ID NO: 866016 - DNA, 22 bp, Artificial Sequence
  chemically synthesized
ttgtggcaaacagcacataacg

SEQ ID NO: 866017 - DNA, 22 bp, Artificial Sequence
  chemically synthesized
attgtggcaaacagcacataac

SEQ ID NO: 866018 - DNA, 22 bp, Artificial Sequence
  chemically synthesized
tattgtggcaaacagcacataa

SEQ ID NO: 866019 - DNA, 22 bp, Artificial Sequence
  chemically synthesized
ttattgtggcaaacagcacata

SEQ ID NO: 866020 - DNA, 22 bp, Artificial Sequence
  chemically synthesized
tttattgtggcaaacagcacat

SEQ ID NO: 866021 - DNA, 22 bp, Artificial Sequence
  chemically synthesized
aattttttattgtggcaaacag

SEQ ID NO: 866022 - DNA, 22 bp, Artificial Sequence
  chemically synthesized
tccgttatgtgctgtttgccac

SEQ ID NO: 866023 - DNA, 22 bp, Artificial Sequence
  chemically synthesized
aaattttttattgtggcaaaca

SEQ ID NO: 866024 - DNA, 22 bp, Artificial Sequence
  chemically synthesized
ccgttatgtgctgtttgccaca

SEQ ID NO: 866025 - DNA, 22 bp, Artificial Sequence
  chemically synthesized
taaattttttattgtggcaaac

SEQ ID NO: 866026 - DNA, 22 bp, Artificial Sequence
  chemically synthesized
cgttatgtgctgtttgccacaa

SEQ ID NO: 866027 - DNA, 22 bp, Artificial Sequence
  chemically synthesized
ttaaattttttattgtggcaaa

SEQ ID NO: 866028 - DNA, 22 bp, Artificial Sequence
  chemically synthesized
tttaaattttttattgtggcaa

SEQ ID NO: 866029 - DNA, 22 bp, Artificial Sequence
  chemically synthesized
ttttaaattttttattgtggca

SEQ ID NO: 866030 - DNA, 22 bp, Artificial Sequence
  chemically synthesized
tgtgctgtttgccacaataaaa

SEQ ID NO: 866031 - DNA, 22 bp, Artificial Sequence
  chemically synthesized
tcaatttttttaaattttttat

SEQ ID NO: 866032 - DNA, 22 bp, Artificial Sequence
  chemically synthesized
tttgccacaataaaaaatttaa

SEQ ID NO: 866033 - DNA, 22 bp, Artificial Sequence
  chemically synthesized
ttgtcaatttttttaaattttt

SEQ ID NO: 866034 - DNA, 22 bp, Artificial Sequence
  chemically synthesized
attgtcaatttttttaaatttt

SEQ ID NO: 866035 - DNA, 22 bp, Artificial Sequence
  chemically synthesized
gccacaataaaaaatttaaaaa

SEQ ID NO: 866036 - DNA, 22 bp, Artificial Sequence
  chemically synthesized
ccacaataaaaaatttaaaaaa

SEQ ID NO: 866037 - DNA, 22 bp, Artificial Sequence
  chemically synthesized
tacttattgtcaatttttttaa

SEQ ID NO: 866038 - DNA, 22 bp, Artificial Sequence
  chemically synthesized
tcctgtacttattgtcaatttt

SEQ ID NO: 866039 - DNA, 22 bp, Artificial Sequence
  chemically synthesized
aaaaaaattgacaataagtaca

SEQ ID NO: 866040 - DNA, 22 bp, Artificial Sequence
  chemically synthesized
aaaaaattgacaataagtacag

SEQ ID NO: 866041 - DNA, 22 bp, Artificial Sequence
  chemically synthesized
gccatcacctatcctgtactta

SEQ ID NO: 866042 - DNA, 22 bp, Artificial Sequence
  chemically synthesized
attggccatcacctatcctgta

SEQ ID NO: 866043 - DNA, 22 bp, Artificial Sequence
  chemically synthesized
acaataagtacaggataggtga

SEQ ID NO: 866044 - DNA, 22 bp, Artificial Sequence
  chemically synthesized
gctgattggccatcacctatcc

SEQ ID NO: 866045 - DNA, 22 bp, Artificial Sequence
  chemically synthesized
ggctgattggccatcacctatc

SEQ ID NO: 866046 - DNA, 22 bp, Artificial Sequence
  chemically synthesized
tggccagcatcttggctgattg

SEQ ID NO: 866047 - DNA, 22 bp, Artificial Sequence
  chemically synthesized
tatggccagcatcttggctgat

SEQ ID NO: 866048 - DNA, 22 bp, Artificial Sequence
  chemically synthesized
ctctatggccagcatcttggct

SEQ ID NO: 866049 - DNA, 22 bp, Artificial Sequence
  chemically synthesized
cattgctctatggccagcatct

SEQ ID NO: 866050 - DNA, 22 bp, Artificial Sequence
  chemically synthesized
gtctgcattgctctatggccag

SEQ ID NO: 866051 - DNA, 22 bp, Artificial Sequence
  chemically synthesized
ctagtctgcattgctctatggc

SEQ ID NO: 866052 - DNA, 22 bp, Artificial Sequence
  chemically synthesized
acccattcctagtctgcattgc

SEQ ID NO: 866053 - DNA, 22 bp, Artificial Sequence
  chemically synthesized
gccatagagcaatgcagactag

SEQ ID NO: 866054 - DNA, 22 bp, Artificial Sequence
  chemically synthesized
gaagttaacccattcctagtct

SEQ ID NO: 866055 - DNA, 22 bp, Artificial Sequence
  chemically synthesized
atatcacctggaagttaaccca

SEQ ID NO: 866056 - DNA, 22 bp, Artificial Sequence
  chemically synthesized
agtgttaatatcacctggaagt

SEQ ID NO: 866057 - DNA, 22 bp, Artificial Sequence
  chemically synthesized
ggaatgggttaacttccaggtg

SEQ ID NO: 866058 - DNA, 22 bp, Artificial Sequence
  chemically synthesized
cagtgttaatatcacctggaag

SEQ ID NO: 866059 - DNA, 22 bp, Artificial Sequence
  chemically synthesized
ttcagtgttaatatcacctgga

SEQ ID NO: 866060 - DNA, 22 bp, Artificial Sequence
  chemically synthesized
gccctcttcagtgttaatatca

SEQ ID NO: 866061 - DNA, 22 bp, Artificial Sequence
  chemically synthesized
acttccaggtgatattaacact

SEQ ID NO: 866062 - DNA, 22 bp, Artificial Sequence
  chemically synthesized
ttagccctcttcagtgttaata

SEQ ID NO: 866063 - DNA, 22 bp, Artificial Sequence
  chemically synthesized
ccaggtgatattaacactgaag

SEQ ID NO: 866064 - DNA, 22 bp, Artificial Sequence
  chemically synthesized
cctgttagccctcttcagtgtt

SEQ ID NO: 866065 - DNA, 22 bp, Artificial Sequence
  chemically synthesized
caggtgatattaacactgaaga

SEQ ID NO: 866066 - DNA, 22 bp, Artificial Sequence
  chemically synthesized
ccctgttagccctcttcagtgt

SEQ ID NO: 866067 - DNA, 22 bp, Artificial Sequence
  chemically synthesized
tccctgttagccctcttcagtg

SEQ ID NO: 866068 - DNA, 22 bp, Artificial Sequence
  chemically synthesized
ttccctgttagccctcttcagt

SEQ ID NO: 866069 - DNA, 22 bp, Artificial Sequence
  chemically synthesized
tttccctgttagccctcttcag

SEQ ID NO: 866070 - DNA, 22 bp, Artificial Sequence
  chemically synthesized
ttttccctgttagccctcttca

SEQ ID NO: 866071 - DNA, 22 bp, Artificial Sequence
  chemically synthesized
cttttttccctgttagccctct

SEQ ID NO: 866072 - DNA, 22 bp, Artificial Sequence
  chemically synthesized
acttttttccctgttagccctc

SEQ ID NO: 866073 - DNA, 22 bp, Artificial Sequence
  chemically synthesized
acactgaagagggctaacaggg

SEQ ID NO: 866074 - DNA, 22 bp, Artificial Sequence
  chemically synthesized
gtttacttttttccctgttagc

SEQ ID NO: 866075 - DNA, 22 bp, Artificial Sequence
  chemically synthesized
agtttacttttttccctgttag

SEQ ID NO: 866076 - DNA, 22 bp, Artificial Sequence
  chemically synthesized
cttagtttacttttttccctgt

SEQ ID NO: 866077 - DNA, 22 bp, Artificial Sequence
  chemically synthesized
aagagggctaacagggaaaaaa

SEQ ID NO: 866078 - DNA, 22 bp, Artificial Sequence
  chemically synthesized
tacttagtttacttttttccct

SEQ ID NO: 866079 - DNA, 22 bp, Artificial Sequence
  chemically synthesized
ctacttagtttacttttttccc

SEQ ID NO: 866080 - DNA, 22 bp, Artificial Sequence
  chemically synthesized
acagggaaaaaagtaaactaag

SEQ ID NO: 866081 - DNA, 22 bp, Artificial Sequence
  chemically synthesized
caaccatttctacttagtttac

SEQ ID NO: 866082 - DNA, 22 bp, Artificial Sequence
  chemically synthesized
ccaaccatttctacttagttta

SEQ ID NO: 866083 - DNA, 22 bp, Artificial Sequence
  chemically synthesized
tggtcacttccaaccatttcta

SEQ ID NO: 866084 - DNA, 22 bp, Artificial Sequence
  chemically synthesized
tgtggtcacttccaaccatttc

SEQ ID NO: 866085 - DNA, 22 bp, Artificial Sequence
  chemically synthesized
agtagaaatggttggaagtgac

SEQ ID NO: 866086 - DNA, 22 bp, Artificial Sequence
  chemically synthesized
agtgatctctgtggtcacttcc

SEQ ID NO: 866087 - DNA, 22 bp, Artificial Sequence
  chemically synthesized
cagtgatctctgtggtcacttc

SEQ ID NO: 866088 - DNA, 22 bp, Artificial Sequence
  chemically synthesized
tcagtgatctctgtggtcactt

SEQ ID NO: 866089 - DNA, 22 bp, Artificial Sequence
  chemically synthesized
ttcagtgatctctgtggtcact

SEQ ID NO: 866090 - DNA, 22 bp, Artificial Sequence
  chemically synthesized
gtttttcagtgatctctgtggt

SEQ ID NO: 866091 - DNA, 22 bp, Artificial Sequence
  chemically synthesized
ggtttttcagtgatctctgtgg

SEQ ID NO: 866092 - DNA, 22 bp, Artificial Sequence
  chemically synthesized
gtttggtttttcagtgatctct

SEQ ID NO: 866093 - DNA, 22 bp, Artificial Sequence
  chemically synthesized
gaagtgaccacagagatcactg

SEQ ID NO: 866094 - DNA, 22 bp, Artificial Sequence
  chemically synthesized
ggtttggtttttcagtgatctc

SEQ ID NO: 866095 - DNA, 22 bp, Artificial Sequence
  chemically synthesized
gtttggtttggtttttcagtga

SEQ ID NO: 866096 - DNA, 22 bp, Artificial Sequence
  chemically synthesized
tggtttggtttggtttttcagt

SEQ ID NO: 866097 - DNA, 22 bp, Artificial Sequence
  chemically synthesized
tctggtttggtttggtttttca

SEQ ID NO: 866098 - DNA, 22 bp, Artificial Sequence
  chemically synthesized
cacattctctggtttggtttgg

SEQ ID NO: 866099 - DNA, 22 bp, Artificial Sequence
  chemically synthesized
agattgcacattctctggtttg

SEQ ID NO: 866100 - DNA, 22 bp, Artificial Sequence
  chemically synthesized
aaaaaccaaaccaaaccagaga

SEQ ID NO: 866101 - DNA, 22 bp, Artificial Sequence
  chemically synthesized
tgagattgcacattctctggtt

SEQ ID NO: 866102 - DNA, 22 bp, Artificial Sequence
  chemically synthesized
ctgagattgcacattctctggt

SEQ ID NO: 866103 - DNA, 22 bp, Artificial Sequence
  chemically synthesized
gtttctgagattgcacattctc

SEQ ID NO: 866104 - DNA, 22 bp, Artificial Sequence
  chemically synthesized
tgttagtttctgagattgcaca

SEQ ID NO: 866105 - DNA, 22 bp, Artificial Sequence
  chemically synthesized
ttgtgttagtttctgagattgc

SEQ ID NO: 866106 - DNA, 22 bp, Artificial Sequence
  chemically synthesized
tattgtgttagtttctgagatt

SEQ ID NO: 866107 - DNA, 22 bp, Artificial Sequence
  chemically synthesized
tctattgtgttagtttctgaga

SEQ ID NO: 866108 - DNA, 22 bp, Artificial Sequence
  chemically synthesized
aattctctattgtgttagtttc

SEQ ID NO: 866109 - DNA, 22 bp, Artificial Sequence
  chemically synthesized
aaattctctattgtgttagttt

SEQ ID NO: 866110 - DNA, 22 bp, Artificial Sequence
  chemically synthesized
aatttaaattctctattgtgtt

SEQ ID NO: 866111 - DNA, 22 bp, Artificial Sequence
  chemically synthesized
caatttaaattctctattgtgt

SEQ ID NO: 866112 - DNA, 22 bp, Artificial Sequence
  chemically synthesized
ttcaatttaaattctctattgt

SEQ ID NO: 866113 - DNA, 22 bp, Artificial Sequence
  chemically synthesized
agaaactaacacaatagagaat

SEQ ID NO: 866114 - DNA, 22 bp, Artificial Sequence
  chemically synthesized
tccctcttcaatttaaattctc

SEQ ID NO: 866115 - DNA, 22 bp, Artificial Sequence
  chemically synthesized
acacaatagagaatttaaattg

SEQ ID NO: 866116 - DNA, 22 bp, Artificial Sequence
  chemically synthesized
cccaaggatcacctatccctct

SEQ ID NO: 866117 - DNA, 22 bp, Artificial Sequence
  chemically synthesized
acccaaggatcacctatccctc

SEQ ID NO: 866118 - DNA, 22 bp, Artificial Sequence
  chemically synthesized
aaattgaagagggataggtgat

SEQ ID NO: 866119 - DNA, 22 bp, Artificial Sequence
  chemically synthesized
aattgaagagggataggtgatc

SEQ ID NO: 866120 - DNA, 22 bp, Artificial Sequence
  chemically synthesized
aatagtcttacccaaggatcac

SEQ ID NO: 866121 - DNA, 22 bp, Artificial Sequence
  chemically synthesized
aagagggataggtgatccttgg

SEQ ID NO: 866122 - DNA, 22 bp, Artificial Sequence
  chemically synthesized
aaatagtcttacccaaggatca

SEQ ID NO: 866123 - DNA, 22 bp, Artificial Sequence
  chemically synthesized
taaatagtcttacccaaggatc

SEQ ID NO: 866124 - DNA, 22 bp, Artificial Sequence
  chemically synthesized
agtgcctttaaatagtcttacc

SEQ ID NO: 866125 - DNA, 22 bp, Artificial Sequence
  chemically synthesized
accctcagtgcctttaaatagt

SEQ ID NO: 866126 - DNA, 22 bp, Artificial Sequence
  chemically synthesized
gggtaagactatttaaaggcac

SEQ ID NO: 866127 - DNA, 22 bp, Artificial Sequence
  chemically synthesized
ggtaagactatttaaaggcact

SEQ ID NO: 866128 - DNA, 22 bp, Artificial Sequence
  chemically synthesized
taatctcaccctcagtgccttt

SEQ ID NO: 866129 - DNA, 22 bp, Artificial Sequence
  chemically synthesized
tgtaatctcaccctcagtgcct

SEQ ID NO: 866130 - DNA, 22 bp, Artificial Sequence
  chemically synthesized
gggttctgtaatctcaccctca

SEQ ID NO: 866131 - DNA, 22 bp, Artificial Sequence
  chemically synthesized
tttaaaggcactgagggtgaga

SEQ ID NO: 866132 - DNA, 22 bp, Artificial Sequence
  chemically synthesized
ctagggttctgtaatctcaccc

SEQ ID NO: 866133 - DNA, 22 bp, Artificial Sequence
  chemically synthesized
aaaggcactgagggtgagatta

SEQ ID NO: 866134 - DNA, 22 bp, Artificial Sequence
  chemically synthesized
gctagggttctgtaatctcacc

SEQ ID NO: 866135 - DNA, 22 bp, Artificial Sequence
  chemically synthesized
aaggcactgagggtgagattac

SEQ ID NO: 866136 - DNA, 22 bp, Artificial Sequence
  chemically synthesized
tgctagggttctgtaatctcac

SEQ ID NO: 866137 - DNA, 22 bp, Artificial Sequence
  chemically synthesized
ccctttgctagggttctgtaat

SEQ ID NO: 866138 - DNA, 22 bp, Artificial Sequence
  chemically synthesized
gccctttgctagggttctgtaa

SEQ ID NO: 866139 - DNA, 22 bp, Artificial Sequence
  chemically synthesized
tgccctttgctagggttctgta

SEQ ID NO: 866140 - DNA, 22 bp, Artificial Sequence
  chemically synthesized
agggtgagattacagaacccta

SEQ ID NO: 866141 - DNA, 22 bp, Artificial Sequence
  chemically synthesized
ttttgccctttgctagggttct

SEQ ID NO: 866142 - DNA, 22 bp, Artificial Sequence
  chemically synthesized
actgttttgccctttgctaggg

SEQ ID NO: 866143 - DNA, 22 bp, Artificial Sequence
  chemically synthesized
ttaactgttttgccctttgcta

SEQ ID NO: 866144 - DNA, 22 bp, Artificial Sequence
  chemically synthesized
attaactgttttgccctttgct

SEQ ID NO: 866145 - DNA, 22 bp, Artificial Sequence
  chemically synthesized
cagaaccctagcaaagggcaaa

SEQ ID NO: 866146 - DNA, 22 bp, Artificial Sequence
  chemically synthesized
tttattaactgttttgcccttt

SEQ ID NO: 866147 - DNA, 22 bp, Artificial Sequence
  chemically synthesized
atttattaactgttttgccctt

SEQ ID NO: 866148 - DNA, 22 bp, Artificial Sequence
  chemically synthesized
tatttattaactgttttgccct

SEQ ID NO: 866149 - DNA, 22 bp, Artificial Sequence
  chemically synthesized
gcaaagggcaaaacagttaata

SEQ ID NO: 866150 - DNA, 22 bp, Artificial Sequence
  chemically synthesized
gacaagattttatttattaact

SEQ ID NO: 866151 - DNA, 22 bp, Artificial Sequence
  chemically synthesized
ctggacaagattttatttatta

SEQ ID NO: 866152 - DNA, 22 bp, Artificial Sequence
  chemically synthesized
atctactggacaagattttatt

SEQ ID NO: 866153 - DNA, 22 bp, Artificial Sequence
  chemically synthesized
gtattaatctactggacaagat

SEQ ID NO: 866154 - DNA, 22 bp, Artificial Sequence
  chemically synthesized
ataaataaaatcttgtccagta

SEQ ID NO: 866155 - DNA, 22 bp, Artificial Sequence
  chemically synthesized
agacgtaattagtattaatcta

SEQ ID NO: 866156 - DNA, 22 bp, Artificial Sequence
  chemically synthesized
aagacgtaattagtattaatct

SEQ ID NO: 866157 - DNA, 22 bp, Artificial Sequence
  chemically synthesized
atttaagacgtaattagtatta

SEQ ID NO: 866158 - DNA, 22 bp, Artificial Sequence
  chemically synthesized
gtccagtagattaatactaatt

SEQ ID NO: 866159 - DNA, 22 bp, Artificial Sequence
  chemically synthesized
tccagtagattaatactaatta

SEQ ID NO: 866160 - DNA, 22 bp, Artificial Sequence
  chemically synthesized
atactaattacgtcttaaatta

SEQ ID NO: 866161 - DNA, 22 bp, Artificial Sequence
  chemically synthesized
catcacatggtgagtattaatt

SEQ ID NO: 866162 - DNA, 22 bp, Artificial Sequence
  chemically synthesized
attacgtcttaaattaatactc

SEQ ID NO: 866163 - DNA, 22 bp, Artificial Sequence
  chemically synthesized
cgtcttaaattaatactcacca

SEQ ID NO: 866164 - DNA, 22 bp, Artificial Sequence
  chemically synthesized
aattgcatcacatggtgagtat

SEQ ID NO: 866165 - DNA, 22 bp, Artificial Sequence
  chemically synthesized
aaattgcatcacatggtgagta

SEQ ID NO: 866166 - DNA, 22 bp, Artificial Sequence
  chemically synthesized
taaattgcatcacatggtgagt

SEQ ID NO: 866167 - DNA, 22 bp, Artificial Sequence
  chemically synthesized
ttaaattgcatcacatggtgag

SEQ ID NO: 866168 - DNA, 22 bp, Artificial Sequence
  chemically synthesized
tttaaattgcatcacatggtga

SEQ ID NO: 866169 - DNA, 22 bp, Artificial Sequence
  chemically synthesized
aaattaatactcaccatgtgat

SEQ ID NO: 866170 - DNA, 22 bp, Artificial Sequence
  chemically synthesized
aattaatactcaccatgtgatg

SEQ ID NO: 866171 - DNA, 22 bp, Artificial Sequence
  chemically synthesized
ttttttaaattgcatcacatgg

SEQ ID NO: 866172 - DNA, 22 bp, Artificial Sequence
  chemically synthesized
atactcaccatgtgatgcaatt

SEQ ID NO: 866173 - DNA, 22 bp, Artificial Sequence
  chemically synthesized
accatgtgatgcaatttaaaaa

SEQ ID NO: 866174 - DNA, 22 bp, Artificial Sequence
  chemically synthesized
gtaaatataattgttttttaaa

SEQ ID NO: 866175 - DNA, 22 bp, Artificial Sequence
  chemically synthesized
ggtaaatataattgttttttaa

SEQ ID NO: 866176 - DNA, 22 bp, Artificial Sequence
  chemically synthesized
ttggtaaatataattgtttttt

SEQ ID NO: 866177 - DNA, 22 bp, Artificial Sequence
  chemically synthesized
acattcttggtaaatataattg

SEQ ID NO: 866178 - DNA, 22 bp, Artificial Sequence
  chemically synthesized
cctaacattcttggtaaatata

SEQ ID NO: 866179 - DNA, 22 bp, Artificial Sequence
  chemically synthesized
acctaacattcttggtaaatat

SEQ ID NO: 866180 - DNA, 22 bp, Artificial Sequence
  chemically synthesized
aaaaaacaattatatttaccaa

SEQ ID NO: 866181 - DNA, 22 bp, Artificial Sequence
  chemically synthesized
tacctaacattcttggtaaata

SEQ ID NO: 866182 - DNA, 22 bp, Artificial Sequence
  chemically synthesized
aaaaacaattatatttaccaag

SEQ ID NO: 866183 - DNA, 22 bp, Artificial Sequence
  chemically synthesized
tgcacattttacctaacattct

SEQ ID NO: 866184 - DNA, 22 bp, Artificial Sequence
  chemically synthesized
atgcacattttacctaacattc

SEQ ID NO: 866185 - DNA, 22 bp, Artificial Sequence
  chemically synthesized
tatgcacattttacctaacatt

SEQ ID NO: 866186 - DNA, 22 bp, Artificial Sequence
  chemically synthesized
tatttaccaagaatgttaggta

SEQ ID NO: 866187 - DNA, 22 bp, Artificial Sequence
  chemically synthesized
ttatgcacattttacctaacat

SEQ ID NO: 866188 - DNA, 22 bp, Artificial Sequence
  chemically synthesized
tttttatgcacattttacctaa

SEQ ID NO: 866189 - DNA, 22 bp, Artificial Sequence
  chemically synthesized
accaagaatgttaggtaaaatg

SEQ ID NO: 866190 - DNA, 22 bp, Artificial Sequence
  chemically synthesized
tatttttatgcacattttacct

SEQ ID NO: 866191 - DNA, 22 bp, Artificial Sequence
  chemically synthesized
ccaagaatgttaggtaaaatgt

SEQ ID NO: 866192 - DNA, 22 bp, Artificial Sequence
  chemically synthesized
ggtaaaatgtgcataaaaatag

SEQ ID NO: 866193 - DNA, 22 bp, Artificial Sequence
  chemically synthesized
ggtcaagtaattctatttttat

SEQ ID NO: 866194 - DNA, 22 bp, Artificial Sequence
  chemically synthesized
atatattaggtcaagtaattct

SEQ ID NO: 866195 - DNA, 22 bp, Artificial Sequence
  chemically synthesized
ttaatatattaggtcaagtaat

SEQ ID NO: 866196 - DNA, 22 bp, Artificial Sequence
  chemically synthesized
aaattattaatatattaggtca

SEQ ID NO: 866197 - DNA, 22 bp, Artificial Sequence
  chemically synthesized
agttcaaattattaatatatta

SEQ ID NO: 866198 - DNA, 22 bp, Artificial Sequence
  chemically synthesized
gagttcaaattattaatatatt

SEQ ID NO: 866199 - DNA, 22 bp, Artificial Sequence
  chemically synthesized
ttgagttcaaattattaatata

SEQ ID NO: 866200 - DNA, 22 bp, Artificial Sequence
  chemically synthesized
cttgagttcaaattattaatat

SEQ ID NO: 866201 - DNA, 22 bp, Artificial Sequence
  chemically synthesized
cttgacctaatatattaataat

SEQ ID NO: 866202 - DNA, 22 bp, Artificial Sequence
  chemically synthesized
cttcttgagttcaaattattaa

SEQ ID NO: 866203 - DNA, 22 bp, Artificial Sequence
  chemically synthesized
gacctaatatattaataatttg

SEQ ID NO: 866204 - DNA, 22 bp, Artificial Sequence
  chemically synthesized
gcttcttgagttcaaattatta

SEQ ID NO: 866205 - DNA, 22 bp, Artificial Sequence
  chemically synthesized
acctaatatattaataatttga

SEQ ID NO: 866206 - DNA, 22 bp, Artificial Sequence
  chemically synthesized
atatattaataatttgaactca

SEQ ID NO: 866207 - DNA, 22 bp, Artificial Sequence
  chemically synthesized
tagtttgcttcttgagttcaaa

SEQ ID NO: 866208 - DNA, 22 bp, Artificial Sequence
  chemically synthesized
ctatagtttgcttcttgagttc

SEQ ID NO: 866209 - DNA, 22 bp, Artificial Sequence
  chemically synthesized
actatagtttgcttcttgagtt

SEQ ID NO: 866210 - DNA, 22 bp, Artificial Sequence
  chemically synthesized
ttactatagtttgcttcttgag

SEQ ID NO: 866211 - DNA, 22 bp, Artificial Sequence
  chemically synthesized
cttactatagtttgcttcttga

SEQ ID NO: 866212 - DNA, 22 bp, Artificial Sequence
  chemically synthesized
ataatttgaactcaagaagcaa

SEQ ID NO: 866213 - DNA, 22 bp, Artificial Sequence
  chemically synthesized
tcttactatagtttgcttcttg

SEQ ID NO: 866214 - DNA, 22 bp, Artificial Sequence
  chemically synthesized
tctttcttactatagtttgctt

SEQ ID NO: 866215 - DNA, 22 bp, Artificial Sequence
  chemically synthesized
tgtctttcttactatagtttgc

SEQ ID NO: 866216 - DNA, 22 bp, Artificial Sequence
  chemically synthesized
gaactcaagaagcaaactatag

SEQ ID NO: 866217 - DNA, 22 bp, Artificial Sequence
  chemically synthesized
aactcaagaagcaaactatagt

SEQ ID NO: 866218 - DNA, 22 bp, Artificial Sequence
  chemically synthesized
ctctgtctttcttactatagtt

SEQ ID NO: 866219 - DNA, 22 bp, Artificial Sequence
  chemically synthesized
tactctgtctttcttactatag

SEQ ID NO: 866220 - DNA, 22 bp, Artificial Sequence
  chemically synthesized
ctactctgtctttcttactata

SEQ ID NO: 866221 - DNA, 22 bp, Artificial Sequence
  chemically synthesized
aagaagcaaactatagtaagaa

SEQ ID NO: 866222 - DNA, 22 bp, Artificial Sequence
  chemically synthesized
tctactctgtctttcttactat

SEQ ID NO: 866223 - DNA, 22 bp, Artificial Sequence
  chemically synthesized
aaaactttctactctgtctttc

SEQ ID NO: 866224 - DNA, 22 bp, Artificial Sequence
  chemically synthesized
gaaaactttctactctgtcttt

SEQ ID NO: 866225 - DNA, 22 bp, Artificial Sequence
  chemically synthesized
acttgaaaactttctactctgt

SEQ ID NO: 866226 - DNA, 22 bp, Artificial Sequence
  chemically synthesized
tagtaagaaagacagagtagaa

SEQ ID NO: 866227 - DNA, 22 bp, Artificial Sequence
  chemically synthesized
agtaatccattgacttgaaaac

SEQ ID NO: 866228 - DNA, 22 bp, Artificial Sequence
  chemically synthesized
cagtaatccattgacttgaaaa

SEQ ID NO: 866229 - DNA, 22 bp, Artificial Sequence
  chemically synthesized
ttcagtaatccattgacttgaa

SEQ ID NO: 866230 - DNA, 22 bp, Artificial Sequence
  chemically synthesized
tcacatgtactcttcagtaatc

SEQ ID NO: 866231 - DNA, 22 bp, Artificial Sequence
  chemically synthesized
tcaagtcaatggattactgaag

SEQ ID NO: 866232 - DNA, 22 bp, Artificial Sequence
  chemically synthesized
caagtcaatggattactgaaga

SEQ ID NO: 866233 - DNA, 22 bp, Artificial Sequence
  chemically synthesized
aagtcaatggattactgaagag

SEQ ID NO: 866234 - DNA, 22 bp, Artificial Sequence
  chemically synthesized
cctgtcacatgtactcttcagt

SEQ ID NO: 866235 - DNA, 22 bp, Artificial Sequence
  chemically synthesized
gcctgtcacatgtactcttcag

SEQ ID NO: 866236 - DNA, 22 bp, Artificial Sequence
  chemically synthesized
tttgcctgtcacatgtactctt

SEQ ID NO: 866237 - DNA, 22 bp, Artificial Sequence
  chemically synthesized
atttgcctgtcacatgtactct

SEQ ID NO: 866238 - DNA, 22 bp, Artificial Sequence
  chemically synthesized
ctgaagagtacatgtgacaggc

SEQ ID NO: 866239 - DNA, 22 bp, Artificial Sequence
  chemically synthesized
ccagtgtttatttgcctgtcac

SEQ ID NO: 866240 - DNA, 22 bp, Artificial Sequence
  chemically synthesized
aagagtacatgtgacaggcaaa

SEQ ID NO: 866241 - DNA, 22 bp, Artificial Sequence
  chemically synthesized
tctaccagtgtttatttgcctg

SEQ ID NO: 866242 - DNA, 22 bp, Artificial Sequence
  chemically synthesized
atctaccagtgtttatttgcct

SEQ ID NO: 866243 - DNA, 22 bp, Artificial Sequence
  chemically synthesized
atatatttatctaccagtgttt

SEQ ID NO: 866244 - DNA, 22 bp, Artificial Sequence
  chemically synthesized
aatatatttatctaccagtgtt

SEQ ID NO: 866245 - DNA, 22 bp, Artificial Sequence
  chemically synthesized
cttaatatatttatctaccagt

SEQ ID NO: 866246 - DNA, 22 bp, Artificial Sequence
  chemically synthesized
caaattccttaatatatttatc

SEQ ID NO: 866247 - DNA, 22 bp, Artificial Sequence
  chemically synthesized
ccactccaaattccttaatata

SEQ ID NO: 866248 - DNA, 22 bp, Artificial Sequence
  chemically synthesized
gtagataaatatattaaggaat

SEQ ID NO: 866249 - DNA, 22 bp, Artificial Sequence
  chemically synthesized
tatgtcagaaagaatctgccac

SEQ ID NO: 866250 - DNA, 22 bp, Artificial Sequence
  chemically synthesized
aggaatttggagtggcagattc

SEQ ID NO: 866251 - DNA, 22 bp, Artificial Sequence
  chemically synthesized
tcatcctatatgtcagaaagaa

SEQ ID NO: 866252 - DNA, 22 bp, Artificial Sequence
  chemically synthesized
ggagtggcagattctttctgac

SEQ ID NO: 866253 - DNA, 22 bp, Artificial Sequence
  chemically synthesized
gtcatcctatatgtcagaaaga

SEQ ID NO: 866254 - DNA, 22 bp, Artificial Sequence
  chemically synthesized
gagtggcagattctttctgaca

SEQ ID NO: 866255 - DNA, 22 bp, Artificial Sequence
  chemically synthesized
tgtcatcctatatgtcagaaag

SEQ ID NO: 866256 - DNA, 22 bp, Artificial Sequence
  chemically synthesized
tttgtcatcctatatgtcagaa

SEQ ID NO: 866257 - DNA, 22 bp, Artificial Sequence
  chemically synthesized
cattctttgtcatcctatatgt

SEQ ID NO: 866258 - DNA, 22 bp, Artificial Sequence
  chemically synthesized
acattctttgtcatcctatatg

SEQ ID NO: 866259 - DNA, 22 bp, Artificial Sequence
  chemically synthesized
tacattctttgtcatcctatat

SEQ ID NO: 866260 - DNA, 22 bp, Artificial Sequence
  chemically synthesized
ttacattctttgtcatcctata

SEQ ID NO: 866261 - DNA, 22 bp, Artificial Sequence
  chemically synthesized
tttacattctttgtcatcctat

SEQ ID NO: 866262 - DNA, 22 bp, Artificial Sequence
  chemically synthesized
tttctgacatataggatgacaa

SEQ ID NO: 866263 - DNA, 22 bp, Artificial Sequence
  chemically synthesized
tctgacatataggatgacaaag

SEQ ID NO: 866264 - DNA, 22 bp, Artificial Sequence
  chemically synthesized
attttttacattctttgtcatc

SEQ ID NO: 866265 - DNA, 22 bp, Artificial Sequence
  chemically synthesized
ctgacatataggatgacaaaga

SEQ ID NO: 866266 - DNA, 22 bp, Artificial Sequence
  chemically synthesized
cattttttacattctttgtcat

SEQ ID NO: 866267 - DNA, 22 bp, Artificial Sequence
  chemically synthesized
tgacatataggatgacaaagaa

SEQ ID NO: 866268 - DNA, 22 bp, Artificial Sequence
  chemically synthesized
tcattttttacattctttgtca

SEQ ID NO: 866269 - DNA, 22 bp, Artificial Sequence
  chemically synthesized
acatataggatgacaaagaatg

SEQ ID NO: 866270 - DNA, 22 bp, Artificial Sequence
  chemically synthesized
cagtctttcattttttacattc

SEQ ID NO: 866271 - DNA, 22 bp, Artificial Sequence
  chemically synthesized
ttccagtctttcattttttaca

SEQ ID NO: 866272 - DNA, 22 bp, Artificial Sequence
  chemically synthesized
gttccagtctttcattttttac

SEQ ID NO: 866273 - DNA, 22 bp, Artificial Sequence
  chemically synthesized
tgttccagtctttcatttttta

SEQ ID NO: 866274 - DNA, 22 bp, Artificial Sequence
  chemically synthesized
ttgttccagtctttcatttttt

SEQ ID NO: 866275 - DNA, 22 bp, Artificial Sequence
  chemically synthesized
atttttgttccagtctttcatt

SEQ ID NO: 866276 - DNA, 22 bp, Artificial Sequence
  chemically synthesized
tgatttttgttccagtctttca

SEQ ID NO: 866277 - DNA, 22 bp, Artificial Sequence
  chemically synthesized
ctctgatttttgttccagtctt

SEQ ID NO: 866278 - DNA, 22 bp, Artificial Sequence
  chemically synthesized
tctcctctgatttttgttccag

SEQ ID NO: 866279 - DNA, 22 bp, Artificial Sequence
  chemically synthesized
atctcctctgatttttgttcca

SEQ ID NO: 866280 - DNA, 22 bp, Artificial Sequence
  chemically synthesized
tatgtcccttatctcctctgat

SEQ ID NO: 866281 - DNA, 22 bp, Artificial Sequence
  chemically synthesized
atatgtcccttatctcctctga

SEQ ID NO: 866282 - DNA, 22 bp, Artificial Sequence
  chemically synthesized
tatatgtcccttatctcctctg

SEQ ID NO: 866283 - DNA, 22 bp, Artificial Sequence
  chemically synthesized
gaacaaaaatcagaggagataa

SEQ ID NO: 866284 - DNA, 22 bp, Artificial Sequence
  chemically synthesized
actttatatgtcccttatctcc

SEQ ID NO: 866285 - DNA, 22 bp, Artificial Sequence
  chemically synthesized
cactttatatgtcccttatctc

SEQ ID NO: 866286 - DNA, 22 bp, Artificial Sequence
  chemically synthesized
tatttcactttatatgtccctt

SEQ ID NO: 866287 - DNA, 22 bp, Artificial Sequence
  chemically synthesized
atatttcactttatatgtccct

SEQ ID NO: 866288 - DNA, 22 bp, Artificial Sequence
  chemically synthesized
tatatttcactttatatgtccc

SEQ ID NO: 866289 - DNA, 22 bp, Artificial Sequence
  chemically synthesized
tttatatttcactttatatgtc

SEQ ID NO: 866290 - DNA, 22 bp, Artificial Sequence
  chemically synthesized
gttctttatatttcactttata

SEQ ID NO: 866291 - DNA, 22 bp, Artificial Sequence
  chemically synthesized
ctggttctttatatttcacttt

SEQ ID NO: 866292 - DNA, 22 bp, Artificial Sequence
  chemically synthesized
cctggttctttatatttcactt

SEQ ID NO: 866293 - DNA, 22 bp, Artificial Sequence
  chemically synthesized
taaatcttcctggttctttata

SEQ ID NO: 866294 - DNA, 22 bp, Artificial Sequence
  chemically synthesized
ccacctataaatcttcctggtt

SEQ ID NO: 866295 - DNA, 22 bp, Artificial Sequence
  chemically synthesized
accacctataaatcttcctggt

SEQ ID NO: 866296 - DNA, 22 bp, Artificial Sequence
  chemically synthesized
ttaccacctataaatcttcctg

SEQ ID NO: 866297 - DNA, 22 bp, Artificial Sequence
  chemically synthesized
caattcttaccacctataaatc

SEQ ID NO: 866298 - DNA, 22 bp, Artificial Sequence
  chemically synthesized
ccaattcttaccacctataaat

SEQ ID NO: 866299 - DNA, 22 bp, Artificial Sequence
  chemically synthesized
gtcacttccaattcttaccacc

SEQ ID NO: 866300 - DNA, 22 bp, Artificial Sequence
  chemically synthesized
ataggtggtaagaattggaagt

SEQ ID NO: 866301 - DNA, 22 bp, Artificial Sequence
  chemically synthesized
taggtggtaagaattggaagtg

SEQ ID NO: 866302 - DNA, 22 bp, Artificial Sequence
  chemically synthesized
aaaccagttggtcacttccaat

SEQ ID NO: 866303 - DNA, 22 bp, Artificial Sequence
  chemically synthesized
gaaaccagttggtcacttccaa

SEQ ID NO: 866304 - DNA, 22 bp, Artificial Sequence
  chemically synthesized
ttgaaaccagttggtcacttcc

SEQ ID NO: 866305 - DNA, 22 bp, Artificial Sequence
  chemically synthesized
cttgaaaccagttggtcacttc

SEQ ID NO: 866306 - DNA, 22 bp, Artificial Sequence
  chemically synthesized
tcttgaaaccagttggtcactt

SEQ ID NO: 866307 - DNA, 22 bp, Artificial Sequence
  chemically synthesized
ttttcttgaaaccagttggtca

SEQ ID NO: 866308 - DNA, 22 bp, Artificial Sequence
  chemically synthesized
gttttcttgaaaccagttggtc

SEQ ID NO: 866309 - DNA, 22 bp, Artificial Sequence
  chemically synthesized
tgttttcttgaaaccagttggt

SEQ ID NO: 866310 - DNA, 22 bp, Artificial Sequence
  chemically synthesized
tttgttttcttgaaaccagttg

SEQ ID NO: 866311 - DNA, 22 bp, Artificial Sequence
  chemically synthesized
gaagtgaccaactggtttcaag

SEQ ID NO: 866312 - DNA, 22 bp, Artificial Sequence
  chemically synthesized
aagattctttgttttcttgaaa

SEQ ID NO: 866313 - DNA, 22 bp, Artificial Sequence
  chemically synthesized
actgaagattctttgttttctt

SEQ ID NO: 866314 - DNA, 22 bp, Artificial Sequence
  chemically synthesized
tcactgaagattctttgttttc

SEQ ID NO: 866315 - DNA, 22 bp, Artificial Sequence
  chemically synthesized
ctctcactgaagattctttgtt

SEQ ID NO: 866316 - DNA, 22 bp, Artificial Sequence
  chemically synthesized
gtttcaagaaaacaaagaatct

SEQ ID NO: 866317 - DNA, 22 bp, Artificial Sequence
  chemically synthesized
agctcctctcactgaagattct

SEQ ID NO: 866318 - DNA, 22 bp, Artificial Sequence
  chemically synthesized
caagaaaacaaagaatcttcag

SEQ ID NO: 866319 - DNA, 22 bp, Artificial Sequence
  chemically synthesized
cagctcctctcactgaagattc

SEQ ID NO: 866320 - DNA, 22 bp, Artificial Sequence
  chemically synthesized
aagaaaacaaagaatcttcagt

SEQ ID NO: 866321 - DNA, 22 bp, Artificial Sequence
  chemically synthesized
tcttcagctcctctcactgaag

SEQ ID NO: 866322 - DNA, 22 bp, Artificial Sequence
  chemically synthesized
ccacatcacgcctgtcttcagc

SEQ ID NO: 866323 - DNA, 22 bp, Artificial Sequence
  chemically synthesized
cagtgagaggagctgaagacag

SEQ ID NO: 866324 - DNA, 22 bp, Artificial Sequence
  chemically synthesized
agtgagaggagctgaagacagg

SEQ ID NO: 866325 - DNA, 22 bp, Artificial Sequence
  chemically synthesized
gaggttgccacatcacgcctgt

SEQ ID NO: 866326 - DNA, 22 bp, Artificial Sequence
  chemically synthesized
ggaggttgccacatcacgcctg

SEQ ID NO: 866327 - DNA, 22 bp, Artificial Sequence
  chemically synthesized
tggaggttgccacatcacgcct

SEQ ID NO: 866328 - DNA, 22 bp, Artificial Sequence
  chemically synthesized
ttggaggttgccacatcacgcc

SEQ ID NO: 866329 - DNA, 22 bp, Artificial Sequence
  chemically synthesized
tttggaggttgccacatcacgc

SEQ ID NO: 866330 - DNA, 22 bp, Artificial Sequence
  chemically synthesized
ttttggaggttgccacatcacg

SEQ ID NO: 866331 - DNA, 22 bp, Artificial Sequence
  chemically synthesized
tttttggaggttgccacatcac

SEQ ID NO: 866332 - DNA, 22 bp, Artificial Sequence
  chemically synthesized
aagacaggcgtgatgtggcaac

SEQ ID NO: 866333 - DNA, 22 bp, Artificial Sequence
  chemically synthesized
agtctttttttggaggttgcca

SEQ ID NO: 866334 - DNA, 22 bp, Artificial Sequence
  chemically synthesized
aagtctttttttggaggttgcc

SEQ ID NO: 866335 - DNA, 22 bp, Artificial Sequence
  chemically synthesized
taagtctttttttggaggttgc

SEQ ID NO: 866336 - DNA, 22 bp, Artificial Sequence
  chemically synthesized
actttaagtctttttttggagg

SEQ ID NO: 866337 - DNA, 22 bp, Artificial Sequence
  chemically synthesized
caaaaaaagacttaaagtgaat

SEQ ID NO: 866338 - DNA, 22 bp, Artificial Sequence
  chemically synthesized
cagtagcggaaaaattcacttt

SEQ ID NO: 866339 - DNA, 22 bp, Artificial Sequence
  chemically synthesized
aaagtgaatttttccgctactg

SEQ ID NO: 866340 - DNA, 22 bp, Artificial Sequence
  chemically synthesized
aagtgaatttttccgctactgc

SEQ ID NO: 866341 - DNA, 22 bp, Artificial Sequence
  chemically synthesized
agaacaaaaaaatattgcagta

SEQ ID NO: 866342 - DNA, 22 bp, Artificial Sequence
  chemically synthesized
gagaacaaaaaaatattgcagt

SEQ ID NO: 866343 - DNA, 22 bp, Artificial Sequence
  chemically synthesized
tttgagaacaaaaaaatattgc

SEQ ID NO: 866344 - DNA, 22 bp, Artificial Sequence
  chemically synthesized
ttccgctactgcaatatttttt

SEQ ID NO: 866345 - DNA, 22 bp, Artificial Sequence
  chemically synthesized
tccgctactgcaatattttttt

SEQ ID NO: 866346 - DNA, 22 bp, Artificial Sequence
  chemically synthesized
ccgctactgcaatatttttttg

SEQ ID NO: 866347 - DNA, 22 bp, Artificial Sequence
  chemically synthesized
cgctactgcaatatttttttgt

SEQ ID NO: 866348 - DNA, 22 bp, Artificial Sequence
  chemically synthesized
ctgcaatatttttttgttctca

SEQ ID NO: 866349 - DNA, 22 bp, Artificial Sequence
  chemically synthesized
caatatttttttgttctcaaac

SEQ ID NO: 866350 - DNA, 22 bp, Artificial Sequence
  chemically synthesized
ttttgttctcaaacaatatttt

SEQ ID NO: 866351 - DNA, 22 bp, Artificial Sequence
  chemically synthesized
tttgttctcaaacaatattttt

SEQ ID NO: 866352 - DNA, 22 bp, Artificial Sequence
  chemically synthesized
taaaagaaaagcaaaaatattg

SEQ ID NO: 866353 - DNA, 22 bp, Artificial Sequence
  chemically synthesized
ttgttctcaaacaatatttttg

SEQ ID NO: 866354 - DNA, 22 bp, Artificial Sequence
  chemically synthesized
tgttctcaaacaatatttttgc

SEQ ID NO: 866355 - DNA, 22 bp, Artificial Sequence
  chemically synthesized
gttctcaaacaatatttttgct

SEQ ID NO: 866356 - DNA, 22 bp, Artificial Sequence
  chemically synthesized
ttctcaaacaatatttttgctt

SEQ ID NO: 866357 - DNA, 22 bp, Artificial Sequence
  chemically synthesized
cacctataaaagaaaagcaaaa

SEQ ID NO: 866358 - DNA, 22 bp, Artificial Sequence
  chemically synthesized
tcaaacaatatttttgcttttc

SEQ ID NO: 866359 - DNA, 22 bp, Artificial Sequence
  chemically synthesized
ccacctataaaagaaaagcaaa

SEQ ID NO: 866360 - DNA, 22 bp, Artificial Sequence
  chemically synthesized
aaacaatatttttgcttttctt

SEQ ID NO: 866361 - DNA, 22 bp, Artificial Sequence
  chemically synthesized
tttccacctataaaagaaaagc

SEQ ID NO: 866362 - DNA, 22 bp, Artificial Sequence
  chemically synthesized
actatttccacctataaaagaa

SEQ ID NO: 866363 - DNA, 22 bp, Artificial Sequence
  chemically synthesized
ttgcttttcttttataggtgga

SEQ ID NO: 866364 - DNA, 22 bp, Artificial Sequence
  chemically synthesized
tgcttttcttttataggtggaa

SEQ ID NO: 866365 - DNA, 22 bp, Artificial Sequence
  chemically synthesized
gcttttcttttataggtggaaa

SEQ ID NO: 866366 - DNA, 22 bp, Artificial Sequence
  chemically synthesized
tcatcctcactatttccaccta

SEQ ID NO: 866367 - DNA, 22 bp, Artificial Sequence
  chemically synthesized
cttttcttttataggtggaaat

SEQ ID NO: 866368 - DNA, 22 bp, Artificial Sequence
  chemically synthesized
ttcttttataggtggaaatagt

SEQ ID NO: 866369 - DNA, 22 bp, Artificial Sequence
  chemically synthesized
tcttttataggtggaaatagtg

SEQ ID NO: 866370 - DNA, 22 bp, Artificial Sequence
  chemically synthesized
cttttataggtggaaatagtga

SEQ ID NO: 866371 - DNA, 22 bp, Artificial Sequence
  chemically synthesized
ttttataggtggaaatagtgag

SEQ ID NO: 866372 - DNA, 22 bp, Artificial Sequence
  chemically synthesized
ttataggtggaaatagtgagga

SEQ ID NO: 866373 - DNA, 22 bp, Artificial Sequence
  chemically synthesized
agtgtactatcatcctcactat

SEQ ID NO: 866374 - DNA, 22 bp, Artificial Sequence
  chemically synthesized
tataggtggaaatagtgaggat

SEQ ID NO: 866375 - DNA, 22 bp, Artificial Sequence
  chemically synthesized
cagtgtactatcatcctcacta

SEQ ID NO: 866376 - DNA, 22 bp, Artificial Sequence
  chemically synthesized
ataggtggaaatagtgaggatg

SEQ ID NO: 866377 - DNA, 22 bp, Artificial Sequence
  chemically synthesized
tcagtgtactatcatcctcact

SEQ ID NO: 866378 - DNA, 22 bp, Artificial Sequence
  chemically synthesized
taggtggaaatagtgaggatga

SEQ ID NO: 866379 - DNA, 22 bp, Artificial Sequence
  chemically synthesized
ttcagtgtactatcatcctcac

SEQ ID NO: 866380 - DNA, 22 bp, Artificial Sequence
  chemically synthesized
aatgtcagaaccatgaaatgtc

SEQ ID NO: 866381 - DNA, 22 bp, Artificial Sequence
  chemically synthesized
gaatgtcagaaccatgaaatgt

SEQ ID NO: 866382 - DNA, 22 bp, Artificial Sequence
  chemically synthesized
caatttgaatgtcagaaccatg

SEQ ID NO: 866383 - DNA, 22 bp, Artificial Sequence
  chemically synthesized
aaaagacatttcatggttctga

SEQ ID NO: 866384 - DNA, 22 bp, Artificial Sequence
  chemically synthesized
acaatttgaatgtcagaaccat

SEQ ID NO: 866385 - DNA, 22 bp, Artificial Sequence
  chemically synthesized
tacaatttgaatgtcagaacca

SEQ ID NO: 866386 - DNA, 22 bp, Artificial Sequence
  chemically synthesized
catggttctgacattcaaattg

SEQ ID NO: 866387 - DNA, 22 bp, Artificial Sequence
  chemically synthesized
atggttctgacattcaaattgt

SEQ ID NO: 866388 - DNA, 22 bp, Artificial Sequence
  chemically synthesized
aacccgatatattttacaattt

SEQ ID NO: 866389 - DNA, 22 bp, Artificial Sequence
  chemically synthesized
tgacattcaaattgtaaaatat

SEQ ID NO: 866390 - DNA, 22 bp, Artificial Sequence
  chemically synthesized
acattcaaattgtaaaatatat

SEQ ID NO: 866391 - DNA, 22 bp, Artificial Sequence
  chemically synthesized
tcattcaacccgatatatttta

SEQ ID NO: 866392 - DNA, 22 bp, Artificial Sequence
  chemically synthesized
gtcattcaacccgatatatttt

SEQ ID NO: 866393 - DNA, 22 bp, Artificial Sequence
  chemically synthesized
tgtcattcaacccgatatattt

SEQ ID NO: 866394 - DNA, 22 bp, Artificial Sequence
  chemically synthesized
aaattgtaaaatatatcgggtt

SEQ ID NO: 866395 - DNA, 22 bp, Artificial Sequence
  chemically synthesized
taaaatatatcgggttgaatga

SEQ ID NO: 866396 - DNA, 22 bp, Artificial Sequence
  chemically synthesized
aaagggggatgaagtaattttg

SEQ ID NO: 866397 - DNA, 22 bp, Artificial Sequence
  chemically synthesized
aaaagggggatgaagtaatttt

SEQ ID NO: 866398 - DNA, 22 bp, Artificial Sequence
  chemically synthesized
taaaagggggatgaagtaattt

SEQ ID NO: 866399 - DNA, 22 bp, Artificial Sequence
  chemically synthesized
aatgacaaaattacttcatccc

SEQ ID NO: 866400 - DNA, 22 bp, Artificial Sequence
  chemically synthesized
cttcatcccccttttaaaattt

SEQ ID NO: 866401 - DNA, 22 bp, Artificial Sequence
  chemically synthesized
aaaagtaccatagaaattttaa

SEQ ID NO: 866402 - DNA, 22 bp, Artificial Sequence
  chemically synthesized
catcccccttttaaaatttcta

SEQ ID NO: 866403 - DNA, 22 bp, Artificial Sequence
  chemically synthesized
atcccccttttaaaatttctat

SEQ ID NO: 866404 - DNA, 22 bp, Artificial Sequence
  chemically synthesized
agactcaaaagtaccatagaaa

SEQ ID NO: 866405 - DNA, 22 bp, Artificial Sequence
  chemically synthesized
gagactcaaaagtaccatagaa

SEQ ID NO: 866406 - DNA, 22 bp, Artificial Sequence
  chemically synthesized
tgagactcaaaagtaccataga

SEQ ID NO: 866407 - DNA, 22 bp, Artificial Sequence
  chemically synthesized
ttaaaatttctatggtactttt

SEQ ID NO: 866408 - DNA, 22 bp, Artificial Sequence
  chemically synthesized
attttgagactcaaaagtacca

SEQ ID NO: 866409 - DNA, 22 bp, Artificial Sequence
  chemically synthesized
taaaatttctatggtacttttg

SEQ ID NO: 866410 - DNA, 22 bp, Artificial Sequence
  chemically synthesized
gattttgagactcaaaagtacc

SEQ ID NO: 866411 - DNA, 22 bp, Artificial Sequence
  chemically synthesized
aaaatttctatggtacttttga

SEQ ID NO: 866412 - DNA, 22 bp, Artificial Sequence
  chemically synthesized
aaatttctatggtacttttgag

SEQ ID NO: 866413 - DNA, 22 bp, Artificial Sequence
  chemically synthesized
ccttgattttgagactcaaaag

SEQ ID NO: 866414 - DNA, 22 bp, Artificial Sequence
  chemically synthesized
cccttgattttgagactcaaaa

SEQ ID NO: 866415 - DNA, 22 bp, Artificial Sequence
  chemically synthesized
tcccttgattttgagactcaaa

SEQ ID NO: 866416 - DNA, 22 bp, Artificial Sequence
  chemically synthesized
ctatggtacttttgagtctcaa

SEQ ID NO: 866417 - DNA, 22 bp, Artificial Sequence
  chemically synthesized
tatggtacttttgagtctcaaa

SEQ ID NO: 866418 - DNA, 22 bp, Artificial Sequence
  chemically synthesized
gttttcccttgattttgagact

SEQ ID NO: 866419 - DNA, 22 bp, Artificial Sequence
  chemically synthesized
tggtacttttgagtctcaaaat

SEQ ID NO: 866420 - DNA, 22 bp, Artificial Sequence
  chemically synthesized
ttgagtctcaaaatcaagggaa

SEQ ID NO: 866421 - DNA, 22 bp, Artificial Sequence
  chemically synthesized
tgagtctcaaaatcaagggaaa

SEQ ID NO: 866422 - DNA, 22 bp, Artificial Sequence
  chemically synthesized
aaaagtattagttttcccttga

SEQ ID NO: 866423 - DNA, 22 bp, Artificial Sequence
  chemically synthesized
gagtctcaaaatcaagggaaaa

SEQ ID NO: 866424 - DNA, 22 bp, Artificial Sequence
  chemically synthesized
caaaagtattagttttcccttg

SEQ ID NO: 866425 - DNA, 22 bp, Artificial Sequence
  chemically synthesized
agtctcaaaatcaagggaaaac

SEQ ID NO: 866426 - DNA, 22 bp, Artificial Sequence
  chemically synthesized
aaaatcaagggaaaactaatac

SEQ ID NO: 866427 - DNA, 22 bp, Artificial Sequence
  chemically synthesized
tatgagcttcaaaagtattagt

SEQ ID NO: 866428 - DNA, 22 bp, Artificial Sequence
  chemically synthesized
gaacaaaaactgtatgagcttc

SEQ ID NO: 866429 - DNA, 22 bp, Artificial Sequence
  chemically synthesized
tagaacaaaaactgtatgagct

SEQ ID NO: 866430 - DNA, 22 bp, Artificial Sequence
  chemically synthesized
ctagaacaaaaactgtatgagc

SEQ ID NO: 866431 - DNA, 22 bp, Artificial Sequence
  chemically synthesized
atacttttgaagctcatacagt

SEQ ID NO: 866432 - DNA, 22 bp, Artificial Sequence
  chemically synthesized
ttgaagctcatacagtttttgt

SEQ ID NO: 866433 - DNA, 22 bp, Artificial Sequence
  chemically synthesized
tgaagctcatacagtttttgtt

SEQ ID NO: 866434 - DNA, 22 bp, Artificial Sequence
  chemically synthesized
gaagctcatacagtttttgttc

SEQ ID NO: 866435 - DNA, 22 bp, Artificial Sequence
  chemically synthesized
aagctcatacagtttttgttct

SEQ ID NO: 866436 - DNA, 22 bp, Artificial Sequence
  chemically synthesized
atacagtttttgttctagaagt

SEQ ID NO: 866437 - DNA, 22 bp, Artificial Sequence
  chemically synthesized
acaaaaaagacaaaacttctag

SEQ ID NO: 866438 - DNA, 22 bp, Artificial Sequence
  chemically synthesized
tgctcacaaaaaagacaaaact

SEQ ID NO: 866439 - DNA, 22 bp, Artificial Sequence
  chemically synthesized
atgctcacaaaaaagacaaaac

SEQ ID NO: 866440 - DNA, 22 bp, Artificial Sequence
  chemically synthesized
ttgttctagaagttttgtcttt

SEQ ID NO: 866441 - DNA, 22 bp, Artificial Sequence
  chemically synthesized
tgttctagaagttttgtctttt

SEQ ID NO: 866442 - DNA, 22 bp, Artificial Sequence
  chemically synthesized
gttctagaagttttgtcttttt

SEQ ID NO: 866443 - DNA, 22 bp, Artificial Sequence
  chemically synthesized
ttctagaagttttgtctttttt

SEQ ID NO: 866444 - DNA, 22 bp, Artificial Sequence
  chemically synthesized
tagaagttttgtcttttttgtg

SEQ ID NO: 866445 - DNA, 22 bp, Artificial Sequence
  chemically synthesized
gaagttttgtcttttttgtgag

SEQ ID NO: 866446 - DNA, 22 bp, Artificial Sequence
  chemically synthesized
ggtaaatttatgctcacaaaaa

SEQ ID NO: 866447 - DNA, 22 bp, Artificial Sequence
  chemically synthesized
tgtcttttttgtgagcataaat

SEQ ID NO: 866448 - DNA, 22 bp, Artificial Sequence
  chemically synthesized
gtcttttttgtgagcataaatt

SEQ ID NO: 866449 - DNA, 22 bp, Artificial Sequence
  chemically synthesized
tcttttttgtgagcataaattt

SEQ ID NO: 866450 - DNA, 22 bp, Artificial Sequence
  chemically synthesized
aacccactgggtaaatttatgc

SEQ ID NO: 866451 - DNA, 22 bp, Artificial Sequence
  chemically synthesized
ctgaacccactgggtaaattta

SEQ ID NO: 866452 - DNA, 22 bp, Artificial Sequence
  chemically synthesized
ttttgtgagcataaatttaccc

SEQ ID NO: 866453 - DNA, 22 bp, Artificial Sequence
  chemically synthesized
cctgaacccactgggtaaattt

SEQ ID NO: 866454 - DNA, 22 bp, Artificial Sequence
  chemically synthesized
tttgtgagcataaatttaccca

SEQ ID NO: 866455 - DNA, 22 bp, Artificial Sequence
  chemically synthesized
ttgtgagcataaatttacccag

SEQ ID NO: 866456 - DNA, 22 bp, Artificial Sequence
  chemically synthesized
ttcctgaacccactgggtaaat

SEQ ID NO: 866457 - DNA, 22 bp, Artificial Sequence
  chemically synthesized
tgtgagcataaatttacccagt

SEQ ID NO: 866458 - DNA, 22 bp, Artificial Sequence
  chemically synthesized
cttcctgaacccactgggtaaa

SEQ ID NO: 866459 - DNA, 22 bp, Artificial Sequence
  chemically synthesized
gtgagcataaatttacccagtg

SEQ ID NO: 866460 - DNA, 22 bp, Artificial Sequence
  chemically synthesized
tgagcataaatttacccagtgg

SEQ ID NO: 866461 - DNA, 22 bp, Artificial Sequence
  chemically synthesized
atcttcttcctgaacccactgg

SEQ ID NO: 866462 - DNA, 22 bp, Artificial Sequence
  chemically synthesized
acccagtgggttcaggaagaag

SEQ ID NO: 866463 - DNA, 22 bp, Artificial Sequence
  chemically synthesized
cccagtgggttcaggaagaaga

SEQ ID NO: 866464 - DNA, 22 bp, Artificial Sequence
  chemically synthesized
aaaaaaaaaaatactcatcttc

SEQ ID NO: 866465 - DNA, 22 bp, Artificial Sequence
  chemically synthesized
gaaaaaaaaaaatactcatctt

SEQ ID NO: 866466 - DNA, 22 bp, Artificial Sequence
  chemically synthesized
tgaaaaaaaaaaatactcatct

SEQ ID NO: 866467 - DNA, 22 bp, Artificial Sequence
  chemically synthesized
ctttgaaaaaaaaaaatactca

SEQ ID NO: 866468 - DNA, 22 bp, Artificial Sequence
  chemically synthesized
gctttgaaaaaaaaaaatactc

SEQ ID NO: 866469 - DNA, 22 bp, Artificial Sequence
  chemically synthesized
aggaagaagatgagtatttttt

SEQ ID NO: 866470 - DNA, 22 bp, Artificial Sequence
  chemically synthesized
tttgctttgaaaaaaaaaaata

SEQ ID NO: 866471 - DNA, 22 bp, Artificial Sequence
  chemically synthesized
gttgtttgctttgaaaaaaaaa

SEQ ID NO: 866472 - DNA, 22 bp, Artificial Sequence
  chemically synthesized
tctcgttgtttgctttgaaaaa

SEQ ID NO: 866473 - DNA, 22 bp, Artificial Sequence
  chemically synthesized
ctgtctcgttgtttgctttgaa

SEQ ID NO: 866474 - DNA, 22 bp, Artificial Sequence
  chemically synthesized
ctgctgtctcgttgtttgcttt

SEQ ID NO: 866475 - DNA, 22 bp, Artificial Sequence
  chemically synthesized
ttttttttcaaagcaaacaacg

SEQ ID NO: 866476 - DNA, 22 bp, Artificial Sequence
  chemically synthesized
tttttttcaaagcaaacaacga

SEQ ID NO: 866477 - DNA, 22 bp, Artificial Sequence
  chemically synthesized
ttttttcaaagcaaacaacgag

SEQ ID NO: 866478 - DNA, 22 bp, Artificial Sequence
  chemically synthesized
tttttcaaagcaaacaacgaga

SEQ ID NO: 866479 - DNA, 22 bp, Artificial Sequence
  chemically synthesized
aacctcctgctgtctcgttgtt

SEQ ID NO: 866480 - DNA, 22 bp, Artificial Sequence
  chemically synthesized
ttttcaaagcaaacaacgagac

SEQ ID NO: 866481 - DNA, 22 bp, Artificial Sequence
  chemically synthesized
caacctcctgctgtctcgttgt

SEQ ID NO: 866482 - DNA, 22 bp, Artificial Sequence
  chemically synthesized
tttcaaagcaaacaacgagaca

SEQ ID NO: 866483 - DNA, 22 bp, Artificial Sequence
  chemically synthesized
tcaacctcctgctgtctcgttg

SEQ ID NO: 866484 - DNA, 22 bp, Artificial Sequence
  chemically synthesized
ttcaaagcaaacaacgagacag

SEQ ID NO: 866485 - DNA, 22 bp, Artificial Sequence
  chemically synthesized
tcaaagcaaacaacgagacagc

SEQ ID NO: 866486 - DNA, 22 bp, Artificial Sequence
  chemically synthesized
caaagcaaacaacgagacagca

SEQ ID NO: 866487 - DNA, 22 bp, Artificial Sequence
  chemically synthesized
aaagcaaacaacgagacagcag

SEQ ID NO: 866488 - DNA, 22 bp, Artificial Sequence
  chemically synthesized
catgtggagaactttcaacctc

SEQ ID NO: 866489 - DNA, 22 bp, Artificial Sequence
  chemically synthesized
agtgacaactccatgtggagaa

SEQ ID NO: 866490 - DNA, 22 bp, Artificial Sequence
  chemically synthesized
gagtgacaactccatgtggaga

SEQ ID NO: 866491 - DNA, 22 bp, Artificial Sequence
  chemically synthesized
aaagttctccacatggagttgt

SEQ ID NO: 866492 - DNA, 22 bp, Artificial Sequence
  chemically synthesized
atgtcagtgcttgagtgacaac

SEQ ID NO: 866493 - DNA, 22 bp, Artificial Sequence
  chemically synthesized
gatgtcagtgcttgagtgacaa

SEQ ID NO: 866494 - DNA, 22 bp, Artificial Sequence
  chemically synthesized
tccacatggagttgtcactcaa

SEQ ID NO: 866495 - DNA, 22 bp, Artificial Sequence
  chemically synthesized
tgatgtcagtgcttgagtgaca

SEQ ID NO: 866496 - DNA, 22 bp, Artificial Sequence
  chemically synthesized
cacatggagttgtcactcaagc

SEQ ID NO: 866497 - DNA, 22 bp, Artificial Sequence
  chemically synthesized
attttgatgtcagtgcttgagt

SEQ ID NO: 866498 - DNA, 22 bp, Artificial Sequence
  chemically synthesized
attgattttgatgtcagtgctt

SEQ ID NO: 866499 - DNA, 22 bp, Artificial Sequence
  chemically synthesized
cattgattttgatgtcagtgct

SEQ ID NO: 866500 - DNA, 22 bp, Artificial Sequence
  chemically synthesized
tcattgattttgatgtcagtgc

SEQ ID NO: 866501 - DNA, 22 bp, Artificial Sequence
  chemically synthesized
ttcattgattttgatgtcagtg

SEQ ID NO: 866502 - DNA, 22 bp, Artificial Sequence
  chemically synthesized
tcactcaagcactgacatcaaa

SEQ ID NO: 866503 - DNA, 22 bp, Artificial Sequence
  chemically synthesized
aagcactgacatcaaaatcaat

SEQ ID NO: 866504 - DNA, 22 bp, Artificial Sequence
  chemically synthesized
gagccacttttcattgattttg

SEQ ID NO: 866505 - DNA, 22 bp, Artificial Sequence
  chemically synthesized
acatcaaaatcaatgaaaagtg

SEQ ID NO: 866506 - DNA, 22 bp, Artificial Sequence
  chemically synthesized
gcacaagactggagccactttt

SEQ ID NO: 866507 - DNA, 22 bp, Artificial Sequence
  chemically synthesized
agcacaagactggagccacttt

SEQ ID NO: 866508 - DNA, 22 bp, Artificial Sequence
  chemically synthesized
tacttagcacaagactggagcc

SEQ ID NO: 866509 - DNA, 22 bp, Artificial Sequence
  chemically synthesized
caaattatacttagcacaagac

SEQ ID NO: 866510 - DNA, 22 bp, Artificial Sequence
  chemically synthesized
ctacaaattatacttagcacaa

SEQ ID NO: 866511 - DNA, 22 bp, Artificial Sequence
  chemically synthesized
tgctacaaattatacttagcac

SEQ ID NO: 866512 - DNA, 22 bp, Artificial Sequence
  chemically synthesized
tctgctacaaattatacttagc

SEQ ID NO: 866513 - DNA, 22 bp, Artificial Sequence
  chemically synthesized
cagtcttgtgctaagtataatt

SEQ ID NO: 866514 - DNA, 22 bp, Artificial Sequence
  chemically synthesized
ctctctgctacaaattatactt

SEQ ID NO: 866515 - DNA, 22 bp, Artificial Sequence
  chemically synthesized
cctctctgctacaaattatact

SEQ ID NO: 866516 - DNA, 22 bp, Artificial Sequence
  chemically synthesized
gtgctaagtataatttgtagca

SEQ ID NO: 866517 - DNA, 22 bp, Artificial Sequence
  chemically synthesized
caacttcctctctgctacaaat

SEQ ID NO: 866518 - DNA, 22 bp, Artificial Sequence
  chemically synthesized
tgctaagtataatttgtagcag

SEQ ID NO: 866519 - DNA, 22 bp, Artificial Sequence
  chemically synthesized
cctccaacttcctctctgctac

SEQ ID NO: 866520 - DNA, 22 bp, Artificial Sequence
  chemically synthesized
gcctccaacttcctctctgcta

SEQ ID NO: 866521 - DNA, 22 bp, Artificial Sequence
  chemically synthesized
agtataatttgtagcagagagg

SEQ ID NO: 866522 - DNA, 22 bp, Artificial Sequence
  chemically synthesized
tgcctccaacttcctctctgct

SEQ ID NO: 866523 - DNA, 22 bp, Artificial Sequence
  chemically synthesized
acactttgcctccaacttcctc

SEQ ID NO: 866524 - DNA, 22 bp, Artificial Sequence
  chemically synthesized
ctcacactttgcctccaacttc

SEQ ID NO: 866525 - DNA, 22 bp, Artificial Sequence
  chemically synthesized
gtagcagagaggaagttggagg

SEQ ID NO: 866526 - DNA, 22 bp, Artificial Sequence
  chemically synthesized
tagcagagaggaagttggaggc

SEQ ID NO: 866527 - DNA, 22 bp, Artificial Sequence
  chemically synthesized
tcctcacactttgcctccaact

SEQ ID NO: 866528 - DNA, 22 bp, Artificial Sequence
  chemically synthesized
ctcctcacactttgcctccaac

SEQ ID NO: 866529 - DNA, 22 bp, Artificial Sequence
  chemically synthesized
ttctcctcacactttgcctcca

SEQ ID NO: 866530 - DNA, 22 bp, Artificial Sequence
  chemically synthesized
tcttctcctcacactttgcctc

SEQ ID NO: 866531 - DNA, 22 bp, Artificial Sequence
  chemically synthesized
agctctcttctcctcacacttt

SEQ ID NO: 866532 - DNA, 22 bp, Artificial Sequence
  chemically synthesized
tcagctctcttctcctcacact

SEQ ID NO: 866533 - DNA, 22 bp, Artificial Sequence
  chemically synthesized
ctcagctctcttctcctcacac

SEQ ID NO: 866534 - DNA, 22 bp, Artificial Sequence
  chemically synthesized
tctcagctctcttctcctcaca

SEQ ID NO: 866535 - DNA, 22 bp, Artificial Sequence
  chemically synthesized
ttctcagctctcttctcctcac

SEQ ID NO: 866536 - DNA, 22 bp, Artificial Sequence
  chemically synthesized
gaggcaaagtgtgaggagaaga

SEQ ID NO: 866537 - DNA, 22 bp, Artificial Sequence
  chemically synthesized
tttttctcagctctcttctcct

SEQ ID NO: 866538 - DNA, 22 bp, Artificial Sequence
  chemically synthesized
tctatttttctcagctctcttc

SEQ ID NO: 866539 - DNA, 22 bp, Artificial Sequence
  chemically synthesized
actatctatttttctcagctct

SEQ ID NO: 866540 - DNA, 22 bp, Artificial Sequence
  chemically synthesized
aatatctgactatctatttttc

SEQ ID NO: 866541 - DNA, 22 bp, Artificial Sequence
  chemically synthesized
ctgaatatctgactatctattt

SEQ ID NO: 866542 - DNA, 22 bp, Artificial Sequence
  chemically synthesized
gctgaatatctgactatctatt

SEQ ID NO: 866543 - DNA, 22 bp, Artificial Sequence
  chemically synthesized
tgtttgctgaatatctgactat

SEQ ID NO: 866544 - DNA, 22 bp, Artificial Sequence
  chemically synthesized
agaaaaatagatagtcagatat

SEQ ID NO: 866545 - DNA, 22 bp, Artificial Sequence
  chemically synthesized
ccctgtgtttgctgaatatctg

SEQ ID NO: 866546 - DNA, 22 bp, Artificial Sequence
  chemically synthesized
cccctgtgtttgctgaatatct

SEQ ID NO: 866547 - DNA, 22 bp, Artificial Sequence
  chemically synthesized
tttcccctgtgtttgctgaata

SEQ ID NO: 866548 - DNA, 22 bp, Artificial Sequence
  chemically synthesized
atttcccctgtgtttgctgaat

SEQ ID NO: 866549 - DNA, 22 bp, Artificial Sequence
  chemically synthesized
tatttcccctgtgtttgctgaa

SEQ ID NO: 866550 - DNA, 22 bp, Artificial Sequence
  chemically synthesized
tttatttcccctgtgtttgctg

SEQ ID NO: 866551 - DNA, 22 bp, Artificial Sequence
  chemically synthesized
ctctttatttcccctgtgtttg

SEQ ID NO: 866552 - DNA, 22 bp, Artificial Sequence
  chemically synthesized
ttcctctttatttcccctgtgt

SEQ ID NO: 866553 - DNA, 22 bp, Artificial Sequence
  chemically synthesized
attcctctttatttcccctgtg

SEQ ID NO: 866554 - DNA, 22 bp, Artificial Sequence
  chemically synthesized
agcaaacacaggggaaataaag

SEQ ID NO: 866555 - DNA, 22 bp, Artificial Sequence
  chemically synthesized
gggtttattcctctttatttcc

SEQ ID NO: 866556 - DNA, 22 bp, Artificial Sequence
  chemically synthesized
agggtttattcctctttatttc

SEQ ID NO: 866557 - DNA, 22 bp, Artificial Sequence
  chemically synthesized
tagggtttattcctctttattt

SEQ ID NO: 866558 - DNA, 22 bp, Artificial Sequence
  chemically synthesized
ccaactttagggtttattcctc

SEQ ID NO: 866559 - DNA, 22 bp, Artificial Sequence
  chemically synthesized
gccaactttagggtttattcct

SEQ ID NO: 866560 - DNA, 22 bp, Artificial Sequence
  chemically synthesized
tgccaactttagggtttattcc

SEQ ID NO: 866561 - DNA, 22 bp, Artificial Sequence
  chemically synthesized
gatcattttgccaactttaggg

SEQ ID NO: 866562 - DNA, 22 bp, Artificial Sequence
  chemically synthesized
ggatcattttgccaactttagg

SEQ ID NO: 866563 - DNA, 22 bp, Artificial Sequence
  chemically synthesized
gaatttggatcattttgccaac

SEQ ID NO: 866564 - DNA, 22 bp, Artificial Sequence
  chemically synthesized
ggaatttggatcattttgccaa

SEQ ID NO: 866565 - DNA, 22 bp, Artificial Sequence
  chemically synthesized
catttggaatttggatcatttt

SEQ ID NO: 866566 - DNA, 22 bp, Artificial Sequence
  chemically synthesized
aagttggcaaaatgatccaaat

SEQ ID NO: 866567 - DNA, 22 bp, Artificial Sequence
  chemically synthesized
attccatttggaatttggatca

SEQ ID NO: 866568 - DNA, 22 bp, Artificial Sequence
  chemically synthesized
cattccatttggaatttggatc

SEQ ID NO: 866569 - DNA, 22 bp, Artificial Sequence
  chemically synthesized
cttcattccatttggaatttgg

SEQ ID NO: 866570 - DNA, 22 bp, Artificial Sequence
  chemically synthesized
acttcattccatttggaatttg

SEQ ID NO: 866571 - DNA, 22 bp, Artificial Sequence
  chemically synthesized
gcaaaatgatccaaattccaaa

SEQ ID NO: 866572 - DNA, 22 bp, Artificial Sequence
  chemically synthesized
tacttcattccatttggaattt

SEQ ID NO: 866573 - DNA, 22 bp, Artificial Sequence
  chemically synthesized
ttacttcattccatttggaatt

SEQ ID NO: 866574 - DNA, 22 bp, Artificial Sequence
  chemically synthesized
tttacttcattccatttggaat

SEQ ID NO: 866575 - DNA, 22 bp, Artificial Sequence
  chemically synthesized
ttttacttcattccatttggaa

SEQ ID NO: 866576 - DNA, 22 bp, Artificial Sequence
  chemically synthesized
tttttacttcattccatttgga

SEQ ID NO: 866577 - DNA, 22 bp, Artificial Sequence
  chemically synthesized
ttttttacttcattccatttgg

SEQ ID NO: 866578 - DNA, 22 bp, Artificial Sequence
  chemically synthesized
tttttttacttcattccatttg

SEQ ID NO: 866579 - DNA, 22 bp, Artificial Sequence
  chemically synthesized
ttttttttacttcattccattt

SEQ ID NO: 866580 - DNA, 22 bp, Artificial Sequence
  chemically synthesized
tttttttttacttcattccatt

SEQ ID NO: 866581 - DNA, 22 bp, Artificial Sequence
  chemically synthesized
ttttttttttacttcattccat

SEQ ID NO: 866582 - DNA, 22 bp, Artificial Sequence
  chemically synthesized
tttttttttttacttcattcca

SEQ ID NO: 866583 - DNA, 22 bp, Artificial Sequence
  chemically synthesized
ttttttttttttacttcattcc

SEQ ID NO: 866584 - DNA, 22 bp, Artificial Sequence
  chemically synthesized
tttttttttttttacttcattc

SEQ ID NO: 866585 - DNA, 22 bp, Artificial Sequence
  chemically synthesized
ttttttttttttttacttcatt

SEQ ID NO: 866586 - DNA, 22 bp, Artificial Sequence
  chemically synthesized
caaatggaatgaagtaaaaaaa

SEQ ID NO: 866587 - DNA, 22 bp, Artificial Sequence
  chemically synthesized
ccacttttttttttttttttac

SEQ ID NO: 866588 - DNA, 22 bp, Artificial Sequence
  chemically synthesized
catggtgctgccactttttttt

SEQ ID NO: 866589 - DNA, 22 bp, Artificial Sequence
  chemically synthesized
cactacatggtgctgccacttt

SEQ ID NO: 866590 - DNA, 22 bp, Artificial Sequence
  chemically synthesized
gcactacatggtgctgccactt

SEQ ID NO: 866591 - DNA, 22 bp, Artificial Sequence
  chemically synthesized
agtccagtgatgtttgcactac

SEQ ID NO: 866592 - DNA, 22 bp, Artificial Sequence
  chemically synthesized
tcagtccagtgatgtttgcact

SEQ ID NO: 866593 - DNA, 22 bp, Artificial Sequence
  chemically synthesized
tcaaatgattctcagtccagtg

SEQ ID NO: 866594 - DNA, 22 bp, Artificial Sequence
  chemically synthesized
ttgtcaaatgattctcagtcca

SEQ ID NO: 866595 - DNA, 22 bp, Artificial Sequence
  chemically synthesized
ccagagtgtctgttgtcaaatg

SEQ ID NO: 866596 - DNA, 22 bp, Artificial Sequence
  chemically synthesized
gactgagaatcatttgacaaca

SEQ ID NO: 866597 - DNA, 22 bp, Artificial Sequence
  chemically synthesized
agaatcatttgacaacagacac

SEQ ID NO: 866598 - DNA, 22 bp, Artificial Sequence
  chemically synthesized
gacaacagacactctgggagtc

SEQ ID NO: 866599 - DNA, 22 bp, Artificial Sequence
  chemically synthesized
acaacagacactctgggagtct

SEQ ID NO: 866600 - DNA, 22 bp, Artificial Sequence
  chemically synthesized
gaatggtgcccagatcaagtag

SEQ ID NO: 866601 - DNA, 22 bp, Artificial Sequence
  chemically synthesized
tgggagtctacttgatctgggc

SEQ ID NO: 866602 - DNA, 22 bp, Artificial Sequence
  chemically synthesized
ggagtctacttgatctgggcac

SEQ ID NO: 866603 - DNA, 22 bp, Artificial Sequence
  chemically synthesized
ccagtgcctagaatggtgccca

SEQ ID NO: 866604 - DNA, 22 bp, Artificial Sequence
  chemically synthesized
cttgatctgggcaccattctag

SEQ ID NO: 866605 - DNA, 22 bp, Artificial Sequence
  chemically synthesized
tactcccagtgcctagaatggt

SEQ ID NO: 866606 - DNA, 22 bp, Artificial Sequence
  chemically synthesized
gatctgggcaccattctaggca

SEQ ID NO: 866607 - DNA, 22 bp, Artificial Sequence
  chemically synthesized
atctgggcaccattctaggcac

SEQ ID NO: 866608 - DNA, 22 bp, Artificial Sequence
  chemically synthesized
ccactgtactcccagtgcctag

SEQ ID NO: 866609 - DNA, 22 bp, Artificial Sequence
  chemically synthesized
accactgtactcccagtgccta

SEQ ID NO: 866610 - DNA, 22 bp, Artificial Sequence
  chemically synthesized
ggcaccattctaggcactggga

SEQ ID NO: 866611 - DNA, 22 bp, Artificial Sequence
  chemically synthesized
tgccacatttaccactgtactc

SEQ ID NO: 866612 - DNA, 22 bp, Artificial Sequence
  chemically synthesized
taggcactgggagtacagtggt

SEQ ID NO: 866613 - DNA, 22 bp, Artificial Sequence
  chemically synthesized
ggcactgggagtacagtggtaa

SEQ ID NO: 866614 - DNA, 22 bp, Artificial Sequence
  chemically synthesized
cctgtgccacatttaccactgt

SEQ ID NO: 866615 - DNA, 22 bp, Artificial Sequence
  chemically synthesized
ggagtacagtggtaaatgtggc

SEQ ID NO: 866616 - DNA, 22 bp, Artificial Sequence
  chemically synthesized
catgaggccattgcctgtgcca

SEQ ID NO: 866617 - DNA, 22 bp, Artificial Sequence
  chemically synthesized
tatcacaatataaattccatga

SEQ ID NO: 866618 - DNA, 22 bp, Artificial Sequence
  chemically synthesized
tatatcacaatataaattccat

SEQ ID NO: 866619 - DNA, 22 bp, Artificial Sequence
  chemically synthesized
ctatatcacaatataaattcca

SEQ ID NO: 866620 - DNA, 22 bp, Artificial Sequence
  chemically synthesized
tctatatcacaatataaattcc

SEQ ID NO: 866621 - DNA, 22 bp, Artificial Sequence
  chemically synthesized
ttctatatcacaatataaattc

SEQ ID NO: 866622 - DNA, 22 bp, Artificial Sequence
  chemically synthesized
ttttctatatcacaatataaat

SEQ ID NO: 866623 - DNA, 22 bp, Artificial Sequence
  chemically synthesized
tctcttttctatatcacaatat

SEQ ID NO: 866624 - DNA, 22 bp, Artificial Sequence
  chemically synthesized
atggaatttatattgtgatata

SEQ ID NO: 866625 - DNA, 22 bp, Artificial Sequence
  chemically synthesized
ctgtctcttttctatatcacaa

SEQ ID NO: 866626 - DNA, 22 bp, Artificial Sequence
  chemically synthesized
cctgtctcttttctatatcaca

SEQ ID NO: 866627 - DNA, 22 bp, Artificial Sequence
  chemically synthesized
atattgtgatatagaaaagaga

SEQ ID NO: 866628 - DNA, 22 bp, Artificial Sequence
  chemically synthesized
tattgtgatatagaaaagagac

SEQ ID NO: 866629 - DNA, 22 bp, Artificial Sequence
  chemically synthesized
aatgtatatttcctgtctcttt

SEQ ID NO: 866630 - DNA, 22 bp, Artificial Sequence
  chemically synthesized
tgatatagaaaagagacaggaa

SEQ ID NO: 866631 - DNA, 22 bp, Artificial Sequence
  chemically synthesized
aaatgatgttaaatgtatattt

SEQ ID NO: 866632 - DNA, 22 bp, Artificial Sequence
  chemically synthesized
atataatctaaaatgatgttaa

SEQ ID NO: 866633 - DNA, 22 bp, Artificial Sequence
  chemically synthesized
catataatctaaaatgatgtta

SEQ ID NO: 866634 - DNA, 22 bp, Artificial Sequence
  chemically synthesized
tcatataatctaaaatgatgtt

SEQ ID NO: 866635 - DNA, 22 bp, Artificial Sequence
  chemically synthesized
cctttcatataatctaaaatga

SEQ ID NO: 866636 - DNA, 22 bp, Artificial Sequence
  chemically synthesized
ctgcctttcatataatctaaaa

SEQ ID NO: 866637 - DNA, 22 bp, Artificial Sequence
  chemically synthesized
actgcctttcatataatctaaa

SEQ ID NO: 866638 - DNA, 22 bp, Artificial Sequence
  chemically synthesized
tactgcctttcatataatctaa

SEQ ID NO: 866639 - DNA, 22 bp, Artificial Sequence
  chemically synthesized
aacatcattttagattatatga

SEQ ID NO: 866640 - DNA, 22 bp, Artificial Sequence
  chemically synthesized
ctttactgcctttcatataatc

SEQ ID NO: 866641 - DNA, 22 bp, Artificial Sequence
  chemically synthesized
acatcattttagattatatgaa

SEQ ID NO: 866642 - DNA, 22 bp, Artificial Sequence
  chemically synthesized
gctttactgcctttcatataat

SEQ ID NO: 866643 - DNA, 22 bp, Artificial Sequence
  chemically synthesized
tgctttactgcctttcatataa

SEQ ID NO: 866644 - DNA, 22 bp, Artificial Sequence
  chemically synthesized
ttttgctttactgcctttcata

SEQ ID NO: 866645 - DNA, 22 bp, Artificial Sequence
  chemically synthesized
tgttttgctttactgcctttca

SEQ ID NO: 866646 - DNA, 22 bp, Artificial Sequence
  chemically synthesized
tagattatatgaaaggcagtaa

SEQ ID NO: 866647 - DNA, 22 bp, Artificial Sequence
  chemically synthesized
agattatatgaaaggcagtaaa

SEQ ID NO: 866648 - DNA, 22 bp, Artificial Sequence
  chemically synthesized
gctctgttttgctttactgcct

SEQ ID NO: 866649 - DNA, 22 bp, Artificial Sequence
  chemically synthesized
gattatatgaaaggcagtaaag

SEQ ID NO: 866650 - DNA, 22 bp, Artificial Sequence
  chemically synthesized
ctggctctgttttgctttactg

SEQ ID NO: 866651 - DNA, 22 bp, Artificial Sequence
  chemically synthesized
cctggctctgttttgctttact

SEQ ID NO: 866652 - DNA, 22 bp, Artificial Sequence
  chemically synthesized
tcctggctctgttttgctttac

SEQ ID NO: 866653 - DNA, 22 bp, Artificial Sequence
  chemically synthesized
tatgaaaggcagtaaagcaaaa

SEQ ID NO: 866654 - DNA, 22 bp, Artificial Sequence
  chemically synthesized
ttcctggctctgttttgcttta

SEQ ID NO: 866655 - DNA, 22 bp, Artificial Sequence
  chemically synthesized
tttcctggctctgttttgcttt

SEQ ID NO: 866656 - DNA, 22 bp, Artificial Sequence
  chemically synthesized
ttttcctggctctgttttgctt

SEQ ID NO: 866657 - DNA, 22 bp, Artificial Sequence
  chemically synthesized
cttttttcctggctctgttttg

SEQ ID NO: 866658 - DNA, 22 bp, Artificial Sequence
  chemically synthesized
acttttttcctggctctgtttt

SEQ ID NO: 866659 - DNA, 22 bp, Artificial Sequence
  chemically synthesized
ttacttttttcctggctctgtt

SEQ ID NO: 866660 - DNA, 22 bp, Artificial Sequence
  chemically synthesized
tcttacttttttcctggctctg

SEQ ID NO: 866661 - DNA, 22 bp, Artificial Sequence
  chemically synthesized
actctcttacttttttcctggc

SEQ ID NO: 866662 - DNA, 22 bp, Artificial Sequence
  chemically synthesized
tcactctcttacttttttcctg

SEQ ID NO: 866663 - DNA, 22 bp, Artificial Sequence
  chemically synthesized
caaccctctcactctcttactt

SEQ ID NO: 866664 - DNA, 22 bp, Artificial Sequence
  chemically synthesized
gcaaccctctcactctcttact

SEQ ID NO: 866665 - DNA, 22 bp, Artificial Sequence
  chemically synthesized
gcccaacttgcaaccctctcac

SEQ ID NO: 866666 - DNA, 22 bp, Artificial Sequence
  chemically synthesized
atagaccctagcccaacttgca

SEQ ID NO: 866667 - DNA, 22 bp, Artificial Sequence
  chemically synthesized
catagaccctagcccaacttgc

SEQ ID NO: 866668 - DNA, 22 bp, Artificial Sequence
  chemically synthesized
tcatagaccctagcccaacttg

SEQ ID NO: 866669 - DNA, 22 bp, Artificial Sequence
  chemically synthesized
ttcatagaccctagcccaactt

SEQ ID NO: 866670 - DNA, 22 bp, Artificial Sequence
  chemically synthesized
gtttttcatagaccctagccca

SEQ ID NO: 866671 - DNA, 22 bp, Artificial Sequence
  chemically synthesized
caagttgggctagggtctatga

SEQ ID NO: 866672 - DNA, 22 bp, Artificial Sequence
  chemically synthesized
agggctagtttttcatagaccc

SEQ ID NO: 866673 - DNA, 22 bp, Artificial Sequence
  chemically synthesized
ggctagggtctatgaaaaacta

SEQ ID NO: 866674 - DNA, 22 bp, Artificial Sequence
  chemically synthesized
ataatgagctaagggctagttt

SEQ ID NO: 866675 - DNA, 22 bp, Artificial Sequence
  chemically synthesized
gggtctatgaaaaactagccct

SEQ ID NO: 866676 - DNA, 22 bp, Artificial Sequence
  chemically synthesized
cataatgagctaagggctagtt

SEQ ID NO: 866677 - DNA, 22 bp, Artificial Sequence
  chemically synthesized
tgaaaaactagcccttagctca

SEQ ID NO: 866678 - DNA, 22 bp, Artificial Sequence
  chemically synthesized
atccaaaccttcataatgagct

SEQ ID NO: 866679 - DNA, 22 bp, Artificial Sequence
  chemically synthesized
gcccttagctcattatgaaggt

SEQ ID NO: 866680 - DNA, 22 bp, Artificial Sequence
  chemically synthesized
agctcattatgaaggtttggat

SEQ ID NO: 866681 - DNA, 22 bp, Artificial Sequence
  chemically synthesized
gctcattatgaaggtttggatg

SEQ ID NO: 866682 - DNA, 22 bp, Artificial Sequence
  chemically synthesized
attatgaaggtttggatgagac

SEQ ID NO: 866683 - DNA, 22 bp, Artificial Sequence
  chemically synthesized
gagggataaaaagtctcatcca

SEQ ID NO: 866684 - DNA, 22 bp, Artificial Sequence
  chemically synthesized
agagggataaaaagtctcatcc

SEQ ID NO: 866685 - DNA, 22 bp, Artificial Sequence
  chemically synthesized
tgaaggtttggatgagactttt

SEQ ID NO: 866686 - DNA, 22 bp, Artificial Sequence
  chemically synthesized
aggaaatttagagggataaaaa

SEQ ID NO: 866687 - DNA, 22 bp, Artificial Sequence
  chemically synthesized
ggatgagactttttatccctct

SEQ ID NO: 866688 - DNA, 22 bp, Artificial Sequence
  chemically synthesized
gatgagactttttatccctcta

SEQ ID NO: 866689 - DNA, 22 bp, Artificial Sequence
  chemically synthesized
ggggagctaaggaaatttagag

SEQ ID NO: 866690 - DNA, 22 bp, Artificial Sequence
  chemically synthesized
gctaggggagctaaggaaattt

SEQ ID NO: 866691 - DNA, 22 bp, Artificial Sequence
  chemically synthesized
tttatccctctaaatttcctta

SEQ ID NO: 866692 - DNA, 22 bp, Artificial Sequence
  chemically synthesized
ttatccctctaaatttccttag

SEQ ID NO: 866693 - DNA, 22 bp, Artificial Sequence
  chemically synthesized
tatccctctaaatttccttagc

SEQ ID NO: 866694 - DNA, 22 bp, Artificial Sequence
  chemically synthesized
atccctctaaatttccttagct

SEQ ID NO: 866695 - DNA, 22 bp, Artificial Sequence
  chemically synthesized
tccctctaaatttccttagctc

SEQ ID NO: 866696 - DNA, 22 bp, Artificial Sequence
  chemically synthesized
taaatttccttagctcccctag

SEQ ID NO: 866697 - DNA, 22 bp, Artificial Sequence
  chemically synthesized
aatttccttagctcccctagct

SEQ ID NO: 866698 - DNA, 22 bp, Artificial Sequence
  chemically synthesized
cagagacaaagctagctagggg

SEQ ID NO: 866699 - DNA, 22 bp, Artificial Sequence
  chemically synthesized
ttccagagacaaagctagctag

SEQ ID NO: 866700 - DNA, 22 bp, Artificial Sequence
  chemically synthesized
ccttagctcccctagctagctt

SEQ ID NO: 866701 - DNA, 22 bp, Artificial Sequence
  chemically synthesized
gttccagagacaaagctagcta

SEQ ID NO: 866702 - DNA, 22 bp, Artificial Sequence
  chemically synthesized
cttagctcccctagctagcttt

SEQ ID NO: 866703 - DNA, 22 bp, Artificial Sequence
  chemically synthesized
agctcccctagctagctttgtc

SEQ ID NO: 866704 - DNA, 22 bp, Artificial Sequence
  chemically synthesized
gctcccctagctagctttgtct

SEQ ID NO: 866705 - DNA, 22 bp, Artificial Sequence
  chemically synthesized
tcatcttgttccagagacaaag

SEQ ID NO: 866706 - DNA, 22 bp, Artificial Sequence
  chemically synthesized
ccctagctagctttgtctctgg

SEQ ID NO: 866707 - DNA, 22 bp, Artificial Sequence
  chemically synthesized
gctagctttgtctctggaacaa

SEQ ID NO: 866708 - DNA, 22 bp, Artificial Sequence
  chemically synthesized
gctttgtctctggaacaagatg

SEQ ID NO: 866709 - DNA, 22 bp, Artificial Sequence
  chemically synthesized
tgtctctggaacaagatgacag

SEQ ID NO: 866710 - DNA, 22 bp, Artificial Sequence
  chemically synthesized
gtctctggaacaagatgacagt

SEQ ID NO: 866711 - DNA, 22 bp, Artificial Sequence
  chemically synthesized
tctctggaacaagatgacagtt

SEQ ID NO: 866712 - DNA, 22 bp, Artificial Sequence
  chemically synthesized
tggaacaagatgacagtttatt

SEQ ID NO: 866713 - DNA, 22 bp, Artificial Sequence
  chemically synthesized
gaacaagatgacagtttatttc

SEQ ID NO: 866714 - DNA, 22 bp, Artificial Sequence
  chemically synthesized
atttcatctttatttccatttc

SEQ ID NO: 866715 - DNA, 22 bp, Artificial Sequence
  chemically synthesized
tttcatctttatttccatttct

SEQ ID NO: 866716 - DNA, 22 bp, Artificial Sequence
  chemically synthesized
catctttatttccatttcttta

SEQ ID NO: 866717 - DNA, 22 bp, Artificial Sequence
  chemically synthesized
atctttatttccatttctttac

SEQ ID NO: 866718 - DNA, 22 bp, Artificial Sequence
  chemically synthesized
tatttccatttctttacatact

SEQ ID NO: 866719 - DNA, 22 bp, Artificial Sequence
  chemically synthesized
atttccatttctttacatactt

SEQ ID NO: 866720 - DNA, 22 bp, Artificial Sequence
  chemically synthesized
tttccatttctttacatacttc

SEQ ID NO: 866721 - DNA, 22 bp, Artificial Sequence
  chemically synthesized
ccatttctttacatacttcctc

SEQ ID NO: 866722 - DNA, 22 bp, Artificial Sequence
  chemically synthesized
catttctttacatacttcctct

SEQ ID NO: 866723 - DNA, 22 bp, Artificial Sequence
  chemically synthesized
ctttacatacttcctcttttac

SEQ ID NO: 866724 - DNA, 22 bp, Artificial Sequence
  chemically synthesized
tttacatacttcctcttttact

SEQ ID NO: 866725 - DNA, 22 bp, Artificial Sequence
  chemically synthesized
tacatacttcctcttttactgc

SEQ ID NO: 866726 - DNA, 22 bp, Artificial Sequence
  chemically synthesized
acatacttcctcttttactgct

SEQ ID NO: 866727 - DNA, 22 bp, Artificial Sequence
  chemically synthesized
catacttcctcttttactgcta

SEQ ID NO: 866728 - DNA, 22 bp, Artificial Sequence
  chemically synthesized
cctcttttactgctactactca

SEQ ID NO: 866729 - DNA, 22 bp, Artificial Sequence
  chemically synthesized
ctcttttactgctactactcat

SEQ ID NO: 866730 - DNA, 22 bp, Artificial Sequence
  chemically synthesized
ttttactgctactactcattct

SEQ ID NO: 866731 - DNA, 22 bp, Artificial Sequence
  chemically synthesized
ttactgctactactcattctcc

SEQ ID NO: 866732 - DNA, 22 bp, Artificial Sequence
  chemically synthesized
tactgctactactcattctcca

SEQ ID NO: 866733 - DNA, 22 bp, Artificial Sequence
  chemically synthesized
actgctactactcattctccac

SEQ ID NO: 866734 - DNA, 22 bp, Artificial Sequence
  chemically synthesized
ctgctactactcattctccact

SEQ ID NO: 866735 - DNA, 22 bp, Artificial Sequence
  chemically synthesized
ctactactcattctccacttct

SEQ ID NO: 866736 - DNA, 22 bp, Artificial Sequence
  chemically synthesized
ctactcattctccacttctctt

SEQ ID NO: 866737 - DNA, 22 bp, Artificial Sequence
  chemically synthesized
ctcattctccacttctcttttt

SEQ ID NO: 866738 - DNA, 22 bp, Artificial Sequence
  chemically synthesized
attctccacttctctttttcac

SEQ ID NO: 866739 - DNA, 22 bp, Artificial Sequence
  chemically synthesized
tccacttctctttttcactccc

SEQ ID NO: 866740 - DNA, 22 bp, Artificial Sequence
  chemically synthesized
cacttctctttttcactcccct

SEQ ID NO: 866741 - DNA, 22 bp, Artificial Sequence
  chemically synthesized
ctctttttcactcccctttggt

SEQ ID NO: 866742 - DNA, 22 bp, Artificial Sequence
  chemically synthesized
gaaacaaggagtaccaaagggg

SEQ ID NO: 866743 - DNA, 22 bp, Artificial Sequence
  chemically synthesized
tctttttcactcccctttggta

SEQ ID NO: 866744 - DNA, 22 bp, Artificial Sequence
  chemically synthesized
tggaaacaaggagtaccaaagg

SEQ ID NO: 866745 - DNA, 22 bp, Artificial Sequence
  chemically synthesized
tttttcactcccctttggtact

SEQ ID NO: 866746 - DNA, 22 bp, Artificial Sequence
  chemically synthesized
ctggaaacaaggagtaccaaag

SEQ ID NO: 866747 - DNA, 22 bp, Artificial Sequence
  chemically synthesized
tttcactcccctttggtactcc

SEQ ID NO: 866748 - DNA, 22 bp, Artificial Sequence
  chemically synthesized
ttcactcccctttggtactcct

SEQ ID NO: 866749 - DNA, 22 bp, Artificial Sequence
  chemically synthesized
tcactcccctttggtactcctt

SEQ ID NO: 866750 - DNA, 22 bp, Artificial Sequence
  chemically synthesized
cactcccctttggtactccttg

SEQ ID NO: 866751 - DNA, 22 bp, Artificial Sequence
  chemically synthesized
actcccctttggtactccttgt

SEQ ID NO: 866752 - DNA, 22 bp, Artificial Sequence
  chemically synthesized
ccctttggtactccttgtttcc

SEQ ID NO: 866753 - DNA, 22 bp, Artificial Sequence
  chemically synthesized
gggatcagagtcttctggaaac

SEQ ID NO: 866754 - DNA, 22 bp, Artificial Sequence
  chemically synthesized
tggtactccttgtttccagaag

SEQ ID NO: 866755 - DNA, 22 bp, Artificial Sequence
  chemically synthesized
ggtactccttgtttccagaaga

SEQ ID NO: 866756 - DNA, 22 bp, Artificial Sequence
  chemically synthesized
gtactccttgtttccagaagac

SEQ ID NO: 866757 - DNA, 22 bp, Artificial Sequence
  chemically synthesized
agctggggatcagagtcttctg

SEQ ID NO: 866758 - DNA, 22 bp, Artificial Sequence
  chemically synthesized
gagctggggatcagagtcttct

SEQ ID NO: 866759 - DNA, 22 bp, Artificial Sequence
  chemically synthesized
cttgtttccagaagactctgat

SEQ ID NO: 866760 - DNA, 22 bp, Artificial Sequence
  chemically synthesized
gtttccagaagactctgatccc

SEQ ID NO: 866761 - DNA, 22 bp, Artificial Sequence
  chemically synthesized
tttccagaagactctgatcccc

SEQ ID NO: 866762 - DNA, 22 bp, Artificial Sequence
  chemically synthesized
ccagaagactctgatccccagc

SEQ ID NO: 866763 - DNA, 22 bp, Artificial Sequence
  chemically synthesized
cagaagactctgatccccagct

SEQ ID NO: 866764 - DNA, 22 bp, Artificial Sequence
  chemically synthesized
agtacagagaaggaacccttga

SEQ ID NO: 866765 - DNA, 22 bp, Artificial Sequence
  chemically synthesized
tgatccccagctcaagggttcc

SEQ ID NO: 866766 - DNA, 22 bp, Artificial Sequence
  chemically synthesized
atccccagctcaagggttcctt

SEQ ID NO: 866767 - DNA, 22 bp, Artificial Sequence
  chemically synthesized
cgagcaagactcagtacagaga

SEQ ID NO: 866768 - DNA, 22 bp, Artificial Sequence
  chemically synthesized
aagggttccttctctgtactga

SEQ ID NO: 866769 - DNA, 22 bp, Artificial Sequence
  chemically synthesized
cttctctgtactgagtcttgct

SEQ ID NO: 866770 - DNA, 22 bp, Artificial Sequence
  chemically synthesized
ctctgtactgagtcttgctcgt

SEQ ID NO: 866771 - DNA, 22 bp, Artificial Sequence
  chemically synthesized
cacaagataattacgagcaaga

SEQ ID NO: 866772 - DNA, 22 bp, Artificial Sequence
  chemically synthesized
tctgtactgagtcttgctcgta

SEQ ID NO: 866773 - DNA, 22 bp, Artificial Sequence
  chemically synthesized
tgtactgagtcttgctcgtaat

SEQ ID NO: 866774 - DNA, 22 bp, Artificial Sequence
  chemically synthesized
tactgagtcttgctcgtaatta

SEQ ID NO: 866775 - DNA, 22 bp, Artificial Sequence
  chemically synthesized
aagttacacaagataattacga

SEQ ID NO: 866776 - DNA, 22 bp, Artificial Sequence
  chemically synthesized
agtcttgctcgtaattatcttg

SEQ ID NO: 866777 - DNA, 22 bp, Artificial Sequence
  chemically synthesized
gctcgtaattatcttgtgtaac

SEQ ID NO: 866778 - DNA, 22 bp, Artificial Sequence
  chemically synthesized
ctcgtaattatcttgtgtaact

SEQ ID NO: 866779 - DNA, 22 bp, Artificial Sequence
  chemically synthesized
gtaattatcttgtgtaacttca

SEQ ID NO: 866780 - DNA, 22 bp, Artificial Sequence
  chemically synthesized
aatatagaaatcctgaagttac

SEQ ID NO: 866781 - DNA, 22 bp, Artificial Sequence
  chemically synthesized
ttcaatatagaaatcctgaagt

SEQ ID NO: 866782 - DNA, 22 bp, Artificial Sequence
  chemically synthesized
tcttgtgtaacttcaggatttc

SEQ ID NO: 866783 - DNA, 22 bp, Artificial Sequence
  chemically synthesized
gtgtaacttcaggatttctata

SEQ ID NO: 866784 - DNA, 22 bp, Artificial Sequence
  chemically synthesized
tgtaacttcaggatttctatat

SEQ ID NO: 866785 - DNA, 22 bp, Artificial Sequence
  chemically synthesized
caggatttctatattgaacaat

SEQ ID NO: 866786 - DNA, 22 bp, Artificial Sequence
  chemically synthesized
aggatttctatattgaacaata

SEQ ID NO: 866787 - DNA, 22 bp, Artificial Sequence
  chemically synthesized
ctatattgaacaatacgctgat

SEQ ID NO: 866788 - DNA, 22 bp, Artificial Sequence
  chemically synthesized
tatattgaacaatacgctgatt

SEQ ID NO: 866789 - DNA, 22 bp, Artificial Sequence
  chemically synthesized
tattgaacaatacgctgatttc

SEQ ID NO: 866790 - DNA, 22 bp, Artificial Sequence
  chemically synthesized
aacaatacgctgatttctattt

SEQ ID NO: 866791 - DNA, 22 bp, Artificial Sequence
  chemically synthesized
ggaatgaatgaggaaggcagaa

SEQ ID NO: 866792 - DNA, 22 bp, Artificial Sequence
  chemically synthesized
atttctatttctgccttcctca

SEQ ID NO: 866793 - DNA, 22 bp, Artificial Sequence
  chemically synthesized
cctgggaatgaatgaggaaggc

SEQ ID NO: 866794 - DNA, 22 bp, Artificial Sequence
  chemically synthesized
ctatttctgccttcctcattca

SEQ ID NO: 866795 - DNA, 22 bp, Artificial Sequence
  chemically synthesized
tatttctgccttcctcattcat

SEQ ID NO: 866796 - DNA, 22 bp, Artificial Sequence
  chemically synthesized
tttctgccttcctcattcattc

SEQ ID NO: 866797 - DNA, 22 bp, Artificial Sequence
  chemically synthesized
ctgccttcctcattcattccca

SEQ ID NO: 866798 - DNA, 22 bp, Artificial Sequence
  chemically synthesized
tgccttcctcattcattcccag

SEQ ID NO: 866799 - DNA, 22 bp, Artificial Sequence
  chemically synthesized
aatccccattacctgggaatga

SEQ ID NO: 866800 - DNA, 22 bp, Artificial Sequence
  chemically synthesized
ccttcctcattcattcccaggt

SEQ ID NO: 866801 - DNA, 22 bp, Artificial Sequence
  chemically synthesized
attgaatccccattacctggga

SEQ ID NO: 866802 - DNA, 22 bp, Artificial Sequence
  chemically synthesized
cattgaatccccattacctggg

SEQ ID NO: 866803 - DNA, 22 bp, Artificial Sequence
  chemically synthesized
cctcattcattcccaggtaatg

SEQ ID NO: 866804 - DNA, 22 bp, Artificial Sequence
  chemically synthesized
tcattgaatccccattacctgg

SEQ ID NO: 866805 - DNA, 22 bp, Artificial Sequence
  chemically synthesized
ctcattcattcccaggtaatgg

SEQ ID NO: 866806 - DNA, 22 bp, Artificial Sequence
  chemically synthesized
attcattcccaggtaatgggga

SEQ ID NO: 866807 - DNA, 22 bp, Artificial Sequence
  chemically synthesized
tcgattttcattgaatccccat

SEQ ID NO: 866808 - DNA, 22 bp, Artificial Sequence
  chemically synthesized
attcccaggtaatggggattca

SEQ ID NO: 866809 - DNA, 22 bp, Artificial Sequence
  chemically synthesized
gtcgattttcattgaatcccca

SEQ ID NO: 866810 - DNA, 22 bp, Artificial Sequence
  chemically synthesized
ttgtcgattttcattgaatccc

SEQ ID NO: 866811 - DNA, 22 bp, Artificial Sequence
  chemically synthesized
ccaggtaatggggattcaatga

SEQ ID NO: 866812 - DNA, 22 bp, Artificial Sequence
  chemically synthesized
aatgaaaatcgacaagagggga

SEQ ID NO: 866813 - DNA, 22 bp, Artificial Sequence
  chemically synthesized
atacaaccaacatcccctcttg

SEQ ID NO: 866814 - DNA, 22 bp, Artificial Sequence
  chemically synthesized
atagcagcatgagaacagacta

SEQ ID NO: 866815 - DNA, 22 bp, Artificial Sequence
  chemically synthesized
catagcagcatgagaacagact

SEQ ID NO: 866816 - DNA, 22 bp, Artificial Sequence
  chemically synthesized
ttcatagcagcatgagaacaga

SEQ ID NO: 866817 - DNA, 22 bp, Artificial Sequence
  chemically synthesized
cttcatagcagcatgagaacag

SEQ ID NO: 866818 - DNA, 22 bp, Artificial Sequence
  chemically synthesized
gttgtattagtctgttctcatg

SEQ ID NO: 866819 - DNA, 22 bp, Artificial Sequence
  chemically synthesized
tattagtctgttctcatgctgc

SEQ ID NO: 866820 - DNA, 22 bp, Artificial Sequence
  chemically synthesized
gggtatttcttcatagcagcat

SEQ ID NO: 866821 - DNA, 22 bp, Artificial Sequence
  chemically synthesized
gtctgttctcatgctgctatga

SEQ ID NO: 866822 - DNA, 22 bp, Artificial Sequence
  chemically synthesized
ttctcatgctgctatgaagaaa

SEQ ID NO: 866823 - DNA, 22 bp, Artificial Sequence
  chemically synthesized
cccagtctcgggtatttcttca

SEQ ID NO: 866824 - DNA, 22 bp, Artificial Sequence
  chemically synthesized
tcatgctgctatgaagaaatac

SEQ ID NO: 866825 - DNA, 22 bp, Artificial Sequence
  chemically synthesized
atgctgctatgaagaaataccc

SEQ ID NO: 866826 - DNA, 22 bp, Artificial Sequence
  chemically synthesized
ataaattacccagtctcgggta

SEQ ID NO: 866827 - DNA, 22 bp, Artificial Sequence
  chemically synthesized
ctatgaagaaatacccgagact

SEQ ID NO: 866828 - DNA, 22 bp, Artificial Sequence
  chemically synthesized
cataaattacccagtctcgggt

SEQ ID NO: 866829 - DNA, 22 bp, Artificial Sequence
  chemically synthesized
ttcataaattacccagtctcgg

SEQ ID NO: 866830 - DNA, 22 bp, Artificial Sequence
  chemically synthesized
tgaagaaatacccgagactggg

SEQ ID NO: 866831 - DNA, 22 bp, Artificial Sequence
  chemically synthesized
cttcataaattacccagtctcg

SEQ ID NO: 866832 - DNA, 22 bp, Artificial Sequence
  chemically synthesized
tcttcataaattacccagtctc

SEQ ID NO: 866833 - DNA, 22 bp, Artificial Sequence
  chemically synthesized
ttttcttcataaattacccagt

SEQ ID NO: 866834 - DNA, 22 bp, Artificial Sequence
  chemically synthesized
aaactgttttcttcataaatta

SEQ ID NO: 866835 - DNA, 22 bp, Artificial Sequence
  chemically synthesized
ggtaatttatgaagaaaacagt

SEQ ID NO: 866836 - DNA, 22 bp, Artificial Sequence
  chemically synthesized
atgaagaaaacagttttaattg

SEQ ID NO: 866837 - DNA, 22 bp, Artificial Sequence
  chemically synthesized
tgaagaaaacagttttaattga

SEQ ID NO: 866838 - DNA, 22 bp, Artificial Sequence
  chemically synthesized
cccagccatgcagaatggtgaa

SEQ ID NO: 866839 - DNA, 22 bp, Artificial Sequence
  chemically synthesized
taattgattcaccattctgcat

SEQ ID NO: 866840 - DNA, 22 bp, Artificial Sequence
  chemically synthesized
aattgattcaccattctgcatg

SEQ ID NO: 866841 - DNA, 22 bp, Artificial Sequence
  chemically synthesized
attgattcaccattctgcatgg

SEQ ID NO: 866842 - DNA, 22 bp, Artificial Sequence
  chemically synthesized
aggcctccccagccatgcagaa

SEQ ID NO: 866843 - DNA, 22 bp, Artificial Sequence
  chemically synthesized
ctgaggcctccccagccatgca

SEQ ID NO: 866844 - DNA, 22 bp, Artificial Sequence
  chemically synthesized
attcaccattctgcatggctgg

SEQ ID NO: 866845 - DNA, 22 bp, Artificial Sequence
  chemically synthesized
cctgaggcctccccagccatgc

SEQ ID NO: 866846 - DNA, 22 bp, Artificial Sequence
  chemically synthesized
accattctgcatggctggggag

SEQ ID NO: 866847 - DNA, 22 bp, Artificial Sequence
  chemically synthesized
taagtttcctgaggcctcccca

SEQ ID NO: 866848 - DNA, 22 bp, Artificial Sequence
  chemically synthesized
tgcatggctggggaggcctcag

SEQ ID NO: 866849 - DNA, 22 bp, Artificial Sequence
  chemically synthesized
catggctggggaggcctcagga

SEQ ID NO: 866850 - DNA, 22 bp, Artificial Sequence
  chemically synthesized
ccatgattgtaagtttcctgag

SEQ ID NO: 866851 - DNA, 22 bp, Artificial Sequence
  chemically synthesized
tgccatgattgtaagtttcctg

SEQ ID NO: 866852 - DNA, 22 bp, Artificial Sequence
  chemically synthesized
ctgccatgattgtaagtttcct

SEQ ID NO: 866853 - DNA, 22 bp, Artificial Sequence
  chemically synthesized
gggaggcctcaggaaacttaca

SEQ ID NO: 866854 - DNA, 22 bp, Artificial Sequence
  chemically synthesized
aggaaacttacaatcatggcag

SEQ ID NO: 866855 - DNA, 22 bp, Artificial Sequence
  chemically synthesized
tgaagaggtgccttctgccatg

SEQ ID NO: 866856 - DNA, 22 bp, Artificial Sequence
  chemically synthesized
acaatcatggcagaaggcacct

SEQ ID NO: 866857 - DNA, 22 bp, Artificial Sequence
  chemically synthesized
caatcatggcagaaggcacctc

SEQ ID NO: 866858 - DNA, 22 bp, Artificial Sequence
  chemically synthesized
ccaccctgtgaagaggtgcctt

SEQ ID NO: 866859 - DNA, 22 bp, Artificial Sequence
  chemically synthesized
ctgccaccctgtgaagaggtgc

SEQ ID NO: 866860 - DNA, 22 bp, Artificial Sequence
  chemically synthesized
cctcctgccaccctgtgaagag

SEQ ID NO: 866861 - DNA, 22 bp, Artificial Sequence
  chemically synthesized
tccctcctgccaccctgtgaag

SEQ ID NO: 866862 - DNA, 22 bp, Artificial Sequence
  chemically synthesized
attctccctcctgccaccctgt

SEQ ID NO: 866863 - DNA, 22 bp, Artificial Sequence
  chemically synthesized
gcactcattctccctcctgcca

SEQ ID NO: 866864 - DNA, 22 bp, Artificial Sequence
  chemically synthesized
ttcacagggtggcaggagggag

SEQ ID NO: 866865 - DNA, 22 bp, Artificial Sequence
  chemically synthesized
ctggcactcattctccctcctg

SEQ ID NO: 866866 - DNA, 22 bp, Artificial Sequence
  chemically synthesized
cacagggtggcaggagggagaa

SEQ ID NO: 866867 - DNA, 22 bp, Artificial Sequence
  chemically synthesized
acagggtggcaggagggagaat

SEQ ID NO: 866868 - DNA, 22 bp, Artificial Sequence
  chemically synthesized
ccctgctggcactcattctccc

SEQ ID NO: 866869 - DNA, 22 bp, Artificial Sequence
  chemically synthesized
cccctgctggcactcattctcc

SEQ ID NO: 866870 - DNA, 22 bp, Artificial Sequence
  chemically synthesized
gcgtttcccctgctggcactca

SEQ ID NO: 866871 - DNA, 22 bp, Artificial Sequence
  chemically synthesized
taagtgtctggcgtttcccctg

SEQ ID NO: 866872 - DNA, 22 bp, Artificial Sequence
  chemically synthesized
ataagtgtctggcgtttcccct

SEQ ID NO: 866873 - DNA, 22 bp, Artificial Sequence
  chemically synthesized
tataagtgtctggcgtttcccc

SEQ ID NO: 866874 - DNA, 22 bp, Artificial Sequence
  chemically synthesized
atggttttataagtgtctggcg

SEQ ID NO: 866875 - DNA, 22 bp, Artificial Sequence
  chemically synthesized
acatgagatctgatggttttat

SEQ ID NO: 866876 - DNA, 22 bp, Artificial Sequence
  chemically synthesized
cacatgagatctgatggtttta

SEQ ID NO: 866877 - DNA, 22 bp, Artificial Sequence
  chemically synthesized
ataaaaccatcagatctcatgt

SEQ ID NO: 866878 - DNA, 22 bp, Artificial Sequence
  chemically synthesized
taaaaccatcagatctcatgtg

SEQ ID NO: 866879 - DNA, 22 bp, Artificial Sequence
  chemically synthesized
atgatagtgggtgatttcacat

SEQ ID NO: 866880 - DNA, 22 bp, Artificial Sequence
  chemically synthesized
tcatgatagtgggtgatttcac

SEQ ID NO: 866881 - DNA, 22 bp, Artificial Sequence
  chemically synthesized
ttctcatgatagtgggtgattt

SEQ ID NO: 866882 - DNA, 22 bp, Artificial Sequence
  chemically synthesized
atgtgaaatcacccactatcat

SEQ ID NO: 866883 - DNA, 22 bp, Artificial Sequence
  chemically synthesized
ccccatgctattctcatgatag

SEQ ID NO: 866884 - DNA, 22 bp, Artificial Sequence
  chemically synthesized
cccccatgctattctcatgata

SEQ ID NO: 866885 - DNA, 22 bp, Artificial Sequence
  chemically synthesized
tcatgagaatagcatgggggaa

SEQ ID NO: 866886 - DNA, 22 bp, Artificial Sequence
  chemically synthesized
aatcatggaggcagtttccccc

SEQ ID NO: 866887 - DNA, 22 bp, Artificial Sequence
  chemically synthesized
cctccatgattcaattacctct

SEQ ID NO: 866888 - DNA, 22 bp, Artificial Sequence
  chemically synthesized
catgattcaattacctctcact

SEQ ID NO: 866889 - DNA, 22 bp, Artificial Sequence
  chemically synthesized
aattacctctcactgggtccct

SEQ ID NO: 866890 - DNA, 22 bp, Artificial Sequence
  chemically synthesized
cctctcactgggtccctcccat

SEQ ID NO: 866891 - DNA, 22 bp, Artificial Sequence
  chemically synthesized
tcactgggtccctcccatgaca

SEQ ID NO: 866892 - DNA, 22 bp, Artificial Sequence
  chemically synthesized
caaaatccccaggtgtcatggg

SEQ ID NO: 866893 - DNA, 22 bp, Artificial Sequence
  chemically synthesized
actgggtccctcccatgacacc

SEQ ID NO: 866894 - DNA, 22 bp, Artificial Sequence
  chemically synthesized
ggtccctcccatgacacctggg

SEQ ID NO: 866895 - DNA, 22 bp, Artificial Sequence
  chemically synthesized
taatctccaaaatccccaggtg

SEQ ID NO: 866896 - DNA, 22 bp, Artificial Sequence
  chemically synthesized
aattgtaatctccaaaatcccc

SEQ ID NO: 866897 - DNA, 22 bp, Artificial Sequence
  chemically synthesized
ccatgacacctggggattttgg

SEQ ID NO: 866898 - DNA, 22 bp, Artificial Sequence
  chemically synthesized
gaattgtaatctccaaaatccc

SEQ ID NO: 866899 - DNA, 22 bp, Artificial Sequence
  chemically synthesized
accttgaattgtaatctccaaa

SEQ ID NO: 866900 - DNA, 22 bp, Artificial Sequence
  chemically synthesized
gggattttggagattacaattc

SEQ ID NO: 866901 - DNA, 22 bp, Artificial Sequence
  chemically synthesized
tggagattacaattcaaggtga

SEQ ID NO: 866902 - DNA, 22 bp, Artificial Sequence
  chemically synthesized
ggagattacaattcaaggtgag

SEQ ID NO: 866903 - DNA, 22 bp, Artificial Sequence
  chemically synthesized
gagattacaattcaaggtgaga

SEQ ID NO: 866904 - DNA, 22 bp, Artificial Sequence
  chemically synthesized
tgtccccacccaaatctcacct

SEQ ID NO: 866905 - DNA, 22 bp, Artificial Sequence
  chemically synthesized
gctgtgtccccacccaaatctc

SEQ ID NO: 866906 - DNA, 22 bp, Artificial Sequence
  chemically synthesized
caattcaaggtgagatttgggt

SEQ ID NO: 866907 - DNA, 22 bp, Artificial Sequence
  chemically synthesized
ggctgtgtccccacccaaatct

SEQ ID NO: 866908 - DNA, 22 bp, Artificial Sequence
  chemically synthesized
tggctgtgtccccacccaaatc

SEQ ID NO: 866909 - DNA, 22 bp, Artificial Sequence
  chemically synthesized
aaggtgagatttgggtggggac

SEQ ID NO: 866910 - DNA, 22 bp, Artificial Sequence
  chemically synthesized
gggtggggacacagccaaaaca

SEQ ID NO: 866911 - DNA, 22 bp, Artificial Sequence
  chemically synthesized
ggtggggacacagccaaaacat

SEQ ID NO: 866912 - DNA, 22 bp, Artificial Sequence
  chemically synthesized
ggaggggccaggagcagaatga

SEQ ID NO: 866913 - DNA, 22 bp, Artificial Sequence
  chemically synthesized
gggaggggccaggagcagaatg

SEQ ID NO: 866914 - DNA, 22 bp, Artificial Sequence
  chemically synthesized
tgctcctggcccctcccaaatc

SEQ ID NO: 866915 - DNA, 22 bp, Artificial Sequence
  chemically synthesized
ctcctggcccctcccaaatctc

SEQ ID NO: 866916 - DNA, 22 bp, Artificial Sequence
  chemically synthesized
aaatgtgatgacatgagatttg

SEQ ID NO: 866917 - DNA, 22 bp, Artificial Sequence
  chemically synthesized
ctggcccctcccaaatctcatg

SEQ ID NO: 866918 - DNA, 22 bp, Artificial Sequence
  chemically synthesized
gaaatgtgatgacatgagattt

SEQ ID NO: 866919 - DNA, 22 bp, Artificial Sequence
  chemically synthesized
tgaaatgtgatgacatgagatt

SEQ ID NO: 866920 - DNA, 22 bp, Artificial Sequence
  chemically synthesized
gcccctcccaaatctcatgtca

SEQ ID NO: 866921 - DNA, 22 bp, Artificial Sequence
  chemically synthesized
tgttttgaaatgtgatgacatg

SEQ ID NO: 866922 - DNA, 22 bp, Artificial Sequence
  chemically synthesized
ttgtgttttgaaatgtgatgac

SEQ ID NO: 866923 - DNA, 22 bp, Artificial Sequence
  chemically synthesized
ccaaatctcatgtcatcacatt

SEQ ID NO: 866924 - DNA, 22 bp, Artificial Sequence
  chemically synthesized
atgtcatcacatttcaaaacac

SEQ ID NO: 866925 - DNA, 22 bp, Artificial Sequence
  chemically synthesized
ggaaggcattattgtgttttga

SEQ ID NO: 866926 - DNA, 22 bp, Artificial Sequence
  chemically synthesized
ttgggaaggcattattgtgttt

SEQ ID NO: 866927 - DNA, 22 bp, Artificial Sequence
  chemically synthesized
ggtgactgttgggaaggcatta

SEQ ID NO: 866928 - DNA, 22 bp, Artificial Sequence
  chemically synthesized
gggtgactgttgggaaggcatt

SEQ ID NO: 866929 - DNA, 22 bp, Artificial Sequence
  chemically synthesized
caaaacacaataatgccttccc

SEQ ID NO: 866930 - DNA, 22 bp, Artificial Sequence
  chemically synthesized
tgggtgactgttgggaaggcat

SEQ ID NO: 866931 - DNA, 22 bp, Artificial Sequence
  chemically synthesized
aaaacacaataatgccttccca

SEQ ID NO: 866932 - DNA, 22 bp, Artificial Sequence
  chemically synthesized
agactttgggtgactgttggga

SEQ ID NO: 866933 - DNA, 22 bp, Artificial Sequence
  chemically synthesized
gaatgagttaagactttgggtg

SEQ ID NO: 866934 - DNA, 22 bp, Artificial Sequence
  chemically synthesized
cccaacagtcacccaaagtctt

SEQ ID NO: 866935 - DNA, 22 bp, Artificial Sequence
  chemically synthesized
ccaacagtcacccaaagtctta

SEQ ID NO: 866936 - DNA, 22 bp, Artificial Sequence
  chemically synthesized
atgttggaatgagttaagactt

SEQ ID NO: 866937 - DNA, 22 bp, Artificial Sequence
  chemically synthesized
ggttaatgttggaatgagttaa

SEQ ID NO: 866938 - DNA, 22 bp, Artificial Sequence
  chemically synthesized
gggttaatgttggaatgagtta

SEQ ID NO: 866939 - DNA, 22 bp, Artificial Sequence
  chemically synthesized
tgggttaatgttggaatgagtt

SEQ ID NO: 866940 - DNA, 22 bp, Artificial Sequence
  chemically synthesized
ttgggttaatgttggaatgagt

SEQ ID NO: 866941 - DNA, 22 bp, Artificial Sequence
  chemically synthesized
gacttttgggttaatgttggaa

SEQ ID NO: 866942 - DNA, 22 bp, Artificial Sequence
  chemically synthesized
ggacttttgggttaatgttgga

SEQ ID NO: 866943 - DNA, 22 bp, Artificial Sequence
  chemically synthesized
aactcattccaacattaaccca

SEQ ID NO: 866944 - DNA, 22 bp, Artificial Sequence
  chemically synthesized
gacttggacttttgggttaatg

SEQ ID NO: 866945 - DNA, 22 bp, Artificial Sequence
  chemically synthesized
actcattccaacattaacccaa

SEQ ID NO: 866946 - DNA, 22 bp, Artificial Sequence
  chemically synthesized
ggacttggacttttgggttaat

SEQ ID NO: 866947 - DNA, 22 bp, Artificial Sequence
  chemically synthesized
tggacttggacttttgggttaa

SEQ ID NO: 866948 - DNA, 22 bp, Artificial Sequence
  chemically synthesized
attccaacattaacccaaaagt

SEQ ID NO: 866949 - DNA, 22 bp, Artificial Sequence
  chemically synthesized
caacattaacccaaaagtccaa

SEQ ID NO: 866950 - DNA, 22 bp, Artificial Sequence
  chemically synthesized
gatgaaactttggacttggact

SEQ ID NO: 866951 - DNA, 22 bp, Artificial Sequence
  chemically synthesized
agatgaaactttggacttggac

SEQ ID NO: 866952 - DNA, 22 bp, Artificial Sequence
  chemically synthesized
acccaaaagtccaagtccaaag

SEQ ID NO: 866953 - DNA, 22 bp, Artificial Sequence
  chemically synthesized
ccttagatgaaactttggactt

SEQ ID NO: 866954 - DNA, 22 bp, Artificial Sequence
  chemically synthesized
gccttagatgaaactttggact

SEQ ID NO: 866955 - DNA, 22 bp, Artificial Sequence
  chemically synthesized
tgccttagatgaaactttggac

SEQ ID NO: 866956 - DNA, 22 bp, Artificial Sequence
  chemically synthesized
ctttgccttagatgaaactttg

SEQ ID NO: 866957 - DNA, 22 bp, Artificial Sequence
  chemically synthesized
gctttgccttagatgaaacttt

SEQ ID NO: 866958 - DNA, 22 bp, Artificial Sequence
  chemically synthesized
ataggcggatgggacttgcttt

SEQ ID NO: 866959 - DNA, 22 bp, Artificial Sequence
  chemically synthesized
catctaaggcaaagcaagtccc

SEQ ID NO: 866960 - DNA, 22 bp, Artificial Sequence
  chemically synthesized
atctaaggcaaagcaagtccca

SEQ ID NO: 866961 - DNA, 22 bp, Artificial Sequence
  chemically synthesized
aggctcataggcggatgggact

SEQ ID NO: 866962 - DNA, 22 bp, Artificial Sequence
  chemically synthesized
caggctcataggcggatgggac

SEQ ID NO: 866963 - DNA, 22 bp, Artificial Sequence
  chemically synthesized
aggcaaagcaagtcccatccgc

SEQ ID NO: 866964 - DNA, 22 bp, Artificial Sequence
  chemically synthesized
tcaggctcataggcggatggga

SEQ ID NO: 866965 - DNA, 22 bp, Artificial Sequence
  chemically synthesized
gattttcaggctcataggcgga

SEQ ID NO: 866966 - DNA, 22 bp, Artificial Sequence
  chemically synthesized
ggattttcaggctcataggcgg

SEQ ID NO: 866967 - DNA, 22 bp, Artificial Sequence
  chemically synthesized
tggattttcaggctcataggcg

SEQ ID NO: 866968 - DNA, 22 bp, Artificial Sequence
  chemically synthesized
ttttggattttcaggctcatag

SEQ ID NO: 866969 - DNA, 22 bp, Artificial Sequence
  chemically synthesized
gttttggattttcaggctcata

SEQ ID NO: 866970 - DNA, 22 bp, Artificial Sequence
  chemically synthesized
acttgttttggattttcaggct

SEQ ID NO: 866971 - DNA, 22 bp, Artificial Sequence
  chemically synthesized
tgagcctgaaaatccaaaacaa

SEQ ID NO: 866972 - DNA, 22 bp, Artificial Sequence
  chemically synthesized
gaagtaactaacttgttttgga

SEQ ID NO: 866973 - DNA, 22 bp, Artificial Sequence
  chemically synthesized
tatcctggaagtaactaacttg

SEQ ID NO: 866974 - DNA, 22 bp, Artificial Sequence
  chemically synthesized
aaaatccaaaacaagttagtta

SEQ ID NO: 866975 - DNA, 22 bp, Artificial Sequence
  chemically synthesized
taccccccattgtatcctggaa

SEQ ID NO: 866976 - DNA, 22 bp, Artificial Sequence
  chemically synthesized
gttacttccaggatacaatggg

SEQ ID NO: 866977 - DNA, 22 bp, Artificial Sequence
  chemically synthesized
cttccaggatacaatggggggt

SEQ ID NO: 866978 - DNA, 22 bp, Artificial Sequence
  chemically synthesized
cccaatgcctgtaccccccatt

SEQ ID NO: 866979 - DNA, 22 bp, Artificial Sequence
  chemically synthesized
acccaatgcctgtaccccccat

SEQ ID NO: 866980 - DNA, 22 bp, Artificial Sequence
  chemically synthesized
ccaggatacaatggggggtaca

SEQ ID NO: 866981 - DNA, 22 bp, Artificial Sequence
  chemically synthesized
caggatacaatggggggtacag

SEQ ID NO: 866982 - DNA, 22 bp, Artificial Sequence
  chemically synthesized
ggaacaggtgtatttacccaat

SEQ ID NO: 866983 - DNA, 22 bp, Artificial Sequence
  chemically synthesized
ccattcggaacaggtgtattta

SEQ ID NO: 866984 - DNA, 22 bp, Artificial Sequence
  chemically synthesized
tcccattcggaacaggtgtatt

SEQ ID NO: 866985 - DNA, 22 bp, Artificial Sequence
  chemically synthesized
ctcccattcggaacaggtgtat

SEQ ID NO: 866986 - DNA, 22 bp, Artificial Sequence
  chemically synthesized
ggtaaatacacctgttccgaat

SEQ ID NO: 866987 - DNA, 22 bp, Artificial Sequence
  chemically synthesized
gccaatttctcccattcggaac

SEQ ID NO: 866988 - DNA, 22 bp, Artificial Sequence
  chemically synthesized
ggccaatttctcccattcggaa

SEQ ID NO: 866989 - DNA, 22 bp, Artificial Sequence
  chemically synthesized
tggccaatttctcccattcgga

SEQ ID NO: 866990 - DNA, 22 bp, Artificial Sequence
  chemically synthesized
ttttggccaatttctcccattc

SEQ ID NO: 866991 - DNA, 22 bp, Artificial Sequence
  chemically synthesized
attttggccaatttctcccatt

SEQ ID NO: 866992 - DNA, 22 bp, Artificial Sequence
  chemically synthesized
tattttggccaatttctcccat

SEQ ID NO: 866993 - DNA, 22 bp, Artificial Sequence
  chemically synthesized
ttccgaatgggagaaattggcc

SEQ ID NO: 866994 - DNA, 22 bp, Artificial Sequence
  chemically synthesized
cgaatgggagaaattggccaaa

SEQ ID NO: 866995 - DNA, 22 bp, Artificial Sequence
  chemically synthesized
taacccctttattttggccaat

SEQ ID NO: 866996 - DNA, 22 bp, Artificial Sequence
  chemically synthesized
catgtggcctgtaaccccttta

SEQ ID NO: 866997 - DNA, 22 bp, Artificial Sequence
  chemically synthesized
gcatgtggcctgtaaccccttt

SEQ ID NO: 866998 - DNA, 22 bp, Artificial Sequence
  chemically synthesized
gccaaaataaaggggttacagg

SEQ ID NO: 866999 - DNA, 22 bp, Artificial Sequence
  chemically synthesized
agacttgcatgtggcctgtaac

SEQ ID NO: 867000 - DNA, 22 bp, Artificial Sequence
  chemically synthesized
aagacttgcatgtggcctgtaa

SEQ ID NO: 867001 - DNA, 22 bp, Artificial Sequence
  chemically synthesized
gatttaagacttgcatgtggcc

SEQ ID NO: 867002 - DNA, 22 bp, Artificial Sequence
  chemically synthesized
ttggatttaagacttgcatgtg

SEQ ID NO: 867003 - DNA, 22 bp, Artificial Sequence
  chemically synthesized
ccctattggatttaagacttgc

SEQ ID NO: 867004 - DNA, 22 bp, Artificial Sequence
  chemically synthesized
caggccacatgcaagtcttaaa

SEQ ID NO: 867005 - DNA, 22 bp, Artificial Sequence
  chemically synthesized
aaagtgtaatgactgccctatt

SEQ ID NO: 867006 - DNA, 22 bp, Artificial Sequence
  chemically synthesized
aaatccaatagggcagtcatta

SEQ ID NO: 867007 - DNA, 22 bp, Artificial Sequence
  chemically synthesized
aatccaatagggcagtcattac

SEQ ID NO: 867008 - DNA, 22 bp, Artificial Sequence
  chemically synthesized
ggcagttcaaagtgtaatgact

SEQ ID NO: 867009 - DNA, 22 bp, Artificial Sequence
  chemically synthesized
gggcagttcaaagtgtaatgac

SEQ ID NO: 867010 - DNA, 22 bp, Artificial Sequence
  chemically synthesized
cactttgaactgcccaaatgat

SEQ ID NO: 867011 - DNA, 22 bp, Artificial Sequence
  chemically synthesized
tgaactgcccaaatgatctcct

SEQ ID NO: 867012 - DNA, 22 bp, Artificial Sequence
  chemically synthesized
gaactgcccaaatgatctcctt

SEQ ID NO: 867013 - DNA, 22 bp, Artificial Sequence
  chemically synthesized
aactgcccaaatgatctccttt

SEQ ID NO: 867014 - DNA, 22 bp, Artificial Sequence
  chemically synthesized
cccaaatgatctcctttgacta

SEQ ID NO: 867015 - DNA, 22 bp, Artificial Sequence
  chemically synthesized
gatgtgagacatgtagtcaaag

SEQ ID NO: 867016 - DNA, 22 bp, Artificial Sequence
  chemically synthesized
ctttgactacatgtctcacatc

SEQ ID NO: 867017 - DNA, 22 bp, Artificial Sequence
  chemically synthesized
tgactacatgtctcacatccag

SEQ ID NO: 867018 - DNA, 22 bp, Artificial Sequence
  chemically synthesized
catcagcatgacctggatgtga

SEQ ID NO: 867019 - DNA, 22 bp, Artificial Sequence
  chemically synthesized
gactacatgtctcacatccagg

SEQ ID NO: 867020 - DNA, 22 bp, Artificial Sequence
  chemically synthesized
gcatcagcatgacctggatgtg

SEQ ID NO: 867021 - DNA, 22 bp, Artificial Sequence
  chemically synthesized
actacatgtctcacatccaggt

SEQ ID NO: 867022 - DNA, 22 bp, Artificial Sequence
  chemically synthesized
ttgcatcagcatgacctggatg

SEQ ID NO: 867023 - DNA, 22 bp, Artificial Sequence
  chemically synthesized
catgtctcacatccaggtcatg

SEQ ID NO: 867024 - DNA, 22 bp, Artificial Sequence
  chemically synthesized
acatccaggtcatgctgatgca

SEQ ID NO: 867025 - DNA, 22 bp, Artificial Sequence
  chemically synthesized
cccaaggccatgggagcccacc

SEQ ID NO: 867026 - DNA, 22 bp, Artificial Sequence
  chemically synthesized
atgcaagaggtgggctcccatg

SEQ ID NO: 867027 - DNA, 22 bp, Artificial Sequence
  chemically synthesized
ccatggccttgggcagctctgc

SEQ ID NO: 867028 - DNA, 22 bp, Artificial Sequence
  chemically synthesized
caaagccacaagggcagagctg

SEQ ID NO: 867029 - DNA, 22 bp, Artificial Sequence
  chemically synthesized
taccctgcaaagccacaagggc

SEQ ID NO: 867030 - DNA, 22 bp, Artificial Sequence
  chemically synthesized
gggcagctctgcccttgtggct

SEQ ID NO: 867031 - DNA, 22 bp, Artificial Sequence
  chemically synthesized
ggcagctctgcccttgtggctt

SEQ ID NO: 867032 - DNA, 22 bp, Artificial Sequence
  chemically synthesized
tgcccttgtggctttgcagggt

SEQ ID NO: 867033 - DNA, 22 bp, Artificial Sequence
  chemically synthesized
ggagggggctgtaccctgcaaa

SEQ ID NO: 867034 - DNA, 22 bp, Artificial Sequence
  chemically synthesized
cccttgtggctttgcagggtac

SEQ ID NO: 867035 - DNA, 22 bp, Artificial Sequence
  chemically synthesized
gtggctttgcagggtacagccc

SEQ ID NO: 867036 - DNA, 22 bp, Artificial Sequence
  chemically synthesized
tggctttgcagggtacagcccc

SEQ ID NO: 867037 - DNA, 22 bp, Artificial Sequence
  chemically synthesized
tgcagggtacagccccctccca

SEQ ID NO: 867038 - DNA, 22 bp, Artificial Sequence
  chemically synthesized
gcagggtacagccccctcccag

SEQ ID NO: 867039 - DNA, 22 bp, Artificial Sequence
  chemically synthesized
cagggtacagccccctcccagc

SEQ ID NO: 867040 - DNA, 22 bp, Artificial Sequence
  chemically synthesized
gccatgatagcagctgggaggg

SEQ ID NO: 867041 - DNA, 22 bp, Artificial Sequence
  chemically synthesized
agtgctagccatgatagcagct

SEQ ID NO: 867042 - DNA, 22 bp, Artificial Sequence
  chemically synthesized
cagatactcagtgctagccatg

SEQ ID NO: 867043 - DNA, 22 bp, Artificial Sequence
  chemically synthesized
ccagctgctatcatggctagca

SEQ ID NO: 867044 - DNA, 22 bp, Artificial Sequence
  chemically synthesized
ctatcatggctagcactgagta

SEQ ID NO: 867045 - DNA, 22 bp, Artificial Sequence
  chemically synthesized
gaaaagctgcagatactcagtg

SEQ ID NO: 867046 - DNA, 22 bp, Artificial Sequence
  chemically synthesized
tcatggctagcactgagtatct

SEQ ID NO: 867047 - DNA, 22 bp, Artificial Sequence
  chemically synthesized
gcactgagtatctgcagctttt

SEQ ID NO: 867048 - DNA, 22 bp, Artificial Sequence
  chemically synthesized
aaccatgcatctagaaaagctg

SEQ ID NO: 867049 - DNA, 22 bp, Artificial Sequence
  chemically synthesized
gaaccatgcatctagaaaagct

SEQ ID NO: 867050 - DNA, 22 bp, Artificial Sequence
  chemically synthesized
agtatctgcagcttttctagat

SEQ ID NO: 867051 - DNA, 22 bp, Artificial Sequence
  chemically synthesized
atagtttgaaccatgcatctag

SEQ ID NO: 867052 - DNA, 22 bp, Artificial Sequence
  chemically synthesized
cagcttttctagatgcatggtt

SEQ ID NO: 867053 - DNA, 22 bp, Artificial Sequence
  chemically synthesized
ttctagatgcatggttcaaact

SEQ ID NO: 867054 - DNA, 22 bp, Artificial Sequence
  chemically synthesized
tctagatgcatggttcaaacta

SEQ ID NO: 867055 - DNA, 22 bp, Artificial Sequence
  chemically synthesized
ctagatgcatggttcaaactat

SEQ ID NO: 867056 - DNA, 22 bp, Artificial Sequence
  chemically synthesized
tagatgcatggttcaaactatc

SEQ ID NO: 867057 - DNA, 22 bp, Artificial Sequence
  chemically synthesized
gatgcatggttcaaactatcag

SEQ ID NO: 867058 - DNA, 22 bp, Artificial Sequence
  chemically synthesized
aaactatcagcatttctgacta

SEQ ID NO: 867059 - DNA, 22 bp, Artificial Sequence
  chemically synthesized
tcagcatttctgactattctgg

SEQ ID NO: 867060 - DNA, 22 bp, Artificial Sequence
  chemically synthesized
ctgactattctggggtttggat

SEQ ID NO: 867061 - DNA, 22 bp, Artificial Sequence
  chemically synthesized
tgactattctggggtttggatg

SEQ ID NO: 867062 - DNA, 22 bp, Artificial Sequence
  chemically synthesized
actattctggggtttggatgat

SEQ ID NO: 867063 - DNA, 22 bp, Artificial Sequence
  chemically synthesized
ttctggggtttggatgatggtg

SEQ ID NO: 867064 - DNA, 22 bp, Artificial Sequence
  chemically synthesized
tgagaagaggaccaccatcatc

SEQ ID NO: 867065 - DNA, 22 bp, Artificial Sequence
  chemically synthesized
tggggtttggatgatggtggtc

SEQ ID NO: 867066 - DNA, 22 bp, Artificial Sequence
  chemically synthesized
gggtttggatgatggtggtcct

SEQ ID NO: 867067 - DNA, 22 bp, Artificial Sequence
  chemically synthesized
gtggagctgtgagaagaggacc

SEQ ID NO: 867068 - DNA, 22 bp, Artificial Sequence
  chemically synthesized
ggatgatggtggtcctcttctc

SEQ ID NO: 867069 - DNA, 22 bp, Artificial Sequence
  chemically synthesized
gatgatggtggtcctcttctca

SEQ ID NO: 867070 - DNA, 22 bp, Artificial Sequence
  chemically synthesized
cctagtggagctgtgagaagag

SEQ ID NO: 867071 - DNA, 22 bp, Artificial Sequence
  chemically synthesized
gggcactgcctagtggagctgt

SEQ ID NO: 867072 - DNA, 22 bp, Artificial Sequence
  chemically synthesized
ttctcacagctccactaggcag

SEQ ID NO: 867073 - DNA, 22 bp, Artificial Sequence
  chemically synthesized
ctcacagctccactaggcagtg

SEQ ID NO: 867074 - DNA, 22 bp, Artificial Sequence
  chemically synthesized
tcacagctccactaggcagtgc

SEQ ID NO: 867075 - DNA, 22 bp, Artificial Sequence
  chemically synthesized
acagctccactaggcagtgccc

SEQ ID NO: 867076 - DNA, 22 bp, Artificial Sequence
  chemically synthesized
cacacagagtccccactggggc

SEQ ID NO: 867077 - DNA, 22 bp, Artificial Sequence
  chemically synthesized
cactaggcagtgccccagtggg

SEQ ID NO: 867078 - DNA, 22 bp, Artificial Sequence
  chemically synthesized
ggcagtgccccagtggggactc

SEQ ID NO: 867079 - DNA, 22 bp, Artificial Sequence
  chemically synthesized
tgtgtggagctccgaccccaca

SEQ ID NO: 867080 - DNA, 22 bp, Artificial Sequence
  chemically synthesized
tgtggagctccgaccccacatt

SEQ ID NO: 867081 - DNA, 22 bp, Artificial Sequence
  chemically synthesized
ggacagtgcagaaggaaaatgt

SEQ ID NO: 867082 - DNA, 22 bp, Artificial Sequence
  chemically synthesized
ctgggacagtgcagaaggaaaa

SEQ ID NO: 867083 - DNA, 22 bp, Artificial Sequence
  chemically synthesized
cgaccccacattttccttctgc

SEQ ID NO: 867084 - DNA, 22 bp, Artificial Sequence
  chemically synthesized
tgctgggacagtgcagaaggaa

SEQ ID NO: 867085 - DNA, 22 bp, Artificial Sequence
  chemically synthesized
tctgctgggacagtgcagaagg

SEQ ID NO: 867086 - DNA, 22 bp, Artificial Sequence
  chemically synthesized
tccttctgcactgtcccagcag

SEQ ID NO: 867087 - DNA, 22 bp, Artificial Sequence
  chemically synthesized
ccttctgcactgtcccagcaga

SEQ ID NO: 867088 - DNA, 22 bp, Artificial Sequence
  chemically synthesized
atggaaaacctctctgctggga

SEQ ID NO: 867089 - DNA, 22 bp, Artificial Sequence
  chemically synthesized
cttctgcactgtcccagcagag

SEQ ID NO: 867090 - DNA, 22 bp, Artificial Sequence
  chemically synthesized
ctgcactgtcccagcagagagg

SEQ ID NO: 867091 - DNA, 22 bp, Artificial Sequence
  chemically synthesized
tgcactgtcccagcagagaggt

SEQ ID NO: 867092 - DNA, 22 bp, Artificial Sequence
  chemically synthesized
cactgtcccagcagagaggttt

SEQ ID NO: 867093 - DNA, 22 bp, Artificial Sequence
  chemically synthesized
tcccagcagagaggttttccat

SEQ ID NO: 867094 - DNA, 22 bp, Artificial Sequence
  chemically synthesized
caggggcagggccctcatggaa

SEQ ID NO: 867095 - DNA, 22 bp, Artificial Sequence
  chemically synthesized
ctgcaggggcagggccctcatg

SEQ ID NO: 867096 - DNA, 22 bp, Artificial Sequence
  chemically synthesized
gctgcaggggcagggccctcat

SEQ ID NO: 867097 - DNA, 22 bp, Artificial Sequence
  chemically synthesized
tccatgagggccctgcccctgc

SEQ ID NO: 867098 - DNA, 22 bp, Artificial Sequence
  chemically synthesized
ccatgagggccctgcccctgca

SEQ ID NO: 867099 - DNA, 22 bp, Artificial Sequence
  chemically synthesized
catgagggccctgcccctgcag

SEQ ID NO: 867100 - DNA, 22 bp, Artificial Sequence
  chemically synthesized
ggtgtccaggcagaagtttgct

SEQ ID NO: 867101 - DNA, 22 bp, Artificial Sequence
  chemically synthesized
cccctgcagcaaacttctgcct

SEQ ID NO: 867102 - DNA, 22 bp, Artificial Sequence
  chemically synthesized
cagcaaacttctgcctggacac

SEQ ID NO: 867103 - DNA, 22 bp, Artificial Sequence
  chemically synthesized
ctgcctggacacctaggctttt

SEQ ID NO: 867104 - DNA, 22 bp, Artificial Sequence
  chemically synthesized
tgcctggacacctaggcttttc

SEQ ID NO: 867105 - DNA, 22 bp, Artificial Sequence
  chemically synthesized
agaggatgtatggaaaagccta

SEQ ID NO: 867106 - DNA, 22 bp, Artificial Sequence
  chemically synthesized
cctggacacctaggcttttcca

SEQ ID NO: 867107 - DNA, 22 bp, Artificial Sequence
  chemically synthesized
gacacctaggcttttccataca

SEQ ID NO: 867108 - DNA, 22 bp, Artificial Sequence
  chemically synthesized
gaattcagaggatgtatggaaa

SEQ ID NO: 867109 - DNA, 22 bp, Artificial Sequence
  chemically synthesized
cctagaattcagaggatgtatg

SEQ ID NO: 867110 - DNA, 22 bp, Artificial Sequence
  chemically synthesized
tgcctagaattcagaggatgta

SEQ ID NO: 867111 - DNA, 22 bp, Artificial Sequence
  chemically synthesized
ggcttttccatacatcctctga

SEQ ID NO: 867112 - DNA, 22 bp, Artificial Sequence
  chemically synthesized
ttccatacatcctctgaattct

SEQ ID NO: 867113 - DNA, 22 bp, Artificial Sequence
  chemically synthesized
caacctctgcctagaattcaga

SEQ ID NO: 867114 - DNA, 22 bp, Artificial Sequence
  chemically synthesized
tccatacatcctctgaattcta

SEQ ID NO: 867115 - DNA, 22 bp, Artificial Sequence
  chemically synthesized
gcaacctctgcctagaattcag

SEQ ID NO: 867116 - DNA, 22 bp, Artificial Sequence
  chemically synthesized
ccatacatcctctgaattctag

SEQ ID NO: 867117 - DNA, 22 bp, Artificial Sequence
  chemically synthesized
catacatcctctgaattctagg

SEQ ID NO: 867118 - DNA, 22 bp, Artificial Sequence
  chemically synthesized
aggtttgcaacctctgcctaga

SEQ ID NO: 867119 - DNA, 22 bp, Artificial Sequence
  chemically synthesized
tgaattctaggcagaggttgca

SEQ ID NO: 867120 - DNA, 22 bp, Artificial Sequence
  chemically synthesized
aattctaggcagaggttgcaaa

SEQ ID NO: 867121 - DNA, 22 bp, Artificial Sequence
  chemically synthesized
taggcagaggttgcaaacctca

SEQ ID NO: 867122 - DNA, 22 bp, Artificial Sequence
  chemically synthesized
ggcagaggttgcaaacctcaat

SEQ ID NO: 867123 - DNA, 22 bp, Artificial Sequence
  chemically synthesized
gacagaagtcaagaattgaggt

SEQ ID NO: 867124 - DNA, 22 bp, Artificial Sequence
  chemically synthesized
gggttggacagaagtcaagaat

SEQ ID NO: 867125 - DNA, 22 bp, Artificial Sequence
  chemically synthesized
caaacctcaattcttgacttct

SEQ ID NO: 867126 - DNA, 22 bp, Artificial Sequence
  chemically synthesized
ggcctggggttggacagaagtc

SEQ ID NO: 867127 - DNA, 22 bp, Artificial Sequence
  chemically synthesized
aattcttgacttctgtccaacc

SEQ ID NO: 867128 - DNA, 22 bp, Artificial Sequence
  chemically synthesized
ttgacttctgtccaaccccagg

SEQ ID NO: 867129 - DNA, 22 bp, Artificial Sequence
  chemically synthesized
gacttctgtccaaccccaggcc

SEQ ID NO: 867130 - DNA, 22 bp, Artificial Sequence
  chemically synthesized
catgtggtgttgggcctggggt

SEQ ID NO: 867131 - DNA, 22 bp, Artificial Sequence
  chemically synthesized
acttctgtccaaccccaggccc

SEQ ID NO: 867132 - DNA, 22 bp, Artificial Sequence
  chemically synthesized
acatgtggtgttgggcctgggg

SEQ ID NO: 867133 - DNA, 22 bp, Artificial Sequence
  chemically synthesized
ctgtccaaccccaggcccaaca

SEQ ID NO: 867134 - DNA, 22 bp, Artificial Sequence
  chemically synthesized
tgtccaaccccaggcccaacac

SEQ ID NO: 867135 - DNA, 22 bp, Artificial Sequence
  chemically synthesized
tccaaccccaggcccaacacca

SEQ ID NO: 867136 - DNA, 22 bp, Artificial Sequence
  chemically synthesized
gtggcttacatgtggtgttggg

SEQ ID NO: 867137 - DNA, 22 bp, Artificial Sequence
  chemically synthesized
agtggcttacatgtggtgttgg

SEQ ID NO: 867138 - DNA, 22 bp, Artificial Sequence
  chemically synthesized
agagggtgcaggccttagtggc

SEQ ID NO: 867139 - DNA, 22 bp, Artificial Sequence
  chemically synthesized
cagagggtgcaggccttagtgg

SEQ ID NO: 867140 - DNA, 22 bp, Artificial Sequence
  chemically synthesized
cttcagagggtgcaggccttag

SEQ ID NO: 867141 - DNA, 22 bp, Artificial Sequence
  chemically synthesized
ttgcttcagagggtgcaggcct

SEQ ID NO: 867142 - DNA, 22 bp, Artificial Sequence
  chemically synthesized
aggctgttgcttcagagggtgc

SEQ ID NO: 867143 - DNA, 22 bp, Artificial Sequence
  chemically synthesized
aggcctgcaccctctgaagcaa

SEQ ID NO: 867144 - DNA, 22 bp, Artificial Sequence
  chemically synthesized
caccctctgaagcaacagcctg

SEQ ID NO: 867145 - DNA, 22 bp, Artificial Sequence
  chemically synthesized
tgaagcaacagcctgagctgta

SEQ ID NO: 867146 - DNA, 22 bp, Artificial Sequence
  chemically synthesized
aaagaagccaaagtacagctca

SEQ ID NO: 867147 - DNA, 22 bp, Artificial Sequence
  chemically synthesized
aagcaacagcctgagctgtact

SEQ ID NO: 867148 - DNA, 22 bp, Artificial Sequence
  chemically synthesized
tggctcaaagaagccaaagtac

SEQ ID NO: 867149 - DNA, 22 bp, Artificial Sequence
  chemically synthesized
agctgtactttggcttctttga

SEQ ID NO: 867150 - DNA, 22 bp, Artificial Sequence
  chemically synthesized
cataccagctgtggctcaaaga

SEQ ID NO: 867151 - DNA, 22 bp, Artificial Sequence
  chemically synthesized
tactttggcttctttgagccac

SEQ ID NO: 867152 - DNA, 22 bp, Artificial Sequence
  chemically synthesized
tggcttctttgagccacagctg

SEQ ID NO: 867153 - DNA, 22 bp, Artificial Sequence
  chemically synthesized
ggcttctttgagccacagctgg

SEQ ID NO: 867154 - DNA, 22 bp, Artificial Sequence
  chemically synthesized
gtgccctgcataccagctgtgg

SEQ ID NO: 867155 - DNA, 22 bp, Artificial Sequence
  chemically synthesized
gcttctttgagccacagctggt

SEQ ID NO: 867156 - DNA, 22 bp, Artificial Sequence
  chemically synthesized
cgtgccctgcataccagctgtg

SEQ ID NO: 867157 - DNA, 22 bp, Artificial Sequence
  chemically synthesized
ctttgagccacagctggtatgc

SEQ ID NO: 867158 - DNA, 22 bp, Artificial Sequence
  chemically synthesized
tttgagccacagctggtatgca

SEQ ID NO: 867159 - DNA, 22 bp, Artificial Sequence
  chemically synthesized
tgagccacagctggtatgcagg

SEQ ID NO: 867160 - DNA, 22 bp, Artificial Sequence
  chemically synthesized
aggacttcgtgccctgcatacc

SEQ ID NO: 867161 - DNA, 22 bp, Artificial Sequence
  chemically synthesized
gagccacagctggtatgcaggg

SEQ ID NO: 867162 - DNA, 22 bp, Artificial Sequence
  chemically synthesized
agccacagctggtatgcagggc

SEQ ID NO: 867163 - DNA, 22 bp, Artificial Sequence
  chemically synthesized
tggagtctcaggacttcgtgcc

SEQ ID NO: 867164 - DNA, 22 bp, Artificial Sequence
  chemically synthesized
gtggagtctcaggacttcgtgc

SEQ ID NO: 867165 - DNA, 22 bp, Artificial Sequence
  chemically synthesized
tgtggagtctcaggacttcgtg

SEQ ID NO: 867166 - DNA, 22 bp, Artificial Sequence
  chemically synthesized
gtatgcagggcacgaagtcctg

SEQ ID NO: 867167 - DNA, 22 bp, Artificial Sequence
  chemically synthesized
ctttgtggagtctcaggacttc

SEQ ID NO: 867168 - DNA, 22 bp, Artificial Sequence
  chemically synthesized
agactccacaaagcagcacggc

SEQ ID NO: 867169 - DNA, 22 bp, Artificial Sequence
  chemically synthesized
acgggccaggcacagggccgtg

SEQ ID NO: 867170 - DNA, 22 bp, Artificial Sequence
  chemically synthesized
cacgggccaggcacagggccgt

SEQ ID NO: 867171 - DNA, 22 bp, Artificial Sequence
  chemically synthesized
cacaaagcagcacggccctgtg

SEQ ID NO: 867172 - DNA, 22 bp, Artificial Sequence
  chemically synthesized
aaaggaaaacatggtttcacgg

SEQ ID NO: 867173 - DNA, 22 bp, Artificial Sequence
  chemically synthesized
tgcctggcccgtgaaaccatgt

SEQ ID NO: 867174 - DNA, 22 bp, Artificial Sequence
  chemically synthesized
gcccgtgaaaccatgttttcct

SEQ ID NO: 867175 - DNA, 22 bp, Artificial Sequence
  chemically synthesized
ccatcacaagcccagaggccta

SEQ ID NO: 867176 - DNA, 22 bp, Artificial Sequence
  chemically synthesized
tccttttaggcctctgggcttg

SEQ ID NO: 867177 - DNA, 22 bp, Artificial Sequence
  chemically synthesized
ccttttaggcctctgggcttgt

SEQ ID NO: 867178 - DNA, 22 bp, Artificial Sequence
  chemically synthesized
cttttaggcctctgggcttgtg

SEQ ID NO: 867179 - DNA, 22 bp, Artificial Sequence
  chemically synthesized
ttaggcctctgggcttgtgatg

SEQ ID NO: 867180 - DNA, 22 bp, Artificial Sequence
  chemically synthesized
taggcctctgggcttgtgatgg

SEQ ID NO: 867181 - DNA, 22 bp, Artificial Sequence
  chemically synthesized
aggcctctgggcttgtgatggg

SEQ ID NO: 867182 - DNA, 22 bp, Artificial Sequence
  chemically synthesized
atggcagcccctcccatcacaa

SEQ ID NO: 867183 - DNA, 22 bp, Artificial Sequence
  chemically synthesized
ggcctctgggcttgtgatggga

SEQ ID NO: 867184 - DNA, 22 bp, Artificial Sequence
  chemically synthesized
aatggcagcccctcccatcaca

SEQ ID NO: 867185 - DNA, 22 bp, Artificial Sequence
  chemically synthesized
tgggcttgtgatgggaggggct

SEQ ID NO: 867186 - DNA, 22 bp, Artificial Sequence
  chemically synthesized
ggcttgtgatgggaggggctgc

SEQ ID NO: 867187 - DNA, 22 bp, Artificial Sequence
  chemically synthesized
gtgatgggaggggctgccatta

SEQ ID NO: 867188 - DNA, 22 bp, Artificial Sequence
  chemically synthesized
tgatgggaggggctgccattaa

SEQ ID NO: 867189 - DNA, 22 bp, Artificial Sequence
  chemically synthesized
cagggcatgtcagaggtcttaa

SEQ ID NO: 867190 - DNA, 22 bp, Artificial Sequence
  chemically synthesized
ccattaagacctctgacatgcc

SEQ ID NO: 867191 - DNA, 22 bp, Artificial Sequence
  chemically synthesized
agacctctgacatgccctggag

SEQ ID NO: 867192 - DNA, 22 bp, Artificial Sequence
  chemically synthesized
tgacatgccctggagacatctt

SEQ ID NO: 867193 - DNA, 22 bp, Artificial Sequence
  chemically synthesized
acatgccctggagacatcttcc

SEQ ID NO: 867194 - DNA, 22 bp, Artificial Sequence
  chemically synthesized
agcgccaagacaatggggaaga

SEQ ID NO: 867195 - DNA, 22 bp, Artificial Sequence
  chemically synthesized
gagacatcttccccattgtctt

SEQ ID NO: 867196 - DNA, 22 bp, Artificial Sequence
  chemically synthesized
ccccattgtcttggcgcttaac

SEQ ID NO: 867197 - DNA, 22 bp, Artificial Sequence
  chemically synthesized
cccattgtcttggcgcttaaca

SEQ ID NO: 867198 - DNA, 22 bp, Artificial Sequence
  chemically synthesized
agtaaaggagccaaatgttaag

SEQ ID NO: 867199 - DNA, 22 bp, Artificial Sequence
  chemically synthesized
aagtaaaggagccaaatgttaa

SEQ ID NO: 867200 - DNA, 22 bp, Artificial Sequence
  chemically synthesized
tcttggcgcttaacatttggct

SEQ ID NO: 867201 - DNA, 22 bp, Artificial Sequence
  chemically synthesized
cttaagtaaaggagccaaatgt

SEQ ID NO: 867202 - DNA, 22 bp, Artificial Sequence
  chemically synthesized
gcttaagtaaaggagccaaatg

SEQ ID NO: 867203 - DNA, 22 bp, Artificial Sequence
  chemically synthesized
tgcttaagtaaaggagccaaat

SEQ ID NO: 867204 - DNA, 22 bp, Artificial Sequence
  chemically synthesized
ggcgcttaacatttggctcctt

SEQ ID NO: 867205 - DNA, 22 bp, Artificial Sequence
  chemically synthesized
gcgcttaacatttggctccttt

SEQ ID NO: 867206 - DNA, 22 bp, Artificial Sequence
  chemically synthesized
cagaactttgcttaagtaaagg

SEQ ID NO: 867207 - DNA, 22 bp, Artificial Sequence
  chemically synthesized
aacatttggctcctttacttaa

SEQ ID NO: 867208 - DNA, 22 bp, Artificial Sequence
  chemically synthesized
acatttggctcctttacttaag

SEQ ID NO: 867209 - DNA, 22 bp, Artificial Sequence
  chemically synthesized
gctgcagaactttgcttaagta

SEQ ID NO: 867210 - DNA, 22 bp, Artificial Sequence
  chemically synthesized
ggctcctttacttaagcaaagt

SEQ ID NO: 867211 - DNA, 22 bp, Artificial Sequence
  chemically synthesized
gctcctttacttaagcaaagtt

SEQ ID NO: 867212 - DNA, 22 bp, Artificial Sequence
  chemically synthesized
ctttacttaagcaaagttctgc

SEQ ID NO: 867213 - DNA, 22 bp, Artificial Sequence
  chemically synthesized
tacttaagcaaagttctgcagc

SEQ ID NO: 867214 - DNA, 22 bp, Artificial Sequence
  chemically synthesized
acttaagcaaagttctgcagcc

SEQ ID NO: 867215 - DNA, 22 bp, Artificial Sequence
  chemically synthesized
cttaagcaaagttctgcagcca

SEQ ID NO: 867216 - DNA, 22 bp, Artificial Sequence
  chemically synthesized
agaaatacaagctggctgcaga

SEQ ID NO: 867217 - DNA, 22 bp, Artificial Sequence
  chemically synthesized
tgagaaatacaagctggctgca

SEQ ID NO: 867218 - DNA, 22 bp, Artificial Sequence
  chemically synthesized
aagcaaagttctgcagccagct

SEQ ID NO: 867219 - DNA, 22 bp, Artificial Sequence
  chemically synthesized
ctgagaaatacaagctggctgc

SEQ ID NO: 867220 - DNA, 22 bp, Artificial Sequence
  chemically synthesized
agcaaagttctgcagccagctt

SEQ ID NO: 867221 - DNA, 22 bp, Artificial Sequence
  chemically synthesized
tctgagaaatacaagctggctg

SEQ ID NO: 867222 - DNA, 22 bp, Artificial Sequence
  chemically synthesized
tgcagccagcttgtatttctca

SEQ ID NO: 867223 - DNA, 22 bp, Artificial Sequence
  chemically synthesized
cagccagcttgtatttctcaga

SEQ ID NO: 867224 - DNA, 22 bp, Artificial Sequence
  chemically synthesized
gtatttctcagaaaatgggttt

SEQ ID NO: 867225 - DNA, 22 bp, Artificial Sequence
  chemically synthesized
tatttctcagaaaatgggtttt

SEQ ID NO: 867226 - DNA, 22 bp, Artificial Sequence
  chemically synthesized
ctcagaaaatgggtttttcttt

SEQ ID NO: 867227 - DNA, 22 bp, Artificial Sequence
  chemically synthesized
tcagaaaatgggtttttctttt

SEQ ID NO: 867228 - DNA, 22 bp, Artificial Sequence
  chemically synthesized
acaatgtgatagaaaagaaaaa

SEQ ID NO: 867229 - DNA, 22 bp, Artificial Sequence
  chemically synthesized
agaaaatgggtttttcttttct

SEQ ID NO: 867230 - DNA, 22 bp, Artificial Sequence
  chemically synthesized
cagcctaacaatgtgatagaaa

SEQ ID NO: 867231 - DNA, 22 bp, Artificial Sequence
  chemically synthesized
ttcttttctatcacattgttag

SEQ ID NO: 867232 - DNA, 22 bp, Artificial Sequence
  chemically synthesized
tcttttctatcacattgttagg

SEQ ID NO: 867233 - DNA, 22 bp, Artificial Sequence
  chemically synthesized
gaaaatctgcagcctaacaatg

SEQ ID NO: 867234 - DNA, 22 bp, Artificial Sequence
  chemically synthesized
cttttctatcacattgttaggc

SEQ ID NO: 867235 - DNA, 22 bp, Artificial Sequence
  chemically synthesized
ggaaaatctgcagcctaacaat

SEQ ID NO: 867236 - DNA, 22 bp, Artificial Sequence
  chemically synthesized
ttttctatcacattgttaggct

SEQ ID NO: 867237 - DNA, 22 bp, Artificial Sequence
  chemically synthesized
ttctatcacattgttaggctgc

SEQ ID NO: 867238 - DNA, 22 bp, Artificial Sequence
  chemically synthesized
tctatcacattgttaggctgca

SEQ ID NO: 867239 - DNA, 22 bp, Artificial Sequence
  chemically synthesized
ctatcacattgttaggctgcag

SEQ ID NO: 867240 - DNA, 22 bp, Artificial Sequence
  chemically synthesized
tatcacattgttaggctgcaga

SEQ ID NO: 867241 - DNA, 22 bp, Artificial Sequence
  chemically synthesized
tcacattgttaggctgcagatt

SEQ ID NO: 867242 - DNA, 22 bp, Artificial Sequence
  chemically synthesized
ttaggctgcagattttccaaac

SEQ ID NO: 867243 - DNA, 22 bp, Artificial Sequence
  chemically synthesized
ggctgcagattttccaaacttt

SEQ ID NO: 867244 - DNA, 22 bp, Artificial Sequence
  chemically synthesized
cagattttccaaactttgatgc

SEQ ID NO: 867245 - DNA, 22 bp, Artificial Sequence
  chemically synthesized
aagggaagcagagcatcaaagt

SEQ ID NO: 867246 - DNA, 22 bp, Artificial Sequence
  chemically synthesized
aaagggaagcagagcatcaaag

SEQ ID NO: 867247 - DNA, 22 bp, Artificial Sequence
  chemically synthesized
taaagggaagcagagcatcaaa

SEQ ID NO: 867248 - DNA, 22 bp, Artificial Sequence
  chemically synthesized
ttttaaagggaagcagagcatc

SEQ ID NO: 867249 - DNA, 22 bp, Artificial Sequence
  chemically synthesized
gttttaaagggaagcagagcat

SEQ ID NO: 867250 - DNA, 22 bp, Artificial Sequence
  chemically synthesized
tccaaactttgatgctctgctt

SEQ ID NO: 867251 - DNA, 22 bp, Artificial Sequence
  chemically synthesized
tgttttaaagggaagcagagca

SEQ ID NO: 867252 - DNA, 22 bp, Artificial Sequence
  chemically synthesized
ccaaactttgatgctctgcttc

SEQ ID NO: 867253 - DNA, 22 bp, Artificial Sequence
  chemically synthesized
caaactttgatgctctgcttcc

SEQ ID NO: 867254 - DNA, 22 bp, Artificial Sequence
  chemically synthesized
gaactttgttttaaagggaagc

SEQ ID NO: 867255 - DNA, 22 bp, Artificial Sequence
  chemically synthesized
tgatgctctgcttccctttaaa

SEQ ID NO: 867256 - DNA, 22 bp, Artificial Sequence
  chemically synthesized
gatgctctgcttccctttaaaa

SEQ ID NO: 867257 - DNA, 22 bp, Artificial Sequence
  chemically synthesized
atgctctgcttccctttaaaac

SEQ ID NO: 867258 - DNA, 22 bp, Artificial Sequence
  chemically synthesized
aaattggaactttgttttaaag

SEQ ID NO: 867259 - DNA, 22 bp, Artificial Sequence
  chemically synthesized
tgcttccctttaaaacaaagtt

SEQ ID NO: 867260 - DNA, 22 bp, Artificial Sequence
  chemically synthesized
cttccctttaaaacaaagttcc

SEQ ID NO: 867261 - DNA, 22 bp, Artificial Sequence
  chemically synthesized
ccctttaaaacaaagttccaat

SEQ ID NO: 867262 - DNA, 22 bp, Artificial Sequence
  chemically synthesized
cctttaaaacaaagttccaatt

SEQ ID NO: 867263 - DNA, 22 bp, Artificial Sequence
  chemically synthesized
agagagatgatctgaaattgga

SEQ ID NO: 867264 - DNA, 22 bp, Artificial Sequence
  chemically synthesized
taaaacaaagttccaatttcag

SEQ ID NO: 867265 - DNA, 22 bp, Artificial Sequence
  chemically synthesized
gagagagatgatctgaaattgg

SEQ ID NO: 867266 - DNA, 22 bp, Artificial Sequence
  chemically synthesized
aaaacaaagttccaatttcaga

SEQ ID NO: 867267 - DNA, 22 bp, Artificial Sequence
  chemically synthesized
aaacaaagttccaatttcagat

SEQ ID NO: 867268 - DNA, 22 bp, Artificial Sequence
  chemically synthesized
aacttgagagagatgatctgaa

SEQ ID NO: 867269 - DNA, 22 bp, Artificial Sequence
  chemically synthesized
gaacttgagagagatgatctga

SEQ ID NO: 867270 - DNA, 22 bp, Artificial Sequence
  chemically synthesized
caatttcagatcatctctctca

SEQ ID NO: 867271 - DNA, 22 bp, Artificial Sequence
  chemically synthesized
tggaaatttgaacttgagagag

SEQ ID NO: 867272 - DNA, 22 bp, Artificial Sequence
  chemically synthesized
cagatcatctctctcaagttca

SEQ ID NO: 867273 - DNA, 22 bp, Artificial Sequence
  chemically synthesized
agatcatctctctcaagttcaa

SEQ ID NO: 867274 - DNA, 22 bp, Artificial Sequence
  chemically synthesized
gagatctgtggaaatttgaact

SEQ ID NO: 867275 - DNA, 22 bp, Artificial Sequence
  chemically synthesized
gcctagagatctgtggaaattt

SEQ ID NO: 867276 - DNA, 22 bp, Artificial Sequence
  chemically synthesized
tctcaagttcaaatttccacag

SEQ ID NO: 867277 - DNA, 22 bp, Artificial Sequence
  chemically synthesized
tcaagttcaaatttccacagat

SEQ ID NO: 867278 - DNA, 22 bp, Artificial Sequence
  chemically synthesized
ccctggcctagagatctgtgga

SEQ ID NO: 867279 - DNA, 22 bp, Artificial Sequence
  chemically synthesized
aagttcaaatttccacagatct

SEQ ID NO: 867280 - DNA, 22 bp, Artificial Sequence
  chemically synthesized
cccctggcctagagatctgtgg

SEQ ID NO: 867281 - DNA, 22 bp, Artificial Sequence
  chemically synthesized
tcccctggcctagagatctgtg

SEQ ID NO: 867282 - DNA, 22 bp, Artificial Sequence
  chemically synthesized
aaatttccacagatctctaggc

SEQ ID NO: 867283 - DNA, 22 bp, Artificial Sequence
  chemically synthesized
gcagcattttcccctggcctag

SEQ ID NO: 867284 - DNA, 22 bp, Artificial Sequence
  chemically synthesized
ccacagatctctaggccagggg

SEQ ID NO: 867285 - DNA, 22 bp, Artificial Sequence
  chemically synthesized
cacagatctctaggccagggga

SEQ ID NO: 867286 - DNA, 22 bp, Artificial Sequence
  chemically synthesized
gcaaagagactggcagcatttt

SEQ ID NO: 867287 - DNA, 22 bp, Artificial Sequence
  chemically synthesized
taggccaggggaaaatgctgcc

SEQ ID NO: 867288 - DNA, 22 bp, Artificial Sequence
  chemically synthesized
agcaaagagactggcagcattt

SEQ ID NO: 867289 - DNA, 22 bp, Artificial Sequence
  chemically synthesized
tagcaaagagactggcagcatt

SEQ ID NO: 867290 - DNA, 22 bp, Artificial Sequence
  chemically synthesized
ggccaggggaaaatgctgccag

SEQ ID NO: 867291 - DNA, 22 bp, Artificial Sequence
  chemically synthesized
agctttagcaaagagactggca

SEQ ID NO: 867292 - DNA, 22 bp, Artificial Sequence
  chemically synthesized
ctaagctttagcaaagagactg

SEQ ID NO: 867293 - DNA, 22 bp, Artificial Sequence
  chemically synthesized
ttgctaagctttagcaaagaga

SEQ ID NO: 867294 - DNA, 22 bp, Artificial Sequence
  chemically synthesized
ccagtctctttgctaaagctta

SEQ ID NO: 867295 - DNA, 22 bp, Artificial Sequence
  chemically synthesized
gagcaaaggacactgttgctaa

SEQ ID NO: 867296 - DNA, 22 bp, Artificial Sequence
  chemically synthesized
tttgctaaagcttagcaacagt

SEQ ID NO: 867297 - DNA, 22 bp, Artificial Sequence
  chemically synthesized
tgctaaagcttagcaacagtgt

SEQ ID NO: 867298 - DNA, 22 bp, Artificial Sequence
  chemically synthesized
gctaaagcttagcaacagtgtc

SEQ ID NO: 867299 - DNA, 22 bp, Artificial Sequence
  chemically synthesized
ctaaagcttagcaacagtgtcc

SEQ ID NO: 867300 - DNA, 22 bp, Artificial Sequence
  chemically synthesized
ggaactggagcaaaggacactg

SEQ ID NO: 867301 - DNA, 22 bp, Artificial Sequence
  chemically synthesized
aagcttagcaacagtgtccttt

SEQ ID NO: 867302 - DNA, 22 bp, Artificial Sequence
  chemically synthesized
gggaactggagcaaaggacact

SEQ ID NO: 867303 - DNA, 22 bp, Artificial Sequence
  chemically synthesized
ttgggaactggagcaaaggaca

SEQ ID NO: 867304 - DNA, 22 bp, Artificial Sequence
  chemically synthesized
cttgggaactggagcaaaggac

SEQ ID NO: 867305 - DNA, 22 bp, Artificial Sequence
  chemically synthesized
agcaacagtgtcctttgctcca

SEQ ID NO: 867306 - DNA, 22 bp, Artificial Sequence
  chemically synthesized
gcaacagtgtcctttgctccag

SEQ ID NO: 867307 - DNA, 22 bp, Artificial Sequence
  chemically synthesized
ggaacttcttgggaactggagc

SEQ ID NO: 867308 - DNA, 22 bp, Artificial Sequence
  chemically synthesized
tgctccagttcccaagaagttc

SEQ ID NO: 867309 - DNA, 22 bp, Artificial Sequence
  chemically synthesized
gctccagttcccaagaagttcc

SEQ ID NO: 867310 - DNA, 22 bp, Artificial Sequence
  chemically synthesized
agatggagattaggaacttctt

SEQ ID NO: 867311 - DNA, 22 bp, Artificial Sequence
  chemically synthesized
ctccagttcccaagaagttcct

SEQ ID NO: 867312 - DNA, 22 bp, Artificial Sequence
  chemically synthesized
cagttcccaagaagttcctaat

SEQ ID NO: 867313 - DNA, 22 bp, Artificial Sequence
  chemically synthesized
ccaagaagttcctaatctccat

SEQ ID NO: 867314 - DNA, 22 bp, Artificial Sequence
  chemically synthesized
aggtggtctcagatggagatta

SEQ ID NO: 867315 - DNA, 22 bp, Artificial Sequence
  chemically synthesized
ctaatctccatctgagaccacc

SEQ ID NO: 867316 - DNA, 22 bp, Artificial Sequence
  chemically synthesized
atctccatctgagaccacctca

SEQ ID NO: 867317 - DNA, 22 bp, Artificial Sequence
  chemically synthesized
catctgagaccacctcagcctg

SEQ ID NO: 867318 - DNA, 22 bp, Artificial Sequence
  chemically synthesized
agaccacctcagcctggacttc

SEQ ID NO: 867319 - DNA, 22 bp, Artificial Sequence
  chemically synthesized
agcctggacttcatcgtccaca

SEQ ID NO: 867320 - DNA, 22 bp, Artificial Sequence
  chemically synthesized
gacttcatcgtccacatcacca

SEQ ID NO: 867321 - DNA, 22 bp, Artificial Sequence
  chemically synthesized
accaaaatgccgatggtgatgt

SEQ ID NO: 867322 - DNA, 22 bp, Artificial Sequence
  chemically synthesized
gaccaaaatgccgatggtgatg

SEQ ID NO: 867323 - DNA, 22 bp, Artificial Sequence
  chemically synthesized
tgaccaaaatgccgatggtgat

SEQ ID NO: 867324 - DNA, 22 bp, Artificial Sequence
  chemically synthesized
catcgtccacatcaccatcggc

SEQ ID NO: 867325 - DNA, 22 bp, Artificial Sequence
  chemically synthesized
atcgtccacatcaccatcggca

SEQ ID NO: 867326 - DNA, 22 bp, Artificial Sequence
  chemically synthesized
aatggttttgaccaaaatgccg

SEQ ID NO: 867327 - DNA, 22 bp, Artificial Sequence
  chemically synthesized
ttgaatggttttgaccaaaatg

SEQ ID NO: 867328 - DNA, 22 bp, Artificial Sequence
  chemically synthesized
gttgaatggttttgaccaaaat

SEQ ID NO: 867329 - DNA, 22 bp, Artificial Sequence
  chemically synthesized
gagacttgttgaatggttttga

SEQ ID NO: 867330 - DNA, 22 bp, Artificial Sequence
  chemically synthesized
ctagagacttgttgaatggttt

SEQ ID NO: 867331 - DNA, 22 bp, Artificial Sequence
  chemically synthesized
cctagagacttgttgaatggtt

SEQ ID NO: 867332 - DNA, 22 bp, Artificial Sequence
  chemically synthesized
tggtcaaaaccattcaacaagt

SEQ ID NO: 867333 - DNA, 22 bp, Artificial Sequence
  chemically synthesized
ggtcaaaaccattcaacaagtc

SEQ ID NO: 867334 - DNA, 22 bp, Artificial Sequence
  chemically synthesized
aaacttcctagagacttgttga

SEQ ID NO: 867335 - DNA, 22 bp, Artificial Sequence
  chemically synthesized
gtcaaaaccattcaacaagtct

SEQ ID NO: 867336 - DNA, 22 bp, Artificial Sequence
  chemically synthesized
gaaacttcctagagacttgttg

SEQ ID NO: 867337 - DNA, 22 bp, Artificial Sequence
  chemically synthesized
aacaagtctctaggaagtttca

SEQ ID NO: 867338 - DNA, 22 bp, Artificial Sequence
  chemically synthesized
taggaagtttcaaattttccca

SEQ ID NO: 867339 - DNA, 22 bp, Artificial Sequence
  chemically synthesized
ggaagtttcaaattttcccaca

SEQ ID NO: 867340 - DNA, 22 bp, Artificial Sequence
  chemically synthesized
gaagatgacaggaaaatgtggg

SEQ ID NO: 867341 - DNA, 22 bp, Artificial Sequence
  chemically synthesized
caaattttcccacattttcctg

SEQ ID NO: 867342 - DNA, 22 bp, Artificial Sequence
  chemically synthesized
aaattttcccacattttcctgt

SEQ ID NO: 867343 - DNA, 22 bp, Artificial Sequence
  chemically synthesized
gagggctagaagatgacaggaa

SEQ ID NO: 867344 - DNA, 22 bp, Artificial Sequence
  chemically synthesized
ggagggctagaagatgacagga

SEQ ID NO: 867345 - DNA, 22 bp, Artificial Sequence
  chemically synthesized
tcccacattttcctgtcatctt

SEQ ID NO: 867346 - DNA, 22 bp, Artificial Sequence
  chemically synthesized
cccacattttcctgtcatcttc

SEQ ID NO: 867347 - DNA, 22 bp, Artificial Sequence
  chemically synthesized
ccacattttcctgtcatcttct

SEQ ID NO: 867348 - DNA, 22 bp, Artificial Sequence
  chemically synthesized
gaacagtttggagggctagaag

SEQ ID NO: 867349 - DNA, 22 bp, Artificial Sequence
  chemically synthesized
tcctgtcatcttctagccctcc

SEQ ID NO: 867350 - DNA, 22 bp, Artificial Sequence
  chemically synthesized
cctgtcatcttctagccctcca

SEQ ID NO: 867351 - DNA, 22 bp, Artificial Sequence
  chemically synthesized
ctgtcatcttctagccctccaa

SEQ ID NO: 867352 - DNA, 22 bp, Artificial Sequence
  chemically synthesized
tcatcttctagccctccaaact

SEQ ID NO: 867353 - DNA, 22 bp, Artificial Sequence
  chemically synthesized
ctagccctccaaactgttccaa

SEQ ID NO: 867354 - DNA, 22 bp, Artificial Sequence
  chemically synthesized
tagccctccaaactgttccaac

SEQ ID NO: 867355 - DNA, 22 bp, Artificial Sequence
  chemically synthesized
gccctccaaactgttccaacct

SEQ ID NO: 867356 - DNA, 22 bp, Artificial Sequence
  chemically synthesized
ggtaagaggcacaggttggaac

SEQ ID NO: 867357 - DNA, 22 bp, Artificial Sequence
  chemically synthesized
caaactgttccaacctgtgcct

SEQ ID NO: 867358 - DNA, 22 bp, Artificial Sequence
  chemically synthesized
gaactgggtaagaggcacaggt

SEQ ID NO: 867359 - DNA, 22 bp, Artificial Sequence
  chemically synthesized
ggaactgggtaagaggcacagg

SEQ ID NO: 867360 - DNA, 22 bp, Artificial Sequence
  chemically synthesized
ttccaacctgtgcctcttaccc

SEQ ID NO: 867361 - DNA, 22 bp, Artificial Sequence
  chemically synthesized
caacctgtgcctcttacccagt

SEQ ID NO: 867362 - DNA, 22 bp, Artificial Sequence
  chemically synthesized
tgcctcttacccagttccaagt

SEQ ID NO: 867363 - DNA, 22 bp, Artificial Sequence
  chemically synthesized
aaaatgtggaagtgacttggaa

SEQ ID NO: 867364 - DNA, 22 bp, Artificial Sequence
  chemically synthesized
ttacccagttccaagtcacttc

SEQ ID NO: 867365 - DNA, 22 bp, Artificial Sequence
  chemically synthesized
acccagttccaagtcacttcca

SEQ ID NO: 867366 - DNA, 22 bp, Artificial Sequence
  chemically synthesized
cccagttccaagtcacttccac

SEQ ID NO: 867367 - DNA, 22 bp, Artificial Sequence
  chemically synthesized
taaatatacctgaaaatgtgga

SEQ ID NO: 867368 - DNA, 22 bp, Artificial Sequence
  chemically synthesized
caagtcacttccacattttcag

SEQ ID NO: 867369 - DNA, 22 bp, Artificial Sequence
  chemically synthesized
ctgtaaatatacctgaaaatgt

SEQ ID NO: 867370 - DNA, 22 bp, Artificial Sequence
  chemically synthesized
ccacattttcaggtatatttac

SEQ ID NO: 867371 - DNA, 22 bp, Artificial Sequence
  chemically synthesized
cacattttcaggtatatttaca

SEQ ID NO: 867372 - DNA, 22 bp, Artificial Sequence
  chemically synthesized
cagagagtggggtattgctgta

SEQ ID NO: 867373 - DNA, 22 bp, Artificial Sequence
  chemically synthesized
tcaggtatatttacagcaatac

SEQ ID NO: 867374 - DNA, 22 bp, Artificial Sequence
  chemically synthesized
caggtatatttacagcaatacc

SEQ ID NO: 867375 - DNA, 22 bp, Artificial Sequence
  chemically synthesized
aggtatatttacagcaataccc

SEQ ID NO: 867376 - DNA, 22 bp, Artificial Sequence
  chemically synthesized
gtactgcagagagtggggtatt

SEQ ID NO: 867377 - DNA, 22 bp, Artificial Sequence
  chemically synthesized
acagcaataccccactctctgc

SEQ ID NO: 867378 - DNA, 22 bp, Artificial Sequence
  chemically synthesized
cagcaataccccactctctgca

SEQ ID NO: 867379 - DNA, 22 bp, Artificial Sequence
  chemically synthesized
atacagtaaattggtactgcag

SEQ ID NO: 867380 - DNA, 22 bp, Artificial Sequence
  chemically synthesized
tctgcagtaccaatttactgta

SEQ ID NO: 867381 - DNA, 22 bp, Artificial Sequence
  chemically synthesized
tgcagtaccaatttactgtatt

SEQ ID NO: 867382 - DNA, 22 bp, Artificial Sequence
  chemically synthesized
cagtaccaatttactgtattag

SEQ ID NO: 867383 - DNA, 22 bp, Artificial Sequence
  chemically synthesized
atagcagcatgagaacggacta

SEQ ID NO: 867384 - DNA, 22 bp, Artificial Sequence
  chemically synthesized
catagcagcatgagaacggact

SEQ ID NO: 867385 - DNA, 22 bp, Artificial Sequence
  chemically synthesized
ttcatagcagcatgagaacgga

SEQ ID NO: 867386 - DNA, 22 bp, Artificial Sequence
  chemically synthesized
cttcatagcagcatgagaacgg

SEQ ID NO: 867387 - DNA, 22 bp, Artificial Sequence
  chemically synthesized
actgtattagtccgttctcatg

SEQ ID NO: 867388 - DNA, 22 bp, Artificial Sequence
  chemically synthesized
ctgtattagtccgttctcatgc

SEQ ID NO: 867389 - DNA, 22 bp, Artificial Sequence
  chemically synthesized
tattagtccgttctcatgctgc

SEQ ID NO: 867390 - DNA, 22 bp, Artificial Sequence
  chemically synthesized
ggtatttcttcatagcagcatg

SEQ ID NO: 867391 - DNA, 22 bp, Artificial Sequence
  chemically synthesized
gggtatttcttcatagcagcat

SEQ ID NO: 867392 - DNA, 22 bp, Artificial Sequence
  chemically synthesized
gtccgttctcatgctgctatga

SEQ ID NO: 867393 - DNA, 22 bp, Artificial Sequence
  chemically synthesized
cccggtcttgggtatttcttca

SEQ ID NO: 867394 - DNA, 22 bp, Artificial Sequence
  chemically synthesized
tcatgctgctatgaagaaatac

SEQ ID NO: 867395 - DNA, 22 bp, Artificial Sequence
  chemically synthesized
atgctgctatgaagaaataccc

SEQ ID NO: 867396 - DNA, 22 bp, Artificial Sequence
  chemically synthesized
taaattacccggtcttgggtat

SEQ ID NO: 867397 - DNA, 22 bp, Artificial Sequence
  chemically synthesized
ataaattacccggtcttgggta

SEQ ID NO: 867398 - DNA, 22 bp, Artificial Sequence
  chemically synthesized
ctatgaagaaatacccaagacc

SEQ ID NO: 867399 - DNA, 22 bp, Artificial Sequence
  chemically synthesized
tataaattacccggtcttgggt

SEQ ID NO: 867400 - DNA, 22 bp, Artificial Sequence
  chemically synthesized
tttataaattacccggtcttgg

SEQ ID NO: 867401 - DNA, 22 bp, Artificial Sequence
  chemically synthesized
tgaagaaatacccaagaccggg

SEQ ID NO: 867402 - DNA, 22 bp, Artificial Sequence
  chemically synthesized
ctttataaattacccggtcttg

SEQ ID NO: 867403 - DNA, 22 bp, Artificial Sequence
  chemically synthesized
tctttataaattacccggtctt

SEQ ID NO: 867404 - DNA, 22 bp, Artificial Sequence
  chemically synthesized
ttctttataaattacccggtct

SEQ ID NO: 867405 - DNA, 22 bp, Artificial Sequence
  chemically synthesized
ttttctttataaattacccggt

SEQ ID NO: 867406 - DNA, 22 bp, Artificial Sequence
  chemically synthesized
aacctcttttctttataaatta

SEQ ID NO: 867407 - DNA, 22 bp, Artificial Sequence
  chemically synthesized
ttaaacctcttttctttataaa

SEQ ID NO: 867408 - DNA, 22 bp, Artificial Sequence
  chemically synthesized
tgagtctattaaacctcttttc

SEQ ID NO: 867409 - DNA, 22 bp, Artificial Sequence
  chemically synthesized
ataaagaaaagaggtttaatag

SEQ ID NO: 867410 - DNA, 22 bp, Artificial Sequence
  chemically synthesized
taaagaaaagaggtttaataga

SEQ ID NO: 867411 - DNA, 22 bp, Artificial Sequence
  chemically synthesized
aagccatgcggaactgtgagtc

SEQ ID NO: 867412 - DNA, 22 bp, Artificial Sequence
  chemically synthesized
tgaagccatgcggaactgtgag

SEQ ID NO: 867413 - DNA, 22 bp, Artificial Sequence
  chemically synthesized
aatagactcacagttccgcatg

SEQ ID NO: 867414 - DNA, 22 bp, Artificial Sequence
  chemically synthesized
atagactcacagttccgcatgg

SEQ ID NO: 867415 - DNA, 22 bp, Artificial Sequence
  chemically synthesized
cggaggcctctgaagccatgcg

SEQ ID NO: 867416 - DNA, 22 bp, Artificial Sequence
  chemically synthesized
ccggaggcctctgaagccatgc

SEQ ID NO: 867417 - DNA, 22 bp, Artificial Sequence
  chemically synthesized
acagttccgcatggcttcagag

SEQ ID NO: 867418 - DNA, 22 bp, Artificial Sequence
  chemically synthesized
taagtttccggaggcctctgaa

SEQ ID NO: 867419 - DNA, 22 bp, Artificial Sequence
  chemically synthesized
cgcatggcttcagaggcctccg

SEQ ID NO: 867420 - DNA, 22 bp, Artificial Sequence
  chemically synthesized
catgattgtaagtttccggagg

SEQ ID NO: 867421 - DNA, 22 bp, Artificial Sequence
  chemically synthesized
ctccatgattgtaagtttccgg

SEQ ID NO: 867422 - DNA, 22 bp, Artificial Sequence
  chemically synthesized
cctccatgattgtaagtttccg

SEQ ID NO: 867423 - DNA, 22 bp, Artificial Sequence
  chemically synthesized
cagaggcctccggaaacttaca

SEQ ID NO: 867424 - DNA, 22 bp, Artificial Sequence
  chemically synthesized
agaggcctccggaaacttacaa

SEQ ID NO: 867425 - DNA, 22 bp, Artificial Sequence
  chemically synthesized
cggaaacttacaatcatggagg

SEQ ID NO: 867426 - DNA, 22 bp, Artificial Sequence
  chemically synthesized
tgaaaaggtgccttcctccatg

SEQ ID NO: 867427 - DNA, 22 bp, Artificial Sequence
  chemically synthesized
acaatcatggaggaaggcacct

SEQ ID NO: 867428 - DNA, 22 bp, Artificial Sequence
  chemically synthesized
caatcatggaggaaggcacctt

SEQ ID NO: 867429 - DNA, 22 bp, Artificial Sequence
  chemically synthesized
tcaccctgtgaaaaggtgcctt

SEQ ID NO: 867430 - DNA, 22 bp, Artificial Sequence
  chemically synthesized
ctatcaccctgtgaaaaggtgc

SEQ ID NO: 867431 - DNA, 22 bp, Artificial Sequence
  chemically synthesized
tcctatcaccctgtgaaaaggt

SEQ ID NO: 867432 - DNA, 22 bp, Artificial Sequence
  chemically synthesized
tctcctatcaccctgtgaaaag

SEQ ID NO: 867433 - DNA, 22 bp, Artificial Sequence
  chemically synthesized
tctctcctatcaccctgtgaaa

SEQ ID NO: 867434 - DNA, 22 bp, Artificial Sequence
  chemically synthesized
attctctctcctatcaccctgt

SEQ ID NO: 867435 - DNA, 22 bp, Artificial Sequence
  chemically synthesized
gcactcattctctctcctatca

SEQ ID NO: 867436 - DNA, 22 bp, Artificial Sequence
  chemically synthesized
ttcacagggtgataggagagag

SEQ ID NO: 867437 - DNA, 22 bp, Artificial Sequence
  chemically synthesized
ctggcactcattctctctccta

SEQ ID NO: 867438 - DNA, 22 bp, Artificial Sequence
  chemically synthesized
tcacagggtgataggagagaga

SEQ ID NO: 867439 - DNA, 22 bp, Artificial Sequence
  chemically synthesized
gctggcactcattctctctcct

SEQ ID NO: 867440 - DNA, 22 bp, Artificial Sequence
  chemically synthesized
cacagggtgataggagagagaa

SEQ ID NO: 867441 - DNA, 22 bp, Artificial Sequence
  chemically synthesized
acagggtgataggagagagaat

SEQ ID NO: 867442 - DNA, 22 bp, Artificial Sequence
  chemically synthesized
ccttgctggcactcattctctc

SEQ ID NO: 867443 - DNA, 22 bp, Artificial Sequence
  chemically synthesized
cccttgctggcactcattctct

SEQ ID NO: 867444 - DNA, 22 bp, Artificial Sequence
  chemically synthesized
gcatttcccttgctggcactca

SEQ ID NO: 867445 - DNA, 22 bp, Artificial Sequence
  chemically synthesized
taagcatctggcatttcccttg

SEQ ID NO: 867446 - DNA, 22 bp, Artificial Sequence
  chemically synthesized
ataagcatctggcatttccctt

SEQ ID NO: 867447 - DNA, 22 bp, Artificial Sequence
  chemically synthesized
tataagcatctggcatttccct

SEQ ID NO: 867448 - DNA, 22 bp, Artificial Sequence
  chemically synthesized
atggttttataagcatctggca

SEQ ID NO: 867449 - DNA, 22 bp, Artificial Sequence
  chemically synthesized
atgagatctgatggttttataa

SEQ ID NO: 867450 - DNA, 22 bp, Artificial Sequence
  chemically synthesized
tcatgagatctgatggttttat

SEQ ID NO: 867451 - DNA, 22 bp, Artificial Sequence
  chemically synthesized
ataaaaccatcagatctcatga

SEQ ID NO: 867452 - DNA, 22 bp, Artificial Sequence
  chemically synthesized
taaaaccatcagatctcatgag

SEQ ID NO: 867453 - DNA, 22 bp, Artificial Sequence
  chemically synthesized
tcgtgatagtgaatgagttctc

SEQ ID NO: 867454 - DNA, 22 bp, Artificial Sequence
  chemically synthesized
ttgtcgtgatagtgaatgagtt

SEQ ID NO: 867455 - DNA, 22 bp, Artificial Sequence
  chemically synthesized
atgagaactcattcactatcac

SEQ ID NO: 867456 - DNA, 22 bp, Artificial Sequence
  chemically synthesized
cccccatgctgttgtcgtgata

SEQ ID NO: 867457 - DNA, 22 bp, Artificial Sequence
  chemically synthesized
ccccccatgctgttgtcgtgat

SEQ ID NO: 867458 - DNA, 22 bp, Artificial Sequence
  chemically synthesized
tttccccccatgctgttgtcgt

SEQ ID NO: 867459 - DNA, 22 bp, Artificial Sequence
  chemically synthesized
gtttccccccatgctgttgtcg

SEQ ID NO: 867460 - DNA, 22 bp, Artificial Sequence
  chemically synthesized
attcactatcacgacaacagca

SEQ ID NO: 867461 - DNA, 22 bp, Artificial Sequence
  chemically synthesized
actatcacgacaacagcatggg

SEQ ID NO: 867462 - DNA, 22 bp, Artificial Sequence
  chemically synthesized
tcacgacaacagcatgggggga

SEQ ID NO: 867463 - DNA, 22 bp, Artificial Sequence
  chemically synthesized
aatcatgggtttgtttcccccc

SEQ ID NO: 867464 - DNA, 22 bp, Artificial Sequence
  chemically synthesized
tgggagggacccagggggaagt

SEQ ID NO: 867465 - DNA, 22 bp, Artificial Sequence
  chemically synthesized
aattacttccccctgggtccct

SEQ ID NO: 867466 - DNA, 22 bp, Artificial Sequence
  chemically synthesized
ccatgtgttgtgggagggaccc

SEQ ID NO: 867467 - DNA, 22 bp, Artificial Sequence
  chemically synthesized
cttccccctgggtccctcccac

SEQ ID NO: 867468 - DNA, 22 bp, Artificial Sequence
  chemically synthesized
ccccctgggtccctcccacaac

SEQ ID NO: 867469 - DNA, 22 bp, Artificial Sequence
  chemically synthesized
taattcccatgtgttgtgggag

SEQ ID NO: 867470 - DNA, 22 bp, Artificial Sequence
  chemically synthesized
cccctgggtccctcccacaaca

SEQ ID NO: 867471 - DNA, 22 bp, Artificial Sequence
  chemically synthesized
ggtccctcccacaacacatggg

SEQ ID NO: 867472 - DNA, 22 bp, Artificial Sequence
  chemically synthesized
taatccctgtaattcccatgtg

SEQ ID NO: 867473 - DNA, 22 bp, Artificial Sequence
  chemically synthesized
aattgtaatccctgtaattccc

SEQ ID NO: 867474 - DNA, 22 bp, Artificial Sequence
  chemically synthesized
ccacaacacatgggaattacag

SEQ ID NO: 867475 - DNA, 22 bp, Artificial Sequence
  chemically synthesized
gaattgtaatccctgtaattcc

SEQ ID NO: 867476 - DNA, 22 bp, Artificial Sequence
  chemically synthesized
accttgaattgtaatccctgta

SEQ ID NO: 867477 - DNA, 22 bp, Artificial Sequence
  chemically synthesized
cagggattacaattcaaggtga

SEQ ID NO: 867478 - DNA, 22 bp, Artificial Sequence
  chemically synthesized
tgtccccacccaaatctcacct

SEQ ID NO: 867479 - DNA, 22 bp, Artificial Sequence
  chemically synthesized
gctgtgtccccacccaaatctc

SEQ ID NO: 867480 - DNA, 22 bp, Artificial Sequence
  chemically synthesized
caattcaaggtgagatttgggt

SEQ ID NO: 867481 - DNA, 22 bp, Artificial Sequence
  chemically synthesized
ggctgtgtccccacccaaatct

SEQ ID NO: 867482 - DNA, 22 bp, Artificial Sequence
  chemically synthesized
aaggtgagatttgggtggggac

SEQ ID NO: 867483 - DNA, 22 bp, Artificial Sequence
  chemically synthesized
accaatgatatggtttggctgt

SEQ ID NO: 867484 - DNA, 22 bp, Artificial Sequence
  chemically synthesized
gaccaatgatatggtttggctg

SEQ ID NO: 867485 - DNA, 22 bp, Artificial Sequence
  chemically synthesized
gggtggggacacagccaaacca

SEQ ID NO: 867486 - DNA, 22 bp, Artificial Sequence
  chemically synthesized
tgaccaatgatatggtttggct

SEQ ID NO: 867487 - DNA, 22 bp, Artificial Sequence
  chemically synthesized
ggtggggacacagccaaaccat

SEQ ID NO: 867488 - DNA, 22 bp, Artificial Sequence
  chemically synthesized
tgccctttgaccaatgatatgg

SEQ ID NO: 867489 - DNA, 22 bp, Artificial Sequence
  chemically synthesized
gtgccctttgaccaatgatatg

SEQ ID NO: 867490 - DNA, 22 bp, Artificial Sequence
  chemically synthesized
aaagtttgtgccctttgaccaa

SEQ ID NO: 867491 - DNA, 22 bp, Artificial Sequence
  chemically synthesized
taactgaaagtttgtgcccttt

SEQ ID NO: 867492 - DNA, 22 bp, Artificial Sequence
  chemically synthesized
ataactgaaagtttgtgccctt

SEQ ID NO: 867493 - DNA, 22 bp, Artificial Sequence
  chemically synthesized
gtcaaagggcacaaactttcag

SEQ ID NO: 867494 - DNA, 22 bp, Artificial Sequence
  chemically synthesized
gatccccagacatcttataact

SEQ ID NO: 867495 - DNA, 22 bp, Artificial Sequence
  chemically synthesized
tcagttataagatgtctgggga

SEQ ID NO: 867496 - DNA, 22 bp, Artificial Sequence
  chemically synthesized
cagttataagatgtctggggat

SEQ ID NO: 867497 - DNA, 22 bp, Artificial Sequence
  chemically synthesized
agttataagatgtctggggatc

SEQ ID NO: 867498 - DNA, 22 bp, Artificial Sequence
  chemically synthesized
taagatgtctggggatctaatg

SEQ ID NO: 867499 - DNA, 22 bp, Artificial Sequence
  chemically synthesized
tagtaaccataatgtacattag

SEQ ID NO: 867500 - DNA, 22 bp, Artificial Sequence
  chemically synthesized
actatagtaaccataatgtaca

SEQ ID NO: 867501 - DNA, 22 bp, Artificial Sequence
  chemically synthesized
gggatctaatgtacattatggt

SEQ ID NO: 867502 - DNA, 22 bp, Artificial Sequence
  chemically synthesized
ttaactatagtaaccataatgt

SEQ ID NO: 867503 - DNA, 22 bp, Artificial Sequence
  chemically synthesized
atgtacattatggttactatag

SEQ ID NO: 867504 - DNA, 22 bp, Artificial Sequence
  chemically synthesized
tggttactatagttaataatac

SEQ ID NO: 867505 - DNA, 22 bp, Artificial Sequence
  chemically synthesized
aagtaaacagtaaagtattatt

SEQ ID NO: 867506 - DNA, 22 bp, Artificial Sequence
  chemically synthesized
caagtaaacagtaaagtattat

SEQ ID NO: 867507 - DNA, 22 bp, Artificial Sequence
  chemically synthesized
ctatagttaataatactttact

SEQ ID NO: 867508 - DNA, 22 bp, Artificial Sequence
  chemically synthesized
tagttaataatactttactgtt

SEQ ID NO: 867509 - DNA, 22 bp, Artificial Sequence
  chemically synthesized
tagcaaatttcaagtaaacagt

SEQ ID NO: 867510 - DNA, 22 bp, Artificial Sequence
  chemically synthesized
gtagcaaatttcaagtaaacag

SEQ ID NO: 867511 - DNA, 22 bp, Artificial Sequence
  chemically synthesized
ataatactttactgtttacttg

SEQ ID NO: 867512 - DNA, 22 bp, Artificial Sequence
  chemically synthesized
tactgtttacttgaaatttgct

SEQ ID NO: 867513 - DNA, 22 bp, Artificial Sequence
  chemically synthesized
actgtttacttgaaatttgcta

SEQ ID NO: 867514 - DNA, 22 bp, Artificial Sequence
  chemically synthesized
ctgtttacttgaaatttgctac

SEQ ID NO: 867515 - DNA, 22 bp, Artificial Sequence
  chemically synthesized
agatccagtcttgtagcaaatt

SEQ ID NO: 867516 - DNA, 22 bp, Artificial Sequence
  chemically synthesized
aagatccagtcttgtagcaaat

SEQ ID NO: 867517 - DNA, 22 bp, Artificial Sequence
  chemically synthesized
tttacttgaaatttgctacaag

SEQ ID NO: 867518 - DNA, 22 bp, Artificial Sequence
  chemically synthesized
acttgaaatttgctacaagact

SEQ ID NO: 867519 - DNA, 22 bp, Artificial Sequence
  chemically synthesized
cttgaaatttgctacaagactg

SEQ ID NO: 867520 - DNA, 22 bp, Artificial Sequence
  chemically synthesized
gaaatttgctacaagactggat

SEQ ID NO: 867521 - DNA, 22 bp, Artificial Sequence
  chemically synthesized
aaatttgctacaagactggatc

SEQ ID NO: 867522 - DNA, 22 bp, Artificial Sequence
  chemically synthesized
gctacaagactggatcttaagt

SEQ ID NO: 867523 - DNA, 22 bp, Artificial Sequence
  chemically synthesized
ctacaagactggatcttaagtg

SEQ ID NO: 867524 - DNA, 22 bp, Artificial Sequence
  chemically synthesized
caagactggatcttaagtgtcc

SEQ ID NO: 867525 - DNA, 22 bp, Artificial Sequence
  chemically synthesized
ggggggggggatgaggacactt

SEQ ID NO: 867526 - DNA, 22 bp, Artificial Sequence
  chemically synthesized
gatcttaagtgtcctcatcccc

SEQ ID NO: 867527 - DNA, 22 bp, Artificial Sequence
  chemically synthesized
tgtgtgtgttggggggggggga

SEQ ID NO: 867528 - DNA, 22 bp, Artificial Sequence
  chemically synthesized
aagtgtcctcatcccccccccc

SEQ ID NO: 867529 - DNA, 22 bp, Artificial Sequence
  chemically synthesized
agtgtcctcatccccccccccc

SEQ ID NO: 867530 - DNA, 22 bp, Artificial Sequence
  chemically synthesized
ttgtgtgtgtgttggggggggg

SEQ ID NO: 867531 - DNA, 22 bp, Artificial Sequence
  chemically synthesized
ctattgtgtgtgtgttgggggg

SEQ ID NO: 867532 - DNA, 22 bp, Artificial Sequence
  chemically synthesized
atcccccccccccaacacacac

SEQ ID NO: 867533 - DNA, 22 bp, Artificial Sequence
  chemically synthesized
gcacaagaaatagttactattg

SEQ ID NO: 867534 - DNA, 22 bp, Artificial Sequence
  chemically synthesized
atacatctagcacaagaaatag

SEQ ID NO: 867535 - DNA, 22 bp, Artificial Sequence
  chemically synthesized
attaatacatctagcacaagaa

SEQ ID NO: 867536 - DNA, 22 bp, Artificial Sequence
  chemically synthesized
tttcttgtgctagatgtattaa

SEQ ID NO: 867537 - DNA, 22 bp, Artificial Sequence
  chemically synthesized
cttgtgctagatgtattaatta

SEQ ID NO: 867538 - DNA, 22 bp, Artificial Sequence
  chemically synthesized
ccacaatcaaattaattaatac

SEQ ID NO: 867539 - DNA, 22 bp, Artificial Sequence
  chemically synthesized
ttgtgctagatgtattaattaa

SEQ ID NO: 867540 - DNA, 22 bp, Artificial Sequence
  chemically synthesized
gtgctagatgtattaattaatt

SEQ ID NO: 867541 - DNA, 22 bp, Artificial Sequence
  chemically synthesized
tgctagatgtattaattaattt

SEQ ID NO: 867542 - DNA, 22 bp, Artificial Sequence
  chemically synthesized
gatgtattaattaatttgattg

SEQ ID NO: 867543 - DNA, 22 bp, Artificial Sequence
  chemically synthesized
tgagatgattaccacaatcaaa

SEQ ID NO: 867544 - DNA, 22 bp, Artificial Sequence
  chemically synthesized
tattgtgagatgattaccacaa

SEQ ID NO: 867545 - DNA, 22 bp, Artificial Sequence
  chemically synthesized
attaatttgattgtggtaatca

SEQ ID NO: 867546 - DNA, 22 bp, Artificial Sequence
  chemically synthesized
atttgattgtggtaatcatctc

SEQ ID NO: 867547 - DNA, 22 bp, Artificial Sequence
  chemically synthesized
tatgactatattgtgagatgat

SEQ ID NO: 867548 - DNA, 22 bp, Artificial Sequence
  chemically synthesized
atatgactatattgtgagatga

SEQ ID NO: 867549 - DNA, 22 bp, Artificial Sequence
  chemically synthesized
gattgtggtaatcatctcacaa

SEQ ID NO: 867550 - DNA, 22 bp, Artificial Sequence
  chemically synthesized
tatatgactatattgtgagatg

SEQ ID NO: 867551 - DNA, 22 bp, Artificial Sequence
  chemically synthesized
attgtggtaatcatctcacaat

SEQ ID NO: 867552 - DNA, 22 bp, Artificial Sequence
  chemically synthesized
tggtaatcatctcacaatatag

SEQ ID NO: 867553 - DNA, 22 bp, Artificial Sequence
  chemically synthesized
acaatatagtcatataaaatca

SEQ ID NO: 867554 - DNA, 22 bp, Artificial Sequence
  chemically synthesized
aaggtatacaacatgatgattt

SEQ ID NO: 867555 - DNA, 22 bp, Artificial Sequence
  chemically synthesized
tatgtattcaaggtatacaaca

SEQ ID NO: 867556 - DNA, 22 bp, Artificial Sequence
  chemically synthesized
agaaataaaaactgtatgtatt

SEQ ID NO: 867557 - DNA, 22 bp, Artificial Sequence
  chemically synthesized
tataccttgaatacatacagtt

SEQ ID NO: 867558 - DNA, 22 bp, Artificial Sequence
  chemically synthesized
gaatacatacagtttttatttc

SEQ ID NO: 867559 - DNA, 22 bp, Artificial Sequence
  chemically synthesized
aagtataattgagaaataaaaa

SEQ ID NO: 867560 - DNA, 22 bp, Artificial Sequence
  chemically synthesized
aatacatacagtttttatttct

SEQ ID NO: 867561 - DNA, 22 bp, Artificial Sequence
  chemically synthesized
ttgaagtataattgagaaataa

SEQ ID NO: 867562 - DNA, 22 bp, Artificial Sequence
  chemically synthesized
attgaagtataattgagaaata

SEQ ID NO: 867563 - DNA, 22 bp, Artificial Sequence
  chemically synthesized
tattgaagtataattgagaaat

SEQ ID NO: 867564 - DNA, 22 bp, Artificial Sequence
  chemically synthesized
gctttattgaagtataattgag

SEQ ID NO: 867565 - DNA, 22 bp, Artificial Sequence
  chemically synthesized
cctagctttattgaagtataat

SEQ ID NO: 867566 - DNA, 22 bp, Artificial Sequence
  chemically synthesized
acctagctttattgaagtataa

SEQ ID NO: 867567 - DNA, 22 bp, Artificial Sequence
  chemically synthesized
ttatttctcaattatacttcaa

SEQ ID NO: 867568 - DNA, 22 bp, Artificial Sequence
  chemically synthesized
tatttctcaattatacttcaat

SEQ ID NO: 867569 - DNA, 22 bp, Artificial Sequence
  chemically synthesized
atttctcaattatacttcaata

SEQ ID NO: 867570 - DNA, 22 bp, Artificial Sequence
  chemically synthesized
cttacctagctttattgaagta

SEQ ID NO: 867571 - DNA, 22 bp, Artificial Sequence
  chemically synthesized
tttctcaattatacttcaataa

SEQ ID NO: 867572 - DNA, 22 bp, Artificial Sequence
  chemically synthesized
ctccttacctagctttattgaa

SEQ ID NO: 867573 - DNA, 22 bp, Artificial Sequence
  chemically synthesized
ctcaattatacttcaataaagc

SEQ ID NO: 867574 - DNA, 22 bp, Artificial Sequence
  chemically synthesized
tcaattatacttcaataaagct

SEQ ID NO: 867575 - DNA, 22 bp, Artificial Sequence
  chemically synthesized
aattatacttcaataaagctag

SEQ ID NO: 867576 - DNA, 22 bp, Artificial Sequence
  chemically synthesized
cctcctccttacctagctttat

SEQ ID NO: 867577 - DNA, 22 bp, Artificial Sequence
  chemically synthesized
tgcctcctccttacctagcttt

SEQ ID NO: 867578 - DNA, 22 bp, Artificial Sequence
  chemically synthesized
tacttcaataaagctaggtaag

SEQ ID NO: 867579 - DNA, 22 bp, Artificial Sequence
  chemically synthesized
caataaagctaggtaaggagga

SEQ ID NO: 867580 - DNA, 22 bp, Artificial Sequence
  chemically synthesized
aataaagctaggtaaggaggag

SEQ ID NO: 867581 - DNA, 22 bp, Artificial Sequence
  chemically synthesized
aggacatactctgcctcctcct

SEQ ID NO: 867582 - DNA, 22 bp, Artificial Sequence
  chemically synthesized
gaggacatactctgcctcctcc

SEQ ID NO: 867583 - DNA, 22 bp, Artificial Sequence
  chemically synthesized
ttgaggacatactctgcctcct

SEQ ID NO: 867584 - DNA, 22 bp, Artificial Sequence
  chemically synthesized
cttgaggacatactctgcctcc

SEQ ID NO: 867585 - DNA, 22 bp, Artificial Sequence
  chemically synthesized
ggtaaggaggaggcagagtatg

SEQ ID NO: 867586 - DNA, 22 bp, Artificial Sequence
  chemically synthesized
tgagcttcttgaggacatactc

SEQ ID NO: 867587 - DNA, 22 bp, Artificial Sequence
  chemically synthesized
aattgtgagcttcttgaggaca

SEQ ID NO: 867588 - DNA, 22 bp, Artificial Sequence
  chemically synthesized
ctcaattgtgagcttcttgagg

SEQ ID NO: 867589 - DNA, 22 bp, Artificial Sequence
  chemically synthesized
cccctactcaattgtgagcttc

SEQ ID NO: 867590 - DNA, 22 bp, Artificial Sequence
  chemically synthesized
ttccccctactcaattgtgagc

SEQ ID NO: 867591 - DNA, 22 bp, Artificial Sequence
  chemically synthesized
atgttgttccccctactcaatt

SEQ ID NO: 867592 - DNA, 22 bp, Artificial Sequence
  chemically synthesized
aagaagctcacaattgagtagg

SEQ ID NO: 867593 - DNA, 22 bp, Artificial Sequence
  chemically synthesized
aattcatgttgttccccctact

SEQ ID NO: 867594 - DNA, 22 bp, Artificial Sequence
  chemically synthesized
gaattcatgttgttccccctac

SEQ ID NO: 867595 - DNA, 22 bp, Artificial Sequence
  chemically synthesized
acaattgagtagggggaacaac

SEQ ID NO: 867596 - DNA, 22 bp, Artificial Sequence
  chemically synthesized
agtagggggaacaacatgaatt

SEQ ID NO: 867597 - DNA, 22 bp, Artificial Sequence
  chemically synthesized
tgggacaatttgaattcatgtt

SEQ ID NO: 867598 - DNA, 22 bp, Artificial Sequence
  chemically synthesized
gtgggacaatttgaattcatgt

SEQ ID NO: 867599 - DNA, 22 bp, Artificial Sequence
  chemically synthesized
tttgtgggacaatttgaattca

SEQ ID NO: 867600 - DNA, 22 bp, Artificial Sequence
  chemically synthesized
atttgtgggacaatttgaattc

SEQ ID NO: 867601 - DNA, 22 bp, Artificial Sequence
  chemically synthesized
tatttatttgtgggacaatttg

SEQ ID NO: 867602 - DNA, 22 bp, Artificial Sequence
  chemically synthesized
atatttatttgtgggacaattt

SEQ ID NO: 867603 - DNA, 22 bp, Artificial Sequence
  chemically synthesized
aaattgtcccacaaataaatat

SEQ ID NO: 867604 - DNA, 22 bp, Artificial Sequence
  chemically synthesized
tcccacaaataaatataagatt

SEQ ID NO: 867605 - DNA, 22 bp, Artificial Sequence
  chemically synthesized
cagagcacacaccaaatcttat

SEQ ID NO: 867606 - DNA, 22 bp, Artificial Sequence
  chemically synthesized
ccagagcacacaccaaatctta

SEQ ID NO: 867607 - DNA, 22 bp, Artificial Sequence
  chemically synthesized
ttccagagcacacaccaaatct

SEQ ID NO: 867608 - DNA, 22 bp, Artificial Sequence
  chemically synthesized
ctcttccagagcacacaccaaa

SEQ ID NO: 867609 - DNA, 22 bp, Artificial Sequence
  chemically synthesized
tactcctcttccagagcacaca

SEQ ID NO: 867610 - DNA, 22 bp, Artificial Sequence
  chemically synthesized
atactcctcttccagagcacac

SEQ ID NO: 867611 - DNA, 22 bp, Artificial Sequence
  chemically synthesized
tttatactcctcttccagagca

SEQ ID NO: 867612 - DNA, 22 bp, Artificial Sequence
  chemically synthesized
ggtgtgtgctctggaagaggag

SEQ ID NO: 867613 - DNA, 22 bp, Artificial Sequence
  chemically synthesized
gtgtgtgctctggaagaggagt

SEQ ID NO: 867614 - DNA, 22 bp, Artificial Sequence
  chemically synthesized
gtgtaaatggcactatttatac

SEQ ID NO: 867615 - DNA, 22 bp, Artificial Sequence
  chemically synthesized
tggaagaggagtataaatagtg

SEQ ID NO: 867616 - DNA, 22 bp, Artificial Sequence
  chemically synthesized
gaagaggagtataaatagtgcc

SEQ ID NO: 867617 - DNA, 22 bp, Artificial Sequence
  chemically synthesized
ggttagtgtaaatggcactatt

SEQ ID NO: 867618 - DNA, 22 bp, Artificial Sequence
  chemically synthesized
ccaaactaggttagtgtaaatg

SEQ ID NO: 867619 - DNA, 22 bp, Artificial Sequence
  chemically synthesized
cctcccaaactaggttagtgta

SEQ ID NO: 867620 - DNA, 22 bp, Artificial Sequence
  chemically synthesized
acctcccaaactaggttagtgt

SEQ ID NO: 867621 - DNA, 22 bp, Artificial Sequence
  chemically synthesized
cttacctcccaaactaggttag

SEQ ID NO: 867622 - DNA, 22 bp, Artificial Sequence
  chemically synthesized
acactaacctagtttgggaggt

SEQ ID NO: 867623 - DNA, 22 bp, Artificial Sequence
  chemically synthesized
cactaacctagtttgggaggta

SEQ ID NO: 867624 - DNA, 22 bp, Artificial Sequence
  chemically synthesized
aggaaagacgctccttacctcc

SEQ ID NO: 867625 - DNA, 22 bp, Artificial Sequence
  chemically synthesized
acctagtttgggaggtaaggag

SEQ ID NO: 867626 - DNA, 22 bp, Artificial Sequence
  chemically synthesized
tactcaggaaagacgctcctta

SEQ ID NO: 867627 - DNA, 22 bp, Artificial Sequence
  chemically synthesized
gtttgggaggtaaggagcgtct

SEQ ID NO: 867628 - DNA, 22 bp, Artificial Sequence
  chemically synthesized
gggaggtaaggagcgtctttcc

SEQ ID NO: 867629 - DNA, 22 bp, Artificial Sequence
  chemically synthesized
ggaggtaaggagcgtctttcct

SEQ ID NO: 867630 - DNA, 22 bp, Artificial Sequence
  chemically synthesized
aaatgttatactcaggaaagac

SEQ ID NO: 867631 - DNA, 22 bp, Artificial Sequence
  chemically synthesized
agctcaaatgttatactcagga

SEQ ID NO: 867632 - DNA, 22 bp, Artificial Sequence
  chemically synthesized
aggtctcagctcaaatgttata

SEQ ID NO: 867633 - DNA, 22 bp, Artificial Sequence
  chemically synthesized
caggtctcagctcaaatgttat

SEQ ID NO: 867634 - DNA, 22 bp, Artificial Sequence
  chemically synthesized
tcaggtctcagctcaaatgtta

SEQ ID NO: 867635 - DNA, 22 bp, Artificial Sequence
  chemically synthesized
ttcaggtctcagctcaaatgtt

SEQ ID NO: 867636 - DNA, 22 bp, Artificial Sequence
  chemically synthesized
tcctgagtataacatttgagct

SEQ ID NO: 867637 - DNA, 22 bp, Artificial Sequence
  chemically synthesized
cctgagtataacatttgagctg

SEQ ID NO: 867638 - DNA, 22 bp, Artificial Sequence
  chemically synthesized
ctgagtataacatttgagctga

SEQ ID NO: 867639 - DNA, 22 bp, Artificial Sequence
  chemically synthesized
acttttcaggtctcagctcaaa

SEQ ID NO: 867640 - DNA, 22 bp, Artificial Sequence
  chemically synthesized
agtataacatttgagctgagac

SEQ ID NO: 867641 - DNA, 22 bp, Artificial Sequence
  chemically synthesized
ctcacttttcaggtctcagctc

SEQ ID NO: 867642 - DNA, 22 bp, Artificial Sequence
  chemically synthesized
atacctactcacttttcaggtc

SEQ ID NO: 867643 - DNA, 22 bp, Artificial Sequence
  chemically synthesized
gagctgagacctgaaaagtgag

SEQ ID NO: 867644 - DNA, 22 bp, Artificial Sequence
  chemically synthesized
acctcatacctactcacttttc

SEQ ID NO: 867645 - DNA, 22 bp, Artificial Sequence
  chemically synthesized
agctgagacctgaaaagtgagt

SEQ ID NO: 867646 - DNA, 22 bp, Artificial Sequence
  chemically synthesized
gacctcatacctactcactttt

SEQ ID NO: 867647 - DNA, 22 bp, Artificial Sequence
  chemically synthesized
tgacctcatacctactcacttt

SEQ ID NO: 867648 - DNA, 22 bp, Artificial Sequence
  chemically synthesized
ttgacctcatacctactcactt

SEQ ID NO: 867649 - DNA, 22 bp, Artificial Sequence
  chemically synthesized
agacctgaaaagtgagtaggta

SEQ ID NO: 867650 - DNA, 22 bp, Artificial Sequence
  chemically synthesized
aatttttgacctcatacctact

SEQ ID NO: 867651 - DNA, 22 bp, Artificial Sequence
  chemically synthesized
gaatttttgacctcatacctac

SEQ ID NO: 867652 - DNA, 22 bp, Artificial Sequence
  chemically synthesized
tgaatttttgacctcataccta

SEQ ID NO: 867653 - DNA, 22 bp, Artificial Sequence
  chemically synthesized
ttgaatttttgacctcatacct

SEQ ID NO: 867654 - DNA, 22 bp, Artificial Sequence
  chemically synthesized
aaaagtgagtaggtatgaggtc

SEQ ID NO: 867655 - DNA, 22 bp, Artificial Sequence
  chemically synthesized
tccttttgaatttttgacctca

SEQ ID NO: 867656 - DNA, 22 bp, Artificial Sequence
  chemically synthesized
agacactatccttttgaatttt

SEQ ID NO: 867657 - DNA, 22 bp, Artificial Sequence
  chemically synthesized
attgagacactatccttttgaa

SEQ ID NO: 867658 - DNA, 22 bp, Artificial Sequence
  chemically synthesized
tgattgagacactatccttttg

SEQ ID NO: 867659 - DNA, 22 bp, Artificial Sequence
  chemically synthesized
tctgattgagacactatccttt

SEQ ID NO: 867660 - DNA, 22 bp, Artificial Sequence
  chemically synthesized
gtctctctgattgagacactat

SEQ ID NO: 867661 - DNA, 22 bp, Artificial Sequence
  chemically synthesized
aaaaggatagtgtctcaatcag

SEQ ID NO: 867662 - DNA, 22 bp, Artificial Sequence
  chemically synthesized
cacatattggtctctctgattg

SEQ ID NO: 867663 - DNA, 22 bp, Artificial Sequence
  chemically synthesized
aagccattgcacatattggtct

SEQ ID NO: 867664 - DNA, 22 bp, Artificial Sequence
  chemically synthesized
aaagccattgcacatattggtc

SEQ ID NO: 867665 - DNA, 22 bp, Artificial Sequence
  chemically synthesized
taaagccattgcacatattggt

SEQ ID NO: 867666 - DNA, 22 bp, Artificial Sequence
  chemically synthesized
ttaaagccattgcacatattgg

SEQ ID NO: 867667 - DNA, 22 bp, Artificial Sequence
  chemically synthesized
aatcagagagaccaatatgtgc

SEQ ID NO: 867668 - DNA, 22 bp, Artificial Sequence
  chemically synthesized
tttaaagccattgcacatattg

SEQ ID NO: 867669 - DNA, 22 bp, Artificial Sequence
  chemically synthesized
ttttttaaagccattgcacata

SEQ ID NO: 867670 - DNA, 22 bp, Artificial Sequence
  chemically synthesized
tgttttttaaagccattgcaca

SEQ ID NO: 867671 - DNA, 22 bp, Artificial Sequence
  chemically synthesized
ctgttttttaaagccattgcac

SEQ ID NO: 867672 - DNA, 22 bp, Artificial Sequence
  chemically synthesized
tctgttttttaaagccattgca

SEQ ID NO: 867673 - DNA, 22 bp, Artificial Sequence
  chemically synthesized
ttttctgttttttaaagccatt

SEQ ID NO: 867674 - DNA, 22 bp, Artificial Sequence
  chemically synthesized
attttctgttttttaaagccat

SEQ ID NO: 867675 - DNA, 22 bp, Artificial Sequence
  chemically synthesized
tgaaagtgcttattttctgttt

SEQ ID NO: 867676 - DNA, 22 bp, Artificial Sequence
  chemically synthesized
atgaaagtgcttattttctgtt

SEQ ID NO: 867677 - DNA, 22 bp, Artificial Sequence
  chemically synthesized
cttatgaaagtgcttattttct

SEQ ID NO: 867678 - DNA, 22 bp, Artificial Sequence
  chemically synthesized
gcttatgaaagtgcttattttc

SEQ ID NO: 867679 - DNA, 22 bp, Artificial Sequence
  chemically synthesized
tgcttatgaaagtgcttatttt

SEQ ID NO: 867680 - DNA, 22 bp, Artificial Sequence
  chemically synthesized
taaaaaacagaaaataagcact

SEQ ID NO: 867681 - DNA, 22 bp, Artificial Sequence
  chemically synthesized
aaaaaacagaaaataagcactt

SEQ ID NO: 867682 - DNA, 22 bp, Artificial Sequence
  chemically synthesized
ttttgcttatgaaagtgcttat

SEQ ID NO: 867683 - DNA, 22 bp, Artificial Sequence
  chemically synthesized
aaaaacagaaaataagcacttt

SEQ ID NO: 867684 - DNA, 22 bp, Artificial Sequence
  chemically synthesized
gttttgcttatgaaagtgctta

SEQ ID NO: 867685 - DNA, 22 bp, Artificial Sequence
  chemically synthesized
tgttttgcttatgaaagtgctt

SEQ ID NO: 867686 - DNA, 22 bp, Artificial Sequence
  chemically synthesized
gttttgttttgcttatgaaagt

SEQ ID NO: 867687 - DNA, 22 bp, Artificial Sequence
  chemically synthesized
ctagttttgttttgcttatgaa

SEQ ID NO: 867688 - DNA, 22 bp, Artificial Sequence
  chemically synthesized
cctcctagttttgttttgctta

SEQ ID NO: 867689 - DNA, 22 bp, Artificial Sequence
  chemically synthesized
acctccctcctagttttgtttt

SEQ ID NO: 867690 - DNA, 22 bp, Artificial Sequence
  chemically synthesized
tcataagcaaaacaaaactagg

SEQ ID NO: 867691 - DNA, 22 bp, Artificial Sequence
  chemically synthesized
cataagcaaaacaaaactagga

SEQ ID NO: 867692 - DNA, 22 bp, Artificial Sequence
  chemically synthesized
ataagcaaaacaaaactaggag

SEQ ID NO: 867693 - DNA, 22 bp, Artificial Sequence
  chemically synthesized
cacattgacctccctcctagtt

SEQ ID NO: 867694 - DNA, 22 bp, Artificial Sequence
  chemically synthesized
tctccacattgacctccctcct

SEQ ID NO: 867695 - DNA, 22 bp, Artificial Sequence
  chemically synthesized
atctccacattgacctccctcc

SEQ ID NO: 867696 - DNA, 22 bp, Artificial Sequence
  chemically synthesized
ttatctccacattgacctccct

SEQ ID NO: 867697 - DNA, 22 bp, Artificial Sequence
  chemically synthesized
tcttatctccacattgacctcc

SEQ ID NO: 867698 - DNA, 22 bp, Artificial Sequence
  chemically synthesized
ctctcttatctccacattgacc

SEQ ID NO: 867699 - DNA, 22 bp, Artificial Sequence
  chemically synthesized
actctcttatctccacattgac

SEQ ID NO: 867700 - DNA, 22 bp, Artificial Sequence
  chemically synthesized
cttactctcttatctccacatt

SEQ ID NO: 867701 - DNA, 22 bp, Artificial Sequence
  chemically synthesized
ggagggaggtcaatgtggagat

SEQ ID NO: 867702 - DNA, 22 bp, Artificial Sequence
  chemically synthesized
tgaactacttactctcttatct

SEQ ID NO: 867703 - DNA, 22 bp, Artificial Sequence
  chemically synthesized
taccagatactgtgaactactt

SEQ ID NO: 867704 - DNA, 22 bp, Artificial Sequence
  chemically synthesized
ataccagatactgtgaactact

SEQ ID NO: 867705 - DNA, 22 bp, Artificial Sequence
  chemically synthesized
atcatccttataccagatactg

SEQ ID NO: 867706 - DNA, 22 bp, Artificial Sequence
  chemically synthesized
catcatccttataccagatact

SEQ ID NO: 867707 - DNA, 22 bp, Artificial Sequence
  chemically synthesized
catttcatcatccttataccag

SEQ ID NO: 867708 - DNA, 22 bp, Artificial Sequence
  chemically synthesized
ccatttcatcatccttatacca

SEQ ID NO: 867709 - DNA, 22 bp, Artificial Sequence
  chemically synthesized
tccatttcatcatccttatacc

SEQ ID NO: 867710 - DNA, 22 bp, Artificial Sequence
  chemically synthesized
acagtatctggtataaggatga

SEQ ID NO: 867711 - DNA, 22 bp, Artificial Sequence
  chemically synthesized
gtataaggatgatgaaatggaa

SEQ ID NO: 867712 - DNA, 22 bp, Artificial Sequence
  chemically synthesized
tatagtgtgaccctttccattt

SEQ ID NO: 867713 - DNA, 22 bp, Artificial Sequence
  chemically synthesized
gtatagtgtgaccctttccatt

SEQ ID NO: 867714 - DNA, 22 bp, Artificial Sequence
  chemically synthesized
aaaaaaagaaatgatatcccac

SEQ ID NO: 867715 - DNA, 22 bp, Artificial Sequence
  chemically synthesized
tacaagatcctgtgggatatca

SEQ ID NO: 867716 - DNA, 22 bp, Artificial Sequence
  chemically synthesized
caaaaaaagaaatgatatccca

SEQ ID NO: 867717 - DNA, 22 bp, Artificial Sequence
  chemically synthesized
tgggatatcatttctttttttg

SEQ ID NO: 867718 - DNA, 22 bp, Artificial Sequence
  chemically synthesized
aaaataaaaatttcaaaaaaag

SEQ ID NO: 867719 - DNA, 22 bp, Artificial Sequence
  chemically synthesized
tctcaaaataaaaatttcaaaa

SEQ ID NO: 867720 - DNA, 22 bp, Artificial Sequence
  chemically synthesized
atctcaaaataaaaatttcaaa

SEQ ID NO: 867721 - DNA, 22 bp, Artificial Sequence
  chemically synthesized
ccatttatctcaaaataaaaat

SEQ ID NO: 867722 - DNA, 22 bp, Artificial Sequence
  chemically synthesized
ctttttttgaaatttttatttt

SEQ ID NO: 867723 - DNA, 22 bp, Artificial Sequence
  chemically synthesized
accatttatctcaaaataaaaa

SEQ ID NO: 867724 - DNA, 22 bp, Artificial Sequence
  chemically synthesized
tttttttgaaatttttattttg

SEQ ID NO: 867725 - DNA, 22 bp, Artificial Sequence
  chemically synthesized
tttttgaaatttttattttgag

SEQ ID NO: 867726 - DNA, 22 bp, Artificial Sequence
  chemically synthesized
ttttgaaatttttattttgaga

SEQ ID NO: 867727 - DNA, 22 bp, Artificial Sequence
  chemically synthesized
tttgaaatttttattttgagat

SEQ ID NO: 867728 - DNA, 22 bp, Artificial Sequence
  chemically synthesized
ttgaaatttttattttgagata

SEQ ID NO: 867729 - DNA, 22 bp, Artificial Sequence
  chemically synthesized
tgaaatttttattttgagataa

SEQ ID NO: 867730 - DNA, 22 bp, Artificial Sequence
  chemically synthesized
gaaatttttattttgagataaa

SEQ ID NO: 867731 - DNA, 22 bp, Artificial Sequence
  chemically synthesized
aaatttttattttgagataaat

SEQ ID NO: 867732 - DNA, 22 bp, Artificial Sequence
  chemically synthesized
cagtaccttaccatttatctca

SEQ ID NO: 867733 - DNA, 22 bp, Artificial Sequence
  chemically synthesized
ttattttgagataaatggtaag

SEQ ID NO: 867734 - DNA, 22 bp, Artificial Sequence
  chemically synthesized
tattttgagataaatggtaagg

SEQ ID NO: 867735 - DNA, 22 bp, Artificial Sequence
  chemically synthesized
attttgagataaatggtaaggt

SEQ ID NO: 867736 - DNA, 22 bp, Artificial Sequence
  chemically synthesized
aaatgctccagtaccttaccat

SEQ ID NO: 867737 - DNA, 22 bp, Artificial Sequence
  chemically synthesized
ttttgagataaatggtaaggta

SEQ ID NO: 867738 - DNA, 22 bp, Artificial Sequence
  chemically synthesized
aaaatgctccagtaccttacca

SEQ ID NO: 867739 - DNA, 22 bp, Artificial Sequence
  chemically synthesized
tgagataaatggtaaggtactg

SEQ ID NO: 867740 - DNA, 22 bp, Artificial Sequence
  chemically synthesized
tttaaaatgctccagtacctta

SEQ ID NO: 867741 - DNA, 22 bp, Artificial Sequence
  chemically synthesized
gagataaatggtaaggtactgg

SEQ ID NO: 867742 - DNA, 22 bp, Artificial Sequence
  chemically synthesized
agataaatggtaaggtactgga

SEQ ID NO: 867743 - DNA, 22 bp, Artificial Sequence
  chemically synthesized
tgtttaaaatgctccagtacct

SEQ ID NO: 867744 - DNA, 22 bp, Artificial Sequence
  chemically synthesized
atgacagacagaactctgttta

SEQ ID NO: 867745 - DNA, 22 bp, Artificial Sequence
  chemically synthesized
gatgacagacagaactctgttt

SEQ ID NO: 867746 - DNA, 22 bp, Artificial Sequence
  chemically synthesized
gagcattttaaacagagttctg

SEQ ID NO: 867747 - DNA, 22 bp, Artificial Sequence
  chemically synthesized
taaacagagttctgtctgtcat

SEQ ID NO: 867748 - DNA, 22 bp, Artificial Sequence
  chemically synthesized
aaacagagttctgtctgtcatc

SEQ ID NO: 867749 - DNA, 22 bp, Artificial Sequence
  chemically synthesized
aacagagttctgtctgtcatca

SEQ ID NO: 867750 - DNA, 22 bp, Artificial Sequence
  chemically synthesized
aaaatataaatttgatgacaga

SEQ ID NO: 867751 - DNA, 22 bp, Artificial Sequence
  chemically synthesized
tgtctgtcatcaaatttatatt

SEQ ID NO: 867752 - DNA, 22 bp, Artificial Sequence
  chemically synthesized
tgtgaaaattcaaaatataaat

SEQ ID NO: 867753 - DNA, 22 bp, Artificial Sequence
  chemically synthesized
tctgtcatcaaatttatatttt

SEQ ID NO: 867754 - DNA, 22 bp, Artificial Sequence
  chemically synthesized
gctgtgtgaaaattcaaaatat

SEQ ID NO: 867755 - DNA, 22 bp, Artificial Sequence
  chemically synthesized
tcatcaaatttatattttgaat

SEQ ID NO: 867756 - DNA, 22 bp, Artificial Sequence
  chemically synthesized
agctgtgtgaaaattcaaaata

SEQ ID NO: 867757 - DNA, 22 bp, Artificial Sequence
  chemically synthesized
tgcatcttagctgtgtgaaaat

SEQ ID NO: 867758 - DNA, 22 bp, Artificial Sequence
  chemically synthesized
atattttgaattttcacacagc

SEQ ID NO: 867759 - DNA, 22 bp, Artificial Sequence
  chemically synthesized
ctatgcatcttagctgtgtgaa

SEQ ID NO: 867760 - DNA, 22 bp, Artificial Sequence
  chemically synthesized
tattttgaattttcacacagct

SEQ ID NO: 867761 - DNA, 22 bp, Artificial Sequence
  chemically synthesized
tcctatgcatcttagctgtgtg

SEQ ID NO: 867762 - DNA, 22 bp, Artificial Sequence
  chemically synthesized
tctcctatgcatcttagctgtg

SEQ ID NO: 867763 - DNA, 22 bp, Artificial Sequence
  chemically synthesized
ctctcctatgcatcttagctgt

SEQ ID NO: 867764 - DNA, 22 bp, Artificial Sequence
  chemically synthesized
tgaattttcacacagctaagat

SEQ ID NO: 867765 - DNA, 22 bp, Artificial Sequence
  chemically synthesized
gaattttcacacagctaagatg

SEQ ID NO: 867766 - DNA, 22 bp, Artificial Sequence
  chemically synthesized
ttctctcctatgcatcttagct

SEQ ID NO: 867767 - DNA, 22 bp, Artificial Sequence
  chemically synthesized
aattttcacacagctaagatgc

SEQ ID NO: 867768 - DNA, 22 bp, Artificial Sequence
  chemically synthesized
cttctctcctatgcatcttagc

SEQ ID NO: 867769 - DNA, 22 bp, Artificial Sequence
  chemically synthesized
atttcttctctcctatgcatct

SEQ ID NO: 867770 - DNA, 22 bp, Artificial Sequence
  chemically synthesized
tcacacagctaagatgcatagg

SEQ ID NO: 867771 - DNA, 22 bp, Artificial Sequence
  chemically synthesized
cacacagctaagatgcatagga

SEQ ID NO: 867772 - DNA, 22 bp, Artificial Sequence
  chemically synthesized
acacagctaagatgcataggag

SEQ ID NO: 867773 - DNA, 22 bp, Artificial Sequence
  chemically synthesized
attcatttcttctctcctatgc

SEQ ID NO: 867774 - DNA, 22 bp, Artificial Sequence
  chemically synthesized
ctcattcatttcttctctccta

SEQ ID NO: 867775 - DNA, 22 bp, Artificial Sequence
  chemically synthesized
tcctcattcatttcttctctcc

SEQ ID NO: 867776 - DNA, 22 bp, Artificial Sequence
  chemically synthesized
agatgcataggagagaagaaat

SEQ ID NO: 867777 - DNA, 22 bp, Artificial Sequence
  chemically synthesized
atctctcctcattcatttcttc

SEQ ID NO: 867778 - DNA, 22 bp, Artificial Sequence
  chemically synthesized
tcatccaaacctaatctctcct

SEQ ID NO: 867779 - DNA, 22 bp, Artificial Sequence
  chemically synthesized
aataatactgtcatccaaacct

SEQ ID NO: 867780 - DNA, 22 bp, Artificial Sequence
  chemically synthesized
ggttaaataatactgtcatcca

SEQ ID NO: 867781 - DNA, 22 bp, Artificial Sequence
  chemically synthesized
ttgggttaaataatactgtcat

SEQ ID NO: 867782 - DNA, 22 bp, Artificial Sequence
  chemically synthesized
ggtttggatgacagtattattt

SEQ ID NO: 867783 - DNA, 22 bp, Artificial Sequence
  chemically synthesized
tgcaggttattgggttaaataa

SEQ ID NO: 867784 - DNA, 22 bp, Artificial Sequence
  chemically synthesized
ggatgacagtattatttaaccc

SEQ ID NO: 867785 - DNA, 22 bp, Artificial Sequence
  chemically synthesized
gatgacagtattatttaaccca

SEQ ID NO: 867786 - DNA, 22 bp, Artificial Sequence
  chemically synthesized
taacactatgcaggttattggg

SEQ ID NO: 867787 - DNA, 22 bp, Artificial Sequence
  chemically synthesized
gtaacactatgcaggttattgg

SEQ ID NO: 867788 - DNA, 22 bp, Artificial Sequence
  chemically synthesized
acttgtaacactatgcaggtta

SEQ ID NO: 867789 - DNA, 22 bp, Artificial Sequence
  chemically synthesized
cacttgtaacactatgcaggtt

SEQ ID NO: 867790 - DNA, 22 bp, Artificial Sequence
  chemically synthesized
tttaacccaataacctgcatag

SEQ ID NO: 867791 - DNA, 22 bp, Artificial Sequence
  chemically synthesized
tcacttgtaacactatgcaggt

SEQ ID NO: 867792 - DNA, 22 bp, Artificial Sequence
  chemically synthesized
aacccaataacctgcatagtgt

SEQ ID NO: 867793 - DNA, 22 bp, Artificial Sequence
  chemically synthesized
acccaataacctgcatagtgtt

SEQ ID NO: 867794 - DNA, 22 bp, Artificial Sequence
  chemically synthesized
atagtcccacctttcacttgta

SEQ ID NO: 867795 - DNA, 22 bp, Artificial Sequence
  chemically synthesized
catagtgttacaagtgaaaggt

SEQ ID NO: 867796 - DNA, 22 bp, Artificial Sequence
  chemically synthesized
agagtgactaatagtcccacct

SEQ ID NO: 867797 - DNA, 22 bp, Artificial Sequence
  chemically synthesized
caagtgaaaggtgggactatta

SEQ ID NO: 867798 - DNA, 22 bp, Artificial Sequence
  chemically synthesized
cctcagagtgactaatagtccc

SEQ ID NO: 867799 - DNA, 22 bp, Artificial Sequence
  chemically synthesized
tgtcattgcctcagagtgacta

SEQ ID NO: 867800 - DNA, 22 bp, Artificial Sequence
  chemically synthesized
atgtcattgcctcagagtgact

SEQ ID NO: 867801 - DNA, 22 bp, Artificial Sequence
  chemically synthesized
tatgtcattgcctcagagtgac

SEQ ID NO: 867802 - DNA, 22 bp, Artificial Sequence
  chemically synthesized
ttagtcactctgaggcaatgac

SEQ ID NO: 867803 - DNA, 22 bp, Artificial Sequence
  chemically synthesized
gtcactctgaggcaatgacata

SEQ ID NO: 867804 - DNA, 22 bp, Artificial Sequence
  chemically synthesized
gagaaaacatgctttatgtcat

SEQ ID NO: 867805 - DNA, 22 bp, Artificial Sequence
  chemically synthesized
cctagagaaaacatgctttatg

SEQ ID NO: 867806 - DNA, 22 bp, Artificial Sequence
  chemically synthesized
tgaggcaatgacataaagcatg

SEQ ID NO: 867807 - DNA, 22 bp, Artificial Sequence
  chemically synthesized
gcctagagaaaacatgctttat

SEQ ID NO: 867808 - DNA, 22 bp, Artificial Sequence
  chemically synthesized
aggcaatgacataaagcatgtt

SEQ ID NO: 867809 - DNA, 22 bp, Artificial Sequence
  chemically synthesized
atttgcctagagaaaacatgct

SEQ ID NO: 867810 - DNA, 22 bp, Artificial Sequence
  chemically synthesized
gatttgcctagagaaaacatgc

SEQ ID NO: 867811 - DNA, 22 bp, Artificial Sequence
  chemically synthesized
ggatgatcatagtcttgatttg

SEQ ID NO: 867812 - DNA, 22 bp, Artificial Sequence
  chemically synthesized
tctctaggcaaatcaagactat

SEQ ID NO: 867813 - DNA, 22 bp, Artificial Sequence
  chemically synthesized
ctctaggcaaatcaagactatg

SEQ ID NO: 867814 - DNA, 22 bp, Artificial Sequence
  chemically synthesized
tattaggatgatcatagtcttg

SEQ ID NO: 867815 - DNA, 22 bp, Artificial Sequence
  chemically synthesized
tctaggcaaatcaagactatga

SEQ ID NO: 867816 - DNA, 22 bp, Artificial Sequence
  chemically synthesized
atattaggatgatcatagtctt

SEQ ID NO: 867817 - DNA, 22 bp, Artificial Sequence
  chemically synthesized
taggcaaatcaagactatgatc

SEQ ID NO: 867818 - DNA, 22 bp, Artificial Sequence
  chemically synthesized
ggcaaatcaagactatgatcat

SEQ ID NO: 867819 - DNA, 22 bp, Artificial Sequence
  chemically synthesized
cagtagtcttatattaggatga

SEQ ID NO: 867820 - DNA, 22 bp, Artificial Sequence
  chemically synthesized
ttacagtagtcttatattagga

SEQ ID NO: 867821 - DNA, 22 bp, Artificial Sequence
  chemically synthesized
gactgttacagtagtcttatat

SEQ ID NO: 867822 - DNA, 22 bp, Artificial Sequence
  chemically synthesized
tgatcatcctaatataagacta

SEQ ID NO: 867823 - DNA, 22 bp, Artificial Sequence
  chemically synthesized
ctggactgttacagtagtctta

SEQ ID NO: 867824 - DNA, 22 bp, Artificial Sequence
  chemically synthesized
cctggactgttacagtagtctt

SEQ ID NO: 867825 - DNA, 22 bp, Artificial Sequence
  chemically synthesized
tcctggactgttacagtagtct

SEQ ID NO: 867826 - DNA, 22 bp, Artificial Sequence
  chemically synthesized
tttcctggactgttacagtagt

SEQ ID NO: 867827 - DNA, 22 bp, Artificial Sequence
  chemically synthesized
atataagactactgtaacagtc

SEQ ID NO: 867828 - DNA, 22 bp, Artificial Sequence
  chemically synthesized
atcatctctttcctggactgtt

SEQ ID NO: 867829 - DNA, 22 bp, Artificial Sequence
  chemically synthesized
ctgtaacagtccaggaaagaga

SEQ ID NO: 867830 - DNA, 22 bp, Artificial Sequence
  chemically synthesized
tacaatctcatcatctctttcc

SEQ ID NO: 867831 - DNA, 22 bp, Artificial Sequence
  chemically synthesized
taacagtccaggaaagagatga

SEQ ID NO: 867832 - DNA, 22 bp, Artificial Sequence
  chemically synthesized
catacccctgtacaatctcatc

SEQ ID NO: 867833 - DNA, 22 bp, Artificial Sequence
  chemically synthesized
tcctgcatacccctgtacaatc

SEQ ID NO: 867834 - DNA, 22 bp, Artificial Sequence
  chemically synthesized
atcctgcatacccctgtacaat

SEQ ID NO: 867835 - DNA, 22 bp, Artificial Sequence
  chemically synthesized
gatttatcctgcatacccctgt

SEQ ID NO: 867836 - DNA, 22 bp, Artificial Sequence
  chemically synthesized
agatttatcctgcatacccctg

SEQ ID NO: 867837 - DNA, 22 bp, Artificial Sequence
  chemically synthesized
tagatttatcctgcatacccct

SEQ ID NO: 867838 - DNA, 22 bp, Artificial Sequence
  chemically synthesized
ttagatttatcctgcatacccc

SEQ ID NO: 867839 - DNA, 22 bp, Artificial Sequence
  chemically synthesized
atttttagatttatcctgcata

SEQ ID NO: 867840 - DNA, 22 bp, Artificial Sequence
  chemically synthesized
catttttagatttatcctgcat

SEQ ID NO: 867841 - DNA, 22 bp, Artificial Sequence
  chemically synthesized
tcatttttagatttatcctgca

SEQ ID NO: 867842 - DNA, 22 bp, Artificial Sequence
  chemically synthesized
tacaggggtatgcaggataaat

SEQ ID NO: 867843 - DNA, 22 bp, Artificial Sequence
  chemically synthesized
agctttcatttttagatttatc

SEQ ID NO: 867844 - DNA, 22 bp, Artificial Sequence
  chemically synthesized
gttcagctttcatttttagatt

SEQ ID NO: 867845 - DNA, 22 bp, Artificial Sequence
  chemically synthesized
ggttcagctttcatttttagat

SEQ ID NO: 867846 - DNA, 22 bp, Artificial Sequence
  chemically synthesized
ttggttcagctttcatttttag

SEQ ID NO: 867847 - DNA, 22 bp, Artificial Sequence
  chemically synthesized
cttggttcagctttcattttta

SEQ ID NO: 867848 - DNA, 22 bp, Artificial Sequence
  chemically synthesized
aatatttcttggttcagctttc

SEQ ID NO: 867849 - DNA, 22 bp, Artificial Sequence
  chemically synthesized
ctaaatatttcttggttcagct

SEQ ID NO: 867850 - DNA, 22 bp, Artificial Sequence
  chemically synthesized
ctcctaaatatttcttggttca

SEQ ID NO: 867851 - DNA, 22 bp, Artificial Sequence
  chemically synthesized
aaaatgaaagctgaaccaagaa

SEQ ID NO: 867852 - DNA, 22 bp, Artificial Sequence
  chemically synthesized
gctcctaaatatttcttggttc

SEQ ID NO: 867853 - DNA, 22 bp, Artificial Sequence
  chemically synthesized
tgctcctaaatatttcttggtt

SEQ ID NO: 867854 - DNA, 22 bp, Artificial Sequence
  chemically synthesized
ttgctcctaaatatttcttggt

SEQ ID NO: 867855 - DNA, 22 bp, Artificial Sequence
  chemically synthesized
tttgctcctaaatatttcttgg

SEQ ID NO: 867856 - DNA, 22 bp, Artificial Sequence
  chemically synthesized
ttttgctcctaaatatttcttg

SEQ ID NO: 867857 - DNA, 22 bp, Artificial Sequence
  chemically synthesized
atttttttgctcctaaatattt

SEQ ID NO: 867858 - DNA, 22 bp, Artificial Sequence
  chemically synthesized
aaccaagaaatatttaggagca

SEQ ID NO: 867859 - DNA, 22 bp, Artificial Sequence
  chemically synthesized
agttgatttttttgctcctaaa

SEQ ID NO: 867860 - DNA, 22 bp, Artificial Sequence
  chemically synthesized
agttcagttgatttttttgctc

SEQ ID NO: 867861 - DNA, 22 bp, Artificial Sequence
  chemically synthesized
aggagcaaaaaaatcaactgaa

SEQ ID NO: 867862 - DNA, 22 bp, Artificial Sequence
  chemically synthesized
ggagcaaaaaaatcaactgaac

SEQ ID NO: 867863 - DNA, 22 bp, Artificial Sequence
  chemically synthesized
gacatccaccactaagttcagt

SEQ ID NO: 867864 - DNA, 22 bp, Artificial Sequence
  chemically synthesized
ctggacatccaccactaagttc

SEQ ID NO: 867865 - DNA, 22 bp, Artificial Sequence
  chemically synthesized
acccctgctggacatccaccac

SEQ ID NO: 867866 - DNA, 22 bp, Artificial Sequence
  chemically synthesized
aacttagtggtggatgtccagc

SEQ ID NO: 867867 - DNA, 22 bp, Artificial Sequence
  chemically synthesized
ccacctcacccctgctggacat

SEQ ID NO: 867868 - DNA, 22 bp, Artificial Sequence
  chemically synthesized
cccacctcacccctgctggaca

SEQ ID NO: 867869 - DNA, 22 bp, Artificial Sequence
  chemically synthesized
agtggtggatgtccagcagggg

SEQ ID NO: 867870 - DNA, 22 bp, Artificial Sequence
  chemically synthesized
gtggtggatgtccagcaggggt

SEQ ID NO: 867871 - DNA, 22 bp, Artificial Sequence
  chemically synthesized
aaaccttcccacctcacccctg

SEQ ID NO: 867872 - DNA, 22 bp, Artificial Sequence
  chemically synthesized
aaaaccttcccacctcacccct

SEQ ID NO: 867873 - DNA, 22 bp, Artificial Sequence
  chemically synthesized
ttaaaaccttcccacctcaccc

SEQ ID NO: 867874 - DNA, 22 bp, Artificial Sequence
  chemically synthesized
ggggtcattcttaaaaccttcc

SEQ ID NO: 867875 - DNA, 22 bp, Artificial Sequence
  chemically synthesized
gggggtcattcttaaaaccttc

SEQ ID NO: 867876 - DNA, 22 bp, Artificial Sequence
  chemically synthesized
tccagtaacaaaatcttggggg

SEQ ID NO: 867877 - DNA, 22 bp, Artificial Sequence
  chemically synthesized
taagaatgacccccaagatttt

SEQ ID NO: 867878 - DNA, 22 bp, Artificial Sequence
  chemically synthesized
aagaatgacccccaagattttg

SEQ ID NO: 867879 - DNA, 22 bp, Artificial Sequence
  chemically synthesized
gctatccagtaacaaaatcttg

SEQ ID NO: 867880 - DNA, 22 bp, Artificial Sequence
  chemically synthesized
agaatgacccccaagattttgt

SEQ ID NO: 867881 - DNA, 22 bp, Artificial Sequence
  chemically synthesized
agctatccagtaacaaaatctt

SEQ ID NO: 867882 - DNA, 22 bp, Artificial Sequence
  chemically synthesized
tagcaccacttagctatccagt

SEQ ID NO: 867883 - DNA, 22 bp, Artificial Sequence
  chemically synthesized
gtagcaccacttagctatccag

SEQ ID NO: 867884 - DNA, 22 bp, Artificial Sequence
  chemically synthesized
tgtagcaccacttagctatcca

SEQ ID NO: 867885 - DNA, 22 bp, Artificial Sequence
  chemically synthesized
tgttactggatagctaagtggt

SEQ ID NO: 867886 - DNA, 22 bp, Artificial Sequence
  chemically synthesized
aggttttgtagcaccacttagc

SEQ ID NO: 867887 - DNA, 22 bp, Artificial Sequence
  chemically synthesized
gttactggatagctaagtggtg

SEQ ID NO: 867888 - DNA, 22 bp, Artificial Sequence
  chemically synthesized
caggttttgtagcaccacttag

SEQ ID NO: 867889 - DNA, 22 bp, Artificial Sequence
  chemically synthesized
ttactggatagctaagtggtgc

SEQ ID NO: 867890 - DNA, 22 bp, Artificial Sequence
  chemically synthesized
ttcaggttttgtagcaccactt

SEQ ID NO: 867891 - DNA, 22 bp, Artificial Sequence
  chemically synthesized
cttcaggttttgtagcaccact

SEQ ID NO: 867892 - DNA, 22 bp, Artificial Sequence
  chemically synthesized
ctggatagctaagtggtgctac

SEQ ID NO: 867893 - DNA, 22 bp, Artificial Sequence
  chemically synthesized
tcttcaggttttgtagcaccac

SEQ ID NO: 867894 - DNA, 22 bp, Artificial Sequence
  chemically synthesized
gatagctaagtggtgctacaaa

SEQ ID NO: 867895 - DNA, 22 bp, Artificial Sequence
  chemically synthesized
ctttcttcaggttttgtagcac

SEQ ID NO: 867896 - DNA, 22 bp, Artificial Sequence
  chemically synthesized
agtggtgctacaaaacctgaag

SEQ ID NO: 867897 - DNA, 22 bp, Artificial Sequence
  chemically synthesized
atatattcctttcttcaggttt

SEQ ID NO: 867898 - DNA, 22 bp, Artificial Sequence
  chemically synthesized
ccctgatatattcctttcttca

SEQ ID NO: 867899 - DNA, 22 bp, Artificial Sequence
  chemically synthesized
cccctgatatattcctttcttc

SEQ ID NO: 867900 - DNA, 22 bp, Artificial Sequence
  chemically synthesized
caaaacctgaagaaaggaatat

SEQ ID NO: 867901 - DNA, 22 bp, Artificial Sequence
  chemically synthesized
aagaaaggaatatatcagggga

SEQ ID NO: 867902 - DNA, 22 bp, Artificial Sequence
  chemically synthesized
tgaaatgcatgaccttcccctg

SEQ ID NO: 867903 - DNA, 22 bp, Artificial Sequence
  chemically synthesized
ctatgaaatgcatgaccttccc

SEQ ID NO: 867904 - DNA, 22 bp, Artificial Sequence
  chemically synthesized
ctgctatgaaatgcatgacctt

SEQ ID NO: 867905 - DNA, 22 bp, Artificial Sequence
  chemically synthesized
actgctatgaaatgcatgacct

SEQ ID NO: 867906 - DNA, 22 bp, Artificial Sequence
  chemically synthesized
tactgctatgaaatgcatgacc

SEQ ID NO: 867907 - DNA, 22 bp, Artificial Sequence
  chemically synthesized
ttactgctatgaaatgcatgac

SEQ ID NO: 867908 - DNA, 22 bp, Artificial Sequence
  chemically synthesized
atgatcttttactgctatgaaa

SEQ ID NO: 867909 - DNA, 22 bp, Artificial Sequence
  chemically synthesized
aaaaataatctcatgatctttt

SEQ ID NO: 867910 - DNA, 22 bp, Artificial Sequence
  chemically synthesized
catagcagtaaaagatcatgag

SEQ ID NO: 867911 - DNA, 22 bp, Artificial Sequence
  chemically synthesized
atagcagtaaaagatcatgaga

SEQ ID NO: 867912 - DNA, 22 bp, Artificial Sequence
  chemically synthesized
gatgtctcaaaaataatctcat

SEQ ID NO: 867913 - DNA, 22 bp, Artificial Sequence
  chemically synthesized
agatgtctcaaaaataatctca

SEQ ID NO: 867914 - DNA, 22 bp, Artificial Sequence
  chemically synthesized
cacttagatgtctcaaaaataa

SEQ ID NO: 867915 - DNA, 22 bp, Artificial Sequence
  chemically synthesized
aacagttccacttagatgtctc

SEQ ID NO: 867916 - DNA, 22 bp, Artificial Sequence
  chemically synthesized
ctcaacagttccacttagatgt

SEQ ID NO: 867917 - DNA, 22 bp, Artificial Sequence
  chemically synthesized
tttttgagacatctaagtggaa

SEQ ID NO: 867918 - DNA, 22 bp, Artificial Sequence
  chemically synthesized
cctactcaacagttccacttag

SEQ ID NO: 867919 - DNA, 22 bp, Artificial Sequence
  chemically synthesized
ttgagacatctaagtggaactg

SEQ ID NO: 867920 - DNA, 22 bp, Artificial Sequence
  chemically synthesized
tgagacatctaagtggaactgt

SEQ ID NO: 867921 - DNA, 22 bp, Artificial Sequence
  chemically synthesized
actgcctactcaacagttccac

SEQ ID NO: 867922 - DNA, 22 bp, Artificial Sequence
  chemically synthesized
gagacatctaagtggaactgtt

SEQ ID NO: 867923 - DNA, 22 bp, Artificial Sequence
  chemically synthesized
aactgcctactcaacagttcca

SEQ ID NO: 867924 - DNA, 22 bp, Artificial Sequence
  chemically synthesized
agacatctaagtggaactgttg

SEQ ID NO: 867925 - DNA, 22 bp, Artificial Sequence
  chemically synthesized
catatttaactgcctactcaac

SEQ ID NO: 867926 - DNA, 22 bp, Artificial Sequence
  chemically synthesized
agtggaactgttgagtaggcag

SEQ ID NO: 867927 - DNA, 22 bp, Artificial Sequence
  chemically synthesized
catactgcatatttaactgcct

SEQ ID NO: 867928 - DNA, 22 bp, Artificial Sequence
  chemically synthesized
tattccatactgcatatttaac

SEQ ID NO: 867929 - DNA, 22 bp, Artificial Sequence
  chemically synthesized
ttgagtaggcagttaaatatgc

SEQ ID NO: 867930 - DNA, 22 bp, Artificial Sequence
  chemically synthesized
tgtattccatactgcatattta

SEQ ID NO: 867931 - DNA, 22 bp, Artificial Sequence
  chemically synthesized
agtaggcagttaaatatgcagt

SEQ ID NO: 867932 - DNA, 22 bp, Artificial Sequence
  chemically synthesized
ctctgtattccatactgcatat

SEQ ID NO: 867933 - DNA, 22 bp, Artificial Sequence
  chemically synthesized
aatatgcagtatggaatacaga

SEQ ID NO: 867934 - DNA, 22 bp, Artificial Sequence
  chemically synthesized
aggcatgaaaaaagttcctctg

SEQ ID NO: 867935 - DNA, 22 bp, Artificial Sequence
  chemically synthesized
aaggcatgaaaaaagttcctct

SEQ ID NO: 867936 - DNA, 22 bp, Artificial Sequence
  chemically synthesized
taaggcatgaaaaaagttcctc

SEQ ID NO: 867937 - DNA, 22 bp, Artificial Sequence
  chemically synthesized
aaagaggagaagactttaaggc

SEQ ID NO: 867938 - DNA, 22 bp, Artificial Sequence
  chemically synthesized
ttttcatgccttaaagtcttct

SEQ ID NO: 867939 - DNA, 22 bp, Artificial Sequence
  chemically synthesized
tttcatgccttaaagtcttctc

SEQ ID NO: 867940 - DNA, 22 bp, Artificial Sequence
  chemically synthesized
ttcatgccttaaagtcttctcc

SEQ ID NO: 867941 - DNA, 22 bp, Artificial Sequence
  chemically synthesized
tcatgccttaaagtcttctcct

SEQ ID NO: 867942 - DNA, 22 bp, Artificial Sequence
  chemically synthesized
catgccttaaagtcttctcctc

SEQ ID NO: 867943 - DNA, 22 bp, Artificial Sequence
  chemically synthesized
atgccttaaagtcttctcctct

SEQ ID NO: 867944 - DNA, 22 bp, Artificial Sequence
  chemically synthesized
aaagtcttctcctctttcagtt

SEQ ID NO: 867945 - DNA, 22 bp, Artificial Sequence
  chemically synthesized
aagtcttctcctctttcagttc

SEQ ID NO: 867946 - DNA, 22 bp, Artificial Sequence
  chemically synthesized
ctcctctttcagttccattttt

SEQ ID NO: 867947 - DNA, 22 bp, Artificial Sequence
  chemically synthesized
tcctctttcagttccatttttc

SEQ ID NO: 867948 - DNA, 22 bp, Artificial Sequence
  chemically synthesized
ctctttcagttccatttttctt

SEQ ID NO: 867949 - DNA, 22 bp, Artificial Sequence
  chemically synthesized
tttcagttccatttttcttatt

SEQ ID NO: 867950 - DNA, 22 bp, Artificial Sequence
  chemically synthesized
tcagttccatttttcttattgt

SEQ ID NO: 867951 - DNA, 22 bp, Artificial Sequence
  chemically synthesized
cagttccatttttcttattgtt

SEQ ID NO: 867952 - DNA, 22 bp, Artificial Sequence
  chemically synthesized
agttccatttttcttattgttg

SEQ ID NO: 867953 - DNA, 22 bp, Artificial Sequence
  chemically synthesized
aggggacccaaagacaacaata

SEQ ID NO: 867954 - DNA, 22 bp, Artificial Sequence
  chemically synthesized
caggggacccaaagacaacaat

SEQ ID NO: 867955 - DNA, 22 bp, Artificial Sequence
  chemically synthesized
tcaggggacccaaagacaacaa

SEQ ID NO: 867956 - DNA, 22 bp, Artificial Sequence
  chemically synthesized
catttttcttattgttgtcttt

SEQ ID NO: 867957 - DNA, 22 bp, Artificial Sequence
  chemically synthesized
ttttcaggggacccaaagacaa

SEQ ID NO: 867958 - DNA, 22 bp, Artificial Sequence
  chemically synthesized
ttcttattgttgtctttgggtc

SEQ ID NO: 867959 - DNA, 22 bp, Artificial Sequence
  chemically synthesized
tcttattgttgtctttgggtcc

SEQ ID NO: 867960 - DNA, 22 bp, Artificial Sequence
  chemically synthesized
cttattgttgtctttgggtccc

SEQ ID NO: 867961 - DNA, 22 bp, Artificial Sequence
  chemically synthesized
ttattgttgtctttgggtcccc

SEQ ID NO: 867962 - DNA, 22 bp, Artificial Sequence
  chemically synthesized
attgttgtctttgggtcccctg

SEQ ID NO: 867963 - DNA, 22 bp, Artificial Sequence
  chemically synthesized
ttgttgtctttgggtcccctga

SEQ ID NO: 867964 - DNA, 22 bp, Artificial Sequence
  chemically synthesized
ttgtctttgggtcccctgaaaa

SEQ ID NO: 867965 - DNA, 22 bp, Artificial Sequence
  chemically synthesized
atccaggccctgttttcagggg

SEQ ID NO: 867966 - DNA, 22 bp, Artificial Sequence
  chemically synthesized
tctttgggtcccctgaaaacag

SEQ ID NO: 867967 - DNA, 22 bp, Artificial Sequence
  chemically synthesized
tgggtcccctgaaaacagggcc

SEQ ID NO: 867968 - DNA, 22 bp, Artificial Sequence
  chemically synthesized
gggtcccctgaaaacagggcct

SEQ ID NO: 867969 - DNA, 22 bp, Artificial Sequence
  chemically synthesized
ggtcccctgaaaacagggcctg

SEQ ID NO: 867970 - DNA, 22 bp, Artificial Sequence
  chemically synthesized
tacccaagtcctcatccaggcc

SEQ ID NO: 867971 - DNA, 22 bp, Artificial Sequence
  chemically synthesized
tctgtacccaagtcctcatcca

SEQ ID NO: 867972 - DNA, 22 bp, Artificial Sequence
  chemically synthesized
aaaacagggcctggatgaggac

SEQ ID NO: 867973 - DNA, 22 bp, Artificial Sequence
  chemically synthesized
caaatgagctatctgtacccaa

SEQ ID NO: 867974 - DNA, 22 bp, Artificial Sequence
  chemically synthesized
ccaaatgagctatctgtaccca

SEQ ID NO: 867975 - DNA, 22 bp, Artificial Sequence
  chemically synthesized
gatgaggacttgggtacagata

SEQ ID NO: 867976 - DNA, 22 bp, Artificial Sequence
  chemically synthesized
gggatcagcttccaaatgagct

SEQ ID NO: 867977 - DNA, 22 bp, Artificial Sequence
  chemically synthesized
gggtacagatagctcatttgga

SEQ ID NO: 867978 - DNA, 22 bp, Artificial Sequence
  chemically synthesized
ggtacagatagctcatttggaa

SEQ ID NO: 867979 - DNA, 22 bp, Artificial Sequence
  chemically synthesized
ctagggatcagcttccaaatga

SEQ ID NO: 867980 - DNA, 22 bp, Artificial Sequence
  chemically synthesized
cctagggatcagcttccaaatg

SEQ ID NO: 867981 - DNA, 22 bp, Artificial Sequence
  chemically synthesized
cttcctagggatcagcttccaa

SEQ ID NO: 867982 - DNA, 22 bp, Artificial Sequence
  chemically synthesized
gcttcctagggatcagcttcca

SEQ ID NO: 867983 - DNA, 22 bp, Artificial Sequence
  chemically synthesized
ttgcttcctagggatcagcttc

SEQ ID NO: 867984 - DNA, 22 bp, Artificial Sequence
  chemically synthesized
attcttgcttcctagggatcag

SEQ ID NO: 867985 - DNA, 22 bp, Artificial Sequence
  chemically synthesized
cattcttgcttcctagggatca

SEQ ID NO: 867986 - DNA, 22 bp, Artificial Sequence
  chemically synthesized
tcattcttgcttcctagggatc

SEQ ID NO: 867987 - DNA, 22 bp, Artificial Sequence
  chemically synthesized
atttggaagctgatccctagga

SEQ ID NO: 867988 - DNA, 22 bp, Artificial Sequence
  chemically synthesized
ttcattcttgcttcctagggat

SEQ ID NO: 867989 - DNA, 22 bp, Artificial Sequence
  chemically synthesized
ggaagctgatccctaggaagca

SEQ ID NO: 867990 - DNA, 22 bp, Artificial Sequence
  chemically synthesized
gtttttcattcttgcttcctag

SEQ ID NO: 867991 - DNA, 22 bp, Artificial Sequence
  chemically synthesized
gaagctgatccctaggaagcaa

SEQ ID NO: 867992 - DNA, 22 bp, Artificial Sequence
  chemically synthesized
ggtttttcattcttgcttccta

SEQ ID NO: 867993 - DNA, 22 bp, Artificial Sequence
  chemically synthesized
tggtttttcattcttgcttcct

SEQ ID NO: 867994 - DNA, 22 bp, Artificial Sequence
  chemically synthesized
ttggtttttcattcttgcttcc

SEQ ID NO: 867995 - DNA, 22 bp, Artificial Sequence
  chemically synthesized
ttttggtttttcattcttgctt

SEQ ID NO: 867996 - DNA, 22 bp, Artificial Sequence
  chemically synthesized
atccctaggaagcaagaatgaa

SEQ ID NO: 867997 - DNA, 22 bp, Artificial Sequence
  chemically synthesized
actcttttggtttttcattctt

SEQ ID NO: 867998 - DNA, 22 bp, Artificial Sequence
  chemically synthesized
tctcactcttttggtttttcat

SEQ ID NO: 867999 - DNA, 22 bp, Artificial Sequence
  chemically synthesized
ggaagcaagaatgaaaaaccaa

SEQ ID NO: 868000 - DNA, 22 bp, Artificial Sequence
  chemically synthesized
tgtctcactcttttggtttttc

SEQ ID NO: 868001 - DNA, 22 bp, Artificial Sequence
  chemically synthesized
cccctctgtctcactcttttgg

SEQ ID NO: 868002 - DNA, 22 bp, Artificial Sequence
  chemically synthesized
ctccccctctgtctcactcttt

SEQ ID NO: 868003 - DNA, 22 bp, Artificial Sequence
  chemically synthesized
cctccccctctgtctcactctt

SEQ ID NO: 868004 - DNA, 22 bp, Artificial Sequence
  chemically synthesized
gcatttcctccccctctgtctc

SEQ ID NO: 868005 - DNA, 22 bp, Artificial Sequence
  chemically synthesized
attggcatttcctccccctctg

SEQ ID NO: 868006 - DNA, 22 bp, Artificial Sequence
  chemically synthesized
gattggcatttcctccccctct

SEQ ID NO: 868007 - DNA, 22 bp, Artificial Sequence
  chemically synthesized
atgataatacatttgattggca

SEQ ID NO: 868008 - DNA, 22 bp, Artificial Sequence
  chemically synthesized
gatgataatacatttgattggc

SEQ ID NO: 868009 - DNA, 22 bp, Artificial Sequence
  chemically synthesized
ccttgatgataatacatttgat

SEQ ID NO: 868010 - DNA, 22 bp, Artificial Sequence
  chemically synthesized
tcatcaaggtaatgcttatgga

SEQ ID NO: 868011 - DNA, 22 bp, Artificial Sequence
  chemically synthesized
tcaaaatacagtccccatggtc

SEQ ID NO: 868012 - DNA, 22 bp, Artificial Sequence
  chemically synthesized
tgtcaaaatacagtccccatgg

SEQ ID NO: 868013 - DNA, 22 bp, Artificial Sequence
  chemically synthesized
atggaccatggggactgtattt

SEQ ID NO: 868014 - DNA, 22 bp, Artificial Sequence
  chemically synthesized
tggaccatggggactgtatttt

SEQ ID NO: 868015 - DNA, 22 bp, Artificial Sequence
  chemically synthesized
aggaacatacaaaagttctgtc

SEQ ID NO: 868016 - DNA, 22 bp, Artificial Sequence
  chemically synthesized
tcaggaacatacaaaagttctg

SEQ ID NO: 868017 - DNA, 22 bp, Artificial Sequence
  chemically synthesized
tattttgacagaacttttgtat

SEQ ID NO: 868018 - DNA, 22 bp, Artificial Sequence
  chemically synthesized
tgattctcaggaacatacaaaa

SEQ ID NO: 868019 - DNA, 22 bp, Artificial Sequence
  chemically synthesized
tgtgattctcaggaacatacaa

SEQ ID NO: 868020 - DNA, 22 bp, Artificial Sequence
  chemically synthesized
tgacagaacttttgtatgttcc

SEQ ID NO: 868021 - DNA, 22 bp, Artificial Sequence
  chemically synthesized
gacagaacttttgtatgttcct

SEQ ID NO: 868022 - DNA, 22 bp, Artificial Sequence
  chemically synthesized
tctgtgattctcaggaacatac

SEQ ID NO: 868023 - DNA, 22 bp, Artificial Sequence
  chemically synthesized
acagaacttttgtatgttcctg

SEQ ID NO: 868024 - DNA, 22 bp, Artificial Sequence
  chemically synthesized
ttgtatgttcctgagaatcaca

SEQ ID NO: 868025 - DNA, 22 bp, Artificial Sequence
  chemically synthesized
tgtatgttcctgagaatcacag

SEQ ID NO: 868026 - DNA, 22 bp, Artificial Sequence
  chemically synthesized
gtatgttcctgagaatcacaga

SEQ ID NO: 868027 - DNA, 22 bp, Artificial Sequence
  chemically synthesized
tatgttcctgagaatcacagag

SEQ ID NO: 868028 - DNA, 22 bp, Artificial Sequence
  chemically synthesized
cgggggcaaggggaattctctg

SEQ ID NO: 868029 - DNA, 22 bp, Artificial Sequence
  chemically synthesized
ccgggggcaaggggaattctct

SEQ ID NO: 868030 - DNA, 22 bp, Artificial Sequence
  chemically synthesized
ctgagaatcacagagaattccc

SEQ ID NO: 868031 - DNA, 22 bp, Artificial Sequence
  chemically synthesized
cttccgggggcaaggggaattc

SEQ ID NO: 868032 - DNA, 22 bp, Artificial Sequence
  chemically synthesized
agaatcacagagaattcccctt

SEQ ID NO: 868033 - DNA, 22 bp, Artificial Sequence
  chemically synthesized
ttccttccgggggcaaggggaa

SEQ ID NO: 868034 - DNA, 22 bp, Artificial Sequence
  chemically synthesized
accactattccttccgggggca

SEQ ID NO: 868035 - DNA, 22 bp, Artificial Sequence
  chemically synthesized
aaccactattccttccgggggc

SEQ ID NO: 868036 - DNA, 22 bp, Artificial Sequence
  chemically synthesized
taaccactattccttccggggg

SEQ ID NO: 868037 - DNA, 22 bp, Artificial Sequence
  chemically synthesized
ttaaccactattccttccgggg

SEQ ID NO: 868038 - DNA, 22 bp, Artificial Sequence
  chemically synthesized
cccttgcccccggaaggaatag

SEQ ID NO: 868039 - DNA, 22 bp, Artificial Sequence
  chemically synthesized
gcccccggaaggaatagtggtt

SEQ ID NO: 868040 - DNA, 22 bp, Artificial Sequence
  chemically synthesized
cccccggaaggaatagtggtta

SEQ ID NO: 868041 - DNA, 22 bp, Artificial Sequence
  chemically synthesized
aaaatatatccatgggctccca

SEQ ID NO: 868042 - DNA, 22 bp, Artificial Sequence
  chemically synthesized
aaccaatggagatgggagccca

SEQ ID NO: 868043 - DNA, 22 bp, Artificial Sequence
  chemically synthesized
caaccaatggagatgggagccc

SEQ ID NO: 868044 - DNA, 22 bp, Artificial Sequence
  chemically synthesized
gtgagtgagcaaccttcaacca

SEQ ID NO: 868045 - DNA, 22 bp, Artificial Sequence
  chemically synthesized
agtgagtgagcaaccttcaacc

SEQ ID NO: 868046 - DNA, 22 bp, Artificial Sequence
  chemically synthesized
ccatctccattggttgaaggtt

SEQ ID NO: 868047 - DNA, 22 bp, Artificial Sequence
  chemically synthesized
tagtgagtgagcaaccttcaac

SEQ ID NO: 868048 - DNA, 22 bp, Artificial Sequence
  chemically synthesized
aagttttagtgagtgagcaacc

SEQ ID NO: 868049 - DNA, 22 bp, Artificial Sequence
  chemically synthesized
cattggttgaaggttgctcact

SEQ ID NO: 868050 - DNA, 22 bp, Artificial Sequence
  chemically synthesized
gaagttttagtgagtgagcaac

SEQ ID NO: 868051 - DNA, 22 bp, Artificial Sequence
  chemically synthesized
gttgaaggttgctcactcacta

SEQ ID NO: 868052 - DNA, 22 bp, Artificial Sequence
  chemically synthesized
acccttgaagttttagtgagtg

SEQ ID NO: 868053 - DNA, 22 bp, Artificial Sequence
  chemically synthesized
tcacccttgaagttttagtgag

SEQ ID NO: 868054 - DNA, 22 bp, Artificial Sequence
  chemically synthesized
aaggttgctcactcactaaaac

SEQ ID NO: 868055 - DNA, 22 bp, Artificial Sequence
  chemically synthesized
ctcacccttgaagttttagtga

SEQ ID NO: 868056 - DNA, 22 bp, Artificial Sequence
  chemically synthesized
tctcacccttgaagttttagtg

SEQ ID NO: 868057 - DNA, 22 bp, Artificial Sequence
  chemically synthesized
ctcactcactaaaacttcaagg

SEQ ID NO: 868058 - DNA, 22 bp, Artificial Sequence
  chemically synthesized
tgagctttctcacccttgaagt

SEQ ID NO: 868059 - DNA, 22 bp, Artificial Sequence
  chemically synthesized
gtgagctttctcacccttgaag

SEQ ID NO: 868060 - DNA, 22 bp, Artificial Sequence
  chemically synthesized
actcactaaaacttcaagggtg

SEQ ID NO: 868061 - DNA, 22 bp, Artificial Sequence
  chemically synthesized
tgtgagctttctcacccttgaa

SEQ ID NO: 868062 - DNA, 22 bp, Artificial Sequence
  chemically synthesized
actaaaacttcaagggtgagaa

SEQ ID NO: 868063 - DNA, 22 bp, Artificial Sequence
  chemically synthesized
aaacttcaagggtgagaaagct

SEQ ID NO: 868064 - DNA, 22 bp, Artificial Sequence
  chemically synthesized
caagggtgagaaagctcacaaa

SEQ ID NO: 868065 - DNA, 22 bp, Artificial Sequence
  chemically synthesized
aagggtgagaaagctcacaaaa

SEQ ID NO: 868066 - DNA, 22 bp, Artificial Sequence
  chemically synthesized
acatcccaggagcccacagatt

SEQ ID NO: 868067 - DNA, 22 bp, Artificial Sequence
  chemically synthesized
tgacatcccaggagcccacaga

SEQ ID NO: 868068 - DNA, 22 bp, Artificial Sequence
  chemically synthesized
tctgacatcccaggagcccaca

SEQ ID NO: 868069 - DNA, 22 bp, Artificial Sequence
  chemically synthesized
ctctgacatcccaggagcccac

SEQ ID NO: 868070 - DNA, 22 bp, Artificial Sequence
  chemically synthesized
acaaaatctgtgggctcctggg

SEQ ID NO: 868071 - DNA, 22 bp, Artificial Sequence
  chemically synthesized
agggacttctctgacatcccag

SEQ ID NO: 868072 - DNA, 22 bp, Artificial Sequence
  chemically synthesized
tctaagggacttctctgacatc

SEQ ID NO: 868073 - DNA, 22 bp, Artificial Sequence
  chemically synthesized
tgggctcctgggatgtcagaga

SEQ ID NO: 868074 - DNA, 22 bp, Artificial Sequence
  chemically synthesized
tatctaagggacttctctgaca

SEQ ID NO: 868075 - DNA, 22 bp, Artificial Sequence
  chemically synthesized
ctatctaagggacttctctgac

SEQ ID NO: 868076 - DNA, 22 bp, Artificial Sequence
  chemically synthesized
tctatctaagggacttctctga

SEQ ID NO: 868077 - DNA, 22 bp, Artificial Sequence
  chemically synthesized
ctttctatctaagggacttctc

SEQ ID NO: 868078 - DNA, 22 bp, Artificial Sequence
  chemically synthesized
ctgggatgtcagagaagtccct

SEQ ID NO: 868079 - DNA, 22 bp, Artificial Sequence
  chemically synthesized
tactttctatctaagggacttc

SEQ ID NO: 868080 - DNA, 22 bp, Artificial Sequence
  chemically synthesized
ctactttctatctaagggactt

SEQ ID NO: 868081 - DNA, 22 bp, Artificial Sequence
  chemically synthesized
ggatgtcagagaagtcccttag

SEQ ID NO: 868082 - DNA, 22 bp, Artificial Sequence
  chemically synthesized
tctactttctatctaagggact

SEQ ID NO: 868083 - DNA, 22 bp, Artificial Sequence
  chemically synthesized
ttctactttctatctaagggac

SEQ ID NO: 868084 - DNA, 22 bp, Artificial Sequence
  chemically synthesized
ccatttttctactttctatcta

SEQ ID NO: 868085 - DNA, 22 bp, Artificial Sequence
  chemically synthesized
agatagaaagtagaaaaatggg

SEQ ID NO: 868086 - DNA, 22 bp, Artificial Sequence
  chemically synthesized
gatagaaagtagaaaaatggga

SEQ ID NO: 868087 - DNA, 22 bp, Artificial Sequence
  chemically synthesized
acagcatcccatgtcaagggaa

SEQ ID NO: 868088 - DNA, 22 bp, Artificial Sequence
  chemically synthesized
gctgacagcatcccatgtcaag

SEQ ID NO: 868089 - DNA, 22 bp, Artificial Sequence
  chemically synthesized
agctgacagcatcccatgtcaa

SEQ ID NO: 868090 - DNA, 22 bp, Artificial Sequence
  chemically synthesized
tagctgacagcatcccatgtca

SEQ ID NO: 868091 - DNA, 22 bp, Artificial Sequence
  chemically synthesized
cctttagctgacagcatcccat

SEQ ID NO: 868092 - DNA, 22 bp, Artificial Sequence
  chemically synthesized
gcctttagctgacagcatccca

SEQ ID NO: 868093 - DNA, 22 bp, Artificial Sequence
  chemically synthesized
ccttgacatgggatgctgtcag

SEQ ID NO: 868094 - DNA, 22 bp, Artificial Sequence
  chemically synthesized
agacttgcctttagctgacagc

SEQ ID NO: 868095 - DNA, 22 bp, Artificial Sequence
  chemically synthesized
gacatgggatgctgtcagctaa

SEQ ID NO: 868096 - DNA, 22 bp, Artificial Sequence
  chemically synthesized
acatgggatgctgtcagctaaa

SEQ ID NO: 868097 - DNA, 22 bp, Artificial Sequence
  chemically synthesized
tgtgagttcagacttgccttta

SEQ ID NO: 868098 - DNA, 22 bp, Artificial Sequence
  chemically synthesized
tcagctaaaggcaagtctgaac

SEQ ID NO: 868099 - DNA, 22 bp, Artificial Sequence
  chemically synthesized
aaggcaagtctgaactcacaca

SEQ ID NO: 868100 - DNA, 22 bp, Artificial Sequence
  chemically synthesized
cagtggacagccctgtgtgagt

SEQ ID NO: 868101 - DNA, 22 bp, Artificial Sequence
  chemically synthesized
cagctgcagtggacagccctgt

SEQ ID NO: 868102 - DNA, 22 bp, Artificial Sequence
  chemically synthesized
aactcacacagggctgtccact

SEQ ID NO: 868103 - DNA, 22 bp, Artificial Sequence
  chemically synthesized
cagttgcagctgcagtggacag

SEQ ID NO: 868104 - DNA, 22 bp, Artificial Sequence
  chemically synthesized
acacagggctgtccactgcagc

SEQ ID NO: 868105 - DNA, 22 bp, Artificial Sequence
  chemically synthesized
cactgcagttgcagctgcagtg

SEQ ID NO: 868106 - DNA, 22 bp, Artificial Sequence
  chemically synthesized
ctgcactgcagttgcagctgca

SEQ ID NO: 868107 - DNA, 22 bp, Artificial Sequence
  chemically synthesized
cctgcactgcagttgcagctgc

SEQ ID NO: 868108 - DNA, 22 bp, Artificial Sequence
  chemically synthesized
tcctgcactgcagttgcagctg

SEQ ID NO: 868109 - DNA, 22 bp, Artificial Sequence
  chemically synthesized
tccactgcagctgcaactgcag

SEQ ID NO: 868110 - DNA, 22 bp, Artificial Sequence
  chemically synthesized
cagctgcaactgcagtgcagga

SEQ ID NO: 868111 - DNA, 22 bp, Artificial Sequence
  chemically synthesized
gagtcacacgccattttcctgc

SEQ ID NO: 868112 - DNA, 22 bp, Artificial Sequence
  chemically synthesized
caactgcagtgcaggaaaatgg

SEQ ID NO: 868113 - DNA, 22 bp, Artificial Sequence
  chemically synthesized
gtgcctggagtcacacgccatt

SEQ ID NO: 868114 - DNA, 22 bp, Artificial Sequence
  chemically synthesized
cagtgcaggaaaatggcgtgtg

SEQ ID NO: 868115 - DNA, 22 bp, Artificial Sequence
  chemically synthesized
ccctggtgcctggagtcacacg

SEQ ID NO: 868116 - DNA, 22 bp, Artificial Sequence
  chemically synthesized
taacagattcccctggtgcctg

SEQ ID NO: 868117 - DNA, 22 bp, Artificial Sequence
  chemically synthesized
caggcaccaggggaatctgtta

SEQ ID NO: 868118 - DNA, 22 bp, Artificial Sequence
  chemically synthesized
tcatcacaattgtaacagattc

SEQ ID NO: 868119 - DNA, 22 bp, Artificial Sequence
  chemically synthesized
caaaagattatcatcacaattg

SEQ ID NO: 868120 - DNA, 22 bp, Artificial Sequence
  chemically synthesized
ccaaaagattatcatcacaatt

SEQ ID NO: 868121 - DNA, 22 bp, Artificial Sequence
  chemically synthesized
ttacaattgtgatgataatctt

SEQ ID NO: 868122 - DNA, 22 bp, Artificial Sequence
  chemically synthesized
caattgtgatgataatcttttg

SEQ ID NO: 868123 - DNA, 22 bp, Artificial Sequence
  chemically synthesized
tgatgataatcttttggaagct

SEQ ID NO: 868124 - DNA, 22 bp, Artificial Sequence
  chemically synthesized
taaaagaaaataaaagcttcca

SEQ ID NO: 868125 - DNA, 22 bp, Artificial Sequence
  chemically synthesized
actgtaaaagaaaataaaagct

SEQ ID NO: 868126 - DNA, 22 bp, Artificial Sequence
  chemically synthesized
cactgtaaaagaaaataaaagc

SEQ ID NO: 868127 - DNA, 22 bp, Artificial Sequence
  chemically synthesized
ttggaagcttttattttctttt

SEQ ID NO: 868128 - DNA, 22 bp, Artificial Sequence
  chemically synthesized
tggaagcttttattttctttta

SEQ ID NO: 868129 - DNA, 22 bp, Artificial Sequence
  chemically synthesized
ggaagcttttattttcttttac

SEQ ID NO: 868130 - DNA, 22 bp, Artificial Sequence
  chemically synthesized
gaagcttttattttcttttaca

SEQ ID NO: 868131 - DNA, 22 bp, Artificial Sequence
  chemically synthesized
ttattttcttttacagtgaaat

SEQ ID NO: 868132 - DNA, 22 bp, Artificial Sequence
  chemically synthesized
tagataagacagatttcactgt

SEQ ID NO: 868133 - DNA, 22 bp, Artificial Sequence
  chemically synthesized
tattttcttttacagtgaaatc

SEQ ID NO: 868134 - DNA, 22 bp, Artificial Sequence
  chemically synthesized
attttcttttacagtgaaatct

SEQ ID NO: 868135 - DNA, 22 bp, Artificial Sequence
  chemically synthesized
ttttcttttacagtgaaatctg

SEQ ID NO: 868136 - DNA, 22 bp, Artificial Sequence
  chemically synthesized
tcttttacagtgaaatctgtct

SEQ ID NO: 868137 - DNA, 22 bp, Artificial Sequence
  chemically synthesized
cttttacagtgaaatctgtctt

SEQ ID NO: 868138 - DNA, 22 bp, Artificial Sequence
  chemically synthesized
ttttacagtgaaatctgtctta

SEQ ID NO: 868139 - DNA, 22 bp, Artificial Sequence
  chemically synthesized
ttacagtgaaatctgtcttatc

SEQ ID NO: 868140 - DNA, 22 bp, Artificial Sequence
  chemically synthesized
tacagtgaaatctgtcttatct

SEQ ID NO: 868141 - DNA, 22 bp, Artificial Sequence
  chemically synthesized
acagtgaaatctgtcttatcta

SEQ ID NO: 868142 - DNA, 22 bp, Artificial Sequence
  chemically synthesized
tgtaatcatctatagataagac

SEQ ID NO: 868143 - DNA, 22 bp, Artificial Sequence
  chemically synthesized
cagtgaaatctgtcttatctat

SEQ ID NO: 868144 - DNA, 22 bp, Artificial Sequence
  chemically synthesized
tatgtaatcatctatagataag

SEQ ID NO: 868145 - DNA, 22 bp, Artificial Sequence
  chemically synthesized
tcttatctatagatgattacat

SEQ ID NO: 868146 - DNA, 22 bp, Artificial Sequence
  chemically synthesized
tgtgtacgttctatgtaatcat

SEQ ID NO: 868147 - DNA, 22 bp, Artificial Sequence
  chemically synthesized
atgtgtacgttctatgtaatca

SEQ ID NO: 868148 - DNA, 22 bp, Artificial Sequence
  chemically synthesized
tatgtgtacgttctatgtaatc

SEQ ID NO: 868149 - DNA, 22 bp, Artificial Sequence
  chemically synthesized
atctatagatgattacatagaa

SEQ ID NO: 868150 - DNA, 22 bp, Artificial Sequence
  chemically synthesized
tctatagatgattacatagaac

SEQ ID NO: 868151 - DNA, 22 bp, Artificial Sequence
  chemically synthesized
acactttatgtgtacgttctat

SEQ ID NO: 868152 - DNA, 22 bp, Artificial Sequence
  chemically synthesized
tagatgattacatagaacgtac

SEQ ID NO: 868153 - DNA, 22 bp, Artificial Sequence
  chemically synthesized
cacactttatgtgtacgttcta

SEQ ID NO: 868154 - DNA, 22 bp, Artificial Sequence
  chemically synthesized
ttcacactttatgtgtacgttc

SEQ ID NO: 868155 - DNA, 22 bp, Artificial Sequence
  chemically synthesized
ttcttcacactttatgtgtacg

SEQ ID NO: 868156 - DNA, 22 bp, Artificial Sequence
  chemically synthesized
catagaacgtacacataaagtg

SEQ ID NO: 868157 - DNA, 22 bp, Artificial Sequence
  chemically synthesized
taattattcttcacactttatg

SEQ ID NO: 868158 - DNA, 22 bp, Artificial Sequence
  chemically synthesized
ataattattcttcacactttat

SEQ ID NO: 868159 - DNA, 22 bp, Artificial Sequence
  chemically synthesized
tataattattcttcacacttta

SEQ ID NO: 868160 - DNA, 22 bp, Artificial Sequence
  chemically synthesized
ctttataattattcttcacact

SEQ ID NO: 868161 - DNA, 22 bp, Artificial Sequence
  chemically synthesized
cataaagtgttgctttataatt

SEQ ID NO: 868162 - DNA, 22 bp, Artificial Sequence
  chemically synthesized
acataaagtgttgctttataat

SEQ ID NO: 868163 - DNA, 22 bp, Artificial Sequence
  chemically synthesized
tatttacataaagtgttgcttt

SEQ ID NO: 868164 - DNA, 22 bp, Artificial Sequence
  chemically synthesized
gggttgtatttacataaagtgt

SEQ ID NO: 868165 - DNA, 22 bp, Artificial Sequence
  chemically synthesized
attggggttgtatttacataaa

SEQ ID NO: 868166 - DNA, 22 bp, Artificial Sequence
  chemically synthesized
taaagcaacactttatgtaaat

SEQ ID NO: 868167 - DNA, 22 bp, Artificial Sequence
  chemically synthesized
gattggggttgtatttacataa

SEQ ID NO: 868168 - DNA, 22 bp, Artificial Sequence
  chemically synthesized
ttgattggggttgtatttacat

SEQ ID NO: 868169 - DNA, 22 bp, Artificial Sequence
  chemically synthesized
cttgattggggttgtatttaca

SEQ ID NO: 868170 - DNA, 22 bp, Artificial Sequence
  chemically synthesized
tttcttgattggggttgtattt

SEQ ID NO: 868171 - DNA, 22 bp, Artificial Sequence
  chemically synthesized
tatttcttgattggggttgtat

SEQ ID NO: 868172 - DNA, 22 bp, Artificial Sequence
  chemically synthesized
tatgtaaatacaaccccaatca

SEQ ID NO: 868173 - DNA, 22 bp, Artificial Sequence
  chemically synthesized
atgtaaatacaaccccaatcaa

SEQ ID NO: 868174 - DNA, 22 bp, Artificial Sequence
  chemically synthesized
tgtaaatacaaccccaatcaag

SEQ ID NO: 868175 - DNA, 22 bp, Artificial Sequence
  chemically synthesized
gcagtattctatttcttgattg

SEQ ID NO: 868176 - DNA, 22 bp, Artificial Sequence
  chemically synthesized
tggggaacacaagggtggggtc

SEQ ID NO: 868177 - DNA, 22 bp, Artificial Sequence
  chemically synthesized
ctaataccttgaccccaccctt

SEQ ID NO: 868178 - DNA, 22 bp, Artificial Sequence
  chemically synthesized
ataccttgaccccacccttgtg

SEQ ID NO: 868179 - DNA, 22 bp, Artificial Sequence
  chemically synthesized
tgctgtggggaacacaagggtg

SEQ ID NO: 868180 - DNA, 22 bp, Artificial Sequence
  chemically synthesized
gaccccacccttgtgttcccca

SEQ ID NO: 868181 - DNA, 22 bp, Artificial Sequence
  chemically synthesized
accccacccttgtgttccccac

SEQ ID NO: 868182 - DNA, 22 bp, Artificial Sequence
  chemically synthesized
gtgttccccacagcacaatcgc

SEQ ID NO: 868183 - DNA, 22 bp, Artificial Sequence
  chemically synthesized
tgttccccacagcacaatcgcc

SEQ ID NO: 868184 - DNA, 22 bp, Artificial Sequence
  chemically synthesized
cagggagatggaggcgattgtg

SEQ ID NO: 868185 - DNA, 22 bp, Artificial Sequence
  chemically synthesized
ccagggagatggaggcgattgt

SEQ ID NO: 868186 - DNA, 22 bp, Artificial Sequence
  chemically synthesized
cttccagggagatggaggcgat

SEQ ID NO: 868187 - DNA, 22 bp, Artificial Sequence
  chemically synthesized
cccacagcacaatcgcctccat

SEQ ID NO: 868188 - DNA, 22 bp, Artificial Sequence
  chemically synthesized
aggagaatggttacttccaggg

SEQ ID NO: 868189 - DNA, 22 bp, Artificial Sequence
  chemically synthesized
catctccctggaagtaaccatt

SEQ ID NO: 868190 - DNA, 22 bp, Artificial Sequence
  chemically synthesized
cctggaagtaaccattctcctg

SEQ ID NO: 868191 - DNA, 22 bp, Artificial Sequence
  chemically synthesized
gaagtaaccattctcctgaatt

SEQ ID NO: 868192 - DNA, 22 bp, Artificial Sequence
  chemically synthesized
tcctgaatttttctccttttct

SEQ ID NO: 868193 - DNA, 22 bp, Artificial Sequence
  chemically synthesized
ctgaatttttctccttttcttt

SEQ ID NO: 868194 - DNA, 22 bp, Artificial Sequence
  chemically synthesized
aatttttctccttttcttttct

SEQ ID NO: 868195 - DNA, 22 bp, Artificial Sequence
  chemically synthesized
ttctccttttcttttctttccc

SEQ ID NO: 868196 - DNA, 22 bp, Artificial Sequence
  chemically synthesized
tctccttttcttttctttccct

SEQ ID NO: 868197 - DNA, 22 bp, Artificial Sequence
  chemically synthesized
ctccttttcttttctttccctc

SEQ ID NO: 868198 - DNA, 22 bp, Artificial Sequence
  chemically synthesized
tccttttcttttctttccctcc

SEQ ID NO: 868199 - DNA, 22 bp, Artificial Sequence
  chemically synthesized
cttttcttttctttccctccct

SEQ ID NO: 868200 - DNA, 22 bp, Artificial Sequence
  chemically synthesized
ttcttttctttccctccctccc

SEQ ID NO: 868201 - DNA, 22 bp, Artificial Sequence
  chemically synthesized
tcttttctttccctccctccct

SEQ ID NO: 868202 - DNA, 22 bp, Artificial Sequence
  chemically synthesized
cttttctttccctccctccctc

SEQ ID NO: 868203 - DNA, 22 bp, Artificial Sequence
  chemically synthesized
ttttctttccctccctccctcc

SEQ ID NO: 868204 - DNA, 22 bp, Artificial Sequence
  chemically synthesized
ttctttccctccctccctccct

SEQ ID NO: 868205 - DNA, 22 bp, Artificial Sequence
  chemically synthesized
tctttccctccctccctccctc

SEQ ID NO: 868206 - DNA, 22 bp, Artificial Sequence
  chemically synthesized
ctttccctccctccctccctcc

SEQ ID NO: 868207 - DNA, 22 bp, Artificial Sequence
  chemically synthesized
tttccctccctccctccctccc

SEQ ID NO: 868208 - DNA, 22 bp, Artificial Sequence
  chemically synthesized
tccctccctccctccctccctc

SEQ ID NO: 868209 - DNA, 22 bp, Artificial Sequence
  chemically synthesized
ccctccctccctccctccctcc

SEQ ID NO: 868210 - DNA, 22 bp, Artificial Sequence
  chemically synthesized
cctccctccctccctccctccc

SEQ ID NO: 868211 - DNA, 22 bp, Artificial Sequence
  chemically synthesized
cctccctccctccctccctccc

SEQ ID NO: 868212 - DNA, 22 bp, Artificial Sequence
  chemically synthesized
cctccctccctccctcccttcc

SEQ ID NO: 868213 - DNA, 22 bp, Artificial Sequence
  chemically synthesized
cctccctccctcccttccttcc

SEQ ID NO: 868214 - DNA, 22 bp, Artificial Sequence
  chemically synthesized
cctccctcccttccttcctttc

SEQ ID NO: 868215 - DNA, 22 bp, Artificial Sequence
  chemically synthesized
cctcccttccttcctttctttg

SEQ ID NO: 868216 - DNA, 22 bp, Artificial Sequence
  chemically synthesized
ccttccttcctttctttgtctt

SEQ ID NO: 868217 - DNA, 22 bp, Artificial Sequence
  chemically synthesized
ccttcctttctttgtcttcctc

SEQ ID NO: 868218 - DNA, 22 bp, Artificial Sequence
  chemically synthesized
cttcctttctttgtcttcctct

SEQ ID NO: 868219 - DNA, 22 bp, Artificial Sequence
  chemically synthesized
cctttctttgtcttcctctctc

SEQ ID NO: 868220 - DNA, 22 bp, Artificial Sequence
  chemically synthesized
ctttctttgtcttcctctctct

SEQ ID NO: 868221 - DNA, 22 bp, Artificial Sequence
  chemically synthesized
tctttgtcttcctctctctctt

SEQ ID NO: 868222 - DNA, 22 bp, Artificial Sequence
  chemically synthesized
ctttgtcttcctctctctcttt

SEQ ID NO: 868223 - DNA, 22 bp, Artificial Sequence
  chemically synthesized
tttgtcttcctctctctctttc

SEQ ID NO: 868224 - DNA, 22 bp, Artificial Sequence
  chemically synthesized
tgtcttcctctctctctttctc

SEQ ID NO: 868225 - DNA, 22 bp, Artificial Sequence
  chemically synthesized
gtcttcctctctctctttctct

SEQ ID NO: 868226 - DNA, 22 bp, Artificial Sequence
  chemically synthesized
tcttcctctctctctttctctg

SEQ ID NO: 868227 - DNA, 22 bp, Artificial Sequence
  chemically synthesized
cctctctctctttctctgtttc

SEQ ID NO: 868228 - DNA, 22 bp, Artificial Sequence
  chemically synthesized
ctctctctctttctctgtttct

SEQ ID NO: 868229 - DNA, 22 bp, Artificial Sequence
  chemically synthesized
tctctctttctctgtttctctc

SEQ ID NO: 868230 - DNA, 22 bp, Artificial Sequence
  chemically synthesized
tctctttctctgtttctctctc

SEQ ID NO: 868231 - DNA, 22 bp, Artificial Sequence
  chemically synthesized
tctttctctgtttctctctctc

SEQ ID NO: 868232 - DNA, 22 bp, Artificial Sequence
  chemically synthesized
tttctctgtttctctctctctc

SEQ ID NO: 868233 - DNA, 22 bp, Artificial Sequence
  chemically synthesized
tctctgtttctctctctctctc

SEQ ID NO: 868234 - DNA, 22 bp, Artificial Sequence
  chemically synthesized
ctctgtttctctctctctctct

SEQ ID NO: 868235 - DNA, 22 bp, Artificial Sequence
  chemically synthesized
tctgtttctctctctctctctc

SEQ ID NO: 868236 - DNA, 22 bp, Artificial Sequence
  chemically synthesized
tgtttctctctctctctctctc

SEQ ID NO: 868237 - DNA, 22 bp, Artificial Sequence
  chemically synthesized
tttctctctctctctctctctc

SEQ ID NO: 868238 - DNA, 22 bp, Artificial Sequence
  chemically synthesized
ctctctctctctctctctctct

SEQ ID NO: 868239 - DNA, 22 bp, Artificial Sequence
  chemically synthesized
tctctctctctctctctctctc

SEQ ID NO: 868240 - DNA, 22 bp, Artificial Sequence
  chemically synthesized
tctctctctctctctctctctt

SEQ ID NO: 868241 - DNA, 22 bp, Artificial Sequence
  chemically synthesized
tctctctctctctctctctttc

SEQ ID NO: 868242 - DNA, 22 bp, Artificial Sequence
  chemically synthesized
aaaaaataaaaagaaagagaga

SEQ ID NO: 868243 - DNA, 22 bp, Artificial Sequence
  chemically synthesized
tctctctctctctctctttctt

SEQ ID NO: 868244 - DNA, 22 bp, Artificial Sequence
  chemically synthesized
tctctctctctctctttctttt

SEQ ID NO: 868245 - DNA, 22 bp, Artificial Sequence
  chemically synthesized
tctctctctctctttcttttta

SEQ ID NO: 868246 - DNA, 22 bp, Artificial Sequence
  chemically synthesized
cgtctcaaaaaataaaaagaaa

SEQ ID NO: 868247 - DNA, 22 bp, Artificial Sequence
  chemically synthesized
tctctctctctttctttttatt

SEQ ID NO: 868248 - DNA, 22 bp, Artificial Sequence
  chemically synthesized
tctctctctttctttttatttt

SEQ ID NO: 868249 - DNA, 22 bp, Artificial Sequence
  chemically synthesized
tctctctttctttttatttttt

SEQ ID NO: 868250 - DNA, 22 bp, Artificial Sequence
  chemically synthesized
tctctttctttttattttttga

SEQ ID NO: 868251 - DNA, 22 bp, Artificial Sequence
  chemically synthesized
tctttctttttattttttgaga

SEQ ID NO: 868252 - DNA, 22 bp, Artificial Sequence
  chemically synthesized
tttctttttattttttgagacg

SEQ ID NO: 868253 - DNA, 22 bp, Artificial Sequence
  chemically synthesized
tctttttattttttgagacgga

SEQ ID NO: 868254 - DNA, 22 bp, Artificial Sequence
  chemically synthesized
ctttttattttttgagacggag

SEQ ID NO: 868255 - DNA, 22 bp, Artificial Sequence
  chemically synthesized
tttttattttttgagacggagt

SEQ ID NO: 868256 - DNA, 22 bp, Artificial Sequence
  chemically synthesized
tttattttttgagacggagttt

SEQ ID NO: 868257 - DNA, 22 bp, Artificial Sequence
  chemically synthesized
ttattttttgagacggagtttc

SEQ ID NO: 868258 - DNA, 22 bp, Artificial Sequence
  chemically synthesized
ggcaacaagagtgaaactccgt

SEQ ID NO: 868259 - DNA, 22 bp, Artificial Sequence
  chemically synthesized
tattttttgagacggagtttca

SEQ ID NO: 868260 - DNA, 22 bp, Artificial Sequence
  chemically synthesized
attttttgagacggagtttcac

SEQ ID NO: 868261 - DNA, 22 bp, Artificial Sequence
  chemically synthesized
ttttttgagacggagtttcact

SEQ ID NO: 868262 - DNA, 22 bp, Artificial Sequence
  chemically synthesized
tttgagacggagtttcactctt

SEQ ID NO: 868263 - DNA, 22 bp, Artificial Sequence
  chemically synthesized
ttgagacggagtttcactcttg

SEQ ID NO: 868264 - DNA, 22 bp, Artificial Sequence
  chemically synthesized
cagcctgggcaacaagagtgaa

SEQ ID NO: 868265 - DNA, 22 bp, Artificial Sequence
  chemically synthesized
tgagacggagtttcactcttgt

SEQ ID NO: 868266 - DNA, 22 bp, Artificial Sequence
  chemically synthesized
gagacggagtttcactcttgtt

SEQ ID NO: 868267 - DNA, 22 bp, Artificial Sequence
  chemically synthesized
agacggagtttcactcttgttg

SEQ ID NO: 868268 - DNA, 22 bp, Artificial Sequence
  chemically synthesized
cgctccagcctgggcaacaaga

SEQ ID NO: 868269 - DNA, 22 bp, Artificial Sequence
  chemically synthesized
tgccattgcgctccagcctggg

SEQ ID NO: 868270 - DNA, 22 bp, Artificial Sequence
  chemically synthesized
cactcttgttgcccaggctgga

SEQ ID NO: 868271 - DNA, 22 bp, Artificial Sequence
  chemically synthesized
actcttgttgcccaggctggag

SEQ ID NO: 868272 - DNA, 22 bp, Artificial Sequence
  chemically synthesized
ttgttgcccaggctggagcgca

SEQ ID NO: 868273 - DNA, 22 bp, Artificial Sequence
  chemically synthesized
gttgcccaggctggagcgcaat

SEQ ID NO: 868274 - DNA, 22 bp, Artificial Sequence
  chemically synthesized
ttgcccaggctggagcgcaatg

SEQ ID NO: 868275 - DNA, 22 bp, Artificial Sequence
  chemically synthesized
cccaggctggagcgcaatggca

SEQ ID NO: 868276 - DNA, 22 bp, Artificial Sequence
  chemically synthesized
cggtgagccaagattgtgccat

SEQ ID NO: 868277 - DNA, 22 bp, Artificial Sequence
  chemically synthesized
gagcgcaatggcacaatcttgg

SEQ ID NO: 868278 - DNA, 22 bp, Artificial Sequence
  chemically synthesized
aacccaggaggtggaggttgcg

SEQ ID NO: 868279 - DNA, 22 bp, Artificial Sequence
  chemically synthesized
gaacccaggaggtggaggttgc

SEQ ID NO: 868280 - DNA, 22 bp, Artificial Sequence
  chemically synthesized
ggctcaccgcaacctccacctc

SEQ ID NO: 868281 - DNA, 22 bp, Artificial Sequence
  chemically synthesized
gctcaccgcaacctccacctcc

SEQ ID NO: 868282 - DNA, 22 bp, Artificial Sequence
  chemically synthesized
accgcaacctccacctcctggg

SEQ ID NO: 868283 - DNA, 22 bp, Artificial Sequence
  chemically synthesized
aggcaggagaatcgcttgaacc

SEQ ID NO: 868284 - DNA, 22 bp, Artificial Sequence
  chemically synthesized
cacctcctgggttcaagcgatt

SEQ ID NO: 868285 - DNA, 22 bp, Artificial Sequence
  chemically synthesized
ctgggttcaagcgattctcctg

SEQ ID NO: 868286 - DNA, 22 bp, Artificial Sequence
  chemically synthesized
gggaggctgaggcaggagaatc

SEQ ID NO: 868287 - DNA, 22 bp, Artificial Sequence
  chemically synthesized
ggttcaagcgattctcctgcct

SEQ ID NO: 868288 - DNA, 22 bp, Artificial Sequence
  chemically synthesized
ctcgggaggctgaggcaggaga

SEQ ID NO: 868289 - DNA, 22 bp, Artificial Sequence
  chemically synthesized
aagcgattctcctgcctcagcc

SEQ ID NO: 868290 - DNA, 22 bp, Artificial Sequence
  chemically synthesized
taatcccagctactcgggaggc

SEQ ID NO: 868291 - DNA, 22 bp, Artificial Sequence
  chemically synthesized
tcctgcctcagcctcccgagta

SEQ ID NO: 868292 - DNA, 22 bp, Artificial Sequence
  chemically synthesized
ctgcctcagcctcccgagtagc

SEQ ID NO: 868293 - DNA, 22 bp, Artificial Sequence
  chemically synthesized
cctcagcctcccgagtagctgg

SEQ ID NO: 868294 - DNA, 22 bp, Artificial Sequence
  chemically synthesized
agcctcccgagtagctgggatt

SEQ ID NO: 868295 - DNA, 22 bp, Artificial Sequence
  chemically synthesized
ccgagtagctgggattacaggc

SEQ ID NO: 868296 - DNA, 22 bp, Artificial Sequence
  chemically synthesized
ggattacaggcatgcgccacca

SEQ ID NO: 868297 - DNA, 22 bp, Artificial Sequence
  chemically synthesized
caggcatgcgccaccatgcctg

SEQ ID NO: 868298 - DNA, 22 bp, Artificial Sequence
  chemically synthesized
aaaatacaaaatcagccaggca

SEQ ID NO: 868299 - DNA, 22 bp, Artificial Sequence
  chemically synthesized
ctaaaaatacaaaatcagccag

SEQ ID NO: 868300 - DNA, 22 bp, Artificial Sequence
  chemically synthesized
tactaaaaatacaaaatcagcc

SEQ ID NO: 868301 - DNA, 22 bp, Artificial Sequence
  chemically synthesized
gctgattttgtatttttagtag

SEQ ID NO: 868302 - DNA, 22 bp, Artificial Sequence
  chemically synthesized
attttgtatttttagtagagac

SEQ ID NO: 868303 - DNA, 22 bp, Artificial Sequence
  chemically synthesized
tgtatttttagtagagacacgg

SEQ ID NO: 868304 - DNA, 22 bp, Artificial Sequence
  chemically synthesized
gtatttttagtagagacacggt

SEQ ID NO: 868305 - DNA, 22 bp, Artificial Sequence
  chemically synthesized
tatttttagtagagacacggtt

SEQ ID NO: 868306 - DNA, 22 bp, Artificial Sequence
  chemically synthesized
accaacatggagaaaccgtgtc

SEQ ID NO: 868307 - DNA, 22 bp, Artificial Sequence
  chemically synthesized
ttagtagagacacggtttctcc

SEQ ID NO: 868308 - DNA, 22 bp, Artificial Sequence
  chemically synthesized
tagtagagacacggtttctcca

SEQ ID NO: 868309 - DNA, 22 bp, Artificial Sequence
  chemically synthesized
agtagagacacggtttctccat

SEQ ID NO: 868310 - DNA, 22 bp, Artificial Sequence
  chemically synthesized
gtagagacacggtttctccatg

SEQ ID NO: 868311 - DNA, 22 bp, Artificial Sequence
  chemically synthesized
agaccagcctgaccaacatgga

SEQ ID NO: 868312 - DNA, 22 bp, Artificial Sequence
  chemically synthesized
gagaccagcctgaccaacatgg

SEQ ID NO: 868313 - DNA, 22 bp, Artificial Sequence
  chemically synthesized
ctccatgttggtcaggctggtc

SEQ ID NO: 868314 - DNA, 22 bp, Artificial Sequence
  chemically synthesized
tccatgttggtcaggctggtct

SEQ ID NO: 868315 - DNA, 22 bp, Artificial Sequence
  chemically synthesized
catgttggtcaggctggtctca

SEQ ID NO: 868316 - DNA, 22 bp, Artificial Sequence
  chemically synthesized
aggtcgggagtttgagaccagc

SEQ ID NO: 868317 - DNA, 22 bp, Artificial Sequence
  chemically synthesized
gtcaggctggtctcaaactccc

SEQ ID NO: 868318 - DNA, 22 bp, Artificial Sequence
  chemically synthesized
gtctcaaactcccgacctcagg

SEQ ID NO: 868319 - DNA, 22 bp, Artificial Sequence
  chemically synthesized
aaactcccgacctcaggtgatc

SEQ ID NO: 868320 - DNA, 22 bp, Artificial Sequence
  chemically synthesized
gggggccgaggtgggtggatca

SEQ ID NO: 868321 - DNA, 22 bp, Artificial Sequence
  chemically synthesized
ccgacctcaggtgatccaccca

SEQ ID NO: 868322 - DNA, 22 bp, Artificial Sequence
  chemically synthesized
ggggggccgaggtgggtggatc

SEQ ID NO: 868323 - DNA, 22 bp, Artificial Sequence
  chemically synthesized
tggggggccgaggtgggtggat

SEQ ID NO: 868324 - DNA, 22 bp, Artificial Sequence
  chemically synthesized
aggtgatccacccacctcggcc

SEQ ID NO: 868325 - DNA, 22 bp, Artificial Sequence
  chemically synthesized
taatcccaacactttggggggc

SEQ ID NO: 868326 - DNA, 22 bp, Artificial Sequence
  chemically synthesized
acgcctgtaatcccaacacttt

SEQ ID NO: 868327 - DNA, 22 bp, Artificial Sequence
  chemically synthesized
ggccccccaaagtgttgggatt

SEQ ID NO: 868328 - DNA, 22 bp, Artificial Sequence
  chemically synthesized
ggattacaggcgtgagccaccg

SEQ ID NO: 868329 - DNA, 22 bp, Artificial Sequence
  chemically synthesized
caggcgtgagccaccgtgcctg

SEQ ID NO: 868330 - DNA, 22 bp, Artificial Sequence
  chemically synthesized
gcctctccttttactttttacc

SEQ ID NO: 868331 - DNA, 22 bp, Artificial Sequence
  chemically synthesized
gagaaggcagcaggtaaaaagt

SEQ ID NO: 868332 - DNA, 22 bp, Artificial Sequence
  chemically synthesized
tccttttactttttacctgctg

SEQ ID NO: 868333 - DNA, 22 bp, Artificial Sequence
  chemically synthesized
ggctggagaaggcagcaggtaa

SEQ ID NO: 868334 - DNA, 22 bp, Artificial Sequence
  chemically synthesized
cttttactttttacctgctgcc

SEQ ID NO: 868335 - DNA, 22 bp, Artificial Sequence
  chemically synthesized
ttactttttacctgctgccttc

SEQ ID NO: 868336 - DNA, 22 bp, Artificial Sequence
  chemically synthesized
tactttttacctgctgccttct

SEQ ID NO: 868337 - DNA, 22 bp, Artificial Sequence
  chemically synthesized
actttttacctgctgccttctc

SEQ ID NO: 868338 - DNA, 22 bp, Artificial Sequence
  chemically synthesized
ctttttacctgctgccttctcc

SEQ ID NO: 868339 - DNA, 22 bp, Artificial Sequence
  chemically synthesized
aacatctaggctggagaaggca

SEQ ID NO: 868340 - DNA, 22 bp, Artificial Sequence
  chemically synthesized
tttacctgctgccttctccagc

SEQ ID NO: 868341 - DNA, 22 bp, Artificial Sequence
  chemically synthesized
ttacctgctgccttctccagcc

SEQ ID NO: 868342 - DNA, 22 bp, Artificial Sequence
  chemically synthesized
tacctgctgccttctccagcct

SEQ ID NO: 868343 - DNA, 22 bp, Artificial Sequence
  chemically synthesized
acctgctgccttctccagccta

SEQ ID NO: 868344 - DNA, 22 bp, Artificial Sequence
  chemically synthesized
cctgctgccttctccagcctag

SEQ ID NO: 868345 - DNA, 22 bp, Artificial Sequence
  chemically synthesized
ctgccttctccagcctagatgt

SEQ ID NO: 868346 - DNA, 22 bp, Artificial Sequence
  chemically synthesized
ccttctccagcctagatgttta

SEQ ID NO: 868347 - DNA, 22 bp, Artificial Sequence
  chemically synthesized
gagggtaagaacacctaaacat

SEQ ID NO: 868348 - DNA, 22 bp, Artificial Sequence
  chemically synthesized
ctccagcctagatgtttaggtg

SEQ ID NO: 868349 - DNA, 22 bp, Artificial Sequence
  chemically synthesized
tccagcctagatgtttaggtgt

SEQ ID NO: 868350 - DNA, 22 bp, Artificial Sequence
  chemically synthesized
cagcctagatgtttaggtgttc

SEQ ID NO: 868351 - DNA, 22 bp, Artificial Sequence
  chemically synthesized
aagtctcgagggtaagaacacc

SEQ ID NO: 868352 - DNA, 22 bp, Artificial Sequence
  chemically synthesized
gatgtttaggtgttcttaccct

SEQ ID NO: 868353 - DNA, 22 bp, Artificial Sequence
  chemically synthesized
aggtgttcttaccctcgagact

SEQ ID NO: 868354 - DNA, 22 bp, Artificial Sequence
  chemically synthesized
ggtgttcttaccctcgagactt

SEQ ID NO: 868355 - DNA, 22 bp, Artificial Sequence
  chemically synthesized
tgataaaacaaagctgaagtct

SEQ ID NO: 868356 - DNA, 22 bp, Artificial Sequence
  chemically synthesized
ttaccctcgagacttcagcttt

SEQ ID NO: 868357 - DNA, 22 bp, Artificial Sequence
  chemically synthesized
accctcgagacttcagctttgt

SEQ ID NO: 868358 - DNA, 22 bp, Artificial Sequence
  chemically synthesized
ccctcgagacttcagctttgtt

SEQ ID NO: 868359 - DNA, 22 bp, Artificial Sequence
  chemically synthesized
accagcgttatgataaaacaaa

SEQ ID NO: 868360 - DNA, 22 bp, Artificial Sequence
  chemically synthesized
gagacttcagctttgttttatc

SEQ ID NO: 868361 - DNA, 22 bp, Artificial Sequence
  chemically synthesized
cagctttgttttatcataacgc

SEQ ID NO: 868362 - DNA, 22 bp, Artificial Sequence
  chemically synthesized
agctttgttttatcataacgct

SEQ ID NO: 868363 - DNA, 22 bp, Artificial Sequence
  chemically synthesized
tgttttatcataacgctggtta

SEQ ID NO: 868364 - DNA, 22 bp, Artificial Sequence
  chemically synthesized
gttttatcataacgctggttaa

SEQ ID NO: 868365 - DNA, 22 bp, Artificial Sequence
  chemically synthesized
ttttatcataacgctggttaac

SEQ ID NO: 868366 - DNA, 22 bp, Artificial Sequence
  chemically synthesized
tatcataacgctggttaactct

SEQ ID NO: 868367 - DNA, 22 bp, Artificial Sequence
  chemically synthesized
atcataacgctggttaactctg

SEQ ID NO: 868368 - DNA, 22 bp, Artificial Sequence
  chemically synthesized
tcataacgctggttaactctgg

SEQ ID NO: 868369 - DNA, 22 bp, Artificial Sequence
  chemically synthesized
aaaatatggatgccagagttaa

SEQ ID NO: 868370 - DNA, 22 bp, Artificial Sequence
  chemically synthesized
ggctaaaaatatggatgccaga

SEQ ID NO: 868371 - DNA, 22 bp, Artificial Sequence
  chemically synthesized
aggctaaaaatatggatgccag

SEQ ID NO: 868372 - DNA, 22 bp, Artificial Sequence
  chemically synthesized
gttaactctggcatccatattt

SEQ ID NO: 868373 - DNA, 22 bp, Artificial Sequence
  chemically synthesized
actctggcatccatatttttag

SEQ ID NO: 868374 - DNA, 22 bp, Artificial Sequence
  chemically synthesized
tggcatccatatttttagccta

SEQ ID NO: 868375 - DNA, 22 bp, Artificial Sequence
  chemically synthesized
gcatccatatttttagcctaaa

SEQ ID NO: 868376 - DNA, 22 bp, Artificial Sequence
  chemically synthesized
agcatatgagtcaggagagaag

SEQ ID NO: 868377 - DNA, 22 bp, Artificial Sequence
  chemically synthesized
ttagcctaaacttctctcctga

SEQ ID NO: 868378 - DNA, 22 bp, Artificial Sequence
  chemically synthesized
tagcctaaacttctctcctgac

SEQ ID NO: 868379 - DNA, 22 bp, Artificial Sequence
  chemically synthesized
agcctaaacttctctcctgact

SEQ ID NO: 868380 - DNA, 22 bp, Artificial Sequence
  chemically synthesized
gcctaaacttctctcctgactc

SEQ ID NO: 868381 - DNA, 22 bp, Artificial Sequence
  chemically synthesized
aggtaactgagcatatgagtca

SEQ ID NO: 868382 - DNA, 22 bp, Artificial Sequence
  chemically synthesized
aacttctctcctgactcatatg

SEQ ID NO: 868383 - DNA, 22 bp, Artificial Sequence
  chemically synthesized
ctctcctgactcatatgctcag

SEQ ID NO: 868384 - DNA, 22 bp, Artificial Sequence
  chemically synthesized
tctcctgactcatatgctcagt

SEQ ID NO: 868385 - DNA, 22 bp, Artificial Sequence
  chemically synthesized
tcctgactcatatgctcagtta

SEQ ID NO: 868386 - DNA, 22 bp, Artificial Sequence
  chemically synthesized
ctgactcatatgctcagttacc

SEQ ID NO: 868387 - DNA, 22 bp, Artificial Sequence
  chemically synthesized
caaggccactgaggtaactgag

SEQ ID NO: 868388 - DNA, 22 bp, Artificial Sequence
  chemically synthesized
gcaaggccactgaggtaactga

SEQ ID NO: 868389 - DNA, 22 bp, Artificial Sequence
  chemically synthesized
tgcaaggccactgaggtaactg

SEQ ID NO: 868390 - DNA, 22 bp, Artificial Sequence
  chemically synthesized
actcatatgctcagttacctca

SEQ ID NO: 868391 - DNA, 22 bp, Artificial Sequence
  chemically synthesized
gttttgcaaggccactgaggta

SEQ ID NO: 868392 - DNA, 22 bp, Artificial Sequence
  chemically synthesized
atatgctcagttacctcagtgg

SEQ ID NO: 868393 - DNA, 22 bp, Artificial Sequence
  chemically synthesized
gacatctagttttgcaaggcca

SEQ ID NO: 868394 - DNA, 22 bp, Artificial Sequence
  chemically synthesized
agttacctcagtggccttgcaa

SEQ ID NO: 868395 - DNA, 22 bp, Artificial Sequence
  chemically synthesized
agacatctagttttgcaaggcc

SEQ ID NO: 868396 - DNA, 22 bp, Artificial Sequence
  chemically synthesized
tagacatctagttttgcaaggc

SEQ ID NO: 868397 - DNA, 22 bp, Artificial Sequence
  chemically synthesized
cctcagtggccttgcaaaacta

SEQ ID NO: 868398 - DNA, 22 bp, Artificial Sequence
  chemically synthesized
aattttagacatctagttttgc

SEQ ID NO: 868399 - DNA, 22 bp, Artificial Sequence
  chemically synthesized
agtggccttgcaaaactagatg

SEQ ID NO: 868400 - DNA, 22 bp, Artificial Sequence
  chemically synthesized
tgagttcaattttagacatcta

SEQ ID NO: 868401 - DNA, 22 bp, Artificial Sequence
  chemically synthesized
gcaaaactagatgtctaaaatt

SEQ ID NO: 868402 - DNA, 22 bp, Artificial Sequence
  chemically synthesized
caaaactagatgtctaaaattg

SEQ ID NO: 868403 - DNA, 22 bp, Artificial Sequence
  chemically synthesized
aggggaactgtgagttcaattt

SEQ ID NO: 868404 - DNA, 22 bp, Artificial Sequence
  chemically synthesized
gatgtctaaaattgaactcaca

SEQ ID NO: 868405 - DNA, 22 bp, Artificial Sequence
  chemically synthesized
gggttcaggggaactgtgagtt

SEQ ID NO: 868406 - DNA, 22 bp, Artificial Sequence
  chemically synthesized
agggttcaggggaactgtgagt

SEQ ID NO: 868407 - DNA, 22 bp, Artificial Sequence
  chemically synthesized
tagggttcaggggaactgtgag

SEQ ID NO: 868408 - DNA, 22 bp, Artificial Sequence
  chemically synthesized
aaattgaactcacagttcccct

SEQ ID NO: 868409 - DNA, 22 bp, Artificial Sequence
  chemically synthesized
aactcacagttcccctgaaccc

SEQ ID NO: 868410 - DNA, 22 bp, Artificial Sequence
  chemically synthesized
tggagtattttagggttcaggg

SEQ ID NO: 868411 - DNA, 22 bp, Artificial Sequence
  chemically synthesized
acagttcccctgaaccctaaaa

SEQ ID NO: 868412 - DNA, 22 bp, Artificial Sequence
  chemically synthesized
aactatggagtattttagggtt

SEQ ID NO: 868413 - DNA, 22 bp, Artificial Sequence
  chemically synthesized
ctaaactatggagtattttagg

SEQ ID NO: 868414 - DNA, 22 bp, Artificial Sequence
  chemically synthesized
ccctgaaccctaaaatactcca

SEQ ID NO: 868415 - DNA, 22 bp, Artificial Sequence
  chemically synthesized
aaccctaaaatactccatagtt

SEQ ID NO: 868416 - DNA, 22 bp, Artificial Sequence
  chemically synthesized
aaatactccatagtttagtaat

SEQ ID NO: 868417 - DNA, 22 bp, Artificial Sequence
  chemically synthesized
catagtttagtaatttctacca

SEQ ID NO: 868418 - DNA, 22 bp, Artificial Sequence
  chemically synthesized
ataaaccgagtagaccgtggta

SEQ ID NO: 868419 - DNA, 22 bp, Artificial Sequence
  chemically synthesized
gataaaccgagtagaccgtggt

SEQ ID NO: 868420 - DNA, 22 bp, Artificial Sequence
  chemically synthesized
agtaatttctaccacggtctac

SEQ ID NO: 868421 - DNA, 22 bp, Artificial Sequence
  chemically synthesized
gtaatttctaccacggtctact

SEQ ID NO: 868422 - DNA, 22 bp, Artificial Sequence
  chemically synthesized
gcttgataaaccgagtagaccg

SEQ ID NO: 868423 - DNA, 22 bp, Artificial Sequence
  chemically synthesized
ggcttgataaaccgagtagacc

SEQ ID NO: 868424 - DNA, 22 bp, Artificial Sequence
  chemically synthesized
ctaccacggtctactcggttta

SEQ ID NO: 868425 - DNA, 22 bp, Artificial Sequence
  chemically synthesized
taccacggtctactcggtttat

SEQ ID NO: 868426 - DNA, 22 bp, Artificial Sequence
  chemically synthesized
ccacggtctactcggtttatca

SEQ ID NO: 868427 - DNA, 22 bp, Artificial Sequence
  chemically synthesized
ctcggtttatcaagccaaatgc

SEQ ID NO: 868428 - DNA, 22 bp, Artificial Sequence
  chemically synthesized
ggtttatcaagccaaatgcctg

SEQ ID NO: 868429 - DNA, 22 bp, Artificial Sequence
  chemically synthesized
atcaagccaaatgcctgggtgt

SEQ ID NO: 868430 - DNA, 22 bp, Artificial Sequence
  chemically synthesized
tcaagccaaatgcctgggtgtt

SEQ ID NO: 868431 - DNA, 22 bp, Artificial Sequence
  chemically synthesized
ggtgttctattcgcgttctctg

SEQ ID NO: 868432 - DNA, 22 bp, Artificial Sequence
  chemically synthesized
tattcgcgttctctgtatctct

SEQ ID NO: 868433 - DNA, 22 bp, Artificial Sequence
  chemically synthesized
gacataaaatggagagatacag

SEQ ID NO: 868434 - DNA, 22 bp, Artificial Sequence
  chemically synthesized
ttcgcgttctctgtatctctcc

SEQ ID NO: 868435 - DNA, 22 bp, Artificial Sequence
  chemically synthesized
attggacataaaatggagagat

SEQ ID NO: 868436 - DNA, 22 bp, Artificial Sequence
  chemically synthesized
gcgttctctgtatctctccatt

SEQ ID NO: 868437 - DNA, 22 bp, Artificial Sequence
  chemically synthesized
tctgtatctctccattttatgt

SEQ ID NO: 868438 - DNA, 22 bp, Artificial Sequence
  chemically synthesized
gtaactgattggacataaaatg

SEQ ID NO: 868439 - DNA, 22 bp, Artificial Sequence
  chemically synthesized
tgtatctctccattttatgtcc

SEQ ID NO: 868440 - DNA, 22 bp, Artificial Sequence
  chemically synthesized
tatctctccattttatgtccaa

SEQ ID NO: 868441 - DNA, 22 bp, Artificial Sequence
  chemically synthesized
tccattttatgtccaatcagtt

SEQ ID NO: 868442 - DNA, 22 bp, Artificial Sequence
  chemically synthesized
cattttatgtccaatcagttac

SEQ ID NO: 868443 - DNA, 22 bp, Artificial Sequence
  chemically synthesized
tatgtccaatcagttaccaggg

SEQ ID NO: 868444 - DNA, 22 bp, Artificial Sequence
  chemically synthesized
atgtccaatcagttaccagggc

SEQ ID NO: 868445 - DNA, 22 bp, Artificial Sequence
  chemically synthesized
tgtccaatcagttaccagggcc

SEQ ID NO: 868446 - DNA, 22 bp, Artificial Sequence
  chemically synthesized
gcacgtggaaacaacaggccct

SEQ ID NO: 868447 - DNA, 22 bp, Artificial Sequence
  chemically synthesized
ggcacgtggaaacaacaggccc

SEQ ID NO: 868448 - DNA, 22 bp, Artificial Sequence
  chemically synthesized
ccagggcctgttgtttccacgt

SEQ ID NO: 868449 - DNA, 22 bp, Artificial Sequence
  chemically synthesized
aagtgatacttggcacgtggaa

SEQ ID NO: 868450 - DNA, 22 bp, Artificial Sequence
  chemically synthesized
ttgtttccacgtgccaagtatc

SEQ ID NO: 868451 - DNA, 22 bp, Artificial Sequence
  chemically synthesized
tttccacgtgccaagtatcact

SEQ ID NO: 868452 - DNA, 22 bp, Artificial Sequence
  chemically synthesized
ccacgtgccaagtatcacttga

SEQ ID NO: 868453 - DNA, 22 bp, Artificial Sequence
  chemically synthesized
cacgtgccaagtatcacttgaa

SEQ ID NO: 868454 - DNA, 22 bp, Artificial Sequence
  chemically synthesized
gaatctgtctactttgtctcca

SEQ ID NO: 868455 - DNA, 22 bp, Artificial Sequence
  chemically synthesized
aatctgtctactttgtctccat

SEQ ID NO: 868456 - DNA, 22 bp, Artificial Sequence
  chemically synthesized
aagaagtaataaagggaatgga

SEQ ID NO: 868457 - DNA, 22 bp, Artificial Sequence
  chemically synthesized
tctactttgtctccattccctt

SEQ ID NO: 868458 - DNA, 22 bp, Artificial Sequence
  chemically synthesized
ctttgtctccattccctttatt

SEQ ID NO: 868459 - DNA, 22 bp, Artificial Sequence
  chemically synthesized
aactaaagaagtaataaaggga

SEQ ID NO: 868460 - DNA, 22 bp, Artificial Sequence
  chemically synthesized
tgtctccattccctttattact

SEQ ID NO: 868461 - DNA, 22 bp, Artificial Sequence
  chemically synthesized
gtctccattccctttattactt

SEQ ID NO: 868462 - DNA, 22 bp, Artificial Sequence
  chemically synthesized
tctccattccctttattacttc

SEQ ID NO: 868463 - DNA, 22 bp, Artificial Sequence
  chemically synthesized
cattccctttattacttcttta

SEQ ID NO: 868464 - DNA, 22 bp, Artificial Sequence
  chemically synthesized
cctttattacttctttagttta

SEQ ID NO: 868465 - DNA, 22 bp, Artificial Sequence
  chemically synthesized
tattacttctttagtttaggtc

SEQ ID NO: 868466 - DNA, 22 bp, Artificial Sequence
  chemically synthesized
attacttctttagtttaggtca

SEQ ID NO: 868467 - DNA, 22 bp, Artificial Sequence
  chemically synthesized
ttacttctttagtttaggtcat

SEQ ID NO: 868468 - DNA, 22 bp, Artificial Sequence
  chemically synthesized
cttctttagtttaggtcattat

SEQ ID NO: 868469 - DNA, 22 bp, Artificial Sequence
  chemically synthesized
aggtgatagataataatgacct

SEQ ID NO: 868470 - DNA, 22 bp, Artificial Sequence
  chemically synthesized
ctttagtttaggtcattattat

SEQ ID NO: 868471 - DNA, 22 bp, Artificial Sequence
  chemically synthesized
tttagtttaggtcattattatc

SEQ ID NO: 868472 - DNA, 22 bp, Artificial Sequence
  chemically synthesized
tagtttaggtcattattatcta

SEQ ID NO: 868473 - DNA, 22 bp, Artificial Sequence
  chemically synthesized
agtttaggtcattattatctat

SEQ ID NO: 868474 - DNA, 22 bp, Artificial Sequence
  chemically synthesized
gtttaggtcattattatctatc

SEQ ID NO: 868475 - DNA, 22 bp, Artificial Sequence
  chemically synthesized
cagtggttcaggtgatagataa

SEQ ID NO: 868476 - DNA, 22 bp, Artificial Sequence
  chemically synthesized
aggtcattattatctatcacct

SEQ ID NO: 868477 - DNA, 22 bp, Artificial Sequence
  chemically synthesized
ttccagtggttcaggtgataga

SEQ ID NO: 868478 - DNA, 22 bp, Artificial Sequence
  chemically synthesized
ggtcattattatctatcacctg

SEQ ID NO: 868479 - DNA, 22 bp, Artificial Sequence
  chemically synthesized
gaggctattccagtggttcagg

SEQ ID NO: 868480 - DNA, 22 bp, Artificial Sequence
  chemically synthesized
ggaggctattccagtggttcag

SEQ ID NO: 868481 - DNA, 22 bp, Artificial Sequence
  chemically synthesized
ttatctatcacctgaaccactg

SEQ ID NO: 868482 - DNA, 22 bp, Artificial Sequence
  chemically synthesized
tggaggctattccagtggttca

SEQ ID NO: 868483 - DNA, 22 bp, Artificial Sequence
  chemically synthesized
tctatcacctgaaccactggaa

SEQ ID NO: 868484 - DNA, 22 bp, Artificial Sequence
  chemically synthesized
tcacctgaaccactggaatagc

SEQ ID NO: 868485 - DNA, 22 bp, Artificial Sequence
  chemically synthesized
aaccactggaatagcctccaaa

SEQ ID NO: 868486 - DNA, 22 bp, Artificial Sequence
  chemically synthesized
gataagagcaactttggaggct

SEQ ID NO: 868487 - DNA, 22 bp, Artificial Sequence
  chemically synthesized
attggataagagcaactttgga

SEQ ID NO: 868488 - DNA, 22 bp, Artificial Sequence
  chemically synthesized
gaatagcctccaaagttgctct

SEQ ID NO: 868489 - DNA, 22 bp, Artificial Sequence
  chemically synthesized
caaagttgctcttatccaatca

SEQ ID NO: 868490 - DNA, 22 bp, Artificial Sequence
  chemically synthesized
aagaataggtaactgattggat

SEQ ID NO: 868491 - DNA, 22 bp, Artificial Sequence
  chemically synthesized
gctgaagaataggtaactgatt

SEQ ID NO: 868492 - DNA, 22 bp, Artificial Sequence
  chemically synthesized
tggctgaagaataggtaactga

SEQ ID NO: 868493 - DNA, 22 bp, Artificial Sequence
  chemically synthesized
ctcttatccaatcagttaccta

SEQ ID NO: 868494 - DNA, 22 bp, Artificial Sequence
  chemically synthesized
ctctggctgaagaataggtaac

SEQ ID NO: 868495 - DNA, 22 bp, Artificial Sequence
  chemically synthesized
ttatccaatcagttacctattc

SEQ ID NO: 868496 - DNA, 22 bp, Artificial Sequence
  chemically synthesized
atccaatcagttacctattctt

SEQ ID NO: 868497 - DNA, 22 bp, Artificial Sequence
  chemically synthesized
tccaatcagttacctattcttc

SEQ ID NO: 868498 - DNA, 22 bp, Artificial Sequence
  chemically synthesized
gagggattactctggctgaaga

SEQ ID NO: 868499 - DNA, 22 bp, Artificial Sequence
  chemically synthesized
agagggattactctggctgaag

SEQ ID NO: 868500 - DNA, 22 bp, Artificial Sequence
  chemically synthesized
tagagggattactctggctgaa

SEQ ID NO: 868501 - DNA, 22 bp, Artificial Sequence
  chemically synthesized
cctattcttcagccagagtaat

SEQ ID NO: 868502 - DNA, 22 bp, Artificial Sequence
  chemically synthesized
ggttttagagggattactctgg

SEQ ID NO: 868503 - DNA, 22 bp, Artificial Sequence
  chemically synthesized
gggttttagagggattactctg

SEQ ID NO: 868504 - DNA, 22 bp, Artificial Sequence
  chemically synthesized
ttcttcagccagagtaatccct

SEQ ID NO: 868505 - DNA, 22 bp, Artificial Sequence
  chemically synthesized
ttcagccagagtaatccctcta

SEQ ID NO: 868506 - DNA, 22 bp, Artificial Sequence
  chemically synthesized
cagccagagtaatccctctaaa

SEQ ID NO: 868507 - DNA, 22 bp, Artificial Sequence
  chemically synthesized
agccagagtaatccctctaaaa

SEQ ID NO: 868508 - DNA, 22 bp, Artificial Sequence
  chemically synthesized
gtgacatgagcatatttgggtt

SEQ ID NO: 868509 - DNA, 22 bp, Artificial Sequence
  chemically synthesized
taaaacccaaatatgctcatgt

SEQ ID NO: 868510 - DNA, 22 bp, Artificial Sequence
  chemically synthesized
aaacccaaatatgctcatgtca

SEQ ID NO: 868511 - DNA, 22 bp, Artificial Sequence
  chemically synthesized
tagagagactagtgacatgagc

SEQ ID NO: 868512 - DNA, 22 bp, Artificial Sequence
  chemically synthesized
aagcattgtagagagactagtg

SEQ ID NO: 868513 - DNA, 22 bp, Artificial Sequence
  chemically synthesized
atgtcactagtctctctacaat

SEQ ID NO: 868514 - DNA, 22 bp, Artificial Sequence
  chemically synthesized
aaagccactgaagcattgtaga

SEQ ID NO: 868515 - DNA, 22 bp, Artificial Sequence
  chemically synthesized
gtctctctacaatgcttcagtg

SEQ ID NO: 868516 - DNA, 22 bp, Artificial Sequence
  chemically synthesized
aagggtaattgaaagccactga

SEQ ID NO: 868517 - DNA, 22 bp, Artificial Sequence
  chemically synthesized
tctacaatgcttcagtggcttt

SEQ ID NO: 868518 - DNA, 22 bp, Artificial Sequence
  chemically synthesized
gaagggtaattgaaagccactg

SEQ ID NO: 868519 - DNA, 22 bp, Artificial Sequence
  chemically synthesized
tacaatgcttcagtggctttca

SEQ ID NO: 868520 - DNA, 22 bp, Artificial Sequence
  chemically synthesized
tttgaagggtaattgaaagcca

SEQ ID NO: 868521 - DNA, 22 bp, Artificial Sequence
  chemically synthesized
caatgcttcagtggctttcaat

SEQ ID NO: 868522 - DNA, 22 bp, Artificial Sequence
  chemically synthesized
atttgaagggtaattgaaagcc

SEQ ID NO: 868523 - DNA, 22 bp, Artificial Sequence
  chemically synthesized
tatttgaagggtaattgaaagc

SEQ ID NO: 868524 - DNA, 22 bp, Artificial Sequence
  chemically synthesized
cagtggctttcaattacccttc

SEQ ID NO: 868525 - DNA, 22 bp, Artificial Sequence
  chemically synthesized
agtggctttcaattacccttca

SEQ ID NO: 868526 - DNA, 22 bp, Artificial Sequence
  chemically synthesized
tcaattacccttcaaataaaat

SEQ ID NO: 868527 - DNA, 22 bp, Artificial Sequence
  chemically synthesized
caattacccttcaaataaaatg

SEQ ID NO: 868528 - DNA, 22 bp, Artificial Sequence
  chemically synthesized
aattacccttcaaataaaatgt

SEQ ID NO: 868529 - DNA, 22 bp, Artificial Sequence
  chemically synthesized
gagaaatcaaacacattttatt

SEQ ID NO: 868530 - DNA, 22 bp, Artificial Sequence
  chemically synthesized
cccttcaaataaaatgtgtttg

SEQ ID NO: 868531 - DNA, 22 bp, Artificial Sequence
  chemically synthesized
caaataaaatgtgtttgatttc

SEQ ID NO: 868532 - DNA, 22 bp, Artificial Sequence
  chemically synthesized
agacatgttagagaaatcaaac

SEQ ID NO: 868533 - DNA, 22 bp, Artificial Sequence
  chemically synthesized
aaataaaatgtgtttgatttct

SEQ ID NO: 868534 - DNA, 22 bp, Artificial Sequence
  chemically synthesized
aagacatgttagagaaatcaaa

SEQ ID NO: 868535 - DNA, 22 bp, Artificial Sequence
  chemically synthesized
taagacatgttagagaaatcaa

SEQ ID NO: 868536 - DNA, 22 bp, Artificial Sequence
  chemically synthesized
cattttaagacatgttagagaa

SEQ ID NO: 868537 - DNA, 22 bp, Artificial Sequence
  chemically synthesized
gcaaactgcattttaagacatg

SEQ ID NO: 868538 - DNA, 22 bp, Artificial Sequence
  chemically synthesized
gatttctctaacatgtcttaaa

SEQ ID NO: 868539 - DNA, 22 bp, Artificial Sequence
  chemically synthesized
atttctctaacatgtcttaaaa

SEQ ID NO: 868540 - DNA, 22 bp, Artificial Sequence
  chemically synthesized
ctctaacatgtcttaaaatgca

SEQ ID NO: 868541 - DNA, 22 bp, Artificial Sequence
  chemically synthesized
tctaacatgtcttaaaatgcag

SEQ ID NO: 868542 - DNA, 22 bp, Artificial Sequence
  chemically synthesized
taacatgtcttaaaatgcagtt

SEQ ID NO: 868543 - DNA, 22 bp, Artificial Sequence
  chemically synthesized
acatgtcttaaaatgcagtttg

SEQ ID NO: 868544 - DNA, 22 bp, Artificial Sequence
  chemically synthesized
gaaatgcatgcatgttcgcaaa

SEQ ID NO: 868545 - DNA, 22 bp, Artificial Sequence
  chemically synthesized
aaaatgcagtttgcgaacatgc

SEQ ID NO: 868546 - DNA, 22 bp, Artificial Sequence
  chemically synthesized
aaatgcagtttgcgaacatgca

SEQ ID NO: 868547 - DNA, 22 bp, Artificial Sequence
  chemically synthesized
cagatgatgctggaaatgcatg

SEQ ID NO: 868548 - DNA, 22 bp, Artificial Sequence
  chemically synthesized
gcgaacatgcatgcatttccag

SEQ ID NO: 868549 - DNA, 22 bp, Artificial Sequence
  chemically synthesized
cgaacatgcatgcatttccagc

SEQ ID NO: 868550 - DNA, 22 bp, Artificial Sequence
  chemically synthesized
ccagcatcatctggaatgtcct

SEQ ID NO: 868551 - DNA, 22 bp, Artificial Sequence
  chemically synthesized
cagcatcatctggaatgtcctc

SEQ ID NO: 868552 - DNA, 22 bp, Artificial Sequence
  chemically synthesized
gaatgtcctccctgacacatcg

SEQ ID NO: 868553 - DNA, 22 bp, Artificial Sequence
  chemically synthesized
ggaatgggtgaggagcgatgtg

SEQ ID NO: 868554 - DNA, 22 bp, Artificial Sequence
  chemically synthesized
gggttgggaatgggtgaggagc

SEQ ID NO: 868555 - DNA, 22 bp, Artificial Sequence
  chemically synthesized
cctgacacatcgctcctcaccc

SEQ ID NO: 868556 - DNA, 22 bp, Artificial Sequence
  chemically synthesized
acacatcgctcctcacccattc

SEQ ID NO: 868557 - DNA, 22 bp, Artificial Sequence
  chemically synthesized
agttggggttgggaatgggtga

SEQ ID NO: 868558 - DNA, 22 bp, Artificial Sequence
  chemically synthesized
aagcactgagttggggttggga

SEQ ID NO: 868559 - DNA, 22 bp, Artificial Sequence
  chemically synthesized
ctcacccattcccaaccccaac

SEQ ID NO: 868560 - DNA, 22 bp, Artificial Sequence
  chemically synthesized
acccattcccaaccccaactca

SEQ ID NO: 868561 - DNA, 22 bp, Artificial Sequence
  chemically synthesized
ccaaccccaactcagtgcttca

SEQ ID NO: 868562 - DNA, 22 bp, Artificial Sequence
  chemically synthesized
aaaatatcagtatggctgaagc

SEQ ID NO: 868563 - DNA, 22 bp, Artificial Sequence
  chemically synthesized
aaaaatatcagtatggctgaag

SEQ ID NO: 868564 - DNA, 22 bp, Artificial Sequence
  chemically synthesized
taaaaatatcagtatggctgaa

SEQ ID NO: 868565 - DNA, 22 bp, Artificial Sequence
  chemically synthesized
agtgcttcagccatactgatat

SEQ ID NO: 868566 - DNA, 22 bp, Artificial Sequence
  chemically synthesized
gcacgttttaaaaatatcagta

SEQ ID NO: 868567 - DNA, 22 bp, Artificial Sequence
  chemically synthesized
cagccatactgatatttttaaa

SEQ ID NO: 868568 - DNA, 22 bp, Artificial Sequence
  chemically synthesized
agccatactgatatttttaaaa

SEQ ID NO: 868569 - DNA, 22 bp, Artificial Sequence
  chemically synthesized
atatttttaaaacgtgctaggc

SEQ ID NO: 868570 - DNA, 22 bp, Artificial Sequence
  chemically synthesized
gaggcaaaatggagcctagcac

SEQ ID NO: 868571 - DNA, 22 bp, Artificial Sequence
  chemically synthesized
ttaaaacgtgctaggctccatt

SEQ ID NO: 868572 - DNA, 22 bp, Artificial Sequence
  chemically synthesized
taaaacgtgctaggctccattt

SEQ ID NO: 868573 - DNA, 22 bp, Artificial Sequence
  chemically synthesized
aaaacgtgctaggctccatttt

SEQ ID NO: 868574 - DNA, 22 bp, Artificial Sequence
  chemically synthesized
aaacgtgctaggctccattttg

SEQ ID NO: 868575 - DNA, 22 bp, Artificial Sequence
  chemically synthesized
ggctccattttgcctccaactg

SEQ ID NO: 868576 - DNA, 22 bp, Artificial Sequence
  chemically synthesized
cattttgcctccaactgttact

SEQ ID NO: 868577 - DNA, 22 bp, Artificial Sequence
  chemically synthesized
caggcaagagaaacaagtaaca

SEQ ID NO: 868578 - DNA, 22 bp, Artificial Sequence
  chemically synthesized
tgcctccaactgttacttgttt

SEQ ID NO: 868579 - DNA, 22 bp, Artificial Sequence
  chemically synthesized
gcctccaactgttacttgtttc

SEQ ID NO: 868580 - DNA, 22 bp, Artificial Sequence
  chemically synthesized
cctccaactgttacttgtttct

SEQ ID NO: 868581 - DNA, 22 bp, Artificial Sequence
  chemically synthesized
caactgttacttgtttctcttg

SEQ ID NO: 868582 - DNA, 22 bp, Artificial Sequence
  chemically synthesized
ttacttgtttctcttgcctgga

SEQ ID NO: 868583 - DNA, 22 bp, Artificial Sequence
  chemically synthesized
cttgtttctcttgcctggaaca

SEQ ID NO: 868584 - DNA, 22 bp, Artificial Sequence
  chemically synthesized
gtttctcttgcctggaacactc

SEQ ID NO: 868585 - DNA, 22 bp, Artificial Sequence
  chemically synthesized
tttctcttgcctggaacactct

SEQ ID NO: 868586 - DNA, 22 bp, Artificial Sequence
  chemically synthesized
ctcttgcctggaacactctccc

SEQ ID NO: 868587 - DNA, 22 bp, Artificial Sequence
  chemically synthesized
tcttgcctggaacactctcccc

SEQ ID NO: 868588 - DNA, 22 bp, Artificial Sequence
  chemically synthesized
ggcaaacaagtaggggagagtg

SEQ ID NO: 868589 - DNA, 22 bp, Artificial Sequence
  chemically synthesized
ttgcctggaacactctccccta

SEQ ID NO: 868590 - DNA, 22 bp, Artificial Sequence
  chemically synthesized
gcctggaacactctcccctact

SEQ ID NO: 868591 - DNA, 22 bp, Artificial Sequence
  chemically synthesized
cctggaacactctcccctactt

SEQ ID NO: 868592 - DNA, 22 bp, Artificial Sequence
  chemically synthesized
gaacactctcccctacttgttt

SEQ ID NO: 868593 - DNA, 22 bp, Artificial Sequence
  chemically synthesized
tcccctacttgtttgcctaggt

SEQ ID NO: 868594 - DNA, 22 bp, Artificial Sequence
  chemically synthesized
ccctacttgtttgcctaggtac

SEQ ID NO: 868595 - DNA, 22 bp, Artificial Sequence
  chemically synthesized
aaggataagtaggtgtacctag

SEQ ID NO: 868596 - DNA, 22 bp, Artificial Sequence
  chemically synthesized
gaaggataagtaggtgtaccta

SEQ ID NO: 868597 - DNA, 22 bp, Artificial Sequence
  chemically synthesized
cttgtttgcctaggtacaccta

SEQ ID NO: 868598 - DNA, 22 bp, Artificial Sequence
  chemically synthesized
gtttgcctaggtacacctactt

SEQ ID NO: 868599 - DNA, 22 bp, Artificial Sequence
  chemically synthesized
tttgcctaggtacacctactta

SEQ ID NO: 868600 - DNA, 22 bp, Artificial Sequence
  chemically synthesized
gcctaggtacacctacttatcc

SEQ ID NO: 868601 - DNA, 22 bp, Artificial Sequence
  chemically synthesized
cctaggtacacctacttatcct

SEQ ID NO: 868602 - DNA, 22 bp, Artificial Sequence
  chemically synthesized
aagatgagacttgaaggataag

SEQ ID NO: 868603 - DNA, 22 bp, Artificial Sequence
  chemically synthesized
gaagatgagacttgaaggataa

SEQ ID NO: 868604 - DNA, 22 bp, Artificial Sequence
  chemically synthesized
ggtacacctacttatccttcaa

SEQ ID NO: 868605 - DNA, 22 bp, Artificial Sequence
  chemically synthesized
cttatccttcaagtctcatctt

SEQ ID NO: 868606 - DNA, 22 bp, Artificial Sequence
  chemically synthesized
atccttcaagtctcatcttcaa

SEQ ID NO: 868607 - DNA, 22 bp, Artificial Sequence
  chemically synthesized
tccttcaagtctcatcttcaaa

SEQ ID NO: 868608 - DNA, 22 bp, Artificial Sequence
  chemically synthesized
caagtctcatcttcaaatttcc

SEQ ID NO: 868609 - DNA, 22 bp, Artificial Sequence
  chemically synthesized
aagtctcatcttcaaatttcct

SEQ ID NO: 868610 - DNA, 22 bp, Artificial Sequence
  chemically synthesized
gaaaaaaaaaaaaaaaaggaaa

SEQ ID NO: 868611 - DNA, 22 bp, Artificial Sequence
  chemically synthesized
tggaaaaaaaaaaaaaaaagga

SEQ ID NO: 868612 - DNA, 22 bp, Artificial Sequence
  chemically synthesized
atcttcaaatttcctttttttt

SEQ ID NO: 868613 - DNA, 22 bp, Artificial Sequence
  chemically synthesized
caaatttccttttttttttttt

SEQ ID NO: 868614 - DNA, 22 bp, Artificial Sequence
  chemically synthesized
aaatttcctttttttttttttt

SEQ ID NO: 868615 - DNA, 22 bp, Artificial Sequence
  chemically synthesized
ccttttttttttttttttccag

SEQ ID NO: 868616 - DNA, 22 bp, Artificial Sequence
  chemically synthesized
cttttttttttttttttccaga

SEQ ID NO: 868617 - DNA, 22 bp, Artificial Sequence
  chemically synthesized
ttttttttttttttccagaatt

SEQ ID NO: 868618 - DNA, 22 bp, Artificial Sequence
  chemically synthesized
tttttttttttttccagaattt

SEQ ID NO: 868619 - DNA, 22 bp, Artificial Sequence
  chemically synthesized
ttttttttttttccagaatttt

SEQ ID NO: 868620 - DNA, 22 bp, Artificial Sequence
  chemically synthesized
tttttttttttccagaattttt

SEQ ID NO: 868621 - DNA, 22 bp, Artificial Sequence
  chemically synthesized
ttttttttttccagaatttttc

SEQ ID NO: 868622 - DNA, 22 bp, Artificial Sequence
  chemically synthesized
tttttttttccagaatttttcc

SEQ ID NO: 868623 - DNA, 22 bp, Artificial Sequence
  chemically synthesized
ttttttttccagaatttttcct

SEQ ID NO: 868624 - DNA, 22 bp, Artificial Sequence
  chemically synthesized
tttttttccagaatttttcctc

SEQ ID NO: 868625 - DNA, 22 bp, Artificial Sequence
  chemically synthesized
ttttttccagaatttttcctct

SEQ ID NO: 868626 - DNA, 22 bp, Artificial Sequence
  chemically synthesized
tttttccagaatttttcctctg

SEQ ID NO: 868627 - DNA, 22 bp, Artificial Sequence
  chemically synthesized
ttttccagaatttttcctctga

SEQ ID NO: 868628 - DNA, 22 bp, Artificial Sequence
  chemically synthesized
tttccagaatttttcctctgac

SEQ ID NO: 868629 - DNA, 22 bp, Artificial Sequence
  chemically synthesized
caacagagcgatgtcagaggaa

SEQ ID NO: 868630 - DNA, 22 bp, Artificial Sequence
  chemically synthesized
ttccagaatttttcctctgaca

SEQ ID NO: 868631 - DNA, 22 bp, Artificial Sequence
  chemically synthesized
tccagaatttttcctctgacat

SEQ ID NO: 868632 - DNA, 22 bp, Artificial Sequence
  chemically synthesized
ccagaatttttcctctgacatc

SEQ ID NO: 868633 - DNA, 22 bp, Artificial Sequence
  chemically synthesized
cagaatttttcctctgacatcg

SEQ ID NO: 868634 - DNA, 22 bp, Artificial Sequence
  chemically synthesized
gagtattgcaacagagcgatgt

SEQ ID NO: 868635 - DNA, 22 bp, Artificial Sequence
  chemically synthesized
ttcctctgacatcgctctgttg

SEQ ID NO: 868636 - DNA, 22 bp, Artificial Sequence
  chemically synthesized
tcctctgacatcgctctgttgc

SEQ ID NO: 868637 - DNA, 22 bp, Artificial Sequence
  chemically synthesized
cctctgacatcgctctgttgca

SEQ ID NO: 868638 - DNA, 22 bp, Artificial Sequence
  chemically synthesized
ctctgacatcgctctgttgcaa

SEQ ID NO: 868639 - DNA, 22 bp, Artificial Sequence
  chemically synthesized
tgacatcgctctgttgcaatac

SEQ ID NO: 868640 - DNA, 22 bp, Artificial Sequence
  chemically synthesized
acccagtctggagtattgcaac

SEQ ID NO: 868641 - DNA, 22 bp, Artificial Sequence
  chemically synthesized
acatcgctctgttgcaatactc

SEQ ID NO: 868642 - DNA, 22 bp, Artificial Sequence
  chemically synthesized
tgttgcaatactccagactggg

SEQ ID NO: 868643 - DNA, 22 bp, Artificial Sequence
  chemically synthesized
ttgcaatactccagactgggtg

SEQ ID NO: 868644 - DNA, 22 bp, Artificial Sequence
  chemically synthesized
caatactccagactgggtgagg

SEQ ID NO: 868645 - DNA, 22 bp, Artificial Sequence
  chemically synthesized
cagactgggtgaggtgattctt

SEQ ID NO: 868646 - DNA, 22 bp, Artificial Sequence
  chemically synthesized
gggaagaatcaggaagaatcac

SEQ ID NO: 868647 - DNA, 22 bp, Artificial Sequence
  chemically synthesized
ggtgaggtgattcttcctgatt

SEQ ID NO: 868648 - DNA, 22 bp, Artificial Sequence
  chemically synthesized
ggatgtagaatactagggaaga

SEQ ID NO: 868649 - DNA, 22 bp, Artificial Sequence
  chemically synthesized
ttcctgattcttccctagtatt

SEQ ID NO: 868650 - DNA, 22 bp, Artificial Sequence
  chemically synthesized
cctgattcttccctagtattct

SEQ ID NO: 868651 - DNA, 22 bp, Artificial Sequence
  chemically synthesized
ctgattcttccctagtattcta

SEQ ID NO: 868652 - DNA, 22 bp, Artificial Sequence
  chemically synthesized
attcttccctagtattctacat

SEQ ID NO: 868653 - DNA, 22 bp, Artificial Sequence
  chemically synthesized
ttccctagtattctacatccta

SEQ ID NO: 868654 - DNA, 22 bp, Artificial Sequence
  chemically synthesized
ccctagtattctacatcctagt

SEQ ID NO: 868655 - DNA, 22 bp, Artificial Sequence
  chemically synthesized
tacgtgacaaatactaggatgt

SEQ ID NO: 868656 - DNA, 22 bp, Artificial Sequence
  chemically synthesized
cctagtattctacatcctagta

SEQ ID NO: 868657 - DNA, 22 bp, Artificial Sequence
  chemically synthesized
gtattctacatcctagtatttg

SEQ ID NO: 868658 - DNA, 22 bp, Artificial Sequence
  chemically synthesized
aataactgtacgtgacaaatac

SEQ ID NO: 868659 - DNA, 22 bp, Artificial Sequence
  chemically synthesized
tacatcctagtatttgtcacgt

SEQ ID NO: 868660 - DNA, 22 bp, Artificial Sequence
  chemically synthesized
catcctagtatttgtcacgtac

SEQ ID NO: 868661 - DNA, 22 bp, Artificial Sequence
  chemically synthesized
gtatttgtcacgtacagttatt

SEQ ID NO: 868662 - DNA, 22 bp, Artificial Sequence
  chemically synthesized
gaaagtaagaaaactaaataac

SEQ ID NO: 868663 - DNA, 22 bp, Artificial Sequence
  chemically synthesized
gtcacgtacagttatttagttt

SEQ ID NO: 868664 - DNA, 22 bp, Artificial Sequence
  chemically synthesized
tcacgtacagttatttagtttt

SEQ ID NO: 868665 - DNA, 22 bp, Artificial Sequence
  chemically synthesized
ctagaaagtaagaaaactaaat

SEQ ID NO: 868666 - DNA, 22 bp, Artificial Sequence
  chemically synthesized
gactcctagaaagtaagaaaac

SEQ ID NO: 868667 - DNA, 22 bp, Artificial Sequence
  chemically synthesized
ctagactcctagaaagtaagaa

SEQ ID NO: 868668 - DNA, 22 bp, Artificial Sequence
  chemically synthesized
tttagttttcttactttctagg

SEQ ID NO: 868669 - DNA, 22 bp, Artificial Sequence
  chemically synthesized
agttttcttactttctaggagt

SEQ ID NO: 868670 - DNA, 22 bp, Artificial Sequence
  chemically synthesized
gttttcttactttctaggagtc

SEQ ID NO: 868671 - DNA, 22 bp, Artificial Sequence
  chemically synthesized
tcttactttctaggagtctagg

SEQ ID NO: 868672 - DNA, 22 bp, Artificial Sequence
  chemically synthesized
cttactttctaggagtctagga

SEQ ID NO: 868673 - DNA, 22 bp, Artificial Sequence
  chemically synthesized
ttactttctaggagtctaggaa

SEQ ID NO: 868674 - DNA, 22 bp, Artificial Sequence
  chemically synthesized
actttctaggagtctaggaatc

SEQ ID NO: 868675 - DNA, 22 bp, Artificial Sequence
  chemically synthesized
ctttctaggagtctaggaatca

SEQ ID NO: 868676 - DNA, 22 bp, Artificial Sequence
  chemically synthesized
tctaggagtctaggaatcacgc

SEQ ID NO: 868677 - DNA, 22 bp, Artificial Sequence
  chemically synthesized
ctaggagtctaggaatcacgct

SEQ ID NO: 868678 - DNA, 22 bp, Artificial Sequence
  chemically synthesized
taggagtctaggaatcacgctt

SEQ ID NO: 868679 - DNA, 22 bp, Artificial Sequence
  chemically synthesized
ggagtctaggaatcacgcttat

SEQ ID NO: 868680 - DNA, 22 bp, Artificial Sequence
  chemically synthesized
ggaatcacgcttatcttgatcc

SEQ ID NO: 868681 - DNA, 22 bp, Artificial Sequence
  chemically synthesized
gggatacaatatggatcaagat

SEQ ID NO: 868682 - DNA, 22 bp, Artificial Sequence
  chemically synthesized
tagggatacaatatggatcaag

SEQ ID NO: 868683 - DNA, 22 bp, Artificial Sequence
  chemically synthesized
gattctagggatacaatatgga

SEQ ID NO: 868684 - DNA, 22 bp, Artificial Sequence
  chemically synthesized
atcttgatccatattgtatccc

SEQ ID NO: 868685 - DNA, 22 bp, Artificial Sequence
  chemically synthesized
tcttgatccatattgtatccct

SEQ ID NO: 868686 - DNA, 22 bp, Artificial Sequence
  chemically synthesized
tgtgttagattctagggataca

SEQ ID NO: 868687 - DNA, 22 bp, Artificial Sequence
  chemically synthesized
gatccatattgtatccctagaa

SEQ ID NO: 868688 - DNA, 22 bp, Artificial Sequence
  chemically synthesized
ctgtgtgttagattctagggat

SEQ ID NO: 868689 - DNA, 22 bp, Artificial Sequence
  chemically synthesized
atccatattgtatccctagaat

SEQ ID NO: 868690 - DNA, 22 bp, Artificial Sequence
  chemically synthesized
tgtgccctcctgtgtgttagat

SEQ ID NO: 868691 - DNA, 22 bp, Artificial Sequence
  chemically synthesized
tatccctagaatctaacacaca

SEQ ID NO: 868692 - DNA, 22 bp, Artificial Sequence
  chemically synthesized
ctgtgtgccctcctgtgtgtta

SEQ ID NO: 868693 - DNA, 22 bp, Artificial Sequence
  chemically synthesized
gaatctaacacacaggagggca

SEQ ID NO: 868694 - DNA, 22 bp, Artificial Sequence
  chemically synthesized
aggattactgtgtgccctcctg

SEQ ID NO: 868695 - DNA, 22 bp, Artificial Sequence
  chemically synthesized
ttaaggattactgtgtgccctc

SEQ ID NO: 868696 - DNA, 22 bp, Artificial Sequence
  chemically synthesized
attaaggattactgtgtgccct

SEQ ID NO: 868697 - DNA, 22 bp, Artificial Sequence
  chemically synthesized
acacacaggagggcacacagta

SEQ ID NO: 868698 - DNA, 22 bp, Artificial Sequence
  chemically synthesized
acaaataatttattaaggatta

SEQ ID NO: 868699 - DNA, 22 bp, Artificial Sequence
  chemically synthesized
atctgacaaataatttattaag

SEQ ID NO: 868700 - DNA, 22 bp, Artificial Sequence
  chemically synthesized
tcaatatactaatctgacaaat

SEQ ID NO: 868701 - DNA, 22 bp, Artificial Sequence
  chemically synthesized
atcaatatactaatctgacaaa

SEQ ID NO: 868702 - DNA, 22 bp, Artificial Sequence
  chemically synthesized
aataaattatttgtcagattag

SEQ ID NO: 868703 - DNA, 22 bp, Artificial Sequence
  chemically synthesized
ataaattatttgtcagattagt

SEQ ID NO: 868704 - DNA, 22 bp, Artificial Sequence
  chemically synthesized
atttatcaatatactaatctga

SEQ ID NO: 868705 - DNA, 22 bp, Artificial Sequence
  chemically synthesized
aatttatcaatatactaatctg

SEQ ID NO: 868706 - DNA, 22 bp, Artificial Sequence
  chemically synthesized
tttgtcagattagtatattgat

SEQ ID NO: 868707 - DNA, 22 bp, Artificial Sequence
  chemically synthesized
tatccttaatttatcaatatac

SEQ ID NO: 868708 - DNA, 22 bp, Artificial Sequence
  chemically synthesized
gtatccttaatttatcaatata

SEQ ID NO: 868709 - DNA, 22 bp, Artificial Sequence
  chemically synthesized
gtcagattagtatattgataaa

SEQ ID NO: 868710 - DNA, 22 bp, Artificial Sequence
  chemically synthesized
tcagattagtatattgataaat

SEQ ID NO: 868711 - DNA, 22 bp, Artificial Sequence
  chemically synthesized
atttgtatccttaatttatcaa

SEQ ID NO: 868712 - DNA, 22 bp, Artificial Sequence
  chemically synthesized
ctcatttgtatccttaatttat

SEQ ID NO: 868713 - DNA, 22 bp, Artificial Sequence
  chemically synthesized
gtatattgataaattaaggata

SEQ ID NO: 868714 - DNA, 22 bp, Artificial Sequence
  chemically synthesized
taggttactcatttgtatcctt

SEQ ID NO: 868715 - DNA, 22 bp, Artificial Sequence
  chemically synthesized
actgtaggttactcatttgtat

SEQ ID NO: 868716 - DNA, 22 bp, Artificial Sequence
  chemically synthesized
ataaattaaggatacaaatgag

SEQ ID NO: 868717 - DNA, 22 bp, Artificial Sequence
  chemically synthesized
aactgtaggttactcatttgta

SEQ ID NO: 868718 - DNA, 22 bp, Artificial Sequence
  chemically synthesized
taactgtaggttactcatttgt

SEQ ID NO: 868719 - DNA, 22 bp, Artificial Sequence
  chemically synthesized
tttaactgtaggttactcattt

SEQ ID NO: 868720 - DNA, 22 bp, Artificial Sequence
  chemically synthesized
ctttaactgtaggttactcatt

SEQ ID NO: 868721 - DNA, 22 bp, Artificial Sequence
  chemically synthesized
cttctttaactgtaggttactc

SEQ ID NO: 868722 - DNA, 22 bp, Artificial Sequence
  chemically synthesized
aggatacaaatgagtaacctac

SEQ ID NO: 868723 - DNA, 22 bp, Artificial Sequence
  chemically synthesized
gtgcagttccttctttaactgt

SEQ ID NO: 868724 - DNA, 22 bp, Artificial Sequence
  chemically synthesized
actggtgcagttccttctttaa

SEQ ID NO: 868725 - DNA, 22 bp, Artificial Sequence
  chemically synthesized
aactggtgcagttccttcttta

SEQ ID NO: 868726 - DNA, 22 bp, Artificial Sequence
  chemically synthesized
acttaactggtgcagttccttc

SEQ ID NO: 868727 - DNA, 22 bp, Artificial Sequence
  chemically synthesized
gacttaactggtgcagttcctt

SEQ ID NO: 868728 - DNA, 22 bp, Artificial Sequence
  chemically synthesized
cagttaaagaaggaactgcacc

SEQ ID NO: 868729 - DNA, 22 bp, Artificial Sequence
  chemically synthesized
tttgacttaactggtgcagttc

SEQ ID NO: 868730 - DNA, 22 bp, Artificial Sequence
  chemically synthesized
aagaaggaactgcaccagttaa

SEQ ID NO: 868731 - DNA, 22 bp, Artificial Sequence
  chemically synthesized
cagtacactatttgacttaact

SEQ ID NO: 868732 - DNA, 22 bp, Artificial Sequence
  chemically synthesized
ccagtacactatttgacttaac

SEQ ID NO: 868733 - DNA, 22 bp, Artificial Sequence
  chemically synthesized
tccagtacactatttgacttaa

SEQ ID NO: 868734 - DNA, 22 bp, Artificial Sequence
  chemically synthesized
caccagttaagtcaaatagtgt

SEQ ID NO: 868735 - DNA, 22 bp, Artificial Sequence
  chemically synthesized
agtcaaatagtgtactggaaaa

SEQ ID NO: 868736 - DNA, 22 bp, Artificial Sequence
  chemically synthesized
gaaaatggcttcttatccccct

SEQ ID NO: 868737 - DNA, 22 bp, Artificial Sequence
  chemically synthesized
cttatccccctgatggtgacat

SEQ ID NO: 868738 - DNA, 22 bp, Artificial Sequence
  chemically synthesized
ttatccccctgatggtgacatc

SEQ ID NO: 868739 - DNA, 22 bp, Artificial Sequence
  chemically synthesized
caggcagcaggagatgtcacca

SEQ ID NO: 868740 - DNA, 22 bp, Artificial Sequence
  chemically synthesized
atccccctgatggtgacatctc

SEQ ID NO: 868741 - DNA, 22 bp, Artificial Sequence
  chemically synthesized
tccccctgatggtgacatctcc

SEQ ID NO: 868742 - DNA, 22 bp, Artificial Sequence
  chemically synthesized
tatagttacaggcagcaggaga

SEQ ID NO: 868743 - DNA, 22 bp, Artificial Sequence
  chemically synthesized
atggtgacatctcctgctgcct

SEQ ID NO: 868744 - DNA, 22 bp, Artificial Sequence
  chemically synthesized
aattatatagttacaggcagca

SEQ ID NO: 868745 - DNA, 22 bp, Artificial Sequence
  chemically synthesized
ggaagagttaaattatatagtt

SEQ ID NO: 868746 - DNA, 22 bp, Artificial Sequence
  chemically synthesized
ctgctgcctgtaactatataat

SEQ ID NO: 868747 - DNA, 22 bp, Artificial Sequence
  chemically synthesized
ctgcctgtaactatataattta

SEQ ID NO: 868748 - DNA, 22 bp, Artificial Sequence
  chemically synthesized
gttaggaagagttaaattatat

SEQ ID NO: 868749 - DNA, 22 bp, Artificial Sequence
  chemically synthesized
cctgtaactatataatttaact

SEQ ID NO: 868750 - DNA, 22 bp, Artificial Sequence
  chemically synthesized
taactatataatttaactcttc

SEQ ID NO: 868751 - DNA, 22 bp, Artificial Sequence
  chemically synthesized
aataatgaattagttaggaaga

SEQ ID NO: 868752 - DNA, 22 bp, Artificial Sequence
  chemically synthesized
tataatttaactcttcctaact

SEQ ID NO: 868753 - DNA, 22 bp, Artificial Sequence
  chemically synthesized
aaataatgaattagttaggaag

SEQ ID NO: 868754 - DNA, 22 bp, Artificial Sequence
  chemically synthesized
tcatttaaataatgaattagtt

SEQ ID NO: 868755 - DNA, 22 bp, Artificial Sequence
  chemically synthesized
aactcttcctaactaattcatt

SEQ ID NO: 868756 - DNA, 22 bp, Artificial Sequence
  chemically synthesized
actcttcctaactaattcatta

SEQ ID NO: 868757 - DNA, 22 bp, Artificial Sequence
  chemically synthesized
actatcatttaaataatgaatt

SEQ ID NO: 868758 - DNA, 22 bp, Artificial Sequence
  chemically synthesized
ttcctaactaattcattattta

SEQ ID NO: 868759 - DNA, 22 bp, Artificial Sequence
  chemically synthesized
cctaactaattcattatttaaa

SEQ ID NO: 868760 - DNA, 22 bp, Artificial Sequence
  chemically synthesized
aactgactatcatttaaataat

SEQ ID NO: 868761 - DNA, 22 bp, Artificial Sequence
  chemically synthesized
ctaactaattcattatttaaat

SEQ ID NO: 868762 - DNA, 22 bp, Artificial Sequence
  chemically synthesized
caactgactatcatttaaataa

SEQ ID NO: 868763 - DNA, 22 bp, Artificial Sequence
  chemically synthesized
actaattcattatttaaatgat

SEQ ID NO: 868764 - DNA, 22 bp, Artificial Sequence
  chemically synthesized
attcattatttaaatgatagtc

SEQ ID NO: 868765 - DNA, 22 bp, Artificial Sequence
  chemically synthesized
attatttaaatgatagtcagtt

SEQ ID NO: 868766 - DNA, 22 bp, Artificial Sequence
  chemically synthesized
tgataatgccacttcaactgac

SEQ ID NO: 868767 - DNA, 22 bp, Artificial Sequence
  chemically synthesized
tttaaatgatagtcagttgaag

SEQ ID NO: 868768 - DNA, 22 bp, Artificial Sequence
  chemically synthesized
aaatgatagtcagttgaagtgg

SEQ ID NO: 868769 - DNA, 22 bp, Artificial Sequence
  chemically synthesized
aatgatagtcagttgaagtggc

SEQ ID NO: 868770 - DNA, 22 bp, Artificial Sequence
  chemically synthesized
gcagaaaagagctatgataatg

SEQ ID NO: 868771 - DNA, 22 bp, Artificial Sequence
  chemically synthesized
aagtggcattatcatagctctt

SEQ ID NO: 868772 - DNA, 22 bp, Artificial Sequence
  chemically synthesized
tcatagctcttttctgctaatc

SEQ ID NO: 868773 - DNA, 22 bp, Artificial Sequence
  chemically synthesized
ccaaagcagcgtcatagattag

SEQ ID NO: 868774 - DNA, 22 bp, Artificial Sequence
  chemically synthesized
ttttctgctaatctatgacgct

SEQ ID NO: 868775 - DNA, 22 bp, Artificial Sequence
  chemically synthesized
ttctgctaatctatgacgctgc

SEQ ID NO: 868776 - DNA, 22 bp, Artificial Sequence
  chemically synthesized
tctgctaatctatgacgctgct

SEQ ID NO: 868777 - DNA, 22 bp, Artificial Sequence
  chemically synthesized
ctgctaatctatgacgctgctt

SEQ ID NO: 868778 - DNA, 22 bp, Artificial Sequence
  chemically synthesized
tgctaatctatgacgctgcttt

SEQ ID NO: 868779 - DNA, 22 bp, Artificial Sequence
  chemically synthesized
ctaatctatgacgctgctttgg

SEQ ID NO: 868780 - DNA, 22 bp, Artificial Sequence
  chemically synthesized
atctatgacgctgctttgggag

SEQ ID NO: 868781 - DNA, 22 bp, Artificial Sequence
  chemically synthesized
tgacgctgctttgggagaccat

SEQ ID NO: 868782 - DNA, 22 bp, Artificial Sequence
  chemically synthesized
tacaaaggtagaatggtctccc

SEQ ID NO: 868783 - DNA, 22 bp, Artificial Sequence
  chemically synthesized
gtacaaaggtagaatggtctcc

SEQ ID NO: 868784 - DNA, 22 bp, Artificial Sequence
  chemically synthesized
ctttgggagaccattctacctt

SEQ ID NO: 868785 - DNA, 22 bp, Artificial Sequence
  chemically synthesized
tgggagaccattctacctttgt

SEQ ID NO: 868786 - DNA, 22 bp, Artificial Sequence
  chemically synthesized
gggagaccattctacctttgta

SEQ ID NO: 868787 - DNA, 22 bp, Artificial Sequence
  chemically synthesized
ggagaccattctacctttgtac

SEQ ID NO: 868788 - DNA, 22 bp, Artificial Sequence
  chemically synthesized
aaatggcatacttgtacaaagg

SEQ ID NO: 868789 - DNA, 22 bp, Artificial Sequence
  chemically synthesized
gaaatggcatacttgtacaaag

SEQ ID NO: 868790 - DNA, 22 bp, Artificial Sequence
  chemically synthesized
aaacttgaaatggcatacttgt

SEQ ID NO: 868791 - DNA, 22 bp, Artificial Sequence
  chemically synthesized
gaaacttgaaatggcatacttg

SEQ ID NO: 868792 - DNA, 22 bp, Artificial Sequence
  chemically synthesized
tgaaacttgaaatggcatactt

SEQ ID NO: 868793 - DNA, 22 bp, Artificial Sequence
  chemically synthesized
tacctttgtacaagtatgccat

SEQ ID NO: 868794 - DNA, 22 bp, Artificial Sequence
  chemically synthesized
tttgaaacttgaaatggcatac

SEQ ID NO: 868795 - DNA, 22 bp, Artificial Sequence
  chemically synthesized
cctttgtacaagtatgccattt

SEQ ID NO: 868796 - DNA, 22 bp, Artificial Sequence
  chemically synthesized
ctttgaaacttgaaatggcata

SEQ ID NO: 868797 - DNA, 22 bp, Artificial Sequence
  chemically synthesized
tctttgaaacttgaaatggcat

SEQ ID NO: 868798 - DNA, 22 bp, Artificial Sequence
  chemically synthesized
tgtacaagtatgccatttcaag

SEQ ID NO: 868799 - DNA, 22 bp, Artificial Sequence
  chemically synthesized
gtacaagtatgccatttcaagt

SEQ ID NO: 868800 - DNA, 22 bp, Artificial Sequence
  chemically synthesized
tacaagtatgccatttcaagtt

SEQ ID NO: 868801 - DNA, 22 bp, Artificial Sequence
  chemically synthesized
agctttctttgaaacttgaaat

SEQ ID NO: 868802 - DNA, 22 bp, Artificial Sequence
  chemically synthesized
tacaccacatctcagctttctt

SEQ ID NO: 868803 - DNA, 22 bp, Artificial Sequence
  chemically synthesized
caagtttcaaagaaagctgaga

SEQ ID NO: 868804 - DNA, 22 bp, Artificial Sequence
  chemically synthesized
aagtttcaaagaaagctgagat

SEQ ID NO: 868805 - DNA, 22 bp, Artificial Sequence
  chemically synthesized
aaatgttatacaccacatctca

SEQ ID NO: 868806 - DNA, 22 bp, Artificial Sequence
  chemically synthesized
caaagaaagctgagatgtggtg

SEQ ID NO: 868807 - DNA, 22 bp, Artificial Sequence
  chemically synthesized
aaagaaagctgagatgtggtgt

SEQ ID NO: 868808 - DNA, 22 bp, Artificial Sequence
  chemically synthesized
gagattaaaatgttatacacca

SEQ ID NO: 868809 - DNA, 22 bp, Artificial Sequence
  chemically synthesized
tcgagattaaaatgttatacac

SEQ ID NO: 868810 - DNA, 22 bp, Artificial Sequence
  chemically synthesized
agatgtggtgtataacatttta

SEQ ID NO: 868811 - DNA, 22 bp, Artificial Sequence
  chemically synthesized
atagttctcgagattaaaatgt

SEQ ID NO: 868812 - DNA, 22 bp, Artificial Sequence
  chemically synthesized
ctcatagttctcgagattaaaa

SEQ ID NO: 868813 - DNA, 22 bp, Artificial Sequence
  chemically synthesized
ctgctcatagttctcgagatta

SEQ ID NO: 868814 - DNA, 22 bp, Artificial Sequence
  chemically synthesized
attactgctcatagttctcgag

SEQ ID NO: 868815 - DNA, 22 bp, Artificial Sequence
  chemically synthesized
taatctcgagaactatgagcag

SEQ ID NO: 868816 - DNA, 22 bp, Artificial Sequence
  chemically synthesized
aatctcgagaactatgagcagt

SEQ ID NO: 868817 - DNA, 22 bp, Artificial Sequence
  chemically synthesized
atctcgagaactatgagcagta

SEQ ID NO: 868818 - DNA, 22 bp, Artificial Sequence
  chemically synthesized
tgggaaatctaattactgctca

SEQ ID NO: 868819 - DNA, 22 bp, Artificial Sequence
  chemically synthesized
gagaactatgagcagtaattag

SEQ ID NO: 868820 - DNA, 22 bp, Artificial Sequence
  chemically synthesized
gatattatgggaaatctaatta

SEQ ID NO: 868821 - DNA, 22 bp, Artificial Sequence
  chemically synthesized
cgatattatgggaaatctaatt

SEQ ID NO: 868822 - DNA, 22 bp, Artificial Sequence
  chemically synthesized
tgagcagtaattagatttccca

SEQ ID NO: 868823 - DNA, 22 bp, Artificial Sequence
  chemically synthesized
gatttcccataatatcgaaatt

SEQ ID NO: 868824 - DNA, 22 bp, Artificial Sequence
  chemically synthesized
agtagaagtaataatttcgata

SEQ ID NO: 868825 - DNA, 22 bp, Artificial Sequence
  chemically synthesized
cccataatatcgaaattattac

SEQ ID NO: 868826 - DNA, 22 bp, Artificial Sequence
  chemically synthesized
ccataatatcgaaattattact

SEQ ID NO: 868827 - DNA, 22 bp, Artificial Sequence
  chemically synthesized
aatatacctaagtagaagtaat

SEQ ID NO: 868828 - DNA, 22 bp, Artificial Sequence
  chemically synthesized
aaatatacctaagtagaagtaa

SEQ ID NO: 868829 - DNA, 22 bp, Artificial Sequence
  chemically synthesized
aagtacccttaaatatacctaa

SEQ ID NO: 868830 - DNA, 22 bp, Artificial Sequence
  chemically synthesized
ttacttctacttaggtatattt

SEQ ID NO: 868831 - DNA, 22 bp, Artificial Sequence
  chemically synthesized
cttctacttaggtatatttaag

SEQ ID NO: 868832 - DNA, 22 bp, Artificial Sequence
  chemically synthesized
gatattgaagtacccttaaata

SEQ ID NO: 868833 - DNA, 22 bp, Artificial Sequence
  chemically synthesized
ctacttaggtatatttaagggt

SEQ ID NO: 868834 - DNA, 22 bp, Artificial Sequence
  chemically synthesized
agatattgaagtacccttaaat

SEQ ID NO: 868835 - DNA, 22 bp, Artificial Sequence
  chemically synthesized
tacttaggtatatttaagggta

SEQ ID NO: 868836 - DNA, 22 bp, Artificial Sequence
  chemically synthesized
cttaggtatatttaagggtact

SEQ ID NO: 868837 - DNA, 22 bp, Artificial Sequence
  chemically synthesized
aggtatatttaagggtacttca

SEQ ID NO: 868838 - DNA, 22 bp, Artificial Sequence
  chemically synthesized
ggtatatttaagggtacttcaa

SEQ ID NO: 868839 - DNA, 22 bp, Artificial Sequence
  chemically synthesized
aagggtacttcaatatctaaat

SEQ ID NO: 868840 - DNA, 22 bp, Artificial Sequence
  chemically synthesized
taagtcccatatatttagatat

SEQ ID NO: 868841 - DNA, 22 bp, Artificial Sequence
  chemically synthesized
agggtacttcaatatctaaata

SEQ ID NO: 868842 - DNA, 22 bp, Artificial Sequence
  chemically synthesized
atgactataagtcccatatatt

SEQ ID NO: 868843 - DNA, 22 bp, Artificial Sequence
  chemically synthesized
tcatgactataagtcccatata

SEQ ID NO: 868844 - DNA, 22 bp, Artificial Sequence
  chemically synthesized
caatatctaaatatatgggact

SEQ ID NO: 868845 - DNA, 22 bp, Artificial Sequence
  chemically synthesized
aatatctaaatatatgggactt

SEQ ID NO: 868846 - DNA, 22 bp, Artificial Sequence
  chemically synthesized
aattctcatgactataagtccc

SEQ ID NO: 868847 - DNA, 22 bp, Artificial Sequence
  chemically synthesized
taaattctcatgactataagtc

SEQ ID NO: 868848 - DNA, 22 bp, Artificial Sequence
  chemically synthesized
ctaaattctcatgactataagt

SEQ ID NO: 868849 - DNA, 22 bp, Artificial Sequence
  chemically synthesized
tctaaattctcatgactataag

SEQ ID NO: 868850 - DNA, 22 bp, Artificial Sequence
  chemically synthesized
aatatatgggacttatagtcat

SEQ ID NO: 868851 - DNA, 22 bp, Artificial Sequence
  chemically synthesized
gattttctaaattctcatgact

SEQ ID NO: 868852 - DNA, 22 bp, Artificial Sequence
  chemically synthesized
agattttctaaattctcatgac

SEQ ID NO: 868853 - DNA, 22 bp, Artificial Sequence
  chemically synthesized
ggtcttagattttctaaattct

SEQ ID NO: 868854 - DNA, 22 bp, Artificial Sequence
  chemically synthesized
atagtcatgagaatttagaaaa

SEQ ID NO: 868855 - DNA, 22 bp, Artificial Sequence
  chemically synthesized
tagtcatgagaatttagaaaat

SEQ ID NO: 868856 - DNA, 22 bp, Artificial Sequence
  chemically synthesized
agaaaatctaagacctagttat

SEQ ID NO: 868857 - DNA, 22 bp, Artificial Sequence
  chemically synthesized
gaaaatctaagacctagttatc

SEQ ID NO: 868858 - DNA, 22 bp, Artificial Sequence
  chemically synthesized
agacctagttatcccctttctt

SEQ ID NO: 868859 - DNA, 22 bp, Artificial Sequence
  chemically synthesized
agcatcaaaaaatacaaagaaa

SEQ ID NO: 868860 - DNA, 22 bp, Artificial Sequence
  chemically synthesized
gttatcccctttctttgtattt

SEQ ID NO: 868861 - DNA, 22 bp, Artificial Sequence
  chemically synthesized
tctcagcatcaaaaaatacaaa

SEQ ID NO: 868862 - DNA, 22 bp, Artificial Sequence
  chemically synthesized
tcccctttctttgtattttttg

SEQ ID NO: 868863 - DNA, 22 bp, Artificial Sequence
  chemically synthesized
ctatctcagcatcaaaaaatac

SEQ ID NO: 868864 - DNA, 22 bp, Artificial Sequence
  chemically synthesized
cctatctcagcatcaaaaaata

SEQ ID NO: 868865 - DNA, 22 bp, Artificial Sequence
  chemically synthesized
tcctatctcagcatcaaaaaat

SEQ ID NO: 868866 - DNA, 22 bp, Artificial Sequence
  chemically synthesized
tctttgtattttttgatgctga

SEQ ID NO: 868867 - DNA, 22 bp, Artificial Sequence
  chemically synthesized
ctttgtattttttgatgctgag

SEQ ID NO: 868868 - DNA, 22 bp, Artificial Sequence
  chemically synthesized
tttgtattttttgatgctgaga

SEQ ID NO: 868869 - DNA, 22 bp, Artificial Sequence
  chemically synthesized
tgtattttttgatgctgagata

SEQ ID NO: 868870 - DNA, 22 bp, Artificial Sequence
  chemically synthesized
gtattttttgatgctgagatag

SEQ ID NO: 868871 - DNA, 22 bp, Artificial Sequence
  chemically synthesized
gataacgttttcctatctcagc

SEQ ID NO: 868872 - DNA, 22 bp, Artificial Sequence
  chemically synthesized
tattttttgatgctgagatagg

SEQ ID NO: 868873 - DNA, 22 bp, Artificial Sequence
  chemically synthesized
ggataacgttttcctatctcag

SEQ ID NO: 868874 - DNA, 22 bp, Artificial Sequence
  chemically synthesized
tggataacgttttcctatctca

SEQ ID NO: 868875 - DNA, 22 bp, Artificial Sequence
  chemically synthesized
tttgatgctgagataggaaaac

SEQ ID NO: 868876 - DNA, 22 bp, Artificial Sequence
  chemically synthesized
actttggataacgttttcctat

SEQ ID NO: 868877 - DNA, 22 bp, Artificial Sequence
  chemically synthesized
ttgatgctgagataggaaaacg

SEQ ID NO: 868878 - DNA, 22 bp, Artificial Sequence
  chemically synthesized
tgatgctgagataggaaaacgt

SEQ ID NO: 868879 - DNA, 22 bp, Artificial Sequence
  chemically synthesized
tcactttggataacgttttcct

SEQ ID NO: 868880 - DNA, 22 bp, Artificial Sequence
  chemically synthesized
gatgctgagataggaaaacgtt

SEQ ID NO: 868881 - DNA, 22 bp, Artificial Sequence
  chemically synthesized
atgctgagataggaaaacgtta

SEQ ID NO: 868882 - DNA, 22 bp, Artificial Sequence
  chemically synthesized
ttctcactttggataacgtttt

SEQ ID NO: 868883 - DNA, 22 bp, Artificial Sequence
  chemically synthesized
gttctcactttggataacgttt

SEQ ID NO: 868884 - DNA, 22 bp, Artificial Sequence
  chemically synthesized
agataggaaaacgttatccaaa

SEQ ID NO: 868885 - DNA, 22 bp, Artificial Sequence
  chemically synthesized
aaacatttgttctcactttgga

SEQ ID NO: 868886 - DNA, 22 bp, Artificial Sequence
  chemically synthesized
gagcctaaaacatttgttctca

SEQ ID NO: 868887 - DNA, 22 bp, Artificial Sequence
  chemically synthesized
tccaaagtgagaacaaatgttt

SEQ ID NO: 868888 - DNA, 22 bp, Artificial Sequence
  chemically synthesized
tataaaaggactcgagcctaaa

SEQ ID NO: 868889 - DNA, 22 bp, Artificial Sequence
  chemically synthesized
taggctcgagtccttttatata

SEQ ID NO: 868890 - DNA, 22 bp, Artificial Sequence
  chemically synthesized
aggctcgagtccttttatataa

SEQ ID NO: 868891 - DNA, 22 bp, Artificial Sequence
  chemically synthesized
ggctcgagtccttttatataac

SEQ ID NO: 868892 - DNA, 22 bp, Artificial Sequence
  chemically synthesized
gagtccttttatataactacta

SEQ ID NO: 868893 - DNA, 22 bp, Artificial Sequence
  chemically synthesized
aaaaaatgatgagtagtagtta

SEQ ID NO: 868894 - DNA, 22 bp, Artificial Sequence
  chemically synthesized
gaaaaaatgatgagtagtagtt

SEQ ID NO: 868895 - DNA, 22 bp, Artificial Sequence
  chemically synthesized
ttatataactactactcatcat

SEQ ID NO: 868896 - DNA, 22 bp, Artificial Sequence
  chemically synthesized
tcatttgaaaaaatgatgagta

SEQ ID NO: 868897 - DNA, 22 bp, Artificial Sequence
  chemically synthesized
tatataactactactcatcatt

SEQ ID NO: 868898 - DNA, 22 bp, Artificial Sequence
  chemically synthesized
atataactactactcatcattt

SEQ ID NO: 868899 - DNA, 22 bp, Artificial Sequence
  chemically synthesized
tataactactactcatcatttt

SEQ ID NO: 868900 - DNA, 22 bp, Artificial Sequence
  chemically synthesized
cactatcatttgaaaaaatgat

SEQ ID NO: 868901 - DNA, 22 bp, Artificial Sequence
  chemically synthesized
ctactcatcattttttcaaatg

SEQ ID NO: 868902 - DNA, 22 bp, Artificial Sequence
  chemically synthesized
ctcatcattttttcaaatgata

SEQ ID NO: 868903 - DNA, 22 bp, Artificial Sequence
  chemically synthesized
agagtgttccactatcatttga

SEQ ID NO: 868904 - DNA, 22 bp, Artificial Sequence
  chemically synthesized
aagagtgttccactatcatttg

SEQ ID NO: 868905 - DNA, 22 bp, Artificial Sequence
  chemically synthesized
atcattttttcaaatgatagtg

SEQ ID NO: 868906 - DNA, 22 bp, Artificial Sequence
  chemically synthesized
ttaagagtgttccactatcatt

SEQ ID NO: 868907 - DNA, 22 bp, Artificial Sequence
  chemically synthesized
tttcaaatgatagtggaacact

SEQ ID NO: 868908 - DNA, 22 bp, Artificial Sequence
  chemically synthesized
ttcaaatgatagtggaacactc

SEQ ID NO: 868909 - DNA, 22 bp, Artificial Sequence
  chemically synthesized
tcaaatgatagtggaacactct

SEQ ID NO: 868910 - DNA, 22 bp, Artificial Sequence
  chemically synthesized
gtacaactcttaagagtgttcc

SEQ ID NO: 868911 - DNA, 22 bp, Artificial Sequence
  chemically synthesized
caaatgatagtggaacactctt

SEQ ID NO: 868912 - DNA, 22 bp, Artificial Sequence
  chemically synthesized
aaatgatagtggaacactctta

SEQ ID NO: 868913 - DNA, 22 bp, Artificial Sequence
  chemically synthesized
ttaagagttgtaccaggtattt

SEQ ID NO: 868914 - DNA, 22 bp, Artificial Sequence
  chemically synthesized
aagagttgtaccaggtatttca

SEQ ID NO: 868915 - DNA, 22 bp, Artificial Sequence
  chemically synthesized
agagttgtaccaggtatttcac

SEQ ID NO: 868916 - DNA, 22 bp, Artificial Sequence
  chemically synthesized
taccaggtatttcacatctctt

SEQ ID NO: 868917 - DNA, 22 bp, Artificial Sequence
  chemically synthesized
atggaaagaataaagagatgtg

SEQ ID NO: 868918 - DNA, 22 bp, Artificial Sequence
  chemically synthesized
taaagccactcatggaaagaat

SEQ ID NO: 868919 - DNA, 22 bp, Artificial Sequence
  chemically synthesized
cacatctctttattctttccat

SEQ ID NO: 868920 - DNA, 22 bp, Artificial Sequence
  chemically synthesized
ataaagccactcatggaaagaa

SEQ ID NO: 868921 - DNA, 22 bp, Artificial Sequence
  chemically synthesized
acatctctttattctttccatg

SEQ ID NO: 868922 - DNA, 22 bp, Artificial Sequence
  chemically synthesized
tttattctttccatgagtggct

SEQ ID NO: 868923 - DNA, 22 bp, Artificial Sequence
  chemically synthesized
tattctttccatgagtggcttt

SEQ ID NO: 868924 - DNA, 22 bp, Artificial Sequence
  chemically synthesized
attctttccatgagtggcttta

SEQ ID NO: 868925 - DNA, 22 bp, Artificial Sequence
  chemically synthesized
ttctttccatgagtggctttat

SEQ ID NO: 868926 - DNA, 22 bp, Artificial Sequence
  chemically synthesized
tttccatgagtggctttataaa

SEQ ID NO: 868927 - DNA, 22 bp, Artificial Sequence
  chemically synthesized
tccatgagtggctttataaatg

SEQ ID NO: 868928 - DNA, 22 bp, Artificial Sequence
  chemically synthesized
gcatagaatggacatttataaa

SEQ ID NO: 868929 - DNA, 22 bp, Artificial Sequence
  chemically synthesized
ccatgagtggctttataaatgt

SEQ ID NO: 868930 - DNA, 22 bp, Artificial Sequence
  chemically synthesized
agcatagaatggacatttataa

SEQ ID NO: 868931 - DNA, 22 bp, Artificial Sequence
  chemically synthesized
catgagtggctttataaatgtc

SEQ ID NO: 868932 - DNA, 22 bp, Artificial Sequence
  chemically synthesized
cttagcatagaatggacattta

SEQ ID NO: 868933 - DNA, 22 bp, Artificial Sequence
  chemically synthesized
acttagcatagaatggacattt

SEQ ID NO: 868934 - DNA, 22 bp, Artificial Sequence
  chemically synthesized
tataaatgtccattctatgcta

SEQ ID NO: 868935 - DNA, 22 bp, Artificial Sequence
  chemically synthesized
ataaatgtccattctatgctaa

SEQ ID NO: 868936 - DNA, 22 bp, Artificial Sequence
  chemically synthesized
taaatgtccattctatgctaag

SEQ ID NO: 868937 - DNA, 22 bp, Artificial Sequence
  chemically synthesized
agaacaaagaataccacttact

SEQ ID NO: 868938 - DNA, 22 bp, Artificial Sequence
  chemically synthesized
ctcagaacaaagaataccactt

SEQ ID NO: 868939 - DNA, 22 bp, Artificial Sequence
  chemically synthesized
actcagaacaaagaataccact

SEQ ID NO: 868940 - DNA, 22 bp, Artificial Sequence
  chemically synthesized
tatgctaagtaagtggtattct

SEQ ID NO: 868941 - DNA, 22 bp, Artificial Sequence
  chemically synthesized
tgctaagtaagtggtattcttt

SEQ ID NO: 868942 - DNA, 22 bp, Artificial Sequence
  chemically synthesized
atgcttactcagaacaaagaat

SEQ ID NO: 868943 - DNA, 22 bp, Artificial Sequence
  chemically synthesized
agtaagtggtattctttgttct

SEQ ID NO: 868944 - DNA, 22 bp, Artificial Sequence
  chemically synthesized
ttaatgcttactcagaacaaag

SEQ ID NO: 868945 - DNA, 22 bp, Artificial Sequence
  chemically synthesized
tttgttctgagtaagcattaat

SEQ ID NO: 868946 - DNA, 22 bp, Artificial Sequence
  chemically synthesized
tgttctgagtaagcattaataa

SEQ ID NO: 868947 - DNA, 22 bp, Artificial Sequence
  chemically synthesized
tcatcagcagtgttattaatgc

SEQ ID NO: 868948 - DNA, 22 bp, Artificial Sequence
  chemically synthesized
gttctgagtaagcattaataac

SEQ ID NO: 868949 - DNA, 22 bp, Artificial Sequence
  chemically synthesized
atcatcagcagtgttattaatg

SEQ ID NO: 868950 - DNA, 22 bp, Artificial Sequence
  chemically synthesized
ttctgagtaagcattaataaca

SEQ ID NO: 868951 - DNA, 22 bp, Artificial Sequence
  chemically synthesized
ttatcatcagcagtgttattaa

SEQ ID NO: 868952 - DNA, 22 bp, Artificial Sequence
  chemically synthesized
cttatcatcagcagtgttatta

SEQ ID NO: 868953 - DNA, 22 bp, Artificial Sequence
  chemically synthesized
tgagtaagcattaataacactg

SEQ ID NO: 868954 - DNA, 22 bp, Artificial Sequence
  chemically synthesized
agtaagcattaataacactgct

SEQ ID NO: 868955 - DNA, 22 bp, Artificial Sequence
  chemically synthesized
ataacactgctgatgataagaa

SEQ ID NO: 868956 - DNA, 22 bp, Artificial Sequence
  chemically synthesized
caggggaaaaaatatttcttat

SEQ ID NO: 868957 - DNA, 22 bp, Artificial Sequence
  chemically synthesized
ctccaggggaaaaaatatttct

SEQ ID NO: 868958 - DNA, 22 bp, Artificial Sequence
  chemically synthesized
cctccaggggaaaaaatatttc

SEQ ID NO: 868959 - DNA, 22 bp, Artificial Sequence
  chemically synthesized
ctgatgataagaaatatttttt

SEQ ID NO: 868960 - DNA, 22 bp, Artificial Sequence
  chemically synthesized
atgataagaaatattttttccc

SEQ ID NO: 868961 - DNA, 22 bp, Artificial Sequence
  chemically synthesized
aggcttcctccaggggaaaaaa

SEQ ID NO: 868962 - DNA, 22 bp, Artificial Sequence
  chemically synthesized
aaggcttcctccaggggaaaaa

SEQ ID NO: 868963 - DNA, 22 bp, Artificial Sequence
  chemically synthesized
ttaaggcttcctccaggggaaa

SEQ ID NO: 868964 - DNA, 22 bp, Artificial Sequence
  chemically synthesized
cttaaggcttcctccaggggaa

SEQ ID NO: 868965 - DNA, 22 bp, Artificial Sequence
  chemically synthesized
atcttcttaaggcttcctccag

SEQ ID NO: 868966 - DNA, 22 bp, Artificial Sequence
  chemically synthesized
cctaatcttcttaaggcttcct

SEQ ID NO: 868967 - DNA, 22 bp, Artificial Sequence
  chemically synthesized
ccctaatcttcttaaggcttcc

SEQ ID NO: 868968 - DNA, 22 bp, Artificial Sequence
  chemically synthesized
tttcccctggaggaagccttaa

SEQ ID NO: 868969 - DNA, 22 bp, Artificial Sequence
  chemically synthesized
ttcccctggaggaagccttaag

SEQ ID NO: 868970 - DNA, 22 bp, Artificial Sequence
  chemically synthesized
tcccctggaggaagccttaaga

SEQ ID NO: 868971 - DNA, 22 bp, Artificial Sequence
  chemically synthesized
cccctggaggaagccttaagaa

SEQ ID NO: 868972 - DNA, 22 bp, Artificial Sequence
  chemically synthesized
ccctggaggaagccttaagaag

SEQ ID NO: 868973 - DNA, 22 bp, Artificial Sequence
  chemically synthesized
atgtgtttccctaatcttctta

SEQ ID NO: 868974 - DNA, 22 bp, Artificial Sequence
  chemically synthesized
aatgtgtttccctaatcttctt

SEQ ID NO: 868975 - DNA, 22 bp, Artificial Sequence
  chemically synthesized
gaggaagccttaagaagattag

SEQ ID NO: 868976 - DNA, 22 bp, Artificial Sequence
  chemically synthesized
tttaatgtgtttccctaatctt

SEQ ID NO: 868977 - DNA, 22 bp, Artificial Sequence
  chemically synthesized
aagaagattagggaaacacatt

SEQ ID NO: 868978 - DNA, 22 bp, Artificial Sequence
  chemically synthesized
agaagattagggaaacacatta

SEQ ID NO: 868979 - DNA, 22 bp, Artificial Sequence
  chemically synthesized
gggaaacacattaaacaatcta

SEQ ID NO: 868980 - DNA, 22 bp, Artificial Sequence
  chemically synthesized
ataaagggaatatagattgttt

SEQ ID NO: 868981 - DNA, 22 bp, Artificial Sequence
  chemically synthesized
tagctaataaagggaatataga

SEQ ID NO: 868982 - DNA, 22 bp, Artificial Sequence
  chemically synthesized
gtagctaataaagggaatatag

SEQ ID NO: 868983 - DNA, 22 bp, Artificial Sequence
  chemically synthesized
cttgtagctaataaagggaata

SEQ ID NO: 868984 - DNA, 22 bp, Artificial Sequence
  chemically synthesized
aacaatctatattccctttatt

SEQ ID NO: 868985 - DNA, 22 bp, Artificial Sequence
  chemically synthesized
tattccctttattagctacaag

SEQ ID NO: 868986 - DNA, 22 bp, Artificial Sequence
  chemically synthesized
gtcaatagattccttgtagcta

SEQ ID NO: 868987 - DNA, 22 bp, Artificial Sequence
  chemically synthesized
cctttattagctacaaggaatc

SEQ ID NO: 868988 - DNA, 22 bp, Artificial Sequence
  chemically synthesized
tattagctacaaggaatctatt

SEQ ID NO: 868989 - DNA, 22 bp, Artificial Sequence
  chemically synthesized
attagctacaaggaatctattg

SEQ ID NO: 868990 - DNA, 22 bp, Artificial Sequence
  chemically synthesized
ttagctacaaggaatctattga

SEQ ID NO: 868991 - DNA, 22 bp, Artificial Sequence
  chemically synthesized
gataaatactagtcaatagatt

SEQ ID NO: 868992 - DNA, 22 bp, Artificial Sequence
  chemically synthesized
agataaatactagtcaatagat

SEQ ID NO: 868993 - DNA, 22 bp, Artificial Sequence
  chemically synthesized
tagataaatactagtcaataga

SEQ ID NO: 868994 - DNA, 22 bp, Artificial Sequence
  chemically synthesized
gctacaaggaatctattgacta

SEQ ID NO: 868995 - DNA, 22 bp, Artificial Sequence
  chemically synthesized
ttttagataaatactagtcaat

SEQ ID NO: 868996 - DNA, 22 bp, Artificial Sequence
  chemically synthesized
caaggaatctattgactagtat

SEQ ID NO: 868997 - DNA, 22 bp, Artificial Sequence
  chemically synthesized
acccctgttttagataaatact

SEQ ID NO: 868998 - DNA, 22 bp, Artificial Sequence
  chemically synthesized
actgacccctgttttagataaa

SEQ ID NO: 868999 - DNA, 22 bp, Artificial Sequence
  chemically synthesized
ttgactagtatttatctaaaac

SEQ ID NO: 869000 - DNA, 22 bp, Artificial Sequence
  chemically synthesized
actagtatttatctaaaacagg

SEQ ID NO: 869001 - DNA, 22 bp, Artificial Sequence
  chemically synthesized
gtatttatctaaaacaggggtc

SEQ ID NO: 869002 - DNA, 22 bp, Artificial Sequence
  chemically synthesized
atctaaaacaggggtcagtgaa

SEQ ID NO: 869003 - DNA, 22 bp, Artificial Sequence
  chemically synthesized
tctaaaacaggggtcagtgaac

SEQ ID NO: 869004 - DNA, 22 bp, Artificial Sequence
  chemically synthesized
gcccacaagccgtagttcactg

SEQ ID NO: 869005 - DNA, 22 bp, Artificial Sequence
  chemically synthesized
ggcccacaagccgtagttcact

SEQ ID NO: 869006 - DNA, 22 bp, Artificial Sequence
  chemically synthesized
aaacaggggtcagtgaactacg

SEQ ID NO: 869007 - DNA, 22 bp, Artificial Sequence
  chemically synthesized
gatttggcccacaagccgtagt

SEQ ID NO: 869008 - DNA, 22 bp, Artificial Sequence
  chemically synthesized
gttggatttggcccacaagccg

SEQ ID NO: 869009 - DNA, 22 bp, Artificial Sequence
  chemically synthesized
cggcttgtgggccaaatccaac

SEQ ID NO: 869010 - DNA, 22 bp, Artificial Sequence
  chemically synthesized
caagaacaggcagttggttgga

SEQ ID NO: 869011 - DNA, 22 bp, Artificial Sequence
  chemically synthesized
gcaagaacaggcagttggttgg

SEQ ID NO: 869012 - DNA, 22 bp, Artificial Sequence
  chemically synthesized
gtgggccaaatccaaccaactg

SEQ ID NO: 869013 - DNA, 22 bp, Artificial Sequence
  chemically synthesized
tgggccaaatccaaccaactgc

SEQ ID NO: 869014 - DNA, 22 bp, Artificial Sequence
  chemically synthesized
caataaaagtgtgtttgcaaga

SEQ ID NO: 869015 - DNA, 22 bp, Artificial Sequence
  chemically synthesized
tgttccaataaaagtgtgtttg

SEQ ID NO: 869016 - DNA, 22 bp, Artificial Sequence
  chemically synthesized
cctgttcttgcaaacacacttt

SEQ ID NO: 869017 - DNA, 22 bp, Artificial Sequence
  chemically synthesized
ttcttgcaaacacacttttatt

SEQ ID NO: 869018 - DNA, 22 bp, Artificial Sequence
  chemically synthesized
ttgcaaacacacttttattgga

SEQ ID NO: 869019 - DNA, 22 bp, Artificial Sequence
  chemically synthesized
gcaaacacacttttattggaac

SEQ ID NO: 869020 - DNA, 22 bp, Artificial Sequence
  chemically synthesized
caaacacacttttattggaaca

SEQ ID NO: 869021 - DNA, 22 bp, Artificial Sequence
  chemically synthesized
taaatgcataagtgtggctgtg

SEQ ID NO: 869022 - DNA, 22 bp, Artificial Sequence
  chemically synthesized
gtaaatgcataagtgtggctgt

SEQ ID NO: 869023 - DNA, 22 bp, Artificial Sequence
  chemically synthesized
ttattggaacacagccacactt

SEQ ID NO: 869024 - DNA, 22 bp, Artificial Sequence
  chemically synthesized
tattggaacacagccacactta

SEQ ID NO: 869025 - DNA, 22 bp, Artificial Sequence
  chemically synthesized
attggaacacagccacacttat

SEQ ID NO: 869026 - DNA, 22 bp, Artificial Sequence
  chemically synthesized
ttggaacacagccacacttatg

SEQ ID NO: 869027 - DNA, 22 bp, Artificial Sequence
  chemically synthesized
gaacacagccacacttatgcat

SEQ ID NO: 869028 - DNA, 22 bp, Artificial Sequence
  chemically synthesized
atgcatttacaaactgcctatg

SEQ ID NO: 869029 - DNA, 22 bp, Artificial Sequence
  chemically synthesized
tgcatttacaaactgcctatgg

SEQ ID NO: 869030 - DNA, 22 bp, Artificial Sequence
  chemically synthesized
atgaggtgcaaagcagccatag

SEQ ID NO: 869031 - DNA, 22 bp, Artificial Sequence
  chemically synthesized
acaaactgcctatggctgcttt

SEQ ID NO: 869032 - DNA, 22 bp, Artificial Sequence
  chemically synthesized
ctaatgaggtgcaaagcagcca

SEQ ID NO: 869033 - DNA, 22 bp, Artificial Sequence
  chemically synthesized
caaactgcctatggctgctttg

SEQ ID NO: 869034 - DNA, 22 bp, Artificial Sequence
  chemically synthesized
tgctaatgaggtgcaaagcagc

SEQ ID NO: 869035 - DNA, 22 bp, Artificial Sequence
  chemically synthesized
aactctgctaatgaggtgcaaa

SEQ ID NO: 869036 - DNA, 22 bp, Artificial Sequence
  chemically synthesized
cctatggctgctttgcacctca

SEQ ID NO: 869037 - DNA, 22 bp, Artificial Sequence
  chemically synthesized
ctcaactctgctaatgaggtgc

SEQ ID NO: 869038 - DNA, 22 bp, Artificial Sequence
  chemically synthesized
tggctgctttgcacctcattag

SEQ ID NO: 869039 - DNA, 22 bp, Artificial Sequence
  chemically synthesized
aagttactcaactctgctaatg

SEQ ID NO: 869040 - DNA, 22 bp, Artificial Sequence
  chemically synthesized
ctttgcacctcattagcagagt

SEQ ID NO: 869041 - DNA, 22 bp, Artificial Sequence
  chemically synthesized
ttgaagttactcaactctgcta

SEQ ID NO: 869042 - DNA, 22 bp, Artificial Sequence
  chemically synthesized
gttgaagttactcaactctgct

SEQ ID NO: 869043 - DNA, 22 bp, Artificial Sequence
  chemically synthesized
tgcacctcattagcagagttga

SEQ ID NO: 869044 - DNA, 22 bp, Artificial Sequence
  chemically synthesized
tgttgaagttactcaactctgc

SEQ ID NO: 869045 - DNA, 22 bp, Artificial Sequence
  chemically synthesized
gcacctcattagcagagttgag

SEQ ID NO: 869046 - DNA, 22 bp, Artificial Sequence
  chemically synthesized
cacctcattagcagagttgagt

SEQ ID NO: 869047 - DNA, 22 bp, Artificial Sequence
  chemically synthesized
attagcagagttgagtaacttc

SEQ ID NO: 869048 - DNA, 22 bp, Artificial Sequence
  chemically synthesized
gcagagttgagtaacttcaaca

SEQ ID NO: 869049 - DNA, 22 bp, Artificial Sequence
  chemically synthesized
caagccagaagatctttgttga

SEQ ID NO: 869050 - DNA, 22 bp, Artificial Sequence
  chemically synthesized
acaagccagaagatctttgttg

SEQ ID NO: 869051 - DNA, 22 bp, Artificial Sequence
  chemically synthesized
tacaagccagaagatctttgtt

SEQ ID NO: 869052 - DNA, 22 bp, Artificial Sequence
  chemically synthesized
agtaacttcaacaaagatcttc

SEQ ID NO: 869053 - DNA, 22 bp, Artificial Sequence
  chemically synthesized
ggttttacaagccagaagatct

SEQ ID NO: 869054 - DNA, 22 bp, Artificial Sequence
  chemically synthesized
gggttttacaagccagaagatc

SEQ ID NO: 869055 - DNA, 22 bp, Artificial Sequence
  chemically synthesized
tgggttttacaagccagaagat

SEQ ID NO: 869056 - DNA, 22 bp, Artificial Sequence
  chemically synthesized
caacaaagatcttctggcttgt

SEQ ID NO: 869057 - DNA, 22 bp, Artificial Sequence
  chemically synthesized
aacaaagatcttctggcttgta

SEQ ID NO: 869058 - DNA, 22 bp, Artificial Sequence
  chemically synthesized
ctggcttgtaaaacccaaaata

SEQ ID NO: 869059 - DNA, 22 bp, Artificial Sequence
  chemically synthesized
tggcttgtaaaacccaaaatat

SEQ ID NO: 869060 - DNA, 22 bp, Artificial Sequence
  chemically synthesized
gcttgtaaaacccaaaatattt

SEQ ID NO: 869061 - DNA, 22 bp, Artificial Sequence
  chemically synthesized
gtaaaacccaaaatatttacta

SEQ ID NO: 869062 - DNA, 22 bp, Artificial Sequence
  chemically synthesized
taaaaagccagatagtaaatat

SEQ ID NO: 869063 - DNA, 22 bp, Artificial Sequence
  chemically synthesized
taaaacccaaaatatttactat

SEQ ID NO: 869064 - DNA, 22 bp, Artificial Sequence
  chemically synthesized
tgtaaaaagccagatagtaaat

SEQ ID NO: 869065 - DNA, 22 bp, Artificial Sequence
  chemically synthesized
ctgtaaaaagccagatagtaaa

SEQ ID NO: 869066 - DNA, 22 bp, Artificial Sequence
  chemically synthesized
tctgtaaaaagccagatagtaa

SEQ ID NO: 869067 - DNA, 22 bp, Artificial Sequence
  chemically synthesized
ttctgtaaaaagccagatagta

SEQ ID NO: 869068 - DNA, 22 bp, Artificial Sequence
  chemically synthesized
tttctgtaaaaagccagatagt

SEQ ID NO: 869069 - DNA, 22 bp, Artificial Sequence
  chemically synthesized
ccaattttttctgtaaaaagcc

SEQ ID NO: 869070 - DNA, 22 bp, Artificial Sequence
  chemically synthesized
gccaattttttctgtaaaaagc

SEQ ID NO: 869071 - DNA, 22 bp, Artificial Sequence
  chemically synthesized
tgccaattttttctgtaaaaag

SEQ ID NO: 869072 - DNA, 22 bp, Artificial Sequence
  chemically synthesized
actatctggctttttacagaaa

SEQ ID NO: 869073 - DNA, 22 bp, Artificial Sequence
  chemically synthesized
ctatctggctttttacagaaaa

SEQ ID NO: 869074 - DNA, 22 bp, Artificial Sequence
  chemically synthesized
tctggctttttacagaaaaaat

SEQ ID NO: 869075 - DNA, 22 bp, Artificial Sequence
  chemically synthesized
gtcgaagttttgccaatttttt

SEQ ID NO: 869076 - DNA, 22 bp, Artificial Sequence
  chemically synthesized
gctttttacagaaaaaattggc

SEQ ID NO: 869077 - DNA, 22 bp, Artificial Sequence
  chemically synthesized
ggtcgaagttttgccaattttt

SEQ ID NO: 869078 - DNA, 22 bp, Artificial Sequence
  chemically synthesized
tggtcgaagttttgccaatttt

SEQ ID NO: 869079 - DNA, 22 bp, Artificial Sequence
  chemically synthesized
tttacagaaaaaattggcaaaa

SEQ ID NO: 869080 - DNA, 22 bp, Artificial Sequence
  chemically synthesized
ttacagaaaaaattggcaaaac

SEQ ID NO: 869081 - DNA, 22 bp, Artificial Sequence
  chemically synthesized
tacagaaaaaattggcaaaact

SEQ ID NO: 869082 - DNA, 22 bp, Artificial Sequence
  chemically synthesized
acagaaaaaattggcaaaactt

SEQ ID NO: 869083 - DNA, 22 bp, Artificial Sequence
  chemically synthesized
cagaaaaaattggcaaaacttc

SEQ ID NO: 869084 - DNA, 22 bp, Artificial Sequence
  chemically synthesized
aagaaggttttggtcgaagttt

SEQ ID NO: 869085 - DNA, 22 bp, Artificial Sequence
  chemically synthesized
caagaaggttttggtcgaagtt

SEQ ID NO: 869086 - DNA, 22 bp, Artificial Sequence
  chemically synthesized
gcaaaacttcgaccaaaacctt

SEQ ID NO: 869087 - DNA, 22 bp, Artificial Sequence
  chemically synthesized
gtaatgtaagtcacttcaagaa

SEQ ID NO: 869088 - DNA, 22 bp, Artificial Sequence
  chemically synthesized
cgaccaaaaccttcttgaagtg

SEQ ID NO: 869089 - DNA, 22 bp, Artificial Sequence
  chemically synthesized
gaccaaaaccttcttgaagtga

SEQ ID NO: 869090 - DNA, 22 bp, Artificial Sequence
  chemically synthesized
cttgaagtgacttacattacta

SEQ ID NO: 869091 - DNA, 22 bp, Artificial Sequence
  chemically synthesized
ttgaagtgacttacattactaa

SEQ ID NO: 869092 - DNA, 22 bp, Artificial Sequence
  chemically synthesized
gaagtgacttacattactaacc

SEQ ID NO: 869093 - DNA, 22 bp, Artificial Sequence
  chemically synthesized
aagtgacttacattactaacct

SEQ ID NO: 869094 - DNA, 22 bp, Artificial Sequence
  chemically synthesized
agcgggaggtataggttagtaa

SEQ ID NO: 869095 - DNA, 22 bp, Artificial Sequence
  chemically synthesized
cagcgggaggtataggttagta

SEQ ID NO: 869096 - DNA, 22 bp, Artificial Sequence
  chemically synthesized
tttcagcgggaggtataggtta

SEQ ID NO: 869097 - DNA, 22 bp, Artificial Sequence
  chemically synthesized
ctgtttcagcgggaggtatagg

SEQ ID NO: 869098 - DNA, 22 bp, Artificial Sequence
  chemically synthesized
actgtttcagcgggaggtatag

SEQ ID NO: 869099 - DNA, 22 bp, Artificial Sequence
  chemically synthesized
acattactaacctatacctccc

SEQ ID NO: 869100 - DNA, 22 bp, Artificial Sequence
  chemically synthesized
cattactaacctatacctcccg

SEQ ID NO: 869101 - DNA, 22 bp, Artificial Sequence
  chemically synthesized
ctaacctatacctcccgctgaa

SEQ ID NO: 869102 - DNA, 22 bp, Artificial Sequence
  chemically synthesized
tataatttactgtttcagcggg

SEQ ID NO: 869103 - DNA, 22 bp, Artificial Sequence
  chemically synthesized
atataatttactgtttcagcgg

SEQ ID NO: 869104 - DNA, 22 bp, Artificial Sequence
  chemically synthesized
acctatacctcccgctgaaaca

SEQ ID NO: 869105 - DNA, 22 bp, Artificial Sequence
  chemically synthesized
gtttatataatttactgtttca

SEQ ID NO: 869106 - DNA, 22 bp, Artificial Sequence
  chemically synthesized
tacctcccgctgaaacagtaaa

SEQ ID NO: 869107 - DNA, 22 bp, Artificial Sequence
  chemically synthesized
ttggtttatataatttactgtt

SEQ ID NO: 869108 - DNA, 22 bp, Artificial Sequence
  chemically synthesized
ccgctgaaacagtaaattatat

SEQ ID NO: 869109 - DNA, 22 bp, Artificial Sequence
  chemically synthesized
aaacagtaaattatataaacca

SEQ ID NO: 869110 - DNA, 22 bp, Artificial Sequence
  chemically synthesized
taaagtcaattattggtttata

SEQ ID NO: 869111 - DNA, 22 bp, Artificial Sequence
  chemically synthesized
ataaagtcaattattggtttat

SEQ ID NO: 869112 - DNA, 22 bp, Artificial Sequence
  chemically synthesized
tataaaccaataattgacttta

SEQ ID NO: 869113 - DNA, 22 bp, Artificial Sequence
  chemically synthesized
aggcaaataaaaaatccatatt

SEQ ID NO: 869114 - DNA, 22 bp, Artificial Sequence
  chemically synthesized
gaggcaaataaaaaatccatat

SEQ ID NO: 869115 - DNA, 22 bp, Artificial Sequence
  chemically synthesized
actttataaatatggatttttt

SEQ ID NO: 869116 - DNA, 22 bp, Artificial Sequence
  chemically synthesized
tataaatatggattttttattt

SEQ ID NO: 869117 - DNA, 22 bp, Artificial Sequence
  chemically synthesized
ataaatatggattttttatttg

SEQ ID NO: 869118 - DNA, 22 bp, Artificial Sequence
  chemically synthesized
taaatatggattttttatttgc

SEQ ID NO: 869119 - DNA, 22 bp, Artificial Sequence
  chemically synthesized
gaagacacgatttgaggcaaat

SEQ ID NO: 869120 - DNA, 22 bp, Artificial Sequence
  chemically synthesized
ggaagacacgatttgaggcaaa

SEQ ID NO: 869121 - DNA, 22 bp, Artificial Sequence
  chemically synthesized
aatcttggaagacacgatttga

SEQ ID NO: 869122 - DNA, 22 bp, Artificial Sequence
  chemically synthesized
gaatcttggaagacacgatttg

SEQ ID NO: 869123 - DNA, 22 bp, Artificial Sequence
  chemically synthesized
tttatttgcctcaaatcgtgtc

SEQ ID NO: 869124 - DNA, 22 bp, Artificial Sequence
  chemically synthesized
ttatttgcctcaaatcgtgtct

SEQ ID NO: 869125 - DNA, 22 bp, Artificial Sequence
  chemically synthesized
tatttgcctcaaatcgtgtctt

SEQ ID NO: 869126 - DNA, 22 bp, Artificial Sequence
  chemically synthesized
atttgcctcaaatcgtgtcttc

SEQ ID NO: 869127 - DNA, 22 bp, Artificial Sequence
  chemically synthesized
tttgcctcaaatcgtgtcttcc

SEQ ID NO: 869128 - DNA, 22 bp, Artificial Sequence
  chemically synthesized
gcctcaaatcgtgtcttccaag

SEQ ID NO: 869129 - DNA, 22 bp, Artificial Sequence
  chemically synthesized
cctcaaatcgtgtcttccaaga

SEQ ID NO: 869130 - DNA, 22 bp, Artificial Sequence
  chemically synthesized
aaatcgtgtcttccaagattca

SEQ ID NO: 869131 - DNA, 22 bp, Artificial Sequence
  chemically synthesized
ggggatgccatttgaatcttgg

SEQ ID NO: 869132 - DNA, 22 bp, Artificial Sequence
  chemically synthesized
caattaggggatgccatttgaa

SEQ ID NO: 869133 - DNA, 22 bp, Artificial Sequence
  chemically synthesized
ccaagattcaaatggcatcccc

SEQ ID NO: 869134 - DNA, 22 bp, Artificial Sequence
  chemically synthesized
caagattcaaatggcatcccct

SEQ ID NO: 869135 - DNA, 22 bp, Artificial Sequence
  chemically synthesized
aaatggcatcccctaattgcaa

SEQ ID NO: 869136 - DNA, 22 bp, Artificial Sequence
  chemically synthesized
accaaatcataatacattgcaa

SEQ ID NO: 869137 - DNA, 22 bp, Artificial Sequence
  chemically synthesized
ttcaccaaatcataatacattg

SEQ ID NO: 869138 - DNA, 22 bp, Artificial Sequence
  chemically synthesized
attcaccaaatcataatacatt

SEQ ID NO: 869139 - DNA, 22 bp, Artificial Sequence
  chemically synthesized
attgcaatgtattatgatttgg

SEQ ID NO: 869140 - DNA, 22 bp, Artificial Sequence
  chemically synthesized
caatgtattatgatttggtgaa

SEQ ID NO: 869141 - DNA, 22 bp, Artificial Sequence
  chemically synthesized
tgatttggtgaataaattcttg

SEQ ID NO: 869142 - DNA, 22 bp, Artificial Sequence
  chemically synthesized
cagtagtgagaacaagaattta

SEQ ID NO: 869143 - DNA, 22 bp, Artificial Sequence
  chemically synthesized
actacagtagtgagaacaagaa

SEQ ID NO: 869144 - DNA, 22 bp, Artificial Sequence
  chemically synthesized
ggtgaataaattcttgttctca

SEQ ID NO: 869145 - DNA, 22 bp, Artificial Sequence
  chemically synthesized
taactacagtagtgagaacaag

SEQ ID NO: 869146 - DNA, 22 bp, Artificial Sequence
  chemically synthesized
gtgaataaattcttgttctcac

SEQ ID NO: 869147 - DNA, 22 bp, Artificial Sequence
  chemically synthesized
ctaactacagtagtgagaacaa

SEQ ID NO: 869148 - DNA, 22 bp, Artificial Sequence
  chemically synthesized
ttctaactacagtagtgagaac

SEQ ID NO: 869149 - DNA, 22 bp, Artificial Sequence
  chemically synthesized
cttctaactacagtagtgagaa

SEQ ID NO: 869150 - DNA, 22 bp, Artificial Sequence
  chemically synthesized
tcttctaactacagtagtgaga

SEQ ID NO: 869151 - DNA, 22 bp, Artificial Sequence
  chemically synthesized
ttcttctaactacagtagtgag

SEQ ID NO: 869152 - DNA, 22 bp, Artificial Sequence
  chemically synthesized
ttgttctcactactgtagttag

SEQ ID NO: 869153 - DNA, 22 bp, Artificial Sequence
  chemically synthesized
gtccatttttcttctaactaca

SEQ ID NO: 869154 - DNA, 22 bp, Artificial Sequence
  chemically synthesized
gttctcactactgtagttagaa

SEQ ID NO: 869155 - DNA, 22 bp, Artificial Sequence
  chemically synthesized
ttctcactactgtagttagaag

SEQ ID NO: 869156 - DNA, 22 bp, Artificial Sequence
  chemically synthesized
ctagtccatttttcttctaact

SEQ ID NO: 869157 - DNA, 22 bp, Artificial Sequence
  chemically synthesized
tcactactgtagttagaagaaa

SEQ ID NO: 869158 - DNA, 22 bp, Artificial Sequence
  chemically synthesized
actactgtagttagaagaaaaa

SEQ ID NO: 869159 - DNA, 22 bp, Artificial Sequence
  chemically synthesized
gtattcctagtccatttttctt

SEQ ID NO: 869160 - DNA, 22 bp, Artificial Sequence
  chemically synthesized
cgtattcctagtccatttttct

SEQ ID NO: 869161 - DNA, 22 bp, Artificial Sequence
  chemically synthesized
ctgtagttagaagaaaaatgga

SEQ ID NO: 869162 - DNA, 22 bp, Artificial Sequence
  chemically synthesized
ttcgtattcctagtccattttt

SEQ ID NO: 869163 - DNA, 22 bp, Artificial Sequence
  chemically synthesized
tagttagaagaaaaatggacta

SEQ ID NO: 869164 - DNA, 22 bp, Artificial Sequence
  chemically synthesized
tcttcgtattcctagtccattt

SEQ ID NO: 869165 - DNA, 22 bp, Artificial Sequence
  chemically synthesized
ctcttcgtattcctagtccatt

SEQ ID NO: 869166 - DNA, 22 bp, Artificial Sequence
  chemically synthesized
tctcttcgtattcctagtccat

SEQ ID NO: 869167 - DNA, 22 bp, Artificial Sequence
  chemically synthesized
ttctcttcgtattcctagtcca

SEQ ID NO: 869168 - DNA, 22 bp, Artificial Sequence
  chemically synthesized
gaagaaaaatggactaggaata

SEQ ID NO: 869169 - DNA, 22 bp, Artificial Sequence
  chemically synthesized
ggaatacgaagagaaaagattc

SEQ ID NO: 869170 - DNA, 22 bp, Artificial Sequence
  chemically synthesized
aataagaggagaatcaggacag

SEQ ID NO: 869171 - DNA, 22 bp, Artificial Sequence
  chemically synthesized
aggaaactgaataagaggagaa

SEQ ID NO: 869172 - DNA, 22 bp, Artificial Sequence
  chemically synthesized
tgtcctgattctcctcttattc

SEQ ID NO: 869173 - DNA, 22 bp, Artificial Sequence
  chemically synthesized
tcctgattctcctcttattcag

SEQ ID NO: 869174 - DNA, 22 bp, Artificial Sequence
  chemically synthesized
ccgcagttgaggaaactgaata

SEQ ID NO: 869175 - DNA, 22 bp, Artificial Sequence
  chemically synthesized
attctcctcttattcagtttcc

SEQ ID NO: 869176 - DNA, 22 bp, Artificial Sequence
  chemically synthesized
tcctcttattcagtttcctcaa

SEQ ID NO: 869177 - DNA, 22 bp, Artificial Sequence
  chemically synthesized
taaattcccgcagttgaggaaa

SEQ ID NO: 869178 - DNA, 22 bp, Artificial Sequence
  chemically synthesized
ctcttattcagtttcctcaact

SEQ ID NO: 869179 - DNA, 22 bp, Artificial Sequence
  chemically synthesized
ttattcagtttcctcaactgcg

SEQ ID NO: 869180 - DNA, 22 bp, Artificial Sequence
  chemically synthesized
attcagtttcctcaactgcggg

SEQ ID NO: 869181 - DNA, 22 bp, Artificial Sequence
  chemically synthesized
ttcagtttcctcaactgcggga

SEQ ID NO: 869182 - DNA, 22 bp, Artificial Sequence
  chemically synthesized
agtttcctcaactgcgggaatt

SEQ ID NO: 869183 - DNA, 22 bp, Artificial Sequence
  chemically synthesized
agaatgaagattataaattccc

SEQ ID NO: 869184 - DNA, 22 bp, Artificial Sequence
  chemically synthesized
aagaatgaagattataaattcc

SEQ ID NO: 869185 - DNA, 22 bp, Artificial Sequence
  chemically synthesized
cctcaactgcgggaatttataa

SEQ ID NO: 869186 - DNA, 22 bp, Artificial Sequence
  chemically synthesized
ctcaactgcgggaatttataat

SEQ ID NO: 869187 - DNA, 22 bp, Artificial Sequence
  chemically synthesized
ccttaagaatgaagattataaa

SEQ ID NO: 869188 - DNA, 22 bp, Artificial Sequence
  chemically synthesized
aactgcgggaatttataatctt

SEQ ID NO: 869189 - DNA, 22 bp, Artificial Sequence
  chemically synthesized
cccttaagaatgaagattataa

SEQ ID NO: 869190 - DNA, 22 bp, Artificial Sequence
  chemically synthesized
cgggaatttataatcttcattc

SEQ ID NO: 869191 - DNA, 22 bp, Artificial Sequence
  chemically synthesized
aaatttcccttaagaatgaaga

SEQ ID NO: 869192 - DNA, 22 bp, Artificial Sequence
  chemically synthesized
tctaaaatttcccttaagaatg

SEQ ID NO: 869193 - DNA, 22 bp, Artificial Sequence
  chemically synthesized
ataatcttcattcttaagggaa

SEQ ID NO: 869194 - DNA, 22 bp, Artificial Sequence
  chemically synthesized
taatcttcattcttaagggaaa

SEQ ID NO: 869195 - DNA, 22 bp, Artificial Sequence
  chemically synthesized
cattcttaagggaaattttaga

SEQ ID NO: 869196 - DNA, 22 bp, Artificial Sequence
  chemically synthesized
attcttaagggaaattttagat

SEQ ID NO: 869197 - DNA, 22 bp, Artificial Sequence
  chemically synthesized
catgtatatattatctaaaatt

SEQ ID NO: 869198 - DNA, 22 bp, Artificial Sequence
  chemically synthesized
acatgtatatattatctaaaat

SEQ ID NO: 869199 - DNA, 22 bp, Artificial Sequence
  chemically synthesized
ttaagggaaattttagataata

SEQ ID NO: 869200 - DNA, 22 bp, Artificial Sequence
  chemically synthesized
tttacatgtatatattatctaa

SEQ ID NO: 869201 - DNA, 22 bp, Artificial Sequence
  chemically synthesized
aagggaaattttagataatata

SEQ ID NO: 869202 - DNA, 22 bp, Artificial Sequence
  chemically synthesized
agggaaattttagataatatat

SEQ ID NO: 869203 - DNA, 22 bp, Artificial Sequence
  chemically synthesized
tagataatatatacatgtaaac

SEQ ID NO: 869204 - DNA, 22 bp, Artificial Sequence
  chemically synthesized
agataatatatacatgtaaaca

SEQ ID NO: 869205 - DNA, 22 bp, Artificial Sequence
  chemically synthesized
gataatatatacatgtaaacaa

SEQ ID NO: 869206 - DNA, 22 bp, Artificial Sequence
  chemically synthesized
atcaaaaaataataaaattgtt

SEQ ID NO: 869207 - DNA, 22 bp, Artificial Sequence
  chemically synthesized
aaatccatctgatcaaaaaata

SEQ ID NO: 869208 - DNA, 22 bp, Artificial Sequence
  chemically synthesized
tattattttttgatcagatgga

SEQ ID NO: 869209 - DNA, 22 bp, Artificial Sequence
  chemically synthesized
attattttttgatcagatggat

SEQ ID NO: 869210 - DNA, 22 bp, Artificial Sequence
  chemically synthesized
ttattttttgatcagatggatt

SEQ ID NO: 869211 - DNA, 22 bp, Artificial Sequence
  chemically synthesized
ttttttgatcagatggatttca

SEQ ID NO: 869212 - DNA, 22 bp, Artificial Sequence
  chemically synthesized
tttgatcagatggatttcaata

SEQ ID NO: 869213 - DNA, 22 bp, Artificial Sequence
  chemically synthesized
ttgatcagatggatttcaatat

SEQ ID NO: 869214 - DNA, 22 bp, Artificial Sequence
  chemically synthesized
tgatcagatggatttcaatatt

SEQ ID NO: 869215 - DNA, 22 bp, Artificial Sequence
  chemically synthesized
gatcagatggatttcaatattt

SEQ ID NO: 869216 - DNA, 22 bp, Artificial Sequence
  chemically synthesized
atcagatggatttcaatatttt

SEQ ID NO: 869217 - DNA, 22 bp, Artificial Sequence
  chemically synthesized
gagtgaagaaaacaaaatattg

SEQ ID NO: 869218 - DNA, 22 bp, Artificial Sequence
  chemically synthesized
gtgaaccctagagtgaagaaaa

SEQ ID NO: 869219 - DNA, 22 bp, Artificial Sequence
  chemically synthesized
caatattttgttttcttcactc

SEQ ID NO: 869220 - DNA, 22 bp, Artificial Sequence
  chemically synthesized
aatattttgttttcttcactct

SEQ ID NO: 869221 - DNA, 22 bp, Artificial Sequence
  chemically synthesized
tagttagtgaaccctagagtga

SEQ ID NO: 869222 - DNA, 22 bp, Artificial Sequence
  chemically synthesized
tgttttcttcactctagggttc

SEQ ID NO: 869223 - DNA, 22 bp, Artificial Sequence
  chemically synthesized
gttttcttcactctagggttca

SEQ ID NO: 869224 - DNA, 22 bp, Artificial Sequence
  chemically synthesized
ttttcttcactctagggttcac

SEQ ID NO: 869225 - DNA, 22 bp, Artificial Sequence
  chemically synthesized
tgactgtagttagtgaacccta

SEQ ID NO: 869226 - DNA, 22 bp, Artificial Sequence
  chemically synthesized
tcttcactctagggttcactaa

SEQ ID NO: 869227 - DNA, 22 bp, Artificial Sequence
  chemically synthesized
cttcactctagggttcactaac

SEQ ID NO: 869228 - DNA, 22 bp, Artificial Sequence
  chemically synthesized
ttcactctagggttcactaact

SEQ ID NO: 869229 - DNA, 22 bp, Artificial Sequence
  chemically synthesized
cactctagggttcactaactac

SEQ ID NO: 869230 - DNA, 22 bp, Artificial Sequence
  chemically synthesized
actctagggttcactaactaca

SEQ ID NO: 869231 - DNA, 22 bp, Artificial Sequence
  chemically synthesized
aaacaagttatgactgtagtta

SEQ ID NO: 869232 - DNA, 22 bp, Artificial Sequence
  chemically synthesized
tagggttcactaactacagtca

SEQ ID NO: 869233 - DNA, 22 bp, Artificial Sequence
  chemically synthesized
gggttcactaactacagtcata

SEQ ID NO: 869234 - DNA, 22 bp, Artificial Sequence
  chemically synthesized
actaactacagtcataacttgt

SEQ ID NO: 869235 - DNA, 22 bp, Artificial Sequence
  chemically synthesized
actacagtcataacttgtttca

SEQ ID NO: 869236 - DNA, 22 bp, Artificial Sequence
  chemically synthesized
cagtcataacttgtttcagttg

SEQ ID NO: 869237 - DNA, 22 bp, Artificial Sequence
  chemically synthesized
tcacatgaatatcaactgaaac

SEQ ID NO: 869238 - DNA, 22 bp, Artificial Sequence
  chemically synthesized
atcagactgtcacatgaatatc

SEQ ID NO: 869239 - DNA, 22 bp, Artificial Sequence
  chemically synthesized
gatcagactgtcacatgaatat

SEQ ID NO: 869240 - DNA, 22 bp, Artificial Sequence
  chemically synthesized
gtttcagttgatattcatgtga

SEQ ID NO: 869241 - DNA, 22 bp, Artificial Sequence
  chemically synthesized
tttcagttgatattcatgtgac

SEQ ID NO: 869242 - DNA, 22 bp, Artificial Sequence
  chemically synthesized
cagttgatattcatgtgacagt

SEQ ID NO: 869243 - DNA, 22 bp, Artificial Sequence
  chemically synthesized
agttgatattcatgtgacagtc

SEQ ID NO: 869244 - DNA, 22 bp, Artificial Sequence
  chemically synthesized
atattcatgtgacagtctgatc

SEQ ID NO: 869245 - DNA, 22 bp, Artificial Sequence
  chemically synthesized
aacaaatgatacatttgatcag

SEQ ID NO: 869246 - DNA, 22 bp, Artificial Sequence
  chemically synthesized
atgtgacagtctgatcaaatgt

SEQ ID NO: 869247 - DNA, 22 bp, Artificial Sequence
  chemically synthesized
atcaaatgtatcatttgttcag

SEQ ID NO: 869248 - DNA, 22 bp, Artificial Sequence
  chemically synthesized
gaggtagcagaataactgaaca

SEQ ID NO: 869249 - DNA, 22 bp, Artificial Sequence
  chemically synthesized
gttcagttattctgctacctcc

SEQ ID NO: 869250 - DNA, 22 bp, Artificial Sequence
  chemically synthesized
aaggaataaattggaggtagca

SEQ ID NO: 869251 - DNA, 22 bp, Artificial Sequence
  chemically synthesized
ttcagttattctgctacctcca

SEQ ID NO: 869252 - DNA, 22 bp, Artificial Sequence
  chemically synthesized
agttattctgctacctccaatt

SEQ ID NO: 869253 - DNA, 22 bp, Artificial Sequence
  chemically synthesized
ttctgctacctccaatttattc

SEQ ID NO: 869254 - DNA, 22 bp, Artificial Sequence
  chemically synthesized
tgctacctccaatttattcctt

SEQ ID NO: 869255 - DNA, 22 bp, Artificial Sequence
  chemically synthesized
ctacctccaatttattccttga

SEQ ID NO: 869256 - DNA, 22 bp, Artificial Sequence
  chemically synthesized
cctccaatttattccttgagtg

SEQ ID NO: 869257 - DNA, 22 bp, Artificial Sequence
  chemically synthesized
caatttattccttgagtgtgca

SEQ ID NO: 869258 - DNA, 22 bp, Artificial Sequence
  chemically synthesized
attccttgagtgtgcatccctt

SEQ ID NO: 869259 - DNA, 22 bp, Artificial Sequence
  chemically synthesized
ttccttgagtgtgcatcccttg

SEQ ID NO: 869260 - DNA, 22 bp, Artificial Sequence
  chemically synthesized
cttgagtgtgcatcccttggta

SEQ ID NO: 869261 - DNA, 22 bp, Artificial Sequence
  chemically synthesized
gagtgtgcatcccttggtatgg

SEQ ID NO: 869262 - DNA, 22 bp, Artificial Sequence
  chemically synthesized
agtgtgcatcccttggtatggc

SEQ ID NO: 869263 - DNA, 22 bp, Artificial Sequence
  chemically synthesized
ggtatggcttattgctgacctc

SEQ ID NO: 869264 - DNA, 22 bp, Artificial Sequence
  chemically synthesized
gtatggcttattgctgacctca

SEQ ID NO: 869265 - DNA, 22 bp, Artificial Sequence
  chemically synthesized
cgtgggcagaaataatgaggtc

SEQ ID NO: 869266 - DNA, 22 bp, Artificial Sequence
  chemically synthesized
attgctgacctcattatttctg

SEQ ID NO: 869267 - DNA, 22 bp, Artificial Sequence
  chemically synthesized
ttgctgacctcattatttctgc

SEQ ID NO: 869268 - DNA, 22 bp, Artificial Sequence
  chemically synthesized
ctgacctcattatttctgccca

SEQ ID NO: 869269 - DNA, 22 bp, Artificial Sequence
  chemically synthesized
acctcattatttctgcccacgc

SEQ ID NO: 869270 - DNA, 22 bp, Artificial Sequence
  chemically synthesized
attatttctgcccacgcaggtc

SEQ ID NO: 869271 - DNA, 22 bp, Artificial Sequence
  chemically synthesized
tttctgcccacgcaggtctatc

SEQ ID NO: 869272 - DNA, 22 bp, Artificial Sequence
  chemically synthesized
agatgaatgagtggatagacct

SEQ ID NO: 869273 - DNA, 22 bp, Artificial Sequence
  chemically synthesized
ctgcccacgcaggtctatccac

SEQ ID NO: 869274 - DNA, 22 bp, Artificial Sequence
  chemically synthesized
tgcccacgcaggtctatccact

SEQ ID NO: 869275 - DNA, 22 bp, Artificial Sequence
  chemically synthesized
cccacgcaggtctatccactca

SEQ ID NO: 869276 - DNA, 22 bp, Artificial Sequence
  chemically synthesized
tccactcattcatctcaatcca

SEQ ID NO: 869277 - DNA, 22 bp, Artificial Sequence
  chemically synthesized
attcatctcaatccacttgcat

SEQ ID NO: 869278 - DNA, 22 bp, Artificial Sequence
  chemically synthesized
atctcaatccacttgcatccat

SEQ ID NO: 869279 - DNA, 22 bp, Artificial Sequence
  chemically synthesized
aatccacttgcatccatggcct

SEQ ID NO: 869280 - DNA, 22 bp, Artificial Sequence
  chemically synthesized
gcatccatggccttgctcacac

SEQ ID NO: 869281 - DNA, 22 bp, Artificial Sequence
  chemically synthesized
tagtaaaacccagtgtgagcaa

SEQ ID NO: 869282 - DNA, 22 bp, Artificial Sequence
  chemically synthesized
catccatggccttgctcacact

SEQ ID NO: 869283 - DNA, 22 bp, Artificial Sequence
  chemically synthesized
aagcattatagtaaaacccagt

SEQ ID NO: 869284 - DNA, 22 bp, Artificial Sequence
  chemically synthesized
gctcacactgggttttactata

SEQ ID NO: 869285 - DNA, 22 bp, Artificial Sequence
  chemically synthesized
ctcacactgggttttactataa

SEQ ID NO: 869286 - DNA, 22 bp, Artificial Sequence
  chemically synthesized
acactgggttttactataatgc

SEQ ID NO: 869287 - DNA, 22 bp, Artificial Sequence
  chemically synthesized
gataaatctgaagcattatagt

SEQ ID NO: 869288 - DNA, 22 bp, Artificial Sequence
  chemically synthesized
atctggataaatctgaagcatt

SEQ ID NO: 869289 - DNA, 22 bp, Artificial Sequence
  chemically synthesized
ggttttactataatgcttcaga

SEQ ID NO: 869290 - DNA, 22 bp, Artificial Sequence
  chemically synthesized
tcatctggataaatctgaagca

SEQ ID NO: 869291 - DNA, 22 bp, Artificial Sequence
  chemically synthesized
ctcatctggataaatctgaagc

SEQ ID NO: 869292 - DNA, 22 bp, Artificial Sequence
  chemically synthesized
tctcatctggataaatctgaag

SEQ ID NO: 869293 - DNA, 22 bp, Artificial Sequence
  chemically synthesized
ttctcatctggataaatctgaa

SEQ ID NO: 869294 - DNA, 22 bp, Artificial Sequence
  chemically synthesized
tactataatgcttcagatttat

SEQ ID NO: 869295 - DNA, 22 bp, Artificial Sequence
  chemically synthesized
actataatgcttcagatttatc

SEQ ID NO: 869296 - DNA, 22 bp, Artificial Sequence
  chemically synthesized
ctataatgcttcagatttatcc

SEQ ID NO: 869297 - DNA, 22 bp, Artificial Sequence
  chemically synthesized
tttttctcatctggataaatct

SEQ ID NO: 869298 - DNA, 22 bp, Artificial Sequence
  chemically synthesized
atttttctcatctggataaatc

SEQ ID NO: 869299 - DNA, 22 bp, Artificial Sequence
  chemically synthesized
taatgcttcagatttatccaga

SEQ ID NO: 869300 - DNA, 22 bp, Artificial Sequence
  chemically synthesized
gaatttatttttctcatctgga

SEQ ID NO: 869301 - DNA, 22 bp, Artificial Sequence
  chemically synthesized
cagatttatccagatgagaaaa

SEQ ID NO: 869302 - DNA, 22 bp, Artificial Sequence
  chemically synthesized
gctggaatttatttttctcatc

SEQ ID NO: 869303 - DNA, 22 bp, Artificial Sequence
  chemically synthesized
agatttatccagatgagaaaaa

SEQ ID NO: 869304 - DNA, 22 bp, Artificial Sequence
  chemically synthesized
ggctggaatttatttttctcat

SEQ ID NO: 869305 - DNA, 22 bp, Artificial Sequence
  chemically synthesized
ttggctggaatttatttttctc

SEQ ID NO: 869306 - DNA, 22 bp, Artificial Sequence
  chemically synthesized
cttggctggaatttatttttct

SEQ ID NO: 869307 - DNA, 22 bp, Artificial Sequence
  chemically synthesized
atccagatgagaaaaataaatt

SEQ ID NO: 869308 - DNA, 22 bp, Artificial Sequence
  chemically synthesized
tccagatgagaaaaataaattc

SEQ ID NO: 869309 - DNA, 22 bp, Artificial Sequence
  chemically synthesized
agcatgcttcttggctggaatt

SEQ ID NO: 869310 - DNA, 22 bp, Artificial Sequence
  chemically synthesized
aagcatgcttcttggctggaat

SEQ ID NO: 869311 - DNA, 22 bp, Artificial Sequence
  chemically synthesized
gccagtgtcccacttaagcatg

SEQ ID NO: 869312 - DNA, 22 bp, Artificial Sequence
  chemically synthesized
cagccaagaagcatgcttaagt

SEQ ID NO: 869313 - DNA, 22 bp, Artificial Sequence
  chemically synthesized
tagccagtgtcccacttaagca

SEQ ID NO: 869314 - DNA, 22 bp, Artificial Sequence
  chemically synthesized
ctctagccagtgtcccacttaa

SEQ ID NO: 869315 - DNA, 22 bp, Artificial Sequence
  chemically synthesized
cctctagccagtgtcccactta

SEQ ID NO: 869316 - DNA, 22 bp, Artificial Sequence
  chemically synthesized
tcctctagccagtgtcccactt

SEQ ID NO: 869317 - DNA, 22 bp, Artificial Sequence
  chemically synthesized
acctttcctctagccagtgtcc

SEQ ID NO: 869318 - DNA, 22 bp, Artificial Sequence
  chemically synthesized
ttgacctttcctctagccagtg

SEQ ID NO: 869319 - DNA, 22 bp, Artificial Sequence
  chemically synthesized
aagtgggacactggctagagga

SEQ ID NO: 869320 - DNA, 22 bp, Artificial Sequence
  chemically synthesized
agtgggacactggctagaggaa

SEQ ID NO: 869321 - DNA, 22 bp, Artificial Sequence
  chemically synthesized
tcataatggatattgttgacct

SEQ ID NO: 869322 - DNA, 22 bp, Artificial Sequence
  chemically synthesized
atcataatggatattgttgacc

SEQ ID NO: 869323 - DNA, 22 bp, Artificial Sequence
  chemically synthesized
gctagaggaaaggtcaacaata

SEQ ID NO: 869324 - DNA, 22 bp, Artificial Sequence
  chemically synthesized
gaggaaaggtcaacaatatcca

SEQ ID NO: 869325 - DNA, 22 bp, Artificial Sequence
  chemically synthesized
ccacttatcataatggatattg

SEQ ID NO: 869326 - DNA, 22 bp, Artificial Sequence
  chemically synthesized
acagaggtgttaccacttatca

SEQ ID NO: 869327 - DNA, 22 bp, Artificial Sequence
  chemically synthesized
tgataagtggtaacacctctgt

SEQ ID NO: 869328 - DNA, 22 bp, Artificial Sequence
  chemically synthesized
taaaataaaaagggagttaaca

SEQ ID NO: 869329 - DNA, 22 bp, Artificial Sequence
  chemically synthesized
tgtaaaataaaaagggagttaa

SEQ ID NO: 869330 - DNA, 22 bp, Artificial Sequence
  chemically synthesized
ctgtaaaataaaaagggagtta

SEQ ID NO: 869331 - DNA, 22 bp, Artificial Sequence
  chemically synthesized
tgttaactccctttttatttta

SEQ ID NO: 869332 - DNA, 22 bp, Artificial Sequence
  chemically synthesized
ttaactccctttttattttaca

SEQ ID NO: 869333 - DNA, 22 bp, Artificial Sequence
  chemically synthesized
actccctttttattttacagaa

SEQ ID NO: 869334 - DNA, 22 bp, Artificial Sequence
  chemically synthesized
gatgataataaaatttctgtaa

SEQ ID NO: 869335 - DNA, 22 bp, Artificial Sequence
  chemically synthesized
cctttttattttacagaaattt

SEQ ID NO: 869336 - DNA, 22 bp, Artificial Sequence
  chemically synthesized
gactagatgataataaaatttc

SEQ ID NO: 869337 - DNA, 22 bp, Artificial Sequence
  chemically synthesized
tttattttacagaaattttatt

SEQ ID NO: 869338 - DNA, 22 bp, Artificial Sequence
  chemically synthesized
ttattttacagaaattttatta

SEQ ID NO: 869339 - DNA, 22 bp, Artificial Sequence
  chemically synthesized
tattttacagaaattttattat

SEQ ID NO: 869340 - DNA, 22 bp, Artificial Sequence
  chemically synthesized
attttacagaaattttattatc

SEQ ID NO: 869341 - DNA, 22 bp, Artificial Sequence
  chemically synthesized
ttttacagaaattttattatca

SEQ ID NO: 869342 - DNA, 22 bp, Artificial Sequence
  chemically synthesized
tacagaaattttattatcatct

SEQ ID NO: 869343 - DNA, 22 bp, Artificial Sequence
  chemically synthesized
acagaaattttattatcatcta

SEQ ID NO: 869344 - DNA, 22 bp, Artificial Sequence
  chemically synthesized
cagaaattttattatcatctag

SEQ ID NO: 869345 - DNA, 22 bp, Artificial Sequence
  chemically synthesized
aaagtcactggactagatgata

SEQ ID NO: 869346 - DNA, 22 bp, Artificial Sequence
  chemically synthesized
tattatcatctagtccagtgac

SEQ ID NO: 869347 - DNA, 22 bp, Artificial Sequence
  chemically synthesized
aaaatactaaaagtcactggac

SEQ ID NO: 869348 - DNA, 22 bp, Artificial Sequence
  chemically synthesized
attatcatctagtccagtgact

SEQ ID NO: 869349 - DNA, 22 bp, Artificial Sequence
  chemically synthesized
aaaaatactaaaagtcactgga

SEQ ID NO: 869350 - DNA, 22 bp, Artificial Sequence
  chemically synthesized
ttatcatctagtccagtgactt

SEQ ID NO: 869351 - DNA, 22 bp, Artificial Sequence
  chemically synthesized
taaaaatactaaaagtcactgg

SEQ ID NO: 869352 - DNA, 22 bp, Artificial Sequence
  chemically synthesized
tcatctagtccagtgactttta

SEQ ID NO: 869353 - DNA, 22 bp, Artificial Sequence
  chemically synthesized
tatgctttaaaaatactaaaag

SEQ ID NO: 869354 - DNA, 22 bp, Artificial Sequence
  chemically synthesized
gtccagtgacttttagtatttt

SEQ ID NO: 869355 - DNA, 22 bp, Artificial Sequence
  chemically synthesized
aaaaaagggttgtatgctttaa

SEQ ID NO: 869356 - DNA, 22 bp, Artificial Sequence
  chemically synthesized
gaaaaaagggttgtatgcttta

SEQ ID NO: 869357 - DNA, 22 bp, Artificial Sequence
  chemically synthesized
ttagtatttttaaagcatacaa

SEQ ID NO: 869358 - DNA, 22 bp, Artificial Sequence
  chemically synthesized
tagtatttttaaagcatacaac

SEQ ID NO: 869359 - DNA, 22 bp, Artificial Sequence
  chemically synthesized
agtatttttaaagcatacaacc

SEQ ID NO: 869360 - DNA, 22 bp, Artificial Sequence
  chemically synthesized
acttgaaaaaagggttgtatgc

SEQ ID NO: 869361 - DNA, 22 bp, Artificial Sequence
  chemically synthesized
gtatttttaaagcatacaaccc

SEQ ID NO: 869362 - DNA, 22 bp, Artificial Sequence
  chemically synthesized
ttaaagcatacaaccctttttt

SEQ ID NO: 869363 - DNA, 22 bp, Artificial Sequence
  chemically synthesized
ggagctcacttgaaaaaagggt

SEQ ID NO: 869364 - DNA, 22 bp, Artificial Sequence
  chemically synthesized
taaagcatacaacccttttttc

SEQ ID NO: 869365 - DNA, 22 bp, Artificial Sequence
  chemically synthesized
aggagctcacttgaaaaaaggg

SEQ ID NO: 869366 - DNA, 22 bp, Artificial Sequence
  chemically synthesized
aaagcatacaacccttttttca

SEQ ID NO: 869367 - DNA, 22 bp, Artificial Sequence
  chemically synthesized
aagcatacaacccttttttcaa

SEQ ID NO: 869368 - DNA, 22 bp, Artificial Sequence
  chemically synthesized
ttaggagctcacttgaaaaaag

SEQ ID NO: 869369 - DNA, 22 bp, Artificial Sequence
  chemically synthesized
cttaggagctcacttgaaaaaa

SEQ ID NO: 869370 - DNA, 22 bp, Artificial Sequence
  chemically synthesized
ttcttaggagctcacttgaaaa

SEQ ID NO: 869371 - DNA, 22 bp, Artificial Sequence
  chemically synthesized
cttcttaggagctcacttgaaa

SEQ ID NO: 869372 - DNA, 22 bp, Artificial Sequence
  chemically synthesized
ttttcaagtgagctcctaagaa

SEQ ID NO: 869373 - DNA, 22 bp, Artificial Sequence
  chemically synthesized
tttcaagtgagctcctaagaag

SEQ ID NO: 869374 - DNA, 22 bp, Artificial Sequence
  chemically synthesized
ttcaagtgagctcctaagaaga

SEQ ID NO: 869375 - DNA, 22 bp, Artificial Sequence
  chemically synthesized
acataccggatttcttcttagg

SEQ ID NO: 869376 - DNA, 22 bp, Artificial Sequence
  chemically synthesized
tcaagtgagctcctaagaagaa

SEQ ID NO: 869377 - DNA, 22 bp, Artificial Sequence
  chemically synthesized
cacataccggatttcttcttag

SEQ ID NO: 869378 - DNA, 22 bp, Artificial Sequence
  chemically synthesized
caagtgagctcctaagaagaaa

SEQ ID NO: 869379 - DNA, 22 bp, Artificial Sequence
  chemically synthesized
aagtgagctcctaagaagaaat

SEQ ID NO: 869380 - DNA, 22 bp, Artificial Sequence
  chemically synthesized
ggcttcacataccggatttctt

SEQ ID NO: 869381 - DNA, 22 bp, Artificial Sequence
  chemically synthesized
aggcttcacataccggatttct

SEQ ID NO: 869382 - DNA, 22 bp, Artificial Sequence
  chemically synthesized
taggcttcacataccggatttc

SEQ ID NO: 869383 - DNA, 22 bp, Artificial Sequence
  chemically synthesized
ttaggcttcacataccggattt

SEQ ID NO: 869384 - DNA, 22 bp, Artificial Sequence
  chemically synthesized
tttaggcttcacataccggatt

SEQ ID NO: 869385 - DNA, 22 bp, Artificial Sequence
  chemically synthesized
ctaagaagaaatccggtatgtg

SEQ ID NO: 869386 - DNA, 22 bp, Artificial Sequence
  chemically synthesized
agaagaaatccggtatgtgaag

SEQ ID NO: 869387 - DNA, 22 bp, Artificial Sequence
  chemically synthesized
gccctttttaggcttcacatac

SEQ ID NO: 869388 - DNA, 22 bp, Artificial Sequence
  chemically synthesized
tcgccctttttaggcttcacat

SEQ ID NO: 869389 - DNA, 22 bp, Artificial Sequence
  chemically synthesized
ctctcgccctttttaggcttca

SEQ ID NO: 869390 - DNA, 22 bp, Artificial Sequence
  chemically synthesized
ttgctctcgccctttttaggct

SEQ ID NO: 869391 - DNA, 22 bp, Artificial Sequence
  chemically synthesized
aaccagtctgttgctctcgccc

SEQ ID NO: 869392 - DNA, 22 bp, Artificial Sequence
  chemically synthesized
caaccagtctgttgctctcgcc

SEQ ID NO: 869393 - DNA, 22 bp, Artificial Sequence
  chemically synthesized
caatttcaaccagtctgttgct

SEQ ID NO: 869394 - DNA, 22 bp, Artificial Sequence
  chemically synthesized
aaaagggcgagagcaacagact

SEQ ID NO: 869395 - DNA, 22 bp, Artificial Sequence
  chemically synthesized
ccatctgcaatttcaaccagtc

SEQ ID NO: 869396 - DNA, 22 bp, Artificial Sequence
  chemically synthesized
cctcccatctgcaatttcaacc

SEQ ID NO: 869397 - DNA, 22 bp, Artificial Sequence
  chemically synthesized
gcctcccatctgcaatttcaac

SEQ ID NO: 869398 - DNA, 22 bp, Artificial Sequence
  chemically synthesized
tgcctcccatctgcaatttcaa

SEQ ID NO: 869399 - DNA, 22 bp, Artificial Sequence
  chemically synthesized
cctttgcctcccatctgcaatt

SEQ ID NO: 869400 - DNA, 22 bp, Artificial Sequence
  chemically synthesized
ccctttgcctcccatctgcaat

SEQ ID NO: 869401 - DNA, 22 bp, Artificial Sequence
  chemically synthesized
gttgaaattgcagatgggaggc

SEQ ID NO: 869402 - DNA, 22 bp, Artificial Sequence
  chemically synthesized
atacttccctttgcctcccatc

SEQ ID NO: 869403 - DNA, 22 bp, Artificial Sequence
  chemically synthesized
aaattgcagatgggaggcaaag

SEQ ID NO: 869404 - DNA, 22 bp, Artificial Sequence
  chemically synthesized
cagatgggaggcaaagggaagt

SEQ ID NO: 869405 - DNA, 22 bp, Artificial Sequence
  chemically synthesized
caacatatgttcatacttccct

SEQ ID NO: 869406 - DNA, 22 bp, Artificial Sequence
  chemically synthesized
ctccaacatatgttcatacttc

SEQ ID NO: 869407 - DNA, 22 bp, Artificial Sequence
  chemically synthesized
cctccaacatatgttcatactt

SEQ ID NO: 869408 - DNA, 22 bp, Artificial Sequence
  chemically synthesized
ggccgtcaaaagggtagagttt

SEQ ID NO: 869409 - DNA, 22 bp, Artificial Sequence
  chemically synthesized
cggccgtcaaaagggtagagtt

SEQ ID NO: 869410 - DNA, 22 bp, Artificial Sequence
  chemically synthesized
gaggaaactctacccttttgac

SEQ ID NO: 869411 - DNA, 22 bp, Artificial Sequence
  chemically synthesized
gaaagcgtccccttcggccgtc

SEQ ID NO: 869412 - DNA, 22 bp, Artificial Sequence
  chemically synthesized
tggaaagcgtccccttcggccg

SEQ ID NO: 869413 - DNA, 22 bp, Artificial Sequence
  chemically synthesized
tacccttttgacggccgaaggg

SEQ ID NO: 869414 - DNA, 22 bp, Artificial Sequence
  chemically synthesized
ctggaaagcgtccccttcggcc

SEQ ID NO: 869415 - DNA, 22 bp, Artificial Sequence
  chemically synthesized
cccttttgacggccgaagggga

SEQ ID NO: 869416 - DNA, 22 bp, Artificial Sequence
  chemically synthesized
ttctggaaagcgtccccttcgg

SEQ ID NO: 869417 - DNA, 22 bp, Artificial Sequence
  chemically synthesized
ttgacggccgaaggggacgctt

SEQ ID NO: 869418 - DNA, 22 bp, Artificial Sequence
  chemically synthesized
tgacggccgaaggggacgcttt

SEQ ID NO: 869419 - DNA, 22 bp, Artificial Sequence
  chemically synthesized
gacggccgaaggggacgctttc

SEQ ID NO: 869420 - DNA, 22 bp, Artificial Sequence
  chemically synthesized
acggccgaaggggacgctttcc

SEQ ID NO: 869421 - DNA, 22 bp, Artificial Sequence
  chemically synthesized
atcacctcttctggaaagcgtc

SEQ ID NO: 869422 - DNA, 22 bp, Artificial Sequence
  chemically synthesized
tccagaagaggtgatgaactct

SEQ ID NO: 869423 - DNA, 22 bp, Artificial Sequence
  chemically synthesized
ccagaagaggtgatgaactcta

SEQ ID NO: 869424 - DNA, 22 bp, Artificial Sequence
  chemically synthesized
cagaagaggtgatgaactctat

SEQ ID NO: 869425 - DNA, 22 bp, Artificial Sequence
  chemically synthesized
aatcaatcacacaaaccagaaa

SEQ ID NO: 869426 - DNA, 22 bp, Artificial Sequence
  chemically synthesized
caatcaatcacacaaaccagaa

SEQ ID NO: 869427 - DNA, 22 bp, Artificial Sequence
  chemically synthesized
gaacttcaatcaatcacacaaa

SEQ ID NO: 869428 - DNA, 22 bp, Artificial Sequence
  chemically synthesized
tatgtttctggtttgtgtgatt

SEQ ID NO: 869429 - DNA, 22 bp, Artificial Sequence
  chemically synthesized
tgtttctggtttgtgtgattga

SEQ ID NO: 869430 - DNA, 22 bp, Artificial Sequence
  chemically synthesized
ctggtttgtgtgattgattgaa

SEQ ID NO: 869431 - DNA, 22 bp, Artificial Sequence
  chemically synthesized
tggtttgtgtgattgattgaag

SEQ ID NO: 869432 - DNA, 22 bp, Artificial Sequence
  chemically synthesized
gtttgtgtgattgattgaagtt

SEQ ID NO: 869433 - DNA, 22 bp, Artificial Sequence
  chemically synthesized
gtgtgattgattgaagttccag

SEQ ID NO: 869434 - DNA, 22 bp, Artificial Sequence
  chemically synthesized
tgtgattgattgaagttccagc

SEQ ID NO: 869435 - DNA, 22 bp, Artificial Sequence
  chemically synthesized
attgaagttccagcccatattc

SEQ ID NO: 869436 - DNA, 22 bp, Artificial Sequence
  chemically synthesized
aagttccagcccatattcattt

SEQ ID NO: 869437 - DNA, 22 bp, Artificial Sequence
  chemically synthesized
cagcatgaaatcgtagaaatga

SEQ ID NO: 869438 - DNA, 22 bp, Artificial Sequence
  chemically synthesized
cagcccatattcatttctacga

SEQ ID NO: 869439 - DNA, 22 bp, Artificial Sequence
  chemically synthesized
cctacagcatgaaatcgtagaa

SEQ ID NO: 869440 - DNA, 22 bp, Artificial Sequence
  chemically synthesized
atttctacgatttcatgctgta

SEQ ID NO: 869441 - DNA, 22 bp, Artificial Sequence
  chemically synthesized
ctacgatttcatgctgtaggca

SEQ ID NO: 869442 - DNA, 22 bp, Artificial Sequence
  chemically synthesized
tacgatttcatgctgtaggcaa

SEQ ID NO: 869443 - DNA, 22 bp, Artificial Sequence
  chemically synthesized
cgatttcatgctgtaggcaatt

SEQ ID NO: 869444 - DNA, 22 bp, Artificial Sequence
  chemically synthesized
catgctgtaggcaattgggtcc

SEQ ID NO: 869445 - DNA, 22 bp, Artificial Sequence
  chemically synthesized
tggtgaataagtggacccaatt

SEQ ID NO: 869446 - DNA, 22 bp, Artificial Sequence
  chemically synthesized
atgctgtaggcaattgggtcca

SEQ ID NO: 869447 - DNA, 22 bp, Artificial Sequence
  chemically synthesized
taggcaattgggtccacttatt

SEQ ID NO: 869448 - DNA, 22 bp, Artificial Sequence
  chemically synthesized
ggtggctgtggtgaataagtgg

SEQ ID NO: 869449 - DNA, 22 bp, Artificial Sequence
  chemically synthesized
ttcggtggctgtggtgaataag

SEQ ID NO: 869450 - DNA, 22 bp, Artificial Sequence
  chemically synthesized
gttcggtggctgtggtgaataa

SEQ ID NO: 869451 - DNA, 22 bp, Artificial Sequence
  chemically synthesized
tgttcggtggctgtggtgaata

SEQ ID NO: 869452 - DNA, 22 bp, Artificial Sequence
  chemically synthesized
tttgttcggtggctgtggtgaa

SEQ ID NO: 869453 - DNA, 22 bp, Artificial Sequence
  chemically synthesized
ctttgttcggtggctgtggtga

SEQ ID NO: 869454 - DNA, 22 bp, Artificial Sequence
  chemically synthesized
ggtccacttattcaccacagcc

SEQ ID NO: 869455 - DNA, 22 bp, Artificial Sequence
  chemically synthesized
tctttgttcggtggctgtggtg

SEQ ID NO: 869456 - DNA, 22 bp, Artificial Sequence
  chemically synthesized
gtgttttctttgttcggtggct

SEQ ID NO: 869457 - DNA, 22 bp, Artificial Sequence
  chemically synthesized
tagtgttttctttgttcggtgg

SEQ ID NO: 869458 - DNA, 22 bp, Artificial Sequence
  chemically synthesized
attcaccacagccaccgaacaa

SEQ ID NO: 869459 - DNA, 22 bp, Artificial Sequence
  chemically synthesized
ctagtgttttctttgttcggtg

SEQ ID NO: 869460 - DNA, 22 bp, Artificial Sequence
  chemically synthesized
ttcaccacagccaccgaacaaa

SEQ ID NO: 869461 - DNA, 22 bp, Artificial Sequence
  chemically synthesized
tctagtgttttctttgttcggt

SEQ ID NO: 869462 - DNA, 22 bp, Artificial Sequence
  chemically synthesized
accacagccaccgaacaaagaa

SEQ ID NO: 869463 - DNA, 22 bp, Artificial Sequence
  chemically synthesized
aaagtattttctagtgttttct

SEQ ID NO: 869464 - DNA, 22 bp, Artificial Sequence
  chemically synthesized
tgaaagtattttctagtgtttt

SEQ ID NO: 869465 - DNA, 22 bp, Artificial Sequence
  chemically synthesized
tctgaaagtattttctagtgtt

SEQ ID NO: 869466 - DNA, 22 bp, Artificial Sequence
  chemically synthesized
attctctgaaagtattttctag

SEQ ID NO: 869467 - DNA, 22 bp, Artificial Sequence
  chemically synthesized
agacctgattctctgaaagtat

SEQ ID NO: 869468 - DNA, 22 bp, Artificial Sequence
  chemically synthesized
tgttcagacctgattctctgaa

SEQ ID NO: 869469 - DNA, 22 bp, Artificial Sequence
  chemically synthesized
gtgttcagacctgattctctga

SEQ ID NO: 869470 - DNA, 22 bp, Artificial Sequence
  chemically synthesized
tgtgttcagacctgattctctg

SEQ ID NO: 869471 - DNA, 22 bp, Artificial Sequence
  chemically synthesized
gaaaatactttcagagaatcag

SEQ ID NO: 869472 - DNA, 22 bp, Artificial Sequence
  chemically synthesized
ttgtgttcagacctgattctct

SEQ ID NO: 869473 - DNA, 22 bp, Artificial Sequence
  chemically synthesized
tttgtgttcagacctgattctc

SEQ ID NO: 869474 - DNA, 22 bp, Artificial Sequence
  chemically synthesized
ttttgtgttcagacctgattct

SEQ ID NO: 869475 - DNA, 22 bp, Artificial Sequence
  chemically synthesized
ttttttgtgttcagacctgatt

SEQ ID NO: 869476 - DNA, 22 bp, Artificial Sequence
  chemically synthesized
tcagagaatcaggtctgaacac

SEQ ID NO: 869477 - DNA, 22 bp, Artificial Sequence
  chemically synthesized
cagagaatcaggtctgaacaca

SEQ ID NO: 869478 - DNA, 22 bp, Artificial Sequence
  chemically synthesized
agagaatcaggtctgaacacaa

SEQ ID NO: 869479 - DNA, 22 bp, Artificial Sequence
  chemically synthesized
gaaaattcttttttgtgttcag

SEQ ID NO: 869480 - DNA, 22 bp, Artificial Sequence
  chemically synthesized
ggaaaattcttttttgtgttca

SEQ ID NO: 869481 - DNA, 22 bp, Artificial Sequence
  chemically synthesized
ccttggaaaattcttttttgtg

SEQ ID NO: 869482 - DNA, 22 bp, Artificial Sequence
  chemically synthesized
aacacaaaaaagaattttccaa

SEQ ID NO: 869483 - DNA, 22 bp, Artificial Sequence
  chemically synthesized
agggcaccacgactcccttgga

SEQ ID NO: 869484 - DNA, 22 bp, Artificial Sequence
  chemically synthesized
aagggcaccacgactcccttgg

SEQ ID NO: 869485 - DNA, 22 bp, Artificial Sequence
  chemically synthesized
atcttaagggcaccacgactcc

SEQ ID NO: 869486 - DNA, 22 bp, Artificial Sequence
  chemically synthesized
aatcttaagggcaccacgactc

SEQ ID NO: 869487 - DNA, 22 bp, Artificial Sequence
  chemically synthesized
atttaatcttaagggcaccacg

SEQ ID NO: 869488 - DNA, 22 bp, Artificial Sequence
  chemically synthesized
tccaagggagtcgtggtgccct

SEQ ID NO: 869489 - DNA, 22 bp, Artificial Sequence
  chemically synthesized
catttaatcttaagggcaccac

SEQ ID NO: 869490 - DNA, 22 bp, Artificial Sequence
  chemically synthesized
ccaagggagtcgtggtgccctt

SEQ ID NO: 869491 - DNA, 22 bp, Artificial Sequence
  chemically synthesized
caagggagtcgtggtgccctta

SEQ ID NO: 869492 - DNA, 22 bp, Artificial Sequence
  chemically synthesized
aacagcacttcatttaatctta

SEQ ID NO: 869493 - DNA, 22 bp, Artificial Sequence
  chemically synthesized
aaacagcacttcatttaatctt

SEQ ID NO: 869494 - DNA, 22 bp, Artificial Sequence
  chemically synthesized
aagattaaatgaagtgctgttt

SEQ ID NO: 869495 - DNA, 22 bp, Artificial Sequence
  chemically synthesized
agattaaatgaagtgctgttta

SEQ ID NO: 869496 - DNA, 22 bp, Artificial Sequence
  chemically synthesized
aataaatatgtttaaacagcac

SEQ ID NO: 869497 - DNA, 22 bp, Artificial Sequence
  chemically synthesized
aatgaagtgctgtttaaacata

SEQ ID NO: 869498 - DNA, 22 bp, Artificial Sequence
  chemically synthesized
caagtcaaaatcaattaaataa

SEQ ID NO: 869499 - DNA, 22 bp, Artificial Sequence
  chemically synthesized
tttaaacatatttatttaattg

SEQ ID NO: 869500 - DNA, 22 bp, Artificial Sequence
  chemically synthesized
ctgcaagtcaaaatcaattaaa

SEQ ID NO: 869501 - DNA, 22 bp, Artificial Sequence
  chemically synthesized
aaacatatttatttaattgatt

SEQ ID NO: 869502 - DNA, 22 bp, Artificial Sequence
  chemically synthesized
aacatatttatttaattgattt

SEQ ID NO: 869503 - DNA, 22 bp, Artificial Sequence
  chemically synthesized
atttaattgattttgacttgca

SEQ ID NO: 869504 - DNA, 22 bp, Artificial Sequence
  chemically synthesized
tttaattgattttgacttgcag

SEQ ID NO: 869505 - DNA, 22 bp, Artificial Sequence
  chemically synthesized
aattgattttgacttgcagcag

SEQ ID NO: 869506 - DNA, 22 bp, Artificial Sequence
  chemically synthesized
attgattttgacttgcagcagg

SEQ ID NO: 869507 - DNA, 22 bp, Artificial Sequence
  chemically synthesized
attttgacttgcagcagggtgc

SEQ ID NO: 869508 - DNA, 22 bp, Artificial Sequence
  chemically synthesized
tgacttgcagcagggtgctgga

SEQ ID NO: 869509 - DNA, 22 bp, Artificial Sequence
  chemically synthesized
gacttgcagcagggtgctggac

SEQ ID NO: 869510 - DNA, 22 bp, Artificial Sequence
  chemically synthesized
tagggtaccatagtccagcacc

SEQ ID NO: 869511 - DNA, 22 bp, Artificial Sequence
  chemically synthesized
acttgcagcagggtgctggact

SEQ ID NO: 869512 - DNA, 22 bp, Artificial Sequence
  chemically synthesized
gcagcagggtgctggactatgg

SEQ ID NO: 869513 - DNA, 22 bp, Artificial Sequence
  chemically synthesized
cagcagggtgctggactatggt

SEQ ID NO: 869514 - DNA, 22 bp, Artificial Sequence
  chemically synthesized
gaaaatctatagggtaccatag

SEQ ID NO: 869515 - DNA, 22 bp, Artificial Sequence
  chemically synthesized
gactatggtaccctatagattt

SEQ ID NO: 869516 - DNA, 22 bp, Artificial Sequence
  chemically synthesized
tggtaccctatagattttccag

SEQ ID NO: 869517 - DNA, 22 bp, Artificial Sequence
  chemically synthesized
caaaaagtagatctggaaaatc

SEQ ID NO: 869518 - DNA, 22 bp, Artificial Sequence
  chemically synthesized
tagattttccagatctactttt

SEQ ID NO: 869519 - DNA, 22 bp, Artificial Sequence
  chemically synthesized
tccagatctactttttgtaatt

SEQ ID NO: 869520 - DNA, 22 bp, Artificial Sequence
  chemically synthesized
ccagatctactttttgtaattc

SEQ ID NO: 869521 - DNA, 22 bp, Artificial Sequence
  chemically synthesized
cagatctactttttgtaattct

SEQ ID NO: 869522 - DNA, 22 bp, Artificial Sequence
  chemically synthesized
ctttttgtaattctgctgctgt

SEQ ID NO: 869523 - DNA, 22 bp, Artificial Sequence
  chemically synthesized
tttgtaattctgctgctgtact

SEQ ID NO: 869524 - DNA, 22 bp, Artificial Sequence
  chemically synthesized
ttgtaattctgctgctgtactg

SEQ ID NO: 869525 - DNA, 22 bp, Artificial Sequence
  chemically synthesized
tgtaattctgctgctgtactgg

SEQ ID NO: 869526 - DNA, 22 bp, Artificial Sequence
  chemically synthesized
aaggtcaaaaagccagtacagc

SEQ ID NO: 869527 - DNA, 22 bp, Artificial Sequence
  chemically synthesized
gtaattctgctgctgtactggc

SEQ ID NO: 869528 - DNA, 22 bp, Artificial Sequence
  chemically synthesized
taattctgctgctgtactggct

SEQ ID NO: 869529 - DNA, 22 bp, Artificial Sequence
  chemically synthesized
tcaattcaaggtcaaaaagcca

SEQ ID NO: 869530 - DNA, 22 bp, Artificial Sequence
  chemically synthesized
tgctgctgtactggctttttga

SEQ ID NO: 869531 - DNA, 22 bp, Artificial Sequence
  chemically synthesized
ctgctgtactggctttttgacc

SEQ ID NO: 869532 - DNA, 22 bp, Artificial Sequence
  chemically synthesized
ctgtactggctttttgaccttg

SEQ ID NO: 869533 - DNA, 22 bp, Artificial Sequence
  chemically synthesized
taactgtcaattcaaggtcaaa

SEQ ID NO: 869534 - DNA, 22 bp, Artificial Sequence
  chemically synthesized
tactggctttttgaccttgaat

SEQ ID NO: 869535 - DNA, 22 bp, Artificial Sequence
  chemically synthesized
gctttttgaccttgaattgaca

SEQ ID NO: 869536 - DNA, 22 bp, Artificial Sequence
  chemically synthesized
ccacatctgtaactgtcaattc

SEQ ID NO: 869537 - DNA, 22 bp, Artificial Sequence
  chemically synthesized
tcccacatctgtaactgtcaat

SEQ ID NO: 869538 - DNA, 22 bp, Artificial Sequence
  chemically synthesized
tttgaccttgaattgacagtta

SEQ ID NO: 869539 - DNA, 22 bp, Artificial Sequence
  chemically synthesized
ttgaccttgaattgacagttac

SEQ ID NO: 869540 - DNA, 22 bp, Artificial Sequence
  chemically synthesized
tgaccttgaattgacagttaca

SEQ ID NO: 869541 - DNA, 22 bp, Artificial Sequence
  chemically synthesized
ttctcccacatctgtaactgtc

SEQ ID NO: 869542 - DNA, 22 bp, Artificial Sequence
  chemically synthesized
gaccttgaattgacagttacag

SEQ ID NO: 869543 - DNA, 22 bp, Artificial Sequence
  chemically synthesized
attctcccacatctgtaactgt

SEQ ID NO: 869544 - DNA, 22 bp, Artificial Sequence
  chemically synthesized
accttgaattgacagttacaga

SEQ ID NO: 869545 - DNA, 22 bp, Artificial Sequence
  chemically synthesized
tttattctcccacatctgtaac

SEQ ID NO: 869546 - DNA, 22 bp, Artificial Sequence
  chemically synthesized
atttattctcccacatctgtaa

SEQ ID NO: 869547 - DNA, 22 bp, Artificial Sequence
  chemically synthesized
tatttattctcccacatctgta

SEQ ID NO: 869548 - DNA, 22 bp, Artificial Sequence
  chemically synthesized
gaattgacagttacagatgtgg

SEQ ID NO: 869549 - DNA, 22 bp, Artificial Sequence
  chemically synthesized
aattgacagttacagatgtggg

SEQ ID NO: 869550 - DNA, 22 bp, Artificial Sequence
  chemically synthesized
gctttatttattctcccacatc

SEQ ID NO: 869551 - DNA, 22 bp, Artificial Sequence
  chemically synthesized
agctttatttattctcccacat

SEQ ID NO: 869552 - DNA, 22 bp, Artificial Sequence
  chemically synthesized
acagttacagatgtgggagaat

SEQ ID NO: 869553 - DNA, 22 bp, Artificial Sequence
  chemically synthesized
cttagctttatttattctccca

SEQ ID NO: 869554 - DNA, 22 bp, Artificial Sequence
  chemically synthesized
ctacttagctttatttattctc

SEQ ID NO: 869555 - DNA, 22 bp, Artificial Sequence
  chemically synthesized
cagatgtgggagaataaataaa

SEQ ID NO: 869556 - DNA, 22 bp, Artificial Sequence
  chemically synthesized
ccacagtgttactacttagctt

SEQ ID NO: 869557 - DNA, 22 bp, Artificial Sequence
  chemically synthesized
tcccacagtgttactacttagc

SEQ ID NO: 869558 - DNA, 22 bp, Artificial Sequence
  chemically synthesized
attctcccacagtgttactact

SEQ ID NO: 869559 - DNA, 22 bp, Artificial Sequence
  chemically synthesized
gattctcccacagtgttactac

SEQ ID NO: 869560 - DNA, 22 bp, Artificial Sequence
  chemically synthesized
agtagtaacactgtgggagaat

SEQ ID NO: 869561 - DNA, 22 bp, Artificial Sequence
  chemically synthesized
agatgataggcttgattctccc

SEQ ID NO: 869562 - DNA, 22 bp, Artificial Sequence
  chemically synthesized
tgggagaatcaagcctatcatc

SEQ ID NO: 869563 - DNA, 22 bp, Artificial Sequence
  chemically synthesized
tcatcttaatgtctttttctct

SEQ ID NO: 869564 - DNA, 22 bp, Artificial Sequence
  chemically synthesized
gaatagaaggcaatcaggagag

SEQ ID NO: 869565 - DNA, 22 bp, Artificial Sequence
  chemically synthesized
aatgtctttttctctcctgatt

SEQ ID NO: 869566 - DNA, 22 bp, Artificial Sequence
  chemically synthesized
atgtctttttctctcctgattg

SEQ ID NO: 869567 - DNA, 22 bp, Artificial Sequence
  chemically synthesized
tagaatagaaggcaatcaggag

SEQ ID NO: 869568 - DNA, 22 bp, Artificial Sequence
  chemically synthesized
ctctagaatagaaggcaatcag

SEQ ID NO: 869569 - DNA, 22 bp, Artificial Sequence
  chemically synthesized
tttctctcctgattgccttcta

SEQ ID NO: 869570 - DNA, 22 bp, Artificial Sequence
  chemically synthesized
gctcctctagaatagaaggcaa

SEQ ID NO: 869571 - DNA, 22 bp, Artificial Sequence
  chemically synthesized
ttctctcctgattgccttctat

SEQ ID NO: 869572 - DNA, 22 bp, Artificial Sequence
  chemically synthesized
ggctcctctagaatagaaggca

SEQ ID NO: 869573 - DNA, 22 bp, Artificial Sequence
  chemically synthesized
tctctcctgattgccttctatt

SEQ ID NO: 869574 - DNA, 22 bp, Artificial Sequence
  chemically synthesized
tggctcctctagaatagaaggc

SEQ ID NO: 869575 - DNA, 22 bp, Artificial Sequence
  chemically synthesized
ctctcctgattgccttctattc

SEQ ID NO: 869576 - DNA, 22 bp, Artificial Sequence
  chemically synthesized
ttggctcctctagaatagaagg

SEQ ID NO: 869577 - DNA, 22 bp, Artificial Sequence
  chemically synthesized
tctcctgattgccttctattct

SEQ ID NO: 869578 - DNA, 22 bp, Artificial Sequence
  chemically synthesized
tttggctcctctagaatagaag

SEQ ID NO: 869579 - DNA, 22 bp, Artificial Sequence
  chemically synthesized
ttttggctcctctagaatagaa

SEQ ID NO: 869580 - DNA, 22 bp, Artificial Sequence
  chemically synthesized
tcctgattgccttctattctag

SEQ ID NO: 869581 - DNA, 22 bp, Artificial Sequence
  chemically synthesized
tttttggctcctctagaataga

SEQ ID NO: 869582 - DNA, 22 bp, Artificial Sequence
  chemically synthesized
ctgattgccttctattctagag

SEQ ID NO: 869583 - DNA, 22 bp, Artificial Sequence
  chemically synthesized
tttttttggctcctctagaata

SEQ ID NO: 869584 - DNA, 22 bp, Artificial Sequence
  chemically synthesized
ctttttttggctcctctagaat

SEQ ID NO: 869585 - DNA, 22 bp, Artificial Sequence
  chemically synthesized
tctttttttggctcctctagaa

SEQ ID NO: 869586 - DNA, 22 bp, Artificial Sequence
  chemically synthesized
attgccttctattctagaggag

SEQ ID NO: 869587 - DNA, 22 bp, Artificial Sequence
  chemically synthesized
ttctttttttggctcctctaga

SEQ ID NO: 869588 - DNA, 22 bp, Artificial Sequence
  chemically synthesized
ttttctttttttggctcctcta

SEQ ID NO: 869589 - DNA, 22 bp, Artificial Sequence
  chemically synthesized
cttttctttttttggctcctct

SEQ ID NO: 869590 - DNA, 22 bp, Artificial Sequence
  chemically synthesized
ccttctattctagaggagccaa

SEQ ID NO: 869591 - DNA, 22 bp, Artificial Sequence
  chemically synthesized
tcttttctttttttggctcctc

SEQ ID NO: 869592 - DNA, 22 bp, Artificial Sequence
  chemically synthesized
ttcttttctttttttggctcct

SEQ ID NO: 869593 - DNA, 22 bp, Artificial Sequence
  chemically synthesized
ttttcttttctttttttggctc

SEQ ID NO: 869594 - DNA, 22 bp, Artificial Sequence
  chemically synthesized
ctattctagaggagccaaaaaa

SEQ ID NO: 869595 - DNA, 22 bp, Artificial Sequence
  chemically synthesized
cttttcttttctttttttggct

SEQ ID NO: 869596 - DNA, 22 bp, Artificial Sequence
  chemically synthesized
tattctagaggagccaaaaaaa

SEQ ID NO: 869597 - DNA, 22 bp, Artificial Sequence
  chemically synthesized
tcttttcttttctttttttggc

SEQ ID NO: 869598 - DNA, 22 bp, Artificial Sequence
  chemically synthesized
ttcttttcttttctttttttgg

SEQ ID NO: 869599 - DNA, 22 bp, Artificial Sequence
  chemically synthesized
ttctagaggagccaaaaaaaga

SEQ ID NO: 869600 - DNA, 22 bp, Artificial Sequence
  chemically synthesized
ttttcttttcttttcttttttt

SEQ ID NO: 869601 - DNA, 22 bp, Artificial Sequence
  chemically synthesized
cttttcttttcttttctttttt

SEQ ID NO: 869602 - DNA, 22 bp, Artificial Sequence
  chemically synthesized
tagaggagccaaaaaaagaaaa

SEQ ID NO: 869603 - DNA, 22 bp, Artificial Sequence
  chemically synthesized
tcttttcttttcttttcttttt

SEQ ID NO: 869604 - DNA, 22 bp, Artificial Sequence
  chemically synthesized
ttcttttcttttcttttctttt

SEQ ID NO: 869605 - DNA, 22 bp, Artificial Sequence
  chemically synthesized
gaggagccaaaaaaagaaaaga

SEQ ID NO: 869606 - DNA, 22 bp, Artificial Sequence
  chemically synthesized
ttttcttttcttttcttttctt

SEQ ID NO: 869607 - DNA, 22 bp, Artificial Sequence
  chemically synthesized
aatatgaagaaatatatacgtt

SEQ ID NO: 869608 - DNA, 22 bp, Artificial Sequence
  chemically synthesized
caatatgaagaaatatatacgt

SEQ ID NO: 869609 - DNA, 22 bp, Artificial Sequence
  chemically synthesized
cggaagtggtttcaatatgaag

SEQ ID NO: 869610 - DNA, 22 bp, Artificial Sequence
  chemically synthesized
agagttacggaagtggtttcaa

SEQ ID NO: 869611 - DNA, 22 bp, Artificial Sequence
  chemically synthesized
cttcatattgaaaccacttccg

SEQ ID NO: 869612 - DNA, 22 bp, Artificial Sequence
  chemically synthesized
ttcatattgaaaccacttccgt

SEQ ID NO: 869613 - DNA, 22 bp, Artificial Sequence
  chemically synthesized
taacctcagagttacggaagtg

SEQ ID NO: 869614 - DNA, 22 bp, Artificial Sequence
  chemically synthesized
catattgaaaccacttccgtaa

SEQ ID NO: 869615 - DNA, 22 bp, Artificial Sequence
  chemically synthesized
atattgaaaccacttccgtaac

SEQ ID NO: 869616 - DNA, 22 bp, Artificial Sequence
  chemically synthesized
atactataacctcagagttacg

SEQ ID NO: 869617 - DNA, 22 bp, Artificial Sequence
  chemically synthesized
aatactataacctcagagttac

SEQ ID NO: 869618 - DNA, 22 bp, Artificial Sequence
  chemically synthesized
aaaccacttccgtaactctgag

SEQ ID NO: 869619 - DNA, 22 bp, Artificial Sequence
  chemically synthesized
aagcttaatactataacctcag

SEQ ID NO: 869620 - DNA, 22 bp, Artificial Sequence
  chemically synthesized
gaagcttaatactataacctca

SEQ ID NO: 869621 - DNA, 22 bp, Artificial Sequence
  chemically synthesized
tgaagcttaatactataacctc

SEQ ID NO: 869622 - DNA, 22 bp, Artificial Sequence
  chemically synthesized
ccgtaactctgaggttatagta

SEQ ID NO: 869623 - DNA, 22 bp, Artificial Sequence
  chemically synthesized
cgtaactctgaggttatagtat

SEQ ID NO: 869624 - DNA, 22 bp, Artificial Sequence
  chemically synthesized
tgaggttatagtattaagcttc

SEQ ID NO: 869625 - DNA, 22 bp, Artificial Sequence
  chemically synthesized
aggttatagtattaagcttcaa

SEQ ID NO: 869626 - DNA, 22 bp, Artificial Sequence
  chemically synthesized
agtagtagtacctttgaagctt

SEQ ID NO: 869627 - DNA, 22 bp, Artificial Sequence
  chemically synthesized
aagtagtagtacctttgaagct

SEQ ID NO: 869628 - DNA, 22 bp, Artificial Sequence
  chemically synthesized
tagtattaagcttcaaaggtac

SEQ ID NO: 869629 - DNA, 22 bp, Artificial Sequence
  chemically synthesized
ggccttaagtagtagtaccttt

SEQ ID NO: 869630 - DNA, 22 bp, Artificial Sequence
  chemically synthesized
agcttcaaaggtactactactt

SEQ ID NO: 869631 - DNA, 22 bp, Artificial Sequence
  chemically synthesized
caaaggtactactacttaaggc

SEQ ID NO: 869632 - DNA, 22 bp, Artificial Sequence
  chemically synthesized
aaaggtactactacttaaggcc

SEQ ID NO: 869633 - DNA, 22 bp, Artificial Sequence
  chemically synthesized
cgtgggtggaattgggccttaa

SEQ ID NO: 869634 - DNA, 22 bp, Artificial Sequence
  chemically synthesized
aatctccgtgggtggaattggg

SEQ ID NO: 869635 - DNA, 22 bp, Artificial Sequence
  chemically synthesized
ctacttaaggcccaattccacc

SEQ ID NO: 869636 - DNA, 22 bp, Artificial Sequence
  chemically synthesized
ttaaatctccgtgggtggaatt

SEQ ID NO: 869637 - DNA, 22 bp, Artificial Sequence
  chemically synthesized
attaaatctccgtgggtggaat

SEQ ID NO: 869638 - DNA, 22 bp, Artificial Sequence
  chemically synthesized
cttaaggcccaattccacccac

SEQ ID NO: 869639 - DNA, 22 bp, Artificial Sequence
  chemically synthesized
tattaaatctccgtgggtggaa

SEQ ID NO: 869640 - DNA, 22 bp, Artificial Sequence
  chemically synthesized
ttattaaatctccgtgggtgga

SEQ ID NO: 869641 - DNA, 22 bp, Artificial Sequence
  chemically synthesized
aaggcccaattccacccacgga

SEQ ID NO: 869642 - DNA, 22 bp, Artificial Sequence
  chemically synthesized
aggcccaattccacccacggag

SEQ ID NO: 869643 - DNA, 22 bp, Artificial Sequence
  chemically synthesized
aatcttttattaaatctccgtg

SEQ ID NO: 869644 - DNA, 22 bp, Artificial Sequence
  chemically synthesized
cacccacggagatttaataaaa

SEQ ID NO: 869645 - DNA, 22 bp, Artificial Sequence
  chemically synthesized
catgacatctaaatcttttatt

SEQ ID NO: 869646 - DNA, 22 bp, Artificial Sequence
  chemically synthesized
gcatgacatctaaatcttttat

SEQ ID NO: 869647 - DNA, 22 bp, Artificial Sequence
  chemically synthesized
tgcatgacatctaaatctttta

SEQ ID NO: 869648 - DNA, 22 bp, Artificial Sequence
  chemically synthesized
cgttttgcatgacatctaaatc

SEQ ID NO: 869649 - DNA, 22 bp, Artificial Sequence
  chemically synthesized
ccgttttgcatgacatctaaat

SEQ ID NO: 869650 - DNA, 22 bp, Artificial Sequence
  chemically synthesized
tccgttttgcatgacatctaaa

SEQ ID NO: 869651 - DNA, 22 bp, Artificial Sequence
  chemically synthesized
ttccgttttgcatgacatctaa

SEQ ID NO: 869652 - DNA, 22 bp, Artificial Sequence
  chemically synthesized
aataaaagatttagatgtcatg

SEQ ID NO: 869653 - DNA, 22 bp, Artificial Sequence
  chemically synthesized
ttttccgttttgcatgacatct

SEQ ID NO: 869654 - DNA, 22 bp, Artificial Sequence
  chemically synthesized
ataaaagatttagatgtcatgc

SEQ ID NO: 869655 - DNA, 22 bp, Artificial Sequence
  chemically synthesized
cttttccgttttgcatgacatc

SEQ ID NO: 869656 - DNA, 22 bp, Artificial Sequence
  chemically synthesized
tcttttccgttttgcatgacat

SEQ ID NO: 869657 - DNA, 22 bp, Artificial Sequence
  chemically synthesized
ccctttcttttccgttttgcat

SEQ ID NO: 869658 - DNA, 22 bp, Artificial Sequence
  chemically synthesized
cccctttcttttccgttttgca

SEQ ID NO: 869659 - DNA, 22 bp, Artificial Sequence
  chemically synthesized
ttcccctttcttttccgttttg

SEQ ID NO: 869660 - DNA, 22 bp, Artificial Sequence
  chemically synthesized
agatgtcatgcaaaacggaaaa

SEQ ID NO: 869661 - DNA, 22 bp, Artificial Sequence
  chemically synthesized
tcttcccctttcttttccgttt

SEQ ID NO: 869662 - DNA, 22 bp, Artificial Sequence
  chemically synthesized
gatgtcatgcaaaacggaaaag

SEQ ID NO: 869663 - DNA, 22 bp, Artificial Sequence
  chemically synthesized
tctcttcccctttcttttccgt

SEQ ID NO: 869664 - DNA, 22 bp, Artificial Sequence
  chemically synthesized
aacaacaatactctctcttccc

SEQ ID NO: 869665 - DNA, 22 bp, Artificial Sequence
  chemically synthesized
caaatgaaattaaacaacaata

SEQ ID NO: 869666 - DNA, 22 bp, Artificial Sequence
  chemically synthesized
ccaaatgaaattaaacaacaat

SEQ ID NO: 869667 - DNA, 22 bp, Artificial Sequence
  chemically synthesized
tccaaatgaaattaaacaacaa

SEQ ID NO: 869668 - DNA, 22 bp, Artificial Sequence
  chemically synthesized
tacatattttccaaatgaaatt

SEQ ID NO: 869669 - DNA, 22 bp, Artificial Sequence
  chemically synthesized
gtacatattttccaaatgaaat

SEQ ID NO: 869670 - DNA, 22 bp, Artificial Sequence
  chemically synthesized
tgtacatattttccaaatgaaa

SEQ ID NO: 869671 - DNA, 22 bp, Artificial Sequence
  chemically synthesized
ttgtacatattttccaaatgaa

SEQ ID NO: 869672 - DNA, 22 bp, Artificial Sequence
  chemically synthesized
ttgtttaatttcatttggaaaa

SEQ ID NO: 869673 - DNA, 22 bp, Artificial Sequence
  chemically synthesized
tttaatttcatttggaaaatat

SEQ ID NO: 869674 - DNA, 22 bp, Artificial Sequence
  chemically synthesized
aatttcatttggaaaatatgta

SEQ ID NO: 869675 - DNA, 22 bp, Artificial Sequence
  chemically synthesized
tgcatgcttttgtacatatttt

SEQ ID NO: 869676 - DNA, 22 bp, Artificial Sequence
  chemically synthesized
atttcatttggaaaatatgtac

SEQ ID NO: 869677 - DNA, 22 bp, Artificial Sequence
  chemically synthesized
catttggaaaatatgtacaaaa

SEQ ID NO: 869678 - DNA, 22 bp, Artificial Sequence
  chemically synthesized
atttggaaaatatgtacaaaag

SEQ ID NO: 869679 - DNA, 22 bp, Artificial Sequence
  chemically synthesized
ccatattgtgcatgcttttgta

SEQ ID NO: 869680 - DNA, 22 bp, Artificial Sequence
  chemically synthesized
ggaaaatatgtacaaaagcatg

SEQ ID NO: 869681 - DNA, 22 bp, Artificial Sequence
  chemically synthesized
taccatattgtgcatgcttttg

SEQ ID NO: 869682 - DNA, 22 bp, Artificial Sequence
  chemically synthesized
gaaaatatgtacaaaagcatgc

SEQ ID NO: 869683 - DNA, 22 bp, Artificial Sequence
  chemically synthesized
ggaccaattctaccatattgtg

SEQ ID NO: 869684 - DNA, 22 bp, Artificial Sequence
  chemically synthesized
taggaccaattctaccatattg

SEQ ID NO: 869685 - DNA, 22 bp, Artificial Sequence
  chemically synthesized
catatactctaggaccaattct

SEQ ID NO: 869686 - DNA, 22 bp, Artificial Sequence
  chemically synthesized
tgaatgaagactccatatactc

SEQ ID NO: 869687 - DNA, 22 bp, Artificial Sequence
  chemically synthesized
gtcctagagtatatggagtctt

SEQ ID NO: 869688 - DNA, 22 bp, Artificial Sequence
  chemically synthesized
gagtatatggagtcttcattca

SEQ ID NO: 869689 - DNA, 22 bp, Artificial Sequence
  chemically synthesized
gtcatgcagtctatgaatgaag

SEQ ID NO: 869690 - DNA, 22 bp, Artificial Sequence
  chemically synthesized
ggtcatgcagtctatgaatgaa

SEQ ID NO: 869691 - DNA, 22 bp, Artificial Sequence
  chemically synthesized
aatcttggtcatgcagtctatg

SEQ ID NO: 869692 - DNA, 22 bp, Artificial Sequence
  chemically synthesized
cattcatagactgcatgaccaa

SEQ ID NO: 869693 - DNA, 22 bp, Artificial Sequence
  chemically synthesized
attcatagactgcatgaccaag

SEQ ID NO: 869694 - DNA, 22 bp, Artificial Sequence
  chemically synthesized
aacatactgaatcttggtcatg

SEQ ID NO: 869695 - DNA, 22 bp, Artificial Sequence
  chemically synthesized
atagactgcatgaccaagattc

SEQ ID NO: 869696 - DNA, 22 bp, Artificial Sequence
  chemically synthesized
tgttaaacatactgaatcttgg

SEQ ID NO: 869697 - DNA, 22 bp, Artificial Sequence
  chemically synthesized
atgttaaacatactgaatcttg

SEQ ID NO: 869698 - DNA, 22 bp, Artificial Sequence
  chemically synthesized
tatgttaaacatactgaatctt

SEQ ID NO: 869699 - DNA, 22 bp, Artificial Sequence
  chemically synthesized
cctttatgttaaacatactgaa

SEQ ID NO: 869700 - DNA, 22 bp, Artificial Sequence
  chemically synthesized
catgaccaagattcagtatgtt

SEQ ID NO: 869701 - DNA, 22 bp, Artificial Sequence
  chemically synthesized
acctttatgttaaacatactga

SEQ ID NO: 869702 - DNA, 22 bp, Artificial Sequence
  chemically synthesized
tacctttatgttaaacatactg

SEQ ID NO: 869703 - DNA, 22 bp, Artificial Sequence
  chemically synthesized
ttacctttatgttaaacatact

SEQ ID NO: 869704 - DNA, 22 bp, Artificial Sequence
  chemically synthesized
tcttttacctttatgttaaaca

SEQ ID NO: 869705 - DNA, 22 bp, Artificial Sequence
  chemically synthesized
atgcctgtcttttacctttatg

SEQ ID NO: 869706 - DNA, 22 bp, Artificial Sequence
  chemically synthesized
agtatgtttaacataaaggtaa

SEQ ID NO: 869707 - DNA, 22 bp, Artificial Sequence
  chemically synthesized
taaagttcatgcctgtctttta

SEQ ID NO: 869708 - DNA, 22 bp, Artificial Sequence
  chemically synthesized
ataaagttcatgcctgtctttt

SEQ ID NO: 869709 - DNA, 22 bp, Artificial Sequence
  chemically synthesized
aacataaaggtaaaagacaggc

SEQ ID NO: 869710 - DNA, 22 bp, Artificial Sequence
  chemically synthesized
tataaagttcatgcctgtcttt

SEQ ID NO: 869711 - DNA, 22 bp, Artificial Sequence
  chemically synthesized
acataaaggtaaaagacaggca

SEQ ID NO: 869712 - DNA, 22 bp, Artificial Sequence
  chemically synthesized
agtctttataaagttcatgcct

SEQ ID NO: 869713 - DNA, 22 bp, Artificial Sequence
  chemically synthesized
aacctgagtctttataaagttc

SEQ ID NO: 869714 - DNA, 22 bp, Artificial Sequence
  chemically synthesized
gaacctgagtctttataaagtt

SEQ ID NO: 869715 - DNA, 22 bp, Artificial Sequence
  chemically synthesized
tataaagactcaggttcaaggc

SEQ ID NO: 869716 - DNA, 22 bp, Artificial Sequence
  chemically synthesized
ataaagactcaggttcaaggcc

SEQ ID NO: 869717 - DNA, 22 bp, Artificial Sequence
  chemically synthesized
taaagactcaggttcaaggcca

SEQ ID NO: 869718 - DNA, 22 bp, Artificial Sequence
  chemically synthesized
agtgggcacagcatggccttga

SEQ ID NO: 869719 - DNA, 22 bp, Artificial Sequence
  chemically synthesized
ctaagtgggcacagcatggcct

SEQ ID NO: 869720 - DNA, 22 bp, Artificial Sequence
  chemically synthesized
aggttcaaggccatgctgtgcc

SEQ ID NO: 869721 - DNA, 22 bp, Artificial Sequence
  chemically synthesized
aaggccatgctgtgcccactta

SEQ ID NO: 869722 - DNA, 22 bp, Artificial Sequence
  chemically synthesized
tccaaaaacacccagctactaa

SEQ ID NO: 869723 - DNA, 22 bp, Artificial Sequence
  chemically synthesized
tgcccacttagtagctgggtgt

SEQ ID NO: 869724 - DNA, 22 bp, Artificial Sequence
  chemically synthesized
gagagaatggttatccaaaaac

SEQ ID NO: 869725 - DNA, 22 bp, Artificial Sequence
  chemically synthesized
agtagctgggtgtttttggata

SEQ ID NO: 869726 - DNA, 22 bp, Artificial Sequence
  chemically synthesized
gtagctgggtgtttttggataa

SEQ ID NO: 869727 - DNA, 22 bp, Artificial Sequence
  chemically synthesized
ggtgtttttggataaccattct

SEQ ID NO: 869728 - DNA, 22 bp, Artificial Sequence
  chemically synthesized
ttggataaccattctctctagg

SEQ ID NO: 869729 - DNA, 22 bp, Artificial Sequence
  chemically synthesized
tggataaccattctctctaggc

SEQ ID NO: 869730 - DNA, 22 bp, Artificial Sequence
  chemically synthesized
ggataaccattctctctaggct

SEQ ID NO: 869731 - DNA, 22 bp, Artificial Sequence
  chemically synthesized
gataaccattctctctaggctt

SEQ ID NO: 869732 - DNA, 22 bp, Artificial Sequence
  chemically synthesized
accatgagaggaaatgaaagcc

SEQ ID NO: 869733 - DNA, 22 bp, Artificial Sequence
  chemically synthesized
caccatgagaggaaatgaaagc

SEQ ID NO: 869734 - DNA, 22 bp, Artificial Sequence
  chemically synthesized
tcaccatgagaggaaatgaaag

SEQ ID NO: 869735 - DNA, 22 bp, Artificial Sequence
  chemically synthesized
ttcaccatgagaggaaatgaaa

SEQ ID NO: 869736 - DNA, 22 bp, Artificial Sequence
  chemically synthesized
tctctaggctttcatttcctct

SEQ ID NO: 869737 - DNA, 22 bp, Artificial Sequence
  chemically synthesized
tttttcaccatgagaggaaatg

SEQ ID NO: 869738 - DNA, 22 bp, Artificial Sequence
  chemically synthesized
tctaggctttcatttcctctca

SEQ ID NO: 869739 - DNA, 22 bp, Artificial Sequence
  chemically synthesized
ttatttttcaccatgagaggaa

SEQ ID NO: 869740 - DNA, 22 bp, Artificial Sequence
  chemically synthesized
taggctttcatttcctctcatg

SEQ ID NO: 869741 - DNA, 22 bp, Artificial Sequence
  chemically synthesized
ggctttcatttcctctcatggt

SEQ ID NO: 869742 - DNA, 22 bp, Artificial Sequence
  chemically synthesized
ttattatttttcaccatgagag

SEQ ID NO: 869743 - DNA, 22 bp, Artificial Sequence
  chemically synthesized
tcatttcctctcatggtgaaaa

SEQ ID NO: 869744 - DNA, 22 bp, Artificial Sequence
  chemically synthesized
cattattattatttttcaccat

SEQ ID NO: 869745 - DNA, 22 bp, Artificial Sequence
  chemically synthesized
catttcctctcatggtgaaaaa

SEQ ID NO: 869746 - DNA, 22 bp, Artificial Sequence
  chemically synthesized
atttcctctcatggtgaaaaat

SEQ ID NO: 869747 - DNA, 22 bp, Artificial Sequence
  chemically synthesized
cctctcatggtgaaaaataata

SEQ ID NO: 869748 - DNA, 22 bp, Artificial Sequence
  chemically synthesized
ctctcatggtgaaaaataataa

SEQ ID NO: 869749 - DNA, 22 bp, Artificial Sequence
  chemically synthesized
tcatggtgaaaaataataataa

SEQ ID NO: 869750 - DNA, 22 bp, Artificial Sequence
  chemically synthesized
atggtgaaaaataataataatg

SEQ ID NO: 869751 - DNA, 22 bp, Artificial Sequence
  chemically synthesized
tgaaataggtactacattatta

SEQ ID NO: 869752 - DNA, 22 bp, Artificial Sequence
  chemically synthesized
atgaaataggtactacattatt

SEQ ID NO: 869753 - DNA, 22 bp, Artificial Sequence
  chemically synthesized
cagcagccttatgaaataggta

SEQ ID NO: 869754 - DNA, 22 bp, Artificial Sequence
  chemically synthesized
acagcagccttatgaaataggt

SEQ ID NO: 869755 - DNA, 22 bp, Artificial Sequence
  chemically synthesized
atcttacagcagccttatgaaa

SEQ ID NO: 869756 - DNA, 22 bp, Artificial Sequence
  chemically synthesized
aatcttacagcagccttatgaa

SEQ ID NO: 869757 - DNA, 22 bp, Artificial Sequence
  chemically synthesized
tttaatcttacagcagccttat

SEQ ID NO: 869758 - DNA, 22 bp, Artificial Sequence
  chemically synthesized
tgtttaatcttacagcagcctt

SEQ ID NO: 869759 - DNA, 22 bp, Artificial Sequence
  chemically synthesized
ctgtttaatcttacagcagcct

SEQ ID NO: 869760 - DNA, 22 bp, Artificial Sequence
  chemically synthesized
tctgtttaatcttacagcagcc

SEQ ID NO: 869761 - DNA, 22 bp, Artificial Sequence
  chemically synthesized
ttctgtttaatcttacagcagc

SEQ ID NO: 869762 - DNA, 22 bp, Artificial Sequence
  chemically synthesized
tttcataaggctgctgtaagat

SEQ ID NO: 869763 - DNA, 22 bp, Artificial Sequence
  chemically synthesized
cataaggctgctgtaagattaa

SEQ ID NO: 869764 - DNA, 22 bp, Artificial Sequence
  chemically synthesized
ataaggctgctgtaagattaaa

SEQ ID NO: 869765 - DNA, 22 bp, Artificial Sequence
  chemically synthesized
tgcatttttctgtttaatctta

SEQ ID NO: 869766 - DNA, 22 bp, Artificial Sequence
  chemically synthesized
gtgcatttttctgtttaatctt

SEQ ID NO: 869767 - DNA, 22 bp, Artificial Sequence
  chemically synthesized
tgtgcatttttctgtttaatct

SEQ ID NO: 869768 - DNA, 22 bp, Artificial Sequence
  chemically synthesized
tttgtgcatttttctgtttaat

SEQ ID NO: 869769 - DNA, 22 bp, Artificial Sequence
  chemically synthesized
ctgtaagattaaacagaaaaat

SEQ ID NO: 869770 - DNA, 22 bp, Artificial Sequence
  chemically synthesized
taagattaaacagaaaaatgca

SEQ ID NO: 869771 - DNA, 22 bp, Artificial Sequence
  chemically synthesized
ccaagtattctttgtgcatttt

SEQ ID NO: 869772 - DNA, 22 bp, Artificial Sequence
  chemically synthesized
gccaagtattctttgtgcattt

SEQ ID NO: 869773 - DNA, 22 bp, Artificial Sequence
  chemically synthesized
tgccaagtattctttgtgcatt

SEQ ID NO: 869774 - DNA, 22 bp, Artificial Sequence
  chemically synthesized
aacagaaaaatgcacaaagaat

SEQ ID NO: 869775 - DNA, 22 bp, Artificial Sequence
  chemically synthesized
taccaggcattttgccaagtat

SEQ ID NO: 869776 - DNA, 22 bp, Artificial Sequence
  chemically synthesized
tgtaccaggcattttgccaagt

SEQ ID NO: 869777 - DNA, 22 bp, Artificial Sequence
  chemically synthesized
ctctgtaccaggcattttgcca

SEQ ID NO: 869778 - DNA, 22 bp, Artificial Sequence
  chemically synthesized
gctctgtaccaggcattttgcc

SEQ ID NO: 869779 - DNA, 22 bp, Artificial Sequence
  chemically synthesized
atgccttgctctgtaccaggca

SEQ ID NO: 869780 - DNA, 22 bp, Artificial Sequence
  chemically synthesized
ggcaaaatgcctggtacagagc

SEQ ID NO: 869781 - DNA, 22 bp, Artificial Sequence
  chemically synthesized
gcaaaatgcctggtacagagca

SEQ ID NO: 869782 - DNA, 22 bp, Artificial Sequence
  chemically synthesized
acacgcattaatgccttgctct

SEQ ID NO: 869783 - DNA, 22 bp, Artificial Sequence
  chemically synthesized
gggctaacacgcattaatgcct

SEQ ID NO: 869784 - DNA, 22 bp, Artificial Sequence
  chemically synthesized
agggctaacacgcattaatgcc

SEQ ID NO: 869785 - DNA, 22 bp, Artificial Sequence
  chemically synthesized
gtacagagcaaggcattaatgc

SEQ ID NO: 869786 - DNA, 22 bp, Artificial Sequence
  chemically synthesized
tcttagggctaacacgcattaa

SEQ ID NO: 869787 - DNA, 22 bp, Artificial Sequence
  chemically synthesized
atcttagggctaacacgcatta

SEQ ID NO: 869788 - DNA, 22 bp, Artificial Sequence
  chemically synthesized
atatttatcttagggctaacac

SEQ ID NO: 869789 - DNA, 22 bp, Artificial Sequence
  chemically synthesized
atgcgtgttagccctaagataa

SEQ ID NO: 869790 - DNA, 22 bp, Artificial Sequence
  chemically synthesized
acccgaacatacctaatattta

SEQ ID NO: 869791 - DNA, 22 bp, Artificial Sequence
  chemically synthesized
gccctaagataaatattaggta

SEQ ID NO: 869792 - DNA, 22 bp, Artificial Sequence
  chemically synthesized
cattgacccgaacatacctaat

SEQ ID NO: 869793 - DNA, 22 bp, Artificial Sequence
  chemically synthesized
gcattgacccgaacatacctaa

SEQ ID NO: 869794 - DNA, 22 bp, Artificial Sequence
  chemically synthesized
tgcattgacccgaacataccta

SEQ ID NO: 869795 - DNA, 22 bp, Artificial Sequence
  chemically synthesized
ttgcattgacccgaacatacct

SEQ ID NO: 869796 - DNA, 22 bp, Artificial Sequence
  chemically synthesized
agataaatattaggtatgttcg

SEQ ID NO: 869797 - DNA, 22 bp, Artificial Sequence
  chemically synthesized
gcttttgcattgacccgaacat

SEQ ID NO: 869798 - DNA, 22 bp, Artificial Sequence
  chemically synthesized
cccctagcttttgcattgaccc

SEQ ID NO: 869799 - DNA, 22 bp, Artificial Sequence
  chemically synthesized
ggtatgttcgggtcaatgcaaa

SEQ ID NO: 869800 - DNA, 22 bp, Artificial Sequence
  chemically synthesized
ttccccctagcttttgcattga

SEQ ID NO: 869801 - DNA, 22 bp, Artificial Sequence
  chemically synthesized
gattattccccctagcttttgc

SEQ ID NO: 869802 - DNA, 22 bp, Artificial Sequence
  chemically synthesized
cgattattccccctagcttttg

SEQ ID NO: 869803 - DNA, 22 bp, Artificial Sequence
  chemically synthesized
gggtcaatgcaaaagctagggg

SEQ ID NO: 869804 - DNA, 22 bp, Artificial Sequence
  chemically synthesized
atttcgattattccccctagct

SEQ ID NO: 869805 - DNA, 22 bp, Artificial Sequence
  chemically synthesized
catttcgattattccccctagc

SEQ ID NO: 869806 - DNA, 22 bp, Artificial Sequence
  chemically synthesized
tcatttcgattattccccctag

SEQ ID NO: 869807 - DNA, 22 bp, Artificial Sequence
  chemically synthesized
ctttcatttcgattattccccc

SEQ ID NO: 869808 - DNA, 22 bp, Artificial Sequence
  chemically synthesized
gggggaataatcgaaatgaaag

SEQ ID NO: 869809 - DNA, 22 bp, Artificial Sequence
  chemically synthesized
aaaaataatacctgctttcatt

SEQ ID NO: 869810 - DNA, 22 bp, Artificial Sequence
  chemically synthesized
caaaaataatacctgctttcat

SEQ ID NO: 869811 - DNA, 22 bp, Artificial Sequence
  chemically synthesized
tcaaaaataatacctgctttca

SEQ ID NO: 869812 - DNA, 22 bp, Artificial Sequence
  chemically synthesized
tcatagccattttcaaaaataa

SEQ ID NO: 869813 - DNA, 22 bp, Artificial Sequence
  chemically synthesized
tttttgaaaatggctatgatag

SEQ ID NO: 869814 - DNA, 22 bp, Artificial Sequence
  chemically synthesized
ttgaaaatggctatgataggcc

SEQ ID NO: 869815 - DNA, 22 bp, Artificial Sequence
  chemically synthesized
cagtaatatataggcctatcat

SEQ ID NO: 869816 - DNA, 22 bp, Artificial Sequence
  chemically synthesized
tgaaaatggctatgataggcct

SEQ ID NO: 869817 - DNA, 22 bp, Artificial Sequence
  chemically synthesized
gaaaatggctatgataggccta

SEQ ID NO: 869818 - DNA, 22 bp, Artificial Sequence
  chemically synthesized
aaaatggctatgataggcctat

SEQ ID NO: 869819 - DNA, 22 bp, Artificial Sequence
  chemically synthesized
ttccagtaatatataggcctat

SEQ ID NO: 869820 - DNA, 22 bp, Artificial Sequence
  chemically synthesized
tattccagtaatatataggcct

SEQ ID NO: 869821 - DNA, 22 bp, Artificial Sequence
  chemically synthesized
gttctattccagtaatatatag

SEQ ID NO: 869822 - DNA, 22 bp, Artificial Sequence
  chemically synthesized
ggttctattccagtaatatata

SEQ ID NO: 869823 - DNA, 22 bp, Artificial Sequence
  chemically synthesized
tgataggcctatatattactgg

SEQ ID NO: 869824 - DNA, 22 bp, Artificial Sequence
  chemically synthesized
acagtttggttctattccagta

SEQ ID NO: 869825 - DNA, 22 bp, Artificial Sequence
  chemically synthesized
tatattactggaatagaaccaa

SEQ ID NO: 869826 - DNA, 22 bp, Artificial Sequence
  chemically synthesized
aggtctcacagtttggttctat

SEQ ID NO: 869827 - DNA, 22 bp, Artificial Sequence
  chemically synthesized
taaggtctcacagtttggttct

SEQ ID NO: 869828 - DNA, 22 bp, Artificial Sequence
  chemically synthesized
ctggaatagaaccaaactgtga

SEQ ID NO: 869829 - DNA, 22 bp, Artificial Sequence
  chemically synthesized
gaatagaaccaaactgtgagac

SEQ ID NO: 869830 - DNA, 22 bp, Artificial Sequence
  chemically synthesized
gagggtctctaaggtctcacag

SEQ ID NO: 869831 - DNA, 22 bp, Artificial Sequence
  chemically synthesized
ctggagggtctctaaggtctca

SEQ ID NO: 869832 - DNA, 22 bp, Artificial Sequence
  chemically synthesized
tcctggagggtctctaaggtct

SEQ ID NO: 869833 - DNA, 22 bp, Artificial Sequence
  chemically synthesized
actctcctggagggtctctaag

SEQ ID NO: 869834 - DNA, 22 bp, Artificial Sequence
  chemically synthesized
aactctcctggagggtctctaa

SEQ ID NO: 869835 - DNA, 22 bp, Artificial Sequence
  chemically synthesized
tgagaccttagagaccctccag

SEQ ID NO: 869836 - DNA, 22 bp, Artificial Sequence
  chemically synthesized
atgtttaactctcctggagggt

SEQ ID NO: 869837 - DNA, 22 bp, Artificial Sequence
  chemically synthesized
catgtttaactctcctggaggg

SEQ ID NO: 869838 - DNA, 22 bp, Artificial Sequence
  chemically synthesized
tcacttcatgtttaactctcct

SEQ ID NO: 869839 - DNA, 22 bp, Artificial Sequence
  chemically synthesized
agagaccctccaggagagttaa

SEQ ID NO: 869840 - DNA, 22 bp, Artificial Sequence
  chemically synthesized
gagaccctccaggagagttaaa

SEQ ID NO: 869841 - DNA, 22 bp, Artificial Sequence
  chemically synthesized
caggagagttaaacatgaagtg

SEQ ID NO: 869842 - DNA, 22 bp, Artificial Sequence
  chemically synthesized
aacatgaagtgacaatgttgtt

SEQ ID NO: 869843 - DNA, 22 bp, Artificial Sequence
  chemically synthesized
atgtaaatcaggcaaaacaaca

SEQ ID NO: 869844 - DNA, 22 bp, Artificial Sequence
  chemically synthesized
acaacataagtctgatgtaaat

SEQ ID NO: 869845 - DNA, 22 bp, Artificial Sequence
  chemically synthesized
aacaacataagtctgatgtaaa

SEQ ID NO: 869846 - DNA, 22 bp, Artificial Sequence
  chemically synthesized
taacaacataagtctgatgtaa

SEQ ID NO: 869847 - DNA, 22 bp, Artificial Sequence
  chemically synthesized
ttttgcctgatttacatcagac

SEQ ID NO: 869848 - DNA, 22 bp, Artificial Sequence
  chemically synthesized
tgcctgatttacatcagactta

SEQ ID NO: 869849 - DNA, 22 bp, Artificial Sequence
  chemically synthesized
gcctgatttacatcagacttat

SEQ ID NO: 869850 - DNA, 22 bp, Artificial Sequence
  chemically synthesized
cctgatttacatcagacttatg

SEQ ID NO: 869851 - DNA, 22 bp, Artificial Sequence
  chemically synthesized
atttacatcagacttatgttgt

SEQ ID NO: 869852 - DNA, 22 bp, Artificial Sequence
  chemically synthesized
acatcagacttatgttgttaaa

SEQ ID NO: 869853 - DNA, 22 bp, Artificial Sequence
  chemically synthesized
catcagacttatgttgttaaag

SEQ ID NO: 869854 - DNA, 22 bp, Artificial Sequence
  chemically synthesized
aaaaaaggggtgctttaacaac

SEQ ID NO: 869855 - DNA, 22 bp, Artificial Sequence
  chemically synthesized
atattgaaaaaaggggtgcttt

SEQ ID NO: 869856 - DNA, 22 bp, Artificial Sequence
  chemically synthesized
catattgaaaaaaggggtgctt

SEQ ID NO: 869857 - DNA, 22 bp, Artificial Sequence
  chemically synthesized
atgttgttaaagcacccctttt

SEQ ID NO: 869858 - DNA, 22 bp, Artificial Sequence
  chemically synthesized
tgttgttaaagcaccccttttt

SEQ ID NO: 869859 - DNA, 22 bp, Artificial Sequence
  chemically synthesized
ttaaagcaccccttttttcaat

SEQ ID NO: 869860 - DNA, 22 bp, Artificial Sequence
  chemically synthesized
aagcaccccttttttcaatatg

SEQ ID NO: 869861 - DNA, 22 bp, Artificial Sequence
  chemically synthesized
ggtgaataaatgcttcatattg

SEQ ID NO: 869862 - DNA, 22 bp, Artificial Sequence
  chemically synthesized
tctgggtgaataaatgcttcat

SEQ ID NO: 869863 - DNA, 22 bp, Artificial Sequence
  chemically synthesized
ttttcaatatgaagcatttatt

SEQ ID NO: 869864 - DNA, 22 bp, Artificial Sequence
  chemically synthesized
tttcaatatgaagcatttattc

SEQ ID NO: 869865 - DNA, 22 bp, Artificial Sequence
  chemically synthesized
ttcaatatgaagcatttattca

SEQ ID NO: 869866 - DNA, 22 bp, Artificial Sequence
  chemically synthesized
tcaatatgaagcatttattcac

SEQ ID NO: 869867 - DNA, 22 bp, Artificial Sequence
  chemically synthesized
caatatgaagcatttattcacc

SEQ ID NO: 869868 - DNA, 22 bp, Artificial Sequence
  chemically synthesized
aatatgaagcatttattcaccc

SEQ ID NO: 869869 - DNA, 22 bp, Artificial Sequence
  chemically synthesized
tatccattatctgggtgaataa

SEQ ID NO: 869870 - DNA, 22 bp, Artificial Sequence
  chemically synthesized
gtatccattatctgggtgaata

SEQ ID NO: 869871 - DNA, 22 bp, Artificial Sequence
  chemically synthesized
attcacccagataatggataca

SEQ ID NO: 869872 - DNA, 22 bp, Artificial Sequence
  chemically synthesized
aatgcatggatttgtatccatt

SEQ ID NO: 869873 - DNA, 22 bp, Artificial Sequence
  chemically synthesized
ttcacccagataatggatacaa

SEQ ID NO: 869874 - DNA, 22 bp, Artificial Sequence
  chemically synthesized
gaatgcatggatttgtatccat

SEQ ID NO: 869875 - DNA, 22 bp, Artificial Sequence
  chemically synthesized
acccagataatggatacaaatc

SEQ ID NO: 869876 - DNA, 22 bp, Artificial Sequence
  chemically synthesized
caaggaacatttgaatgcatgg

SEQ ID NO: 869877 - DNA, 22 bp, Artificial Sequence
  chemically synthesized
actccaaggaacatttgaatgc

SEQ ID NO: 869878 - DNA, 22 bp, Artificial Sequence
  chemically synthesized
tgactccaaggaacatttgaat

SEQ ID NO: 869879 - DNA, 22 bp, Artificial Sequence
  chemically synthesized
atctctgactccaaggaacatt

SEQ ID NO: 869880 - DNA, 22 bp, Artificial Sequence
  chemically synthesized
gatctctgactccaaggaacat

SEQ ID NO: 869881 - DNA, 22 bp, Artificial Sequence
  chemically synthesized
catcttgatctctgactccaag

SEQ ID NO: 869882 - DNA, 22 bp, Artificial Sequence
  chemically synthesized
ccatcttgatctctgactccaa

SEQ ID NO: 869883 - DNA, 22 bp, Artificial Sequence
  chemically synthesized
aaatgttccttggagtcagaga

SEQ ID NO: 869884 - DNA, 22 bp, Artificial Sequence
  chemically synthesized
gggatttccatcttgatctctg

SEQ ID NO: 869885 - DNA, 22 bp, Artificial Sequence
  chemically synthesized
tggggatttccatcttgatctc

SEQ ID NO: 869886 - DNA, 22 bp, Artificial Sequence
  chemically synthesized
cttggagtcagagatcaagatg

SEQ ID NO: 869887 - DNA, 22 bp, Artificial Sequence
  chemically synthesized
ggagtcagagatcaagatggaa

SEQ ID NO: 869888 - DNA, 22 bp, Artificial Sequence
  chemically synthesized
gagtcagagatcaagatggaaa

SEQ ID NO: 869889 - DNA, 22 bp, Artificial Sequence
  chemically synthesized
tgattctggggatttccatctt

SEQ ID NO: 869890 - DNA, 22 bp, Artificial Sequence
  chemically synthesized
tatgattctggggatttccatc

SEQ ID NO: 869891 - DNA, 22 bp, Artificial Sequence
  chemically synthesized
cagacgcaaatctctatgattc

SEQ ID NO: 869892 - DNA, 22 bp, Artificial Sequence
  chemically synthesized
acagacgcaaatctctatgatt

SEQ ID NO: 869893 - DNA, 22 bp, Artificial Sequence
  chemically synthesized
aatgtgaatataataagccagt

SEQ ID NO: 869894 - DNA, 22 bp, Artificial Sequence
  chemically synthesized
gaatgtgaatataataagccag

SEQ ID NO: 869895 - DNA, 22 bp, Artificial Sequence
  chemically synthesized
gcgtctgtaaactggcttatta

SEQ ID NO: 869896 - DNA, 22 bp, Artificial Sequence
  chemically synthesized
tgaatgtgaatataataagcca

SEQ ID NO: 869897 - DNA, 22 bp, Artificial Sequence
  chemically synthesized
cgtctgtaaactggcttattat

SEQ ID NO: 869898 - DNA, 22 bp, Artificial Sequence
  chemically synthesized
tttgaatgtgaatataataagc

SEQ ID NO: 869899 - DNA, 22 bp, Artificial Sequence
  chemically synthesized
taaactggcttattatattcac

SEQ ID NO: 869900 - DNA, 22 bp, Artificial Sequence
  chemically synthesized
caacctctttgaatgtgaatat

SEQ ID NO: 869901 - DNA, 22 bp, Artificial Sequence
  chemically synthesized
ccaacctctttgaatgtgaata

SEQ ID NO: 869902 - DNA, 22 bp, Artificial Sequence
  chemically synthesized
gcttattatattcacattcaaa

SEQ ID NO: 869903 - DNA, 22 bp, Artificial Sequence
  chemically synthesized
ccccttccaacctctttgaatg

SEQ ID NO: 869904 - DNA, 22 bp, Artificial Sequence
  chemically synthesized
attatattcacattcaaagagg

SEQ ID NO: 869905 - DNA, 22 bp, Artificial Sequence
  chemically synthesized
ttatattcacattcaaagaggt

SEQ ID NO: 869906 - DNA, 22 bp, Artificial Sequence
  chemically synthesized
tattcacattcaaagaggttgg

SEQ ID NO: 869907 - DNA, 22 bp, Artificial Sequence
  chemically synthesized
acactgccccttccaacctctt

SEQ ID NO: 869908 - DNA, 22 bp, Artificial Sequence
  chemically synthesized
acattcaaagaggttggaaggg

SEQ ID NO: 869909 - DNA, 22 bp, Artificial Sequence
  chemically synthesized
aaaagctgacactgccccttcc

SEQ ID NO: 869910 - DNA, 22 bp, Artificial Sequence
  chemically synthesized
aaagaggttggaaggggcagtg

SEQ ID NO: 869911 - DNA, 22 bp, Artificial Sequence
  chemically synthesized
gttaaaaagctgacactgcccc

SEQ ID NO: 869912 - DNA, 22 bp, Artificial Sequence
  chemically synthesized
tagttaaaaagctgacactgcc

SEQ ID NO: 869913 - DNA, 22 bp, Artificial Sequence
  chemically synthesized
gaaggggcagtgtcagcttttt

SEQ ID NO: 869914 - DNA, 22 bp, Artificial Sequence
  chemically synthesized
tttaactagaatcttttcatta

SEQ ID NO: 869915 - DNA, 22 bp, Artificial Sequence
  chemically synthesized
ttaactagaatcttttcattac

SEQ ID NO: 869916 - DNA, 22 bp, Artificial Sequence
  chemically synthesized
taactagaatcttttcattact

SEQ ID NO: 869917 - DNA, 22 bp, Artificial Sequence
  chemically synthesized
aactagaatcttttcattactt

SEQ ID NO: 869918 - DNA, 22 bp, Artificial Sequence
  chemically synthesized
actagaatcttttcattacttc

SEQ ID NO: 869919 - DNA, 22 bp, Artificial Sequence
  chemically synthesized
caaccccaacagggagaagtaa

SEQ ID NO: 869920 - DNA, 22 bp, Artificial Sequence
  chemically synthesized
gaatcttttcattacttctccc

SEQ ID NO: 869921 - DNA, 22 bp, Artificial Sequence
  chemically synthesized
ttcattacttctccctgttggg

SEQ ID NO: 869922 - DNA, 22 bp, Artificial Sequence
  chemically synthesized
tcattacttctccctgttgggg

SEQ ID NO: 869923 - DNA, 22 bp, Artificial Sequence
  chemically synthesized
cattacttctccctgttggggt

SEQ ID NO: 869924 - DNA, 22 bp, Artificial Sequence
  chemically synthesized
attacttctccctgttggggtt

SEQ ID NO: 869925 - DNA, 22 bp, Artificial Sequence
  chemically synthesized
acagcatgtgttgcaaccccaa

SEQ ID NO: 869926 - DNA, 22 bp, Artificial Sequence
  chemically synthesized
cttctccctgttggggttgcaa

SEQ ID NO: 869927 - DNA, 22 bp, Artificial Sequence
  chemically synthesized
ctccctgttggggttgcaacac

SEQ ID NO: 869928 - DNA, 22 bp, Artificial Sequence
  chemically synthesized
tccctgttggggttgcaacaca

SEQ ID NO: 869929 - DNA, 22 bp, Artificial Sequence
  chemically synthesized
cctgttggggttgcaacacatg

SEQ ID NO: 869930 - DNA, 22 bp, Artificial Sequence
  chemically synthesized
gaggtcactcacagcatgtgtt

SEQ ID NO: 869931 - DNA, 22 bp, Artificial Sequence
  chemically synthesized
ttggggttgcaacacatgctgt

SEQ ID NO: 869932 - DNA, 22 bp, Artificial Sequence
  chemically synthesized
tggaggtcactcacagcatgtg

SEQ ID NO: 869933 - DNA, 22 bp, Artificial Sequence
  chemically synthesized
gggttgcaacacatgctgtgag

SEQ ID NO: 869934 - DNA, 22 bp, Artificial Sequence
  chemically synthesized
caacacatgctgtgagtgacct

SEQ ID NO: 869935 - DNA, 22 bp, Artificial Sequence
  chemically synthesized
aggaatctctggaggtcactca

SEQ ID NO: 869936 - DNA, 22 bp, Artificial Sequence
  chemically synthesized
gaggaatctctggaggtcactc

SEQ ID NO: 869937 - DNA, 22 bp, Artificial Sequence
  chemically synthesized
catacagcttgaggaatctctg

SEQ ID NO: 869938 - DNA, 22 bp, Artificial Sequence
  chemically synthesized
tgagtgacctccagagattcct

SEQ ID NO: 869939 - DNA, 22 bp, Artificial Sequence
  chemically synthesized
cctgcatacagcttgaggaatc

SEQ ID NO: 869940 - DNA, 22 bp, Artificial Sequence
  chemically synthesized
ctgcctgcatacagcttgagga

SEQ ID NO: 869941 - DNA, 22 bp, Artificial Sequence
  chemically synthesized
gctgcctgcatacagcttgagg

SEQ ID NO: 869942 - DNA, 22 bp, Artificial Sequence
  chemically synthesized
cagagattcctcaagctgtatg

SEQ ID NO: 869943 - DNA, 22 bp, Artificial Sequence
  chemically synthesized
aatttgctgcctgcatacagct

SEQ ID NO: 869944 - DNA, 22 bp, Artificial Sequence
  chemically synthesized
agattcaatttgctgcctgcat

SEQ ID NO: 869945 - DNA, 22 bp, Artificial Sequence
  chemically synthesized
cagattcaatttgctgcctgca

SEQ ID NO: 869946 - DNA, 22 bp, Artificial Sequence
  chemically synthesized
ctcaagctgtatgcaggcagca

SEQ ID NO: 869947 - DNA, 22 bp, Artificial Sequence
  chemically synthesized
tcagattcaatttgctgcctgc

SEQ ID NO: 869948 - DNA, 22 bp, Artificial Sequence
  chemically synthesized
aagctgtatgcaggcagcaaat

SEQ ID NO: 869949 - DNA, 22 bp, Artificial Sequence
  chemically synthesized
tatgcaggcagcaaattgaatc

SEQ ID NO: 869950 - DNA, 22 bp, Artificial Sequence
  chemically synthesized
ataaagctttcagattcaattt

SEQ ID NO: 869951 - DNA, 22 bp, Artificial Sequence
  chemically synthesized
tctaataaagctttcagattca

SEQ ID NO: 869952 - DNA, 22 bp, Artificial Sequence
  chemically synthesized
gtctaataaagctttcagattc

SEQ ID NO: 869953 - DNA, 22 bp, Artificial Sequence
  chemically synthesized
aatctgaaagctttattagaca

SEQ ID NO: 869954 - DNA, 22 bp, Artificial Sequence
  chemically synthesized
aaagacaagaaaaacttgtcta

SEQ ID NO: 869955 - DNA, 22 bp, Artificial Sequence
  chemically synthesized
aaagctttattagacaagtttt

SEQ ID NO: 869956 - DNA, 22 bp, Artificial Sequence
  chemically synthesized
tattagacaagtttttcttgtc

SEQ ID NO: 869957 - DNA, 22 bp, Artificial Sequence
  chemically synthesized
attagacaagtttttcttgtct

SEQ ID NO: 869958 - DNA, 22 bp, Artificial Sequence
  chemically synthesized
ccaccagctgaaagacaagaaa

SEQ ID NO: 869959 - DNA, 22 bp, Artificial Sequence
  chemically synthesized
ttagacaagtttttcttgtctt

SEQ ID NO: 869960 - DNA, 22 bp, Artificial Sequence
  chemically synthesized
gacaagtttttcttgtctttca

SEQ ID NO: 869961 - DNA, 22 bp, Artificial Sequence
  chemically synthesized
acatccactcccaccagctgaa

SEQ ID NO: 869962 - DNA, 22 bp, Artificial Sequence
  chemically synthesized
ttcttgtctttcagctggtggg

SEQ ID NO: 869963 - DNA, 22 bp, Artificial Sequence
  chemically synthesized
tcttgtctttcagctggtggga

SEQ ID NO: 869964 - DNA, 22 bp, Artificial Sequence
  chemically synthesized
cttgtctttcagctggtgggag

SEQ ID NO: 869965 - DNA, 22 bp, Artificial Sequence
  chemically synthesized
ttgtctttcagctggtgggagt

SEQ ID NO: 869966 - DNA, 22 bp, Artificial Sequence
  chemically synthesized
gtctttcagctggtgggagtgg

SEQ ID NO: 869967 - DNA, 22 bp, Artificial Sequence
  chemically synthesized
tctttcagctggtgggagtgga

SEQ ID NO: 869968 - DNA, 22 bp, Artificial Sequence
  chemically synthesized
caatacaactgacatccactcc

SEQ ID NO: 869969 - DNA, 22 bp, Artificial Sequence
  chemically synthesized
ccaatacaactgacatccactc

SEQ ID NO: 869970 - DNA, 22 bp, Artificial Sequence
  chemically synthesized
tcagctggtgggagtggatgtc

SEQ ID NO: 869971 - DNA, 22 bp, Artificial Sequence
  chemically synthesized
tccaatacaactgacatccact

SEQ ID NO: 869972 - DNA, 22 bp, Artificial Sequence
  chemically synthesized
cagctggtgggagtggatgtca

SEQ ID NO: 869973 - DNA, 22 bp, Artificial Sequence
  chemically synthesized
ttccaatacaactgacatccac

SEQ ID NO: 869974 - DNA, 22 bp, Artificial Sequence
  chemically synthesized
agctggtgggagtggatgtcag

SEQ ID NO: 869975 - DNA, 22 bp, Artificial Sequence
  chemically synthesized
tttccaatacaactgacatcca

SEQ ID NO: 869976 - DNA, 22 bp, Artificial Sequence
  chemically synthesized
ttttttccaatacaactgacat

SEQ ID NO: 869977 - DNA, 22 bp, Artificial Sequence
  chemically synthesized
attttttccaatacaactgaca

SEQ ID NO: 869978 - DNA, 22 bp, Artificial Sequence
  chemically synthesized
gtgggagtggatgtcagttgta

SEQ ID NO: 869979 - DNA, 22 bp, Artificial Sequence
  chemically synthesized
tattttttccaatacaactgac

SEQ ID NO: 869980 - DNA, 22 bp, Artificial Sequence
  chemically synthesized
acaagaagttttattttttcca

SEQ ID NO: 869981 - DNA, 22 bp, Artificial Sequence
  chemically synthesized
cacaagaagttttattttttcc

SEQ ID NO: 869982 - DNA, 22 bp, Artificial Sequence
  chemically synthesized
tattggaaaaaataaaacttct

SEQ ID NO: 869983 - DNA, 22 bp, Artificial Sequence
  chemically synthesized
gaaaaaataaaacttcttgtga

SEQ ID NO: 869984 - DNA, 22 bp, Artificial Sequence
  chemically synthesized
aaggtcaggacccagtttcaca

SEQ ID NO: 869985 - DNA, 22 bp, Artificial Sequence
  chemically synthesized
caaggtcaggacccagtttcac

SEQ ID NO: 869986 - DNA, 22 bp, Artificial Sequence
  chemically synthesized
tcaaggtcaggacccagtttca

SEQ ID NO: 869987 - DNA, 22 bp, Artificial Sequence
  chemically synthesized
ttcaaggtcaggacccagtttc

SEQ ID NO: 869988 - DNA, 22 bp, Artificial Sequence
  chemically synthesized
tttcaaggtcaggacccagttt

SEQ ID NO: 869989 - DNA, 22 bp, Artificial Sequence
  chemically synthesized
ttttcaaggtcaggacccagtt

SEQ ID NO: 869990 - DNA, 22 bp, Artificial Sequence
  chemically synthesized
tttttcaaggtcaggacccagt

SEQ ID NO: 869991 - DNA, 22 bp, Artificial Sequence
  chemically synthesized
ttttttcaaggtcaggacccag

SEQ ID NO: 869992 - DNA, 22 bp, Artificial Sequence
  chemically synthesized
cttgtgaaactgggtcctgacc

SEQ ID NO: 869993 - DNA, 22 bp, Artificial Sequence
  chemically synthesized
ttgtgaaactgggtcctgacct

SEQ ID NO: 869994 - DNA, 22 bp, Artificial Sequence
  chemically synthesized
agcttttttttcaaggtcagga

SEQ ID NO: 869995 - DNA, 22 bp, Artificial Sequence
  chemically synthesized
gtgaaactgggtcctgaccttg

SEQ ID NO: 869996 - DNA, 22 bp, Artificial Sequence
  chemically synthesized
gagcttttttttcaaggtcagg

SEQ ID NO: 869997 - DNA, 22 bp, Artificial Sequence
  chemically synthesized
tgaaactgggtcctgaccttga

SEQ ID NO: 869998 - DNA, 22 bp, Artificial Sequence
  chemically synthesized
gatttgagcttttttttcaagg

SEQ ID NO: 869999 - DNA, 22 bp, Artificial Sequence
  chemically synthesized
cgatttgagcttttttttcaag

SEQ ID NO: 870000 - DNA, 22 bp, Artificial Sequence
  chemically synthesized
ggtcctgaccttgaaaaaaaag

SEQ ID NO: 870001 - DNA, 22 bp, Artificial Sequence
  chemically synthesized
tacacttcgatttgagcttttt

SEQ ID NO: 870002 - DNA, 22 bp, Artificial Sequence
  chemically synthesized
accttgaaaaaaaagctcaaat

SEQ ID NO: 870003 - DNA, 22 bp, Artificial Sequence
  chemically synthesized
aattgtacacttcgatttgagc

SEQ ID NO: 870004 - DNA, 22 bp, Artificial Sequence
  chemically synthesized
gaaaaaaaagctcaaatcgaag

SEQ ID NO: 870005 - DNA, 22 bp, Artificial Sequence
  chemically synthesized
aaaaaaaagctcaaatcgaagt

SEQ ID NO: 870006 - DNA, 22 bp, Artificial Sequence
  chemically synthesized
aggattgaattgtacacttcga

SEQ ID NO: 870007 - DNA, 22 bp, Artificial Sequence
  chemically synthesized
aaatcgaagtgtacaattcaat

SEQ ID NO: 870008 - DNA, 22 bp, Artificial Sequence
  chemically synthesized
acaaataagcacataactcagg

SEQ ID NO: 870009 - DNA, 22 bp, Artificial Sequence
  chemically synthesized
aacaaataagcacataactcag

SEQ ID NO: 870010 - DNA, 22 bp, Artificial Sequence
  chemically synthesized
tttaacaaataagcacataact

SEQ ID NO: 870011 - DNA, 22 bp, Artificial Sequence
  chemically synthesized
aatcctgagttatgtgcttatt

SEQ ID NO: 870012 - DNA, 22 bp, Artificial Sequence
  chemically synthesized
cacactgtttaacaaataagca

SEQ ID NO: 870013 - DNA, 22 bp, Artificial Sequence
  chemically synthesized
agttatgtgcttatttgttaaa

SEQ ID NO: 870014 - DNA, 22 bp, Artificial Sequence
  chemically synthesized
aacctgcacactgtttaacaaa

SEQ ID NO: 870015 - DNA, 22 bp, Artificial Sequence
  chemically synthesized
gaacctgcacactgtttaacaa

SEQ ID NO: 870016 - DNA, 22 bp, Artificial Sequence
  chemically synthesized
tgaacctgcacactgtttaaca

SEQ ID NO: 870017 - DNA, 22 bp, Artificial Sequence
  chemically synthesized
tgtgcttatttgttaaacagtg

SEQ ID NO: 870018 - DNA, 22 bp, Artificial Sequence
  chemically synthesized
ctttgaacctgcacactgttta

SEQ ID NO: 870019 - DNA, 22 bp, Artificial Sequence
  chemically synthesized
cctttgaacctgcacactgttt

SEQ ID NO: 870020 - DNA, 22 bp, Artificial Sequence
  chemically synthesized
tcctttgaacctgcacactgtt

SEQ ID NO: 870021 - DNA, 22 bp, Artificial Sequence
  chemically synthesized
ttcctttgaacctgcacactgt

SEQ ID NO: 870022 - DNA, 22 bp, Artificial Sequence
  chemically synthesized
atttgttaaacagtgtgcaggt

SEQ ID NO: 870023 - DNA, 22 bp, Artificial Sequence
  chemically synthesized
tttgttaaacagtgtgcaggtt

SEQ ID NO: 870024 - DNA, 22 bp, Artificial Sequence
  chemically synthesized
gttaaacagtgtgcaggttcaa

SEQ ID NO: 870025 - DNA, 22 bp, Artificial Sequence
  chemically synthesized
ttaaacagtgtgcaggttcaaa

SEQ ID NO: 870026 - DNA, 22 bp, Artificial Sequence
  chemically synthesized
aacagtgtgcaggttcaaagga

SEQ ID NO: 870027 - DNA, 22 bp, Artificial Sequence
  chemically synthesized
aggtaaaatatgcccttttcct

SEQ ID NO: 870028 - DNA, 22 bp, Artificial Sequence
  chemically synthesized
aaggtaaaatatgcccttttcc

SEQ ID NO: 870029 - DNA, 22 bp, Artificial Sequence
  chemically synthesized
taaggtaaaatatgcccttttc

SEQ ID NO: 870030 - DNA, 22 bp, Artificial Sequence
  chemically synthesized
tttaaggtaaaatatgcccttt

SEQ ID NO: 870031 - DNA, 22 bp, Artificial Sequence
  chemically synthesized
ctttaaggtaaaatatgccctt

SEQ ID NO: 870032 - DNA, 22 bp, Artificial Sequence
  chemically synthesized
tttctttaaggtaaaatatgcc

SEQ ID NO: 870033 - DNA, 22 bp, Artificial Sequence
  chemically synthesized
atttctttaaggtaaaatatgc

SEQ ID NO: 870034 - DNA, 22 bp, Artificial Sequence
  chemically synthesized
aaaggaaaagggcatattttac

SEQ ID NO: 870035 - DNA, 22 bp, Artificial Sequence
  chemically synthesized
ttatttctttaaggtaaaatat

SEQ ID NO: 870036 - DNA, 22 bp, Artificial Sequence
  chemically synthesized
attcttatttctttaaggtaaa

SEQ ID NO: 870037 - DNA, 22 bp, Artificial Sequence
  chemically synthesized
ttgattcttatttctttaaggt

SEQ ID NO: 870038 - DNA, 22 bp, Artificial Sequence
  chemically synthesized
ttgttgattcttatttctttaa

SEQ ID NO: 870039 - DNA, 22 bp, Artificial Sequence
  chemically synthesized
attgttgattcttatttcttta

SEQ ID NO: 870040 - DNA, 22 bp, Artificial Sequence
  chemically synthesized
tattgttgattcttatttcttt

SEQ ID NO: 870041 - DNA, 22 bp, Artificial Sequence
  chemically synthesized
ttattgttgattcttatttctt

SEQ ID NO: 870042 - DNA, 22 bp, Artificial Sequence
  chemically synthesized
tttttattgttgattcttattt

SEQ ID NO: 870043 - DNA, 22 bp, Artificial Sequence
  chemically synthesized
taccttaaagaaataagaatca

SEQ ID NO: 870044 - DNA, 22 bp, Artificial Sequence
  chemically synthesized
accttaaagaaataagaatcaa

SEQ ID NO: 870045 - DNA, 22 bp, Artificial Sequence
  chemically synthesized
ttatttttattgttgattctta

SEQ ID NO: 870046 - DNA, 22 bp, Artificial Sequence
  chemically synthesized
ccttaaagaaataagaatcaac

SEQ ID NO: 870047 - DNA, 22 bp, Artificial Sequence
  chemically synthesized
ctattatttttattgttgattc

SEQ ID NO: 870048 - DNA, 22 bp, Artificial Sequence
  chemically synthesized
aaagaaataagaatcaacaata

SEQ ID NO: 870049 - DNA, 22 bp, Artificial Sequence
  chemically synthesized
aagaaataagaatcaacaataa

SEQ ID NO: 870050 - DNA, 22 bp, Artificial Sequence
  chemically synthesized
agcatgatcaaaacagaactcc

SEQ ID NO: 870051 - DNA, 22 bp, Artificial Sequence
  chemically synthesized
agttcagcatgatcaaaacaga

SEQ ID NO: 870052 - DNA, 22 bp, Artificial Sequence
  chemically synthesized
ctaagttcagcatgatcaaaac

SEQ ID NO: 870053 - DNA, 22 bp, Artificial Sequence
  chemically synthesized
actaagttcagcatgatcaaaa

SEQ ID NO: 870054 - DNA, 22 bp, Artificial Sequence
  chemically synthesized
cttactaagttcagcatgatca

SEQ ID NO: 870055 - DNA, 22 bp, Artificial Sequence
  chemically synthesized
gcttactaagttcagcatgatc

SEQ ID NO: 870056 - DNA, 22 bp, Artificial Sequence
  chemically synthesized
tgcttactaagttcagcatgat

SEQ ID NO: 870057 - DNA, 22 bp, Artificial Sequence
  chemically synthesized
ttgcttactaagttcagcatga

SEQ ID NO: 870058 - DNA, 22 bp, Artificial Sequence
  chemically synthesized
tgttttgatcatgctgaactta

SEQ ID NO: 870059 - DNA, 22 bp, Artificial Sequence
  chemically synthesized
ttttgatcatgctgaacttagt

SEQ ID NO: 870060 - DNA, 22 bp, Artificial Sequence
  chemically synthesized
tgatcatgctgaacttagtaag

SEQ ID NO: 870061 - DNA, 22 bp, Artificial Sequence
  chemically synthesized
gatcatgctgaacttagtaagc

SEQ ID NO: 870062 - DNA, 22 bp, Artificial Sequence
  chemically synthesized
atcatgctgaacttagtaagca

SEQ ID NO: 870063 - DNA, 22 bp, Artificial Sequence
  chemically synthesized
gtgataggcacttttgcttact

SEQ ID NO: 870064 - DNA, 22 bp, Artificial Sequence
  chemically synthesized
ggtgataggcacttttgcttac

SEQ ID NO: 870065 - DNA, 22 bp, Artificial Sequence
  chemically synthesized
aacttagtaagcaaaagtgcct

SEQ ID NO: 870066 - DNA, 22 bp, Artificial Sequence
  chemically synthesized
tgtgatttggtgataggcactt

SEQ ID NO: 870067 - DNA, 22 bp, Artificial Sequence
  chemically synthesized
agtaagcaaaagtgcctatcac

SEQ ID NO: 870068 - DNA, 22 bp, Artificial Sequence
  chemically synthesized
gtaagcaaaagtgcctatcacc

SEQ ID NO: 870069 - DNA, 22 bp, Artificial Sequence
  chemically synthesized
ataactatgtgatttggtgata

SEQ ID NO: 870070 - DNA, 22 bp, Artificial Sequence
  chemically synthesized
cataactatgtgatttggtgat

SEQ ID NO: 870071 - DNA, 22 bp, Artificial Sequence
  chemically synthesized
tcataactatgtgatttggtga

SEQ ID NO: 870072 - DNA, 22 bp, Artificial Sequence
  chemically synthesized
ttcataactatgtgatttggtg

SEQ ID NO: 870073 - DNA, 22 bp, Artificial Sequence
  chemically synthesized
gcatacttttcataactatgtg

SEQ ID NO: 870074 - DNA, 22 bp, Artificial Sequence
  chemically synthesized
tcaccaaatcacatagttatga

SEQ ID NO: 870075 - DNA, 22 bp, Artificial Sequence
  chemically synthesized
ttagcatacttttcataactat

SEQ ID NO: 870076 - DNA, 22 bp, Artificial Sequence
  chemically synthesized
gattattagcatacttttcata

SEQ ID NO: 870077 - DNA, 22 bp, Artificial Sequence
  chemically synthesized
cgattattagcatacttttcat

SEQ ID NO: 870078 - DNA, 22 bp, Artificial Sequence
  chemically synthesized
ttcgattattagcatacttttc

SEQ ID NO: 870079 - DNA, 22 bp, Artificial Sequence
  chemically synthesized
cttcgattattagcatactttt

SEQ ID NO: 870080 - DNA, 22 bp, Artificial Sequence
  chemically synthesized
tttcttcgattattagcatact

SEQ ID NO: 870081 - DNA, 22 bp, Artificial Sequence
  chemically synthesized
tgaaaagtatgctaataatcga

SEQ ID NO: 870082 - DNA, 22 bp, Artificial Sequence
  chemically synthesized
aagtgaatgggaattgtttctt

SEQ ID NO: 870083 - DNA, 22 bp, Artificial Sequence
  chemically synthesized
ataatcgaagaaacaattccca

SEQ ID NO: 870084 - DNA, 22 bp, Artificial Sequence
  chemically synthesized
tcatactgaagtgaatgggaat

SEQ ID NO: 870085 - DNA, 22 bp, Artificial Sequence
  chemically synthesized
gtcatactgaagtgaatgggaa

SEQ ID NO: 870086 - DNA, 22 bp, Artificial Sequence
  chemically synthesized
ttgtcatactgaagtgaatggg

SEQ ID NO: 870087 - DNA, 22 bp, Artificial Sequence
  chemically synthesized
cttgtcatactgaagtgaatgg

SEQ ID NO: 870088 - DNA, 22 bp, Artificial Sequence
  chemically synthesized
tcttgtcatactgaagtgaatg

SEQ ID NO: 870089 - DNA, 22 bp, Artificial Sequence
  chemically synthesized
taatagttttcttgtcatactg

SEQ ID NO: 870090 - DNA, 22 bp, Artificial Sequence
  chemically synthesized
ccattcacttcagtatgacaag

SEQ ID NO: 870091 - DNA, 22 bp, Artificial Sequence
  chemically synthesized
tggattataatagttttcttgt

SEQ ID NO: 870092 - DNA, 22 bp, Artificial Sequence
  chemically synthesized
acttcagtatgacaagaaaact

SEQ ID NO: 870093 - DNA, 22 bp, Artificial Sequence
  chemically synthesized
attatggattataatagttttc

SEQ ID NO: 870094 - DNA, 22 bp, Artificial Sequence
  chemically synthesized
cagtatgacaagaaaactatta

SEQ ID NO: 870095 - DNA, 22 bp, Artificial Sequence
  chemically synthesized
agtatgacaagaaaactattat

SEQ ID NO: 870096 - DNA, 22 bp, Artificial Sequence
  chemically synthesized
taatgttcattatggattataa

SEQ ID NO: 870097 - DNA, 22 bp, Artificial Sequence
  chemically synthesized
tataatgttcattatggattat

SEQ ID NO: 870098 - DNA, 22 bp, Artificial Sequence
  chemically synthesized
ttataatccataatgaacatta

SEQ ID NO: 870099 - DNA, 22 bp, Artificial Sequence
  chemically synthesized
taatccataatgaacattatag

SEQ ID NO: 870100 - DNA, 22 bp, Artificial Sequence
  chemically synthesized
tagaacatttatttatattgtg

SEQ ID NO: 870101 - DNA, 22 bp, Artificial Sequence
  chemically synthesized
aaagaaatgtatgaatacacaa

SEQ ID NO: 870102 - DNA, 22 bp, Artificial Sequence
  chemically synthesized
tcaaagaaatgtatgaatacac

SEQ ID NO: 870103 - DNA, 22 bp, Artificial Sequence
  chemically synthesized
atttatattgtgtattcataca

SEQ ID NO: 870104 - DNA, 22 bp, Artificial Sequence
  chemically synthesized
ttctcaaagaaatgtatgaata

SEQ ID NO: 870105 - DNA, 22 bp, Artificial Sequence
  chemically synthesized
tttatattgtgtattcatacat

SEQ ID NO: 870106 - DNA, 22 bp, Artificial Sequence
  chemically synthesized
attctcaaagaaatgtatgaat

SEQ ID NO: 870107 - DNA, 22 bp, Artificial Sequence
  chemically synthesized
tattctcaaagaaatgtatgaa

SEQ ID NO: 870108 - DNA, 22 bp, Artificial Sequence
  chemically synthesized
atattgtgtattcatacatttc

SEQ ID NO: 870109 - DNA, 22 bp, Artificial Sequence
  chemically synthesized
tttattctcaaagaaatgtatg

SEQ ID NO: 870110 - DNA, 22 bp, Artificial Sequence
  chemically synthesized
tattgtgtattcatacatttct

SEQ ID NO: 870111 - DNA, 22 bp, Artificial Sequence
  chemically synthesized
ctttattctcaaagaaatgtat

SEQ ID NO: 870112 - DNA, 22 bp, Artificial Sequence
  chemically synthesized
ttctttattctcaaagaaatgt

SEQ ID NO: 870113 - DNA, 22 bp, Artificial Sequence
  chemically synthesized
tgtattcatacatttctttgag

SEQ ID NO: 870114 - DNA, 22 bp, Artificial Sequence
  chemically synthesized
ccaggactcttctttattctca

SEQ ID NO: 870115 - DNA, 22 bp, Artificial Sequence
  chemically synthesized
atacatttctttgagaataaag

SEQ ID NO: 870116 - DNA, 22 bp, Artificial Sequence
  chemically synthesized
cccaggactcttctttattctc

SEQ ID NO: 870117 - DNA, 22 bp, Artificial Sequence
  chemically synthesized
tcccaggactcttctttattct

SEQ ID NO: 870118 - DNA, 22 bp, Artificial Sequence
  chemically synthesized
attttcccaggactcttcttta

SEQ ID NO: 870119 - DNA, 22 bp, Artificial Sequence
  chemically synthesized
cattttcccaggactcttcttt

SEQ ID NO: 870120 - DNA, 22 bp, Artificial Sequence
  chemically synthesized
ctttgagaataaagaagagtcc

SEQ ID NO: 870121 - DNA, 22 bp, Artificial Sequence
  chemically synthesized
tttgagaataaagaagagtcct

SEQ ID NO: 870122 - DNA, 22 bp, Artificial Sequence
  chemically synthesized
tgagaataaagaagagtcctgg

SEQ ID NO: 870123 - DNA, 22 bp, Artificial Sequence
  chemically synthesized
gagaataaagaagagtcctggg

SEQ ID NO: 870124 - DNA, 22 bp, Artificial Sequence
  chemically synthesized
agaataaagaagagtcctggga

SEQ ID NO: 870125 - DNA, 22 bp, Artificial Sequence
  chemically synthesized
caatgtcccttcattttcccag

SEQ ID NO: 870126 - DNA, 22 bp, Artificial Sequence
  chemically synthesized
gccaatctccaatgtcccttca

SEQ ID NO: 870127 - DNA, 22 bp, Artificial Sequence
  chemically synthesized
ggaaaatgaagggacattggag

SEQ ID NO: 870128 - DNA, 22 bp, Artificial Sequence
  chemically synthesized
aaataaaacaaactagccaatc

SEQ ID NO: 870129 - DNA, 22 bp, Artificial Sequence
  chemically synthesized
gagattggctagtttgttttat

SEQ ID NO: 870130 - DNA, 22 bp, Artificial Sequence
  chemically synthesized
gctagtttgttttatttcaata

SEQ ID NO: 870131 - DNA, 22 bp, Artificial Sequence
  chemically synthesized
gtttgttttatttcaatattgt

SEQ ID NO: 870132 - DNA, 22 bp, Artificial Sequence
  chemically synthesized
gttttatttcaatattgtctct

SEQ ID NO: 870133 - DNA, 22 bp, Artificial Sequence
  chemically synthesized
tatgtatatatgagagacaata

SEQ ID NO: 870134 - DNA, 22 bp, Artificial Sequence
  chemically synthesized
ttttatttcaatattgtctctc

SEQ ID NO: 870135 - DNA, 22 bp, Artificial Sequence
  chemically synthesized
atatgtatatatgagagacaat

SEQ ID NO: 870136 - DNA, 22 bp, Artificial Sequence
  chemically synthesized
tatatgtatatatgagagacaa

SEQ ID NO: 870137 - DNA, 22 bp, Artificial Sequence
  chemically synthesized
tatttcaatattgtctctcata

SEQ ID NO: 870138 - DNA, 22 bp, Artificial Sequence
  chemically synthesized
atttcaatattgtctctcatat

SEQ ID NO: 870139 - DNA, 22 bp, Artificial Sequence
  chemically synthesized
tttcaatattgtctctcatata

SEQ ID NO: 870140 - DNA, 22 bp, Artificial Sequence
  chemically synthesized
caatattgtctctcatatatac

SEQ ID NO: 870141 - DNA, 22 bp, Artificial Sequence
  chemically synthesized
aatattgtctctcatatataca

SEQ ID NO: 870142 - DNA, 22 bp, Artificial Sequence
  chemically synthesized
tctctcatatatacatataaaa

SEQ ID NO: 870143 - DNA, 22 bp, Artificial Sequence
  chemically synthesized
tcatatatacatataaaatctc

SEQ ID NO: 870144 - DNA, 22 bp, Artificial Sequence
  chemically synthesized
atatatatataagagattttat

SEQ ID NO: 870145 - DNA, 22 bp, Artificial Sequence
  chemically synthesized
atatatacatataaaatctctt

SEQ ID NO: 870146 - DNA, 22 bp, Artificial Sequence
  chemically synthesized
tatataaactcatatatatata

SEQ ID NO: 870147 - DNA, 22 bp, Artificial Sequence
  chemically synthesized
atatataaactcatatatatat

SEQ ID NO: 870148 - DNA, 22 bp, Artificial Sequence
  chemically synthesized
ttatatatatatgagtttatat

SEQ ID NO: 870149 - DNA, 22 bp, Artificial Sequence
  chemically synthesized
atatatatttatatataaactc

SEQ ID NO: 870150 - DNA, 22 bp, Artificial Sequence
  chemically synthesized
atatatatatgagtttatatat

SEQ ID NO: 870151 - DNA, 22 bp, Artificial Sequence
  chemically synthesized
tatatatatgagtttatatata

SEQ ID NO: 870152 - DNA, 22 bp, Artificial Sequence
  chemically synthesized
tatataaactcatatatattta

SEQ ID NO: 870153 - DNA, 22 bp, Artificial Sequence
  chemically synthesized
atatataaactcatatatattt

SEQ ID NO: 870154 - DNA, 22 bp, Artificial Sequence
  chemically synthesized
atatataaatatatatgagttt

SEQ ID NO: 870155 - DNA, 22 bp, Artificial Sequence
  chemically synthesized
tatataaatatatatgagttta

SEQ ID NO: 870156 - DNA, 22 bp, Artificial Sequence
  chemically synthesized
atatatatttatatataaactc

SEQ ID NO: 870157 - DNA, 22 bp, Artificial Sequence
  chemically synthesized
atatatatataaactcatatat

SEQ ID NO: 870158 - DNA, 22 bp, Artificial Sequence
  chemically synthesized
atatataaatatatatgagttt

SEQ ID NO: 870159 - DNA, 22 bp, Artificial Sequence
  chemically synthesized
tatataaatatatatgagttta

SEQ ID NO: 870160 - DNA, 22 bp, Artificial Sequence
  chemically synthesized
tatataaactcatatatatata

SEQ ID NO: 870161 - DNA, 22 bp, Artificial Sequence
  chemically synthesized
atatataaactcatatatatat

SEQ ID NO: 870162 - DNA, 22 bp, Artificial Sequence
  chemically synthesized
atatatatttatatataaactc

SEQ ID NO: 870163 - DNA, 22 bp, Artificial Sequence
  chemically synthesized
atatatatatgagtttatatat

SEQ ID NO: 870164 - DNA, 22 bp, Artificial Sequence
  chemically synthesized
tatatatatgagtttatatata

SEQ ID NO: 870165 - DNA, 22 bp, Artificial Sequence
  chemically synthesized
tatatataaactcatatatatt

SEQ ID NO: 870166 - DNA, 22 bp, Artificial Sequence
  chemically synthesized
atatataaatatatatgagttt

SEQ ID NO: 870167 - DNA, 22 bp, Artificial Sequence
  chemically synthesized
tatataaatatatatgagttta

SEQ ID NO: 870168 - DNA, 22 bp, Artificial Sequence
  chemically synthesized
tataggaaactatatatataaa

SEQ ID NO: 870169 - DNA, 22 bp, Artificial Sequence
  chemically synthesized
atataggaaactatatatataa

SEQ ID NO: 870170 - DNA, 22 bp, Artificial Sequence
  chemically synthesized
tatataggaaactatatatata

SEQ ID NO: 870171 - DNA, 22 bp, Artificial Sequence
  chemically synthesized
ttatataggaaactatatatat

SEQ ID NO: 870172 - DNA, 22 bp, Artificial Sequence
  chemically synthesized
tatagtttttatataggaaact

SEQ ID NO: 870173 - DNA, 22 bp, Artificial Sequence
  chemically synthesized
tatatagtttttatataggaaa

SEQ ID NO: 870174 - DNA, 22 bp, Artificial Sequence
  chemically synthesized
atatatatagtttcctatataa

SEQ ID NO: 870175 - DNA, 22 bp, Artificial Sequence
  chemically synthesized
tatatatagtttcctatataaa

SEQ ID NO: 870176 - DNA, 22 bp, Artificial Sequence
  chemically synthesized
tatctctatatagtttttatat

SEQ ID NO: 870177 - DNA, 22 bp, Artificial Sequence
  chemically synthesized
cctatataaaaactatatagag

SEQ ID NO: 870178 - DNA, 22 bp, Artificial Sequence
  chemically synthesized
ctatataaaaactatatagaga

SEQ ID NO: 870179 - DNA, 22 bp, Artificial Sequence
  chemically synthesized
tataaaaactatatagagatat

SEQ ID NO: 870180 - DNA, 22 bp, Artificial Sequence
  chemically synthesized
tatatacagatagctatatctc

SEQ ID NO: 870181 - DNA, 22 bp, Artificial Sequence
  chemically synthesized
tatagagatatagctatctgta

SEQ ID NO: 870182 - DNA, 22 bp, Artificial Sequence
  chemically synthesized
tatatggttatatatacagata

SEQ ID NO: 870183 - DNA, 22 bp, Artificial Sequence
  chemically synthesized
catgtcactatatatggttata

SEQ ID NO: 870184 - DNA, 22 bp, Artificial Sequence
  chemically synthesized
tctgtatatataaccatatata

SEQ ID NO: 870185 - DNA, 22 bp, Artificial Sequence
  chemically synthesized
tatatataaccatatatagtga

SEQ ID NO: 870186 - DNA, 22 bp, Artificial Sequence
  chemically synthesized
tatatatattacatgtcactat

SEQ ID NO: 870187 - DNA, 22 bp, Artificial Sequence
  chemically synthesized
atatatatattacatgtcacta

SEQ ID NO: 870188 - DNA, 22 bp, Artificial Sequence
  chemically synthesized
tatatagtttatatatatatta

SEQ ID NO: 870189 - DNA, 22 bp, Artificial Sequence
  chemically synthesized
tatagacatataactgtatata

SEQ ID NO: 870190 - DNA, 22 bp, Artificial Sequence
  chemically synthesized
tatacagttatatgtctatata

SEQ ID NO: 870191 - DNA, 22 bp, Artificial Sequence
  chemically synthesized
tatatatatagctatatagaca

SEQ ID NO: 870192 - DNA, 22 bp, Artificial Sequence
  chemically synthesized
catcactatatatatatagcta

SEQ ID NO: 870193 - DNA, 22 bp, Artificial Sequence
  chemically synthesized
tatgtctatatagctatatata

SEQ ID NO: 870194 - DNA, 22 bp, Artificial Sequence
  chemically synthesized
aattacatcactatatatatat

SEQ ID NO: 870195 - DNA, 22 bp, Artificial Sequence
  chemically synthesized
tatagctatatatatatagtga

SEQ ID NO: 870196 - DNA, 22 bp, Artificial Sequence
  chemically synthesized
tatatatatagtgatgtaattt

SEQ ID NO: 870197 - DNA, 22 bp, Artificial Sequence
  chemically synthesized
aaaaccaggaactaaattacat

SEQ ID NO: 870198 - DNA, 22 bp, Artificial Sequence
  chemically synthesized
caatattaaaaaccaggaacta

SEQ ID NO: 870199 - DNA, 22 bp, Artificial Sequence
  chemically synthesized
tccaatattaaaaaccaggaac

SEQ ID NO: 870200 - DNA, 22 bp, Artificial Sequence
  chemically synthesized
ttctccaatattaaaaaccagg

SEQ ID NO: 870201 - DNA, 22 bp, Artificial Sequence
  chemically synthesized
ataattgttctccaatattaaa

SEQ ID NO: 870202 - DNA, 22 bp, Artificial Sequence
  chemically synthesized
agttcctggtttttaatattgg

SEQ ID NO: 870203 - DNA, 22 bp, Artificial Sequence
  chemically synthesized
gttcctggtttttaatattgga

SEQ ID NO: 870204 - DNA, 22 bp, Artificial Sequence
  chemically synthesized
ctggtttttaatattggagaac

SEQ ID NO: 870205 - DNA, 22 bp, Artificial Sequence
  chemically synthesized
gtttttaatattggagaacaat

SEQ ID NO: 870206 - DNA, 22 bp, Artificial Sequence
  chemically synthesized
aaaaaaactcataattgttctc

SEQ ID NO: 870207 - DNA, 22 bp, Artificial Sequence
  chemically synthesized
caaaaaaactcataattgttct

SEQ ID NO: 870208 - DNA, 22 bp, Artificial Sequence
  chemically synthesized
ttaatattggagaacaattatg

SEQ ID NO: 870209 - DNA, 22 bp, Artificial Sequence
  chemically synthesized
taatattggagaacaattatga

SEQ ID NO: 870210 - DNA, 22 bp, Artificial Sequence
  chemically synthesized
aatattggagaacaattatgag

SEQ ID NO: 870211 - DNA, 22 bp, Artificial Sequence
  chemically synthesized
atattggagaacaattatgagt

SEQ ID NO: 870212 - DNA, 22 bp, Artificial Sequence
  chemically synthesized
tcacaccttcaaaaaaactcat

SEQ ID NO: 870213 - DNA, 22 bp, Artificial Sequence
  chemically synthesized
gagaacaattatgagttttttt

SEQ ID NO: 870214 - DNA, 22 bp, Artificial Sequence
  chemically synthesized
gaataattatcacaccttcaaa

SEQ ID NO: 870215 - DNA, 22 bp, Artificial Sequence
  chemically synthesized
tggaataattatcacaccttca

SEQ ID NO: 870216 - DNA, 22 bp, Artificial Sequence
  chemically synthesized
ctggaataattatcacaccttc

SEQ ID NO: 870217 - DNA, 22 bp, Artificial Sequence
  chemically synthesized
tgagtttttttgaaggtgtgat

SEQ ID NO: 870218 - DNA, 22 bp, Artificial Sequence
  chemically synthesized
cttctggaataattatcacacc

SEQ ID NO: 870219 - DNA, 22 bp, Artificial Sequence
  chemically synthesized
ctacttctggaataattatcac

SEQ ID NO: 870220 - DNA, 22 bp, Artificial Sequence
  chemically synthesized
ttttgaaggtgtgataattatt

SEQ ID NO: 870221 - DNA, 22 bp, Artificial Sequence
  chemically synthesized
tttgaaggtgtgataattattc

SEQ ID NO: 870222 - DNA, 22 bp, Artificial Sequence
  chemically synthesized
ttgaaggtgtgataattattcc

SEQ ID NO: 870223 - DNA, 22 bp, Artificial Sequence
  chemically synthesized
tgaaggtgtgataattattcca

SEQ ID NO: 870224 - DNA, 22 bp, Artificial Sequence
  chemically synthesized
aattcctacttctggaataatt

SEQ ID NO: 870225 - DNA, 22 bp, Artificial Sequence
  chemically synthesized
gaaggtgtgataattattccag

SEQ ID NO: 870226 - DNA, 22 bp, Artificial Sequence
  chemically synthesized
caattcctacttctggaataat

SEQ ID NO: 870227 - DNA, 22 bp, Artificial Sequence
  chemically synthesized
aaggtgtgataattattccaga

SEQ ID NO: 870228 - DNA, 22 bp, Artificial Sequence
  chemically synthesized
tcaattcctacttctggaataa

SEQ ID NO: 870229 - DNA, 22 bp, Artificial Sequence
  chemically synthesized
ctttcaattcctacttctggaa

SEQ ID NO: 870230 - DNA, 22 bp, Artificial Sequence
  chemically synthesized
tactactttcaattcctacttc

SEQ ID NO: 870231 - DNA, 22 bp, Artificial Sequence
  chemically synthesized
ttccagaagtaggaattgaaag

SEQ ID NO: 870232 - DNA, 22 bp, Artificial Sequence
  chemically synthesized
cagaagtaggaattgaaagtag

SEQ ID NO: 870233 - DNA, 22 bp, Artificial Sequence
  chemically synthesized
aaagtagtataattttgacttt

SEQ ID NO: 870234 - DNA, 22 bp, Artificial Sequence
  chemically synthesized
caataggaaaaaaaaagtcaaa

SEQ ID NO: 870235 - DNA, 22 bp, Artificial Sequence
  chemically synthesized
caatataaacctacaataggaa

SEQ ID NO: 870236 - DNA, 22 bp, Artificial Sequence
  chemically synthesized
tgactttttttttcctattgta

SEQ ID NO: 870237 - DNA, 22 bp, Artificial Sequence
  chemically synthesized
gactttttttttcctattgtag

SEQ ID NO: 870238 - DNA, 22 bp, Artificial Sequence
  chemically synthesized
actttttttttcctattgtagg

SEQ ID NO: 870239 - DNA, 22 bp, Artificial Sequence
  chemically synthesized
aattgcaatataaacctacaat

SEQ ID NO: 870240 - DNA, 22 bp, Artificial Sequence
  chemically synthesized
aaattgcaatataaacctacaa

SEQ ID NO: 870241 - DNA, 22 bp, Artificial Sequence
  chemically synthesized
tttttttcctattgtaggttta

SEQ ID NO: 870242 - DNA, 22 bp, Artificial Sequence
  chemically synthesized
ttttttcctattgtaggtttat

SEQ ID NO: 870243 - DNA, 22 bp, Artificial Sequence
  chemically synthesized
tttttcctattgtaggtttata

SEQ ID NO: 870244 - DNA, 22 bp, Artificial Sequence
  chemically synthesized
ttttcctattgtaggtttatat

SEQ ID NO: 870245 - DNA, 22 bp, Artificial Sequence
  chemically synthesized
tttcctattgtaggtttatatt

SEQ ID NO: 870246 - DNA, 22 bp, Artificial Sequence
  chemically synthesized
ttcctattgtaggtttatattg

SEQ ID NO: 870247 - DNA, 22 bp, Artificial Sequence
  chemically synthesized
tcctattgtaggtttatattgc

SEQ ID NO: 870248 - DNA, 22 bp, Artificial Sequence
  chemically synthesized
cctattgtaggtttatattgca

SEQ ID NO: 870249 - DNA, 22 bp, Artificial Sequence
  chemically synthesized
ctattgtaggtttatattgcaa

SEQ ID NO: 870250 - DNA, 22 bp, Artificial Sequence
  chemically synthesized
ttgtaggtttatattgcaattt

SEQ ID NO: 870251 - DNA, 22 bp, Artificial Sequence
  chemically synthesized
taggtttatattgcaatttaag

SEQ ID NO: 870252 - DNA, 22 bp, Artificial Sequence
  chemically synthesized
taccagtacccacttaaattgc

SEQ ID NO: 870253 - DNA, 22 bp, Artificial Sequence
  chemically synthesized
actataccagtacccacttaaa

SEQ ID NO: 870254 - DNA, 22 bp, Artificial Sequence
  chemically synthesized
atattgcaatttaagtgggtac

SEQ ID NO: 870255 - DNA, 22 bp, Artificial Sequence
  chemically synthesized
tattgcaatttaagtgggtact

SEQ ID NO: 870256 - DNA, 22 bp, Artificial Sequence
  chemically synthesized
caatttaagtgggtactggtat

SEQ ID NO: 870257 - DNA, 22 bp, Artificial Sequence
  chemically synthesized
gcagcactaactataccagtac

SEQ ID NO: 870258 - DNA, 22 bp, Artificial Sequence
  chemically synthesized
ctagcagcactaactataccag

SEQ ID NO: 870259 - DNA, 22 bp, Artificial Sequence
  chemically synthesized
aagtgggtactggtatagttag

SEQ ID NO: 870260 - DNA, 22 bp, Artificial Sequence
  chemically synthesized
agtgggtactggtatagttagt

SEQ ID NO: 870261 - DNA, 22 bp, Artificial Sequence
  chemically synthesized
ggtaaaattgctagcagcacta

SEQ ID NO: 870262 - DNA, 22 bp, Artificial Sequence
  chemically synthesized
aggtaaaattgctagcagcact

SEQ ID NO: 870263 - DNA, 22 bp, Artificial Sequence
  chemically synthesized
gtatagttagtgctgctagcaa

SEQ ID NO: 870264 - DNA, 22 bp, Artificial Sequence
  chemically synthesized
atatttaggtaaaattgctagc

SEQ ID NO: 870265 - DNA, 22 bp, Artificial Sequence
  chemically synthesized
gtgctgctagcaattttaccta

SEQ ID NO: 870266 - DNA, 22 bp, Artificial Sequence
  chemically synthesized
ggtatcctaatatttaggtaaa

SEQ ID NO: 870267 - DNA, 22 bp, Artificial Sequence
  chemically synthesized
ctagcaattttacctaaatatt

SEQ ID NO: 870268 - DNA, 22 bp, Artificial Sequence
  chemically synthesized
gcaattttacctaaatattagg

SEQ ID NO: 870269 - DNA, 22 bp, Artificial Sequence
  chemically synthesized
gacaaacaatctaggtatccta

SEQ ID NO: 870270 - DNA, 22 bp, Artificial Sequence
  chemically synthesized
tacctaaatattaggataccta

SEQ ID NO: 870271 - DNA, 22 bp, Artificial Sequence
  chemically synthesized
acctaaatattaggatacctag

SEQ ID NO: 870272 - DNA, 22 bp, Artificial Sequence
  chemically synthesized
cctaaatattaggatacctaga

SEQ ID NO: 870273 - DNA, 22 bp, Artificial Sequence
  chemically synthesized
attagacaaacaatctaggtat

SEQ ID NO: 870274 - DNA, 22 bp, Artificial Sequence
  chemically synthesized
aatattaggatacctagattgt

SEQ ID NO: 870275 - DNA, 22 bp, Artificial Sequence
  chemically synthesized
agttcattagacaaacaatcta

SEQ ID NO: 870276 - DNA, 22 bp, Artificial Sequence
  chemically synthesized
ggatacctagattgtttgtcta

SEQ ID NO: 870277 - DNA, 22 bp, Artificial Sequence
  chemically synthesized
ccagcccatgctgagttcatta

SEQ ID NO: 870278 - DNA, 22 bp, Artificial Sequence
  chemically synthesized
gattgtttgtctaatgaactca

SEQ ID NO: 870279 - DNA, 22 bp, Artificial Sequence
  chemically synthesized
gccagcccatgctgagttcatt

SEQ ID NO: 870280 - DNA, 22 bp, Artificial Sequence
  chemically synthesized
tttgtctaatgaactcagcatg

SEQ ID NO: 870281 - DNA, 22 bp, Artificial Sequence
  chemically synthesized
gtctaatgaactcagcatgggc

SEQ ID NO: 870282 - DNA, 22 bp, Artificial Sequence
  chemically synthesized
tctaatgaactcagcatgggct

SEQ ID NO: 870283 - DNA, 22 bp, Artificial Sequence
  chemically synthesized
caaagtgcttgccagcccatgc

SEQ ID NO: 870284 - DNA, 22 bp, Artificial Sequence
  chemically synthesized
ccaaagtgcttgccagcccatg

SEQ ID NO: 870285 - DNA, 22 bp, Artificial Sequence
  chemically synthesized
atgaactcagcatgggctggca

SEQ ID NO: 870286 - DNA, 22 bp, Artificial Sequence
  chemically synthesized
tttccaaagtgcttgccagccc

SEQ ID NO: 870287 - DNA, 22 bp, Artificial Sequence
  chemically synthesized
atttccaaagtgcttgccagcc

SEQ ID NO: 870288 - DNA, 22 bp, Artificial Sequence
  chemically synthesized
ttatttccaaagtgcttgccag

SEQ ID NO: 870289 - DNA, 22 bp, Artificial Sequence
  chemically synthesized
ctcttatttccaaagtgcttgc

SEQ ID NO: 870290 - DNA, 22 bp, Artificial Sequence
  chemically synthesized
agcatgggctggcaagcacttt

SEQ ID NO: 870291 - DNA, 22 bp, Artificial Sequence
  chemically synthesized
actcttatttccaaagtgcttg

SEQ ID NO: 870292 - DNA, 22 bp, Artificial Sequence
  chemically synthesized
tactcttatttccaaagtgctt

SEQ ID NO: 870293 - DNA, 22 bp, Artificial Sequence
  chemically synthesized
gcaagcactttggaaataagag

SEQ ID NO: 870294 - DNA, 22 bp, Artificial Sequence
  chemically synthesized
tgaaaatatgttttactcttat

SEQ ID NO: 870295 - DNA, 22 bp, Artificial Sequence
  chemically synthesized
atgaaaatatgttttactctta

SEQ ID NO: 870296 - DNA, 22 bp, Artificial Sequence
  chemically synthesized
tatgaaaatatgttttactctt

SEQ ID NO: 870297 - DNA, 22 bp, Artificial Sequence
  chemically synthesized
ttatgaaaatatgttttactct

SEQ ID NO: 870298 - DNA, 22 bp, Artificial Sequence
  chemically synthesized
tggaaataagagtaaaacatat

SEQ ID NO: 870299 - DNA, 22 bp, Artificial Sequence
  chemically synthesized
ggaaataagagtaaaacatatt

SEQ ID NO: 870300 - DNA, 22 bp, Artificial Sequence
  chemically synthesized
gaaataagagtaaaacatattt

SEQ ID NO: 870301 - DNA, 22 bp, Artificial Sequence
  chemically synthesized
agtatttttatgaaaatatgtt

SEQ ID NO: 870302 - DNA, 22 bp, Artificial Sequence
  chemically synthesized
cagtatttttatgaaaatatgt

SEQ ID NO: 870303 - DNA, 22 bp, Artificial Sequence
  chemically synthesized
atcttcagtatttttatgaaaa

SEQ ID NO: 870304 - DNA, 22 bp, Artificial Sequence
  chemically synthesized
tcatcttcagtatttttatgaa

SEQ ID NO: 870305 - DNA, 22 bp, Artificial Sequence
  chemically synthesized
tctcatcttcagtatttttatg

SEQ ID NO: 870306 - DNA, 22 bp, Artificial Sequence
  chemically synthesized
ctctcatcttcagtatttttat

SEQ ID NO: 870307 - DNA, 22 bp, Artificial Sequence
  chemically synthesized
cttctctcatcttcagtatttt

SEQ ID NO: 870308 - DNA, 22 bp, Artificial Sequence
  chemically synthesized
ttccttctctcatcttcagtat

SEQ ID NO: 870309 - DNA, 22 bp, Artificial Sequence
  chemically synthesized
attccttctctcatcttcagta

SEQ ID NO: 870310 - DNA, 22 bp, Artificial Sequence
  chemically synthesized
tcataaaaatactgaagatgag

SEQ ID NO: 870311 - DNA, 22 bp, Artificial Sequence
  chemically synthesized
cataaaaatactgaagatgaga

SEQ ID NO: 870312 - DNA, 22 bp, Artificial Sequence
  chemically synthesized
ataaaaatactgaagatgagag

SEQ ID NO: 870313 - DNA, 22 bp, Artificial Sequence
  chemically synthesized
ataaggtttattccttctctca

SEQ ID NO: 870314 - DNA, 22 bp, Artificial Sequence
  chemically synthesized
aaattcataaggtttattcctt

SEQ ID NO: 870315 - DNA, 22 bp, Artificial Sequence
  chemically synthesized
aaaattcataaggtttattcct

SEQ ID NO: 870316 - DNA, 22 bp, Artificial Sequence
  chemically synthesized
aagatgagagaaggaataaacc

SEQ ID NO: 870317 - DNA, 22 bp, Artificial Sequence
  chemically synthesized
ttaaaattcataaggtttattc

SEQ ID NO: 870318 - DNA, 22 bp, Artificial Sequence
  chemically synthesized
ctcttaaaattcataaggttta

SEQ ID NO: 870319 - DNA, 22 bp, Artificial Sequence
  chemically synthesized
cctcttaaaattcataaggttt

SEQ ID NO: 870320 - DNA, 22 bp, Artificial Sequence
  chemically synthesized
ccttcctcttaaaattcataag

SEQ ID NO: 870321 - DNA, 22 bp, Artificial Sequence
  chemically synthesized
catgctaccttcctcttaaaat

SEQ ID NO: 870322 - DNA, 22 bp, Artificial Sequence
  chemically synthesized
acatgctaccttcctcttaaaa

SEQ ID NO: 870323 - DNA, 22 bp, Artificial Sequence
  chemically synthesized
tacatgctaccttcctcttaaa

SEQ ID NO: 870324 - DNA, 22 bp, Artificial Sequence
  chemically synthesized
ctttacatgctaccttcctctt

SEQ ID NO: 870325 - DNA, 22 bp, Artificial Sequence
  chemically synthesized
tgctttacatgctaccttcctc

SEQ ID NO: 870326 - DNA, 22 bp, Artificial Sequence
  chemically synthesized
atgaattttaagaggaaggtag

SEQ ID NO: 870327 - DNA, 22 bp, Artificial Sequence
  chemically synthesized
tgaattttaagaggaaggtagc

SEQ ID NO: 870328 - DNA, 22 bp, Artificial Sequence
  chemically synthesized
agaacctctgctttacatgcta

SEQ ID NO: 870329 - DNA, 22 bp, Artificial Sequence
  chemically synthesized
taagaggaaggtagcatgtaaa

SEQ ID NO: 870330 - DNA, 22 bp, Artificial Sequence
  chemically synthesized
gagaacctctgctttacatgct

SEQ ID NO: 870331 - DNA, 22 bp, Artificial Sequence
  chemically synthesized
aagaggaaggtagcatgtaaag

SEQ ID NO: 870332 - DNA, 22 bp, Artificial Sequence
  chemically synthesized
agaggaaggtagcatgtaaagc

SEQ ID NO: 870333 - DNA, 22 bp, Artificial Sequence
  chemically synthesized
aaatcaaatttgagaacctctg

SEQ ID NO: 870334 - DNA, 22 bp, Artificial Sequence
  chemically synthesized
gaaatcaaatttgagaacctct

SEQ ID NO: 870335 - DNA, 22 bp, Artificial Sequence
  chemically synthesized
tgtcttgaaatcaaatttgaga

SEQ ID NO: 870336 - DNA, 22 bp, Artificial Sequence
  chemically synthesized
actgtgtcttgaaatcaaattt

SEQ ID NO: 870337 - DNA, 22 bp, Artificial Sequence
  chemically synthesized
gactgtgtcttgaaatcaaatt

SEQ ID NO: 870338 - DNA, 22 bp, Artificial Sequence
  chemically synthesized
ttgactgtgtcttgaaatcaaa

SEQ ID NO: 870339 - DNA, 22 bp, Artificial Sequence
  chemically synthesized
attcttgactgtgtcttgaaat

SEQ ID NO: 870340 - DNA, 22 bp, Artificial Sequence
  chemically synthesized
tcaaatttgatttcaagacaca

SEQ ID NO: 870341 - DNA, 22 bp, Artificial Sequence
  chemically synthesized
aaatttgatttcaagacacagt

SEQ ID NO: 870342 - DNA, 22 bp, Artificial Sequence
  chemically synthesized
aaccctcattcttgactgtgtc

SEQ ID NO: 870343 - DNA, 22 bp, Artificial Sequence
  chemically synthesized
aaaccctcattcttgactgtgt

SEQ ID NO: 870344 - DNA, 22 bp, Artificial Sequence
  chemically synthesized
gatttcaagacacagtcaagaa

SEQ ID NO: 870345 - DNA, 22 bp, Artificial Sequence
  chemically synthesized
cttaaaccctcattcttgactg

SEQ ID NO: 870346 - DNA, 22 bp, Artificial Sequence
  chemically synthesized
atttcaagacacagtcaagaat

SEQ ID NO: 870347 - DNA, 22 bp, Artificial Sequence
  chemically synthesized
tctccttaaaccctcattcttg

SEQ ID NO: 870348 - DNA, 22 bp, Artificial Sequence
  chemically synthesized
caagacacagtcaagaatgagg

SEQ ID NO: 870349 - DNA, 22 bp, Artificial Sequence
  chemically synthesized
aagacacagtcaagaatgaggg

SEQ ID NO: 870350 - DNA, 22 bp, Artificial Sequence
  chemically synthesized
caggccagatataacccctatc

SEQ ID NO: 870351 - DNA, 22 bp, Artificial Sequence
  chemically synthesized
ccaggccagatataacccctat

SEQ ID NO: 870352 - DNA, 22 bp, Artificial Sequence
  chemically synthesized
aaggagataggggttatatctg

SEQ ID NO: 870353 - DNA, 22 bp, Artificial Sequence
  chemically synthesized
aggagataggggttatatctgg

SEQ ID NO: 870354 - DNA, 22 bp, Artificial Sequence
  chemically synthesized
atgcaaatcttccaggccagat

SEQ ID NO: 870355 - DNA, 22 bp, Artificial Sequence
  chemically synthesized
tggcattgatgcaaatcttcca

SEQ ID NO: 870356 - DNA, 22 bp, Artificial Sequence
  chemically synthesized
tatggcattgatgcaaatcttc

SEQ ID NO: 870357 - DNA, 22 bp, Artificial Sequence
  chemically synthesized
tatctggcctggaagatttgca

SEQ ID NO: 870358 - DNA, 22 bp, Artificial Sequence
  chemically synthesized
gcctggaagatttgcatcaatg

SEQ ID NO: 870359 - DNA, 22 bp, Artificial Sequence
  chemically synthesized
gaagatttgcatcaatgccata

SEQ ID NO: 870360 - DNA, 22 bp, Artificial Sequence
  chemically synthesized
atcaaagagggatattctatgg

SEQ ID NO: 870361 - DNA, 22 bp, Artificial Sequence
  chemically synthesized
gcatcaatgccatagaatatcc

SEQ ID NO: 870362 - DNA, 22 bp, Artificial Sequence
  chemically synthesized
catcaatgccatagaatatccc

SEQ ID NO: 870363 - DNA, 22 bp, Artificial Sequence
  chemically synthesized
cagtgctgatcaaagagggata

SEQ ID NO: 870364 - DNA, 22 bp, Artificial Sequence
  chemically synthesized
agattacagtgctgatcaaaga

SEQ ID NO: 870365 - DNA, 22 bp, Artificial Sequence
  chemically synthesized
aagattacagtgctgatcaaag

SEQ ID NO: 870366 - DNA, 22 bp, Artificial Sequence
  chemically synthesized
taagattacagtgctgatcaaa

SEQ ID NO: 870367 - DNA, 22 bp, Artificial Sequence
  chemically synthesized
ttaagattacagtgctgatcaa

SEQ ID NO: 870368 - DNA, 22 bp, Artificial Sequence
  chemically synthesized
tttaagattacagtgctgatca

SEQ ID NO: 870369 - DNA, 22 bp, Artificial Sequence
  chemically synthesized
ttttaagattacagtgctgatc

SEQ ID NO: 870370 - DNA, 22 bp, Artificial Sequence
  chemically synthesized
tttttttaagattacagtgctg

SEQ ID NO: 870371 - DNA, 22 bp, Artificial Sequence
  chemically synthesized
tttgatcagcactgtaatctta

SEQ ID NO: 870372 - DNA, 22 bp, Artificial Sequence
  chemically synthesized
tgatcagcactgtaatcttaaa

SEQ ID NO: 870373 - DNA, 22 bp, Artificial Sequence
  chemically synthesized
gatcagcactgtaatcttaaaa

SEQ ID NO: 870374 - DNA, 22 bp, Artificial Sequence
  chemically synthesized
atcagcactgtaatcttaaaaa

SEQ ID NO: 870375 - DNA, 22 bp, Artificial Sequence
  chemically synthesized
agtagtaagccctattttttta

SEQ ID NO: 870376 - DNA, 22 bp, Artificial Sequence
  chemically synthesized
taatcttaaaaaaatagggctt

SEQ ID NO: 870377 - DNA, 22 bp, Artificial Sequence
  chemically synthesized
acaatctcagtagtaagcccta

SEQ ID NO: 870378 - DNA, 22 bp, Artificial Sequence
  chemically synthesized
cacaatctcagtagtaagccct

SEQ ID NO: 870379 - DNA, 22 bp, Artificial Sequence
  chemically synthesized
aaaaaaatagggcttactactg

SEQ ID NO: 870380 - DNA, 22 bp, Artificial Sequence
  chemically synthesized
aaaaaatagggcttactactga

SEQ ID NO: 870381 - DNA, 22 bp, Artificial Sequence
  chemically synthesized
actactgagattgtgaagatat

SEQ ID NO: 870382 - DNA, 22 bp, Artificial Sequence
  chemically synthesized
ctactgagattgtgaagatata

SEQ ID NO: 870383 - DNA, 22 bp, Artificial Sequence
  chemically synthesized
acagatatatatatatatcttc

SEQ ID NO: 870384 - DNA, 22 bp, Artificial Sequence
  chemically synthesized
ctgagattgtgaagatatatat

SEQ ID NO: 870385 - DNA, 22 bp, Artificial Sequence
  chemically synthesized
agattgtgaagatatatatata

SEQ ID NO: 870386 - DNA, 22 bp, Artificial Sequence
  chemically synthesized
tgaagatatatatatatatctg

SEQ ID NO: 870387 - DNA, 22 bp, Artificial Sequence
  chemically synthesized
agacacagctgacagatatata

SEQ ID NO: 870388 - DNA, 22 bp, Artificial Sequence
  chemically synthesized
ctgagacacagctgacagatat

SEQ ID NO: 870389 - DNA, 22 bp, Artificial Sequence
  chemically synthesized
cctgctgagacacagctgacag

SEQ ID NO: 870390 - DNA, 22 bp, Artificial Sequence
  chemically synthesized
ttccctgctgagacacagctga

SEQ ID NO: 870391 - DNA, 22 bp, Artificial Sequence
  chemically synthesized
gttccctgctgagacacagctg

SEQ ID NO: 870392 - DNA, 22 bp, Artificial Sequence
  chemically synthesized
tgttccctgctgagacacagct

SEQ ID NO: 870393 - DNA, 22 bp, Artificial Sequence
  chemically synthesized
aactttgttccctgctgagaca

SEQ ID NO: 870394 - DNA, 22 bp, Artificial Sequence
  chemically synthesized
tcagctgtgtctcagcagggaa

SEQ ID NO: 870395 - DNA, 22 bp, Artificial Sequence
  chemically synthesized
tatatctcaactttgttccctg

SEQ ID NO: 870396 - DNA, 22 bp, Artificial Sequence
  chemically synthesized
atatatctcaactttgttccct

SEQ ID NO: 870397 - DNA, 22 bp, Artificial Sequence
  chemically synthesized
ttatatatctcaactttgttcc

SEQ ID NO: 870398 - DNA, 22 bp, Artificial Sequence
  chemically synthesized
tgtctcagcagggaacaaagtt

SEQ ID NO: 870399 - DNA, 22 bp, Artificial Sequence
  chemically synthesized
agcagggaacaaagttgagata

SEQ ID NO: 870400 - DNA, 22 bp, Artificial Sequence
  chemically synthesized
agcattcttatatatctcaact

SEQ ID NO: 870401 - DNA, 22 bp, Artificial Sequence
  chemically synthesized
cagcattcttatatatctcaac

SEQ ID NO: 870402 - DNA, 22 bp, Artificial Sequence
  chemically synthesized
ttcagcattcttatatatctca

SEQ ID NO: 870403 - DNA, 22 bp, Artificial Sequence
  chemically synthesized
agtgctcttcagcattcttata

SEQ ID NO: 870404 - DNA, 22 bp, Artificial Sequence
  chemically synthesized
cagtgctcttcagcattcttat

SEQ ID NO: 870405 - DNA, 22 bp, Artificial Sequence
  chemically synthesized
atttcagtgctcttcagcattc

SEQ ID NO: 870406 - DNA, 22 bp, Artificial Sequence
  chemically synthesized
aatttcagtgctcttcagcatt

SEQ ID NO: 870407 - DNA, 22 bp, Artificial Sequence
  chemically synthesized
agatatataagaatgctgaaga

SEQ ID NO: 870408 - DNA, 22 bp, Artificial Sequence
  chemically synthesized
agtttaatttcagtgctcttca

SEQ ID NO: 870409 - DNA, 22 bp, Artificial Sequence
  chemically synthesized
ctgagtttaatttcagtgctct

SEQ ID NO: 870410 - DNA, 22 bp, Artificial Sequence
  chemically synthesized
aagagcactgaaattaaactca

SEQ ID NO: 870411 - DNA, 22 bp, Artificial Sequence
  chemically synthesized
gacccaaccccacatctcctga

SEQ ID NO: 870412 - DNA, 22 bp, Artificial Sequence
  chemically synthesized
aaattaaactcaggagatgtgg

SEQ ID NO: 870413 - DNA, 22 bp, Artificial Sequence
  chemically synthesized
aactcaggagatgtggggttgg

SEQ ID NO: 870414 - DNA, 22 bp, Artificial Sequence
  chemically synthesized
gtggcagaatctggacccaacc

SEQ ID NO: 870415 - DNA, 22 bp, Artificial Sequence
  chemically synthesized
aggagatgtggggttgggtcca

SEQ ID NO: 870416 - DNA, 22 bp, Artificial Sequence
  chemically synthesized
agtggcagaatctggacccaac

SEQ ID NO: 870417 - DNA, 22 bp, Artificial Sequence
  chemically synthesized
tttagtggcagaatctggaccc

SEQ ID NO: 870418 - DNA, 22 bp, Artificial Sequence
  chemically synthesized
accagctgtttagtggcagaat

SEQ ID NO: 870419 - DNA, 22 bp, Artificial Sequence
  chemically synthesized
gaccagctgtttagtggcagaa

SEQ ID NO: 870420 - DNA, 22 bp, Artificial Sequence
  chemically synthesized
ggtccagattctgccactaaac

SEQ ID NO: 870421 - DNA, 22 bp, Artificial Sequence
  chemically synthesized
tgccactaaacagctggtcaag

SEQ ID NO: 870422 - DNA, 22 bp, Artificial Sequence
  chemically synthesized
aatgatcgcgtgcttgaccagc

SEQ ID NO: 870423 - DNA, 22 bp, Artificial Sequence
  chemically synthesized
ccactaaacagctggtcaagca

SEQ ID NO: 870424 - DNA, 22 bp, Artificial Sequence
  chemically synthesized
aacagctggtcaagcacgcgat

SEQ ID NO: 870425 - DNA, 22 bp, Artificial Sequence
  chemically synthesized
gtcaagcacgcgatcatttaat

SEQ ID NO: 870426 - DNA, 22 bp, Artificial Sequence
  chemically synthesized
ccatgtaataataataatacca

SEQ ID NO: 870427 - DNA, 22 bp, Artificial Sequence
  chemically synthesized
cccatgtaataataataatacc

SEQ ID NO: 870428 - DNA, 22 bp, Artificial Sequence
  chemically synthesized
aatcttcttggtattattatta

SEQ ID NO: 870429 - DNA, 22 bp, Artificial Sequence
  chemically synthesized
atcttcttggtattattattat

SEQ ID NO: 870430 - DNA, 22 bp, Artificial Sequence
  chemically synthesized
cttggtattattattattacat

SEQ ID NO: 870431 - DNA, 22 bp, Artificial Sequence
  chemically synthesized
ttggtattattattattacatg

SEQ ID NO: 870432 - DNA, 22 bp, Artificial Sequence
  chemically synthesized
ggtattattattattacatggg

SEQ ID NO: 870433 - DNA, 22 bp, Artificial Sequence
  chemically synthesized
gtattattattattacatggga

SEQ ID NO: 870434 - DNA, 22 bp, Artificial Sequence
  chemically synthesized
ttattattacatgggaaggttg

SEQ ID NO: 870435 - DNA, 22 bp, Artificial Sequence
  chemically synthesized
ttattacatgggaaggttgatg

SEQ ID NO: 870436 - DNA, 22 bp, Artificial Sequence
  chemically synthesized
ttacatgggaaggttgatgtat

SEQ ID NO: 870437 - DNA, 22 bp, Artificial Sequence
  chemically synthesized
cagatagatcaaatacatcaac

SEQ ID NO: 870438 - DNA, 22 bp, Artificial Sequence
  chemically synthesized
acagatagatcaaatacatcaa

SEQ ID NO: 870439 - DNA, 22 bp, Artificial Sequence
  chemically synthesized
tacagatagatcaaatacatca

SEQ ID NO: 870440 - DNA, 22 bp, Artificial Sequence
  chemically synthesized
catgggaaggttgatgtatttg

SEQ ID NO: 870441 - DNA, 22 bp, Artificial Sequence
  chemically synthesized
atgtatttgatctatctgtaaa

SEQ ID NO: 870442 - DNA, 22 bp, Artificial Sequence
  chemically synthesized
gtcaagtgaacatatattttac

SEQ ID NO: 870443 - DNA, 22 bp, Artificial Sequence
  chemically synthesized
ggtcaagtgaacatatatttta

SEQ ID NO: 870444 - DNA, 22 bp, Artificial Sequence
  chemically synthesized
tggtcaagtgaacatatatttt

SEQ ID NO: 870445 - DNA, 22 bp, Artificial Sequence
  chemically synthesized
gatctatctgtaaaatatatgt

SEQ ID NO: 870446 - DNA, 22 bp, Artificial Sequence
  chemically synthesized
ttggtcaagtgaacatatattt

SEQ ID NO: 870447 - DNA, 22 bp, Artificial Sequence
  chemically synthesized
atctatctgtaaaatatatgtt

SEQ ID NO: 870448 - DNA, 22 bp, Artificial Sequence
  chemically synthesized
tttggtcaagtgaacatatatt

SEQ ID NO: 870449 - DNA, 22 bp, Artificial Sequence
  chemically synthesized
tctgtaaaatatatgttcactt

SEQ ID NO: 870450 - DNA, 22 bp, Artificial Sequence
  chemically synthesized
atattttttggtcaagtgaaca

SEQ ID NO: 870451 - DNA, 22 bp, Artificial Sequence
  chemically synthesized
taaaatatatgttcacttgacc

SEQ ID NO: 870452 - DNA, 22 bp, Artificial Sequence
  chemically synthesized
cactaatattttttggtcaagt

SEQ ID NO: 870453 - DNA, 22 bp, Artificial Sequence
  chemically synthesized
acttgaccaaaaaatattagtg

SEQ ID NO: 870454 - DNA, 22 bp, Artificial Sequence
  chemically synthesized
gaccaaaaaatattagtgcaat

SEQ ID NO: 870455 - DNA, 22 bp, Artificial Sequence
  chemically synthesized
accaaaaaatattagtgcaata

SEQ ID NO: 870456 - DNA, 22 bp, Artificial Sequence
  chemically synthesized
gcatatggtaggtattgcacta

SEQ ID NO: 870457 - DNA, 22 bp, Artificial Sequence
  chemically synthesized
aatgactagcatatggtaggta

SEQ ID NO: 870458 - DNA, 22 bp, Artificial Sequence
  chemically synthesized
attcaatgactagcatatggta

SEQ ID NO: 870459 - DNA, 22 bp, Artificial Sequence
  chemically synthesized
aattcaatgactagcatatggt

SEQ ID NO: 870460 - DNA, 22 bp, Artificial Sequence
  chemically synthesized
gtgcaatacctaccatatgcta

SEQ ID NO: 870461 - DNA, 22 bp, Artificial Sequence
  chemically synthesized
taattcaatgactagcatatgg

SEQ ID NO: 870462 - DNA, 22 bp, Artificial Sequence
  chemically synthesized
gctttaattcaatgactagcat

SEQ ID NO: 870463 - DNA, 22 bp, Artificial Sequence
  chemically synthesized
ccatatgctagtcattgaatta

SEQ ID NO: 870464 - DNA, 22 bp, Artificial Sequence
  chemically synthesized
gtcattgaattaaagctagaca

SEQ ID NO: 870465 - DNA, 22 bp, Artificial Sequence
  chemically synthesized
catgccaaataccaggtgtgtc

SEQ ID NO: 870466 - DNA, 22 bp, Artificial Sequence
  chemically synthesized
aattaaagctagacacacctgg

SEQ ID NO: 870467 - DNA, 22 bp, Artificial Sequence
  chemically synthesized
acatgccaaataccaggtgtgt

SEQ ID NO: 870468 - DNA, 22 bp, Artificial Sequence
  chemically synthesized
aagctagacacacctggtattt

SEQ ID NO: 870469 - DNA, 22 bp, Artificial Sequence
  chemically synthesized
cgtttacatgccaaataccagg

SEQ ID NO: 870470 - DNA, 22 bp, Artificial Sequence
  chemically synthesized
ctacgtttacatgccaaatacc

SEQ ID NO: 870471 - DNA, 22 bp, Artificial Sequence
  chemically synthesized
cctacgtttacatgccaaatac

SEQ ID NO: 870472 - DNA, 22 bp, Artificial Sequence
  chemically synthesized
tcctacgtttacatgccaaata

SEQ ID NO: 870473 - DNA, 22 bp, Artificial Sequence
  chemically synthesized
gacacacctggtatttggcatg

SEQ ID NO: 870474 - DNA, 22 bp, Artificial Sequence
  chemically synthesized
ttcctacgtttacatgccaaat

SEQ ID NO: 870475 - DNA, 22 bp, Artificial Sequence
  chemically synthesized
gtatttggcatgtaaacgtagg

SEQ ID NO: 870476 - DNA, 22 bp, Artificial Sequence
  chemically synthesized
tatatacccttttcctacgttt

SEQ ID NO: 870477 - DNA, 22 bp, Artificial Sequence
  chemically synthesized
ggcatgtaaacgtaggaaaagg

SEQ ID NO: 870478 - DNA, 22 bp, Artificial Sequence
  chemically synthesized
gcatgtaaacgtaggaaaaggg

SEQ ID NO: 870479 - DNA, 22 bp, Artificial Sequence
  chemically synthesized
tcacatcataaagtctatatat

SEQ ID NO: 870480 - DNA, 22 bp, Artificial Sequence
  chemically synthesized
tgtcacatcataaagtctatat

SEQ ID NO: 870481 - DNA, 22 bp, Artificial Sequence
  chemically synthesized
ccatgactctgtcacatcataa

SEQ ID NO: 870482 - DNA, 22 bp, Artificial Sequence
  chemically synthesized
cccatgactctgtcacatcata

SEQ ID NO: 870483 - DNA, 22 bp, Artificial Sequence
  chemically synthesized
gtcttcccatgactctgtcaca

SEQ ID NO: 870484 - DNA, 22 bp, Artificial Sequence
  chemically synthesized
ctggtcttcccatgactctgtc

SEQ ID NO: 870485 - DNA, 22 bp, Artificial Sequence
  chemically synthesized
tatgatgtgacagagtcatggg

SEQ ID NO: 870486 - DNA, 22 bp, Artificial Sequence
  chemically synthesized
atgatgtgacagagtcatggga

SEQ ID NO: 870487 - DNA, 22 bp, Artificial Sequence
  chemically synthesized
tgatgtgacagagtcatgggaa

SEQ ID NO: 870488 - DNA, 22 bp, Artificial Sequence
  chemically synthesized
cataattactggtcttcccatg

SEQ ID NO: 870489 - DNA, 22 bp, Artificial Sequence
  chemically synthesized
ttccataattactggtcttccc

SEQ ID NO: 870490 - DNA, 22 bp, Artificial Sequence
  chemically synthesized
gatgctgttccataattactgg

SEQ ID NO: 870491 - DNA, 22 bp, Artificial Sequence
  chemically synthesized
agaattggatgctgttccataa

SEQ ID NO: 870492 - DNA, 22 bp, Artificial Sequence
  chemically synthesized
cagaattggatgctgttccata

SEQ ID NO: 870493 - DNA, 22 bp, Artificial Sequence
  chemically synthesized
tgggcttcagaattggatgctg

SEQ ID NO: 870494 - DNA, 22 bp, Artificial Sequence
  chemically synthesized
ttgtgggcttcagaattggatg

SEQ ID NO: 870495 - DNA, 22 bp, Artificial Sequence
  chemically synthesized
tgttgtgggcttcagaattgga

SEQ ID NO: 870496 - DNA, 22 bp, Artificial Sequence
  chemically synthesized
ctgttgtgggcttcagaattgg

SEQ ID NO: 870497 - DNA, 22 bp, Artificial Sequence
  chemically synthesized
tggaacagcatccaattctgaa

SEQ ID NO: 870498 - DNA, 22 bp, Artificial Sequence
  chemically synthesized
tctgttgtgggcttcagaattg

SEQ ID NO: 870499 - DNA, 22 bp, Artificial Sequence
  chemically synthesized
ttctgttgtgggcttcagaatt

SEQ ID NO: 870500 - DNA, 22 bp, Artificial Sequence
  chemically synthesized
tttttctgttgtgggcttcaga

SEQ ID NO: 870501 - DNA, 22 bp, Artificial Sequence
  chemically synthesized
catactatttttctgttgtggg

SEQ ID NO: 870502 - DNA, 22 bp, Artificial Sequence
  chemically synthesized
ccatactatttttctgttgtgg

SEQ ID NO: 870503 - DNA, 22 bp, Artificial Sequence
  chemically synthesized
tccatactatttttctgttgtg

SEQ ID NO: 870504 - DNA, 22 bp, Artificial Sequence
  chemically synthesized
tgaagcccacaacagaaaaata

SEQ ID NO: 870505 - DNA, 22 bp, Artificial Sequence
  chemically synthesized
aagcccacaacagaaaaatagt

SEQ ID NO: 870506 - DNA, 22 bp, Artificial Sequence
  chemically synthesized
caagtgttttccatactatttt

SEQ ID NO: 870507 - DNA, 22 bp, Artificial Sequence
  chemically synthesized
ccaagtgttttccatactattt

SEQ ID NO: 870508 - DNA, 22 bp, Artificial Sequence
  chemically synthesized
cccttccaagtgttttccatac

SEQ ID NO: 870509 - DNA, 22 bp, Artificial Sequence
  chemically synthesized
ctacccttccaagtgttttcca

SEQ ID NO: 870510 - DNA, 22 bp, Artificial Sequence
  chemically synthesized
ctcctacccttccaagtgtttt

SEQ ID NO: 870511 - DNA, 22 bp, Artificial Sequence
  chemically synthesized
tggccctcctcctacccttcca

SEQ ID NO: 870512 - DNA, 22 bp, Artificial Sequence
  chemically synthesized
tgtggccctcctcctacccttc

SEQ ID NO: 870513 - DNA, 22 bp, Artificial Sequence
  chemically synthesized
acgtctctgtggccctcctcct

SEQ ID NO: 870514 - DNA, 22 bp, Artificial Sequence
  chemically synthesized
aacgtctctgtggccctcctcc

SEQ ID NO: 870515 - DNA, 22 bp, Artificial Sequence
  chemically synthesized
taacgtctctgtggccctcctc

SEQ ID NO: 870516 - DNA, 22 bp, Artificial Sequence
  chemically synthesized
ttaacgtctctgtggccctcct

SEQ ID NO: 870517 - DNA, 22 bp, Artificial Sequence
  chemically synthesized
ggaagggtaggaggagggccac

SEQ ID NO: 870518 - DNA, 22 bp, Artificial Sequence
  chemically synthesized
gaagggtaggaggagggccaca

SEQ ID NO: 870519 - DNA, 22 bp, Artificial Sequence
  chemically synthesized
aaatttttaacgtctctgtggc

SEQ ID NO: 870520 - DNA, 22 bp, Artificial Sequence
  chemically synthesized
tcaaatttttaacgtctctgtg

SEQ ID NO: 870521 - DNA, 22 bp, Artificial Sequence
  chemically synthesized
ctcaaatttttaacgtctctgt

SEQ ID NO: 870522 - DNA, 22 bp, Artificial Sequence
  chemically synthesized
tttctcaaatttttaacgtctc

SEQ ID NO: 870523 - DNA, 22 bp, Artificial Sequence
  chemically synthesized
gcaacaaaacagctgtttctca

SEQ ID NO: 870524 - DNA, 22 bp, Artificial Sequence
  chemically synthesized
aaaatttgagaaacagctgttt

SEQ ID NO: 870525 - DNA, 22 bp, Artificial Sequence
  chemically synthesized
gagaaacagctgttttgttgcc

SEQ ID NO: 870526 - DNA, 22 bp, Artificial Sequence
  chemically synthesized
agaaacagctgttttgttgcca

SEQ ID NO: 870527 - DNA, 22 bp, Artificial Sequence
  chemically synthesized
aatcagatgagtccccatggtc

SEQ ID NO: 870528 - DNA, 22 bp, Artificial Sequence
  chemically synthesized
ttttgttgccagaccatgggga

SEQ ID NO: 870529 - DNA, 22 bp, Artificial Sequence
  chemically synthesized
aaatcagatgagtccccatggt

SEQ ID NO: 870530 - DNA, 22 bp, Artificial Sequence
  chemically synthesized
tgttgccagaccatggggactc

SEQ ID NO: 870531 - DNA, 22 bp, Artificial Sequence
  chemically synthesized
gttgccagaccatggggactca

SEQ ID NO: 870532 - DNA, 22 bp, Artificial Sequence
  chemically synthesized
tcttaaatcagatgagtcccca

SEQ ID NO: 870533 - DNA, 22 bp, Artificial Sequence
  chemically synthesized
ttgccagaccatggggactcat

SEQ ID NO: 870534 - DNA, 22 bp, Artificial Sequence
  chemically synthesized
tatcttaaatcagatgagtccc

SEQ ID NO: 870535 - DNA, 22 bp, Artificial Sequence
  chemically synthesized
ctatcttaaatcagatgagtcc

SEQ ID NO: 870536 - DNA, 22 bp, Artificial Sequence
  chemically synthesized
ccagaccatggggactcatctg

SEQ ID NO: 870537 - DNA, 22 bp, Artificial Sequence
  chemically synthesized
tctatcttaaatcagatgagtc

SEQ ID NO: 870538 - DNA, 22 bp, Artificial Sequence
  chemically synthesized
ttctatcttaaatcagatgagt

SEQ ID NO: 870539 - DNA, 22 bp, Artificial Sequence
  chemically synthesized
ttttctatcttaaatcagatga

SEQ ID NO: 870540 - DNA, 22 bp, Artificial Sequence
  chemically synthesized
cttttctatcttaaatcagatg

SEQ ID NO: 870541 - DNA, 22 bp, Artificial Sequence
  chemically synthesized
tcttttctatcttaaatcagat

SEQ ID NO: 870542 - DNA, 22 bp, Artificial Sequence
  chemically synthesized
ttcttttctatcttaaatcaga

SEQ ID NO: 870543 - DNA, 22 bp, Artificial Sequence
  chemically synthesized
ccacttttcttttctatcttaa

SEQ ID NO: 870544 - DNA, 22 bp, Artificial Sequence
  chemically synthesized
cccacttttcttttctatctta

SEQ ID NO: 870545 - DNA, 22 bp, Artificial Sequence
  chemically synthesized
cttcccacttttcttttctatc

SEQ ID NO: 870546 - DNA, 22 bp, Artificial Sequence
  chemically synthesized
atctgatttaagatagaaaaga

SEQ ID NO: 870547 - DNA, 22 bp, Artificial Sequence
  chemically synthesized
atctccttcccacttttctttt

SEQ ID NO: 870548 - DNA, 22 bp, Artificial Sequence
  chemically synthesized
atttaagatagaaaagaaaagt

SEQ ID NO: 870549 - DNA, 22 bp, Artificial Sequence
  chemically synthesized
aatctccttcccacttttcttt

SEQ ID NO: 870550 - DNA, 22 bp, Artificial Sequence
  chemically synthesized
tttaatctccttcccacttttc

SEQ ID NO: 870551 - DNA, 22 bp, Artificial Sequence
  chemically synthesized
aagatagaaaagaaaagtggga

SEQ ID NO: 870552 - DNA, 22 bp, Artificial Sequence
  chemically synthesized
agatagaaaagaaaagtgggaa

SEQ ID NO: 870553 - DNA, 22 bp, Artificial Sequence
  chemically synthesized
ttatttaatctccttcccactt

SEQ ID NO: 870554 - DNA, 22 bp, Artificial Sequence
  chemically synthesized
aggtctgttatttaatctcctt

SEQ ID NO: 870555 - DNA, 22 bp, Artificial Sequence
  chemically synthesized
gaggtctgttatttaatctcct

SEQ ID NO: 870556 - DNA, 22 bp, Artificial Sequence
  chemically synthesized
tgaggtctgttatttaatctcc

SEQ ID NO: 870557 - DNA, 22 bp, Artificial Sequence
  chemically synthesized
tttgaggtctgttatttaatct

SEQ ID NO: 870558 - DNA, 22 bp, Artificial Sequence
  chemically synthesized
attctttgaggtctgttattta

SEQ ID NO: 870559 - DNA, 22 bp, Artificial Sequence
  chemically synthesized
gacagtgttcattctttgaggt

SEQ ID NO: 870560 - DNA, 22 bp, Artificial Sequence
  chemically synthesized
cgacagtgttcattctttgagg

SEQ ID NO: 870561 - DNA, 22 bp, Artificial Sequence
  chemically synthesized
aataacagacctcaaagaatga

SEQ ID NO: 870562 - DNA, 22 bp, Artificial Sequence
  chemically synthesized
tacatttcgacagtgttcattc

SEQ ID NO: 870563 - DNA, 22 bp, Artificial Sequence
  chemically synthesized
ctgtacatttcgacagtgttca

SEQ ID NO: 870564 - DNA, 22 bp, Artificial Sequence
  chemically synthesized
actgtacatttcgacagtgttc

SEQ ID NO: 870565 - DNA, 22 bp, Artificial Sequence
  chemically synthesized
aaagaatgaacactgtcgaaat

SEQ ID NO: 870566 - DNA, 22 bp, Artificial Sequence
  chemically synthesized
tgcttactgtacatttcgacag

SEQ ID NO: 870567 - DNA, 22 bp, Artificial Sequence
  chemically synthesized
atgcttactgtacatttcgaca

SEQ ID NO: 870568 - DNA, 22 bp, Artificial Sequence
  chemically synthesized
tcgaaatgtacagtaagcataa

SEQ ID NO: 870569 - DNA, 22 bp, Artificial Sequence
  chemically synthesized
gaataggaaaaatacatttatg

SEQ ID NO: 870570 - DNA, 22 bp, Artificial Sequence
  chemically synthesized
ttcgaataggaaaaatacattt

SEQ ID NO: 870571 - DNA, 22 bp, Artificial Sequence
  chemically synthesized
attcgaataggaaaaatacatt

SEQ ID NO: 870572 - DNA, 22 bp, Artificial Sequence
  chemically synthesized
tattcgaataggaaaaatacat

SEQ ID NO: 870573 - DNA, 22 bp, Artificial Sequence
  chemically synthesized
ttattcgaataggaaaaataca

SEQ ID NO: 870574 - DNA, 22 bp, Artificial Sequence
  chemically synthesized
tttttattcgaataggaaaaat

SEQ ID NO: 870575 - DNA, 22 bp, Artificial Sequence
  chemically synthesized
aattatttttattcgaatagga

SEQ ID NO: 870576 - DNA, 22 bp, Artificial Sequence
  chemically synthesized
tctaaattatttttattcgaat

SEQ ID NO: 870577 - DNA, 22 bp, Artificial Sequence
  chemically synthesized
ctgtctaaattatttttattcg

SEQ ID NO: 870578 - DNA, 22 bp, Artificial Sequence
  chemically synthesized
ttcctattcgaataaaaataat

SEQ ID NO: 870579 - DNA, 22 bp, Artificial Sequence
  chemically synthesized
tcctattcgaataaaaataatt

SEQ ID NO: 870580 - DNA, 22 bp, Artificial Sequence
  chemically synthesized
cctattcgaataaaaataattt

SEQ ID NO: 870581 - DNA, 22 bp, Artificial Sequence
  chemically synthesized
cagttactgtctaaattatttt

SEQ ID NO: 870582 - DNA, 22 bp, Artificial Sequence
  chemically synthesized
ctattcgaataaaaataattta

SEQ ID NO: 870583 - DNA, 22 bp, Artificial Sequence
  chemically synthesized
ttcgaataaaaataatttagac

SEQ ID NO: 870584 - DNA, 22 bp, Artificial Sequence
  chemically synthesized
agttccagttactgtctaaatt

SEQ ID NO: 870585 - DNA, 22 bp, Artificial Sequence
  chemically synthesized
gaataaaaataatttagacagt

SEQ ID NO: 870586 - DNA, 22 bp, Artificial Sequence
  chemically synthesized
acctaagttccagttactgtct

SEQ ID NO: 870587 - DNA, 22 bp, Artificial Sequence
  chemically synthesized
cctaacctaagttccagttact

SEQ ID NO: 870588 - DNA, 22 bp, Artificial Sequence
  chemically synthesized
aactacctaacctaagttccag

SEQ ID NO: 870589 - DNA, 22 bp, Artificial Sequence
  chemically synthesized
caactacctaacctaagttcca

SEQ ID NO: 870590 - DNA, 22 bp, Artificial Sequence
  chemically synthesized
tcaactacctaacctaagttcc

SEQ ID NO: 870591 - DNA, 22 bp, Artificial Sequence
  chemically synthesized
agacagtaactggaacttaggt

SEQ ID NO: 870592 - DNA, 22 bp, Artificial Sequence
  chemically synthesized
ttcaactacctaacctaagttc

SEQ ID NO: 870593 - DNA, 22 bp, Artificial Sequence
  chemically synthesized
gacagtaactggaacttaggtt

SEQ ID NO: 870594 - DNA, 22 bp, Artificial Sequence
  chemically synthesized
acagtttttcaactacctaacc

SEQ ID NO: 870595 - DNA, 22 bp, Artificial Sequence
  chemically synthesized
gacagtttttcaactacctaac

SEQ ID NO: 870596 - DNA, 22 bp, Artificial Sequence
  chemically synthesized
gaacttaggttaggtagttgaa

SEQ ID NO: 870597 - DNA, 22 bp, Artificial Sequence
  chemically synthesized
tacttgacagtttttcaactac

SEQ ID NO: 870598 - DNA, 22 bp, Artificial Sequence
  chemically synthesized
ctatacttgacagtttttcaac

SEQ ID NO: 870599 - DNA, 22 bp, Artificial Sequence
  chemically synthesized
aggttaggtagttgaaaaactg

SEQ ID NO: 870600 - DNA, 22 bp, Artificial Sequence
  chemically synthesized
ggttaggtagttgaaaaactgt

SEQ ID NO: 870601 - DNA, 22 bp, Artificial Sequence
  chemically synthesized
ggtagttgaaaaactgtcaagt

SEQ ID NO: 870602 - DNA, 22 bp, Artificial Sequence
  chemically synthesized
ccaatctgctatacttgacagt

SEQ ID NO: 870603 - DNA, 22 bp, Artificial Sequence
  chemically synthesized
taccaatctgctatacttgaca

SEQ ID NO: 870604 - DNA, 22 bp, Artificial Sequence
  chemically synthesized
aaaaactgtcaagtatagcaga

SEQ ID NO: 870605 - DNA, 22 bp, Artificial Sequence
  chemically synthesized
tcaagtatagcagattggtaga

SEQ ID NO: 870606 - DNA, 22 bp, Artificial Sequence
  chemically synthesized
aaaagtgaagagcagatggagt

SEQ ID NO: 870607 - DNA, 22 bp, Artificial Sequence
  chemically synthesized
aaaaagtgaagagcagatggag

SEQ ID NO: 870608 - DNA, 22 bp, Artificial Sequence
  chemically synthesized
ttaaaaagtgaagagcagatgg

SEQ ID NO: 870609 - DNA, 22 bp, Artificial Sequence
  chemically synthesized
cttaaaaagtgaagagcagatg

SEQ ID NO: 870610 - DNA, 22 bp, Artificial Sequence
  chemically synthesized
ttcttaaaaagtgaagagcaga

SEQ ID NO: 870611 - DNA, 22 bp, Artificial Sequence
  chemically synthesized
gtagaactccatctgctcttca

SEQ ID NO: 870612 - DNA, 22 bp, Artificial Sequence
  chemically synthesized
tcttcttaaaaagtgaagagca

SEQ ID NO: 870613 - DNA, 22 bp, Artificial Sequence
  chemically synthesized
ccaactctcttcttaaaaagtg

SEQ ID NO: 870614 - DNA, 22 bp, Artificial Sequence
  chemically synthesized
catctgctcttcactttttaag

SEQ ID NO: 870615 - DNA, 22 bp, Artificial Sequence
  chemically synthesized
ctcttcactttttaagaagaga

SEQ ID NO: 870616 - DNA, 22 bp, Artificial Sequence
  chemically synthesized
ttcactttttaagaagagagtt

SEQ ID NO: 870617 - DNA, 22 bp, Artificial Sequence
  chemically synthesized
cactttttaagaagagagttgg

SEQ ID NO: 870618 - DNA, 22 bp, Artificial Sequence
  chemically synthesized
gaagcgtaactgccaactctct

SEQ ID NO: 870619 - DNA, 22 bp, Artificial Sequence
  chemically synthesized
actttttaagaagagagttggc

SEQ ID NO: 870620 - DNA, 22 bp, Artificial Sequence
  chemically synthesized
agaagcgtaactgccaactctc

SEQ ID NO: 870621 - DNA, 22 bp, Artificial Sequence
  chemically synthesized
tttaagaagagagttggcagtt

SEQ ID NO: 870622 - DNA, 22 bp, Artificial Sequence
  chemically synthesized
ttaagaagagagttggcagtta

SEQ ID NO: 870623 - DNA, 22 bp, Artificial Sequence
  chemically synthesized
taagaagagagttggcagttac

SEQ ID NO: 870624 - DNA, 22 bp, Artificial Sequence
  chemically synthesized
aagaagagagttggcagttacg

SEQ ID NO: 870625 - DNA, 22 bp, Artificial Sequence
  chemically synthesized
agaagagagttggcagttacgc

SEQ ID NO: 870626 - DNA, 22 bp, Artificial Sequence
  chemically synthesized
gaagcaatcttagaagcgtaac

SEQ ID NO: 870627 - DNA, 22 bp, Artificial Sequence
  chemically synthesized
ttagaagcaatcttagaagcgt

SEQ ID NO: 870628 - DNA, 22 bp, Artificial Sequence
  chemically synthesized
tattagaagcaatcttagaagc

SEQ ID NO: 870629 - DNA, 22 bp, Artificial Sequence
  chemically synthesized
gcagttacgcttctaagattgc

SEQ ID NO: 870630 - DNA, 22 bp, Artificial Sequence
  chemically synthesized
attctattagaagcaatcttag

SEQ ID NO: 870631 - DNA, 22 bp, Artificial Sequence
  chemically synthesized
tcattctattagaagcaatctt

SEQ ID NO: 870632 - DNA, 22 bp, Artificial Sequence
  chemically synthesized
cgcttctaagattgcttctaat

SEQ ID NO: 870633 - DNA, 22 bp, Artificial Sequence
  chemically synthesized
ctaagattgcttctaatagaat

SEQ ID NO: 870634 - DNA, 22 bp, Artificial Sequence
  chemically synthesized
taagattgcttctaatagaatg

SEQ ID NO: 870635 - DNA, 22 bp, Artificial Sequence
  chemically synthesized
aggaaaggctctcattctatta

SEQ ID NO: 870636 - DNA, 22 bp, Artificial Sequence
  chemically synthesized
agattgcttctaatagaatgag

SEQ ID NO: 870637 - DNA, 22 bp, Artificial Sequence
  chemically synthesized
tctcaggaaaggctctcattct

SEQ ID NO: 870638 - DNA, 22 bp, Artificial Sequence
  chemically synthesized
cttctaatagaatgagagcctt

SEQ ID NO: 870639 - DNA, 22 bp, Artificial Sequence
  chemically synthesized
cactatctcaggaaaggctctc

SEQ ID NO: 870640 - DNA, 22 bp, Artificial Sequence
  chemically synthesized
ccactatctcaggaaaggctct

SEQ ID NO: 870641 - DNA, 22 bp, Artificial Sequence
  chemically synthesized
ctaatagaatgagagcctttcc

SEQ ID NO: 870642 - DNA, 22 bp, Artificial Sequence
  chemically synthesized
tccactatctcaggaaaggctc

SEQ ID NO: 870643 - DNA, 22 bp, Artificial Sequence
  chemically synthesized
taatagaatgagagcctttcct

SEQ ID NO: 870644 - DNA, 22 bp, Artificial Sequence
  chemically synthesized
ttccactatctcaggaaaggct

SEQ ID NO: 870645 - DNA, 22 bp, Artificial Sequence
  chemically synthesized
atagaatgagagcctttcctga

SEQ ID NO: 870646 - DNA, 22 bp, Artificial Sequence
  chemically synthesized
ttttccactatctcaggaaagg

SEQ ID NO: 870647 - DNA, 22 bp, Artificial Sequence
  chemically synthesized
cttttccactatctcaggaaag

SEQ ID NO: 870648 - DNA, 22 bp, Artificial Sequence
  chemically synthesized
tcttttccactatctcaggaaa

SEQ ID NO: 870649 - DNA, 22 bp, Artificial Sequence
  chemically synthesized
tttcttttccactatctcagga

SEQ ID NO: 870650 - DNA, 22 bp, Artificial Sequence
  chemically synthesized
aacagtcattctttcttttcca

SEQ ID NO: 870651 - DNA, 22 bp, Artificial Sequence
  chemically synthesized
tcctgagatagtggaaaagaaa

SEQ ID NO: 870652 - DNA, 22 bp, Artificial Sequence
  chemically synthesized
gaacagtcattctttcttttcc

SEQ ID NO: 870653 - DNA, 22 bp, Artificial Sequence
  chemically synthesized
cctgagatagtggaaaagaaag

SEQ ID NO: 870654 - DNA, 22 bp, Artificial Sequence
  chemically synthesized
ctgagatagtggaaaagaaaga

SEQ ID NO: 870655 - DNA, 22 bp, Artificial Sequence
  chemically synthesized
agatagtggaaaagaaagaatg

SEQ ID NO: 870656 - DNA, 22 bp, Artificial Sequence
  chemically synthesized
aaaagtatttgaacagtcattc

SEQ ID NO: 870657 - DNA, 22 bp, Artificial Sequence
  chemically synthesized
tggtctgaaaagtatttgaaca

SEQ ID NO: 870658 - DNA, 22 bp, Artificial Sequence
  chemically synthesized
agattgtggtctgaaaagtatt

SEQ ID NO: 870659 - DNA, 22 bp, Artificial Sequence
  chemically synthesized
aagattgtggtctgaaaagtat

SEQ ID NO: 870660 - DNA, 22 bp, Artificial Sequence
  chemically synthesized
taagattgtggtctgaaaagta

SEQ ID NO: 870661 - DNA, 22 bp, Artificial Sequence
  chemically synthesized
ttcaaatacttttcagaccaca

SEQ ID NO: 870662 - DNA, 22 bp, Artificial Sequence
  chemically synthesized
tcgattttaagattgtggtctg

SEQ ID NO: 870663 - DNA, 22 bp, Artificial Sequence
  chemically synthesized
aaatacttttcagaccacaatc

SEQ ID NO: 870664 - DNA, 22 bp, Artificial Sequence
  chemically synthesized
aattgtcgattttaagattgtg

SEQ ID NO: 870665 - DNA, 22 bp, Artificial Sequence
  chemically synthesized
caattgtcgattttaagattgt

SEQ ID NO: 870666 - DNA, 22 bp, Artificial Sequence
  chemically synthesized
ttcagaccacaatcttaaaatc

SEQ ID NO: 870667 - DNA, 22 bp, Artificial Sequence
  chemically synthesized
tcagaccacaatcttaaaatcg

SEQ ID NO: 870668 - DNA, 22 bp, Artificial Sequence
  chemically synthesized
tacttcaattgtcgattttaag

SEQ ID NO: 870669 - DNA, 22 bp, Artificial Sequence
  chemically synthesized
cagaccacaatcttaaaatcga

SEQ ID NO: 870670 - DNA, 22 bp, Artificial Sequence
  chemically synthesized
gtacttcaattgtcgattttaa

SEQ ID NO: 870671 - DNA, 22 bp, Artificial Sequence
  chemically synthesized
agaccacaatcttaaaatcgac

SEQ ID NO: 870672 - DNA, 22 bp, Artificial Sequence
  chemically synthesized
tgtacttcaattgtcgatttta

SEQ ID NO: 870673 - DNA, 22 bp, Artificial Sequence
  chemically synthesized
tagcagttttgtacttcaattg

SEQ ID NO: 870674 - DNA, 22 bp, Artificial Sequence
  chemically synthesized
aaaatcgacaattgaagtacaa

SEQ ID NO: 870675 - DNA, 22 bp, Artificial Sequence
  chemically synthesized
aaatcgacaattgaagtacaaa

SEQ ID NO: 870676 - DNA, 22 bp, Artificial Sequence
  chemically synthesized
gaaaggaaattgtagcagtttt

SEQ ID NO: 870677 - DNA, 22 bp, Artificial Sequence
  chemically synthesized
cgaaaggaaattgtagcagttt

SEQ ID NO: 870678 - DNA, 22 bp, Artificial Sequence
  chemically synthesized
aagtacaaaactgctacaattt

SEQ ID NO: 870679 - DNA, 22 bp, Artificial Sequence
  chemically synthesized
agagagaaacaagatttcgaaa

SEQ ID NO: 870680 - DNA, 22 bp, Artificial Sequence
  chemically synthesized
ctacaatttcctttcgaaatct

SEQ ID NO: 870681 - DNA, 22 bp, Artificial Sequence
  chemically synthesized
cagagagaaacaagatttcgaa

SEQ ID NO: 870682 - DNA, 22 bp, Artificial Sequence
  chemically synthesized
caatttcctttcgaaatcttgt

SEQ ID NO: 870683 - DNA, 22 bp, Artificial Sequence
  chemically synthesized
ccttcagagagaaacaagattt

SEQ ID NO: 870684 - DNA, 22 bp, Artificial Sequence
  chemically synthesized
accttcagagagaaacaagatt

SEQ ID NO: 870685 - DNA, 22 bp, Artificial Sequence
  chemically synthesized
taccttcagagagaaacaagat

SEQ ID NO: 870686 - DNA, 22 bp, Artificial Sequence
  chemically synthesized
cctttcgaaatcttgtttctct

SEQ ID NO: 870687 - DNA, 22 bp, Artificial Sequence
  chemically synthesized
ctttcgaaatcttgtttctctc

SEQ ID NO: 870688 - DNA, 22 bp, Artificial Sequence
  chemically synthesized
tcgaaatcttgtttctctctga

SEQ ID NO: 870689 - DNA, 22 bp, Artificial Sequence
  chemically synthesized
cgaaatcttgtttctctctgaa

SEQ ID NO: 870690 - DNA, 22 bp, Artificial Sequence
  chemically synthesized
gaaatcttgtttctctctgaag

SEQ ID NO: 870691 - DNA, 22 bp, Artificial Sequence
  chemically synthesized
aatataactttaccttcagaga

SEQ ID NO: 870692 - DNA, 22 bp, Artificial Sequence
  chemically synthesized
aaattgaatataactttacctt

SEQ ID NO: 870693 - DNA, 22 bp, Artificial Sequence
  chemically synthesized
gtttctctctgaaggtaaagtt

SEQ ID NO: 870694 - DNA, 22 bp, Artificial Sequence
  chemically synthesized
aaaattgaatataactttacct

SEQ ID NO: 870695 - DNA, 22 bp, Artificial Sequence
  chemically synthesized
tttctctctgaaggtaaagtta

SEQ ID NO: 870696 - DNA, 22 bp, Artificial Sequence
  chemically synthesized
taaaattgaatataactttacc

SEQ ID NO: 870697 - DNA, 22 bp, Artificial Sequence
  chemically synthesized
ctctctgaaggtaaagttatat

SEQ ID NO: 870698 - DNA, 22 bp, Artificial Sequence
  chemically synthesized
tctctgaaggtaaagttatatt

SEQ ID NO: 870699 - DNA, 22 bp, Artificial Sequence
  chemically synthesized
tctgaaggtaaagttatattca

SEQ ID NO: 870700 - DNA, 22 bp, Artificial Sequence
  chemically synthesized
tgaaggtaaagttatattcaat

SEQ ID NO: 870701 - DNA, 22 bp, Artificial Sequence
  chemically synthesized
aatagttttaaaattgaatata

SEQ ID NO: 870702 - DNA, 22 bp, Artificial Sequence
  chemically synthesized
aaggtaaagttatattcaattt

SEQ ID NO: 870703 - DNA, 22 bp, Artificial Sequence
  chemically synthesized
actgaatagttttaaaattgaa

SEQ ID NO: 870704 - DNA, 22 bp, Artificial Sequence
  chemically synthesized
cactgaatagttttaaaattga

SEQ ID NO: 870705 - DNA, 22 bp, Artificial Sequence
  chemically synthesized
aaacttcactgaatagttttaa

SEQ ID NO: 870706 - DNA, 22 bp, Artificial Sequence
  chemically synthesized
tattcaattttaaaactattca

SEQ ID NO: 870707 - DNA, 22 bp, Artificial Sequence
  chemically synthesized
ctaaaacttcactgaatagttt

SEQ ID NO: 870708 - DNA, 22 bp, Artificial Sequence
  chemically synthesized
cctaaaacttcactgaatagtt

SEQ ID NO: 870709 - DNA, 22 bp, Artificial Sequence
  chemically synthesized
aattttaaaactattcagtgaa

SEQ ID NO: 870710 - DNA, 22 bp, Artificial Sequence
  chemically synthesized
atatttcctaaaacttcactga

SEQ ID NO: 870711 - DNA, 22 bp, Artificial Sequence
  chemically synthesized
taaaactattcagtgaagtttt

SEQ ID NO: 870712 - DNA, 22 bp, Artificial Sequence
  chemically synthesized
ctaatatttcctaaaacttcac

SEQ ID NO: 870713 - DNA, 22 bp, Artificial Sequence
  chemically synthesized
aaaactattcagtgaagtttta

SEQ ID NO: 870714 - DNA, 22 bp, Artificial Sequence
  chemically synthesized
aaactattcagtgaagttttag

SEQ ID NO: 870715 - DNA, 22 bp, Artificial Sequence
  chemically synthesized
ttcagtgaagttttaggaaata

SEQ ID NO: 870716 - DNA, 22 bp, Artificial Sequence
  chemically synthesized
agtgaagttttaggaaatatta

SEQ ID NO: 870717 - DNA, 22 bp, Artificial Sequence
  chemically synthesized
aacatgtattcctaatatttcc

SEQ ID NO: 870718 - DNA, 22 bp, Artificial Sequence
  chemically synthesized
caacatgtattcctaatatttc

SEQ ID NO: 870719 - DNA, 22 bp, Artificial Sequence
  chemically synthesized
taggaaatattaggaatacatg

SEQ ID NO: 870720 - DNA, 22 bp, Artificial Sequence
  chemically synthesized
aggaaatattaggaatacatgt

SEQ ID NO: 870721 - DNA, 22 bp, Artificial Sequence
  chemically synthesized
ggaaatattaggaatacatgtt

SEQ ID NO: 870722 - DNA, 22 bp, Artificial Sequence
  chemically synthesized
aaaatggaaggcttcaacatgt

SEQ ID NO: 870723 - DNA, 22 bp, Artificial Sequence
  chemically synthesized
ccgctcaaaatggaaggcttca

SEQ ID NO: 870724 - DNA, 22 bp, Artificial Sequence
  chemically synthesized
ggaatacatgttgaagccttcc

SEQ ID NO: 870725 - DNA, 22 bp, Artificial Sequence
  chemically synthesized
aagccttccattttgagcggta

SEQ ID NO: 870726 - DNA, 22 bp, Artificial Sequence
  chemically synthesized
tgagagtaagtaccctaccgct

SEQ ID NO: 870727 - DNA, 22 bp, Artificial Sequence
  chemically synthesized
atgagagtaagtaccctaccgc

SEQ ID NO: 870728 - DNA, 22 bp, Artificial Sequence
  chemically synthesized
ccattttgagcggtagggtact

SEQ ID NO: 870729 - DNA, 22 bp, Artificial Sequence
  chemically synthesized
cattttgagcggtagggtactt

SEQ ID NO: 870730 - DNA, 22 bp, Artificial Sequence
  chemically synthesized
tgagcggtagggtacttactct

SEQ ID NO: 870731 - DNA, 22 bp, Artificial Sequence
  chemically synthesized
ggcatatttatgagagtaagta

SEQ ID NO: 870732 - DNA, 22 bp, Artificial Sequence
  chemically synthesized
gagcggtagggtacttactctc

SEQ ID NO: 870733 - DNA, 22 bp, Artificial Sequence
  chemically synthesized
aggcatatttatgagagtaagt

SEQ ID NO: 870734 - DNA, 22 bp, Artificial Sequence
  chemically synthesized
agcggtagggtacttactctca

SEQ ID NO: 870735 - DNA, 22 bp, Artificial Sequence
  chemically synthesized
tttaggcatatttatgagagta

SEQ ID NO: 870736 - DNA, 22 bp, Artificial Sequence
  chemically synthesized
actctcataaatatgcctaaat

SEQ ID NO: 870737 - DNA, 22 bp, Artificial Sequence
  chemically synthesized
ctctcataaatatgcctaaata

SEQ ID NO: 870738 - DNA, 22 bp, Artificial Sequence
  chemically synthesized
tcataaatatgcctaaatagtt

SEQ ID NO: 870739 - DNA, 22 bp, Artificial Sequence
  chemically synthesized
accaagaaaccagaactattta

SEQ ID NO: 870740 - DNA, 22 bp, Artificial Sequence
  chemically synthesized
ataaatatgcctaaatagttct

SEQ ID NO: 870741 - DNA, 22 bp, Artificial Sequence
  chemically synthesized
tgaccaagaaaccagaactatt

SEQ ID NO: 870742 - DNA, 22 bp, Artificial Sequence
  chemically synthesized
tcatactctgaccaagaaacca

SEQ ID NO: 870743 - DNA, 22 bp, Artificial Sequence
  chemically synthesized
aatagttctggtttcttggtca

SEQ ID NO: 870744 - DNA, 22 bp, Artificial Sequence
  chemically synthesized
actgtcatactctgaccaagaa

SEQ ID NO: 870745 - DNA, 22 bp, Artificial Sequence
  chemically synthesized
gactgtcatactctgaccaaga

SEQ ID NO: 870746 - DNA, 22 bp, Artificial Sequence
  chemically synthesized
tggtttcttggtcagagtatga

SEQ ID NO: 870747 - DNA, 22 bp, Artificial Sequence
  chemically synthesized
gtttcttggtcagagtatgaca

SEQ ID NO: 870748 - DNA, 22 bp, Artificial Sequence
  chemically synthesized
cttggtcagagtatgacagtca

SEQ ID NO: 870749 - DNA, 22 bp, Artificial Sequence
  chemically synthesized
ttggtcagagtatgacagtcaa

SEQ ID NO: 870750 - DNA, 22 bp, Artificial Sequence
  chemically synthesized
ggtcagagtatgacagtcaaga

SEQ ID NO: 870751 - DNA, 22 bp, Artificial Sequence
  chemically synthesized
gtcagagtatgacagtcaagat

SEQ ID NO: 870752 - DNA, 22 bp, Artificial Sequence
  chemically synthesized
cagagtataccataatcttgac

SEQ ID NO: 870753 - DNA, 22 bp, Artificial Sequence
  chemically synthesized
aaatcactacagagtataccat

SEQ ID NO: 870754 - DNA, 22 bp, Artificial Sequence
  chemically synthesized
gaaatcactacagagtatacca

SEQ ID NO: 870755 - DNA, 22 bp, Artificial Sequence
  chemically synthesized
cttgaaatcactacagagtata

SEQ ID NO: 870756 - DNA, 22 bp, Artificial Sequence
  chemically synthesized
gcttgaaatcactacagagtat

SEQ ID NO: 870757 - DNA, 22 bp, Artificial Sequence
  chemically synthesized
tgcttgaaatcactacagagta

SEQ ID NO: 870758 - DNA, 22 bp, Artificial Sequence
  chemically synthesized
ttgcttgaaatcactacagagt

SEQ ID NO: 870759 - DNA, 22 bp, Artificial Sequence
  chemically synthesized
tggtatactctgtagtgatttc

SEQ ID NO: 870760 - DNA, 22 bp, Artificial Sequence
  chemically synthesized
aagaaaggacttttgcttgaaa

SEQ ID NO: 870761 - DNA, 22 bp, Artificial Sequence
  chemically synthesized
caagaaaggacttttgcttgaa

SEQ ID NO: 870762 - DNA, 22 bp, Artificial Sequence
  chemically synthesized
ttcaagaaaggacttttgcttg

SEQ ID NO: 870763 - DNA, 22 bp, Artificial Sequence
  chemically synthesized
tgtagtgatttcaagcaaaagt

SEQ ID NO: 870764 - DNA, 22 bp, Artificial Sequence
  chemically synthesized
tagtgatttcaagcaaaagtcc

SEQ ID NO: 870765 - DNA, 22 bp, Artificial Sequence
  chemically synthesized
acactcttcaagaaaggacttt

SEQ ID NO: 870766 - DNA, 22 bp, Artificial Sequence
  chemically synthesized
aacactcttcaagaaaggactt

SEQ ID NO: 870767 - DNA, 22 bp, Artificial Sequence
  chemically synthesized
tttaacactcttcaagaaagga

SEQ ID NO: 870768 - DNA, 22 bp, Artificial Sequence
  chemically synthesized
caagcaaaagtcctttcttgaa

SEQ ID NO: 870769 - DNA, 22 bp, Artificial Sequence
  chemically synthesized
aagcaaaagtcctttcttgaag

SEQ ID NO: 870770 - DNA, 22 bp, Artificial Sequence
  chemically synthesized
tgctatttaacactcttcaaga

SEQ ID NO: 870771 - DNA, 22 bp, Artificial Sequence
  chemically synthesized
atgctatttaacactcttcaag

SEQ ID NO: 870772 - DNA, 22 bp, Artificial Sequence
  chemically synthesized
ttatgctatttaacactcttca

SEQ ID NO: 870773 - DNA, 22 bp, Artificial Sequence
  chemically synthesized
cttatgctatttaacactcttc

SEQ ID NO: 870774 - DNA, 22 bp, Artificial Sequence
  chemically synthesized
accttcttatgctatttaacac

SEQ ID NO: 870775 - DNA, 22 bp, Artificial Sequence
  chemically synthesized
aaccttcttatgctatttaaca

SEQ ID NO: 870776 - DNA, 22 bp, Artificial Sequence
  chemically synthesized
taaccttcttatgctatttaac

SEQ ID NO: 870777 - DNA, 22 bp, Artificial Sequence
  chemically synthesized
tcttgaagagtgttaaatagca

SEQ ID NO: 870778 - DNA, 22 bp, Artificial Sequence
  chemically synthesized
cttgaagagtgttaaatagcat

SEQ ID NO: 870779 - DNA, 22 bp, Artificial Sequence
  chemically synthesized
ttgaagagtgttaaatagcata

SEQ ID NO: 870780 - DNA, 22 bp, Artificial Sequence
  chemically synthesized
ctttaaccttcttatgctattt

SEQ ID NO: 870781 - DNA, 22 bp, Artificial Sequence
  chemically synthesized
actttaaccttcttatgctatt

SEQ ID NO: 870782 - DNA, 22 bp, Artificial Sequence
  chemically synthesized
gaagagtgttaaatagcataag

SEQ ID NO: 870783 - DNA, 22 bp, Artificial Sequence
  chemically synthesized
aagagtgttaaatagcataaga

SEQ ID NO: 870784 - DNA, 22 bp, Artificial Sequence
  chemically synthesized
cagtaaacttactttaaccttc

SEQ ID NO: 870785 - DNA, 22 bp, Artificial Sequence
  chemically synthesized
aatagcataagaaggttaaagt

SEQ ID NO: 870786 - DNA, 22 bp, Artificial Sequence
  chemically synthesized
attacagtaaacttactttaac

SEQ ID NO: 870787 - DNA, 22 bp, Artificial Sequence
  chemically synthesized
aagtaagtttactgtaattaac

SEQ ID NO: 870788 - DNA, 22 bp, Artificial Sequence
  chemically synthesized
acagaaataaaatgttaattac

SEQ ID NO: 870789 - DNA, 22 bp, Artificial Sequence
  chemically synthesized
aacagaaataaaatgttaatta

SEQ ID NO: 870790 - DNA, 22 bp, Artificial Sequence
  chemically synthesized
taacagaaataaaatgttaatt

SEQ ID NO: 870791 - DNA, 22 bp, Artificial Sequence
  chemically synthesized
cattttaacagaaataaaatgt

SEQ ID NO: 870792 - DNA, 22 bp, Artificial Sequence
  chemically synthesized
actgtaattaacattttatttc

SEQ ID NO: 870793 - DNA, 22 bp, Artificial Sequence
  chemically synthesized
ctgtaattaacattttatttct

SEQ ID NO: 870794 - DNA, 22 bp, Artificial Sequence
  chemically synthesized
taattaacattttatttctgtt

SEQ ID NO: 870795 - DNA, 22 bp, Artificial Sequence
  chemically synthesized
tgtcctgcattttaacagaaat

SEQ ID NO: 870796 - DNA, 22 bp, Artificial Sequence
  chemically synthesized
cctatgtcctgcattttaacag

SEQ ID NO: 870797 - DNA, 22 bp, Artificial Sequence
  chemically synthesized
acattttatttctgttaaaatg

SEQ ID NO: 870798 - DNA, 22 bp, Artificial Sequence
  chemically synthesized
attacctatgtcctgcatttta

SEQ ID NO: 870799 - DNA, 22 bp, Artificial Sequence
  chemically synthesized
gattacctatgtcctgcatttt

SEQ ID NO: 870800 - DNA, 22 bp, Artificial Sequence
  chemically synthesized
tgattacctatgtcctgcattt

SEQ ID NO: 870801 - DNA, 22 bp, Artificial Sequence
  chemically synthesized
tatttctgttaaaatgcaggac

SEQ ID NO: 870802 - DNA, 22 bp, Artificial Sequence
  chemically synthesized
ttgattacctatgtcctgcatt

SEQ ID NO: 870803 - DNA, 22 bp, Artificial Sequence
  chemically synthesized
atttctgttaaaatgcaggaca

SEQ ID NO: 870804 - DNA, 22 bp, Artificial Sequence
  chemically synthesized
tttgattacctatgtcctgcat

SEQ ID NO: 870805 - DNA, 22 bp, Artificial Sequence
  chemically synthesized
tttctgttaaaatgcaggacat

SEQ ID NO: 870806 - DNA, 22 bp, Artificial Sequence
  chemically synthesized
ctgttaaaatgcaggacatagg

SEQ ID NO: 870807 - DNA, 22 bp, Artificial Sequence
  chemically synthesized
tgttaaaatgcaggacataggt

SEQ ID NO: 870808 - DNA, 22 bp, Artificial Sequence
  chemically synthesized
ttaaaatgcaggacataggtaa

SEQ ID NO: 870809 - DNA, 22 bp, Artificial Sequence
  chemically synthesized
gagattttttgattacctatgt

SEQ ID NO: 870810 - DNA, 22 bp, Artificial Sequence
  chemically synthesized
aaatgcaggacataggtaatca

SEQ ID NO: 870811 - DNA, 22 bp, Artificial Sequence
  chemically synthesized
atgattagagattttttgatta

SEQ ID NO: 870812 - DNA, 22 bp, Artificial Sequence
  chemically synthesized
tgatgattagagattttttgat

SEQ ID NO: 870813 - DNA, 22 bp, Artificial Sequence
  chemically synthesized
acatcaattctgatgattagag

SEQ ID NO: 870814 - DNA, 22 bp, Artificial Sequence
  chemically synthesized
taatcatcagaattgatgttag

SEQ ID NO: 870815 - DNA, 22 bp, Artificial Sequence
  chemically synthesized
atcatcagaattgatgttagcc

SEQ ID NO: 870816 - DNA, 22 bp, Artificial Sequence
  chemically synthesized
ggaaaaagagaaggctaacatc

SEQ ID NO: 870817 - DNA, 22 bp, Artificial Sequence
  chemically synthesized
taggaaaaagagaaggctaaca

SEQ ID NO: 870818 - DNA, 22 bp, Artificial Sequence
  chemically synthesized
ctaggaaaaagagaaggctaac

SEQ ID NO: 870819 - DNA, 22 bp, Artificial Sequence
  chemically synthesized
atcatttctaggaaaaagagaa

SEQ ID NO: 870820 - DNA, 22 bp, Artificial Sequence
  chemically synthesized
atgttagccttctctttttcct

SEQ ID NO: 870821 - DNA, 22 bp, Artificial Sequence
  chemically synthesized
gttcatcatttctaggaaaaag

SEQ ID NO: 870822 - DNA, 22 bp, Artificial Sequence
  chemically synthesized
tagttcatcatttctaggaaaa

SEQ ID NO: 870823 - DNA, 22 bp, Artificial Sequence
  chemically synthesized
gccttctctttttcctagaaat

SEQ ID NO: 870824 - DNA, 22 bp, Artificial Sequence
  chemically synthesized
ctctttttcctagaaatgatga

SEQ ID NO: 870825 - DNA, 22 bp, Artificial Sequence
  chemically synthesized
tctttttcctagaaatgatgaa

SEQ ID NO: 870826 - DNA, 22 bp, Artificial Sequence
  chemically synthesized
tttttcctagaaatgatgaact

SEQ ID NO: 870827 - DNA, 22 bp, Artificial Sequence
  chemically synthesized
tttcctagaaatgatgaactag

SEQ ID NO: 870828 - DNA, 22 bp, Artificial Sequence
  chemically synthesized
ttcctagaaatgatgaactaga

SEQ ID NO: 870829 - DNA, 22 bp, Artificial Sequence
  chemically synthesized
tcctagaaatgatgaactagag

SEQ ID NO: 870830 - DNA, 22 bp, Artificial Sequence
  chemically synthesized
cctagaaatgatgaactagagt

SEQ ID NO: 870831 - DNA, 22 bp, Artificial Sequence
  chemically synthesized
ctagaaatgatgaactagagtt

SEQ ID NO: 870832 - DNA, 22 bp, Artificial Sequence
  chemically synthesized
atgaaggaagagaaactctagt

SEQ ID NO: 870833 - DNA, 22 bp, Artificial Sequence
  chemically synthesized
gaaatgatgaactagagtttct

SEQ ID NO: 870834 - DNA, 22 bp, Artificial Sequence
  chemically synthesized
aactgatgaaggaagagaaact

SEQ ID NO: 870835 - DNA, 22 bp, Artificial Sequence
  chemically synthesized
gggtctgaactgatgaaggaag

SEQ ID NO: 870836 - DNA, 22 bp, Artificial Sequence
  chemically synthesized
ggggtctgaactgatgaaggaa

SEQ ID NO: 870837 - DNA, 22 bp, Artificial Sequence
  chemically synthesized
tggggtctgaactgatgaagga

SEQ ID NO: 870838 - DNA, 22 bp, Artificial Sequence
  chemically synthesized
gagtttctcttccttcatcagt

SEQ ID NO: 870839 - DNA, 22 bp, Artificial Sequence
  chemically synthesized
tgctttggggtctgaactgatg

SEQ ID NO: 870840 - DNA, 22 bp, Artificial Sequence
  chemically synthesized
ctcttccttcatcagttcagac

SEQ ID NO: 870841 - DNA, 22 bp, Artificial Sequence
  chemically synthesized
tcttccttcatcagttcagacc

SEQ ID NO: 870842 - DNA, 22 bp, Artificial Sequence
  chemically synthesized
ttccttcatcagttcagacccc

SEQ ID NO: 870843 - DNA, 22 bp, Artificial Sequence
  chemically synthesized
gggttgtgctttggggtctgaa

SEQ ID NO: 870844 - DNA, 22 bp, Artificial Sequence
  chemically synthesized
ccttcatcagttcagaccccaa

SEQ ID NO: 870845 - DNA, 22 bp, Artificial Sequence
  chemically synthesized
cttcatcagttcagaccccaaa

SEQ ID NO: 870846 - DNA, 22 bp, Artificial Sequence
  chemically synthesized
catcagttcagaccccaaagca

SEQ ID NO: 870847 - DNA, 22 bp, Artificial Sequence
  chemically synthesized
cagttagggttgtgctttgggg

SEQ ID NO: 870848 - DNA, 22 bp, Artificial Sequence
  chemically synthesized
atcagttcagaccccaaagcac

SEQ ID NO: 870849 - DNA, 22 bp, Artificial Sequence
  chemically synthesized
ccagttagggttgtgctttggg

SEQ ID NO: 870850 - DNA, 22 bp, Artificial Sequence
  chemically synthesized
ccatttccagttagggttgtgc

SEQ ID NO: 870851 - DNA, 22 bp, Artificial Sequence
  chemically synthesized
agaccccaaagcacaaccctaa

SEQ ID NO: 870852 - DNA, 22 bp, Artificial Sequence
  chemically synthesized
catggttaccatttccagttag

SEQ ID NO: 870853 - DNA, 22 bp, Artificial Sequence
  chemically synthesized
ttgcatggttaccatttccagt

SEQ ID NO: 870854 - DNA, 22 bp, Artificial Sequence
  chemically synthesized
attgcatggttaccatttccag

SEQ ID NO: 870855 - DNA, 22 bp, Artificial Sequence
  chemically synthesized
tattgcatggttaccatttcca

SEQ ID NO: 870856 - DNA, 22 bp, Artificial Sequence
  chemically synthesized
gtagttttattgcatggttacc

SEQ ID NO: 870857 - DNA, 22 bp, Artificial Sequence
  chemically synthesized
ggtagttttattgcatggttac

SEQ ID NO: 870858 - DNA, 22 bp, Artificial Sequence
  chemically synthesized
tggtagttttattgcatggtta

SEQ ID NO: 870859 - DNA, 22 bp, Artificial Sequence
  chemically synthesized
actggaaatggtaaccatgcaa

SEQ ID NO: 870860 - DNA, 22 bp, Artificial Sequence
  chemically synthesized
ttggtagttttattgcatggtt

SEQ ID NO: 870861 - DNA, 22 bp, Artificial Sequence
  chemically synthesized
gaaatggtaaccatgcaataaa

SEQ ID NO: 870862 - DNA, 22 bp, Artificial Sequence
  chemically synthesized
accttttggtagttttattgca

SEQ ID NO: 870863 - DNA, 22 bp, Artificial Sequence
  chemically synthesized
aaccttttggtagttttattgc

SEQ ID NO: 870864 - DNA, 22 bp, Artificial Sequence
  chemically synthesized
ttaaccttttggtagttttatt

SEQ ID NO: 870865 - DNA, 22 bp, Artificial Sequence
  chemically synthesized
tcttaaccttttggtagtttta

SEQ ID NO: 870866 - DNA, 22 bp, Artificial Sequence
  chemically synthesized
cctctcttaaccttttggtagt

SEQ ID NO: 870867 - DNA, 22 bp, Artificial Sequence
  chemically synthesized
tccctctcttaaccttttggta

SEQ ID NO: 870868 - DNA, 22 bp, Artificial Sequence
  chemically synthesized
ctccctctcttaaccttttggt

SEQ ID NO: 870869 - DNA, 22 bp, Artificial Sequence
  chemically synthesized
ttctccctctcttaaccttttg

SEQ ID NO: 870870 - DNA, 22 bp, Artificial Sequence
  chemically synthesized
cttctccctctcttaacctttt

SEQ ID NO: 870871 - DNA, 22 bp, Artificial Sequence
  chemically synthesized
tcttctccctctcttaaccttt

SEQ ID NO: 870872 - DNA, 22 bp, Artificial Sequence
  chemically synthesized
cctttcttctccctctcttaac

SEQ ID NO: 870873 - DNA, 22 bp, Artificial Sequence
  chemically synthesized
ccaaaaggttaagagagggaga

SEQ ID NO: 870874 - DNA, 22 bp, Artificial Sequence
  chemically synthesized
tgatgaagttccctttcttctc

SEQ ID NO: 870875 - DNA, 22 bp, Artificial Sequence
  chemically synthesized
gtgatgaagttccctttcttct

SEQ ID NO: 870876 - DNA, 22 bp, Artificial Sequence
  chemically synthesized
tgtgatgaagttccctttcttc

SEQ ID NO: 870877 - DNA, 22 bp, Artificial Sequence
  chemically synthesized
agagagggagaagaaagggaac

SEQ ID NO: 870878 - DNA, 22 bp, Artificial Sequence
  chemically synthesized
tccattttgtgatgaagttccc

SEQ ID NO: 870879 - DNA, 22 bp, Artificial Sequence
  chemically synthesized
attatccattttgtgatgaagt

SEQ ID NO: 870880 - DNA, 22 bp, Artificial Sequence
  chemically synthesized
gatgttaattatccattttgtg

SEQ ID NO: 870881 - DNA, 22 bp, Artificial Sequence
  chemically synthesized
agatgttaattatccattttgt

SEQ ID NO: 870882 - DNA, 22 bp, Artificial Sequence
  chemically synthesized
agcatttagatgttaattatcc

SEQ ID NO: 870883 - DNA, 22 bp, Artificial Sequence
  chemically synthesized
catcacaaaatggataattaac

SEQ ID NO: 870884 - DNA, 22 bp, Artificial Sequence
  chemically synthesized
atcacaaaatggataattaaca

SEQ ID NO: 870885 - DNA, 22 bp, Artificial Sequence
  chemically synthesized
gtattcagcatttagatgttaa

SEQ ID NO: 870886 - DNA, 22 bp, Artificial Sequence
  chemically synthesized
agtattcagcatttagatgtta

SEQ ID NO: 870887 - DNA, 22 bp, Artificial Sequence
  chemically synthesized
gtatttagtattcagcatttag

SEQ ID NO: 870888 - DNA, 22 bp, Artificial Sequence
  chemically synthesized
agtatttagtattcagcattta

SEQ ID NO: 870889 - DNA, 22 bp, Artificial Sequence
  chemically synthesized
tttagtatttagtattcagcat

SEQ ID NO: 870890 - DNA, 22 bp, Artificial Sequence
  chemically synthesized
ctgtttagtatttagtattcag

SEQ ID NO: 870891 - DNA, 22 bp, Artificial Sequence
  chemically synthesized
acatctaaatgctgaatactaa

SEQ ID NO: 870892 - DNA, 22 bp, Artificial Sequence
  chemically synthesized
tactgtttagtatttagtattc

SEQ ID NO: 870893 - DNA, 22 bp, Artificial Sequence
  chemically synthesized
ctactgtttagtatttagtatt

SEQ ID NO: 870894 - DNA, 22 bp, Artificial Sequence
  chemically synthesized
aatgctgaatactaaatactaa

SEQ ID NO: 870895 - DNA, 22 bp, Artificial Sequence
  chemically synthesized
aatactaaatactaaacagtag

SEQ ID NO: 870896 - DNA, 22 bp, Artificial Sequence
  chemically synthesized
aatactaaacagtagaagtttc

SEQ ID NO: 870897 - DNA, 22 bp, Artificial Sequence
  chemically synthesized
aacagtagaagtttcacattct

SEQ ID NO: 870898 - DNA, 22 bp, Artificial Sequence
  chemically synthesized
acatccaagacagtgatagaat

SEQ ID NO: 870899 - DNA, 22 bp, Artificial Sequence
  chemically synthesized
ttaacatccaagacagtgatag

SEQ ID NO: 870900 - DNA, 22 bp, Artificial Sequence
  chemically synthesized
cacattctatcactgtcttgga

SEQ ID NO: 870901 - DNA, 22 bp, Artificial Sequence
  chemically synthesized
acattctatcactgtcttggat

SEQ ID NO: 870902 - DNA, 22 bp, Artificial Sequence
  chemically synthesized
tatcactgtcttggatgttaac

SEQ ID NO: 870903 - DNA, 22 bp, Artificial Sequence
  chemically synthesized
cagtggcatcattgttaacatc

SEQ ID NO: 870904 - DNA, 22 bp, Artificial Sequence
  chemically synthesized
tcactgtcttggatgttaacaa

SEQ ID NO: 870905 - DNA, 22 bp, Artificial Sequence
  chemically synthesized
tcttggatgttaacaatgatgc

SEQ ID NO: 870906 - DNA, 22 bp, Artificial Sequence
  chemically synthesized
ggatgttaacaatgatgccact

SEQ ID NO: 870907 - DNA, 22 bp, Artificial Sequence
  chemically synthesized
gatgttaacaatgatgccactg

SEQ ID NO: 870908 - DNA, 22 bp, Artificial Sequence
  chemically synthesized
acaggaaaggcactacagtggc

SEQ ID NO: 870909 - DNA, 22 bp, Artificial Sequence
  chemically synthesized
acaatgatgccactgtagtgcc

SEQ ID NO: 870910 - DNA, 22 bp, Artificial Sequence
  chemically synthesized
gttaacaggaaaggcactacag

SEQ ID NO: 870911 - DNA, 22 bp, Artificial Sequence
  chemically synthesized
actggttaacaggaaaggcact

SEQ ID NO: 870912 - DNA, 22 bp, Artificial Sequence
  chemically synthesized
aacaatgctcactggttaacag

SEQ ID NO: 870913 - DNA, 22 bp, Artificial Sequence
  chemically synthesized
tagtgcctttcctgttaaccag

SEQ ID NO: 870914 - DNA, 22 bp, Artificial Sequence
  chemically synthesized
caacaatgctcactggttaaca

SEQ ID NO: 870915 - DNA, 22 bp, Artificial Sequence
  chemically synthesized
tcctgttaaccagtgagcattg

SEQ ID NO: 870916 - DNA, 22 bp, Artificial Sequence
  chemically synthesized
cctgttaaccagtgagcattgt

SEQ ID NO: 870917 - DNA, 22 bp, Artificial Sequence
  chemically synthesized
ctgttaaccagtgagcattgtt

SEQ ID NO: 870918 - DNA, 22 bp, Artificial Sequence
  chemically synthesized
ttaaccagtgagcattgttgaa

SEQ ID NO: 870919 - DNA, 22 bp, Artificial Sequence
  chemically synthesized
accagtgagcattgttgaagga

SEQ ID NO: 870920 - DNA, 22 bp, Artificial Sequence
  chemically synthesized
gtcccaggccaggtccttcaac

SEQ ID NO: 870921 - DNA, 22 bp, Artificial Sequence
  chemically synthesized
ttgaaggacctggcctgggacc

SEQ ID NO: 870922 - DNA, 22 bp, Artificial Sequence
  chemically synthesized
aaggacctggcctgggaccagg

SEQ ID NO: 870923 - DNA, 22 bp, Artificial Sequence
  chemically synthesized
catgaaggcagtagggggtccc

SEQ ID NO: 870924 - DNA, 22 bp, Artificial Sequence
  chemically synthesized
gcctgggaccagggacccccta

SEQ ID NO: 870925 - DNA, 22 bp, Artificial Sequence
  chemically synthesized
ccatgaaggcagtagggggtcc

SEQ ID NO: 870926 - DNA, 22 bp, Artificial Sequence
  chemically synthesized
tccatgaaggcagtagggggtc

SEQ ID NO: 870927 - DNA, 22 bp, Artificial Sequence
  chemically synthesized
ggaccagggaccccctactgcc

SEQ ID NO: 870928 - DNA, 22 bp, Artificial Sequence
  chemically synthesized
atcagaaggaagtctttccatg

SEQ ID NO: 870929 - DNA, 22 bp, Artificial Sequence
  chemically synthesized
ctgccttcatggaaagacttcc

SEQ ID NO: 870930 - DNA, 22 bp, Artificial Sequence
  chemically synthesized
acactcatcagaaggaagtctt

SEQ ID NO: 870931 - DNA, 22 bp, Artificial Sequence
  chemically synthesized
ccttcatggaaagacttccttc

SEQ ID NO: 870932 - DNA, 22 bp, Artificial Sequence
  chemically synthesized
tcacactcatcagaaggaagtc

SEQ ID NO: 870933 - DNA, 22 bp, Artificial Sequence
  chemically synthesized
ctcacactcatcagaaggaagt

SEQ ID NO: 870934 - DNA, 22 bp, Artificial Sequence
  chemically synthesized
catggaaagacttccttctgat

SEQ ID NO: 870935 - DNA, 22 bp, Artificial Sequence
  chemically synthesized
atggaaagacttccttctgatg

SEQ ID NO: 870936 - DNA, 22 bp, Artificial Sequence
  chemically synthesized
ccttctgatgagtgtgagaagt

SEQ ID NO: 870937 - DNA, 22 bp, Artificial Sequence
  chemically synthesized
cttctgatgagtgtgagaagtg

SEQ ID NO: 870938 - DNA, 22 bp, Artificial Sequence
  chemically synthesized
gtgaggccccagcacttctcac

SEQ ID NO: 870939 - DNA, 22 bp, Artificial Sequence
  chemically synthesized
ctgatgagtgtgagaagtgctg

SEQ ID NO: 870940 - DNA, 22 bp, Artificial Sequence
  chemically synthesized
tgatgagtgtgagaagtgctgg

SEQ ID NO: 870941 - DNA, 22 bp, Artificial Sequence
  chemically synthesized
gctggtgaggccccagcacttc

SEQ ID NO: 870942 - DNA, 22 bp, Artificial Sequence
  chemically synthesized
atgagtgtgagaagtgctgggg

SEQ ID NO: 870943 - DNA, 22 bp, Artificial Sequence
  chemically synthesized
gggcctcaccagccagggcttt

SEQ ID NO: 870944 - DNA, 22 bp, Artificial Sequence
  chemically synthesized
accagccagggctttctgttgt

SEQ ID NO: 870945 - DNA, 22 bp, Artificial Sequence
  chemically synthesized
tagaaaggggagtgacaacaga

SEQ ID NO: 870946 - DNA, 22 bp, Artificial Sequence
  chemically synthesized
tctgttgtcactcccctttcta

SEQ ID NO: 870947 - DNA, 22 bp, Artificial Sequence
  chemically synthesized
ctgttgtcactcccctttctac

SEQ ID NO: 870948 - DNA, 22 bp, Artificial Sequence
  chemically synthesized
tgttgtcactcccctttctaca

SEQ ID NO: 870949 - DNA, 22 bp, Artificial Sequence
  chemically synthesized
ttgtcactcccctttctacagt

SEQ ID NO: 870950 - DNA, 22 bp, Artificial Sequence
  chemically synthesized
tcactcccctttctacagtgtg

SEQ ID NO: 870951 - DNA, 22 bp, Artificial Sequence
  chemically synthesized
ccctttctacagtgtgacacat

SEQ ID NO: 870952 - DNA, 22 bp, Artificial Sequence
  chemically synthesized
aaatataatgagatgtgtcaca

SEQ ID NO: 870953 - DNA, 22 bp, Artificial Sequence
  chemically synthesized
gaaatataatgagatgtgtcac

SEQ ID NO: 870954 - DNA, 22 bp, Artificial Sequence
  chemically synthesized
tctacagtgtgacacatctcat

SEQ ID NO: 870955 - DNA, 22 bp, Artificial Sequence
  chemically synthesized
ctacagtgtgacacatctcatt

SEQ ID NO: 870956 - DNA, 22 bp, Artificial Sequence
  chemically synthesized
tacagtgtgacacatctcatta

SEQ ID NO: 870957 - DNA, 22 bp, Artificial Sequence
  chemically synthesized
cagtgtgacacatctcattata

SEQ ID NO: 870958 - DNA, 22 bp, Artificial Sequence
  chemically synthesized
attatatttcaagcactcttac

SEQ ID NO: 870959 - DNA, 22 bp, Artificial Sequence
  chemically synthesized
tatgtatcagtgaggtaagagt

SEQ ID NO: 870960 - DNA, 22 bp, Artificial Sequence
  chemically synthesized
gtatgtatcagtgaggtaagag

SEQ ID NO: 870961 - DNA, 22 bp, Artificial Sequence
  chemically synthesized
tatttcaagcactcttacctca

SEQ ID NO: 870962 - DNA, 22 bp, Artificial Sequence
  chemically synthesized
caagcactcttacctcactgat

SEQ ID NO: 870963 - DNA, 22 bp, Artificial Sequence
  chemically synthesized
atatttgtatgtatcagtgagg

SEQ ID NO: 870964 - DNA, 22 bp, Artificial Sequence
  chemically synthesized
aagcactcttacctcactgata

SEQ ID NO: 870965 - DNA, 22 bp, Artificial Sequence
  chemically synthesized
aaaattcatatttgtatgtatc

SEQ ID NO: 870966 - DNA, 22 bp, Artificial Sequence
  chemically synthesized
aaaaattcatatttgtatgtat

SEQ ID NO: 870967 - DNA, 22 bp, Artificial Sequence
  chemically synthesized
ttacctcactgatacatacaaa

SEQ ID NO: 870968 - DNA, 22 bp, Artificial Sequence
  chemically synthesized
acctcactgatacatacaaata

SEQ ID NO: 870969 - DNA, 22 bp, Artificial Sequence
  chemically synthesized
cctcactgatacatacaaatat

SEQ ID NO: 870970 - DNA, 22 bp, Artificial Sequence
  chemically synthesized
atttaaaaattcatatttgtat

SEQ ID NO: 870971 - DNA, 22 bp, Artificial Sequence
  chemically synthesized
actgatacatacaaatatgaat

SEQ ID NO: 870972 - DNA, 22 bp, Artificial Sequence
  chemically synthesized
attaatttaaaaattcatattt

SEQ ID NO: 870973 - DNA, 22 bp, Artificial Sequence
  chemically synthesized
atacatacaaatatgaattttt

SEQ ID NO: 870974 - DNA, 22 bp, Artificial Sequence
  chemically synthesized
attaattaatttaaaaattcat

SEQ ID NO: 870975 - DNA, 22 bp, Artificial Sequence
  chemically synthesized
acattaattaattaatttaaaa

SEQ ID NO: 870976 - DNA, 22 bp, Artificial Sequence
  chemically synthesized
gacattaattaattaatttaaa

SEQ ID NO: 870977 - DNA, 22 bp, Artificial Sequence
  chemically synthesized
ttgacattaattaattaattta

SEQ ID NO: 870978 - DNA, 22 bp, Artificial Sequence
  chemically synthesized
actcttgacattaattaattaa

SEQ ID NO: 870979 - DNA, 22 bp, Artificial Sequence
  chemically synthesized
aactcttgacattaattaatta

SEQ ID NO: 870980 - DNA, 22 bp, Artificial Sequence
  chemically synthesized
cttaactcttgacattaattaa

SEQ ID NO: 870981 - DNA, 22 bp, Artificial Sequence
  chemically synthesized
ttaaattaattaattaatgtca

SEQ ID NO: 870982 - DNA, 22 bp, Artificial Sequence
  chemically synthesized
taaattaattaattaatgtcaa

SEQ ID NO: 870983 - DNA, 22 bp, Artificial Sequence
  chemically synthesized
aaattaattaattaatgtcaag

SEQ ID NO: 870984 - DNA, 22 bp, Artificial Sequence
  chemically synthesized
aattaattaattaatgtcaaga

SEQ ID NO: 870985 - DNA, 22 bp, Artificial Sequence
  chemically synthesized
gagagactccttaactcttgac

SEQ ID NO: 870986 - DNA, 22 bp, Artificial Sequence
  chemically synthesized
attaattaatgtcaagagttaa

SEQ ID NO: 870987 - DNA, 22 bp, Artificial Sequence
  chemically synthesized
attaatgtcaagagttaaggag

SEQ ID NO: 870988 - DNA, 22 bp, Artificial Sequence
  chemically synthesized
gagcagctggagagactcctta

SEQ ID NO: 870989 - DNA, 22 bp, Artificial Sequence
  chemically synthesized
atgtcaagagttaaggagtctc

SEQ ID NO: 870990 - DNA, 22 bp, Artificial Sequence
  chemically synthesized
ggagcagctggagagactcctt

SEQ ID NO: 870991 - DNA, 22 bp, Artificial Sequence
  chemically synthesized
caaggccttggagcagctggag

SEQ ID NO: 870992 - DNA, 22 bp, Artificial Sequence
  chemically synthesized
aggagtctctccagctgctcca

SEQ ID NO: 870993 - DNA, 22 bp, Artificial Sequence
  chemically synthesized
tccagctgctccaaggccttgc

SEQ ID NO: 870994 - DNA, 22 bp, Artificial Sequence
  chemically synthesized
tcccaagatactgcaaggcctt

SEQ ID NO: 870995 - DNA, 22 bp, Artificial Sequence
  chemically synthesized
cagctgctccaaggccttgcag

SEQ ID NO: 870996 - DNA, 22 bp, Artificial Sequence
  chemically synthesized
aaccctatcccaagatactgca

SEQ ID NO: 870997 - DNA, 22 bp, Artificial Sequence
  chemically synthesized
ctccaaggccttgcagtatctt

SEQ ID NO: 870998 - DNA, 22 bp, Artificial Sequence
  chemically synthesized
aaaccctatcccaagatactgc

SEQ ID NO: 870999 - DNA, 22 bp, Artificial Sequence
  chemically synthesized
taaaccctatcccaagatactg

SEQ ID NO: 871000 - DNA, 22 bp, Artificial Sequence
  chemically synthesized
caaggccttgcagtatcttggg

SEQ ID NO: 871001 - DNA, 22 bp, Artificial Sequence
  chemically synthesized
gcagtatcttgggatagggttt

SEQ ID NO: 871002 - DNA, 22 bp, Artificial Sequence
  chemically synthesized
cagtatcttgggatagggttta

SEQ ID NO: 871003 - DNA, 22 bp, Artificial Sequence
  chemically synthesized
gggatagggtttaaaatggatt

SEQ ID NO: 871004 - DNA, 22 bp, Artificial Sequence
  chemically synthesized
ggatagggtttaaaatggattt

SEQ ID NO: 871005 - DNA, 22 bp, Artificial Sequence
  chemically synthesized
caataacaaaataaatccattt

SEQ ID NO: 871006 - DNA, 22 bp, Artificial Sequence
  chemically synthesized
atcagttccaataacaaaataa

SEQ ID NO: 871007 - DNA, 22 bp, Artificial Sequence
  chemically synthesized
aatcagttccaataacaaaata

SEQ ID NO: 871008 - DNA, 22 bp, Artificial Sequence
  chemically synthesized
aaaatggatttattttgttatt

SEQ ID NO: 871009 - DNA, 22 bp, Artificial Sequence
  chemically synthesized
aaatggatttattttgttattg

SEQ ID NO: 871010 - DNA, 22 bp, Artificial Sequence
  chemically synthesized
attttgttattggaactgatta

SEQ ID NO: 871011 - DNA, 22 bp, Artificial Sequence
  chemically synthesized
ttttgttattggaactgattaa

SEQ ID NO: 871012 - DNA, 22 bp, Artificial Sequence
  chemically synthesized
tgttattggaactgattaaggg

SEQ ID NO: 871013 - DNA, 22 bp, Artificial Sequence
  chemically synthesized
gttattggaactgattaagggt

SEQ ID NO: 871014 - DNA, 22 bp, Artificial Sequence
  chemically synthesized
ttattggaactgattaagggtc

SEQ ID NO: 871015 - DNA, 22 bp, Artificial Sequence
  chemically synthesized
ttggaactgattaagggtcttc

SEQ ID NO: 871016 - DNA, 22 bp, Artificial Sequence
  chemically synthesized
tacaaaaaatgtgaagaccctt

SEQ ID NO: 871017 - DNA, 22 bp, Artificial Sequence
  chemically synthesized
gtacaaaaaatgtgaagaccct

SEQ ID NO: 871018 - DNA, 22 bp, Artificial Sequence
  chemically synthesized
tgtacaaaaaatgtgaagaccc

SEQ ID NO: 871019 - DNA, 22 bp, Artificial Sequence
  chemically synthesized
gaactgattaagggtcttcaca

SEQ ID NO: 871020 - DNA, 22 bp, Artificial Sequence
  chemically synthesized
ttgtacaaaaaatgtgaagacc

SEQ ID NO: 871021 - DNA, 22 bp, Artificial Sequence
  chemically synthesized
attaagggtcttcacatttttt

SEQ ID NO: 871022 - DNA, 22 bp, Artificial Sequence
  chemically synthesized
agggtcttcacattttttgtac

SEQ ID NO: 871023 - DNA, 22 bp, Artificial Sequence
  chemically synthesized
cacattttttgtacaaaagctt

SEQ ID NO: 871024 - DNA, 22 bp, Artificial Sequence
  chemically synthesized
acattttttgtacaaaagcttg

SEQ ID NO: 871025 - DNA, 22 bp, Artificial Sequence
  chemically synthesized
atacgtcaggagcaagcttttg

SEQ ID NO: 871026 - DNA, 22 bp, Artificial Sequence
  chemically synthesized
tttgtacaaaagcttgctcctg

SEQ ID NO: 871027 - DNA, 22 bp, Artificial Sequence
  chemically synthesized
ttgtacaaaagcttgctcctga

SEQ ID NO: 871028 - DNA, 22 bp, Artificial Sequence
  chemically synthesized
tgtacaaaagcttgctcctgac

SEQ ID NO: 871029 - DNA, 22 bp, Artificial Sequence
  chemically synthesized
aaagtctaatacgtcaggagca

SEQ ID NO: 871030 - DNA, 22 bp, Artificial Sequence
  chemically synthesized
gtacaaaagcttgctcctgacg

SEQ ID NO: 871031 - DNA, 22 bp, Artificial Sequence
  chemically synthesized
tacaaaagcttgctcctgacgt

SEQ ID NO: 871032 - DNA, 22 bp, Artificial Sequence
  chemically synthesized
ctcaaagtctaatacgtcagga

SEQ ID NO: 871033 - DNA, 22 bp, Artificial Sequence
  chemically synthesized
cctcaaagtctaatacgtcagg

SEQ ID NO: 871034 - DNA, 22 bp, Artificial Sequence
  chemically synthesized
aaaacttcctcaaagtctaata

SEQ ID NO: 871035 - DNA, 22 bp, Artificial Sequence
  chemically synthesized
gaaaacttcctcaaagtctaat

SEQ ID NO: 871036 - DNA, 22 bp, Artificial Sequence
  chemically synthesized
gctcctgacgtattagactttg

SEQ ID NO: 871037 - DNA, 22 bp, Artificial Sequence
  chemically synthesized
ctcctgacgtattagactttga

SEQ ID NO: 871038 - DNA, 22 bp, Artificial Sequence
  chemically synthesized
ctgacgtattagactttgagga

SEQ ID NO: 871039 - DNA, 22 bp, Artificial Sequence
  chemically synthesized
aaccttgaaaacttcctcaaag

SEQ ID NO: 871040 - DNA, 22 bp, Artificial Sequence
  chemically synthesized
acgtattagactttgaggaagt

SEQ ID NO: 871041 - DNA, 22 bp, Artificial Sequence
  chemically synthesized
taaaccttgaaaacttcctcaa

SEQ ID NO: 871042 - DNA, 22 bp, Artificial Sequence
  chemically synthesized
caggctctaaaccttgaaaact

SEQ ID NO: 871043 - DNA, 22 bp, Artificial Sequence
  chemically synthesized
gactttgaggaagttttcaagg

SEQ ID NO: 871044 - DNA, 22 bp, Artificial Sequence
  chemically synthesized
tgaggaagttttcaaggtttag

SEQ ID NO: 871045 - DNA, 22 bp, Artificial Sequence
  chemically synthesized
tagttacaggctctaaaccttg

SEQ ID NO: 871046 - DNA, 22 bp, Artificial Sequence
  chemically synthesized
gaggaagttttcaaggtttaga

SEQ ID NO: 871047 - DNA, 22 bp, Artificial Sequence
  chemically synthesized
atagttacaggctctaaacctt

SEQ ID NO: 871048 - DNA, 22 bp, Artificial Sequence
  chemically synthesized
aggaagttttcaaggtttagag

SEQ ID NO: 871049 - DNA, 22 bp, Artificial Sequence
  chemically synthesized
tatagttacaggctctaaacct

SEQ ID NO: 871050 - DNA, 22 bp, Artificial Sequence
  chemically synthesized
ccggttttatagttacaggctc

SEQ ID NO: 871051 - DNA, 22 bp, Artificial Sequence
  chemically synthesized
tcaaggtttagagcctgtaact

SEQ ID NO: 871052 - DNA, 22 bp, Artificial Sequence
  chemically synthesized
caaggtttagagcctgtaacta

SEQ ID NO: 871053 - DNA, 22 bp, Artificial Sequence
  chemically synthesized
ttgccggttttatagttacagg

SEQ ID NO: 871054 - DNA, 22 bp, Artificial Sequence
  chemically synthesized
aaggtttagagcctgtaactat

SEQ ID NO: 871055 - DNA, 22 bp, Artificial Sequence
  chemically synthesized
tactattgccggttttatagtt

SEQ ID NO: 871056 - DNA, 22 bp, Artificial Sequence
  chemically synthesized
agagcctgtaactataaaaccg

SEQ ID NO: 871057 - DNA, 22 bp, Artificial Sequence
  chemically synthesized
gagcctgtaactataaaaccgg

SEQ ID NO: 871058 - DNA, 22 bp, Artificial Sequence
  chemically synthesized
taactataaaaccggcaatagt

SEQ ID NO: 871059 - DNA, 22 bp, Artificial Sequence
  chemically synthesized
cgacatggctatactattgccg

SEQ ID NO: 871060 - DNA, 22 bp, Artificial Sequence
  chemically synthesized
acgacatggctatactattgcc

SEQ ID NO: 871061 - DNA, 22 bp, Artificial Sequence
  chemically synthesized
taaaaccggcaatagtatagcc

SEQ ID NO: 871062 - DNA, 22 bp, Artificial Sequence
  chemically synthesized
aaaacacttacgacatggctat

SEQ ID NO: 871063 - DNA, 22 bp, Artificial Sequence
  chemically synthesized
ctaaaaacacttacgacatggc

SEQ ID NO: 871064 - DNA, 22 bp, Artificial Sequence
  chemically synthesized
tgctaaaaacacttacgacatg

SEQ ID NO: 871065 - DNA, 22 bp, Artificial Sequence
  chemically synthesized
tctgctaaaaacacttacgaca

SEQ ID NO: 871066 - DNA, 22 bp, Artificial Sequence
  chemically synthesized
ctctgctaaaaacacttacgac

SEQ ID NO: 871067 - DNA, 22 bp, Artificial Sequence
  chemically synthesized
acagatgatttctctgctaaaa

SEQ ID NO: 871068 - DNA, 22 bp, Artificial Sequence
  chemically synthesized
attaacagatgatttctctgct

SEQ ID NO: 871069 - DNA, 22 bp, Artificial Sequence
  chemically synthesized
ctcattaacagatgatttctct

SEQ ID NO: 871070 - DNA, 22 bp, Artificial Sequence
  chemically synthesized
cctcattaacagatgatttctc

SEQ ID NO: 871071 - DNA, 22 bp, Artificial Sequence
  chemically synthesized
ttcctcattaacagatgatttc

SEQ ID NO: 871072 - DNA, 22 bp, Artificial Sequence
  chemically synthesized
cttcctcattaacagatgattt

SEQ ID NO: 871073 - DNA, 22 bp, Artificial Sequence
  chemically synthesized
tcttcctcattaacagatgatt

SEQ ID NO: 871074 - DNA, 22 bp, Artificial Sequence
  chemically synthesized
ttcttcctcattaacagatgat

SEQ ID NO: 871075 - DNA, 22 bp, Artificial Sequence
  chemically synthesized
ttagcagagaaatcatctgtta

SEQ ID NO: 871076 - DNA, 22 bp, Artificial Sequence
  chemically synthesized
tttcttcctcattaacagatga

SEQ ID NO: 871077 - DNA, 22 bp, Artificial Sequence
  chemically synthesized
tagcagagaaatcatctgttaa

SEQ ID NO: 871078 - DNA, 22 bp, Artificial Sequence
  chemically synthesized
agcagagaaatcatctgttaat

SEQ ID NO: 871079 - DNA, 22 bp, Artificial Sequence
  chemically synthesized
gcagagaaatcatctgttaatg

SEQ ID NO: 871080 - DNA, 22 bp, Artificial Sequence
  chemically synthesized
cgtgaggccaaatctttttctt

SEQ ID NO: 871081 - DNA, 22 bp, Artificial Sequence
  chemically synthesized
ccgtgaggccaaatctttttct

SEQ ID NO: 871082 - DNA, 22 bp, Artificial Sequence
  chemically synthesized
ttaatgaggaagaaaaagattt

SEQ ID NO: 871083 - DNA, 22 bp, Artificial Sequence
  chemically synthesized
atgaggaagaaaaagatttggc

SEQ ID NO: 871084 - DNA, 22 bp, Artificial Sequence
  chemically synthesized
ggcaaataaatttccgtgaggc

SEQ ID NO: 871085 - DNA, 22 bp, Artificial Sequence
  chemically synthesized
ggattaggcaaataaatttccg

SEQ ID NO: 871086 - DNA, 22 bp, Artificial Sequence
  chemically synthesized
aggattaggcaaataaatttcc

SEQ ID NO: 871087 - DNA, 22 bp, Artificial Sequence
  chemically synthesized
taggattaggcaaataaatttc

SEQ ID NO: 871088 - DNA, 22 bp, Artificial Sequence
  chemically synthesized
ggcctcacggaaatttatttgc

SEQ ID NO: 871089 - DNA, 22 bp, Artificial Sequence
  chemically synthesized
gcctcacggaaatttatttgcc

SEQ ID NO: 871090 - DNA, 22 bp, Artificial Sequence
  chemically synthesized
acggaaatttatttgcctaatc

SEQ ID NO: 871091 - DNA, 22 bp, Artificial Sequence
  chemically synthesized
aggtgaacctttaggattaggc

SEQ ID NO: 871092 - DNA, 22 bp, Artificial Sequence
  chemically synthesized
caggtgaacctttaggattagg

SEQ ID NO: 871093 - DNA, 22 bp, Artificial Sequence
  chemically synthesized
cttcaggtgaacctttaggatt

SEQ ID NO: 871094 - DNA, 22 bp, Artificial Sequence
  chemically synthesized
tgcttcaggtgaacctttagga

SEQ ID NO: 871095 - DNA, 22 bp, Artificial Sequence
  chemically synthesized
atttgcctaatcctaaaggttc

SEQ ID NO: 871096 - DNA, 22 bp, Artificial Sequence
  chemically synthesized
tttgcctaatcctaaaggttca

SEQ ID NO: 871097 - DNA, 22 bp, Artificial Sequence
  chemically synthesized
attctgcttcaggtgaaccttt

SEQ ID NO: 871098 - DNA, 22 bp, Artificial Sequence
  chemically synthesized
gcctaatcctaaaggttcacct

SEQ ID NO: 871099 - DNA, 22 bp, Artificial Sequence
  chemically synthesized
cctaatcctaaaggttcacctg

SEQ ID NO: 871100 - DNA, 22 bp, Artificial Sequence
  chemically synthesized
ttgattctgcttcaggtgaacc

SEQ ID NO: 871101 - DNA, 22 bp, Artificial Sequence
  chemically synthesized
atcctaaaggttcacctgaagc

SEQ ID NO: 871102 - DNA, 22 bp, Artificial Sequence
  chemically synthesized
cactgttgattctgcttcaggt

SEQ ID NO: 871103 - DNA, 22 bp, Artificial Sequence
  chemically synthesized
ccactgttgattctgcttcagg

SEQ ID NO: 871104 - DNA, 22 bp, Artificial Sequence
  chemically synthesized
aaggttcacctgaagcagaatc

SEQ ID NO: 871105 - DNA, 22 bp, Artificial Sequence
  chemically synthesized
tgtttccactgttgattctgct

SEQ ID NO: 871106 - DNA, 22 bp, Artificial Sequence
  chemically synthesized
acctgaagcagaatcaacagtg

SEQ ID NO: 871107 - DNA, 22 bp, Artificial Sequence
  chemically synthesized
tggttatgtttccactgttgat

SEQ ID NO: 871108 - DNA, 22 bp, Artificial Sequence
  chemically synthesized
ttgtggttatgtttccactgtt

SEQ ID NO: 871109 - DNA, 22 bp, Artificial Sequence
  chemically synthesized
aagcagaatcaacagtggaaac

SEQ ID NO: 871110 - DNA, 22 bp, Artificial Sequence
  chemically synthesized
ctgttgtggttatgtttccact

SEQ ID NO: 871111 - DNA, 22 bp, Artificial Sequence
  chemically synthesized
cctgttgtggttatgtttccac

SEQ ID NO: 871112 - DNA, 22 bp, Artificial Sequence
  chemically synthesized
tcctgttgtggttatgtttcca

SEQ ID NO: 871113 - DNA, 22 bp, Artificial Sequence
  chemically synthesized
atagaaacatggcaggggaggg

SEQ ID NO: 871114 - DNA, 22 bp, Artificial Sequence
  chemically synthesized
attaatagaaacatggcagggg

SEQ ID NO: 871115 - DNA, 22 bp, Artificial Sequence
  chemically synthesized
tcattaatagaaacatggcagg

SEQ ID NO: 871116 - DNA, 22 bp, Artificial Sequence
  chemically synthesized
tatacccctcccctgccatgtt

SEQ ID NO: 871117 - DNA, 22 bp, Artificial Sequence
  chemically synthesized
ctcattaatagaaacatggcag

SEQ ID NO: 871118 - DNA, 22 bp, Artificial Sequence
  chemically synthesized
atccttctcattaatagaaaca

SEQ ID NO: 871119 - DNA, 22 bp, Artificial Sequence
  chemically synthesized
ccctgccatgtttctattaatg

SEQ ID NO: 871120 - DNA, 22 bp, Artificial Sequence
  chemically synthesized
ggtcctgatccttctcattaat

SEQ ID NO: 871121 - DNA, 22 bp, Artificial Sequence
  chemically synthesized
gggtcctgatccttctcattaa

SEQ ID NO: 871122 - DNA, 22 bp, Artificial Sequence
  chemically synthesized
ccatgtttctattaatgagaag

SEQ ID NO: 871123 - DNA, 22 bp, Artificial Sequence
  chemically synthesized
ttgggtcctgatccttctcatt

SEQ ID NO: 871124 - DNA, 22 bp, Artificial Sequence
  chemically synthesized
tcttgggtcctgatccttctca

SEQ ID NO: 871125 - DNA, 22 bp, Artificial Sequence
  chemically synthesized
ctctcttgggtcctgatccttc

SEQ ID NO: 871126 - DNA, 22 bp, Artificial Sequence
  chemically synthesized
ctattaatgagaaggatcagga

SEQ ID NO: 871127 - DNA, 22 bp, Artificial Sequence
  chemically synthesized
tattaatgagaaggatcaggac

SEQ ID NO: 871128 - DNA, 22 bp, Artificial Sequence
  chemically synthesized
ttcctctcttgggtcctgatcc

SEQ ID NO: 871129 - DNA, 22 bp, Artificial Sequence
  chemically synthesized
attcctctcttgggtcctgatc

SEQ ID NO: 871130 - DNA, 22 bp, Artificial Sequence
  chemically synthesized
ttaatgagaaggatcaggaccc

SEQ ID NO: 871131 - DNA, 22 bp, Artificial Sequence
  chemically synthesized
ttattcctctcttgggtcctga

SEQ ID NO: 871132 - DNA, 22 bp, Artificial Sequence
  chemically synthesized
atgagaaggatcaggacccaag

SEQ ID NO: 871133 - DNA, 22 bp, Artificial Sequence
  chemically synthesized
cattcttattcctctcttgggt

SEQ ID NO: 871134 - DNA, 22 bp, Artificial Sequence
  chemically synthesized
gcattcttattcctctcttggg

SEQ ID NO: 871135 - DNA, 22 bp, Artificial Sequence
  chemically synthesized
ttgcattcttattcctctcttg

SEQ ID NO: 871136 - DNA, 22 bp, Artificial Sequence
  chemically synthesized
gttcttgcattcttattcctct

SEQ ID NO: 871137 - DNA, 22 bp, Artificial Sequence
  chemically synthesized
cagcaaaggaaaaagaggatgg

SEQ ID NO: 871138 - DNA, 22 bp, Artificial Sequence
  chemically synthesized
tctgcagcaaaggaaaaagagg

SEQ ID NO: 871139 - DNA, 22 bp, Artificial Sequence
  chemically synthesized
atctgcagcaaaggaaaaagag

SEQ ID NO: 871140 - DNA, 22 bp, Artificial Sequence
  chemically synthesized
attgccatcctctttttccttt

SEQ ID NO: 871141 - DNA, 22 bp, Artificial Sequence
  chemically synthesized
gtttatctgcagcaaaggaaaa

SEQ ID NO: 871142 - DNA, 22 bp, Artificial Sequence
  chemically synthesized
cgtttatctgcagcaaaggaaa

SEQ ID NO: 871143 - DNA, 22 bp, Artificial Sequence
  chemically synthesized
ccatcctctttttcctttgctg

SEQ ID NO: 871144 - DNA, 22 bp, Artificial Sequence
  chemically synthesized
tttttcctttgctgcagataaa

SEQ ID NO: 871145 - DNA, 22 bp, Artificial Sequence
  chemically synthesized
tttcctttgctgcagataaacg

SEQ ID NO: 871146 - DNA, 22 bp, Artificial Sequence
  chemically synthesized
ttcctttgctgcagataaacga

SEQ ID NO: 871147 - DNA, 22 bp, Artificial Sequence
  chemically synthesized
tgaaaatggccttcgtttatct

SEQ ID NO: 871148 - DNA, 22 bp, Artificial Sequence
  chemically synthesized
tcctttgctgcagataaacgaa

SEQ ID NO: 871149 - DNA, 22 bp, Artificial Sequence
  chemically synthesized
gtgaaaatggccttcgtttatc

SEQ ID NO: 871150 - DNA, 22 bp, Artificial Sequence
  chemically synthesized
cctttgctgcagataaacgaag

SEQ ID NO: 871151 - DNA, 22 bp, Artificial Sequence
  chemically synthesized
tgtgaaaatggccttcgtttat

SEQ ID NO: 871152 - DNA, 22 bp, Artificial Sequence
  chemically synthesized
ctttgctgcagataaacgaagg

SEQ ID NO: 871153 - DNA, 22 bp, Artificial Sequence
  chemically synthesized
ttgtgaaaatggccttcgttta

SEQ ID NO: 871154 - DNA, 22 bp, Artificial Sequence
  chemically synthesized
tttgtgaaaatggccttcgttt

SEQ ID NO: 871155 - DNA, 22 bp, Artificial Sequence
  chemically synthesized
ttttgtgaaaatggccttcgtt

SEQ ID NO: 871156 - DNA, 22 bp, Artificial Sequence
  chemically synthesized
tgctgcagataaacgaaggcca

SEQ ID NO: 871157 - DNA, 22 bp, Artificial Sequence
  chemically synthesized
tttttgtgaaaatggccttcgt

SEQ ID NO: 871158 - DNA, 22 bp, Artificial Sequence
  chemically synthesized
gctgcagataaacgaaggccat

SEQ ID NO: 871159 - DNA, 22 bp, Artificial Sequence
  chemically synthesized
ctgcagataaacgaaggccatt

SEQ ID NO: 871160 - DNA, 22 bp, Artificial Sequence
  chemically synthesized
cagataaacgaaggccattttc

SEQ ID NO: 871161 - DNA, 22 bp, Artificial Sequence
  chemically synthesized
cagtgatcattttttttgtgaa

SEQ ID NO: 871162 - DNA, 22 bp, Artificial Sequence
  chemically synthesized
tctgcagtgatcattttttttg

SEQ ID NO: 871163 - DNA, 22 bp, Artificial Sequence
  chemically synthesized
atctgcagtgatcatttttttt

SEQ ID NO: 871164 - DNA, 22 bp, Artificial Sequence
  chemically synthesized
catttatctgcagtgatcattt

SEQ ID NO: 871165 - DNA, 22 bp, Artificial Sequence
  chemically synthesized
tcacaaaaaaaatgatcactgc

SEQ ID NO: 871166 - DNA, 22 bp, Artificial Sequence
  chemically synthesized
cacaaaaaaaatgatcactgca

SEQ ID NO: 871167 - DNA, 22 bp, Artificial Sequence
  chemically synthesized
acaaaaaaaatgatcactgcag

SEQ ID NO: 871168 - DNA, 22 bp, Artificial Sequence
  chemically synthesized
tgacaataccctacatttatct

SEQ ID NO: 871169 - DNA, 22 bp, Artificial Sequence
  chemically synthesized
ttgtgacaataccctacattta

SEQ ID NO: 871170 - DNA, 22 bp, Artificial Sequence
  chemically synthesized
attgtgacaataccctacattt

SEQ ID NO: 871171 - DNA, 22 bp, Artificial Sequence
  chemically synthesized
atttattgtgacaataccctac

SEQ ID NO: 871172 - DNA, 22 bp, Artificial Sequence
  chemically synthesized
cagataaatgtagggtattgtc

SEQ ID NO: 871173 - DNA, 22 bp, Artificial Sequence
  chemically synthesized
caaaaaaaaaaaatggttaatt

SEQ ID NO: 871174 - DNA, 22 bp, Artificial Sequence
  chemically synthesized
tcacaataaattaaccattttt

SEQ ID NO: 871175 - DNA, 22 bp, Artificial Sequence
  chemically synthesized
aattgcaaaaaaaaaaaatggt

SEQ ID NO: 871176 - DNA, 22 bp, Artificial Sequence
  chemically synthesized
aaattgcaaaaaaaaaaaatgg

SEQ ID NO: 871177 - DNA, 22 bp, Artificial Sequence
  chemically synthesized
gcttaaattgcaaaaaaaaaaa

SEQ ID NO: 871178 - DNA, 22 bp, Artificial Sequence
  chemically synthesized
ttggcttaaattgcaaaaaaaa

SEQ ID NO: 871179 - DNA, 22 bp, Artificial Sequence
  chemically synthesized
gttggcttaaattgcaaaaaaa

SEQ ID NO: 871180 - DNA, 22 bp, Artificial Sequence
  chemically synthesized
tgttggcttaaattgcaaaaaa

SEQ ID NO: 871181 - DNA, 22 bp, Artificial Sequence
  chemically synthesized
ttgttggcttaaattgcaaaaa

SEQ ID NO: 871182 - DNA, 22 bp, Artificial Sequence
  chemically synthesized
accattttttttttttgcaatt

SEQ ID NO: 871183 - DNA, 22 bp, Artificial Sequence
  chemically synthesized
cttttgttggcttaaattgcaa

SEQ ID NO: 871184 - DNA, 22 bp, Artificial Sequence
  chemically synthesized
tttttttttgcaatttaagcca

SEQ ID NO: 871185 - DNA, 22 bp, Artificial Sequence
  chemically synthesized
ttttttttgcaatttaagccaa

SEQ ID NO: 871186 - DNA, 22 bp, Artificial Sequence
  chemically synthesized
tttttttgcaatttaagccaac

SEQ ID NO: 871187 - DNA, 22 bp, Artificial Sequence
  chemically synthesized
ttttttgcaatttaagccaaca

SEQ ID NO: 871188 - DNA, 22 bp, Artificial Sequence
  chemically synthesized
tcatactacttttgttggctta

SEQ ID NO: 871189 - DNA, 22 bp, Artificial Sequence
  chemically synthesized
tttttgcaatttaagccaacaa

SEQ ID NO: 871190 - DNA, 22 bp, Artificial Sequence
  chemically synthesized
gtcatactacttttgttggctt

SEQ ID NO: 871191 - DNA, 22 bp, Artificial Sequence
  chemically synthesized
ttttgcaatttaagccaacaaa

SEQ ID NO: 871192 - DNA, 22 bp, Artificial Sequence
  chemically synthesized
tttgcaatttaagccaacaaaa

SEQ ID NO: 871193 - DNA, 22 bp, Artificial Sequence
  chemically synthesized
ttgtcatactacttttgttggc

SEQ ID NO: 871194 - DNA, 22 bp, Artificial Sequence
  chemically synthesized
ttgcaatttaagccaacaaaag

SEQ ID NO: 871195 - DNA, 22 bp, Artificial Sequence
  chemically synthesized
tgcaatttaagccaacaaaagt

SEQ ID NO: 871196 - DNA, 22 bp, Artificial Sequence
  chemically synthesized
gcaatttaagccaacaaaagta

SEQ ID NO: 871197 - DNA, 22 bp, Artificial Sequence
  chemically synthesized
caatttaagccaacaaaagtag

SEQ ID NO: 871198 - DNA, 22 bp, Artificial Sequence
  chemically synthesized
aatgtactcttgtcatactact

SEQ ID NO: 871199 - DNA, 22 bp, Artificial Sequence
  chemically synthesized
aagccaacaaaagtagtatgac

SEQ ID NO: 871200 - DNA, 22 bp, Artificial Sequence
  chemically synthesized
aaatgtactcttgtcatactac

SEQ ID NO: 871201 - DNA, 22 bp, Artificial Sequence
  chemically synthesized
agccaacaaaagtagtatgaca

SEQ ID NO: 871202 - DNA, 22 bp, Artificial Sequence
  chemically synthesized
gcacttaaatgtactcttgtca

SEQ ID NO: 871203 - DNA, 22 bp, Artificial Sequence
  chemically synthesized
ggcacttaaatgtactcttgtc

SEQ ID NO: 871204 - DNA, 22 bp, Artificial Sequence
  chemically synthesized
cttggcacttaaatgtactctt

SEQ ID NO: 871205 - DNA, 22 bp, Artificial Sequence
  chemically synthesized
aagcatgaggttacttggcact

SEQ ID NO: 871206 - DNA, 22 bp, Artificial Sequence
  chemically synthesized
ggcagttaaagcatgaggttac

SEQ ID NO: 871207 - DNA, 22 bp, Artificial Sequence
  chemically synthesized
aagtgccaagtaacctcatgct

SEQ ID NO: 871208 - DNA, 22 bp, Artificial Sequence
  chemically synthesized
agtgccaagtaacctcatgctt

SEQ ID NO: 871209 - DNA, 22 bp, Artificial Sequence
  chemically synthesized
aatatctaggcagttaaagcat

SEQ ID NO: 871210 - DNA, 22 bp, Artificial Sequence
  chemically synthesized
aaatatctaggcagttaaagca

SEQ ID NO: 871211 - DNA, 22 bp, Artificial Sequence
  chemically synthesized
taaatatctaggcagttaaagc

SEQ ID NO: 871212 - DNA, 22 bp, Artificial Sequence
  chemically synthesized
atgctttaactgcctagatatt

SEQ ID NO: 871213 - DNA, 22 bp, Artificial Sequence
  chemically synthesized
aataatactttaaatatctagg

SEQ ID NO: 871214 - DNA, 22 bp, Artificial Sequence
  chemically synthesized
caataatactttaaatatctag

SEQ ID NO: 871215 - DNA, 22 bp, Artificial Sequence
  chemically synthesized
taactgcctagatatttaaagt

SEQ ID NO: 871216 - DNA, 22 bp, Artificial Sequence
  chemically synthesized
catttcaataatactttaaata

SEQ ID NO: 871217 - DNA, 22 bp, Artificial Sequence
  chemically synthesized
aactgcctagatatttaaagta

SEQ ID NO: 871218 - DNA, 22 bp, Artificial Sequence
  chemically synthesized
ccatttcaataatactttaaat

SEQ ID NO: 871219 - DNA, 22 bp, Artificial Sequence
  chemically synthesized
actgcctagatatttaaagtat

SEQ ID NO: 871220 - DNA, 22 bp, Artificial Sequence
  chemically synthesized
cctagatatttaaagtattatt

SEQ ID NO: 871221 - DNA, 22 bp, Artificial Sequence
  chemically synthesized
catttccatttcaataatactt

SEQ ID NO: 871222 - DNA, 22 bp, Artificial Sequence
  chemically synthesized
gatatttaaagtattattgaaa

SEQ ID NO: 871223 - DNA, 22 bp, Artificial Sequence
  chemically synthesized
aaagtattattgaaatggaaat

SEQ ID NO: 871224 - DNA, 22 bp, Artificial Sequence
  chemically synthesized
aagtattattgaaatggaaatg

SEQ ID NO: 871225 - DNA, 22 bp, Artificial Sequence
  chemically synthesized
aataaagcattccatttccatt

SEQ ID NO: 871226 - DNA, 22 bp, Artificial Sequence
  chemically synthesized
ttgaaatggaaatggaatgctt

SEQ ID NO: 871227 - DNA, 22 bp, Artificial Sequence
  chemically synthesized
caaagttaaataaagcattcca

SEQ ID NO: 871228 - DNA, 22 bp, Artificial Sequence
  chemically synthesized
tacaaagttaaataaagcattc

SEQ ID NO: 871229 - DNA, 22 bp, Artificial Sequence
  chemically synthesized
aaatggaaatggaatgctttat

SEQ ID NO: 871230 - DNA, 22 bp, Artificial Sequence
  chemically synthesized
acctctacaaagttaaataaag

SEQ ID NO: 871231 - DNA, 22 bp, Artificial Sequence
  chemically synthesized
actcacctctacaaagttaaat

SEQ ID NO: 871232 - DNA, 22 bp, Artificial Sequence
  chemically synthesized
cactcacctctacaaagttaaa

SEQ ID NO: 871233 - DNA, 22 bp, Artificial Sequence
  chemically synthesized
aacttcactcacctctacaaag

SEQ ID NO: 871234 - DNA, 22 bp, Artificial Sequence
  chemically synthesized
gaacttcactcacctctacaaa

SEQ ID NO: 871235 - DNA, 22 bp, Artificial Sequence
  chemically synthesized
tatttaactttgtagaggtgag

SEQ ID NO: 871236 - DNA, 22 bp, Artificial Sequence
  chemically synthesized
atttgaacttcactcacctcta

SEQ ID NO: 871237 - DNA, 22 bp, Artificial Sequence
  chemically synthesized
atttaactttgtagaggtgagt

SEQ ID NO: 871238 - DNA, 22 bp, Artificial Sequence
  chemically synthesized
aatttgaacttcactcacctct

SEQ ID NO: 871239 - DNA, 22 bp, Artificial Sequence
  chemically synthesized
tttaactttgtagaggtgagtg

SEQ ID NO: 871240 - DNA, 22 bp, Artificial Sequence
  chemically synthesized
taatttgaacttcactcacctc

SEQ ID NO: 871241 - DNA, 22 bp, Artificial Sequence
  chemically synthesized
aactttgtagaggtgagtgaag

SEQ ID NO: 871242 - DNA, 22 bp, Artificial Sequence
  chemically synthesized
actttgtagaggtgagtgaagt

SEQ ID NO: 871243 - DNA, 22 bp, Artificial Sequence
  chemically synthesized
tacattttaatttgaacttcac

SEQ ID NO: 871244 - DNA, 22 bp, Artificial Sequence
  chemically synthesized
tgtagaggtgagtgaagttcaa

SEQ ID NO: 871245 - DNA, 22 bp, Artificial Sequence
  chemically synthesized
atacattttaatttgaacttca

SEQ ID NO: 871246 - DNA, 22 bp, Artificial Sequence
  chemically synthesized
gtagaggtgagtgaagttcaaa

SEQ ID NO: 871247 - DNA, 22 bp, Artificial Sequence
  chemically synthesized
tagaggtgagtgaagttcaaat

SEQ ID NO: 871248 - DNA, 22 bp, Artificial Sequence
  chemically synthesized
catggtgatttatacattttaa

SEQ ID NO: 871249 - DNA, 22 bp, Artificial Sequence
  chemically synthesized
aaattaaaatgtataaatcacc

SEQ ID NO: 871250 - DNA, 22 bp, Artificial Sequence
  chemically synthesized
catagtattccatggtgattta

SEQ ID NO: 871251 - DNA, 22 bp, Artificial Sequence
  chemically synthesized
aaatgtataaatcaccatggaa

SEQ ID NO: 871252 - DNA, 22 bp, Artificial Sequence
  chemically synthesized
tggctgcatagtattccatggt

SEQ ID NO: 871253 - DNA, 22 bp, Artificial Sequence
  chemically synthesized
atggctgcatagtattccatgg

SEQ ID NO: 871254 - DNA, 22 bp, Artificial Sequence
  chemically synthesized
tatggctgcatagtattccatg

SEQ ID NO: 871255 - DNA, 22 bp, Artificial Sequence
  chemically synthesized
ttatggctgcatagtattccat

SEQ ID NO: 871256 - DNA, 22 bp, Artificial Sequence
  chemically synthesized
tttatggctgcatagtattcca

SEQ ID NO: 871257 - DNA, 22 bp, Artificial Sequence
  chemically synthesized
atcattttttatggctgcatag

SEQ ID NO: 871258 - DNA, 22 bp, Artificial Sequence
  chemically synthesized
tgcagccataaaaaatgatgag

SEQ ID NO: 871259 - DNA, 22 bp, Artificial Sequence
  chemically synthesized
caaaggacatgaactcatcatt

SEQ ID NO: 871260 - DNA, 22 bp, Artificial Sequence
  chemically synthesized
atccatatccctacaaaggaca

SEQ ID NO: 871261 - DNA, 22 bp, Artificial Sequence
  chemically synthesized
catccatatccctacaaaggac

SEQ ID NO: 871262 - DNA, 22 bp, Artificial Sequence
  chemically synthesized
cagcttcatccatatccctaca

SEQ ID NO: 871263 - DNA, 22 bp, Artificial Sequence
  chemically synthesized
acagcttcatccatatccctac

SEQ ID NO: 871264 - DNA, 22 bp, Artificial Sequence
  chemically synthesized
atgtcctttgtagggatatgga

SEQ ID NO: 871265 - DNA, 22 bp, Artificial Sequence
  chemically synthesized
tgtagggatatggatgaagctg

SEQ ID NO: 871266 - DNA, 22 bp, Artificial Sequence
  chemically synthesized
gtagggatatggatgaagctgt

SEQ ID NO: 871267 - DNA, 22 bp, Artificial Sequence
  chemically synthesized
tagggatatggatgaagctgta

SEQ ID NO: 871268 - DNA, 22 bp, Artificial Sequence
  chemically synthesized
agaatgatggtttacagcttca

SEQ ID NO: 871269 - DNA, 22 bp, Artificial Sequence
  chemically synthesized
ctgagaatgatggtttacagct

SEQ ID NO: 871270 - DNA, 22 bp, Artificial Sequence
  chemically synthesized
gctgagaatgatggtttacagc

SEQ ID NO: 871271 - DNA, 22 bp, Artificial Sequence
  chemically synthesized
cgatagtttgctgagaatgatg

SEQ ID NO: 871272 - DNA, 22 bp, Artificial Sequence
  chemically synthesized
gcgatagtttgctgagaatgat

SEQ ID NO: 871273 - DNA, 22 bp, Artificial Sequence
  chemically synthesized
tccttgcgatagtttgctgaga

SEQ ID NO: 871274 - DNA, 22 bp, Artificial Sequence
  chemically synthesized
taaaccatcattctcagcaaac

SEQ ID NO: 871275 - DNA, 22 bp, Artificial Sequence
  chemically synthesized
gtccttgcgatagtttgctgag

SEQ ID NO: 871276 - DNA, 22 bp, Artificial Sequence
  chemically synthesized
tgtccttgcgatagtttgctga

SEQ ID NO: 871277 - DNA, 22 bp, Artificial Sequence
  chemically synthesized
ttgtccttgcgatagtttgctg

SEQ ID NO: 871278 - DNA, 22 bp, Artificial Sequence
  chemically synthesized
tttgtccttgcgatagtttgct

SEQ ID NO: 871279 - DNA, 22 bp, Artificial Sequence
  chemically synthesized
gttttttgtccttgcgatagtt

SEQ ID NO: 871280 - DNA, 22 bp, Artificial Sequence
  chemically synthesized
ggttttttgtccttgcgatagt

SEQ ID NO: 871281 - DNA, 22 bp, Artificial Sequence
  chemically synthesized
tcagcaaactatcgcaaggaca

SEQ ID NO: 871282 - DNA, 22 bp, Artificial Sequence
  chemically synthesized
agcaaactatcgcaaggacaaa

SEQ ID NO: 871283 - DNA, 22 bp, Artificial Sequence
  chemically synthesized
tcgcaaggacaaaaaaccaaac

SEQ ID NO: 871284 - DNA, 22 bp, Artificial Sequence
  chemically synthesized
tgagtgagaatatgcggtgttt

SEQ ID NO: 871285 - DNA, 22 bp, Artificial Sequence
  chemically synthesized
ccacctgtgagtgagaatatgc

SEQ ID NO: 871286 - DNA, 22 bp, Artificial Sequence
  chemically synthesized
aattcccacctgtgagtgagaa

SEQ ID NO: 871287 - DNA, 22 bp, Artificial Sequence
  chemically synthesized
ttcaattcccacctgtgagtga

SEQ ID NO: 871288 - DNA, 22 bp, Artificial Sequence
  chemically synthesized
attgttcaattcccacctgtga

SEQ ID NO: 871289 - DNA, 22 bp, Artificial Sequence
  chemically synthesized
tcattgttcaattcccacctgt

SEQ ID NO: 871290 - DNA, 22 bp, Artificial Sequence
  chemically synthesized
tcactcacaggtgggaattgaa

SEQ ID NO: 871291 - DNA, 22 bp, Artificial Sequence
  chemically synthesized
actcacaggtgggaattgaaca

SEQ ID NO: 871292 - DNA, 22 bp, Artificial Sequence
  chemically synthesized
acaggtgggaattgaacaatga

SEQ ID NO: 871293 - DNA, 22 bp, Artificial Sequence
  chemically synthesized
tgaccatgtgttctcattgttc

SEQ ID NO: 871294 - DNA, 22 bp, Artificial Sequence
  chemically synthesized
ctgtgaccatgtgttctcattg

SEQ ID NO: 871295 - DNA, 22 bp, Artificial Sequence
  chemically synthesized
cctgtgaccatgtgttctcatt

SEQ ID NO: 871296 - DNA, 22 bp, Artificial Sequence
  chemically synthesized
cccttcctgtgaccatgtgttc

SEQ ID NO: 871297 - DNA, 22 bp, Artificial Sequence
  chemically synthesized
aacaatgagaacacatggtcac

SEQ ID NO: 871298 - DNA, 22 bp, Artificial Sequence
  chemically synthesized
cccccaccccacagcaggcccc

SEQ ID NO: 871299 - DNA, 22 bp, Artificial Sequence
  chemically synthesized
ccccctccccccaccccacagc

SEQ ID NO: 871300 - DNA, 22 bp, Artificial Sequence
  chemically synthesized
gggcctgctgtggggtgggggg

SEQ ID NO: 871301 - DNA, 22 bp, Artificial Sequence
  chemically synthesized
tccctcccccctccccccaccc

SEQ ID NO: 871302 - DNA, 22 bp, Artificial Sequence
  chemically synthesized
atgctatccctcccccctcccc

SEQ ID NO: 871303 - DNA, 22 bp, Artificial Sequence
  chemically synthesized
ctgtggggtggggggagggggg

SEQ ID NO: 871304 - DNA, 22 bp, Artificial Sequence
  chemically synthesized
ctaatgctatccctcccccctc

SEQ ID NO: 871305 - DNA, 22 bp, Artificial Sequence
  chemically synthesized
tggggtggggggaggggggagg

SEQ ID NO: 871306 - DNA, 22 bp, Artificial Sequence
  chemically synthesized
ggtatatctcctaatgctatcc

SEQ ID NO: 871307 - DNA, 22 bp, Artificial Sequence
  chemically synthesized
aacattaggtatatctcctaat

SEQ ID NO: 871308 - DNA, 22 bp, Artificial Sequence
  chemically synthesized
gtcattgaacattaggtatatc

SEQ ID NO: 871309 - DNA, 22 bp, Artificial Sequence
  chemically synthesized
actcgtcattgaacattaggta

SEQ ID NO: 871310 - DNA, 22 bp, Artificial Sequence
  chemically synthesized
ggagatatacctaatgttcaat

SEQ ID NO: 871311 - DNA, 22 bp, Artificial Sequence
  chemically synthesized
cacccattaactcgtcattgaa

SEQ ID NO: 871312 - DNA, 22 bp, Artificial Sequence
  chemically synthesized
gtgtgctgcacccattaactcg

SEQ ID NO: 871313 - DNA, 22 bp, Artificial Sequence
  chemically synthesized
atgttcaatgacgagttaatgg

SEQ ID NO: 871314 - DNA, 22 bp, Artificial Sequence
  chemically synthesized
aatgacgagttaatgggtgcag

SEQ ID NO: 871315 - DNA, 22 bp, Artificial Sequence
  chemically synthesized
atgggtgcagcacaccaacatg

SEQ ID NO: 871316 - DNA, 22 bp, Artificial Sequence
  chemically synthesized
catatatatacatgtgccatgt

SEQ ID NO: 871317 - DNA, 22 bp, Artificial Sequence
  chemically synthesized
ttacatatatatacatgtgcca

SEQ ID NO: 871318 - DNA, 22 bp, Artificial Sequence
  chemically synthesized
gggtacatgtgcacaatgtgca

SEQ ID NO: 871319 - DNA, 22 bp, Artificial Sequence
  chemically synthesized
agggtacatgtgcacaatgtgc

SEQ ID NO: 871320 - DNA, 22 bp, Artificial Sequence
  chemically synthesized
tagggtacatgtgcacaatgtg

SEQ ID NO: 871321 - DNA, 22 bp, Artificial Sequence
  chemically synthesized
agttttagggtacatgtgcaca

SEQ ID NO: 871322 - DNA, 22 bp, Artificial Sequence
  chemically synthesized
aagttttagggtacatgtgcac

SEQ ID NO: 871323 - DNA, 22 bp, Artificial Sequence
  chemically synthesized
taagttttagggtacatgtgca

SEQ ID NO: 871324 - DNA, 22 bp, Artificial Sequence
  chemically synthesized
cacattgtgcacatgtacccta

SEQ ID NO: 871325 - DNA, 22 bp, Artificial Sequence
  chemically synthesized
tactttaagttttagggtacat

SEQ ID NO: 871326 - DNA, 22 bp, Artificial Sequence
  chemically synthesized
ttatactttaagttttagggta

SEQ ID NO: 871327 - DNA, 22 bp, Artificial Sequence
  chemically synthesized
attatactttaagttttagggt

SEQ ID NO: 871328 - DNA, 22 bp, Artificial Sequence
  chemically synthesized
tattatactttaagttttaggg

SEQ ID NO: 871329 - DNA, 22 bp, Artificial Sequence
  chemically synthesized
ttattatactttaagttttagg

SEQ ID NO: 871330 - DNA, 22 bp, Artificial Sequence
  chemically synthesized
tgcacatgtaccctaaaactta

SEQ ID NO: 871331 - DNA, 22 bp, Artificial Sequence
  chemically synthesized
tttattatactttaagttttag

SEQ ID NO: 871332 - DNA, 22 bp, Artificial Sequence
  chemically synthesized
ttttattatactttaagtttta

SEQ ID NO: 871333 - DNA, 22 bp, Artificial Sequence
  chemically synthesized
tttttattatactttaagtttt

SEQ ID NO: 871334 - DNA, 22 bp, Artificial Sequence
  chemically synthesized
ttttttattatactttaagttt

SEQ ID NO: 871335 - DNA, 22 bp, Artificial Sequence
  chemically synthesized
acttttttttattatactttaa

SEQ ID NO: 871336 - DNA, 22 bp, Artificial Sequence
  chemically synthesized
aacttttttttattatacttta

SEQ ID NO: 871337 - DNA, 22 bp, Artificial Sequence
  chemically synthesized
cttaacttttttttattatact

SEQ ID NO: 871338 - DNA, 22 bp, Artificial Sequence
  chemically synthesized
gcttaacttttttttattatac

SEQ ID NO: 871339 - DNA, 22 bp, Artificial Sequence
  chemically synthesized
tgcttaacttttttttattata

SEQ ID NO: 871340 - DNA, 22 bp, Artificial Sequence
  chemically synthesized
ttgcttaacttttttttattat

SEQ ID NO: 871341 - DNA, 22 bp, Artificial Sequence
  chemically synthesized
aaacttaaagtataataaaaaa

SEQ ID NO: 871342 - DNA, 22 bp, Artificial Sequence
  chemically synthesized
tttttgcttaacttttttttat

SEQ ID NO: 871343 - DNA, 22 bp, Artificial Sequence
  chemically synthesized
atttttgcttaactttttttta

SEQ ID NO: 871344 - DNA, 22 bp, Artificial Sequence
  chemically synthesized
aaagtataataaaaaaaagtta

SEQ ID NO: 871345 - DNA, 22 bp, Artificial Sequence
  chemically synthesized
tttatttttgcttaactttttt

SEQ ID NO: 871346 - DNA, 22 bp, Artificial Sequence
  chemically synthesized
aagtataataaaaaaaagttaa

SEQ ID NO: 871347 - DNA, 22 bp, Artificial Sequence
  chemically synthesized
atttatttttgcttaacttttt

SEQ ID NO: 871348 - DNA, 22 bp, Artificial Sequence
  chemically synthesized
tttatttatttttgcttaactt

SEQ ID NO: 871349 - DNA, 22 bp, Artificial Sequence
  chemically synthesized
atttatttatttttgcttaact

SEQ ID NO: 871350 - DNA, 22 bp, Artificial Sequence
  chemically synthesized
tttatttatttatttttgctta

SEQ ID NO: 871351 - DNA, 22 bp, Artificial Sequence
  chemically synthesized
atttatttatttatttttgctt

SEQ ID NO: 871352 - DNA, 22 bp, Artificial Sequence
  chemically synthesized
tatttatttatttatttttgct

SEQ ID NO: 871353 - DNA, 22 bp, Artificial Sequence
  chemically synthesized
ttttatttatttatttattttt

SEQ ID NO: 871354 - DNA, 22 bp, Artificial Sequence
  chemically synthesized
gttttatttatttatttatttt

SEQ ID NO: 871355 - DNA, 22 bp, Artificial Sequence
  chemically synthesized
tttgttttatttatttatttat

SEQ ID NO: 871356 - DNA, 22 bp, Artificial Sequence
  chemically synthesized
atttgttttatttatttattta

SEQ ID NO: 871357 - DNA, 22 bp, Artificial Sequence
  chemically synthesized
tatttgttttatttatttattt

SEQ ID NO: 871358 - DNA, 22 bp, Artificial Sequence
  chemically synthesized
ttatttgttttatttatttatt

SEQ ID NO: 871359 - DNA, 22 bp, Artificial Sequence
  chemically synthesized
tttatttgttttatttatttat

SEQ ID NO: 871360 - DNA, 22 bp, Artificial Sequence
  chemically synthesized
agcaaaaataaataaataaata

SEQ ID NO: 871361 - DNA, 22 bp, Artificial Sequence
  chemically synthesized
tacctttttatttgttttattt

SEQ ID NO: 871362 - DNA, 22 bp, Artificial Sequence
  chemically synthesized
atacctttttatttgttttatt

SEQ ID NO: 871363 - DNA, 22 bp, Artificial Sequence
  chemically synthesized
tttatacctttttatttgtttt

SEQ ID NO: 871364 - DNA, 22 bp, Artificial Sequence
  chemically synthesized
acatataaggttatttatacct

SEQ ID NO: 871365 - DNA, 22 bp, Artificial Sequence
  chemically synthesized
aatatcaaatcctcacatataa

SEQ ID NO: 871366 - DNA, 22 bp, Artificial Sequence
  chemically synthesized
aattgaatatcaaatcctcaca

SEQ ID NO: 871367 - DNA, 22 bp, Artificial Sequence
  chemically synthesized
aaattgaatatcaaatcctcac

SEQ ID NO: 871368 - DNA, 22 bp, Artificial Sequence
  chemically synthesized
tttaaattgaatatcaaatcct

SEQ ID NO: 871369 - DNA, 22 bp, Artificial Sequence
  chemically synthesized
tatttaaattgaatatcaaatc

SEQ ID NO: 871370 - DNA, 22 bp, Artificial Sequence
  chemically synthesized
atatgtgaggatttgatattca

SEQ ID NO: 871371 - DNA, 22 bp, Artificial Sequence
  chemically synthesized
tatgtgaggatttgatattcaa

SEQ ID NO: 871372 - DNA, 22 bp, Artificial Sequence
  chemically synthesized
aagtctctatttaaattgaata

SEQ ID NO: 871373 - DNA, 22 bp, Artificial Sequence
  chemically synthesized
gaagtctctatttaaattgaat

SEQ ID NO: 871374 - DNA, 22 bp, Artificial Sequence
  chemically synthesized
tgaagtctctatttaaattgaa

SEQ ID NO: 871375 - DNA, 22 bp, Artificial Sequence
  chemically synthesized
ttgaagtctctatttaaattga

SEQ ID NO: 871376 - DNA, 22 bp, Artificial Sequence
  chemically synthesized
tttgaagtctctatttaaattg

SEQ ID NO: 871377 - DNA, 22 bp, Artificial Sequence
  chemically synthesized
aattttttgaagtctctattta

SEQ ID NO: 871378 - DNA, 22 bp, Artificial Sequence
  chemically synthesized
gatattcaatttaaatagagac

SEQ ID NO: 871379 - DNA, 22 bp, Artificial Sequence
  chemically synthesized
gaattttttgaagtctctattt

SEQ ID NO: 871380 - DNA, 22 bp, Artificial Sequence
  chemically synthesized
atattcaatttaaatagagact

SEQ ID NO: 871381 - DNA, 22 bp, Artificial Sequence
  chemically synthesized
atttgaattttttgaagtctct

SEQ ID NO: 871382 - DNA, 22 bp, Artificial Sequence
  chemically synthesized
catttgaattttttgaagtctc

SEQ ID NO: 871383 - DNA, 22 bp, Artificial Sequence
  chemically synthesized
aatttaaatagagacttcaaaa

SEQ ID NO: 871384 - DNA, 22 bp, Artificial Sequence
  chemically synthesized
tcttcatttgaattttttgaag

SEQ ID NO: 871385 - DNA, 22 bp, Artificial Sequence
  chemically synthesized
aaatagagacttcaaaaaattc

SEQ ID NO: 871386 - DNA, 22 bp, Artificial Sequence
  chemically synthesized
aatagagacttcaaaaaattca

SEQ ID NO: 871387 - DNA, 22 bp, Artificial Sequence
  chemically synthesized
gttatcttcatttgaatttttt

SEQ ID NO: 871388 - DNA, 22 bp, Artificial Sequence
  chemically synthesized
agttatcttcatttgaattttt

SEQ ID NO: 871389 - DNA, 22 bp, Artificial Sequence
  chemically synthesized
caaaaaattcaaatgaagataa

SEQ ID NO: 871390 - DNA, 22 bp, Artificial Sequence
  chemically synthesized
aaaaaattcaaatgaagataac

SEQ ID NO: 871391 - DNA, 22 bp, Artificial Sequence
  chemically synthesized
aaatgaagataactaaatcact

SEQ ID NO: 871392 - DNA, 22 bp, Artificial Sequence
  chemically synthesized
atcagtgcaccatgtatcaagc

SEQ ID NO: 871393 - DNA, 22 bp, Artificial Sequence
  chemically synthesized
ttaatcagtgcaccatgtatca

SEQ ID NO: 871394 - DNA, 22 bp, Artificial Sequence
  chemically synthesized
aatcactgcttgatacatggtg

SEQ ID NO: 871395 - DNA, 22 bp, Artificial Sequence
  chemically synthesized
tgctattaatcagtgcaccatg

SEQ ID NO: 871396 - DNA, 22 bp, Artificial Sequence
  chemically synthesized
atgctattaatcagtgcaccat

SEQ ID NO: 871397 - DNA, 22 bp, Artificial Sequence
  chemically synthesized
cttgatacatggtgcactgatt

SEQ ID NO: 871398 - DNA, 22 bp, Artificial Sequence
  chemically synthesized
gatacatggtgcactgattaat

SEQ ID NO: 871399 - DNA, 22 bp, Artificial Sequence
  chemically synthesized
atacatggtgcactgattaata

SEQ ID NO: 871400 - DNA, 22 bp, Artificial Sequence
  chemically synthesized
cagagcttatgctattaatcag

SEQ ID NO: 871401 - DNA, 22 bp, Artificial Sequence
  chemically synthesized
tgattccagagcttatgctatt

SEQ ID NO: 871402 - DNA, 22 bp, Artificial Sequence
  chemically synthesized
tatgattccagagcttatgcta

SEQ ID NO: 871403 - DNA, 22 bp, Artificial Sequence
  chemically synthesized
attaatagcataagctctggaa

SEQ ID NO: 871404 - DNA, 22 bp, Artificial Sequence
  chemically synthesized
atagcataagctctggaatcat

SEQ ID NO: 871405 - DNA, 22 bp, Artificial Sequence
  chemically synthesized
aaaaataagtctctatgattcc

SEQ ID NO: 871406 - DNA, 22 bp, Artificial Sequence
  chemically synthesized
tggaatcatagagacttatttt

SEQ ID NO: 871407 - DNA, 22 bp, Artificial Sequence
  chemically synthesized
gaatcatagagacttatttttg

SEQ ID NO: 871408 - DNA, 22 bp, Artificial Sequence
  chemically synthesized
gtcagtgacagagtgggtattc

SEQ ID NO: 871409 - DNA, 22 bp, Artificial Sequence
  chemically synthesized
atttttgaatacccactctgtc

SEQ ID NO: 871410 - DNA, 22 bp, Artificial Sequence
  chemically synthesized
tttttgaatacccactctgtca

SEQ ID NO: 871411 - DNA, 22 bp, Artificial Sequence
  chemically synthesized
cagagctagtcagtgacagagt

SEQ ID NO: 871412 - DNA, 22 bp, Artificial Sequence
  chemically synthesized
ttgaatacccactctgtcactg

SEQ ID NO: 871413 - DNA, 22 bp, Artificial Sequence
  chemically synthesized
tgaatacccactctgtcactga

SEQ ID NO: 871414 - DNA, 22 bp, Artificial Sequence
  chemically synthesized
gaatacccactctgtcactgac

SEQ ID NO: 871415 - DNA, 22 bp, Artificial Sequence
  chemically synthesized
aatacccactctgtcactgact

SEQ ID NO: 871416 - DNA, 22 bp, Artificial Sequence
  chemically synthesized
tccaaggttacagagctagtca

SEQ ID NO: 871417 - DNA, 22 bp, Artificial Sequence
  chemically synthesized
gtccaaggttacagagctagtc

SEQ ID NO: 871418 - DNA, 22 bp, Artificial Sequence
  chemically synthesized
tgtcactgactagctctgtaac

SEQ ID NO: 871419 - DNA, 22 bp, Artificial Sequence
  chemically synthesized
tcactgactagctctgtaacct

SEQ ID NO: 871420 - DNA, 22 bp, Artificial Sequence
  chemically synthesized
aataatttgtccaaggttacag

SEQ ID NO: 871421 - DNA, 22 bp, Artificial Sequence
  chemically synthesized
actagctctgtaaccttggaca

SEQ ID NO: 871422 - DNA, 22 bp, Artificial Sequence
  chemically synthesized
gctctgtaaccttggacaaatt

SEQ ID NO: 871423 - DNA, 22 bp, Artificial Sequence
  chemically synthesized
tgtaaccttggacaaattattt

SEQ ID NO: 871424 - DNA, 22 bp, Artificial Sequence
  chemically synthesized
taaccttggacaaattatttaa

SEQ ID NO: 871425 - DNA, 22 bp, Artificial Sequence
  chemically synthesized
ggacaaattatttaacctttct

SEQ ID NO: 871426 - DNA, 22 bp, Artificial Sequence
  chemically synthesized
gacaaattatttaacctttctg

SEQ ID NO: 871427 - DNA, 22 bp, Artificial Sequence
  chemically synthesized
tagatgagataaccaagggtca

SEQ ID NO: 871428 - DNA, 22 bp, Artificial Sequence
  chemically synthesized
tttaacctttctgacccttggt

SEQ ID NO: 871429 - DNA, 22 bp, Artificial Sequence
  chemically synthesized
atagatgagataaccaagggtc

SEQ ID NO: 871430 - DNA, 22 bp, Artificial Sequence
  chemically synthesized
tatagatgagataaccaagggt

SEQ ID NO: 871431 - DNA, 22 bp, Artificial Sequence
  chemically synthesized
aacctttctgacccttggttat

SEQ ID NO: 871432 - DNA, 22 bp, Artificial Sequence
  chemically synthesized
acctttctgacccttggttatc

SEQ ID NO: 871433 - DNA, 22 bp, Artificial Sequence
  chemically synthesized
ccattttatagatgagataacc

SEQ ID NO: 871434 - DNA, 22 bp, Artificial Sequence
  chemically synthesized
tctgacccttggttatctcatc

SEQ ID NO: 871435 - DNA, 22 bp, Artificial Sequence
  chemically synthesized
ctgacccttggttatctcatct

SEQ ID NO: 871436 - DNA, 22 bp, Artificial Sequence
  chemically synthesized
tgacccttggttatctcatcta

SEQ ID NO: 871437 - DNA, 22 bp, Artificial Sequence
  chemically synthesized
acccttggttatctcatctata

SEQ ID NO: 871438 - DNA, 22 bp, Artificial Sequence
  chemically synthesized
caattcccattttatagatgag

SEQ ID NO: 871439 - DNA, 22 bp, Artificial Sequence
  chemically synthesized
tgttgcaattcccattttatag

SEQ ID NO: 871440 - DNA, 22 bp, Artificial Sequence
  chemically synthesized
ggttatctcatctataaaatgg

SEQ ID NO: 871441 - DNA, 22 bp, Artificial Sequence
  chemically synthesized
gttatctcatctataaaatggg

SEQ ID NO: 871442 - DNA, 22 bp, Artificial Sequence
  chemically synthesized
tctcatctataaaatgggaatt

SEQ ID NO: 871443 - DNA, 22 bp, Artificial Sequence
  chemically synthesized
agtaagttatgttgcaattccc

SEQ ID NO: 871444 - DNA, 22 bp, Artificial Sequence
  chemically synthesized
atctataaaatgggaattgcaa

SEQ ID NO: 871445 - DNA, 22 bp, Artificial Sequence
  chemically synthesized
gagtaagttatgttgcaattcc

SEQ ID NO: 871446 - DNA, 22 bp, Artificial Sequence
  chemically synthesized
tgagtaagttatgttgcaattc

SEQ ID NO: 871447 - DNA, 22 bp, Artificial Sequence
  chemically synthesized
ttgagtaagttatgttgcaatt

SEQ ID NO: 871448 - DNA, 22 bp, Artificial Sequence
  chemically synthesized
taaaatgggaattgcaacataa

SEQ ID NO: 871449 - DNA, 22 bp, Artificial Sequence
  chemically synthesized
taccttttgagtaagttatgtt

SEQ ID NO: 871450 - DNA, 22 bp, Artificial Sequence
  chemically synthesized
caacataacttactcaaaaggt

SEQ ID NO: 871451 - DNA, 22 bp, Artificial Sequence
  chemically synthesized
gtgccacagttataccttttga

SEQ ID NO: 871452 - DNA, 22 bp, Artificial Sequence
  chemically synthesized
gaattagtgccacagttatacc

SEQ ID NO: 871453 - DNA, 22 bp, Artificial Sequence
  chemically synthesized
agaattagtgccacagttatac

SEQ ID NO: 871454 - DNA, 22 bp, Artificial Sequence
  chemically synthesized
actcaaaaggtataactgtggc

SEQ ID NO: 871455 - DNA, 22 bp, Artificial Sequence
  chemically synthesized
ctcaaaaggtataactgtggca

SEQ ID NO: 871456 - DNA, 22 bp, Artificial Sequence
  chemically synthesized
aaaaggtataactgtggcacta

SEQ ID NO: 871457 - DNA, 22 bp, Artificial Sequence
  chemically synthesized
atacaagtcttagaattagtgc

SEQ ID NO: 871458 - DNA, 22 bp, Artificial Sequence
  chemically synthesized
aattaatacaagtcttagaatt

SEQ ID NO: 871459 - DNA, 22 bp, Artificial Sequence
  chemically synthesized
tggcactaattctaagacttgt

SEQ ID NO: 871460 - DNA, 22 bp, Artificial Sequence
  chemically synthesized
agcaaacctaaattaatacaag

SEQ ID NO: 871461 - DNA, 22 bp, Artificial Sequence
  chemically synthesized
tgagcaaacctaaattaataca

SEQ ID NO: 871462 - DNA, 22 bp, Artificial Sequence
  chemically synthesized
attctaagacttgtattaattt

SEQ ID NO: 871463 - DNA, 22 bp, Artificial Sequence
  chemically synthesized
ctgagcaaacctaaattaatac

SEQ ID NO: 871464 - DNA, 22 bp, Artificial Sequence
  chemically synthesized
cttctgagcaaacctaaattaa

SEQ ID NO: 871465 - DNA, 22 bp, Artificial Sequence
  chemically synthesized
taagacttgtattaatttaggt

SEQ ID NO: 871466 - DNA, 22 bp, Artificial Sequence
  chemically synthesized
agacttgtattaatttaggttt

SEQ ID NO: 871467 - DNA, 22 bp, Artificial Sequence
  chemically synthesized
agggtctacttctgagcaaacc

SEQ ID NO: 871468 - DNA, 22 bp, Artificial Sequence
  chemically synthesized
gtattaatttaggtttgctcag

SEQ ID NO: 871469 - DNA, 22 bp, Artificial Sequence
  chemically synthesized
tattaatttaggtttgctcaga

SEQ ID NO: 871470 - DNA, 22 bp, Artificial Sequence
  chemically synthesized
tctcagggtctacttctgagca

SEQ ID NO: 871471 - DNA, 22 bp, Artificial Sequence
  chemically synthesized
gtctcagggtctacttctgagc

SEQ ID NO: 871472 - DNA, 22 bp, Artificial Sequence
  chemically synthesized
atttaggtttgctcagaagtag

SEQ ID NO: 871473 - DNA, 22 bp, Artificial Sequence
  chemically synthesized
aggtttgctcagaagtagaccc

SEQ ID NO: 871474 - DNA, 22 bp, Artificial Sequence
  chemically synthesized
ggtttgctcagaagtagaccct

SEQ ID NO: 871475 - DNA, 22 bp, Artificial Sequence
  chemically synthesized
aatccttgtctcagggtctact

SEQ ID NO: 871476 - DNA, 22 bp, Artificial Sequence
  chemically synthesized
aaatccttgtctcagggtctac

SEQ ID NO: 871477 - DNA, 22 bp, Artificial Sequence
  chemically synthesized
gctcagaagtagaccctgagac

SEQ ID NO: 871478 - DNA, 22 bp, Artificial Sequence
  chemically synthesized
ctcagaagtagaccctgagaca

SEQ ID NO: 871479 - DNA, 22 bp, Artificial Sequence
  chemically synthesized
tatttaaatccttgtctcaggg

SEQ ID NO: 871480 - DNA, 22 bp, Artificial Sequence
  chemically synthesized
gtatttaaatccttgtctcagg

SEQ ID NO: 871481 - DNA, 22 bp, Artificial Sequence
  chemically synthesized
agaagtagaccctgagacaagg

SEQ ID NO: 871482 - DNA, 22 bp, Artificial Sequence
  chemically synthesized
tttgtatttaaatccttgtctc

SEQ ID NO: 871483 - DNA, 22 bp, Artificial Sequence
  chemically synthesized
aattatttgtatttaaatcctt

SEQ ID NO: 871484 - DNA, 22 bp, Artificial Sequence
  chemically synthesized
ccaattgaattatttgtattta

SEQ ID NO: 871485 - DNA, 22 bp, Artificial Sequence
  chemically synthesized
agacaaggatttaaatacaaat

SEQ ID NO: 871486 - DNA, 22 bp, Artificial Sequence
  chemically synthesized
ggatcagctcccaattgaatta

SEQ ID NO: 871487 - DNA, 22 bp, Artificial Sequence
  chemically synthesized
tgggatcagctcccaattgaat

SEQ ID NO: 871488 - DNA, 22 bp, Artificial Sequence
  chemically synthesized
aaatacaaataattcaattggg

SEQ ID NO: 871489 - DNA, 22 bp, Artificial Sequence
  chemically synthesized
ctgggatcagctcccaattgaa

SEQ ID NO: 871490 - DNA, 22 bp, Artificial Sequence
  chemically synthesized
aatacaaataattcaattggga

SEQ ID NO: 871491 - DNA, 22 bp, Artificial Sequence
  chemically synthesized
tctgggatcagctcccaattga

SEQ ID NO: 871492 - DNA, 22 bp, Artificial Sequence
  chemically synthesized
ccatggctttctgggatcagct

SEQ ID NO: 871493 - DNA, 22 bp, Artificial Sequence
  chemically synthesized
taccatggctttctgggatcag

SEQ ID NO: 871494 - DNA, 22 bp, Artificial Sequence
  chemically synthesized
ctaccatggctttctgggatca

SEQ ID NO: 871495 - DNA, 22 bp, Artificial Sequence
  chemically synthesized
aattgggagctgatcccagaaa

SEQ ID NO: 871496 - DNA, 22 bp, Artificial Sequence
  chemically synthesized
ttctaccatggctttctgggat

SEQ ID NO: 871497 - DNA, 22 bp, Artificial Sequence
  chemically synthesized
tcttctaccatggctttctggg

SEQ ID NO: 871498 - DNA, 22 bp, Artificial Sequence
  chemically synthesized
ctcttctaccatggctttctgg

SEQ ID NO: 871499 - DNA, 22 bp, Artificial Sequence
  chemically synthesized
ggagctgatcccagaaagccat

SEQ ID NO: 871500 - DNA, 22 bp, Artificial Sequence
  chemically synthesized
tcttctcttctaccatggcttt

SEQ ID NO: 871501 - DNA, 22 bp, Artificial Sequence
  chemically synthesized
tatcttctcttctaccatggct

SEQ ID NO: 871502 - DNA, 22 bp, Artificial Sequence
  chemically synthesized
atcccagaaagccatggtagaa

SEQ ID NO: 871503 - DNA, 22 bp, Artificial Sequence
  chemically synthesized
cagctctatcttctcttctacc

SEQ ID NO: 871504 - DNA, 22 bp, Artificial Sequence
  chemically synthesized
tgcagctctatcttctcttcta

SEQ ID NO: 871505 - DNA, 22 bp, Artificial Sequence
  chemically synthesized
agctctgcagctctatcttctc

SEQ ID NO: 871506 - DNA, 22 bp, Artificial Sequence
  chemically synthesized
cagctctgcagctctatcttct

SEQ ID NO: 871507 - DNA, 22 bp, Artificial Sequence
  chemically synthesized
acagatatatatgtatcttcag

SEQ ID NO: 871508 - DNA, 22 bp, Artificial Sequence
  chemically synthesized
cagagctgaagatacatatata

SEQ ID NO: 871509 - DNA, 22 bp, Artificial Sequence
  chemically synthesized
agatacaactgacagatatata

SEQ ID NO: 871510 - DNA, 22 bp, Artificial Sequence
  chemically synthesized
ctgagatacaactgacagatat

SEQ ID NO: 871511 - DNA, 22 bp, Artificial Sequence
  chemically synthesized
aagatacatatatatctgtcag

SEQ ID NO: 871512 - DNA, 22 bp, Artificial Sequence
  chemically synthesized
cctgctgagatacaactgacag

SEQ ID NO: 871513 - DNA, 22 bp, Artificial Sequence
  chemically synthesized
ttccctgctgagatacaactga

SEQ ID NO: 871514 - DNA, 22 bp, Artificial Sequence
  chemically synthesized
gttccctgctgagatacaactg

SEQ ID NO: 871515 - DNA, 22 bp, Artificial Sequence
  chemically synthesized
tgttccctgctgagatacaact

SEQ ID NO: 871516 - DNA, 22 bp, Artificial Sequence
  chemically synthesized
aactttgttccctgctgagata

SEQ ID NO: 871517 - DNA, 22 bp, Artificial Sequence
  chemically synthesized
tcagttgtatctcagcagggaa

SEQ ID NO: 871518 - DNA, 22 bp, Artificial Sequence
  chemically synthesized
atatatctcaactttgttccct

SEQ ID NO: 871519 - DNA, 22 bp, Artificial Sequence
  chemically synthesized
tcatatatctcaactttgttcc

SEQ ID NO: 871520 - DNA, 22 bp, Artificial Sequence
  chemically synthesized
tatctcagcagggaacaaagtt

SEQ ID NO: 871521 - DNA, 22 bp, Artificial Sequence
  chemically synthesized
agcagggaacaaagttgagata

SEQ ID NO: 871522 - DNA, 22 bp, Artificial Sequence
  chemically synthesized
agtattctcatatatctcaact

SEQ ID NO: 871523 - DNA, 22 bp, Artificial Sequence
  chemically synthesized
cagtattctcatatatctcaac

SEQ ID NO: 871524 - DNA, 22 bp, Artificial Sequence
  chemically synthesized
ttcagtattctcatatatctca

SEQ ID NO: 871525 - DNA, 22 bp, Artificial Sequence
  chemically synthesized
agtcctcttcagtattctcata

SEQ ID NO: 871526 - DNA, 22 bp, Artificial Sequence
  chemically synthesized
cagtcctcttcagtattctcat

SEQ ID NO: 871527 - DNA, 22 bp, Artificial Sequence
  chemically synthesized
atttcagtcctcttcagtattc

SEQ ID NO: 871528 - DNA, 22 bp, Artificial Sequence
  chemically synthesized
gatttcagtcctcttcagtatt

SEQ ID NO: 871529 - DNA, 22 bp, Artificial Sequence
  chemically synthesized
agatatatgagaatactgaaga

SEQ ID NO: 871530 - DNA, 22 bp, Artificial Sequence
  chemically synthesized
agtttgatttcagtcctcttca

SEQ ID NO: 871531 - DNA, 22 bp, Artificial Sequence
  chemically synthesized
ctgagtttgatttcagtcctct

SEQ ID NO: 871532 - DNA, 22 bp, Artificial Sequence
  chemically synthesized
aagaggactgaaatcaaactca

SEQ ID NO: 871533 - DNA, 22 bp, Artificial Sequence
  chemically synthesized
gacccaaccccacatctcctga

SEQ ID NO: 871534 - DNA, 22 bp, Artificial Sequence
  chemically synthesized
aaatcaaactcaggagatgtgg

SEQ ID NO: 871535 - DNA, 22 bp, Artificial Sequence
  chemically synthesized
gcagaatctggacccaacccca

SEQ ID NO: 871536 - DNA, 22 bp, Artificial Sequence
  chemically synthesized
ggcagaatctggacccaacccc

SEQ ID NO: 871537 - DNA, 22 bp, Artificial Sequence
  chemically synthesized
tggcagaatctggacccaaccc

SEQ ID NO: 871538 - DNA, 22 bp, Artificial Sequence
  chemically synthesized
aggagatgtggggttgggtcca

SEQ ID NO: 871539 - DNA, 22 bp, Artificial Sequence
  chemically synthesized
ccattttggcagaatctggacc

SEQ ID NO: 871540 - DNA, 22 bp, Artificial Sequence
  chemically synthesized
cccattttggcagaatctggac

SEQ ID NO: 871541 - DNA, 22 bp, Artificial Sequence
  chemically synthesized
ttcccattttggcagaatctgg

SEQ ID NO: 871542 - DNA, 22 bp, Artificial Sequence
  chemically synthesized
cttcccattttggcagaatctg

SEQ ID NO: 871543 - DNA, 22 bp, Artificial Sequence
  chemically synthesized
tcttcccattttggcagaatct

SEQ ID NO: 871544 - DNA, 22 bp, Artificial Sequence
  chemically synthesized
ggtccagattctgccaaaatgg

SEQ ID NO: 871545 - DNA, 22 bp, Artificial Sequence
  chemically synthesized
cgatgtgtaggctttcttccca

SEQ ID NO: 871546 - DNA, 22 bp, Artificial Sequence
  chemically synthesized
ccgatgtgtaggctttcttccc

SEQ ID NO: 871547 - DNA, 22 bp, Artificial Sequence
  chemically synthesized
tgccaaaatgggaagaaagcct

SEQ ID NO: 871548 - DNA, 22 bp, Artificial Sequence
  chemically synthesized
cttccgatgtgtaggctttctt

SEQ ID NO: 871549 - DNA, 22 bp, Artificial Sequence
  chemically synthesized
ccttccgatgtgtaggctttct

SEQ ID NO: 871550 - DNA, 22 bp, Artificial Sequence
  chemically synthesized
ccaaaatgggaagaaagcctac

SEQ ID NO: 871551 - DNA, 22 bp, Artificial Sequence
  chemically synthesized
gtataggcttccttccgatgtg

SEQ ID NO: 871552 - DNA, 22 bp, Artificial Sequence
  chemically synthesized
gcatgcctcgtataggcttcct

SEQ ID NO: 871553 - DNA, 22 bp, Artificial Sequence
  chemically synthesized
cacatcggaaggaagcctatac

SEQ ID NO: 871554 - DNA, 22 bp, Artificial Sequence
  chemically synthesized
ttagcatgcctcgtataggctt

SEQ ID NO: 871555 - DNA, 22 bp, Artificial Sequence
  chemically synthesized
attagcatgcctcgtataggct

SEQ ID NO: 871556 - DNA, 22 bp, Artificial Sequence
  chemically synthesized
tacgaggcatgctaataagtat

SEQ ID NO: 871557 - DNA, 22 bp, Artificial Sequence
  chemically synthesized
accacaatgataagcatactta

SEQ ID NO: 871558 - DNA, 22 bp, Artificial Sequence
  chemically synthesized
ggcagttgaccacaatgataag

SEQ ID NO: 871559 - DNA, 22 bp, Artificial Sequence
  chemically synthesized
ataagtatgcttatcattgtgg

SEQ ID NO: 871560 - DNA, 22 bp, Artificial Sequence
  chemically synthesized
cagtgaattgggcagttgacca

SEQ ID NO: 871561 - DNA, 22 bp, Artificial Sequence
  chemically synthesized
atcattgtggtcaactgcccaa

SEQ ID NO: 871562 - DNA, 22 bp, Artificial Sequence
  chemically synthesized
tcattgtggtcaactgcccaat

SEQ ID NO: 871563 - DNA, 22 bp, Artificial Sequence
  chemically synthesized
aaaatctccagtgaattgggca

SEQ ID NO: 871564 - DNA, 22 bp, Artificial Sequence
  chemically synthesized
tggtcaactgcccaattcactg

SEQ ID NO: 871565 - DNA, 22 bp, Artificial Sequence
  chemically synthesized
cacactaaaaatctccagtgaa

SEQ ID NO: 871566 - DNA, 22 bp, Artificial Sequence
  chemically synthesized
cccaattcactggagattttta

SEQ ID NO: 871567 - DNA, 22 bp, Artificial Sequence
  chemically synthesized
caatgcatgttccacactaaaa

SEQ ID NO: 871568 - DNA, 22 bp, Artificial Sequence
  chemically synthesized
actggagatttttagtgtggaa

SEQ ID NO: 871569 - DNA, 22 bp, Artificial Sequence
  chemically synthesized
gagatttttagtgtggaacatg

SEQ ID NO: 871570 - DNA, 22 bp, Artificial Sequence
  chemically synthesized
ggtaggacacctccaatgcatg

SEQ ID NO: 871571 - DNA, 22 bp, Artificial Sequence
  chemically synthesized
ttagtgtggaacatgcattgga

SEQ ID NO: 871572 - DNA, 22 bp, Artificial Sequence
  chemically synthesized
gggtaggacacctccaatgcat

SEQ ID NO: 871573 - DNA, 22 bp, Artificial Sequence
  chemically synthesized
tagtgtggaacatgcattggag

SEQ ID NO: 871574 - DNA, 22 bp, Artificial Sequence
  chemically synthesized
agtgtggaacatgcattggagg

SEQ ID NO: 871575 - DNA, 22 bp, Artificial Sequence
  chemically synthesized
gtgtggaacatgcattggaggt

SEQ ID NO: 871576 - DNA, 22 bp, Artificial Sequence
  chemically synthesized
cccttgggtaggacacctccaa

SEQ ID NO: 871577 - DNA, 22 bp, Artificial Sequence
  chemically synthesized
tccccttgggtaggacacctcc

SEQ ID NO: 871578 - DNA, 22 bp, Artificial Sequence
  chemically synthesized
ctccccttgggtaggacacctc

SEQ ID NO: 871579 - DNA, 22 bp, Artificial Sequence
  chemically synthesized
ttctccccttgggtaggacacc

SEQ ID NO: 871580 - DNA, 22 bp, Artificial Sequence
  chemically synthesized
cttctccccttgggtaggacac

SEQ ID NO: 871581 - DNA, 22 bp, Artificial Sequence
  chemically synthesized
gaggtgtcctacccaaggggag

SEQ ID NO: 871582 - DNA, 22 bp, Artificial Sequence
  chemically synthesized
cccaaggggagaagaaggtggg

SEQ ID NO: 871583 - DNA, 22 bp, Artificial Sequence
  chemically synthesized
ggtgagaacacagccaaaccat

SEQ ID NO: 871584 - DNA, 22 bp, Artificial Sequence
  chemically synthesized
gggtgagaacacagccaaacca

SEQ ID NO: 871585 - DNA, 22 bp, Artificial Sequence
  chemically synthesized
attgatatggtttggctgtgtt

SEQ ID NO: 871586 - DNA, 22 bp, Artificial Sequence
  chemically synthesized
ttgatatggtttggctgtgttc

SEQ ID NO: 871587 - DNA, 22 bp, Artificial Sequence
  chemically synthesized
atatggtttggctgtgttctca

SEQ ID NO: 871588 - DNA, 22 bp, Artificial Sequence
  chemically synthesized
aagatgagatttgggtgagaac

SEQ ID NO: 871589 - DNA, 22 bp, Artificial Sequence
  chemically synthesized
ggctgtgttctcacccaaatct

SEQ ID NO: 871590 - DNA, 22 bp, Artificial Sequence
  chemically synthesized
caattcaagatgagatttgggt

SEQ ID NO: 871591 - DNA, 22 bp, Artificial Sequence
  chemically synthesized
gctgtgttctcacccaaatctc

SEQ ID NO: 871592 - DNA, 22 bp, Artificial Sequence
  chemically synthesized
tgttctcacccaaatctcatct

SEQ ID NO: 871593 - DNA, 22 bp, Artificial Sequence
  chemically synthesized
gagttacaattcaagatgagat

SEQ ID NO: 871594 - DNA, 22 bp, Artificial Sequence
  chemically synthesized
ttggagttacaattcaagatga

SEQ ID NO: 871595 - DNA, 22 bp, Artificial Sequence
  chemically synthesized
tcacccaaatctcatcttgaat

SEQ ID NO: 871596 - DNA, 22 bp, Artificial Sequence
  chemically synthesized
acccaaatctcatcttgaattg

SEQ ID NO: 871597 - DNA, 22 bp, Artificial Sequence
  chemically synthesized
atcttgaattgtaactccaata

SEQ ID NO: 871598 - DNA, 22 bp, Artificial Sequence
  chemically synthesized
gaattgtaactccaataatccc

SEQ ID NO: 871599 - DNA, 22 bp, Artificial Sequence
  chemically synthesized
ccacaacacgtggggattattg

SEQ ID NO: 871600 - DNA, 22 bp, Artificial Sequence
  chemically synthesized
aattgtaactccaataatcccc

SEQ ID NO: 871601 - DNA, 22 bp, Artificial Sequence
  chemically synthesized
taactccaataatccccacgtg

SEQ ID NO: 871602 - DNA, 22 bp, Artificial Sequence
  chemically synthesized
caataatccccacgtgttgtgg

SEQ ID NO: 871603 - DNA, 22 bp, Artificial Sequence
  chemically synthesized
ccacatggtccctcccacaaca

SEQ ID NO: 871604 - DNA, 22 bp, Artificial Sequence
  chemically synthesized
cctcccacatggtccctcccac

SEQ ID NO: 871605 - DNA, 22 bp, Artificial Sequence
  chemically synthesized
agttacctcccacatggtccct

SEQ ID NO: 871606 - DNA, 22 bp, Artificial Sequence
  chemically synthesized
tgggagggaccatgtgggaggt

SEQ ID NO: 871607 - DNA, 22 bp, Artificial Sequence
  chemically synthesized
aatcatgggggtggggttttcc

SEQ ID NO: 871608 - DNA, 22 bp, Artificial Sequence
  chemically synthesized
tcaggagaacagcacaggaaaa

SEQ ID NO: 871609 - DNA, 22 bp, Artificial Sequence
  chemically synthesized
actatcaggagaacagcacagg

SEQ ID NO: 871610 - DNA, 22 bp, Artificial Sequence
  chemically synthesized
ttcactatcaggagaacagcac

SEQ ID NO: 871611 - DNA, 22 bp, Artificial Sequence
  chemically synthesized
attcactatcaggagaacagca

SEQ ID NO: 871612 - DNA, 22 bp, Artificial Sequence
  chemically synthesized
tcctgtgctgttctcctgatag

SEQ ID NO: 871613 - DNA, 22 bp, Artificial Sequence
  chemically synthesized
cctgtgctgttctcctgatagt

SEQ ID NO: 871614 - DNA, 22 bp, Artificial Sequence
  chemically synthesized
ctgtgctgttctcctgatagtg

SEQ ID NO: 871615 - DNA, 22 bp, Artificial Sequence
  chemically synthesized
atgagacttattcactatcagg

SEQ ID NO: 871616 - DNA, 22 bp, Artificial Sequence
  chemically synthesized
tgctgttctcctgatagtgaat

SEQ ID NO: 871617 - DNA, 22 bp, Artificial Sequence
  chemically synthesized
ttctcctgatagtgaataagtc

SEQ ID NO: 871618 - DNA, 22 bp, Artificial Sequence
  chemically synthesized
tcctgatagtgaataagtctca

SEQ ID NO: 871619 - DNA, 22 bp, Artificial Sequence
  chemically synthesized
ctgatagtgaataagtctcatg

SEQ ID NO: 871620 - DNA, 22 bp, Artificial Sequence
  chemically synthesized
atagtgaataagtctcatgaga

SEQ ID NO: 871621 - DNA, 22 bp, Artificial Sequence
  chemically synthesized
taaaaccatcagatctcatgag

SEQ ID NO: 871622 - DNA, 22 bp, Artificial Sequence
  chemically synthesized
ataaaaccatcagatctcatga

SEQ ID NO: 871623 - DNA, 22 bp, Artificial Sequence
  chemically synthesized
tataaaaccatcagatctcatg

SEQ ID NO: 871624 - DNA, 22 bp, Artificial Sequence
  chemically synthesized
tttataaaaccatcagatctca

SEQ ID NO: 871625 - DNA, 22 bp, Artificial Sequence
  chemically synthesized
ctctttataaaaccatcagatc

SEQ ID NO: 871626 - DNA, 22 bp, Artificial Sequence
  chemically synthesized
atgagatctgatggttttataa

SEQ ID NO: 871627 - DNA, 22 bp, Artificial Sequence
  chemically synthesized
atggttttataaagagcagttt

SEQ ID NO: 871628 - DNA, 22 bp, Artificial Sequence
  chemically synthesized
tataaagagcagtttccctgca

SEQ ID NO: 871629 - DNA, 22 bp, Artificial Sequence
  chemically synthesized
ataaagagcagtttccctgcac

SEQ ID NO: 871630 - DNA, 22 bp, Artificial Sequence
  chemically synthesized
taaagagcagtttccctgcaca

SEQ ID NO: 871631 - DNA, 22 bp, Artificial Sequence
  chemically synthesized
catgacagcaggcaagagagca

SEQ ID NO: 871632 - DNA, 22 bp, Artificial Sequence
  chemically synthesized
acatgacagcaggcaagagagc

SEQ ID NO: 871633 - DNA, 22 bp, Artificial Sequence
  chemically synthesized
ccctgcacatgctctcttgcct

SEQ ID NO: 871634 - DNA, 22 bp, Artificial Sequence
  chemically synthesized
ttacatgacagcaggcaagaga

SEQ ID NO: 871635 - DNA, 22 bp, Artificial Sequence
  chemically synthesized
cctgcacatgctctcttgcctg

SEQ ID NO: 871636 - DNA, 22 bp, Artificial Sequence
  chemically synthesized
cttacatgacagcaggcaagag

SEQ ID NO: 871637 - DNA, 22 bp, Artificial Sequence
  chemically synthesized
cacatgctctcttgcctgctgt

SEQ ID NO: 871638 - DNA, 22 bp, Artificial Sequence
  chemically synthesized
tcttgcctgctgtcatgtaaga

SEQ ID NO: 871639 - DNA, 22 bp, Artificial Sequence
  chemically synthesized
ttgcctgctgtcatgtaagaag

SEQ ID NO: 871640 - DNA, 22 bp, Artificial Sequence
  chemically synthesized
gcctgctgtcatgtaagaagtg

SEQ ID NO: 871641 - DNA, 22 bp, Artificial Sequence
  chemically synthesized
cctgctgtcatgtaagaagtgc

SEQ ID NO: 871642 - DNA, 22 bp, Artificial Sequence
  chemically synthesized
ctgtcatgtaagaagtgcctct

SEQ ID NO: 871643 - DNA, 22 bp, Artificial Sequence
  chemically synthesized
tcatgtaagaagtgcctctgct

SEQ ID NO: 871644 - DNA, 22 bp, Artificial Sequence
  chemically synthesized
acaatcatggcagaaggcgaag

SEQ ID NO: 871645 - DNA, 22 bp, Artificial Sequence
  chemically synthesized
tgctcttccttcgccttctgcc

SEQ ID NO: 871646 - DNA, 22 bp, Artificial Sequence
  chemically synthesized
ctcttccttcgccttctgccat

SEQ ID NO: 871647 - DNA, 22 bp, Artificial Sequence
  chemically synthesized
ttccttcgccttctgccatgat

SEQ ID NO: 871648 - DNA, 22 bp, Artificial Sequence
  chemically synthesized
gagaggcctcacaatcatggca

SEQ ID NO: 871649 - DNA, 22 bp, Artificial Sequence
  chemically synthesized
ccttcgccttctgccatgattg

SEQ ID NO: 871650 - DNA, 22 bp, Artificial Sequence
  chemically synthesized
cttcgccttctgccatgattgt

SEQ ID NO: 871651 - DNA, 22 bp, Artificial Sequence
  chemically synthesized
cgccttctgccatgattgtgag

SEQ ID NO: 871652 - DNA, 22 bp, Artificial Sequence
  chemically synthesized
gccttctgccatgattgtgagg

SEQ ID NO: 871653 - DNA, 22 bp, Artificial Sequence
  chemically synthesized
cacatggctggagaggcctcac

SEQ ID NO: 871654 - DNA, 22 bp, Artificial Sequence
  chemically synthesized
ctgccatgattgtgaggcctct

SEQ ID NO: 871655 - DNA, 22 bp, Artificial Sequence
  chemically synthesized
tgccatgattgtgaggcctctc

SEQ ID NO: 871656 - DNA, 22 bp, Artificial Sequence
  chemically synthesized
ccatgattgtgaggcctctcca

SEQ ID NO: 871657 - DNA, 22 bp, Artificial Sequence
  chemically synthesized
acagttccacatggctggagag

SEQ ID NO: 871658 - DNA, 22 bp, Artificial Sequence
  chemically synthesized
tgaggcctctccagccatgtgg

SEQ ID NO: 871659 - DNA, 22 bp, Artificial Sequence
  chemically synthesized
atggactcacagttccacatgg

SEQ ID NO: 871660 - DNA, 22 bp, Artificial Sequence
  chemically synthesized
aatggactcacagttccacatg

SEQ ID NO: 871661 - DNA, 22 bp, Artificial Sequence
  chemically synthesized
tccagccatgtggaactgtgag

SEQ ID NO: 871662 - DNA, 22 bp, Artificial Sequence
  chemically synthesized
cagccatgtggaactgtgagtc

SEQ ID NO: 871663 - DNA, 22 bp, Artificial Sequence
  chemically synthesized
tacaggaaaaagaagtttaatg

SEQ ID NO: 871664 - DNA, 22 bp, Artificial Sequence
  chemically synthesized
atacaggaaaaagaagtttaat

SEQ ID NO: 871665 - DNA, 22 bp, Artificial Sequence
  chemically synthesized
tgagtccattaaacttcttttt

SEQ ID NO: 871666 - DNA, 22 bp, Artificial Sequence
  chemically synthesized
gataatttatacaggaaaaaga

SEQ ID NO: 871667 - DNA, 22 bp, Artificial Sequence
  chemically synthesized
aacttctttttcctgtataaat

SEQ ID NO: 871668 - DNA, 22 bp, Artificial Sequence
  chemically synthesized
ctttttcctgtataaattatcc

SEQ ID NO: 871669 - DNA, 22 bp, Artificial Sequence
  chemically synthesized
tttttcctgtataaattatcca

SEQ ID NO: 871670 - DNA, 22 bp, Artificial Sequence
  chemically synthesized
tttcctgtataaattatccagt

SEQ ID NO: 871671 - DNA, 22 bp, Artificial Sequence
  chemically synthesized
ttcctgtataaattatccagtc

SEQ ID NO: 871672 - DNA, 22 bp, Artificial Sequence
  chemically synthesized
tcctgtataaattatccagtct

SEQ ID NO: 871673 - DNA, 22 bp, Artificial Sequence
  chemically synthesized
cctgtataaattatccagtctc

SEQ ID NO: 871674 - DNA, 22 bp, Artificial Sequence
  chemically synthesized
ctgtataaattatccagtctcg

SEQ ID NO: 871675 - DNA, 22 bp, Artificial Sequence
  chemically synthesized
tgaagaaatacccgagactgga

SEQ ID NO: 871676 - DNA, 22 bp, Artificial Sequence
  chemically synthesized
tataaattatccagtctcgggt

SEQ ID NO: 871677 - DNA, 22 bp, Artificial Sequence
  chemically synthesized
ctatgaagaaatacccgagact

SEQ ID NO: 871678 - DNA, 22 bp, Artificial Sequence
  chemically synthesized
atactgctatgaagaaataccc

SEQ ID NO: 871679 - DNA, 22 bp, Artificial Sequence
  chemically synthesized
catactgctatgaagaaatacc

SEQ ID NO: 871680 - DNA, 22 bp, Artificial Sequence
  chemically synthesized
tcatactgctatgaagaaatac

SEQ ID NO: 871681 - DNA, 22 bp, Artificial Sequence
  chemically synthesized
tccagtctcgggtatttcttca

SEQ ID NO: 871682 - DNA, 22 bp, Artificial Sequence
  chemically synthesized
atagttttcatactgctatgaa

SEQ ID NO: 871683 - DNA, 22 bp, Artificial Sequence
  chemically synthesized
catagttttcatactgctatga

SEQ ID NO: 871684 - DNA, 22 bp, Artificial Sequence
  chemically synthesized
gggtatttcttcatagcagtat

SEQ ID NO: 871685 - DNA, 22 bp, Artificial Sequence
  chemically synthesized
gtcttcatagttttcatactgc

SEQ ID NO: 871686 - DNA, 22 bp, Artificial Sequence
  chemically synthesized
cttcatagcagtatgaaaacta

SEQ ID NO: 871687 - DNA, 22 bp, Artificial Sequence
  chemically synthesized
ttcatagcagtatgaaaactat

SEQ ID NO: 871688 - DNA, 22 bp, Artificial Sequence
  chemically synthesized
catagcagtatgaaaactatga

SEQ ID NO: 871689 - DNA, 22 bp, Artificial Sequence
  chemically synthesized
atagcagtatgaaaactatgaa

SEQ ID NO: 871690 - DNA, 22 bp, Artificial Sequence
  chemically synthesized
ggggataaaggtgttggtcttc

SEQ ID NO: 871691 - DNA, 22 bp, Artificial Sequence
  chemically synthesized
tgaagaccaacacctttatccc

SEQ ID NO: 871692 - DNA, 22 bp, Artificial Sequence
  chemically synthesized
accaatggacaaaagctggggg

SEQ ID NO: 871693 - DNA, 22 bp, Artificial Sequence
  chemically synthesized
aaccaatggacaaaagctgggg

SEQ ID NO: 871694 - DNA, 22 bp, Artificial Sequence
  chemically synthesized
tatcccccagcttttgtccatt

SEQ ID NO: 871695 - DNA, 22 bp, Artificial Sequence
  chemically synthesized
atcccccagcttttgtccattg

SEQ ID NO: 871696 - DNA, 22 bp, Artificial Sequence
  chemically synthesized
tcccccagcttttgtccattgg

SEQ ID NO: 871697 - DNA, 22 bp, Artificial Sequence
  chemically synthesized
gaatagcacttaaccaatggac

SEQ ID NO: 871698 - DNA, 22 bp, Artificial Sequence
  chemically synthesized
tggaatagcacttaaccaatgg

SEQ ID NO: 871699 - DNA, 22 bp, Artificial Sequence
  chemically synthesized
tctctggaatagcacttaacca

SEQ ID NO: 871700 - DNA, 22 bp, Artificial Sequence
  chemically synthesized
ttgtccattggttaagtgctat

SEQ ID NO: 871701 - DNA, 22 bp, Artificial Sequence
  chemically synthesized
tgtccattggttaagtgctatt

SEQ ID NO: 871702 - DNA, 22 bp, Artificial Sequence
  chemically synthesized
gtccattggttaagtgctattc

SEQ ID NO: 871703 - DNA, 22 bp, Artificial Sequence
  chemically synthesized
tccattggttaagtgctattcc

SEQ ID NO: 871704 - DNA, 22 bp, Artificial Sequence
  chemically synthesized
gggaggagattatctctggaat

SEQ ID NO: 871705 - DNA, 22 bp, Artificial Sequence
  chemically synthesized
gttaagtgctattccagagata

SEQ ID NO: 871706 - DNA, 22 bp, Artificial Sequence
  chemically synthesized
agtgctattccagagataatct

SEQ ID NO: 871707 - DNA, 22 bp, Artificial Sequence
  chemically synthesized
gaagctggggaggagattatct

SEQ ID NO: 871708 - DNA, 22 bp, Artificial Sequence
  chemically synthesized
ttccagagataatctcctcccc

SEQ ID NO: 871709 - DNA, 22 bp, Artificial Sequence
  chemically synthesized
cagagataatctcctccccagc

SEQ ID NO: 871710 - DNA, 22 bp, Artificial Sequence
  chemically synthesized
cagagcaggctggaagctgggg

SEQ ID NO: 871711 - DNA, 22 bp, Artificial Sequence
  chemically synthesized
gcagagcaggctggaagctggg

SEQ ID NO: 871712 - DNA, 22 bp, Artificial Sequence
  chemically synthesized
ccacttgcagagcaggctggaa

SEQ ID NO: 871713 - DNA, 22 bp, Artificial Sequence
  chemically synthesized
tcccacttgcagagcaggctgg

SEQ ID NO: 871714 - DNA, 22 bp, Artificial Sequence
  chemically synthesized
ctccccagcttccagcctgctc

SEQ ID NO: 871715 - DNA, 22 bp, Artificial Sequence
  chemically synthesized
cccagcttccagcctgctctgc

SEQ ID NO: 871716 - DNA, 22 bp, Artificial Sequence
  chemically synthesized
ccagcctgctctgcaagtggga

SEQ ID NO: 871717 - DNA, 22 bp, Artificial Sequence
  chemically synthesized
taggagtagctctcccacttgc

SEQ ID NO: 871718 - DNA, 22 bp, Artificial Sequence
  chemically synthesized
cagcctgctctgcaagtgggag

SEQ ID NO: 871719 - DNA, 22 bp, Artificial Sequence
  chemically synthesized
cctgtaggagtagctctcccac

SEQ ID NO: 871720 - DNA, 22 bp, Artificial Sequence
  chemically synthesized
tgcctgtaggagtagctctccc

SEQ ID NO: 871721 - DNA, 22 bp, Artificial Sequence
  chemically synthesized
ctctgcaagtgggagagctact

SEQ ID NO: 871722 - DNA, 22 bp, Artificial Sequence
  chemically synthesized
tctgcctgtaggagtagctctc

SEQ ID NO: 871723 - DNA, 22 bp, Artificial Sequence
  chemically synthesized
ctctgcctgtaggagtagctct

SEQ ID NO: 871724 - DNA, 22 bp, Artificial Sequence
  chemically synthesized
tctctgcctgtaggagtagctc

SEQ ID NO: 871725 - DNA, 22 bp, Artificial Sequence
  chemically synthesized
tgcaagtgggagagctactcct

SEQ ID NO: 871726 - DNA, 22 bp, Artificial Sequence
  chemically synthesized
caagtgggagagctactcctac

SEQ ID NO: 871727 - DNA, 22 bp, Artificial Sequence
  chemically synthesized
agtcctttctctgcctgtagga

SEQ ID NO: 871728 - DNA, 22 bp, Artificial Sequence
  chemically synthesized
ctgagtcctttctctgcctgta

SEQ ID NO: 871729 - DNA, 22 bp, Artificial Sequence
  chemically synthesized
cctgagtcctttctctgcctgt

SEQ ID NO: 871730 - DNA, 22 bp, Artificial Sequence
  chemically synthesized
ctcctacaggcagagaaaggac

SEQ ID NO: 871731 - DNA, 22 bp, Artificial Sequence
  chemically synthesized
tgagtcttcctgagtcctttct

SEQ ID NO: 871732 - DNA, 22 bp, Artificial Sequence
  chemically synthesized
ctacaggcagagaaaggactca

SEQ ID NO: 871733 - DNA, 22 bp, Artificial Sequence
  chemically synthesized
caggcagagaaaggactcagga

SEQ ID NO: 871734 - DNA, 22 bp, Artificial Sequence
  chemically synthesized
caagtacctgtgagtcttcctg

SEQ ID NO: 871735 - DNA, 22 bp, Artificial Sequence
  chemically synthesized
actacaagtacctgtgagtctt

SEQ ID NO: 871736 - DNA, 22 bp, Artificial Sequence
  chemically synthesized
aggaagactcacaggtacttgt

SEQ ID NO: 871737 - DNA, 22 bp, Artificial Sequence
  chemically synthesized
taaaccatgaagcgtctaacta

SEQ ID NO: 871738 - DNA, 22 bp, Artificial Sequence
  chemically synthesized
acaggtacttgtagttagacgc

SEQ ID NO: 871739 - DNA, 22 bp, Artificial Sequence
  chemically synthesized
ctataaaccatgaagcgtctaa

SEQ ID NO: 871740 - DNA, 22 bp, Artificial Sequence
  chemically synthesized
cctataaaccatgaagcgtcta

SEQ ID NO: 871741 - DNA, 22 bp, Artificial Sequence
  chemically synthesized
agccttcctataaaccatgaag

SEQ ID NO: 871742 - DNA, 22 bp, Artificial Sequence
  chemically synthesized
gtagttagacgcttcatggttt

SEQ ID NO: 871743 - DNA, 22 bp, Artificial Sequence
  chemically synthesized
tagttagacgcttcatggttta

SEQ ID NO: 871744 - DNA, 22 bp, Artificial Sequence
  chemically synthesized
gcactcagccttcctataaacc

SEQ ID NO: 871745 - DNA, 22 bp, Artificial Sequence
  chemically synthesized
agcactcagccttcctataaac

SEQ ID NO: 871746 - DNA, 22 bp, Artificial Sequence
  chemically synthesized
gacgcttcatggtttataggaa

SEQ ID NO: 871747 - DNA, 22 bp, Artificial Sequence
  chemically synthesized
cccttagcactcagccttccta

SEQ ID NO: 871748 - DNA, 22 bp, Artificial Sequence
  chemically synthesized
ccccttagcactcagccttcct

SEQ ID NO: 871749 - DNA, 22 bp, Artificial Sequence
  chemically synthesized
catggtttataggaaggctgag

SEQ ID NO: 871750 - DNA, 22 bp, Artificial Sequence
  chemically synthesized
atggtttataggaaggctgagt

SEQ ID NO: 871751 - DNA, 22 bp, Artificial Sequence
  chemically synthesized
cccatttccccttagcactcag

SEQ ID NO: 871752 - DNA, 22 bp, Artificial Sequence
  chemically synthesized
ataggaaggctgagtgctaagg

SEQ ID NO: 871753 - DNA, 22 bp, Artificial Sequence
  chemically synthesized
taggaaggctgagtgctaaggg

SEQ ID NO: 871754 - DNA, 22 bp, Artificial Sequence
  chemically synthesized
gtgggctacccatttcccctta

SEQ ID NO: 871755 - DNA, 22 bp, Artificial Sequence
  chemically synthesized
agtgggctacccatttcccctt

SEQ ID NO: 871756 - DNA, 22 bp, Artificial Sequence
  chemically synthesized
agtgctaaggggaaatgggtag

SEQ ID NO: 871757 - DNA, 22 bp, Artificial Sequence
  chemically synthesized
acccttagtgggctacccattt

SEQ ID NO: 871758 - DNA, 22 bp, Artificial Sequence
  chemically synthesized
gacccttagtgggctacccatt

SEQ ID NO: 871759 - DNA, 22 bp, Artificial Sequence
  chemically synthesized
aggggaaatgggtagcccacta

SEQ ID NO: 871760 - DNA, 22 bp, Artificial Sequence
  chemically synthesized
cagaaacgaggcaggtaagata

SEQ ID NO: 871761 - DNA, 22 bp, Artificial Sequence
  chemically synthesized
agggtcaaatctatcttacctg

SEQ ID NO: 871762 - DNA, 22 bp, Artificial Sequence
  chemically synthesized
acagaaacgaggcaggtaagat

SEQ ID NO: 871763 - DNA, 22 bp, Artificial Sequence
  chemically synthesized
tttacagaaacgaggcaggtaa

SEQ ID NO: 871764 - DNA, 22 bp, Artificial Sequence
  chemically synthesized
atttacagaaacgaggcaggta

SEQ ID NO: 871765 - DNA, 22 bp, Artificial Sequence
  chemically synthesized
tatttacagaaacgaggcaggt

SEQ ID NO: 871766 - DNA, 22 bp, Artificial Sequence
  chemically synthesized
tcttacctgcctcgtttctgta

SEQ ID NO: 871767 - DNA, 22 bp, Artificial Sequence
  chemically synthesized
cagtgacactttatttacagaa

SEQ ID NO: 871768 - DNA, 22 bp, Artificial Sequence
  chemically synthesized
acctgcctcgtttctgtaaata

SEQ ID NO: 871769 - DNA, 22 bp, Artificial Sequence
  chemically synthesized
cctgcctcgtttctgtaaataa

SEQ ID NO: 871770 - DNA, 22 bp, Artificial Sequence
  chemically synthesized
tgctccagtgacactttattta

SEQ ID NO: 871771 - DNA, 22 bp, Artificial Sequence
  chemically synthesized
cctcgtttctgtaaataaagtg

SEQ ID NO: 871772 - DNA, 22 bp, Artificial Sequence
  chemically synthesized
gtttctgtaaataaagtgtcac

SEQ ID NO: 871773 - DNA, 22 bp, Artificial Sequence
  chemically synthesized
ctgtaaataaagtgtcactgga

SEQ ID NO: 871774 - DNA, 22 bp, Artificial Sequence
  chemically synthesized
tgtaaataaagtgtcactggag

SEQ ID NO: 871775 - DNA, 22 bp, Artificial Sequence
  chemically synthesized
taaataaagtgtcactggagca

SEQ ID NO: 871776 - DNA, 22 bp, Artificial Sequence
  chemically synthesized
aataaagggacatggctgtgct

SEQ ID NO: 871777 - DNA, 22 bp, Artificial Sequence
  chemically synthesized
gagcacagccatgtccctttat

SEQ ID NO: 871778 - DNA, 22 bp, Artificial Sequence
  chemically synthesized
aaagccacagacaatacctaaa

SEQ ID NO: 871779 - DNA, 22 bp, Artificial Sequence
  chemically synthesized
tatactaaaagccacagacaat

SEQ ID NO: 871780 - DNA, 22 bp, Artificial Sequence
  chemically synthesized
tatttaggtattgtctgtggct

SEQ ID NO: 871781 - DNA, 22 bp, Artificial Sequence
  chemically synthesized
atttaggtattgtctgtggctt

SEQ ID NO: 871782 - DNA, 22 bp, Artificial Sequence
  chemically synthesized
tttaggtattgtctgtggcttt

SEQ ID NO: 871783 - DNA, 22 bp, Artificial Sequence
  chemically synthesized
tcattgtatactaaaagccaca

SEQ ID NO: 871784 - DNA, 22 bp, Artificial Sequence
  chemically synthesized
aggtattgtctgtggcttttag

SEQ ID NO: 871785 - DNA, 22 bp, Artificial Sequence
  chemically synthesized
tgtcattgtatactaaaagcca

SEQ ID NO: 871786 - DNA, 22 bp, Artificial Sequence
  chemically synthesized
ggtattgtctgtggcttttagt

SEQ ID NO: 871787 - DNA, 22 bp, Artificial Sequence
  chemically synthesized
tctgtggcttttagtatacaat

SEQ ID NO: 871788 - DNA, 22 bp, Artificial Sequence
  chemically synthesized
tggcttttagtatacaatgaca

SEQ ID NO: 871789 - DNA, 22 bp, Artificial Sequence
  chemically synthesized
ttagtatacaatgacagagttg

SEQ ID NO: 871790 - DNA, 22 bp, Artificial Sequence
  chemically synthesized
tagtatacaatgacagagttga

SEQ ID NO: 871791 - DNA, 22 bp, Artificial Sequence
  chemically synthesized
tgggtcatgtggtcaactctgt

SEQ ID NO: 871792 - DNA, 22 bp, Artificial Sequence
  chemically synthesized
agtatacaatgacagagttgac

SEQ ID NO: 871793 - DNA, 22 bp, Artificial Sequence
  chemically synthesized
atgggtcatgtggtcaactctg

SEQ ID NO: 871794 - DNA, 22 bp, Artificial Sequence
  chemically synthesized
gtatacaatgacagagttgacc

SEQ ID NO: 871795 - DNA, 22 bp, Artificial Sequence
  chemically synthesized
tatgggtcatgtggtcaactct

SEQ ID NO: 871796 - DNA, 22 bp, Artificial Sequence
  chemically synthesized
ctttatgggtcatgtggtcaac

SEQ ID NO: 871797 - DNA, 22 bp, Artificial Sequence
  chemically synthesized
tgctttatgggtcatgtggtca

SEQ ID NO: 871798 - DNA, 22 bp, Artificial Sequence
  chemically synthesized
ctgctttatgggtcatgtggtc

SEQ ID NO: 871799 - DNA, 22 bp, Artificial Sequence
  chemically synthesized
tctgctttatgggtcatgtggt

SEQ ID NO: 871800 - DNA, 22 bp, Artificial Sequence
  chemically synthesized
gatattttctgctttatgggtc

SEQ ID NO: 871801 - DNA, 22 bp, Artificial Sequence
  chemically synthesized
accacatgacccataaagcaga

SEQ ID NO: 871802 - DNA, 22 bp, Artificial Sequence
  chemically synthesized
caaaggaccgatactagatatt

SEQ ID NO: 871803 - DNA, 22 bp, Artificial Sequence
  chemically synthesized
tgcaaaggaccgatactagata

SEQ ID NO: 871804 - DNA, 22 bp, Artificial Sequence
  chemically synthesized
ctgcaaaggaccgatactagat

SEQ ID NO: 871805 - DNA, 22 bp, Artificial Sequence
  chemically synthesized
tttctgcaaaggaccgatacta

SEQ ID NO: 871806 - DNA, 22 bp, Artificial Sequence
  chemically synthesized
gtatcggtcctttgcagaaaca

SEQ ID NO: 871807 - DNA, 22 bp, Artificial Sequence
  chemically synthesized
tataagggatcaacagactgtt

SEQ ID NO: 871808 - DNA, 22 bp, Artificial Sequence
  chemically synthesized
tgcagaaacagtctgttgatcc

SEQ ID NO: 871809 - DNA, 22 bp, Artificial Sequence
  chemically synthesized
gcagaaacagtctgttgatccc

SEQ ID NO: 871810 - DNA, 22 bp, Artificial Sequence
  chemically synthesized
ccaactatataagggatcaaca

SEQ ID NO: 871811 - DNA, 22 bp, Artificial Sequence
  chemically synthesized
cagaaacagtctgttgatccct

SEQ ID NO: 871812 - DNA, 22 bp, Artificial Sequence
  chemically synthesized
tgctaccaactatataagggat

SEQ ID NO: 871813 - DNA, 22 bp, Artificial Sequence
  chemically synthesized
agttgtgctaccaactatataa

SEQ ID NO: 871814 - DNA, 22 bp, Artificial Sequence
  chemically synthesized
ttgatcccttatatagttggta

SEQ ID NO: 871815 - DNA, 22 bp, Artificial Sequence
  chemically synthesized
atcccttatatagttggtagca

SEQ ID NO: 871816 - DNA, 22 bp, Artificial Sequence
  chemically synthesized
atatctcagttgtgctaccaac

SEQ ID NO: 871817 - DNA, 22 bp, Artificial Sequence
  chemically synthesized
tgatatctcagttgtgctacca

SEQ ID NO: 871818 - DNA, 22 bp, Artificial Sequence
  chemically synthesized
atatagttggtagcacaactga

SEQ ID NO: 871819 - DNA, 22 bp, Artificial Sequence
  chemically synthesized
aattctgatatctcagttgtgc

SEQ ID NO: 871820 - DNA, 22 bp, Artificial Sequence
  chemically synthesized
tatagttggtagcacaactgag

SEQ ID NO: 871821 - DNA, 22 bp, Artificial Sequence
  chemically synthesized
gtagcacaactgagatatcaga

SEQ ID NO: 871822 - DNA, 22 bp, Artificial Sequence
  chemically synthesized
gaggtcaagaagcctaaattct

SEQ ID NO: 871823 - DNA, 22 bp, Artificial Sequence
  chemically synthesized
agatatcagaatttaggcttct

SEQ ID NO: 871824 - DNA, 22 bp, Artificial Sequence
  chemically synthesized
ggaaagcacagtattggaggtc

SEQ ID NO: 871825 - DNA, 22 bp, Artificial Sequence
  chemically synthesized
aggcttcttgacctccaatact

SEQ ID NO: 871826 - DNA, 22 bp, Artificial Sequence
  chemically synthesized
ggcttcttgacctccaatactg

SEQ ID NO: 871827 - DNA, 22 bp, Artificial Sequence
  chemically synthesized
cttgacctccaatactgtgctt

SEQ ID NO: 871828 - DNA, 22 bp, Artificial Sequence
  chemically synthesized
ttgacctccaatactgtgcttt

SEQ ID NO: 871829 - DNA, 22 bp, Artificial Sequence
  chemically synthesized
aagtgtaattaggaaagcacag

SEQ ID NO: 871830 - DNA, 22 bp, Artificial Sequence
  chemically synthesized
gacctccaatactgtgctttcc

SEQ ID NO: 871831 - DNA, 22 bp, Artificial Sequence
  chemically synthesized
acctccaatactgtgctttcct

SEQ ID NO: 871832 - DNA, 22 bp, Artificial Sequence
  chemically synthesized
caatactgtgctttcctaatta

SEQ ID NO: 871833 - DNA, 22 bp, Artificial Sequence
  chemically synthesized
tgctttcctaattacacttgag

SEQ ID NO: 871834 - DNA, 22 bp, Artificial Sequence
  chemically synthesized
gagagagcaagtctcaagtgta

SEQ ID NO: 871835 - DNA, 22 bp, Artificial Sequence
  chemically synthesized
ggagagagcaagtctcaagtgt

SEQ ID NO: 871836 - DNA, 22 bp, Artificial Sequence
  chemically synthesized
tcctaattacacttgagacttg

SEQ ID NO: 871837 - DNA, 22 bp, Artificial Sequence
  chemically synthesized
cctaattacacttgagacttgc

SEQ ID NO: 871838 - DNA, 22 bp, Artificial Sequence
  chemically synthesized
agtttggagagagcaagtctca

SEQ ID NO: 871839 - DNA, 22 bp, Artificial Sequence
  chemically synthesized
ctaattacacttgagacttgct

SEQ ID NO: 871840 - DNA, 22 bp, Artificial Sequence
  chemically synthesized
attacacttgagacttgctctc

SEQ ID NO: 871841 - DNA, 22 bp, Artificial Sequence
  chemically synthesized
taattaagtttggagagagcaa

SEQ ID NO: 871842 - DNA, 22 bp, Artificial Sequence
  chemically synthesized
cacttgagacttgctctctcca

SEQ ID NO: 871843 - DNA, 22 bp, Artificial Sequence
  chemically synthesized
ctgtaattaagtttggagagag

SEQ ID NO: 871844 - DNA, 22 bp, Artificial Sequence
  chemically synthesized
cctgtaattaagtttggagaga

SEQ ID NO: 871845 - DNA, 22 bp, Artificial Sequence
  chemically synthesized
ttcctgtaattaagtttggaga

SEQ ID NO: 871846 - DNA, 22 bp, Artificial Sequence
  chemically synthesized
gagacttgctctctccaaactt

SEQ ID NO: 871847 - DNA, 22 bp, Artificial Sequence
  chemically synthesized
agacttgctctctccaaactta

SEQ ID NO: 871848 - DNA, 22 bp, Artificial Sequence
  chemically synthesized
gctctctccaaacttaattaca

SEQ ID NO: 871849 - DNA, 22 bp, Artificial Sequence
  chemically synthesized
ctctctccaaacttaattacag

SEQ ID NO: 871850 - DNA, 22 bp, Artificial Sequence
  chemically synthesized
tctccaaacttaattacaggaa

SEQ ID NO: 871851 - DNA, 22 bp, Artificial Sequence
  chemically synthesized
gtaaaatcatctcttcctgtaa

SEQ ID NO: 871852 - DNA, 22 bp, Artificial Sequence
  chemically synthesized
tccaaacttaattacaggaaga

SEQ ID NO: 871853 - DNA, 22 bp, Artificial Sequence
  chemically synthesized
caaacttaattacaggaagaga

SEQ ID NO: 871854 - DNA, 22 bp, Artificial Sequence
  chemically synthesized
aacactggtaaaatcatctctt

SEQ ID NO: 871855 - DNA, 22 bp, Artificial Sequence
  chemically synthesized
aattacaggaagagatgatttt

SEQ ID NO: 871856 - DNA, 22 bp, Artificial Sequence
  chemically synthesized
attacaggaagagatgatttta

SEQ ID NO: 871857 - DNA, 22 bp, Artificial Sequence
  chemically synthesized
attaaacactggtaaaatcatc

SEQ ID NO: 871858 - DNA, 22 bp, Artificial Sequence
  chemically synthesized
caggaagagatgattttaccag

SEQ ID NO: 871859 - DNA, 22 bp, Artificial Sequence
  chemically synthesized
gttgattaaacactggtaaaat

SEQ ID NO: 871860 - DNA, 22 bp, Artificial Sequence
  chemically synthesized
tagttgattaaacactggtaaa

SEQ ID NO: 871861 - DNA, 22 bp, Artificial Sequence
  chemically synthesized
ctagttgattaaacactggtaa

SEQ ID NO: 871862 - DNA, 22 bp, Artificial Sequence
  chemically synthesized
tctagttgattaaacactggta

SEQ ID NO: 871863 - DNA, 22 bp, Artificial Sequence
  chemically synthesized
taccagtgtttaatcaactaga

SEQ ID NO: 871864 - DNA, 22 bp, Artificial Sequence
  chemically synthesized
accagtgtttaatcaactagaa

SEQ ID NO: 871865 - DNA, 22 bp, Artificial Sequence
  chemically synthesized
ccagtgtttaatcaactagaaa

SEQ ID NO: 871866 - DNA, 22 bp, Artificial Sequence
  chemically synthesized
aatcaactagaaaactctgggc

SEQ ID NO: 871867 - DNA, 22 bp, Artificial Sequence
  chemically synthesized
atcaactagaaaactctgggcc

SEQ ID NO: 871868 - DNA, 22 bp, Artificial Sequence
  chemically synthesized
gaaaactctgggccgggcgcgg

SEQ ID NO: 871869 - DNA, 22 bp, Artificial Sequence
  chemically synthesized
caggcgtgagccaccgcgcccg

SEQ ID NO: 871870 - DNA, 22 bp, Artificial Sequence
  chemically synthesized
ggattacaggcgtgagccaccg

SEQ ID NO: 871871 - DNA, 22 bp, Artificial Sequence
  chemically synthesized
tgggccgggcgcggtggctcac

SEQ ID NO: 871872 - DNA, 22 bp, Artificial Sequence
  chemically synthesized
ggccgggcgcggtggctcacgc

SEQ ID NO: 871873 - DNA, 22 bp, Artificial Sequence
  chemically synthesized
caaagtgctgggattacaggcg

SEQ ID NO: 871874 - DNA, 22 bp, Artificial Sequence
  chemically synthesized
ccaaagtgctgggattacaggc

SEQ ID NO: 871875 - DNA, 22 bp, Artificial Sequence
  chemically synthesized
ggccttccaaagtgctgggatt

SEQ ID NO: 871876 - DNA, 22 bp, Artificial Sequence
  chemically synthesized
acgcctgtaatcccagcacttt

SEQ ID NO: 871877 - DNA, 22 bp, Artificial Sequence
  chemically synthesized
taatcccagcactttggaaggc

SEQ ID NO: 871878 - DNA, 22 bp, Artificial Sequence
  chemically synthesized
gtgatccgcccgcctcggcctt

SEQ ID NO: 871879 - DNA, 22 bp, Artificial Sequence
  chemically synthesized
acctcgtgatccgcccgcctcg

SEQ ID NO: 871880 - DNA, 22 bp, Artificial Sequence
  chemically synthesized
ctgacctcgtgatccgcccgcc

SEQ ID NO: 871881 - DNA, 22 bp, Artificial Sequence
  chemically synthesized
tggaaggccgaggcgggcggat

SEQ ID NO: 871882 - DNA, 22 bp, Artificial Sequence
  chemically synthesized
ggaaggccgaggcgggcggatc

SEQ ID NO: 871883 - DNA, 22 bp, Artificial Sequence
  chemically synthesized
gaaggccgaggcgggcggatca

SEQ ID NO: 871884 - DNA, 22 bp, Artificial Sequence
  chemically synthesized
gatctcctgacctcgtgatccg

SEQ ID NO: 871885 - DNA, 22 bp, Artificial Sequence
  chemically synthesized
gccaggatggtctcgatctcct

SEQ ID NO: 871886 - DNA, 22 bp, Artificial Sequence
  chemically synthesized
tgttagccaggatggtctcgat

SEQ ID NO: 871887 - DNA, 22 bp, Artificial Sequence
  chemically synthesized
actgtgttagccaggatggtct

SEQ ID NO: 871888 - DNA, 22 bp, Artificial Sequence
  chemically synthesized
cactgtgttagccaggatggtc

SEQ ID NO: 871889 - DNA, 22 bp, Artificial Sequence
  chemically synthesized
gtagagacggggtttcactgtg

SEQ ID NO: 871890 - DNA, 22 bp, Artificial Sequence
  chemically synthesized
agtagagacggggtttcactgt

SEQ ID NO: 871891 - DNA, 22 bp, Artificial Sequence
  chemically synthesized
tagtagagacggggtttcactg

SEQ ID NO: 871892 - DNA, 22 bp, Artificial Sequence
  chemically synthesized
ttagtagagacggggtttcact

SEQ ID NO: 871893 - DNA, 22 bp, Artificial Sequence
  chemically synthesized
tttagtagagacggggtttcac

SEQ ID NO: 871894 - DNA, 22 bp, Artificial Sequence
  chemically synthesized
gctaacacagtgaaaccccgtc

SEQ ID NO: 871895 - DNA, 22 bp, Artificial Sequence
  chemically synthesized
tgttttttagtagagacggggt

SEQ ID NO: 871896 - DNA, 22 bp, Artificial Sequence
  chemically synthesized
gtgttttttagtagagacgggg

SEQ ID NO: 871897 - DNA, 22 bp, Artificial Sequence
  chemically synthesized
acacagtgaaaccccgtctcta

SEQ ID NO: 871898 - DNA, 22 bp, Artificial Sequence
  chemically synthesized
tgtgttttttagtagagacggg

SEQ ID NO: 871899 - DNA, 22 bp, Artificial Sequence
  chemically synthesized
ttgtgttttttagtagagacgg

SEQ ID NO: 871900 - DNA, 22 bp, Artificial Sequence
  chemically synthesized
tttgtgttttttagtagagacg

SEQ ID NO: 871901 - DNA, 22 bp, Artificial Sequence
  chemically synthesized
ttttgtgttttttagtagagac

SEQ ID NO: 871902 - DNA, 22 bp, Artificial Sequence
  chemically synthesized
atttttttgtgttttttagtag

SEQ ID NO: 871903 - DNA, 22 bp, Artificial Sequence
  chemically synthesized
tactaaaaaacacaaaaaaatt

SEQ ID NO: 871904 - DNA, 22 bp, Artificial Sequence
  chemically synthesized
ctaaaaaacacaaaaaaattag

SEQ ID NO: 871905 - DNA, 22 bp, Artificial Sequence
  chemically synthesized
aaaaacacaaaaaaattagccg

SEQ ID NO: 871906 - DNA, 22 bp, Artificial Sequence
  chemically synthesized
caggcgcccgccaccacgcccg

SEQ ID NO: 871907 - DNA, 22 bp, Artificial Sequence
  chemically synthesized
ggactacaggcgcccgccacca

SEQ ID NO: 871908 - DNA, 22 bp, Artificial Sequence
  chemically synthesized
gccgggcgtggtggcgggcgcc

SEQ ID NO: 871909 - DNA, 22 bp, Artificial Sequence
  chemically synthesized
ccccgtagctgggactacaggc

SEQ ID NO: 871910 - DNA, 22 bp, Artificial Sequence
  chemically synthesized
agcctcccccgtagctgggact

SEQ ID NO: 871911 - DNA, 22 bp, Artificial Sequence
  chemically synthesized
cctcagcctcccccgtagctgg

SEQ ID NO: 871912 - DNA, 22 bp, Artificial Sequence
  chemically synthesized
ctgcctcagcctcccccgtagc

SEQ ID NO: 871913 - DNA, 22 bp, Artificial Sequence
  chemically synthesized
tcctgcctcagcctcccccgta

SEQ ID NO: 871914 - DNA, 22 bp, Artificial Sequence
  chemically synthesized
tagtcccagctacgggggaggc

SEQ ID NO: 871915 - DNA, 22 bp, Artificial Sequence
  chemically synthesized
acgccattctcctgcctcagcc

SEQ ID NO: 871916 - DNA, 22 bp, Artificial Sequence
  chemically synthesized
cgggggaggctgaggcaggaga

SEQ ID NO: 871917 - DNA, 22 bp, Artificial Sequence
  chemically synthesized
ccgggttcacgccattctcctg

SEQ ID NO: 871918 - DNA, 22 bp, Artificial Sequence
  chemically synthesized
cgcctcccgggttcacgccatt

SEQ ID NO: 871919 - DNA, 22 bp, Artificial Sequence
  chemically synthesized
aggcaggagaatggcgtgaacc

SEQ ID NO: 871920 - DNA, 22 bp, Artificial Sequence
  chemically synthesized
caagctccgcctcccgggttca

SEQ ID NO: 871921 - DNA, 22 bp, Artificial Sequence
  chemically synthesized
actgcaagctccgcctcccggg

SEQ ID NO: 871922 - DNA, 22 bp, Artificial Sequence
  chemically synthesized
ggctcactgcaagctccgcctc

SEQ ID NO: 871923 - DNA, 22 bp, Artificial Sequence
  chemically synthesized
gagtgcagtggcgcgatctcgg

SEQ ID NO: 871924 - DNA, 22 bp, Artificial Sequence
  chemically synthesized
gcagtgagccgagatcgcgcca

SEQ ID NO: 871925 - DNA, 22 bp, Artificial Sequence
  chemically synthesized
cagtgagccgagatcgcgccac

SEQ ID NO: 871926 - DNA, 22 bp, Artificial Sequence
  chemically synthesized
tcgcccaggctggagtgcagtg

SEQ ID NO: 871927 - DNA, 22 bp, Artificial Sequence
  chemically synthesized
tgtcgcccaggctggagtgcag

SEQ ID NO: 871928 - DNA, 22 bp, Artificial Sequence
  chemically synthesized
actctgtcgcccaggctggagt

SEQ ID NO: 871929 - DNA, 22 bp, Artificial Sequence
  chemically synthesized
cactccagcctgggcgacagag

SEQ ID NO: 871930 - DNA, 22 bp, Artificial Sequence
  chemically synthesized
agacggagtctcactctgtcgc

SEQ ID NO: 871931 - DNA, 22 bp, Artificial Sequence
  chemically synthesized
gagacggagtctcactctgtcg

SEQ ID NO: 871932 - DNA, 22 bp, Artificial Sequence
  chemically synthesized
tgagacggagtctcactctgtc

SEQ ID NO: 871933 - DNA, 22 bp, Artificial Sequence
  chemically synthesized
ttgagacggagtctcactctgt

SEQ ID NO: 871934 - DNA, 22 bp, Artificial Sequence
  chemically synthesized
cagcctgggcgacagagtgaga

SEQ ID NO: 871935 - DNA, 22 bp, Artificial Sequence
  chemically synthesized
tttgagacggagtctcactctg

SEQ ID NO: 871936 - DNA, 22 bp, Artificial Sequence
  chemically synthesized
ttttgagacggagtctcactct

SEQ ID NO: 871937 - DNA, 22 bp, Artificial Sequence
  chemically synthesized
tttttgagacggagtctcactc

SEQ ID NO: 871938 - DNA, 22 bp, Artificial Sequence
  chemically synthesized
ttttttgagacggagtctcact

SEQ ID NO: 871939 - DNA, 22 bp, Artificial Sequence
  chemically synthesized
tttttttgagacggagtctcac

SEQ ID NO: 871940 - DNA, 22 bp, Artificial Sequence
  chemically synthesized
ttttttttgagacggagtctca

SEQ ID NO: 871941 - DNA, 22 bp, Artificial Sequence
  chemically synthesized
tttttttttgagacggagtctc

SEQ ID NO: 871942 - DNA, 22 bp, Artificial Sequence
  chemically synthesized
ggcgacagagtgagactccgtc

SEQ ID NO: 871943 - DNA, 22 bp, Artificial Sequence
  chemically synthesized
ttttttttttgagacggagtct

SEQ ID NO: 871944 - DNA, 22 bp, Artificial Sequence
  chemically synthesized
tttttttttttgagacggagtc

SEQ ID NO: 871945 - DNA, 22 bp, Artificial Sequence
  chemically synthesized
ttttttttttttgagacggagt

SEQ ID NO: 871946 - DNA, 22 bp, Artificial Sequence
  chemically synthesized
tttttttttttttgagacggag

SEQ ID NO: 871947 - DNA, 22 bp, Artificial Sequence
  chemically synthesized
ttttttttttttttgagacgga

SEQ ID NO: 871948 - DNA, 22 bp, Artificial Sequence
  chemically synthesized
tttttttttttttttgagacgg

SEQ ID NO: 871949 - DNA, 22 bp, Artificial Sequence
  chemically synthesized
ttttttttttttttttgagacg

SEQ ID NO: 871950 - DNA, 22 bp, Artificial Sequence
  chemically synthesized
tttttttttttttttttgagac

SEQ ID NO: 871951 - DNA, 22 bp, Artificial Sequence
  chemically synthesized
ttttttttttttttttttgaga

SEQ ID NO: 871952 - DNA, 22 bp, Artificial Sequence
  chemically synthesized
tttttttttttttttttttgag

SEQ ID NO: 871953 - DNA, 22 bp, Artificial Sequence
  chemically synthesized
ttttttttttttttttttttga

SEQ ID NO: 871954 - DNA, 22 bp, Artificial Sequence
  chemically synthesized
tttttttttttttttttttttg

SEQ ID NO: 871955 - DNA, 22 bp, Artificial Sequence
  chemically synthesized
tttttttttttttttttttttt

SEQ ID NO: 871956 - DNA, 22 bp, Artificial Sequence
  chemically synthesized
tttttttttttttttttttttt

SEQ ID NO: 871957 - DNA, 22 bp, Artificial Sequence
  chemically synthesized
tttttttttttttttttttttt

SEQ ID NO: 871958 - DNA, 22 bp, Artificial Sequence
  chemically synthesized
tttttttttttttttttttttt

SEQ ID NO: 871959 - DNA, 22 bp, Artificial Sequence
  chemically synthesized
tttttttttttttttttttttt

SEQ ID NO: 871960 - DNA, 22 bp, Artificial Sequence
  chemically synthesized
tttttttttttttttttttttt

SEQ ID NO: 871961 - DNA, 22 bp, Artificial Sequence
  chemically synthesized
cgtctcaaaaaaaaaaaaaaaa

SEQ ID NO: 871962 - DNA, 22 bp, Artificial Sequence
  chemically synthesized
tttttttttttttttttttttt

SEQ ID NO: 871963 - DNA, 22 bp, Artificial Sequence
  chemically synthesized
tttttttttttttttttttttt

SEQ ID NO: 871964 - DNA, 22 bp, Artificial Sequence
  chemically synthesized
tttttttttttttttttttttt

SEQ ID NO: 871965 - DNA, 22 bp, Artificial Sequence
  chemically synthesized
tttttttttttttttttttttt

SEQ ID NO: 871966 - DNA, 22 bp, Artificial Sequence
  chemically synthesized
tttttttttttttttttttttt

SEQ ID NO: 871967 - DNA, 22 bp, Artificial Sequence
  chemically synthesized
aaaaaaaaaaaaaaaaaaaaaa

SEQ ID NO: 871968 - DNA, 22 bp, Artificial Sequence
  chemically synthesized
cttttttttttttttttttttt

SEQ ID NO: 871969 - DNA, 22 bp, Artificial Sequence
  chemically synthesized
tctttttttttttttttttttt

SEQ ID NO: 871970 - DNA, 22 bp, Artificial Sequence
  chemically synthesized
acagagttttcttttttttttt

SEQ ID NO: 871971 - DNA, 22 bp, Artificial Sequence
  chemically synthesized
tatatggacatatagaagagcc

SEQ ID NO: 871972 - DNA, 22 bp, Artificial Sequence
  chemically synthesized
tgttaactggctcttctatatg

SEQ ID NO: 871973 - DNA, 22 bp, Artificial Sequence
  chemically synthesized
ttaactggctcttctatatgtc

SEQ ID NO: 871974 - DNA, 22 bp, Artificial Sequence
  chemically synthesized
actggctcttctatatgtccat

SEQ ID NO: 871975 - DNA, 22 bp, Artificial Sequence
  chemically synthesized
gctcttctatatgtccatatac

SEQ ID NO: 871976 - DNA, 22 bp, Artificial Sequence
  chemically synthesized
ttctatatgtccatatacaatg

SEQ ID NO: 871977 - DNA, 22 bp, Artificial Sequence
  chemically synthesized
ctatatgtccatatacaatggg

SEQ ID NO: 871978 - DNA, 22 bp, Artificial Sequence
  chemically synthesized
tggaatgaataacccattgtat

SEQ ID NO: 871979 - DNA, 22 bp, Artificial Sequence
  chemically synthesized
tatatgtccatatacaatgggt

SEQ ID NO: 871980 - DNA, 22 bp, Artificial Sequence
  chemically synthesized
tatgtccatatacaatgggtta

SEQ ID NO: 871981 - DNA, 22 bp, Artificial Sequence
  chemically synthesized
gtaataactatggaatgaataa

SEQ ID NO: 871982 - DNA, 22 bp, Artificial Sequence
  chemically synthesized
ggtaataactatggaatgaata

SEQ ID NO: 871983 - DNA, 22 bp, Artificial Sequence
  chemically synthesized
ttggtaataactatggaatgaa

SEQ ID NO: 871984 - DNA, 22 bp, Artificial Sequence
  chemically synthesized
aaatgtctcttggtaataacta

SEQ ID NO: 871985 - DNA, 22 bp, Artificial Sequence
  chemically synthesized
ttcattccatagttattaccaa

SEQ ID NO: 871986 - DNA, 22 bp, Artificial Sequence
  chemically synthesized
attcaaatgtctcttggtaata

SEQ ID NO: 871987 - DNA, 22 bp, Artificial Sequence
  chemically synthesized
gattcaaatgtctcttggtaat

SEQ ID NO: 871988 - DNA, 22 bp, Artificial Sequence
  chemically synthesized
attccatagttattaccaagag

SEQ ID NO: 871989 - DNA, 22 bp, Artificial Sequence
  chemically synthesized
catagttattaccaagagacat

SEQ ID NO: 871990 - DNA, 22 bp, Artificial Sequence
  chemically synthesized
ttaccaagagacatttgaatca

SEQ ID NO: 871991 - DNA, 22 bp, Artificial Sequence
  chemically synthesized
caaatcaggatatttgattcaa

SEQ ID NO: 871992 - DNA, 22 bp, Artificial Sequence
  chemically synthesized
ccaagagacatttgaatcaaat

SEQ ID NO: 871993 - DNA, 22 bp, Artificial Sequence
  chemically synthesized
atgtgaagactccaaatcagga

SEQ ID NO: 871994 - DNA, 22 bp, Artificial Sequence
  chemically synthesized
aatgtgaagactccaaatcagg

SEQ ID NO: 871995 - DNA, 22 bp, Artificial Sequence
  chemically synthesized
gaatcaaatatcctgatttgga

SEQ ID NO: 871996 - DNA, 22 bp, Artificial Sequence
  chemically synthesized
aatcaaatatcctgatttggag

SEQ ID NO: 871997 - DNA, 22 bp, Artificial Sequence
  chemically synthesized
catatagacatgcttaatgtga

SEQ ID NO: 871998 - DNA, 22 bp, Artificial Sequence
  chemically synthesized
atttggagtcttcacattaagc

SEQ ID NO: 871999 - DNA, 22 bp, Artificial Sequence
  chemically synthesized
ggagtcttcacattaagcatgt

SEQ ID NO: 872000 - DNA, 22 bp, Artificial Sequence
  chemically synthesized
gagtcttcacattaagcatgtc

SEQ ID NO: 872001 - DNA, 22 bp, Artificial Sequence
  chemically synthesized
aaagaaattgcatatagacatg

SEQ ID NO: 872002 - DNA, 22 bp, Artificial Sequence
  chemically synthesized
gaaagaaattgcatatagacat

SEQ ID NO: 872003 - DNA, 22 bp, Artificial Sequence
  chemically synthesized
tgaaagaaattgcatatagaca

SEQ ID NO: 872004 - DNA, 22 bp, Artificial Sequence
  chemically synthesized
cacattaagcatgtctatatgc

SEQ ID NO: 872005 - DNA, 22 bp, Artificial Sequence
  chemically synthesized
ttgaaagaaattgcatatagac

SEQ ID NO: 872006 - DNA, 22 bp, Artificial Sequence
  chemically synthesized
acattaagcatgtctatatgca

SEQ ID NO: 872007 - DNA, 22 bp, Artificial Sequence
  chemically synthesized
gcatttttgaaagaaattgcat

SEQ ID NO: 872008 - DNA, 22 bp, Artificial Sequence
  chemically synthesized
agcatgtctatatgcaatttct

SEQ ID NO: 872009 - DNA, 22 bp, Artificial Sequence
  chemically synthesized
agcatttttgaaagaaattgca

SEQ ID NO: 872010 - DNA, 22 bp, Artificial Sequence
  chemically synthesized
tatgcaatttctttcaaaaatg

SEQ ID NO: 872011 - DNA, 22 bp, Artificial Sequence
  chemically synthesized
caatacccgatttagcattttt

SEQ ID NO: 872012 - DNA, 22 bp, Artificial Sequence
  chemically synthesized
tacaatacccgatttagcattt

SEQ ID NO: 872013 - DNA, 22 bp, Artificial Sequence
  chemically synthesized
ctttcaaaaatgctaaatcggg

SEQ ID NO: 872014 - DNA, 22 bp, Artificial Sequence
  chemically synthesized
tttcaaaaatgctaaatcgggt

SEQ ID NO: 872015 - DNA, 22 bp, Artificial Sequence
  chemically synthesized
atgttctacaatacccgattta

SEQ ID NO: 872016 - DNA, 22 bp, Artificial Sequence
  chemically synthesized
tcaaaaatgctaaatcgggtat

SEQ ID NO: 872017 - DNA, 22 bp, Artificial Sequence
  chemically synthesized
caaaaatgctaaatcgggtatt

SEQ ID NO: 872018 - DNA, 22 bp, Artificial Sequence
  chemically synthesized
aaaaatgctaaatcgggtattg

SEQ ID NO: 872019 - DNA, 22 bp, Artificial Sequence
  chemically synthesized
agaacattaatgttctacaata

SEQ ID NO: 872020 - DNA, 22 bp, Artificial Sequence
  chemically synthesized
aatcgggtattgtagaacatta

SEQ ID NO: 872021 - DNA, 22 bp, Artificial Sequence
  chemically synthesized
ggcctgagaacattaatgttct

SEQ ID NO: 872022 - DNA, 22 bp, Artificial Sequence
  chemically synthesized
ctgggcctgagaacattaatgt

SEQ ID NO: 872023 - DNA, 22 bp, Artificial Sequence
  chemically synthesized
tagaacattaatgttctcaggc

SEQ ID NO: 872024 - DNA, 22 bp, Artificial Sequence
  chemically synthesized
tccacaagctgctgggcctgag

SEQ ID NO: 872025 - DNA, 22 bp, Artificial Sequence
  chemically synthesized
atccacaagctgctgggcctga

SEQ ID NO: 872026 - DNA, 22 bp, Artificial Sequence
  chemically synthesized
ttatccacaagctgctgggcct

SEQ ID NO: 872027 - DNA, 22 bp, Artificial Sequence
  chemically synthesized
cttatccacaagctgctgggcc

SEQ ID NO: 872028 - DNA, 22 bp, Artificial Sequence
  chemically synthesized
tcttatccacaagctgctgggc

SEQ ID NO: 872029 - DNA, 22 bp, Artificial Sequence
  chemically synthesized
atgttctcaggcccagcagctt

SEQ ID NO: 872030 - DNA, 22 bp, Artificial Sequence
  chemically synthesized
tcaggcccagcagcttgtggat

SEQ ID NO: 872031 - DNA, 22 bp, Artificial Sequence
  chemically synthesized
aggcccagcagcttgtggataa

SEQ ID NO: 872032 - DNA, 22 bp, Artificial Sequence
  chemically synthesized
taaatgtcaatgtgaatccttt

SEQ ID NO: 872033 - DNA, 22 bp, Artificial Sequence
  chemically synthesized
gtggataagaaaggattcacat

SEQ ID NO: 872034 - DNA, 22 bp, Artificial Sequence
  chemically synthesized
tggataagaaaggattcacatt

SEQ ID NO: 872035 - DNA, 22 bp, Artificial Sequence
  chemically synthesized
gttgtaaatgtcaatgtgaatc

SEQ ID NO: 872036 - DNA, 22 bp, Artificial Sequence
  chemically synthesized
acattgacatttacaaccagat

SEQ ID NO: 872037 - DNA, 22 bp, Artificial Sequence
  chemically synthesized
acatttacaaccagatttgctg

SEQ ID NO: 872038 - DNA, 22 bp, Artificial Sequence
  chemically synthesized
acaaccagatttgctggctctt

SEQ ID NO: 872039 - DNA, 22 bp, Artificial Sequence
  chemically synthesized
caaccagatttgctggctcttt

SEQ ID NO: 872040 - DNA, 22 bp, Artificial Sequence
  chemically synthesized
catggcagatggaggcaaagag

SEQ ID NO: 872041 - DNA, 22 bp, Artificial Sequence
  chemically synthesized
gcatggcagatggaggcaaaga

SEQ ID NO: 872042 - DNA, 22 bp, Artificial Sequence
  chemically synthesized
gctggctctttgcctccatctg

SEQ ID NO: 872043 - DNA, 22 bp, Artificial Sequence
  chemically synthesized
ctggctctttgcctccatctgc

SEQ ID NO: 872044 - DNA, 22 bp, Artificial Sequence
  chemically synthesized
aaggcttgcatggcagatggag

SEQ ID NO: 872045 - DNA, 22 bp, Artificial Sequence
  chemically synthesized
gctctttgcctccatctgccat

SEQ ID NO: 872046 - DNA, 22 bp, Artificial Sequence
  chemically synthesized
tttgcctccatctgccatgcaa

SEQ ID NO: 872047 - DNA, 22 bp, Artificial Sequence
  chemically synthesized
tgcctccatctgccatgcaagc

SEQ ID NO: 872048 - DNA, 22 bp, Artificial Sequence
  chemically synthesized
gcctccatctgccatgcaagcc

SEQ ID NO: 872049 - DNA, 22 bp, Artificial Sequence
  chemically synthesized
catgggtctgaaggcttgcatg

SEQ ID NO: 872050 - DNA, 22 bp, Artificial Sequence
  chemically synthesized
cctccatctgccatgcaagcct

SEQ ID NO: 872051 - DNA, 22 bp, Artificial Sequence
  chemically synthesized
gcatgggtctgaaggcttgcat

SEQ ID NO: 872052 - DNA, 22 bp, Artificial Sequence
  chemically synthesized
tgcatgggtctgaaggcttgca

SEQ ID NO: 872053 - DNA, 22 bp, Artificial Sequence
  chemically synthesized
catctgccatgcaagccttcag

SEQ ID NO: 872054 - DNA, 22 bp, Artificial Sequence
  chemically synthesized
ccatgcaagccttcagacccat

SEQ ID NO: 872055 - DNA, 22 bp, Artificial Sequence
  chemically synthesized
ggtagacaggactttgcatggg

SEQ ID NO: 872056 - DNA, 22 bp, Artificial Sequence
  chemically synthesized
aggtagacaggactttgcatgg

SEQ ID NO: 872057 - DNA, 22 bp, Artificial Sequence
  chemically synthesized
cagacccatgcaaagtcctgtc

SEQ ID NO: 872058 - DNA, 22 bp, Artificial Sequence
  chemically synthesized
agacccatgcaaagtcctgtct

SEQ ID NO: 872059 - DNA, 22 bp, Artificial Sequence
  chemically synthesized
acaatcatttaggtagacagga

SEQ ID NO: 872060 - DNA, 22 bp, Artificial Sequence
  chemically synthesized
cacaatcatttaggtagacagg

SEQ ID NO: 872061 - DNA, 22 bp, Artificial Sequence
  chemically synthesized
tcacaatcatttaggtagacag

SEQ ID NO: 872062 - DNA, 22 bp, Artificial Sequence
  chemically synthesized
gagactttcacaatcatttagg

SEQ ID NO: 872063 - DNA, 22 bp, Artificial Sequence
  chemically synthesized
tagagactttcacaatcattta

SEQ ID NO: 872064 - DNA, 22 bp, Artificial Sequence
  chemically synthesized
ctctagagactttcacaatcat

SEQ ID NO: 872065 - DNA, 22 bp, Artificial Sequence
  chemically synthesized
tctacctaaatgattgtgaaag

SEQ ID NO: 872066 - DNA, 22 bp, Artificial Sequence
  chemically synthesized
cctaaatgattgtgaaagtctc

SEQ ID NO: 872067 - DNA, 22 bp, Artificial Sequence
  chemically synthesized
aatgattgtgaaagtctctaga

SEQ ID NO: 872068 - DNA, 22 bp, Artificial Sequence
  chemically synthesized
tgaaagtctctagaggaactta

SEQ ID NO: 872069 - DNA, 22 bp, Artificial Sequence
  chemically synthesized
agaagaaaagccataagttcct

SEQ ID NO: 872070 - DNA, 22 bp, Artificial Sequence
  chemically synthesized
tgagaagaaaagccataagttc

SEQ ID NO: 872071 - DNA, 22 bp, Artificial Sequence
  chemically synthesized
tagaggaacttatggcttttct

SEQ ID NO: 872072 - DNA, 22 bp, Artificial Sequence
  chemically synthesized
gaggaacttatggcttttcttc

SEQ ID NO: 872073 - DNA, 22 bp, Artificial Sequence
  chemically synthesized
gatgagacctctgagaagaaaa

SEQ ID NO: 872074 - DNA, 22 bp, Artificial Sequence
  chemically synthesized
ctggatgagacctctgagaaga

SEQ ID NO: 872075 - DNA, 22 bp, Artificial Sequence
  chemically synthesized
atggcttttcttctcagaggtc

SEQ ID NO: 872076 - DNA, 22 bp, Artificial Sequence
  chemically synthesized
tggcttttcttctcagaggtct

SEQ ID NO: 872077 - DNA, 22 bp, Artificial Sequence
  chemically synthesized
agtgttcctggatgagacctct

SEQ ID NO: 872078 - DNA, 22 bp, Artificial Sequence
  chemically synthesized
ttcagtgttcctggatgagacc

SEQ ID NO: 872079 - DNA, 22 bp, Artificial Sequence
  chemically synthesized
ttcttctcagaggtctcatcca

SEQ ID NO: 872080 - DNA, 22 bp, Artificial Sequence
  chemically synthesized
tcttctcagaggtctcatccag

SEQ ID NO: 872081 - DNA, 22 bp, Artificial Sequence
  chemically synthesized
cttctcagaggtctcatccagg

SEQ ID NO: 872082 - DNA, 22 bp, Artificial Sequence
  chemically synthesized
ttctcagaggtctcatccagga

SEQ ID NO: 872083 - DNA, 22 bp, Artificial Sequence
  chemically synthesized
ctcagaggtctcatccaggaac

SEQ ID NO: 872084 - DNA, 22 bp, Artificial Sequence
  chemically synthesized
tcagaggtctcatccaggaaca

SEQ ID NO: 872085 - DNA, 22 bp, Artificial Sequence
  chemically synthesized
cagagctgttcagtgttcctgg

SEQ ID NO: 872086 - DNA, 22 bp, Artificial Sequence
  chemically synthesized
agaggtctcatccaggaacact

SEQ ID NO: 872087 - DNA, 22 bp, Artificial Sequence
  chemically synthesized
ccctgcagagctgttcagtgtt

SEQ ID NO: 872088 - DNA, 22 bp, Artificial Sequence
  chemically synthesized
gccctgcagagctgttcagtgt

SEQ ID NO: 872089 - DNA, 22 bp, Artificial Sequence
  chemically synthesized
atccaggaacactgaacagctc

SEQ ID NO: 872090 - DNA, 22 bp, Artificial Sequence
  chemically synthesized
aaccaggcagtatttgccctgc

SEQ ID NO: 872091 - DNA, 22 bp, Artificial Sequence
  chemically synthesized
aacagctctgcagggcaaatac

SEQ ID NO: 872092 - DNA, 22 bp, Artificial Sequence
  chemically synthesized
tgcagggcaaatactgcctggt

SEQ ID NO: 872093 - DNA, 22 bp, Artificial Sequence
  chemically synthesized
cagggcaaatactgcctggttt

SEQ ID NO: 872094 - DNA, 22 bp, Artificial Sequence
  chemically synthesized
aaggagatggacaacacactaa

SEQ ID NO: 872095 - DNA, 22 bp, Artificial Sequence
  chemically synthesized
cctggtttagtgtgttgtccat

SEQ ID NO: 872096 - DNA, 22 bp, Artificial Sequence
  chemically synthesized
gaagttcaaggagatggacaac

SEQ ID NO: 872097 - DNA, 22 bp, Artificial Sequence
  chemically synthesized
agaagttcaaggagatggacaa

SEQ ID NO: 872098 - DNA, 22 bp, Artificial Sequence
  chemically synthesized
gtttagtgtgttgtccatctcc

SEQ ID NO: 872099 - DNA, 22 bp, Artificial Sequence
  chemically synthesized
agtgtgttgtccatctccttga

SEQ ID NO: 872100 - DNA, 22 bp, Artificial Sequence
  chemically synthesized
tagcttagaagttcaaggagat

SEQ ID NO: 872101 - DNA, 22 bp, Artificial Sequence
  chemically synthesized
gtgtgttgtccatctccttgaa

SEQ ID NO: 872102 - DNA, 22 bp, Artificial Sequence
  chemically synthesized
tccatctccttgaacttctaag

SEQ ID NO: 872103 - DNA, 22 bp, Artificial Sequence
  chemically synthesized
cttgaacttctaagctataaca

SEQ ID NO: 872104 - DNA, 22 bp, Artificial Sequence
  chemically synthesized
cccaccccgaggatgttatagc

SEQ ID NO: 872105 - DNA, 22 bp, Artificial Sequence
  chemically synthesized
gaacttctaagctataacatcc

SEQ ID NO: 872106 - DNA, 22 bp, Artificial Sequence
  chemically synthesized
aacttctaagctataacatcct

SEQ ID NO: 872107 - DNA, 22 bp, Artificial Sequence
  chemically synthesized
ctaagctataacatcctcgggg

SEQ ID NO: 872108 - DNA, 22 bp, Artificial Sequence
  chemically synthesized
cccatctccccaccccgaggat

SEQ ID NO: 872109 - DNA, 22 bp, Artificial Sequence
  chemically synthesized
taagctataacatcctcggggt

SEQ ID NO: 872110 - DNA, 22 bp, Artificial Sequence
  chemically synthesized
agctataacatcctcggggtgg

SEQ ID NO: 872111 - DNA, 22 bp, Artificial Sequence
  chemically synthesized
ctccccatctccccaccccgag

SEQ ID NO: 872112 - DNA, 22 bp, Artificial Sequence
  chemically synthesized
tactccccatctccccaccccg

SEQ ID NO: 872113 - DNA, 22 bp, Artificial Sequence
  chemically synthesized
taacatcctcggggtggggaga

SEQ ID NO: 872114 - DNA, 22 bp, Artificial Sequence
  chemically synthesized
gcacctctactccccatctccc

SEQ ID NO: 872115 - DNA, 22 bp, Artificial Sequence
  chemically synthesized
agcacctctactccccatctcc

SEQ ID NO: 872116 - DNA, 22 bp, Artificial Sequence
  chemically synthesized
tagcacctctactccccatctc

SEQ ID NO: 872117 - DNA, 22 bp, Artificial Sequence
  chemically synthesized
ttttagcacctctactccccat

SEQ ID NO: 872118 - DNA, 22 bp, Artificial Sequence
  chemically synthesized
ggggtggggagatggggagtag

SEQ ID NO: 872119 - DNA, 22 bp, Artificial Sequence
  chemically synthesized
attttagcacctctactcccca

SEQ ID NO: 872120 - DNA, 22 bp, Artificial Sequence
  chemically synthesized
aagggaaatccatcttatttta

SEQ ID NO: 872121 - DNA, 22 bp, Artificial Sequence
  chemically synthesized
tgaatgctaaagggaaatccat

SEQ ID NO: 872122 - DNA, 22 bp, Artificial Sequence
  chemically synthesized
aaataagatggatttcccttta

SEQ ID NO: 872123 - DNA, 22 bp, Artificial Sequence
  chemically synthesized
caatgagatccagtgctgtgaa

SEQ ID NO: 872124 - DNA, 22 bp, Artificial Sequence
  chemically synthesized
ccctttagcattcacagcactg

SEQ ID NO: 872125 - DNA, 22 bp, Artificial Sequence
  chemically synthesized
cctttagcattcacagcactgg

SEQ ID NO: 872126 - DNA, 22 bp, Artificial Sequence
  chemically synthesized
tagcattcacagcactggatct

SEQ ID NO: 872127 - DNA, 22 bp, Artificial Sequence
  chemically synthesized
agcattcacagcactggatctc

SEQ ID NO: 872128 - DNA, 22 bp, Artificial Sequence
  chemically synthesized
gcattcacagcactggatctca

SEQ ID NO: 872129 - DNA, 22 bp, Artificial Sequence
  chemically synthesized
acagcactggatctcattggaa

SEQ ID NO: 872130 - DNA, 22 bp, Artificial Sequence
  chemically synthesized
tgtgcagcaaggagtgggattc

SEQ ID NO: 872131 - DNA, 22 bp, Artificial Sequence
  chemically synthesized
gatctcattggaatcccactcc

SEQ ID NO: 872132 - DNA, 22 bp, Artificial Sequence
  chemically synthesized
ctgtgtgcagcaaggagtggga

SEQ ID NO: 872133 - DNA, 22 bp, Artificial Sequence
  chemically synthesized
tgctgtgtgcagcaaggagtgg

SEQ ID NO: 872134 - DNA, 22 bp, Artificial Sequence
  chemically synthesized
ctgctgtgtgcagcaaggagtg

SEQ ID NO: 872135 - DNA, 22 bp, Artificial Sequence
  chemically synthesized
attggaatcccactccttgctg

SEQ ID NO: 872136 - DNA, 22 bp, Artificial Sequence
  chemically synthesized
gaatcccactccttgctgcaca

SEQ ID NO: 872137 - DNA, 22 bp, Artificial Sequence
  chemically synthesized
atcccttctgctgtgtgcagca

SEQ ID NO: 872138 - DNA, 22 bp, Artificial Sequence
  chemically synthesized
cttgctgcacacagcagaaggg

SEQ ID NO: 872139 - DNA, 22 bp, Artificial Sequence
  chemically synthesized
gctgcacacagcagaagggatg

SEQ ID NO: 872140 - DNA, 22 bp, Artificial Sequence
  chemically synthesized
ctgcacacagcagaagggatga

SEQ ID NO: 872141 - DNA, 22 bp, Artificial Sequence
  chemically synthesized
cacacagcagaagggatgaatt

SEQ ID NO: 872142 - DNA, 22 bp, Artificial Sequence
  chemically synthesized
ccacagacatacagtgagtggg

SEQ ID NO: 872143 - DNA, 22 bp, Artificial Sequence
  chemically synthesized
ctaccacagacatacagtgagt

SEQ ID NO: 872144 - DNA, 22 bp, Artificial Sequence
  chemically synthesized
attcttccccactcactgtatg

SEQ ID NO: 872145 - DNA, 22 bp, Artificial Sequence
  chemically synthesized
ttcttccccactcactgtatgt

SEQ ID NO: 872146 - DNA, 22 bp, Artificial Sequence
  chemically synthesized
ttccccactcactgtatgtctg

SEQ ID NO: 872147 - DNA, 22 bp, Artificial Sequence
  chemically synthesized
agaactactaccacagacatac

SEQ ID NO: 872148 - DNA, 22 bp, Artificial Sequence
  chemically synthesized
ccccactcactgtatgtctgtg

SEQ ID NO: 872149 - DNA, 22 bp, Artificial Sequence
  chemically synthesized
gagaactactaccacagacata

SEQ ID NO: 872150 - DNA, 22 bp, Artificial Sequence
  chemically synthesized
cccactcactgtatgtctgtgg

SEQ ID NO: 872151 - DNA, 22 bp, Artificial Sequence
  chemically synthesized
tgagaactactaccacagacat

SEQ ID NO: 872152 - DNA, 22 bp, Artificial Sequence
  chemically synthesized
tgctttgagaactactaccaca

SEQ ID NO: 872153 - DNA, 22 bp, Artificial Sequence
  chemically synthesized
actgtatgtctgtggtagtagt

SEQ ID NO: 872154 - DNA, 22 bp, Artificial Sequence
  chemically synthesized
gcctatgctttgagaactacta

SEQ ID NO: 872155 - DNA, 22 bp, Artificial Sequence
  chemically synthesized
tatgtctgtggtagtagttctc

SEQ ID NO: 872156 - DNA, 22 bp, Artificial Sequence
  chemically synthesized
atgctggcctatgctttgagaa

SEQ ID NO: 872157 - DNA, 22 bp, Artificial Sequence
  chemically synthesized
tggtagtagttctcaaagcata

SEQ ID NO: 872158 - DNA, 22 bp, Artificial Sequence
  chemically synthesized
tgctgatgctggcctatgcttt

SEQ ID NO: 872159 - DNA, 22 bp, Artificial Sequence
  chemically synthesized
ggttatgctgatgctggcctat

SEQ ID NO: 872160 - DNA, 22 bp, Artificial Sequence
  chemically synthesized
ctaggttatgctgatgctggcc

SEQ ID NO: 872161 - DNA, 22 bp, Artificial Sequence
  chemically synthesized
tcaaagcataggccagcatcag

SEQ ID NO: 872162 - DNA, 22 bp, Artificial Sequence
  chemically synthesized
aaagcataggccagcatcagca

SEQ ID NO: 872163 - DNA, 22 bp, Artificial Sequence
  chemically synthesized
aaaagttcctaggttatgctga

SEQ ID NO: 872164 - DNA, 22 bp, Artificial Sequence
  chemically synthesized
tgaaaagttcctaggttatgct

SEQ ID NO: 872165 - DNA, 22 bp, Artificial Sequence
  chemically synthesized
catctctgaaaagttcctaggt

SEQ ID NO: 872166 - DNA, 22 bp, Artificial Sequence
  chemically synthesized
gcatctctgaaaagttcctagg

SEQ ID NO: 872167 - DNA, 22 bp, Artificial Sequence
  chemically synthesized
ggaacttttcagagatgcaagt

SEQ ID NO: 872168 - DNA, 22 bp, Artificial Sequence
  chemically synthesized
tgcccagccaagacttgcatct

SEQ ID NO: 872169 - DNA, 22 bp, Artificial Sequence
  chemically synthesized
ttcagagatgcaagtcttggct

SEQ ID NO: 872170 - DNA, 22 bp, Artificial Sequence
  chemically synthesized
tcagagatgcaagtcttggctg

SEQ ID NO: 872171 - DNA, 22 bp, Artificial Sequence
  chemically synthesized
cagagatgcaagtcttggctgg

SEQ ID NO: 872172 - DNA, 22 bp, Artificial Sequence
  chemically synthesized
agagatgcaagtcttggctggg

SEQ ID NO: 872173 - DNA, 22 bp, Artificial Sequence
  chemically synthesized
caggcgtgagccactgtgccca

SEQ ID NO: 872174 - DNA, 22 bp, Artificial Sequence
  chemically synthesized
ggattacaggcgtgagccactg

SEQ ID NO: 872175 - DNA, 22 bp, Artificial Sequence
  chemically synthesized
ggctgggcacagtggctcacgc

SEQ ID NO: 872176 - DNA, 22 bp, Artificial Sequence
  chemically synthesized
gctgggcacagtggctcacgcc

SEQ ID NO: 872177 - DNA, 22 bp, Artificial Sequence
  chemically synthesized
ggcacagtggctcacgcctgta

SEQ ID NO: 872178 - DNA, 22 bp, Artificial Sequence
  chemically synthesized
ccatagtgctgggattacaggc

SEQ ID NO: 872179 - DNA, 22 bp, Artificial Sequence
  chemically synthesized
agcctcccatagtgctgggatt

SEQ ID NO: 872180 - DNA, 22 bp, Artificial Sequence
  chemically synthesized
acgcctgtaatcccagcactat

SEQ ID NO: 872181 - DNA, 22 bp, Artificial Sequence
  chemically synthesized
cctcagcctcccatagtgctgg

SEQ ID NO: 872182 - DNA, 22 bp, Artificial Sequence
  chemically synthesized
taatcccagcactatgggaggc

SEQ ID NO: 872183 - DNA, 22 bp, Artificial Sequence
  chemically synthesized
aggtgatccacctgcctcagcc

SEQ ID NO: 872184 - DNA, 22 bp, Artificial Sequence
  chemically synthesized
acctcaggtgatccacctgcct

SEQ ID NO: 872185 - DNA, 22 bp, Artificial Sequence
  chemically synthesized
tgggaggctgaggcaggtggat

SEQ ID NO: 872186 - DNA, 22 bp, Artificial Sequence
  chemically synthesized
ctgacctcaggtgatccacctg

SEQ ID NO: 872187 - DNA, 22 bp, Artificial Sequence
  chemically synthesized
gaactcctgacctcaggtgatc

SEQ ID NO: 872188 - DNA, 22 bp, Artificial Sequence
  chemically synthesized
aggcaggtggatcacctgaggt

SEQ ID NO: 872189 - DNA, 22 bp, Artificial Sequence
  chemically synthesized
gtctcgaactcctgacctcagg

SEQ ID NO: 872190 - DNA, 22 bp, Artificial Sequence
  chemically synthesized
gtcaggctggtctcgaactcct

SEQ ID NO: 872191 - DNA, 22 bp, Artificial Sequence
  chemically synthesized
aggtcaggagttcgagaccagc

SEQ ID NO: 872192 - DNA, 22 bp, Artificial Sequence
  chemically synthesized
accatgttggtcaggctggtct

SEQ ID NO: 872193 - DNA, 22 bp, Artificial Sequence
  chemically synthesized
caccatgttggtcaggctggtc

SEQ ID NO: 872194 - DNA, 22 bp, Artificial Sequence
  chemically synthesized
gagaccagcctgaccaacatgg

SEQ ID NO: 872195 - DNA, 22 bp, Artificial Sequence
  chemically synthesized
gtagagacagggtttcaccatg

SEQ ID NO: 872196 - DNA, 22 bp, Artificial Sequence
  chemically synthesized
agtagagacagggtttcaccat

SEQ ID NO: 872197 - DNA, 22 bp, Artificial Sequence
  chemically synthesized
tagtagagacagggtttcacca

SEQ ID NO: 872198 - DNA, 22 bp, Artificial Sequence
  chemically synthesized
ttagtagagacagggtttcacc

SEQ ID NO: 872199 - DNA, 22 bp, Artificial Sequence
  chemically synthesized
accaacatggtgaaaccctgtc

SEQ ID NO: 872200 - DNA, 22 bp, Artificial Sequence
  chemically synthesized
tatttttagtagagacagggtt

SEQ ID NO: 872201 - DNA, 22 bp, Artificial Sequence
  chemically synthesized
gtatttttagtagagacagggt

SEQ ID NO: 872202 - DNA, 22 bp, Artificial Sequence
  chemically synthesized
tgtatttttagtagagacaggg

SEQ ID NO: 872203 - DNA, 22 bp, Artificial Sequence
  chemically synthesized
ttgtatttttagtagagacagg

SEQ ID NO: 872204 - DNA, 22 bp, Artificial Sequence
  chemically synthesized
atttttgtatttttagtagaga

SEQ ID NO: 872205 - DNA, 22 bp, Artificial Sequence
  chemically synthesized
gctaatttttgtatttttagta

SEQ ID NO: 872206 - DNA, 22 bp, Artificial Sequence
  chemically synthesized
tctctactaaaaatacaaaaat

SEQ ID NO: 872207 - DNA, 22 bp, Artificial Sequence
  chemically synthesized
tactaaaaatacaaaaattagc

SEQ ID NO: 872208 - DNA, 22 bp, Artificial Sequence
  chemically synthesized
ctaaaaatacaaaaattagcca

SEQ ID NO: 872209 - DNA, 22 bp, Artificial Sequence
  chemically synthesized
aaaatacaaaaattagccaggc

SEQ ID NO: 872210 - DNA, 22 bp, Artificial Sequence
  chemically synthesized
taggcacccgccaccacgcctg

SEQ ID NO: 872211 - DNA, 22 bp, Artificial Sequence
  chemically synthesized
ggattataggcacccgccacca

SEQ ID NO: 872212 - DNA, 22 bp, Artificial Sequence
  chemically synthesized
gccaggcgtggtggcgggtgcc

SEQ ID NO: 872213 - DNA, 22 bp, Artificial Sequence
  chemically synthesized
agtagctaggattataggcacc

SEQ ID NO: 872214 - DNA, 22 bp, Artificial Sequence
  chemically synthesized
ctgagtagctaggattataggc

SEQ ID NO: 872215 - DNA, 22 bp, Artificial Sequence
  chemically synthesized
agcctcctgagtagctaggatt

SEQ ID NO: 872216 - DNA, 22 bp, Artificial Sequence
  chemically synthesized
cctcagcctcctgagtagctag

SEQ ID NO: 872217 - DNA, 22 bp, Artificial Sequence
  chemically synthesized
ctgcctcagcctcctgagtagc

SEQ ID NO: 872218 - DNA, 22 bp, Artificial Sequence
  chemically synthesized
tcctgcctcagcctcctgagta

SEQ ID NO: 872219 - DNA, 22 bp, Artificial Sequence
  chemically synthesized
taatcctagctactcaggaggc

SEQ ID NO: 872220 - DNA, 22 bp, Artificial Sequence
  chemically synthesized
aagcggttctcctgcctcagcc

SEQ ID NO: 872221 - DNA, 22 bp, Artificial Sequence
  chemically synthesized
gctactcaggaggctgaggcag

SEQ ID NO: 872222 - DNA, 22 bp, Artificial Sequence
  chemically synthesized
ctcaggaggctgaggcaggaga

SEQ ID NO: 872223 - DNA, 22 bp, Artificial Sequence
  chemically synthesized
ggttgaagcggttctcctgcct

SEQ ID NO: 872224 - DNA, 22 bp, Artificial Sequence
  chemically synthesized
aggaggctgaggcaggagaacc

SEQ ID NO: 872225 - DNA, 22 bp, Artificial Sequence
  chemically synthesized
ctgggttgaagcggttctcctg

SEQ ID NO: 872226 - DNA, 22 bp, Artificial Sequence
  chemically synthesized
cctcctgggttgaagcggttct

SEQ ID NO: 872227 - DNA, 22 bp, Artificial Sequence
  chemically synthesized
tgcctcctgggttgaagcggtt

SEQ ID NO: 872228 - DNA, 22 bp, Artificial Sequence
  chemically synthesized
aggcaggagaaccgcttcaacc

SEQ ID NO: 872229 - DNA, 22 bp, Artificial Sequence
  chemically synthesized
acagcaacctctgcctcctggg

SEQ ID NO: 872230 - DNA, 22 bp, Artificial Sequence
  chemically synthesized
ggctcacagcaacctctgcctc

SEQ ID NO: 872231 - DNA, 22 bp, Artificial Sequence
  chemically synthesized
caacccaggaggcagaggttgc

SEQ ID NO: 872232 - DNA, 22 bp, Artificial Sequence
  chemically synthesized
aacccaggaggcagaggttgct

SEQ ID NO: 872233 - DNA, 22 bp, Artificial Sequence
  chemically synthesized
gagtgcagtggtgcaatctcgg

SEQ ID NO: 872234 - DNA, 22 bp, Artificial Sequence
  chemically synthesized
ctgtgagccgagattgcaccac

SEQ ID NO: 872235 - DNA, 22 bp, Artificial Sequence
  chemically synthesized
tgagccgagattgcaccactgc

SEQ ID NO: 872236 - DNA, 22 bp, Artificial Sequence
  chemically synthesized
tcacccaggctggagtgcagtg

SEQ ID NO: 872237 - DNA, 22 bp, Artificial Sequence
  chemically synthesized
tgtcacccaggctggagtgcag

SEQ ID NO: 872238 - DNA, 22 bp, Artificial Sequence
  chemically synthesized
ctctgtcacccaggctggagtg

SEQ ID NO: 872239 - DNA, 22 bp, Artificial Sequence
  chemically synthesized
gctctgtcacccaggctggagt

SEQ ID NO: 872240 - DNA, 22 bp, Artificial Sequence
  chemically synthesized
caccactgcactccagcctggg

SEQ ID NO: 872241 - DNA, 22 bp, Artificial Sequence
  chemically synthesized
agtcttgctctgtcacccaggc

SEQ ID NO: 872242 - DNA, 22 bp, Artificial Sequence
  chemically synthesized
cactccagcctgggtgacagag

SEQ ID NO: 872243 - DNA, 22 bp, Artificial Sequence
  chemically synthesized
agactgagtcttgctctgtcac

SEQ ID NO: 872244 - DNA, 22 bp, Artificial Sequence
  chemically synthesized
gagactgagtcttgctctgtca

SEQ ID NO: 872245 - DNA, 22 bp, Artificial Sequence
  chemically synthesized
tgagactgagtcttgctctgtc

SEQ ID NO: 872246 - DNA, 22 bp, Artificial Sequence
  chemically synthesized
ttgagactgagtcttgctctgt

SEQ ID NO: 872247 - DNA, 22 bp, Artificial Sequence
  chemically synthesized
cagcctgggtgacagagcaaga

SEQ ID NO: 872248 - DNA, 22 bp, Artificial Sequence
  chemically synthesized
tttgagactgagtcttgctctg

SEQ ID NO: 872249 - DNA, 22 bp, Artificial Sequence
  chemically synthesized
ttttgagactgagtcttgctct

SEQ ID NO: 872250 - DNA, 22 bp, Artificial Sequence
  chemically synthesized
tttttgagactgagtcttgctc

SEQ ID NO: 872251 - DNA, 22 bp, Artificial Sequence
  chemically synthesized
ttttttgagactgagtcttgct

SEQ ID NO: 872252 - DNA, 22 bp, Artificial Sequence
  chemically synthesized
tttttttgagactgagtcttgc

SEQ ID NO: 872253 - DNA, 22 bp, Artificial Sequence
  chemically synthesized
tttttttttgagactgagtctt

SEQ ID NO: 872254 - DNA, 22 bp, Artificial Sequence
  chemically synthesized
ggtgacagagcaagactcagtc

SEQ ID NO: 872255 - DNA, 22 bp, Artificial Sequence
  chemically synthesized
tctttttttttgagactgagtc

SEQ ID NO: 872256 - DNA, 22 bp, Artificial Sequence
  chemically synthesized
tctctttttttttgagactgag

SEQ ID NO: 872257 - DNA, 22 bp, Artificial Sequence
  chemically synthesized
tctctctttttttttgagactg

SEQ ID NO: 872258 - DNA, 22 bp, Artificial Sequence
  chemically synthesized
tctctctctttttttttgagac

SEQ ID NO: 872259 - DNA, 22 bp, Artificial Sequence
  chemically synthesized
tctctctctctttttttttgag

SEQ ID NO: 872260 - DNA, 22 bp, Artificial Sequence
  chemically synthesized
catctctctctctctctttttt

SEQ ID NO: 872261 - DNA, 22 bp, Artificial Sequence
  chemically synthesized
agtctcaaaaaaaaagagagag

SEQ ID NO: 872262 - DNA, 22 bp, Artificial Sequence
  chemically synthesized
aaaaaaaaagagagagagagag

SEQ ID NO: 872263 - DNA, 22 bp, Artificial Sequence
  chemically synthesized
gggtgagacctgcatctctctc

SEQ ID NO: 872264 - DNA, 22 bp, Artificial Sequence
  chemically synthesized
tggggtgagacctgcatctctc

SEQ ID NO: 872265 - DNA, 22 bp, Artificial Sequence
  chemically synthesized
gctctggggtgagacctgcatc

SEQ ID NO: 872266 - DNA, 22 bp, Artificial Sequence
  chemically synthesized
ctagctctggggtgagacctgc

SEQ ID NO: 872267 - DNA, 22 bp, Artificial Sequence
  chemically synthesized
actagctctggggtgagacctg

SEQ ID NO: 872268 - DNA, 22 bp, Artificial Sequence
  chemically synthesized
atttactagctctggggtgaga

SEQ ID NO: 872269 - DNA, 22 bp, Artificial Sequence
  chemically synthesized
tgatttactagctctggggtga

SEQ ID NO: 872270 - DNA, 22 bp, Artificial Sequence
  chemically synthesized
ctgatttactagctctggggtg

SEQ ID NO: 872271 - DNA, 22 bp, Artificial Sequence
  chemically synthesized
accccagagctagtaaatcaga

SEQ ID NO: 872272 - DNA, 22 bp, Artificial Sequence
  chemically synthesized
aaccccagagtttctgatttac

SEQ ID NO: 872273 - DNA, 22 bp, Artificial Sequence
  chemically synthesized
caaccccagagtttctgattta

SEQ ID NO: 872274 - DNA, 22 bp, Artificial Sequence
  chemically synthesized
ggcttcaaccccagagtttctg

SEQ ID NO: 872275 - DNA, 22 bp, Artificial Sequence
  chemically synthesized
ctgggcttcaaccccagagttt

SEQ ID NO: 872276 - DNA, 22 bp, Artificial Sequence
  chemically synthesized
gtaaatcagaaactctggggtt

SEQ ID NO: 872277 - DNA, 22 bp, Artificial Sequence
  chemically synthesized
gcaaagtatagattactgggct

SEQ ID NO: 872278 - DNA, 22 bp, Artificial Sequence
  chemically synthesized
cgcaaagtatagattactgggc

SEQ ID NO: 872279 - DNA, 22 bp, Artificial Sequence
  chemically synthesized
tggggttgaagcccagtaatct

SEQ ID NO: 872280 - DNA, 22 bp, Artificial Sequence
  chemically synthesized
ttcgcaaagtatagattactgg

SEQ ID NO: 872281 - DNA, 22 bp, Artificial Sequence
  chemically synthesized
gggttgaagcccagtaatctat

SEQ ID NO: 872282 - DNA, 22 bp, Artificial Sequence
  chemically synthesized
aagcccagtaatctatactttg

SEQ ID NO: 872283 - DNA, 22 bp, Artificial Sequence
  chemically synthesized
gaaccacccagttcttcgcaaa

SEQ ID NO: 872284 - DNA, 22 bp, Artificial Sequence
  chemically synthesized
tactttgcgaagaactgggtgg

SEQ ID NO: 872285 - DNA, 22 bp, Artificial Sequence
  chemically synthesized
ccatgcgttagaaccacccagt

SEQ ID NO: 872286 - DNA, 22 bp, Artificial Sequence
  chemically synthesized
tgcgaagaactgggtggttcta

SEQ ID NO: 872287 - DNA, 22 bp, Artificial Sequence
  chemically synthesized
gcgaagaactgggtggttctaa

SEQ ID NO: 872288 - DNA, 22 bp, Artificial Sequence
  chemically synthesized
cgaagaactgggtggttctaac

SEQ ID NO: 872289 - DNA, 22 bp, Artificial Sequence
  chemically synthesized
aaaaattaccatgcgttagaac

SEQ ID NO: 872290 - DNA, 22 bp, Artificial Sequence
  chemically synthesized
tcaaaaattaccatgcgttaga

SEQ ID NO: 872291 - DNA, 22 bp, Artificial Sequence
  chemically synthesized
attctcaaaaattaccatgcgt

SEQ ID NO: 872292 - DNA, 22 bp, Artificial Sequence
  chemically synthesized
aattctcaaaaattaccatgcg

SEQ ID NO: 872293 - DNA, 22 bp, Artificial Sequence
  chemically synthesized
ggtggttctaacgcatggtaat

SEQ ID NO: 872294 - DNA, 22 bp, Artificial Sequence
  chemically synthesized
taacgcatggtaatttttgaga

SEQ ID NO: 872295 - DNA, 22 bp, Artificial Sequence
  chemically synthesized
atccaacttaattctcaaaaat

SEQ ID NO: 872296 - DNA, 22 bp, Artificial Sequence
  chemically synthesized
aatccaacttaattctcaaaaa

SEQ ID NO: 872297 - DNA, 22 bp, Artificial Sequence
  chemically synthesized
acgcatggtaatttttgagaat

SEQ ID NO: 872298 - DNA, 22 bp, Artificial Sequence
  chemically synthesized
gtcttaatccaacttaattctc

SEQ ID NO: 872299 - DNA, 22 bp, Artificial Sequence
  chemically synthesized
ttgagaattaagttggattaag

SEQ ID NO: 872300 - DNA, 22 bp, Artificial Sequence
  chemically synthesized
tgagaattaagttggattaaga

SEQ ID NO: 872301 - DNA, 22 bp, Artificial Sequence
  chemically synthesized
gagaattaagttggattaagac

SEQ ID NO: 872302 - DNA, 22 bp, Artificial Sequence
  chemically synthesized
agaattaagttggattaagacc

SEQ ID NO: 872303 - DNA, 22 bp, Artificial Sequence
  chemically synthesized
gagatcaaaagtgttggtctta

SEQ ID NO: 872304 - DNA, 22 bp, Artificial Sequence
  chemically synthesized
agttggattaagaccaacactt

SEQ ID NO: 872305 - DNA, 22 bp, Artificial Sequence
  chemically synthesized
gattaagaccaacacttttgat

SEQ ID NO: 872306 - DNA, 22 bp, Artificial Sequence
  chemically synthesized
agaccaacacttttgatctcca

SEQ ID NO: 872307 - DNA, 22 bp, Artificial Sequence
  chemically synthesized
gggaaaaggagggaaactggag

SEQ ID NO: 872308 - DNA, 22 bp, Artificial Sequence
  chemically synthesized
cattggggaaaaggagggaaac

SEQ ID NO: 872309 - DNA, 22 bp, Artificial Sequence
  chemically synthesized
ttgatctccagtttccctcctt

SEQ ID NO: 872310 - DNA, 22 bp, Artificial Sequence
  chemically synthesized
tgatctccagtttccctccttt

SEQ ID NO: 872311 - DNA, 22 bp, Artificial Sequence
  chemically synthesized
gatctccagtttccctcctttt

SEQ ID NO: 872312 - DNA, 22 bp, Artificial Sequence
  chemically synthesized
atctccagtttccctccttttc

SEQ ID NO: 872313 - DNA, 22 bp, Artificial Sequence
  chemically synthesized
cagtttccctccttttccccaa

SEQ ID NO: 872314 - DNA, 22 bp, Artificial Sequence
  chemically synthesized
tacacaaatcactacattgggg

SEQ ID NO: 872315 - DNA, 22 bp, Artificial Sequence
  chemically synthesized
atacacaaatcactacattggg

SEQ ID NO: 872316 - DNA, 22 bp, Artificial Sequence
  chemically synthesized
ccctccttttccccaatgtagt

SEQ ID NO: 872317 - DNA, 22 bp, Artificial Sequence
  chemically synthesized
cctccttttccccaatgtagtg

SEQ ID NO: 872318 - DNA, 22 bp, Artificial Sequence
  chemically synthesized
cttttccccaatgtagtgattt

SEQ ID NO: 872319 - DNA, 22 bp, Artificial Sequence
  chemically synthesized
ttccccaatgtagtgatttgtg

SEQ ID NO: 872320 - DNA, 22 bp, Artificial Sequence
  chemically synthesized
tccccaatgtagtgatttgtgt

SEQ ID NO: 872321 - DNA, 22 bp, Artificial Sequence
  chemically synthesized
ccccaatgtagtgatttgtgta

SEQ ID NO: 872322 - DNA, 22 bp, Artificial Sequence
  chemically synthesized
tcaccgtatttatacacaaatc

SEQ ID NO: 872323 - DNA, 22 bp, Artificial Sequence
  chemically synthesized
cccaatgtagtgatttgtgtat

SEQ ID NO: 872324 - DNA, 22 bp, Artificial Sequence
  chemically synthesized
ttgtcaccgtatttatacacaa

SEQ ID NO: 872325 - DNA, 22 bp, Artificial Sequence
  chemically synthesized
attgtcaccgtatttatacaca

SEQ ID NO: 872326 - DNA, 22 bp, Artificial Sequence
  chemically synthesized
tattgtcaccgtatttatacac

SEQ ID NO: 872327 - DNA, 22 bp, Artificial Sequence
  chemically synthesized
gtgtataaatacggtgacaata

SEQ ID NO: 872328 - DNA, 22 bp, Artificial Sequence
  chemically synthesized
tgtataaatacggtgacaataa

SEQ ID NO: 872329 - DNA, 22 bp, Artificial Sequence
  chemically synthesized
gggatagaaggttttattgtca

SEQ ID NO: 872330 - DNA, 22 bp, Artificial Sequence
  chemically synthesized
ctatccccaatatgcatacccc

SEQ ID NO: 872331 - DNA, 22 bp, Artificial Sequence
  chemically synthesized
tatccccaatatgcatacccct

SEQ ID NO: 872332 - DNA, 22 bp, Artificial Sequence
  chemically synthesized
tccccaatatgcataccccttt

SEQ ID NO: 872333 - DNA, 22 bp, Artificial Sequence
  chemically synthesized
gtgaaaggaggagatgccacat

SEQ ID NO: 872334 - DNA, 22 bp, Artificial Sequence
  chemically synthesized
tgatatgcgatgtggcatctcc

SEQ ID NO: 872335 - DNA, 22 bp, Artificial Sequence
  chemically synthesized
gatatgcgatgtggcatctcct

SEQ ID NO: 872336 - DNA, 22 bp, Artificial Sequence
  chemically synthesized
atatgcgatgtggcatctcctc

SEQ ID NO: 872337 - DNA, 22 bp, Artificial Sequence
  chemically synthesized
atctcgtgaaaggaggagatgc

SEQ ID NO: 872338 - DNA, 22 bp, Artificial Sequence
  chemically synthesized
catctcgtgaaaggaggagatg

SEQ ID NO: 872339 - DNA, 22 bp, Artificial Sequence
  chemically synthesized
cttcatctcgtgaaaggaggag

SEQ ID NO: 872340 - DNA, 22 bp, Artificial Sequence
  chemically synthesized
ctcctttcacgagatgaagtaa

SEQ ID NO: 872341 - DNA, 22 bp, Artificial Sequence
  chemically synthesized
aagagatgaggaaattacttca

SEQ ID NO: 872342 - DNA, 22 bp, Artificial Sequence
  chemically synthesized
ctttcacgagatgaagtaattt

SEQ ID NO: 872343 - DNA, 22 bp, Artificial Sequence
  chemically synthesized
tcacgagatgaagtaatttcct

SEQ ID NO: 872344 - DNA, 22 bp, Artificial Sequence
  chemically synthesized
cacgagatgaagtaatttcctc

SEQ ID NO: 872345 - DNA, 22 bp, Artificial Sequence
  chemically synthesized
acgagatgaagtaatttcctca

SEQ ID NO: 872346 - DNA, 22 bp, Artificial Sequence
  chemically synthesized
aaaagatcagcccagattcaag

SEQ ID NO: 872347 - DNA, 22 bp, Artificial Sequence
  chemically synthesized
cctcatctcttgaatctgggct

SEQ ID NO: 872348 - DNA, 22 bp, Artificial Sequence
  chemically synthesized
ctcatctcttgaatctgggctg

SEQ ID NO: 872349 - DNA, 22 bp, Artificial Sequence
  chemically synthesized
atctcttgaatctgggctgatc

SEQ ID NO: 872350 - DNA, 22 bp, Artificial Sequence
  chemically synthesized
ttgaatctgggctgatcttttg

SEQ ID NO: 872351 - DNA, 22 bp, Artificial Sequence
  chemically synthesized
gtcaaagcacctcaaaagatca

SEQ ID NO: 872352 - DNA, 22 bp, Artificial Sequence
  chemically synthesized
gaatctgggctgatcttttgag

SEQ ID NO: 872353 - DNA, 22 bp, Artificial Sequence
  chemically synthesized
aatctgggctgatcttttgagg

SEQ ID NO: 872354 - DNA, 22 bp, Artificial Sequence
  chemically synthesized
tattggtcaaagcacctcaaaa

SEQ ID NO: 872355 - DNA, 22 bp, Artificial Sequence
  chemically synthesized
ggctgatcttttgaggtgcttt

SEQ ID NO: 872356 - DNA, 22 bp, Artificial Sequence
  chemically synthesized
agttatattggtcaaagcacct

SEQ ID NO: 872357 - DNA, 22 bp, Artificial Sequence
  chemically synthesized
ctaagttatattggtcaaagca

SEQ ID NO: 872358 - DNA, 22 bp, Artificial Sequence
  chemically synthesized
atcttttgaggtgctttgacca

SEQ ID NO: 872359 - DNA, 22 bp, Artificial Sequence
  chemically synthesized
tgctaagttatattggtcaaag

SEQ ID NO: 872360 - DNA, 22 bp, Artificial Sequence
  chemically synthesized
ctgctaagttatattggtcaaa

SEQ ID NO: 872361 - DNA, 22 bp, Artificial Sequence
  chemically synthesized
ttgaggtgctttgaccaatata

SEQ ID NO: 872362 - DNA, 22 bp, Artificial Sequence
  chemically synthesized
cttctgctaagttatattggtc

SEQ ID NO: 872363 - DNA, 22 bp, Artificial Sequence
  chemically synthesized
tgaggtgctttgaccaatataa

SEQ ID NO: 872364 - DNA, 22 bp, Artificial Sequence
  chemically synthesized
gaggtgctttgaccaatataac

SEQ ID NO: 872365 - DNA, 22 bp, Artificial Sequence
  chemically synthesized
aggtgctttgaccaatataact

SEQ ID NO: 872366 - DNA, 22 bp, Artificial Sequence
  chemically synthesized
tgaccaatataacttagcagaa

SEQ ID NO: 872367 - DNA, 22 bp, Artificial Sequence
  chemically synthesized
gaccaatataacttagcagaag

SEQ ID NO: 872368 - DNA, 22 bp, Artificial Sequence
  chemically synthesized
accaatataacttagcagaagt

SEQ ID NO: 872369 - DNA, 22 bp, Artificial Sequence
  chemically synthesized
aaacgtgtaggttacttctgct

SEQ ID NO: 872370 - DNA, 22 bp, Artificial Sequence
  chemically synthesized
gaaacgtgtaggttacttctgc

SEQ ID NO: 872371 - DNA, 22 bp, Artificial Sequence
  chemically synthesized
tgaaacgtgtaggttacttctg

SEQ ID NO: 872372 - DNA, 22 bp, Artificial Sequence
  chemically synthesized
ggctttgaaacgtgtaggttac

SEQ ID NO: 872373 - DNA, 22 bp, Artificial Sequence
  chemically synthesized
agcagaagtaacctacacgttt

SEQ ID NO: 872374 - DNA, 22 bp, Artificial Sequence
  chemically synthesized
gcagaagtaacctacacgtttc

SEQ ID NO: 872375 - DNA, 22 bp, Artificial Sequence
  chemically synthesized
atgcctaggctttgaaacgtgt

SEQ ID NO: 872376 - DNA, 22 bp, Artificial Sequence
  chemically synthesized
tgatgcctaggctttgaaacgt

SEQ ID NO: 872377 - DNA, 22 bp, Artificial Sequence
  chemically synthesized
ctgatgcctaggctttgaaacg

SEQ ID NO: 872378 - DNA, 22 bp, Artificial Sequence
  chemically synthesized
caagaccttctgatgcctaggc

SEQ ID NO: 872379 - DNA, 22 bp, Artificial Sequence
  chemically synthesized
cacgtttcaaagcctaggcatc

SEQ ID NO: 872380 - DNA, 22 bp, Artificial Sequence
  chemically synthesized
caaagcctaggcatcagaaggt

SEQ ID NO: 872381 - DNA, 22 bp, Artificial Sequence
  chemically synthesized
aaagcctaggcatcagaaggtc

SEQ ID NO: 872382 - DNA, 22 bp, Artificial Sequence
  chemically synthesized
ggcatcagaaggtcttgtagct

SEQ ID NO: 872383 - DNA, 22 bp, Artificial Sequence
  chemically synthesized
caagagagggcgggtggaagct

SEQ ID NO: 872384 - DNA, 22 bp, Artificial Sequence
  chemically synthesized
ccaagagagggcgggtggaagc

SEQ ID NO: 872385 - DNA, 22 bp, Artificial Sequence
  chemically synthesized
tccaagagagggcgggtggaag

SEQ ID NO: 872386 - DNA, 22 bp, Artificial Sequence
  chemically synthesized
gtagcttccacccgccctctct

SEQ ID NO: 872387 - DNA, 22 bp, Artificial Sequence
  chemically synthesized
tagcttccacccgccctctctt

SEQ ID NO: 872388 - DNA, 22 bp, Artificial Sequence
  chemically synthesized
agggcagttttccaagagaggg

SEQ ID NO: 872389 - DNA, 22 bp, Artificial Sequence
  chemically synthesized
tcagggcagttttccaagagag

SEQ ID NO: 872390 - DNA, 22 bp, Artificial Sequence
  chemically synthesized
ccacccgccctctcttggaaaa

SEQ ID NO: 872391 - DNA, 22 bp, Artificial Sequence
  chemically synthesized
cacccgccctctcttggaaaac

SEQ ID NO: 872392 - DNA, 22 bp, Artificial Sequence
  chemically synthesized
catggtattctcagggcagttt

SEQ ID NO: 872393 - DNA, 22 bp, Artificial Sequence
  chemically synthesized
attacatggtattctcagggca

SEQ ID NO: 872394 - DNA, 22 bp, Artificial Sequence
  chemically synthesized
tcttggaaaactgccctgagaa

SEQ ID NO: 872395 - DNA, 22 bp, Artificial Sequence
  chemically synthesized
cattacatggtattctcagggc

SEQ ID NO: 872396 - DNA, 22 bp, Artificial Sequence
  chemically synthesized
ttggaaaactgccctgagaata

SEQ ID NO: 872397 - DNA, 22 bp, Artificial Sequence
  chemically synthesized
ggaaaactgccctgagaatacc

SEQ ID NO: 872398 - DNA, 22 bp, Artificial Sequence
  chemically synthesized
gaaaactgccctgagaatacca

SEQ ID NO: 872399 - DNA, 22 bp, Artificial Sequence
  chemically synthesized
ggcttcattacatggtattctc

SEQ ID NO: 872400 - DNA, 22 bp, Artificial Sequence
  chemically synthesized
gattaggcttcattacatggta

SEQ ID NO: 872401 - DNA, 22 bp, Artificial Sequence
  chemically synthesized
ccctgagaataccatgtaatga

SEQ ID NO: 872402 - DNA, 22 bp, Artificial Sequence
  chemically synthesized
taggctagattaggcttcatta

SEQ ID NO: 872403 - DNA, 22 bp, Artificial Sequence
  chemically synthesized
agaataccatgtaatgaagcct

SEQ ID NO: 872404 - DNA, 22 bp, Artificial Sequence
  chemically synthesized
atcatcctgtaggctagattag

SEQ ID NO: 872405 - DNA, 22 bp, Artificial Sequence
  chemically synthesized
ataaggccactcatcatcctgt

SEQ ID NO: 872406 - DNA, 22 bp, Artificial Sequence
  chemically synthesized
cataaggccactcatcatcctg

SEQ ID NO: 872407 - DNA, 22 bp, Artificial Sequence
  chemically synthesized
atctagcctacaggatgatgag

SEQ ID NO: 872408 - DNA, 22 bp, Artificial Sequence
  chemically synthesized
ttcataaggccactcatcatcc

SEQ ID NO: 872409 - DNA, 22 bp, Artificial Sequence
  chemically synthesized
attcttcataaggccactcatc

SEQ ID NO: 872410 - DNA, 22 bp, Artificial Sequence
  chemically synthesized
gcctacaggatgatgagtggcc

SEQ ID NO: 872411 - DNA, 22 bp, Artificial Sequence
  chemically synthesized
gattcttcataaggccactcat

SEQ ID NO: 872412 - DNA, 22 bp, Artificial Sequence
  chemically synthesized
caggatgatgagtggccttatg

SEQ ID NO: 872413 - DNA, 22 bp, Artificial Sequence
  chemically synthesized
cagaaccttgattcttcataag

SEQ ID NO: 872414 - DNA, 22 bp, Artificial Sequence
  chemically synthesized
gttgcagaaccttgattcttca

SEQ ID NO: 872415 - DNA, 22 bp, Artificial Sequence
  chemically synthesized
ttggttgcagaaccttgattct

SEQ ID NO: 872416 - DNA, 22 bp, Artificial Sequence
  chemically synthesized
gctgttggttgcagaaccttga

SEQ ID NO: 872417 - DNA, 22 bp, Artificial Sequence
  chemically synthesized
atgaagaatcaaggttctgcaa

SEQ ID NO: 872418 - DNA, 22 bp, Artificial Sequence
  chemically synthesized
tgaagaatcaaggttctgcaac

SEQ ID NO: 872419 - DNA, 22 bp, Artificial Sequence
  chemically synthesized
acagctggctgttggttgcaga

SEQ ID NO: 872420 - DNA, 22 bp, Artificial Sequence
  chemically synthesized
agatatctgacagctggctgtt

SEQ ID NO: 872421 - DNA, 22 bp, Artificial Sequence
  chemically synthesized
tcagatatctgacagctggctg

SEQ ID NO: 872422 - DNA, 22 bp, Artificial Sequence
  chemically synthesized
tctcagatatctgacagctggc

SEQ ID NO: 872423 - DNA, 22 bp, Artificial Sequence
  chemically synthesized
tgcaaccaacagccagctgtca

SEQ ID NO: 872424 - DNA, 22 bp, Artificial Sequence
  chemically synthesized
caaccaacagccagctgtcaga

SEQ ID NO: 872425 - DNA, 22 bp, Artificial Sequence
  chemically synthesized
aaatgcactctctcagatatct

SEQ ID NO: 872426 - DNA, 22 bp, Artificial Sequence
  chemically synthesized
gatggtctaaaatgcactctct

SEQ ID NO: 872427 - DNA, 22 bp, Artificial Sequence
  chemically synthesized
tcagatatctgagagagtgcat

SEQ ID NO: 872428 - DNA, 22 bp, Artificial Sequence
  chemically synthesized
agagagtgcattttagaccatc

SEQ ID NO: 872429 - DNA, 22 bp, Artificial Sequence
  chemically synthesized
gcaagtgaacaggagctagatg

SEQ ID NO: 872430 - DNA, 22 bp, Artificial Sequence
  chemically synthesized
tctagcaagtgaacaggagcta

SEQ ID NO: 872431 - DNA, 22 bp, Artificial Sequence
  chemically synthesized
tagaccatctagctcctgttca

SEQ ID NO: 872432 - DNA, 22 bp, Artificial Sequence
  chemically synthesized
agaccatctagctcctgttcac

SEQ ID NO: 872433 - DNA, 22 bp, Artificial Sequence
  chemically synthesized
gaccatctagctcctgttcact

SEQ ID NO: 872434 - DNA, 22 bp, Artificial Sequence
  chemically synthesized
gctcctgttcacttgctagata

SEQ ID NO: 872435 - DNA, 22 bp, Artificial Sequence
  chemically synthesized
tgtggatgcagttatctagcaa

SEQ ID NO: 872436 - DNA, 22 bp, Artificial Sequence
  chemically synthesized
atgtggatgcagttatctagca

SEQ ID NO: 872437 - DNA, 22 bp, Artificial Sequence
  chemically synthesized
ctgttcacttgctagataactg

SEQ ID NO: 872438 - DNA, 22 bp, Artificial Sequence
  chemically synthesized
cttatgtggatgcagttatcta

SEQ ID NO: 872439 - DNA, 22 bp, Artificial Sequence
  chemically synthesized
ttcacttgctagataactgcat

SEQ ID NO: 872440 - DNA, 22 bp, Artificial Sequence
  chemically synthesized
acttgctagataactgcatcca

SEQ ID NO: 872441 - DNA, 22 bp, Artificial Sequence
  chemically synthesized
gtgttacttatgtggatgcagt

SEQ ID NO: 872442 - DNA, 22 bp, Artificial Sequence
  chemically synthesized
ggtgttacttatgtggatgcag

SEQ ID NO: 872443 - DNA, 22 bp, Artificial Sequence
  chemically synthesized
gctagataactgcatccacata

SEQ ID NO: 872444 - DNA, 22 bp, Artificial Sequence
  chemically synthesized
cttggtgttacttatgtggatg

SEQ ID NO: 872445 - DNA, 22 bp, Artificial Sequence
  chemically synthesized
ctagataactgcatccacataa

SEQ ID NO: 872446 - DNA, 22 bp, Artificial Sequence
  chemically synthesized
gcttggtgttacttatgtggat

SEQ ID NO: 872447 - DNA, 22 bp, Artificial Sequence
  chemically synthesized
gataactgcatccacataagta

SEQ ID NO: 872448 - DNA, 22 bp, Artificial Sequence
  chemically synthesized
atggtcttgcttggtgttactt

SEQ ID NO: 872449 - DNA, 22 bp, Artificial Sequence
  chemically synthesized
tgatggtcttgcttggtgttac

SEQ ID NO: 872450 - DNA, 22 bp, Artificial Sequence
  chemically synthesized
catccacataagtaacaccaag

SEQ ID NO: 872451 - DNA, 22 bp, Artificial Sequence
  chemically synthesized
ttctgatggtcttgcttggtgt

SEQ ID NO: 872452 - DNA, 22 bp, Artificial Sequence
  chemically synthesized
gatagttattctgatggtcttg

SEQ ID NO: 872453 - DNA, 22 bp, Artificial Sequence
  chemically synthesized
gctggatagttattctgatggt

SEQ ID NO: 872454 - DNA, 22 bp, Artificial Sequence
  chemically synthesized
tgattagctggatagttattct

SEQ ID NO: 872455 - DNA, 22 bp, Artificial Sequence
  chemically synthesized
tgtgattagctggatagttatt

SEQ ID NO: 872456 - DNA, 22 bp, Artificial Sequence
  chemically synthesized
ctctgtgattagctggatagtt

SEQ ID NO: 872457 - DNA, 22 bp, Artificial Sequence
  chemically synthesized
gctctgtgattagctggatagt

SEQ ID NO: 872458 - DNA, 22 bp, Artificial Sequence
  chemically synthesized
aagtttgctctgtgattagctg

SEQ ID NO: 872459 - DNA, 22 bp, Artificial Sequence
  chemically synthesized
tgtgtctgaagtttgctctgtg

SEQ ID NO: 872460 - DNA, 22 bp, Artificial Sequence
  chemically synthesized
tccagctaatcacagagcaaac

SEQ ID NO: 872461 - DNA, 22 bp, Artificial Sequence
  chemically synthesized
tgtgtgtctgaagtttgctctg

SEQ ID NO: 872462 - DNA, 22 bp, Artificial Sequence
  chemically synthesized
ataattctgtgtgtctgaagtt

SEQ ID NO: 872463 - DNA, 22 bp, Artificial Sequence
  chemically synthesized
atcacagagcaaacttcagaca

SEQ ID NO: 872464 - DNA, 22 bp, Artificial Sequence
  chemically synthesized
ctcataattctgtgtgtctgaa

SEQ ID NO: 872465 - DNA, 22 bp, Artificial Sequence
  chemically synthesized
ttgctcataattctgtgtgtct

SEQ ID NO: 872466 - DNA, 22 bp, Artificial Sequence
  chemically synthesized
attgctcataattctgtgtgtc

SEQ ID NO: 872467 - DNA, 22 bp, Artificial Sequence
  chemically synthesized
cagacacacagaattatgagca

SEQ ID NO: 872468 - DNA, 22 bp, Artificial Sequence
  chemically synthesized
agacacacagaattatgagcaa

SEQ ID NO: 872469 - DNA, 22 bp, Artificial Sequence
  chemically synthesized
aaaacgagtgatttattgctca

SEQ ID NO: 872470 - DNA, 22 bp, Artificial Sequence
  chemically synthesized
acagttcaaaacgagtgattta

SEQ ID NO: 872471 - DNA, 22 bp, Artificial Sequence
  chemically synthesized
aacagttcaaaacgagtgattt

SEQ ID NO: 872472 - DNA, 22 bp, Artificial Sequence
  chemically synthesized
tgagcaataaatcactcgtttt

SEQ ID NO: 872473 - DNA, 22 bp, Artificial Sequence
  chemically synthesized
gttttgaactgttaagttttgg

SEQ ID NO: 872474 - DNA, 22 bp, Artificial Sequence
  chemically synthesized
catagaagcaccccaaaactta

SEQ ID NO: 872475 - DNA, 22 bp, Artificial Sequence
  chemically synthesized
ttgcatagaagcaccccaaaac

SEQ ID NO: 872476 - DNA, 22 bp, Artificial Sequence
  chemically synthesized
tgaactgttaagttttggggtg

SEQ ID NO: 872477 - DNA, 22 bp, Artificial Sequence
  chemically synthesized
gaactgttaagttttggggtgc

SEQ ID NO: 872478 - DNA, 22 bp, Artificial Sequence
  chemically synthesized
aactgttaagttttggggtgct

SEQ ID NO: 872479 - DNA, 22 bp, Artificial Sequence
  chemically synthesized
ttgttgcatagaagcaccccaa

SEQ ID NO: 872480 - DNA, 22 bp, Artificial Sequence
  chemically synthesized
tattgttgcatagaagcacccc

SEQ ID NO: 872481 - DNA, 22 bp, Artificial Sequence
  chemically synthesized
ctattgttgcatagaagcaccc

SEQ ID NO: 872482 - DNA, 22 bp, Artificial Sequence
  chemically synthesized
ttaagttttggggtgcttctat

SEQ ID NO: 872483 - DNA, 22 bp, Artificial Sequence
  chemically synthesized
agttttggggtgcttctatgca

SEQ ID NO: 872484 - DNA, 22 bp, Artificial Sequence
  chemically synthesized
tggggtgcttctatgcaacaat

SEQ ID NO: 872485 - DNA, 22 bp, Artificial Sequence
  chemically synthesized
ggggtgcttctatgcaacaata

SEQ ID NO: 872486 - DNA, 22 bp, Artificial Sequence
  chemically synthesized
gggtgcttctatgcaacaatag

SEQ ID NO: 872487 - DNA, 22 bp, Artificial Sequence
  chemically synthesized
tccatatcagtttctattgttg

SEQ ID NO: 872488 - DNA, 22 bp, Artificial Sequence
  chemically synthesized
ctatgcaacaatagaaactgat

SEQ ID NO: 872489 - DNA, 22 bp, Artificial Sequence
  chemically synthesized
tatgcaacaatagaaactgata

SEQ ID NO: 872490 - DNA, 22 bp, Artificial Sequence
  chemically synthesized
gacacctgtccatatcagtttc

SEQ ID NO: 872491 - DNA, 22 bp, Artificial Sequence
  chemically synthesized
agacacctgtccatatcagttt

SEQ ID NO: 872492 - DNA, 22 bp, Artificial Sequence
  chemically synthesized
tgcaacaatagaaactgatatg

SEQ ID NO: 872493 - DNA, 22 bp, Artificial Sequence
  chemically synthesized
cttagacacctgtccatatcag

SEQ ID NO: 872494 - DNA, 22 bp, Artificial Sequence
  chemically synthesized
ttgcttagacacctgtccatat

SEQ ID NO: 872495 - DNA, 22 bp, Artificial Sequence
  chemically synthesized
ttgttgcttagacacctgtcca

SEQ ID NO: 872496 - DNA, 22 bp, Artificial Sequence
  chemically synthesized
caattgttgttgcttagacacc

SEQ ID NO: 872497 - DNA, 22 bp, Artificial Sequence
  chemically synthesized
gcaattgttgttgcttagacac

SEQ ID NO: 872498 - DNA, 22 bp, Artificial Sequence
  chemically synthesized
atatggacaggtgtctaagcaa

SEQ ID NO: 872499 - DNA, 22 bp, Artificial Sequence
  chemically synthesized
agcaacaacaattgcaagtttt

SEQ ID NO: 872500 - DNA, 22 bp, Artificial Sequence
  chemically synthesized
gaaaaaaaaagcaaaacttgca

SEQ ID NO: 872501 - DNA, 22 bp, Artificial Sequence
  chemically synthesized
caagttttgctttttttttcca

SEQ ID NO: 872502 - DNA, 22 bp, Artificial Sequence
  chemically synthesized
tgctttttttttccagtatgtt

SEQ ID NO: 872503 - DNA, 22 bp, Artificial Sequence
  chemically synthesized
tcaggacaaatcaacatactgg

SEQ ID NO: 872504 - DNA, 22 bp, Artificial Sequence
  chemically synthesized
gctttttttttccagtatgttg

SEQ ID NO: 872505 - DNA, 22 bp, Artificial Sequence
  chemically synthesized
ctttttttttccagtatgttga

SEQ ID NO: 872506 - DNA, 22 bp, Artificial Sequence
  chemically synthesized
attatcaggacaaatcaacata

SEQ ID NO: 872507 - DNA, 22 bp, Artificial Sequence
  chemically synthesized
tttttttccagtatgttgattt

SEQ ID NO: 872508 - DNA, 22 bp, Artificial Sequence
  chemically synthesized
aattatcaggacaaatcaacat

SEQ ID NO: 872509 - DNA, 22 bp, Artificial Sequence
  chemically synthesized
ttttttccagtatgttgatttg

SEQ ID NO: 872510 - DNA, 22 bp, Artificial Sequence
  chemically synthesized
taattatcaggacaaatcaaca

SEQ ID NO: 872511 - DNA, 22 bp, Artificial Sequence
  chemically synthesized
tttttccagtatgttgatttgt

SEQ ID NO: 872512 - DNA, 22 bp, Artificial Sequence
  chemically synthesized
ttttccagtatgttgatttgtc

SEQ ID NO: 872513 - DNA, 22 bp, Artificial Sequence
  chemically synthesized
tttccagtatgttgatttgtcc

SEQ ID NO: 872514 - DNA, 22 bp, Artificial Sequence
  chemically synthesized
ttttaattatcaggacaaatca

SEQ ID NO: 872515 - DNA, 22 bp, Artificial Sequence
  chemically synthesized
ttccagtatgttgatttgtcct

SEQ ID NO: 872516 - DNA, 22 bp, Artificial Sequence
  chemically synthesized
tccagtatgttgatttgtcctg

SEQ ID NO: 872517 - DNA, 22 bp, Artificial Sequence
  chemically synthesized
ccagtatgttgatttgtcctga

SEQ ID NO: 872518 - DNA, 22 bp, Artificial Sequence
  chemically synthesized
cagtatgttgatttgtcctgat

SEQ ID NO: 872519 - DNA, 22 bp, Artificial Sequence
  chemically synthesized
tataaattgttttaattatcag

SEQ ID NO: 872520 - DNA, 22 bp, Artificial Sequence
  chemically synthesized
atttgtcctgataattaaaaca

SEQ ID NO: 872521 - DNA, 22 bp, Artificial Sequence
  chemically synthesized
agctgtataaattgttttaatt

SEQ ID NO: 872522 - DNA, 22 bp, Artificial Sequence
  chemically synthesized
gtcctgataattaaaacaattt

SEQ ID NO: 872523 - DNA, 22 bp, Artificial Sequence
  chemically synthesized
cctgagctgtataaattgtttt

SEQ ID NO: 872524 - DNA, 22 bp, Artificial Sequence
  chemically synthesized
tcctgataattaaaacaattta

SEQ ID NO: 872525 - DNA, 22 bp, Artificial Sequence
  chemically synthesized
gcctgagctgtataaattgttt

SEQ ID NO: 872526 - DNA, 22 bp, Artificial Sequence
  chemically synthesized
ataattaaaacaatttatacag

SEQ ID NO: 872527 - DNA, 22 bp, Artificial Sequence
  chemically synthesized
aaacaatttatacagctcaggc

SEQ ID NO: 872528 - DNA, 22 bp, Artificial Sequence
  chemically synthesized
taatggggtggccttgcctgag

SEQ ID NO: 872529 - DNA, 22 bp, Artificial Sequence
  chemically synthesized
atacagctcaggcaaggccacc

SEQ ID NO: 872530 - DNA, 22 bp, Artificial Sequence
  chemically synthesized
tacagctcaggcaaggccaccc

SEQ ID NO: 872531 - DNA, 22 bp, Artificial Sequence
  chemically synthesized
taaattataatggggtggcctt

SEQ ID NO: 872532 - DNA, 22 bp, Artificial Sequence
  chemically synthesized
aattataaattataatggggtg

SEQ ID NO: 872533 - DNA, 22 bp, Artificial Sequence
  chemically synthesized
aaattataaattataatggggt

SEQ ID NO: 872534 - DNA, 22 bp, Artificial Sequence
  chemically synthesized
aggcaaggccaccccattataa

SEQ ID NO: 872535 - DNA, 22 bp, Artificial Sequence
  chemically synthesized
cttaaattataaattataatgg

SEQ ID NO: 872536 - DNA, 22 bp, Artificial Sequence
  chemically synthesized
acttaaattataaattataatg

SEQ ID NO: 872537 - DNA, 22 bp, Artificial Sequence
  chemically synthesized
cttacttaaattataaattata

SEQ ID NO: 872538 - DNA, 22 bp, Artificial Sequence
  chemically synthesized
tggctgcttacttaaattataa

SEQ ID NO: 872539 - DNA, 22 bp, Artificial Sequence
  chemically synthesized
gtggctgcttacttaaattata

SEQ ID NO: 872540 - DNA, 22 bp, Artificial Sequence
  chemically synthesized
ccttgtggctgcttacttaaat

SEQ ID NO: 872541 - DNA, 22 bp, Artificial Sequence
  chemically synthesized
taatttataatttaagtaagca

SEQ ID NO: 872542 - DNA, 22 bp, Artificial Sequence
  chemically synthesized
ataatttaagtaagcagccaca

SEQ ID NO: 872543 - DNA, 22 bp, Artificial Sequence
  chemically synthesized
taatttaagtaagcagccacaa

SEQ ID NO: 872544 - DNA, 22 bp, Artificial Sequence
  chemically synthesized
aaccaaactaccttgtggctgc

SEQ ID NO: 872545 - DNA, 22 bp, Artificial Sequence
  chemically synthesized
aagtaagcagccacaaggtagt

SEQ ID NO: 872546 - DNA, 22 bp, Artificial Sequence
  chemically synthesized
agtaagcagccacaaggtagtt

SEQ ID NO: 872547 - DNA, 22 bp, Artificial Sequence
  chemically synthesized
tgaacactaaaccaaactacct

SEQ ID NO: 872548 - DNA, 22 bp, Artificial Sequence
  chemically synthesized
atgaacactaaaccaaactacc

SEQ ID NO: 872549 - DNA, 22 bp, Artificial Sequence
  chemically synthesized
tatgaacactaaaccaaactac

SEQ ID NO: 872550 - DNA, 22 bp, Artificial Sequence
  chemically synthesized
ttttatgaacactaaaccaaac

SEQ ID NO: 872551 - DNA, 22 bp, Artificial Sequence
  chemically synthesized
gttttatgaacactaaaccaaa

SEQ ID NO: 872552 - DNA, 22 bp, Artificial Sequence
  chemically synthesized
tgttttatgaacactaaaccaa

SEQ ID NO: 872553 - DNA, 22 bp, Artificial Sequence
  chemically synthesized
ttttgttttatgaacactaaac

SEQ ID NO: 872554 - DNA, 22 bp, Artificial Sequence
  chemically synthesized
gttttgttttatgaacactaaa

SEQ ID NO: 872555 - DNA, 22 bp, Artificial Sequence
  chemically synthesized
cttgttttgttttatgaacact

SEQ ID NO: 872556 - DNA, 22 bp, Artificial Sequence
  chemically synthesized
aagttgcttgttttgttttatg

SEQ ID NO: 872557 - DNA, 22 bp, Artificial Sequence
  chemically synthesized
ggtttagtgttcataaaacaaa

SEQ ID NO: 872558 - DNA, 22 bp, Artificial Sequence
  chemically synthesized
gtttagtgttcataaaacaaaa

SEQ ID NO: 872559 - DNA, 22 bp, Artificial Sequence
  chemically synthesized
agtgttcataaaacaaaacaag

SEQ ID NO: 872560 - DNA, 22 bp, Artificial Sequence
  chemically synthesized
gtgttcataaaacaaaacaagc

SEQ ID NO: 872561 - DNA, 22 bp, Artificial Sequence
  chemically synthesized
aggcctaaagttgcttgttttg

SEQ ID NO: 872562 - DNA, 22 bp, Artificial Sequence
  chemically synthesized
ataaaacaaaacaagcaacttt

SEQ ID NO: 872563 - DNA, 22 bp, Artificial Sequence
  chemically synthesized
tagatgtagaagctgaggccta

SEQ ID NO: 872564 - DNA, 22 bp, Artificial Sequence
  chemically synthesized
atagatgtagaagctgaggcct

SEQ ID NO: 872565 - DNA, 22 bp, Artificial Sequence
  chemically synthesized
tatagatgtagaagctgaggcc

SEQ ID NO: 872566 - DNA, 22 bp, Artificial Sequence
  chemically synthesized
ttatagatgtagaagctgaggc

SEQ ID NO: 872567 - DNA, 22 bp, Artificial Sequence
  chemically synthesized
ttttatagatgtagaagctgag

SEQ ID NO: 872568 - DNA, 22 bp, Artificial Sequence
  chemically synthesized
cttttatagatgtagaagctga

SEQ ID NO: 872569 - DNA, 22 bp, Artificial Sequence
  chemically synthesized
ttcttttatagatgtagaagct

SEQ ID NO: 872570 - DNA, 22 bp, Artificial Sequence
  chemically synthesized
taggcctcagcttctacatcta

SEQ ID NO: 872571 - DNA, 22 bp, Artificial Sequence
  chemically synthesized
aggcctcagcttctacatctat

SEQ ID NO: 872572 - DNA, 22 bp, Artificial Sequence
  chemically synthesized
ggcctcagcttctacatctata

SEQ ID NO: 872573 - DNA, 22 bp, Artificial Sequence
  chemically synthesized
agtattcttcttttatagatgt

SEQ ID NO: 872574 - DNA, 22 bp, Artificial Sequence
  chemically synthesized
gttgagtattcttcttttatag

SEQ ID NO: 872575 - DNA, 22 bp, Artificial Sequence
  chemically synthesized
agcttctacatctataaaagaa

SEQ ID NO: 872576 - DNA, 22 bp, Artificial Sequence
  chemically synthesized
tctagttgagtattcttctttt

SEQ ID NO: 872577 - DNA, 22 bp, Artificial Sequence
  chemically synthesized
ctacatctataaaagaagaata

SEQ ID NO: 872578 - DNA, 22 bp, Artificial Sequence
  chemically synthesized
tacatctataaaagaagaatac

SEQ ID NO: 872579 - DNA, 22 bp, Artificial Sequence
  chemically synthesized
ttatctagttgagtattcttct

SEQ ID NO: 872580 - DNA, 22 bp, Artificial Sequence
  chemically synthesized
catctataaaagaagaatactc

SEQ ID NO: 872581 - DNA, 22 bp, Artificial Sequence
  chemically synthesized
caattattatctagttgagtat

SEQ ID NO: 872582 - DNA, 22 bp, Artificial Sequence
  chemically synthesized
taaaagaagaatactcaactag

SEQ ID NO: 872583 - DNA, 22 bp, Artificial Sequence
  chemically synthesized
ttgcaattattatctagttgag

SEQ ID NO: 872584 - DNA, 22 bp, Artificial Sequence
  chemically synthesized
gaataattattgcaattattat

SEQ ID NO: 872585 - DNA, 22 bp, Artificial Sequence
  chemically synthesized
ggaataattattgcaattatta

SEQ ID NO: 872586 - DNA, 22 bp, Artificial Sequence
  chemically synthesized
aactagataataattgcaataa

SEQ ID NO: 872587 - DNA, 22 bp, Artificial Sequence
  chemically synthesized
gataataattgcaataattatt

SEQ ID NO: 872588 - DNA, 22 bp, Artificial Sequence
  chemically synthesized
caataattattccaagtttgga

SEQ ID NO: 872589 - DNA, 22 bp, Artificial Sequence
  chemically synthesized
gaaccatagaaatccaaacttg

SEQ ID NO: 872590 - DNA, 22 bp, Artificial Sequence
  chemically synthesized
agaaccatagaaatccaaactt

SEQ ID NO: 872591 - DNA, 22 bp, Artificial Sequence
  chemically synthesized
ttagaaccatagaaatccaaac

SEQ ID NO: 872592 - DNA, 22 bp, Artificial Sequence
  chemically synthesized
cttagaaccatagaaatccaaa

SEQ ID NO: 872593 - DNA, 22 bp, Artificial Sequence
  chemically synthesized
ttccaagtttggatttctatgg

SEQ ID NO: 872594 - DNA, 22 bp, Artificial Sequence
  chemically synthesized
aatttcttagaaccatagaaat

SEQ ID NO: 872595 - DNA, 22 bp, Artificial Sequence
  chemically synthesized
gaatttcttagaaccatagaaa

SEQ ID NO: 872596 - DNA, 22 bp, Artificial Sequence
  chemically synthesized
caagtttggatttctatggttc

SEQ ID NO: 872597 - DNA, 22 bp, Artificial Sequence
  chemically synthesized
tttgaatttcttagaaccatag

SEQ ID NO: 872598 - DNA, 22 bp, Artificial Sequence
  chemically synthesized
tatttgaatttcttagaaccat

SEQ ID NO: 872599 - DNA, 22 bp, Artificial Sequence
  chemically synthesized
ggatttctatggttctaagaaa

SEQ ID NO: 872600 - DNA, 22 bp, Artificial Sequence
  chemically synthesized
actctatttgaatttcttagaa

SEQ ID NO: 872601 - DNA, 22 bp, Artificial Sequence
  chemically synthesized
gatttctatggttctaagaaat

SEQ ID NO: 872602 - DNA, 22 bp, Artificial Sequence
  chemically synthesized
gttcactctatttgaatttctt

SEQ ID NO: 872603 - DNA, 22 bp, Artificial Sequence
  chemically synthesized
ctatggttctaagaaattcaaa

SEQ ID NO: 872604 - DNA, 22 bp, Artificial Sequence
  chemically synthesized
tatggttctaagaaattcaaat

SEQ ID NO: 872605 - DNA, 22 bp, Artificial Sequence
  chemically synthesized
tggttctaagaaattcaaatag

SEQ ID NO: 872606 - DNA, 22 bp, Artificial Sequence
  chemically synthesized
taagaaattcaaatagagtgaa

SEQ ID NO: 872607 - DNA, 22 bp, Artificial Sequence
  chemically synthesized
agaaattcaaatagagtgaacc

SEQ ID NO: 872608 - DNA, 22 bp, Artificial Sequence
  chemically synthesized
agaagtagaaaaaattggttca

SEQ ID NO: 872609 - DNA, 22 bp, Artificial Sequence
  chemically synthesized
aagaagtagaaaaaattggttc

SEQ ID NO: 872610 - DNA, 22 bp, Artificial Sequence
  chemically synthesized
aaatagagtgaaccaatttttt

SEQ ID NO: 872611 - DNA, 22 bp, Artificial Sequence
  chemically synthesized
cttaagaagtagaaaaaattgg

SEQ ID NO: 872612 - DNA, 22 bp, Artificial Sequence
  chemically synthesized
tacttaagaagtagaaaaaatt

SEQ ID NO: 872613 - DNA, 22 bp, Artificial Sequence
  chemically synthesized
ctacttaagaagtagaaaaaat

SEQ ID NO: 872614 - DNA, 22 bp, Artificial Sequence
  chemically synthesized
tctacttaagaagtagaaaaaa

SEQ ID NO: 872615 - DNA, 22 bp, Artificial Sequence
  chemically synthesized
ttctacttaagaagtagaaaaa

SEQ ID NO: 872616 - DNA, 22 bp, Artificial Sequence
  chemically synthesized
tttctacttaagaagtagaaaa

SEQ ID NO: 872617 - DNA, 22 bp, Artificial Sequence
  chemically synthesized
tgttttttctacttaagaagta

SEQ ID NO: 872618 - DNA, 22 bp, Artificial Sequence
  chemically synthesized
tgtgttttttctacttaagaag

SEQ ID NO: 872619 - DNA, 22 bp, Artificial Sequence
  chemically synthesized
ctgtgttttttctacttaagaa

SEQ ID NO: 872620 - DNA, 22 bp, Artificial Sequence
  chemically synthesized
tttctgtgttttttctacttaa

SEQ ID NO: 872621 - DNA, 22 bp, Artificial Sequence
  chemically synthesized
tttctacttcttaagtagaaaa

SEQ ID NO: 872622 - DNA, 22 bp, Artificial Sequence
  chemically synthesized
ttctacttcttaagtagaaaaa

SEQ ID NO: 872623 - DNA, 22 bp, Artificial Sequence
  chemically synthesized
tctacttcttaagtagaaaaaa

SEQ ID NO: 872624 - DNA, 22 bp, Artificial Sequence
  chemically synthesized
ctacttcttaagtagaaaaaac

SEQ ID NO: 872625 - DNA, 22 bp, Artificial Sequence
  chemically synthesized
gcctgtttctgtgttttttcta

SEQ ID NO: 872626 - DNA, 22 bp, Artificial Sequence
  chemically synthesized
tacttcttaagtagaaaaaaca

SEQ ID NO: 872627 - DNA, 22 bp, Artificial Sequence
  chemically synthesized
cttcttaagtagaaaaaacaca

SEQ ID NO: 872628 - DNA, 22 bp, Artificial Sequence
  chemically synthesized
actggcctgtttctgtgttttt

SEQ ID NO: 872629 - DNA, 22 bp, Artificial Sequence
  chemically synthesized
gactggcctgtttctgtgtttt

SEQ ID NO: 872630 - DNA, 22 bp, Artificial Sequence
  chemically synthesized
cttaagtagaaaaaacacagaa

SEQ ID NO: 872631 - DNA, 22 bp, Artificial Sequence
  chemically synthesized
ttaagtagaaaaaacacagaaa

SEQ ID NO: 872632 - DNA, 22 bp, Artificial Sequence
  chemically synthesized
aagtagaaaaaacacagaaaca

SEQ ID NO: 872633 - DNA, 22 bp, Artificial Sequence
  chemically synthesized
agtagaaaaaacacagaaacag

SEQ ID NO: 872634 - DNA, 22 bp, Artificial Sequence
  chemically synthesized
caggcatgagccaccttgactg

SEQ ID NO: 872635 - DNA, 22 bp, Artificial Sequence
  chemically synthesized
ggattacaggcatgagccacct

SEQ ID NO: 872636 - DNA, 22 bp, Artificial Sequence
  chemically synthesized
aaagtgctgggattacaggcat

SEQ ID NO: 872637 - DNA, 22 bp, Artificial Sequence
  chemically synthesized
tcaaagtgctgggattacaggc

SEQ ID NO: 872638 - DNA, 22 bp, Artificial Sequence
  chemically synthesized
agcctctcaaagtgctgggatt

SEQ ID NO: 872639 - DNA, 22 bp, Artificial Sequence
  chemically synthesized
atgcctgtaatcccagcacttt

SEQ ID NO: 872640 - DNA, 22 bp, Artificial Sequence
  chemically synthesized
cctcagcctctcaaagtgctgg

SEQ ID NO: 872641 - DNA, 22 bp, Artificial Sequence
  chemically synthesized
taatcccagcactttgagaggc

SEQ ID NO: 872642 - DNA, 22 bp, Artificial Sequence
  chemically synthesized
aagtgatccgcctgcctcagcc

SEQ ID NO: 872643 - DNA, 22 bp, Artificial Sequence
  chemically synthesized
acctcaagtgatccgcctgcct

SEQ ID NO: 872644 - DNA, 22 bp, Artificial Sequence
  chemically synthesized
tgagaggctgaggcaggcggat

SEQ ID NO: 872645 - DNA, 22 bp, Artificial Sequence
  chemically synthesized
gagaggctgaggcaggcggatc

SEQ ID NO: 872646 - DNA, 22 bp, Artificial Sequence
  chemically synthesized
ctgacctcaagtgatccgcctg

SEQ ID NO: 872647 - DNA, 22 bp, Artificial Sequence
  chemically synthesized
agaggctgaggcaggcggatca

SEQ ID NO: 872648 - DNA, 22 bp, Artificial Sequence
  chemically synthesized
aactcctgacctcaagtgatcc

SEQ ID NO: 872649 - DNA, 22 bp, Artificial Sequence
  chemically synthesized
aaactcctgacctcaagtgatc

SEQ ID NO: 872650 - DNA, 22 bp, Artificial Sequence
  chemically synthesized
aggcaggcggatcacttgaggt

SEQ ID NO: 872651 - DNA, 22 bp, Artificial Sequence
  chemically synthesized
gtcttaaactcctgacctcaag

SEQ ID NO: 872652 - DNA, 22 bp, Artificial Sequence
  chemically synthesized
atcaggctggtcttaaactcct

SEQ ID NO: 872653 - DNA, 22 bp, Artificial Sequence
  chemically synthesized
gaggtcaggagtttaagaccag

SEQ ID NO: 872654 - DNA, 22 bp, Artificial Sequence
  chemically synthesized
aggtcaggagtttaagaccagc

SEQ ID NO: 872655 - DNA, 22 bp, Artificial Sequence
  chemically synthesized
catgttgatcaggctggtctta

SEQ ID NO: 872656 - DNA, 22 bp, Artificial Sequence
  chemically synthesized
ctccatgttgatcaggctggtc

SEQ ID NO: 872657 - DNA, 22 bp, Artificial Sequence
  chemically synthesized
aagaccagcctgatcaacatgg

SEQ ID NO: 872658 - DNA, 22 bp, Artificial Sequence
  chemically synthesized
agaccagcctgatcaacatgga

SEQ ID NO: 872659 - DNA, 22 bp, Artificial Sequence
  chemically synthesized
gtaaagacggggttgctccatg

SEQ ID NO: 872660 - DNA, 22 bp, Artificial Sequence
  chemically synthesized
agtaaagacggggttgctccat

SEQ ID NO: 872661 - DNA, 22 bp, Artificial Sequence
  chemically synthesized
tagtaaagacggggttgctcca

SEQ ID NO: 872662 - DNA, 22 bp, Artificial Sequence
  chemically synthesized
atcaacatggagcaaccccgtc

SEQ ID NO: 872663 - DNA, 22 bp, Artificial Sequence
  chemically synthesized
tagttttagtaaagacggggtt

SEQ ID NO: 872664 - DNA, 22 bp, Artificial Sequence
  chemically synthesized
gtagttttagtaaagacggggt

SEQ ID NO: 872665 - DNA, 22 bp, Artificial Sequence
  chemically synthesized
tgtagttttagtaaagacgggg

SEQ ID NO: 872666 - DNA, 22 bp, Artificial Sequence
  chemically synthesized
ttgtagttttagtaaagacggg

SEQ ID NO: 872667 - DNA, 22 bp, Artificial Sequence
  chemically synthesized
atttttgtagttttagtaaaga

SEQ ID NO: 872668 - DNA, 22 bp, Artificial Sequence
  chemically synthesized
tactaaaactacaaaaattagc

SEQ ID NO: 872669 - DNA, 22 bp, Artificial Sequence
  chemically synthesized
actaaaactacaaaaattagct

SEQ ID NO: 872670 - DNA, 22 bp, Artificial Sequence
  chemically synthesized
ctaaaactacaaaaattagctg

SEQ ID NO: 872671 - DNA, 22 bp, Artificial Sequence
  chemically synthesized
aaactacaaaaattagctgggc

SEQ ID NO: 872672 - DNA, 22 bp, Artificial Sequence
  chemically synthesized
caaaaattagctgggcatggtg

SEQ ID NO: 872673 - DNA, 22 bp, Artificial Sequence
  chemically synthesized
ggatacaggtgcgcaccaccat

SEQ ID NO: 872674 - DNA, 22 bp, Artificial Sequence
  chemically synthesized
gctgggcatggtggtgcgcacc

SEQ ID NO: 872675 - DNA, 22 bp, Artificial Sequence
  chemically synthesized
ggcatggtggtgcgcacctgta

SEQ ID NO: 872676 - DNA, 22 bp, Artificial Sequence
  chemically synthesized
ccaagtagctgggatacaggtg

SEQ ID NO: 872677 - DNA, 22 bp, Artificial Sequence
  chemically synthesized
agcctcccaagtagctgggata

SEQ ID NO: 872678 - DNA, 22 bp, Artificial Sequence
  chemically synthesized
cctcagcctcccaagtagctgg

SEQ ID NO: 872679 - DNA, 22 bp, Artificial Sequence
  chemically synthesized
ctgcctcagcctcccaagtagc

SEQ ID NO: 872680 - DNA, 22 bp, Artificial Sequence
  chemically synthesized
tcctgcctcagcctcccaagta

SEQ ID NO: 872681 - DNA, 22 bp, Artificial Sequence
  chemically synthesized
tatcccagctacttgggaggct

SEQ ID NO: 872682 - DNA, 22 bp, Artificial Sequence
  chemically synthesized
aagcgattctcctgcctcagcc

SEQ ID NO: 872683 - DNA, 22 bp, Artificial Sequence
  chemically synthesized
cttgggaggctgaggcaggaga

SEQ ID NO: 872684 - DNA, 22 bp, Artificial Sequence
  chemically synthesized
aggttcaagcgattctcctgcc

SEQ ID NO: 872685 - DNA, 22 bp, Artificial Sequence
  chemically synthesized
caggttcaagcgattctcctgc

SEQ ID NO: 872686 - DNA, 22 bp, Artificial Sequence
  chemically synthesized
gggaggctgaggcaggagaatc

SEQ ID NO: 872687 - DNA, 22 bp, Artificial Sequence
  chemically synthesized
tcaggttcaagcgattctcctg

SEQ ID NO: 872688 - DNA, 22 bp, Artificial Sequence
  chemically synthesized
ggaggctgaggcaggagaatcg

SEQ ID NO: 872689 - DNA, 22 bp, Artificial Sequence
  chemically synthesized
cctttcaggttcaagcgattct

SEQ ID NO: 872690 - DNA, 22 bp, Artificial Sequence
  chemically synthesized
tgcctttcaggttcaagcgatt

SEQ ID NO: 872691 - DNA, 22 bp, Artificial Sequence
  chemically synthesized
aggcaggagaatcgcttgaacc

SEQ ID NO: 872692 - DNA, 22 bp, Artificial Sequence
  chemically synthesized
caacctctgcctttcaggttca

SEQ ID NO: 872693 - DNA, 22 bp, Artificial Sequence
  chemically synthesized
ctacaacctctgcctttcaggt

SEQ ID NO: 872694 - DNA, 22 bp, Artificial Sequence
  chemically synthesized
actacaacctctgcctttcagg

SEQ ID NO: 872695 - DNA, 22 bp, Artificial Sequence
  chemically synthesized
ggtttactacaacctctgcctt

SEQ ID NO: 872696 - DNA, 22 bp, Artificial Sequence
  chemically synthesized
gaacctgaaaggcagaggttgt

SEQ ID NO: 872697 - DNA, 22 bp, Artificial Sequence
  chemically synthesized
aacctgaaaggcagaggttgta

SEQ ID NO: 872698 - DNA, 22 bp, Artificial Sequence
  chemically synthesized
aaaggcagaggttgtagtaaac

SEQ ID NO: 872699 - DNA, 22 bp, Artificial Sequence
  chemically synthesized
gagtgcagtggtgcgatctcgg

SEQ ID NO: 872700 - DNA, 22 bp, Artificial Sequence
  chemically synthesized
tagtaaaccgagatcgcaccac

SEQ ID NO: 872701 - DNA, 22 bp, Artificial Sequence
  chemically synthesized
cccaggctggagtgcagtggtg

SEQ ID NO: 872702 - DNA, 22 bp, Artificial Sequence
  chemically synthesized
ttgcccaggctggagtgcagtg

SEQ ID NO: 872703 - DNA, 22 bp, Artificial Sequence
  chemically synthesized
tgttgcccaggctggagtgcag

SEQ ID NO: 872704 - DNA, 22 bp, Artificial Sequence
  chemically synthesized
ctctgttgcccaggctggagtg

SEQ ID NO: 872705 - DNA, 22 bp, Artificial Sequence
  chemically synthesized
gctctgttgcccaggctggagt

SEQ ID NO: 872706 - DNA, 22 bp, Artificial Sequence
  chemically synthesized
cactccagcctgggcaacagag

SEQ ID NO: 872707 - DNA, 22 bp, Artificial Sequence
  chemically synthesized
cagcctgggcaacagagcaaga

SEQ ID NO: 872708 - DNA, 22 bp, Artificial Sequence
  chemically synthesized
ggcaacagagcaagattctgtc

SEQ ID NO: 872709 - DNA, 22 bp, Artificial Sequence
  chemically synthesized
tgtgtgtgtgtgtgtgtgtgtg

SEQ ID NO: 872710 - DNA, 22 bp, Artificial Sequence
  chemically synthesized
gtgtgtgtgtgtgtgtgtgtgt

SEQ ID NO: 872711 - DNA, 22 bp, Artificial Sequence
  chemically synthesized
tgtgtgtgtgtgtgtgtgtgtg

SEQ ID NO: 872712 - DNA, 22 bp, Artificial Sequence
  chemically synthesized
tttgtgtgtgtgtgtgtgtgtg

SEQ ID NO: 872713 - DNA, 22 bp, Artificial Sequence
  chemically synthesized
tgtcacacacacacacacacac

SEQ ID NO: 872714 - DNA, 22 bp, Artificial Sequence
  chemically synthesized
ctttgtgtgtgtgtgtgtgtgt

SEQ ID NO: 872715 - DNA, 22 bp, Artificial Sequence
  chemically synthesized
tctttgtgtgtgtgtgtgtgtg

SEQ ID NO: 872716 - DNA, 22 bp, Artificial Sequence
  chemically synthesized
tcacacacacacacacacacac

SEQ ID NO: 872717 - DNA, 22 bp, Artificial Sequence
  chemically synthesized
ttctttgtgtgtgtgtgtgtgt

SEQ ID NO: 872718 - DNA, 22 bp, Artificial Sequence
  chemically synthesized
tttctttgtgtgtgtgtgtgtg

SEQ ID NO: 872719 - DNA, 22 bp, Artificial Sequence
  chemically synthesized
ttttctttgtgtgtgtgtgtgt

SEQ ID NO: 872720 - DNA, 22 bp, Artificial Sequence
  chemically synthesized
ttttttctttgtgtgtgtgtgt

SEQ ID NO: 872721 - DNA, 22 bp, Artificial Sequence
  chemically synthesized
cttttttctttgtgtgtgtgtg

SEQ ID NO: 872722 - DNA, 22 bp, Artificial Sequence
  chemically synthesized
tcttttttctttgtgtgtgtgt

SEQ ID NO: 872723 - DNA, 22 bp, Artificial Sequence
  chemically synthesized
tttcttttttctttgtgtgtgt

SEQ ID NO: 872724 - DNA, 22 bp, Artificial Sequence
  chemically synthesized
ctttcttttttctttgtgtgtg

SEQ ID NO: 872725 - DNA, 22 bp, Artificial Sequence
  chemically synthesized
tctttcttttttctttgtgtgt

SEQ ID NO: 872726 - DNA, 22 bp, Artificial Sequence
  chemically synthesized
tttctttcttttttctttgtgt

SEQ ID NO: 872727 - DNA, 22 bp, Artificial Sequence
  chemically synthesized
ctttctttcttttttctttgtg

SEQ ID NO: 872728 - DNA, 22 bp, Artificial Sequence
  chemically synthesized
tctttctttcttttttctttgt

SEQ ID NO: 872729 - DNA, 22 bp, Artificial Sequence
  chemically synthesized
ttctttctttcttttttctttg

SEQ ID NO: 872730 - DNA, 22 bp, Artificial Sequence
  chemically synthesized
ttttctttctttcttttttctt

SEQ ID NO: 872731 - DNA, 22 bp, Artificial Sequence
  chemically synthesized
cttttctttctttcttttttct

SEQ ID NO: 872732 - DNA, 22 bp, Artificial Sequence
  chemically synthesized
tcttttctttctttcttttttc

SEQ ID NO: 872733 - DNA, 22 bp, Artificial Sequence
  chemically synthesized
ttcttttctttctttctttttt

SEQ ID NO: 872734 - DNA, 22 bp, Artificial Sequence
  chemically synthesized
tttcttttctttctttcttttt

SEQ ID NO: 872735 - DNA, 22 bp, Artificial Sequence
  chemically synthesized
cgtgttttttcttttctttctt

SEQ ID NO: 872736 - DNA, 22 bp, Artificial Sequence
  chemically synthesized
ccgtgttttttcttttctttct

SEQ ID NO: 872737 - DNA, 22 bp, Artificial Sequence
  chemically synthesized
gagtaaaagtgatacaagtttc

SEQ ID NO: 872738 - DNA, 22 bp, Artificial Sequence
  chemically synthesized
tctggagtaaaagtgatacaag

SEQ ID NO: 872739 - DNA, 22 bp, Artificial Sequence
  chemically synthesized
atctggagtaaaagtgatacaa

SEQ ID NO: 872740 - DNA, 22 bp, Artificial Sequence
  chemically synthesized
aatttatctggagtaaaagtga

SEQ ID NO: 872741 - DNA, 22 bp, Artificial Sequence
  chemically synthesized
aaatttatctggagtaaaagtg

SEQ ID NO: 872742 - DNA, 22 bp, Artificial Sequence
  chemically synthesized
aatcttaaatttatctggagta

SEQ ID NO: 872743 - DNA, 22 bp, Artificial Sequence
  chemically synthesized
gtatcacttttactccagataa

SEQ ID NO: 872744 - DNA, 22 bp, Artificial Sequence
  chemically synthesized
tatcacttttactccagataaa

SEQ ID NO: 872745 - DNA, 22 bp, Artificial Sequence
  chemically synthesized
actcaatcttaaatttatctgg

SEQ ID NO: 872746 - DNA, 22 bp, Artificial Sequence
  chemically synthesized
aactcaatcttaaatttatctg

SEQ ID NO: 872747 - DNA, 22 bp, Artificial Sequence
  chemically synthesized
ttactccagataaatttaagat

SEQ ID NO: 872748 - DNA, 22 bp, Artificial Sequence
  chemically synthesized
tactccagataaatttaagatt

SEQ ID NO: 872749 - DNA, 22 bp, Artificial Sequence
  chemically synthesized
actccagataaatttaagattg

SEQ ID NO: 872750 - DNA, 22 bp, Artificial Sequence
  chemically synthesized
ctccagataaatttaagattga

SEQ ID NO: 872751 - DNA, 22 bp, Artificial Sequence
  chemically synthesized
atataatttaactcaatcttaa

SEQ ID NO: 872752 - DNA, 22 bp, Artificial Sequence
  chemically synthesized
cagataaatttaagattgagtt

SEQ ID NO: 872753 - DNA, 22 bp, Artificial Sequence
  chemically synthesized
gccagcagttaatataatttaa

SEQ ID NO: 872754 - DNA, 22 bp, Artificial Sequence
  chemically synthesized
aagattgagttaaattatatta

SEQ ID NO: 872755 - DNA, 22 bp, Artificial Sequence
  chemically synthesized
agattgagttaaattatattaa

SEQ ID NO: 872756 - DNA, 22 bp, Artificial Sequence
  chemically synthesized
agttaaattatattaactgctg

SEQ ID NO: 872757 - DNA, 22 bp, Artificial Sequence
  chemically synthesized
aattatattaactgctggccag

SEQ ID NO: 872758 - DNA, 22 bp, Artificial Sequence
  chemically synthesized
cagatacagatgcagctggcca

SEQ ID NO: 872759 - DNA, 22 bp, Artificial Sequence
  chemically synthesized
tattaactgctggccagctgca

SEQ ID NO: 872760 - DNA, 22 bp, Artificial Sequence
  chemically synthesized
actgctggccagctgcatctgt

SEQ ID NO: 872761 - DNA, 22 bp, Artificial Sequence
  chemically synthesized
ctggccagctgcatctgtatct

SEQ ID NO: 872762 - DNA, 22 bp, Artificial Sequence
  chemically synthesized
atggaaaattacagatacagat

SEQ ID NO: 872763 - DNA, 22 bp, Artificial Sequence
  chemically synthesized
gccagctgcatctgtatctgta

SEQ ID NO: 872764 - DNA, 22 bp, Artificial Sequence
  chemically synthesized
catctgtatctgtaattttcca

SEQ ID NO: 872765 - DNA, 22 bp, Artificial Sequence
  chemically synthesized
tccaagaacctaatggaaaatt

SEQ ID NO: 872766 - DNA, 22 bp, Artificial Sequence
  chemically synthesized
tgtccaagaacctaatggaaaa

SEQ ID NO: 872767 - DNA, 22 bp, Artificial Sequence
  chemically synthesized
tctgtccaagaacctaatggaa

SEQ ID NO: 872768 - DNA, 22 bp, Artificial Sequence
  chemically synthesized
tatctgtaattttccattaggt

SEQ ID NO: 872769 - DNA, 22 bp, Artificial Sequence
  chemically synthesized
tctctctgtccaagaacctaat

SEQ ID NO: 872770 - DNA, 22 bp, Artificial Sequence
  chemically synthesized
taattttccattaggttcttgg

SEQ ID NO: 872771 - DNA, 22 bp, Artificial Sequence
  chemically synthesized
cactatctctctgtccaagaac

SEQ ID NO: 872772 - DNA, 22 bp, Artificial Sequence
  chemically synthesized
acactatctctctgtccaagaa

SEQ ID NO: 872773 - DNA, 22 bp, Artificial Sequence
  chemically synthesized
tacactatctctctgtccaaga

SEQ ID NO: 872774 - DNA, 22 bp, Artificial Sequence
  chemically synthesized
tccattaggttcttggacagag

SEQ ID NO: 872775 - DNA, 22 bp, Artificial Sequence
  chemically synthesized
ccattaggttcttggacagaga

SEQ ID NO: 872776 - DNA, 22 bp, Artificial Sequence
  chemically synthesized
cattaggttcttggacagagag

SEQ ID NO: 872777 - DNA, 22 bp, Artificial Sequence
  chemically synthesized
tgctttacactatctctctgtc

SEQ ID NO: 872778 - DNA, 22 bp, Artificial Sequence
  chemically synthesized
ggttcttggacagagagatagt

SEQ ID NO: 872779 - DNA, 22 bp, Artificial Sequence
  chemically synthesized
tggctgtgctttacactatctc

SEQ ID NO: 872780 - DNA, 22 bp, Artificial Sequence
  chemically synthesized
gtggctgtgctttacactatct

SEQ ID NO: 872781 - DNA, 22 bp, Artificial Sequence
  chemically synthesized
tgtggctgtgctttacactatc

SEQ ID NO: 872782 - DNA, 22 bp, Artificial Sequence
  chemically synthesized
ttggacagagagatagtgtaaa

SEQ ID NO: 872783 - DNA, 22 bp, Artificial Sequence
  chemically synthesized
ggacagagagatagtgtaaagc

SEQ ID NO: 872784 - DNA, 22 bp, Artificial Sequence
  chemically synthesized
ttttgtggctgtgctttacact

SEQ ID NO: 872785 - DNA, 22 bp, Artificial Sequence
  chemically synthesized
gacagagagatagtgtaaagca

SEQ ID NO: 872786 - DNA, 22 bp, Artificial Sequence
  chemically synthesized
gttttgtggctgtgctttacac

SEQ ID NO: 872787 - DNA, 22 bp, Artificial Sequence
  chemically synthesized
tgttttgtggctgtgctttaca

SEQ ID NO: 872788 - DNA, 22 bp, Artificial Sequence
  chemically synthesized
tgttttgttttgtggctgtgct

SEQ ID NO: 872789 - DNA, 22 bp, Artificial Sequence
  chemically synthesized
cacagcctgtgttttgttttgt

SEQ ID NO: 872790 - DNA, 22 bp, Artificial Sequence
  chemically synthesized
agtccacatgtcaagctccaca

SEQ ID NO: 872791 - DNA, 22 bp, Artificial Sequence
  chemically synthesized
cagtccacatgtcaagctccac

SEQ ID NO: 872792 - DNA, 22 bp, Artificial Sequence
  chemically synthesized
tggagcttgacatgtggactga

SEQ ID NO: 872793 - DNA, 22 bp, Artificial Sequence
  chemically synthesized
gacatgtggactgaaacccttg

SEQ ID NO: 872794 - DNA, 22 bp, Artificial Sequence
  chemically synthesized
acatgtggactgaaacccttgc

SEQ ID NO: 872795 - DNA, 22 bp, Artificial Sequence
  chemically synthesized
gaaagcaagcaagcaagggttt

SEQ ID NO: 872796 - DNA, 22 bp, Artificial Sequence
  chemically synthesized
aaacccttgcttgcttgctttc

SEQ ID NO: 872797 - DNA, 22 bp, Artificial Sequence
  chemically synthesized
aggccacacagctagaaagcaa

SEQ ID NO: 872798 - DNA, 22 bp, Artificial Sequence
  chemically synthesized
gattaaggccacacagctagaa

SEQ ID NO: 872799 - DNA, 22 bp, Artificial Sequence
  chemically synthesized
gcttgcttgctttctagctgtg

SEQ ID NO: 872800 - DNA, 22 bp, Artificial Sequence
  chemically synthesized
cttgcttgctttctagctgtgt

SEQ ID NO: 872801 - DNA, 22 bp, Artificial Sequence
  chemically synthesized
gcttgctttctagctgtgtggc

SEQ ID NO: 872802 - DNA, 22 bp, Artificial Sequence
  chemically synthesized
cttgctttctagctgtgtggcc

SEQ ID NO: 872803 - DNA, 22 bp, Artificial Sequence
  chemically synthesized
gctttctagctgtgtggcctta

SEQ ID NO: 872804 - DNA, 22 bp, Artificial Sequence
  chemically synthesized
ctttctagctgtgtggccttaa

SEQ ID NO: 872805 - DNA, 22 bp, Artificial Sequence
  chemically synthesized
tctagctgtgtggccttaatct

SEQ ID NO: 872806 - DNA, 22 bp, Artificial Sequence
  chemically synthesized
ctagctgtgtggccttaatcta

SEQ ID NO: 872807 - DNA, 22 bp, Artificial Sequence
  chemically synthesized
tagctgtgtggccttaatctag

SEQ ID NO: 872808 - DNA, 22 bp, Artificial Sequence
  chemically synthesized
gaggggagatagctagattaag

SEQ ID NO: 872809 - DNA, 22 bp, Artificial Sequence
  chemically synthesized
agaggggagatagctagattaa

SEQ ID NO: 872810 - DNA, 22 bp, Artificial Sequence
  chemically synthesized
gctgtgtggccttaatctagct

SEQ ID NO: 872811 - DNA, 22 bp, Artificial Sequence
  chemically synthesized
tgtggccttaatctagctatct

SEQ ID NO: 872812 - DNA, 22 bp, Artificial Sequence
  chemically synthesized
aggtttagaggggagatagcta

SEQ ID NO: 872813 - DNA, 22 bp, Artificial Sequence
  chemically synthesized
aatctagctatctcccctctaa

SEQ ID NO: 872814 - DNA, 22 bp, Artificial Sequence
  chemically synthesized
atctagctatctcccctctaaa

SEQ ID NO: 872815 - DNA, 22 bp, Artificial Sequence
  chemically synthesized
aggagcctgaggtttagagggg

SEQ ID NO: 872816 - DNA, 22 bp, Artificial Sequence
  chemically synthesized
gctatctcccctctaaacctca

SEQ ID NO: 872817 - DNA, 22 bp, Artificial Sequence
  chemically synthesized
aagattaaggagcctgaggttt

SEQ ID NO: 872818 - DNA, 22 bp, Artificial Sequence
  chemically synthesized
aaagattaaggagcctgaggtt

SEQ ID NO: 872819 - DNA, 22 bp, Artificial Sequence
  chemically synthesized
tctcccctctaaacctcaggct

SEQ ID NO: 872820 - DNA, 22 bp, Artificial Sequence
  chemically synthesized
taaagattaaggagcctgaggt

SEQ ID NO: 872821 - DNA, 22 bp, Artificial Sequence
  chemically synthesized
ttaaagattaaggagcctgagg

SEQ ID NO: 872822 - DNA, 22 bp, Artificial Sequence
  chemically synthesized
ccctctaaacctcaggctcctt

SEQ ID NO: 872823 - DNA, 22 bp, Artificial Sequence
  chemically synthesized
taaacctcaggctccttaatct

SEQ ID NO: 872824 - DNA, 22 bp, Artificial Sequence
  chemically synthesized
aacctcaggctccttaatcttt

SEQ ID NO: 872825 - DNA, 22 bp, Artificial Sequence
  chemically synthesized
aggctccttaatctttaaaaat

SEQ ID NO: 872826 - DNA, 22 bp, Artificial Sequence
  chemically synthesized
caaagaacatatagataatttt

SEQ ID NO: 872827 - DNA, 22 bp, Artificial Sequence
  chemically synthesized
cttaatctttaaaaattatcta

SEQ ID NO: 872828 - DNA, 22 bp, Artificial Sequence
  chemically synthesized
aatctttaaaaattatctatat

SEQ ID NO: 872829 - DNA, 22 bp, Artificial Sequence
  chemically synthesized
atctttaaaaattatctatatg

SEQ ID NO: 872830 - DNA, 22 bp, Artificial Sequence
  chemically synthesized
taaaaattatctatatgttctt

SEQ ID NO: 872831 - DNA, 22 bp, Artificial Sequence
  chemically synthesized
aaaataactgcaaagaacatat

SEQ ID NO: 872832 - DNA, 22 bp, Artificial Sequence
  chemically synthesized
aaaaattatctatatgttcttt

SEQ ID NO: 872833 - DNA, 22 bp, Artificial Sequence
  chemically synthesized
aaaattatctatatgttctttg

SEQ ID NO: 872834 - DNA, 22 bp, Artificial Sequence
  chemically synthesized
tcctcaaaataactgcaaagaa

SEQ ID NO: 872835 - DNA, 22 bp, Artificial Sequence
  chemically synthesized
atcctcaaaataactgcaaaga

SEQ ID NO: 872836 - DNA, 22 bp, Artificial Sequence
  chemically synthesized
tatcctcaaaataactgcaaag

SEQ ID NO: 872837 - DNA, 22 bp, Artificial Sequence
  chemically synthesized
tctatatgttctttgcagttat

SEQ ID NO: 872838 - DNA, 22 bp, Artificial Sequence
  chemically synthesized
tatgttctttgcagttattttg

SEQ ID NO: 872839 - DNA, 22 bp, Artificial Sequence
  chemically synthesized
tttgcagttattttgaggataa

SEQ ID NO: 872840 - DNA, 22 bp, Artificial Sequence
  chemically synthesized
acatatatgtctttatcctcaa

SEQ ID NO: 872841 - DNA, 22 bp, Artificial Sequence
  chemically synthesized
aacatatatgtctttatcctca

SEQ ID NO: 872842 - DNA, 22 bp, Artificial Sequence
  chemically synthesized
tgcagttattttgaggataaag

SEQ ID NO: 872843 - DNA, 22 bp, Artificial Sequence
  chemically synthesized
taacatatatgtctttatcctc

SEQ ID NO: 872844 - DNA, 22 bp, Artificial Sequence
  chemically synthesized
gcagttattttgaggataaaga

SEQ ID NO: 872845 - DNA, 22 bp, Artificial Sequence
  chemically synthesized
cagttattttgaggataaagac

SEQ ID NO: 872846 - DNA, 22 bp, Artificial Sequence
  chemically synthesized
tagctttaacatatatgtcttt

SEQ ID NO: 872847 - DNA, 22 bp, Artificial Sequence
  chemically synthesized
gtagctttaacatatatgtctt

SEQ ID NO: 872848 - DNA, 22 bp, Artificial Sequence
  chemically synthesized
ttttgaggataaagacatatat

SEQ ID NO: 872849 - DNA, 22 bp, Artificial Sequence
  chemically synthesized
tgaggataaagacatatatgtt

SEQ ID NO: 872850 - DNA, 22 bp, Artificial Sequence
  chemically synthesized
gaggataaagacatatatgtta

SEQ ID NO: 872851 - DNA, 22 bp, Artificial Sequence
  chemically synthesized
aggataaagacatatatgttaa

SEQ ID NO: 872852 - DNA, 22 bp, Artificial Sequence
  chemically synthesized
cacatatacttgtagctttaac

SEQ ID NO: 872853 - DNA, 22 bp, Artificial Sequence
  chemically synthesized
aatatgtagaagctacacatat

SEQ ID NO: 872854 - DNA, 22 bp, Artificial Sequence
  chemically synthesized
aagctacaagtatatgtgtagc

SEQ ID NO: 872855 - DNA, 22 bp, Artificial Sequence
  chemically synthesized
ttaaatatgtagaagctacaca

SEQ ID NO: 872856 - DNA, 22 bp, Artificial Sequence
  chemically synthesized
ctattaaatatgtagaagctac

SEQ ID NO: 872857 - DNA, 22 bp, Artificial Sequence
  chemically synthesized
caagtatatgtgtagcttctac

SEQ ID NO: 872858 - DNA, 22 bp, Artificial Sequence
  chemically synthesized
ctactattaaatatgtagaagc

SEQ ID NO: 872859 - DNA, 22 bp, Artificial Sequence
  chemically synthesized
cattcctactattaaatatgta

SEQ ID NO: 872860 - DNA, 22 bp, Artificial Sequence
  chemically synthesized
cattgcattcctactattaaat

SEQ ID NO: 872861 - DNA, 22 bp, Artificial Sequence
  chemically synthesized
ccattgcattcctactattaaa

SEQ ID NO: 872862 - DNA, 22 bp, Artificial Sequence
  chemically synthesized
tttccattgcattcctactatt

SEQ ID NO: 872863 - DNA, 22 bp, Artificial Sequence
  chemically synthesized
ctacatatttaatagtaggaat

SEQ ID NO: 872864 - DNA, 22 bp, Artificial Sequence
  chemically synthesized
tacatatttaatagtaggaatg

SEQ ID NO: 872865 - DNA, 22 bp, Artificial Sequence
  chemically synthesized
catatttaatagtaggaatgca

SEQ ID NO: 872866 - DNA, 22 bp, Artificial Sequence
  chemically synthesized
tagcagattgtttccattgcat

SEQ ID NO: 872867 - DNA, 22 bp, Artificial Sequence
  chemically synthesized
aatagtaggaatgcaatggaaa

SEQ ID NO: 872868 - DNA, 22 bp, Artificial Sequence
  chemically synthesized
atagtaggaatgcaatggaaac

SEQ ID NO: 872869 - DNA, 22 bp, Artificial Sequence
  chemically synthesized
attatagcagattgtttccatt

SEQ ID NO: 872870 - DNA, 22 bp, Artificial Sequence
  chemically synthesized
taattcattatagcagattgtt

SEQ ID NO: 872871 - DNA, 22 bp, Artificial Sequence
  chemically synthesized
ataattcattatagcagattgt

SEQ ID NO: 872872 - DNA, 22 bp, Artificial Sequence
  chemically synthesized
caatgtaatagaatttataatt

SEQ ID NO: 872873 - DNA, 22 bp, Artificial Sequence
  chemically synthesized
ctataatgaattataaattcta

SEQ ID NO: 872874 - DNA, 22 bp, Artificial Sequence
  chemically synthesized
tattacaatgtaatagaattta

SEQ ID NO: 872875 - DNA, 22 bp, Artificial Sequence
  chemically synthesized
taatgaattataaattctatta

SEQ ID NO: 872876 - DNA, 22 bp, Artificial Sequence
  chemically synthesized
atgtactgtattacaatgtaat

SEQ ID NO: 872877 - DNA, 22 bp, Artificial Sequence
  chemically synthesized
catgtactgtattacaatgtaa

SEQ ID NO: 872878 - DNA, 22 bp, Artificial Sequence
  chemically synthesized
taaattctattacattgtaata

SEQ ID NO: 872879 - DNA, 22 bp, Artificial Sequence
  chemically synthesized
tttcatgtactgtattacaatg

SEQ ID NO: 872880 - DNA, 22 bp, Artificial Sequence
  chemically synthesized
ttatttcatgtactgtattaca

SEQ ID NO: 872881 - DNA, 22 bp, Artificial Sequence
  chemically synthesized
attatttcatgtactgtattac

SEQ ID NO: 872882 - DNA, 22 bp, Artificial Sequence
  chemically synthesized
tattacattgtaatacagtaca

SEQ ID NO: 872883 - DNA, 22 bp, Artificial Sequence
  chemically synthesized
ttacattgtaatacagtacatg

SEQ ID NO: 872884 - DNA, 22 bp, Artificial Sequence
  chemically synthesized
cattgtaatacagtacatgaaa

SEQ ID NO: 872885 - DNA, 22 bp, Artificial Sequence
  chemically synthesized
tatatgtttattatttcatgta

SEQ ID NO: 872886 - DNA, 22 bp, Artificial Sequence
  chemically synthesized
gtatatgtttattatttcatgt

SEQ ID NO: 872887 - DNA, 22 bp, Artificial Sequence
  chemically synthesized
ttgtatatgtttattatttcat

SEQ ID NO: 872888 - DNA, 22 bp, Artificial Sequence
  chemically synthesized
taatacagtacatgaaataata

SEQ ID NO: 872889 - DNA, 22 bp, Artificial Sequence
  chemically synthesized
cttgtatatgtttattatttca

SEQ ID NO: 872890 - DNA, 22 bp, Artificial Sequence
  chemically synthesized
tgcttcttgtatatgtttatta

SEQ ID NO: 872891 - DNA, 22 bp, Artificial Sequence
  chemically synthesized
tattatgcttcttgtatatgtt

SEQ ID NO: 872892 - DNA, 22 bp, Artificial Sequence
  chemically synthesized
gtattatgcttcttgtatatgt

SEQ ID NO: 872893 - DNA, 22 bp, Artificial Sequence
  chemically synthesized
atttgtattatgcttcttgtat

SEQ ID NO: 872894 - DNA, 22 bp, Artificial Sequence
  chemically synthesized
gattttctttttttatattgca

SEQ ID NO: 872895 - DNA, 22 bp, Artificial Sequence
  chemically synthesized
atcagaaataaatgcaatataa

SEQ ID NO: 872896 - DNA, 22 bp, Artificial Sequence
  chemically synthesized
tctttttttatattgcatttat

SEQ ID NO: 872897 - DNA, 22 bp, Artificial Sequence
  chemically synthesized
ctttttttatattgcatttatt

SEQ ID NO: 872898 - DNA, 22 bp, Artificial Sequence
  chemically synthesized
tttttttatattgcatttattt

SEQ ID NO: 872899 - DNA, 22 bp, Artificial Sequence
  chemically synthesized
tttttatattgcatttatttct

SEQ ID NO: 872900 - DNA, 22 bp, Artificial Sequence
  chemically synthesized
ttttatattgcatttatttctg

SEQ ID NO: 872901 - DNA, 22 bp, Artificial Sequence
  chemically synthesized
caggaagttaatcagaaataaa

SEQ ID NO: 872902 - DNA, 22 bp, Artificial Sequence
  chemically synthesized
tttatattgcatttatttctga

SEQ ID NO: 872903 - DNA, 22 bp, Artificial Sequence
  chemically synthesized
gcaggaagttaatcagaaataa

SEQ ID NO: 872904 - DNA, 22 bp, Artificial Sequence
  chemically synthesized
ttatattgcatttatttctgat

SEQ ID NO: 872905 - DNA, 22 bp, Artificial Sequence
  chemically synthesized
tatattgcatttatttctgatt

SEQ ID NO: 872906 - DNA, 22 bp, Artificial Sequence
  chemically synthesized
atattgcatttatttctgatta

SEQ ID NO: 872907 - DNA, 22 bp, Artificial Sequence
  chemically synthesized
tattgcatttatttctgattaa

SEQ ID NO: 872908 - DNA, 22 bp, Artificial Sequence
  chemically synthesized
acttgcaggaagttaatcagaa

SEQ ID NO: 872909 - DNA, 22 bp, Artificial Sequence
  chemically synthesized
ctgacttgcaggaagttaatca

SEQ ID NO: 872910 - DNA, 22 bp, Artificial Sequence
  chemically synthesized
cctgacttgcaggaagttaatc

SEQ ID NO: 872911 - DNA, 22 bp, Artificial Sequence
  chemically synthesized
catttatttctgattaacttcc

SEQ ID NO: 872912 - DNA, 22 bp, Artificial Sequence
  chemically synthesized
atttctgattaacttcctgcaa

SEQ ID NO: 872913 - DNA, 22 bp, Artificial Sequence
  chemically synthesized
tttctgattaacttcctgcaag

SEQ ID NO: 872914 - DNA, 22 bp, Artificial Sequence
  chemically synthesized
ccgacttcctgacttgcaggaa

SEQ ID NO: 872915 - DNA, 22 bp, Artificial Sequence
  chemically synthesized
ctgattaacttcctgcaagtca

SEQ ID NO: 872916 - DNA, 22 bp, Artificial Sequence
  chemically synthesized
ttcccgacttcctgacttgcag

SEQ ID NO: 872917 - DNA, 22 bp, Artificial Sequence
  chemically synthesized
tgattaacttcctgcaagtcag

SEQ ID NO: 872918 - DNA, 22 bp, Artificial Sequence
  chemically synthesized
tattcccgacttcctgacttgc

SEQ ID NO: 872919 - DNA, 22 bp, Artificial Sequence
  chemically synthesized
attaacttcctgcaagtcagga

SEQ ID NO: 872920 - DNA, 22 bp, Artificial Sequence
  chemically synthesized
ctattcccgacttcctgacttg

SEQ ID NO: 872921 - DNA, 22 bp, Artificial Sequence
  chemically synthesized
tttctattcccgacttcctgac

SEQ ID NO: 872922 - DNA, 22 bp, Artificial Sequence
  chemically synthesized
acttcctgcaagtcaggaagtc

SEQ ID NO: 872923 - DNA, 22 bp, Artificial Sequence
  chemically synthesized
cctgcaagtcaggaagtcggga

SEQ ID NO: 872924 - DNA, 22 bp, Artificial Sequence
  chemically synthesized
ctgcaagtcaggaagtcgggaa

SEQ ID NO: 872925 - DNA, 22 bp, Artificial Sequence
  chemically synthesized
caagtcaggaagtcgggaatag

SEQ ID NO: 872926 - DNA, 22 bp, Artificial Sequence
  chemically synthesized
aaatatcagaataaagaattgt

SEQ ID NO: 872927 - DNA, 22 bp, Artificial Sequence
  chemically synthesized
tggtagttcaaatatcagaata

SEQ ID NO: 872928 - DNA, 22 bp, Artificial Sequence
  chemically synthesized
ctgtggtagttcaaatatcaga

SEQ ID NO: 872929 - DNA, 22 bp, Artificial Sequence
  chemically synthesized
actgtggtagttcaaatatcag

SEQ ID NO: 872930 - DNA, 22 bp, Artificial Sequence
  chemically synthesized
tactgtggtagttcaaatatca

SEQ ID NO: 872931 - DNA, 22 bp, Artificial Sequence
  chemically synthesized
tttactgtggtagttcaaatat

SEQ ID NO: 872932 - DNA, 22 bp, Artificial Sequence
  chemically synthesized
ctttactgtggtagttcaaata

SEQ ID NO: 872933 - DNA, 22 bp, Artificial Sequence
  chemically synthesized
tctttactgtggtagttcaaat

SEQ ID NO: 872934 - DNA, 22 bp, Artificial Sequence
  chemically synthesized
tttattctgatatttgaactac

SEQ ID NO: 872935 - DNA, 22 bp, Artificial Sequence
  chemically synthesized
ttctttactgtggtagttcaaa

SEQ ID NO: 872936 - DNA, 22 bp, Artificial Sequence
  chemically synthesized
tttctttactgtggtagttcaa

SEQ ID NO: 872937 - DNA, 22 bp, Artificial Sequence
  chemically synthesized
tattctgatatttgaactacca

SEQ ID NO: 872938 - DNA, 22 bp, Artificial Sequence
  chemically synthesized
ttttctttactgtggtagttca

SEQ ID NO: 872939 - DNA, 22 bp, Artificial Sequence
  chemically synthesized
attctgatatttgaactaccac

SEQ ID NO: 872940 - DNA, 22 bp, Artificial Sequence
  chemically synthesized
ttctgatatttgaactaccaca

SEQ ID NO: 872941 - DNA, 22 bp, Artificial Sequence
  chemically synthesized
ttttttctttactgtggtagtt

SEQ ID NO: 872942 - DNA, 22 bp, Artificial Sequence
  chemically synthesized
cttttttctttactgtggtagt

SEQ ID NO: 872943 - DNA, 22 bp, Artificial Sequence
  chemically synthesized
tcttttttctttactgtggtag

SEQ ID NO: 872944 - DNA, 22 bp, Artificial Sequence
  chemically synthesized
tgatatttgaactaccacagta

SEQ ID NO: 872945 - DNA, 22 bp, Artificial Sequence
  chemically synthesized
atatttgaactaccacagtaaa

SEQ ID NO: 872946 - DNA, 22 bp, Artificial Sequence
  chemically synthesized
gaactaccacagtaaagaaaaa

SEQ ID NO: 872947 - DNA, 22 bp, Artificial Sequence
  chemically synthesized
aactaccacagtaaagaaaaaa

SEQ ID NO: 872948 - DNA, 22 bp, Artificial Sequence
  chemically synthesized
aaataagattttcttttttctt

SEQ ID NO: 872949 - DNA, 22 bp, Artificial Sequence
  chemically synthesized
ttaaaataagattttctttttt

SEQ ID NO: 872950 - DNA, 22 bp, Artificial Sequence
  chemically synthesized
ccacagtaaagaaaaaagaaaa

SEQ ID NO: 872951 - DNA, 22 bp, Artificial Sequence
  chemically synthesized
attaaaataagattttcttttt

SEQ ID NO: 872952 - DNA, 22 bp, Artificial Sequence
  chemically synthesized
tattaaaataagattttctttt

SEQ ID NO: 872953 - DNA, 22 bp, Artificial Sequence
  chemically synthesized
ttattaaaataagattttcttt

SEQ ID NO: 872954 - DNA, 22 bp, Artificial Sequence
  chemically synthesized
cttttattaaaataagattttc

SEQ ID NO: 872955 - DNA, 22 bp, Artificial Sequence
  chemically synthesized
agagctgcttttattaaaataa

SEQ ID NO: 872956 - DNA, 22 bp, Artificial Sequence
  chemically synthesized
aattcagagctgcttttattaa

SEQ ID NO: 872957 - DNA, 22 bp, Artificial Sequence
  chemically synthesized
aaattcagagctgcttttatta

SEQ ID NO: 872958 - DNA, 22 bp, Artificial Sequence
  chemically synthesized
attttaataaaagcagctctga

SEQ ID NO: 872959 - DNA, 22 bp, Artificial Sequence
  chemically synthesized
ttttaataaaagcagctctgaa

SEQ ID NO: 872960 - DNA, 22 bp, Artificial Sequence
  chemically synthesized
taataaaagcagctctgaattt

SEQ ID NO: 872961 - DNA, 22 bp, Artificial Sequence
  chemically synthesized
aataaaagcagctctgaattta

SEQ ID NO: 872962 - DNA, 22 bp, Artificial Sequence
  chemically synthesized
ataaaagcagctctgaatttaa

SEQ ID NO: 872963 - DNA, 22 bp, Artificial Sequence
  chemically synthesized
tgaatttaaatgactacctttt

SEQ ID NO: 872964 - DNA, 22 bp, Artificial Sequence
  chemically synthesized
aatttaaatgactaccttttgt

SEQ ID NO: 872965 - DNA, 22 bp, Artificial Sequence
  chemically synthesized
aatgaaaaaaaaaacaaaaggt

SEQ ID NO: 872966 - DNA, 22 bp, Artificial Sequence
  chemically synthesized
aaatgactaccttttgtttttt

SEQ ID NO: 872967 - DNA, 22 bp, Artificial Sequence
  chemically synthesized
aatgactaccttttgttttttt

SEQ ID NO: 872968 - DNA, 22 bp, Artificial Sequence
  chemically synthesized
ccttttgttttttttttcattc

SEQ ID NO: 872969 - DNA, 22 bp, Artificial Sequence
  chemically synthesized
aatacacaaatgttgaatgaaa

SEQ ID NO: 872970 - DNA, 22 bp, Artificial Sequence
  chemically synthesized
ttgttttttttttcattcaaca

SEQ ID NO: 872971 - DNA, 22 bp, Artificial Sequence
  chemically synthesized
tgttttttttttcattcaacat

SEQ ID NO: 872972 - DNA, 22 bp, Artificial Sequence
  chemically synthesized
gttttttttttcattcaacatt

SEQ ID NO: 872973 - DNA, 22 bp, Artificial Sequence
  chemically synthesized
ttttttttttcattcaacattt

SEQ ID NO: 872974 - DNA, 22 bp, Artificial Sequence
  chemically synthesized
tttttttcattcaacatttgtg

SEQ ID NO: 872975 - DNA, 22 bp, Artificial Sequence
  chemically synthesized
ttttttcattcaacatttgtgt

SEQ ID NO: 872976 - DNA, 22 bp, Artificial Sequence
  chemically synthesized
tttttcattcaacatttgtgta

SEQ ID NO: 872977 - DNA, 22 bp, Artificial Sequence
  chemically synthesized
ttttcattcaacatttgtgtat

SEQ ID NO: 872978 - DNA, 22 bp, Artificial Sequence
  chemically synthesized
tttcattcaacatttgtgtatt

SEQ ID NO: 872979 - DNA, 22 bp, Artificial Sequence
  chemically synthesized
ttcattcaacatttgtgtattt

SEQ ID NO: 872980 - DNA, 22 bp, Artificial Sequence
  chemically synthesized
agtcaagatgttaaatacacaa

SEQ ID NO: 872981 - DNA, 22 bp, Artificial Sequence
  chemically synthesized
tcattcaacatttgtgtattta

SEQ ID NO: 872982 - DNA, 22 bp, Artificial Sequence
  chemically synthesized
cattcaacatttgtgtatttaa

SEQ ID NO: 872983 - DNA, 22 bp, Artificial Sequence
  chemically synthesized
attcaacatttgtgtatttaac

SEQ ID NO: 872984 - DNA, 22 bp, Artificial Sequence
  chemically synthesized
aacatttgtgtatttaacatct

SEQ ID NO: 872985 - DNA, 22 bp, Artificial Sequence
  chemically synthesized
agcattaagtcaagatgttaaa

SEQ ID NO: 872986 - DNA, 22 bp, Artificial Sequence
  chemically synthesized
gtgtatttaacatcttgactta

SEQ ID NO: 872987 - DNA, 22 bp, Artificial Sequence
  chemically synthesized
tgtatttaacatcttgacttaa

SEQ ID NO: 872988 - DNA, 22 bp, Artificial Sequence
  chemically synthesized
aacatcttgacttaatgctcag

SEQ ID NO: 872989 - DNA, 22 bp, Artificial Sequence
  chemically synthesized
acatcttgacttaatgctcaga

SEQ ID NO: 872990 - DNA, 22 bp, Artificial Sequence
  chemically synthesized
gcaaaccgaaacagatctgagc

SEQ ID NO: 872991 - DNA, 22 bp, Artificial Sequence
  chemically synthesized
agcaaaccgaaacagatctgag

SEQ ID NO: 872992 - DNA, 22 bp, Artificial Sequence
  chemically synthesized
tagcaaaccgaaacagatctga

SEQ ID NO: 872993 - DNA, 22 bp, Artificial Sequence
  chemically synthesized
gacttaatgctcagatctgttt

SEQ ID NO: 872994 - DNA, 22 bp, Artificial Sequence
  chemically synthesized
tttagcaaaccgaaacagatct

SEQ ID NO: 872995 - DNA, 22 bp, Artificial Sequence
  chemically synthesized
acttaatgctcagatctgtttc

SEQ ID NO: 872996 - DNA, 22 bp, Artificial Sequence
  chemically synthesized
aatgctcagatctgtttcggtt

SEQ ID NO: 872997 - DNA, 22 bp, Artificial Sequence
  chemically synthesized
atgctcagatctgtttcggttt

SEQ ID NO: 872998 - DNA, 22 bp, Artificial Sequence
  chemically synthesized
atcctctttagcaaaccgaaac

SEQ ID NO: 872999 - DNA, 22 bp, Artificial Sequence
  chemically synthesized
catcctctttagcaaaccgaaa

SEQ ID NO: 873000 - DNA, 22 bp, Artificial Sequence
  chemically synthesized
tcatcctctttagcaaaccgaa

SEQ ID NO: 873001 - DNA, 22 bp, Artificial Sequence
  chemically synthesized
ttcatcctctttagcaaaccga

SEQ ID NO: 873002 - DNA, 22 bp, Artificial Sequence
  chemically synthesized
agatctgtttcggtttgctaaa

SEQ ID NO: 873003 - DNA, 22 bp, Artificial Sequence
  chemically synthesized
tttcggtttgctaaagaggatg

SEQ ID NO: 873004 - DNA, 22 bp, Artificial Sequence
  chemically synthesized
cggtttgctaaagaggatgaaa

SEQ ID NO: 873005 - DNA, 22 bp, Artificial Sequence
  chemically synthesized
ggtttgctaaagaggatgaaaa

SEQ ID NO: 873006 - DNA, 22 bp, Artificial Sequence
  chemically synthesized
aaaagcaggtgcttttcatcct

SEQ ID NO: 873007 - DNA, 22 bp, Artificial Sequence
  chemically synthesized
tcaaaagcaggtgcttttcatc

SEQ ID NO: 873008 - DNA, 22 bp, Artificial Sequence
  chemically synthesized
ctcaaaagcaggtgcttttcat

SEQ ID NO: 873009 - DNA, 22 bp, Artificial Sequence
  chemically synthesized
tctcaaaagcaggtgcttttca

SEQ ID NO: 873010 - DNA, 22 bp, Artificial Sequence
  chemically synthesized
gctaaagaggatgaaaagcacc

SEQ ID NO: 873011 - DNA, 22 bp, Artificial Sequence
  chemically synthesized
ctaaagaggatgaaaagcacct

SEQ ID NO: 873012 - DNA, 22 bp, Artificial Sequence
  chemically synthesized
aagaggatgaaaagcacctgct

SEQ ID NO: 873013 - DNA, 22 bp, Artificial Sequence
  chemically synthesized
agggaaagaggaattttctcaa

SEQ ID NO: 873014 - DNA, 22 bp, Artificial Sequence
  chemically synthesized
cttttgagaaaattcctctttc

SEQ ID NO: 873015 - DNA, 22 bp, Artificial Sequence
  chemically synthesized
aaaaagaattaagggaaagagg

SEQ ID NO: 873016 - DNA, 22 bp, Artificial Sequence
  chemically synthesized
ttgagaaaattcctctttccct

SEQ ID NO: 873017 - DNA, 22 bp, Artificial Sequence
  chemically synthesized
tgagaaaattcctctttccctt

SEQ ID NO: 873018 - DNA, 22 bp, Artificial Sequence
  chemically synthesized
gagaaaattcctctttccctta

SEQ ID NO: 873019 - DNA, 22 bp, Artificial Sequence
  chemically synthesized
agaaaattcctctttcccttaa

SEQ ID NO: 873020 - DNA, 22 bp, Artificial Sequence
  chemically synthesized
tggtagtagctaaaaaagaatt

SEQ ID NO: 873021 - DNA, 22 bp, Artificial Sequence
  chemically synthesized
ctctttcccttaattctttttt

SEQ ID NO: 873022 - DNA, 22 bp, Artificial Sequence
  chemically synthesized
tttcccttaattcttttttagc

SEQ ID NO: 873023 - DNA, 22 bp, Artificial Sequence
  chemically synthesized
tcccttaattcttttttagcta

SEQ ID NO: 873024 - DNA, 22 bp, Artificial Sequence
  chemically synthesized
cccttaattcttttttagctac

SEQ ID NO: 873025 - DNA, 22 bp, Artificial Sequence
  chemically synthesized
ccttaattcttttttagctact

SEQ ID NO: 873026 - DNA, 22 bp, Artificial Sequence
  chemically synthesized
gcagagttgtggtagtagctaa

SEQ ID NO: 873027 - DNA, 22 bp, Artificial Sequence
  chemically synthesized
aattcttttttagctactacca

SEQ ID NO: 873028 - DNA, 22 bp, Artificial Sequence
  chemically synthesized
attcttttttagctactaccac

SEQ ID NO: 873029 - DNA, 22 bp, Artificial Sequence
  chemically synthesized
ttttttagctactaccacaact

SEQ ID NO: 873030 - DNA, 22 bp, Artificial Sequence
  chemically synthesized
ttttagctactaccacaactct

SEQ ID NO: 873031 - DNA, 22 bp, Artificial Sequence
  chemically synthesized
gtgatagctggcagagttgtgg

SEQ ID NO: 873032 - DNA, 22 bp, Artificial Sequence
  chemically synthesized
tttagctactaccacaactctg

SEQ ID NO: 873033 - DNA, 22 bp, Artificial Sequence
  chemically synthesized
ggtgatagctggcagagttgtg

SEQ ID NO: 873034 - DNA, 22 bp, Artificial Sequence
  chemically synthesized
ttagctactaccacaactctgc

SEQ ID NO: 873035 - DNA, 22 bp, Artificial Sequence
  chemically synthesized
tagctactaccacaactctgcc

SEQ ID NO: 873036 - DNA, 22 bp, Artificial Sequence
  chemically synthesized
agctactaccacaactctgcca

SEQ ID NO: 873037 - DNA, 22 bp, Artificial Sequence
  chemically synthesized
tttggtgatagctggcagagtt

SEQ ID NO: 873038 - DNA, 22 bp, Artificial Sequence
  chemically synthesized
gctactaccacaactctgccag

SEQ ID NO: 873039 - DNA, 22 bp, Artificial Sequence
  chemically synthesized
ctaccacaactctgccagctat

SEQ ID NO: 873040 - DNA, 22 bp, Artificial Sequence
  chemically synthesized
aaagctgtttggtgatagctgg

SEQ ID NO: 873041 - DNA, 22 bp, Artificial Sequence
  chemically synthesized
ccacaactctgccagctatcac

SEQ ID NO: 873042 - DNA, 22 bp, Artificial Sequence
  chemically synthesized
agctcaaagctgtttggtgata

SEQ ID NO: 873043 - DNA, 22 bp, Artificial Sequence
  chemically synthesized
tgccagctatcaccaaacagct

SEQ ID NO: 873044 - DNA, 22 bp, Artificial Sequence
  chemically synthesized
ccagctatcaccaaacagcttt

SEQ ID NO: 873045 - DNA, 22 bp, Artificial Sequence
  chemically synthesized
ggaatgccctcagctcaaagct

SEQ ID NO: 873046 - DNA, 22 bp, Artificial Sequence
  chemically synthesized
tcaccaaacagctttgagctga

SEQ ID NO: 873047 - DNA, 22 bp, Artificial Sequence
  chemically synthesized
tgagctgagggcattcccagac

SEQ ID NO: 873048 - DNA, 22 bp, Artificial Sequence
  chemically synthesized
ccagtatggagagtctgggaat

SEQ ID NO: 873049 - DNA, 22 bp, Artificial Sequence
  chemically synthesized
gagctgagggcattcccagact

SEQ ID NO: 873050 - DNA, 22 bp, Artificial Sequence
  chemically synthesized
agctgagggcattcccagactc

SEQ ID NO: 873051 - DNA, 22 bp, Artificial Sequence
  chemically synthesized
ctgccagtatggagagtctggg

SEQ ID NO: 873052 - DNA, 22 bp, Artificial Sequence
  chemically synthesized
agggcattcccagactctccat

SEQ ID NO: 873053 - DNA, 22 bp, Artificial Sequence
  chemically synthesized
cacattgctgccagtatggaga

SEQ ID NO: 873054 - DNA, 22 bp, Artificial Sequence
  chemically synthesized
ccagactctccatactggcagc

SEQ ID NO: 873055 - DNA, 22 bp, Artificial Sequence
  chemically synthesized
tgtcctccacattgctgccagt

SEQ ID NO: 873056 - DNA, 22 bp, Artificial Sequence
  chemically synthesized
ctatgtcctccacattgctgcc

SEQ ID NO: 873057 - DNA, 22 bp, Artificial Sequence
  chemically synthesized
tcctatgtcctccacattgctg

SEQ ID NO: 873058 - DNA, 22 bp, Artificial Sequence
  chemically synthesized
ctcctatgtcctccacattgct

SEQ ID NO: 873059 - DNA, 22 bp, Artificial Sequence
  chemically synthesized
tccatactggcagcaatgtgga

SEQ ID NO: 873060 - DNA, 22 bp, Artificial Sequence
  chemically synthesized
catactggcagcaatgtggagg

SEQ ID NO: 873061 - DNA, 22 bp, Artificial Sequence
  chemically synthesized
tcttctcctatgtcctccacat

SEQ ID NO: 873062 - DNA, 22 bp, Artificial Sequence
  chemically synthesized
gtcttctcctatgtcctccaca

SEQ ID NO: 873063 - DNA, 22 bp, Artificial Sequence
  chemically synthesized
ttgtcttctcctatgtcctcca

SEQ ID NO: 873064 - DNA, 22 bp, Artificial Sequence
  chemically synthesized
gcagcaatgtggaggacatagg

SEQ ID NO: 873065 - DNA, 22 bp, Artificial Sequence
  chemically synthesized
atcaccccccaccactcttgtc

SEQ ID NO: 873066 - DNA, 22 bp, Artificial Sequence
  chemically synthesized
cccaacatgagggtctcatcac

SEQ ID NO: 873067 - DNA, 22 bp, Artificial Sequence
  chemically synthesized
tccccaacatgagggtctcatc

SEQ ID NO: 873068 - DNA, 22 bp, Artificial Sequence
  chemically synthesized
ctccccaacatgagggtctcat

SEQ ID NO: 873069 - DNA, 22 bp, Artificial Sequence
  chemically synthesized
cttctccccaacatgagggtct

SEQ ID NO: 873070 - DNA, 22 bp, Artificial Sequence
  chemically synthesized
ccttctccccaacatgagggtc

SEQ ID NO: 873071 - DNA, 22 bp, Artificial Sequence
  chemically synthesized
cttccttctccccaacatgagg

SEQ ID NO: 873072 - DNA, 22 bp, Artificial Sequence
  chemically synthesized
ccctacttccttctccccaaca

SEQ ID NO: 873073 - DNA, 22 bp, Artificial Sequence
  chemically synthesized
atagcactgccctacttccttc

SEQ ID NO: 873074 - DNA, 22 bp, Artificial Sequence
  chemically synthesized
catagcactgccctacttcctt

SEQ ID NO: 873075 - DNA, 22 bp, Artificial Sequence
  chemically synthesized
atgttggggagaaggaagtagg

SEQ ID NO: 873076 - DNA, 22 bp, Artificial Sequence
  chemically synthesized
tcatagcactgccctacttcct

SEQ ID NO: 873077 - DNA, 22 bp, Artificial Sequence
  chemically synthesized
atctttcatagcactgccctac

SEQ ID NO: 873078 - DNA, 22 bp, Artificial Sequence
  chemically synthesized
gggagaaggaagtagggcagtg

SEQ ID NO: 873079 - DNA, 22 bp, Artificial Sequence
  chemically synthesized
tgaaagatgagtatctctcatg

SEQ ID NO: 873080 - DNA, 22 bp, Artificial Sequence
  chemically synthesized
tcatggcttccatcacacttcc

SEQ ID NO: 873081 - DNA, 22 bp, Artificial Sequence
  chemically synthesized
atggcttccatcacacttcccc

SEQ ID NO: 873082 - DNA, 22 bp, Artificial Sequence
  chemically synthesized
gaggagtgggtcaggggaagtg

SEQ ID NO: 873083 - DNA, 22 bp, Artificial Sequence
  chemically synthesized
ccatcacacttcccctgaccca

SEQ ID NO: 873084 - DNA, 22 bp, Artificial Sequence
  chemically synthesized
catcacacttcccctgacccac

SEQ ID NO: 873085 - DNA, 22 bp, Artificial Sequence
  chemically synthesized
cccctgacccactcctctagtc

SEQ ID NO: 873086 - DNA, 22 bp, Artificial Sequence
  chemically synthesized
ccctgacccactcctctagtct

SEQ ID NO: 873087 - DNA, 22 bp, Artificial Sequence
  chemically synthesized
aggagatcagtgagactagagg

SEQ ID NO: 873088 - DNA, 22 bp, Artificial Sequence
  chemically synthesized
acccactcctctagtctcactg

SEQ ID NO: 873089 - DNA, 22 bp, Artificial Sequence
  chemically synthesized
ctctagtctcactgatctcctt

SEQ ID NO: 873090 - DNA, 22 bp, Artificial Sequence
  chemically synthesized
tagtctcactgatctccttaat

SEQ ID NO: 873091 - DNA, 22 bp, Artificial Sequence
  chemically synthesized
gtctcactgatctccttaatat

SEQ ID NO: 873092 - DNA, 22 bp, Artificial Sequence
  chemically synthesized
actgatctccttaatattccgt

SEQ ID NO: 873093 - DNA, 22 bp, Artificial Sequence
  chemically synthesized
atctccttaatattccgtcatc

SEQ ID NO: 873094 - DNA, 22 bp, Artificial Sequence
  chemically synthesized
aagtaggaacaagatgacggaa

SEQ ID NO: 873095 - DNA, 22 bp, Artificial Sequence
  chemically synthesized
cttaatattccgtcatcttgtt

SEQ ID NO: 873096 - DNA, 22 bp, Artificial Sequence
  chemically synthesized
aatattccgtcatcttgttcct

SEQ ID NO: 873097 - DNA, 22 bp, Artificial Sequence
  chemically synthesized
atattccgtcatcttgttccta

SEQ ID NO: 873098 - DNA, 22 bp, Artificial Sequence
  chemically synthesized
agcaacgatactgaagtaggaa

SEQ ID NO: 873099 - DNA, 22 bp, Artificial Sequence
  chemically synthesized
cgtcatcttgttcctacttcag

SEQ ID NO: 873100 - DNA, 22 bp, Artificial Sequence
  chemically synthesized
gttcctacttcagtatcgttgc

SEQ ID NO: 873101 - DNA, 22 bp, Artificial Sequence
  chemically synthesized
ttcctacttcagtatcgttgct

SEQ ID NO: 873102 - DNA, 22 bp, Artificial Sequence
  chemically synthesized
ctacttcagtatcgttgctcag

SEQ ID NO: 873103 - DNA, 22 bp, Artificial Sequence
  chemically synthesized
cttcagtatcgttgctcagtct

SEQ ID NO: 873104 - DNA, 22 bp, Artificial Sequence
  chemically synthesized
cagtatcgttgctcagtctttt

SEQ ID NO: 873105 - DNA, 22 bp, Artificial Sequence
  chemically synthesized
agtatcgttgctcagtcttttc

SEQ ID NO: 873106 - DNA, 22 bp, Artificial Sequence
  chemically synthesized
caggcagggagagaaaagactg

SEQ ID NO: 873107 - DNA, 22 bp, Artificial Sequence
  chemically synthesized
ttccaggcagggagagaaaaga

SEQ ID NO: 873108 - DNA, 22 bp, Artificial Sequence
  chemically synthesized
ctcagtcttttctctccctgcc

SEQ ID NO: 873109 - DNA, 22 bp, Artificial Sequence
  chemically synthesized
ggaaaattattccaggcaggga

SEQ ID NO: 873110 - DNA, 22 bp, Artificial Sequence
  chemically synthesized
agtcttttctctccctgcctgg

SEQ ID NO: 873111 - DNA, 22 bp, Artificial Sequence
  chemically synthesized
tgggaaaattattccaggcagg

SEQ ID NO: 873112 - DNA, 22 bp, Artificial Sequence
  chemically synthesized
ctgggaaaattattccaggcag

SEQ ID NO: 873113 - DNA, 22 bp, Artificial Sequence
  chemically synthesized
ttctctccctgcctggaataat

SEQ ID NO: 873114 - DNA, 22 bp, Artificial Sequence
  chemically synthesized
tctctccctgcctggaataatt

SEQ ID NO: 873115 - DNA, 22 bp, Artificial Sequence
  chemically synthesized
ctctccctgcctggaataattt

SEQ ID NO: 873116 - DNA, 22 bp, Artificial Sequence
  chemically synthesized
tctccctgcctggaataatttt

SEQ ID NO: 873117 - DNA, 22 bp, Artificial Sequence
  chemically synthesized
gtgtatttctgggaaaattatt

SEQ ID NO: 873118 - DNA, 22 bp, Artificial Sequence
  chemically synthesized
tccctgcctggaataattttcc

SEQ ID NO: 873119 - DNA, 22 bp, Artificial Sequence
  chemically synthesized
cctgcctggaataattttccca

SEQ ID NO: 873120 - DNA, 22 bp, Artificial Sequence
  chemically synthesized
cctggaataattttcccagaaa

SEQ ID NO: 873121 - DNA, 22 bp, Artificial Sequence
  chemically synthesized
gaataattttcccagaaataca

SEQ ID NO: 873122 - DNA, 22 bp, Artificial Sequence
  chemically synthesized
tcccagaaatacaccaggctca

SEQ ID NO: 873123 - DNA, 22 bp, Artificial Sequence
  chemically synthesized
cccagaaatacaccaggctcac

SEQ ID NO: 873124 - DNA, 22 bp, Artificial Sequence
  chemically synthesized
ccagaaatacaccaggctcact

SEQ ID NO: 873125 - DNA, 22 bp, Artificial Sequence
  chemically synthesized
atgtaagtgaggaagtgagcct

SEQ ID NO: 873126 - DNA, 22 bp, Artificial Sequence
  chemically synthesized
acttcctcacttacatcagttt

SEQ ID NO: 873127 - DNA, 22 bp, Artificial Sequence
  chemically synthesized
agagaacatcagaaaactgatg

SEQ ID NO: 873128 - DNA, 22 bp, Artificial Sequence
  chemically synthesized
cctcacttacatcagttttctg

SEQ ID NO: 873129 - DNA, 22 bp, Artificial Sequence
  chemically synthesized
ttaagagaacatcagaaaactg

SEQ ID NO: 873130 - DNA, 22 bp, Artificial Sequence
  chemically synthesized
ctcacttacatcagttttctga

SEQ ID NO: 873131 - DNA, 22 bp, Artificial Sequence
  chemically synthesized
acttacatcagttttctgatgt

SEQ ID NO: 873132 - DNA, 22 bp, Artificial Sequence
  chemically synthesized
tctgttaagagaacatcagaaa

SEQ ID NO: 873133 - DNA, 22 bp, Artificial Sequence
  chemically synthesized
gtctgttaagagaacatcagaa

SEQ ID NO: 873134 - DNA, 22 bp, Artificial Sequence
  chemically synthesized
acatcagttttctgatgttctc

SEQ ID NO: 873135 - DNA, 22 bp, Artificial Sequence
  chemically synthesized
catcagttttctgatgttctct

SEQ ID NO: 873136 - DNA, 22 bp, Artificial Sequence
  chemically synthesized
tctgatgttctcttaacagaca

SEQ ID NO: 873137 - DNA, 22 bp, Artificial Sequence
  chemically synthesized
ctgatgttctcttaacagacaa

SEQ ID NO: 873138 - DNA, 22 bp, Artificial Sequence
  chemically synthesized
tgatgttctcttaacagacaag

SEQ ID NO: 873139 - DNA, 22 bp, Artificial Sequence
  chemically synthesized
atgttctcttaacagacaagct

SEQ ID NO: 873140 - DNA, 22 bp, Artificial Sequence
  chemically synthesized
tagtgtggtcagggaagcttgt

SEQ ID NO: 873141 - DNA, 22 bp, Artificial Sequence
  chemically synthesized
tcttaacagacaagcttccctg

SEQ ID NO: 873142 - DNA, 22 bp, Artificial Sequence
  chemically synthesized
tctatagtgtggtcagggaagc

SEQ ID NO: 873143 - DNA, 22 bp, Artificial Sequence
  chemically synthesized
ttaacagacaagcttccctgac

SEQ ID NO: 873144 - DNA, 22 bp, Artificial Sequence
  chemically synthesized
aacagacaagcttccctgacca

SEQ ID NO: 873145 - DNA, 22 bp, Artificial Sequence
  chemically synthesized
ttgtctatagtgtggtcaggga

SEQ ID NO: 873146 - DNA, 22 bp, Artificial Sequence
  chemically synthesized
acagacaagcttccctgaccac

SEQ ID NO: 873147 - DNA, 22 bp, Artificial Sequence
  chemically synthesized
ccctgaccacactatagacaat

SEQ ID NO: 873148 - DNA, 22 bp, Artificial Sequence
  chemically synthesized
cctgaccacactatagacaata

SEQ ID NO: 873149 - DNA, 22 bp, Artificial Sequence
  chemically synthesized
accacactatagacaataatac

SEQ ID NO: 873150 - DNA, 22 bp, Artificial Sequence
  chemically synthesized
agcagggagatgggatgagggt

SEQ ID NO: 873151 - DNA, 22 bp, Artificial Sequence
  chemically synthesized
tagacaataataccctcatccc

SEQ ID NO: 873152 - DNA, 22 bp, Artificial Sequence
  chemically synthesized
cagagaacaactaagcagggag

SEQ ID NO: 873153 - DNA, 22 bp, Artificial Sequence
  chemically synthesized
atcccatctccctgcttagttg

SEQ ID NO: 873154 - DNA, 22 bp, Artificial Sequence
  chemically synthesized
agaaacaccattacagagaaca

SEQ ID NO: 873155 - DNA, 22 bp, Artificial Sequence
  chemically synthesized
gagaaacaccattacagagaac

SEQ ID NO: 873156 - DNA, 22 bp, Artificial Sequence
  chemically synthesized
cctgcttagttgttctctgtaa

SEQ ID NO: 873157 - DNA, 22 bp, Artificial Sequence
  chemically synthesized
cttagttgttctctgtaatggt

SEQ ID NO: 873158 - DNA, 22 bp, Artificial Sequence
  chemically synthesized
acatttgagaaacaccattaca

SEQ ID NO: 873159 - DNA, 22 bp, Artificial Sequence
  chemically synthesized
agttgttctctgtaatggtgtt

SEQ ID NO: 873160 - DNA, 22 bp, Artificial Sequence
  chemically synthesized
gttgttctctgtaatggtgttt

SEQ ID NO: 873161 - DNA, 22 bp, Artificial Sequence
  chemically synthesized
ttctctgtaatggtgtttctca

SEQ ID NO: 873162 - DNA, 22 bp, Artificial Sequence
  chemically synthesized
tgcacactgacatttgagaaac

SEQ ID NO: 873163 - DNA, 22 bp, Artificial Sequence
  chemically synthesized
tctgtaatggtgtttctcaaat

SEQ ID NO: 873164 - DNA, 22 bp, Artificial Sequence
  chemically synthesized
tgtaatggtgtttctcaaatgt

SEQ ID NO: 873165 - DNA, 22 bp, Artificial Sequence
  chemically synthesized
taatggtgtttctcaaatgtca

SEQ ID NO: 873166 - DNA, 22 bp, Artificial Sequence
  chemically synthesized
ctcaaatgtcagtgtgcacagg

SEQ ID NO: 873167 - DNA, 22 bp, Artificial Sequence
  chemically synthesized
tcaaatgtcagtgtgcacagga

SEQ ID NO: 873168 - DNA, 22 bp, Artificial Sequence
  chemically synthesized
aaatgtcagtgtgcacaggatt

SEQ ID NO: 873169 - DNA, 22 bp, Artificial Sequence
  chemically synthesized
atagaatccccaggtgaatcct

SEQ ID NO: 873170 - DNA, 22 bp, Artificial Sequence
  chemically synthesized
aatagaatccccaggtgaatcc

SEQ ID NO: 873171 - DNA, 22 bp, Artificial Sequence
  chemically synthesized
taatagaatccccaggtgaatc

SEQ ID NO: 873172 - DNA, 22 bp, Artificial Sequence
  chemically synthesized
cattttaatagaatccccaggt

SEQ ID NO: 873173 - DNA, 22 bp, Artificial Sequence
  chemically synthesized
acctggggattctattaaaatg

SEQ ID NO: 873174 - DNA, 22 bp, Artificial Sequence
  chemically synthesized
aatcacaatctgcattttaata

SEQ ID NO: 873175 - DNA, 22 bp, Artificial Sequence
  chemically synthesized
gggattctattaaaatgcagat

SEQ ID NO: 873176 - DNA, 22 bp, Artificial Sequence
  chemically synthesized
gacccactgaatcacaatctgc

SEQ ID NO: 873177 - DNA, 22 bp, Artificial Sequence
  chemically synthesized
tattaaaatgcagattgtgatt

SEQ ID NO: 873178 - DNA, 22 bp, Artificial Sequence
  chemically synthesized
ttaaaatgcagattgtgattca

SEQ ID NO: 873179 - DNA, 22 bp, Artificial Sequence
  chemically synthesized
tcctagacccactgaatcacaa

SEQ ID NO: 873180 - DNA, 22 bp, Artificial Sequence
  chemically synthesized
aaatgcagattgtgattcagtg

SEQ ID NO: 873181 - DNA, 22 bp, Artificial Sequence
  chemically synthesized
aggcccctatcctagacccact

SEQ ID NO: 873182 - DNA, 22 bp, Artificial Sequence
  chemically synthesized
tgattcagtgggtctaggatag

SEQ ID NO: 873183 - DNA, 22 bp, Artificial Sequence
  chemically synthesized
agtgggtctaggataggggcct

SEQ ID NO: 873184 - DNA, 22 bp, Artificial Sequence
  chemically synthesized
gacacacagaatctgaggcccc

SEQ ID NO: 873185 - DNA, 22 bp, Artificial Sequence
  chemically synthesized
ttagacacacagaatctgaggc

SEQ ID NO: 873186 - DNA, 22 bp, Artificial Sequence
  chemically synthesized
gttagacacacagaatctgagg

SEQ ID NO: 873187 - DNA, 22 bp, Artificial Sequence
  chemically synthesized
ggataggggcctcagattctgt

SEQ ID NO: 873188 - DNA, 22 bp, Artificial Sequence
  chemically synthesized
agattctgtgtgtctaacaaat

SEQ ID NO: 873189 - DNA, 22 bp, Artificial Sequence
  chemically synthesized
atgtcaatgggtatttgttaga

SEQ ID NO: 873190 - DNA, 22 bp, Artificial Sequence
  chemically synthesized
tgtgtgtctaacaaatacccat

SEQ ID NO: 873191 - DNA, 22 bp, Artificial Sequence
  chemically synthesized
cagattgatgtcaatgggtatt

SEQ ID NO: 873192 - DNA, 22 bp, Artificial Sequence
  chemically synthesized
tgtgtctaacaaatacccattg

SEQ ID NO: 873193 - DNA, 22 bp, Artificial Sequence
  chemically synthesized
acaaatacccattgacatcaat

SEQ ID NO: 873194 - DNA, 22 bp, Artificial Sequence
  chemically synthesized
tagagtgtagtctacagattga

SEQ ID NO: 873195 - DNA, 22 bp, Artificial Sequence
  chemically synthesized
acatcaatctgtagactacact

SEQ ID NO: 873196 - DNA, 22 bp, Artificial Sequence
  chemically synthesized
taagtgctgtagagtgtagtct

SEQ ID NO: 873197 - DNA, 22 bp, Artificial Sequence
  chemically synthesized
aataattataagtgctgtagag

SEQ ID NO: 873198 - DNA, 22 bp, Artificial Sequence
  chemically synthesized
tagactacactctacagcactt

SEQ ID NO: 873199 - DNA, 22 bp, Artificial Sequence
  chemically synthesized
tctcaataattataagtgctgt

SEQ ID NO: 873200 - DNA, 22 bp, Artificial Sequence
  chemically synthesized
cactctacagcacttataatta

SEQ ID NO: 873201 - DNA, 22 bp, Artificial Sequence
  chemically synthesized
tacagcacttataattattgag

SEQ ID NO: 873202 - DNA, 22 bp, Artificial Sequence
  chemically synthesized
cagcacttataattattgagac

SEQ ID NO: 873203 - DNA, 22 bp, Artificial Sequence
  chemically synthesized
atgaagaaaatatatactgtct

SEQ ID NO: 873204 - DNA, 22 bp, Artificial Sequence
  chemically synthesized
ataattattgagacagtatata

SEQ ID NO: 873205 - DNA, 22 bp, Artificial Sequence
  chemically synthesized
taattattgagacagtatatat

SEQ ID NO: 873206 - DNA, 22 bp, Artificial Sequence
  chemically synthesized
ttgagacagtatatattttctt

SEQ ID NO: 873207 - DNA, 22 bp, Artificial Sequence
  chemically synthesized
agacagtatatattttcttcat

SEQ ID NO: 873208 - DNA, 22 bp, Artificial Sequence
  chemically synthesized
aaagagaaagacaataaactaa

SEQ ID NO: 873209 - DNA, 22 bp, Artificial Sequence
  chemically synthesized
tcttcattagtttattgtcttt

SEQ ID NO: 873210 - DNA, 22 bp, Artificial Sequence
  chemically synthesized
taattgaaagagaaagacaata

SEQ ID NO: 873211 - DNA, 22 bp, Artificial Sequence
  chemically synthesized
cttcattagtttattgtctttc

SEQ ID NO: 873212 - DNA, 22 bp, Artificial Sequence
  chemically synthesized
ttcattagtttattgtctttct

SEQ ID NO: 873213 - DNA, 22 bp, Artificial Sequence
  chemically synthesized
cattagtttattgtctttctct

SEQ ID NO: 873214 - DNA, 22 bp, Artificial Sequence
  chemically synthesized
attagtttattgtctttctctt

SEQ ID NO: 873215 - DNA, 22 bp, Artificial Sequence
  chemically synthesized
gtttattgtctttctctttcaa

SEQ ID NO: 873216 - DNA, 22 bp, Artificial Sequence
  chemically synthesized
attgtctttctctttcaattac

SEQ ID NO: 873217 - DNA, 22 bp, Artificial Sequence
  chemically synthesized
ttgtctttctctttcaattaca

SEQ ID NO: 873218 - DNA, 22 bp, Artificial Sequence
  chemically synthesized
ataaaacatatattgtaattga

SEQ ID NO: 873219 - DNA, 22 bp, Artificial Sequence
  chemically synthesized
cataaaacatatattgtaattg

SEQ ID NO: 873220 - DNA, 22 bp, Artificial Sequence
  chemically synthesized
tctttctctttcaattacaata

SEQ ID NO: 873221 - DNA, 22 bp, Artificial Sequence
  chemically synthesized
tcataaaacatatattgtaatt

SEQ ID NO: 873222 - DNA, 22 bp, Artificial Sequence
  chemically synthesized
ctttcataaaacatatattgta

SEQ ID NO: 873223 - DNA, 22 bp, Artificial Sequence
  chemically synthesized
tctctttcaattacaatatatg

SEQ ID NO: 873224 - DNA, 22 bp, Artificial Sequence
  chemically synthesized
ctctttcaattacaatatatgt

SEQ ID NO: 873225 - DNA, 22 bp, Artificial Sequence
  chemically synthesized
tcctttcataaaacatatattg

SEQ ID NO: 873226 - DNA, 22 bp, Artificial Sequence
  chemically synthesized
tctttcaattacaatatatgtt

SEQ ID NO: 873227 - DNA, 22 bp, Artificial Sequence
  chemically synthesized
tttcaattacaatatatgtttt

SEQ ID NO: 873228 - DNA, 22 bp, Artificial Sequence
  chemically synthesized
tcaattacaatatatgttttat

SEQ ID NO: 873229 - DNA, 22 bp, Artificial Sequence
  chemically synthesized
caattacaatatatgttttatg

SEQ ID NO: 873230 - DNA, 22 bp, Artificial Sequence
  chemically synthesized
aattacaatatatgttttatga

SEQ ID NO: 873231 - DNA, 22 bp, Artificial Sequence
  chemically synthesized
caatatatgttttatgaaagga

SEQ ID NO: 873232 - DNA, 22 bp, Artificial Sequence
  chemically synthesized
tatgaaaggagagacttttatt

SEQ ID NO: 873233 - DNA, 22 bp, Artificial Sequence
  chemically synthesized
atgaaaggagagacttttattc

SEQ ID NO: 873234 - DNA, 22 bp, Artificial Sequence
  chemically synthesized
tgaaaggagagacttttattct

SEQ ID NO: 873235 - DNA, 22 bp, Artificial Sequence
  chemically synthesized
cgagtacagcatagaataaaag

SEQ ID NO: 873236 - DNA, 22 bp, Artificial Sequence
  chemically synthesized
gtgctgcgagtacagcatagaa

SEQ ID NO: 873237 - DNA, 22 bp, Artificial Sequence
  chemically synthesized
ttattctatgctgtactcgcag

SEQ ID NO: 873238 - DNA, 22 bp, Artificial Sequence
  chemically synthesized
tattctatgctgtactcgcagc

SEQ ID NO: 873239 - DNA, 22 bp, Artificial Sequence
  chemically synthesized
attctatgctgtactcgcagca

SEQ ID NO: 873240 - DNA, 22 bp, Artificial Sequence
  chemically synthesized
ttctatgctgtactcgcagcac

SEQ ID NO: 873241 - DNA, 22 bp, Artificial Sequence
  chemically synthesized
agcatcatactggtgctgcgag

SEQ ID NO: 873242 - DNA, 22 bp, Artificial Sequence
  chemically synthesized
tatgctgtactcgcagcaccag

SEQ ID NO: 873243 - DNA, 22 bp, Artificial Sequence
  chemically synthesized
tgctgtactcgcagcaccagta

SEQ ID NO: 873244 - DNA, 22 bp, Artificial Sequence
  chemically synthesized
catgtgttgagcatcatactgg

SEQ ID NO: 873245 - DNA, 22 bp, Artificial Sequence
  chemically synthesized
tactcgcagcaccagtatgatg

SEQ ID NO: 873246 - DNA, 22 bp, Artificial Sequence
  chemically synthesized
ccatgtgttgagcatcatactg

SEQ ID NO: 873247 - DNA, 22 bp, Artificial Sequence
  chemically synthesized
acttccatgtgttgagcatcat

SEQ ID NO: 873248 - DNA, 22 bp, Artificial Sequence
  chemically synthesized
gcagcaccagtatgatgctcaa

SEQ ID NO: 873249 - DNA, 22 bp, Artificial Sequence
  chemically synthesized
ttaacttccatgtgttgagcat

SEQ ID NO: 873250 - DNA, 22 bp, Artificial Sequence
  chemically synthesized
attaacttccatgtgttgagca

SEQ ID NO: 873251 - DNA, 22 bp, Artificial Sequence
  chemically synthesized
tttattaacttccatgtgttga

SEQ ID NO: 873252 - DNA, 22 bp, Artificial Sequence
  chemically synthesized
atttattaacttccatgtgttg

SEQ ID NO: 873253 - DNA, 22 bp, Artificial Sequence
  chemically synthesized
tatttattaacttccatgtgtt

SEQ ID NO: 873254 - DNA, 22 bp, Artificial Sequence
  chemically synthesized
atccactttatttattaacttc

SEQ ID NO: 873255 - DNA, 22 bp, Artificial Sequence
  chemically synthesized
aacacatggaagttaataaata

SEQ ID NO: 873256 - DNA, 22 bp, Artificial Sequence
  chemically synthesized
cagcaacatatataattcatcc

SEQ ID NO: 873257 - DNA, 22 bp, Artificial Sequence
  chemically synthesized
ataaataaagtggatgaattat

SEQ ID NO: 873258 - DNA, 22 bp, Artificial Sequence
  chemically synthesized
ccagcaacatatataattcatc

SEQ ID NO: 873259 - DNA, 22 bp, Artificial Sequence
  chemically synthesized
acttccagcaacatatataatt

SEQ ID NO: 873260 - DNA, 22 bp, Artificial Sequence
  chemically synthesized
gacttccagcaacatatataat

SEQ ID NO: 873261 - DNA, 22 bp, Artificial Sequence
  chemically synthesized
tgacttccagcaacatatataa

SEQ ID NO: 873262 - DNA, 22 bp, Artificial Sequence
  chemically synthesized
cagttttgacttccagcaacat

SEQ ID NO: 873263 - DNA, 22 bp, Artificial Sequence
  chemically synthesized
gaagttccagttttgacttcca

SEQ ID NO: 873264 - DNA, 22 bp, Artificial Sequence
  chemically synthesized
tatatgttgctggaagtcaaaa

SEQ ID NO: 873265 - DNA, 22 bp, Artificial Sequence
  chemically synthesized
ctggaagtcaaaactggaactt

SEQ ID NO: 873266 - DNA, 22 bp, Artificial Sequence
  chemically synthesized
gaagtcaaaactggaacttcca

SEQ ID NO: 873267 - DNA, 22 bp, Artificial Sequence
  chemically synthesized
taagaaaaatacattggaagtt

SEQ ID NO: 873268 - DNA, 22 bp, Artificial Sequence
  chemically synthesized
ataagaaaaatacattggaagt

SEQ ID NO: 873269 - DNA, 22 bp, Artificial Sequence
  chemically synthesized
gaacttccaatgtatttttctt

SEQ ID NO: 873270 - DNA, 22 bp, Artificial Sequence
  chemically synthesized
aatgtaacaatgtttataagaa

SEQ ID NO: 873271 - DNA, 22 bp, Artificial Sequence
  chemically synthesized
ccaatgtatttttcttataaac

SEQ ID NO: 873272 - DNA, 22 bp, Artificial Sequence
  chemically synthesized
caatgtatttttcttataaaca

SEQ ID NO: 873273 - DNA, 22 bp, Artificial Sequence
  chemically synthesized
cctaaatgtaacaatgtttata

SEQ ID NO: 873274 - DNA, 22 bp, Artificial Sequence
  chemically synthesized
acctaaatgtaacaatgtttat

SEQ ID NO: 873275 - DNA, 22 bp, Artificial Sequence
  chemically synthesized
ttcttataaacattgttacatt

SEQ ID NO: 873276 - DNA, 22 bp, Artificial Sequence
  chemically synthesized
tcttataaacattgttacattt

SEQ ID NO: 873277 - DNA, 22 bp, Artificial Sequence
  chemically synthesized
cttataaacattgttacattta

SEQ ID NO: 873278 - DNA, 22 bp, Artificial Sequence
  chemically synthesized
ttataaacattgttacatttag

SEQ ID NO: 873279 - DNA, 22 bp, Artificial Sequence
  chemically synthesized
acgtgtaacttacctaaatgta

SEQ ID NO: 873280 - DNA, 22 bp, Artificial Sequence
  chemically synthesized
ataaacattgttacatttaggt

SEQ ID NO: 873281 - DNA, 22 bp, Artificial Sequence
  chemically synthesized
aacgtgtaacttacctaaatgt

SEQ ID NO: 873282 - DNA, 22 bp, Artificial Sequence
  chemically synthesized
taaacattgttacatttaggta

SEQ ID NO: 873283 - DNA, 22 bp, Artificial Sequence
  chemically synthesized
ttacatttaggtaagttacacg

SEQ ID NO: 873284 - DNA, 22 bp, Artificial Sequence
  chemically synthesized
catttaggtaagttacacgtta

SEQ ID NO: 873285 - DNA, 22 bp, Artificial Sequence
  chemically synthesized
aggtaagttacacgttaaatgg

SEQ ID NO: 873286 - DNA, 22 bp, Artificial Sequence
  chemically synthesized
ggtaagttacacgttaaatgga

SEQ ID NO: 873287 - DNA, 22 bp, Artificial Sequence
  chemically synthesized
caaaaccagggcgccgaaatcc

SEQ ID NO: 873288 - DNA, 22 bp, Artificial Sequence
  chemically synthesized
cacgttaaatggatttcggcgc

SEQ ID NO: 873289 - DNA, 22 bp, Artificial Sequence
  chemically synthesized
aatggatttcggcgccctggtt

SEQ ID NO: 873290 - DNA, 22 bp, Artificial Sequence
  chemically synthesized
cggcgccctggttttggagcct

SEQ ID NO: 873291 - DNA, 22 bp, Artificial Sequence
  chemically synthesized
cacatggtaggaaggctccaaa

SEQ ID NO: 873292 - DNA, 22 bp, Artificial Sequence
  chemically synthesized
ggcgccctggttttggagcctt

SEQ ID NO: 873293 - DNA, 22 bp, Artificial Sequence
  chemically synthesized
gttttggagccttcctaccatg

SEQ ID NO: 873294 - DNA, 22 bp, Artificial Sequence
  chemically synthesized
tggagccttcctaccatgtgta

SEQ ID NO: 873295 - DNA, 22 bp, Artificial Sequence
  chemically synthesized
ggagccttcctaccatgtgtaa

SEQ ID NO: 873296 - DNA, 22 bp, Artificial Sequence
  chemically synthesized
gagccttcctaccatgtgtaac

SEQ ID NO: 873297 - DNA, 22 bp, Artificial Sequence
  chemically synthesized
tgtcccatataagccacgttac

SEQ ID NO: 873298 - DNA, 22 bp, Artificial Sequence
  chemically synthesized
atgtcccatataagccacgtta

SEQ ID NO: 873299 - DNA, 22 bp, Artificial Sequence
  chemically synthesized
cctaccatgtgtaacgtggctt

SEQ ID NO: 873300 - DNA, 22 bp, Artificial Sequence
  chemically synthesized
ctaccatgtgtaacgtggctta

SEQ ID NO: 873301 - DNA, 22 bp, Artificial Sequence
  chemically synthesized
ccatgtgtaacgtggcttatat

SEQ ID NO: 873302 - DNA, 22 bp, Artificial Sequence
  chemically synthesized
atgagtttatgtcccatataag

SEQ ID NO: 873303 - DNA, 22 bp, Artificial Sequence
  chemically synthesized
aactcatgagtttatgtcccat

SEQ ID NO: 873304 - DNA, 22 bp, Artificial Sequence
  chemically synthesized
tgaactcatgagtttatgtccc

SEQ ID NO: 873305 - DNA, 22 bp, Artificial Sequence
  chemically synthesized
aactctgaactcatgagtttat

SEQ ID NO: 873306 - DNA, 22 bp, Artificial Sequence
  chemically synthesized
atatgggacataaactcatgag

SEQ ID NO: 873307 - DNA, 22 bp, Artificial Sequence
  chemically synthesized
ttaaactctgaactcatgagtt

SEQ ID NO: 873308 - DNA, 22 bp, Artificial Sequence
  chemically synthesized
tatgggacataaactcatgagt

SEQ ID NO: 873309 - DNA, 22 bp, Artificial Sequence
  chemically synthesized
gttaaactctgaactcatgagt

SEQ ID NO: 873310 - DNA, 22 bp, Artificial Sequence
  chemically synthesized
taagtttgttaaactctgaact

SEQ ID NO: 873311 - DNA, 22 bp, Artificial Sequence
  chemically synthesized
ataagtttgttaaactctgaac

SEQ ID NO: 873312 - DNA, 22 bp, Artificial Sequence
  chemically synthesized
tataagtttgttaaactctgaa

SEQ ID NO: 873313 - DNA, 22 bp, Artificial Sequence
  chemically synthesized
atgagttcagagtttaacaaac

SEQ ID NO: 873314 - DNA, 22 bp, Artificial Sequence
  chemically synthesized
caatgatgttttataagtttgt

SEQ ID NO: 873315 - DNA, 22 bp, Artificial Sequence
  chemically synthesized
agagtttaacaaacttataaaa

SEQ ID NO: 873316 - DNA, 22 bp, Artificial Sequence
  chemically synthesized
tgttccaatgatgttttataag

SEQ ID NO: 873317 - DNA, 22 bp, Artificial Sequence
  chemically synthesized
aacaaacttataaaacatcatt

SEQ ID NO: 873318 - DNA, 22 bp, Artificial Sequence
  chemically synthesized
acaaacttataaaacatcattg

SEQ ID NO: 873319 - DNA, 22 bp, Artificial Sequence
  chemically synthesized
catgaagagattatgttccaat

SEQ ID NO: 873320 - DNA, 22 bp, Artificial Sequence
  chemically synthesized
ataaaacatcattggaacataa

SEQ ID NO: 873321 - DNA, 22 bp, Artificial Sequence
  chemically synthesized
taaaacatcattggaacataat

SEQ ID NO: 873322 - DNA, 22 bp, Artificial Sequence
  chemically synthesized
taactccatgaagagattatgt

SEQ ID NO: 873323 - DNA, 22 bp, Artificial Sequence
  chemically synthesized
tgtaactccatgaagagattat

SEQ ID NO: 873324 - DNA, 22 bp, Artificial Sequence
  chemically synthesized
agactctgtaactccatgaaga

SEQ ID NO: 873325 - DNA, 22 bp, Artificial Sequence
  chemically synthesized
gaacataatctcttcatggagt

SEQ ID NO: 873326 - DNA, 22 bp, Artificial Sequence
  chemically synthesized
agcctcagactctgtaactcca

SEQ ID NO: 873327 - DNA, 22 bp, Artificial Sequence
  chemically synthesized
ttcatggagttacagagtctga

SEQ ID NO: 873328 - DNA, 22 bp, Artificial Sequence
  chemically synthesized
gtaggttcagcctcagactctg

SEQ ID NO: 873329 - DNA, 22 bp, Artificial Sequence
  chemically synthesized
catggagttacagagtctgagg

SEQ ID NO: 873330 - DNA, 22 bp, Artificial Sequence
  chemically synthesized
tggtaggttcagcctcagactc

SEQ ID NO: 873331 - DNA, 22 bp, Artificial Sequence
  chemically synthesized
atggagttacagagtctgaggc

SEQ ID NO: 873332 - DNA, 22 bp, Artificial Sequence
  chemically synthesized
tctctggtaggttcagcctcag

SEQ ID NO: 873333 - DNA, 22 bp, Artificial Sequence
  chemically synthesized
gctgtctctggtaggttcagcc

SEQ ID NO: 873334 - DNA, 22 bp, Artificial Sequence
  chemically synthesized
cagagtctgaggctgaacctac

SEQ ID NO: 873335 - DNA, 22 bp, Artificial Sequence
  chemically synthesized
tggctgtctctggtaggttcag

SEQ ID NO: 873336 - DNA, 22 bp, Artificial Sequence
  chemically synthesized
ctggctgtctctggtaggttca

SEQ ID NO: 873337 - DNA, 22 bp, Artificial Sequence
  chemically synthesized
tctggctgtctctggtaggttc

SEQ ID NO: 873338 - DNA, 22 bp, Artificial Sequence
  chemically synthesized
ttttctggctgtctctggtagg

SEQ ID NO: 873339 - DNA, 22 bp, Artificial Sequence
  chemically synthesized
aggctgaacctaccagagacag

SEQ ID NO: 873340 - DNA, 22 bp, Artificial Sequence
  chemically synthesized
gtgtctgttttctggctgtctc

SEQ ID NO: 873341 - DNA, 22 bp, Artificial Sequence
  chemically synthesized
aacctaccagagacagccagaa

SEQ ID NO: 873342 - DNA, 22 bp, Artificial Sequence
  chemically synthesized
ttggtgtctgttttctggctgt

SEQ ID NO: 873343 - DNA, 22 bp, Artificial Sequence
  chemically synthesized
attggtgtctgttttctggctg

SEQ ID NO: 873344 - DNA, 22 bp, Artificial Sequence
  chemically synthesized
ccagagacagccagaaaacaga

SEQ ID NO: 873345 - DNA, 22 bp, Artificial Sequence
  chemically synthesized
tcatttattggtgtctgttttc

SEQ ID NO: 873346 - DNA, 22 bp, Artificial Sequence
  chemically synthesized
tgttatcatttattggtgtctg

SEQ ID NO: 873347 - DNA, 22 bp, Artificial Sequence
  chemically synthesized
ctatgttatcatttattggtgt

SEQ ID NO: 873348 - DNA, 22 bp, Artificial Sequence
  chemically synthesized
ttcctatgttatcatttattgg

SEQ ID NO: 873349 - DNA, 22 bp, Artificial Sequence
  chemically synthesized
gttcctatgttatcatttattg

SEQ ID NO: 873350 - DNA, 22 bp, Artificial Sequence
  chemically synthesized
agcgcatatgcatagtttgttc

SEQ ID NO: 873351 - DNA, 22 bp, Artificial Sequence
  chemically synthesized
cctcagcgcatatgcatagttt

SEQ ID NO: 873352 - DNA, 22 bp, Artificial Sequence
  chemically synthesized
gttccctcagcgcatatgcata

SEQ ID NO: 873353 - DNA, 22 bp, Artificial Sequence
  chemically synthesized
ggttccctcagcgcatatgcat

SEQ ID NO: 873354 - DNA, 22 bp, Artificial Sequence
  chemically synthesized
tggttccctcagcgcatatgca

SEQ ID NO: 873355 - DNA, 22 bp, Artificial Sequence
  chemically synthesized
ttggttccctcagcgcatatgc

SEQ ID NO: 873356 - DNA, 22 bp, Artificial Sequence
  chemically synthesized
taatttttggttccctcagcgc

SEQ ID NO: 873357 - DNA, 22 bp, Artificial Sequence
  chemically synthesized
tgcatatgcgctgagggaacca

SEQ ID NO: 873358 - DNA, 22 bp, Artificial Sequence
  chemically synthesized
tgagctgtaatttttggttccc

SEQ ID NO: 873359 - DNA, 22 bp, Artificial Sequence
  chemically synthesized
atgagctgtaatttttggttcc

SEQ ID NO: 873360 - DNA, 22 bp, Artificial Sequence
  chemically synthesized
tatgagctgtaatttttggttc

SEQ ID NO: 873361 - DNA, 22 bp, Artificial Sequence
  chemically synthesized
ttatgagctgtaatttttggtt

SEQ ID NO: 873362 - DNA, 22 bp, Artificial Sequence
  chemically synthesized
tttttatgagctgtaatttttg

SEQ ID NO: 873363 - DNA, 22 bp, Artificial Sequence
  chemically synthesized
gtttttatgagctgtaattttt

SEQ ID NO: 873364 - DNA, 22 bp, Artificial Sequence
  chemically synthesized
tttgtttttatgagctgtaatt

SEQ ID NO: 873365 - DNA, 22 bp, Artificial Sequence
  chemically synthesized
agggaaccaaaaattacagctc

SEQ ID NO: 873366 - DNA, 22 bp, Artificial Sequence
  chemically synthesized
atttgtttttatgagctgtaat

SEQ ID NO: 873367 - DNA, 22 bp, Artificial Sequence
  chemically synthesized
tgtcaggtttatttgtttttat

SEQ ID NO: 873368 - DNA, 22 bp, Artificial Sequence
  chemically synthesized
aactgtgtcaggtttatttgtt

SEQ ID NO: 873369 - DNA, 22 bp, Artificial Sequence
  chemically synthesized
cagctcataaaaacaaataaac

SEQ ID NO: 873370 - DNA, 22 bp, Artificial Sequence
  chemically synthesized
tactcaactgtgtcaggtttat

SEQ ID NO: 873371 - DNA, 22 bp, Artificial Sequence
  chemically synthesized
ataaaaacaaataaacctgaca

SEQ ID NO: 873372 - DNA, 22 bp, Artificial Sequence
  chemically synthesized
tatcagggttatactcaactgt

SEQ ID NO: 873373 - DNA, 22 bp, Artificial Sequence
  chemically synthesized
ctgtatcagggttatactcaac

SEQ ID NO: 873374 - DNA, 22 bp, Artificial Sequence
  chemically synthesized
aaattgctgtatcagggttata

SEQ ID NO: 873375 - DNA, 22 bp, Artificial Sequence
  chemically synthesized
acacagttgagtataaccctga

SEQ ID NO: 873376 - DNA, 22 bp, Artificial Sequence
  chemically synthesized
ggacactgaaattgctgtatca

SEQ ID NO: 873377 - DNA, 22 bp, Artificial Sequence
  chemically synthesized
agtataaccctgatacagcaat

SEQ ID NO: 873378 - DNA, 22 bp, Artificial Sequence
  chemically synthesized
tcaatctgggacactgaaattg

SEQ ID NO: 873379 - DNA, 22 bp, Artificial Sequence
  chemically synthesized
gtcaatctgggacactgaaatt

SEQ ID NO: 873380 - DNA, 22 bp, Artificial Sequence
  chemically synthesized
tgtcaatctgggacactgaaat

SEQ ID NO: 873381 - DNA, 22 bp, Artificial Sequence
  chemically synthesized
ttgtcaatctgggacactgaaa

SEQ ID NO: 873382 - DNA, 22 bp, Artificial Sequence
  chemically synthesized
tttgtcaatctgggacactgaa

SEQ ID NO: 873383 - DNA, 22 bp, Artificial Sequence
  chemically synthesized
ttttgtcaatctgggacactga

SEQ ID NO: 873384 - DNA, 22 bp, Artificial Sequence
  chemically synthesized
atacagcaatttcagtgtccca

SEQ ID NO: 873385 - DNA, 22 bp, Artificial Sequence
  chemically synthesized
tttttgtcaatctgggacactg

SEQ ID NO: 873386 - DNA, 22 bp, Artificial Sequence
  chemically synthesized
ttttttgtcaatctgggacact

SEQ ID NO: 873387 - DNA, 22 bp, Artificial Sequence
  chemically synthesized
tttttttgtcaatctgggacac

SEQ ID NO: 873388 - DNA, 22 bp, Artificial Sequence
  chemically synthesized
ttttttttgtcaatctgggaca

SEQ ID NO: 873389 - DNA, 22 bp, Artificial Sequence
  chemically synthesized
tttttttttgtcaatctgggac

SEQ ID NO: 873390 - DNA, 22 bp, Artificial Sequence
  chemically synthesized
tggttttttttttttgtcaatc

SEQ ID NO: 873391 - DNA, 22 bp, Artificial Sequence
  chemically synthesized
cagtgtcccagattgacaaaaa

SEQ ID NO: 873392 - DNA, 22 bp, Artificial Sequence
  chemically synthesized
agtgtcccagattgacaaaaaa

SEQ ID NO: 873393 - DNA, 22 bp, Artificial Sequence
  chemically synthesized
agcattatggtttttttttttt

SEQ ID NO: 873394 - DNA, 22 bp, Artificial Sequence
  chemically synthesized
aagcattatggttttttttttt

SEQ ID NO: 873395 - DNA, 22 bp, Artificial Sequence
  chemically synthesized
gagacttaagcattatggtttt

SEQ ID NO: 873396 - DNA, 22 bp, Artificial Sequence
  chemically synthesized
ggagacttaagcattatggttt

SEQ ID NO: 873397 - DNA, 22 bp, Artificial Sequence
  chemically synthesized
acaaaaaaaaaaaaccataatg

SEQ ID NO: 873398 - DNA, 22 bp, Artificial Sequence
  chemically synthesized
tggagacttaagcattatggtt

SEQ ID NO: 873399 - DNA, 22 bp, Artificial Sequence
  chemically synthesized
acgactttggagacttaagcat

SEQ ID NO: 873400 - DNA, 22 bp, Artificial Sequence
  chemically synthesized
aacgactttggagacttaagca

SEQ ID NO: 873401 - DNA, 22 bp, Artificial Sequence
  chemically synthesized
gatttaacgactttggagactt

SEQ ID NO: 873402 - DNA, 22 bp, Artificial Sequence
  chemically synthesized
aagtctccaaagtcgttaaatc

SEQ ID NO: 873403 - DNA, 22 bp, Artificial Sequence
  chemically synthesized
agtctccaaagtcgttaaatct

SEQ ID NO: 873404 - DNA, 22 bp, Artificial Sequence
  chemically synthesized
ggcagtcatcagagttagattt

SEQ ID NO: 873405 - DNA, 22 bp, Artificial Sequence
  chemically synthesized
caaagtcgttaaatctaactct

SEQ ID NO: 873406 - DNA, 22 bp, Artificial Sequence
  chemically synthesized
ctcggcagtcatcagagttaga

SEQ ID NO: 873407 - DNA, 22 bp, Artificial Sequence
  chemically synthesized
ggattactcggcagtcatcaga

SEQ ID NO: 873408 - DNA, 22 bp, Artificial Sequence
  chemically synthesized
tgggattactcggcagtcatca

SEQ ID NO: 873409 - DNA, 22 bp, Artificial Sequence
  chemically synthesized
aatctaactctgatgactgccg

SEQ ID NO: 873410 - DNA, 22 bp, Artificial Sequence
  chemically synthesized
actctgatgactgccgagtaat

SEQ ID NO: 873411 - DNA, 22 bp, Artificial Sequence
  chemically synthesized
atgtgccctctgggattactcg

SEQ ID NO: 873412 - DNA, 22 bp, Artificial Sequence
  chemically synthesized
tgatgactgccgagtaatccca

SEQ ID NO: 873413 - DNA, 22 bp, Artificial Sequence
  chemically synthesized
atgactgccgagtaatcccaga

SEQ ID NO: 873414 - DNA, 22 bp, Artificial Sequence
  chemically synthesized
ccgagtaatcccagagggcaca

SEQ ID NO: 873415 - DNA, 22 bp, Artificial Sequence
  chemically synthesized
gggacagtgcatctcatgtgcc

SEQ ID NO: 873416 - DNA, 22 bp, Artificial Sequence
  chemically synthesized
caatctggggacagtgcatctc

SEQ ID NO: 873417 - DNA, 22 bp, Artificial Sequence
  chemically synthesized
aaagaagccctacaatctgggg

SEQ ID NO: 873418 - DNA, 22 bp, Artificial Sequence
  chemically synthesized
gattaaaagaagccctacaatc

SEQ ID NO: 873419 - DNA, 22 bp, Artificial Sequence
  chemically synthesized
ggattaaaagaagccctacaat

SEQ ID NO: 873420 - DNA, 22 bp, Artificial Sequence
  chemically synthesized
tccccagattgtagggcttctt

SEQ ID NO: 873421 - DNA, 22 bp, Artificial Sequence
  chemically synthesized
tagggcttcttttaatccaagc

SEQ ID NO: 873422 - DNA, 22 bp, Artificial Sequence
  chemically synthesized
gaaggcataaatagtgcttgga

SEQ ID NO: 873423 - DNA, 22 bp, Artificial Sequence
  chemically synthesized
attagaaggcataaatagtgct

SEQ ID NO: 873424 - DNA, 22 bp, Artificial Sequence
  chemically synthesized
cttttaatccaagcactattta

SEQ ID NO: 873425 - DNA, 22 bp, Artificial Sequence
  chemically synthesized
ttttaatccaagcactatttat

SEQ ID NO: 873426 - DNA, 22 bp, Artificial Sequence
  chemically synthesized
ttaatccaagcactatttatgc

SEQ ID NO: 873427 - DNA, 22 bp, Artificial Sequence
  chemically synthesized
taatccaagcactatttatgcc

SEQ ID NO: 873428 - DNA, 22 bp, Artificial Sequence
  chemically synthesized
aatccaagcactatttatgcct

SEQ ID NO: 873429 - DNA, 22 bp, Artificial Sequence
  chemically synthesized
atccaagcactatttatgcctt

SEQ ID NO: 873430 - DNA, 22 bp, Artificial Sequence
  chemically synthesized
tttatgccttctaatgaattat

SEQ ID NO: 873431 - DNA, 22 bp, Artificial Sequence
  chemically synthesized
gggtagcacaatcataattcat

SEQ ID NO: 873432 - DNA, 22 bp, Artificial Sequence
  chemically synthesized
atgccttctaatgaattatgat

SEQ ID NO: 873433 - DNA, 22 bp, Artificial Sequence
  chemically synthesized
tgccttctaatgaattatgatt

SEQ ID NO: 873434 - DNA, 22 bp, Artificial Sequence
  chemically synthesized
ctaatgaattatgattgtgcta

SEQ ID NO: 873435 - DNA, 22 bp, Artificial Sequence
  chemically synthesized
taatgaattatgattgtgctac

SEQ ID NO: 873436 - DNA, 22 bp, Artificial Sequence
  chemically synthesized
atgaattatgattgtgctaccc

SEQ ID NO: 873437 - DNA, 22 bp, Artificial Sequence
  chemically synthesized
gaagaatcacagctggggtagc

SEQ ID NO: 873438 - DNA, 22 bp, Artificial Sequence
  chemically synthesized
tgattgtgctaccccagctgtg

SEQ ID NO: 873439 - DNA, 22 bp, Artificial Sequence
  chemically synthesized
aactggaagaatcacagctggg

SEQ ID NO: 873440 - DNA, 22 bp, Artificial Sequence
  chemically synthesized
tgctaccccagctgtgattctt

SEQ ID NO: 873441 - DNA, 22 bp, Artificial Sequence
  chemically synthesized
ccccagctgtgattcttccagt

SEQ ID NO: 873442 - DNA, 22 bp, Artificial Sequence
  chemically synthesized
tgattcttccagttcagtattt

SEQ ID NO: 873443 - DNA, 22 bp, Artificial Sequence
  chemically synthesized
tgtcaagtagaaaaatactgaa

SEQ ID NO: 873444 - DNA, 22 bp, Artificial Sequence
  chemically synthesized
atgtcaagtagaaaaatactga

SEQ ID NO: 873445 - DNA, 22 bp, Artificial Sequence
  chemically synthesized
tatgtcaagtagaaaaatactg

SEQ ID NO: 873446 - DNA, 22 bp, Artificial Sequence
  chemically synthesized
ttttatgtcaagtagaaaaata

SEQ ID NO: 873447 - DNA, 22 bp, Artificial Sequence
  chemically synthesized
ttccagttcagtatttttctac

SEQ ID NO: 873448 - DNA, 22 bp, Artificial Sequence
  chemically synthesized
attttatgtcaagtagaaaaat

SEQ ID NO: 873449 - DNA, 22 bp, Artificial Sequence
  chemically synthesized
tattttatgtcaagtagaaaaa

SEQ ID NO: 873450 - DNA, 22 bp, Artificial Sequence
  chemically synthesized
ccagttcagtatttttctactt

SEQ ID NO: 873451 - DNA, 22 bp, Artificial Sequence
  chemically synthesized
ttattttatgtcaagtagaaaa

SEQ ID NO: 873452 - DNA, 22 bp, Artificial Sequence
  chemically synthesized
cagttcagtatttttctacttg

SEQ ID NO: 873453 - DNA, 22 bp, Artificial Sequence
  chemically synthesized
atttttattttatgtcaagtag

SEQ ID NO: 873454 - DNA, 22 bp, Artificial Sequence
  chemically synthesized
agtatttttctacttgacataa

SEQ ID NO: 873455 - DNA, 22 bp, Artificial Sequence
  chemically synthesized
ttctacttgacataaaataaaa

SEQ ID NO: 873456 - DNA, 22 bp, Artificial Sequence
  chemically synthesized
tctacttgacataaaataaaaa

SEQ ID NO: 873457 - DNA, 22 bp, Artificial Sequence
  chemically synthesized
aggtaaagttgatttttatttt

SEQ ID NO: 873458 - DNA, 22 bp, Artificial Sequence
  chemically synthesized
ctacttgacataaaataaaaat

SEQ ID NO: 873459 - DNA, 22 bp, Artificial Sequence
  chemically synthesized
caggtaaagttgatttttattt

SEQ ID NO: 873460 - DNA, 22 bp, Artificial Sequence
  chemically synthesized
tacttgacataaaataaaaatc

SEQ ID NO: 873461 - DNA, 22 bp, Artificial Sequence
  chemically synthesized
ttcaggtaaagttgatttttat

SEQ ID NO: 873462 - DNA, 22 bp, Artificial Sequence
  chemically synthesized
cttgacataaaataaaaatcaa

SEQ ID NO: 873463 - DNA, 22 bp, Artificial Sequence
  chemically synthesized
gacataaaataaaaatcaactt

SEQ ID NO: 873464 - DNA, 22 bp, Artificial Sequence
  chemically synthesized
gttcttcaggtaaagttgattt

SEQ ID NO: 873465 - DNA, 22 bp, Artificial Sequence
  chemically synthesized
acataaaataaaaatcaacttt

SEQ ID NO: 873466 - DNA, 22 bp, Artificial Sequence
  chemically synthesized
aagcatggtgactggttcttca

SEQ ID NO: 873467 - DNA, 22 bp, Artificial Sequence
  chemically synthesized
tacctgaagaaccagtcaccat

SEQ ID NO: 873468 - DNA, 22 bp, Artificial Sequence
  chemically synthesized
aagcattaaagcatggtgactg

SEQ ID NO: 873469 - DNA, 22 bp, Artificial Sequence
  chemically synthesized
acctgaagaaccagtcaccatg

SEQ ID NO: 873470 - DNA, 22 bp, Artificial Sequence
  chemically synthesized
cctgaagaaccagtcaccatgc

SEQ ID NO: 873471 - DNA, 22 bp, Artificial Sequence
  chemically synthesized
aagaaccagtcaccatgcttta

SEQ ID NO: 873472 - DNA, 22 bp, Artificial Sequence
  chemically synthesized
aaagatcaaatgattgaagcat

SEQ ID NO: 873473 - DNA, 22 bp, Artificial Sequence
  chemically synthesized
caaagatcaaatgattgaagca

SEQ ID NO: 873474 - DNA, 22 bp, Artificial Sequence
  chemically synthesized
tcaaagatcaaatgattgaagc

SEQ ID NO: 873475 - DNA, 22 bp, Artificial Sequence
  chemically synthesized
ttcaaagatcaaatgattgaag

SEQ ID NO: 873476 - DNA, 22 bp, Artificial Sequence
  chemically synthesized
cttttcaaagatcaaatgattg

SEQ ID NO: 873477 - DNA, 22 bp, Artificial Sequence
  chemically synthesized
taatgcttcaatcatttgatct

SEQ ID NO: 873478 - DNA, 22 bp, Artificial Sequence
  chemically synthesized
tctgcttttcaaagatcaaatg

SEQ ID NO: 873479 - DNA, 22 bp, Artificial Sequence
  chemically synthesized
aatgcttcaatcatttgatctt

SEQ ID NO: 873480 - DNA, 22 bp, Artificial Sequence
  chemically synthesized
gtctgcttttcaaagatcaaat

SEQ ID NO: 873481 - DNA, 22 bp, Artificial Sequence
  chemically synthesized
atgcttcaatcatttgatcttt

SEQ ID NO: 873482 - DNA, 22 bp, Artificial Sequence
  chemically synthesized
ccttgtctgcttttcaaagatc

SEQ ID NO: 873483 - DNA, 22 bp, Artificial Sequence
  chemically synthesized
gccttgtctgcttttcaaagat

SEQ ID NO: 873484 - DNA, 22 bp, Artificial Sequence
  chemically synthesized
tgccttgtctgcttttcaaaga

SEQ ID NO: 873485 - DNA, 22 bp, Artificial Sequence
  chemically synthesized
caatcatttgatctttgaaaag

SEQ ID NO: 873486 - DNA, 22 bp, Artificial Sequence
  chemically synthesized
ttgccttgtctgcttttcaaag

SEQ ID NO: 873487 - DNA, 22 bp, Artificial Sequence
  chemically synthesized
aatcatttgatctttgaaaagc

SEQ ID NO: 873488 - DNA, 22 bp, Artificial Sequence
  chemically synthesized
tttgccttgtctgcttttcaaa

SEQ ID NO: 873489 - DNA, 22 bp, Artificial Sequence
  chemically synthesized
ttttgccttgtctgcttttcaa

SEQ ID NO: 873490 - DNA, 22 bp, Artificial Sequence
  chemically synthesized
tttttgccttgtctgcttttca

SEQ ID NO: 873491 - DNA, 22 bp, Artificial Sequence
  chemically synthesized
ttttttgccttgtctgcttttc

SEQ ID NO: 873492 - DNA, 22 bp, Artificial Sequence
  chemically synthesized
tttttttgccttgtctgctttt

SEQ ID NO: 873493 - DNA, 22 bp, Artificial Sequence
  chemically synthesized
ttttttttgccttgtctgcttt

SEQ ID NO: 873494 - DNA, 22 bp, Artificial Sequence
  chemically synthesized
gatctttgaaaagcagacaagg

SEQ ID NO: 873495 - DNA, 22 bp, Artificial Sequence
  chemically synthesized
tttttttttttgccttgtctgc

SEQ ID NO: 873496 - DNA, 22 bp, Artificial Sequence
  chemically synthesized
atctttgaaaagcagacaaggc

SEQ ID NO: 873497 - DNA, 22 bp, Artificial Sequence
  chemically synthesized
gtttttttttttgccttgtctg

SEQ ID NO: 873498 - DNA, 22 bp, Artificial Sequence
  chemically synthesized
tgtttttttttttgccttgtct

SEQ ID NO: 873499 - DNA, 22 bp, Artificial Sequence
  chemically synthesized
ttgtttttttttttgccttgtc

SEQ ID NO: 873500 - DNA, 22 bp, Artificial Sequence
  chemically synthesized
tgaaaagcagacaaggcaaaaa

SEQ ID NO: 873501 - DNA, 22 bp, Artificial Sequence
  chemically synthesized
tttttgtttttttttttgcctt

SEQ ID NO: 873502 - DNA, 22 bp, Artificial Sequence
  chemically synthesized
gaaaagcagacaaggcaaaaaa

SEQ ID NO: 873503 - DNA, 22 bp, Artificial Sequence
  chemically synthesized
gtttttgtttttttttttgcct

SEQ ID NO: 873504 - DNA, 22 bp, Artificial Sequence
  chemically synthesized
aaaagcagacaaggcaaaaaaa

SEQ ID NO: 873505 - DNA, 22 bp, Artificial Sequence
  chemically synthesized
tgtttttgtttttttttttgcc

SEQ ID NO: 873506 - DNA, 22 bp, Artificial Sequence
  chemically synthesized
ttgtttttgtttttttttttgc

SEQ ID NO: 873507 - DNA, 22 bp, Artificial Sequence
  chemically synthesized
tttgtttttgtttttttttttg

SEQ ID NO: 873508 - DNA, 22 bp, Artificial Sequence
  chemically synthesized
ttttttgtttttgttttttttt

SEQ ID NO: 873509 - DNA, 22 bp, Artificial Sequence
  chemically synthesized
ggtgttgttttttgtttttgtt

SEQ ID NO: 873510 - DNA, 22 bp, Artificial Sequence
  chemically synthesized
gggtgttgttttttgtttttgt

SEQ ID NO: 873511 - DNA, 22 bp, Artificial Sequence
  chemically synthesized
tgggtgttgttttttgtttttg

SEQ ID NO: 873512 - DNA, 22 bp, Artificial Sequence
  chemically synthesized
aaaacatctttgggtgttgttt

SEQ ID NO: 873513 - DNA, 22 bp, Artificial Sequence
  chemically synthesized
ggcagaactaaaaacatctttg

SEQ ID NO: 873514 - DNA, 22 bp, Artificial Sequence
  chemically synthesized
cataattaggcagaactaaaaa

SEQ ID NO: 873515 - DNA, 22 bp, Artificial Sequence
  chemically synthesized
taccattccataattaggcaga

SEQ ID NO: 873516 - DNA, 22 bp, Artificial Sequence
  chemically synthesized
ctgtaccattccataattaggc

SEQ ID NO: 873517 - DNA, 22 bp, Artificial Sequence
  chemically synthesized
gctgtaccattccataattagg

SEQ ID NO: 873518 - DNA, 22 bp, Artificial Sequence
  chemically synthesized
tgctgtaccattccataattag

SEQ ID NO: 873519 - DNA, 22 bp, Artificial Sequence
  chemically synthesized
ttagttctgcctaattatggaa

SEQ ID NO: 873520 - DNA, 22 bp, Artificial Sequence
  chemically synthesized
tttgctgtaccattccataatt

SEQ ID NO: 873521 - DNA, 22 bp, Artificial Sequence
  chemically synthesized
tagttctgcctaattatggaat

SEQ ID NO: 873522 - DNA, 22 bp, Artificial Sequence
  chemically synthesized
ctttgctgtaccattccataat

SEQ ID NO: 873523 - DNA, 22 bp, Artificial Sequence
  chemically synthesized
agttctgcctaattatggaatg

SEQ ID NO: 873524 - DNA, 22 bp, Artificial Sequence
  chemically synthesized
gttctgcctaattatggaatgg

SEQ ID NO: 873525 - DNA, 22 bp, Artificial Sequence
  chemically synthesized
tgcctaattatggaatggtaca

SEQ ID NO: 873526 - DNA, 22 bp, Artificial Sequence
  chemically synthesized
cctaattatggaatggtacagc

SEQ ID NO: 873527 - DNA, 22 bp, Artificial Sequence
  chemically synthesized
attatggaatggtacagcaaag

SEQ ID NO: 873528 - DNA, 22 bp, Artificial Sequence
  chemically synthesized
tggaatggtacagcaaagaagt

SEQ ID NO: 873529 - DNA, 22 bp, Artificial Sequence
  chemically synthesized
aggggaaagaggccagaaaact

SEQ ID NO: 873530 - DNA, 22 bp, Artificial Sequence
  chemically synthesized
tcaggggaaagaggccagaaaa

SEQ ID NO: 873531 - DNA, 22 bp, Artificial Sequence
  chemically synthesized
actctcaggggaaagaggccag

SEQ ID NO: 873532 - DNA, 22 bp, Artificial Sequence
  chemically synthesized
gactctcaggggaaagaggcca

SEQ ID NO: 873533 - DNA, 22 bp, Artificial Sequence
  chemically synthesized
tgactctcaggggaaagaggcc

SEQ ID NO: 873534 - DNA, 22 bp, Artificial Sequence
  chemically synthesized
gctttgactctcaggggaaaga

SEQ ID NO: 873535 - DNA, 22 bp, Artificial Sequence
  chemically synthesized
tctggcctctttcccctgagag

SEQ ID NO: 873536 - DNA, 22 bp, Artificial Sequence
  chemically synthesized
ctggcctctttcccctgagagt

SEQ ID NO: 873537 - DNA, 22 bp, Artificial Sequence
  chemically synthesized
atgctggctttgactctcaggg

SEQ ID NO: 873538 - DNA, 22 bp, Artificial Sequence
  chemically synthesized
tggcctctttcccctgagagtc

SEQ ID NO: 873539 - DNA, 22 bp, Artificial Sequence
  chemically synthesized
gcctctttcccctgagagtcaa

SEQ ID NO: 873540 - DNA, 22 bp, Artificial Sequence
  chemically synthesized
tttcccctgagagtcaaagcca

SEQ ID NO: 873541 - DNA, 22 bp, Artificial Sequence
  chemically synthesized
tcccctgagagtcaaagccagc

SEQ ID NO: 873542 - DNA, 22 bp, Artificial Sequence
  chemically synthesized
cccctgagagtcaaagccagca

SEQ ID NO: 873543 - DNA, 22 bp, Artificial Sequence
  chemically synthesized
ccctgagagtcaaagccagcat

SEQ ID NO: 873544 - DNA, 22 bp, Artificial Sequence
  chemically synthesized
atggcaatgttaatgctggctt

SEQ ID NO: 873545 - DNA, 22 bp, Artificial Sequence
  chemically synthesized
tcatggcaatgttaatgctggc

SEQ ID NO: 873546 - DNA, 22 bp, Artificial Sequence
  chemically synthesized
agagtcaaagccagcattaaca

SEQ ID NO: 873547 - DNA, 22 bp, Artificial Sequence
  chemically synthesized
ataaattctcatggcaatgtta

SEQ ID NO: 873548 - DNA, 22 bp, Artificial Sequence
  chemically synthesized
atagaaggtattcataaattct

SEQ ID NO: 873549 - DNA, 22 bp, Artificial Sequence
  chemically synthesized
acattgccatgagaatttatga

SEQ ID NO: 873550 - DNA, 22 bp, Artificial Sequence
  chemically synthesized
ttgatagaaggtattcataaat

SEQ ID NO: 873551 - DNA, 22 bp, Artificial Sequence
  chemically synthesized
ccatgagaatttatgaatacct

SEQ ID NO: 873552 - DNA, 22 bp, Artificial Sequence
  chemically synthesized
agttgttgatagaaggtattca

SEQ ID NO: 873553 - DNA, 22 bp, Artificial Sequence
  chemically synthesized
cagttgttgatagaaggtattc

SEQ ID NO: 873554 - DNA, 22 bp, Artificial Sequence
  chemically synthesized
ttcagttgttgatagaaggtat

SEQ ID NO: 873555 - DNA, 22 bp, Artificial Sequence
  chemically synthesized
ctcttcagttgttgatagaagg

SEQ ID NO: 873556 - DNA, 22 bp, Artificial Sequence
  chemically synthesized
cctcttcagttgttgatagaag

SEQ ID NO: 873557 - DNA, 22 bp, Artificial Sequence
  chemically synthesized
tcctcttcagttgttgatagaa

SEQ ID NO: 873558 - DNA, 22 bp, Artificial Sequence
  chemically synthesized
tttcctcttcagttgttgatag

SEQ ID NO: 873559 - DNA, 22 bp, Artificial Sequence
  chemically synthesized
atgaataccttctatcaacaac

SEQ ID NO: 873560 - DNA, 22 bp, Artificial Sequence
  chemically synthesized
ctttcctcttcagttgttgata

SEQ ID NO: 873561 - DNA, 22 bp, Artificial Sequence
  chemically synthesized
tgaataccttctatcaacaact

SEQ ID NO: 873562 - DNA, 22 bp, Artificial Sequence
  chemically synthesized
tctttcctcttcagttgttgat

SEQ ID NO: 873563 - DNA, 22 bp, Artificial Sequence
  chemically synthesized
ttttctttcctcttcagttgtt

SEQ ID NO: 873564 - DNA, 22 bp, Artificial Sequence
  chemically synthesized
attttctttcctcttcagttgt

SEQ ID NO: 873565 - DNA, 22 bp, Artificial Sequence
  chemically synthesized
tattttctttcctcttcagttg

SEQ ID NO: 873566 - DNA, 22 bp, Artificial Sequence
  chemically synthesized
ttttattttctttcctcttcag

SEQ ID NO: 873567 - DNA, 22 bp, Artificial Sequence
  chemically synthesized
ctatcaacaactgaagaggaaa

SEQ ID NO: 873568 - DNA, 22 bp, Artificial Sequence
  chemically synthesized
tatcaacaactgaagaggaaag

SEQ ID NO: 873569 - DNA, 22 bp, Artificial Sequence
  chemically synthesized
tcaacaactgaagaggaaagaa

SEQ ID NO: 873570 - DNA, 22 bp, Artificial Sequence
  chemically synthesized
agtctattttattttctttcct

SEQ ID NO: 873571 - DNA, 22 bp, Artificial Sequence
  chemically synthesized
cagtctattttattttctttcc

SEQ ID NO: 873572 - DNA, 22 bp, Artificial Sequence
  chemically synthesized
tcagtctattttattttctttc

SEQ ID NO: 873573 - DNA, 22 bp, Artificial Sequence
  chemically synthesized
aagaggaaagaaaataaaatag

SEQ ID NO: 873574 - DNA, 22 bp, Artificial Sequence
  chemically synthesized
catattttcagtctattttatt

SEQ ID NO: 873575 - DNA, 22 bp, Artificial Sequence
  chemically synthesized
actgcatattttcagtctattt

SEQ ID NO: 873576 - DNA, 22 bp, Artificial Sequence
  chemically synthesized
cactgcatattttcagtctatt

SEQ ID NO: 873577 - DNA, 22 bp, Artificial Sequence
  chemically synthesized
tcactgcatattttcagtctat

SEQ ID NO: 873578 - DNA, 22 bp, Artificial Sequence
  chemically synthesized
ttttcactgcatattttcagtc

SEQ ID NO: 873579 - DNA, 22 bp, Artificial Sequence
  chemically synthesized
gttttcactgcatattttcagt

SEQ ID NO: 873580 - DNA, 22 bp, Artificial Sequence
  chemically synthesized
tgttttcactgcatattttcag

SEQ ID NO: 873581 - DNA, 22 bp, Artificial Sequence
  chemically synthesized
ttgttttcactgcatattttca

SEQ ID NO: 873582 - DNA, 22 bp, Artificial Sequence
  chemically synthesized
acttttgttttcactgcatatt

SEQ ID NO: 873583 - DNA, 22 bp, Artificial Sequence
  chemically synthesized
aacttttgttttcactgcatat

SEQ ID NO: 873584 - DNA, 22 bp, Artificial Sequence
  chemically synthesized
taacttttgttttcactgcata

SEQ ID NO: 873585 - DNA, 22 bp, Artificial Sequence
  chemically synthesized
tagttttaacttttgttttcac

SEQ ID NO: 873586 - DNA, 22 bp, Artificial Sequence
  chemically synthesized
aaaatatgcagtgaaaacaaaa

SEQ ID NO: 873587 - DNA, 22 bp, Artificial Sequence
  chemically synthesized
gctgtagttttaacttttgttt

SEQ ID NO: 873588 - DNA, 22 bp, Artificial Sequence
  chemically synthesized
agctgtagttttaacttttgtt

SEQ ID NO: 873589 - DNA, 22 bp, Artificial Sequence
  chemically synthesized
atttagctgtagttttaacttt

SEQ ID NO: 873590 - DNA, 22 bp, Artificial Sequence
  chemically synthesized
ctcatttagctgtagttttaac

SEQ ID NO: 873591 - DNA, 22 bp, Artificial Sequence
  chemically synthesized
cctcatttagctgtagttttaa

SEQ ID NO: 873592 - DNA, 22 bp, Artificial Sequence
  chemically synthesized
ggggaggaatatttcctcattt

SEQ ID NO: 873593 - DNA, 22 bp, Artificial Sequence
  chemically synthesized
aaactacagctaaatgaggaaa

SEQ ID NO: 873594 - DNA, 22 bp, Artificial Sequence
  chemically synthesized
gggggaggaatatttcctcatt

SEQ ID NO: 873595 - DNA, 22 bp, Artificial Sequence
  chemically synthesized
acttgggggaggaatatttcct

SEQ ID NO: 873596 - DNA, 22 bp, Artificial Sequence
  chemically synthesized
cagctaaatgaggaaatattcc

SEQ ID NO: 873597 - DNA, 22 bp, Artificial Sequence
  chemically synthesized
aatgaggaaatattcctccccc

SEQ ID NO: 873598 - DNA, 22 bp, Artificial Sequence
  chemically synthesized
ggaggaccacaagctgacttgg

SEQ ID NO: 873599 - DNA, 22 bp, Artificial Sequence
  chemically synthesized
ctcccccaagtcagcttgtggt

SEQ ID NO: 873600 - DNA, 22 bp, Artificial Sequence
  chemically synthesized
ccccaagtcagcttgtggtcct

SEQ ID NO: 873601 - DNA, 22 bp, Artificial Sequence
  chemically synthesized
aagaaaaagaaaaatggattgg

SEQ ID NO: 873602 - DNA, 22 bp, Artificial Sequence
  chemically synthesized
gtggtcctcccaatccattttt

SEQ ID NO: 873603 - DNA, 22 bp, Artificial Sequence
  chemically synthesized
tggtcctcccaatccatttttc

SEQ ID NO: 873604 - DNA, 22 bp, Artificial Sequence
  chemically synthesized
gttcaagaaaaagaaaaatgga

SEQ ID NO: 873605 - DNA, 22 bp, Artificial Sequence
  chemically synthesized
agttcaagaaaaagaaaaatgg

SEQ ID NO: 873606 - DNA, 22 bp, Artificial Sequence
  chemically synthesized
tagttcaagaaaaagaaaaatg

SEQ ID NO: 873607 - DNA, 22 bp, Artificial Sequence
  chemically synthesized
ttagttcaagaaaaagaaaaat

SEQ ID NO: 873608 - DNA, 22 bp, Artificial Sequence
  chemically synthesized
ccaatccatttttctttttctt

SEQ ID NO: 873609 - DNA, 22 bp, Artificial Sequence
  chemically synthesized
ccatttttagttcaagaaaaag

SEQ ID NO: 873610 - DNA, 22 bp, Artificial Sequence
  chemically synthesized
tcccatttttagttcaagaaaa

SEQ ID NO: 873611 - DNA, 22 bp, Artificial Sequence
  chemically synthesized
agagctctcccatttttagttc

SEQ ID NO: 873612 - DNA, 22 bp, Artificial Sequence
  chemically synthesized
ttctttttcttgaactaaaaat

SEQ ID NO: 873613 - DNA, 22 bp, Artificial Sequence
  chemically synthesized
aagagctctcccatttttagtt

SEQ ID NO: 873614 - DNA, 22 bp, Artificial Sequence
  chemically synthesized
tctttttcttgaactaaaaatg

SEQ ID NO: 873615 - DNA, 22 bp, Artificial Sequence
  chemically synthesized
ctttttcttgaactaaaaatgg

SEQ ID NO: 873616 - DNA, 22 bp, Artificial Sequence
  chemically synthesized
tttttcttgaactaaaaatggg

SEQ ID NO: 873617 - DNA, 22 bp, Artificial Sequence
  chemically synthesized
tttcttgaactaaaaatgggag

SEQ ID NO: 873618 - DNA, 22 bp, Artificial Sequence
  chemically synthesized
ttcttgaactaaaaatgggaga

SEQ ID NO: 873619 - DNA, 22 bp, Artificial Sequence
  chemically synthesized
tcttgaactaaaaatgggagag

SEQ ID NO: 873620 - DNA, 22 bp, Artificial Sequence
  chemically synthesized
cttgaactaaaaatgggagagc

SEQ ID NO: 873621 - DNA, 22 bp, Artificial Sequence
  chemically synthesized
ttgaactaaaaatgggagagct

SEQ ID NO: 873622 - DNA, 22 bp, Artificial Sequence
  chemically synthesized
caaacaatttaagagctctccc

SEQ ID NO: 873623 - DNA, 22 bp, Artificial Sequence
  chemically synthesized
gaactaaaaatgggagagctct

SEQ ID NO: 873624 - DNA, 22 bp, Artificial Sequence
  chemically synthesized
gcaaacaatttaagagctctcc

SEQ ID NO: 873625 - DNA, 22 bp, Artificial Sequence
  chemically synthesized
aactaaaaatgggagagctctt

SEQ ID NO: 873626 - DNA, 22 bp, Artificial Sequence
  chemically synthesized
aaaatgggagagctcttaaatt

SEQ ID NO: 873627 - DNA, 22 bp, Artificial Sequence
  chemically synthesized
tcccatttgcaaacaatttaag

SEQ ID NO: 873628 - DNA, 22 bp, Artificial Sequence
  chemically synthesized
cctgtcccatttgcaaacaatt

SEQ ID NO: 873629 - DNA, 22 bp, Artificial Sequence
  chemically synthesized
tccctgtcccatttgcaaacaa

SEQ ID NO: 873630 - DNA, 22 bp, Artificial Sequence
  chemically synthesized
ttaaattgtttgcaaatgggac

SEQ ID NO: 873631 - DNA, 22 bp, Artificial Sequence
  chemically synthesized
gcacctctccctgtcccatttg

SEQ ID NO: 873632 - DNA, 22 bp, Artificial Sequence
  chemically synthesized
aaattgtttgcaaatgggacag

SEQ ID NO: 873633 - DNA, 22 bp, Artificial Sequence
  chemically synthesized
aattgtttgcaaatgggacagg

SEQ ID NO: 873634 - DNA, 22 bp, Artificial Sequence
  chemically synthesized
ctagcacctctccctgtcccat

SEQ ID NO: 873635 - DNA, 22 bp, Artificial Sequence
  chemically synthesized
tttgcaaatgggacagggagag

SEQ ID NO: 873636 - DNA, 22 bp, Artificial Sequence
  chemically synthesized
gcaaatgggacagggagaggtg

SEQ ID NO: 873637 - DNA, 22 bp, Artificial Sequence
  chemically synthesized
caaatgggacagggagaggtgc

SEQ ID NO: 873638 - DNA, 22 bp, Artificial Sequence
  chemically synthesized
gtaggactgtgtgtgtttctgt

SEQ ID NO: 873639 - DNA, 22 bp, Artificial Sequence
  chemically synthesized
caaaaatcacagaaaccacaga

SEQ ID NO: 873640 - DNA, 22 bp, Artificial Sequence
  chemically synthesized
tgtgtgtttctgtggtttctgt

SEQ ID NO: 873641 - DNA, 22 bp, Artificial Sequence
  chemically synthesized
ctgtggtttctgtgatttttgt

SEQ ID NO: 873642 - DNA, 22 bp, Artificial Sequence
  chemically synthesized
tgtggtttctgtgatttttgta

SEQ ID NO: 873643 - DNA, 22 bp, Artificial Sequence
  chemically synthesized
tggtttctgtgatttttgtaga

SEQ ID NO: 873644 - DNA, 22 bp, Artificial Sequence
  chemically synthesized
aagagggacaagtatgtctaca

SEQ ID NO: 873645 - DNA, 22 bp, Artificial Sequence
  chemically synthesized
ctgtgatttttgtagacatact

SEQ ID NO: 873646 - DNA, 22 bp, Artificial Sequence
  chemically synthesized
tgtgatttttgtagacatactt

SEQ ID NO: 873647 - DNA, 22 bp, Artificial Sequence
  chemically synthesized
ctgaagagggacaagtatgtct

SEQ ID NO: 873648 - DNA, 22 bp, Artificial Sequence
  chemically synthesized
tgatttttgtagacatacttgt

SEQ ID NO: 873649 - DNA, 22 bp, Artificial Sequence
  chemically synthesized
ttcctgaagagggacaagtatg

SEQ ID NO: 873650 - DNA, 22 bp, Artificial Sequence
  chemically synthesized
ttgtagacatacttgtccctct

SEQ ID NO: 873651 - DNA, 22 bp, Artificial Sequence
  chemically synthesized
tgtagacatacttgtccctctt

SEQ ID NO: 873652 - DNA, 22 bp, Artificial Sequence
  chemically synthesized
gtagacatacttgtccctcttc

SEQ ID NO: 873653 - DNA, 22 bp, Artificial Sequence
  chemically synthesized
tagacatacttgtccctcttca

SEQ ID NO: 873654 - DNA, 22 bp, Artificial Sequence
  chemically synthesized
gtccctcttcaggaacaatgca

SEQ ID NO: 873655 - DNA, 22 bp, Artificial Sequence
  chemically synthesized
tccctcttcaggaacaatgcac

SEQ ID NO: 873656 - DNA, 22 bp, Artificial Sequence
  chemically synthesized
gcatccagggatgtgtgcattg

SEQ ID NO: 873657 - DNA, 22 bp, Artificial Sequence
  chemically synthesized
ctagcatccagggatgtgtgca

SEQ ID NO: 873658 - DNA, 22 bp, Artificial Sequence
  chemically synthesized
ttcaggaacaatgcacacatcc

SEQ ID NO: 873659 - DNA, 22 bp, Artificial Sequence
  chemically synthesized
caggaacaatgcacacatccct

SEQ ID NO: 873660 - DNA, 22 bp, Artificial Sequence
  chemically synthesized
aggaacaatgcacacatccctg

SEQ ID NO: 873661 - DNA, 22 bp, Artificial Sequence
  chemically synthesized
acaaccaatattcctagcatcc

SEQ ID NO: 873662 - DNA, 22 bp, Artificial Sequence
  chemically synthesized
gatgctaggaatattggttgtt

SEQ ID NO: 873663 - DNA, 22 bp, Artificial Sequence
  chemically synthesized
gtaaggaacaccattaacaacc

SEQ ID NO: 873664 - DNA, 22 bp, Artificial Sequence
  chemically synthesized
agtaaggaacaccattaacaac

SEQ ID NO: 873665 - DNA, 22 bp, Artificial Sequence
  chemically synthesized
ttagtaaggaacaccattaaca

SEQ ID NO: 873666 - DNA, 22 bp, Artificial Sequence
  chemically synthesized
ggaatattggttgttaatggtg

SEQ ID NO: 873667 - DNA, 22 bp, Artificial Sequence
  chemically synthesized
gttgttaatggtgttccttact

SEQ ID NO: 873668 - DNA, 22 bp, Artificial Sequence
  chemically synthesized
ttaatggtgttccttactaaga

SEQ ID NO: 873669 - DNA, 22 bp, Artificial Sequence
  chemically synthesized
aggccgaaggcaattcttagta

SEQ ID NO: 873670 - DNA, 22 bp, Artificial Sequence
  chemically synthesized
atggtgttccttactaagaatt

SEQ ID NO: 873671 - DNA, 22 bp, Artificial Sequence
  chemically synthesized
tgaggccgaaggcaattcttag

SEQ ID NO: 873672 - DNA, 22 bp, Artificial Sequence
  chemically synthesized
ctgaggccgaaggcaattctta

SEQ ID NO: 873673 - DNA, 22 bp, Artificial Sequence
  chemically synthesized
tctgaggccgaaggcaattctt

SEQ ID NO: 873674 - DNA, 22 bp, Artificial Sequence
  chemically synthesized
cttactaagaattgccttcggc

SEQ ID NO: 873675 - DNA, 22 bp, Artificial Sequence
  chemically synthesized
actaagaattgccttcggcctc

SEQ ID NO: 873676 - DNA, 22 bp, Artificial Sequence
  chemically synthesized
gacaagttttctgaggccgaag

SEQ ID NO: 873677 - DNA, 22 bp, Artificial Sequence
  chemically synthesized
ctaagaattgccttcggcctca

SEQ ID NO: 873678 - DNA, 22 bp, Artificial Sequence
  chemically synthesized
ggacaagttttctgaggccgaa

SEQ ID NO: 873679 - DNA, 22 bp, Artificial Sequence
  chemically synthesized
agaattgccttcggcctcagaa

SEQ ID NO: 873680 - DNA, 22 bp, Artificial Sequence
  chemically synthesized
ccttcggcctcagaaaacttgt

SEQ ID NO: 873681 - DNA, 22 bp, Artificial Sequence
  chemically synthesized
cggcctcagaaaacttgtccaa

SEQ ID NO: 873682 - DNA, 22 bp, Artificial Sequence
  chemically synthesized
ggcctcagaaaacttgtccaag

SEQ ID NO: 873683 - DNA, 22 bp, Artificial Sequence
  chemically synthesized
agagtggaaggacaacttggac

SEQ ID NO: 873684 - DNA, 22 bp, Artificial Sequence
  chemically synthesized
agaaaacttgtccaagttgtcc

SEQ ID NO: 873685 - DNA, 22 bp, Artificial Sequence
  chemically synthesized
cctgagagtggaaggacaactt

SEQ ID NO: 873686 - DNA, 22 bp, Artificial Sequence
  chemically synthesized
ctgcctgagagtggaaggacaa

SEQ ID NO: 873687 - DNA, 22 bp, Artificial Sequence
  chemically synthesized
gctgctgcctgagagtggaagg

SEQ ID NO: 873688 - DNA, 22 bp, Artificial Sequence
  chemically synthesized
gtccaagttgtccttccactct

SEQ ID NO: 873689 - DNA, 22 bp, Artificial Sequence
  chemically synthesized
tccaagttgtccttccactctc

SEQ ID NO: 873690 - DNA, 22 bp, Artificial Sequence
  chemically synthesized
tccttccactctcaggcagcag

SEQ ID NO: 873691 - DNA, 22 bp, Artificial Sequence
  chemically synthesized
gccaggggctggctgctgcctg

SEQ ID NO: 873692 - DNA, 22 bp, Artificial Sequence
  chemically synthesized
ccactctcaggcagcagccagc

SEQ ID NO: 873693 - DNA, 22 bp, Artificial Sequence
  chemically synthesized
cactctcaggcagcagccagcc

SEQ ID NO: 873694 - DNA, 22 bp, Artificial Sequence
  chemically synthesized
tcaggcagcagccagcccctgg

SEQ ID NO: 873695 - DNA, 22 bp, Artificial Sequence
  chemically synthesized
aggcagcagccagcccctggcc

SEQ ID NO: 873696 - DNA, 22 bp, Artificial Sequence
  chemically synthesized
atccagccagccattggccagg

SEQ ID NO: 873697 - DNA, 22 bp, Artificial Sequence
  chemically synthesized
ctgatccagccagccattggcc

SEQ ID NO: 873698 - DNA, 22 bp, Artificial Sequence
  chemically synthesized
tattcctgatccagccagccat

SEQ ID NO: 873699 - DNA, 22 bp, Artificial Sequence
  chemically synthesized
gtattcctgatccagccagcca

SEQ ID NO: 873700 - DNA, 22 bp, Artificial Sequence
  chemically synthesized
gcccttgtattcctgatccagc

SEQ ID NO: 873701 - DNA, 22 bp, Artificial Sequence
  chemically synthesized
gccaatggctggctggatcagg

SEQ ID NO: 873702 - DNA, 22 bp, Artificial Sequence
  chemically synthesized
gctggatcaggaatacaagggc

SEQ ID NO: 873703 - DNA, 22 bp, Artificial Sequence
  chemically synthesized
caggcagtgggcctggcccttg

SEQ ID NO: 873704 - DNA, 22 bp, Artificial Sequence
  chemically synthesized
gatcaggaatacaagggccagg

SEQ ID NO: 873705 - DNA, 22 bp, Artificial Sequence
  chemically synthesized
aattgcaggcagtgggcctggc

SEQ ID NO: 873706 - DNA, 22 bp, Artificial Sequence
  chemically synthesized
tcctgaattgcaggcagtgggc

SEQ ID NO: 873707 - DNA, 22 bp, Artificial Sequence
  chemically synthesized
tgcagagctgtcctgaattgca

SEQ ID NO: 873708 - DNA, 22 bp, Artificial Sequence
  chemically synthesized
gctgtgcagagctgtcctgaat

SEQ ID NO: 873709 - DNA, 22 bp, Artificial Sequence
  chemically synthesized
ggctggctgtgcagagctgtcc

SEQ ID NO: 873710 - DNA, 22 bp, Artificial Sequence
  chemically synthesized
cctgcaattcaggacagctctg

SEQ ID NO: 873711 - DNA, 22 bp, Artificial Sequence
  chemically synthesized
caattcaggacagctctgcaca

SEQ ID NO: 873712 - DNA, 22 bp, Artificial Sequence
  chemically synthesized
catctgggctggctgtgcagag

SEQ ID NO: 873713 - DNA, 22 bp, Artificial Sequence
  chemically synthesized
aggacagctctgcacagccagc

SEQ ID NO: 873714 - DNA, 22 bp, Artificial Sequence
  chemically synthesized
gcaggagccctacatctgggct

SEQ ID NO: 873715 - DNA, 22 bp, Artificial Sequence
  chemically synthesized
tgcacagccagcccagatgtag

SEQ ID NO: 873716 - DNA, 22 bp, Artificial Sequence
  chemically synthesized
cacagccagcccagatgtaggg

SEQ ID NO: 873717 - DNA, 22 bp, Artificial Sequence
  chemically synthesized
agccagtctcgcaggagcccta

SEQ ID NO: 873718 - DNA, 22 bp, Artificial Sequence
  chemically synthesized
cagcagaggcctaagccagtct

SEQ ID NO: 873719 - DNA, 22 bp, Artificial Sequence
  chemically synthesized
tctgcagcagaggcctaagcca

SEQ ID NO: 873720 - DNA, 22 bp, Artificial Sequence
  chemically synthesized
gtctgcagcagaggcctaagcc

SEQ ID NO: 873721 - DNA, 22 bp, Artificial Sequence
  chemically synthesized
ctgcgagactggcttaggcctc

SEQ ID NO: 873722 - DNA, 22 bp, Artificial Sequence
  chemically synthesized
cgagactggcttaggcctctgc

SEQ ID NO: 873723 - DNA, 22 bp, Artificial Sequence
  chemically synthesized
aaatgtgatttgtctgcagcag

SEQ ID NO: 873724 - DNA, 22 bp, Artificial Sequence
  chemically synthesized
gcttaggcctctgctgcagaca

SEQ ID NO: 873725 - DNA, 22 bp, Artificial Sequence
  chemically synthesized
aggcctctgctgcagacaaatc

SEQ ID NO: 873726 - DNA, 22 bp, Artificial Sequence
  chemically synthesized
ggcctctgctgcagacaaatca

SEQ ID NO: 873727 - DNA, 22 bp, Artificial Sequence
  chemically synthesized
tgggagagtctgaaatgtgatt

SEQ ID NO: 873728 - DNA, 22 bp, Artificial Sequence
  chemically synthesized
tgctgcagacaaatcacatttc

SEQ ID NO: 873729 - DNA, 22 bp, Artificial Sequence
  chemically synthesized
ctgcagacaaatcacatttcag

SEQ ID NO: 873730 - DNA, 22 bp, Artificial Sequence
  chemically synthesized
cagacaaatcacatttcagact

SEQ ID NO: 873731 - DNA, 22 bp, Artificial Sequence
  chemically synthesized
cagactctcccacaatctccct

SEQ ID NO: 873732 - DNA, 22 bp, Artificial Sequence
  chemically synthesized
agactctcccacaatctccctt

SEQ ID NO: 873733 - DNA, 22 bp, Artificial Sequence
  chemically synthesized
tcccacaatctcccttgtgctc

SEQ ID NO: 873734 - DNA, 22 bp, Artificial Sequence
  chemically synthesized
ccacaatctcccttgtgctctt

SEQ ID NO: 873735 - DNA, 22 bp, Artificial Sequence
  chemically synthesized
ccttgtgctcttctcttccttg

SEQ ID NO: 873736 - DNA, 22 bp, Artificial Sequence
  chemically synthesized
gagatacacccacaaggaagag

SEQ ID NO: 873737 - DNA, 22 bp, Artificial Sequence
  chemically synthesized
tggagatacacccacaaggaag

SEQ ID NO: 873738 - DNA, 22 bp, Artificial Sequence
  chemically synthesized
gtgctcttctcttccttgtggg

SEQ ID NO: 873739 - DNA, 22 bp, Artificial Sequence
  chemically synthesized
tctggagatacacccacaagga

SEQ ID NO: 873740 - DNA, 22 bp, Artificial Sequence
  chemically synthesized
tgctcttctcttccttgtgggt

SEQ ID NO: 873741 - DNA, 22 bp, Artificial Sequence
  chemically synthesized
ttctcttccttgtgggtgtatc

SEQ ID NO: 873742 - DNA, 22 bp, Artificial Sequence
  chemically synthesized
ctcttccttgtgggtgtatctc

SEQ ID NO: 873743 - DNA, 22 bp, Artificial Sequence
  chemically synthesized
tcttccttgtgggtgtatctcc

SEQ ID NO: 873744 - DNA, 22 bp, Artificial Sequence
  chemically synthesized
ttccttgtgggtgtatctccag

SEQ ID NO: 873745 - DNA, 22 bp, Artificial Sequence
  chemically synthesized
ccttgtgggtgtatctccagag

SEQ ID NO: 873746 - DNA, 22 bp, Artificial Sequence
  chemically synthesized
cttgtgggtgtatctccagaga

SEQ ID NO: 873747 - DNA, 22 bp, Artificial Sequence
  chemically synthesized
gtgggtgtatctccagagaaca

SEQ ID NO: 873748 - DNA, 22 bp, Artificial Sequence
  chemically synthesized
tgggtgtatctccagagaacac

SEQ ID NO: 873749 - DNA, 22 bp, Artificial Sequence
  chemically synthesized
catgacaacgggatatggggag

SEQ ID NO: 873750 - DNA, 22 bp, Artificial Sequence
  chemically synthesized
cagagaacactccccatatccc

SEQ ID NO: 873751 - DNA, 22 bp, Artificial Sequence
  chemically synthesized
aaagtgttgcatgacaacggga

SEQ ID NO: 873752 - DNA, 22 bp, Artificial Sequence
  chemically synthesized
attcaaagtgttgcatgacaac

SEQ ID NO: 873753 - DNA, 22 bp, Artificial Sequence
  chemically synthesized
cccatatcccgttgtcatgcaa

SEQ ID NO: 873754 - DNA, 22 bp, Artificial Sequence
  chemically synthesized
tgattcaaagtgttgcatgaca

SEQ ID NO: 873755 - DNA, 22 bp, Artificial Sequence
  chemically synthesized
actctgattcaaagtgttgcat

SEQ ID NO: 873756 - DNA, 22 bp, Artificial Sequence
  chemically synthesized
gaaattgactctgattcaaagt

SEQ ID NO: 873757 - DNA, 22 bp, Artificial Sequence
  chemically synthesized
ggaaattgactctgattcaaag

SEQ ID NO: 873758 - DNA, 22 bp, Artificial Sequence
  chemically synthesized
tcatgcaacactttgaatcaga

SEQ ID NO: 873759 - DNA, 22 bp, Artificial Sequence
  chemically synthesized
cttggaaattgactctgattca

SEQ ID NO: 873760 - DNA, 22 bp, Artificial Sequence
  chemically synthesized
gagtacattccttggaaattga

SEQ ID NO: 873761 - DNA, 22 bp, Artificial Sequence
  chemically synthesized
agagtacattccttggaaattg

SEQ ID NO: 873762 - DNA, 22 bp, Artificial Sequence
  chemically synthesized
tgaatcagagtcaatttccaag

SEQ ID NO: 873763 - DNA, 22 bp, Artificial Sequence
  chemically synthesized
gaatcagagtcaatttccaagg

SEQ ID NO: 873764 - DNA, 22 bp, Artificial Sequence
  chemically synthesized
aatcagagtcaatttccaagga

SEQ ID NO: 873765 - DNA, 22 bp, Artificial Sequence
  chemically synthesized
tgcaaaaagtcttagagtacat

SEQ ID NO: 873766 - DNA, 22 bp, Artificial Sequence
  chemically synthesized
actgtgcaaaaagtcttagagt

SEQ ID NO: 873767 - DNA, 22 bp, Artificial Sequence
  chemically synthesized
ccaaggaatgtactctaagact

SEQ ID NO: 873768 - DNA, 22 bp, Artificial Sequence
  chemically synthesized
caaggaatgtactctaagactt

SEQ ID NO: 873769 - DNA, 22 bp, Artificial Sequence
  chemically synthesized
ttgactgtgcaaaaagtcttag

SEQ ID NO: 873770 - DNA, 22 bp, Artificial Sequence
  chemically synthesized
tgttattgactgtgcaaaaagt

SEQ ID NO: 873771 - DNA, 22 bp, Artificial Sequence
  chemically synthesized
gtgttattgactgtgcaaaaag

SEQ ID NO: 873772 - DNA, 22 bp, Artificial Sequence
  chemically synthesized
tgtgttattgactgtgcaaaaa

SEQ ID NO: 873773 - DNA, 22 bp, Artificial Sequence
  chemically synthesized
taagactttttgcacagtcaat

SEQ ID NO: 873774 - DNA, 22 bp, Artificial Sequence
  chemically synthesized
agactttttgcacagtcaataa

SEQ ID NO: 873775 - DNA, 22 bp, Artificial Sequence
  chemically synthesized
tttgcacagtcaataacacaaa

SEQ ID NO: 873776 - DNA, 22 bp, Artificial Sequence
  chemically synthesized
ttgcacagtcaataacacaaag

SEQ ID NO: 873777 - DNA, 22 bp, Artificial Sequence
  chemically synthesized
tgcacagtcaataacacaaagg

SEQ ID NO: 873778 - DNA, 22 bp, Artificial Sequence
  chemically synthesized
gcacagtcaataacacaaaggt

SEQ ID NO: 873779 - DNA, 22 bp, Artificial Sequence
  chemically synthesized
cacagtcaataacacaaaggtt

SEQ ID NO: 873780 - DNA, 22 bp, Artificial Sequence
  chemically synthesized
aagatagagataaacctttgtg

SEQ ID NO: 873781 - DNA, 22 bp, Artificial Sequence
  chemically synthesized
taaagatagagataaacctttg

SEQ ID NO: 873782 - DNA, 22 bp, Artificial Sequence
  chemically synthesized
aattctaaagatagagataaac

SEQ ID NO: 873783 - DNA, 22 bp, Artificial Sequence
  chemically synthesized
caattctaaagatagagataaa

SEQ ID NO: 873784 - DNA, 22 bp, Artificial Sequence
  chemically synthesized
tttcaattctaaagatagagat

SEQ ID NO: 873785 - DNA, 22 bp, Artificial Sequence
  chemically synthesized
gtttcaattctaaagatagaga

SEQ ID NO: 873786 - DNA, 22 bp, Artificial Sequence
  chemically synthesized
atctctatctttagaattgaaa

SEQ ID NO: 873787 - DNA, 22 bp, Artificial Sequence
  chemically synthesized
tctctatctttagaattgaaac

SEQ ID NO: 873788 - DNA, 22 bp, Artificial Sequence
  chemically synthesized
tatctttagaattgaaacaaat

SEQ ID NO: 873789 - DNA, 22 bp, Artificial Sequence
  chemically synthesized
ggtgagagagaaaatttgtttc

SEQ ID NO: 873790 - DNA, 22 bp, Artificial Sequence
  chemically synthesized
tctttagaattgaaacaaattt

SEQ ID NO: 873791 - DNA, 22 bp, Artificial Sequence
  chemically synthesized
tagaattgaaacaaattttctc

SEQ ID NO: 873792 - DNA, 22 bp, Artificial Sequence
  chemically synthesized
agaattgaaacaaattttctct

SEQ ID NO: 873793 - DNA, 22 bp, Artificial Sequence
  chemically synthesized
gaattgaaacaaattttctctc

SEQ ID NO: 873794 - DNA, 22 bp, Artificial Sequence
  chemically synthesized
aaacaaattttctctctcaccc

SEQ ID NO: 873795 - DNA, 22 bp, Artificial Sequence
  chemically synthesized
tgaagtgatgactgggtgagag

SEQ ID NO: 873796 - DNA, 22 bp, Artificial Sequence
  chemically synthesized
tctctctcacccagtcatcact

SEQ ID NO: 873797 - DNA, 22 bp, Artificial Sequence
  chemically synthesized
ctctctcacccagtcatcactt

SEQ ID NO: 873798 - DNA, 22 bp, Artificial Sequence
  chemically synthesized
tctctcacccagtcatcacttc

SEQ ID NO: 873799 - DNA, 22 bp, Artificial Sequence
  chemically synthesized
tctcacccagtcatcacttcat

SEQ ID NO: 873800 - DNA, 22 bp, Artificial Sequence
  chemically synthesized
aaaagtgcaactatgaagtgat

SEQ ID NO: 873801 - DNA, 22 bp, Artificial Sequence
  chemically synthesized
tcacccagtcatcacttcatag

SEQ ID NO: 873802 - DNA, 22 bp, Artificial Sequence
  chemically synthesized
ttcaaaagtgcaactatgaagt

SEQ ID NO: 873803 - DNA, 22 bp, Artificial Sequence
  chemically synthesized
acccagtcatcacttcatagtt

SEQ ID NO: 873804 - DNA, 22 bp, Artificial Sequence
  chemically synthesized
gttcaaaagtgcaactatgaag

SEQ ID NO: 873805 - DNA, 22 bp, Artificial Sequence
  chemically synthesized
tttgttcaaaagtgcaactatg

SEQ ID NO: 873806 - DNA, 22 bp, Artificial Sequence
  chemically synthesized
gctatttgttcaaaagtgcaac

SEQ ID NO: 873807 - DNA, 22 bp, Artificial Sequence
  chemically synthesized
tagctatttgttcaaaagtgca

SEQ ID NO: 873808 - DNA, 22 bp, Artificial Sequence
  chemically synthesized
gctctagctatttgttcaaaag

SEQ ID NO: 873809 - DNA, 22 bp, Artificial Sequence
  chemically synthesized
ggctctagctatttgttcaaaa

SEQ ID NO: 873810 - DNA, 22 bp, Artificial Sequence
  chemically synthesized
catagttgcacttttgaacaaa

SEQ ID NO: 873811 - DNA, 22 bp, Artificial Sequence
  chemically synthesized
tggctctagctatttgttcaaa

SEQ ID NO: 873812 - DNA, 22 bp, Artificial Sequence
  chemically synthesized
atagttgcacttttgaacaaat

SEQ ID NO: 873813 - DNA, 22 bp, Artificial Sequence
  chemically synthesized
tttggctctagctatttgttca

SEQ ID NO: 873814 - DNA, 22 bp, Artificial Sequence
  chemically synthesized
tctttggctctagctatttgtt

SEQ ID NO: 873815 - DNA, 22 bp, Artificial Sequence
  chemically synthesized
cacttttgaacaaatagctaga

SEQ ID NO: 873816 - DNA, 22 bp, Artificial Sequence
  chemically synthesized
ttgaacaaatagctagagccaa

SEQ ID NO: 873817 - DNA, 22 bp, Artificial Sequence
  chemically synthesized
tgaacaaatagctagagccaaa

SEQ ID NO: 873818 - DNA, 22 bp, Artificial Sequence
  chemically synthesized
gatcccattctctttggctcta

SEQ ID NO: 873819 - DNA, 22 bp, Artificial Sequence
  chemically synthesized
gaacaaatagctagagccaaag

SEQ ID NO: 873820 - DNA, 22 bp, Artificial Sequence
  chemically synthesized
aacaaatagctagagccaaaga

SEQ ID NO: 873821 - DNA, 22 bp, Artificial Sequence
  chemically synthesized
taagtatactggatcccattct

SEQ ID NO: 873822 - DNA, 22 bp, Artificial Sequence
  chemically synthesized
gagccaaagagaatgggatcca

SEQ ID NO: 873823 - DNA, 22 bp, Artificial Sequence
  chemically synthesized
gagcctgtaagtatactggatc

SEQ ID NO: 873824 - DNA, 22 bp, Artificial Sequence
  chemically synthesized
ttggagcctgtaagtatactgg

SEQ ID NO: 873825 - DNA, 22 bp, Artificial Sequence
  chemically synthesized
accactattggagcctgtaagt

SEQ ID NO: 873826 - DNA, 22 bp, Artificial Sequence
  chemically synthesized
gactgaccactattggagcctg

SEQ ID NO: 873827 - DNA, 22 bp, Artificial Sequence
  chemically synthesized
ctggactgaccactattggagc

SEQ ID NO: 873828 - DNA, 22 bp, Artificial Sequence
  chemically synthesized
gctcctggactgaccactattg

SEQ ID NO: 873829 - DNA, 22 bp, Artificial Sequence
  chemically synthesized
acaggctccaatagtggtcagt

SEQ ID NO: 873830 - DNA, 22 bp, Artificial Sequence
  chemically synthesized
caggctccaatagtggtcagtc

SEQ ID NO: 873831 - DNA, 22 bp, Artificial Sequence
  chemically synthesized
acctagctcctggactgaccac

SEQ ID NO: 873832 - DNA, 22 bp, Artificial Sequence
  chemically synthesized
caatagtggtcagtccaggagc

SEQ ID NO: 873833 - DNA, 22 bp, Artificial Sequence
  chemically synthesized
agggcaaagcagcctgacctag

SEQ ID NO: 873834 - DNA, 22 bp, Artificial Sequence
  chemically synthesized
aagagctgagggcaaagcagcc

SEQ ID NO: 873835 - DNA, 22 bp, Artificial Sequence
  chemically synthesized
caagagctgagggcaaagcagc

SEQ ID NO: 873836 - DNA, 22 bp, Artificial Sequence
  chemically synthesized
cttcaagagctgagggcaaagc

SEQ ID NO: 873837 - DNA, 22 bp, Artificial Sequence
  chemically synthesized
acttcaagagctgagggcaaag

SEQ ID NO: 873838 - DNA, 22 bp, Artificial Sequence
  chemically synthesized
ggtcaggctgctttgccctcag

SEQ ID NO: 873839 - DNA, 22 bp, Artificial Sequence
  chemically synthesized
ctttgccctcagctcttgaagt

SEQ ID NO: 873840 - DNA, 22 bp, Artificial Sequence
  chemically synthesized
tgccctcagctcttgaagtaaa

SEQ ID NO: 873841 - DNA, 22 bp, Artificial Sequence
  chemically synthesized
gccctcagctcttgaagtaaac

SEQ ID NO: 873842 - DNA, 22 bp, Artificial Sequence
  chemically synthesized
ccctcagctcttgaagtaaacg

SEQ ID NO: 873843 - DNA, 22 bp, Artificial Sequence
  chemically synthesized
agctcttgaagtaaacggttta

SEQ ID NO: 873844 - DNA, 22 bp, Artificial Sequence
  chemically synthesized
agtggaaggcggtaaaccgttt

SEQ ID NO: 873845 - DNA, 22 bp, Artificial Sequence
  chemically synthesized
tgagtggaaggcggtaaaccgt

SEQ ID NO: 873846 - DNA, 22 bp, Artificial Sequence
  chemically synthesized
ttgaagtaaacggtttaccgcc

SEQ ID NO: 873847 - DNA, 22 bp, Artificial Sequence
  chemically synthesized
gaagtaaacggtttaccgcctt

SEQ ID NO: 873848 - DNA, 22 bp, Artificial Sequence
  chemically synthesized
agctctgagtggaaggcggtaa

SEQ ID NO: 873849 - DNA, 22 bp, Artificial Sequence
  chemically synthesized
aagtaaacggtttaccgccttc

SEQ ID NO: 873850 - DNA, 22 bp, Artificial Sequence
  chemically synthesized
gaagatctgagctctgagtgga

SEQ ID NO: 873851 - DNA, 22 bp, Artificial Sequence
  chemically synthesized
accgccttccactcagagctca

SEQ ID NO: 873852 - DNA, 22 bp, Artificial Sequence
  chemically synthesized
ccgccttccactcagagctcag

SEQ ID NO: 873853 - DNA, 22 bp, Artificial Sequence
  chemically synthesized
aagaggaagttagaagatctga

SEQ ID NO: 873854 - DNA, 22 bp, Artificial Sequence
  chemically synthesized
ccactcagagctcagatcttct

SEQ ID NO: 873855 - DNA, 22 bp, Artificial Sequence
  chemically synthesized
cactcagagctcagatcttcta

SEQ ID NO: 873856 - DNA, 22 bp, Artificial Sequence
  chemically synthesized
ttaaagaggaagttagaagatc

SEQ ID NO: 873857 - DNA, 22 bp, Artificial Sequence
  chemically synthesized
tgttaaagaggaagttagaaga

SEQ ID NO: 873858 - DNA, 22 bp, Artificial Sequence
  chemically synthesized
ctgttaaagaggaagttagaag

SEQ ID NO: 873859 - DNA, 22 bp, Artificial Sequence
  chemically synthesized
agagctcagatcttctaacttc

SEQ ID NO: 873860 - DNA, 22 bp, Artificial Sequence
  chemically synthesized
tctgttaaagaggaagttagaa

SEQ ID NO: 873861 - DNA, 22 bp, Artificial Sequence
  chemically synthesized
ttctgttaaagaggaagttaga

SEQ ID NO: 873862 - DNA, 22 bp, Artificial Sequence
  chemically synthesized
agatcttctaacttcctcttta

SEQ ID NO: 873863 - DNA, 22 bp, Artificial Sequence
  chemically synthesized
ctaacttcctctttaacagaaa

SEQ ID NO: 873864 - DNA, 22 bp, Artificial Sequence
  chemically synthesized
taacttcctctttaacagaaaa

SEQ ID NO: 873865 - DNA, 22 bp, Artificial Sequence
  chemically synthesized
acttcctctttaacagaaaagc

SEQ ID NO: 873866 - DNA, 22 bp, Artificial Sequence
  chemically synthesized
cctctttaacagaaaagcatac

SEQ ID NO: 873867 - DNA, 22 bp, Artificial Sequence
  chemically synthesized
ctctttaacagaaaagcataca

SEQ ID NO: 873868 - DNA, 22 bp, Artificial Sequence
  chemically synthesized
tttaacagaaaagcatacacat

SEQ ID NO: 873869 - DNA, 22 bp, Artificial Sequence
  chemically synthesized
atcgaataagtaatgtgtatgc

SEQ ID NO: 873870 - DNA, 22 bp, Artificial Sequence
  chemically synthesized
taacagaaaagcatacacatta

SEQ ID NO: 873871 - DNA, 22 bp, Artificial Sequence
  chemically synthesized
aacagaaaagcatacacattac

SEQ ID NO: 873872 - DNA, 22 bp, Artificial Sequence
  chemically synthesized
acagaaaagcatacacattact

SEQ ID NO: 873873 - DNA, 22 bp, Artificial Sequence
  chemically synthesized
aaagtgttaatcgaataagtaa

SEQ ID NO: 873874 - DNA, 22 bp, Artificial Sequence
  chemically synthesized
caaagtgttaatcgaataagta

SEQ ID NO: 873875 - DNA, 22 bp, Artificial Sequence
  chemically synthesized
tcttcaaagtgttaatcgaata

SEQ ID NO: 873876 - DNA, 22 bp, Artificial Sequence
  chemically synthesized
atgaattatcttcaaagtgtta

SEQ ID NO: 873877 - DNA, 22 bp, Artificial Sequence
  chemically synthesized
cttattcgattaacactttgaa

SEQ ID NO: 873878 - DNA, 22 bp, Artificial Sequence
  chemically synthesized
attcgattaacactttgaagat

SEQ ID NO: 873879 - DNA, 22 bp, Artificial Sequence
  chemically synthesized
ttcgattaacactttgaagata

SEQ ID NO: 873880 - DNA, 22 bp, Artificial Sequence
  chemically synthesized
agatgttcatgaattatcttca

SEQ ID NO: 873881 - DNA, 22 bp, Artificial Sequence
  chemically synthesized
gattaacactttgaagataatt

SEQ ID NO: 873882 - DNA, 22 bp, Artificial Sequence
  chemically synthesized
acactttgaagataattcatga

SEQ ID NO: 873883 - DNA, 22 bp, Artificial Sequence
  chemically synthesized
tgaagataattcatgaacatct

SEQ ID NO: 873884 - DNA, 22 bp, Artificial Sequence
  chemically synthesized
gaagataattcatgaacatctt

SEQ ID NO: 873885 - DNA, 22 bp, Artificial Sequence
  chemically synthesized
accaaatggattaagatgttca

SEQ ID NO: 873886 - DNA, 22 bp, Artificial Sequence
  chemically synthesized
aagataattcatgaacatctta

SEQ ID NO: 873887 - DNA, 22 bp, Artificial Sequence
  chemically synthesized
atgaacatcttaatccatttgg

SEQ ID NO: 873888 - DNA, 22 bp, Artificial Sequence
  chemically synthesized
aatccatttggtgaatatatta

SEQ ID NO: 873889 - DNA, 22 bp, Artificial Sequence
  chemically synthesized
atccatttggtgaatatattat

SEQ ID NO: 873890 - DNA, 22 bp, Artificial Sequence
  chemically synthesized
ggtgaatatattattggatttc

SEQ ID NO: 873891 - DNA, 22 bp, Artificial Sequence
  chemically synthesized
gtgaatatattattggatttct

SEQ ID NO: 873892 - DNA, 22 bp, Artificial Sequence
  chemically synthesized
gaagtaaaatataatagaaatc

SEQ ID NO: 873893 - DNA, 22 bp, Artificial Sequence
  chemically synthesized
agaagtaaaatataatagaaat

SEQ ID NO: 873894 - DNA, 22 bp, Artificial Sequence
  chemically synthesized
atttagaagtaaaatataatag

SEQ ID NO: 873895 - DNA, 22 bp, Artificial Sequence
  chemically synthesized
ttggatttctattatattttac

SEQ ID NO: 873896 - DNA, 22 bp, Artificial Sequence
  chemically synthesized
aagttaatttagaagtaaaata

SEQ ID NO: 873897 - DNA, 22 bp, Artificial Sequence
  chemically synthesized
gatttctattatattttacttc

SEQ ID NO: 873898 - DNA, 22 bp, Artificial Sequence
  chemically synthesized
ctattatattttacttctaaat

SEQ ID NO: 873899 - DNA, 22 bp, Artificial Sequence
  chemically synthesized
tattatattttacttctaaatt

SEQ ID NO: 873900 - DNA, 22 bp, Artificial Sequence
  chemically synthesized
cccactaaagttaatttagaag

SEQ ID NO: 873901 - DNA, 22 bp, Artificial Sequence
  chemically synthesized
ttatattttacttctaaattaa

SEQ ID NO: 873902 - DNA, 22 bp, Artificial Sequence
  chemically synthesized
tacccactaaagttaatttaga

SEQ ID NO: 873903 - DNA, 22 bp, Artificial Sequence
  chemically synthesized
tattttacttctaaattaactt

SEQ ID NO: 873904 - DNA, 22 bp, Artificial Sequence
  chemically synthesized
tacttctaaattaactttagtg

SEQ ID NO: 873905 - DNA, 22 bp, Artificial Sequence
  chemically synthesized
acttctaaattaactttagtgg

SEQ ID NO: 873906 - DNA, 22 bp, Artificial Sequence
  chemically synthesized
cttctaaattaactttagtggg

SEQ ID NO: 873907 - DNA, 22 bp, Artificial Sequence
  chemically synthesized
aaagaaattctacccactaaag

SEQ ID NO: 873908 - DNA, 22 bp, Artificial Sequence
  chemically synthesized
aaaagaaattctacccactaaa

SEQ ID NO: 873909 - DNA, 22 bp, Artificial Sequence
  chemically synthesized
taaaagaaattctacccactaa

SEQ ID NO: 873910 - DNA, 22 bp, Artificial Sequence
  chemically synthesized
ctaaattaactttagtgggtag

SEQ ID NO: 873911 - DNA, 22 bp, Artificial Sequence
  chemically synthesized
taaattaactttagtgggtaga

SEQ ID NO: 873912 - DNA, 22 bp, Artificial Sequence
  chemically synthesized
ctttaaaagaaattctacccac

SEQ ID NO: 873913 - DNA, 22 bp, Artificial Sequence
  chemically synthesized
aattaactttagtgggtagaat

SEQ ID NO: 873914 - DNA, 22 bp, Artificial Sequence
  chemically synthesized
actttagtgggtagaatttctt

SEQ ID NO: 873915 - DNA, 22 bp, Artificial Sequence
  chemically synthesized
taattcctttaaaagaaattct

SEQ ID NO: 873916 - DNA, 22 bp, Artificial Sequence
  chemically synthesized
tagtgggtagaatttcttttaa

SEQ ID NO: 873917 - DNA, 22 bp, Artificial Sequence
  chemically synthesized
agtgggtagaatttcttttaaa

SEQ ID NO: 873918 - DNA, 22 bp, Artificial Sequence
  chemically synthesized
gtgggtagaatttcttttaaag

SEQ ID NO: 873919 - DNA, 22 bp, Artificial Sequence
  chemically synthesized
aaataattataattcctttaaa

SEQ ID NO: 873920 - DNA, 22 bp, Artificial Sequence
  chemically synthesized
gctaaaataattataattcctt

SEQ ID NO: 873921 - DNA, 22 bp, Artificial Sequence
  chemically synthesized
cttttaaaggaattataattat

SEQ ID NO: 873922 - DNA, 22 bp, Artificial Sequence
  chemically synthesized
ttttaaaggaattataattatt

SEQ ID NO: 873923 - DNA, 22 bp, Artificial Sequence
  chemically synthesized
ttaaaggaattataattatttt

SEQ ID NO: 873924 - DNA, 22 bp, Artificial Sequence
  chemically synthesized
taaaggaattataattatttta

SEQ ID NO: 873925 - DNA, 22 bp, Artificial Sequence
  chemically synthesized
aaaggaattataattattttag

SEQ ID NO: 873926 - DNA, 22 bp, Artificial Sequence
  chemically synthesized
tagggtggttggctaaaataat

SEQ ID NO: 873927 - DNA, 22 bp, Artificial Sequence
  chemically synthesized
aaggaattataattattttagc

SEQ ID NO: 873928 - DNA, 22 bp, Artificial Sequence
  chemically synthesized
gtagggtggttggctaaaataa

SEQ ID NO: 873929 - DNA, 22 bp, Artificial Sequence
  chemically synthesized
taattattttagccaaccaccc

SEQ ID NO: 873930 - DNA, 22 bp, Artificial Sequence
  chemically synthesized
ataaatatttgtagggtggttg

SEQ ID NO: 873931 - DNA, 22 bp, Artificial Sequence
  chemically synthesized
ttttagccaaccaccctacaaa

SEQ ID NO: 873932 - DNA, 22 bp, Artificial Sequence
  chemically synthesized
tagccaaccaccctacaaatat

SEQ ID NO: 873933 - DNA, 22 bp, Artificial Sequence
  chemically synthesized
agccaaccaccctacaaatatt

SEQ ID NO: 873934 - DNA, 22 bp, Artificial Sequence
  chemically synthesized
gccaaccaccctacaaatattt

SEQ ID NO: 873935 - DNA, 22 bp, Artificial Sequence
  chemically synthesized
tatggagcaattgataaatatt

SEQ ID NO: 873936 - DNA, 22 bp, Artificial Sequence
  chemically synthesized
gtatggagcaattgataaatat

SEQ ID NO: 873937 - DNA, 22 bp, Artificial Sequence
  chemically synthesized
tgtatggagcaattgataaata

SEQ ID NO: 873938 - DNA, 22 bp, Artificial Sequence
  chemically synthesized
ttgtatggagcaattgataaat

SEQ ID NO: 873939 - DNA, 22 bp, Artificial Sequence
  chemically synthesized
caaatatttatcaattgctcca

SEQ ID NO: 873940 - DNA, 22 bp, Artificial Sequence
  chemically synthesized
gagaaagggtttttgtatggag

SEQ ID NO: 873941 - DNA, 22 bp, Artificial Sequence
  chemically synthesized
atcaattgctccatacaaaaac

SEQ ID NO: 873942 - DNA, 22 bp, Artificial Sequence
  chemically synthesized
tcaattgctccatacaaaaacc

SEQ ID NO: 873943 - DNA, 22 bp, Artificial Sequence
  chemically synthesized
tgcctggagaaagggtttttgt

SEQ ID NO: 873944 - DNA, 22 bp, Artificial Sequence
  chemically synthesized
ctccatacaaaaaccctttctc

SEQ ID NO: 873945 - DNA, 22 bp, Artificial Sequence
  chemically synthesized
catacaaaaaccctttctccag

SEQ ID NO: 873946 - DNA, 22 bp, Artificial Sequence
  chemically synthesized
aataaaattatgcctggagaaa

SEQ ID NO: 873947 - DNA, 22 bp, Artificial Sequence
  chemically synthesized
aaataaaattatgcctggagaa

SEQ ID NO: 873948 - DNA, 22 bp, Artificial Sequence
  chemically synthesized
taaataaaattatgcctggaga

SEQ ID NO: 873949 - DNA, 22 bp, Artificial Sequence
  chemically synthesized
ctttaaataaaattatgcctgg

SEQ ID NO: 873950 - DNA, 22 bp, Artificial Sequence
  chemically synthesized
cctttaaataaaattatgcctg

SEQ ID NO: 873951 - DNA, 22 bp, Artificial Sequence
  chemically synthesized
cttcctttaaataaaattatgc

SEQ ID NO: 873952 - DNA, 22 bp, Artificial Sequence
  chemically synthesized
tacttcctttaaataaaattat

SEQ ID NO: 873953 - DNA, 22 bp, Artificial Sequence
  chemically synthesized
tctccaggcataattttattta

SEQ ID NO: 873954 - DNA, 22 bp, Artificial Sequence
  chemically synthesized
ctccaggcataattttatttaa

SEQ ID NO: 873955 - DNA, 22 bp, Artificial Sequence
  chemically synthesized
tccaggcataattttatttaaa

SEQ ID NO: 873956 - DNA, 22 bp, Artificial Sequence
  chemically synthesized
cactctacttcctttaaataaa

SEQ ID NO: 873957 - DNA, 22 bp, Artificial Sequence
  chemically synthesized
gcactctacttcctttaaataa

SEQ ID NO: 873958 - DNA, 22 bp, Artificial Sequence
  chemically synthesized
caggcataattttatttaaagg

SEQ ID NO: 873959 - DNA, 22 bp, Artificial Sequence
  chemically synthesized
atgtttgcactctacttccttt

SEQ ID NO: 873960 - DNA, 22 bp, Artificial Sequence
  chemically synthesized
actaatgtttgcactctacttc

SEQ ID NO: 873961 - DNA, 22 bp, Artificial Sequence
  chemically synthesized
cactaatgtttgcactctactt

SEQ ID NO: 873962 - DNA, 22 bp, Artificial Sequence
  chemically synthesized
tcactaatgtttgcactctact

SEQ ID NO: 873963 - DNA, 22 bp, Artificial Sequence
  chemically synthesized
tatttaaaggaagtagagtgca

SEQ ID NO: 873964 - DNA, 22 bp, Artificial Sequence
  chemically synthesized
atttaaaggaagtagagtgcaa

SEQ ID NO: 873965 - DNA, 22 bp, Artificial Sequence
  chemically synthesized
tttaaaggaagtagagtgcaaa

SEQ ID NO: 873966 - DNA, 22 bp, Artificial Sequence
  chemically synthesized
ttttcactaatgtttgcactct

SEQ ID NO: 873967 - DNA, 22 bp, Artificial Sequence
  chemically synthesized
gttttcactaatgtttgcactc

SEQ ID NO: 873968 - DNA, 22 bp, Artificial Sequence
  chemically synthesized
aaaggaagtagagtgcaaacat

SEQ ID NO: 873969 - DNA, 22 bp, Artificial Sequence
  chemically synthesized
aaggaagtagagtgcaaacatt

SEQ ID NO: 873970 - DNA, 22 bp, Artificial Sequence
  chemically synthesized
gtttgttttcactaatgtttgc

SEQ ID NO: 873971 - DNA, 22 bp, Artificial Sequence
  chemically synthesized
ttggtttgttttcactaatgtt

SEQ ID NO: 873972 - DNA, 22 bp, Artificial Sequence
  chemically synthesized
gttggtttgttttcactaatgt

SEQ ID NO: 873973 - DNA, 22 bp, Artificial Sequence
  chemically synthesized
tgttggtttgttttcactaatg

SEQ ID NO: 873974 - DNA, 22 bp, Artificial Sequence
  chemically synthesized
ttgttggtttgttttcactaat

SEQ ID NO: 873975 - DNA, 22 bp, Artificial Sequence
  chemically synthesized
tttgttggtttgttttcactaa

SEQ ID NO: 873976 - DNA, 22 bp, Artificial Sequence
  chemically synthesized
ttttttgttggtttgttttcac

SEQ ID NO: 873977 - DNA, 22 bp, Artificial Sequence
  chemically synthesized
agagggaactgttttttgttgg

SEQ ID NO: 873978 - DNA, 22 bp, Artificial Sequence
  chemically synthesized
gtgaaaacaaaccaacaaaaaa

SEQ ID NO: 873979 - DNA, 22 bp, Artificial Sequence
  chemically synthesized
ctgagagggaactgttttttgt

SEQ ID NO: 873980 - DNA, 22 bp, Artificial Sequence
  chemically synthesized
gttgctgagagggaactgtttt

SEQ ID NO: 873981 - DNA, 22 bp, Artificial Sequence
  chemically synthesized
agctagttgctgagagggaact

SEQ ID NO: 873982 - DNA, 22 bp, Artificial Sequence
  chemically synthesized
aagaattaagctagttgctgag

SEQ ID NO: 873983 - DNA, 22 bp, Artificial Sequence
  chemically synthesized
caagaattaagctagttgctga

SEQ ID NO: 873984 - DNA, 22 bp, Artificial Sequence
  chemically synthesized
ttcaagaattaagctagttgct

SEQ ID NO: 873985 - DNA, 22 bp, Artificial Sequence
  chemically synthesized
cctctcagcaactagcttaatt

SEQ ID NO: 873986 - DNA, 22 bp, Artificial Sequence
  chemically synthesized
tcagcaactagcttaattcttg

SEQ ID NO: 873987 - DNA, 22 bp, Artificial Sequence
  chemically synthesized
agcaactagcttaattcttgaa

SEQ ID NO: 873988 - DNA, 22 bp, Artificial Sequence
  chemically synthesized
gcttaattcttgaagagtatct

SEQ ID NO: 873989 - DNA, 22 bp, Artificial Sequence
  chemically synthesized
gtatgcaaccacaatagatact

SEQ ID NO: 873990 - DNA, 22 bp, Artificial Sequence
  chemically synthesized
aattcttgaagagtatctattg

SEQ ID NO: 873991 - DNA, 22 bp, Artificial Sequence
  chemically synthesized
agtatgcaaccacaatagatac

SEQ ID NO: 873992 - DNA, 22 bp, Artificial Sequence
  chemically synthesized
attcttgaagagtatctattgt

SEQ ID NO: 873993 - DNA, 22 bp, Artificial Sequence
  chemically synthesized
tagtatgcaaccacaatagata

SEQ ID NO: 873994 - DNA, 22 bp, Artificial Sequence
  chemically synthesized
ttgaagagtatctattgtggtt

SEQ ID NO: 873995 - DNA, 22 bp, Artificial Sequence
  chemically synthesized
gaagagtatctattgtggttgc

SEQ ID NO: 873996 - DNA, 22 bp, Artificial Sequence
  chemically synthesized
aagagtatctattgtggttgca

SEQ ID NO: 873997 - DNA, 22 bp, Artificial Sequence
  chemically synthesized
gataattttagtatgcaaccac

SEQ ID NO: 873998 - DNA, 22 bp, Artificial Sequence
  chemically synthesized
tctggataattttagtatgcaa

SEQ ID NO: 873999 - DNA, 22 bp, Artificial Sequence
  chemically synthesized
ttgtggttgcatactaaaatta

SEQ ID NO: 874000 - DNA, 22 bp, Artificial Sequence
  chemically synthesized
aagttatctggataattttagt

SEQ ID NO: 874001 - DNA, 22 bp, Artificial Sequence
  chemically synthesized
tggttgcatactaaaattatcc

SEQ ID NO: 874002 - DNA, 22 bp, Artificial Sequence
  chemically synthesized
ctaaagttatctggataatttt

SEQ ID NO: 874003 - DNA, 22 bp, Artificial Sequence
  chemically synthesized
cctaaagttatctggataattt

SEQ ID NO: 874004 - DNA, 22 bp, Artificial Sequence
  chemically synthesized
tcctaaagttatctggataatt

SEQ ID NO: 874005 - DNA, 22 bp, Artificial Sequence
  chemically synthesized
catactaaaattatccagataa

SEQ ID NO: 874006 - DNA, 22 bp, Artificial Sequence
  chemically synthesized
ggattttcctaaagttatctgg

SEQ ID NO: 874007 - DNA, 22 bp, Artificial Sequence
  chemically synthesized
aaattatccagataactttagg

SEQ ID NO: 874008 - DNA, 22 bp, Artificial Sequence
  chemically synthesized
tccagataactttaggaaaatc

SEQ ID NO: 874009 - DNA, 22 bp, Artificial Sequence
  chemically synthesized
ggggtgagccagtacattagga

SEQ ID NO: 874010 - DNA, 22 bp, Artificial Sequence
  chemically synthesized
taggaaaatcctaatgtactgg

SEQ ID NO: 874011 - DNA, 22 bp, Artificial Sequence
  chemically synthesized
actgggggtgagccagtacatt

SEQ ID NO: 874012 - DNA, 22 bp, Artificial Sequence
  chemically synthesized
aggaaaatcctaatgtactggc

SEQ ID NO: 874013 - DNA, 22 bp, Artificial Sequence
  chemically synthesized
ggaaaatcctaatgtactggct

SEQ ID NO: 874014 - DNA, 22 bp, Artificial Sequence
  chemically synthesized
atataattgactgggggtgagc

SEQ ID NO: 874015 - DNA, 22 bp, Artificial Sequence
  chemically synthesized
tgatataattgactgggggtga

SEQ ID NO: 874016 - DNA, 22 bp, Artificial Sequence
  chemically synthesized
atgtactggctcacccccagtc

SEQ ID NO: 874017 - DNA, 22 bp, Artificial Sequence
  chemically synthesized
agagactctgatataattgact

SEQ ID NO: 874018 - DNA, 22 bp, Artificial Sequence
  chemically synthesized
aagagactctgatataattgac

SEQ ID NO: 874019 - DNA, 22 bp, Artificial Sequence
  chemically synthesized
gctcacccccagtcaattatat

SEQ ID NO: 874020 - DNA, 22 bp, Artificial Sequence
  chemically synthesized
taagagactctgatataattga

SEQ ID NO: 874021 - DNA, 22 bp, Artificial Sequence
  chemically synthesized
acccccagtcaattatatcaga

SEQ ID NO: 874022 - DNA, 22 bp, Artificial Sequence
  chemically synthesized
cctttaagagactctgatataa

SEQ ID NO: 874023 - DNA, 22 bp, Artificial Sequence
  chemically synthesized
cagcccctccctttaagagact

SEQ ID NO: 874024 - DNA, 22 bp, Artificial Sequence
  chemically synthesized
tatcagagtctcttaaagggag

SEQ ID NO: 874025 - DNA, 22 bp, Artificial Sequence
  chemically synthesized
ccgtgtccactgcagcccctcc

SEQ ID NO: 874026 - DNA, 22 bp, Artificial Sequence
  chemically synthesized
ttaaagggaggggctgcagtgg

SEQ ID NO: 874027 - DNA, 22 bp, Artificial Sequence
  chemically synthesized
aaagggaggggctgcagtggac

SEQ ID NO: 874028 - DNA, 22 bp, Artificial Sequence
  chemically synthesized
aagggaggggctgcagtggaca

SEQ ID NO: 874029 - DNA, 22 bp, Artificial Sequence
  chemically synthesized
agtagcatattcccgtgtccac

SEQ ID NO: 874030 - DNA, 22 bp, Artificial Sequence
  chemically synthesized
tgagtagcatattcccgtgtcc

SEQ ID NO: 874031 - DNA, 22 bp, Artificial Sequence
  chemically synthesized
cagtggacacgggaatatgcta

SEQ ID NO: 874032 - DNA, 22 bp, Artificial Sequence
  chemically synthesized
aagggggctctgagtagcatat

SEQ ID NO: 874033 - DNA, 22 bp, Artificial Sequence
  chemically synthesized
gaagggggctctgagtagcata

SEQ ID NO: 874034 - DNA, 22 bp, Artificial Sequence
  chemically synthesized
tgaagggggctctgagtagcat

SEQ ID NO: 874035 - DNA, 22 bp, Artificial Sequence
  chemically synthesized
tttgaagggggctctgagtagc

SEQ ID NO: 874036 - DNA, 22 bp, Artificial Sequence
  chemically synthesized
ctttgaagggggctctgagtag

SEQ ID NO: 874037 - DNA, 22 bp, Artificial Sequence
  chemically synthesized
tctttgaagggggctctgagta

SEQ ID NO: 874038 - DNA, 22 bp, Artificial Sequence
  chemically synthesized
gaacaagagtctttctttgaag

SEQ ID NO: 874039 - DNA, 22 bp, Artificial Sequence
  chemically synthesized
ctcagagcccccttcaaagaaa

SEQ ID NO: 874040 - DNA, 22 bp, Artificial Sequence
  chemically synthesized
agagcccccttcaaagaaagac

SEQ ID NO: 874041 - DNA, 22 bp, Artificial Sequence
  chemically synthesized
catcatctagaacaagagtctt

SEQ ID NO: 874042 - DNA, 22 bp, Artificial Sequence
  chemically synthesized
ccatcatctagaacaagagtct

SEQ ID NO: 874043 - DNA, 22 bp, Artificial Sequence
  chemically synthesized
caaagaaagactcttgttctag

SEQ ID NO: 874044 - DNA, 22 bp, Artificial Sequence
  chemically synthesized
aaagaaagactcttgttctaga

SEQ ID NO: 874045 - DNA, 22 bp, Artificial Sequence
  chemically synthesized
acatcatttccatcatctagaa

SEQ ID NO: 874046 - DNA, 22 bp, Artificial Sequence
  chemically synthesized
ctgacatcatttccatcatcta

SEQ ID NO: 874047 - DNA, 22 bp, Artificial Sequence
  chemically synthesized
ttgttctagatgatggaaatga

SEQ ID NO: 874048 - DNA, 22 bp, Artificial Sequence
  chemically synthesized
gttctagatgatggaaatgatg

SEQ ID NO: 874049 - DNA, 22 bp, Artificial Sequence
  chemically synthesized
ttctagatgatggaaatgatgt

SEQ ID NO: 874050 - DNA, 22 bp, Artificial Sequence
  chemically synthesized
aagaatgtctactgacatcatt

SEQ ID NO: 874051 - DNA, 22 bp, Artificial Sequence
  chemically synthesized
tagatgatggaaatgatgtcag

SEQ ID NO: 874052 - DNA, 22 bp, Artificial Sequence
  chemically synthesized
gatgatggaaatgatgtcagta

SEQ ID NO: 874053 - DNA, 22 bp, Artificial Sequence
  chemically synthesized
acagttgaagaatgtctactga

SEQ ID NO: 874054 - DNA, 22 bp, Artificial Sequence
  chemically synthesized
aagggactgacagttgaagaat

SEQ ID NO: 874055 - DNA, 22 bp, Artificial Sequence
  chemically synthesized
aggcagtccctgaagggactga

SEQ ID NO: 874056 - DNA, 22 bp, Artificial Sequence
  chemically synthesized
ttcaactgtcagtcccttcagg

SEQ ID NO: 874057 - DNA, 22 bp, Artificial Sequence
  chemically synthesized
caactgtcagtcccttcaggga

SEQ ID NO: 874058 - DNA, 22 bp, Artificial Sequence
  chemically synthesized
cagctcaggcagtccctgaagg

SEQ ID NO: 874059 - DNA, 22 bp, Artificial Sequence
  chemically synthesized
aactgtcagtcccttcagggac

SEQ ID NO: 874060 - DNA, 22 bp, Artificial Sequence
  chemically synthesized
tgcagctcaggcagtccctgaa

SEQ ID NO: 874061 - DNA, 22 bp, Artificial Sequence
  chemically synthesized
tctgcagctcaggcagtccctg

SEQ ID NO: 874062 - DNA, 22 bp, Artificial Sequence
  chemically synthesized
tcagtcccttcagggactgcct

SEQ ID NO: 874063 - DNA, 22 bp, Artificial Sequence
  chemically synthesized
cagggactgcctgagctgcaga

SEQ ID NO: 874064 - DNA, 22 bp, Artificial Sequence
  chemically synthesized
agggactgcctgagctgcagag

SEQ ID NO: 874065 - DNA, 22 bp, Artificial Sequence
  chemically synthesized
gacaaggcagctctctgcagct

SEQ ID NO: 874066 - DNA, 22 bp, Artificial Sequence
  chemically synthesized
ggacaaggcagctctctgcagc

SEQ ID NO: 874067 - DNA, 22 bp, Artificial Sequence
  chemically synthesized
cctgagctgcagagagctgcct

SEQ ID NO: 874068 - DNA, 22 bp, Artificial Sequence
  chemically synthesized
agctgcagagagctgccttgtc

SEQ ID NO: 874069 - DNA, 22 bp, Artificial Sequence
  chemically synthesized
cagagagctgccttgtccaagt

SEQ ID NO: 874070 - DNA, 22 bp, Artificial Sequence
  chemically synthesized
gggaaaggcatgaacttggaca

SEQ ID NO: 874071 - DNA, 22 bp, Artificial Sequence
  chemically synthesized
cctggggaaaggcatgaacttg

SEQ ID NO: 874072 - DNA, 22 bp, Artificial Sequence
  chemically synthesized
ccttgtccaagttcatgccttt

SEQ ID NO: 874073 - DNA, 22 bp, Artificial Sequence
  chemically synthesized
gtccaagttcatgcctttcccc

SEQ ID NO: 874074 - DNA, 22 bp, Artificial Sequence
  chemically synthesized
tccaagttcatgcctttcccca

SEQ ID NO: 874075 - DNA, 22 bp, Artificial Sequence
  chemically synthesized
aatgagggctgcctggggaaag

SEQ ID NO: 874076 - DNA, 22 bp, Artificial Sequence
  chemically synthesized
atgcctttccccaggcagccct

SEQ ID NO: 874077 - DNA, 22 bp, Artificial Sequence
  chemically synthesized
atcagtcactgaatgagggctg

SEQ ID NO: 874078 - DNA, 22 bp, Artificial Sequence
  chemically synthesized
catcagtcactgaatgagggct

SEQ ID NO: 874079 - DNA, 22 bp, Artificial Sequence
  chemically synthesized
tccccaggcagccctcattcag

SEQ ID NO: 874080 - DNA, 22 bp, Artificial Sequence
  chemically synthesized
ccccaggcagccctcattcagt

SEQ ID NO: 874081 - DNA, 22 bp, Artificial Sequence
  chemically synthesized
cccaggcagccctcattcagtg

SEQ ID NO: 874082 - DNA, 22 bp, Artificial Sequence
  chemically synthesized
accttcatcagtcactgaatga

SEQ ID NO: 874083 - DNA, 22 bp, Artificial Sequence
  chemically synthesized
caccttcatcagtcactgaatg

SEQ ID NO: 874084 - DNA, 22 bp, Artificial Sequence
  chemically synthesized
tcaccttcatcagtcactgaat

SEQ ID NO: 874085 - DNA, 22 bp, Artificial Sequence
  chemically synthesized
tactttcaccttcatcagtcac

SEQ ID NO: 874086 - DNA, 22 bp, Artificial Sequence
  chemically synthesized
tatactttcaccttcatcagtc

SEQ ID NO: 874087 - DNA, 22 bp, Artificial Sequence
  chemically synthesized
attcagtgactgatgaaggtga

SEQ ID NO: 874088 - DNA, 22 bp, Artificial Sequence
  chemically synthesized
ggcctctatactttcaccttca

SEQ ID NO: 874089 - DNA, 22 bp, Artificial Sequence
  chemically synthesized
agtgactgatgaaggtgaaagt

SEQ ID NO: 874090 - DNA, 22 bp, Artificial Sequence
  chemically synthesized
agccaaattaggcctctatact

SEQ ID NO: 874091 - DNA, 22 bp, Artificial Sequence
  chemically synthesized
atgaaggtgaaagtatagaggc

SEQ ID NO: 874092 - DNA, 22 bp, Artificial Sequence
  chemically synthesized
gagccaaattaggcctctatac

SEQ ID NO: 874093 - DNA, 22 bp, Artificial Sequence
  chemically synthesized
tgagccaaattaggcctctata

SEQ ID NO: 874094 - DNA, 22 bp, Artificial Sequence
  chemically synthesized
ctttgagccaaattaggcctct

SEQ ID NO: 874095 - DNA, 22 bp, Artificial Sequence
  chemically synthesized
tcctgctttgagccaaattagg

SEQ ID NO: 874096 - DNA, 22 bp, Artificial Sequence
  chemically synthesized
gtcctgctttgagccaaattag

SEQ ID NO: 874097 - DNA, 22 bp, Artificial Sequence
  chemically synthesized
aaacttgtcctgctttgagcca

SEQ ID NO: 874098 - DNA, 22 bp, Artificial Sequence
  chemically synthesized
caaacttgtcctgctttgagcc

SEQ ID NO: 874099 - DNA, 22 bp, Artificial Sequence
  chemically synthesized
atttggctcaaagcaggacaag

SEQ ID NO: 874100 - DNA, 22 bp, Artificial Sequence
  chemically synthesized
aagtagcccttcaaacttgtcc

SEQ ID NO: 874101 - DNA, 22 bp, Artificial Sequence
  chemically synthesized
ggctcaaagcaggacaagtttg

SEQ ID NO: 874102 - DNA, 22 bp, Artificial Sequence
  chemically synthesized
gctcaaagcaggacaagtttga

SEQ ID NO: 874103 - DNA, 22 bp, Artificial Sequence
  chemically synthesized
aaagcaggacaagtttgaaggg

SEQ ID NO: 874104 - DNA, 22 bp, Artificial Sequence
  chemically synthesized
cagctgaagtagcccttcaaac

SEQ ID NO: 874105 - DNA, 22 bp, Artificial Sequence
  chemically synthesized
tgcagctgaagtagcccttcaa

SEQ ID NO: 874106 - DNA, 22 bp, Artificial Sequence
  chemically synthesized
gaagggctacttcagctgcaga

SEQ ID NO: 874107 - DNA, 22 bp, Artificial Sequence
  chemically synthesized
aagggctacttcagctgcagag

SEQ ID NO: 874108 - DNA, 22 bp, Artificial Sequence
  chemically synthesized
tgccacggggagctctgcagct

SEQ ID NO: 874109 - DNA, 22 bp, Artificial Sequence
  chemically synthesized
atgccacggggagctctgcagc

SEQ ID NO: 874110 - DNA, 22 bp, Artificial Sequence
  chemically synthesized
ccttatgccacggggagctctg

SEQ ID NO: 874111 - DNA, 22 bp, Artificial Sequence
  chemically synthesized
gccttatgccacggggagctct

SEQ ID NO: 874112 - DNA, 22 bp, Artificial Sequence
  chemically synthesized
cttcagctgcagagctccccgt

SEQ ID NO: 874113 - DNA, 22 bp, Artificial Sequence
  chemically synthesized
cagctgcagagctccccgtggc

SEQ ID NO: 874114 - DNA, 22 bp, Artificial Sequence
  chemically synthesized
agctgcagagctccccgtggca

SEQ ID NO: 874115 - DNA, 22 bp, Artificial Sequence
  chemically synthesized
cagagctccccgtggcataagg

SEQ ID NO: 874116 - DNA, 22 bp, Artificial Sequence
  chemically synthesized
gccatatacaggcttgccttat

SEQ ID NO: 874117 - DNA, 22 bp, Artificial Sequence
  chemically synthesized
cccgtggcataaggcaagcctg

SEQ ID NO: 874118 - DNA, 22 bp, Artificial Sequence
  chemically synthesized
ccagcacaccactggccatata

SEQ ID NO: 874119 - DNA, 22 bp, Artificial Sequence
  chemically synthesized
atatacatctaccagcacacca

SEQ ID NO: 874120 - DNA, 22 bp, Artificial Sequence
  chemically synthesized
tatatggccagtggtgtgctgg

SEQ ID NO: 874121 - DNA, 22 bp, Artificial Sequence
  chemically synthesized
agatcagagatccagttgatat

SEQ ID NO: 874122 - DNA, 22 bp, Artificial Sequence
  chemically synthesized
gtagatgtatatcaactggatc

SEQ ID NO: 874123 - DNA, 22 bp, Artificial Sequence
  chemically synthesized
aacaccctgagatcagagatcc

SEQ ID NO: 874124 - DNA, 22 bp, Artificial Sequence
  chemically synthesized
aaacaccctgagatcagagatc

SEQ ID NO: 874125 - DNA, 22 bp, Artificial Sequence
  chemically synthesized
taaacaccctgagatcagagat

SEQ ID NO: 874126 - DNA, 22 bp, Artificial Sequence
  chemically synthesized
ttaaacaccctgagatcagaga

SEQ ID NO: 874127 - DNA, 22 bp, Artificial Sequence
  chemically synthesized
gatctctgatctcagggtgttt

SEQ ID NO: 874128 - DNA, 22 bp, Artificial Sequence
  chemically synthesized
aaaacaaggtgtttttaaacac

SEQ ID NO: 874129 - DNA, 22 bp, Artificial Sequence
  chemically synthesized
tgatctcagggtgtttaaaaac

SEQ ID NO: 874130 - DNA, 22 bp, Artificial Sequence
  chemically synthesized
atctcagggtgtttaaaaacac

SEQ ID NO: 874131 - DNA, 22 bp, Artificial Sequence
  chemically synthesized
agggtgtttaaaaacaccttgt

SEQ ID NO: 874132 - DNA, 22 bp, Artificial Sequence
  chemically synthesized
gcaaacactaaaaacaaggtgt

SEQ ID NO: 874133 - DNA, 22 bp, Artificial Sequence
  chemically synthesized
aaaaacaccttgtttttagtgt

SEQ ID NO: 874134 - DNA, 22 bp, Artificial Sequence
  chemically synthesized
aaaacaccttgtttttagtgtt

SEQ ID NO: 874135 - DNA, 22 bp, Artificial Sequence
  chemically synthesized
caccacagaaattggcaaacac

SEQ ID NO: 874136 - DNA, 22 bp, Artificial Sequence
  chemically synthesized
acaccacagaaattggcaaaca

SEQ ID NO: 874137 - DNA, 22 bp, Artificial Sequence
  chemically synthesized
gtttttagtgtttgccaatttc

SEQ ID NO: 874138 - DNA, 22 bp, Artificial Sequence
  chemically synthesized
tttttagtgtttgccaatttct

SEQ ID NO: 874139 - DNA, 22 bp, Artificial Sequence
  chemically synthesized
ttagtgtttgccaatttctgtg

SEQ ID NO: 874140 - DNA, 22 bp, Artificial Sequence
  chemically synthesized
tagtgtttgccaatttctgtgg

SEQ ID NO: 874141 - DNA, 22 bp, Artificial Sequence
  chemically synthesized
agtgtttgccaatttctgtggt

SEQ ID NO: 874142 - DNA, 22 bp, Artificial Sequence
  chemically synthesized
gtgtttgccaatttctgtggtg

SEQ ID NO: 874143 - DNA, 22 bp, Artificial Sequence
  chemically synthesized
gccaatttctgtggtgtaaata

SEQ ID NO: 874144 - DNA, 22 bp, Artificial Sequence
  chemically synthesized
ccaatttctgtggtgtaaatat

SEQ ID NO: 874145 - DNA, 22 bp, Artificial Sequence
  chemically synthesized
accgtggtaggaatatttacac

SEQ ID NO: 874146 - DNA, 22 bp, Artificial Sequence
  chemically synthesized
aaccgtggtaggaatatttaca

SEQ ID NO: 874147 - DNA, 22 bp, Artificial Sequence
  chemically synthesized
aatttaaccgtggtaggaatat

SEQ ID NO: 874148 - DNA, 22 bp, Artificial Sequence
  chemically synthesized
ctgtggtgtaaatattcctacc

SEQ ID NO: 874149 - DNA, 22 bp, Artificial Sequence
  chemically synthesized
aaatttaaccgtggtaggaata

SEQ ID NO: 874150 - DNA, 22 bp, Artificial Sequence
  chemically synthesized
tgtggtgtaaatattcctacca

SEQ ID NO: 874151 - DNA, 22 bp, Artificial Sequence
  chemically synthesized
tggtgtaaatattcctaccacg

SEQ ID NO: 874152 - DNA, 22 bp, Artificial Sequence
  chemically synthesized
gtaatttaaatttaaccgtggt

SEQ ID NO: 874153 - DNA, 22 bp, Artificial Sequence
  chemically synthesized
ggtaatttaaatttaaccgtgg

SEQ ID NO: 874154 - DNA, 22 bp, Artificial Sequence
  chemically synthesized
ttggtaatttaaatttaaccgt

SEQ ID NO: 874155 - DNA, 22 bp, Artificial Sequence
  chemically synthesized
cttggtaatttaaatttaaccg

SEQ ID NO: 874156 - DNA, 22 bp, Artificial Sequence
  chemically synthesized
tcttcttggtaatttaaattta

SEQ ID NO: 874157 - DNA, 22 bp, Artificial Sequence
  chemically synthesized
ctaccacggttaaatttaaatt

SEQ ID NO: 874158 - DNA, 22 bp, Artificial Sequence
  chemically synthesized
ccacggttaaatttaaattacc

SEQ ID NO: 874159 - DNA, 22 bp, Artificial Sequence
  chemically synthesized
atgttatcttcttggtaattta

SEQ ID NO: 874160 - DNA, 22 bp, Artificial Sequence
  chemically synthesized
gatgttatcttcttggtaattt

SEQ ID NO: 874161 - DNA, 22 bp, Artificial Sequence
  chemically synthesized
aatttaaattaccaagaagata

SEQ ID NO: 874162 - DNA, 22 bp, Artificial Sequence
  chemically synthesized
agccacttgatgttatcttctt

SEQ ID NO: 874163 - DNA, 22 bp, Artificial Sequence
  chemically synthesized
gagccacttgatgttatcttct

SEQ ID NO: 874164 - DNA, 22 bp, Artificial Sequence
  chemically synthesized
tgagccacttgatgttatcttc

SEQ ID NO: 874165 - DNA, 22 bp, Artificial Sequence
  chemically synthesized
ttgagccacttgatgttatctt

SEQ ID NO: 874166 - DNA, 22 bp, Artificial Sequence
  chemically synthesized
aaattaccaagaagataacatc

SEQ ID NO: 874167 - DNA, 22 bp, Artificial Sequence
  chemically synthesized
tttgagccacttgatgttatct

SEQ ID NO: 874168 - DNA, 22 bp, Artificial Sequence
  chemically synthesized
aattaccaagaagataacatca

SEQ ID NO: 874169 - DNA, 22 bp, Artificial Sequence
  chemically synthesized
ccaagaagataacatcaagtgg

SEQ ID NO: 874170 - DNA, 22 bp, Artificial Sequence
  chemically synthesized
ccaggcattttttgagccactt

SEQ ID NO: 874171 - DNA, 22 bp, Artificial Sequence
  chemically synthesized
tattgccaggcattttttgagc

SEQ ID NO: 874172 - DNA, 22 bp, Artificial Sequence
  chemically synthesized
ttatattgccaggcattttttg

SEQ ID NO: 874173 - DNA, 22 bp, Artificial Sequence
  chemically synthesized
ctgttatattgccaggcatttt

SEQ ID NO: 874174 - DNA, 22 bp, Artificial Sequence
  chemically synthesized
aaaaaatgcctggcaatataac

SEQ ID NO: 874175 - DNA, 22 bp, Artificial Sequence
  chemically synthesized
aggacggcctactgttatattg

SEQ ID NO: 874176 - DNA, 22 bp, Artificial Sequence
  chemically synthesized
gcaatataacagtaggccgtcc

SEQ ID NO: 874177 - DNA, 22 bp, Artificial Sequence
  chemically synthesized
cccagtgaagtggaaccagctc

SEQ ID NO: 874178 - DNA, 22 bp, Artificial Sequence
  chemically synthesized
gctgcccagtgaagtggaacca

SEQ ID NO: 874179 - DNA, 22 bp, Artificial Sequence
  chemically synthesized
agctggttccacttcactgggc

SEQ ID NO: 874180 - DNA, 22 bp, Artificial Sequence
  chemically synthesized
tcgtatagctagctgcccagtg

SEQ ID NO: 874181 - DNA, 22 bp, Artificial Sequence
  chemically synthesized
gttccacttcactgggcagcta

SEQ ID NO: 874182 - DNA, 22 bp, Artificial Sequence
  chemically synthesized
cacttcactgggcagctagcta

SEQ ID NO: 874183 - DNA, 22 bp, Artificial Sequence
  chemically synthesized
taaattatcgtatagctagctg

SEQ ID NO: 874184 - DNA, 22 bp, Artificial Sequence
  chemically synthesized
gctataaattatcgtatagcta

SEQ ID NO: 874185 - DNA, 22 bp, Artificial Sequence
  chemically synthesized
cactgggcagctagctatacga

SEQ ID NO: 874186 - DNA, 22 bp, Artificial Sequence
  chemically synthesized
actgggcagctagctatacgat

SEQ ID NO: 874187 - DNA, 22 bp, Artificial Sequence
  chemically synthesized
ctggctataaattatcgtatag

SEQ ID NO: 874188 - DNA, 22 bp, Artificial Sequence
  chemically synthesized
tgctggctataaattatcgtat

SEQ ID NO: 874189 - DNA, 22 bp, Artificial Sequence
  chemically synthesized
ggcagctagctatacgataatt

SEQ ID NO: 874190 - DNA, 22 bp, Artificial Sequence
  chemically synthesized
acattctgctggctataaatta

SEQ ID NO: 874191 - DNA, 22 bp, Artificial Sequence
  chemically synthesized
gctatacgataatttatagcca

SEQ ID NO: 874192 - DNA, 22 bp, Artificial Sequence
  chemically synthesized
ctcacattctgctggctataaa

SEQ ID NO: 874193 - DNA, 22 bp, Artificial Sequence
  chemically synthesized
tgctcacattctgctggctata

SEQ ID NO: 874194 - DNA, 22 bp, Artificial Sequence
  chemically synthesized
ctgctcacattctgctggctat

SEQ ID NO: 874195 - DNA, 22 bp, Artificial Sequence
  chemically synthesized
tacgataatttatagccagcag

SEQ ID NO: 874196 - DNA, 22 bp, Artificial Sequence
  chemically synthesized
atagccagcagaatgtgagcag

SEQ ID NO: 874197 - DNA, 22 bp, Artificial Sequence
  chemically synthesized
tagccagcagaatgtgagcaga

SEQ ID NO: 874198 - DNA, 22 bp, Artificial Sequence
  chemically synthesized
acaaacaacacttctgctcaca

SEQ ID NO: 874199 - DNA, 22 bp, Artificial Sequence
  chemically synthesized
agccccaaactgacaaacaaca

SEQ ID NO: 874200 - DNA, 22 bp, Artificial Sequence
  chemically synthesized
aaagcctcagccccaaactgac

SEQ ID NO: 874201 - DNA, 22 bp, Artificial Sequence
  chemically synthesized
caaagcctcagccccaaactga

SEQ ID NO: 874202 - DNA, 22 bp, Artificial Sequence
  chemically synthesized
tcaaagcctcagccccaaactg

SEQ ID NO: 874203 - DNA, 22 bp, Artificial Sequence
  chemically synthesized
ttcaaagcctcagccccaaact

SEQ ID NO: 874204 - DNA, 22 bp, Artificial Sequence
  chemically synthesized
aatttttcaaagcctcagcccc

SEQ ID NO: 874205 - DNA, 22 bp, Artificial Sequence
  chemically synthesized
tttgtcagtttggggctgaggc

SEQ ID NO: 874206 - DNA, 22 bp, Artificial Sequence
  chemically synthesized
gtcagtttggggctgaggcttt

SEQ ID NO: 874207 - DNA, 22 bp, Artificial Sequence
  chemically synthesized
actaaatttttcaaagcctcag

SEQ ID NO: 874208 - DNA, 22 bp, Artificial Sequence
  chemically synthesized
tcagtttggggctgaggctttg

SEQ ID NO: 874209 - DNA, 22 bp, Artificial Sequence
  chemically synthesized
ggggctgaggctttgaaaaatt

SEQ ID NO: 874210 - DNA, 22 bp, Artificial Sequence
  chemically synthesized
gggctgaggctttgaaaaattt

SEQ ID NO: 874211 - DNA, 22 bp, Artificial Sequence
  chemically synthesized
aggctttgaaaaatttagtgag

SEQ ID NO: 874212 - DNA, 22 bp, Artificial Sequence
  chemically synthesized
tgaaaaatttagtgaggtttcc

SEQ ID NO: 874213 - DNA, 22 bp, Artificial Sequence
  chemically synthesized
gaaaaatttagtgaggtttcca

SEQ ID NO: 874214 - DNA, 22 bp, Artificial Sequence
  chemically synthesized
aaaaatttagtgaggtttccac

SEQ ID NO: 874215 - DNA, 22 bp, Artificial Sequence
  chemically synthesized
agtgaggtttccacattttttt

SEQ ID NO: 874216 - DNA, 22 bp, Artificial Sequence
  chemically synthesized
gtgaggtttccacatttttttt

SEQ ID NO: 874217 - DNA, 22 bp, Artificial Sequence
  chemically synthesized
cagcaatagaaaggaaaaaaaa

SEQ ID NO: 874218 - DNA, 22 bp, Artificial Sequence
  chemically synthesized
ccagcaatagaaaggaaaaaaa

SEQ ID NO: 874219 - DNA, 22 bp, Artificial Sequence
  chemically synthesized
cttccagcaatagaaaggaaaa

SEQ ID NO: 874220 - DNA, 22 bp, Artificial Sequence
  chemically synthesized
tgcttccagcaatagaaaggaa

SEQ ID NO: 874221 - DNA, 22 bp, Artificial Sequence
  chemically synthesized
ccacattttttttcctttctat

SEQ ID NO: 874222 - DNA, 22 bp, Artificial Sequence
  chemically synthesized
ctgcttccagcaatagaaagga

SEQ ID NO: 874223 - DNA, 22 bp, Artificial Sequence
  chemically synthesized
cacattttttttcctttctatt

SEQ ID NO: 874224 - DNA, 22 bp, Artificial Sequence
  chemically synthesized
tttttcctttctattgctggaa

SEQ ID NO: 874225 - DNA, 22 bp, Artificial Sequence
  chemically synthesized
agagtcttctgcttccagcaat

SEQ ID NO: 874226 - DNA, 22 bp, Artificial Sequence
  chemically synthesized
ttttcctttctattgctggaag

SEQ ID NO: 874227 - DNA, 22 bp, Artificial Sequence
  chemically synthesized
tttcctttctattgctggaagc

SEQ ID NO: 874228 - DNA, 22 bp, Artificial Sequence
  chemically synthesized
ttcctttctattgctggaagca

SEQ ID NO: 874229 - DNA, 22 bp, Artificial Sequence
  chemically synthesized
tcctttctattgctggaagcag

SEQ ID NO: 874230 - DNA, 22 bp, Artificial Sequence
  chemically synthesized
cctttctattgctggaagcaga

SEQ ID NO: 874231 - DNA, 22 bp, Artificial Sequence
  chemically synthesized
ctttctattgctggaagcagaa

SEQ ID NO: 874232 - DNA, 22 bp, Artificial Sequence
  chemically synthesized
tctattgctggaagcagaagac

SEQ ID NO: 874233 - DNA, 22 bp, Artificial Sequence
  chemically synthesized
ctattgctggaagcagaagact

SEQ ID NO: 874234 - DNA, 22 bp, Artificial Sequence
  chemically synthesized
tattgctggaagcagaagactc

SEQ ID NO: 874235 - DNA, 22 bp, Artificial Sequence
  chemically synthesized
ccgtaggacctaagagtcttct

SEQ ID NO: 874236 - DNA, 22 bp, Artificial Sequence
  chemically synthesized
ttgctggaagcagaagactctt

SEQ ID NO: 874237 - DNA, 22 bp, Artificial Sequence
  chemically synthesized
gccgtaggacctaagagtcttc

SEQ ID NO: 874238 - DNA, 22 bp, Artificial Sequence
  chemically synthesized
ctggaagcagaagactcttagg

SEQ ID NO: 874239 - DNA, 22 bp, Artificial Sequence
  chemically synthesized
gaagcagaagactcttaggtcc

SEQ ID NO: 874240 - DNA, 22 bp, Artificial Sequence
  chemically synthesized
taaagatttgccgtaggaccta

SEQ ID NO: 874241 - DNA, 22 bp, Artificial Sequence
  chemically synthesized
agtaagttgtaaagatttgccg

SEQ ID NO: 874242 - DNA, 22 bp, Artificial Sequence
  chemically synthesized
ttaggtcctacggcaaatcttt

SEQ ID NO: 874243 - DNA, 22 bp, Artificial Sequence
  chemically synthesized
ctcagtaagttgtaaagatttg

SEQ ID NO: 874244 - DNA, 22 bp, Artificial Sequence
  chemically synthesized
aggtcctacggcaaatctttac

SEQ ID NO: 874245 - DNA, 22 bp, Artificial Sequence
  chemically synthesized
ggtcctacggcaaatctttaca

SEQ ID NO: 874246 - DNA, 22 bp, Artificial Sequence
  chemically synthesized
tcctcagtaagttgtaaagatt

SEQ ID NO: 874247 - DNA, 22 bp, Artificial Sequence
  chemically synthesized
tctcctcagtaagttgtaaaga

SEQ ID NO: 874248 - DNA, 22 bp, Artificial Sequence
  chemically synthesized
attctctcctcagtaagttgta

SEQ ID NO: 874249 - DNA, 22 bp, Artificial Sequence
  chemically synthesized
cggcaaatctttacaacttact

SEQ ID NO: 874250 - DNA, 22 bp, Artificial Sequence
  chemically synthesized
aattctctcctcagtaagttgt

SEQ ID NO: 874251 - DNA, 22 bp, Artificial Sequence
  chemically synthesized
ggacttaattctctcctcagta

SEQ ID NO: 874252 - DNA, 22 bp, Artificial Sequence
  chemically synthesized
tacaacttactgaggagagaat

SEQ ID NO: 874253 - DNA, 22 bp, Artificial Sequence
  chemically synthesized
acaacttactgaggagagaatt

SEQ ID NO: 874254 - DNA, 22 bp, Artificial Sequence
  chemically synthesized
caacttactgaggagagaatta

SEQ ID NO: 874255 - DNA, 22 bp, Artificial Sequence
  chemically synthesized
gggcgttaggacttaattctct

SEQ ID NO: 874256 - DNA, 22 bp, Artificial Sequence
  chemically synthesized
actgaggagagaattaagtcct

SEQ ID NO: 874257 - DNA, 22 bp, Artificial Sequence
  chemically synthesized
ccctagggcgttaggacttaat

SEQ ID NO: 874258 - DNA, 22 bp, Artificial Sequence
  chemically synthesized
ctgaggagagaattaagtccta

SEQ ID NO: 874259 - DNA, 22 bp, Artificial Sequence
  chemically synthesized
aggagagaattaagtcctaacg

SEQ ID NO: 874260 - DNA, 22 bp, Artificial Sequence
  chemically synthesized
agtcctaacgccctagggcagt

SEQ ID NO: 874261 - DNA, 22 bp, Artificial Sequence
  chemically synthesized
aagtatgagaacaactgcccta

SEQ ID NO: 874262 - DNA, 22 bp, Artificial Sequence
  chemically synthesized
acgccctagggcagttgttctc

SEQ ID NO: 874263 - DNA, 22 bp, Artificial Sequence
  chemically synthesized
atcctaaagtatgagaacaact

SEQ ID NO: 874264 - DNA, 22 bp, Artificial Sequence
  chemically synthesized
ttgatcctaaagtatgagaaca

SEQ ID NO: 874265 - DNA, 22 bp, Artificial Sequence
  chemically synthesized
tgttgatcctaaagtatgagaa

SEQ ID NO: 874266 - DNA, 22 bp, Artificial Sequence
  chemically synthesized
gggcagttgttctcatacttta

SEQ ID NO: 874267 - DNA, 22 bp, Artificial Sequence
  chemically synthesized
caggtgattctgttgatcctaa

SEQ ID NO: 874268 - DNA, 22 bp, Artificial Sequence
  chemically synthesized
ttctcatactttaggatcaaca

SEQ ID NO: 874269 - DNA, 22 bp, Artificial Sequence
  chemically synthesized
tcatactttaggatcaacagaa

SEQ ID NO: 874270 - DNA, 22 bp, Artificial Sequence
  chemically synthesized
atactttaggatcaacagaatc

SEQ ID NO: 874271 - DNA, 22 bp, Artificial Sequence
  chemically synthesized
gcaaggtctccaggtgattctg

SEQ ID NO: 874272 - DNA, 22 bp, Artificial Sequence
  chemically synthesized
taggatcaacagaatcacctgg

SEQ ID NO: 874273 - DNA, 22 bp, Artificial Sequence
  chemically synthesized
aggatcaacagaatcacctgga

SEQ ID NO: 874274 - DNA, 22 bp, Artificial Sequence
  chemically synthesized
ggatcaacagaatcacctggag

SEQ ID NO: 874275 - DNA, 22 bp, Artificial Sequence
  chemically synthesized
ccatgcagcaattagcaaggtc

SEQ ID NO: 874276 - DNA, 22 bp, Artificial Sequence
  chemically synthesized
cggggctaccatgcagcaatta

SEQ ID NO: 874277 - DNA, 22 bp, Artificial Sequence
  chemically synthesized
gagaccttgctaattgctgcat

SEQ ID NO: 874278 - DNA, 22 bp, Artificial Sequence
  chemically synthesized
gctaattgctgcatggtagccc

SEQ ID NO: 874279 - DNA, 22 bp, Artificial Sequence
  chemically synthesized
ctaattgctgcatggtagcccc

SEQ ID NO: 874280 - DNA, 22 bp, Artificial Sequence
  chemically synthesized
aatccagaactccggggctacc

SEQ ID NO: 874281 - DNA, 22 bp, Artificial Sequence
  chemically synthesized
attgctgcatggtagccccgga

SEQ ID NO: 874282 - DNA, 22 bp, Artificial Sequence
  chemically synthesized
ctaaatccagaactccggggct

SEQ ID NO: 874283 - DNA, 22 bp, Artificial Sequence
  chemically synthesized
ctgcatggtagccccggagttc

SEQ ID NO: 874284 - DNA, 22 bp, Artificial Sequence
  chemically synthesized
catggtagccccggagttctgg

SEQ ID NO: 874285 - DNA, 22 bp, Artificial Sequence
  chemically synthesized
cacccagtatctactaaatcca

SEQ ID NO: 874286 - DNA, 22 bp, Artificial Sequence
  chemically synthesized
ggctccacccagtatctactaa

SEQ ID NO: 874287 - DNA, 22 bp, Artificial Sequence
  chemically synthesized
ttgggctccacccagtatctac

SEQ ID NO: 874288 - DNA, 22 bp, Artificial Sequence
  chemically synthesized
tggatttagtagatactgggtg

SEQ ID NO: 874289 - DNA, 22 bp, Artificial Sequence
  chemically synthesized
gatttagtagatactgggtgga

SEQ ID NO: 874290 - DNA, 22 bp, Artificial Sequence
  chemically synthesized
agtagatactgggtggagccca

SEQ ID NO: 874291 - DNA, 22 bp, Artificial Sequence
  chemically synthesized
gtagatactgggtggagcccaa

SEQ ID NO: 874292 - DNA, 22 bp, Artificial Sequence
  chemically synthesized
aaaatgcaaattattgggctcc

SEQ ID NO: 874293 - DNA, 22 bp, Artificial Sequence
  chemically synthesized
ttaaaaatgcaaattattgggc

SEQ ID NO: 874294 - DNA, 22 bp, Artificial Sequence
  chemically synthesized
ggtggagcccaataatttgcat

SEQ ID NO: 874295 - DNA, 22 bp, Artificial Sequence
  chemically synthesized
gaaaattgttaaaaatgcaaat

SEQ ID NO: 874296 - DNA, 22 bp, Artificial Sequence
  chemically synthesized
gcatttttaacaattttccagg

SEQ ID NO: 874297 - DNA, 22 bp, Artificial Sequence
  chemically synthesized
catttttaacaattttccaggt

SEQ ID NO: 874298 - DNA, 22 bp, Artificial Sequence
  chemically synthesized
ttaacaattttccaggtggtgt

SEQ ID NO: 874299 - DNA, 22 bp, Artificial Sequence
  chemically synthesized
taacaattttccaggtggtgtt

SEQ ID NO: 874300 - DNA, 22 bp, Artificial Sequence
  chemically synthesized
aacaattttccaggtggtgttg

SEQ ID NO: 874301 - DNA, 22 bp, Artificial Sequence
  chemically synthesized
acaattttccaggtggtgttga

SEQ ID NO: 874302 - DNA, 22 bp, Artificial Sequence
  chemically synthesized
tcatgaacaatcagcatcaaca

SEQ ID NO: 874303 - DNA, 22 bp, Artificial Sequence
  chemically synthesized
gtcatgaacaatcagcatcaac

SEQ ID NO: 874304 - DNA, 22 bp, Artificial Sequence
  chemically synthesized
tgtcatgaacaatcagcatcaa

SEQ ID NO: 874305 - DNA, 22 bp, Artificial Sequence
  chemically synthesized
tccaggtggtgttgatgctgat

SEQ ID NO: 874306 - DNA, 22 bp, Artificial Sequence
  chemically synthesized
ccaggtggtgttgatgctgatt

SEQ ID NO: 874307 - DNA, 22 bp, Artificial Sequence
  chemically synthesized
caggtggtgttgatgctgattg

SEQ ID NO: 874308 - DNA, 22 bp, Artificial Sequence
  chemically synthesized
ggattttgtcatgaacaatcag

SEQ ID NO: 874309 - DNA, 22 bp, Artificial Sequence
  chemically synthesized
aggattttgtcatgaacaatca

SEQ ID NO: 874310 - DNA, 22 bp, Artificial Sequence
  chemically synthesized
atgctgattgttcatgacaaaa

SEQ ID NO: 874311 - DNA, 22 bp, Artificial Sequence
  chemically synthesized
attgttcatgacaaaatcctaa

SEQ ID NO: 874312 - DNA, 22 bp, Artificial Sequence
  chemically synthesized
ggtgtaatagatatcttaggat

SEQ ID NO: 874313 - DNA, 22 bp, Artificial Sequence
  chemically synthesized
ttcatgacaaaatcctaagata

SEQ ID NO: 874314 - DNA, 22 bp, Artificial Sequence
  chemically synthesized
atgacaaaatcctaagatatct

SEQ ID NO: 874315 - DNA, 22 bp, Artificial Sequence
  chemically synthesized
attaggtgtaatagatatctta

SEQ ID NO: 874316 - DNA, 22 bp, Artificial Sequence
  chemically synthesized
aggtaactgattaggtgtaata

SEQ ID NO: 874317 - DNA, 22 bp, Artificial Sequence
  chemically synthesized
agatatctattacacctaatca

SEQ ID NO: 874318 - DNA, 22 bp, Artificial Sequence
  chemically synthesized
tgataaatgctcaggtaactga

SEQ ID NO: 874319 - DNA, 22 bp, Artificial Sequence
  chemically synthesized
ttacacctaatcagttacctga

SEQ ID NO: 874320 - DNA, 22 bp, Artificial Sequence
  chemically synthesized
cacctaatcagttacctgagca

SEQ ID NO: 874321 - DNA, 22 bp, Artificial Sequence
  chemically synthesized
gtctatgataaatgctcaggta

SEQ ID NO: 874322 - DNA, 22 bp, Artificial Sequence
  chemically synthesized
atcagttacctgagcatttatc

SEQ ID NO: 874323 - DNA, 22 bp, Artificial Sequence
  chemically synthesized
cctgagcatttatcatagacta

SEQ ID NO: 874324 - DNA, 22 bp, Artificial Sequence
  chemically synthesized
agcatttatcatagactagata

SEQ ID NO: 874325 - DNA, 22 bp, Artificial Sequence
  chemically synthesized
aagaatggtacatatctagtct

SEQ ID NO: 874326 - DNA, 22 bp, Artificial Sequence
  chemically synthesized
tcaagaatggtacatatctagt

SEQ ID NO: 874327 - DNA, 22 bp, Artificial Sequence
  chemically synthesized
atcatagactagatatgtacca

SEQ ID NO: 874328 - DNA, 22 bp, Artificial Sequence
  chemically synthesized
tgttctcaagaatggtacatat

SEQ ID NO: 874329 - DNA, 22 bp, Artificial Sequence
  chemically synthesized
tcatagactagatatgtaccat

SEQ ID NO: 874330 - DNA, 22 bp, Artificial Sequence
  chemically synthesized
ttatgttctcaagaatggtaca

SEQ ID NO: 874331 - DNA, 22 bp, Artificial Sequence
  chemically synthesized
gatatgtaccattcttgagaac

SEQ ID NO: 874332 - DNA, 22 bp, Artificial Sequence
  chemically synthesized
agggtctattatgttctcaaga

SEQ ID NO: 874333 - DNA, 22 bp, Artificial Sequence
  chemically synthesized
aaaatgatctgagggtctatta

SEQ ID NO: 874334 - DNA, 22 bp, Artificial Sequence
  chemically synthesized
ttgagaacataatagaccctca

SEQ ID NO: 874335 - DNA, 22 bp, Artificial Sequence
  chemically synthesized
ttgaaaatgatctgagggtcta

SEQ ID NO: 874336 - DNA, 22 bp, Artificial Sequence
  chemically synthesized
gagaacataatagaccctcaga

SEQ ID NO: 874337 - DNA, 22 bp, Artificial Sequence
  chemically synthesized
agaacataatagaccctcagat

SEQ ID NO: 874338 - DNA, 22 bp, Artificial Sequence
  chemically synthesized
gcaagaggatgaaatcctattg

SEQ ID NO: 874339 - DNA, 22 bp, Artificial Sequence
  chemically synthesized
cgcaagaggatgaaatcctatt

SEQ ID NO: 874340 - DNA, 22 bp, Artificial Sequence
  chemically synthesized
agatcattttcaataggatttc

SEQ ID NO: 874341 - DNA, 22 bp, Artificial Sequence
  chemically synthesized
gggtttcgcaagaggatgaaat

SEQ ID NO: 874342 - DNA, 22 bp, Artificial Sequence
  chemically synthesized
ctcgggtttcgcaagaggatga

SEQ ID NO: 874343 - DNA, 22 bp, Artificial Sequence
  chemically synthesized
tcaataggatttcatcctcttg

SEQ ID NO: 874344 - DNA, 22 bp, Artificial Sequence
  chemically synthesized
caataggatttcatcctcttgc

SEQ ID NO: 874345 - DNA, 22 bp, Artificial Sequence
  chemically synthesized
tgctcgggtttcgcaagaggat

SEQ ID NO: 874346 - DNA, 22 bp, Artificial Sequence
  chemically synthesized
aataggatttcatcctcttgcg

SEQ ID NO: 874347 - DNA, 22 bp, Artificial Sequence
  chemically synthesized
tctgctcgggtttcgcaagagg

SEQ ID NO: 874348 - DNA, 22 bp, Artificial Sequence
  chemically synthesized
ctctgctcgggtttcgcaagag

SEQ ID NO: 874349 - DNA, 22 bp, Artificial Sequence
  chemically synthesized
tctctgctcgggtttcgcaaga

SEQ ID NO: 874350 - DNA, 22 bp, Artificial Sequence
  chemically synthesized
ttctctgctcgggtttcgcaag

SEQ ID NO: 874351 - DNA, 22 bp, Artificial Sequence
  chemically synthesized
catcctcttgcgaaacccgagc

SEQ ID NO: 874352 - DNA, 22 bp, Artificial Sequence
  chemically synthesized
atcctcttgcgaaacccgagca

SEQ ID NO: 874353 - DNA, 22 bp, Artificial Sequence
  chemically synthesized
gtagcttttctctgctcgggtt

SEQ ID NO: 874354 - DNA, 22 bp, Artificial Sequence
  chemically synthesized
ggtagcttttctctgctcgggt

SEQ ID NO: 874355 - DNA, 22 bp, Artificial Sequence
  chemically synthesized
ccttggtagcttttctctgctc

SEQ ID NO: 874356 - DNA, 22 bp, Artificial Sequence
  chemically synthesized
ttgcgaaacccgagcagagaaa

SEQ ID NO: 874357 - DNA, 22 bp, Artificial Sequence
  chemically synthesized
gcgaaacccgagcagagaaaag

SEQ ID NO: 874358 - DNA, 22 bp, Artificial Sequence
  chemically synthesized
cgaaacccgagcagagaaaagc

SEQ ID NO: 874359 - DNA, 22 bp, Artificial Sequence
  chemically synthesized
ccattcccttggtagcttttct

SEQ ID NO: 874360 - DNA, 22 bp, Artificial Sequence
  chemically synthesized
cctgccattcccttggtagctt

SEQ ID NO: 874361 - DNA, 22 bp, Artificial Sequence
  chemically synthesized
tgcctgccattcccttggtagc

SEQ ID NO: 874362 - DNA, 22 bp, Artificial Sequence
  chemically synthesized
ctctgcctgccattcccttggt

SEQ ID NO: 874363 - DNA, 22 bp, Artificial Sequence
  chemically synthesized
cctctgcctgccattcccttgg

SEQ ID NO: 874364 - DNA, 22 bp, Artificial Sequence
  chemically synthesized
ttcctctgcctgccattccctt

SEQ ID NO: 874365 - DNA, 22 bp, Artificial Sequence
  chemically synthesized
cttcctctgcctgccattccct

SEQ ID NO: 874366 - DNA, 22 bp, Artificial Sequence
  chemically synthesized
atcttcttcctctgcctgccat

SEQ ID NO: 874367 - DNA, 22 bp, Artificial Sequence
  chemically synthesized
ttcatcttcttcctctgcctgc

SEQ ID NO: 874368 - DNA, 22 bp, Artificial Sequence
  chemically synthesized
ccaagggaatggcaggcagagg

SEQ ID NO: 874369 - DNA, 22 bp, Artificial Sequence
  chemically synthesized
ggtcctgttcatcttcttcctc

SEQ ID NO: 874370 - DNA, 22 bp, Artificial Sequence
  chemically synthesized
cagaaacctaggtcctgttcat

SEQ ID NO: 874371 - DNA, 22 bp, Artificial Sequence
  chemically synthesized
ttgcagaaacctaggtcctgtt

SEQ ID NO: 874372 - DNA, 22 bp, Artificial Sequence
  chemically synthesized
catatgttattgcagaaaccta

SEQ ID NO: 874373 - DNA, 22 bp, Artificial Sequence
  chemically synthesized
acatatgttattgcagaaacct

SEQ ID NO: 874374 - DNA, 22 bp, Artificial Sequence
  chemically synthesized
ttacatatgttattgcagaaac

SEQ ID NO: 874375 - DNA, 22 bp, Artificial Sequence
  chemically synthesized
cttacatatgttattgcagaaa

SEQ ID NO: 874376 - DNA, 22 bp, Artificial Sequence
  chemically synthesized
tcttacatatgttattgcagaa

SEQ ID NO: 874377 - DNA, 22 bp, Artificial Sequence
  chemically synthesized
ggtttctgcaataacatatgta

SEQ ID NO: 874378 - DNA, 22 bp, Artificial Sequence
  chemically synthesized
gtcaagcagctttcttacatat

SEQ ID NO: 874379 - DNA, 22 bp, Artificial Sequence
  chemically synthesized
ctgcaataacatatgtaagaaa

SEQ ID NO: 874380 - DNA, 22 bp, Artificial Sequence
  chemically synthesized
tgcaataacatatgtaagaaag

SEQ ID NO: 874381 - DNA, 22 bp, Artificial Sequence
  chemically synthesized
ctagtcaagcagctttcttaca

SEQ ID NO: 874382 - DNA, 22 bp, Artificial Sequence
  chemically synthesized
cctagtcaagcagctttcttac

SEQ ID NO: 874383 - DNA, 22 bp, Artificial Sequence
  chemically synthesized
caataacatatgtaagaaagct

SEQ ID NO: 874384 - DNA, 22 bp, Artificial Sequence
  chemically synthesized
tcctagtcaagcagctttctta

SEQ ID NO: 874385 - DNA, 22 bp, Artificial Sequence
  chemically synthesized
cttgactaggaaaacatacgct

SEQ ID NO: 874386 - DNA, 22 bp, Artificial Sequence
  chemically synthesized
acatgacaacccagcgtatgtt

SEQ ID NO: 874387 - DNA, 22 bp, Artificial Sequence
  chemically synthesized
gactaggaaaacatacgctggg

SEQ ID NO: 874388 - DNA, 22 bp, Artificial Sequence
  chemically synthesized
ctcacatgacaacccagcgtat

SEQ ID NO: 874389 - DNA, 22 bp, Artificial Sequence
  chemically synthesized
actaggaaaacatacgctgggt

SEQ ID NO: 874390 - DNA, 22 bp, Artificial Sequence
  chemically synthesized
gctcacatgacaacccagcgta

SEQ ID NO: 874391 - DNA, 22 bp, Artificial Sequence
  chemically synthesized
ttgctcacatgacaacccagcg

SEQ ID NO: 874392 - DNA, 22 bp, Artificial Sequence
  chemically synthesized
cttgctcacatgacaacccagc

SEQ ID NO: 874393 - DNA, 22 bp, Artificial Sequence
  chemically synthesized
ggaaaacatacgctgggttgtc

SEQ ID NO: 874394 - DNA, 22 bp, Artificial Sequence
  chemically synthesized
tcttgctcacatgacaacccag

SEQ ID NO: 874395 - DNA, 22 bp, Artificial Sequence
  chemically synthesized
ttcttgctcacatgacaaccca

SEQ ID NO: 874396 - DNA, 22 bp, Artificial Sequence
  chemically synthesized
ttttcttgctcacatgacaacc

SEQ ID NO: 874397 - DNA, 22 bp, Artificial Sequence
  chemically synthesized
ggttgtcatgtgagcaagaaaa

SEQ ID NO: 874398 - DNA, 22 bp, Artificial Sequence
  chemically synthesized
acacaataggagttcttttctt

SEQ ID NO: 874399 - DNA, 22 bp, Artificial Sequence
  chemically synthesized
aacacaataggagttcttttct

SEQ ID NO: 874400 - DNA, 22 bp, Artificial Sequence
  chemically synthesized
tcatgtgagcaagaaaagaact

SEQ ID NO: 874401 - DNA, 22 bp, Artificial Sequence
  chemically synthesized
agtggcttaacacaataggagt

SEQ ID NO: 874402 - DNA, 22 bp, Artificial Sequence
  chemically synthesized
cagtggcttaacacaataggag

SEQ ID NO: 874403 - DNA, 22 bp, Artificial Sequence
  chemically synthesized
aatatttcagtggcttaacaca

SEQ ID NO: 874404 - DNA, 22 bp, Artificial Sequence
  chemically synthesized
ctattgtgttaagccactgaaa

SEQ ID NO: 874405 - DNA, 22 bp, Artificial Sequence
  chemically synthesized
taatgaactaaatatttcagtg

SEQ ID NO: 874406 - DNA, 22 bp, Artificial Sequence
  chemically synthesized
ttgtgttaagccactgaaatat

SEQ ID NO: 874407 - DNA, 22 bp, Artificial Sequence
  chemically synthesized
gtaatgaactaaatatttcagt

SEQ ID NO: 874408 - DNA, 22 bp, Artificial Sequence
  chemically synthesized
tgttaagccactgaaatattta

SEQ ID NO: 874409 - DNA, 22 bp, Artificial Sequence
  chemically synthesized
cttgtaatgaactaaatatttc

SEQ ID NO: 874410 - DNA, 22 bp, Artificial Sequence
  chemically synthesized
ctgcttgtaatgaactaaatat

SEQ ID NO: 874411 - DNA, 22 bp, Artificial Sequence
  chemically synthesized
agccactgaaatatttagttca

SEQ ID NO: 874412 - DNA, 22 bp, Artificial Sequence
  chemically synthesized
aaatatttagttcattacaagc

SEQ ID NO: 874413 - DNA, 22 bp, Artificial Sequence
  chemically synthesized
gtaaggtattgctgcttgtaat

SEQ ID NO: 874414 - DNA, 22 bp, Artificial Sequence
  chemically synthesized
tactggtaaggtattgctgctt

SEQ ID NO: 874415 - DNA, 22 bp, Artificial Sequence
  chemically synthesized
agttcattacaagcagcaatac

SEQ ID NO: 874416 - DNA, 22 bp, Artificial Sequence
  chemically synthesized
gttcattacaagcagcaatacc

SEQ ID NO: 874417 - DNA, 22 bp, Artificial Sequence
  chemically synthesized
ctatactggtaaggtattgctg

SEQ ID NO: 874418 - DNA, 22 bp, Artificial Sequence
  chemically synthesized
attacaagcagcaataccttac

SEQ ID NO: 874419 - DNA, 22 bp, Artificial Sequence
  chemically synthesized
gtgctactatactggtaaggta

SEQ ID NO: 874420 - DNA, 22 bp, Artificial Sequence
  chemically synthesized
caagcagcaataccttaccagt

SEQ ID NO: 874421 - DNA, 22 bp, Artificial Sequence
  chemically synthesized
tgactagtgctactatactggt

SEQ ID NO: 874422 - DNA, 22 bp, Artificial Sequence
  chemically synthesized
gtgactagtgctactatactgg

SEQ ID NO: 874423 - DNA, 22 bp, Artificial Sequence
  chemically synthesized
tgtgactagtgctactatactg

SEQ ID NO: 874424 - DNA, 22 bp, Artificial Sequence
  chemically synthesized
ttgtgactagtgctactatact

SEQ ID NO: 874425 - DNA, 22 bp, Artificial Sequence
  chemically synthesized
accagtatagtagcactagtca

SEQ ID NO: 874426 - DNA, 22 bp, Artificial Sequence
  chemically synthesized
gtaaagcttttgtgactagtgc

SEQ ID NO: 874427 - DNA, 22 bp, Artificial Sequence
  chemically synthesized
ccagtatagtagcactagtcac

SEQ ID NO: 874428 - DNA, 22 bp, Artificial Sequence
  chemically synthesized
taggcactggtaaagcttttgt

SEQ ID NO: 874429 - DNA, 22 bp, Artificial Sequence
  chemically synthesized
ataggcactggtaaagcttttg

SEQ ID NO: 874430 - DNA, 22 bp, Artificial Sequence
  chemically synthesized
ttataggcactggtaaagcttt

SEQ ID NO: 874431 - DNA, 22 bp, Artificial Sequence
  chemically synthesized
tctcttataggcactggtaaag

SEQ ID NO: 874432 - DNA, 22 bp, Artificial Sequence
  chemically synthesized
gtcacaaaagctttaccagtgc

SEQ ID NO: 874433 - DNA, 22 bp, Artificial Sequence
  chemically synthesized
ttatctcttataggcactggta

SEQ ID NO: 874434 - DNA, 22 bp, Artificial Sequence
  chemically synthesized
taccagtgcctataagagataa

SEQ ID NO: 874435 - DNA, 22 bp, Artificial Sequence
  chemically synthesized
accagtgcctataagagataat

SEQ ID NO: 874436 - DNA, 22 bp, Artificial Sequence
  chemically synthesized
ccagtgcctataagagataata

SEQ ID NO: 874437 - DNA, 22 bp, Artificial Sequence
  chemically synthesized
cagtgatacaaaaacgcagcta

SEQ ID NO: 874438 - DNA, 22 bp, Artificial Sequence
  chemically synthesized
acagtgatacaaaaacgcagct

SEQ ID NO: 874439 - DNA, 22 bp, Artificial Sequence
  chemically synthesized
taagagataatagctgcgtttt

SEQ ID NO: 874440 - DNA, 22 bp, Artificial Sequence
  chemically synthesized
cgtttttgtatcactgtaaatt

SEQ ID NO: 874441 - DNA, 22 bp, Artificial Sequence
  chemically synthesized
ataaggtaagcataggaattta

SEQ ID NO: 874442 - DNA, 22 bp, Artificial Sequence
  chemically synthesized
ttgtatcactgtaaattcctat

SEQ ID NO: 874443 - DNA, 22 bp, Artificial Sequence
  chemically synthesized
tgtatcactgtaaattcctatg

SEQ ID NO: 874444 - DNA, 22 bp, Artificial Sequence
  chemically synthesized
gtatcactgtaaattcctatgc

SEQ ID NO: 874445 - DNA, 22 bp, Artificial Sequence
  chemically synthesized
ctcataaggtaagcataggaat

SEQ ID NO: 874446 - DNA, 22 bp, Artificial Sequence
  chemically synthesized
tatcactgtaaattcctatgct

SEQ ID NO: 874447 - DNA, 22 bp, Artificial Sequence
  chemically synthesized
tattcctcataaggtaagcata

SEQ ID NO: 874448 - DNA, 22 bp, Artificial Sequence
  chemically synthesized
gtattcctcataaggtaagcat

SEQ ID NO: 874449 - DNA, 22 bp, Artificial Sequence
  chemically synthesized
taaattcctatgcttaccttat

SEQ ID NO: 874450 - DNA, 22 bp, Artificial Sequence
  chemically synthesized
tttgtattcctcataaggtaag

SEQ ID NO: 874451 - DNA, 22 bp, Artificial Sequence
  chemically synthesized
ctatgcttaccttatgaggaat

SEQ ID NO: 874452 - DNA, 22 bp, Artificial Sequence
  chemically synthesized
tgcttaccttatgaggaataca

SEQ ID NO: 874453 - DNA, 22 bp, Artificial Sequence
  chemically synthesized
accttatgaggaatacaaataa

SEQ ID NO: 874454 - DNA, 22 bp, Artificial Sequence
  chemically synthesized
ccttatgaggaatacaaataac

SEQ ID NO: 874455 - DNA, 22 bp, Artificial Sequence
  chemically synthesized
atgaggaatacaaataacttga

SEQ ID NO: 874456 - DNA, 22 bp, Artificial Sequence
  chemically synthesized
tgaggaatacaaataacttgat

SEQ ID NO: 874457 - DNA, 22 bp, Artificial Sequence
  chemically synthesized
accaaacccgacatcaatcaag

SEQ ID NO: 874458 - DNA, 22 bp, Artificial Sequence
  chemically synthesized
aaccaaacccgacatcaatcaa

SEQ ID NO: 874459 - DNA, 22 bp, Artificial Sequence
  chemically synthesized
taaccaaacccgacatcaatca

SEQ ID NO: 874460 - DNA, 22 bp, Artificial Sequence
  chemically synthesized
ttttaaccaaacccgacatcaa

SEQ ID NO: 874461 - DNA, 22 bp, Artificial Sequence
  chemically synthesized
attttaaccaaacccgacatca

SEQ ID NO: 874462 - DNA, 22 bp, Artificial Sequence
  chemically synthesized
atgtatttattttaaccaaacc

SEQ ID NO: 874463 - DNA, 22 bp, Artificial Sequence
  chemically synthesized
gattgatgtcgggtttggttaa

SEQ ID NO: 874464 - DNA, 22 bp, Artificial Sequence
  chemically synthesized
attgatgtcgggtttggttaaa

SEQ ID NO: 874465 - DNA, 22 bp, Artificial Sequence
  chemically synthesized
ctaatgtatttattttaaccaa

SEQ ID NO: 874466 - DNA, 22 bp, Artificial Sequence
  chemically synthesized
tgctaatgtatttattttaacc

SEQ ID NO: 874467 - DNA, 22 bp, Artificial Sequence
  chemically synthesized
atgtcgggtttggttaaaataa

SEQ ID NO: 874468 - DNA, 22 bp, Artificial Sequence
  chemically synthesized
ctgctaatgtatttattttaac

SEQ ID NO: 874469 - DNA, 22 bp, Artificial Sequence
  chemically synthesized
ggttaaaataaatacattagca

SEQ ID NO: 874470 - DNA, 22 bp, Artificial Sequence
  chemically synthesized
gttaaaataaatacattagcag

SEQ ID NO: 874471 - DNA, 22 bp, Artificial Sequence
  chemically synthesized
gaaatgcaatttctgctaatgt

SEQ ID NO: 874472 - DNA, 22 bp, Artificial Sequence
  chemically synthesized
aaataaatacattagcagaaat

SEQ ID NO: 874473 - DNA, 22 bp, Artificial Sequence
  chemically synthesized
agactagaaatgcaatttctgc

SEQ ID NO: 874474 - DNA, 22 bp, Artificial Sequence
  chemically synthesized
cagactagaaatgcaatttctg

SEQ ID NO: 874475 - DNA, 22 bp, Artificial Sequence
  chemically synthesized
ttcagactagaaatgcaatttc

SEQ ID NO: 874476 - DNA, 22 bp, Artificial Sequence
  chemically synthesized
attcttcagactagaaatgcaa

SEQ ID NO: 874477 - DNA, 22 bp, Artificial Sequence
  chemically synthesized
tgattcttcagactagaaatgc

SEQ ID NO: 874478 - DNA, 22 bp, Artificial Sequence
  chemically synthesized
gcagaaattgcatttctagtct

SEQ ID NO: 874479 - DNA, 22 bp, Artificial Sequence
  chemically synthesized
caactctgattcttcagactag

SEQ ID NO: 874480 - DNA, 22 bp, Artificial Sequence
  chemically synthesized
ccaactctgattcttcagacta

SEQ ID NO: 874481 - DNA, 22 bp, Artificial Sequence
  chemically synthesized
tccaactctgattcttcagact

SEQ ID NO: 874482 - DNA, 22 bp, Artificial Sequence
  chemically synthesized
ttccaactctgattcttcagac

SEQ ID NO: 874483 - DNA, 22 bp, Artificial Sequence
  chemically synthesized
ttttccaactctgattcttcag

SEQ ID NO: 874484 - DNA, 22 bp, Artificial Sequence
  chemically synthesized
catttctagtctgaagaatcag

SEQ ID NO: 874485 - DNA, 22 bp, Artificial Sequence
  chemically synthesized
gctcttttccaactctgattct

SEQ ID NO: 874486 - DNA, 22 bp, Artificial Sequence
  chemically synthesized
tggctcttttccaactctgatt

SEQ ID NO: 874487 - DNA, 22 bp, Artificial Sequence
  chemically synthesized
ctagtctgaagaatcagagttg

SEQ ID NO: 874488 - DNA, 22 bp, Artificial Sequence
  chemically synthesized
ctggctcttttccaactctgat

SEQ ID NO: 874489 - DNA, 22 bp, Artificial Sequence
  chemically synthesized
tagtctgaagaatcagagttgg

SEQ ID NO: 874490 - DNA, 22 bp, Artificial Sequence
  chemically synthesized
gtctgaagaatcagagttggaa

SEQ ID NO: 874491 - DNA, 22 bp, Artificial Sequence
  chemically synthesized
tagtttctggctcttttccaac

SEQ ID NO: 874492 - DNA, 22 bp, Artificial Sequence
  chemically synthesized
gtagtttctggctcttttccaa

SEQ ID NO: 874493 - DNA, 22 bp, Artificial Sequence
  chemically synthesized
aagaatcagagttggaaaagag

SEQ ID NO: 874494 - DNA, 22 bp, Artificial Sequence
  chemically synthesized
aagagtttgtagtttctggctc

SEQ ID NO: 874495 - DNA, 22 bp, Artificial Sequence
  chemically synthesized
aaagagtttgtagtttctggct

SEQ ID NO: 874496 - DNA, 22 bp, Artificial Sequence
  chemically synthesized
tttaaagagtttgtagtttctg

SEQ ID NO: 874497 - DNA, 22 bp, Artificial Sequence
  chemically synthesized
gaaaagagccagaaactacaaa

SEQ ID NO: 874498 - DNA, 22 bp, Artificial Sequence
  chemically synthesized
ctatttaaagagtttgtagttt

SEQ ID NO: 874499 - DNA, 22 bp, Artificial Sequence
  chemically synthesized
cattcctatttaaagagtttgt

SEQ ID NO: 874500 - DNA, 22 bp, Artificial Sequence
  chemically synthesized
attccattcctatttaaagagt

SEQ ID NO: 874501 - DNA, 22 bp, Artificial Sequence
  chemically synthesized
ggttcattccattcctatttaa

SEQ ID NO: 874502 - DNA, 22 bp, Artificial Sequence
  chemically synthesized
caaactctttaaataggaatgg

SEQ ID NO: 874503 - DNA, 22 bp, Artificial Sequence
  chemically synthesized
ggttgggttcattccattccta

SEQ ID NO: 874504 - DNA, 22 bp, Artificial Sequence
  chemically synthesized
tttaaataggaatggaatgaac

SEQ ID NO: 874505 - DNA, 22 bp, Artificial Sequence
  chemically synthesized
cagttaggttgggttcattcca

SEQ ID NO: 874506 - DNA, 22 bp, Artificial Sequence
  chemically synthesized
taaataggaatggaatgaaccc

SEQ ID NO: 874507 - DNA, 22 bp, Artificial Sequence
  chemically synthesized
aaataggaatggaatgaaccca

SEQ ID NO: 874508 - DNA, 22 bp, Artificial Sequence
  chemically synthesized
aataggaatggaatgaacccaa

SEQ ID NO: 874509 - DNA, 22 bp, Artificial Sequence
  chemically synthesized
caacgtgtatatgaaacattcc

SEQ ID NO: 874510 - DNA, 22 bp, Artificial Sequence
  chemically synthesized
aactacaacgtgtatatgaaac

SEQ ID NO: 874511 - DNA, 22 bp, Artificial Sequence
  chemically synthesized
actggaatgtttcatatacacg

SEQ ID NO: 874512 - DNA, 22 bp, Artificial Sequence
  chemically synthesized
gcattaaactacaacgtgtata

SEQ ID NO: 874513 - DNA, 22 bp, Artificial Sequence
  chemically synthesized
gaatgtttcatatacacgttgt

SEQ ID NO: 874514 - DNA, 22 bp, Artificial Sequence
  chemically synthesized
atgattagcattaaactacaac

SEQ ID NO: 874515 - DNA, 22 bp, Artificial Sequence
  chemically synthesized
catatacacgttgtagtttaat

SEQ ID NO: 874516 - DNA, 22 bp, Artificial Sequence
  chemically synthesized
atatacacgttgtagtttaatg

SEQ ID NO: 874517 - DNA, 22 bp, Artificial Sequence
  chemically synthesized
aattaatgattagcattaaact

SEQ ID NO: 874518 - DNA, 22 bp, Artificial Sequence
  chemically synthesized
gcattaaattaatgattagcat

SEQ ID NO: 874519 - DNA, 22 bp, Artificial Sequence
  chemically synthesized
tagtttaatgctaatcattaat

SEQ ID NO: 874520 - DNA, 22 bp, Artificial Sequence
  chemically synthesized
aaatgattcgcattaaattaat

SEQ ID NO: 874521 - DNA, 22 bp, Artificial Sequence
  chemically synthesized
aatgctaatcattaatttaatg

SEQ ID NO: 874522 - DNA, 22 bp, Artificial Sequence
  chemically synthesized
atgctaatcattaatttaatgc

SEQ ID NO: 874523 - DNA, 22 bp, Artificial Sequence
  chemically synthesized
attgaaatgattcgcattaaat

SEQ ID NO: 874524 - DNA, 22 bp, Artificial Sequence
  chemically synthesized
cattgaaatgattcgcattaaa

SEQ ID NO: 874525 - DNA, 22 bp, Artificial Sequence
  chemically synthesized
atcattaatttaatgcgaatca

SEQ ID NO: 874526 - DNA, 22 bp, Artificial Sequence
  chemically synthesized
atttaatgcgaatcatttcaat

SEQ ID NO: 874527 - DNA, 22 bp, Artificial Sequence
  chemically synthesized
aatgcgaatcatttcaatgaaa

SEQ ID NO: 874528 - DNA, 22 bp, Artificial Sequence
  chemically synthesized
atgcgaatcatttcaatgaaac

SEQ ID NO: 874529 - DNA, 22 bp, Artificial Sequence
  chemically synthesized
gaataaataaagtaatggtttc

SEQ ID NO: 874530 - DNA, 22 bp, Artificial Sequence
  chemically synthesized
tggaataaataaagtaatggtt

SEQ ID NO: 874531 - DNA, 22 bp, Artificial Sequence
  chemically synthesized
ctggaataaataaagtaatggt

SEQ ID NO: 874532 - DNA, 22 bp, Artificial Sequence
  chemically synthesized
tctggaataaataaagtaatgg

SEQ ID NO: 874533 - DNA, 22 bp, Artificial Sequence
  chemically synthesized
ttctggaataaataaagtaatg

SEQ ID NO: 874534 - DNA, 22 bp, Artificial Sequence
  chemically synthesized
caatgaaaccattactttattt

SEQ ID NO: 874535 - DNA, 22 bp, Artificial Sequence
  chemically synthesized
tttttctggaataaataaagta

SEQ ID NO: 874536 - DNA, 22 bp, Artificial Sequence
  chemically synthesized
aatgaaaccattactttattta

SEQ ID NO: 874537 - DNA, 22 bp, Artificial Sequence
  chemically synthesized
aacaattatttttctggaataa

SEQ ID NO: 874538 - DNA, 22 bp, Artificial Sequence
  chemically synthesized
ctttatttattccagaaaaata

SEQ ID NO: 874539 - DNA, 22 bp, Artificial Sequence
  chemically synthesized
tatttattccagaaaaataatt

SEQ ID NO: 874540 - DNA, 22 bp, Artificial Sequence
  chemically synthesized
atttattccagaaaaataattg

SEQ ID NO: 874541 - DNA, 22 bp, Artificial Sequence
  chemically synthesized
tttattccagaaaaataattgt

SEQ ID NO: 874542 - DNA, 22 bp, Artificial Sequence
  chemically synthesized
attccagaaaaataattgttca

SEQ ID NO: 874543 - DNA, 22 bp, Artificial Sequence
  chemically synthesized
ttccagaaaaataattgttcag

SEQ ID NO: 874544 - DNA, 22 bp, Artificial Sequence
  chemically synthesized
gcacagagtagcacctgaacaa

SEQ ID NO: 874545 - DNA, 22 bp, Artificial Sequence
  chemically synthesized
cagaaaaataattgttcaggtg

SEQ ID NO: 874546 - DNA, 22 bp, Artificial Sequence
  chemically synthesized
gcacaaagtctggcacagagta

SEQ ID NO: 874547 - DNA, 22 bp, Artificial Sequence
  chemically synthesized
ttcaggtgctactctgtgccag

SEQ ID NO: 874548 - DNA, 22 bp, Artificial Sequence
  chemically synthesized
aggtgctactctgtgccagact

SEQ ID NO: 874549 - DNA, 22 bp, Artificial Sequence
  chemically synthesized
gtaactggcacaaagtctggca

SEQ ID NO: 874550 - DNA, 22 bp, Artificial Sequence
  chemically synthesized
agtaactggcacaaagtctggc

SEQ ID NO: 874551 - DNA, 22 bp, Artificial Sequence
  chemically synthesized
ctctgtgccagactttgtgcca

SEQ ID NO: 874552 - DNA, 22 bp, Artificial Sequence
  chemically synthesized
taagcttagtaactggcacaaa

SEQ ID NO: 874553 - DNA, 22 bp, Artificial Sequence
  chemically synthesized
gtaagcttagtaactggcacaa

SEQ ID NO: 874554 - DNA, 22 bp, Artificial Sequence
  chemically synthesized
tgtgccagactttgtgccagtt

SEQ ID NO: 874555 - DNA, 22 bp, Artificial Sequence
  chemically synthesized
tgtaagcttagtaactggcaca

SEQ ID NO: 874556 - DNA, 22 bp, Artificial Sequence
  chemically synthesized
tgccagactttgtgccagttac

SEQ ID NO: 874557 - DNA, 22 bp, Artificial Sequence
  chemically synthesized
agttttgtaagcttagtaactg

SEQ ID NO: 874558 - DNA, 22 bp, Artificial Sequence
  chemically synthesized
cagttttgtaagcttagtaact

SEQ ID NO: 874559 - DNA, 22 bp, Artificial Sequence
  chemically synthesized
tgtgccagttactaagcttaca

SEQ ID NO: 874560 - DNA, 22 bp, Artificial Sequence
  chemically synthesized
gtgccagttactaagcttacaa

SEQ ID NO: 874561 - DNA, 22 bp, Artificial Sequence
  chemically synthesized
cgaacttcagttttgtaagctt

SEQ ID NO: 874562 - DNA, 22 bp, Artificial Sequence
  chemically synthesized
tgccagttactaagcttacaaa

SEQ ID NO: 874563 - DNA, 22 bp, Artificial Sequence
  chemically synthesized
gaggttacgaacttcagttttg

SEQ ID NO: 874564 - DNA, 22 bp, Artificial Sequence
  chemically synthesized
agaggttacgaacttcagtttt

SEQ ID NO: 874565 - DNA, 22 bp, Artificial Sequence
  chemically synthesized
ctaagcttacaaaactgaagtt

SEQ ID NO: 874566 - DNA, 22 bp, Artificial Sequence
  chemically synthesized
agcttacaaaactgaagttcgt

SEQ ID NO: 874567 - DNA, 22 bp, Artificial Sequence
  chemically synthesized
tgaatgcttagaggttacgaac

SEQ ID NO: 874568 - DNA, 22 bp, Artificial Sequence
  chemically synthesized
acaaaactgaagttcgtaacct

SEQ ID NO: 874569 - DNA, 22 bp, Artificial Sequence
  chemically synthesized
caaaactgaagttcgtaacctc

SEQ ID NO: 874570 - DNA, 22 bp, Artificial Sequence
  chemically synthesized
catgtctgtgaatgcttagagg

SEQ ID NO: 874571 - DNA, 22 bp, Artificial Sequence
  chemically synthesized
acatgtctgtgaatgcttagag

SEQ ID NO: 874572 - DNA, 22 bp, Artificial Sequence
  chemically synthesized
aagttcgtaacctctaagcatt

SEQ ID NO: 874573 - DNA, 22 bp, Artificial Sequence
  chemically synthesized
cttacatgtctgtgaatgctta

SEQ ID NO: 874574 - DNA, 22 bp, Artificial Sequence
  chemically synthesized
acttacatgtctgtgaatgctt

SEQ ID NO: 874575 - DNA, 22 bp, Artificial Sequence
  chemically synthesized
gtaacctctaagcattcacaga

SEQ ID NO: 874576 - DNA, 22 bp, Artificial Sequence
  chemically synthesized
atttacttacatgtctgtgaat

SEQ ID NO: 874577 - DNA, 22 bp, Artificial Sequence
  chemically synthesized
taatttacttacatgtctgtga

SEQ ID NO: 874578 - DNA, 22 bp, Artificial Sequence
  chemically synthesized
ttctaatttacttacatgtctg

SEQ ID NO: 874579 - DNA, 22 bp, Artificial Sequence
  chemically synthesized
taagcattcacagacatgtaag

SEQ ID NO: 874580 - DNA, 22 bp, Artificial Sequence
  chemically synthesized
tgttctaatttacttacatgtc

SEQ ID NO: 874581 - DNA, 22 bp, Artificial Sequence
  chemically synthesized
agcattcacagacatgtaagta

SEQ ID NO: 874582 - DNA, 22 bp, Artificial Sequence
  chemically synthesized
aaatctctgttctaatttactt

SEQ ID NO: 874583 - DNA, 22 bp, Artificial Sequence
  chemically synthesized
acagacatgtaagtaaattaga

SEQ ID NO: 874584 - DNA, 22 bp, Artificial Sequence
  chemically synthesized
ctaaaatctctgttctaattta

SEQ ID NO: 874585 - DNA, 22 bp, Artificial Sequence
  chemically synthesized
cctaaaatctctgttctaattt

SEQ ID NO: 874586 - DNA, 22 bp, Artificial Sequence
  chemically synthesized
tcctaaaatctctgttctaatt

SEQ ID NO: 874587 - DNA, 22 bp, Artificial Sequence
  chemically synthesized
ttcctaaaatctctgttctaat

SEQ ID NO: 874588 - DNA, 22 bp, Artificial Sequence
  chemically synthesized
tttcctaaaatctctgttctaa

SEQ ID NO: 874589 - DNA, 22 bp, Artificial Sequence
  chemically synthesized
ttttttcctaaaatctctgttc

SEQ ID NO: 874590 - DNA, 22 bp, Artificial Sequence
  chemically synthesized
aaatcattattttttcctaaaa

SEQ ID NO: 874591 - DNA, 22 bp, Artificial Sequence
  chemically synthesized
gaacagagattttaggaaaaaa

SEQ ID NO: 874592 - DNA, 22 bp, Artificial Sequence
  chemically synthesized
ttgaaatcattattttttccta

SEQ ID NO: 874593 - DNA, 22 bp, Artificial Sequence
  chemically synthesized
gttgaaatcattattttttcct

SEQ ID NO: 874594 - DNA, 22 bp, Artificial Sequence
  chemically synthesized
taggaaaaaataatgatttcaa

SEQ ID NO: 874595 - DNA, 22 bp, Artificial Sequence
  chemically synthesized
aggaaaaaataatgatttcaac

SEQ ID NO: 874596 - DNA, 22 bp, Artificial Sequence
  chemically synthesized
ggaaaaaataatgatttcaaca

SEQ ID NO: 874597 - DNA, 22 bp, Artificial Sequence
  chemically synthesized
ccccgaggtgtcttgttgaaat

SEQ ID NO: 874598 - DNA, 22 bp, Artificial Sequence
  chemically synthesized
ttcccccgaggtgtcttgttga

SEQ ID NO: 874599 - DNA, 22 bp, Artificial Sequence
  chemically synthesized
agctgttcccccgaggtgtctt

SEQ ID NO: 874600 - DNA, 22 bp, Artificial Sequence
  chemically synthesized
agttaagctgttcccccgaggt

SEQ ID NO: 874601 - DNA, 22 bp, Artificial Sequence
  chemically synthesized
caacaagacacctcgggggaac

SEQ ID NO: 874602 - DNA, 22 bp, Artificial Sequence
  chemically synthesized
aacaagacacctcgggggaaca

SEQ ID NO: 874603 - DNA, 22 bp, Artificial Sequence
  chemically synthesized
caggctgagttaagctgttccc

SEQ ID NO: 874604 - DNA, 22 bp, Artificial Sequence
  chemically synthesized
tccaggctgagttaagctgttc

SEQ ID NO: 874605 - DNA, 22 bp, Artificial Sequence
  chemically synthesized
acctctccaggctgagttaagc

SEQ ID NO: 874606 - DNA, 22 bp, Artificial Sequence
  chemically synthesized
gggggaacagcttaactcagcc

SEQ ID NO: 874607 - DNA, 22 bp, Artificial Sequence
  chemically synthesized
ttgacctctccaggctgagtta

SEQ ID NO: 874608 - DNA, 22 bp, Artificial Sequence
  chemically synthesized
tgggtaacctattgacctctcc

SEQ ID NO: 874609 - DNA, 22 bp, Artificial Sequence
  chemically synthesized
gtgggtaacctattgacctctc

SEQ ID NO: 874610 - DNA, 22 bp, Artificial Sequence
  chemically synthesized
aactcagcctggagaggtcaat

SEQ ID NO: 874611 - DNA, 22 bp, Artificial Sequence
  chemically synthesized
tgtgggtaacctattgacctct

SEQ ID NO: 874612 - DNA, 22 bp, Artificial Sequence
  chemically synthesized
actcagcctggagaggtcaata

SEQ ID NO: 874613 - DNA, 22 bp, Artificial Sequence
  chemically synthesized
ttgtgggtaacctattgacctc

SEQ ID NO: 874614 - DNA, 22 bp, Artificial Sequence
  chemically synthesized
agcctggagaggtcaataggtt

SEQ ID NO: 874615 - DNA, 22 bp, Artificial Sequence
  chemically synthesized
gcttttgtgggtaacctattga

SEQ ID NO: 874616 - DNA, 22 bp, Artificial Sequence
  chemically synthesized
gagaggtcaataggttacccac

SEQ ID NO: 874617 - DNA, 22 bp, Artificial Sequence
  chemically synthesized
aaatgttagcttttgtgggtaa

SEQ ID NO: 874618 - DNA, 22 bp, Artificial Sequence
  chemically synthesized
aaaataaattcaaatgttagct

SEQ ID NO: 874619 - DNA, 22 bp, Artificial Sequence
  chemically synthesized
caaaataaattcaaatgttagc

SEQ ID NO: 874620 - DNA, 22 bp, Artificial Sequence
  chemically synthesized
tcaaaataaattcaaatgttag

SEQ ID NO: 874621 - DNA, 22 bp, Artificial Sequence
  chemically synthesized
cccacaaaagctaacatttgaa

SEQ ID NO: 874622 - DNA, 22 bp, Artificial Sequence
  chemically synthesized
gtcgtctttcaaaataaattca

SEQ ID NO: 874623 - DNA, 22 bp, Artificial Sequence
  chemically synthesized
ctagtcgtctttcaaaataaat

SEQ ID NO: 874624 - DNA, 22 bp, Artificial Sequence
  chemically synthesized
cctagtcgtctttcaaaataaa

SEQ ID NO: 874625 - DNA, 22 bp, Artificial Sequence
  chemically synthesized
acatttgaatttattttgaaag

SEQ ID NO: 874626 - DNA, 22 bp, Artificial Sequence
  chemically synthesized
aaaacttcctagtcgtctttca

SEQ ID NO: 874627 - DNA, 22 bp, Artificial Sequence
  chemically synthesized
gaatttattttgaaagacgact

SEQ ID NO: 874628 - DNA, 22 bp, Artificial Sequence
  chemically synthesized
tgaaaacttcctagtcgtcttt

SEQ ID NO: 874629 - DNA, 22 bp, Artificial Sequence
  chemically synthesized
aatttattttgaaagacgacta

SEQ ID NO: 874630 - DNA, 22 bp, Artificial Sequence
  chemically synthesized
ctgaaaacttcctagtcgtctt

SEQ ID NO: 874631 - DNA, 22 bp, Artificial Sequence
  chemically synthesized
attttgaaagacgactaggaag

SEQ ID NO: 874632 - DNA, 22 bp, Artificial Sequence
  chemically synthesized
ttttgaaagacgactaggaagt

SEQ ID NO: 874633 - DNA, 22 bp, Artificial Sequence
  chemically synthesized
tgaaagacgactaggaagtttt

SEQ ID NO: 874634 - DNA, 22 bp, Artificial Sequence
  chemically synthesized
gaaagacgactaggaagttttc

SEQ ID NO: 874635 - DNA, 22 bp, Artificial Sequence
  chemically synthesized
aaagacgactaggaagttttca

SEQ ID NO: 874636 - DNA, 22 bp, Artificial Sequence
  chemically synthesized
aatggccccttctgaaaacttc

SEQ ID NO: 874637 - DNA, 22 bp, Artificial Sequence
  chemically synthesized
gaatggccccttctgaaaactt

SEQ ID NO: 874638 - DNA, 22 bp, Artificial Sequence
  chemically synthesized
gcgcttgaatggccccttctga

SEQ ID NO: 874639 - DNA, 22 bp, Artificial Sequence
  chemically synthesized
ggaagttttcagaaggggccat

SEQ ID NO: 874640 - DNA, 22 bp, Artificial Sequence
  chemically synthesized
cacctggcgcttgaatggcccc

SEQ ID NO: 874641 - DNA, 22 bp, Artificial Sequence
  chemically synthesized
ccacctggcgcttgaatggccc

SEQ ID NO: 874642 - DNA, 22 bp, Artificial Sequence
  chemically synthesized
tccacctggcgcttgaatggcc

SEQ ID NO: 874643 - DNA, 22 bp, Artificial Sequence
  chemically synthesized
ttccacctggcgcttgaatggc

SEQ ID NO: 874644 - DNA, 22 bp, Artificial Sequence
  chemically synthesized
tttccacctggcgcttgaatgg

SEQ ID NO: 874645 - DNA, 22 bp, Artificial Sequence
  chemically synthesized
tcagaaggggccattcaagcgc

SEQ ID NO: 874646 - DNA, 22 bp, Artificial Sequence
  chemically synthesized
cagaaggggccattcaagcgcc

SEQ ID NO: 874647 - DNA, 22 bp, Artificial Sequence
  chemically synthesized
agaaggggccattcaagcgcca

SEQ ID NO: 874648 - DNA, 22 bp, Artificial Sequence
  chemically synthesized
aaatgccctttttccacctggc

SEQ ID NO: 874649 - DNA, 22 bp, Artificial Sequence
  chemically synthesized
tctgaaatgccctttttccacc

SEQ ID NO: 874650 - DNA, 22 bp, Artificial Sequence
  chemically synthesized
tgtctgaaatgccctttttcca

SEQ ID NO: 874651 - DNA, 22 bp, Artificial Sequence
  chemically synthesized
ctgtctgaaatgccctttttcc

SEQ ID NO: 874652 - DNA, 22 bp, Artificial Sequence
  chemically synthesized
aagcgccaggtggaaaaagggc

SEQ ID NO: 874653 - DNA, 22 bp, Artificial Sequence
  chemically synthesized
cttctgtctgaaatgccctttt

SEQ ID NO: 874654 - DNA, 22 bp, Artificial Sequence
  chemically synthesized
ccttctgtctgaaatgcccttt

SEQ ID NO: 874655 - DNA, 22 bp, Artificial Sequence
  chemically synthesized
tccttctgtctgaaatgccctt

SEQ ID NO: 874656 - DNA, 22 bp, Artificial Sequence
  chemically synthesized
cacgtagttttccttctgtctg

SEQ ID NO: 874657 - DNA, 22 bp, Artificial Sequence
  chemically synthesized
gcacgtagttttccttctgtct

SEQ ID NO: 874658 - DNA, 22 bp, Artificial Sequence
  chemically synthesized
tgcacgtagttttccttctgtc

SEQ ID NO: 874659 - DNA, 22 bp, Artificial Sequence
  chemically synthesized
ccattttgcacgtagttttcct

SEQ ID NO: 874660 - DNA, 22 bp, Artificial Sequence
  chemically synthesized
gccattttgcacgtagttttcc

SEQ ID NO: 874661 - DNA, 22 bp, Artificial Sequence
  chemically synthesized
ttgccattttgcacgtagtttt

SEQ ID NO: 874662 - DNA, 22 bp, Artificial Sequence
  chemically synthesized
cagacagaaggaaaactacgtg

SEQ ID NO: 874663 - DNA, 22 bp, Artificial Sequence
  chemically synthesized
agacagaaggaaaactacgtgc

SEQ ID NO: 874664 - DNA, 22 bp, Artificial Sequence
  chemically synthesized
gatacctcttgccattttgcac

SEQ ID NO: 874665 - DNA, 22 bp, Artificial Sequence
  chemically synthesized
aggctcgatacctcttgccatt

SEQ ID NO: 874666 - DNA, 22 bp, Artificial Sequence
  chemically synthesized
aaggctcgatacctcttgccat

SEQ ID NO: 874667 - DNA, 22 bp, Artificial Sequence
  chemically synthesized
taaggctcgatacctcttgcca

SEQ ID NO: 874668 - DNA, 22 bp, Artificial Sequence
  chemically synthesized
ttaaggctcgatacctcttgcc

SEQ ID NO: 874669 - DNA, 22 bp, Artificial Sequence
  chemically synthesized
tttaaggctcgatacctcttgc

SEQ ID NO: 874670 - DNA, 22 bp, Artificial Sequence
  chemically synthesized
cgtgcaaaatggcaagaggtat

SEQ ID NO: 874671 - DNA, 22 bp, Artificial Sequence
  chemically synthesized
ttttaaggctcgatacctcttg

SEQ ID NO: 874672 - DNA, 22 bp, Artificial Sequence
  chemically synthesized
ttttttaaggctcgatacctct

SEQ ID NO: 874673 - DNA, 22 bp, Artificial Sequence
  chemically synthesized
cttttttaaggctcgatacctc

SEQ ID NO: 874674 - DNA, 22 bp, Artificial Sequence
  chemically synthesized
catttcttttttaaggctcgat

SEQ ID NO: 874675 - DNA, 22 bp, Artificial Sequence
  chemically synthesized
gatagccaggacacactgcatt

SEQ ID NO: 874676 - DNA, 22 bp, Artificial Sequence
  chemically synthesized
aaaaaagaaatgcagtgtgtcc

SEQ ID NO: 874677 - DNA, 22 bp, Artificial Sequence
  chemically synthesized
aaaaagaaatgcagtgtgtcct

SEQ ID NO: 874678 - DNA, 22 bp, Artificial Sequence
  chemically synthesized
tagtctagatagccaggacaca

SEQ ID NO: 874679 - DNA, 22 bp, Artificial Sequence
  chemically synthesized
taaacactgtagtctagatagc

SEQ ID NO: 874680 - DNA, 22 bp, Artificial Sequence
  chemically synthesized
gtaaacactgtagtctagatag

SEQ ID NO: 874681 - DNA, 22 bp, Artificial Sequence
  chemically synthesized
cttgtaaacactgtagtctaga

SEQ ID NO: 874682 - DNA, 22 bp, Artificial Sequence
  chemically synthesized
gctatctagactacagtgttta

SEQ ID NO: 874683 - DNA, 22 bp, Artificial Sequence
  chemically synthesized
tatcattacttgtaaacactgt

SEQ ID NO: 874684 - DNA, 22 bp, Artificial Sequence
  chemically synthesized
tgtatcattacttgtaaacact

SEQ ID NO: 874685 - DNA, 22 bp, Artificial Sequence
  chemically synthesized
tctagactacagtgtttacaag

SEQ ID NO: 874686 - DNA, 22 bp, Artificial Sequence
  chemically synthesized
gactacagtgtttacaagtaat

SEQ ID NO: 874687 - DNA, 22 bp, Artificial Sequence
  chemically synthesized
cagctctgtatcattacttgta

SEQ ID NO: 874688 - DNA, 22 bp, Artificial Sequence
  chemically synthesized
gcagctctgtatcattacttgt

SEQ ID NO: 874689 - DNA, 22 bp, Artificial Sequence
  chemically synthesized
ttgcagctctgtatcattactt

SEQ ID NO: 874690 - DNA, 22 bp, Artificial Sequence
  chemically synthesized
cagtgtttacaagtaatgatac

SEQ ID NO: 874691 - DNA, 22 bp, Artificial Sequence
  chemically synthesized
cattcttgcagctctgtatcat

SEQ ID NO: 874692 - DNA, 22 bp, Artificial Sequence
  chemically synthesized
acaagtaatgatacagagctgc

SEQ ID NO: 874693 - DNA, 22 bp, Artificial Sequence
  chemically synthesized
caagtaatgatacagagctgca

SEQ ID NO: 874694 - DNA, 22 bp, Artificial Sequence
  chemically synthesized
ataaattgcattcttgcagctc

SEQ ID NO: 874695 - DNA, 22 bp, Artificial Sequence
  chemically synthesized
aataaattgcattcttgcagct

SEQ ID NO: 874696 - DNA, 22 bp, Artificial Sequence
  chemically synthesized
caaggtcttaataaattgcatt

SEQ ID NO: 874697 - DNA, 22 bp, Artificial Sequence
  chemically synthesized
caagaatgcaatttattaagac

SEQ ID NO: 874698 - DNA, 22 bp, Artificial Sequence
  chemically synthesized
attaagaccttgtaatgtggga

SEQ ID NO: 874699 - DNA, 22 bp, Artificial Sequence
  chemically synthesized
ttaagaccttgtaatgtgggac

SEQ ID NO: 874700 - DNA, 22 bp, Artificial Sequence
  chemically synthesized
agaccttgtaatgtgggactat

SEQ ID NO: 874701 - DNA, 22 bp, Artificial Sequence
  chemically synthesized
gaagagaatgtaatagtcccac

SEQ ID NO: 874702 - DNA, 22 bp, Artificial Sequence
  chemically synthesized
agaagagaatgtaatagtccca

SEQ ID NO: 874703 - DNA, 22 bp, Artificial Sequence
  chemically synthesized
tagaagagaatgtaatagtccc

SEQ ID NO: 874704 - DNA, 22 bp, Artificial Sequence
  chemically synthesized
gtaatgtgggactattacattc

SEQ ID NO: 874705 - DNA, 22 bp, Artificial Sequence
  chemically synthesized
taatgtgggactattacattct

SEQ ID NO: 874706 - DNA, 22 bp, Artificial Sequence
  chemically synthesized
tggttttagaagagaatgtaat

SEQ ID NO: 874707 - DNA, 22 bp, Artificial Sequence
  chemically synthesized
tgtggttttagaagagaatgta

SEQ ID NO: 874708 - DNA, 22 bp, Artificial Sequence
  chemically synthesized
ctctgtggttttagaagagaat

SEQ ID NO: 874709 - DNA, 22 bp, Artificial Sequence
  chemically synthesized
catctactctgtggttttagaa

SEQ ID NO: 874710 - DNA, 22 bp, Artificial Sequence
  chemically synthesized
ccatctactctgtggttttaga

SEQ ID NO: 874711 - DNA, 22 bp, Artificial Sequence
  chemically synthesized
ttacattctcttctaaaaccac

SEQ ID NO: 874712 - DNA, 22 bp, Artificial Sequence
  chemically synthesized
cattctcttctaaaaccacaga

SEQ ID NO: 874713 - DNA, 22 bp, Artificial Sequence
  chemically synthesized
aacacttccatctactctgtgg

SEQ ID NO: 874714 - DNA, 22 bp, Artificial Sequence
  chemically synthesized
tcttctaaaaccacagagtaga

SEQ ID NO: 874715 - DNA, 22 bp, Artificial Sequence
  chemically synthesized
taaacacttccatctactctgt

SEQ ID NO: 874716 - DNA, 22 bp, Artificial Sequence
  chemically synthesized
ttctaaaaccacagagtagatg

SEQ ID NO: 874717 - DNA, 22 bp, Artificial Sequence
  chemically synthesized
tctaaacacttccatctactct

SEQ ID NO: 874718 - DNA, 22 bp, Artificial Sequence
  chemically synthesized
ctctaaacacttccatctactc

SEQ ID NO: 874719 - DNA, 22 bp, Artificial Sequence
  chemically synthesized
ctaaaaccacagagtagatgga

SEQ ID NO: 874720 - DNA, 22 bp, Artificial Sequence
  chemically synthesized
taaaaccacagagtagatggaa

SEQ ID NO: 874721 - DNA, 22 bp, Artificial Sequence
  chemically synthesized
ttctctaaacacttccatctac

SEQ ID NO: 874722 - DNA, 22 bp, Artificial Sequence
  chemically synthesized
cttctctaaacacttccatcta

SEQ ID NO: 874723 - DNA, 22 bp, Artificial Sequence
  chemically synthesized
aaaccacagagtagatggaagt

SEQ ID NO: 874724 - DNA, 22 bp, Artificial Sequence
  chemically synthesized
ttcttctctaaacacttccatc

SEQ ID NO: 874725 - DNA, 22 bp, Artificial Sequence
  chemically synthesized
agagaagaagagccatatgata

SEQ ID NO: 874726 - DNA, 22 bp, Artificial Sequence
  chemically synthesized
gagaagaagagccatatgatac

SEQ ID NO: 874727 - DNA, 22 bp, Artificial Sequence
  chemically synthesized
cacaatgcaaaacacgaatcgt

SEQ ID NO: 874728 - DNA, 22 bp, Artificial Sequence
  chemically synthesized
ataaagcctccacaatgcaaaa

SEQ ID NO: 874729 - DNA, 22 bp, Artificial Sequence
  chemically synthesized
tgataaagcctccacaatgcaa

SEQ ID NO: 874730 - DNA, 22 bp, Artificial Sequence
  chemically synthesized
ctgataaagcctccacaatgca

SEQ ID NO: 874731 - DNA, 22 bp, Artificial Sequence
  chemically synthesized
gtgttttgcattgtggaggctt

SEQ ID NO: 874732 - DNA, 22 bp, Artificial Sequence
  chemically synthesized
cacccttctgataaagcctcca

SEQ ID NO: 874733 - DNA, 22 bp, Artificial Sequence
  chemically synthesized
tgcacccttctgataaagcctc

SEQ ID NO: 874734 - DNA, 22 bp, Artificial Sequence
  chemically synthesized
tgcattgtggaggctttatcag

SEQ ID NO: 874735 - DNA, 22 bp, Artificial Sequence
  chemically synthesized
gcattgtggaggctttatcaga

SEQ ID NO: 874736 - DNA, 22 bp, Artificial Sequence
  chemically synthesized
cattgtggaggctttatcagaa

SEQ ID NO: 874737 - DNA, 22 bp, Artificial Sequence
  chemically synthesized
tatctctgcacccttctgataa

SEQ ID NO: 874738 - DNA, 22 bp, Artificial Sequence
  chemically synthesized
gtatctctgcacccttctgata

SEQ ID NO: 874739 - DNA, 22 bp, Artificial Sequence
  chemically synthesized
tggaggctttatcagaagggtg

SEQ ID NO: 874740 - DNA, 22 bp, Artificial Sequence
  chemically synthesized
ccaacttgtatctctgcaccct

SEQ ID NO: 874741 - DNA, 22 bp, Artificial Sequence
  chemically synthesized
tatcagaagggtgcagagatac

SEQ ID NO: 874742 - DNA, 22 bp, Artificial Sequence
  chemically synthesized
gcctcccaacttgtatctctgc

SEQ ID NO: 874743 - DNA, 22 bp, Artificial Sequence
  chemically synthesized
atcagaagggtgcagagataca

SEQ ID NO: 874744 - DNA, 22 bp, Artificial Sequence
  chemically synthesized
tcagaagggtgcagagatacaa

SEQ ID NO: 874745 - DNA, 22 bp, Artificial Sequence
  chemically synthesized
ccatgttagcctcccaacttgt

SEQ ID NO: 874746 - DNA, 22 bp, Artificial Sequence
  chemically synthesized
cagttaccatgttagcctccca

SEQ ID NO: 874747 - DNA, 22 bp, Artificial Sequence
  chemically synthesized
ccactccagttaccatgttagc

SEQ ID NO: 874748 - DNA, 22 bp, Artificial Sequence
  chemically synthesized
cccactccagttaccatgttag

SEQ ID NO: 874749 - DNA, 22 bp, Artificial Sequence
  chemically synthesized
ggaggctaacatggtaactgga

SEQ ID NO: 874750 - DNA, 22 bp, Artificial Sequence
  chemically synthesized
accacttcccactccagttacc

SEQ ID NO: 874751 - DNA, 22 bp, Artificial Sequence
  chemically synthesized
acatggtaactggagtgggaag

SEQ ID NO: 874752 - DNA, 22 bp, Artificial Sequence
  chemically synthesized
agtccagctgaccacttcccac

SEQ ID NO: 874753 - DNA, 22 bp, Artificial Sequence
  chemically synthesized
cagtccagctgaccacttccca

SEQ ID NO: 874754 - DNA, 22 bp, Artificial Sequence
  chemically synthesized
gagtgggaagtggtcagctgga

SEQ ID NO: 874755 - DNA, 22 bp, Artificial Sequence
  chemically synthesized
tatggccaaagccttcagtcca

SEQ ID NO: 874756 - DNA, 22 bp, Artificial Sequence
  chemically synthesized
tgtatggccaaagccttcagtc

SEQ ID NO: 874757 - DNA, 22 bp, Artificial Sequence
  chemically synthesized
ctgtatggccaaagccttcagt

SEQ ID NO: 874758 - DNA, 22 bp, Artificial Sequence
  chemically synthesized
tctgtatggccaaagccttcag

SEQ ID NO: 874759 - DNA, 22 bp, Artificial Sequence
  chemically synthesized
ttctgtatggccaaagccttca

SEQ ID NO: 874760 - DNA, 22 bp, Artificial Sequence
  chemically synthesized
tttctgtatggccaaagccttc

SEQ ID NO: 874761 - DNA, 22 bp, Artificial Sequence
  chemically synthesized
cctttttctgtatggccaaagc

SEQ ID NO: 874762 - DNA, 22 bp, Artificial Sequence
  chemically synthesized
tgcctttttctgtatggccaaa

SEQ ID NO: 874763 - DNA, 22 bp, Artificial Sequence
  chemically synthesized
gactgaaggctttggccataca

SEQ ID NO: 874764 - DNA, 22 bp, Artificial Sequence
  chemically synthesized
aaggctttggccatacagaaaa

SEQ ID NO: 874765 - DNA, 22 bp, Artificial Sequence
  chemically synthesized
tggccatacagaaaaaggcaga

SEQ ID NO: 874766 - DNA, 22 bp, Artificial Sequence
  chemically synthesized
ggccatacagaaaaaggcagag

SEQ ID NO: 874767 - DNA, 22 bp, Artificial Sequence
  chemically synthesized
gccatacagaaaaaggcagagg

SEQ ID NO: 874768 - DNA, 22 bp, Artificial Sequence
  chemically synthesized
tcaaaggcaagaaaaatacaca

SEQ ID NO: 874769 - DNA, 22 bp, Artificial Sequence
  chemically synthesized
aactatcaaaggcaagaaaaat

SEQ ID NO: 874770 - DNA, 22 bp, Artificial Sequence
  chemically synthesized
aaaatctcaactatcaaaggca

SEQ ID NO: 874771 - DNA, 22 bp, Artificial Sequence
  chemically synthesized
ccagctcaaaatctcaactatc

SEQ ID NO: 874772 - DNA, 22 bp, Artificial Sequence
  chemically synthesized
ttcttgcctttgatagttgaga

SEQ ID NO: 874773 - DNA, 22 bp, Artificial Sequence
  chemically synthesized
accagctcaaaatctcaactat

SEQ ID NO: 874774 - DNA, 22 bp, Artificial Sequence
  chemically synthesized
tcttgcctttgatagttgagat

SEQ ID NO: 874775 - DNA, 22 bp, Artificial Sequence
  chemically synthesized
cttgcctttgatagttgagatt

SEQ ID NO: 874776 - DNA, 22 bp, Artificial Sequence
  chemically synthesized
ttgcctttgatagttgagattt

SEQ ID NO: 874777 - DNA, 22 bp, Artificial Sequence
  chemically synthesized
gcctttgatagttgagattttg

SEQ ID NO: 874778 - DNA, 22 bp, Artificial Sequence
  chemically synthesized
cctttgatagttgagattttga

SEQ ID NO: 874779 - DNA, 22 bp, Artificial Sequence
  chemically synthesized
gtcgtttaccagctcaaaatct

SEQ ID NO: 874780 - DNA, 22 bp, Artificial Sequence
  chemically synthesized
cgtcgtttaccagctcaaaatc

SEQ ID NO: 874781 - DNA, 22 bp, Artificial Sequence
  chemically synthesized
tgatagttgagattttgagctg

SEQ ID NO: 874782 - DNA, 22 bp, Artificial Sequence
  chemically synthesized
ttcgtcgtttaccagctcaaaa

SEQ ID NO: 874783 - DNA, 22 bp, Artificial Sequence
  chemically synthesized
gatagttgagattttgagctgg

SEQ ID NO: 874784 - DNA, 22 bp, Artificial Sequence
  chemically synthesized
atagttgagattttgagctggt

SEQ ID NO: 874785 - DNA, 22 bp, Artificial Sequence
  chemically synthesized
tcttcgtcgtttaccagctcaa

SEQ ID NO: 874786 - DNA, 22 bp, Artificial Sequence
  chemically synthesized
ctcttcgtcgtttaccagctca

SEQ ID NO: 874787 - DNA, 22 bp, Artificial Sequence
  chemically synthesized
agattttgagctggtaaacgac

SEQ ID NO: 874788 - DNA, 22 bp, Artificial Sequence
  chemically synthesized
atggcaagtttctcttcgtcgt

SEQ ID NO: 874789 - DNA, 22 bp, Artificial Sequence
  chemically synthesized
tgagctggtaaacgacgaagag

SEQ ID NO: 874790 - DNA, 22 bp, Artificial Sequence
  chemically synthesized
gatggcaagtttctcttcgtcg

SEQ ID NO: 874791 - DNA, 22 bp, Artificial Sequence
  chemically synthesized
gagctggtaaacgacgaagaga

SEQ ID NO: 874792 - DNA, 22 bp, Artificial Sequence
  chemically synthesized
agctggtaaacgacgaagagaa

SEQ ID NO: 874793 - DNA, 22 bp, Artificial Sequence
  chemically synthesized
gtaaacgacgaagagaaacttg

SEQ ID NO: 874794 - DNA, 22 bp, Artificial Sequence
  chemically synthesized
gaagaaacaatttgatggcaag

SEQ ID NO: 874795 - DNA, 22 bp, Artificial Sequence
  chemically synthesized
gccatcaaattgtttcttccag

SEQ ID NO: 874796 - DNA, 22 bp, Artificial Sequence
  chemically synthesized
ccatcaaattgtttcttccagt

SEQ ID NO: 874797 - DNA, 22 bp, Artificial Sequence
  chemically synthesized
atcatatcccacaactggaaga

SEQ ID NO: 874798 - DNA, 22 bp, Artificial Sequence
  chemically synthesized
tttcttccagttgtgggatatg

SEQ ID NO: 874799 - DNA, 22 bp, Artificial Sequence
  chemically synthesized
aagagaaacctcatcatatccc

SEQ ID NO: 874800 - DNA, 22 bp, Artificial Sequence
  chemically synthesized
cttccagttgtgggatatgatg

SEQ ID NO: 874801 - DNA, 22 bp, Artificial Sequence
  chemically synthesized
gaagagaaacctcatcatatcc

SEQ ID NO: 874802 - DNA, 22 bp, Artificial Sequence
  chemically synthesized
ttccagttgtgggatatgatga

SEQ ID NO: 874803 - DNA, 22 bp, Artificial Sequence
  chemically synthesized
ccagttgtgggatatgatgagg

SEQ ID NO: 874804 - DNA, 22 bp, Artificial Sequence
  chemically synthesized
tttgaagagaaacctcatcata

SEQ ID NO: 874805 - DNA, 22 bp, Artificial Sequence
  chemically synthesized
cagttgtgggatatgatgaggt

SEQ ID NO: 874806 - DNA, 22 bp, Artificial Sequence
  chemically synthesized
tgggatatgatgaggtttctct

SEQ ID NO: 874807 - DNA, 22 bp, Artificial Sequence
  chemically synthesized
atcagattatttgaagagaaac

SEQ ID NO: 874808 - DNA, 22 bp, Artificial Sequence
  chemically synthesized
aagaataaaagattgatcagat

SEQ ID NO: 874809 - DNA, 22 bp, Artificial Sequence
  chemically synthesized
ctcttcaaataatctgatcaat

SEQ ID NO: 874810 - DNA, 22 bp, Artificial Sequence
  chemically synthesized
tcttcaaataatctgatcaatc

SEQ ID NO: 874811 - DNA, 22 bp, Artificial Sequence
  chemically synthesized
ttcaaataatctgatcaatctt

SEQ ID NO: 874812 - DNA, 22 bp, Artificial Sequence
  chemically synthesized
caaataatctgatcaatctttt

SEQ ID NO: 874813 - DNA, 22 bp, Artificial Sequence
  chemically synthesized
aaataatctgatcaatctttta

SEQ ID NO: 874814 - DNA, 22 bp, Artificial Sequence
  chemically synthesized
tgaattaaagaataaaagattg

SEQ ID NO: 874815 - DNA, 22 bp, Artificial Sequence
  chemically synthesized
atcaatcttttattctttaatt

SEQ ID NO: 874816 - DNA, 22 bp, Artificial Sequence
  chemically synthesized
ttattctttaattcatagtacc

SEQ ID NO: 874817 - DNA, 22 bp, Artificial Sequence
  chemically synthesized
tattctttaattcatagtaccc

SEQ ID NO: 874818 - DNA, 22 bp, Artificial Sequence
  chemically synthesized
attctttaattcatagtacccc

SEQ ID NO: 874819 - DNA, 22 bp, Artificial Sequence
  chemically synthesized
ttctttaattcatagtaccccc

SEQ ID NO: 874820 - DNA, 22 bp, Artificial Sequence
  chemically synthesized
tttaattcatagtaccccctga

SEQ ID NO: 874821 - DNA, 22 bp, Artificial Sequence
  chemically synthesized
taattcatagtaccccctgatt

SEQ ID NO: 874822 - DNA, 22 bp, Artificial Sequence
  chemically synthesized
aattcatagtaccccctgattt

SEQ ID NO: 874823 - DNA, 22 bp, Artificial Sequence
  chemically synthesized
attcatagtaccccctgatttt

SEQ ID NO: 874824 - DNA, 22 bp, Artificial Sequence
  chemically synthesized
atagtaccccctgatttttctc

SEQ ID NO: 874825 - DNA, 22 bp, Artificial Sequence
  chemically synthesized
acaaaggtaaaaaggaaaaagg

SEQ ID NO: 874826 - DNA, 22 bp, Artificial Sequence
  chemically synthesized
atttttctcctttttccttttt

SEQ ID NO: 874827 - DNA, 22 bp, Artificial Sequence
  chemically synthesized
ttctcctttttcctttttacct

SEQ ID NO: 874828 - DNA, 22 bp, Artificial Sequence
  chemically synthesized
ggcatctaacaaaggtaaaaag

SEQ ID NO: 874829 - DNA, 22 bp, Artificial Sequence
  chemically synthesized
tctcctttttcctttttacctt

SEQ ID NO: 874830 - DNA, 22 bp, Artificial Sequence
  chemically synthesized
ctcctttttcctttttaccttt

SEQ ID NO: 874831 - DNA, 22 bp, Artificial Sequence
  chemically synthesized
tcctttttcctttttacctttg

SEQ ID NO: 874832 - DNA, 22 bp, Artificial Sequence
  chemically synthesized
ctttttcctttttacctttgtt

SEQ ID NO: 874833 - DNA, 22 bp, Artificial Sequence
  chemically synthesized
tttcctttttacctttgttaga

SEQ ID NO: 874834 - DNA, 22 bp, Artificial Sequence
  chemically synthesized
ttcctttttacctttgttagat

SEQ ID NO: 874835 - DNA, 22 bp, Artificial Sequence
  chemically synthesized
tcctttttacctttgttagatg

SEQ ID NO: 874836 - DNA, 22 bp, Artificial Sequence
  chemically synthesized
cctttttacctttgttagatgc

SEQ ID NO: 874837 - DNA, 22 bp, Artificial Sequence
  chemically synthesized
aggtgtgcctgggcatctaaca

SEQ ID NO: 874838 - DNA, 22 bp, Artificial Sequence
  chemically synthesized
ctttttacctttgttagatgcc

SEQ ID NO: 874839 - DNA, 22 bp, Artificial Sequence
  chemically synthesized
tttacctttgttagatgcccag

SEQ ID NO: 874840 - DNA, 22 bp, Artificial Sequence
  chemically synthesized
ttacctttgttagatgcccagg

SEQ ID NO: 874841 - DNA, 22 bp, Artificial Sequence
  chemically synthesized
tacctttgttagatgcccaggc

SEQ ID NO: 874842 - DNA, 22 bp, Artificial Sequence
  chemically synthesized
gtactgaggtgtgcctgggcat

SEQ ID NO: 874843 - DNA, 22 bp, Artificial Sequence
  chemically synthesized
acctttgttagatgcccaggca

SEQ ID NO: 874844 - DNA, 22 bp, Artificial Sequence
  chemically synthesized
cctttgttagatgcccaggcac

SEQ ID NO: 874845 - DNA, 22 bp, Artificial Sequence
  chemically synthesized
tgttagatgcccaggcacacct

SEQ ID NO: 874846 - DNA, 22 bp, Artificial Sequence
  chemically synthesized
gttagatgcccaggcacacctc

SEQ ID NO: 874847 - DNA, 22 bp, Artificial Sequence
  chemically synthesized
ttagatgcccaggcacacctca

SEQ ID NO: 874848 - DNA, 22 bp, Artificial Sequence
  chemically synthesized
gatgcccaggcacacctcagta

SEQ ID NO: 874849 - DNA, 22 bp, Artificial Sequence
  chemically synthesized
caaataaggaaatgaatgtgag

SEQ ID NO: 874850 - DNA, 22 bp, Artificial Sequence
  chemically synthesized
ccaaataaggaaatgaatgtga

SEQ ID NO: 874851 - DNA, 22 bp, Artificial Sequence
  chemically synthesized
tccaaataaggaaatgaatgtg

SEQ ID NO: 874852 - DNA, 22 bp, Artificial Sequence
  chemically synthesized
agtaccagctcacattcatttc

SEQ ID NO: 874853 - DNA, 22 bp, Artificial Sequence
  chemically synthesized
tttccaaataaggaaatgaatg

SEQ ID NO: 874854 - DNA, 22 bp, Artificial Sequence
  chemically synthesized
gtcctctttccaaataaggaaa

SEQ ID NO: 874855 - DNA, 22 bp, Artificial Sequence
  chemically synthesized
acattcatttccttatttggaa

SEQ ID NO: 874856 - DNA, 22 bp, Artificial Sequence
  chemically synthesized
gaaagttagtcctctttccaaa

SEQ ID NO: 874857 - DNA, 22 bp, Artificial Sequence
  chemically synthesized
atttccttatttggaaagagga

SEQ ID NO: 874858 - DNA, 22 bp, Artificial Sequence
  chemically synthesized
ccttatttggaaagaggactaa

SEQ ID NO: 874859 - DNA, 22 bp, Artificial Sequence
  chemically synthesized
cttatttggaaagaggactaac

SEQ ID NO: 874860 - DNA, 22 bp, Artificial Sequence
  chemically synthesized
taatgagctagaaagttagtcc

SEQ ID NO: 874861 - DNA, 22 bp, Artificial Sequence
  chemically synthesized
atttggaaagaggactaacttt

SEQ ID NO: 874862 - DNA, 22 bp, Artificial Sequence
  chemically synthesized
tttggaaagaggactaactttc

SEQ ID NO: 874863 - DNA, 22 bp, Artificial Sequence
  chemically synthesized
ggaaagaggactaactttctag

SEQ ID NO: 874864 - DNA, 22 bp, Artificial Sequence
  chemically synthesized
gaaagaggactaactttctagc

SEQ ID NO: 874865 - DNA, 22 bp, Artificial Sequence
  chemically synthesized
actttctagctcattacagacg

SEQ ID NO: 874866 - DNA, 22 bp, Artificial Sequence
  chemically synthesized
tctagctcattacagacgcccc

SEQ ID NO: 874867 - DNA, 22 bp, Artificial Sequence
  chemically synthesized
ctagctcattacagacgcccct

SEQ ID NO: 874868 - DNA, 22 bp, Artificial Sequence
  chemically synthesized
tagctcattacagacgcccctt

SEQ ID NO: 874869 - DNA, 22 bp, Artificial Sequence
  chemically synthesized
gctcattacagacgccccttcc

SEQ ID NO: 874870 - DNA, 22 bp, Artificial Sequence
  chemically synthesized
attacagacgccccttcccctt

SEQ ID NO: 874871 - DNA, 22 bp, Artificial Sequence
  chemically synthesized
cagacgccccttccccttcctc

SEQ ID NO: 874872 - DNA, 22 bp, Artificial Sequence
  chemically synthesized
ccccttcctctccacttgattt

SEQ ID NO: 874873 - DNA, 22 bp, Artificial Sequence
  chemically synthesized
cccttcctctccacttgatttt

SEQ ID NO: 874874 - DNA, 22 bp, Artificial Sequence
  chemically synthesized
gatagggtgggcacgtaaaatc

SEQ ID NO: 874875 - DNA, 22 bp, Artificial Sequence
  chemically synthesized
cctctccacttgattttacgtg

SEQ ID NO: 874876 - DNA, 22 bp, Artificial Sequence
  chemically synthesized
agatagggtgggcacgtaaaat

SEQ ID NO: 874877 - DNA, 22 bp, Artificial Sequence
  chemically synthesized
ctctccacttgattttacgtgc

SEQ ID NO: 874878 - DNA, 22 bp, Artificial Sequence
  chemically synthesized
tagatagggtgggcacgtaaaa

SEQ ID NO: 874879 - DNA, 22 bp, Artificial Sequence
  chemically synthesized
ttagatagggtgggcacgtaaa

SEQ ID NO: 874880 - DNA, 22 bp, Artificial Sequence
  chemically synthesized
tttagatagggtgggcacgtaa

SEQ ID NO: 874881 - DNA, 22 bp, Artificial Sequence
  chemically synthesized
tccacttgattttacgtgccca

SEQ ID NO: 874882 - DNA, 22 bp, Artificial Sequence
  chemically synthesized
ttttagatagggtgggcacgta

SEQ ID NO: 874883 - DNA, 22 bp, Artificial Sequence
  chemically synthesized
cacttgattttacgtgcccacc

SEQ ID NO: 874884 - DNA, 22 bp, Artificial Sequence
  chemically synthesized
atttttttagatagggtgggca

SEQ ID NO: 874885 - DNA, 22 bp, Artificial Sequence
  chemically synthesized
gatttttttagatagggtgggc

SEQ ID NO: 874886 - DNA, 22 bp, Artificial Sequence
  chemically synthesized
gattttacgtgcccaccctatc

SEQ ID NO: 874887 - DNA, 22 bp, Artificial Sequence
  chemically synthesized
attttacgtgcccaccctatct

SEQ ID NO: 874888 - DNA, 22 bp, Artificial Sequence
  chemically synthesized
tacgtgcccaccctatctaaaa

SEQ ID NO: 874889 - DNA, 22 bp, Artificial Sequence
  chemically synthesized
aacatttgatttttttagatag

SEQ ID NO: 874890 - DNA, 22 bp, Artificial Sequence
  chemically synthesized
acgtgcccaccctatctaaaaa

SEQ ID NO: 874891 - DNA, 22 bp, Artificial Sequence
  chemically synthesized
cgtgcccaccctatctaaaaaa

SEQ ID NO: 874892 - DNA, 22 bp, Artificial Sequence
  chemically synthesized
gctaaacatttgatttttttag

SEQ ID NO: 874893 - DNA, 22 bp, Artificial Sequence
  chemically synthesized
atcccagttggctaaacatttg

SEQ ID NO: 874894 - DNA, 22 bp, Artificial Sequence
  chemically synthesized
tctaaaaaaatcaaatgtttag

SEQ ID NO: 874895 - DNA, 22 bp, Artificial Sequence
  chemically synthesized
aaaaaatcaaatgtttagccaa

SEQ ID NO: 874896 - DNA, 22 bp, Artificial Sequence
  chemically synthesized
aactaatcccagttggctaaac

SEQ ID NO: 874897 - DNA, 22 bp, Artificial Sequence
  chemically synthesized
ggtcgtacaatctaaactaatc

SEQ ID NO: 874898 - DNA, 22 bp, Artificial Sequence
  chemically synthesized
agccaactgggattagtttaga

SEQ ID NO: 874899 - DNA, 22 bp, Artificial Sequence
  chemically synthesized
gccaactgggattagtttagat

SEQ ID NO: 874900 - DNA, 22 bp, Artificial Sequence
  chemically synthesized
gggttgggtcgtacaatctaaa

SEQ ID NO: 874901 - DNA, 22 bp, Artificial Sequence
  chemically synthesized
gctggggttgggtcgtacaatc

SEQ ID NO: 874902 - DNA, 22 bp, Artificial Sequence
  chemically synthesized
ggattagtttagattgtacgac

SEQ ID NO: 874903 - DNA, 22 bp, Artificial Sequence
  chemically synthesized
gtttagattgtacgacccaacc

SEQ ID NO: 874904 - DNA, 22 bp, Artificial Sequence
  chemically synthesized
cccccattggctggggttgggt

SEQ ID NO: 874905 - DNA, 22 bp, Artificial Sequence
  chemically synthesized
ccccccattggctggggttggg

SEQ ID NO: 874906 - DNA, 22 bp, Artificial Sequence
  chemically synthesized
agattgtacgacccaaccccag

SEQ ID NO: 874907 - DNA, 22 bp, Artificial Sequence
  chemically synthesized
tccccccattggctggggttgg

SEQ ID NO: 874908 - DNA, 22 bp, Artificial Sequence
  chemically synthesized
gattgtacgacccaaccccagc

SEQ ID NO: 874909 - DNA, 22 bp, Artificial Sequence
  chemically synthesized
tacgacccaaccccagccaatg

SEQ ID NO: 874910 - DNA, 22 bp, Artificial Sequence
  chemically synthesized
taccctttccccccattggctg

SEQ ID NO: 874911 - DNA, 22 bp, Artificial Sequence
  chemically synthesized
cccctgtaccctttccccccat

SEQ ID NO: 874912 - DNA, 22 bp, Artificial Sequence
  chemically synthesized
acgcaagtcctgcccctgtacc

SEQ ID NO: 874913 - DNA, 22 bp, Artificial Sequence
  chemically synthesized
ctgacgcaagtcctgcccctgt

SEQ ID NO: 874914 - DNA, 22 bp, Artificial Sequence
  chemically synthesized
ttcctgacgcaagtcctgcccc

SEQ ID NO: 874915 - DNA, 22 bp, Artificial Sequence
  chemically synthesized
attcctgacgcaagtcctgccc

SEQ ID NO: 874916 - DNA, 22 bp, Artificial Sequence
  chemically synthesized
tattcctgacgcaagtcctgcc

SEQ ID NO: 874917 - DNA, 22 bp, Artificial Sequence
  chemically synthesized
gcgtcaggaataaaggctctca

SEQ ID NO: 874918 - DNA, 22 bp, Artificial Sequence
  chemically synthesized
aacaaaggggcatgagagcctt

SEQ ID NO: 874919 - DNA, 22 bp, Artificial Sequence
  chemically synthesized
cgtcaggaataaaggctctcat

SEQ ID NO: 874920 - DNA, 22 bp, Artificial Sequence
  chemically synthesized
ccatgagagcacacctgaacaa

SEQ ID NO: 874921 - DNA, 22 bp, Artificial Sequence
  chemically synthesized
tcatgcccctttgttcaggtgt

SEQ ID NO: 874922 - DNA, 22 bp, Artificial Sequence
  chemically synthesized
atgcccctttgttcaggtgtgc

SEQ ID NO: 874923 - DNA, 22 bp, Artificial Sequence
  chemically synthesized
gccagttgccatgagagcacac

SEQ ID NO: 874924 - DNA, 22 bp, Artificial Sequence
  chemically synthesized
ggccagttgccatgagagcaca

SEQ ID NO: 874925 - DNA, 22 bp, Artificial Sequence
  chemically synthesized
cttggccagttgccatgagagc

SEQ ID NO: 874926 - DNA, 22 bp, Artificial Sequence
  chemically synthesized
tgttcaggtgtgctctcatggc

SEQ ID NO: 874927 - DNA, 22 bp, Artificial Sequence
  chemically synthesized
gttcaggtgtgctctcatggca

SEQ ID NO: 874928 - DNA, 22 bp, Artificial Sequence
  chemically synthesized
ttcaggtgtgctctcatggcaa

SEQ ID NO: 874929 - DNA, 22 bp, Artificial Sequence
  chemically synthesized
aggtgtgctctcatggcaactg

SEQ ID NO: 874930 - DNA, 22 bp, Artificial Sequence
  chemically synthesized
tcatggcaactggccaaggagg

SEQ ID NO: 874931 - DNA, 22 bp, Artificial Sequence
  chemically synthesized
cacagaggggtgcctccttggc

SEQ ID NO: 874932 - DNA, 22 bp, Artificial Sequence
  chemically synthesized
atggcaactggccaaggaggca

SEQ ID NO: 874933 - DNA, 22 bp, Artificial Sequence
  chemically synthesized
tgcacagaggggtgcctccttg

SEQ ID NO: 874934 - DNA, 22 bp, Artificial Sequence
  chemically synthesized
ctgcacagaggggtgcctcctt

SEQ ID NO: 874935 - DNA, 22 bp, Artificial Sequence
  chemically synthesized
cttctgcacagaggggtgcctc

SEQ ID NO: 874936 - DNA, 22 bp, Artificial Sequence
  chemically synthesized
acttctgcacagaggggtgcct

SEQ ID NO: 874937 - DNA, 22 bp, Artificial Sequence
  chemically synthesized
tacttctgcacagaggggtgcc

SEQ ID NO: 874938 - DNA, 22 bp, Artificial Sequence
  chemically synthesized
gccaaggaggcacccctctgtg

SEQ ID NO: 874939 - DNA, 22 bp, Artificial Sequence
  chemically synthesized
gcaaagcaattttacttctgca

SEQ ID NO: 874940 - DNA, 22 bp, Artificial Sequence
  chemically synthesized
agcaaagcaattttacttctgc

SEQ ID NO: 874941 - DNA, 22 bp, Artificial Sequence
  chemically synthesized
ttagcaaagcaattttacttct

SEQ ID NO: 874942 - DNA, 22 bp, Artificial Sequence
  chemically synthesized
tgtgcagaagtaaaattgcttt

SEQ ID NO: 874943 - DNA, 22 bp, Artificial Sequence
  chemically synthesized
tgcagaagtaaaattgctttgc

SEQ ID NO: 874944 - DNA, 22 bp, Artificial Sequence
  chemically synthesized
gaacaaaggattcttagcaaag

SEQ ID NO: 874945 - DNA, 22 bp, Artificial Sequence
  chemically synthesized
aacactcgaacaaaggattctt

SEQ ID NO: 874946 - DNA, 22 bp, Artificial Sequence
  chemically synthesized
ctttgctaagaatcctttgttc

SEQ ID NO: 874947 - DNA, 22 bp, Artificial Sequence
  chemically synthesized
tgctaagaatcctttgttcgag

SEQ ID NO: 874948 - DNA, 22 bp, Artificial Sequence
  chemically synthesized
gctaagaatcctttgttcgagt

SEQ ID NO: 874949 - DNA, 22 bp, Artificial Sequence
  chemically synthesized
aggacattgaacactcgaacaa

SEQ ID NO: 874950 - DNA, 22 bp, Artificial Sequence
  chemically synthesized
ctaagaatcctttgttcgagtg

SEQ ID NO: 874951 - DNA, 22 bp, Artificial Sequence
  chemically synthesized
agaatcctttgttcgagtgttc

SEQ ID NO: 874952 - DNA, 22 bp, Artificial Sequence
  chemically synthesized
aaaatcctgaggacattgaaca

SEQ ID NO: 874953 - DNA, 22 bp, Artificial Sequence
  chemically synthesized
tgttcgagtgttcaatgtcctc

SEQ ID NO: 874954 - DNA, 22 bp, Artificial Sequence
  chemically synthesized
gttcgagtgttcaatgtcctca

SEQ ID NO: 874955 - DNA, 22 bp, Artificial Sequence
  chemically synthesized
ttcgagtgttcaatgtcctcag

SEQ ID NO: 874956 - DNA, 22 bp, Artificial Sequence
  chemically synthesized
gagtgttcaatgtcctcaggat

SEQ ID NO: 874957 - DNA, 22 bp, Artificial Sequence
  chemically synthesized
ggaataatgctcaaaatcctga

SEQ ID NO: 874958 - DNA, 22 bp, Artificial Sequence
  chemically synthesized
aatgtcctcaggattttgagca

SEQ ID NO: 874959 - DNA, 22 bp, Artificial Sequence
  chemically synthesized
tgttaggaataatgctcaaaat

SEQ ID NO: 874960 - DNA, 22 bp, Artificial Sequence
  chemically synthesized
aggattttgagcattattccta

SEQ ID NO: 874961 - DNA, 22 bp, Artificial Sequence
  chemically synthesized
acagggtagactgtgttaggaa

SEQ ID NO: 874962 - DNA, 22 bp, Artificial Sequence
  chemically synthesized
tgagcattattcctaacacagt

SEQ ID NO: 874963 - DNA, 22 bp, Artificial Sequence
  chemically synthesized
gagcattattcctaacacagtc

SEQ ID NO: 874964 - DNA, 22 bp, Artificial Sequence
  chemically synthesized
agcattattcctaacacagtct

SEQ ID NO: 874965 - DNA, 22 bp, Artificial Sequence
  chemically synthesized
ttcctaacacagtctaccctgt

SEQ ID NO: 874966 - DNA, 22 bp, Artificial Sequence
  chemically synthesized
ctaacacagtctaccctgtcag

SEQ ID NO: 874967 - DNA, 22 bp, Artificial Sequence
  chemically synthesized
gaaagacacatgctgacagggt

SEQ ID NO: 874968 - DNA, 22 bp, Artificial Sequence
  chemically synthesized
acacagtctaccctgtcagcat

SEQ ID NO: 874969 - DNA, 22 bp, Artificial Sequence
  chemically synthesized
actggaaagacacatgctgaca

SEQ ID NO: 874970 - DNA, 22 bp, Artificial Sequence
  chemically synthesized
ccctgtcagcatgtgtctttcc

SEQ ID NO: 874971 - DNA, 22 bp, Artificial Sequence
  chemically synthesized
tcagcatgtgtctttccagtca

SEQ ID NO: 874972 - DNA, 22 bp, Artificial Sequence
  chemically synthesized
cgaagggcacatagtctgactg

SEQ ID NO: 874973 - DNA, 22 bp, Artificial Sequence
  chemically synthesized
gcgaagggcacatagtctgact

SEQ ID NO: 874974 - DNA, 22 bp, Artificial Sequence
  chemically synthesized
ccttgcgaagggcacatagtct

SEQ ID NO: 874975 - DNA, 22 bp, Artificial Sequence
  chemically synthesized
tccagtcagactatgtgccctt

SEQ ID NO: 874976 - DNA, 22 bp, Artificial Sequence
  chemically synthesized
ccagtcagactatgtgcccttc

SEQ ID NO: 874977 - DNA, 22 bp, Artificial Sequence
  chemically synthesized
cagtcagactatgtgcccttcg

SEQ ID NO: 874978 - DNA, 22 bp, Artificial Sequence
  chemically synthesized
agtcctgccttgcgaagggcac

SEQ ID NO: 874979 - DNA, 22 bp, Artificial Sequence
  chemically synthesized
tgtgcccttcgcaaggcaggac

SEQ ID NO: 874980 - DNA, 22 bp, Artificial Sequence
  chemically synthesized
cgcaaggcaggactgagtcctc

SEQ ID NO: 874981 - DNA, 22 bp, Artificial Sequence
  chemically synthesized
gcaaggcaggactgagtcctct

SEQ ID NO: 874982 - DNA, 22 bp, Artificial Sequence
  chemically synthesized
agtcctctatgccttgtacgat

SEQ ID NO: 874983 - DNA, 22 bp, Artificial Sequence
  chemically synthesized
gatataaagaaaacatcgtaca

SEQ ID NO: 874984 - DNA, 22 bp, Artificial Sequence
  chemically synthesized
tatgccttgtacgatgttttct

SEQ ID NO: 874985 - DNA, 22 bp, Artificial Sequence
  chemically synthesized
gactggatataaagaaaacatc

SEQ ID NO: 874986 - DNA, 22 bp, Artificial Sequence
  chemically synthesized
tgccttgtacgatgttttcttt

SEQ ID NO: 874987 - DNA, 22 bp, Artificial Sequence
  chemically synthesized
gtacgatgttttctttatatcc

SEQ ID NO: 874988 - DNA, 22 bp, Artificial Sequence
  chemically synthesized
tacgatgttttctttatatcca

SEQ ID NO: 874989 - DNA, 22 bp, Artificial Sequence
  chemically synthesized
ggaagcactagactggatataa

SEQ ID NO: 874990 - DNA, 22 bp, Artificial Sequence
  chemically synthesized
ttaggaagcactagactggata

SEQ ID NO: 874991 - DNA, 22 bp, Artificial Sequence
  chemically synthesized
attaggaagcactagactggat

SEQ ID NO: 874992 - DNA, 22 bp, Artificial Sequence
  chemically synthesized
ttattaggaagcactagactgg

SEQ ID NO: 874993 - DNA, 22 bp, Artificial Sequence
  chemically synthesized
tctttatatccagtctagtgct

SEQ ID NO: 874994 - DNA, 22 bp, Artificial Sequence
  chemically synthesized
ctcttattaggaagcactagac

SEQ ID NO: 874995 - DNA, 22 bp, Artificial Sequence
  chemically synthesized
ctttatatccagtctagtgctt

SEQ ID NO: 874996 - DNA, 22 bp, Artificial Sequence
  chemically synthesized
tttatatccagtctagtgcttc

SEQ ID NO: 874997 - DNA, 22 bp, Artificial Sequence
  chemically synthesized
tatatccagtctagtgcttcct

SEQ ID NO: 874998 - DNA, 22 bp, Artificial Sequence
  chemically synthesized
atatccagtctagtgcttccta

SEQ ID NO: 874999 - DNA, 22 bp, Artificial Sequence
  chemically synthesized
aactcctcttattaggaagcac

SEQ ID NO: 875000 - DNA, 22 bp, Artificial Sequence
  chemically synthesized
tatccagtctagtgcttcctaa

SEQ ID NO: 875001 - DNA, 22 bp, Artificial Sequence
  chemically synthesized
ctgaactcctcttattaggaag

SEQ ID NO: 875002 - DNA, 22 bp, Artificial Sequence
  chemically synthesized
actgaactcctcttattaggaa

SEQ ID NO: 875003 - DNA, 22 bp, Artificial Sequence
  chemically synthesized
gtgcttcctaataagaggagtt

SEQ ID NO: 875004 - DNA, 22 bp, Artificial Sequence
  chemically synthesized
agaaatatttactgaactcctc

SEQ ID NO: 875005 - DNA, 22 bp, Artificial Sequence
  chemically synthesized
cctaataagaggagttcagtaa

SEQ ID NO: 875006 - DNA, 22 bp, Artificial Sequence
  chemically synthesized
ctaataagaggagttcagtaaa

SEQ ID NO: 875007 - DNA, 22 bp, Artificial Sequence
  chemically synthesized
aattcagaaatatttactgaac

SEQ ID NO: 875008 - DNA, 22 bp, Artificial Sequence
  chemically synthesized
ataagaggagttcagtaaatat

SEQ ID NO: 875009 - DNA, 22 bp, Artificial Sequence
  chemically synthesized
ttcaattcagaaatatttactg

SEQ ID NO: 875010 - DNA, 22 bp, Artificial Sequence
  chemically synthesized
attcaattcagaaatatttact

SEQ ID NO: 875011 - DNA, 22 bp, Artificial Sequence
  chemically synthesized
tattcaattcagaaatatttac

SEQ ID NO: 875012 - DNA, 22 bp, Artificial Sequence
  chemically synthesized
attttattcaattcagaaatat

SEQ ID NO: 875013 - DNA, 22 bp, Artificial Sequence
  chemically synthesized
aattttattcaattcagaaata

SEQ ID NO: 875014 - DNA, 22 bp, Artificial Sequence
  chemically synthesized
atttaattttattcaattcaga

SEQ ID NO: 875015 - DNA, 22 bp, Artificial Sequence
  chemically synthesized
catttaattttattcaattcag

SEQ ID NO: 875016 - DNA, 22 bp, Artificial Sequence
  chemically synthesized
agtaaatatttctgaattgaat

SEQ ID NO: 875017 - DNA, 22 bp, Artificial Sequence
  chemically synthesized
tcatttaattttattcaattca

SEQ ID NO: 875018 - DNA, 22 bp, Artificial Sequence
  chemically synthesized
ctgaattgaataaaattaaatg

SEQ ID NO: 875019 - DNA, 22 bp, Artificial Sequence
  chemically synthesized
tgaattgaataaaattaaatga

SEQ ID NO: 875020 - DNA, 22 bp, Artificial Sequence
  chemically synthesized
aagtagcaattttcatttaatt

SEQ ID NO: 875021 - DNA, 22 bp, Artificial Sequence
  chemically synthesized
aattgaataaaattaaatgaaa

SEQ ID NO: 875022 - DNA, 22 bp, Artificial Sequence
  chemically synthesized
ttcaagtagcaattttcattta

SEQ ID NO: 875023 - DNA, 22 bp, Artificial Sequence
  chemically synthesized
attcaagtagcaattttcattt

SEQ ID NO: 875024 - DNA, 22 bp, Artificial Sequence
  chemically synthesized
tattcaagtagcaattttcatt

SEQ ID NO: 875025 - DNA, 22 bp, Artificial Sequence
  chemically synthesized
aataaaattaaatgaaaattgc

SEQ ID NO: 875026 - DNA, 22 bp, Artificial Sequence
  chemically synthesized
ctttattcaagtagcaattttc

SEQ ID NO: 875027 - DNA, 22 bp, Artificial Sequence
  chemically synthesized
cctttattcaagtagcaatttt

SEQ ID NO: 875028 - DNA, 22 bp, Artificial Sequence
  chemically synthesized
tcctttattcaagtagcaattt

SEQ ID NO: 875029 - DNA, 22 bp, Artificial Sequence
  chemically synthesized
ttcctttattcaagtagcaatt

SEQ ID NO: 875030 - DNA, 22 bp, Artificial Sequence
  chemically synthesized
ttttcctttattcaagtagcaa

SEQ ID NO: 875031 - DNA, 22 bp, Artificial Sequence
  chemically synthesized
tcttttcctttattcaagtagc

SEQ ID NO: 875032 - DNA, 22 bp, Artificial Sequence
  chemically synthesized
ctcttttcctttattcaagtag

SEQ ID NO: 875033 - DNA, 22 bp, Artificial Sequence
  chemically synthesized
aatgaaaattgctacttgaata

SEQ ID NO: 875034 - DNA, 22 bp, Artificial Sequence
  chemically synthesized
tctcttttcctttattcaagta

SEQ ID NO: 875035 - DNA, 22 bp, Artificial Sequence
  chemically synthesized
tttctcttttcctttattcaag

SEQ ID NO: 875036 - DNA, 22 bp, Artificial Sequence
  chemically synthesized
tctctttctcttttcctttatt

SEQ ID NO: 875037 - DNA, 22 bp, Artificial Sequence
  chemically synthesized
atctctttctcttttcctttat

SEQ ID NO: 875038 - DNA, 22 bp, Artificial Sequence
  chemically synthesized
tttatctctttctcttttcctt

SEQ ID NO: 875039 - DNA, 22 bp, Artificial Sequence
  chemically synthesized
ctacttgaataaaggaaaagag

SEQ ID NO: 875040 - DNA, 22 bp, Artificial Sequence
  chemically synthesized
atttatctctttctcttttcct

SEQ ID NO: 875041 - DNA, 22 bp, Artificial Sequence
  chemically synthesized
cttgaataaaggaaaagagaaa

SEQ ID NO: 875042 - DNA, 22 bp, Artificial Sequence
  chemically synthesized
gaataaaggaaaagagaaagag

SEQ ID NO: 875043 - DNA, 22 bp, Artificial Sequence
  chemically synthesized
aataaaggaaaagagaaagaga

SEQ ID NO: 875044 - DNA, 22 bp, Artificial Sequence
  chemically synthesized
ggggaaaagaaacttatttatc

SEQ ID NO: 875045 - DNA, 22 bp, Artificial Sequence
  chemically synthesized
aagtcaagttgggggaaaagaa

SEQ ID NO: 875046 - DNA, 22 bp, Artificial Sequence
  chemically synthesized
acattgaagtcaagttggggga

SEQ ID NO: 875047 - DNA, 22 bp, Artificial Sequence
  chemically synthesized
cttttcccccaacttgacttca

SEQ ID NO: 875048 - DNA, 22 bp, Artificial Sequence
  chemically synthesized
ttttcccccaacttgacttcaa

SEQ ID NO: 875049 - DNA, 22 bp, Artificial Sequence
  chemically synthesized
ttcccccaacttgacttcaatg

SEQ ID NO: 875050 - DNA, 22 bp, Artificial Sequence
  chemically synthesized
tcccccaacttgacttcaatgt

SEQ ID NO: 875051 - DNA, 22 bp, Artificial Sequence
  chemically synthesized
cccccaacttgacttcaatgtg

SEQ ID NO: 875052 - DNA, 22 bp, Artificial Sequence
  chemically synthesized
ccccaacttgacttcaatgtga

SEQ ID NO: 875053 - DNA, 22 bp, Artificial Sequence
  chemically synthesized
gacttcaatgtgaactacatac

SEQ ID NO: 875054 - DNA, 22 bp, Artificial Sequence
  chemically synthesized
acttcaatgtgaactacatacc

SEQ ID NO: 875055 - DNA, 22 bp, Artificial Sequence
  chemically synthesized
caatgtgaactacataccatgg

SEQ ID NO: 875056 - DNA, 22 bp, Artificial Sequence
  chemically synthesized
aatgtgaactacataccatgga

SEQ ID NO: 875057 - DNA, 22 bp, Artificial Sequence
  chemically synthesized
cataccatggatgactttatat

SEQ ID NO: 875058 - DNA, 22 bp, Artificial Sequence
  chemically synthesized
aagtcccatatatatataaagt

SEQ ID NO: 875059 - DNA, 22 bp, Artificial Sequence
  chemically synthesized
caagtcccatatatatataaag

SEQ ID NO: 875060 - DNA, 22 bp, Artificial Sequence
  chemically synthesized
cttcaagtcccatatatatata

SEQ ID NO: 875061 - DNA, 22 bp, Artificial Sequence
  chemically synthesized
cataggctccttcaagtcccat

SEQ ID NO: 875062 - DNA, 22 bp, Artificial Sequence
  chemically synthesized
tatatatatatgggacttgaag

SEQ ID NO: 875063 - DNA, 22 bp, Artificial Sequence
  chemically synthesized
atatatatatgggacttgaagg

SEQ ID NO: 875064 - DNA, 22 bp, Artificial Sequence
  chemically synthesized
tatatatatgggacttgaagga

SEQ ID NO: 875065 - DNA, 22 bp, Artificial Sequence
  chemically synthesized
gaaaacctacataggctccttc

SEQ ID NO: 875066 - DNA, 22 bp, Artificial Sequence
  chemically synthesized
cacgcctggaaaacctacatag

SEQ ID NO: 875067 - DNA, 22 bp, Artificial Sequence
  chemically synthesized
gaaggagcctatgtaggttttc

SEQ ID NO: 875068 - DNA, 22 bp, Artificial Sequence
  chemically synthesized
aaggagcctatgtaggttttcc

SEQ ID NO: 875069 - DNA, 22 bp, Artificial Sequence
  chemically synthesized
ataaaatgattgcacgcctgga

SEQ ID NO: 875070 - DNA, 22 bp, Artificial Sequence
  chemically synthesized
tgtaggttttccaggcgtgcaa

SEQ ID NO: 875071 - DNA, 22 bp, Artificial Sequence
  chemically synthesized
tccaggcgtgcaatcattttat

SEQ ID NO: 875072 - DNA, 22 bp, Artificial Sequence
  chemically synthesized
ccaggcgtgcaatcattttatt

SEQ ID NO: 875073 - DNA, 22 bp, Artificial Sequence
  chemically synthesized
caggcgtgcaatcattttatta

SEQ ID NO: 875074 - DNA, 22 bp, Artificial Sequence
  chemically synthesized
aaaagaaaaaataagcctaata

SEQ ID NO: 875075 - DNA, 22 bp, Artificial Sequence
  chemically synthesized
tctcaaaagaaaaaataagcct

SEQ ID NO: 875076 - DNA, 22 bp, Artificial Sequence
  chemically synthesized
tattaggcttattttttctttt

SEQ ID NO: 875077 - DNA, 22 bp, Artificial Sequence
  chemically synthesized
attaggcttattttttcttttg

SEQ ID NO: 875078 - DNA, 22 bp, Artificial Sequence
  chemically synthesized
ttaggcttattttttcttttga

SEQ ID NO: 875079 - DNA, 22 bp, Artificial Sequence
  chemically synthesized
ggcttattttttcttttgagac

SEQ ID NO: 875080 - DNA, 22 bp, Artificial Sequence
  chemically synthesized
attttttcttttgagacagggt

SEQ ID NO: 875081 - DNA, 22 bp, Artificial Sequence
  chemically synthesized
ttttttcttttgagacagggtc

SEQ ID NO: 875082 - DNA, 22 bp, Artificial Sequence
  chemically synthesized
ggtgacagagtgagaccctgtc

SEQ ID NO: 875083 - DNA, 22 bp, Artificial Sequence
  chemically synthesized
tttcttttgagacagggtctca

SEQ ID NO: 875084 - DNA, 22 bp, Artificial Sequence
  chemically synthesized
ttcttttgagacagggtctcac

SEQ ID NO: 875085 - DNA, 22 bp, Artificial Sequence
  chemically synthesized
tcttttgagacagggtctcact

SEQ ID NO: 875086 - DNA, 22 bp, Artificial Sequence
  chemically synthesized
cttttgagacagggtctcactc

SEQ ID NO: 875087 - DNA, 22 bp, Artificial Sequence
  chemically synthesized
ttttgagacagggtctcactct

SEQ ID NO: 875088 - DNA, 22 bp, Artificial Sequence
  chemically synthesized
ccgcctgggtgacagagtgaga

SEQ ID NO: 875089 - DNA, 22 bp, Artificial Sequence
  chemically synthesized
ttgagacagggtctcactctgt

SEQ ID NO: 875090 - DNA, 22 bp, Artificial Sequence
  chemically synthesized
tgagacagggtctcactctgtc

SEQ ID NO: 875091 - DNA, 22 bp, Artificial Sequence
  chemically synthesized
tcccgcctgggtgacagagtga

SEQ ID NO: 875092 - DNA, 22 bp, Artificial Sequence
  chemically synthesized
gagacagggtctcactctgtca

SEQ ID NO: 875093 - DNA, 22 bp, Artificial Sequence
  chemically synthesized
agacagggtctcactctgtcac

SEQ ID NO: 875094 - DNA, 22 bp, Artificial Sequence
  chemically synthesized
ctctcccgcctgggtgacagag

SEQ ID NO: 875095 - DNA, 22 bp, Artificial Sequence
  chemically synthesized
ccactgctctcccgcctgggtg

SEQ ID NO: 875096 - DNA, 22 bp, Artificial Sequence
  chemically synthesized
gccactgctctcccgcctgggt

SEQ ID NO: 875097 - DNA, 22 bp, Artificial Sequence
  chemically synthesized
actctgtcacccaggcgggaga

SEQ ID NO: 875098 - DNA, 22 bp, Artificial Sequence
  chemically synthesized
tgtcacccaggcgggagagcag

SEQ ID NO: 875099 - DNA, 22 bp, Artificial Sequence
  chemically synthesized
tcacccaggcgggagagcagtg

SEQ ID NO: 875100 - DNA, 22 bp, Artificial Sequence
  chemically synthesized
cagtgagccgagatcttgccac

SEQ ID NO: 875101 - DNA, 22 bp, Artificial Sequence
  chemically synthesized
ggaagtcgaggctgcagtgagc

SEQ ID NO: 875102 - DNA, 22 bp, Artificial Sequence
  chemically synthesized
cctaggaagtcgaggctgcagt

SEQ ID NO: 875103 - DNA, 22 bp, Artificial Sequence
  chemically synthesized
ggctcactgcagcctcgacttc

SEQ ID NO: 875104 - DNA, 22 bp, Artificial Sequence
  chemically synthesized
actgcagcctcgacttcctagg

SEQ ID NO: 875105 - DNA, 22 bp, Artificial Sequence
  chemically synthesized
aggtgggaggattgcctaggaa

SEQ ID NO: 875106 - DNA, 22 bp, Artificial Sequence
  chemically synthesized
cagcctcgacttcctaggcaat

SEQ ID NO: 875107 - DNA, 22 bp, Artificial Sequence
  chemically synthesized
gacttcctaggcaatcctccca

SEQ ID NO: 875108 - DNA, 22 bp, Artificial Sequence
  chemically synthesized
aggaggctgaggtgggaggatt

SEQ ID NO: 875109 - DNA, 22 bp, Artificial Sequence
  chemically synthesized
ctcaggaggctgaggtgggagg

SEQ ID NO: 875110 - DNA, 22 bp, Artificial Sequence
  chemically synthesized
cctaggcaatcctcccacctca

SEQ ID NO: 875111 - DNA, 22 bp, Artificial Sequence
  chemically synthesized
ctaggcaatcctcccacctcag

SEQ ID NO: 875112 - DNA, 22 bp, Artificial Sequence
  chemically synthesized
ggcaatcctcccacctcagcct

SEQ ID NO: 875113 - DNA, 22 bp, Artificial Sequence
  chemically synthesized
agtagctactcaggaggctgag

SEQ ID NO: 875114 - DNA, 22 bp, Artificial Sequence
  chemically synthesized
ccacctcagcctcctgagtagc

SEQ ID NO: 875115 - DNA, 22 bp, Artificial Sequence
  chemically synthesized
agtagtagtactgagtagctac

SEQ ID NO: 875116 - DNA, 22 bp, Artificial Sequence
  chemically synthesized
agcctcctgagtagctactcag

SEQ ID NO: 875117 - DNA, 22 bp, Artificial Sequence
  chemically synthesized
ctcagtagtagtactgagtagc

SEQ ID NO: 875118 - DNA, 22 bp, Artificial Sequence
  chemically synthesized
ctgagtagctactcagtactac

SEQ ID NO: 875119 - DNA, 22 bp, Artificial Sequence
  chemically synthesized
agtagctactcagtactactac

SEQ ID NO: 875120 - DNA, 22 bp, Artificial Sequence
  chemically synthesized
agtagtactactcagtagtagt

SEQ ID NO: 875121 - DNA, 22 bp, Artificial Sequence
  chemically synthesized
ctcagtactactactgagtagt

SEQ ID NO: 875122 - DNA, 22 bp, Artificial Sequence
  chemically synthesized
agtactactactgagtagtact

SEQ ID NO: 875123 - DNA, 22 bp, Artificial Sequence
  chemically synthesized
ctactgagtagtactactgagt

SEQ ID NO: 875124 - DNA, 22 bp, Artificial Sequence
  chemically synthesized
ctgagtagtactactgagtaca

SEQ ID NO: 875125 - DNA, 22 bp, Artificial Sequence
  chemically synthesized
cataaaaatgtatgtactcagt

SEQ ID NO: 875126 - DNA, 22 bp, Artificial Sequence
  chemically synthesized
tacataaaaatgtatgtactca

SEQ ID NO: 875127 - DNA, 22 bp, Artificial Sequence
  chemically synthesized
agtagtactactgagtacatac

SEQ ID NO: 875128 - DNA, 22 bp, Artificial Sequence
  chemically synthesized
ctgagtacatacatttttatgt

SEQ ID NO: 875129 - DNA, 22 bp, Artificial Sequence
  chemically synthesized
agtacatacatttttatgtaga

SEQ ID NO: 875130 - DNA, 22 bp, Artificial Sequence
  chemically synthesized
ggcaacatggcaaaaccccgtc

SEQ ID NO: 875131 - DNA, 22 bp, Artificial Sequence
  chemically synthesized
ttatgtagagacggggttttgc

SEQ ID NO: 875132 - DNA, 22 bp, Artificial Sequence
  chemically synthesized
tatgtagagacggggttttgcc

SEQ ID NO: 875133 - DNA, 22 bp, Artificial Sequence
  chemically synthesized
atgtagagacggggttttgcca

SEQ ID NO: 875134 - DNA, 22 bp, Artificial Sequence
  chemically synthesized
tgtagagacggggttttgccat

SEQ ID NO: 875135 - DNA, 22 bp, Artificial Sequence
  chemically synthesized
agaccagcctgggcaacatggc

SEQ ID NO: 875136 - DNA, 22 bp, Artificial Sequence
  chemically synthesized
gagaccagcctgggcaacatgg

SEQ ID NO: 875137 - DNA, 22 bp, Artificial Sequence
  chemically synthesized
tgccatgttgcccaggctggtc

SEQ ID NO: 875138 - DNA, 22 bp, Artificial Sequence
  chemically synthesized
gccatgttgcccaggctggtct

SEQ ID NO: 875139 - DNA, 22 bp, Artificial Sequence
  chemically synthesized
ccatgttgcccaggctggtctc

SEQ ID NO: 875140 - DNA, 22 bp, Artificial Sequence
  chemically synthesized
gagtccaggagtttgagaccag

SEQ ID NO: 875141 - DNA, 22 bp, Artificial Sequence
  chemically synthesized
cccaggctggtctcaaactcct

SEQ ID NO: 875142 - DNA, 22 bp, Artificial Sequence
  chemically synthesized
gtctcaaactcctggactccag

SEQ ID NO: 875143 - DNA, 22 bp, Artificial Sequence
  chemically synthesized
ggatgggcagatcactggagtc

SEQ ID NO: 875144 - DNA, 22 bp, Artificial Sequence
  chemically synthesized
aaactcctggactccagtgatc

SEQ ID NO: 875145 - DNA, 22 bp, Artificial Sequence
  chemically synthesized
ggaggctgggatgggcagatca

SEQ ID NO: 875146 - DNA, 22 bp, Artificial Sequence
  chemically synthesized
ctggactccagtgatctgccca

SEQ ID NO: 875147 - DNA, 22 bp, Artificial Sequence
  chemically synthesized
gggaggctgggatgggcagatc

SEQ ID NO: 875148 - DNA, 22 bp, Artificial Sequence
  chemically synthesized
tgggaggctgggatgggcagat

SEQ ID NO: 875149 - DNA, 22 bp, Artificial Sequence
  chemically synthesized
gactccagtgatctgcccatcc

SEQ ID NO: 875150 - DNA, 22 bp, Artificial Sequence
  chemically synthesized
cagtgatctgcccatcccagcc

SEQ ID NO: 875151 - DNA, 22 bp, Artificial Sequence
  chemically synthesized
cagcgctttgggaggctgggat

SEQ ID NO: 875152 - DNA, 22 bp, Artificial Sequence
  chemically synthesized
taattccagcgctttgggaggc

SEQ ID NO: 875153 - DNA, 22 bp, Artificial Sequence
  chemically synthesized
cccatcccagcctcccaaagcg

SEQ ID NO: 875154 - DNA, 22 bp, Artificial Sequence
  chemically synthesized
acacctgtaattccagcgcttt

SEQ ID NO: 875155 - DNA, 22 bp, Artificial Sequence
  chemically synthesized
ccaaagcgctggaattacaggt

SEQ ID NO: 875156 - DNA, 22 bp, Artificial Sequence
  chemically synthesized
ggtgtggtggctcacacctgta

SEQ ID NO: 875157 - DNA, 22 bp, Artificial Sequence
  chemically synthesized
gaattacaggtgtgagccacca

SEQ ID NO: 875158 - DNA, 22 bp, Artificial Sequence
  chemically synthesized
ataaggctgggtgtggtggctc

SEQ ID NO: 875159 - DNA, 22 bp, Artificial Sequence
  chemically synthesized
caggtgtgagccaccacaccca

SEQ ID NO: 875160 - DNA, 22 bp, Artificial Sequence
  chemically synthesized
taaaagcctaataaggctgggt

SEQ ID NO: 875161 - DNA, 22 bp, Artificial Sequence
  chemically synthesized
ataaaagcctaataaggctggg

SEQ ID NO: 875162 - DNA, 22 bp, Artificial Sequence
  chemically synthesized
aggatttataaaagcctaataa

SEQ ID NO: 875163 - DNA, 22 bp, Artificial Sequence
  chemically synthesized
gttcaggatttataaaagccta

SEQ ID NO: 875164 - DNA, 22 bp, Artificial Sequence
  chemically synthesized
ggttcaggatttataaaagcct

SEQ ID NO: 875165 - DNA, 22 bp, Artificial Sequence
  chemically synthesized
attaggcttttataaatcctga

SEQ ID NO: 875166 - DNA, 22 bp, Artificial Sequence
  chemically synthesized
ttaggcttttataaatcctgaa

SEQ ID NO: 875167 - DNA, 22 bp, Artificial Sequence
  chemically synthesized
aatacagtttggttcaggattt

SEQ ID NO: 875168 - DNA, 22 bp, Artificial Sequence
  chemically synthesized
aaatacagtttggttcaggatt

SEQ ID NO: 875169 - DNA, 22 bp, Artificial Sequence
  chemically synthesized
taaatacagtttggttcaggat

SEQ ID NO: 875170 - DNA, 22 bp, Artificial Sequence
  chemically synthesized
ggcttttataaatcctgaacca

SEQ ID NO: 875171 - DNA, 22 bp, Artificial Sequence
  chemically synthesized
ttaaatacagtttggttcagga

SEQ ID NO: 875172 - DNA, 22 bp, Artificial Sequence
  chemically synthesized
tttaaatacagtttggttcagg

SEQ ID NO: 875173 - DNA, 22 bp, Artificial Sequence
  chemically synthesized
ctttttaaatacagtttggttc

SEQ ID NO: 875174 - DNA, 22 bp, Artificial Sequence
  chemically synthesized
ttataaatcctgaaccaaactg

SEQ ID NO: 875175 - DNA, 22 bp, Artificial Sequence
  chemically synthesized
tataaatcctgaaccaaactgt

SEQ ID NO: 875176 - DNA, 22 bp, Artificial Sequence
  chemically synthesized
ataaatcctgaaccaaactgta

SEQ ID NO: 875177 - DNA, 22 bp, Artificial Sequence
  chemically synthesized
taaatcctgaaccaaactgtat

SEQ ID NO: 875178 - DNA, 22 bp, Artificial Sequence
  chemically synthesized
tgagattactttttaaatacag

SEQ ID NO: 875179 - DNA, 22 bp, Artificial Sequence
  chemically synthesized
aaccaaactgtatttaaaaagt

SEQ ID NO: 875180 - DNA, 22 bp, Artificial Sequence
  chemically synthesized
gtctatgagattactttttaaa

SEQ ID NO: 875181 - DNA, 22 bp, Artificial Sequence
  chemically synthesized
tgaccctagtctatgagattac

SEQ ID NO: 875182 - DNA, 22 bp, Artificial Sequence
  chemically synthesized
gtgaccctagtctatgagatta

SEQ ID NO: 875183 - DNA, 22 bp, Artificial Sequence
  chemically synthesized
tatttaaaaagtaatctcatag

SEQ ID NO: 875184 - DNA, 22 bp, Artificial Sequence
  chemically synthesized
aatttgtgaccctagtctatga

SEQ ID NO: 875185 - DNA, 22 bp, Artificial Sequence
  chemically synthesized
aaaaagtaatctcatagactag

SEQ ID NO: 875186 - DNA, 22 bp, Artificial Sequence
  chemically synthesized
aaaagtaatctcatagactagg

SEQ ID NO: 875187 - DNA, 22 bp, Artificial Sequence
  chemically synthesized
tagggacctgaatttgtgaccc

SEQ ID NO: 875188 - DNA, 22 bp, Artificial Sequence
  chemically synthesized
atagactagggtcacaaattca

SEQ ID NO: 875189 - DNA, 22 bp, Artificial Sequence
  chemically synthesized
gtccctatagggacctgaattt

SEQ ID NO: 875190 - DNA, 22 bp, Artificial Sequence
  chemically synthesized
gggtcacaaattcaggtcccta

SEQ ID NO: 875191 - DNA, 22 bp, Artificial Sequence
  chemically synthesized
caacctagtccctatagggacc

SEQ ID NO: 875192 - DNA, 22 bp, Artificial Sequence
  chemically synthesized
ttacaacctagtccctataggg

SEQ ID NO: 875193 - DNA, 22 bp, Artificial Sequence
  chemically synthesized
gttacaacctagtccctatagg

SEQ ID NO: 875194 - DNA, 22 bp, Artificial Sequence
  chemically synthesized
tgttacaacctagtccctatag

SEQ ID NO: 875195 - DNA, 22 bp, Artificial Sequence
  chemically synthesized
cctttgttacaacctagtccct

SEQ ID NO: 875196 - DNA, 22 bp, Artificial Sequence
  chemically synthesized
ccctttgttacaacctagtccc

SEQ ID NO: 875197 - DNA, 22 bp, Artificial Sequence
  chemically synthesized
aggtccctatagggactaggtt

SEQ ID NO: 875198 - DNA, 22 bp, Artificial Sequence
  chemically synthesized
ttccctttgttacaacctagtc

SEQ ID NO: 875199 - DNA, 22 bp, Artificial Sequence
  chemically synthesized
ttcttccctttgttacaaccta

SEQ ID NO: 875200 - DNA, 22 bp, Artificial Sequence
  chemically synthesized
attcttccctttgttacaacct

SEQ ID NO: 875201 - DNA, 22 bp, Artificial Sequence
  chemically synthesized
tagggactaggttgtaacaaag

SEQ ID NO: 875202 - DNA, 22 bp, Artificial Sequence
  chemically synthesized
gacaaggcttattcttcccttt

SEQ ID NO: 875203 - DNA, 22 bp, Artificial Sequence
  chemically synthesized
agacaaggcttattcttccctt

SEQ ID NO: 875204 - DNA, 22 bp, Artificial Sequence
  chemically synthesized
ggttgtaacaaagggaagaata

SEQ ID NO: 875205 - DNA, 22 bp, Artificial Sequence
  chemically synthesized
atttagacaaggcttattcttc

SEQ ID NO: 875206 - DNA, 22 bp, Artificial Sequence
  chemically synthesized
tgatttagacaaggcttattct

SEQ ID NO: 875207 - DNA, 22 bp, Artificial Sequence
  chemically synthesized
taacaaagggaagaataagcct

SEQ ID NO: 875208 - DNA, 22 bp, Artificial Sequence
  chemically synthesized
tctgatttagacaaggcttatt

SEQ ID NO: 875209 - DNA, 22 bp, Artificial Sequence
  chemically synthesized
tagctctctgatttagacaagg

SEQ ID NO: 875210 - DNA, 22 bp, Artificial Sequence
  chemically synthesized
aagttatagctctctgatttag

SEQ ID NO: 875211 - DNA, 22 bp, Artificial Sequence
  chemically synthesized
gtctaaatcagagagctataac

SEQ ID NO: 875212 - DNA, 22 bp, Artificial Sequence
  chemically synthesized
tctaaatcagagagctataact

SEQ ID NO: 875213 - DNA, 22 bp, Artificial Sequence
  chemically synthesized
aatcagagagctataacttcag

SEQ ID NO: 875214 - DNA, 22 bp, Artificial Sequence
  chemically synthesized
gcagtcagcagccacatctgaa

SEQ ID NO: 875215 - DNA, 22 bp, Artificial Sequence
  chemically synthesized
ttggcagtcagcagccacatct

SEQ ID NO: 875216 - DNA, 22 bp, Artificial Sequence
  chemically synthesized
tgttggcagtcagcagccacat

SEQ ID NO: 875217 - DNA, 22 bp, Artificial Sequence
  chemically synthesized
ctgttggcagtcagcagccaca

SEQ ID NO: 875218 - DNA, 22 bp, Artificial Sequence
  chemically synthesized
tctgttggcagtcagcagccac

SEQ ID NO: 875219 - DNA, 22 bp, Artificial Sequence
  chemically synthesized
taacttcagatgtggctgctga

SEQ ID NO: 875220 - DNA, 22 bp, Artificial Sequence
  chemically synthesized
cagatgtggctgctgactgcca

SEQ ID NO: 875221 - DNA, 22 bp, Artificial Sequence
  chemically synthesized
agatgtggctgctgactgccaa

SEQ ID NO: 875222 - DNA, 22 bp, Artificial Sequence
  chemically synthesized
tgcccacctttctgttggcagt

SEQ ID NO: 875223 - DNA, 22 bp, Artificial Sequence
  chemically synthesized
atgcccacctttctgttggcag

SEQ ID NO: 875224 - DNA, 22 bp, Artificial Sequence
  chemically synthesized
acttatgcccacctttctgttg

SEQ ID NO: 875225 - DNA, 22 bp, Artificial Sequence
  chemically synthesized
aacttatgcccacctttctgtt

SEQ ID NO: 875226 - DNA, 22 bp, Artificial Sequence
  chemically synthesized
taacttatgcccacctttctgt

SEQ ID NO: 875227 - DNA, 22 bp, Artificial Sequence
  chemically synthesized
ttaacttatgcccacctttctg

SEQ ID NO: 875228 - DNA, 22 bp, Artificial Sequence
  chemically synthesized
ctgactgccaacagaaaggtgg

SEQ ID NO: 875229 - DNA, 22 bp, Artificial Sequence
  chemically synthesized
tttaacttatgcccacctttct

SEQ ID NO: 875230 - DNA, 22 bp, Artificial Sequence
  chemically synthesized
actgccaacagaaaggtgggca

SEQ ID NO: 875231 - DNA, 22 bp, Artificial Sequence
  chemically synthesized
ctttttaacttatgcccacctt

SEQ ID NO: 875232 - DNA, 22 bp, Artificial Sequence
  chemically synthesized
gctttttaacttatgcccacct

SEQ ID NO: 875233 - DNA, 22 bp, Artificial Sequence
  chemically synthesized
tgctttttaacttatgcccacc

SEQ ID NO: 875234 - DNA, 22 bp, Artificial Sequence
  chemically synthesized
ccaacagaaaggtgggcataag

SEQ ID NO: 875235 - DNA, 22 bp, Artificial Sequence
  chemically synthesized
tgttttgctttttaacttatgc

SEQ ID NO: 875236 - DNA, 22 bp, Artificial Sequence
  chemically synthesized
tgtgttttgctttttaacttat

SEQ ID NO: 875237 - DNA, 22 bp, Artificial Sequence
  chemically synthesized
ctgtgttttgctttttaactta

SEQ ID NO: 875238 - DNA, 22 bp, Artificial Sequence
  chemically synthesized
tctgtgttttgctttttaactt

SEQ ID NO: 875239 - DNA, 22 bp, Artificial Sequence
  chemically synthesized
ttctgtgttttgctttttaact

SEQ ID NO: 875240 - DNA, 22 bp, Artificial Sequence
  chemically synthesized
tttttctgtgttttgcttttta

SEQ ID NO: 875241 - DNA, 22 bp, Artificial Sequence
  chemically synthesized
gtttttctgtgttttgcttttt

SEQ ID NO: 875242 - DNA, 22 bp, Artificial Sequence
  chemically synthesized
tttgtttttctgtgttttgctt

SEQ ID NO: 875243 - DNA, 22 bp, Artificial Sequence
  chemically synthesized
gtttgtttttctgtgttttgct

SEQ ID NO: 875244 - DNA, 22 bp, Artificial Sequence
  chemically synthesized
tgtttgtttttctgtgttttgc

SEQ ID NO: 875245 - DNA, 22 bp, Artificial Sequence
  chemically synthesized
ttgtttgtttttctgtgttttg

SEQ ID NO: 875246 - DNA, 22 bp, Artificial Sequence
  chemically synthesized
tttgtttgtttttctgtgtttt

SEQ ID NO: 875247 - DNA, 22 bp, Artificial Sequence
  chemically synthesized
aaaagcaaaacacagaaaaaca

SEQ ID NO: 875248 - DNA, 22 bp, Artificial Sequence
  chemically synthesized
gtgagggaatatgatcagcagg

SEQ ID NO: 875249 - DNA, 22 bp, Artificial Sequence
  chemically synthesized
cggtatacactggtgagggaat

SEQ ID NO: 875250 - DNA, 22 bp, Artificial Sequence
  chemically synthesized
tccggtatacactggtgaggga

SEQ ID NO: 875251 - DNA, 22 bp, Artificial Sequence
  chemically synthesized
ctccggtatacactggtgaggg

SEQ ID NO: 875252 - DNA, 22 bp, Artificial Sequence
  chemically synthesized
ctgatcatattccctcaccagt

SEQ ID NO: 875253 - DNA, 22 bp, Artificial Sequence
  chemically synthesized
atcatattccctcaccagtgta

SEQ ID NO: 875254 - DNA, 22 bp, Artificial Sequence
  chemically synthesized
cctcaccagtgtataccggaga

SEQ ID NO: 875255 - DNA, 22 bp, Artificial Sequence
  chemically synthesized
accagtgtataccggagaagtt

SEQ ID NO: 875256 - DNA, 22 bp, Artificial Sequence
  chemically synthesized
agaatgtgagagaaacttctcc

SEQ ID NO: 875257 - DNA, 22 bp, Artificial Sequence
  chemically synthesized
aagaatgtgagagaaacttctc

SEQ ID NO: 875258 - DNA, 22 bp, Artificial Sequence
  chemically synthesized
tgaccttaagaatgtgagagaa

SEQ ID NO: 875259 - DNA, 22 bp, Artificial Sequence
  chemically synthesized
atgaccttaagaatgtgagaga

SEQ ID NO: 875260 - DNA, 22 bp, Artificial Sequence
  chemically synthesized
cttatgaccttaagaatgtgag

SEQ ID NO: 875261 - DNA, 22 bp, Artificial Sequence
  chemically synthesized
ccttatgaccttaagaatgtga

SEQ ID NO: 875262 - DNA, 22 bp, Artificial Sequence
  chemically synthesized
tacttccttatgaccttaagaa

SEQ ID NO: 875263 - DNA, 22 bp, Artificial Sequence
  chemically synthesized
gtacttccttatgaccttaaga

SEQ ID NO: 875264 - DNA, 22 bp, Artificial Sequence
  chemically synthesized
ttgtacttccttatgaccttaa

SEQ ID NO: 875265 - DNA, 22 bp, Artificial Sequence
  chemically synthesized
ctctcacattcttaaggtcata

SEQ ID NO: 875266 - DNA, 22 bp, Artificial Sequence
  chemically synthesized
cttgtacttccttatgacctta

SEQ ID NO: 875267 - DNA, 22 bp, Artificial Sequence
  chemically synthesized
tctcacattcttaaggtcataa

SEQ ID NO: 875268 - DNA, 22 bp, Artificial Sequence
  chemically synthesized
tcttgtacttccttatgacctt

SEQ ID NO: 875269 - DNA, 22 bp, Artificial Sequence
  chemically synthesized
tcacattcttaaggtcataagg

SEQ ID NO: 875270 - DNA, 22 bp, Artificial Sequence
  chemically synthesized
acattcttaaggtcataaggaa

SEQ ID NO: 875271 - DNA, 22 bp, Artificial Sequence
  chemically synthesized
ttaaggtcataaggaagtacaa

SEQ ID NO: 875272 - DNA, 22 bp, Artificial Sequence
  chemically synthesized
aaggtcataaggaagtacaaga

SEQ ID NO: 875273 - DNA, 22 bp, Artificial Sequence
  chemically synthesized
aggtcataaggaagtacaagaa

SEQ ID NO: 875274 - DNA, 22 bp, Artificial Sequence
  chemically synthesized
cccacaatgcagcaacaaactt

SEQ ID NO: 875275 - DNA, 22 bp, Artificial Sequence
  chemically synthesized
aattccccacaatgcagcaaca

SEQ ID NO: 875276 - DNA, 22 bp, Artificial Sequence
  chemically synthesized
gcctcaattccccacaatgcag

SEQ ID NO: 875277 - DNA, 22 bp, Artificial Sequence
  chemically synthesized
gttgctgcattgtggggaattg

SEQ ID NO: 875278 - DNA, 22 bp, Artificial Sequence
  chemically synthesized
ttgctgcattgtggggaattga

SEQ ID NO: 875279 - DNA, 22 bp, Artificial Sequence
  chemically synthesized
ctgcattgtggggaattgaggc

SEQ ID NO: 875280 - DNA, 22 bp, Artificial Sequence
  chemically synthesized
cattgtggggaattgaggccaa

SEQ ID NO: 875281 - DNA, 22 bp, Artificial Sequence
  chemically synthesized
acatacatacccatgttggcct

SEQ ID NO: 875282 - DNA, 22 bp, Artificial Sequence
  chemically synthesized
cacatacatacccatgttggcc

SEQ ID NO: 875283 - DNA, 22 bp, Artificial Sequence
  chemically synthesized
tggggaattgaggccaacatgg

SEQ ID NO: 875284 - DNA, 22 bp, Artificial Sequence
  chemically synthesized
tcacatacatacccatgttggc

SEQ ID NO: 875285 - DNA, 22 bp, Artificial Sequence
  chemically synthesized
tttcacatacatacccatgttg

SEQ ID NO: 875286 - DNA, 22 bp, Artificial Sequence
  chemically synthesized
ctttcacatacatacccatgtt

SEQ ID NO: 875287 - DNA, 22 bp, Artificial Sequence
  chemically synthesized
aggccaacatgggtatgtatgt

SEQ ID NO: 875288 - DNA, 22 bp, Artificial Sequence
  chemically synthesized
tccatttctttcacatacatac

SEQ ID NO: 875289 - DNA, 22 bp, Artificial Sequence
  chemically synthesized
atccatttctttcacatacata

SEQ ID NO: 875290 - DNA, 22 bp, Artificial Sequence
  chemically synthesized
catatacccttatccatttctt

SEQ ID NO: 875291 - DNA, 22 bp, Artificial Sequence
  chemically synthesized
tacatatacccttatccatttc

SEQ ID NO: 875292 - DNA, 22 bp, Artificial Sequence
  chemically synthesized
ctctacatatacccttatccat

SEQ ID NO: 875293 - DNA, 22 bp, Artificial Sequence
  chemically synthesized
aaaaaaaaaaagaaaaaaatcc

SEQ ID NO: 875294 - DNA, 22 bp, Artificial Sequence
  chemically synthesized
catctaaaaaaaaaaaagaaaa

SEQ ID NO: 875295 - DNA, 22 bp, Artificial Sequence
  chemically synthesized
ttttcttttttttttttagatg

SEQ ID NO: 875296 - DNA, 22 bp, Artificial Sequence
  chemically synthesized
tttcttttttttttttagatgg

SEQ ID NO: 875297 - DNA, 22 bp, Artificial Sequence
  chemically synthesized
ttcttttttttttttagatgga

SEQ ID NO: 875298 - DNA, 22 bp, Artificial Sequence
  chemically synthesized
tcttttttttttttagatggag

SEQ ID NO: 875299 - DNA, 22 bp, Artificial Sequence
  chemically synthesized
cttttttttttttagatggagt

SEQ ID NO: 875300 - DNA, 22 bp, Artificial Sequence
  chemically synthesized
ttttttttttttagatggagtt

SEQ ID NO: 875301 - DNA, 22 bp, Artificial Sequence
  chemically synthesized
ttttttttttagatggagtttc

SEQ ID NO: 875302 - DNA, 22 bp, Artificial Sequence
  chemically synthesized
tttttttttagatggagtttca

SEQ ID NO: 875303 - DNA, 22 bp, Artificial Sequence
  chemically synthesized
ttttttttagatggagtttcac

SEQ ID NO: 875304 - DNA, 22 bp, Artificial Sequence
  chemically synthesized
tttttttagatggagtttcact

SEQ ID NO: 875305 - DNA, 22 bp, Artificial Sequence
  chemically synthesized
ttttttagatggagtttcactg

SEQ ID NO: 875306 - DNA, 22 bp, Artificial Sequence
  chemically synthesized
tttttagatggagtttcactgt

SEQ ID NO: 875307 - DNA, 22 bp, Artificial Sequence
  chemically synthesized
ttttagatggagtttcactgtt

SEQ ID NO: 875308 - DNA, 22 bp, Artificial Sequence
  chemically synthesized
tttagatggagtttcactgttg

SEQ ID NO: 875309 - DNA, 22 bp, Artificial Sequence
  chemically synthesized
cagccagggcaacaacagtgaa

SEQ ID NO: 875310 - DNA, 22 bp, Artificial Sequence
  chemically synthesized
ttagatggagtttcactgttgt

SEQ ID NO: 875311 - DNA, 22 bp, Artificial Sequence
  chemically synthesized
tagatggagtttcactgttgtt

SEQ ID NO: 875312 - DNA, 22 bp, Artificial Sequence
  chemically synthesized
agatggagtttcactgttgttg

SEQ ID NO: 875313 - DNA, 22 bp, Artificial Sequence
  chemically synthesized
gatggagtttcactgttgttgc

SEQ ID NO: 875314 - DNA, 22 bp, Artificial Sequence
  chemically synthesized
cattccagccagggcaacaaca

SEQ ID NO: 875315 - DNA, 22 bp, Artificial Sequence
  chemically synthesized
accactgcattccagccagggc

SEQ ID NO: 875316 - DNA, 22 bp, Artificial Sequence
  chemically synthesized
cactgttgttgccctggctgga

SEQ ID NO: 875317 - DNA, 22 bp, Artificial Sequence
  chemically synthesized
actgttgttgccctggctggaa

SEQ ID NO: 875318 - DNA, 22 bp, Artificial Sequence
  chemically synthesized
ttgttgccctggctggaatgca

SEQ ID NO: 875319 - DNA, 22 bp, Artificial Sequence
  chemically synthesized
ttgccctggctggaatgcagtg

SEQ ID NO: 875320 - DNA, 22 bp, Artificial Sequence
  chemically synthesized
ccctggctggaatgcagtggtg

SEQ ID NO: 875321 - DNA, 22 bp, Artificial Sequence
  chemically synthesized
cagtgagccaagatctcaccac

SEQ ID NO: 875322 - DNA, 22 bp, Artificial Sequence
  chemically synthesized
gctggaatgcagtggtgagatc

SEQ ID NO: 875323 - DNA, 22 bp, Artificial Sequence
  chemically synthesized
gaatgcagtggtgagatcttgg

SEQ ID NO: 875324 - DNA, 22 bp, Artificial Sequence
  chemically synthesized
aacccaggaggcaaaggttgca

SEQ ID NO: 875325 - DNA, 22 bp, Artificial Sequence
  chemically synthesized
gaacccaggaggcaaaggttgc

SEQ ID NO: 875326 - DNA, 22 bp, Artificial Sequence
  chemically synthesized
ggctcactgcaacctttgcctc

SEQ ID NO: 875327 - DNA, 22 bp, Artificial Sequence
  chemically synthesized
gctcactgcaacctttgcctcc

SEQ ID NO: 875328 - DNA, 22 bp, Artificial Sequence
  chemically synthesized
actgcaacctttgcctcctggg

SEQ ID NO: 875329 - DNA, 22 bp, Artificial Sequence
  chemically synthesized
caacctttgcctcctgggttca

SEQ ID NO: 875330 - DNA, 22 bp, Artificial Sequence
  chemically synthesized
aggcaggagaatcacttgaacc

SEQ ID NO: 875331 - DNA, 22 bp, Artificial Sequence
  chemically synthesized
tgcctcctgggttcaagtgatt

SEQ ID NO: 875332 - DNA, 22 bp, Artificial Sequence
  chemically synthesized
gcctcctgggttcaagtgattc

SEQ ID NO: 875333 - DNA, 22 bp, Artificial Sequence
  chemically synthesized
cctcctgggttcaagtgattct

SEQ ID NO: 875334 - DNA, 22 bp, Artificial Sequence
  chemically synthesized
ctgggttcaagtgattctcctg

SEQ ID NO: 875335 - DNA, 22 bp, Artificial Sequence
  chemically synthesized
ccgggaggctgaggcaggagaa

SEQ ID NO: 875336 - DNA, 22 bp, Artificial Sequence
  chemically synthesized
ggttcaagtgattctcctgcct

SEQ ID NO: 875337 - DNA, 22 bp, Artificial Sequence
  chemically synthesized
aagtgattctcctgcctcagcc

SEQ ID NO: 875338 - DNA, 22 bp, Artificial Sequence
  chemically synthesized
taatcccagctaccgggaggct

SEQ ID NO: 875339 - DNA, 22 bp, Artificial Sequence
  chemically synthesized
tcctgcctcagcctcccggtag

SEQ ID NO: 875340 - DNA, 22 bp, Artificial Sequence
  chemically synthesized
ctgcctcagcctcccggtagct

SEQ ID NO: 875341 - DNA, 22 bp, Artificial Sequence
  chemically synthesized
cctcagcctcccggtagctggg

SEQ ID NO: 875342 - DNA, 22 bp, Artificial Sequence
  chemically synthesized
agcctcccggtagctgggatta

SEQ ID NO: 875343 - DNA, 22 bp, Artificial Sequence
  chemically synthesized
ccggtagctgggattacaggct

SEQ ID NO: 875344 - DNA, 22 bp, Artificial Sequence
  chemically synthesized
cccgggtgtggtggtgcgagcc

SEQ ID NO: 875345 - DNA, 22 bp, Artificial Sequence
  chemically synthesized
ggattacaggctcgcaccacca

SEQ ID NO: 875346 - DNA, 22 bp, Artificial Sequence
  chemically synthesized
caggctcgcaccaccacacccg

SEQ ID NO: 875347 - DNA, 22 bp, Artificial Sequence
  chemically synthesized
gcaccaccacacccgggtaatt

SEQ ID NO: 875348 - DNA, 22 bp, Artificial Sequence
  chemically synthesized
gccaacatggtgaaatacaaaa

SEQ ID NO: 875349 - DNA, 22 bp, Artificial Sequence
  chemically synthesized
ttgtattttgtatttcaccatg

SEQ ID NO: 875350 - DNA, 22 bp, Artificial Sequence
  chemically synthesized
tgtattttgtatttcaccatgt

SEQ ID NO: 875351 - DNA, 22 bp, Artificial Sequence
  chemically synthesized
gtattttgtatttcaccatgtt

SEQ ID NO: 875352 - DNA, 22 bp, Artificial Sequence
  chemically synthesized
tattttgtatttcaccatgttg

SEQ ID NO: 875353 - DNA, 22 bp, Artificial Sequence
  chemically synthesized
aaggcagcctggccaacatggt

SEQ ID NO: 875354 - DNA, 22 bp, Artificial Sequence
  chemically synthesized
tgtatttcaccatgttggccag

SEQ ID NO: 875355 - DNA, 22 bp, Artificial Sequence
  chemically synthesized
gtatttcaccatgttggccagg

SEQ ID NO: 875356 - DNA, 22 bp, Artificial Sequence
  chemically synthesized
tatttcaccatgttggccaggc

SEQ ID NO: 875357 - DNA, 22 bp, Artificial Sequence
  chemically synthesized
caccatgttggccaggctgcct

SEQ ID NO: 875358 - DNA, 22 bp, Artificial Sequence
  chemically synthesized
accatgttggccaggctgcctt

SEQ ID NO: 875359 - DNA, 22 bp, Artificial Sequence
  chemically synthesized
aggtcaggagttcaaggcagcc

SEQ ID NO: 875360 - DNA, 22 bp, Artificial Sequence
  chemically synthesized
gccaggctgccttgaactcctg

SEQ ID NO: 875361 - DNA, 22 bp, Artificial Sequence
  chemically synthesized
ccttgaactcctgacctcagat

SEQ ID NO: 875362 - DNA, 22 bp, Artificial Sequence
  chemically synthesized
gaactcctgacctcagatgatc

SEQ ID NO: 875363 - DNA, 22 bp, Artificial Sequence
  chemically synthesized
aactcctgacctcagatgatct

SEQ ID NO: 875364 - DNA, 22 bp, Artificial Sequence
  chemically synthesized
ggaggccaagatgggcagatca

SEQ ID NO: 875365 - DNA, 22 bp, Artificial Sequence
  chemically synthesized
ctgacctcagatgatctgccca

SEQ ID NO: 875366 - DNA, 22 bp, Artificial Sequence
  chemically synthesized
acctcagatgatctgcccatct

SEQ ID NO: 875367 - DNA, 22 bp, Artificial Sequence
  chemically synthesized
agatgatctgcccatcttggcc

SEQ ID NO: 875368 - DNA, 22 bp, Artificial Sequence
  chemically synthesized
caatcccagcacattgggaggc

SEQ ID NO: 875369 - DNA, 22 bp, Artificial Sequence
  chemically synthesized
cccatcttggcctcccaatgtg

SEQ ID NO: 875370 - DNA, 22 bp, Artificial Sequence
  chemically synthesized
atgcctgcaatcccagcacatt

SEQ ID NO: 875371 - DNA, 22 bp, Artificial Sequence
  chemically synthesized
ggcctcccaatgtgctgggatt

SEQ ID NO: 875372 - DNA, 22 bp, Artificial Sequence
  chemically synthesized
gcctcccaatgtgctgggattg

SEQ ID NO: 875373 - DNA, 22 bp, Artificial Sequence
  chemically synthesized
ccaatgtgctgggattgcaggc

SEQ ID NO: 875374 - DNA, 22 bp, Artificial Sequence
  chemically synthesized
ggattgcaggcatgagccactg

SEQ ID NO: 875375 - DNA, 22 bp, Artificial Sequence
  chemically synthesized
caggcatgagccactgcgcccg

SEQ ID NO: 875376 - DNA, 22 bp, Artificial Sequence
  chemically synthesized
aagatccacccatggccgggcg

SEQ ID NO: 875377 - DNA, 22 bp, Artificial Sequence
  chemically synthesized
aaagatccacccatggccgggc

SEQ ID NO: 875378 - DNA, 22 bp, Artificial Sequence
  chemically synthesized
taaagatccacccatggccggg

SEQ ID NO: 875379 - DNA, 22 bp, Artificial Sequence
  chemically synthesized
tgttttaaagatccacccatgg

SEQ ID NO: 875380 - DNA, 22 bp, Artificial Sequence
  chemically synthesized
cgcccggccatgggtggatctt

SEQ ID NO: 875381 - DNA, 22 bp, Artificial Sequence
  chemically synthesized
ataattgtgttttaaagatcca

SEQ ID NO: 875382 - DNA, 22 bp, Artificial Sequence
  chemically synthesized
acattcataattgtgttttaaa

SEQ ID NO: 875383 - DNA, 22 bp, Artificial Sequence
  chemically synthesized
taacattcataattgtgtttta

SEQ ID NO: 875384 - DNA, 22 bp, Artificial Sequence
  chemically synthesized
ctaacattcataattgtgtttt

SEQ ID NO: 875385 - DNA, 22 bp, Artificial Sequence
  chemically synthesized
tctaacattcataattgtgttt

SEQ ID NO: 875386 - DNA, 22 bp, Artificial Sequence
  chemically synthesized
ttctaacattcataattgtgtt

SEQ ID NO: 875387 - DNA, 22 bp, Artificial Sequence
  chemically synthesized
gcttttctaacattcataattg

SEQ ID NO: 875388 - DNA, 22 bp, Artificial Sequence
  chemically synthesized
agcttttctaacattcataatt

SEQ ID NO: 875389 - DNA, 22 bp, Artificial Sequence
  chemically synthesized
ttagcttttctaacattcataa

SEQ ID NO: 875390 - DNA, 22 bp, Artificial Sequence
  chemically synthesized
cttagcttttctaacattcata

SEQ ID NO: 875391 - DNA, 22 bp, Artificial Sequence
  chemically synthesized
taaaacacaattatgaatgtta

SEQ ID NO: 875392 - DNA, 22 bp, Artificial Sequence
  chemically synthesized
aaaacacaattatgaatgttag

SEQ ID NO: 875393 - DNA, 22 bp, Artificial Sequence
  chemically synthesized
aaacacaattatgaatgttaga

SEQ ID NO: 875394 - DNA, 22 bp, Artificial Sequence
  chemically synthesized
tttcttagcttttctaacattc

SEQ ID NO: 875395 - DNA, 22 bp, Artificial Sequence
  chemically synthesized
gtttcttagcttttctaacatt

SEQ ID NO: 875396 - DNA, 22 bp, Artificial Sequence
  chemically synthesized
taaatcttgtttcttagctttt

SEQ ID NO: 875397 - DNA, 22 bp, Artificial Sequence
  chemically synthesized
tgaatgttagaaaagctaagaa

SEQ ID NO: 875398 - DNA, 22 bp, Artificial Sequence
  chemically synthesized
tgctataaatcttgtttcttag

SEQ ID NO: 875399 - DNA, 22 bp, Artificial Sequence
  chemically synthesized
cattgtgctataaatcttgttt

SEQ ID NO: 875400 - DNA, 22 bp, Artificial Sequence
  chemically synthesized
gaaaagctaagaaacaagattt

SEQ ID NO: 875401 - DNA, 22 bp, Artificial Sequence
  chemically synthesized
taaaagctacattgtgctataa

SEQ ID NO: 875402 - DNA, 22 bp, Artificial Sequence
  chemically synthesized
agaaacaagatttatagcacaa

SEQ ID NO: 875403 - DNA, 22 bp, Artificial Sequence
  chemically synthesized
ataaaagctacattgtgctata

SEQ ID NO: 875404 - DNA, 22 bp, Artificial Sequence
  chemically synthesized
aatttataaaagctacattgtg

SEQ ID NO: 875405 - DNA, 22 bp, Artificial Sequence
  chemically synthesized
aaatttataaaagctacattgt

SEQ ID NO: 875406 - DNA, 22 bp, Artificial Sequence
  chemically synthesized
taaatttataaaagctacattg

SEQ ID NO: 875407 - DNA, 22 bp, Artificial Sequence
  chemically synthesized
atagcacaatgtagcttttata

SEQ ID NO: 875408 - DNA, 22 bp, Artificial Sequence
  chemically synthesized
tagcacaatgtagcttttataa

SEQ ID NO: 875409 - DNA, 22 bp, Artificial Sequence
  chemically synthesized
taagtatattttaaatttataa

SEQ ID NO: 875410 - DNA, 22 bp, Artificial Sequence
  chemically synthesized
ataagtatattttaaatttata

SEQ ID NO: 875411 - DNA, 22 bp, Artificial Sequence
  chemically synthesized
tttataagtatattttaaattt

SEQ ID NO: 875412 - DNA, 22 bp, Artificial Sequence
  chemically synthesized
ttataaatttaaaatatactta

SEQ ID NO: 875413 - DNA, 22 bp, Artificial Sequence
  chemically synthesized
tataaatttaaaatatacttat

SEQ ID NO: 875414 - DNA, 22 bp, Artificial Sequence
  chemically synthesized
ataaatttaaaatatacttata

SEQ ID NO: 875415 - DNA, 22 bp, Artificial Sequence
  chemically synthesized
aaatatattatttataagtata

SEQ ID NO: 875416 - DNA, 22 bp, Artificial Sequence
  chemically synthesized
taaatttaaaatatacttataa

SEQ ID NO: 875417 - DNA, 22 bp, Artificial Sequence
  chemically synthesized
aaaatatattatttataagtat

SEQ ID NO: 875418 - DNA, 22 bp, Artificial Sequence
  chemically synthesized
taaaatatattatttataagta

SEQ ID NO: 875419 - DNA, 22 bp, Artificial Sequence
  chemically synthesized
ttaaaatatattatttataagt

SEQ ID NO: 875420 - DNA, 22 bp, Artificial Sequence
  chemically synthesized
aaaatatacttataaataatat

SEQ ID NO: 875421 - DNA, 22 bp, Artificial Sequence
  chemically synthesized
tccttttaaaatatattattta

SEQ ID NO: 875422 - DNA, 22 bp, Artificial Sequence
  chemically synthesized
aaatatacttataaataatata

SEQ ID NO: 875423 - DNA, 22 bp, Artificial Sequence
  chemically synthesized
atccttttaaaatatattattt

SEQ ID NO: 875424 - DNA, 22 bp, Artificial Sequence
  chemically synthesized
tatccttttaaaatatattatt

SEQ ID NO: 875425 - DNA, 22 bp, Artificial Sequence
  chemically synthesized
ctttatccttttaaaatatatt

SEQ ID NO: 875426 - DNA, 22 bp, Artificial Sequence
  chemically synthesized
ctgctttatccttttaaaatat

SEQ ID NO: 875427 - DNA, 22 bp, Artificial Sequence
  chemically synthesized
cctgctttatccttttaaaata

SEQ ID NO: 875428 - DNA, 22 bp, Artificial Sequence
  chemically synthesized
tcctgctttatccttttaaaat

SEQ ID NO: 875429 - DNA, 22 bp, Artificial Sequence
  chemically synthesized
ataaataatatattttaaaagg

SEQ ID NO: 875430 - DNA, 22 bp, Artificial Sequence
  chemically synthesized
taaataatatattttaaaagga

SEQ ID NO: 875431 - DNA, 22 bp, Artificial Sequence
  chemically synthesized
tttcctgctttatccttttaaa

SEQ ID NO: 875432 - DNA, 22 bp, Artificial Sequence
  chemically synthesized
ctttcctgctttatccttttaa

SEQ ID NO: 875433 - DNA, 22 bp, Artificial Sequence
  chemically synthesized
tttctttcctgctttatccttt

SEQ ID NO: 875434 - DNA, 22 bp, Artificial Sequence
  chemically synthesized
ctgtttctttcctgctttatcc

SEQ ID NO: 875435 - DNA, 22 bp, Artificial Sequence
  chemically synthesized
ttcctgtttctttcctgcttta

SEQ ID NO: 875436 - DNA, 22 bp, Artificial Sequence
  chemically synthesized
tattcctgtttctttcctgctt

SEQ ID NO: 875437 - DNA, 22 bp, Artificial Sequence
  chemically synthesized
taaaaggataaagcaggaaaga

SEQ ID NO: 875438 - DNA, 22 bp, Artificial Sequence
  chemically synthesized
aaaaggataaagcaggaaagaa

SEQ ID NO: 875439 - DNA, 22 bp, Artificial Sequence
  chemically synthesized
aaaggataaagcaggaaagaaa

SEQ ID NO: 875440 - DNA, 22 bp, Artificial Sequence
  chemically synthesized
aaatgtgacaataatatctcta

SEQ ID NO: 875441 - DNA, 22 bp, Artificial Sequence
  chemically synthesized
ctgaaatgtgacaataatatct

SEQ ID NO: 875442 - DNA, 22 bp, Artificial Sequence
  chemically synthesized
gcaaaattactgaaatgtgaca

SEQ ID NO: 875443 - DNA, 22 bp, Artificial Sequence
  chemically synthesized
ttgtcacatttcagtaattttg

SEQ ID NO: 875444 - DNA, 22 bp, Artificial Sequence
  chemically synthesized
ataaccgattagcaaaattact

SEQ ID NO: 875445 - DNA, 22 bp, Artificial Sequence
  chemically synthesized
aataaccgattagcaaaattac

SEQ ID NO: 875446 - DNA, 22 bp, Artificial Sequence
  chemically synthesized
tcacatttcagtaattttgcta

SEQ ID NO: 875447 - DNA, 22 bp, Artificial Sequence
  chemically synthesized
tgtttaataaccgattagcaaa

SEQ ID NO: 875448 - DNA, 22 bp, Artificial Sequence
  chemically synthesized
cagtaattttgctaatcggtta

SEQ ID NO: 875449 - DNA, 22 bp, Artificial Sequence
  chemically synthesized
agtaattttgctaatcggttat

SEQ ID NO: 875450 - DNA, 22 bp, Artificial Sequence
  chemically synthesized
atggttatgtttaataaccgat

SEQ ID NO: 875451 - DNA, 22 bp, Artificial Sequence
  chemically synthesized
tattaatggttatgtttaataa

SEQ ID NO: 875452 - DNA, 22 bp, Artificial Sequence
  chemically synthesized
atattaatggttatgtttaata

SEQ ID NO: 875453 - DNA, 22 bp, Artificial Sequence
  chemically synthesized
tgctaatcggttattaaacata

SEQ ID NO: 875454 - DNA, 22 bp, Artificial Sequence
  chemically synthesized
gctaatcggttattaaacataa

SEQ ID NO: 875455 - DNA, 22 bp, Artificial Sequence
  chemically synthesized
ctaatcggttattaaacataac

SEQ ID NO: 875456 - DNA, 22 bp, Artificial Sequence
  chemically synthesized
atttatattaatggttatgttt

SEQ ID NO: 875457 - DNA, 22 bp, Artificial Sequence
  chemically synthesized
aatttatattaatggttatgtt

SEQ ID NO: 875458 - DNA, 22 bp, Artificial Sequence
  chemically synthesized
atcggttattaaacataaccat

SEQ ID NO: 875459 - DNA, 22 bp, Artificial Sequence
  chemically synthesized
taaaatttaatttatattaatg

SEQ ID NO: 875460 - DNA, 22 bp, Artificial Sequence
  chemically synthesized
ttaaacataaccattaatataa

SEQ ID NO: 875461 - DNA, 22 bp, Artificial Sequence
  chemically synthesized
ataaaatttaatttatattaat

SEQ ID NO: 875462 - DNA, 22 bp, Artificial Sequence
  chemically synthesized
aacataaccattaatataaatt

SEQ ID NO: 875463 - DNA, 22 bp, Artificial Sequence
  chemically synthesized
tatttataaaatttaatttata

SEQ ID NO: 875464 - DNA, 22 bp, Artificial Sequence
  chemically synthesized
atatttataaaatttaatttat

SEQ ID NO: 875465 - DNA, 22 bp, Artificial Sequence
  chemically synthesized
tatatttataaaatttaattta

SEQ ID NO: 875466 - DNA, 22 bp, Artificial Sequence
  chemically synthesized
ttttatatttataaaatttaat

SEQ ID NO: 875467 - DNA, 22 bp, Artificial Sequence
  chemically synthesized
attttatatttataaaatttaa

SEQ ID NO: 875468 - DNA, 22 bp, Artificial Sequence
  chemically synthesized
atataaattaaattttataaat

SEQ ID NO: 875469 - DNA, 22 bp, Artificial Sequence
  chemically synthesized
gcacagtttattttatatttat

SEQ ID NO: 875470 - DNA, 22 bp, Artificial Sequence
  chemically synthesized
agcacagtttattttatattta

SEQ ID NO: 875471 - DNA, 22 bp, Artificial Sequence
  chemically synthesized
ttagcacagtttattttatatt

SEQ ID NO: 875472 - DNA, 22 bp, Artificial Sequence
  chemically synthesized
aattttataaatataaaataaa

SEQ ID NO: 875473 - DNA, 22 bp, Artificial Sequence
  chemically synthesized
ttcttagcacagtttattttat

SEQ ID NO: 875474 - DNA, 22 bp, Artificial Sequence
  chemically synthesized
gttcttagcacagtttatttta

SEQ ID NO: 875475 - DNA, 22 bp, Artificial Sequence
  chemically synthesized
tgttcttagcacagtttatttt

SEQ ID NO: 875476 - DNA, 22 bp, Artificial Sequence
  chemically synthesized
ttgttcttagcacagtttattt

SEQ ID NO: 875477 - DNA, 22 bp, Artificial Sequence
  chemically synthesized
tataaatataaaataaactgtg

SEQ ID NO: 875478 - DNA, 22 bp, Artificial Sequence
  chemically synthesized
ataaatataaaataaactgtgc

SEQ ID NO: 875479 - DNA, 22 bp, Artificial Sequence
  chemically synthesized
taaatataaaataaactgtgct

SEQ ID NO: 875480 - DNA, 22 bp, Artificial Sequence
  chemically synthesized
tcttttgttcttagcacagttt

SEQ ID NO: 875481 - DNA, 22 bp, Artificial Sequence
  chemically synthesized
tatattatcttttgttcttagc

SEQ ID NO: 875482 - DNA, 22 bp, Artificial Sequence
  chemically synthesized
ctatatattatcttttgttctt

SEQ ID NO: 875483 - DNA, 22 bp, Artificial Sequence
  chemically synthesized
actatatattatcttttgttct

SEQ ID NO: 875484 - DNA, 22 bp, Artificial Sequence
  chemically synthesized
ttactatatattatcttttgtt

SEQ ID NO: 875485 - DNA, 22 bp, Artificial Sequence
  chemically synthesized
tgctaagaacaaaagataatat

SEQ ID NO: 875486 - DNA, 22 bp, Artificial Sequence
  chemically synthesized
agaacaaaagataatatatagt

SEQ ID NO: 875487 - DNA, 22 bp, Artificial Sequence
  chemically synthesized
ggaagtgatgaattcttactat

SEQ ID NO: 875488 - DNA, 22 bp, Artificial Sequence
  chemically synthesized
aattaggaagtgatgaattctt

SEQ ID NO: 875489 - DNA, 22 bp, Artificial Sequence
  chemically synthesized
atgatagttaaattaggaagtg

SEQ ID NO: 875490 - DNA, 22 bp, Artificial Sequence
  chemically synthesized
atcacttcctaatttaactatc

SEQ ID NO: 875491 - DNA, 22 bp, Artificial Sequence
  chemically synthesized
aagagcactgatgatagttaaa

SEQ ID NO: 875492 - DNA, 22 bp, Artificial Sequence
  chemically synthesized
cctaatttaactatcatcagtg

SEQ ID NO: 875493 - DNA, 22 bp, Artificial Sequence
  chemically synthesized
ctaatttaactatcatcagtgc

SEQ ID NO: 875494 - DNA, 22 bp, Artificial Sequence
  chemically synthesized
atttaactatcatcagtgctct

SEQ ID NO: 875495 - DNA, 22 bp, Artificial Sequence
  chemically synthesized
aactatcatcagtgctcttgag

SEQ ID NO: 875496 - DNA, 22 bp, Artificial Sequence
  chemically synthesized
actatcatcagtgctcttgaga

SEQ ID NO: 875497 - DNA, 22 bp, Artificial Sequence
  chemically synthesized
tcatcagtgctcttgagactat

SEQ ID NO: 875498 - DNA, 22 bp, Artificial Sequence
  chemically synthesized
atgtcagacacaatagacatag

SEQ ID NO: 875499 - DNA, 22 bp, Artificial Sequence
  chemically synthesized
gatgtcagacacaatagacata

SEQ ID NO: 875500 - DNA, 22 bp, Artificial Sequence
  chemically synthesized
acttgatgtcagacacaataga

SEQ ID NO: 875501 - DNA, 22 bp, Artificial Sequence
  chemically synthesized
ttgagactatgtctattgtgtc

SEQ ID NO: 875502 - DNA, 22 bp, Artificial Sequence
  chemically synthesized
gacttgatgtcagacacaatag

SEQ ID NO: 875503 - DNA, 22 bp, Artificial Sequence
  chemically synthesized
gagactatgtctattgtgtctg

SEQ ID NO: 875504 - DNA, 22 bp, Artificial Sequence
  chemically synthesized
agactatgtctattgtgtctga

SEQ ID NO: 875505 - DNA, 22 bp, Artificial Sequence
  chemically synthesized
atttgacttgatgtcagacaca

SEQ ID NO: 875506 - DNA, 22 bp, Artificial Sequence
  chemically synthesized
gatttgacttgatgtcagacac

SEQ ID NO: 875507 - DNA, 22 bp, Artificial Sequence
  chemically synthesized
tgtctattgtgtctgacatcaa

SEQ ID NO: 875508 - DNA, 22 bp, Artificial Sequence
  chemically synthesized
aaagccttgatttgacttgatg

SEQ ID NO: 875509 - DNA, 22 bp, Artificial Sequence
  chemically synthesized
ttgtgtctgacatcaagtcaaa

SEQ ID NO: 875510 - DNA, 22 bp, Artificial Sequence
  chemically synthesized
tgtctgacatcaagtcaaatca

SEQ ID NO: 875511 - DNA, 22 bp, Artificial Sequence
  chemically synthesized
acatcaagtcaaatcaaggctt

SEQ ID NO: 875512 - DNA, 22 bp, Artificial Sequence
  chemically synthesized
gataaaaacattgaaagccttg

SEQ ID NO: 875513 - DNA, 22 bp, Artificial Sequence
  chemically synthesized
tggataaaaacattgaaagcct

SEQ ID NO: 875514 - DNA, 22 bp, Artificial Sequence
  chemically synthesized
catcatgcattctggataaaaa

SEQ ID NO: 875515 - DNA, 22 bp, Artificial Sequence
  chemically synthesized
acatcatgcattctggataaaa

SEQ ID NO: 875516 - DNA, 22 bp, Artificial Sequence
  chemically synthesized
tcaatgtttttatccagaatgc

SEQ ID NO: 875517 - DNA, 22 bp, Artificial Sequence
  chemically synthesized
caatgtttttatccagaatgca

SEQ ID NO: 875518 - DNA, 22 bp, Artificial Sequence
  chemically synthesized
aatgtttttatccagaatgcat

SEQ ID NO: 875519 - DNA, 22 bp, Artificial Sequence
  chemically synthesized
gtaaatatttacatcatgcatt

SEQ ID NO: 875520 - DNA, 22 bp, Artificial Sequence
  chemically synthesized
ttatccagaatgcatgatgtaa

SEQ ID NO: 875521 - DNA, 22 bp, Artificial Sequence
  chemically synthesized
tatccagaatgcatgatgtaaa

SEQ ID NO: 875522 - DNA, 22 bp, Artificial Sequence
  chemically synthesized
atccagaatgcatgatgtaaat

SEQ ID NO: 875523 - DNA, 22 bp, Artificial Sequence
  chemically synthesized
tccagaatgcatgatgtaaata

SEQ ID NO: 875524 - DNA, 22 bp, Artificial Sequence
  chemically synthesized
atatgctagtaaatatttacat

SEQ ID NO: 875525 - DNA, 22 bp, Artificial Sequence
  chemically synthesized
ttgatatgctagtaaatattta

SEQ ID NO: 875526 - DNA, 22 bp, Artificial Sequence
  chemically synthesized
attgatatgctagtaaatattt

SEQ ID NO: 875527 - DNA, 22 bp, Artificial Sequence
  chemically synthesized
catttattgatatgctagtaaa

SEQ ID NO: 875528 - DNA, 22 bp, Artificial Sequence
  chemically synthesized
actagcatatcaataaatgtaa

SEQ ID NO: 875529 - DNA, 22 bp, Artificial Sequence
  chemically synthesized
ctagcatatcaataaatgtaac

SEQ ID NO: 875530 - DNA, 22 bp, Artificial Sequence
  chemically synthesized
ataaataaaaaagttacattta

SEQ ID NO: 875531 - DNA, 22 bp, Artificial Sequence
  chemically synthesized
aataaataaaaaagttacattt

SEQ ID NO: 875532 - DNA, 22 bp, Artificial Sequence
  chemically synthesized
taataaataaaaaagttacatt

SEQ ID NO: 875533 - DNA, 22 bp, Artificial Sequence
  chemically synthesized
gcatatcaataaatgtaacttt

SEQ ID NO: 875534 - DNA, 22 bp, Artificial Sequence
  chemically synthesized
ttaataaataaaaaagttacat

SEQ ID NO: 875535 - DNA, 22 bp, Artificial Sequence
  chemically synthesized
atttttaataaataaaaaagtt

SEQ ID NO: 875536 - DNA, 22 bp, Artificial Sequence
  chemically synthesized
aagactgatttttaataaataa

SEQ ID NO: 875537 - DNA, 22 bp, Artificial Sequence
  chemically synthesized
ggttcaagactgatttttaata

SEQ ID NO: 875538 - DNA, 22 bp, Artificial Sequence
  chemically synthesized
gggttcaagactgatttttaat

SEQ ID NO: 875539 - DNA, 22 bp, Artificial Sequence
  chemically synthesized
tgggttcaagactgatttttaa

SEQ ID NO: 875540 - DNA, 22 bp, Artificial Sequence
  chemically synthesized
ttgggttcaagactgattttta

SEQ ID NO: 875541 - DNA, 22 bp, Artificial Sequence
  chemically synthesized
ttttatttattaaaaatcagtc

SEQ ID NO: 875542 - DNA, 22 bp, Artificial Sequence
  chemically synthesized
tttatttattaaaaatcagtct

SEQ ID NO: 875543 - DNA, 22 bp, Artificial Sequence
  chemically synthesized
cttttgggttcaagactgattt

SEQ ID NO: 875544 - DNA, 22 bp, Artificial Sequence
  chemically synthesized
ttatttattaaaaatcagtctt

SEQ ID NO: 875545 - DNA, 22 bp, Artificial Sequence
  chemically synthesized
gcttttgggttcaagactgatt

SEQ ID NO: 875546 - DNA, 22 bp, Artificial Sequence
  chemically synthesized
tatttattaaaaatcagtcttg

SEQ ID NO: 875547 - DNA, 22 bp, Artificial Sequence
  chemically synthesized
atttattaaaaatcagtcttga

SEQ ID NO: 875548 - DNA, 22 bp, Artificial Sequence
  chemically synthesized
tttattaaaaatcagtcttgaa

SEQ ID NO: 875549 - DNA, 22 bp, Artificial Sequence
  chemically synthesized
tttgcttttgggttcaagactg

SEQ ID NO: 875550 - DNA, 22 bp, Artificial Sequence
  chemically synthesized
gtttgcttttgggttcaagact

SEQ ID NO: 875551 - DNA, 22 bp, Artificial Sequence
  chemically synthesized
tgtttgcttttgggttcaagac

SEQ ID NO: 875552 - DNA, 22 bp, Artificial Sequence
  chemically synthesized
attaaaaatcagtcttgaaccc

SEQ ID NO: 875553 - DNA, 22 bp, Artificial Sequence
  chemically synthesized
ttgtttgcttttgggttcaaga

SEQ ID NO: 875554 - DNA, 22 bp, Artificial Sequence
  chemically synthesized
ttaaaaatcagtcttgaaccca

SEQ ID NO: 875555 - DNA, 22 bp, Artificial Sequence
  chemically synthesized
tttgtttgcttttgggttcaag

SEQ ID NO: 875556 - DNA, 22 bp, Artificial Sequence
  chemically synthesized
aaaatcagtcttgaacccaaaa

SEQ ID NO: 875557 - DNA, 22 bp, Artificial Sequence
  chemically synthesized
ttttttgtttgcttttgggttc

SEQ ID NO: 875558 - DNA, 22 bp, Artificial Sequence
  chemically synthesized
gaacccaaaagcaaacaaaaaa

SEQ ID NO: 875559 - DNA, 22 bp, Artificial Sequence
  chemically synthesized
aacccaaaagcaaacaaaaaat

SEQ ID NO: 875560 - DNA, 22 bp, Artificial Sequence
  chemically synthesized
atcagaggcattattttttgtt

SEQ ID NO: 875561 - DNA, 22 bp, Artificial Sequence
  chemically synthesized
actaatcagaggcattattttt

SEQ ID NO: 875562 - DNA, 22 bp, Artificial Sequence
  chemically synthesized
ctgactaatcagaggcattatt

SEQ ID NO: 875563 - DNA, 22 bp, Artificial Sequence
  chemically synthesized
cctgactaatcagaggcattat

SEQ ID NO: 875564 - DNA, 22 bp, Artificial Sequence
  chemically synthesized
tcctgactaatcagaggcatta

SEQ ID NO: 875565 - DNA, 22 bp, Artificial Sequence
  chemically synthesized
caagggtggttttcctgactaa

SEQ ID NO: 875566 - DNA, 22 bp, Artificial Sequence
  chemically synthesized
ccaagggtggttttcctgacta

SEQ ID NO: 875567 - DNA, 22 bp, Artificial Sequence
  chemically synthesized
tgattagtcaggaaaaccaccc

SEQ ID NO: 875568 - DNA, 22 bp, Artificial Sequence
  chemically synthesized
attagtcaggaaaaccaccctt

SEQ ID NO: 875569 - DNA, 22 bp, Artificial Sequence
  chemically synthesized
gtcaggaaaaccacccttggaa

SEQ ID NO: 875570 - DNA, 22 bp, Artificial Sequence
  chemically synthesized
cgtgagtgatgacttccaaggg

SEQ ID NO: 875571 - DNA, 22 bp, Artificial Sequence
  chemically synthesized
ccgtgagtgatgacttccaagg

SEQ ID NO: 875572 - DNA, 22 bp, Artificial Sequence
  chemically synthesized
ggaagtcatcactcacggaaga

SEQ ID NO: 875573 - DNA, 22 bp, Artificial Sequence
  chemically synthesized
gaagtcatcactcacggaagat

SEQ ID NO: 875574 - DNA, 22 bp, Artificial Sequence
  chemically synthesized
atgtcaggacaggaaaatatct

SEQ ID NO: 875575 - DNA, 22 bp, Artificial Sequence
  chemically synthesized
tgatgtcaggacaggaaaatat

SEQ ID NO: 875576 - DNA, 22 bp, Artificial Sequence
  chemically synthesized
acggaagatattttcctgtcct

SEQ ID NO: 875577 - DNA, 22 bp, Artificial Sequence
  chemically synthesized
ggttctgatgtcaggacaggaa

SEQ ID NO: 875578 - DNA, 22 bp, Artificial Sequence
  chemically synthesized
aggttctgatgtcaggacagga

SEQ ID NO: 875579 - DNA, 22 bp, Artificial Sequence
  chemically synthesized
gtgtttaggttctgatgtcagg

SEQ ID NO: 875580 - DNA, 22 bp, Artificial Sequence
  chemically synthesized
agtgtttaggttctgatgtcag

SEQ ID NO: 875581 - DNA, 22 bp, Artificial Sequence
  chemically synthesized
tagtgtttaggttctgatgtca

SEQ ID NO: 875582 - DNA, 22 bp, Artificial Sequence
  chemically synthesized
ttagtgtttaggttctgatgtc

SEQ ID NO: 875583 - DNA, 22 bp, Artificial Sequence
  chemically synthesized
tcctgtcctgacatcagaacct

SEQ ID NO: 875584 - DNA, 22 bp, Artificial Sequence
  chemically synthesized
cctgtcctgacatcagaaccta

SEQ ID NO: 875585 - DNA, 22 bp, Artificial Sequence
  chemically synthesized
atttttagtgtttaggttctga

SEQ ID NO: 875586 - DNA, 22 bp, Artificial Sequence
  chemically synthesized
ctgtcctgacatcagaacctaa

SEQ ID NO: 875587 - DNA, 22 bp, Artificial Sequence
  chemically synthesized
aatttttagtgtttaggttctg

SEQ ID NO: 875588 - DNA, 22 bp, Artificial Sequence
  chemically synthesized
tcctgacatcagaacctaaaca

SEQ ID NO: 875589 - DNA, 22 bp, Artificial Sequence
  chemically synthesized
acatcagaacctaaacactaaa

SEQ ID NO: 875590 - DNA, 22 bp, Artificial Sequence
  chemically synthesized
gaatatttaatttttagtgttt

SEQ ID NO: 875591 - DNA, 22 bp, Artificial Sequence
  chemically synthesized
agaatatttaatttttagtgtt

SEQ ID NO: 875592 - DNA, 22 bp, Artificial Sequence
  chemically synthesized
ttagaatatttaatttttagtg

SEQ ID NO: 875593 - DNA, 22 bp, Artificial Sequence
  chemically synthesized
gtctcttagaatatttaatttt

SEQ ID NO: 875594 - DNA, 22 bp, Artificial Sequence
  chemically synthesized
actagtctcttagaatatttaa

SEQ ID NO: 875595 - DNA, 22 bp, Artificial Sequence
  chemically synthesized
aacactaaaaattaaatattct

SEQ ID NO: 875596 - DNA, 22 bp, Artificial Sequence
  chemically synthesized
ctcactagtctcttagaatatt

SEQ ID NO: 875597 - DNA, 22 bp, Artificial Sequence
  chemically synthesized
aaaattaaatattctaagagac

SEQ ID NO: 875598 - DNA, 22 bp, Artificial Sequence
  chemically synthesized
aatattctaagagactagtgag

SEQ ID NO: 875599 - DNA, 22 bp, Artificial Sequence
  chemically synthesized
taagagactagtgagtaatata

SEQ ID NO: 875600 - DNA, 22 bp, Artificial Sequence
  chemically synthesized
agagactagtgagtaatatatt

SEQ ID NO: 875601 - DNA, 22 bp, Artificial Sequence
  chemically synthesized
gtgagtaatatatttgatcttc

SEQ ID NO: 875602 - DNA, 22 bp, Artificial Sequence
  chemically synthesized
acagggaaaccagaagatcaaa

SEQ ID NO: 875603 - DNA, 22 bp, Artificial Sequence
  chemically synthesized
cacagggaaaccagaagatcaa

SEQ ID NO: 875604 - DNA, 22 bp, Artificial Sequence
  chemically synthesized
cagaaacttcacagggaaacca

SEQ ID NO: 875605 - DNA, 22 bp, Artificial Sequence
  chemically synthesized
gatcttctggtttccctgtgaa

SEQ ID NO: 875606 - DNA, 22 bp, Artificial Sequence
  chemically synthesized
atcttctggtttccctgtgaag

SEQ ID NO: 875607 - DNA, 22 bp, Artificial Sequence
  chemically synthesized
tagggttacagaaacttcacag

SEQ ID NO: 875608 - DNA, 22 bp, Artificial Sequence
  chemically synthesized
gtagggttacagaaacttcaca

SEQ ID NO: 875609 - DNA, 22 bp, Artificial Sequence
  chemically synthesized
tgtagggttacagaaacttcac

SEQ ID NO: 875610 - DNA, 22 bp, Artificial Sequence
  chemically synthesized
ctggtttccctgtgaagtttct

SEQ ID NO: 875611 - DNA, 22 bp, Artificial Sequence
  chemically synthesized
tggtttccctgtgaagtttctg

SEQ ID NO: 875612 - DNA, 22 bp, Artificial Sequence
  chemically synthesized
gtttccctgtgaagtttctgta

SEQ ID NO: 875613 - DNA, 22 bp, Artificial Sequence
  chemically synthesized
tctttgtagggttacagaaact

SEQ ID NO: 875614 - DNA, 22 bp, Artificial Sequence
  chemically synthesized
tgtctttgtagggttacagaaa

SEQ ID NO: 875615 - DNA, 22 bp, Artificial Sequence
  chemically synthesized
ccctgtgaagtttctgtaaccc

SEQ ID NO: 875616 - DNA, 22 bp, Artificial Sequence
  chemically synthesized
cctgtgaagtttctgtaaccct

SEQ ID NO: 875617 - DNA, 22 bp, Artificial Sequence
  chemically synthesized
gtattctgtctttgtagggtta

SEQ ID NO: 875618 - DNA, 22 bp, Artificial Sequence
  chemically synthesized
tgaagtttctgtaaccctacaa

SEQ ID NO: 875619 - DNA, 22 bp, Artificial Sequence
  chemically synthesized
agtattctgtctttgtagggtt

SEQ ID NO: 875620 - DNA, 22 bp, Artificial Sequence
  chemically synthesized
tagtattctgtctttgtagggt

SEQ ID NO: 875621 - DNA, 22 bp, Artificial Sequence
  chemically synthesized
ttagtattctgtctttgtaggg

SEQ ID NO: 875622 - DNA, 22 bp, Artificial Sequence
  chemically synthesized
cttttagtattctgtctttgta

SEQ ID NO: 875623 - DNA, 22 bp, Artificial Sequence
  chemically synthesized
ctgtaaccctacaaagacagaa

SEQ ID NO: 875624 - DNA, 22 bp, Artificial Sequence
  chemically synthesized
tgtaaccctacaaagacagaat

SEQ ID NO: 875625 - DNA, 22 bp, Artificial Sequence
  chemically synthesized
attgcttttagtattctgtctt

SEQ ID NO: 875626 - DNA, 22 bp, Artificial Sequence
  chemically synthesized
taaccctacaaagacagaatac

SEQ ID NO: 875627 - DNA, 22 bp, Artificial Sequence
  chemically synthesized
tcattgcttttagtattctgtc

SEQ ID NO: 875628 - DNA, 22 bp, Artificial Sequence
  chemically synthesized
ctcattgcttttagtattctgt

SEQ ID NO: 875629 - DNA, 22 bp, Artificial Sequence
  chemically synthesized
cttctcattgcttttagtattc

SEQ ID NO: 875630 - DNA, 22 bp, Artificial Sequence
  chemically synthesized
caaagacagaatactaaaagca

SEQ ID NO: 875631 - DNA, 22 bp, Artificial Sequence
  chemically synthesized
tcagaatgattacttctcattg

SEQ ID NO: 875632 - DNA, 22 bp, Artificial Sequence
  chemically synthesized
ttatcagaatgattacttctca

SEQ ID NO: 875633 - DNA, 22 bp, Artificial Sequence
  chemically synthesized
tgttatcagaatgattacttct

SEQ ID NO: 875634 - DNA, 22 bp, Artificial Sequence
  chemically synthesized
ctgttatcagaatgattacttc

SEQ ID NO: 875635 - DNA, 22 bp, Artificial Sequence
  chemically synthesized
tctgttatcagaatgattactt

SEQ ID NO: 875636 - DNA, 22 bp, Artificial Sequence
  chemically synthesized
aaagcaatgagaagtaatcatt

SEQ ID NO: 875637 - DNA, 22 bp, Artificial Sequence
  chemically synthesized
ctttctgttatcagaatgatta

SEQ ID NO: 875638 - DNA, 22 bp, Artificial Sequence
  chemically synthesized
ctactttctgttatcagaatga

SEQ ID NO: 875639 - DNA, 22 bp, Artificial Sequence
  chemically synthesized
ttgctactttctgttatcagaa

SEQ ID NO: 875640 - DNA, 22 bp, Artificial Sequence
  chemically synthesized
ctattgctactttctgttatca

SEQ ID NO: 875641 - DNA, 22 bp, Artificial Sequence
  chemically synthesized
tctcctattgctactttctgtt

SEQ ID NO: 875642 - DNA, 22 bp, Artificial Sequence
  chemically synthesized
attgtctcctattgctactttc

SEQ ID NO: 875643 - DNA, 22 bp, Artificial Sequence
  chemically synthesized
tgataacagaaagtagcaatag

SEQ ID NO: 875644 - DNA, 22 bp, Artificial Sequence
  chemically synthesized
ataacagaaagtagcaatagga

SEQ ID NO: 875645 - DNA, 22 bp, Artificial Sequence
  chemically synthesized
atgttcattgtctcctattgct

SEQ ID NO: 875646 - DNA, 22 bp, Artificial Sequence
  chemically synthesized
catgttcattgtctcctattgc

SEQ ID NO: 875647 - DNA, 22 bp, Artificial Sequence
  chemically synthesized
tcatgttcattgtctcctattg

SEQ ID NO: 875648 - DNA, 22 bp, Artificial Sequence
  chemically synthesized
ttcatgttcattgtctcctatt

SEQ ID NO: 875649 - DNA, 22 bp, Artificial Sequence
  chemically synthesized
agtttttcatgttcattgtctc

SEQ ID NO: 875650 - DNA, 22 bp, Artificial Sequence
  chemically synthesized
aagtttttcatgttcattgtct

SEQ ID NO: 875651 - DNA, 22 bp, Artificial Sequence
  chemically synthesized
taagtttttcatgttcattgtc

SEQ ID NO: 875652 - DNA, 22 bp, Artificial Sequence
  chemically synthesized
agttttaagtttttcatgttca

SEQ ID NO: 875653 - DNA, 22 bp, Artificial Sequence
  chemically synthesized
tcagttttaagtttttcatgtt

SEQ ID NO: 875654 - DNA, 22 bp, Artificial Sequence
  chemically synthesized
ctcagttttaagtttttcatgt

SEQ ID NO: 875655 - DNA, 22 bp, Artificial Sequence
  chemically synthesized
ccacatttctcagttttaagtt

SEQ ID NO: 875656 - DNA, 22 bp, Artificial Sequence
  chemically synthesized
agattaccacatttctcagttt

SEQ ID NO: 875657 - DNA, 22 bp, Artificial Sequence
  chemically synthesized
aaaactgagaaatgtggtaatc

SEQ ID NO: 875658 - DNA, 22 bp, Artificial Sequence
  chemically synthesized
ataaatgactaagattaccaca

SEQ ID NO: 875659 - DNA, 22 bp, Artificial Sequence
  chemically synthesized
aaactgagaaatgtggtaatct

SEQ ID NO: 875660 - DNA, 22 bp, Artificial Sequence
  chemically synthesized
attgataaatgactaagattac

SEQ ID NO: 875661 - DNA, 22 bp, Artificial Sequence
  chemically synthesized
cattgataaatgactaagatta

SEQ ID NO: 875662 - DNA, 22 bp, Artificial Sequence
  chemically synthesized
agaaatgtggtaatcttagtca

SEQ ID NO: 875663 - DNA, 22 bp, Artificial Sequence
  chemically synthesized
aaaggtcatttcattgataaat

SEQ ID NO: 875664 - DNA, 22 bp, Artificial Sequence
  chemically synthesized
agtcatttatcaatgaaatgac

SEQ ID NO: 875665 - DNA, 22 bp, Artificial Sequence
  chemically synthesized
gtcatttatcaatgaaatgacc

SEQ ID NO: 875666 - DNA, 22 bp, Artificial Sequence
  chemically synthesized
atcccatgttgaaaggtcattt

SEQ ID NO: 875667 - DNA, 22 bp, Artificial Sequence
  chemically synthesized
catcccatgttgaaaggtcatt

SEQ ID NO: 875668 - DNA, 22 bp, Artificial Sequence
  chemically synthesized
atcaatgaaatgacctttcaac

SEQ ID NO: 875669 - DNA, 22 bp, Artificial Sequence
  chemically synthesized
tcaatgaaatgacctttcaaca

SEQ ID NO: 875670 - DNA, 22 bp, Artificial Sequence
  chemically synthesized
aatggtgtaggatgagatttca

SEQ ID NO: 875671 - DNA, 22 bp, Artificial Sequence
  chemically synthesized
tcaacatgggatgaaatctcat

SEQ ID NO: 875672 - DNA, 22 bp, Artificial Sequence
  chemically synthesized
caacatgggatgaaatctcatc

SEQ ID NO: 875673 - DNA, 22 bp, Artificial Sequence
  chemically synthesized
aacatgggatgaaatctcatcc

SEQ ID NO: 875674 - DNA, 22 bp, Artificial Sequence
  chemically synthesized
taaattaaatggtgtaggatga

SEQ ID NO: 875675 - DNA, 22 bp, Artificial Sequence
  chemically synthesized
ctataaattaaatggtgtagga

SEQ ID NO: 875676 - DNA, 22 bp, Artificial Sequence
  chemically synthesized
cctataaattaaatggtgtagg

SEQ ID NO: 875677 - DNA, 22 bp, Artificial Sequence
  chemically synthesized
atcctacaccatttaatttata

SEQ ID NO: 875678 - DNA, 22 bp, Artificial Sequence
  chemically synthesized
caccatttaatttataggaaat

SEQ ID NO: 875679 - DNA, 22 bp, Artificial Sequence
  chemically synthesized
agcacatataggtgatttccta

SEQ ID NO: 875680 - DNA, 22 bp, Artificial Sequence
  chemically synthesized
tctcagcacatataggtgattt

SEQ ID NO: 875681 - DNA, 22 bp, Artificial Sequence
  chemically synthesized
aatttataggaaatcacctata

SEQ ID NO: 875682 - DNA, 22 bp, Artificial Sequence
  chemically synthesized
tatctcagcacatataggtgat

SEQ ID NO: 875683 - DNA, 22 bp, Artificial Sequence
  chemically synthesized
atttataggaaatcacctatat

SEQ ID NO: 875684 - DNA, 22 bp, Artificial Sequence
  chemically synthesized
tctatctcagcacatataggtg

SEQ ID NO: 875685 - DNA, 22 bp, Artificial Sequence
  chemically synthesized
tctctatctcagcacatatagg

SEQ ID NO: 875686 - DNA, 22 bp, Artificial Sequence
  chemically synthesized
ataggaaatcacctatatgtgc

SEQ ID NO: 875687 - DNA, 22 bp, Artificial Sequence
  chemically synthesized
ctctctatctcagcacatatag

SEQ ID NO: 875688 - DNA, 22 bp, Artificial Sequence
  chemically synthesized
taggaaatcacctatatgtgct

SEQ ID NO: 875689 - DNA, 22 bp, Artificial Sequence
  chemically synthesized
tctctctatctcagcacatata

SEQ ID NO: 875690 - DNA, 22 bp, Artificial Sequence
  chemically synthesized
ttctctctatctcagcacatat

SEQ ID NO: 875691 - DNA, 22 bp, Artificial Sequence
  chemically synthesized
cttttctctctatctcagcaca

SEQ ID NO: 875692 - DNA, 22 bp, Artificial Sequence
  chemically synthesized
tccttttctctctatctcagca

SEQ ID NO: 875693 - DNA, 22 bp, Artificial Sequence
  chemically synthesized
tctctccttttctctctatctc

SEQ ID NO: 875694 - DNA, 22 bp, Artificial Sequence
  chemically synthesized
tatgtgctgagatagagagaaa

SEQ ID NO: 875695 - DNA, 22 bp, Artificial Sequence
  chemically synthesized
tcactatctctccttttctctc

SEQ ID NO: 875696 - DNA, 22 bp, Artificial Sequence
  chemically synthesized
atctatcactatctctcctttt

SEQ ID NO: 875697 - DNA, 22 bp, Artificial Sequence
  chemically synthesized
agatagagagaaaaggagagat

SEQ ID NO: 875698 - DNA, 22 bp, Artificial Sequence
  chemically synthesized
aatcaatccctaatctatcact

SEQ ID NO: 875699 - DNA, 22 bp, Artificial Sequence
  chemically synthesized
aaatcaatccctaatctatcac

SEQ ID NO: 875700 - DNA, 22 bp, Artificial Sequence
  chemically synthesized
gggattgatttaaatactgctg

SEQ ID NO: 875701 - DNA, 22 bp, Artificial Sequence
  chemically synthesized
atttaaatactgctgggggtat

SEQ ID NO: 875702 - DNA, 22 bp, Artificial Sequence
  chemically synthesized
agtggaaagatgggcatacccc

SEQ ID NO: 875703 - DNA, 22 bp, Artificial Sequence
  chemically synthesized
aaatactgctgggggtatgccc

SEQ ID NO: 875704 - DNA, 22 bp, Artificial Sequence
  chemically synthesized
aatactgctgggggtatgccca

SEQ ID NO: 875705 - DNA, 22 bp, Artificial Sequence
  chemically synthesized
ctgagtggaaagatgggcatac

SEQ ID NO: 875706 - DNA, 22 bp, Artificial Sequence
  chemically synthesized
actgagtggaaagatgggcata

SEQ ID NO: 875707 - DNA, 22 bp, Artificial Sequence
  chemically synthesized
ctgggggtatgcccatctttcc

SEQ ID NO: 875708 - DNA, 22 bp, Artificial Sequence
  chemically synthesized
ggggtatgcccatctttccact

SEQ ID NO: 875709 - DNA, 22 bp, Artificial Sequence
  chemically synthesized
aggggcaatatgcttactgagt

SEQ ID NO: 875710 - DNA, 22 bp, Artificial Sequence
  chemically synthesized
tgaggggcaatatgcttactga

SEQ ID NO: 875711 - DNA, 22 bp, Artificial Sequence
  chemically synthesized
attctgaggggcaatatgctta

SEQ ID NO: 875712 - DNA, 22 bp, Artificial Sequence
  chemically synthesized
tccactcagtaagcatattgcc

SEQ ID NO: 875713 - DNA, 22 bp, Artificial Sequence
  chemically synthesized
ccactcagtaagcatattgccc

SEQ ID NO: 875714 - DNA, 22 bp, Artificial Sequence
  chemically synthesized
cactcagtaagcatattgcccc

SEQ ID NO: 875715 - DNA, 22 bp, Artificial Sequence
  chemically synthesized
tcctcattctgaggggcaatat

SEQ ID NO: 875716 - DNA, 22 bp, Artificial Sequence
  chemically synthesized
atcctcattctgaggggcaata

SEQ ID NO: 875717 - DNA, 22 bp, Artificial Sequence
  chemically synthesized
tatcctcattctgaggggcaat

SEQ ID NO: 875718 - DNA, 22 bp, Artificial Sequence
  chemically synthesized
tttatcctcattctgaggggca

SEQ ID NO: 875719 - DNA, 22 bp, Artificial Sequence
  chemically synthesized
agtaagcatattgcccctcaga

SEQ ID NO: 875720 - DNA, 22 bp, Artificial Sequence
  chemically synthesized
tctttatcctcattctgagggg

SEQ ID NO: 875721 - DNA, 22 bp, Artificial Sequence
  chemically synthesized
atctctctttatcctcattctg

SEQ ID NO: 875722 - DNA, 22 bp, Artificial Sequence
  chemically synthesized
gatctctctttatcctcattct

SEQ ID NO: 875723 - DNA, 22 bp, Artificial Sequence
  chemically synthesized
tgatctctctttatcctcattc

SEQ ID NO: 875724 - DNA, 22 bp, Artificial Sequence
  chemically synthesized
cccctcagaatgaggataaaga

SEQ ID NO: 875725 - DNA, 22 bp, Artificial Sequence
  chemically synthesized
agaatgaggataaagagagatc

SEQ ID NO: 875726 - DNA, 22 bp, Artificial Sequence
  chemically synthesized
gtagaaacatagaaacagcaaa

SEQ ID NO: 875727 - DNA, 22 bp, Artificial Sequence
  chemically synthesized
agtcaactggtagaaacataga

SEQ ID NO: 875728 - DNA, 22 bp, Artificial Sequence
  chemically synthesized
gctgtttctatgtttctaccag

SEQ ID NO: 875729 - DNA, 22 bp, Artificial Sequence
  chemically synthesized
ctgtttctatgtttctaccagt

SEQ ID NO: 875730 - DNA, 22 bp, Artificial Sequence
  chemically synthesized
tttctatgtttctaccagttga

SEQ ID NO: 875731 - DNA, 22 bp, Artificial Sequence
  chemically synthesized
ctatgtttctaccagttgactt

SEQ ID NO: 875732 - DNA, 22 bp, Artificial Sequence
  chemically synthesized
tatgtttctaccagttgactta

SEQ ID NO: 875733 - DNA, 22 bp, Artificial Sequence
  chemically synthesized
tgtttctaccagttgacttagg

SEQ ID NO: 875734 - DNA, 22 bp, Artificial Sequence
  chemically synthesized
ctaccagttgacttaggttcca

SEQ ID NO: 875735 - DNA, 22 bp, Artificial Sequence
  chemically synthesized
taccagttgacttaggttccac

SEQ ID NO: 875736 - DNA, 22 bp, Artificial Sequence
  chemically synthesized
ccagttgacttaggttccactc

SEQ ID NO: 875737 - DNA, 22 bp, Artificial Sequence
  chemically synthesized
caccatgagaagagagtggaac

SEQ ID NO: 875738 - DNA, 22 bp, Artificial Sequence
  chemically synthesized
acaccatgagaagagagtggaa

SEQ ID NO: 875739 - DNA, 22 bp, Artificial Sequence
  chemically synthesized
acttaggttccactctcttctc

SEQ ID NO: 875740 - DNA, 22 bp, Artificial Sequence
  chemically synthesized
agatacttacaccatgagaaga

SEQ ID NO: 875741 - DNA, 22 bp, Artificial Sequence
  chemically synthesized
aggttccactctcttctcatgg

SEQ ID NO: 875742 - DNA, 22 bp, Artificial Sequence
  chemically synthesized
ggttccactctcttctcatggt

SEQ ID NO: 875743 - DNA, 22 bp, Artificial Sequence
  chemically synthesized
cactctcttctcatggtgtaag

SEQ ID NO: 875744 - DNA, 22 bp, Artificial Sequence
  chemically synthesized
aaatcactgagatacttacacc

SEQ ID NO: 875745 - DNA, 22 bp, Artificial Sequence
  chemically synthesized
tcttctcatggtgtaagtatct

SEQ ID NO: 875746 - DNA, 22 bp, Artificial Sequence
  chemically synthesized
actcaaatcactgagatactta

SEQ ID NO: 875747 - DNA, 22 bp, Artificial Sequence
  chemically synthesized
ttctcatggtgtaagtatctca

SEQ ID NO: 875748 - DNA, 22 bp, Artificial Sequence
  chemically synthesized
ctcatggtgtaagtatctcagt

SEQ ID NO: 875749 - DNA, 22 bp, Artificial Sequence
  chemically synthesized
tcatggtgtaagtatctcagtg

SEQ ID NO: 875750 - DNA, 22 bp, Artificial Sequence
  chemically synthesized
atggtgtaagtatctcagtgat

SEQ ID NO: 875751 - DNA, 22 bp, Artificial Sequence
  chemically synthesized
aagctaactcaaatcactgaga

SEQ ID NO: 875752 - DNA, 22 bp, Artificial Sequence
  chemically synthesized
agtattaaagctaactcaaatc

SEQ ID NO: 875753 - DNA, 22 bp, Artificial Sequence
  chemically synthesized
aagtattaaagctaactcaaat

SEQ ID NO: 875754 - DNA, 22 bp, Artificial Sequence
  chemically synthesized
taagtattaaagctaactcaaa

SEQ ID NO: 875755 - DNA, 22 bp, Artificial Sequence
  chemically synthesized
agtgatttgagttagctttaat

SEQ ID NO: 875756 - DNA, 22 bp, Artificial Sequence
  chemically synthesized
gagttagctttaatacttaaag

SEQ ID NO: 875757 - DNA, 22 bp, Artificial Sequence
  chemically synthesized
agttagctttaatacttaaagg

SEQ ID NO: 875758 - DNA, 22 bp, Artificial Sequence
  chemically synthesized
taagataaatacatacctttaa

SEQ ID NO: 875759 - DNA, 22 bp, Artificial Sequence
  chemically synthesized
gctttaatacttaaaggtatgt

SEQ ID NO: 875760 - DNA, 22 bp, Artificial Sequence
  chemically synthesized
gactgtaagataaatacatacc

SEQ ID NO: 875761 - DNA, 22 bp, Artificial Sequence
  chemically synthesized
taatacttaaaggtatgtattt

SEQ ID NO: 875762 - DNA, 22 bp, Artificial Sequence
  chemically synthesized
aatacttaaaggtatgtattta

SEQ ID NO: 875763 - DNA, 22 bp, Artificial Sequence
  chemically synthesized
atacttaaaggtatgtatttat

SEQ ID NO: 875764 - DNA, 22 bp, Artificial Sequence
  chemically synthesized
gaagctagactgtaagataaat

SEQ ID NO: 875765 - DNA, 22 bp, Artificial Sequence
  chemically synthesized
agaagctagactgtaagataaa

SEQ ID NO: 875766 - DNA, 22 bp, Artificial Sequence
  chemically synthesized
aaaggtatgtatttatcttaca

SEQ ID NO: 875767 - DNA, 22 bp, Artificial Sequence
  chemically synthesized
tagaagctagactgtaagataa

SEQ ID NO: 875768 - DNA, 22 bp, Artificial Sequence
  chemically synthesized
aaggtatgtatttatcttacag

SEQ ID NO: 875769 - DNA, 22 bp, Artificial Sequence
  chemically synthesized
ttagaagctagactgtaagata

SEQ ID NO: 875770 - DNA, 22 bp, Artificial Sequence
  chemically synthesized
cttttagaagctagactgtaag

SEQ ID NO: 875771 - DNA, 22 bp, Artificial Sequence
  chemically synthesized
gcttttagaagctagactgtaa

SEQ ID NO: 875772 - DNA, 22 bp, Artificial Sequence
  chemically synthesized
atttgcttttagaagctagact

SEQ ID NO: 875773 - DNA, 22 bp, Artificial Sequence
  chemically synthesized
atcttacagtctagcttctaaa

SEQ ID NO: 875774 - DNA, 22 bp, Artificial Sequence
  chemically synthesized
tcttacagtctagcttctaaaa

SEQ ID NO: 875775 - DNA, 22 bp, Artificial Sequence
  chemically synthesized
aagtggttaatttgcttttaga

SEQ ID NO: 875776 - DNA, 22 bp, Artificial Sequence
  chemically synthesized
acagtctagcttctaaaagcaa

SEQ ID NO: 875777 - DNA, 22 bp, Artificial Sequence
  chemically synthesized
cagtctagcttctaaaagcaaa

SEQ ID NO: 875778 - DNA, 22 bp, Artificial Sequence
  chemically synthesized
gcttctaaaagcaaattaacca

SEQ ID NO: 875779 - DNA, 22 bp, Artificial Sequence
  chemically synthesized
agacccagttgaagtggttaat

SEQ ID NO: 875780 - DNA, 22 bp, Artificial Sequence
  chemically synthesized
ctaaaagcaaattaaccacttc

SEQ ID NO: 875781 - DNA, 22 bp, Artificial Sequence
  chemically synthesized
taaaagcaaattaaccacttca

SEQ ID NO: 875782 - DNA, 22 bp, Artificial Sequence
  chemically synthesized
aaagcaaattaaccacttcaac

SEQ ID NO: 875783 - DNA, 22 bp, Artificial Sequence
  chemically synthesized
agttgagacccagttgaagtgg

SEQ ID NO: 875784 - DNA, 22 bp, Artificial Sequence
  chemically synthesized
cagttgagacccagttgaagtg

SEQ ID NO: 875785 - DNA, 22 bp, Artificial Sequence
  chemically synthesized
ttcagttgagacccagttgaag

SEQ ID NO: 875786 - DNA, 22 bp, Artificial Sequence
  chemically synthesized
cttcagttgagacccagttgaa

SEQ ID NO: 875787 - DNA, 22 bp, Artificial Sequence
  chemically synthesized
tcttcagttgagacccagttga

SEQ ID NO: 875788 - DNA, 22 bp, Artificial Sequence
  chemically synthesized
accacttcaactgggtctcaac

SEQ ID NO: 875789 - DNA, 22 bp, Artificial Sequence
  chemically synthesized
aaagcaccctttcttcagttga

SEQ ID NO: 875790 - DNA, 22 bp, Artificial Sequence
  chemically synthesized
caactgggtctcaactgaagaa

SEQ ID NO: 875791 - DNA, 22 bp, Artificial Sequence
  chemically synthesized
aactgggtctcaactgaagaaa

SEQ ID NO: 875792 - DNA, 22 bp, Artificial Sequence
  chemically synthesized
ggtctcaactgaagaaagggtg

SEQ ID NO: 875793 - DNA, 22 bp, Artificial Sequence
  chemically synthesized
aactgaagaaagggtgctttga

SEQ ID NO: 875794 - DNA, 22 bp, Artificial Sequence
  chemically synthesized
aagaaagggtgctttgaatttc

SEQ ID NO: 875795 - DNA, 22 bp, Artificial Sequence
  chemically synthesized
tatgaggaacatgaaattcaaa

SEQ ID NO: 875796 - DNA, 22 bp, Artificial Sequence
  chemically synthesized
tgaatttcatgttcctcatata

SEQ ID NO: 875797 - DNA, 22 bp, Artificial Sequence
  chemically synthesized
gtgatacagtgttatatgagga

SEQ ID NO: 875798 - DNA, 22 bp, Artificial Sequence
  chemically synthesized
gaatttcatgttcctcatataa

SEQ ID NO: 875799 - DNA, 22 bp, Artificial Sequence
  chemically synthesized
agtgatacagtgttatatgagg

SEQ ID NO: 875800 - DNA, 22 bp, Artificial Sequence
  chemically synthesized
aatttcatgttcctcatataac

SEQ ID NO: 875801 - DNA, 22 bp, Artificial Sequence
  chemically synthesized
tttagtgatacagtgttatatg

SEQ ID NO: 875802 - DNA, 22 bp, Artificial Sequence
  chemically synthesized
tgtttagtgatacagtgttata

SEQ ID NO: 875803 - DNA, 22 bp, Artificial Sequence
  chemically synthesized
catgttcctcatataacactgt

SEQ ID NO: 875804 - DNA, 22 bp, Artificial Sequence
  chemically synthesized
atgttcctcatataacactgta

SEQ ID NO: 875805 - DNA, 22 bp, Artificial Sequence
  chemically synthesized
ctctgtttagtgatacagtgtt

SEQ ID NO: 875806 - DNA, 22 bp, Artificial Sequence
  chemically synthesized
gctctgtttagtgatacagtgt

SEQ ID NO: 875807 - DNA, 22 bp, Artificial Sequence
  chemically synthesized
tgctctgtttagtgatacagtg

SEQ ID NO: 875808 - DNA, 22 bp, Artificial Sequence
  chemically synthesized
ttgctctgtttagtgatacagt

SEQ ID NO: 875809 - DNA, 22 bp, Artificial Sequence
  chemically synthesized
ctcatataacactgtatcacta

SEQ ID NO: 875810 - DNA, 22 bp, Artificial Sequence
  chemically synthesized
atataacactgtatcactaaac

SEQ ID NO: 875811 - DNA, 22 bp, Artificial Sequence
  chemically synthesized
tcacatcaatttttgctctgtt

SEQ ID NO: 875812 - DNA, 22 bp, Artificial Sequence
  chemically synthesized
tatcactaaacagagcaaaaat

SEQ ID NO: 875813 - DNA, 22 bp, Artificial Sequence
  chemically synthesized
aacagagcaaaaattgatgtga

SEQ ID NO: 875814 - DNA, 22 bp, Artificial Sequence
  chemically synthesized
aggggtgtcgttatcacatcaa

SEQ ID NO: 875815 - DNA, 22 bp, Artificial Sequence
  chemically synthesized
caggggtgtcgttatcacatca

SEQ ID NO: 875816 - DNA, 22 bp, Artificial Sequence
  chemically synthesized
tcaggggtgtcgttatcacatc

SEQ ID NO: 875817 - DNA, 22 bp, Artificial Sequence
  chemically synthesized
attttcaggggtgtcgttatca

SEQ ID NO: 875818 - DNA, 22 bp, Artificial Sequence
  chemically synthesized
aattttcaggggtgtcgttatc

SEQ ID NO: 875819 - DNA, 22 bp, Artificial Sequence
  chemically synthesized
ttaattttcaggggtgtcgtta

SEQ ID NO: 875820 - DNA, 22 bp, Artificial Sequence
  chemically synthesized
cttaattttcaggggtgtcgtt

SEQ ID NO: 875821 - DNA, 22 bp, Artificial Sequence
  chemically synthesized
tcttaattttcaggggtgtcgt

SEQ ID NO: 875822 - DNA, 22 bp, Artificial Sequence
  chemically synthesized
ttcttaattttcaggggtgtcg

SEQ ID NO: 875823 - DNA, 22 bp, Artificial Sequence
  chemically synthesized
atgtgataacgacacccctgaa

SEQ ID NO: 875824 - DNA, 22 bp, Artificial Sequence
  chemically synthesized
acttttcttaattttcaggggt

SEQ ID NO: 875825 - DNA, 22 bp, Artificial Sequence
  chemically synthesized
aatcacaatgtaaattaacttt

SEQ ID NO: 875826 - DNA, 22 bp, Artificial Sequence
  chemically synthesized
aaaattaagaaaagttaattta

SEQ ID NO: 875827 - DNA, 22 bp, Artificial Sequence
  chemically synthesized
taaatcacaatgtaaattaact

SEQ ID NO: 875828 - DNA, 22 bp, Artificial Sequence
  chemically synthesized
attctaaatcacaatgtaaatt

SEQ ID NO: 875829 - DNA, 22 bp, Artificial Sequence
  chemically synthesized
tgattctaaatcacaatgtaaa

SEQ ID NO: 875830 - DNA, 22 bp, Artificial Sequence
  chemically synthesized
agaaaagttaatttacattgtg

SEQ ID NO: 875831 - DNA, 22 bp, Artificial Sequence
  chemically synthesized
ctgattctaaatcacaatgtaa

SEQ ID NO: 875832 - DNA, 22 bp, Artificial Sequence
  chemically synthesized
agacttctgattctaaatcaca

SEQ ID NO: 875833 - DNA, 22 bp, Artificial Sequence
  chemically synthesized
atttacattgtgatttagaatc

SEQ ID NO: 875834 - DNA, 22 bp, Artificial Sequence
  chemically synthesized
acattgtgatttagaatcagaa

SEQ ID NO: 875835 - DNA, 22 bp, Artificial Sequence
  chemically synthesized
cattgtgatttagaatcagaag

SEQ ID NO: 875836 - DNA, 22 bp, Artificial Sequence
  chemically synthesized
ggaacgaaacctaagacttctg

SEQ ID NO: 875837 - DNA, 22 bp, Artificial Sequence
  chemically synthesized
tgatttagaatcagaagtctta

SEQ ID NO: 875838 - DNA, 22 bp, Artificial Sequence
  chemically synthesized
agaatcagaagtcttaggtttc

SEQ ID NO: 875839 - DNA, 22 bp, Artificial Sequence
  chemically synthesized
gaatcagaagtcttaggtttcg

SEQ ID NO: 875840 - DNA, 22 bp, Artificial Sequence
  chemically synthesized
aggtttcgttcctaattcacta

SEQ ID NO: 875841 - DNA, 22 bp, Artificial Sequence
  chemically synthesized
ggtttcgttcctaattcactac

SEQ ID NO: 875842 - DNA, 22 bp, Artificial Sequence
  chemically synthesized
cgttcctaattcactactactg

SEQ ID NO: 875843 - DNA, 22 bp, Artificial Sequence
  chemically synthesized
gttcctaattcactactactgg

SEQ ID NO: 875844 - DNA, 22 bp, Artificial Sequence
  chemically synthesized
caaggatcacacaaccagtagt

SEQ ID NO: 875845 - DNA, 22 bp, Artificial Sequence
  chemically synthesized
ccaaggatcacacaaccagtag

SEQ ID NO: 875846 - DNA, 22 bp, Artificial Sequence
  chemically synthesized
ctaattcactactactggttgt

SEQ ID NO: 875847 - DNA, 22 bp, Artificial Sequence
  chemically synthesized
tccaaggatcacacaaccagta

SEQ ID NO: 875848 - DNA, 22 bp, Artificial Sequence
  chemically synthesized
attcactactactggttgtgtg

SEQ ID NO: 875849 - DNA, 22 bp, Artificial Sequence
  chemically synthesized
attttccaaggatcacacaacc

SEQ ID NO: 875850 - DNA, 22 bp, Artificial Sequence
  chemically synthesized
actactactggttgtgtgatcc

SEQ ID NO: 875851 - DNA, 22 bp, Artificial Sequence
  chemically synthesized
ctactggttgtgtgatccttgg

SEQ ID NO: 875852 - DNA, 22 bp, Artificial Sequence
  chemically synthesized
ctggttgtgtgatccttggaaa

SEQ ID NO: 875853 - DNA, 22 bp, Artificial Sequence
  chemically synthesized
gtgacccatctcattttccaag

SEQ ID NO: 875854 - DNA, 22 bp, Artificial Sequence
  chemically synthesized
gttgtgtgatccttggaaaatg

SEQ ID NO: 875855 - DNA, 22 bp, Artificial Sequence
  chemically synthesized
agtgacccatctcattttccaa

SEQ ID NO: 875856 - DNA, 22 bp, Artificial Sequence
  chemically synthesized
tgtgatccttggaaaatgagat

SEQ ID NO: 875857 - DNA, 22 bp, Artificial Sequence
  chemically synthesized
ggaaaatgagatgggtcactaa

SEQ ID NO: 875858 - DNA, 22 bp, Artificial Sequence
  chemically synthesized
gaaaatgagatgggtcactaag

SEQ ID NO: 875859 - DNA, 22 bp, Artificial Sequence
  chemically synthesized
aaggatgataaatcttagtgac

SEQ ID NO: 875860 - DNA, 22 bp, Artificial Sequence
  chemically synthesized
caaggatgataaatcttagtga

SEQ ID NO: 875861 - DNA, 22 bp, Artificial Sequence
  chemically synthesized
tatccatgtttcaaggatgata

SEQ ID NO: 875862 - DNA, 22 bp, Artificial Sequence
  chemically synthesized
ttatatccatgtttcaaggatg

SEQ ID NO: 875863 - DNA, 22 bp, Artificial Sequence
  chemically synthesized
agatttatcatccttgaaacat

SEQ ID NO: 875864 - DNA, 22 bp, Artificial Sequence
  chemically synthesized
atcatccttgaaacatggatat

SEQ ID NO: 875865 - DNA, 22 bp, Artificial Sequence
  chemically synthesized
ggtggtattattatatccatgt

SEQ ID NO: 875866 - DNA, 22 bp, Artificial Sequence
  chemically synthesized
tcatccttgaaacatggatata

SEQ ID NO: 875867 - DNA, 22 bp, Artificial Sequence
  chemically synthesized
tgagttaggtggtattattata

SEQ ID NO: 875868 - DNA, 22 bp, Artificial Sequence
  chemically synthesized
gaaacatggatataataatacc

SEQ ID NO: 875869 - DNA, 22 bp, Artificial Sequence
  chemically synthesized
aaacatggatataataatacca

SEQ ID NO: 875870 - DNA, 22 bp, Artificial Sequence
  chemically synthesized
caacaaagctatgagttaggtg

SEQ ID NO: 875871 - DNA, 22 bp, Artificial Sequence
  chemically synthesized
tccaacaaagctatgagttagg

SEQ ID NO: 875872 - DNA, 22 bp, Artificial Sequence
  chemically synthesized
ctccaacaaagctatgagttag

SEQ ID NO: 875873 - DNA, 22 bp, Artificial Sequence
  chemically synthesized
gtttctccaacaaagctatgag

SEQ ID NO: 875874 - DNA, 22 bp, Artificial Sequence
  chemically synthesized
agtttctccaacaaagctatga

SEQ ID NO: 875875 - DNA, 22 bp, Artificial Sequence
  chemically synthesized
gtttagtttctccaacaaagct

SEQ ID NO: 875876 - DNA, 22 bp, Artificial Sequence
  chemically synthesized
actcatagctttgttggagaaa

SEQ ID NO: 875877 - DNA, 22 bp, Artificial Sequence
  chemically synthesized
atagctttgttggagaaactaa

SEQ ID NO: 875878 - DNA, 22 bp, Artificial Sequence
  chemically synthesized
ccatataaaatatctcgtttag

SEQ ID NO: 875879 - DNA, 22 bp, Artificial Sequence
  chemically synthesized
tgttggagaaactaaacgagat

SEQ ID NO: 875880 - DNA, 22 bp, Artificial Sequence
  chemically synthesized
accatataaaatatctcgttta

SEQ ID NO: 875881 - DNA, 22 bp, Artificial Sequence
  chemically synthesized
gttggagaaactaaacgagata

SEQ ID NO: 875882 - DNA, 22 bp, Artificial Sequence
  chemically synthesized
taccatataaaatatctcgttt

SEQ ID NO: 875883 - DNA, 22 bp, Artificial Sequence
  chemically synthesized
ttggagaaactaaacgagatat

SEQ ID NO: 875884 - DNA, 22 bp, Artificial Sequence
  chemically synthesized
ttaccatataaaatatctcgtt

SEQ ID NO: 875885 - DNA, 22 bp, Artificial Sequence
  chemically synthesized
gagaaactaaacgagatatttt

SEQ ID NO: 875886 - DNA, 22 bp, Artificial Sequence
  chemically synthesized
acagcatttttaccatataaaa

SEQ ID NO: 875887 - DNA, 22 bp, Artificial Sequence
  chemically synthesized
aacgagatattttatatggtaa

SEQ ID NO: 875888 - DNA, 22 bp, Artificial Sequence
  chemically synthesized
tagttcacagcatttttaccat

SEQ ID NO: 875889 - DNA, 22 bp, Artificial Sequence
  chemically synthesized
gtagttcacagcatttttacca

SEQ ID NO: 875890 - DNA, 22 bp, Artificial Sequence
  chemically synthesized
tgtagttcacagcatttttacc

SEQ ID NO: 875891 - DNA, 22 bp, Artificial Sequence
  chemically synthesized
tatatggtaaaaatgctgtgaa

SEQ ID NO: 875892 - DNA, 22 bp, Artificial Sequence
  chemically synthesized
atatggtaaaaatgctgtgaac

SEQ ID NO: 875893 - DNA, 22 bp, Artificial Sequence
  chemically synthesized
tagtgctttgtagttcacagca

SEQ ID NO: 875894 - DNA, 22 bp, Artificial Sequence
  chemically synthesized
tatggtaaaaatgctgtgaact

SEQ ID NO: 875895 - DNA, 22 bp, Artificial Sequence
  chemically synthesized
atagtgctttgtagttcacagc

SEQ ID NO: 875896 - DNA, 22 bp, Artificial Sequence
  chemically synthesized
accaacaaatttatagtgcttt

SEQ ID NO: 875897 - DNA, 22 bp, Artificial Sequence
  chemically synthesized
tgaactacaaagcactataaat

SEQ ID NO: 875898 - DNA, 22 bp, Artificial Sequence
  chemically synthesized
caaagcactataaatttgttgg

SEQ ID NO: 875899 - DNA, 22 bp, Artificial Sequence
  chemically synthesized
agcagcgcataatatctaacca

SEQ ID NO: 875900 - DNA, 22 bp, Artificial Sequence
  chemically synthesized
taaatttgttggttagatatta

SEQ ID NO: 875901 - DNA, 22 bp, Artificial Sequence
  chemically synthesized
attgagcagcgcataatatcta

SEQ ID NO: 875902 - DNA, 22 bp, Artificial Sequence
  chemically synthesized
cattgagcagcgcataatatct

SEQ ID NO: 875903 - DNA, 22 bp, Artificial Sequence
  chemically synthesized
cttcattgagcagcgcataata

SEQ ID NO: 875904 - DNA, 22 bp, Artificial Sequence
  chemically synthesized
gcttcattgagcagcgcataat

SEQ ID NO: 875905 - DNA, 22 bp, Artificial Sequence
  chemically synthesized
gttggttagatattatgcgctg

SEQ ID NO: 875906 - DNA, 22 bp, Artificial Sequence
  chemically synthesized
tgcttcattgagcagcgcataa

SEQ ID NO: 875907 - DNA, 22 bp, Artificial Sequence
  chemically synthesized
ttggttagatattatgcgctgc

SEQ ID NO: 875908 - DNA, 22 bp, Artificial Sequence
  chemically synthesized
ttttgcttcattgagcagcgca

SEQ ID NO: 875909 - DNA, 22 bp, Artificial Sequence
  chemically synthesized
gttagatattatgcgctgctca

SEQ ID NO: 875910 - DNA, 22 bp, Artificial Sequence
  chemically synthesized
tgttttgcttcattgagcagcg

SEQ ID NO: 875911 - DNA, 22 bp, Artificial Sequence
  chemically synthesized
ctgttttgcttcattgagcagc

SEQ ID NO: 875912 - DNA, 22 bp, Artificial Sequence
  chemically synthesized
gatattatgcgctgctcaatga

SEQ ID NO: 875913 - DNA, 22 bp, Artificial Sequence
  chemically synthesized
aatatcttctgttttgcttcat

SEQ ID NO: 875914 - DNA, 22 bp, Artificial Sequence
  chemically synthesized
tgcgctgctcaatgaagcaaaa

SEQ ID NO: 875915 - DNA, 22 bp, Artificial Sequence
  chemically synthesized
gaatatcttctgttttgcttca

SEQ ID NO: 875916 - DNA, 22 bp, Artificial Sequence
  chemically synthesized
ttgaatatcttctgttttgctt

SEQ ID NO: 875917 - DNA, 22 bp, Artificial Sequence
  chemically synthesized
cttgaatatcttctgttttgct

SEQ ID NO: 875918 - DNA, 22 bp, Artificial Sequence
  chemically synthesized
tcttgaatatcttctgttttgc

SEQ ID NO: 875919 - DNA, 22 bp, Artificial Sequence
  chemically synthesized
ttcttgaatatcttctgttttg

SEQ ID NO: 875920 - DNA, 22 bp, Artificial Sequence
  chemically synthesized
ctcaatgaagcaaaacagaaga

SEQ ID NO: 875921 - DNA, 22 bp, Artificial Sequence
  chemically synthesized
aatgaagcaaaacagaagatat

SEQ ID NO: 875922 - DNA, 22 bp, Artificial Sequence
  chemically synthesized
atgagaacttttcttgaatatc

SEQ ID NO: 875923 - DNA, 22 bp, Artificial Sequence
  chemically synthesized
aatgagaacttttcttgaatat

SEQ ID NO: 875924 - DNA, 22 bp, Artificial Sequence
  chemically synthesized
taatgagaacttttcttgaata

SEQ ID NO: 875925 - DNA, 22 bp, Artificial Sequence
  chemically synthesized
ttttaatgagaacttttcttga

SEQ ID NO: 875926 - DNA, 22 bp, Artificial Sequence
  chemically synthesized
tcgtaactattttaatgagaac

SEQ ID NO: 875927 - DNA, 22 bp, Artificial Sequence
  chemically synthesized
atcgtaactattttaatgagaa

SEQ ID NO: 875928 - DNA, 22 bp, Artificial Sequence
  chemically synthesized
tatcgtaactattttaatgaga

SEQ ID NO: 875929 - DNA, 22 bp, Artificial Sequence
  chemically synthesized
aagaaaagttctcattaaaata

SEQ ID NO: 875930 - DNA, 22 bp, Artificial Sequence
  chemically synthesized
aaaaaaattttatcgtaactat

SEQ ID NO: 875931 - DNA, 22 bp, Artificial Sequence
  chemically synthesized
tcattaaaatagttacgataaa

SEQ ID NO: 875932 - DNA, 22 bp, Artificial Sequence
  chemically synthesized
attaaaatagttacgataaaat

SEQ ID NO: 875933 - DNA, 22 bp, Artificial Sequence
  chemically synthesized
aaatagttacgataaaattttt

SEQ ID NO: 875934 - DNA, 22 bp, Artificial Sequence
  chemically synthesized
ataaagcactgaaaaaaatttt

SEQ ID NO: 875935 - DNA, 22 bp, Artificial Sequence
  chemically synthesized
aataaagcactgaaaaaaattt

SEQ ID NO: 875936 - DNA, 22 bp, Artificial Sequence
  chemically synthesized
taataaagcactgaaaaaaatt

SEQ ID NO: 875937 - DNA, 22 bp, Artificial Sequence
  chemically synthesized
cgataaaatttttttcagtgct

SEQ ID NO: 875938 - DNA, 22 bp, Artificial Sequence
  chemically synthesized
gtcctttaataaagcactgaaa

SEQ ID NO: 875939 - DNA, 22 bp, Artificial Sequence
  chemically synthesized
aaacctagtcctttaataaagc

SEQ ID NO: 875940 - DNA, 22 bp, Artificial Sequence
  chemically synthesized
ttttcagtgctttattaaagga

SEQ ID NO: 875941 - DNA, 22 bp, Artificial Sequence
  chemically synthesized
tttcagtgctttattaaaggac

SEQ ID NO: 875942 - DNA, 22 bp, Artificial Sequence
  chemically synthesized
ttcagtgctttattaaaggact

SEQ ID NO: 875943 - DNA, 22 bp, Artificial Sequence
  chemically synthesized
tcagtgctttattaaaggacta

SEQ ID NO: 875944 - DNA, 22 bp, Artificial Sequence
  chemically synthesized
cagtgctttattaaaggactag

SEQ ID NO: 875945 - DNA, 22 bp, Artificial Sequence
  chemically synthesized
ggtaactaaaacctagtccttt

SEQ ID NO: 875946 - DNA, 22 bp, Artificial Sequence
  chemically synthesized
agtgctttattaaaggactagg

SEQ ID NO: 875947 - DNA, 22 bp, Artificial Sequence
  chemically synthesized
taggtaactaaaacctagtcct

SEQ ID NO: 875948 - DNA, 22 bp, Artificial Sequence
  chemically synthesized
ctaggtaactaaaacctagtcc

SEQ ID NO: 875949 - DNA, 22 bp, Artificial Sequence
  chemically synthesized
tctaggtaactaaaacctagtc

SEQ ID NO: 875950 - DNA, 22 bp, Artificial Sequence
  chemically synthesized
ttttctaggtaactaaaaccta

SEQ ID NO: 875951 - DNA, 22 bp, Artificial Sequence
  chemically synthesized
tattaaaggactaggttttagt

SEQ ID NO: 875952 - DNA, 22 bp, Artificial Sequence
  chemically synthesized
attaaaggactaggttttagtt

SEQ ID NO: 875953 - DNA, 22 bp, Artificial Sequence
  chemically synthesized
ttaaaggactaggttttagtta

SEQ ID NO: 875954 - DNA, 22 bp, Artificial Sequence
  chemically synthesized
aaggactaggttttagttacct

SEQ ID NO: 875955 - DNA, 22 bp, Artificial Sequence
  chemically synthesized
ggttttagttacctagaaaata

SEQ ID NO: 875956 - DNA, 22 bp, Artificial Sequence
  chemically synthesized
catgtacaaacatgttattttc

SEQ ID NO: 875957 - DNA, 22 bp, Artificial Sequence
  chemically synthesized
tagttacctagaaaataacatg

SEQ ID NO: 875958 - DNA, 22 bp, Artificial Sequence
  chemically synthesized
agttacctagaaaataacatgt

SEQ ID NO: 875959 - DNA, 22 bp, Artificial Sequence
  chemically synthesized
gttacctagaaaataacatgtt

SEQ ID NO: 875960 - DNA, 22 bp, Artificial Sequence
  chemically synthesized
cctagaaaataacatgtttgta

SEQ ID NO: 875961 - DNA, 22 bp, Artificial Sequence
  chemically synthesized
gaaaataacatgtttgtacatg

SEQ ID NO: 875962 - DNA, 22 bp, Artificial Sequence
  chemically synthesized
ataaaagagaaattgcatgtac

SEQ ID NO: 875963 - DNA, 22 bp, Artificial Sequence
  chemically synthesized
tgtattaataaaagagaaattg

SEQ ID NO: 875964 - DNA, 22 bp, Artificial Sequence
  chemically synthesized
atgtattaataaaagagaaatt

SEQ ID NO: 875965 - DNA, 22 bp, Artificial Sequence
  chemically synthesized
gtacatgcaatttctcttttat

SEQ ID NO: 875966 - DNA, 22 bp, Artificial Sequence
  chemically synthesized
tacatgcaatttctcttttatt

SEQ ID NO: 875967 - DNA, 22 bp, Artificial Sequence
  chemically synthesized
gagtttatgtattaataaaaga

SEQ ID NO: 875968 - DNA, 22 bp, Artificial Sequence
  chemically synthesized
agagtttatgtattaataaaag

SEQ ID NO: 875969 - DNA, 22 bp, Artificial Sequence
  chemically synthesized
tttagagtttatgtattaataa

SEQ ID NO: 875970 - DNA, 22 bp, Artificial Sequence
  chemically synthesized
ctcttttattaatacataaact

SEQ ID NO: 875971 - DNA, 22 bp, Artificial Sequence
  chemically synthesized
tcttttattaatacataaactc

SEQ ID NO: 875972 - DNA, 22 bp, Artificial Sequence
  chemically synthesized
ttttattaatacataaactcta

SEQ ID NO: 875973 - DNA, 22 bp, Artificial Sequence
  chemically synthesized
ttattaatacataaactctaaa

SEQ ID NO: 875974 - DNA, 22 bp, Artificial Sequence
  chemically synthesized
tattaatacataaactctaaat

SEQ ID NO: 875975 - DNA, 22 bp, Artificial Sequence
  chemically synthesized
attaatacataaactctaaata

SEQ ID NO: 875976 - DNA, 22 bp, Artificial Sequence
  chemically synthesized
ttaatacataaactctaaatag

SEQ ID NO: 875977 - DNA, 22 bp, Artificial Sequence
  chemically synthesized
atacataaactctaaatagtct

SEQ ID NO: 875978 - DNA, 22 bp, Artificial Sequence
  chemically synthesized
gagtaaatggacagactattta

SEQ ID NO: 875979 - DNA, 22 bp, Artificial Sequence
  chemically synthesized
taaatagtctgtccatttactc

SEQ ID NO: 875980 - DNA, 22 bp, Artificial Sequence
  chemically synthesized
aatagtctgtccatttactcta

SEQ ID NO: 875981 - DNA, 22 bp, Artificial Sequence
  chemically synthesized
tccatttactctaatattatct

SEQ ID NO: 875982 - DNA, 22 bp, Artificial Sequence
  chemically synthesized
gaaataagagtgggaaagataa

SEQ ID NO: 875983 - DNA, 22 bp, Artificial Sequence
  chemically synthesized
actctaatattatctttcccac

SEQ ID NO: 875984 - DNA, 22 bp, Artificial Sequence
  chemically synthesized
ctctaatattatctttcccact

SEQ ID NO: 875985 - DNA, 22 bp, Artificial Sequence
  chemically synthesized
tctggaaataagagtgggaaag

SEQ ID NO: 875986 - DNA, 22 bp, Artificial Sequence
  chemically synthesized
taatattatctttcccactctt

SEQ ID NO: 875987 - DNA, 22 bp, Artificial Sequence
  chemically synthesized
cctatctggaaataagagtggg

SEQ ID NO: 875988 - DNA, 22 bp, Artificial Sequence
  chemically synthesized
atattatctttcccactcttat

SEQ ID NO: 875989 - DNA, 22 bp, Artificial Sequence
  chemically synthesized
acctatctggaaataagagtgg

SEQ ID NO: 875990 - DNA, 22 bp, Artificial Sequence
  chemically synthesized
atttacctatctggaaataaga

SEQ ID NO: 875991 - DNA, 22 bp, Artificial Sequence
  chemically synthesized
tctttcccactcttatttccag

SEQ ID NO: 875992 - DNA, 22 bp, Artificial Sequence
  chemically synthesized
tcccactcttatttccagatag

SEQ ID NO: 875993 - DNA, 22 bp, Artificial Sequence
  chemically synthesized
cccactcttatttccagatagg

SEQ ID NO: 875994 - DNA, 22 bp, Artificial Sequence
  chemically synthesized
ccactcttatttccagataggt

SEQ ID NO: 875995 - DNA, 22 bp, Artificial Sequence
  chemically synthesized
tagtaacccctcatttacctat

SEQ ID NO: 875996 - DNA, 22 bp, Artificial Sequence
  chemically synthesized
ttatttccagataggtaaatga

SEQ ID NO: 875997 - DNA, 22 bp, Artificial Sequence
  chemically synthesized
atttccagataggtaaatgagg

SEQ ID NO: 875998 - DNA, 22 bp, Artificial Sequence
  chemically synthesized
tttccagataggtaaatgaggg

SEQ ID NO: 875999 - DNA, 22 bp, Artificial Sequence
  chemically synthesized
gagattatagtaacccctcatt

SEQ ID NO: 876000 - DNA, 22 bp, Artificial Sequence
  chemically synthesized
ccagataggtaaatgaggggtt

SEQ ID NO: 876001 - DNA, 22 bp, Artificial Sequence
  chemically synthesized
cagataggtaaatgaggggtta

SEQ ID NO: 876002 - DNA, 22 bp, Artificial Sequence
  chemically synthesized
cattagagattatagtaacccc

SEQ ID NO: 876003 - DNA, 22 bp, Artificial Sequence
  chemically synthesized
tacattagagattatagtaacc

SEQ ID NO: 876004 - DNA, 22 bp, Artificial Sequence
  chemically synthesized
aaaatccacctctacattagag

SEQ ID NO: 876005 - DNA, 22 bp, Artificial Sequence
  chemically synthesized
aaaaatccacctctacattaga

SEQ ID NO: 876006 - DNA, 22 bp, Artificial Sequence
  chemically synthesized
taaaaatccacctctacattag

SEQ ID NO: 876007 - DNA, 22 bp, Artificial Sequence
  chemically synthesized
ctataatctctaatgtagaggt

SEQ ID NO: 876008 - DNA, 22 bp, Artificial Sequence
  chemically synthesized
attttaaaaatccacctctaca

SEQ ID NO: 876009 - DNA, 22 bp, Artificial Sequence
  chemically synthesized
aattttaaaaatccacctctac

SEQ ID NO: 876010 - DNA, 22 bp, Artificial Sequence
  chemically synthesized
taatctctaatgtagaggtgga

SEQ ID NO: 876011 - DNA, 22 bp, Artificial Sequence
  chemically synthesized
taatgtagaggtggatttttaa

SEQ ID NO: 876012 - DNA, 22 bp, Artificial Sequence
  chemically synthesized
atgtagaggtggatttttaaaa

SEQ ID NO: 876013 - DNA, 22 bp, Artificial Sequence
  chemically synthesized
gtagtgccatttaattttaaaa

SEQ ID NO: 876014 - DNA, 22 bp, Artificial Sequence
  chemically synthesized
tgatacattggtagtgccattt

SEQ ID NO: 876015 - DNA, 22 bp, Artificial Sequence
  chemically synthesized
gtgatacattggtagtgccatt

SEQ ID NO: 876016 - DNA, 22 bp, Artificial Sequence
  chemically synthesized
ttaaaattaaatggcactacca

SEQ ID NO: 876017 - DNA, 22 bp, Artificial Sequence
  chemically synthesized
taaaattaaatggcactaccaa

SEQ ID NO: 876018 - DNA, 22 bp, Artificial Sequence
  chemically synthesized
aaaattaaatggcactaccaat

SEQ ID NO: 876019 - DNA, 22 bp, Artificial Sequence
  chemically synthesized
aaattaaatggcactaccaatg

SEQ ID NO: 876020 - DNA, 22 bp, Artificial Sequence
  chemically synthesized
agacatttgtgatacattggta

SEQ ID NO: 876021 - DNA, 22 bp, Artificial Sequence
  chemically synthesized
aatggcactaccaatgtatcac

SEQ ID NO: 876022 - DNA, 22 bp, Artificial Sequence
  chemically synthesized
cagtgtcctcagacatttgtga

SEQ ID NO: 876023 - DNA, 22 bp, Artificial Sequence
  chemically synthesized
ccaatgtatcacaaatgtctga

SEQ ID NO: 876024 - DNA, 22 bp, Artificial Sequence
  chemically synthesized
acccattgcagtgtcctcagac

SEQ ID NO: 876025 - DNA, 22 bp, Artificial Sequence
  chemically synthesized
gacccattgcagtgtcctcaga

SEQ ID NO: 876026 - DNA, 22 bp, Artificial Sequence
  chemically synthesized
tgacccattgcagtgtcctcag

SEQ ID NO: 876027 - DNA, 22 bp, Artificial Sequence
  chemically synthesized
aacctttgacccattgcagtgt

SEQ ID NO: 876028 - DNA, 22 bp, Artificial Sequence
  chemically synthesized
ttgaacctttgacccattgcag

SEQ ID NO: 876029 - DNA, 22 bp, Artificial Sequence
  chemically synthesized
attgaacctttgacccattgca

SEQ ID NO: 876030 - DNA, 22 bp, Artificial Sequence
  chemically synthesized
aggacactgcaatgggtcaaag

SEQ ID NO: 876031 - DNA, 22 bp, Artificial Sequence
  chemically synthesized
agcttattgaacctttgaccca

SEQ ID NO: 876032 - DNA, 22 bp, Artificial Sequence
  chemically synthesized
tgagcttattgaacctttgacc

SEQ ID NO: 876033 - DNA, 22 bp, Artificial Sequence
  chemically synthesized
caatgggtcaaaggttcaataa

SEQ ID NO: 876034 - DNA, 22 bp, Artificial Sequence
  chemically synthesized
tacagttctgagcttattgaac

SEQ ID NO: 876035 - DNA, 22 bp, Artificial Sequence
  chemically synthesized
gaaattatacagttctgagctt

SEQ ID NO: 876036 - DNA, 22 bp, Artificial Sequence
  chemically synthesized
aataagctcagaactgtataat

SEQ ID NO: 876037 - DNA, 22 bp, Artificial Sequence
  chemically synthesized
taaaagattggaaattatacag

SEQ ID NO: 876038 - DNA, 22 bp, Artificial Sequence
  chemically synthesized
ataattataaaagattggaaat

SEQ ID NO: 876039 - DNA, 22 bp, Artificial Sequence
  chemically synthesized
agaactgtataatttccaatct

SEQ ID NO: 876040 - DNA, 22 bp, Artificial Sequence
  chemically synthesized
ctaataattataaaagattgga

SEQ ID NO: 876041 - DNA, 22 bp, Artificial Sequence
  chemically synthesized
gctaataattataaaagattgg

SEQ ID NO: 876042 - DNA, 22 bp, Artificial Sequence
  chemically synthesized
tataatttccaatcttttataa

SEQ ID NO: 876043 - DNA, 22 bp, Artificial Sequence
  chemically synthesized
ataagtatttgctaataattat

SEQ ID NO: 876044 - DNA, 22 bp, Artificial Sequence
  chemically synthesized
cataagtatttgctaataatta

SEQ ID NO: 876045 - DNA, 22 bp, Artificial Sequence
  chemically synthesized
ccaatcttttataattattagc

SEQ ID NO: 876046 - DNA, 22 bp, Artificial Sequence
  chemically synthesized
caatcttttataattattagca

SEQ ID NO: 876047 - DNA, 22 bp, Artificial Sequence
  chemically synthesized
ttataattattagcaaatactt

SEQ ID NO: 876048 - DNA, 22 bp, Artificial Sequence
  chemically synthesized
tagtcatttcataagtatttgc

SEQ ID NO: 876049 - DNA, 22 bp, Artificial Sequence
  chemically synthesized
tataattattagcaaatactta

SEQ ID NO: 876050 - DNA, 22 bp, Artificial Sequence
  chemically synthesized
ataattattagcaaatacttat

SEQ ID NO: 876051 - DNA, 22 bp, Artificial Sequence
  chemically synthesized
taattattagcaaatacttatg

SEQ ID NO: 876052 - DNA, 22 bp, Artificial Sequence
  chemically synthesized
ttagcaaatacttatgaaatga

SEQ ID NO: 876053 - DNA, 22 bp, Artificial Sequence
  chemically synthesized
gcaaatacttatgaaatgacta

SEQ ID NO: 876054 - DNA, 22 bp, Artificial Sequence
  chemically synthesized
atgaaatgactacagtttttga

SEQ ID NO: 876055 - DNA, 22 bp, Artificial Sequence
  chemically synthesized
tgaacagccaaatcaaaaactg

SEQ ID NO: 876056 - DNA, 22 bp, Artificial Sequence
  chemically synthesized
tgaaatgactacagtttttgat

SEQ ID NO: 876057 - DNA, 22 bp, Artificial Sequence
  chemically synthesized
gtgaacagccaaatcaaaaact

SEQ ID NO: 876058 - DNA, 22 bp, Artificial Sequence
  chemically synthesized
tgtgaacagccaaatcaaaaac

SEQ ID NO: 876059 - DNA, 22 bp, Artificial Sequence
  chemically synthesized
ttgtgaacagccaaatcaaaaa

SEQ ID NO: 876060 - DNA, 22 bp, Artificial Sequence
  chemically synthesized
tttttgtgaacagccaaatcaa

SEQ ID NO: 876061 - DNA, 22 bp, Artificial Sequence
  chemically synthesized
cagtttttgatttggctgttca

SEQ ID NO: 876062 - DNA, 22 bp, Artificial Sequence
  chemically synthesized
ttgatttggctgttcacaaaaa

SEQ ID NO: 876063 - DNA, 22 bp, Artificial Sequence
  chemically synthesized
tgatttggctgttcacaaaaac

SEQ ID NO: 876064 - DNA, 22 bp, Artificial Sequence
  chemically synthesized
gatttggctgttcacaaaaaca

SEQ ID NO: 876065 - DNA, 22 bp, Artificial Sequence
  chemically synthesized
atttggctgttcacaaaaacaa

SEQ ID NO: 876066 - DNA, 22 bp, Artificial Sequence
  chemically synthesized
aaaaagtagcaagattgttttt

SEQ ID NO: 876067 - DNA, 22 bp, Artificial Sequence
  chemically synthesized
gaaaaagtagcaagattgtttt

SEQ ID NO: 876068 - DNA, 22 bp, Artificial Sequence
  chemically synthesized
ggctgttcacaaaaacaatctt

SEQ ID NO: 876069 - DNA, 22 bp, Artificial Sequence
  chemically synthesized
gctgttcacaaaaacaatcttg

SEQ ID NO: 876070 - DNA, 22 bp, Artificial Sequence
  chemically synthesized
ttgaaaaagtagcaagattgtt

SEQ ID NO: 876071 - DNA, 22 bp, Artificial Sequence
  chemically synthesized
ttcacaaaaacaatcttgctac

SEQ ID NO: 876072 - DNA, 22 bp, Artificial Sequence
  chemically synthesized
acaaaaacaatcttgctacttt

SEQ ID NO: 876073 - DNA, 22 bp, Artificial Sequence
  chemically synthesized
cagtacaccaaactcttgaaaa

SEQ ID NO: 876074 - DNA, 22 bp, Artificial Sequence
  chemically synthesized
tacagtacaccaaactcttgaa

SEQ ID NO: 876075 - DNA, 22 bp, Artificial Sequence
  chemically synthesized
gctactttttcaagagtttggt

SEQ ID NO: 876076 - DNA, 22 bp, Artificial Sequence
  chemically synthesized
ctactttttcaagagtttggtg

SEQ ID NO: 876077 - DNA, 22 bp, Artificial Sequence
  chemically synthesized
aactctacagtacaccaaactc

SEQ ID NO: 876078 - DNA, 22 bp, Artificial Sequence
  chemically synthesized
caactctacagtacaccaaact

SEQ ID NO: 876079 - DNA, 22 bp, Artificial Sequence
  chemically synthesized
ctttttcaagagtttggtgtac

SEQ ID NO: 876080 - DNA, 22 bp, Artificial Sequence
  chemically synthesized
tttcaagagtttggtgtactgt

SEQ ID NO: 876081 - DNA, 22 bp, Artificial Sequence
  chemically synthesized
ttcaagagtttggtgtactgta

SEQ ID NO: 876082 - DNA, 22 bp, Artificial Sequence
  chemically synthesized
tcaagagtttggtgtactgtag

SEQ ID NO: 876083 - DNA, 22 bp, Artificial Sequence
  chemically synthesized
caagagtttggtgtactgtaga

SEQ ID NO: 876084 - DNA, 22 bp, Artificial Sequence
  chemically synthesized
aagagtttggtgtactgtagag

SEQ ID NO: 876085 - DNA, 22 bp, Artificial Sequence
  chemically synthesized
ggtgtactgtagagttgaaatg

SEQ ID NO: 876086 - DNA, 22 bp, Artificial Sequence
  chemically synthesized
gtgtactgtagagttgaaatgg

SEQ ID NO: 876087 - DNA, 22 bp, Artificial Sequence
  chemically synthesized
tataatatataaataatccatt

SEQ ID NO: 876088 - DNA, 22 bp, Artificial Sequence
  chemically synthesized
gtataatatataaataatccat

SEQ ID NO: 876089 - DNA, 22 bp, Artificial Sequence
  chemically synthesized
tagagttgaaatggattattta

SEQ ID NO: 876090 - DNA, 22 bp, Artificial Sequence
  chemically synthesized
aaatggattatttatatattat

SEQ ID NO: 876091 - DNA, 22 bp, Artificial Sequence
  chemically synthesized
tttatatattatacaagttctt

SEQ ID NO: 876092 - DNA, 22 bp, Artificial Sequence
  chemically synthesized
atatattatacaagttcttttt

SEQ ID NO: 876093 - DNA, 22 bp, Artificial Sequence
  chemically synthesized
tatattatacaagttctttttt

SEQ ID NO: 876094 - DNA, 22 bp, Artificial Sequence
  chemically synthesized
tacaagttcttttttgttttgc

SEQ ID NO: 876095 - DNA, 22 bp, Artificial Sequence
  chemically synthesized
ttttttgttttgcttcattttg

SEQ ID NO: 876096 - DNA, 22 bp, Artificial Sequence
  chemically synthesized
ttttgttttgcttcattttgct

SEQ ID NO: 876097 - DNA, 22 bp, Artificial Sequence
  chemically synthesized
tttgttttgcttcattttgctt

SEQ ID NO: 876098 - DNA, 22 bp, Artificial Sequence
  chemically synthesized
ttgttttgcttcattttgcttt

SEQ ID NO: 876099 - DNA, 22 bp, Artificial Sequence
  chemically synthesized
tgttttgcttcattttgctttt

SEQ ID NO: 876100 - DNA, 22 bp, Artificial Sequence
  chemically synthesized
gttttgcttcattttgcttttc

SEQ ID NO: 876101 - DNA, 22 bp, Artificial Sequence
  chemically synthesized
ttttgcttcattttgcttttca

SEQ ID NO: 876102 - DNA, 22 bp, Artificial Sequence
  chemically synthesized
tgcttcattttgcttttcactt

SEQ ID NO: 876103 - DNA, 22 bp, Artificial Sequence
  chemically synthesized
gcttcattttgcttttcacttc

SEQ ID NO: 876104 - DNA, 22 bp, Artificial Sequence
  chemically synthesized
cttcattttgcttttcacttct

SEQ ID NO: 876105 - DNA, 22 bp, Artificial Sequence
  chemically synthesized
cattttgcttttcacttctctg

SEQ ID NO: 876106 - DNA, 22 bp, Artificial Sequence
  chemically synthesized
attttgcttttcacttctctgg

SEQ ID NO: 876107 - DNA, 22 bp, Artificial Sequence
  chemically synthesized
tgcttttcacttctctggcatt

SEQ ID NO: 876108 - DNA, 22 bp, Artificial Sequence
  chemically synthesized
aaaatatgggcaaatgccagag

SEQ ID NO: 876109 - DNA, 22 bp, Artificial Sequence
  chemically synthesized
gcttttcacttctctggcattt

SEQ ID NO: 876110 - DNA, 22 bp, Artificial Sequence
  chemically synthesized
cttttcacttctctggcatttg

SEQ ID NO: 876111 - DNA, 22 bp, Artificial Sequence
  chemically synthesized
ttcacttctctggcatttgccc

SEQ ID NO: 876112 - DNA, 22 bp, Artificial Sequence
  chemically synthesized
tcacttctctggcatttgccca

SEQ ID NO: 876113 - DNA, 22 bp, Artificial Sequence
  chemically synthesized
cacttctctggcatttgcccat

SEQ ID NO: 876114 - DNA, 22 bp, Artificial Sequence
  chemically synthesized
acttctctggcatttgcccata

SEQ ID NO: 876115 - DNA, 22 bp, Artificial Sequence
  chemically synthesized
ctctggcatttgcccatatttt

SEQ ID NO: 876116 - DNA, 22 bp, Artificial Sequence
  chemically synthesized
tctggcatttgcccatattttc

SEQ ID NO: 876117 - DNA, 22 bp, Artificial Sequence
  chemically synthesized
tggcatttgcccatattttcaa

SEQ ID NO: 876118 - DNA, 22 bp, Artificial Sequence
  chemically synthesized
gcatttgcccatattttcaatt

SEQ ID NO: 876119 - DNA, 22 bp, Artificial Sequence
  chemically synthesized
gaatgatgagagaattgaaaat

SEQ ID NO: 876120 - DNA, 22 bp, Artificial Sequence
  chemically synthesized
attggaatgatgagagaattga

SEQ ID NO: 876121 - DNA, 22 bp, Artificial Sequence
  chemically synthesized
aattggaatgatgagagaattg

SEQ ID NO: 876122 - DNA, 22 bp, Artificial Sequence
  chemically synthesized
gcccatattttcaattctctca

SEQ ID NO: 876123 - DNA, 22 bp, Artificial Sequence
  chemically synthesized
cccatattttcaattctctcat

SEQ ID NO: 876124 - DNA, 22 bp, Artificial Sequence
  chemically synthesized
cagcttaattggaatgatgaga

SEQ ID NO: 876125 - DNA, 22 bp, Artificial Sequence
  chemically synthesized
acagcttaattggaatgatgag

SEQ ID NO: 876126 - DNA, 22 bp, Artificial Sequence
  chemically synthesized
tacagcttaattggaatgatga

SEQ ID NO: 876127 - DNA, 22 bp, Artificial Sequence
  chemically synthesized
tcaattctctcatcattccaat

SEQ ID NO: 876128 - DNA, 22 bp, Artificial Sequence
  chemically synthesized
caattctctcatcattccaatt

SEQ ID NO: 876129 - DNA, 22 bp, Artificial Sequence
  chemically synthesized
aattctctcatcattccaatta

SEQ ID NO: 876130 - DNA, 22 bp, Artificial Sequence
  chemically synthesized
tctcatcattccaattaagctg

SEQ ID NO: 876131 - DNA, 22 bp, Artificial Sequence
  chemically synthesized
tcatcattccaattaagctgta

SEQ ID NO: 876132 - DNA, 22 bp, Artificial Sequence
  chemically synthesized
tgcaaatgaattttacagctta

SEQ ID NO: 876133 - DNA, 22 bp, Artificial Sequence
  chemically synthesized
atcattccaattaagctgtaaa

SEQ ID NO: 876134 - DNA, 22 bp, Artificial Sequence
  chemically synthesized
ttatgcaaatgaattttacagc

SEQ ID NO: 876135 - DNA, 22 bp, Artificial Sequence
  chemically synthesized
gttatgcaaatgaattttacag

SEQ ID NO: 876136 - DNA, 22 bp, Artificial Sequence
  chemically synthesized
tgttatgcaaatgaattttaca

SEQ ID NO: 876137 - DNA, 22 bp, Artificial Sequence
  chemically synthesized
ttgttatgcaaatgaattttac

SEQ ID NO: 876138 - DNA, 22 bp, Artificial Sequence
  chemically synthesized
tttgttatgcaaatgaatttta

SEQ ID NO: 876139 - DNA, 22 bp, Artificial Sequence
  chemically synthesized
caattaagctgtaaaattcatt

SEQ ID NO: 876140 - DNA, 22 bp, Artificial Sequence
  chemically synthesized
agctgtaaaattcatttgcata

SEQ ID NO: 876141 - DNA, 22 bp, Artificial Sequence
  chemically synthesized
taaaattcatttgcataacaaa

SEQ ID NO: 876142 - DNA, 22 bp, Artificial Sequence
  chemically synthesized
cagccaaacattttttgttatg

SEQ ID NO: 876143 - DNA, 22 bp, Artificial Sequence
  chemically synthesized
ctacagccaaacattttttgtt

SEQ ID NO: 876144 - DNA, 22 bp, Artificial Sequence
  chemically synthesized
atttgcataacaaaaaatgttt

SEQ ID NO: 876145 - DNA, 22 bp, Artificial Sequence
  chemically synthesized
gttgctacagccaaacattttt

SEQ ID NO: 876146 - DNA, 22 bp, Artificial Sequence
  chemically synthesized
gcataacaaaaaatgtttggct

SEQ ID NO: 876147 - DNA, 22 bp, Artificial Sequence
  chemically synthesized
actagttgctacagccaaacat

SEQ ID NO: 876148 - DNA, 22 bp, Artificial Sequence
  chemically synthesized
cataacaaaaaatgtttggctg

SEQ ID NO: 876149 - DNA, 22 bp, Artificial Sequence
  chemically synthesized
tatgatgaacacctgactagtt

SEQ ID NO: 876150 - DNA, 22 bp, Artificial Sequence
  chemically synthesized
ggctgtagcaactagtcaggtg

SEQ ID NO: 876151 - DNA, 22 bp, Artificial Sequence
  chemically synthesized
ttatatgatgaacacctgacta

SEQ ID NO: 876152 - DNA, 22 bp, Artificial Sequence
  chemically synthesized
gctgtagcaactagtcaggtgt

SEQ ID NO: 876153 - DNA, 22 bp, Artificial Sequence
  chemically synthesized
attatatgatgaacacctgact

SEQ ID NO: 876154 - DNA, 22 bp, Artificial Sequence
  chemically synthesized
tattatatgatgaacacctgac

SEQ ID NO: 876155 - DNA, 22 bp, Artificial Sequence
  chemically synthesized
tagcaactagtcaggtgttcat

SEQ ID NO: 876156 - DNA, 22 bp, Artificial Sequence
  chemically synthesized
aattttattatatgatgaacac

SEQ ID NO: 876157 - DNA, 22 bp, Artificial Sequence
  chemically synthesized
aaattttattatatgatgaaca

SEQ ID NO: 876158 - DNA, 22 bp, Artificial Sequence
  chemically synthesized
cttaaattttattatatgatga

SEQ ID NO: 876159 - DNA, 22 bp, Artificial Sequence
  chemically synthesized
gtcaggtgttcatcatataata

SEQ ID NO: 876160 - DNA, 22 bp, Artificial Sequence
  chemically synthesized
agcactgcttaaattttattat

SEQ ID NO: 876161 - DNA, 22 bp, Artificial Sequence
  chemically synthesized
ttgagcactgcttaaattttat

SEQ ID NO: 876162 - DNA, 22 bp, Artificial Sequence
  chemically synthesized
tattgagcactgcttaaatttt

SEQ ID NO: 876163 - DNA, 22 bp, Artificial Sequence
  chemically synthesized
ctattgagcactgcttaaattt

SEQ ID NO: 876164 - DNA, 22 bp, Artificial Sequence
  chemically synthesized
atcatataataaaatttaagca

SEQ ID NO: 876165 - DNA, 22 bp, Artificial Sequence
  chemically synthesized
cagatttctattgagcactgct

SEQ ID NO: 876166 - DNA, 22 bp, Artificial Sequence
  chemically synthesized
acagatttctattgagcactgc

SEQ ID NO: 876167 - DNA, 22 bp, Artificial Sequence
  chemically synthesized
tacagatttctattgagcactg

SEQ ID NO: 876168 - DNA, 22 bp, Artificial Sequence
  chemically synthesized
ttacagatttctattgagcact

SEQ ID NO: 876169 - DNA, 22 bp, Artificial Sequence
  chemically synthesized
ccttttacagatttctattgag

SEQ ID NO: 876170 - DNA, 22 bp, Artificial Sequence
  chemically synthesized
ttaccttttacagatttctatt

SEQ ID NO: 876171 - DNA, 22 bp, Artificial Sequence
  chemically synthesized
aagcagtgctcaatagaaatct

SEQ ID NO: 876172 - DNA, 22 bp, Artificial Sequence
  chemically synthesized
agcagtgctcaatagaaatctg

SEQ ID NO: 876173 - DNA, 22 bp, Artificial Sequence
  chemically synthesized
caaattgttaccttttacagat

SEQ ID NO: 876174 - DNA, 22 bp, Artificial Sequence
  chemically synthesized
aatagaaatctgtaaaaggtaa

SEQ ID NO: 876175 - DNA, 22 bp, Artificial Sequence
  chemically synthesized
acatgtattgcaaattgttacc

SEQ ID NO: 876176 - DNA, 22 bp, Artificial Sequence
  chemically synthesized
taaaaggtaacaatttgcaata

SEQ ID NO: 876177 - DNA, 22 bp, Artificial Sequence
  chemically synthesized
tagatgattaacatgtattgca

SEQ ID NO: 876178 - DNA, 22 bp, Artificial Sequence
  chemically synthesized
atagatgattaacatgtattgc

SEQ ID NO: 876179 - DNA, 22 bp, Artificial Sequence
  chemically synthesized
cttatagatgattaacatgtat

SEQ ID NO: 876180 - DNA, 22 bp, Artificial Sequence
  chemically synthesized
gcttatagatgattaacatgta

SEQ ID NO: 876181 - DNA, 22 bp, Artificial Sequence
  chemically synthesized
aatttgcttatagatgattaac

SEQ ID NO: 876182 - DNA, 22 bp, Artificial Sequence
  chemically synthesized
aaatttgcttatagatgattaa

SEQ ID NO: 876183 - DNA, 22 bp, Artificial Sequence
  chemically synthesized
gcaatacatgttaatcatctat

SEQ ID NO: 876184 - DNA, 22 bp, Artificial Sequence
  chemically synthesized
caatacatgttaatcatctata

SEQ ID NO: 876185 - DNA, 22 bp, Artificial Sequence
  chemically synthesized
cttaaatttgcttatagatgat

SEQ ID NO: 876186 - DNA, 22 bp, Artificial Sequence
  chemically synthesized
ccttaaatttgcttatagatga

SEQ ID NO: 876187 - DNA, 22 bp, Artificial Sequence
  chemically synthesized
atttccttaaatttgcttatag

SEQ ID NO: 876188 - DNA, 22 bp, Artificial Sequence
  chemically synthesized
gatttccttaaatttgcttata

SEQ ID NO: 876189 - DNA, 22 bp, Artificial Sequence
  chemically synthesized
tttgatttccttaaatttgctt

SEQ ID NO: 876190 - DNA, 22 bp, Artificial Sequence
  chemically synthesized
atttgatttccttaaatttgct

SEQ ID NO: 876191 - DNA, 22 bp, Artificial Sequence
  chemically synthesized
atcatctataagcaaatttaag

SEQ ID NO: 876192 - DNA, 22 bp, Artificial Sequence
  chemically synthesized
agtacttatttgatttccttaa

SEQ ID NO: 876193 - DNA, 22 bp, Artificial Sequence
  chemically synthesized
aagtacttatttgatttcctta

SEQ ID NO: 876194 - DNA, 22 bp, Artificial Sequence
  chemically synthesized
taagcaaatttaaggaaatcaa

SEQ ID NO: 876195 - DNA, 22 bp, Artificial Sequence
  chemically synthesized
ggatttaagtacttatttgatt

SEQ ID NO: 876196 - DNA, 22 bp, Artificial Sequence
  chemically synthesized
aaggaaatcaaataagtactta

SEQ ID NO: 876197 - DNA, 22 bp, Artificial Sequence
  chemically synthesized
aggaaatcaaataagtacttaa

SEQ ID NO: 876198 - DNA, 22 bp, Artificial Sequence
  chemically synthesized
aataagttgggatttaagtact

SEQ ID NO: 876199 - DNA, 22 bp, Artificial Sequence
  chemically synthesized
aaataagttgggatttaagtac

SEQ ID NO: 876200 - DNA, 22 bp, Artificial Sequence
  chemically synthesized
tttaaataagttgggatttaag

SEQ ID NO: 876201 - DNA, 22 bp, Artificial Sequence
  chemically synthesized
atacgctatttaaataagttgg

SEQ ID NO: 876202 - DNA, 22 bp, Artificial Sequence
  chemically synthesized
aaatcccaacttatttaaatag

SEQ ID NO: 876203 - DNA, 22 bp, Artificial Sequence
  chemically synthesized
aatcccaacttatttaaatagc

SEQ ID NO: 876204 - DNA, 22 bp, Artificial Sequence
  chemically synthesized
tcccactgatacgctatttaaa

SEQ ID NO: 876205 - DNA, 22 bp, Artificial Sequence
  chemically synthesized
ttatcccactgatacgctattt

SEQ ID NO: 876206 - DNA, 22 bp, Artificial Sequence
  chemically synthesized
ataactattatcccactgatac

SEQ ID NO: 876207 - DNA, 22 bp, Artificial Sequence
  chemically synthesized
atttaaatagcgtatcagtggg

SEQ ID NO: 876208 - DNA, 22 bp, Artificial Sequence
  chemically synthesized
gataactattatcccactgata

SEQ ID NO: 876209 - DNA, 22 bp, Artificial Sequence
  chemically synthesized
tttaaatagcgtatcagtggga

SEQ ID NO: 876210 - DNA, 22 bp, Artificial Sequence
  chemically synthesized
aaatagcgtatcagtgggataa

SEQ ID NO: 876211 - DNA, 22 bp, Artificial Sequence
  chemically synthesized
aatagcgtatcagtgggataat

SEQ ID NO: 876212 - DNA, 22 bp, Artificial Sequence
  chemically synthesized
tggagatgtagtcaagaatagg

SEQ ID NO: 876213 - DNA, 22 bp, Artificial Sequence
  chemically synthesized
tcaagtcctattcttgactaca

SEQ ID NO: 876214 - DNA, 22 bp, Artificial Sequence
  chemically synthesized
aaattatggagatgtagtcaag

SEQ ID NO: 876215 - DNA, 22 bp, Artificial Sequence
  chemically synthesized
aaaattatggagatgtagtcaa

SEQ ID NO: 876216 - DNA, 22 bp, Artificial Sequence
  chemically synthesized
taaaattatggagatgtagtca

SEQ ID NO: 876217 - DNA, 22 bp, Artificial Sequence
  chemically synthesized
aaagttttaaaattatggagat

SEQ ID NO: 876218 - DNA, 22 bp, Artificial Sequence
  chemically synthesized
ttcttgactacatctccataat

SEQ ID NO: 876219 - DNA, 22 bp, Artificial Sequence
  chemically synthesized
ttgactacatctccataatttt

SEQ ID NO: 876220 - DNA, 22 bp, Artificial Sequence
  chemically synthesized
gactacatctccataattttaa

SEQ ID NO: 876221 - DNA, 22 bp, Artificial Sequence
  chemically synthesized
actacatctccataattttaaa

SEQ ID NO: 876222 - DNA, 22 bp, Artificial Sequence
  chemically synthesized
gcatattcaaagttttaaaatt

SEQ ID NO: 876223 - DNA, 22 bp, Artificial Sequence
  chemically synthesized
catctccataattttaaaactt

SEQ ID NO: 876224 - DNA, 22 bp, Artificial Sequence
  chemically synthesized
gttagcatattcaaagttttaa

SEQ ID NO: 876225 - DNA, 22 bp, Artificial Sequence
  chemically synthesized
agttagcatattcaaagtttta

SEQ ID NO: 876226 - DNA, 22 bp, Artificial Sequence
  chemically synthesized
cataattttaaaactttgaata

SEQ ID NO: 876227 - DNA, 22 bp, Artificial Sequence
  chemically synthesized
caatttagttagcatattcaaa

SEQ ID NO: 876228 - DNA, 22 bp, Artificial Sequence
  chemically synthesized
taaaactttgaatatgctaact

SEQ ID NO: 876229 - DNA, 22 bp, Artificial Sequence
  chemically synthesized
gacctgcaatttagttagcata

SEQ ID NO: 876230 - DNA, 22 bp, Artificial Sequence
  chemically synthesized
aaaactttgaatatgctaacta

SEQ ID NO: 876231 - DNA, 22 bp, Artificial Sequence
  chemically synthesized
ggacctgcaatttagttagcat

SEQ ID NO: 876232 - DNA, 22 bp, Artificial Sequence
  chemically synthesized
aaactttgaatatgctaactaa

SEQ ID NO: 876233 - DNA, 22 bp, Artificial Sequence
  chemically synthesized
tgaatatgctaactaaattgca

SEQ ID NO: 876234 - DNA, 22 bp, Artificial Sequence
  chemically synthesized
gaatatgctaactaaattgcag

SEQ ID NO: 876235 - DNA, 22 bp, Artificial Sequence
  chemically synthesized
aatatgctaactaaattgcagg

SEQ ID NO: 876236 - DNA, 22 bp, Artificial Sequence
  chemically synthesized
tgcggaaaaccttggacctgca

SEQ ID NO: 876237 - DNA, 22 bp, Artificial Sequence
  chemically synthesized
gtgcggaaaaccttggacctgc

SEQ ID NO: 876238 - DNA, 22 bp, Artificial Sequence
  chemically synthesized
ttgtgcggaaaaccttggacct

SEQ ID NO: 876239 - DNA, 22 bp, Artificial Sequence
  chemically synthesized
actaaattgcaggtccaaggtt

SEQ ID NO: 876240 - DNA, 22 bp, Artificial Sequence
  chemically synthesized
aattgcaggtccaaggttttcc

SEQ ID NO: 876241 - DNA, 22 bp, Artificial Sequence
  chemically synthesized
gagctcttgtgcggaaaacctt

SEQ ID NO: 876242 - DNA, 22 bp, Artificial Sequence
  chemically synthesized
ggagctcttgtgcggaaaacct

SEQ ID NO: 876243 - DNA, 22 bp, Artificial Sequence
  chemically synthesized
caggtccaaggttttccgcaca

SEQ ID NO: 876244 - DNA, 22 bp, Artificial Sequence
  chemically synthesized
agtttggagctcttgtgcggaa

SEQ ID NO: 876245 - DNA, 22 bp, Artificial Sequence
  chemically synthesized
ttgagtttggagctcttgtgcg

SEQ ID NO: 876246 - DNA, 22 bp, Artificial Sequence
  chemically synthesized
tgttgagtttggagctcttgtg

SEQ ID NO: 876247 - DNA, 22 bp, Artificial Sequence
  chemically synthesized
actctgttgagtttggagctct

SEQ ID NO: 876248 - DNA, 22 bp, Artificial Sequence
  chemically synthesized
tccgcacaagagctccaaactc

SEQ ID NO: 876249 - DNA, 22 bp, Artificial Sequence
  chemically synthesized
ccgcacaagagctccaaactca

SEQ ID NO: 876250 - DNA, 22 bp, Artificial Sequence
  chemically synthesized
cgcacaagagctccaaactcaa

SEQ ID NO: 876251 - DNA, 22 bp, Artificial Sequence
  chemically synthesized
gtagaacacgaattcactctgt

SEQ ID NO: 876252 - DNA, 22 bp, Artificial Sequence
  chemically synthesized
ggtagaacacgaattcactctg

SEQ ID NO: 876253 - DNA, 22 bp, Artificial Sequence
  chemically synthesized
tggtagaacacgaattcactct

SEQ ID NO: 876254 - DNA, 22 bp, Artificial Sequence
  chemically synthesized
caaactcaacagagtgaattcg

SEQ ID NO: 876255 - DNA, 22 bp, Artificial Sequence
  chemically synthesized
tccattttggtagaacacgaat

SEQ ID NO: 876256 - DNA, 22 bp, Artificial Sequence
  chemically synthesized
atccattttggtagaacacgaa

SEQ ID NO: 876257 - DNA, 22 bp, Artificial Sequence
  chemically synthesized
aacagagtgaattcgtgttcta

SEQ ID NO: 876258 - DNA, 22 bp, Artificial Sequence
  chemically synthesized
ccaaagtttatccattttggta

SEQ ID NO: 876259 - DNA, 22 bp, Artificial Sequence
  chemically synthesized
gtgttctaccaaaatggataaa

SEQ ID NO: 876260 - DNA, 22 bp, Artificial Sequence
  chemically synthesized
taccaaaatggataaactttgg

SEQ ID NO: 876261 - DNA, 22 bp, Artificial Sequence
  chemically synthesized
ccaaaatggataaactttggga

SEQ ID NO: 876262 - DNA, 22 bp, Artificial Sequence
  chemically synthesized
caaacaaaagaattcccaaagt

SEQ ID NO: 876263 - DNA, 22 bp, Artificial Sequence
  chemically synthesized
acaaacaaaagaattcccaaag

SEQ ID NO: 876264 - DNA, 22 bp, Artificial Sequence
  chemically synthesized
catttacaaacaaaagaattcc

SEQ ID NO: 876265 - DNA, 22 bp, Artificial Sequence
  chemically synthesized
ccatttacaaacaaaagaattc

SEQ ID NO: 876266 - DNA, 22 bp, Artificial Sequence
  chemically synthesized
tccatttacaaacaaaagaatt

SEQ ID NO: 876267 - DNA, 22 bp, Artificial Sequence
  chemically synthesized
ttccatttacaaacaaaagaat

SEQ ID NO: 876268 - DNA, 22 bp, Artificial Sequence
  chemically synthesized
atttttccatttacaaacaaaa

SEQ ID NO: 876269 - DNA, 22 bp, Artificial Sequence
  chemically synthesized
tgggaattcttttgtttgtaaa

SEQ ID NO: 876270 - DNA, 22 bp, Artificial Sequence
  chemically synthesized
gggaattcttttgtttgtaaat

SEQ ID NO: 876271 - DNA, 22 bp, Artificial Sequence
  chemically synthesized
ggaattcttttgtttgtaaatg

SEQ ID NO: 876272 - DNA, 22 bp, Artificial Sequence
  chemically synthesized
taataaatctgatttttccatt

SEQ ID NO: 876273 - DNA, 22 bp, Artificial Sequence
  chemically synthesized
ttttgtttgtaaatggaaaaat

SEQ ID NO: 876274 - DNA, 22 bp, Artificial Sequence
  chemically synthesized
ttgtttgtaaatggaaaaatca

SEQ ID NO: 876275 - DNA, 22 bp, Artificial Sequence
  chemically synthesized
tgtttgtaaatggaaaaatcag

SEQ ID NO: 876276 - DNA, 22 bp, Artificial Sequence
  chemically synthesized
gtttgtaaatggaaaaatcaga

SEQ ID NO: 876277 - DNA, 22 bp, Artificial Sequence
  chemically synthesized
tttgtaaatggaaaaatcagat

SEQ ID NO: 876278 - DNA, 22 bp, Artificial Sequence
  chemically synthesized
gtaaatggaaaaatcagattta

SEQ ID NO: 876279 - DNA, 22 bp, Artificial Sequence
  chemically synthesized
taaatggaaaaatcagatttat

SEQ ID NO: 876280 - DNA, 22 bp, Artificial Sequence
  chemically synthesized
caaaagtcacctataataaatc

SEQ ID NO: 876281 - DNA, 22 bp, Artificial Sequence
  chemically synthesized
agctgcaaaagtcacctataat

SEQ ID NO: 876282 - DNA, 22 bp, Artificial Sequence
  chemically synthesized
attataggtgacttttgcagct

SEQ ID NO: 876283 - DNA, 22 bp, Artificial Sequence
  chemically synthesized
ttataggtgacttttgcagctg

SEQ ID NO: 876284 - DNA, 22 bp, Artificial Sequence
  chemically synthesized
taggtgacttttgcagctgagc

SEQ ID NO: 876285 - DNA, 22 bp, Artificial Sequence
  chemically synthesized
ttgcagctgagcattattctcc

SEQ ID NO: 876286 - DNA, 22 bp, Artificial Sequence
  chemically synthesized
tgcagctgagcattattctcca

SEQ ID NO: 876287 - DNA, 22 bp, Artificial Sequence
  chemically synthesized
gcagctgagcattattctccat

SEQ ID NO: 876288 - DNA, 22 bp, Artificial Sequence
  chemically synthesized
cagctgagcattattctccatt

SEQ ID NO: 876289 - DNA, 22 bp, Artificial Sequence
  chemically synthesized
aagcaaagtatatacaatggag

SEQ ID NO: 876290 - DNA, 22 bp, Artificial Sequence
  chemically synthesized
caagcaaagtatatacaatgga

SEQ ID NO: 876291 - DNA, 22 bp, Artificial Sequence
  chemically synthesized
tcaagcaaagtatatacaatgg

SEQ ID NO: 876292 - DNA, 22 bp, Artificial Sequence
  chemically synthesized
agcattattctccattgtatat

SEQ ID NO: 876293 - DNA, 22 bp, Artificial Sequence
  chemically synthesized
ttctccattgtatatactttgc

SEQ ID NO: 876294 - DNA, 22 bp, Artificial Sequence
  chemically synthesized
atgaatattttcaagcaaagta

SEQ ID NO: 876295 - DNA, 22 bp, Artificial Sequence
  chemically synthesized
tccattgtatatactttgcttg

SEQ ID NO: 876296 - DNA, 22 bp, Artificial Sequence
  chemically synthesized
aatgaatattttcaagcaaagt

SEQ ID NO: 876297 - DNA, 22 bp, Artificial Sequence
  chemically synthesized
cattgtatatactttgcttgaa

SEQ ID NO: 876298 - DNA, 22 bp, Artificial Sequence
  chemically synthesized
acatttaatgaatattttcaag

SEQ ID NO: 876299 - DNA, 22 bp, Artificial Sequence
  chemically synthesized
tatatactttgcttgaaaatat

SEQ ID NO: 876300 - DNA, 22 bp, Artificial Sequence
  chemically synthesized
aacatttaatgaatattttcaa

SEQ ID NO: 876301 - DNA, 22 bp, Artificial Sequence
  chemically synthesized
tcttaacatttaatgaatattt

SEQ ID NO: 876302 - DNA, 22 bp, Artificial Sequence
  chemically synthesized
tgcttgaaaatattcattaaat

SEQ ID NO: 876303 - DNA, 22 bp, Artificial Sequence
  chemically synthesized
gcttgaaaatattcattaaatg

SEQ ID NO: 876304 - DNA, 22 bp, Artificial Sequence
  chemically synthesized
cttgaaaatattcattaaatgt

SEQ ID NO: 876305 - DNA, 22 bp, Artificial Sequence
  chemically synthesized
atatagttgtcttaacatttaa

SEQ ID NO: 876306 - DNA, 22 bp, Artificial Sequence
  chemically synthesized
gaaaatattcattaaatgttaa

SEQ ID NO: 876307 - DNA, 22 bp, Artificial Sequence
  chemically synthesized
gatatagttgtcttaacattta

SEQ ID NO: 876308 - DNA, 22 bp, Artificial Sequence
  chemically synthesized
aaaatattcattaaatgttaag

SEQ ID NO: 876309 - DNA, 22 bp, Artificial Sequence
  chemically synthesized
atagtttgatatagttgtctta

SEQ ID NO: 876310 - DNA, 22 bp, Artificial Sequence
  chemically synthesized
catagtttgatatagttgtctt

SEQ ID NO: 876311 - DNA, 22 bp, Artificial Sequence
  chemically synthesized
attaaatgttaagacaactata

SEQ ID NO: 876312 - DNA, 22 bp, Artificial Sequence
  chemically synthesized
aatgttaagacaactatatcaa

SEQ ID NO: 876313 - DNA, 22 bp, Artificial Sequence
  chemically synthesized
agacaactatatcaaactatga

SEQ ID NO: 876314 - DNA, 22 bp, Artificial Sequence
  chemically synthesized
ataaagcagaaatttcatagtt

SEQ ID NO: 876315 - DNA, 22 bp, Artificial Sequence
  chemically synthesized
cataaagcagaaatttcatagt

SEQ ID NO: 876316 - DNA, 22 bp, Artificial Sequence
  chemically synthesized
ttcataaagcagaaatttcata

SEQ ID NO: 876317 - DNA, 22 bp, Artificial Sequence
  chemically synthesized
ttcttcataaagcagaaatttc

SEQ ID NO: 876318 - DNA, 22 bp, Artificial Sequence
  chemically synthesized
tatcaaactatgaaatttctgc

SEQ ID NO: 876319 - DNA, 22 bp, Artificial Sequence
  chemically synthesized
ctgttcttcataaagcagaaat

SEQ ID NO: 876320 - DNA, 22 bp, Artificial Sequence
  chemically synthesized
attcctgttcttcataaagcag

SEQ ID NO: 876321 - DNA, 22 bp, Artificial Sequence
  chemically synthesized
tgaaatttctgctttatgaaga

SEQ ID NO: 876322 - DNA, 22 bp, Artificial Sequence
  chemically synthesized
taactaattcctgttcttcata

SEQ ID NO: 876323 - DNA, 22 bp, Artificial Sequence
  chemically synthesized
gtaactaattcctgttcttcat

SEQ ID NO: 876324 - DNA, 22 bp, Artificial Sequence
  chemically synthesized
ttgtaactaattcctgttcttc

SEQ ID NO: 876325 - DNA, 22 bp, Artificial Sequence
  chemically synthesized
cttgtaactaattcctgttctt

SEQ ID NO: 876326 - DNA, 22 bp, Artificial Sequence
  chemically synthesized
tcttgtaactaattcctgttct

SEQ ID NO: 876327 - DNA, 22 bp, Artificial Sequence
  chemically synthesized
ctgctttatgaagaacaggaat

SEQ ID NO: 876328 - DNA, 22 bp, Artificial Sequence
  chemically synthesized
ttcttgtaactaattcctgttc

SEQ ID NO: 876329 - DNA, 22 bp, Artificial Sequence
  chemically synthesized
tgctttatgaagaacaggaatt

SEQ ID NO: 876330 - DNA, 22 bp, Artificial Sequence
  chemically synthesized
tttcttgtaactaattcctgtt

SEQ ID NO: 876331 - DNA, 22 bp, Artificial Sequence
  chemically synthesized
ctttatgaagaacaggaattag

SEQ ID NO: 876332 - DNA, 22 bp, Artificial Sequence
  chemically synthesized
tatgaagaacaggaattagtta

SEQ ID NO: 876333 - DNA, 22 bp, Artificial Sequence
  chemically synthesized
atgaagaacaggaattagttac

SEQ ID NO: 876334 - DNA, 22 bp, Artificial Sequence
  chemically synthesized
tgaagaacaggaattagttaca

SEQ ID NO: 876335 - DNA, 22 bp, Artificial Sequence
  chemically synthesized
agaaatcactttttcttgtaac

SEQ ID NO: 876336 - DNA, 22 bp, Artificial Sequence
  chemically synthesized
tattcagaaatcactttttctt

SEQ ID NO: 876337 - DNA, 22 bp, Artificial Sequence
  chemically synthesized
gttacaagaaaaagtgatttct

SEQ ID NO: 876338 - DNA, 22 bp, Artificial Sequence
  chemically synthesized
caagaaaaagtgatttctgaat

SEQ ID NO: 876339 - DNA, 22 bp, Artificial Sequence
  chemically synthesized
aaaggaaagctatattcagaaa

SEQ ID NO: 876340 - DNA, 22 bp, Artificial Sequence
  chemically synthesized
aaaaggaaagctatattcagaa

SEQ ID NO: 876341 - DNA, 22 bp, Artificial Sequence
  chemically synthesized
taaaaggaaagctatattcaga

SEQ ID NO: 876342 - DNA, 22 bp, Artificial Sequence
  chemically synthesized
aattttaaaaggaaagctatat

SEQ ID NO: 876343 - DNA, 22 bp, Artificial Sequence
  chemically synthesized
aaattttaaaaggaaagctata

SEQ ID NO: 876344 - DNA, 22 bp, Artificial Sequence
  chemically synthesized
taaattttaaaaggaaagctat

SEQ ID NO: 876345 - DNA, 22 bp, Artificial Sequence
  chemically synthesized
ctgaatatagctttccttttaa

SEQ ID NO: 876346 - DNA, 22 bp, Artificial Sequence
  chemically synthesized
tgaatatagctttccttttaaa

SEQ ID NO: 876347 - DNA, 22 bp, Artificial Sequence
  chemically synthesized
tccattttaaattttaaaagga

SEQ ID NO: 876348 - DNA, 22 bp, Artificial Sequence
  chemically synthesized
atccattttaaattttaaaagg

SEQ ID NO: 876349 - DNA, 22 bp, Artificial Sequence
  chemically synthesized
aatatagctttccttttaaaat

SEQ ID NO: 876350 - DNA, 22 bp, Artificial Sequence
  chemically synthesized
aatatttatccattttaaattt

SEQ ID NO: 876351 - DNA, 22 bp, Artificial Sequence
  chemically synthesized
aaatatttatccattttaaatt

SEQ ID NO: 876352 - DNA, 22 bp, Artificial Sequence
  chemically synthesized
tccttttaaaatttaaaatgga

SEQ ID NO: 876353 - DNA, 22 bp, Artificial Sequence
  chemically synthesized
ccttttaaaatttaaaatggat

SEQ ID NO: 876354 - DNA, 22 bp, Artificial Sequence
  chemically synthesized
cttttaaaatttaaaatggata

SEQ ID NO: 876355 - DNA, 22 bp, Artificial Sequence
  chemically synthesized
tcaccttaaatatttatccatt

SEQ ID NO: 876356 - DNA, 22 bp, Artificial Sequence
  chemically synthesized
ttaaaatttaaaatggataaat

SEQ ID NO: 876357 - DNA, 22 bp, Artificial Sequence
  chemically synthesized
taaaatttaaaatggataaata

SEQ ID NO: 876358 - DNA, 22 bp, Artificial Sequence
  chemically synthesized
aaaatttaaaatggataaatat

SEQ ID NO: 876359 - DNA, 22 bp, Artificial Sequence
  chemically synthesized
aaatttaaaatggataaatatt

SEQ ID NO: 876360 - DNA, 22 bp, Artificial Sequence
  chemically synthesized
cagtatctatcaccttaaatat

SEQ ID NO: 876361 - DNA, 22 bp, Artificial Sequence
  chemically synthesized
aaaatggataaatatttaaggt

SEQ ID NO: 876362 - DNA, 22 bp, Artificial Sequence
  chemically synthesized
aaatggataaatatttaaggtg

SEQ ID NO: 876363 - DNA, 22 bp, Artificial Sequence
  chemically synthesized
aaggtgatagatactgcaatca

SEQ ID NO: 876364 - DNA, 22 bp, Artificial Sequence
  chemically synthesized
aggtgatagatactgcaatcac

SEQ ID NO: 876365 - DNA, 22 bp, Artificial Sequence
  chemically synthesized
caatcactctgatttgatcatt

SEQ ID NO: 876366 - DNA, 22 bp, Artificial Sequence
  chemically synthesized
atacaagcatataatatataat

SEQ ID NO: 876367 - DNA, 22 bp, Artificial Sequence
  chemically synthesized
gatacaagcatataatatataa

SEQ ID NO: 876368 - DNA, 22 bp, Artificial Sequence
  chemically synthesized
tgatttgatcattatatattat

SEQ ID NO: 876369 - DNA, 22 bp, Artificial Sequence
  chemically synthesized
tgatacaagcatataatatata

SEQ ID NO: 876370 - DNA, 22 bp, Artificial Sequence
  chemically synthesized
atttgatcattatatattatat

SEQ ID NO: 876371 - DNA, 22 bp, Artificial Sequence
  chemically synthesized
gatcattatatattatatgctt

SEQ ID NO: 876372 - DNA, 22 bp, Artificial Sequence
  chemically synthesized
atcattatatattatatgcttg

SEQ ID NO: 876373 - DNA, 22 bp, Artificial Sequence
  chemically synthesized
tatattatatgcttgtatcaaa

SEQ ID NO: 876374 - DNA, 22 bp, Artificial Sequence
  chemically synthesized
ccacaagtgatattttgataca

SEQ ID NO: 876375 - DNA, 22 bp, Artificial Sequence
  chemically synthesized
accacaagtgatattttgatac

SEQ ID NO: 876376 - DNA, 22 bp, Artificial Sequence
  chemically synthesized
taccacaagtgatattttgata

SEQ ID NO: 876377 - DNA, 22 bp, Artificial Sequence
  chemically synthesized
ttaccacaagtgatattttgat

SEQ ID NO: 876378 - DNA, 22 bp, Artificial Sequence
  chemically synthesized
tatgcttgtatcaaaatatcac

SEQ ID NO: 876379 - DNA, 22 bp, Artificial Sequence
  chemically synthesized
cgtccttttaccacaagtgata

SEQ ID NO: 876380 - DNA, 22 bp, Artificial Sequence
  chemically synthesized
ccgtccttttaccacaagtgat

SEQ ID NO: 876381 - DNA, 22 bp, Artificial Sequence
  chemically synthesized
tccgtccttttaccacaagtga

SEQ ID NO: 876382 - DNA, 22 bp, Artificial Sequence
  chemically synthesized
gtatcaaaatatcacttgtggt

SEQ ID NO: 876383 - DNA, 22 bp, Artificial Sequence
  chemically synthesized
ttccgtccttttaccacaagtg

SEQ ID NO: 876384 - DNA, 22 bp, Artificial Sequence
  chemically synthesized
tatcaaaatatcacttgtggta

SEQ ID NO: 876385 - DNA, 22 bp, Artificial Sequence
  chemically synthesized
tttccgtccttttaccacaagt

SEQ ID NO: 876386 - DNA, 22 bp, Artificial Sequence
  chemically synthesized
catggagtatctttttccgtcc

SEQ ID NO: 876387 - DNA, 22 bp, Artificial Sequence
  chemically synthesized
gcatggagtatctttttccgtc

SEQ ID NO: 876388 - DNA, 22 bp, Artificial Sequence
  chemically synthesized
gtggtaaaaggacggaaaaaga

SEQ ID NO: 876389 - DNA, 22 bp, Artificial Sequence
  chemically synthesized
tggtaaaaggacggaaaaagat

SEQ ID NO: 876390 - DNA, 22 bp, Artificial Sequence
  chemically synthesized
ccatttgcatggagtatctttt

SEQ ID NO: 876391 - DNA, 22 bp, Artificial Sequence
  chemically synthesized
gttcccatttgcatggagtatc

SEQ ID NO: 876392 - DNA, 22 bp, Artificial Sequence
  chemically synthesized
ggttcccatttgcatggagtat

SEQ ID NO: 876393 - DNA, 22 bp, Artificial Sequence
  chemically synthesized
tggttcccatttgcatggagta

SEQ ID NO: 876394 - DNA, 22 bp, Artificial Sequence
  chemically synthesized
ttggttcccatttgcatggagt

SEQ ID NO: 876395 - DNA, 22 bp, Artificial Sequence
  chemically synthesized
cttttggttcccatttgcatgg

SEQ ID NO: 876396 - DNA, 22 bp, Artificial Sequence
  chemically synthesized
gcttttggttcccatttgcatg

SEQ ID NO: 876397 - DNA, 22 bp, Artificial Sequence
  chemically synthesized
cttgcttttggttcccatttgc

SEQ ID NO: 876398 - DNA, 22 bp, Artificial Sequence
  chemically synthesized
ctgcttgcttttggttcccatt

SEQ ID NO: 876399 - DNA, 22 bp, Artificial Sequence
  chemically synthesized
ctcctgcttgcttttggttccc

SEQ ID NO: 876400 - DNA, 22 bp, Artificial Sequence
  chemically synthesized
catgcaaatgggaaccaaaagc

SEQ ID NO: 876401 - DNA, 22 bp, Artificial Sequence
  chemically synthesized
atataagaatagctactcctgc

SEQ ID NO: 876402 - DNA, 22 bp, Artificial Sequence
  chemically synthesized
tctgatataagaatagctactc

SEQ ID NO: 876403 - DNA, 22 bp, Artificial Sequence
  chemically synthesized
gtctgatataagaatagctact

SEQ ID NO: 876404 - DNA, 22 bp, Artificial Sequence
  chemically synthesized
tgtctgatataagaatagctac

SEQ ID NO: 876405 - DNA, 22 bp, Artificial Sequence
  chemically synthesized
aagcccattttgtctgatataa

SEQ ID NO: 876406 - DNA, 22 bp, Artificial Sequence
  chemically synthesized
aaagcccattttgtctgatata

SEQ ID NO: 876407 - DNA, 22 bp, Artificial Sequence
  chemically synthesized
taaagcccattttgtctgatat

SEQ ID NO: 876408 - DNA, 22 bp, Artificial Sequence
  chemically synthesized
ctttaaagcccattttgtctga

SEQ ID NO: 876409 - DNA, 22 bp, Artificial Sequence
  chemically synthesized
ttgctttaaagcccattttgtc

SEQ ID NO: 876410 - DNA, 22 bp, Artificial Sequence
  chemically synthesized
ttcttatatcagacaaaatggg

SEQ ID NO: 876411 - DNA, 22 bp, Artificial Sequence
  chemically synthesized
ttatatcagacaaaatgggctt

SEQ ID NO: 876412 - DNA, 22 bp, Artificial Sequence
  chemically synthesized
atatcagacaaaatgggcttta

SEQ ID NO: 876413 - DNA, 22 bp, Artificial Sequence
  chemically synthesized
cggttattgctttaaagcccat

SEQ ID NO: 876414 - DNA, 22 bp, Artificial Sequence
  chemically synthesized
tatcagacaaaatgggctttaa

SEQ ID NO: 876415 - DNA, 22 bp, Artificial Sequence
  chemically synthesized
acggttattgctttaaagccca

SEQ ID NO: 876416 - DNA, 22 bp, Artificial Sequence
  chemically synthesized
tttacggttattgctttaaagc

SEQ ID NO: 876417 - DNA, 22 bp, Artificial Sequence
  chemically synthesized
atttacggttattgctttaaag

SEQ ID NO: 876418 - DNA, 22 bp, Artificial Sequence
  chemically synthesized
tatttacggttattgctttaaa

SEQ ID NO: 876419 - DNA, 22 bp, Artificial Sequence
  chemically synthesized
ttatttacggttattgctttaa

SEQ ID NO: 876420 - DNA, 22 bp, Artificial Sequence
  chemically synthesized
tcttttatttacggttattgct

SEQ ID NO: 876421 - DNA, 22 bp, Artificial Sequence
  chemically synthesized
atcttttatttacggttattgc

SEQ ID NO: 876422 - DNA, 22 bp, Artificial Sequence
  chemically synthesized
tatcttttatttacggttattg

SEQ ID NO: 876423 - DNA, 22 bp, Artificial Sequence
  chemically synthesized
tttatcttttatttacggttat

SEQ ID NO: 876424 - DNA, 22 bp, Artificial Sequence
  chemically synthesized
ctttatcttttatttacggtta

SEQ ID NO: 876425 - DNA, 22 bp, Artificial Sequence
  chemically synthesized
tctttatcttttatttacggtt

SEQ ID NO: 876426 - DNA, 22 bp, Artificial Sequence
  chemically synthesized
taaagcaataaccgtaaataaa

SEQ ID NO: 876427 - DNA, 22 bp, Artificial Sequence
  chemically synthesized
aaagcaataaccgtaaataaaa

SEQ ID NO: 876428 - DNA, 22 bp, Artificial Sequence
  chemically synthesized
aagcaataaccgtaaataaaag

SEQ ID NO: 876429 - DNA, 22 bp, Artificial Sequence
  chemically synthesized
tacaatgtctttctttatcttt

SEQ ID NO: 876430 - DNA, 22 bp, Artificial Sequence
  chemically synthesized
tcattatacaatgtctttcttt

SEQ ID NO: 876431 - DNA, 22 bp, Artificial Sequence
  chemically synthesized
atcattatacaatgtctttctt

SEQ ID NO: 876432 - DNA, 22 bp, Artificial Sequence
  chemically synthesized
tatcattatacaatgtctttct

SEQ ID NO: 876433 - DNA, 22 bp, Artificial Sequence
  chemically synthesized
ttatcattatacaatgtctttc

SEQ ID NO: 876434 - DNA, 22 bp, Artificial Sequence
  chemically synthesized
atccttttatcattatacaatg

SEQ ID NO: 876435 - DNA, 22 bp, Artificial Sequence
  chemically synthesized
gactaatccttttatcattata

SEQ ID NO: 876436 - DNA, 22 bp, Artificial Sequence
  chemically synthesized
ttggactaatccttttatcatt

SEQ ID NO: 876437 - DNA, 22 bp, Artificial Sequence
  chemically synthesized
gttggactaatccttttatcat

SEQ ID NO: 876438 - DNA, 22 bp, Artificial Sequence
  chemically synthesized
ttgttggactaatccttttatc

SEQ ID NO: 876439 - DNA, 22 bp, Artificial Sequence
  chemically synthesized
cttgttggactaatccttttat

SEQ ID NO: 876440 - DNA, 22 bp, Artificial Sequence
  chemically synthesized
tataatgataaaaggattagtc

SEQ ID NO: 876441 - DNA, 22 bp, Artificial Sequence
  chemically synthesized
tagtaaatatcttcttgttgga

SEQ ID NO: 876442 - DNA, 22 bp, Artificial Sequence
  chemically synthesized
agtactgtagtaaatatcttct

SEQ ID NO: 876443 - DNA, 22 bp, Artificial Sequence
  chemically synthesized
gtccaacaagaagatatttact

SEQ ID NO: 876444 - DNA, 22 bp, Artificial Sequence
  chemically synthesized
ggtgcatataaattgagtactg

SEQ ID NO: 876445 - DNA, 22 bp, Artificial Sequence
  chemically synthesized
actacagtactcaatttatatg

SEQ ID NO: 876446 - DNA, 22 bp, Artificial Sequence
  chemically synthesized
ctacagtactcaatttatatgc

SEQ ID NO: 876447 - DNA, 22 bp, Artificial Sequence
  chemically synthesized
cagtactcaatttatatgcacc

SEQ ID NO: 876448 - DNA, 22 bp, Artificial Sequence
  chemically synthesized
ggagcaccagtgttaggtgcat

SEQ ID NO: 876449 - DNA, 22 bp, Artificial Sequence
  chemically synthesized
aatttatatgcacctaacactg

SEQ ID NO: 876450 - DNA, 22 bp, Artificial Sequence
  chemically synthesized
taaagctaggagcaccagtgtt

SEQ ID NO: 876451 - DNA, 22 bp, Artificial Sequence
  chemically synthesized
ataaagctaggagcaccagtgt

SEQ ID NO: 876452 - DNA, 22 bp, Artificial Sequence
  chemically synthesized
atatgcacctaacactggtgct

SEQ ID NO: 876453 - DNA, 22 bp, Artificial Sequence
  chemically synthesized
tataaagctaggagcaccagtg

SEQ ID NO: 876454 - DNA, 22 bp, Artificial Sequence
  chemically synthesized
tatgcacctaacactggtgctc

SEQ ID NO: 876455 - DNA, 22 bp, Artificial Sequence
  chemically synthesized
ttttataaagctaggagcacca

SEQ ID NO: 876456 - DNA, 22 bp, Artificial Sequence
  chemically synthesized
ttgttttataaagctaggagca

SEQ ID NO: 876457 - DNA, 22 bp, Artificial Sequence
  chemically synthesized
acactggtgctcctagctttat

SEQ ID NO: 876458 - DNA, 22 bp, Artificial Sequence
  chemically synthesized
gtactattgttttataaagcta

SEQ ID NO: 876459 - DNA, 22 bp, Artificial Sequence
  chemically synthesized
gtgctcctagctttataaaaca

SEQ ID NO: 876460 - DNA, 22 bp, Artificial Sequence
  chemically synthesized
ggtctagtactattgttttata

SEQ ID NO: 876461 - DNA, 22 bp, Artificial Sequence
  chemically synthesized
aggtctagtactattgttttat

SEQ ID NO: 876462 - DNA, 22 bp, Artificial Sequence
  chemically synthesized
ttaggtctagtactattgtttt

SEQ ID NO: 876463 - DNA, 22 bp, Artificial Sequence
  chemically synthesized
cttaggtctagtactattgttt

SEQ ID NO: 876464 - DNA, 22 bp, Artificial Sequence
  chemically synthesized
ctagctttataaaacaatagta

SEQ ID NO: 876465 - DNA, 22 bp, Artificial Sequence
  chemically synthesized
gctttataaaacaatagtacta

SEQ ID NO: 876466 - DNA, 22 bp, Artificial Sequence
  chemically synthesized
atttcttaggtctagtactatt

SEQ ID NO: 876467 - DNA, 22 bp, Artificial Sequence
  chemically synthesized
tataaaacaatagtactagacc

SEQ ID NO: 876468 - DNA, 22 bp, Artificial Sequence
  chemically synthesized
tctcatttcttaggtctagtac

SEQ ID NO: 876469 - DNA, 22 bp, Artificial Sequence
  chemically synthesized
ataaaacaatagtactagacct

SEQ ID NO: 876470 - DNA, 22 bp, Artificial Sequence
  chemically synthesized
taaaacaatagtactagaccta

SEQ ID NO: 876471 - DNA, 22 bp, Artificial Sequence
  chemically synthesized
tctatctcatttcttaggtcta

SEQ ID NO: 876472 - DNA, 22 bp, Artificial Sequence
  chemically synthesized
ctgtctatctcatttcttaggt

SEQ ID NO: 876473 - DNA, 22 bp, Artificial Sequence
  chemically synthesized
cattgctgtctatctcatttct

SEQ ID NO: 876474 - DNA, 22 bp, Artificial Sequence
  chemically synthesized
ttgcattgctgtctatctcatt

SEQ ID NO: 876475 - DNA, 22 bp, Artificial Sequence
  chemically synthesized
gacctaagaaatgagatagaca

SEQ ID NO: 876476 - DNA, 22 bp, Artificial Sequence
  chemically synthesized
ttattgcattgctgtctatctc

SEQ ID NO: 876477 - DNA, 22 bp, Artificial Sequence
  chemically synthesized
agaaatgagatagacagcaatg

SEQ ID NO: 876478 - DNA, 22 bp, Artificial Sequence
  chemically synthesized
aagtcccccactattattgcat

SEQ ID NO: 876479 - DNA, 22 bp, Artificial Sequence
  chemically synthesized
taaatggagtattgaagtcccc

SEQ ID NO: 876480 - DNA, 22 bp, Artificial Sequence
  chemically synthesized
gtgctgtaaatggagtattgaa

SEQ ID NO: 876481 - DNA, 22 bp, Artificial Sequence
  chemically synthesized
tctagtgctgtaaatggagtat

SEQ ID NO: 876482 - DNA, 22 bp, Artificial Sequence
  chemically synthesized
agtgacctgtctagtgctgtaa

SEQ ID NO: 876483 - DNA, 22 bp, Artificial Sequence
  chemically synthesized
caatactccatttacagcacta

SEQ ID NO: 876484 - DNA, 22 bp, Artificial Sequence
  chemically synthesized
cagtgacctgtctagtgctgta

SEQ ID NO: 876485 - DNA, 22 bp, Artificial Sequence
  chemically synthesized
aatactccatttacagcactag

SEQ ID NO: 876486 - DNA, 22 bp, Artificial Sequence
  chemically synthesized
tttcagtgacctgtctagtgct

SEQ ID NO: 876487 - DNA, 22 bp, Artificial Sequence
  chemically synthesized
gtttcagtgacctgtctagtgc

SEQ ID NO: 876488 - DNA, 22 bp, Artificial Sequence
  chemically synthesized
tgtttcagtgacctgtctagtg

SEQ ID NO: 876489 - DNA, 22 bp, Artificial Sequence
  chemically synthesized
ttgtttcagtgacctgtctagt

SEQ ID NO: 876490 - DNA, 22 bp, Artificial Sequence
  chemically synthesized
catttacagcactagacaggtc

SEQ ID NO: 876491 - DNA, 22 bp, Artificial Sequence
  chemically synthesized
agtttttgtttcagtgacctgt

SEQ ID NO: 876492 - DNA, 22 bp, Artificial Sequence
  chemically synthesized
acagcactagacaggtcactga

SEQ ID NO: 876493 - DNA, 22 bp, Artificial Sequence
  chemically synthesized
cagcactagacaggtcactgaa

SEQ ID NO: 876494 - DNA, 22 bp, Artificial Sequence
  chemically synthesized
ttaagtttttgtttcagtgacc

SEQ ID NO: 876495 - DNA, 22 bp, Artificial Sequence
  chemically synthesized
gttaagtttttgtttcagtgac

SEQ ID NO: 876496 - DNA, 22 bp, Artificial Sequence
  chemically synthesized
tgttaagtttttgtttcagtga

SEQ ID NO: 876497 - DNA, 22 bp, Artificial Sequence
  chemically synthesized
tttgttaagtttttgtttcagt

SEQ ID NO: 876498 - DNA, 22 bp, Artificial Sequence
  chemically synthesized
ctttgttaagtttttgtttcag

SEQ ID NO: 876499 - DNA, 22 bp, Artificial Sequence
  chemically synthesized
gacaggtcactgaaacaaaaac

SEQ ID NO: 876500 - DNA, 22 bp, Artificial Sequence
  chemically synthesized
tttctttgttaagtttttgttt

SEQ ID NO: 876501 - DNA, 22 bp, Artificial Sequence
  chemically synthesized
agtccattgtttctttgttaag

SEQ ID NO: 876502 - DNA, 22 bp, Artificial Sequence
  chemically synthesized
aagtccattgtttctttgttaa

SEQ ID NO: 876503 - DNA, 22 bp, Artificial Sequence
  chemically synthesized
aaacaaaaacttaacaaagaaa

SEQ ID NO: 876504 - DNA, 22 bp, Artificial Sequence
  chemically synthesized
gggtgtaatttaagtccattgt

SEQ ID NO: 876505 - DNA, 22 bp, Artificial Sequence
  chemically synthesized
tagggtgtaatttaagtccatt

SEQ ID NO: 876506 - DNA, 22 bp, Artificial Sequence
  chemically synthesized
aacaaagaaacaatggacttaa

SEQ ID NO: 876507 - DNA, 22 bp, Artificial Sequence
  chemically synthesized
acaaagaaacaatggacttaaa

SEQ ID NO: 876508 - DNA, 22 bp, Artificial Sequence
  chemically synthesized
ttctagggtgtaatttaagtcc

SEQ ID NO: 876509 - DNA, 22 bp, Artificial Sequence
  chemically synthesized
gttctagggtgtaatttaagtc

SEQ ID NO: 876510 - DNA, 22 bp, Artificial Sequence
  chemically synthesized
agtccatttgttctagggtgta

SEQ ID NO: 876511 - DNA, 22 bp, Artificial Sequence
  chemically synthesized
ttaagtccatttgttctagggt

SEQ ID NO: 876512 - DNA, 22 bp, Artificial Sequence
  chemically synthesized
aaattacaccctagaacaaatg

SEQ ID NO: 876513 - DNA, 22 bp, Artificial Sequence
  chemically synthesized
aattacaccctagaacaaatgg

SEQ ID NO: 876514 - DNA, 22 bp, Artificial Sequence
  chemically synthesized
taaatatctgttaagtccattt

SEQ ID NO: 876515 - DNA, 22 bp, Artificial Sequence
  chemically synthesized
caccctagaacaaatggactta

SEQ ID NO: 876516 - DNA, 22 bp, Artificial Sequence
  chemically synthesized
tgtaaatatctgttaagtccat

SEQ ID NO: 876517 - DNA, 22 bp, Artificial Sequence
  chemically synthesized
gaacaaatggacttaacagata

SEQ ID NO: 876518 - DNA, 22 bp, Artificial Sequence
  chemically synthesized
ggaagaatgttctgtaaatatc

SEQ ID NO: 876519 - DNA, 22 bp, Artificial Sequence
  chemically synthesized
ttaggaagaatgttctgtaaat

SEQ ID NO: 876520 - DNA, 22 bp, Artificial Sequence
  chemically synthesized
aacagatatttacagaacattc

SEQ ID NO: 876521 - DNA, 22 bp, Artificial Sequence
  chemically synthesized
acagatatttacagaacattct

SEQ ID NO: 876522 - DNA, 22 bp, Artificial Sequence
  chemically synthesized
taattgttaggaagaatgttct

SEQ ID NO: 876523 - DNA, 22 bp, Artificial Sequence
  chemically synthesized
tataattgttaggaagaatgtt

SEQ ID NO: 876524 - DNA, 22 bp, Artificial Sequence
  chemically synthesized
acagaacattcttcctaacaat

SEQ ID NO: 876525 - DNA, 22 bp, Artificial Sequence
  chemically synthesized
cagaacattcttcctaacaatt

SEQ ID NO: 876526 - DNA, 22 bp, Artificial Sequence
  chemically synthesized
ataagaatgtatattctataat

SEQ ID NO: 876527 - DNA, 22 bp, Artificial Sequence
  chemically synthesized
ttcctaacaattatagaatata

SEQ ID NO: 876528 - DNA, 22 bp, Artificial Sequence
  chemically synthesized
ctgataagaatgtatattctat

SEQ ID NO: 876529 - DNA, 22 bp, Artificial Sequence
  chemically synthesized
cctaacaattatagaatataca

SEQ ID NO: 876530 - DNA, 22 bp, Artificial Sequence
  chemically synthesized
ctaacaattatagaatatacat

SEQ ID NO: 876531 - DNA, 22 bp, Artificial Sequence
  chemically synthesized
acaattatagaatatacattct

SEQ ID NO: 876532 - DNA, 22 bp, Artificial Sequence
  chemically synthesized
tagaatatacattcttatcagc

SEQ ID NO: 876533 - DNA, 22 bp, Artificial Sequence
  chemically synthesized
gagaatggtccatctgctgata

SEQ ID NO: 876534 - DNA, 22 bp, Artificial Sequence
  chemically synthesized
ggagaatggtccatctgctgat

SEQ ID NO: 876535 - DNA, 22 bp, Artificial Sequence
  chemically synthesized
tcttggagaatggtccatctgc

SEQ ID NO: 876536 - DNA, 22 bp, Artificial Sequence
  chemically synthesized
ttatcagcagatggaccattct

SEQ ID NO: 876537 - DNA, 22 bp, Artificial Sequence
  chemically synthesized
atcagcagatggaccattctcc

SEQ ID NO: 876538 - DNA, 22 bp, Artificial Sequence
  chemically synthesized
tcagcagatggaccattctcca

SEQ ID NO: 876539 - DNA, 22 bp, Artificial Sequence
  chemically synthesized
tatgacctgtcttggagaatgg

SEQ ID NO: 876540 - DNA, 22 bp, Artificial Sequence
  chemically synthesized
gtatgacctgtcttggagaatg

SEQ ID NO: 876541 - DNA, 22 bp, Artificial Sequence
  chemically synthesized
ttgtatgacctgtcttggagaa

SEQ ID NO: 876542 - DNA, 22 bp, Artificial Sequence
  chemically synthesized
tggtctcttgtatgacctgtct

SEQ ID NO: 876543 - DNA, 22 bp, Artificial Sequence
  chemically synthesized
gtggtctcttgtatgacctgtc

SEQ ID NO: 876544 - DNA, 22 bp, Artificial Sequence
  chemically synthesized
tgtggtctcttgtatgacctgt

SEQ ID NO: 876545 - DNA, 22 bp, Artificial Sequence
  chemically synthesized
tccaagacaggtcatacaagag

SEQ ID NO: 876546 - DNA, 22 bp, Artificial Sequence
  chemically synthesized
agactttgtggtctcttgtatg

SEQ ID NO: 876547 - DNA, 22 bp, Artificial Sequence
  chemically synthesized
caagacaggtcatacaagagac

SEQ ID NO: 876548 - DNA, 22 bp, Artificial Sequence
  chemically synthesized
ttaagactttgtggtctcttgt

SEQ ID NO: 876549 - DNA, 22 bp, Artificial Sequence
  chemically synthesized
attaagactttgtggtctcttg

SEQ ID NO: 876550 - DNA, 22 bp, Artificial Sequence
  chemically synthesized
aatttattaagactttgtggtc

SEQ ID NO: 876551 - DNA, 22 bp, Artificial Sequence
  chemically synthesized
ctaaatttattaagactttgtg

SEQ ID NO: 876552 - DNA, 22 bp, Artificial Sequence
  chemically synthesized
cctaaatttattaagactttgt

SEQ ID NO: 876553 - DNA, 22 bp, Artificial Sequence
  chemically synthesized
tcctaaatttattaagactttg

SEQ ID NO: 876554 - DNA, 22 bp, Artificial Sequence
  chemically synthesized
attttcctaaatttattaagac

SEQ ID NO: 876555 - DNA, 22 bp, Artificial Sequence
  chemically synthesized
gattttcctaaatttattaaga

SEQ ID NO: 876556 - DNA, 22 bp, Artificial Sequence
  chemically synthesized
tgattttcctaaatttattaag

SEQ ID NO: 876557 - DNA, 22 bp, Artificial Sequence
  chemically synthesized
atatgattttgattttcctaaa

SEQ ID NO: 876558 - DNA, 22 bp, Artificial Sequence
  chemically synthesized
gatatgattttgattttcctaa

SEQ ID NO: 876559 - DNA, 22 bp, Artificial Sequence
  chemically synthesized
aataaatttaggaaaatcaaaa

SEQ ID NO: 876560 - DNA, 22 bp, Artificial Sequence
  chemically synthesized
ataaatttaggaaaatcaaaat

SEQ ID NO: 876561 - DNA, 22 bp, Artificial Sequence
  chemically synthesized
agaagatacttgatatgatttt

SEQ ID NO: 876562 - DNA, 22 bp, Artificial Sequence
  chemically synthesized
aggaaaatcaaaatcatatcaa

SEQ ID NO: 876563 - DNA, 22 bp, Artificial Sequence
  chemically synthesized
ggaaaatcaaaatcatatcaag

SEQ ID NO: 876564 - DNA, 22 bp, Artificial Sequence
  chemically synthesized
tggtctgagaagatacttgata

SEQ ID NO: 876565 - DNA, 22 bp, Artificial Sequence
  chemically synthesized
cactgtggtctgagaagatact

SEQ ID NO: 876566 - DNA, 22 bp, Artificial Sequence
  chemically synthesized
ttccactgtggtctgagaagat

SEQ ID NO: 876567 - DNA, 22 bp, Artificial Sequence
  chemically synthesized
attccactgtggtctgagaaga

SEQ ID NO: 876568 - DNA, 22 bp, Artificial Sequence
  chemically synthesized
tattccactgtggtctgagaag

SEQ ID NO: 876569 - DNA, 22 bp, Artificial Sequence
  chemically synthesized
gttttattccactgtggtctga

SEQ ID NO: 876570 - DNA, 22 bp, Artificial Sequence
  chemically synthesized
agttttattccactgtggtctg

SEQ ID NO: 876571 - DNA, 22 bp, Artificial Sequence
  chemically synthesized
tagttttattccactgtggtct

SEQ ID NO: 876572 - DNA, 22 bp, Artificial Sequence
  chemically synthesized
ttagttttattccactgtggtc

SEQ ID NO: 876573 - DNA, 22 bp, Artificial Sequence
  chemically synthesized
atttttagttttattccactgt

SEQ ID NO: 876574 - DNA, 22 bp, Artificial Sequence
  chemically synthesized
ctcagaccacagtggaataaaa

SEQ ID NO: 876575 - DNA, 22 bp, Artificial Sequence
  chemically synthesized
tcagaccacagtggaataaaac

SEQ ID NO: 876576 - DNA, 22 bp, Artificial Sequence
  chemically synthesized
gagttgatttttagttttattc

SEQ ID NO: 876577 - DNA, 22 bp, Artificial Sequence
  chemically synthesized
agaccacagtggaataaaacta

SEQ ID NO: 876578 - DNA, 22 bp, Artificial Sequence
  chemically synthesized
ggagttgatttttagttttatt

SEQ ID NO: 876579 - DNA, 22 bp, Artificial Sequence
  chemically synthesized
tggagttgatttttagttttat

SEQ ID NO: 876580 - DNA, 22 bp, Artificial Sequence
  chemically synthesized
ttggagttgatttttagtttta

SEQ ID NO: 876581 - DNA, 22 bp, Artificial Sequence
  chemically synthesized
cttttggagttgatttttagtt

SEQ ID NO: 876582 - DNA, 22 bp, Artificial Sequence
  chemically synthesized
agggttccttttggagttgatt

SEQ ID NO: 876583 - DNA, 22 bp, Artificial Sequence
  chemically synthesized
gagggttccttttggagttgat

SEQ ID NO: 876584 - DNA, 22 bp, Artificial Sequence
  chemically synthesized
tgagggttccttttggagttga

SEQ ID NO: 876585 - DNA, 22 bp, Artificial Sequence
  chemically synthesized
aaaatcaactccaaaaggaacc

SEQ ID NO: 876586 - DNA, 22 bp, Artificial Sequence
  chemically synthesized
tatagttttgagggttcctttt

SEQ ID NO: 876587 - DNA, 22 bp, Artificial Sequence
  chemically synthesized
gtatagttttgagggttccttt

SEQ ID NO: 876588 - DNA, 22 bp, Artificial Sequence
  chemically synthesized
catgtgtttgtatagttttgag

SEQ ID NO: 876589 - DNA, 22 bp, Artificial Sequence
  chemically synthesized
caaaaggaaccctcaaaactat

SEQ ID NO: 876590 - DNA, 22 bp, Artificial Sequence
  chemically synthesized
ccatgtgtttgtatagttttga

SEQ ID NO: 876591 - DNA, 22 bp, Artificial Sequence
  chemically synthesized
atttccatgtgtttgtatagtt

SEQ ID NO: 876592 - DNA, 22 bp, Artificial Sequence
  chemically synthesized
aatttccatgtgtttgtatagt

SEQ ID NO: 876593 - DNA, 22 bp, Artificial Sequence
  chemically synthesized
ttaatttccatgtgtttgtata

SEQ ID NO: 876594 - DNA, 22 bp, Artificial Sequence
  chemically synthesized
cttaatttccatgtgtttgtat

SEQ ID NO: 876595 - DNA, 22 bp, Artificial Sequence
  chemically synthesized
aaaactatacaaacacatggaa

SEQ ID NO: 876596 - DNA, 22 bp, Artificial Sequence
  chemically synthesized
aagagcagatttcttaatttcc

SEQ ID NO: 876597 - DNA, 22 bp, Artificial Sequence
  chemically synthesized
tacaaacacatggaaattaaga

SEQ ID NO: 876598 - DNA, 22 bp, Artificial Sequence
  chemically synthesized
accccaaaatcattcaagagca

SEQ ID NO: 876599 - DNA, 22 bp, Artificial Sequence
  chemically synthesized
ttaaccccaaaatcattcaaga

SEQ ID NO: 876600 - DNA, 22 bp, Artificial Sequence
  chemically synthesized
agaaatctgctcttgaatgatt

SEQ ID NO: 876601 - DNA, 22 bp, Artificial Sequence
  chemically synthesized
attgttaaccccaaaatcattc

SEQ ID NO: 876602 - DNA, 22 bp, Artificial Sequence
  chemically synthesized
cattgttaaccccaaaatcatt

SEQ ID NO: 876603 - DNA, 22 bp, Artificial Sequence
  chemically synthesized
aatttcattgttaaccccaaaa

SEQ ID NO: 876604 - DNA, 22 bp, Artificial Sequence
  chemically synthesized
ctcttgaatgattttggggtta

SEQ ID NO: 876605 - DNA, 22 bp, Artificial Sequence
  chemically synthesized
ttgaatgattttggggttaaca

SEQ ID NO: 876606 - DNA, 22 bp, Artificial Sequence
  chemically synthesized
gaatgattttggggttaacaat

SEQ ID NO: 876607 - DNA, 22 bp, Artificial Sequence
  chemically synthesized
catctcaatttcattgttaacc

SEQ ID NO: 876608 - DNA, 22 bp, Artificial Sequence
  chemically synthesized
aatgattttggggttaacaatg

SEQ ID NO: 876609 - DNA, 22 bp, Artificial Sequence
  chemically synthesized
ccatctcaatttcattgttaac

SEQ ID NO: 876610 - DNA, 22 bp, Artificial Sequence
  chemically synthesized
atttccatctcaatttcattgt

SEQ ID NO: 876611 - DNA, 22 bp, Artificial Sequence
  chemically synthesized
aatttccatctcaatttcattg

SEQ ID NO: 876612 - DNA, 22 bp, Artificial Sequence
  chemically synthesized
taatttccatctcaatttcatt

SEQ ID NO: 876613 - DNA, 22 bp, Artificial Sequence
  chemically synthesized
tggggttaacaatgaaattgag

SEQ ID NO: 876614 - DNA, 22 bp, Artificial Sequence
  chemically synthesized
ggggttaacaatgaaattgaga

SEQ ID NO: 876615 - DNA, 22 bp, Artificial Sequence
  chemically synthesized
gggttaacaatgaaattgagat

SEQ ID NO: 876616 - DNA, 22 bp, Artificial Sequence
  chemically synthesized
acaatgaaattgagatggaaat

SEQ ID NO: 876617 - DNA, 22 bp, Artificial Sequence
  chemically synthesized
aaaaaatattttaatttccatc

SEQ ID NO: 876618 - DNA, 22 bp, Artificial Sequence
  chemically synthesized
caaaaaatattttaatttccat

SEQ ID NO: 876619 - DNA, 22 bp, Artificial Sequence
  chemically synthesized
atcatttcaaaaaatattttaa

SEQ ID NO: 876620 - DNA, 22 bp, Artificial Sequence
  chemically synthesized
agatggaaattaaaatattttt

SEQ ID NO: 876621 - DNA, 22 bp, Artificial Sequence
  chemically synthesized
ttaatcatttcaaaaaatattt

SEQ ID NO: 876622 - DNA, 22 bp, Artificial Sequence
  chemically synthesized
tgtcactattaatcatttcaaa

SEQ ID NO: 876623 - DNA, 22 bp, Artificial Sequence
  chemically synthesized
aaatattttttgaaatgattaa

SEQ ID NO: 876624 - DNA, 22 bp, Artificial Sequence
  chemically synthesized
ataaattgtgtcactattaatc

SEQ ID NO: 876625 - DNA, 22 bp, Artificial Sequence
  chemically synthesized
gataaattgtgtcactattaat

SEQ ID NO: 876626 - DNA, 22 bp, Artificial Sequence
  chemically synthesized
tgataaattgtgtcactattaa

SEQ ID NO: 876627 - DNA, 22 bp, Artificial Sequence
  chemically synthesized
tttgaaatgattaatagtgaca

SEQ ID NO: 876628 - DNA, 22 bp, Artificial Sequence
  chemically synthesized
ttgaaatgattaatagtgacac

SEQ ID NO: 876629 - DNA, 22 bp, Artificial Sequence
  chemically synthesized
tgaaatgattaatagtgacaca

SEQ ID NO: 876630 - DNA, 22 bp, Artificial Sequence
  chemically synthesized
gaaatgattaatagtgacacaa

SEQ ID NO: 876631 - DNA, 22 bp, Artificial Sequence
  chemically synthesized
aaatgattaatagtgacacaat

SEQ ID NO: 876632 - DNA, 22 bp, Artificial Sequence
  chemically synthesized
agaggttttgataaattgtgtc

SEQ ID NO: 876633 - DNA, 22 bp, Artificial Sequence
  chemically synthesized
tatctcagaggttttgataaat

SEQ ID NO: 876634 - DNA, 22 bp, Artificial Sequence
  chemically synthesized
atagtgacacaatttatcaaaa

SEQ ID NO: 876635 - DNA, 22 bp, Artificial Sequence
  chemically synthesized
ctgtatctcagaggttttgata

SEQ ID NO: 876636 - DNA, 22 bp, Artificial Sequence
  chemically synthesized
gctgtatctcagaggttttgat

SEQ ID NO: 876637 - DNA, 22 bp, Artificial Sequence
  chemically synthesized
tgctgtatctcagaggttttga

SEQ ID NO: 876638 - DNA, 22 bp, Artificial Sequence
  chemically synthesized
ttgctgtatctcagaggttttg

SEQ ID NO: 876639 - DNA, 22 bp, Artificial Sequence
  chemically synthesized
tttttgctgtatctcagaggtt

SEQ ID NO: 876640 - DNA, 22 bp, Artificial Sequence
  chemically synthesized
gcactgtttttgctgtatctca

SEQ ID NO: 876641 - DNA, 22 bp, Artificial Sequence
  chemically synthesized
atcaaaacctctgagatacagc

SEQ ID NO: 876642 - DNA, 22 bp, Artificial Sequence
  chemically synthesized
agcactgtttttgctgtatctc

SEQ ID NO: 876643 - DNA, 22 bp, Artificial Sequence
  chemically synthesized
tcaaaacctctgagatacagca

SEQ ID NO: 876644 - DNA, 22 bp, Artificial Sequence
  chemically synthesized
ttagcactgtttttgctgtatc

SEQ ID NO: 876645 - DNA, 22 bp, Artificial Sequence
  chemically synthesized
ctcttagcactgtttttgctgt

SEQ ID NO: 876646 - DNA, 22 bp, Artificial Sequence
  chemically synthesized
cctcttagcactgtttttgctg

SEQ ID NO: 876647 - DNA, 22 bp, Artificial Sequence
  chemically synthesized
tcctcttagcactgtttttgct

SEQ ID NO: 876648 - DNA, 22 bp, Artificial Sequence
  chemically synthesized
tgagatacagcaaaaacagtgc

SEQ ID NO: 876649 - DNA, 22 bp, Artificial Sequence
  chemically synthesized
agatacagcaaaaacagtgcta

SEQ ID NO: 876650 - DNA, 22 bp, Artificial Sequence
  chemically synthesized
tgaactttcctcttagcactgt

SEQ ID NO: 876651 - DNA, 22 bp, Artificial Sequence
  chemically synthesized
acactatgaactttcctcttag

SEQ ID NO: 876652 - DNA, 22 bp, Artificial Sequence
  chemically synthesized
aacactatgaactttcctctta

SEQ ID NO: 876653 - DNA, 22 bp, Artificial Sequence
  chemically synthesized
atgtagtatttaacactatgaa

SEQ ID NO: 876654 - DNA, 22 bp, Artificial Sequence
  chemically synthesized
gatgtagtatttaacactatga

SEQ ID NO: 876655 - DNA, 22 bp, Artificial Sequence
  chemically synthesized
tgatgtagtatttaacactatg

SEQ ID NO: 876656 - DNA, 22 bp, Artificial Sequence
  chemically synthesized
agaggaaagttcatagtgttaa

SEQ ID NO: 876657 - DNA, 22 bp, Artificial Sequence
  chemically synthesized
ttgatgtagtatttaacactat

SEQ ID NO: 876658 - DNA, 22 bp, Artificial Sequence
  chemically synthesized
agaatttttgatgtagtattta

SEQ ID NO: 876659 - DNA, 22 bp, Artificial Sequence
  chemically synthesized
cagaatttttgatgtagtattt

SEQ ID NO: 876660 - DNA, 22 bp, Artificial Sequence
  chemically synthesized
tcagaatttttgatgtagtatt

SEQ ID NO: 876661 - DNA, 22 bp, Artificial Sequence
  chemically synthesized
tttcagaatttttgatgtagta

SEQ ID NO: 876662 - DNA, 22 bp, Artificial Sequence
  chemically synthesized
atagtgttaaatactacatcaa

SEQ ID NO: 876663 - DNA, 22 bp, Artificial Sequence
  chemically synthesized
tgctctttcagaatttttgatg

SEQ ID NO: 876664 - DNA, 22 bp, Artificial Sequence
  chemically synthesized
gtgctctttcagaatttttgat

SEQ ID NO: 876665 - DNA, 22 bp, Artificial Sequence
  chemically synthesized
aatactacatcaaaaattctga

SEQ ID NO: 876666 - DNA, 22 bp, Artificial Sequence
  chemically synthesized
tcaatttgtgctctttcagaat

SEQ ID NO: 876667 - DNA, 22 bp, Artificial Sequence
  chemically synthesized
catcaaaaattctgaaagagca

SEQ ID NO: 876668 - DNA, 22 bp, Artificial Sequence
  chemically synthesized
ggttgtcaatttgtgctctttc

SEQ ID NO: 876669 - DNA, 22 bp, Artificial Sequence
  chemically synthesized
tgaaagagcacaaattgacaac

SEQ ID NO: 876670 - DNA, 22 bp, Artificial Sequence
  chemically synthesized
aaagagcacaaattgacaacct

SEQ ID NO: 876671 - DNA, 22 bp, Artificial Sequence
  chemically synthesized
aaatgtgacattaggttgtcaa

SEQ ID NO: 876672 - DNA, 22 bp, Artificial Sequence
  chemically synthesized
gaaatgtgacattaggttgtca

SEQ ID NO: 876673 - DNA, 22 bp, Artificial Sequence
  chemically synthesized
cttgaaatgtgacattaggttg

SEQ ID NO: 876674 - DNA, 22 bp, Artificial Sequence
  chemically synthesized
gttccttgaaatgtgacattag

SEQ ID NO: 876675 - DNA, 22 bp, Artificial Sequence
  chemically synthesized
tagttccttgaaatgtgacatt

SEQ ID NO: 876676 - DNA, 22 bp, Artificial Sequence
  chemically synthesized
tctagttccttgaaatgtgaca

SEQ ID NO: 876677 - DNA, 22 bp, Artificial Sequence
  chemically synthesized
ctctagttccttgaaatgtgac

SEQ ID NO: 876678 - DNA, 22 bp, Artificial Sequence
  chemically synthesized
acaacctaatgtcacatttcaa

SEQ ID NO: 876679 - DNA, 22 bp, Artificial Sequence
  chemically synthesized
tttctctagttccttgaaatgt

SEQ ID NO: 876680 - DNA, 22 bp, Artificial Sequence
  chemically synthesized
gtttctctagttccttgaaatg

SEQ ID NO: 876681 - DNA, 22 bp, Artificial Sequence
  chemically synthesized
ttgtttctctagttccttgaaa

SEQ ID NO: 876682 - DNA, 22 bp, Artificial Sequence
  chemically synthesized
ttcttgtttctctagttccttg

SEQ ID NO: 876683 - DNA, 22 bp, Artificial Sequence
  chemically synthesized
atgtcacatttcaaggaactag

SEQ ID NO: 876684 - DNA, 22 bp, Artificial Sequence
  chemically synthesized
gttcttgtttctctagttcctt

SEQ ID NO: 876685 - DNA, 22 bp, Artificial Sequence
  chemically synthesized
gtttgttcttgtttctctagtt

SEQ ID NO: 876686 - DNA, 22 bp, Artificial Sequence
  chemically synthesized
agtttgttcttgtttctctagt

SEQ ID NO: 876687 - DNA, 22 bp, Artificial Sequence
  chemically synthesized
agtttagtttgttcttgtttct

SEQ ID NO: 876688 - DNA, 22 bp, Artificial Sequence
  chemically synthesized
caaggaactagagaaacaagaa

SEQ ID NO: 876689 - DNA, 22 bp, Artificial Sequence
  chemically synthesized
gagtttagtttgttcttgtttc

SEQ ID NO: 876690 - DNA, 22 bp, Artificial Sequence
  chemically synthesized
aaggaactagagaaacaagaac

SEQ ID NO: 876691 - DNA, 22 bp, Artificial Sequence
  chemically synthesized
gatttgagtttagtttgttctt

SEQ ID NO: 876692 - DNA, 22 bp, Artificial Sequence
  chemically synthesized
ctggatttgagtttagtttgtt

SEQ ID NO: 876693 - DNA, 22 bp, Artificial Sequence
  chemically synthesized
gagaaacaagaacaaactaaac

SEQ ID NO: 876694 - DNA, 22 bp, Artificial Sequence
  chemically synthesized
tgctggatttgagtttagtttg

SEQ ID NO: 876695 - DNA, 22 bp, Artificial Sequence
  chemically synthesized
ctgctggatttgagtttagttt

SEQ ID NO: 876696 - DNA, 22 bp, Artificial Sequence
  chemically synthesized
ttctgctggatttgagtttagt

SEQ ID NO: 876697 - DNA, 22 bp, Artificial Sequence
  chemically synthesized
cttctgctggatttgagtttag

SEQ ID NO: 876698 - DNA, 22 bp, Artificial Sequence
  chemically synthesized
tcttctgctggatttgagttta

SEQ ID NO: 876699 - DNA, 22 bp, Artificial Sequence
  chemically synthesized
ttcttctgctggatttgagttt

SEQ ID NO: 876700 - DNA, 22 bp, Artificial Sequence
  chemically synthesized
ttttcttctgctggatttgagt

SEQ ID NO: 876701 - DNA, 22 bp, Artificial Sequence
  chemically synthesized
cttttcttctgctggatttgag

SEQ ID NO: 876702 - DNA, 22 bp, Artificial Sequence
  chemically synthesized
tttcttttcttctgctggattt

SEQ ID NO: 876703 - DNA, 22 bp, Artificial Sequence
  chemically synthesized
ttatttcttttcttctgctgga

SEQ ID NO: 876704 - DNA, 22 bp, Artificial Sequence
  chemically synthesized
gttatttcttttcttctgctgg

SEQ ID NO: 876705 - DNA, 22 bp, Artificial Sequence
  chemically synthesized
tgttatttcttttcttctgctg

SEQ ID NO: 876706 - DNA, 22 bp, Artificial Sequence
  chemically synthesized
aactcaaatccagcagaagaaa

SEQ ID NO: 876707 - DNA, 22 bp, Artificial Sequence
  chemically synthesized
atctttgttatttcttttcttc

SEQ ID NO: 876708 - DNA, 22 bp, Artificial Sequence
  chemically synthesized
gatctttgttatttcttttctt

SEQ ID NO: 876709 - DNA, 22 bp, Artificial Sequence
  chemically synthesized
aaatccagcagaagaaaagaaa

SEQ ID NO: 876710 - DNA, 22 bp, Artificial Sequence
  chemically synthesized
tgatctttgttatttcttttct

SEQ ID NO: 876711 - DNA, 22 bp, Artificial Sequence
  chemically synthesized
ctttgatctttgttatttcttt

SEQ ID NO: 876712 - DNA, 22 bp, Artificial Sequence
  chemically synthesized
tgctttgatctttgttatttct

SEQ ID NO: 876713 - DNA, 22 bp, Artificial Sequence
  chemically synthesized
gttctgctttgatctttgttat

SEQ ID NO: 876714 - DNA, 22 bp, Artificial Sequence
  chemically synthesized
agttctgctttgatctttgtta

SEQ ID NO: 876715 - DNA, 22 bp, Artificial Sequence
  chemically synthesized
atttagttctgctttgatcttt

SEQ ID NO: 876716 - DNA, 22 bp, Artificial Sequence
  chemically synthesized
catttagttctgctttgatctt

SEQ ID NO: 876717 - DNA, 22 bp, Artificial Sequence
  chemically synthesized
aacttcatttagttctgctttg

SEQ ID NO: 876718 - DNA, 22 bp, Artificial Sequence
  chemically synthesized
caacttcatttagttctgcttt

SEQ ID NO: 876719 - DNA, 22 bp, Artificial Sequence
  chemically synthesized
tttcaacttcatttagttctgc

SEQ ID NO: 876720 - DNA, 22 bp, Artificial Sequence
  chemically synthesized
gtttcaacttcatttagttctg

SEQ ID NO: 876721 - DNA, 22 bp, Artificial Sequence
  chemically synthesized
tgtttcaacttcatttagttct

SEQ ID NO: 876722 - DNA, 22 bp, Artificial Sequence
  chemically synthesized
ttgtttcaacttcatttagttc

SEQ ID NO: 876723 - DNA, 22 bp, Artificial Sequence
  chemically synthesized
tttgtttcaacttcatttagtt

SEQ ID NO: 876724 - DNA, 22 bp, Artificial Sequence
  chemically synthesized
ttttgtttcaacttcatttagt

SEQ ID NO: 876725 - DNA, 22 bp, Artificial Sequence
  chemically synthesized
tatttttttgtttcaacttcat

SEQ ID NO: 876726 - DNA, 22 bp, Artificial Sequence
  chemically synthesized
gtatttttttgtttcaacttca

SEQ ID NO: 876727 - DNA, 22 bp, Artificial Sequence
  chemically synthesized
tgtatttttttgtttcaacttc

SEQ ID NO: 876728 - DNA, 22 bp, Artificial Sequence
  chemically synthesized
tattttgtatttttttgtttca

SEQ ID NO: 876729 - DNA, 22 bp, Artificial Sequence
  chemically synthesized
atattttgtatttttttgtttc

SEQ ID NO: 876730 - DNA, 22 bp, Artificial Sequence
  chemically synthesized
aatgaagttgaaacaaaaaaat

SEQ ID NO: 876731 - DNA, 22 bp, Artificial Sequence
  chemically synthesized
atttatattttgtatttttttg

SEQ ID NO: 876732 - DNA, 22 bp, Artificial Sequence
  chemically synthesized
catttatattttgtattttttt

SEQ ID NO: 876733 - DNA, 22 bp, Artificial Sequence
  chemically synthesized
tttcatttatattttgtatttt

SEQ ID NO: 876734 - DNA, 22 bp, Artificial Sequence
  chemically synthesized
gtttcatttatattttgtattt

SEQ ID NO: 876735 - DNA, 22 bp, Artificial Sequence
  chemically synthesized
tttgtttcatttatattttgta

SEQ ID NO: 876736 - DNA, 22 bp, Artificial Sequence
  chemically synthesized
aaacaaaaaaatacaaaatata

SEQ ID NO: 876737 - DNA, 22 bp, Artificial Sequence
  chemically synthesized
aaagaactatttgtttcattta

SEQ ID NO: 876738 - DNA, 22 bp, Artificial Sequence
  chemically synthesized
caaagaactatttgtttcattt

SEQ ID NO: 876739 - DNA, 22 bp, Artificial Sequence
  chemically synthesized
tcaaagaactatttgtttcatt

SEQ ID NO: 876740 - DNA, 22 bp, Artificial Sequence
  chemically synthesized
ttcaaagaactatttgtttcat

SEQ ID NO: 876741 - DNA, 22 bp, Artificial Sequence
  chemically synthesized
tcttttcaaagaactatttgtt

SEQ ID NO: 876742 - DNA, 22 bp, Artificial Sequence
  chemically synthesized
atcttttcaaagaactatttgt

SEQ ID NO: 876743 - DNA, 22 bp, Artificial Sequence
  chemically synthesized
tttatcttttcaaagaactatt

SEQ ID NO: 876744 - DNA, 22 bp, Artificial Sequence
  chemically synthesized
gtttatcttttcaaagaactat

SEQ ID NO: 876745 - DNA, 22 bp, Artificial Sequence
  chemically synthesized
tgtttatcttttcaaagaacta

SEQ ID NO: 876746 - DNA, 22 bp, Artificial Sequence
  chemically synthesized
tcaattttgtttatcttttcaa

SEQ ID NO: 876747 - DNA, 22 bp, Artificial Sequence
  chemically synthesized
atggtctatcaattttgtttat

SEQ ID NO: 876748 - DNA, 22 bp, Artificial Sequence
  chemically synthesized
tttgaaaagataaacaaaattg

SEQ ID NO: 876749 - DNA, 22 bp, Artificial Sequence
  chemically synthesized
ctaatggtctatcaattttgtt

SEQ ID NO: 876750 - DNA, 22 bp, Artificial Sequence
  chemically synthesized
gctaatggtctatcaattttgt

SEQ ID NO: 876751 - DNA, 22 bp, Artificial Sequence
  chemically synthesized
tgaaaagataaacaaaattgat

SEQ ID NO: 876752 - DNA, 22 bp, Artificial Sequence
  chemically synthesized
gaaaagataaacaaaattgata

SEQ ID NO: 876753 - DNA, 22 bp, Artificial Sequence
  chemically synthesized
aaaagataaacaaaattgatag

SEQ ID NO: 876754 - DNA, 22 bp, Artificial Sequence
  chemically synthesized
atcttgctaatggtctatcaat

SEQ ID NO: 876755 - DNA, 22 bp, Artificial Sequence
  chemically synthesized
gttaatcttgctaatggtctat

SEQ ID NO: 876756 - DNA, 22 bp, Artificial Sequence
  chemically synthesized
ggttaatcttgctaatggtcta

SEQ ID NO: 876757 - DNA, 22 bp, Artificial Sequence
  chemically synthesized
cttggttaatcttgctaatggt

SEQ ID NO: 876758 - DNA, 22 bp, Artificial Sequence
  chemically synthesized
ccttggttaatcttgctaatgg

SEQ ID NO: 876759 - DNA, 22 bp, Artificial Sequence
  chemically synthesized
tccttggttaatcttgctaatg

SEQ ID NO: 876760 - DNA, 22 bp, Artificial Sequence
  chemically synthesized
tttccttggttaatcttgctaa

SEQ ID NO: 876761 - DNA, 22 bp, Artificial Sequence
  chemically synthesized
ctttccttggttaatcttgcta

SEQ ID NO: 876762 - DNA, 22 bp, Artificial Sequence
  chemically synthesized
ttctttccttggttaatcttgc

SEQ ID NO: 876763 - DNA, 22 bp, Artificial Sequence
  chemically synthesized
atagaccattagcaagattaac

SEQ ID NO: 876764 - DNA, 22 bp, Artificial Sequence
  chemically synthesized
tcttctttccttggttaatctt

SEQ ID NO: 876765 - DNA, 22 bp, Artificial Sequence
  chemically synthesized
tctcttctttccttggttaatc

SEQ ID NO: 876766 - DNA, 22 bp, Artificial Sequence
  chemically synthesized
ctctcttctttccttggttaat

SEQ ID NO: 876767 - DNA, 22 bp, Artificial Sequence
  chemically synthesized
aatcttctctcttctttccttg

SEQ ID NO: 876768 - DNA, 22 bp, Artificial Sequence
  chemically synthesized
gcaagattaaccaaggaaagaa

SEQ ID NO: 876769 - DNA, 22 bp, Artificial Sequence
  chemically synthesized
gaatcttctctcttctttcctt

SEQ ID NO: 876770 - DNA, 22 bp, Artificial Sequence
  chemically synthesized
tttgaatcttctctcttctttc

SEQ ID NO: 876771 - DNA, 22 bp, Artificial Sequence
  chemically synthesized
atttgaatcttctctcttcttt

SEQ ID NO: 876772 - DNA, 22 bp, Artificial Sequence
  chemically synthesized
accaaggaaagaagagagaaga

SEQ ID NO: 876773 - DNA, 22 bp, Artificial Sequence
  chemically synthesized
agcttatttgaatcttctctct

SEQ ID NO: 876774 - DNA, 22 bp, Artificial Sequence
  chemically synthesized
gagcttatttgaatcttctctc

SEQ ID NO: 876775 - DNA, 22 bp, Artificial Sequence
  chemically synthesized
cttgagcttatttgaatcttct

SEQ ID NO: 876776 - DNA, 22 bp, Artificial Sequence
  chemically synthesized
tacttgagcttatttgaatctt

SEQ ID NO: 876777 - DNA, 22 bp, Artificial Sequence
  chemically synthesized
ctacttgagcttatttgaatct

SEQ ID NO: 876778 - DNA, 22 bp, Artificial Sequence
  chemically synthesized
atttctacttgagcttatttga

SEQ ID NO: 876779 - DNA, 22 bp, Artificial Sequence
  chemically synthesized
catttctacttgagcttatttg

SEQ ID NO: 876780 - DNA, 22 bp, Artificial Sequence
  chemically synthesized
cagtttcatttctacttgagct

SEQ ID NO: 876781 - DNA, 22 bp, Artificial Sequence
  chemically synthesized
ccagtttcatttctacttgagc

SEQ ID NO: 876782 - DNA, 22 bp, Artificial Sequence
  chemically synthesized
aaataagctcaagtagaaatga

SEQ ID NO: 876783 - DNA, 22 bp, Artificial Sequence
  chemically synthesized
tagtgtttccagtttcatttct

SEQ ID NO: 876784 - DNA, 22 bp, Artificial Sequence
  chemically synthesized
aagtagaaatgaaactggaaac

SEQ ID NO: 876785 - DNA, 22 bp, Artificial Sequence
  chemically synthesized
tgatgtaggttgtagtgtttcc

SEQ ID NO: 876786 - DNA, 22 bp, Artificial Sequence
  chemically synthesized
gtgatgtaggttgtagtgtttc

SEQ ID NO: 876787 - DNA, 22 bp, Artificial Sequence
  chemically synthesized
tgtgatgtaggttgtagtgttt

SEQ ID NO: 876788 - DNA, 22 bp, Artificial Sequence
  chemically synthesized
ttgtgatgtaggttgtagtgtt

SEQ ID NO: 876789 - DNA, 22 bp, Artificial Sequence
  chemically synthesized
tatttttgtgatgtaggttgta

SEQ ID NO: 876790 - DNA, 22 bp, Artificial Sequence
  chemically synthesized
gtatttttgtgatgtaggttgt

SEQ ID NO: 876791 - DNA, 22 bp, Artificial Sequence
  chemically synthesized
tgtatttttgtgatgtaggttg

SEQ ID NO: 876792 - DNA, 22 bp, Artificial Sequence
  chemically synthesized
ttgtatttttgtgatgtaggtt

SEQ ID NO: 876793 - DNA, 22 bp, Artificial Sequence
  chemically synthesized
gaaacactacaacctacatcac

SEQ ID NO: 876794 - DNA, 22 bp, Artificial Sequence
  chemically synthesized
caacctacatcacaaaaataca

SEQ ID NO: 876795 - DNA, 22 bp, Artificial Sequence
  chemically synthesized
catcacaaaaatacaaaagatc

SEQ ID NO: 876796 - DNA, 22 bp, Artificial Sequence
  chemically synthesized
atagtagtagtgaatgatcttt

SEQ ID NO: 876797 - DNA, 22 bp, Artificial Sequence
  chemically synthesized
tgtgcataaaggtgttcatagt

SEQ ID NO: 876798 - DNA, 22 bp, Artificial Sequence
  chemically synthesized
gtgtgcataaaggtgttcatag

SEQ ID NO: 876799 - DNA, 22 bp, Artificial Sequence
  chemically synthesized
gtttgtgtgcataaaggtgttc

SEQ ID NO: 876800 - DNA, 22 bp, Artificial Sequence
  chemically synthesized
actactactatgaacaccttta

SEQ ID NO: 876801 - DNA, 22 bp, Artificial Sequence
  chemically synthesized
tagtttgtgtgcataaaggtgt

SEQ ID NO: 876802 - DNA, 22 bp, Artificial Sequence
  chemically synthesized
ctagtttgtgtgcataaaggtg

SEQ ID NO: 876803 - DNA, 22 bp, Artificial Sequence
  chemically synthesized
tctagtttgtgtgcataaaggt

SEQ ID NO: 876804 - DNA, 22 bp, Artificial Sequence
  chemically synthesized
ctactatgaacacctttatgca

SEQ ID NO: 876805 - DNA, 22 bp, Artificial Sequence
  chemically synthesized
ctatgaacacctttatgcacac

SEQ ID NO: 876806 - DNA, 22 bp, Artificial Sequence
  chemically synthesized
gattttctagtttgtgtgcata

SEQ ID NO: 876807 - DNA, 22 bp, Artificial Sequence
  chemically synthesized
tgaacacctttatgcacacaaa

SEQ ID NO: 876808 - DNA, 22 bp, Artificial Sequence
  chemically synthesized
tagattttctagtttgtgtgca

SEQ ID NO: 876809 - DNA, 22 bp, Artificial Sequence
  chemically synthesized
ctctagattttctagtttgtgt

SEQ ID NO: 876810 - DNA, 22 bp, Artificial Sequence
  chemically synthesized
cctctagattttctagtttgtg

SEQ ID NO: 876811 - DNA, 22 bp, Artificial Sequence
  chemically synthesized
tatgcacacaaactagaaaatc

SEQ ID NO: 876812 - DNA, 22 bp, Artificial Sequence
  chemically synthesized
atgcacacaaactagaaaatct

SEQ ID NO: 876813 - DNA, 22 bp, Artificial Sequence
  chemically synthesized
tgcacacaaactagaaaatcta

SEQ ID NO: 876814 - DNA, 22 bp, Artificial Sequence
  chemically synthesized
caggaatgtatccatttcctct

SEQ ID NO: 876815 - DNA, 22 bp, Artificial Sequence
  chemically synthesized
ccaggaatgtatccatttcctc

SEQ ID NO: 876816 - DNA, 22 bp, Artificial Sequence
  chemically synthesized
gaaaatctagaggaaatggata

SEQ ID NO: 876817 - DNA, 22 bp, Artificial Sequence
  chemically synthesized
tgtgtttccaggaatgtatcca

SEQ ID NO: 876818 - DNA, 22 bp, Artificial Sequence
  chemically synthesized
gaggaaatggatacattcctgg

SEQ ID NO: 876819 - DNA, 22 bp, Artificial Sequence
  chemically synthesized
ggagggttgtgtgtttccagga

SEQ ID NO: 876820 - DNA, 22 bp, Artificial Sequence
  chemically synthesized
aactaggagggttgtgtgtttc

SEQ ID NO: 876821 - DNA, 22 bp, Artificial Sequence
  chemically synthesized
aaactaggagggttgtgtgttt

SEQ ID NO: 876822 - DNA, 22 bp, Artificial Sequence
  chemically synthesized
atttaaactaggagggttgtgt

SEQ ID NO: 876823 - DNA, 22 bp, Artificial Sequence
  chemically synthesized
gatttaaactaggagggttgtg

SEQ ID NO: 876824 - DNA, 22 bp, Artificial Sequence
  chemically synthesized
ttgatttaaactaggagggttg

SEQ ID NO: 876825 - DNA, 22 bp, Artificial Sequence
  chemically synthesized
ctggaaacacacaaccctccta

SEQ ID NO: 876826 - DNA, 22 bp, Artificial Sequence
  chemically synthesized
cttgatttaaactaggagggtt

SEQ ID NO: 876827 - DNA, 22 bp, Artificial Sequence
  chemically synthesized
ttcttgatttaaactaggaggg

SEQ ID NO: 876828 - DNA, 22 bp, Artificial Sequence
  chemically synthesized
gaaacacacaaccctcctagtt

SEQ ID NO: 876829 - DNA, 22 bp, Artificial Sequence
  chemically synthesized
cttcttgatttaaactaggagg

SEQ ID NO: 876830 - DNA, 22 bp, Artificial Sequence
  chemically synthesized
tttcttcttgatttaaactagg

SEQ ID NO: 876831 - DNA, 22 bp, Artificial Sequence
  chemically synthesized
tatttcttcttgatttaaacta

SEQ ID NO: 876832 - DNA, 22 bp, Artificial Sequence
  chemically synthesized
ctatttcttcttgatttaaact

SEQ ID NO: 876833 - DNA, 22 bp, Artificial Sequence
  chemically synthesized
agggtttctatttcttcttgat

SEQ ID NO: 876834 - DNA, 22 bp, Artificial Sequence
  chemically synthesized
ctagtttaaatcaagaagaaat

SEQ ID NO: 876835 - DNA, 22 bp, Artificial Sequence
  chemically synthesized
gtttaaatcaagaagaaataga

SEQ ID NO: 876836 - DNA, 22 bp, Artificial Sequence
  chemically synthesized
aaatcaagaagaaatagaaacc

SEQ ID NO: 876837 - DNA, 22 bp, Artificial Sequence
  chemically synthesized
aatcaagaagaaatagaaaccc

SEQ ID NO: 876838 - DNA, 22 bp, Artificial Sequence
  chemically synthesized
aacgctttggctgggcgcggtg

SEQ ID NO: 876839 - DNA, 22 bp, Artificial Sequence
  chemically synthesized
aaatcacagacgtgagccaccg

SEQ ID NO: 876840 - DNA, 22 bp, Artificial Sequence
  chemically synthesized
tggctgggcgcggtggctcacg

SEQ ID NO: 876841 - DNA, 22 bp, Artificial Sequence
  chemically synthesized
ggctgggcgcggtggctcacgt

SEQ ID NO: 876842 - DNA, 22 bp, Artificial Sequence
  chemically synthesized
gctgggcgcggtggctcacgtc

SEQ ID NO: 876843 - DNA, 22 bp, Artificial Sequence
  chemically synthesized
ggcgcggtggctcacgtctgtg

SEQ ID NO: 876844 - DNA, 22 bp, Artificial Sequence
  chemically synthesized
ccaaagtgctaaaatcacagac

SEQ ID NO: 876845 - DNA, 22 bp, Artificial Sequence
  chemically synthesized
agcctcccaaagtgctaaaatc

SEQ ID NO: 876846 - DNA, 22 bp, Artificial Sequence
  chemically synthesized
acgtctgtgattttagcacttt

SEQ ID NO: 876847 - DNA, 22 bp, Artificial Sequence
  chemically synthesized
cctcagcctcccaaagtgctaa

SEQ ID NO: 876848 - DNA, 22 bp, Artificial Sequence
  chemically synthesized
tgattttagcactttgggaggc

SEQ ID NO: 876849 - DNA, 22 bp, Artificial Sequence
  chemically synthesized
gtgatccacctgcctcagcctc

SEQ ID NO: 876850 - DNA, 22 bp, Artificial Sequence
  chemically synthesized
tagcactttgggaggctgaggc

SEQ ID NO: 876851 - DNA, 22 bp, Artificial Sequence
  chemically synthesized
agcactttgggaggctgaggca

SEQ ID NO: 876852 - DNA, 22 bp, Artificial Sequence
  chemically synthesized
gcactttgggaggctgaggcag

SEQ ID NO: 876853 - DNA, 22 bp, Artificial Sequence
  chemically synthesized
acctagtgatccacctgcctca

SEQ ID NO: 876854 - DNA, 22 bp, Artificial Sequence
  chemically synthesized
ctgacctagtgatccacctgcc

SEQ ID NO: 876855 - DNA, 22 bp, Artificial Sequence
  chemically synthesized
tgggaggctgaggcaggtggat

SEQ ID NO: 876856 - DNA, 22 bp, Artificial Sequence
  chemically synthesized
gggaggctgaggcaggtggatc

SEQ ID NO: 876857 - DNA, 22 bp, Artificial Sequence
  chemically synthesized
ggaggctgaggcaggtggatca

SEQ ID NO: 876858 - DNA, 22 bp, Artificial Sequence
  chemically synthesized
gaactcctgacctagtgatcca

SEQ ID NO: 876859 - DNA, 22 bp, Artificial Sequence
  chemically synthesized
aggcaggtggatcactaggtca

SEQ ID NO: 876860 - DNA, 22 bp, Artificial Sequence
  chemically synthesized
gccaggcaggtctcgaactcct

SEQ ID NO: 876861 - DNA, 22 bp, Artificial Sequence
  chemically synthesized
tgttggccaggcaggtctcgaa

SEQ ID NO: 876862 - DNA, 22 bp, Artificial Sequence
  chemically synthesized
ggtcaggagttcgagacctgcc

SEQ ID NO: 876863 - DNA, 22 bp, Artificial Sequence
  chemically synthesized
actgtgttggccaggcaggtct

SEQ ID NO: 876864 - DNA, 22 bp, Artificial Sequence
  chemically synthesized
cactgtgttggccaggcaggtc

SEQ ID NO: 876865 - DNA, 22 bp, Artificial Sequence
  chemically synthesized
gagacctgcctggccaacacag

SEQ ID NO: 876866 - DNA, 22 bp, Artificial Sequence
  chemically synthesized
gtagagtcggagtttcactgtg

SEQ ID NO: 876867 - DNA, 22 bp, Artificial Sequence
  chemically synthesized
agtagagtcggagtttcactgt

SEQ ID NO: 876868 - DNA, 22 bp, Artificial Sequence
  chemically synthesized
tagtagagtcggagtttcactg

SEQ ID NO: 876869 - DNA, 22 bp, Artificial Sequence
  chemically synthesized
cctggccaacacagtgaaactc

SEQ ID NO: 876870 - DNA, 22 bp, Artificial Sequence
  chemically synthesized
ttagtagagtcggagtttcact

SEQ ID NO: 876871 - DNA, 22 bp, Artificial Sequence
  chemically synthesized
gccaacacagtgaaactccgac

SEQ ID NO: 876872 - DNA, 22 bp, Artificial Sequence
  chemically synthesized
tatttttagtagagtcggagtt

SEQ ID NO: 876873 - DNA, 22 bp, Artificial Sequence
  chemically synthesized
gtatttttagtagagtcggagt

SEQ ID NO: 876874 - DNA, 22 bp, Artificial Sequence
  chemically synthesized
tgtatttttagtagagtcggag

SEQ ID NO: 876875 - DNA, 22 bp, Artificial Sequence
  chemically synthesized
ttgtatttttagtagagtcgga

SEQ ID NO: 876876 - DNA, 22 bp, Artificial Sequence
  chemically synthesized
atttttgtatttttagtagagt

SEQ ID NO: 876877 - DNA, 22 bp, Artificial Sequence
  chemically synthesized
cgactctactaaaaatacaaaa

SEQ ID NO: 876878 - DNA, 22 bp, Artificial Sequence
  chemically synthesized
tactaaaaatacaaaaattagc

SEQ ID NO: 876879 - DNA, 22 bp, Artificial Sequence
  chemically synthesized
ctaaaaatacaaaaattagctg

SEQ ID NO: 876880 - DNA, 22 bp, Artificial Sequence
  chemically synthesized
aaaatacaaaaattagctgggc

SEQ ID NO: 876881 - DNA, 22 bp, Artificial Sequence
  chemically synthesized
caggtgcccaccaccacgccca

SEQ ID NO: 876882 - DNA, 22 bp, Artificial Sequence
  chemically synthesized
agattacaggtgcccaccacca

SEQ ID NO: 876883 - DNA, 22 bp, Artificial Sequence
  chemically synthesized
gctgggcgtggtggtgggcacc

SEQ ID NO: 876884 - DNA, 22 bp, Artificial Sequence
  chemically synthesized
ggcgtggtggtgggcacctgta

SEQ ID NO: 876885 - DNA, 22 bp, Artificial Sequence
  chemically synthesized
ccaagtagctgagattacaggt

SEQ ID NO: 876886 - DNA, 22 bp, Artificial Sequence
  chemically synthesized
agcctcccaagtagctgagatt

SEQ ID NO: 876887 - DNA, 22 bp, Artificial Sequence
  chemically synthesized
cctcagcctcccaagtagctga

SEQ ID NO: 876888 - DNA, 22 bp, Artificial Sequence
  chemically synthesized
ctgcctcagcctcccaagtagc

SEQ ID NO: 876889 - DNA, 22 bp, Artificial Sequence
  chemically synthesized
tcctgcctcagcctcccaagta

SEQ ID NO: 876890 - DNA, 22 bp, Artificial Sequence
  chemically synthesized
taatctcagctacttgggaggc

SEQ ID NO: 876891 - DNA, 22 bp, Artificial Sequence
  chemically synthesized
agctacttgggaggctgaggca

SEQ ID NO: 876892 - DNA, 22 bp, Artificial Sequence
  chemically synthesized
aagtaattctcctgcctcagcc

SEQ ID NO: 876893 - DNA, 22 bp, Artificial Sequence
  chemically synthesized
caagtaattctcctgcctcagc

SEQ ID NO: 876894 - DNA, 22 bp, Artificial Sequence
  chemically synthesized
cttgggaggctgaggcaggaga

SEQ ID NO: 876895 - DNA, 22 bp, Artificial Sequence
  chemically synthesized
cagtttcaagtaattctcctgc

SEQ ID NO: 876896 - DNA, 22 bp, Artificial Sequence
  chemically synthesized
gggaggctgaggcaggagaatt

SEQ ID NO: 876897 - DNA, 22 bp, Artificial Sequence
  chemically synthesized
ccagtttcaagtaattctcctg

SEQ ID NO: 876898 - DNA, 22 bp, Artificial Sequence
  chemically synthesized
ggaggctgaggcaggagaatta

SEQ ID NO: 876899 - DNA, 22 bp, Artificial Sequence
  chemically synthesized
caccttccagtttcaagtaatt

SEQ ID NO: 876900 - DNA, 22 bp, Artificial Sequence
  chemically synthesized
aggcaggagaattacttgaaac

SEQ ID NO: 876901 - DNA, 22 bp, Artificial Sequence
  chemically synthesized
caacctccaccttccagtttca

SEQ ID NO: 876902 - DNA, 22 bp, Artificial Sequence
  chemically synthesized
actgcaacctccaccttccagt

SEQ ID NO: 876903 - DNA, 22 bp, Artificial Sequence
  chemically synthesized
gctcactgcaacctccaccttc

SEQ ID NO: 876904 - DNA, 22 bp, Artificial Sequence
  chemically synthesized
ggctcactgcaacctccacctt

SEQ ID NO: 876905 - DNA, 22 bp, Artificial Sequence
  chemically synthesized
cttgaaactggaaggtggaggt

SEQ ID NO: 876906 - DNA, 22 bp, Artificial Sequence
  chemically synthesized
gaaactggaaggtggaggttgc

SEQ ID NO: 876907 - DNA, 22 bp, Artificial Sequence
  chemically synthesized
aaactggaaggtggaggttgca

SEQ ID NO: 876908 - DNA, 22 bp, Artificial Sequence
  chemically synthesized
gaaggtggaggttgcagtgagc

SEQ ID NO: 876909 - DNA, 22 bp, Artificial Sequence
  chemically synthesized
tggcatgatcttggctcactgc

SEQ ID NO: 876910 - DNA, 22 bp, Artificial Sequence
  chemically synthesized
gtgctgtggcatgatcttggct

SEQ ID NO: 876911 - DNA, 22 bp, Artificial Sequence
  chemically synthesized
agtgctgtggcatgatcttggc

SEQ ID NO: 876912 - DNA, 22 bp, Artificial Sequence
  chemically synthesized
tagtgctgtggcatgatcttgg

SEQ ID NO: 876913 - DNA, 22 bp, Artificial Sequence
  chemically synthesized
cagtgagccaagatcatgccac

SEQ ID NO: 876914 - DNA, 22 bp, Artificial Sequence
  chemically synthesized
ggctttagtgctgtggcatgat

SEQ ID NO: 876915 - DNA, 22 bp, Artificial Sequence
  chemically synthesized
acctaggctttagtgctgtggc

SEQ ID NO: 876916 - DNA, 22 bp, Artificial Sequence
  chemically synthesized
cacctaggctttagtgctgtgg

SEQ ID NO: 876917 - DNA, 22 bp, Artificial Sequence
  chemically synthesized
tcacctaggctttagtgctgtg

SEQ ID NO: 876918 - DNA, 22 bp, Artificial Sequence
  chemically synthesized
tttcacctaggctttagtgctg

SEQ ID NO: 876919 - DNA, 22 bp, Artificial Sequence
  chemically synthesized
ctctttcacctaggctttagtg

SEQ ID NO: 876920 - DNA, 22 bp, Artificial Sequence
  chemically synthesized
gctctttcacctaggctttagt

SEQ ID NO: 876921 - DNA, 22 bp, Artificial Sequence
  chemically synthesized
tgctctttcacctaggctttag

SEQ ID NO: 876922 - DNA, 22 bp, Artificial Sequence
  chemically synthesized
agatggagttttgctctttcac

SEQ ID NO: 876923 - DNA, 22 bp, Artificial Sequence
  chemically synthesized
gagatggagttttgctctttca

SEQ ID NO: 876924 - DNA, 22 bp, Artificial Sequence
  chemically synthesized
tgagatggagttttgctctttc

SEQ ID NO: 876925 - DNA, 22 bp, Artificial Sequence
  chemically synthesized
ttgagatggagttttgctcttt

SEQ ID NO: 876926 - DNA, 22 bp, Artificial Sequence
  chemically synthesized
aagcctaggtgaaagagcaaaa

SEQ ID NO: 876927 - DNA, 22 bp, Artificial Sequence
  chemically synthesized
tttgagatggagttttgctctt

SEQ ID NO: 876928 - DNA, 22 bp, Artificial Sequence
  chemically synthesized
ttttgagatggagttttgctct

SEQ ID NO: 876929 - DNA, 22 bp, Artificial Sequence
  chemically synthesized
tttttgagatggagttttgctc

SEQ ID NO: 876930 - DNA, 22 bp, Artificial Sequence
  chemically synthesized
ttttttgagatggagttttgct

SEQ ID NO: 876931 - DNA, 22 bp, Artificial Sequence
  chemically synthesized
tttttttgagatggagttttgc

SEQ ID NO: 876932 - DNA, 22 bp, Artificial Sequence
  chemically synthesized
ttttttttgagatggagttttg

SEQ ID NO: 876933 - DNA, 22 bp, Artificial Sequence
  chemically synthesized
tttttttttgagatggagtttt

SEQ ID NO: 876934 - DNA, 22 bp, Artificial Sequence
  chemically synthesized
ggtgaaagagcaaaactccatc

SEQ ID NO: 876935 - DNA, 22 bp, Artificial Sequence
  chemically synthesized
ttttttttttgagatggagttt

SEQ ID NO: 876936 - DNA, 22 bp, Artificial Sequence
  chemically synthesized
tttttttttttgagatggagtt

SEQ ID NO: 876937 - DNA, 22 bp, Artificial Sequence
  chemically synthesized
ttttttttttttgagatggagt

SEQ ID NO: 876938 - DNA, 22 bp, Artificial Sequence
  chemically synthesized
tttttttttttttgagatggag

SEQ ID NO: 876939 - DNA, 22 bp, Artificial Sequence
  chemically synthesized
ttttttttttttttgagatgga

SEQ ID NO: 876940 - DNA, 22 bp, Artificial Sequence
  chemically synthesized
tttttttttttttttgagatgg

SEQ ID NO: 876941 - DNA, 22 bp, Artificial Sequence
  chemically synthesized
ttttttttttttttttgagatg

SEQ ID NO: 876942 - DNA, 22 bp, Artificial Sequence
  chemically synthesized
ttttttttttttttttttgaga

SEQ ID NO: 876943 - DNA, 22 bp, Artificial Sequence
  chemically synthesized
cttttttttttttttttttgag

SEQ ID NO: 876944 - DNA, 22 bp, Artificial Sequence
  chemically synthesized
tcttttttttttttttttttga

SEQ ID NO: 876945 - DNA, 22 bp, Artificial Sequence
  chemically synthesized
tttctttttttttttttttttt

SEQ ID NO: 876946 - DNA, 22 bp, Artificial Sequence
  chemically synthesized
ctttcttttttttttttttttt

SEQ ID NO: 876947 - DNA, 22 bp, Artificial Sequence
  chemically synthesized
catctcaaaaaaaaaaaaaaaa

SEQ ID NO: 876948 - DNA, 22 bp, Artificial Sequence
  chemically synthesized
agggtttctttctttttttttt

SEQ ID NO: 876949 - DNA, 22 bp, Artificial Sequence
  chemically synthesized
aaaaaaaaaaaaaaaaaagaaa

SEQ ID NO: 876950 - DNA, 22 bp, Artificial Sequence
  chemically synthesized
gtatgttcagggtttctttctt

SEQ ID NO: 876951 - DNA, 22 bp, Artificial Sequence
  chemically synthesized
ctggtatgttcagggtttcttt

SEQ ID NO: 876952 - DNA, 22 bp, Artificial Sequence
  chemically synthesized
gttactggtatgttcagggttt

SEQ ID NO: 876953 - DNA, 22 bp, Artificial Sequence
  chemically synthesized
ctcgttactggtatgttcaggg

SEQ ID NO: 876954 - DNA, 22 bp, Artificial Sequence
  chemically synthesized
ctgctcgttactggtatgttca

SEQ ID NO: 876955 - DNA, 22 bp, Artificial Sequence
  chemically synthesized
gctgctcgttactggtatgttc

SEQ ID NO: 876956 - DNA, 22 bp, Artificial Sequence
  chemically synthesized
aaccttgctgctcgttactggt

SEQ ID NO: 876957 - DNA, 22 bp, Artificial Sequence
  chemically synthesized
atattcaaccttgctgctcgtt

SEQ ID NO: 876958 - DNA, 22 bp, Artificial Sequence
  chemically synthesized
aacataccagtaacgagcagca

SEQ ID NO: 876959 - DNA, 22 bp, Artificial Sequence
  chemically synthesized
ctgatattcaaccttgctgctc

SEQ ID NO: 876960 - DNA, 22 bp, Artificial Sequence
  chemically synthesized
aattactgatattcaaccttgc

SEQ ID NO: 876961 - DNA, 22 bp, Artificial Sequence
  chemically synthesized
aaattactgatattcaaccttg

SEQ ID NO: 876962 - DNA, 22 bp, Artificial Sequence
  chemically synthesized
taaattactgatattcaacctt

SEQ ID NO: 876963 - DNA, 22 bp, Artificial Sequence
  chemically synthesized
ttaaattactgatattcaacct

SEQ ID NO: 876964 - DNA, 22 bp, Artificial Sequence
  chemically synthesized
gcaatttttaaattactgatat

SEQ ID NO: 876965 - DNA, 22 bp, Artificial Sequence
  chemically synthesized
ggcaatttttaaattactgata

SEQ ID NO: 876966 - DNA, 22 bp, Artificial Sequence
  chemically synthesized
tggcaatttttaaattactgat

SEQ ID NO: 876967 - DNA, 22 bp, Artificial Sequence
  chemically synthesized
ttggcaatttttaaattactga

SEQ ID NO: 876968 - DNA, 22 bp, Artificial Sequence
  chemically synthesized
tttggcaatttttaaattactg

SEQ ID NO: 876969 - DNA, 22 bp, Artificial Sequence
  chemically synthesized
ttttggcaatttttaaattact

SEQ ID NO: 876970 - DNA, 22 bp, Artificial Sequence
  chemically synthesized
tttttggcaatttttaaattac

SEQ ID NO: 876971 - DNA, 22 bp, Artificial Sequence
  chemically synthesized
ttttttggcaatttttaaatta

SEQ ID NO: 876972 - DNA, 22 bp, Artificial Sequence
  chemically synthesized
aatatcagtaatttaaaaattg

SEQ ID NO: 876973 - DNA, 22 bp, Artificial Sequence
  chemically synthesized
gacttttttttggcaattttta

SEQ ID NO: 876974 - DNA, 22 bp, Artificial Sequence
  chemically synthesized
gtcctggacttttttttggcaa

SEQ ID NO: 876975 - DNA, 22 bp, Artificial Sequence
  chemically synthesized
aaaaattgccaaaaaaaagtcc

SEQ ID NO: 876976 - DNA, 22 bp, Artificial Sequence
  chemically synthesized
aaaattgccaaaaaaaagtcca

SEQ ID NO: 876977 - DNA, 22 bp, Artificial Sequence
  chemically synthesized
tgaatccatctggtcctggact

SEQ ID NO: 876978 - DNA, 22 bp, Artificial Sequence
  chemically synthesized
ccaaaaaaaagtccaggaccag

SEQ ID NO: 876979 - DNA, 22 bp, Artificial Sequence
  chemically synthesized
agctgtgaatccatctggtcct

SEQ ID NO: 876980 - DNA, 22 bp, Artificial Sequence
  chemically synthesized
gtagaattcagctgtgaatcca

SEQ ID NO: 876981 - DNA, 22 bp, Artificial Sequence
  chemically synthesized
aatgtctggtagaattcagctg

SEQ ID NO: 876982 - DNA, 22 bp, Artificial Sequence
  chemically synthesized
gaatgtctggtagaattcagct

SEQ ID NO: 876983 - DNA, 22 bp, Artificial Sequence
  chemically synthesized
tgaatgtctggtagaattcagc

SEQ ID NO: 876984 - DNA, 22 bp, Artificial Sequence
  chemically synthesized
tttgaatgtctggtagaattca

SEQ ID NO: 876985 - DNA, 22 bp, Artificial Sequence
  chemically synthesized
ctttgaatgtctggtagaattc

SEQ ID NO: 876986 - DNA, 22 bp, Artificial Sequence
  chemically synthesized
ttctttgaatgtctggtagaat

SEQ ID NO: 876987 - DNA, 22 bp, Artificial Sequence
  chemically synthesized
acagctgaattctaccagacat

SEQ ID NO: 876988 - DNA, 22 bp, Artificial Sequence
  chemically synthesized
gtaccaattcttctttgaatgt

SEQ ID NO: 876989 - DNA, 22 bp, Artificial Sequence
  chemically synthesized
aattctaccagacattcaaaga

SEQ ID NO: 876990 - DNA, 22 bp, Artificial Sequence
  chemically synthesized
taccagacattcaaagaagaat

SEQ ID NO: 876991 - DNA, 22 bp, Artificial Sequence
  chemically synthesized
taattggtaccaattcttcttt

SEQ ID NO: 876992 - DNA, 22 bp, Artificial Sequence
  chemically synthesized
ccagacattcaaagaagaattg

SEQ ID NO: 876993 - DNA, 22 bp, Artificial Sequence
  chemically synthesized
attataattggtaccaattctt

SEQ ID NO: 876994 - DNA, 22 bp, Artificial Sequence
  chemically synthesized
cattataattggtaccaattct

SEQ ID NO: 876995 - DNA, 22 bp, Artificial Sequence
  chemically synthesized
aaagaagaattggtaccaatta

SEQ ID NO: 876996 - DNA, 22 bp, Artificial Sequence
  chemically synthesized
aaatagtttcattataattggt

SEQ ID NO: 876997 - DNA, 22 bp, Artificial Sequence
  chemically synthesized
gaaatagtttcattataattgg

SEQ ID NO: 876998 - DNA, 22 bp, Artificial Sequence
  chemically synthesized
tgaaatagtttcattataattg

SEQ ID NO: 876999 - DNA, 22 bp, Artificial Sequence
  chemically synthesized
ttgaaatagtttcattataatt

SEQ ID NO: 877000 - DNA, 22 bp, Artificial Sequence
  chemically synthesized
tcttttgaaatagtttcattat

SEQ ID NO: 877001 - DNA, 22 bp, Artificial Sequence
  chemically synthesized
atcttttgaaatagtttcatta

SEQ ID NO: 877002 - DNA, 22 bp, Artificial Sequence
  chemically synthesized
tatcttttgaaatagtttcatt

SEQ ID NO: 877003 - DNA, 22 bp, Artificial Sequence
  chemically synthesized
gtaccaattataatgaaactat

SEQ ID NO: 877004 - DNA, 22 bp, Artificial Sequence
  chemically synthesized
tttatcttttgaaatagtttca

SEQ ID NO: 877005 - DNA, 22 bp, Artificial Sequence
  chemically synthesized
cctctttatcttttgaaatagt

SEQ ID NO: 877006 - DNA, 22 bp, Artificial Sequence
  chemically synthesized
taatgaaactatttcaaaagat

SEQ ID NO: 877007 - DNA, 22 bp, Artificial Sequence
  chemically synthesized
gggaggattccctctttatctt

SEQ ID NO: 877008 - DNA, 22 bp, Artificial Sequence
  chemically synthesized
agggaggattccctctttatct

SEQ ID NO: 877009 - DNA, 22 bp, Artificial Sequence
  chemically synthesized
tttcaaaagataaagagggaat

SEQ ID NO: 877010 - DNA, 22 bp, Artificial Sequence
  chemically synthesized
caaaagataaagagggaatcct

SEQ ID NO: 877011 - DNA, 22 bp, Artificial Sequence
  chemically synthesized
aaaagataaagagggaatcctc

SEQ ID NO: 877012 - DNA, 22 bp, Artificial Sequence
  chemically synthesized
atagaatgatttagggaggatt

SEQ ID NO: 877013 - DNA, 22 bp, Artificial Sequence
  chemically synthesized
catagaatgatttagggaggat

SEQ ID NO: 877014 - DNA, 22 bp, Artificial Sequence
  chemically synthesized
acttcatagaatgatttaggga

SEQ ID NO: 877015 - DNA, 22 bp, Artificial Sequence
  chemically synthesized
gggtgatactgacttcatagaa

SEQ ID NO: 877016 - DNA, 22 bp, Artificial Sequence
  chemically synthesized
cctaaatcattctatgaagtca

SEQ ID NO: 877017 - DNA, 22 bp, Artificial Sequence
  chemically synthesized
gtattagggtgatactgacttc

SEQ ID NO: 877018 - DNA, 22 bp, Artificial Sequence
  chemically synthesized
aatcattctatgaagtcagtat

SEQ ID NO: 877019 - DNA, 22 bp, Artificial Sequence
  chemically synthesized
ggtattagggtgatactgactt

SEQ ID NO: 877020 - DNA, 22 bp, Artificial Sequence
  chemically synthesized
tggtattagggtgatactgact

SEQ ID NO: 877021 - DNA, 22 bp, Artificial Sequence
  chemically synthesized
gttttggtattagggtgatact

SEQ ID NO: 877022 - DNA, 22 bp, Artificial Sequence
  chemically synthesized
tggttttggtattagggtgata

SEQ ID NO: 877023 - DNA, 22 bp, Artificial Sequence
  chemically synthesized
tatgaagtcagtatcaccctaa

SEQ ID NO: 877024 - DNA, 22 bp, Artificial Sequence
  chemically synthesized
ctggttttggtattagggtgat

SEQ ID NO: 877025 - DNA, 22 bp, Artificial Sequence
  chemically synthesized
tctggttttggtattagggtga

SEQ ID NO: 877026 - DNA, 22 bp, Artificial Sequence
  chemically synthesized
tgaagtcagtatcaccctaata

SEQ ID NO: 877027 - DNA, 22 bp, Artificial Sequence
  chemically synthesized
ttctggttttggtattagggtg

SEQ ID NO: 877028 - DNA, 22 bp, Artificial Sequence
  chemically synthesized
cttttctggttttggtattagg

SEQ ID NO: 877029 - DNA, 22 bp, Artificial Sequence
  chemically synthesized
ccttttctggttttggtattag

SEQ ID NO: 877030 - DNA, 22 bp, Artificial Sequence
  chemically synthesized
tttccttttctggttttggtat

SEQ ID NO: 877031 - DNA, 22 bp, Artificial Sequence
  chemically synthesized
ttatttccttttctggttttgg

SEQ ID NO: 877032 - DNA, 22 bp, Artificial Sequence
  chemically synthesized
gttatttccttttctggttttg

SEQ ID NO: 877033 - DNA, 22 bp, Artificial Sequence
  chemically synthesized
tgttatttccttttctggtttt

SEQ ID NO: 877034 - DNA, 22 bp, Artificial Sequence
  chemically synthesized
ttgttatttccttttctggttt

SEQ ID NO: 877035 - DNA, 22 bp, Artificial Sequence
  chemically synthesized
tttgttatttccttttctggtt

SEQ ID NO: 877036 - DNA, 22 bp, Artificial Sequence
  chemically synthesized
ttttgttatttccttttctggt

SEQ ID NO: 877037 - DNA, 22 bp, Artificial Sequence
  chemically synthesized
ttttttgttatttccttttctg

SEQ ID NO: 877038 - DNA, 22 bp, Artificial Sequence
  chemically synthesized
cttttttgttatttccttttct

SEQ ID NO: 877039 - DNA, 22 bp, Artificial Sequence
  chemically synthesized
ataccaaaaccagaaaaggaaa

SEQ ID NO: 877040 - DNA, 22 bp, Artificial Sequence
  chemically synthesized
tcttttttgttatttccttttc

SEQ ID NO: 877041 - DNA, 22 bp, Artificial Sequence
  chemically synthesized
ctttcttttttgttatttcctt

SEQ ID NO: 877042 - DNA, 22 bp, Artificial Sequence
  chemically synthesized
ctgctttcttttttgttatttc

SEQ ID NO: 877043 - DNA, 22 bp, Artificial Sequence
  chemically synthesized
tgctgctgctttcttttttgtt

SEQ ID NO: 877044 - DNA, 22 bp, Artificial Sequence
  chemically synthesized
gtgctgctgctttcttttttgt

SEQ ID NO: 877045 - DNA, 22 bp, Artificial Sequence
  chemically synthesized
tgtgctgctgctttcttttttg

SEQ ID NO: 877046 - DNA, 22 bp, Artificial Sequence
  chemically synthesized
ttgtgctgctgctttctttttt

SEQ ID NO: 877047 - DNA, 22 bp, Artificial Sequence
  chemically synthesized
tttttgtgctgctgctttcttt

SEQ ID NO: 877048 - DNA, 22 bp, Artificial Sequence
  chemically synthesized
ctatttttgtgctgctgctttc

SEQ ID NO: 877049 - DNA, 22 bp, Artificial Sequence
  chemically synthesized
tgctgctatttttgtgctgctg

SEQ ID NO: 877050 - DNA, 22 bp, Artificial Sequence
  chemically synthesized
caaattgtgctgctatttttgt

SEQ ID NO: 877051 - DNA, 22 bp, Artificial Sequence
  chemically synthesized
caattgcaaattgtgctgctat

SEQ ID NO: 877052 - DNA, 22 bp, Artificial Sequence
  chemically synthesized
gcaattgcaaattgtgctgcta

SEQ ID NO: 877053 - DNA, 22 bp, Artificial Sequence
  chemically synthesized
catatcttgcaattgcaaattg

SEQ ID NO: 877054 - DNA, 22 bp, Artificial Sequence
  chemically synthesized
gttccatatcttgcaattgcaa

SEQ ID NO: 877055 - DNA, 22 bp, Artificial Sequence
  chemically synthesized
ggttggttccatatcttgcaat

SEQ ID NO: 877056 - DNA, 22 bp, Artificial Sequence
  chemically synthesized
gggttggttccatatcttgcaa

SEQ ID NO: 877057 - DNA, 22 bp, Artificial Sequence
  chemically synthesized
gcaattgcaagatatggaacca

SEQ ID NO: 877058 - DNA, 22 bp, Artificial Sequence
  chemically synthesized
caattgcaagatatggaaccaa

SEQ ID NO: 877059 - DNA, 22 bp, Artificial Sequence
  chemically synthesized
gtcgatggacacttgggttggt

SEQ ID NO: 877060 - DNA, 22 bp, Artificial Sequence
  chemically synthesized
caagatatggaaccaacccaag

SEQ ID NO: 877061 - DNA, 22 bp, Artificial Sequence
  chemically synthesized
attggtcgatggacacttgggt

SEQ ID NO: 877062 - DNA, 22 bp, Artificial Sequence
  chemically synthesized
tccattcattggtcgatggaca

SEQ ID NO: 877063 - DNA, 22 bp, Artificial Sequence
  chemically synthesized
atccattcattggtcgatggac

SEQ ID NO: 877064 - DNA, 22 bp, Artificial Sequence
  chemically synthesized
tatccattcattggtcgatgga

SEQ ID NO: 877065 - DNA, 22 bp, Artificial Sequence
  chemically synthesized
tttatccattcattggtcgatg

SEQ ID NO: 877066 - DNA, 22 bp, Artificial Sequence
  chemically synthesized
ctttatccattcattggtcgat

SEQ ID NO: 877067 - DNA, 22 bp, Artificial Sequence
  chemically synthesized
tctttatccattcattggtcga

SEQ ID NO: 877068 - DNA, 22 bp, Artificial Sequence
  chemically synthesized
catggtatatagataccacatt

SEQ ID NO: 877069 - DNA, 22 bp, Artificial Sequence
  chemically synthesized
agtaatattccatggtatatag

SEQ ID NO: 877070 - DNA, 22 bp, Artificial Sequence
  chemically synthesized
tggctgagtaatattccatggt

SEQ ID NO: 877071 - DNA, 22 bp, Artificial Sequence
  chemically synthesized
atggctgagtaatattccatgg

SEQ ID NO: 877072 - DNA, 22 bp, Artificial Sequence
  chemically synthesized
tatggctgagtaatattccatg

SEQ ID NO: 877073 - DNA, 22 bp, Artificial Sequence
  chemically synthesized
ttatggctgagtaatattccat

SEQ ID NO: 877074 - DNA, 22 bp, Artificial Sequence
  chemically synthesized
tttatggctgagtaatattcca

SEQ ID NO: 877075 - DNA, 22 bp, Artificial Sequence
  chemically synthesized
ttttatggctgagtaatattcc

SEQ ID NO: 877076 - DNA, 22 bp, Artificial Sequence
  chemically synthesized
ttttttatggctgagtaatatt

SEQ ID NO: 877077 - DNA, 22 bp, Artificial Sequence
  chemically synthesized
tataccatggaatattactcag

SEQ ID NO: 877078 - DNA, 22 bp, Artificial Sequence
  chemically synthesized
caaaagagattcttttttatgg

SEQ ID NO: 877079 - DNA, 22 bp, Artificial Sequence
  chemically synthesized
ctgcaaaagagattctttttta

SEQ ID NO: 877080 - DNA, 22 bp, Artificial Sequence
  chemically synthesized
ctcagccataaaaaagaatctc

SEQ ID NO: 877081 - DNA, 22 bp, Artificial Sequence
  chemically synthesized
aagttgctgcaaaagagattct

SEQ ID NO: 877082 - DNA, 22 bp, Artificial Sequence
  chemically synthesized
agccataaaaaagaatctcttt

SEQ ID NO: 877083 - DNA, 22 bp, Artificial Sequence
  chemically synthesized
cattcaagttgctgcaaaagag

SEQ ID NO: 877084 - DNA, 22 bp, Artificial Sequence
  chemically synthesized
ccagctccattcaagttgctgc

SEQ ID NO: 877085 - DNA, 22 bp, Artificial Sequence
  chemically synthesized
ttttgcagcaacttgaatggag

SEQ ID NO: 877086 - DNA, 22 bp, Artificial Sequence
  chemically synthesized
ttgcagcaacttgaatggagct

SEQ ID NO: 877087 - DNA, 22 bp, Artificial Sequence
  chemically synthesized
tgcagcaacttgaatggagctg

SEQ ID NO: 877088 - DNA, 22 bp, Artificial Sequence
  chemically synthesized
gcagcaacttgaatggagctgg

SEQ ID NO: 877089 - DNA, 22 bp, Artificial Sequence
  chemically synthesized
gaatagtggctgccagctccat

SEQ ID NO: 877090 - DNA, 22 bp, Artificial Sequence
  chemically synthesized
cagcaacttgaatggagctggc

SEQ ID NO: 877091 - DNA, 22 bp, Artificial Sequence
  chemically synthesized
ggaatagtggctgccagctcca

SEQ ID NO: 877092 - DNA, 22 bp, Artificial Sequence
  chemically synthesized
cttggaatagtggctgccagct

SEQ ID NO: 877093 - DNA, 22 bp, Artificial Sequence
  chemically synthesized
acttggaatagtggctgccagc

SEQ ID NO: 877094 - DNA, 22 bp, Artificial Sequence
  chemically synthesized
tacttggaatagtggctgccag

SEQ ID NO: 877095 - DNA, 22 bp, Artificial Sequence
  chemically synthesized
ctttacttggaatagtggctgc

SEQ ID NO: 877096 - DNA, 22 bp, Artificial Sequence
  chemically synthesized
gaatggagctggcagccactat

SEQ ID NO: 877097 - DNA, 22 bp, Artificial Sequence
  chemically synthesized
aatggagctggcagccactatt

SEQ ID NO: 877098 - DNA, 22 bp, Artificial Sequence
  chemically synthesized
agttactttacttggaatagtg

SEQ ID NO: 877099 - DNA, 22 bp, Artificial Sequence
  chemically synthesized
ctgagttactttacttggaata

SEQ ID NO: 877100 - DNA, 22 bp, Artificial Sequence
  chemically synthesized
gcagccactattccaagtaaag

SEQ ID NO: 877101 - DNA, 22 bp, Artificial Sequence
  chemically synthesized
cgttcctgagttactttacttg

SEQ ID NO: 877102 - DNA, 22 bp, Artificial Sequence
  chemically synthesized
ccgttcctgagttactttactt

SEQ ID NO: 877103 - DNA, 22 bp, Artificial Sequence
  chemically synthesized
tccgttcctgagttactttact

SEQ ID NO: 877104 - DNA, 22 bp, Artificial Sequence
  chemically synthesized
gttttccgttcctgagttactt

SEQ ID NO: 877105 - DNA, 22 bp, Artificial Sequence
  chemically synthesized
agttttccgttcctgagttact

SEQ ID NO: 877106 - DNA, 22 bp, Artificial Sequence
  chemically synthesized
ttccaagtaaagtaactcagga

SEQ ID NO: 877107 - DNA, 22 bp, Artificial Sequence
  chemically synthesized
caagtaaagtaactcaggaacg

SEQ ID NO: 877108 - DNA, 22 bp, Artificial Sequence
  chemically synthesized
aggaacggaaaactaaatacca

SEQ ID NO: 877109 - DNA, 22 bp, Artificial Sequence
  chemically synthesized
cgagtgagaacatatggtattt

SEQ ID NO: 877110 - DNA, 22 bp, Artificial Sequence
  chemically synthesized
acgagtgagaacatatggtatt

SEQ ID NO: 877111 - DNA, 22 bp, Artificial Sequence
  chemically synthesized
ccacttacgagtgagaacatat

SEQ ID NO: 877112 - DNA, 22 bp, Artificial Sequence
  chemically synthesized
gctcccacttacgagtgagaac

SEQ ID NO: 877113 - DNA, 22 bp, Artificial Sequence
  chemically synthesized
agctcccacttacgagtgagaa

SEQ ID NO: 877114 - DNA, 22 bp, Artificial Sequence
  chemically synthesized
aataccatatgttctcactcgt

SEQ ID NO: 877115 - DNA, 22 bp, Artificial Sequence
  chemically synthesized
atagcttagctcccacttacga

SEQ ID NO: 877116 - DNA, 22 bp, Artificial Sequence
  chemically synthesized
tatcctcatagcttagctccca

SEQ ID NO: 877117 - DNA, 22 bp, Artificial Sequence
  chemically synthesized
tcactcgtaagtgggagctaag

SEQ ID NO: 877118 - DNA, 22 bp, Artificial Sequence
  chemically synthesized
gtatcctcatagcttagctccc

SEQ ID NO: 877119 - DNA, 22 bp, Artificial Sequence
  chemically synthesized
tgtatcctcatagcttagctcc

SEQ ID NO: 877120 - DNA, 22 bp, Artificial Sequence
  chemically synthesized
actcgtaagtgggagctaagct

SEQ ID NO: 877121 - DNA, 22 bp, Artificial Sequence
  chemically synthesized
gtaagtgggagctaagctatga

SEQ ID NO: 877122 - DNA, 22 bp, Artificial Sequence
  chemically synthesized
cgtatgtctttgtatcctcata

SEQ ID NO: 877123 - DNA, 22 bp, Artificial Sequence
  chemically synthesized
tatcactccgtatgtctttgta

SEQ ID NO: 877124 - DNA, 22 bp, Artificial Sequence
  chemically synthesized
agctatgaggatacaaagacat

SEQ ID NO: 877125 - DNA, 22 bp, Artificial Sequence
  chemically synthesized
tgaggatacaaagacatacgga

SEQ ID NO: 877126 - DNA, 22 bp, Artificial Sequence
  chemically synthesized
gagtccccaaagtccattgtat

SEQ ID NO: 877127 - DNA, 22 bp, Artificial Sequence
  chemically synthesized
agagtccccaaagtccattgta

SEQ ID NO: 877128 - DNA, 22 bp, Artificial Sequence
  chemically synthesized
cccacttagagtccccaaagtc

SEQ ID NO: 877129 - DNA, 22 bp, Artificial Sequence
  chemically synthesized
ccaagctccccacttagagtcc

SEQ ID NO: 877130 - DNA, 22 bp, Artificial Sequence
  chemically synthesized
actcccaagctccccacttaga

SEQ ID NO: 877131 - DNA, 22 bp, Artificial Sequence
  chemically synthesized
cctcactcccaagctccccact

SEQ ID NO: 877132 - DNA, 22 bp, Artificial Sequence
  chemically synthesized
tggggactctaagtggggagct

SEQ ID NO: 877133 - DNA, 22 bp, Artificial Sequence
  chemically synthesized
acctcactcccaagctccccac

SEQ ID NO: 877134 - DNA, 22 bp, Artificial Sequence
  chemically synthesized
ggggactctaagtggggagctt

SEQ ID NO: 877135 - DNA, 22 bp, Artificial Sequence
  chemically synthesized
gggactctaagtggggagcttg

SEQ ID NO: 877136 - DNA, 22 bp, Artificial Sequence
  chemically synthesized
tcccttacctcactcccaagct

SEQ ID NO: 877137 - DNA, 22 bp, Artificial Sequence
  chemically synthesized
atcccttacctcactcccaagc

SEQ ID NO: 877138 - DNA, 22 bp, Artificial Sequence
  chemically synthesized
tatcccttacctcactcccaag

SEQ ID NO: 877139 - DNA, 22 bp, Artificial Sequence
  chemically synthesized
taagtggggagcttgggagtga

SEQ ID NO: 877140 - DNA, 22 bp, Artificial Sequence
  chemically synthesized
ttatcccttacctcactcccaa

SEQ ID NO: 877141 - DNA, 22 bp, Artificial Sequence
  chemically synthesized
agtggggagcttgggagtgagg

SEQ ID NO: 877142 - DNA, 22 bp, Artificial Sequence
  chemically synthesized
gggagtgaggtaagggataaaa

SEQ ID NO: 877143 - DNA, 22 bp, Artificial Sequence
  chemically synthesized
ggagtgaggtaagggataaaag

SEQ ID NO: 877144 - DNA, 22 bp, Artificial Sequence
  chemically synthesized
tacccaataaatagtcttttat

SEQ ID NO: 877145 - DNA, 22 bp, Artificial Sequence
  chemically synthesized
tatactgtacccaataaatagt

SEQ ID NO: 877146 - DNA, 22 bp, Artificial Sequence
  chemically synthesized
agtactatatactgtacccaat

SEQ ID NO: 877147 - DNA, 22 bp, Artificial Sequence
  chemically synthesized
ctgagtactatatactgtaccc

SEQ ID NO: 877148 - DNA, 22 bp, Artificial Sequence
  chemically synthesized
cctgagtactatatactgtacc

SEQ ID NO: 877149 - DNA, 22 bp, Artificial Sequence
  chemically synthesized
tttattgggtacagtatatagt

SEQ ID NO: 877150 - DNA, 22 bp, Artificial Sequence
  chemically synthesized
attgggtacagtatatagtact

SEQ ID NO: 877151 - DNA, 22 bp, Artificial Sequence
  chemically synthesized
ttgggtacagtatatagtactc

SEQ ID NO: 877152 - DNA, 22 bp, Artificial Sequence
  chemically synthesized
tgtatccatttcctgagtacta

SEQ ID NO: 877153 - DNA, 22 bp, Artificial Sequence
  chemically synthesized
ggtacagtatatagtactcagg

SEQ ID NO: 877154 - DNA, 22 bp, Artificial Sequence
  chemically synthesized
atgtatccatttcctgagtact

SEQ ID NO: 877155 - DNA, 22 bp, Artificial Sequence
  chemically synthesized
tatgtatccatttcctgagtac

SEQ ID NO: 877156 - DNA, 22 bp, Artificial Sequence
  chemically synthesized
ttatgtatccatttcctgagta

SEQ ID NO: 877157 - DNA, 22 bp, Artificial Sequence
  chemically synthesized
tttatgtatccatttcctgagt

SEQ ID NO: 877158 - DNA, 22 bp, Artificial Sequence
  chemically synthesized
aaattttttatgtatccatttc

SEQ ID NO: 877159 - DNA, 22 bp, Artificial Sequence
  chemically synthesized
tgaaattttttatgtatccatt

SEQ ID NO: 877160 - DNA, 22 bp, Artificial Sequence
  chemically synthesized
aggaaatggatacataaaaaat

SEQ ID NO: 877161 - DNA, 22 bp, Artificial Sequence
  chemically synthesized
tagtggcgaattctgaaatttt

SEQ ID NO: 877162 - DNA, 22 bp, Artificial Sequence
  chemically synthesized
tatagtggcgaattctgaaatt

SEQ ID NO: 877163 - DNA, 22 bp, Artificial Sequence
  chemically synthesized
catggatgagttctatagtggc

SEQ ID NO: 877164 - DNA, 22 bp, Artificial Sequence
  chemically synthesized
cagaattcgccactatagaact

SEQ ID NO: 877165 - DNA, 22 bp, Artificial Sequence
  chemically synthesized
gttacatggatgagttctatag

SEQ ID NO: 877166 - DNA, 22 bp, Artificial Sequence
  chemically synthesized
agaattcgccactatagaactc

SEQ ID NO: 877167 - DNA, 22 bp, Artificial Sequence
  chemically synthesized
ggttacatggatgagttctata

SEQ ID NO: 877168 - DNA, 22 bp, Artificial Sequence
  chemically synthesized
tggttacatggatgagttctat

SEQ ID NO: 877169 - DNA, 22 bp, Artificial Sequence
  chemically synthesized
ttggttacatggatgagttcta

SEQ ID NO: 877170 - DNA, 22 bp, Artificial Sequence
  chemically synthesized
gccactatagaactcatccatg

SEQ ID NO: 877171 - DNA, 22 bp, Artificial Sequence
  chemically synthesized
tagaactcatccatgtaaccaa

SEQ ID NO: 877172 - DNA, 22 bp, Artificial Sequence
  chemically synthesized
ggggtataggtggtttttggtt

SEQ ID NO: 877173 - DNA, 22 bp, Artificial Sequence
  chemically synthesized
gggggtataggtggtttttggt

SEQ ID NO: 877174 - DNA, 22 bp, Artificial Sequence
  chemically synthesized
tgggggtataggtggtttttgg

SEQ ID NO: 877175 - DNA, 22 bp, Artificial Sequence
  chemically synthesized
atccatgtaaccaaaaaccacc

SEQ ID NO: 877176 - DNA, 22 bp, Artificial Sequence
  chemically synthesized
agtagttttgggggtataggtg

SEQ ID NO: 877177 - DNA, 22 bp, Artificial Sequence
  chemically synthesized
cagtagttttgggggtataggt

SEQ ID NO: 877178 - DNA, 22 bp, Artificial Sequence
  chemically synthesized
taatttcagtagttttgggggt

SEQ ID NO: 877179 - DNA, 22 bp, Artificial Sequence
  chemically synthesized
ataatttcagtagttttggggg

SEQ ID NO: 877180 - DNA, 22 bp, Artificial Sequence
  chemically synthesized
tataatttcagtagttttgggg

SEQ ID NO: 877181 - DNA, 22 bp, Artificial Sequence
  chemically synthesized
ttataatttcagtagttttggg

SEQ ID NO: 877182 - DNA, 22 bp, Artificial Sequence
  chemically synthesized
tttataatttcagtagttttgg

SEQ ID NO: 877183 - DNA, 22 bp, Artificial Sequence
  chemically synthesized
ttttttataatttcagtagttt

SEQ ID NO: 877184 - DNA, 22 bp, Artificial Sequence
  chemically synthesized
attttttataatttcagtagtt

SEQ ID NO: 877185 - DNA, 22 bp, Artificial Sequence
  chemically synthesized
tacccccaaaactactgaaatt

SEQ ID NO: 877186 - DNA, 22 bp, Artificial Sequence
  chemically synthesized
cttattttttataatttcagta

SEQ ID NO: 877187 - DNA, 22 bp, Artificial Sequence
  chemically synthesized
gcttattttttataatttcagt

SEQ ID NO: 877188 - DNA, 22 bp, Artificial Sequence
  chemically synthesized
tgcttattttttataatttcag

SEQ ID NO: 877189 - DNA, 22 bp, Artificial Sequence
  chemically synthesized
tattttgcttattttttataat

SEQ ID NO: 877190 - DNA, 22 bp, Artificial Sequence
  chemically synthesized
ctgaaattataaaaaataagca

SEQ ID NO: 877191 - DNA, 22 bp, Artificial Sequence
  chemically synthesized
aaattataaaaaataagcaaaa

SEQ ID NO: 877192 - DNA, 22 bp, Artificial Sequence
  chemically synthesized
tgcggtacaagttatattttgc

SEQ ID NO: 877193 - DNA, 22 bp, Artificial Sequence
  chemically synthesized
gtgcggtacaagttatattttg

SEQ ID NO: 877194 - DNA, 22 bp, Artificial Sequence
  chemically synthesized
taaaaaataagcaaaatataac

SEQ ID NO: 877195 - DNA, 22 bp, Artificial Sequence
  chemically synthesized
tttgtgcggtacaagttatatt

SEQ ID NO: 877196 - DNA, 22 bp, Artificial Sequence
  chemically synthesized
atttgtgcggtacaagttatat

SEQ ID NO: 877197 - DNA, 22 bp, Artificial Sequence
  chemically synthesized
tacatatttatttgtgcggtac

SEQ ID NO: 877198 - DNA, 22 bp, Artificial Sequence
  chemically synthesized
gtaccgcacaaataaatatgta

SEQ ID NO: 877199 - DNA, 22 bp, Artificial Sequence
  chemically synthesized
taccgcacaaataaatatgtac

SEQ ID NO: 877200 - DNA, 22 bp, Artificial Sequence
  chemically synthesized
tatgtgtataattgtacatatt

SEQ ID NO: 877201 - DNA, 22 bp, Artificial Sequence
  chemically synthesized
atatgtgtataattgtacatat

SEQ ID NO: 877202 - DNA, 22 bp, Artificial Sequence
  chemically synthesized
tatatgtgtataattgtacata

SEQ ID NO: 877203 - DNA, 22 bp, Artificial Sequence
  chemically synthesized
attttatatgtgtataattgta

SEQ ID NO: 877204 - DNA, 22 bp, Artificial Sequence
  chemically synthesized
aattttatatgtgtataattgt

SEQ ID NO: 877205 - DNA, 22 bp, Artificial Sequence
  chemically synthesized
taattttatatgtgtataattg

SEQ ID NO: 877206 - DNA, 22 bp, Artificial Sequence
  chemically synthesized
ttaattttatatgtgtataatt

SEQ ID NO: 877207 - DNA, 22 bp, Artificial Sequence
  chemically synthesized
tttttaattttatatgtgtata

SEQ ID NO: 877208 - DNA, 22 bp, Artificial Sequence
  chemically synthesized
atttttaattttatatgtgtat

SEQ ID NO: 877209 - DNA, 22 bp, Artificial Sequence
  chemically synthesized
tatttttaattttatatgtgta

SEQ ID NO: 877210 - DNA, 22 bp, Artificial Sequence
  chemically synthesized
ttatttttaattttatatgtgt

SEQ ID NO: 877211 - DNA, 22 bp, Artificial Sequence
  chemically synthesized
tttatttttaattttatatgtg

SEQ ID NO: 877212 - DNA, 22 bp, Artificial Sequence
  chemically synthesized
ttttatttttaattttatatgt

SEQ ID NO: 877213 - DNA, 22 bp, Artificial Sequence
  chemically synthesized
tttttatttttaattttatatg

SEQ ID NO: 877214 - DNA, 22 bp, Artificial Sequence
  chemically synthesized
ttttttatttttaattttatat

SEQ ID NO: 877215 - DNA, 22 bp, Artificial Sequence
  chemically synthesized
tacacatataaaattaaaaata

SEQ ID NO: 877216 - DNA, 22 bp, Artificial Sequence
  chemically synthesized
aaaaatttttttttatttttaa

SEQ ID NO: 877217 - DNA, 22 bp, Artificial Sequence
  chemically synthesized
attaaaaaatttttttttattt

SEQ ID NO: 877218 - DNA, 22 bp, Artificial Sequence
  chemically synthesized
aattaaaaaatttttttttatt

SEQ ID NO: 877219 - DNA, 22 bp, Artificial Sequence
  chemically synthesized
ggaaacttaattaaaaaatttt

SEQ ID NO: 877220 - DNA, 22 bp, Artificial Sequence
  chemically synthesized
aggaaacttaattaaaaaattt

SEQ ID NO: 877221 - DNA, 22 bp, Artificial Sequence
  chemically synthesized
aaaataaaaaaaaattttttaa

SEQ ID NO: 877222 - DNA, 22 bp, Artificial Sequence
  chemically synthesized
ccttaggaaacttaattaaaaa

SEQ ID NO: 877223 - DNA, 22 bp, Artificial Sequence
  chemically synthesized
tagctaccttaggaaacttaat

SEQ ID NO: 877224 - DNA, 22 bp, Artificial Sequence
  chemically synthesized
tttaattaagtttcctaaggta

SEQ ID NO: 877225 - DNA, 22 bp, Artificial Sequence
  chemically synthesized
ttaattaagtttcctaaggtag

SEQ ID NO: 877226 - DNA, 22 bp, Artificial Sequence
  chemically synthesized
taattaagtttcctaaggtagc

SEQ ID NO: 877227 - DNA, 22 bp, Artificial Sequence
  chemically synthesized
aattaagtttcctaaggtagct

SEQ ID NO: 877228 - DNA, 22 bp, Artificial Sequence
  chemically synthesized
attaagtttcctaaggtagcta

SEQ ID NO: 877229 - DNA, 22 bp, Artificial Sequence
  chemically synthesized
agtttcctaaggtagctacaat

SEQ ID NO: 877230 - DNA, 22 bp, Artificial Sequence
  chemically synthesized
cctaaggtagctacaattgtgg

SEQ ID NO: 877231 - DNA, 22 bp, Artificial Sequence
  chemically synthesized
ctaaggtagctacaattgtggc

SEQ ID NO: 877232 - DNA, 22 bp, Artificial Sequence
  chemically synthesized
aggtagctacaattgtggctgc

SEQ ID NO: 877233 - DNA, 22 bp, Artificial Sequence
  chemically synthesized
caattgtggctgctttcttgcc

SEQ ID NO: 877234 - DNA, 22 bp, Artificial Sequence
  chemically synthesized
tggctgctttcttgcctcatat

SEQ ID NO: 877235 - DNA, 22 bp, Artificial Sequence
  chemically synthesized
aatatccaaaaaatatgaggca

SEQ ID NO: 877236 - DNA, 22 bp, Artificial Sequence
  chemically synthesized
aaatatccaaaaaatatgaggc

SEQ ID NO: 877237 - DNA, 22 bp, Artificial Sequence
  chemically synthesized
taaatatccaaaaaatatgagg

SEQ ID NO: 877238 - DNA, 22 bp, Artificial Sequence
  chemically synthesized
ttaaatatccaaaaaatatgag

SEQ ID NO: 877239 - DNA, 22 bp, Artificial Sequence
  chemically synthesized
tttaaatatccaaaaaatatga

SEQ ID NO: 877240 - DNA, 22 bp, Artificial Sequence
  chemically synthesized
ctttcttgcctcatattttttg

SEQ ID NO: 877241 - DNA, 22 bp, Artificial Sequence
  chemically synthesized
tcttgcctcatattttttggat

SEQ ID NO: 877242 - DNA, 22 bp, Artificial Sequence
  chemically synthesized
cttgcctcatattttttggata

SEQ ID NO: 877243 - DNA, 22 bp, Artificial Sequence
  chemically synthesized
atattttttaaatatccaaaaa

SEQ ID NO: 877244 - DNA, 22 bp, Artificial Sequence
  chemically synthesized
ttgcctcatattttttggatat

SEQ ID NO: 877245 - DNA, 22 bp, Artificial Sequence
  chemically synthesized
aatattttttaaatatccaaaa

SEQ ID NO: 877246 - DNA, 22 bp, Artificial Sequence
  chemically synthesized
gcctcatattttttggatattt

SEQ ID NO: 877247 - DNA, 22 bp, Artificial Sequence
  chemically synthesized
cctcatattttttggatattta

SEQ ID NO: 877248 - DNA, 22 bp, Artificial Sequence
  chemically synthesized
atattttttggatatttaaaaa

SEQ ID NO: 877249 - DNA, 22 bp, Artificial Sequence
  chemically synthesized
tttggatatttaaaaaatatta

SEQ ID NO: 877250 - DNA, 22 bp, Artificial Sequence
  chemically synthesized
ttggatatttaaaaaatattaa

SEQ ID NO: 877251 - DNA, 22 bp, Artificial Sequence
  chemically synthesized
tggatatttaaaaaatattaaa

SEQ ID NO: 877252 - DNA, 22 bp, Artificial Sequence
  chemically synthesized
ggatatttaaaaaatattaaat

SEQ ID NO: 877253 - DNA, 22 bp, Artificial Sequence
  chemically synthesized
gatatttaaaaaatattaaatg

SEQ ID NO: 877254 - DNA, 22 bp, Artificial Sequence
  chemically synthesized
aaaaaatattaaatgattttta

SEQ ID NO: 877255 - DNA, 22 bp, Artificial Sequence
  chemically synthesized
aaaaatattaaatgatttttat

SEQ ID NO: 877256 - DNA, 22 bp, Artificial Sequence
  chemically synthesized
atgatagaaaacataaaaatca

SEQ ID NO: 877257 - DNA, 22 bp, Artificial Sequence
  chemically synthesized
aatgatagaaaacataaaaatc

SEQ ID NO: 877258 - DNA, 22 bp, Artificial Sequence
  chemically synthesized
tcttaatgatagaaaacataaa

SEQ ID NO: 877259 - DNA, 22 bp, Artificial Sequence
  chemically synthesized
gtcttaatgatagaaaacataa

SEQ ID NO: 877260 - DNA, 22 bp, Artificial Sequence
  chemically synthesized
cttgtcttaatgatagaaaaca

SEQ ID NO: 877261 - DNA, 22 bp, Artificial Sequence
  chemically synthesized
aatgatttttatgttttctatc

SEQ ID NO: 877262 - DNA, 22 bp, Artificial Sequence
  chemically synthesized
ccttgtcttaatgatagaaaac

SEQ ID NO: 877263 - DNA, 22 bp, Artificial Sequence
  chemically synthesized
tccttgtcttaatgatagaaaa

SEQ ID NO: 877264 - DNA, 22 bp, Artificial Sequence
  chemically synthesized
ttccttgtcttaatgatagaaa

SEQ ID NO: 877265 - DNA, 22 bp, Artificial Sequence
  chemically synthesized
tttccttgtcttaatgatagaa

SEQ ID NO: 877266 - DNA, 22 bp, Artificial Sequence
  chemically synthesized
ttttccttgtcttaatgataga

SEQ ID NO: 877267 - DNA, 22 bp, Artificial Sequence
  chemically synthesized
ttatgttttctatcattaagac

SEQ ID NO: 877268 - DNA, 22 bp, Artificial Sequence
  chemically synthesized
tatgttttctatcattaagaca

SEQ ID NO: 877269 - DNA, 22 bp, Artificial Sequence
  chemically synthesized
atgttttctatcattaagacaa

SEQ ID NO: 877270 - DNA, 22 bp, Artificial Sequence
  chemically synthesized
tgttttctatcattaagacaag

SEQ ID NO: 877271 - DNA, 22 bp, Artificial Sequence
  chemically synthesized
gaaggcttttttccttgtctta

SEQ ID NO: 877272 - DNA, 22 bp, Artificial Sequence
  chemically synthesized
tagaaggcttttttccttgtct

SEQ ID NO: 877273 - DNA, 22 bp, Artificial Sequence
  chemically synthesized
ctagaaggcttttttccttgtc

SEQ ID NO: 877274 - DNA, 22 bp, Artificial Sequence
  chemically synthesized
tctatcattaagacaaggaaaa

SEQ ID NO: 877275 - DNA, 22 bp, Artificial Sequence
  chemically synthesized
ctatcattaagacaaggaaaaa

SEQ ID NO: 877276 - DNA, 22 bp, Artificial Sequence
  chemically synthesized
tatcattaagacaaggaaaaaa

SEQ ID NO: 877277 - DNA, 22 bp, Artificial Sequence
  chemically synthesized
tttctagaaggcttttttcctt

SEQ ID NO: 877278 - DNA, 22 bp, Artificial Sequence
  chemically synthesized
tcattaagacaaggaaaaaagc

SEQ ID NO: 877279 - DNA, 22 bp, Artificial Sequence
  chemically synthesized
agacaaggaaaaaagccttcta

SEQ ID NO: 877280 - DNA, 22 bp, Artificial Sequence
  chemically synthesized
catcaaataatatctatttcta

SEQ ID NO: 877281 - DNA, 22 bp, Artificial Sequence
  chemically synthesized
tacatcaaataatatctatttc

SEQ ID NO: 877282 - DNA, 22 bp, Artificial Sequence
  chemically synthesized
ttctacatcaaataatatctat

SEQ ID NO: 877283 - DNA, 22 bp, Artificial Sequence
  chemically synthesized
attctacatcaaataatatcta

SEQ ID NO: 877284 - DNA, 22 bp, Artificial Sequence
  chemically synthesized
cttattctacatcaaataatat

SEQ ID NO: 877285 - DNA, 22 bp, Artificial Sequence
  chemically synthesized
acttattctacatcaaataata

SEQ ID NO: 877286 - DNA, 22 bp, Artificial Sequence
  chemically synthesized
ctagaaatagatattatttgat

SEQ ID NO: 877287 - DNA, 22 bp, Artificial Sequence
  chemically synthesized
tagaaatagatattatttgatg

SEQ ID NO: 877288 - DNA, 22 bp, Artificial Sequence
  chemically synthesized
cttacttattctacatcaaata

SEQ ID NO: 877289 - DNA, 22 bp, Artificial Sequence
  chemically synthesized
gaaatagatattatttgatgta

SEQ ID NO: 877290 - DNA, 22 bp, Artificial Sequence
  chemically synthesized
ccttacttattctacatcaaat

SEQ ID NO: 877291 - DNA, 22 bp, Artificial Sequence
  chemically synthesized
tccttacttattctacatcaaa

SEQ ID NO: 877292 - DNA, 22 bp, Artificial Sequence
  chemically synthesized
ttccttacttattctacatcaa

SEQ ID NO: 877293 - DNA, 22 bp, Artificial Sequence
  chemically synthesized
tttttccttacttattctacat

SEQ ID NO: 877294 - DNA, 22 bp, Artificial Sequence
  chemically synthesized
tttgatgtagaataagtaagga

SEQ ID NO: 877295 - DNA, 22 bp, Artificial Sequence
  chemically synthesized
gatgtagaataagtaaggaaaa

SEQ ID NO: 877296 - DNA, 22 bp, Artificial Sequence
  chemically synthesized
atgtagaataagtaaggaaaaa

SEQ ID NO: 877297 - DNA, 22 bp, Artificial Sequence
  chemically synthesized
aacaaatacattatttttcctt

SEQ ID NO: 877298 - DNA, 22 bp, Artificial Sequence
  chemically synthesized
tattaaacaaatacattatttt

SEQ ID NO: 877299 - DNA, 22 bp, Artificial Sequence
  chemically synthesized
tgattgtattaaacaaatacat

SEQ ID NO: 877300 - DNA, 22 bp, Artificial Sequence
  chemically synthesized
atgattgtattaaacaaataca

SEQ ID NO: 877301 - DNA, 22 bp, Artificial Sequence
  chemically synthesized
tatgattgtattaaacaaatac

SEQ ID NO: 877302 - DNA, 22 bp, Artificial Sequence
  chemically synthesized
ttatgattgtattaaacaaata

SEQ ID NO: 877303 - DNA, 22 bp, Artificial Sequence
  chemically synthesized
tttatgattgtattaaacaaat

SEQ ID NO: 877304 - DNA, 22 bp, Artificial Sequence
  chemically synthesized
aacaaatgattttttatgattg

SEQ ID NO: 877305 - DNA, 22 bp, Artificial Sequence
  chemically synthesized
aaacaaatgattttttatgatt

SEQ ID NO: 877306 - DNA, 22 bp, Artificial Sequence
  chemically synthesized
taaacaaatgattttttatgat

SEQ ID NO: 877307 - DNA, 22 bp, Artificial Sequence
  chemically synthesized
ttaaacaaatgattttttatga

SEQ ID NO: 877308 - DNA, 22 bp, Artificial Sequence
  chemically synthesized
gtttaatacaatcataaaaaat

SEQ ID NO: 877309 - DNA, 22 bp, Artificial Sequence
  chemically synthesized
tttaaacaaatgattttttatg

SEQ ID NO: 877310 - DNA, 22 bp, Artificial Sequence
  chemically synthesized
tttaatacaatcataaaaaatc

SEQ ID NO: 877311 - DNA, 22 bp, Artificial Sequence
  chemically synthesized
ttttaaacaaatgattttttat

SEQ ID NO: 877312 - DNA, 22 bp, Artificial Sequence
  chemically synthesized
aatacaatcataaaaaatcatt

SEQ ID NO: 877313 - DNA, 22 bp, Artificial Sequence
  chemically synthesized
cttttttaaacaaatgattttt

SEQ ID NO: 877314 - DNA, 22 bp, Artificial Sequence
  chemically synthesized
atacaatcataaaaaatcattt

SEQ ID NO: 877315 - DNA, 22 bp, Artificial Sequence
  chemically synthesized
acttttttaaacaaatgatttt

SEQ ID NO: 877316 - DNA, 22 bp, Artificial Sequence
  chemically synthesized
gtttacttttttaaacaaatga

SEQ ID NO: 877317 - DNA, 22 bp, Artificial Sequence
  chemically synthesized
tagtttacttttttaaacaaat

SEQ ID NO: 877318 - DNA, 22 bp, Artificial Sequence
  chemically synthesized
tattctagtttacttttttaaa

SEQ ID NO: 877319 - DNA, 22 bp, Artificial Sequence
  chemically synthesized
aaactatattctagtttacttt

SEQ ID NO: 877320 - DNA, 22 bp, Artificial Sequence
  chemically synthesized
aaaactatattctagtttactt

SEQ ID NO: 877321 - DNA, 22 bp, Artificial Sequence
  chemically synthesized
gtttaaaaaagtaaactagaat

SEQ ID NO: 877322 - DNA, 22 bp, Artificial Sequence
  chemically synthesized
tttaaaaaagtaaactagaata

SEQ ID NO: 877323 - DNA, 22 bp, Artificial Sequence
  chemically synthesized
aaaaaagtaaactagaatatag

SEQ ID NO: 877324 - DNA, 22 bp, Artificial Sequence
  chemically synthesized
aaaaagtaaactagaatatagt

SEQ ID NO: 877325 - DNA, 22 bp, Artificial Sequence
  chemically synthesized
aaatagagtttaaaactatatt

SEQ ID NO: 877326 - DNA, 22 bp, Artificial Sequence
  chemically synthesized
aaactcaaatagagtttaaaac

SEQ ID NO: 877327 - DNA, 22 bp, Artificial Sequence
  chemically synthesized
gaatatagttttaaactctatt

SEQ ID NO: 877328 - DNA, 22 bp, Artificial Sequence
  chemically synthesized
aaaatctcaaactcaaatagag

SEQ ID NO: 877329 - DNA, 22 bp, Artificial Sequence
  chemically synthesized
gaaaatctcaaactcaaataga

SEQ ID NO: 877330 - DNA, 22 bp, Artificial Sequence
  chemically synthesized
tgaaaatctcaaactcaaatag

SEQ ID NO: 877331 - DNA, 22 bp, Artificial Sequence
  chemically synthesized
aattttgaaaatctcaaactca

SEQ ID NO: 877332 - DNA, 22 bp, Artificial Sequence
  chemically synthesized
taaactctatttgagtttgaga

SEQ ID NO: 877333 - DNA, 22 bp, Artificial Sequence
  chemically synthesized
aaattttgaaaatctcaaactc

SEQ ID NO: 877334 - DNA, 22 bp, Artificial Sequence
  chemically synthesized
aaactctatttgagtttgagat

SEQ ID NO: 877335 - DNA, 22 bp, Artificial Sequence
  chemically synthesized
taaattttgaaaatctcaaact

SEQ ID NO: 877336 - DNA, 22 bp, Artificial Sequence
  chemically synthesized
aactctatttgagtttgagatt

SEQ ID NO: 877337 - DNA, 22 bp, Artificial Sequence
  chemically synthesized
ttaaattttgaaaatctcaaac

SEQ ID NO: 877338 - DNA, 22 bp, Artificial Sequence
  chemically synthesized
tatttgagtttgagattttcaa

SEQ ID NO: 877339 - DNA, 22 bp, Artificial Sequence
  chemically synthesized
tttgagtttgagattttcaaaa

SEQ ID NO: 877340 - DNA, 22 bp, Artificial Sequence
  chemically synthesized
gagtttgagattttcaaaattt

SEQ ID NO: 877341 - DNA, 22 bp, Artificial Sequence
  chemically synthesized
agtttgagattttcaaaattta

SEQ ID NO: 877342 - DNA, 22 bp, Artificial Sequence
  chemically synthesized
acacaagatatatttttaaatt

SEQ ID NO: 877343 - DNA, 22 bp, Artificial Sequence
  chemically synthesized
gagattttcaaaatttaaaaat

SEQ ID NO: 877344 - DNA, 22 bp, Artificial Sequence
  chemically synthesized
agattttcaaaatttaaaaata

SEQ ID NO: 877345 - DNA, 22 bp, Artificial Sequence
  chemically synthesized
tcaaaatttaaaaatatatctt

SEQ ID NO: 877346 - DNA, 22 bp, Artificial Sequence
  chemically synthesized
caaaatttaaaaatatatcttg

SEQ ID NO: 877347 - DNA, 22 bp, Artificial Sequence
  chemically synthesized
aaaatttaaaaatatatcttgt

SEQ ID NO: 877348 - DNA, 22 bp, Artificial Sequence
  chemically synthesized
catgccaaccattgacacaaga

SEQ ID NO: 877349 - DNA, 22 bp, Artificial Sequence
  chemically synthesized
aaaaatatatcttgtgtcaatg

SEQ ID NO: 877350 - DNA, 22 bp, Artificial Sequence
  chemically synthesized
aaaatatatcttgtgtcaatgg

SEQ ID NO: 877351 - DNA, 22 bp, Artificial Sequence
  chemically synthesized
attgcatgccaaccattgacac

SEQ ID NO: 877352 - DNA, 22 bp, Artificial Sequence
  chemically synthesized
agtagatattaattgcatgcca

SEQ ID NO: 877353 - DNA, 22 bp, Artificial Sequence
  chemically synthesized
gtgtcaatggttggcatgcaat

SEQ ID NO: 877354 - DNA, 22 bp, Artificial Sequence
  chemically synthesized
tgtcaatggttggcatgcaatt

SEQ ID NO: 877355 - DNA, 22 bp, Artificial Sequence
  chemically synthesized
ttcagtagatattaattgcatg

SEQ ID NO: 877356 - DNA, 22 bp, Artificial Sequence
  chemically synthesized
attcagtagatattaattgcat

SEQ ID NO: 877357 - DNA, 22 bp, Artificial Sequence
  chemically synthesized
tttattcagtagatattaattg

SEQ ID NO: 877358 - DNA, 22 bp, Artificial Sequence
  chemically synthesized
atttattcagtagatattaatt

SEQ ID NO: 877359 - DNA, 22 bp, Artificial Sequence
  chemically synthesized
tatttattcagtagatattaat

SEQ ID NO: 877360 - DNA, 22 bp, Artificial Sequence
  chemically synthesized
gcatgcaattaatatctactga

SEQ ID NO: 877361 - DNA, 22 bp, Artificial Sequence
  chemically synthesized
atatctactgaataaataaagg

SEQ ID NO: 877362 - DNA, 22 bp, Artificial Sequence
  chemically synthesized
ctgaataaataaaggactctac

SEQ ID NO: 877363 - DNA, 22 bp, Artificial Sequence
  chemically synthesized
aataaataaaggactctaccta

SEQ ID NO: 877364 - DNA, 22 bp, Artificial Sequence
  chemically synthesized
tatatatacagccgtaggtaga

SEQ ID NO: 877365 - DNA, 22 bp, Artificial Sequence
  chemically synthesized
gaatgtatgcctgtatatatac

SEQ ID NO: 877366 - DNA, 22 bp, Artificial Sequence
  chemically synthesized
tacctacggctgtatatataca

SEQ ID NO: 877367 - DNA, 22 bp, Artificial Sequence
  chemically synthesized
cctacggctgtatatatacagg

SEQ ID NO: 877368 - DNA, 22 bp, Artificial Sequence
  chemically synthesized
cggctgtatatatacaggcata

SEQ ID NO: 877369 - DNA, 22 bp, Artificial Sequence
  chemically synthesized
caatattcgaatgtatgcctgt

SEQ ID NO: 877370 - DNA, 22 bp, Artificial Sequence
  chemically synthesized
tatatatacaggcatacattcg

SEQ ID NO: 877371 - DNA, 22 bp, Artificial Sequence
  chemically synthesized
agttacaatattcgaatgtatg

SEQ ID NO: 877372 - DNA, 22 bp, Artificial Sequence
  chemically synthesized
cagttacaatattcgaatgtat

SEQ ID NO: 877373 - DNA, 22 bp, Artificial Sequence
  chemically synthesized
gaatattgtaactgaaacatct

SEQ ID NO: 877374 - DNA, 22 bp, Artificial Sequence
  chemically synthesized
taactgaaacatctatgtctct

SEQ ID NO: 877375 - DNA, 22 bp, Artificial Sequence
  chemically synthesized
aagagagagacaaagagacata

SEQ ID NO: 877376 - DNA, 22 bp, Artificial Sequence
  chemically synthesized
aaagagagagacaaagagacat

SEQ ID NO: 877377 - DNA, 22 bp, Artificial Sequence
  chemically synthesized
aaacatctatgtctctttgtct

SEQ ID NO: 877378 - DNA, 22 bp, Artificial Sequence
  chemically synthesized
cacttaaagagagagacaaaga

SEQ ID NO: 877379 - DNA, 22 bp, Artificial Sequence
  chemically synthesized
gttacacttaaagagagagaca

SEQ ID NO: 877380 - DNA, 22 bp, Artificial Sequence
  chemically synthesized
tgtctctttgtctctctcttta

SEQ ID NO: 877381 - DNA, 22 bp, Artificial Sequence
  chemically synthesized
tattagttacacttaaagagag

SEQ ID NO: 877382 - DNA, 22 bp, Artificial Sequence
  chemically synthesized
tttgtctctctctttaagtgta

SEQ ID NO: 877383 - DNA, 22 bp, Artificial Sequence
  chemically synthesized
agttgtattagttacacttaaa

SEQ ID NO: 877384 - DNA, 22 bp, Artificial Sequence
  chemically synthesized
tgtctctctctttaagtgtaac

SEQ ID NO: 877385 - DNA, 22 bp, Artificial Sequence
  chemically synthesized
gtctctctctttaagtgtaact

SEQ ID NO: 877386 - DNA, 22 bp, Artificial Sequence
  chemically synthesized
tctctctctttaagtgtaacta

SEQ ID NO: 877387 - DNA, 22 bp, Artificial Sequence
  chemically synthesized
tcctcagttgtattagttacac

SEQ ID NO: 877388 - DNA, 22 bp, Artificial Sequence
  chemically synthesized
gtcctcagttgtattagttaca

SEQ ID NO: 877389 - DNA, 22 bp, Artificial Sequence
  chemically synthesized
tctctttaagtgtaactaatac

SEQ ID NO: 877390 - DNA, 22 bp, Artificial Sequence
  chemically synthesized
ttgtcctcagttgtattagtta

SEQ ID NO: 877391 - DNA, 22 bp, Artificial Sequence
  chemically synthesized
tctttaagtgtaactaatacaa

SEQ ID NO: 877392 - DNA, 22 bp, Artificial Sequence
  chemically synthesized
tttaagtgtaactaatacaact

SEQ ID NO: 877393 - DNA, 22 bp, Artificial Sequence
  chemically synthesized
acctcttgtcctcagttgtatt

SEQ ID NO: 877394 - DNA, 22 bp, Artificial Sequence
  chemically synthesized
taagtgtaactaatacaactga

SEQ ID NO: 877395 - DNA, 22 bp, Artificial Sequence
  chemically synthesized
cacctcttgtcctcagttgtat

SEQ ID NO: 877396 - DNA, 22 bp, Artificial Sequence
  chemically synthesized
aagtgtaactaatacaactgag

SEQ ID NO: 877397 - DNA, 22 bp, Artificial Sequence
  chemically synthesized
agtgtaactaatacaactgagg

SEQ ID NO: 877398 - DNA, 22 bp, Artificial Sequence
  chemically synthesized
aatttcacctcttgtcctcagt

SEQ ID NO: 877399 - DNA, 22 bp, Artificial Sequence
  chemically synthesized
gaatttcacctcttgtcctcag

SEQ ID NO: 877400 - DNA, 22 bp, Artificial Sequence
  chemically synthesized
atacaactgaggacaagaggtg

SEQ ID NO: 877401 - DNA, 22 bp, Artificial Sequence
  chemically synthesized
gagatttgaatttcacctcttg

SEQ ID NO: 877402 - DNA, 22 bp, Artificial Sequence
  chemically synthesized
agagatttgaatttcacctctt

SEQ ID NO: 877403 - DNA, 22 bp, Artificial Sequence
  chemically synthesized
tagagatttgaatttcacctct

SEQ ID NO: 877404 - DNA, 22 bp, Artificial Sequence
  chemically synthesized
aggacaagaggtgaaattcaaa

SEQ ID NO: 877405 - DNA, 22 bp, Artificial Sequence
  chemically synthesized
gggaagcattttagagatttga

SEQ ID NO: 877406 - DNA, 22 bp, Artificial Sequence
  chemically synthesized
aaattagggaagcattttagag

SEQ ID NO: 877407 - DNA, 22 bp, Artificial Sequence
  chemically synthesized
atgctgaaattagggaagcatt

SEQ ID NO: 877408 - DNA, 22 bp, Artificial Sequence
  chemically synthesized
aaatctctaaaatgcttcccta

SEQ ID NO: 877409 - DNA, 22 bp, Artificial Sequence
  chemically synthesized
agtagctcatgctgaaattagg

SEQ ID NO: 877410 - DNA, 22 bp, Artificial Sequence
  chemically synthesized
taaaatgcttccctaatttcag

SEQ ID NO: 877411 - DNA, 22 bp, Artificial Sequence
  chemically synthesized
aaatgcttccctaatttcagca

SEQ ID NO: 877412 - DNA, 22 bp, Artificial Sequence
  chemically synthesized
atgtactcagtagctcatgctg

SEQ ID NO: 877413 - DNA, 22 bp, Artificial Sequence
  chemically synthesized
ccctaatttcagcatgagctac

SEQ ID NO: 877414 - DNA, 22 bp, Artificial Sequence
  chemically synthesized
cctaatttcagcatgagctact

SEQ ID NO: 877415 - DNA, 22 bp, Artificial Sequence
  chemically synthesized
atttcagcatgagctactgagt

SEQ ID NO: 877416 - DNA, 22 bp, Artificial Sequence
  chemically synthesized
cagcatgagctactgagtacat

SEQ ID NO: 877417 - DNA, 22 bp, Artificial Sequence
  chemically synthesized
agcatgagctactgagtacatg

SEQ ID NO: 877418 - DNA, 22 bp, Artificial Sequence
  chemically synthesized
agtgaaaagtctcatgtactca

SEQ ID NO: 877419 - DNA, 22 bp, Artificial Sequence
  chemically synthesized
gagtgaaaagtctcatgtactc

SEQ ID NO: 877420 - DNA, 22 bp, Artificial Sequence
  chemically synthesized
ctgagtacatgagacttttcac

SEQ ID NO: 877421 - DNA, 22 bp, Artificial Sequence
  chemically synthesized
agagaatatttgagtgaaaagt

SEQ ID NO: 877422 - DNA, 22 bp, Artificial Sequence
  chemically synthesized
agtacatgagacttttcactca

SEQ ID NO: 877423 - DNA, 22 bp, Artificial Sequence
  chemically synthesized
tgagagaatatttgagtgaaaa

SEQ ID NO: 877424 - DNA, 22 bp, Artificial Sequence
  chemically synthesized
ctgagagaatatttgagtgaaa

SEQ ID NO: 877425 - DNA, 22 bp, Artificial Sequence
  chemically synthesized
tctgagagaatatttgagtgaa

SEQ ID NO: 877426 - DNA, 22 bp, Artificial Sequence
  chemically synthesized
ttctgagagaatatttgagtga

SEQ ID NO: 877427 - DNA, 22 bp, Artificial Sequence
  chemically synthesized
ttttctgagagaatatttgagt

SEQ ID NO: 877428 - DNA, 22 bp, Artificial Sequence
  chemically synthesized
cttttctgagagaatatttgag

SEQ ID NO: 877429 - DNA, 22 bp, Artificial Sequence
  chemically synthesized
tcttttctgagagaatatttga

SEQ ID NO: 877430 - DNA, 22 bp, Artificial Sequence
  chemically synthesized
ttcactcaaatattctctcaga

SEQ ID NO: 877431 - DNA, 22 bp, Artificial Sequence
  chemically synthesized
tcactcaaatattctctcagaa

SEQ ID NO: 877432 - DNA, 22 bp, Artificial Sequence
  chemically synthesized
cactcaaatattctctcagaaa

SEQ ID NO: 877433 - DNA, 22 bp, Artificial Sequence
  chemically synthesized
actcaaatattctctcagaaaa

SEQ ID NO: 877434 - DNA, 22 bp, Artificial Sequence
  chemically synthesized
aaatattctctcagaaaagaaa

SEQ ID NO: 877435 - DNA, 22 bp, Artificial Sequence
  chemically synthesized
aatatgagccaactttcttttc

SEQ ID NO: 877436 - DNA, 22 bp, Artificial Sequence
  chemically synthesized
gaatatgagccaactttctttt

SEQ ID NO: 877437 - DNA, 22 bp, Artificial Sequence
  chemically synthesized
tctcagaaaagaaagttggctc

SEQ ID NO: 877438 - DNA, 22 bp, Artificial Sequence
  chemically synthesized
tcagaaaagaaagttggctcat

SEQ ID NO: 877439 - DNA, 22 bp, Artificial Sequence
  chemically synthesized
agaaaagaaagttggctcatat

SEQ ID NO: 877440 - DNA, 22 bp, Artificial Sequence
  chemically synthesized
gctcatattcaagactttatac

SEQ ID NO: 877441 - DNA, 22 bp, Artificial Sequence
  chemically synthesized
agacataagagatagtataaag

SEQ ID NO: 877442 - DNA, 22 bp, Artificial Sequence
  chemically synthesized
atattcaagactttatactatc

SEQ ID NO: 877443 - DNA, 22 bp, Artificial Sequence
  chemically synthesized
aagactttatactatctcttat

SEQ ID NO: 877444 - DNA, 22 bp, Artificial Sequence
  chemically synthesized
tatactatctcttatgtctcaa

SEQ ID NO: 877445 - DNA, 22 bp, Artificial Sequence
  chemically synthesized
cgaataaaataattgagacata

SEQ ID NO: 877446 - DNA, 22 bp, Artificial Sequence
  chemically synthesized
atactatctcttatgtctcaat

SEQ ID NO: 877447 - DNA, 22 bp, Artificial Sequence
  chemically synthesized
tactatctcttatgtctcaatt

SEQ ID NO: 877448 - DNA, 22 bp, Artificial Sequence
  chemically synthesized
tggttccgaataaaataattga

SEQ ID NO: 877449 - DNA, 22 bp, Artificial Sequence
  chemically synthesized
tctcttatgtctcaattatttt

SEQ ID NO: 877450 - DNA, 22 bp, Artificial Sequence
  chemically synthesized
ttatgtctcaattattttattc

SEQ ID NO: 877451 - DNA, 22 bp, Artificial Sequence
  chemically synthesized
atgtctcaattattttattcgg

SEQ ID NO: 877452 - DNA, 22 bp, Artificial Sequence
  chemically synthesized
tgtctcaattattttattcgga

SEQ ID NO: 877453 - DNA, 22 bp, Artificial Sequence
  chemically synthesized
atatacaacattgtggttccga

SEQ ID NO: 877454 - DNA, 22 bp, Artificial Sequence
  chemically synthesized
aattattttattcggaaccaca

SEQ ID NO: 877455 - DNA, 22 bp, Artificial Sequence
  chemically synthesized
ttttattcggaaccacaatgtt

SEQ ID NO: 877456 - DNA, 22 bp, Artificial Sequence
  chemically synthesized
aggctaatatacaacattgtgg

SEQ ID NO: 877457 - DNA, 22 bp, Artificial Sequence
  chemically synthesized
caggctaatatacaacattgtg

SEQ ID NO: 877458 - DNA, 22 bp, Artificial Sequence
  chemically synthesized
tattcggaaccacaatgttgta

SEQ ID NO: 877459 - DNA, 22 bp, Artificial Sequence
  chemically synthesized
attcggaaccacaatgttgtat

SEQ ID NO: 877460 - DNA, 22 bp, Artificial Sequence
  chemically synthesized
tttcaggctaatatacaacatt

SEQ ID NO: 877461 - DNA, 22 bp, Artificial Sequence
  chemically synthesized
ttcggaaccacaatgttgtata

SEQ ID NO: 877462 - DNA, 22 bp, Artificial Sequence
  chemically synthesized
ggaaccacaatgttgtatatta

SEQ ID NO: 877463 - DNA, 22 bp, Artificial Sequence
  chemically synthesized
aggttatttcaggctaatatac

SEQ ID NO: 877464 - DNA, 22 bp, Artificial Sequence
  chemically synthesized
gaggttatttcaggctaatata

SEQ ID NO: 877465 - DNA, 22 bp, Artificial Sequence
  chemically synthesized
ttgaggttatttcaggctaata

SEQ ID NO: 877466 - DNA, 22 bp, Artificial Sequence
  chemically synthesized
tatattagcctgaaataacctc

SEQ ID NO: 877467 - DNA, 22 bp, Artificial Sequence
  chemically synthesized
gcctgaaataacctcaagagat

SEQ ID NO: 877468 - DNA, 22 bp, Artificial Sequence
  chemically synthesized
tgtaagcatcacatctcttgag

SEQ ID NO: 877469 - DNA, 22 bp, Artificial Sequence
  chemically synthesized
atgtaagcatcacatctcttga

SEQ ID NO: 877470 - DNA, 22 bp, Artificial Sequence
  chemically synthesized
aaataacctcaagagatgtgat

SEQ ID NO: 877471 - DNA, 22 bp, Artificial Sequence
  chemically synthesized
tcagaatacttatgtaagcatc

SEQ ID NO: 877472 - DNA, 22 bp, Artificial Sequence
  chemically synthesized
tgtcagaatacttatgtaagca

SEQ ID NO: 877473 - DNA, 22 bp, Artificial Sequence
  chemically synthesized
aagagatgtgatgcttacataa

SEQ ID NO: 877474 - DNA, 22 bp, Artificial Sequence
  chemically synthesized
agcaaattctgtcagaatactt

SEQ ID NO: 877475 - DNA, 22 bp, Artificial Sequence
  chemically synthesized
attaagcaaattctgtcagaat

SEQ ID NO: 877476 - DNA, 22 bp, Artificial Sequence
  chemically synthesized
aattaagcaaattctgtcagaa

SEQ ID NO: 877477 - DNA, 22 bp, Artificial Sequence
  chemically synthesized
taattaagcaaattctgtcaga

SEQ ID NO: 877478 - DNA, 22 bp, Artificial Sequence
  chemically synthesized
ttaattaagcaaattctgtcag

SEQ ID NO: 877479 - DNA, 22 bp, Artificial Sequence
  chemically synthesized
acataagtattctgacagaatt

SEQ ID NO: 877480 - DNA, 22 bp, Artificial Sequence
  chemically synthesized
tttaattaagcaaattctgtca

SEQ ID NO: 877481 - DNA, 22 bp, Artificial Sequence
  chemically synthesized
cataagtattctgacagaattt

SEQ ID NO: 877482 - DNA, 22 bp, Artificial Sequence
  chemically synthesized
cctttttaattaagcaaattct

SEQ ID NO: 877483 - DNA, 22 bp, Artificial Sequence
  chemically synthesized
cctccctttttaattaagcaaa

SEQ ID NO: 877484 - DNA, 22 bp, Artificial Sequence
  chemically synthesized
gcctccctttttaattaagcaa

SEQ ID NO: 877485 - DNA, 22 bp, Artificial Sequence
  chemically synthesized
tgcctccctttttaattaagca

SEQ ID NO: 877486 - DNA, 22 bp, Artificial Sequence
  chemically synthesized
tgacagaatttgcttaattaaa

SEQ ID NO: 877487 - DNA, 22 bp, Artificial Sequence
  chemically synthesized
tttgcctccctttttaattaag

SEQ ID NO: 877488 - DNA, 22 bp, Artificial Sequence
  chemically synthesized
ctttgcctccctttttaattaa

SEQ ID NO: 877489 - DNA, 22 bp, Artificial Sequence
  chemically synthesized
acagaatttgcttaattaaaaa

SEQ ID NO: 877490 - DNA, 22 bp, Artificial Sequence
  chemically synthesized
tctttgcctccctttttaatta

SEQ ID NO: 877491 - DNA, 22 bp, Artificial Sequence
  chemically synthesized
tcaactttctttgcctcccttt

SEQ ID NO: 877492 - DNA, 22 bp, Artificial Sequence
  chemically synthesized
atcaactttctttgcctccctt

SEQ ID NO: 877493 - DNA, 22 bp, Artificial Sequence
  chemically synthesized
gcttaattaaaaagggaggcaa

SEQ ID NO: 877494 - DNA, 22 bp, Artificial Sequence
  chemically synthesized
cttaattaaaaagggaggcaaa

SEQ ID NO: 877495 - DNA, 22 bp, Artificial Sequence
  chemically synthesized
aattaaaaagggaggcaaagaa

SEQ ID NO: 877496 - DNA, 22 bp, Artificial Sequence
  chemically synthesized
attaaaaagggaggcaaagaaa

SEQ ID NO: 877497 - DNA, 22 bp, Artificial Sequence
  chemically synthesized
aagatttatcaactttctttgc

SEQ ID NO: 877498 - DNA, 22 bp, Artificial Sequence
  chemically synthesized
aaaagggaggcaaagaaagttg

SEQ ID NO: 877499 - DNA, 22 bp, Artificial Sequence
  chemically synthesized
ctaaagatttatcaactttctt

SEQ ID NO: 877500 - DNA, 22 bp, Artificial Sequence
  chemically synthesized
ggaatgattgctaaagatttat

SEQ ID NO: 877501 - DNA, 22 bp, Artificial Sequence
  chemically synthesized
tacattaggaatgattgctaaa

SEQ ID NO: 877502 - DNA, 22 bp, Artificial Sequence
  chemically synthesized
ataaatctttagcaatcattcc

SEQ ID NO: 877503 - DNA, 22 bp, Artificial Sequence
  chemically synthesized
tgaagctatacattaggaatga

SEQ ID NO: 877504 - DNA, 22 bp, Artificial Sequence
  chemically synthesized
tagcaatcattcctaatgtata

SEQ ID NO: 877505 - DNA, 22 bp, Artificial Sequence
  chemically synthesized
agcaatcattcctaatgtatag

SEQ ID NO: 877506 - DNA, 22 bp, Artificial Sequence
  chemically synthesized
gcaatcattcctaatgtatagc

SEQ ID NO: 877507 - DNA, 22 bp, Artificial Sequence
  chemically synthesized
ccacgagtgattgtgaagctat

SEQ ID NO: 877508 - DNA, 22 bp, Artificial Sequence
  chemically synthesized
tgccacgagtgattgtgaagct

SEQ ID NO: 877509 - DNA, 22 bp, Artificial Sequence
  chemically synthesized
ctaatgtatagcttcacaatca

SEQ ID NO: 877510 - DNA, 22 bp, Artificial Sequence
  chemically synthesized
atgtatagcttcacaatcactc

SEQ ID NO: 877511 - DNA, 22 bp, Artificial Sequence
  chemically synthesized
caatgatctctgccacgagtga

SEQ ID NO: 877512 - DNA, 22 bp, Artificial Sequence
  chemically synthesized
acaatgatctctgccacgagtg

SEQ ID NO: 877513 - DNA, 22 bp, Artificial Sequence
  chemically synthesized
gtttacaatgatctctgccacg

SEQ ID NO: 877514 - DNA, 22 bp, Artificial Sequence
  chemically synthesized
cacaatcactcgtggcagagat

SEQ ID NO: 877515 - DNA, 22 bp, Artificial Sequence
  chemically synthesized
acaatcactcgtggcagagatc

SEQ ID NO: 877516 - DNA, 22 bp, Artificial Sequence
  chemically synthesized
aaagactcgtttacaatgatct

SEQ ID NO: 877517 - DNA, 22 bp, Artificial Sequence
  chemically synthesized
gaaagactcgtttacaatgatc

SEQ ID NO: 877518 - DNA, 22 bp, Artificial Sequence
  chemically synthesized
tgaaagactcgtttacaatgat

SEQ ID NO: 877519 - DNA, 22 bp, Artificial Sequence
  chemically synthesized
tttgaaagactcgtttacaatg

SEQ ID NO: 877520 - DNA, 22 bp, Artificial Sequence
  chemically synthesized
gtggcagagatcattgtaaacg

SEQ ID NO: 877521 - DNA, 22 bp, Artificial Sequence
  chemically synthesized
acaaattctttgaaagactcgt

SEQ ID NO: 877522 - DNA, 22 bp, Artificial Sequence
  chemically synthesized
aacaaattctttgaaagactcg

SEQ ID NO: 877523 - DNA, 22 bp, Artificial Sequence
  chemically synthesized
taacaaattctttgaaagactc

SEQ ID NO: 877524 - DNA, 22 bp, Artificial Sequence
  chemically synthesized
ttaacaaattctttgaaagact

SEQ ID NO: 877525 - DNA, 22 bp, Artificial Sequence
  chemically synthesized
tttaacaaattctttgaaagac

SEQ ID NO: 877526 - DNA, 22 bp, Artificial Sequence
  chemically synthesized
gctttttaacaaattctttgaa

SEQ ID NO: 877527 - DNA, 22 bp, Artificial Sequence
  chemically synthesized
taaacgagtctttcaaagaatt

SEQ ID NO: 877528 - DNA, 22 bp, Artificial Sequence
  chemically synthesized
ggctttttaacaaattctttga

SEQ ID NO: 877529 - DNA, 22 bp, Artificial Sequence
  chemically synthesized
tttggctttttaacaaattctt

SEQ ID NO: 877530 - DNA, 22 bp, Artificial Sequence
  chemically synthesized
agttgtttggctttttaacaaa

SEQ ID NO: 877531 - DNA, 22 bp, Artificial Sequence
  chemically synthesized
aagttgtttggctttttaacaa

SEQ ID NO: 877532 - DNA, 22 bp, Artificial Sequence
  chemically synthesized
taagttgtttggctttttaaca

SEQ ID NO: 877533 - DNA, 22 bp, Artificial Sequence
  chemically synthesized
ttaagttgtttggctttttaac

SEQ ID NO: 877534 - DNA, 22 bp, Artificial Sequence
  chemically synthesized
tcaaagaatttgttaaaaagcc

SEQ ID NO: 877535 - DNA, 22 bp, Artificial Sequence
  chemically synthesized
tttaagttgtttggctttttaa

SEQ ID NO: 877536 - DNA, 22 bp, Artificial Sequence
  chemically synthesized
caaagaatttgttaaaaagcca

SEQ ID NO: 877537 - DNA, 22 bp, Artificial Sequence
  chemically synthesized
aaagaatttgttaaaaagccaa

SEQ ID NO: 877538 - DNA, 22 bp, Artificial Sequence
  chemically synthesized
ctttttaagttgtttggctttt

SEQ ID NO: 877539 - DNA, 22 bp, Artificial Sequence
  chemically synthesized
tgctttttaagttgtttggctt

SEQ ID NO: 877540 - DNA, 22 bp, Artificial Sequence
  chemically synthesized
ctgctttttaagttgtttggct

SEQ ID NO: 877541 - DNA, 22 bp, Artificial Sequence
  chemically synthesized
tctgctttttaagttgtttggc

SEQ ID NO: 877542 - DNA, 22 bp, Artificial Sequence
  chemically synthesized
tttctgctttttaagttgtttg

SEQ ID NO: 877543 - DNA, 22 bp, Artificial Sequence
  chemically synthesized
gttaaaaagccaaacaacttaa

SEQ ID NO: 877544 - DNA, 22 bp, Artificial Sequence
  chemically synthesized
ttaaaaagccaaacaacttaaa

SEQ ID NO: 877545 - DNA, 22 bp, Artificial Sequence
  chemically synthesized
aaaagccaaacaacttaaaaag

SEQ ID NO: 877546 - DNA, 22 bp, Artificial Sequence
  chemically synthesized
acatattctttctgctttttaa

SEQ ID NO: 877547 - DNA, 22 bp, Artificial Sequence
  chemically synthesized
ccaatagactaacatattcttt

SEQ ID NO: 877548 - DNA, 22 bp, Artificial Sequence
  chemically synthesized
aaaaagcagaaagaatatgtta

SEQ ID NO: 877549 - DNA, 22 bp, Artificial Sequence
  chemically synthesized
aaaagcagaaagaatatgttag

SEQ ID NO: 877550 - DNA, 22 bp, Artificial Sequence
  chemically synthesized
aaaattcccaatagactaacat

SEQ ID NO: 877551 - DNA, 22 bp, Artificial Sequence
  chemically synthesized
aaaaattcccaatagactaaca

SEQ ID NO: 877552 - DNA, 22 bp, Artificial Sequence
  chemically synthesized
taaaaattcccaatagactaac

SEQ ID NO: 877553 - DNA, 22 bp, Artificial Sequence
  chemically synthesized
ttaaaaattcccaatagactaa

SEQ ID NO: 877554 - DNA, 22 bp, Artificial Sequence
  chemically synthesized
gtctattgggaatttttaaaag

SEQ ID NO: 877555 - DNA, 22 bp, Artificial Sequence
  chemically synthesized
ttgggaatttttaaaagatcac

SEQ ID NO: 877556 - DNA, 22 bp, Artificial Sequence
  chemically synthesized
cacccagccagatgtgatcttt

SEQ ID NO: 877557 - DNA, 22 bp, Artificial Sequence
  chemically synthesized
ggaatttttaaaagatcacatc

SEQ ID NO: 877558 - DNA, 22 bp, Artificial Sequence
  chemically synthesized
ttaaaagatcacatctggctgg

SEQ ID NO: 877559 - DNA, 22 bp, Artificial Sequence
  chemically synthesized
taaaagatcacatctggctggg

SEQ ID NO: 877560 - DNA, 22 bp, Artificial Sequence
  chemically synthesized
aaaagatcacatctggctgggt

SEQ ID NO: 877561 - DNA, 22 bp, Artificial Sequence
  chemically synthesized
aaagatcacatctggctgggtg

SEQ ID NO: 877562 - DNA, 22 bp, Artificial Sequence
  chemically synthesized
caggcgtgagccactgcaccca

SEQ ID NO: 877563 - DNA, 22 bp, Artificial Sequence
  chemically synthesized
ggattacaggcgtgagccactg

SEQ ID NO: 877564 - DNA, 22 bp, Artificial Sequence
  chemically synthesized
gctgggtgcagtggctcacgcc

SEQ ID NO: 877565 - DNA, 22 bp, Artificial Sequence
  chemically synthesized
ggtgcagtggctcacgcctgta

SEQ ID NO: 877566 - DNA, 22 bp, Artificial Sequence
  chemically synthesized
ccaaagtcctgggattacaggc

SEQ ID NO: 877567 - DNA, 22 bp, Artificial Sequence
  chemically synthesized
ggcctcccaaagtcctgggatt

SEQ ID NO: 877568 - DNA, 22 bp, Artificial Sequence
  chemically synthesized
acgcctgtaatcccaggacttt

SEQ ID NO: 877569 - DNA, 22 bp, Artificial Sequence
  chemically synthesized
cctcggcctcccaaagtcctgg

SEQ ID NO: 877570 - DNA, 22 bp, Artificial Sequence
  chemically synthesized
taatcccaggactttgggaggc

SEQ ID NO: 877571 - DNA, 22 bp, Artificial Sequence
  chemically synthesized
aggtgatcaggctgcctcggcc

SEQ ID NO: 877572 - DNA, 22 bp, Artificial Sequence
  chemically synthesized
tgggaggccgaggcagcctgat

SEQ ID NO: 877573 - DNA, 22 bp, Artificial Sequence
  chemically synthesized
gggaggccgaggcagcctgatc

SEQ ID NO: 877574 - DNA, 22 bp, Artificial Sequence
  chemically synthesized
ccgacctcaggtgatcaggctg

SEQ ID NO: 877575 - DNA, 22 bp, Artificial Sequence
  chemically synthesized
ggaggccgaggcagcctgatca

SEQ ID NO: 877576 - DNA, 22 bp, Artificial Sequence
  chemically synthesized
gaactcccgacctcaggtgatc

SEQ ID NO: 877577 - DNA, 22 bp, Artificial Sequence
  chemically synthesized
gtctcgaactcccgacctcagg

SEQ ID NO: 877578 - DNA, 22 bp, Artificial Sequence
  chemically synthesized
atcacctgaggtcgggagttcg

SEQ ID NO: 877579 - DNA, 22 bp, Artificial Sequence
  chemically synthesized
gtcaagctggtctcgaactccc

SEQ ID NO: 877580 - DNA, 22 bp, Artificial Sequence
  chemically synthesized
aggtcgggagttcgagaccagc

SEQ ID NO: 877581 - DNA, 22 bp, Artificial Sequence
  chemically synthesized
cacgttggtcaagctggtctcg

SEQ ID NO: 877582 - DNA, 22 bp, Artificial Sequence
  chemically synthesized
tccacgttggtcaagctggtct

SEQ ID NO: 877583 - DNA, 22 bp, Artificial Sequence
  chemically synthesized
ctccacgttggtcaagctggtc

SEQ ID NO: 877584 - DNA, 22 bp, Artificial Sequence
  chemically synthesized
gagaccagcttgaccaacgtgg

SEQ ID NO: 877585 - DNA, 22 bp, Artificial Sequence
  chemically synthesized
gtagagatggggtttctccacg

SEQ ID NO: 877586 - DNA, 22 bp, Artificial Sequence
  chemically synthesized
agtagagatggggtttctccac

SEQ ID NO: 877587 - DNA, 22 bp, Artificial Sequence
  chemically synthesized
tagtagagatggggtttctcca

SEQ ID NO: 877588 - DNA, 22 bp, Artificial Sequence
  chemically synthesized
ttagtagagatggggtttctcc

SEQ ID NO: 877589 - DNA, 22 bp, Artificial Sequence
  chemically synthesized
gaccaacgtggagaaaccccat

SEQ ID NO: 877590 - DNA, 22 bp, Artificial Sequence
  chemically synthesized
accaacgtggagaaaccccatc

SEQ ID NO: 877591 - DNA, 22 bp, Artificial Sequence
  chemically synthesized
tatttttagtagagatggggtt

SEQ ID NO: 877592 - DNA, 22 bp, Artificial Sequence
  chemically synthesized
gtatttttagtagagatggggt

SEQ ID NO: 877593 - DNA, 22 bp, Artificial Sequence
  chemically synthesized
tgtatttttagtagagatgggg

SEQ ID NO: 877594 - DNA, 22 bp, Artificial Sequence
  chemically synthesized
attttgtatttttagtagagat

SEQ ID NO: 877595 - DNA, 22 bp, Artificial Sequence
  chemically synthesized
tactaaaaatacaaaattagct

SEQ ID NO: 877596 - DNA, 22 bp, Artificial Sequence
  chemically synthesized
ctaaaaatacaaaattagctgg

SEQ ID NO: 877597 - DNA, 22 bp, Artificial Sequence
  chemically synthesized
aaaatacaaaattagctgggca

SEQ ID NO: 877598 - DNA, 22 bp, Artificial Sequence
  chemically synthesized
caggcgcccaccaccatgccca

SEQ ID NO: 877599 - DNA, 22 bp, Artificial Sequence
  chemically synthesized
ggattacaggcgcccaccacca

SEQ ID NO: 877600 - DNA, 22 bp, Artificial Sequence
  chemically synthesized
gctgggcatggtggtgggcgcc

SEQ ID NO: 877601 - DNA, 22 bp, Artificial Sequence
  chemically synthesized
ggcatggtggtgggcgcctgta

SEQ ID NO: 877602 - DNA, 22 bp, Artificial Sequence
  chemically synthesized
caagtagctgggattacaggcg

SEQ ID NO: 877603 - DNA, 22 bp, Artificial Sequence
  chemically synthesized
ccaagtagctgggattacaggc

SEQ ID NO: 877604 - DNA, 22 bp, Artificial Sequence
  chemically synthesized
agccttccaagtagctgggatt

SEQ ID NO: 877605 - DNA, 22 bp, Artificial Sequence
  chemically synthesized
cctcagccttccaagtagctgg

SEQ ID NO: 877606 - DNA, 22 bp, Artificial Sequence
  chemically synthesized
ctgcctcagccttccaagtagc

SEQ ID NO: 877607 - DNA, 22 bp, Artificial Sequence
  chemically synthesized
tcctgcctcagccttccaagta

SEQ ID NO: 877608 - DNA, 22 bp, Artificial Sequence
  chemically synthesized
taatcccagctacttggaaggc

SEQ ID NO: 877609 - DNA, 22 bp, Artificial Sequence
  chemically synthesized
aagcgattctcctgcctcagcc

SEQ ID NO: 877610 - DNA, 22 bp, Artificial Sequence
  chemically synthesized
cttggaaggctgaggcaggaga

SEQ ID NO: 877611 - DNA, 22 bp, Artificial Sequence
  chemically synthesized
ggaaggctgaggcaggagaatc

SEQ ID NO: 877612 - DNA, 22 bp, Artificial Sequence
  chemically synthesized
ccaggttcaagcgattctcctg

SEQ ID NO: 877613 - DNA, 22 bp, Artificial Sequence
  chemically synthesized
gaaggctgaggcaggagaatcg

SEQ ID NO: 877614 - DNA, 22 bp, Artificial Sequence
  chemically synthesized
cacctcccaggttcaagcgatt

SEQ ID NO: 877615 - DNA, 22 bp, Artificial Sequence
  chemically synthesized
aggcaggagaatcgcttgaacc

SEQ ID NO: 877616 - DNA, 22 bp, Artificial Sequence
  chemically synthesized
accgcaacctacacctcccagg

SEQ ID NO: 877617 - DNA, 22 bp, Artificial Sequence
  chemically synthesized
ggctcaccgcaacctacacctc

SEQ ID NO: 877618 - DNA, 22 bp, Artificial Sequence
  chemically synthesized
gaacctgggaggtgtaggttgc

SEQ ID NO: 877619 - DNA, 22 bp, Artificial Sequence
  chemically synthesized
aacctgggaggtgtaggttgcg

SEQ ID NO: 877620 - DNA, 22 bp, Artificial Sequence
  chemically synthesized
ggaggtgtaggttgcggtgagc

SEQ ID NO: 877621 - DNA, 22 bp, Artificial Sequence
  chemically synthesized
gagtgcggtggcgcgatctcgg

SEQ ID NO: 877622 - DNA, 22 bp, Artificial Sequence
  chemically synthesized
cggtgagccgagatcgcgccac

SEQ ID NO: 877623 - DNA, 22 bp, Artificial Sequence
  chemically synthesized
cccaggctggagtgcggtggcg

SEQ ID NO: 877624 - DNA, 22 bp, Artificial Sequence
  chemically synthesized
ttgcccaggctggagtgcggtg

SEQ ID NO: 877625 - DNA, 22 bp, Artificial Sequence
  chemically synthesized
gttgcccaggctggagtgcggt

SEQ ID NO: 877626 - DNA, 22 bp, Artificial Sequence
  chemically synthesized
ttgttgcccaggctggagtgcg

SEQ ID NO: 877627 - DNA, 22 bp, Artificial Sequence
  chemically synthesized
gctcttgttgcccaggctggag

SEQ ID NO: 877628 - DNA, 22 bp, Artificial Sequence
  chemically synthesized
cgctcttgttgcccaggctgga

SEQ ID NO: 877629 - DNA, 22 bp, Artificial Sequence
  chemically synthesized
agacggagtttcgctcttgttg

SEQ ID NO: 877630 - DNA, 22 bp, Artificial Sequence
  chemically synthesized
gagacggagtttcgctcttgtt

SEQ ID NO: 877631 - DNA, 22 bp, Artificial Sequence
  chemically synthesized
tgagacggagtttcgctcttgt

SEQ ID NO: 877632 - DNA, 22 bp, Artificial Sequence
  chemically synthesized
cagcctgggcaacaagagcgaa

SEQ ID NO: 877633 - DNA, 22 bp, Artificial Sequence
  chemically synthesized
ttgagacggagtttcgctcttg

SEQ ID NO: 877634 - DNA, 22 bp, Artificial Sequence
  chemically synthesized
tttttgagacggagtttcgctc

SEQ ID NO: 877635 - DNA, 22 bp, Artificial Sequence
  chemically synthesized
gtttttgagacggagtttcgct

SEQ ID NO: 877636 - DNA, 22 bp, Artificial Sequence
  chemically synthesized
ggcaacaagagcgaaactccgt

SEQ ID NO: 877637 - DNA, 22 bp, Artificial Sequence
  chemically synthesized
tttgtttttgagacggagtttc

SEQ ID NO: 877638 - DNA, 22 bp, Artificial Sequence
  chemically synthesized
gtttgtttttgagacggagttt

SEQ ID NO: 877639 - DNA, 22 bp, Artificial Sequence
  chemically synthesized
tttgtttgtttttgagacggag

SEQ ID NO: 877640 - DNA, 22 bp, Artificial Sequence
  chemically synthesized
gttgtttgtttgtttttgagac

SEQ ID NO: 877641 - DNA, 22 bp, Artificial Sequence
  chemically synthesized
ggttgtttgtttgtttttgaga

SEQ ID NO: 877642 - DNA, 22 bp, Artificial Sequence
  chemically synthesized
tggttgtttgtttgtttttgag

SEQ ID NO: 877643 - DNA, 22 bp, Artificial Sequence
  chemically synthesized
cgtctcaaaaacaaacaaacaa

SEQ ID NO: 877644 - DNA, 22 bp, Artificial Sequence
  chemically synthesized
gatatgattttggttgtttgtt

SEQ ID NO: 877645 - DNA, 22 bp, Artificial Sequence
  chemically synthesized
agatatgattttggttgtttgt

SEQ ID NO: 877646 - DNA, 22 bp, Artificial Sequence
  chemically synthesized
ttagatatgattttggttgttt

SEQ ID NO: 877647 - DNA, 22 bp, Artificial Sequence
  chemically synthesized
cttagatatgattttggttgtt

SEQ ID NO: 877648 - DNA, 22 bp, Artificial Sequence
  chemically synthesized
aaaaacaaacaaacaaccaaaa

SEQ ID NO: 877649 - DNA, 22 bp, Artificial Sequence
  chemically synthesized
tcttagatatgattttggttgt

SEQ ID NO: 877650 - DNA, 22 bp, Artificial Sequence
  chemically synthesized
ttcttagatatgattttggttg

SEQ ID NO: 877651 - DNA, 22 bp, Artificial Sequence
  chemically synthesized
atttttcttagatatgattttg

SEQ ID NO: 877652 - DNA, 22 bp, Artificial Sequence
  chemically synthesized
catttttcttagatatgatttt

SEQ ID NO: 877653 - DNA, 22 bp, Artificial Sequence
  chemically synthesized
tcatttttcttagatatgattt

SEQ ID NO: 877654 - DNA, 22 bp, Artificial Sequence
  chemically synthesized
ttcatttttcttagatatgatt

SEQ ID NO: 877655 - DNA, 22 bp, Artificial Sequence
  chemically synthesized
tttcatttttcttagatatgat

SEQ ID NO: 877656 - DNA, 22 bp, Artificial Sequence
  chemically synthesized
ttttcatttttcttagatatga

SEQ ID NO: 877657 - DNA, 22 bp, Artificial Sequence
  chemically synthesized
tttttttcatttttcttagata

SEQ ID NO: 877658 - DNA, 22 bp, Artificial Sequence
  chemically synthesized
ggaaaactgtttttttcatttt

SEQ ID NO: 877659 - DNA, 22 bp, Artificial Sequence
  chemically synthesized
agaaaaatgaaaaaaacagttt

SEQ ID NO: 877660 - DNA, 22 bp, Artificial Sequence
  chemically synthesized
acaaaatattaggaaaactgtt

SEQ ID NO: 877661 - DNA, 22 bp, Artificial Sequence
  chemically synthesized
aatacccattcacaaaatatta

SEQ ID NO: 877662 - DNA, 22 bp, Artificial Sequence
  chemically synthesized
caatacccattcacaaaatatt

SEQ ID NO: 877663 - DNA, 22 bp, Artificial Sequence
  chemically synthesized
tcctaatattttgtgaatgggt

SEQ ID NO: 877664 - DNA, 22 bp, Artificial Sequence
  chemically synthesized
cctaatattttgtgaatgggta

SEQ ID NO: 877665 - DNA, 22 bp, Artificial Sequence
  chemically synthesized
ctaatattttgtgaatgggtat

SEQ ID NO: 877666 - DNA, 22 bp, Artificial Sequence
  chemically synthesized
tcccaaacttcaatacccattc

SEQ ID NO: 877667 - DNA, 22 bp, Artificial Sequence
  chemically synthesized
atcccaaacttcaatacccatt

SEQ ID NO: 877668 - DNA, 22 bp, Artificial Sequence
  chemically synthesized
tatcccaaacttcaatacccat

SEQ ID NO: 877669 - DNA, 22 bp, Artificial Sequence
  chemically synthesized
atattttgtgaatgggtattga

SEQ ID NO: 877670 - DNA, 22 bp, Artificial Sequence
  chemically synthesized
ttatcccaaacttcaataccca

SEQ ID NO: 877671 - DNA, 22 bp, Artificial Sequence
  chemically synthesized
tgtgaatgggtattgaagtttg

SEQ ID NO: 877672 - DNA, 22 bp, Artificial Sequence
  chemically synthesized
aaatttttatcccaaacttcaa

SEQ ID NO: 877673 - DNA, 22 bp, Artificial Sequence
  chemically synthesized
gtgaatgggtattgaagtttgg

SEQ ID NO: 877674 - DNA, 22 bp, Artificial Sequence
  chemically synthesized
tgaatgggtattgaagtttggg

SEQ ID NO: 877675 - DNA, 22 bp, Artificial Sequence
  chemically synthesized
tcgctgaaatttttatcccaaa

SEQ ID NO: 877676 - DNA, 22 bp, Artificial Sequence
  chemically synthesized
aatgctgtcgctgaaattttta

SEQ ID NO: 877677 - DNA, 22 bp, Artificial Sequence
  chemically synthesized
aagtttgggataaaaatttcag

SEQ ID NO: 877678 - DNA, 22 bp, Artificial Sequence
  chemically synthesized
tcaatgctgtcgctgaaatttt

SEQ ID NO: 877679 - DNA, 22 bp, Artificial Sequence
  chemically synthesized
gggataaaaatttcagcgacag

SEQ ID NO: 877680 - DNA, 22 bp, Artificial Sequence
  chemically synthesized
acgttctcaatgctgtcgctga

SEQ ID NO: 877681 - DNA, 22 bp, Artificial Sequence
  chemically synthesized
ggataaaaatttcagcgacagc

SEQ ID NO: 877682 - DNA, 22 bp, Artificial Sequence
  chemically synthesized
cacgttctcaatgctgtcgctg

SEQ ID NO: 877683 - DNA, 22 bp, Artificial Sequence
  chemically synthesized
tcacgttctcaatgctgtcgct

SEQ ID NO: 877684 - DNA, 22 bp, Artificial Sequence
  chemically synthesized
ttcacgttctcaatgctgtcgc

SEQ ID NO: 877685 - DNA, 22 bp, Artificial Sequence
  chemically synthesized
tttttcacgttctcaatgctgt

SEQ ID NO: 877686 - DNA, 22 bp, Artificial Sequence
  chemically synthesized
cagcgacagcattgagaacgtg

SEQ ID NO: 877687 - DNA, 22 bp, Artificial Sequence
  chemically synthesized
agcgacagcattgagaacgtga

SEQ ID NO: 877688 - DNA, 22 bp, Artificial Sequence
  chemically synthesized
tcagcagagctatttttcacgt

SEQ ID NO: 877689 - DNA, 22 bp, Artificial Sequence
  chemically synthesized
ccagctatcagcagagctattt

SEQ ID NO: 877690 - DNA, 22 bp, Artificial Sequence
  chemically synthesized
agaacgtgaaaaatagctctgc

SEQ ID NO: 877691 - DNA, 22 bp, Artificial Sequence
  chemically synthesized
ccagctgccagctatcagcaga

SEQ ID NO: 877692 - DNA, 22 bp, Artificial Sequence
  chemically synthesized
gctgccagctgccagctatcag

SEQ ID NO: 877693 - DNA, 22 bp, Artificial Sequence
  chemically synthesized
gctagctgccagctgccagcta

SEQ ID NO: 877694 - DNA, 22 bp, Artificial Sequence
  chemically synthesized
tgctgatagctggcagctggca

SEQ ID NO: 877695 - DNA, 22 bp, Artificial Sequence
  chemically synthesized
ctgatagctggcagctggcagc

SEQ ID NO: 877696 - DNA, 22 bp, Artificial Sequence
  chemically synthesized
atagctggcagctggcagctag

SEQ ID NO: 877697 - DNA, 22 bp, Artificial Sequence
  chemically synthesized
ggaccatcatggcctagctagc

SEQ ID NO: 877698 - DNA, 22 bp, Artificial Sequence
  chemically synthesized
gcagctggcagctagctaggcc

SEQ ID NO: 877699 - DNA, 22 bp, Artificial Sequence
  chemically synthesized
gcagctagctaggccatgatgg

SEQ ID NO: 877700 - DNA, 22 bp, Artificial Sequence
  chemically synthesized
acatccagctgggaccatcatg

SEQ ID NO: 877701 - DNA, 22 bp, Artificial Sequence
  chemically synthesized
aacatccagctgggaccatcat

SEQ ID NO: 877702 - DNA, 22 bp, Artificial Sequence
  chemically synthesized
taacatccagctgggaccatca

SEQ ID NO: 877703 - DNA, 22 bp, Artificial Sequence
  chemically synthesized
ttaacatccagctgggaccatc

SEQ ID NO: 877704 - DNA, 22 bp, Artificial Sequence
  chemically synthesized
tttaacatccagctgggaccat

SEQ ID NO: 877705 - DNA, 22 bp, Artificial Sequence
  chemically synthesized
gctaggccatgatggtcccagc

SEQ ID NO: 877706 - DNA, 22 bp, Artificial Sequence
  chemically synthesized
ggccatgatggtcccagctgga

SEQ ID NO: 877707 - DNA, 22 bp, Artificial Sequence
  chemically synthesized
tgagtgttttttaacatccagc

SEQ ID NO: 877708 - DNA, 22 bp, Artificial Sequence
  chemically synthesized
tatgagtgttttttaacatcca

SEQ ID NO: 877709 - DNA, 22 bp, Artificial Sequence
  chemically synthesized
ctatgagtgttttttaacatcc

SEQ ID NO: 877710 - DNA, 22 bp, Artificial Sequence
  chemically synthesized
tttctatgagtgttttttaaca

SEQ ID NO: 877711 - DNA, 22 bp, Artificial Sequence
  chemically synthesized
atttctatgagtgttttttaac

SEQ ID NO: 877712 - DNA, 22 bp, Artificial Sequence
  chemically synthesized
gtttatttctatgagtgttttt

SEQ ID NO: 877713 - DNA, 22 bp, Artificial Sequence
  chemically synthesized
cctagtttatttctatgagtgt

SEQ ID NO: 877714 - DNA, 22 bp, Artificial Sequence
  chemically synthesized
gatgttaaaaaacactcataga

SEQ ID NO: 877715 - DNA, 22 bp, Artificial Sequence
  chemically synthesized
tgtctgcctagtttatttctat

SEQ ID NO: 877716 - DNA, 22 bp, Artificial Sequence
  chemically synthesized
gtgtctgcctagtttatttcta

SEQ ID NO: 877717 - DNA, 22 bp, Artificial Sequence
  chemically synthesized
aaaaacactcatagaaataaac

SEQ ID NO: 877718 - DNA, 22 bp, Artificial Sequence
  chemically synthesized
atagaaataaactaggcagaca

SEQ ID NO: 877719 - DNA, 22 bp, Artificial Sequence
  chemically synthesized
aaacacggccatggggtggcct

SEQ ID NO: 877720 - DNA, 22 bp, Artificial Sequence
  chemically synthesized
caaacacggccatggggtggcc

SEQ ID NO: 877721 - DNA, 22 bp, Artificial Sequence
  chemically synthesized
ggcagacacaaggccaccccat

SEQ ID NO: 877722 - DNA, 22 bp, Artificial Sequence
  chemically synthesized
tttcaaacacggccatggggtg

SEQ ID NO: 877723 - DNA, 22 bp, Artificial Sequence
  chemically synthesized
gtttcaaacacggccatggggt

SEQ ID NO: 877724 - DNA, 22 bp, Artificial Sequence
  chemically synthesized
tcttgtttcaaacacggccatg

SEQ ID NO: 877725 - DNA, 22 bp, Artificial Sequence
  chemically synthesized
tgtcttgtttcaaacacggcca

SEQ ID NO: 877726 - DNA, 22 bp, Artificial Sequence
  chemically synthesized
tctctgtcttgtttcaaacacg

SEQ ID NO: 877727 - DNA, 22 bp, Artificial Sequence
  chemically synthesized
gtctctgtcttgtttcaaacac

SEQ ID NO: 877728 - DNA, 22 bp, Artificial Sequence
  chemically synthesized
gaaacaagacagagacaaggcc

SEQ ID NO: 877729 - DNA, 22 bp, Artificial Sequence
  chemically synthesized
tgatagcagaaaggccttgtct

SEQ ID NO: 877730 - DNA, 22 bp, Artificial Sequence
  chemically synthesized
aaacaagacagagacaaggcct

SEQ ID NO: 877731 - DNA, 22 bp, Artificial Sequence
  chemically synthesized
tgtgatagcagaaaggccttgt

SEQ ID NO: 877732 - DNA, 22 bp, Artificial Sequence
  chemically synthesized
ctgtgatagcagaaaggccttg

SEQ ID NO: 877733 - DNA, 22 bp, Artificial Sequence
  chemically synthesized
gtcatttctgtgatagcagaaa

SEQ ID NO: 877734 - DNA, 22 bp, Artificial Sequence
  chemically synthesized
atattagtcatttctgtgatag

SEQ ID NO: 877735 - DNA, 22 bp, Artificial Sequence
  chemically synthesized
tctgctatcacagaaatgacta

SEQ ID NO: 877736 - DNA, 22 bp, Artificial Sequence
  chemically synthesized
ctgctatcacagaaatgactaa

SEQ ID NO: 877737 - DNA, 22 bp, Artificial Sequence
  chemically synthesized
tgctatcacagaaatgactaat

SEQ ID NO: 877738 - DNA, 22 bp, Artificial Sequence
  chemically synthesized
ctatcacagaaatgactaatat

SEQ ID NO: 877739 - DNA, 22 bp, Artificial Sequence
  chemically synthesized
tcacagaaatgactaatatgag

SEQ ID NO: 877740 - DNA, 22 bp, Artificial Sequence
  chemically synthesized
gtaaaggagcagcaatgcctca

SEQ ID NO: 877741 - DNA, 22 bp, Artificial Sequence
  chemically synthesized
atatgaggcattgctgctcctt

SEQ ID NO: 877742 - DNA, 22 bp, Artificial Sequence
  chemically synthesized
gacacgtcgttggtaaaggagc

SEQ ID NO: 877743 - DNA, 22 bp, Artificial Sequence
  chemically synthesized
ctgctcctttaccaacgacgtg

SEQ ID NO: 877744 - DNA, 22 bp, Artificial Sequence
  chemically synthesized
aagtagggctagacacgtcgtt

SEQ ID NO: 877745 - DNA, 22 bp, Artificial Sequence
  chemically synthesized
ctcctttaccaacgacgtgtct

SEQ ID NO: 877746 - DNA, 22 bp, Artificial Sequence
  chemically synthesized
ctttaccaacgacgtgtctagc

SEQ ID NO: 877747 - DNA, 22 bp, Artificial Sequence
  chemically synthesized
taccaacgacgtgtctagccct

SEQ ID NO: 877748 - DNA, 22 bp, Artificial Sequence
  chemically synthesized
accaacgacgtgtctagcccta

SEQ ID NO: 877749 - DNA, 22 bp, Artificial Sequence
  chemically synthesized
ccaacgacgtgtctagccctac

SEQ ID NO: 877750 - DNA, 22 bp, Artificial Sequence
  chemically synthesized
gaagatgagattaaagtagggc

SEQ ID NO: 877751 - DNA, 22 bp, Artificial Sequence
  chemically synthesized
tctagaagatgagattaaagta

SEQ ID NO: 877752 - DNA, 22 bp, Artificial Sequence
  chemically synthesized
atctagaagatgagattaaagt

SEQ ID NO: 877753 - DNA, 22 bp, Artificial Sequence
  chemically synthesized
gtgtttatctagaagatgagat

SEQ ID NO: 877754 - DNA, 22 bp, Artificial Sequence
  chemically synthesized
gccctactttaatctcatcttc

SEQ ID NO: 877755 - DNA, 22 bp, Artificial Sequence
  chemically synthesized
agtgtttatctagaagatgaga

SEQ ID NO: 877756 - DNA, 22 bp, Artificial Sequence
  chemically synthesized
ctttaatctcatcttctagata

SEQ ID NO: 877757 - DNA, 22 bp, Artificial Sequence
  chemically synthesized
ggtatcttagtgtttatctaga

SEQ ID NO: 877758 - DNA, 22 bp, Artificial Sequence
  chemically synthesized
taatctcatcttctagataaac

SEQ ID NO: 877759 - DNA, 22 bp, Artificial Sequence
  chemically synthesized
aatctcatcttctagataaaca

SEQ ID NO: 877760 - DNA, 22 bp, Artificial Sequence
  chemically synthesized
atctcatcttctagataaacac

SEQ ID NO: 877761 - DNA, 22 bp, Artificial Sequence
  chemically synthesized
atcttctagataaacactaaga

SEQ ID NO: 877762 - DNA, 22 bp, Artificial Sequence
  chemically synthesized
ctagataaacactaagatacct

SEQ ID NO: 877763 - DNA, 22 bp, Artificial Sequence
  chemically synthesized
tagataaacactaagataccta

SEQ ID NO: 877764 - DNA, 22 bp, Artificial Sequence
  chemically synthesized
gataaacactaagatacctaat

SEQ ID NO: 877765 - DNA, 22 bp, Artificial Sequence
  chemically synthesized
aagaaacagagtcaatgtagtg

SEQ ID NO: 877766 - DNA, 22 bp, Artificial Sequence
  chemically synthesized
agatacctaatcactacattga

SEQ ID NO: 877767 - DNA, 22 bp, Artificial Sequence
  chemically synthesized
caagaaacagagtcaatgtagt

SEQ ID NO: 877768 - DNA, 22 bp, Artificial Sequence
  chemically synthesized
tcaagaaacagagtcaatgtag

SEQ ID NO: 877769 - DNA, 22 bp, Artificial Sequence
  chemically synthesized
gatgctttcaagaaacagagtc

SEQ ID NO: 877770 - DNA, 22 bp, Artificial Sequence
  chemically synthesized
atcactacattgactctgtttc

SEQ ID NO: 877771 - DNA, 22 bp, Artificial Sequence
  chemically synthesized
gattagatgctttcaagaaaca

SEQ ID NO: 877772 - DNA, 22 bp, Artificial Sequence
  chemically synthesized
tggattagatgctttcaagaaa

SEQ ID NO: 877773 - DNA, 22 bp, Artificial Sequence
  chemically synthesized
cattgactctgtttcttgaaag

SEQ ID NO: 877774 - DNA, 22 bp, Artificial Sequence
  chemically synthesized
ctggattagatgctttcaagaa

SEQ ID NO: 877775 - DNA, 22 bp, Artificial Sequence
  chemically synthesized
actctgtttcttgaaagcatct

SEQ ID NO: 877776 - DNA, 22 bp, Artificial Sequence
  chemically synthesized
tgtttcttgaaagcatctaatc

SEQ ID NO: 877777 - DNA, 22 bp, Artificial Sequence
  chemically synthesized
tttcttgaaagcatctaatcca

SEQ ID NO: 877778 - DNA, 22 bp, Artificial Sequence
  chemically synthesized
cttgaaagcatctaatccagaa

SEQ ID NO: 877779 - DNA, 22 bp, Artificial Sequence
  chemically synthesized
ttgaaagcatctaatccagaaa

SEQ ID NO: 877780 - DNA, 22 bp, Artificial Sequence
  chemically synthesized
gaaagcatctaatccagaaatg

SEQ ID NO: 877781 - DNA, 22 bp, Artificial Sequence
  chemically synthesized
aaagcatctaatccagaaatgg

SEQ ID NO: 877782 - DNA, 22 bp, Artificial Sequence
  chemically synthesized
agaaagtagaagccatttctgg

SEQ ID NO: 877783 - DNA, 22 bp, Artificial Sequence
  chemically synthesized
atccagaaatggcttctacttt

SEQ ID NO: 877784 - DNA, 22 bp, Artificial Sequence
  chemically synthesized
aggaggaattcagaaagtagaa

SEQ ID NO: 877785 - DNA, 22 bp, Artificial Sequence
  chemically synthesized
taaggaggaattcagaaagtag

SEQ ID NO: 877786 - DNA, 22 bp, Artificial Sequence
  chemically synthesized
catgattctaaggaggaattca

SEQ ID NO: 877787 - DNA, 22 bp, Artificial Sequence
  chemically synthesized
ctactttctgaattcctcctta

SEQ ID NO: 877788 - DNA, 22 bp, Artificial Sequence
  chemically synthesized
gctgcatgattctaaggaggaa

SEQ ID NO: 877789 - DNA, 22 bp, Artificial Sequence
  chemically synthesized
tactttctgaattcctccttag

SEQ ID NO: 877790 - DNA, 22 bp, Artificial Sequence
  chemically synthesized
ctttctgaattcctccttagaa

SEQ ID NO: 877791 - DNA, 22 bp, Artificial Sequence
  chemically synthesized
agctggctgcatgattctaagg

SEQ ID NO: 877792 - DNA, 22 bp, Artificial Sequence
  chemically synthesized
tctgaattcctccttagaatca

SEQ ID NO: 877793 - DNA, 22 bp, Artificial Sequence
  chemically synthesized
ctgaattcctccttagaatcat

SEQ ID NO: 877794 - DNA, 22 bp, Artificial Sequence
  chemically synthesized
tgaattcctccttagaatcatg

SEQ ID NO: 877795 - DNA, 22 bp, Artificial Sequence
  chemically synthesized
aattcctccttagaatcatgca

SEQ ID NO: 877796 - DNA, 22 bp, Artificial Sequence
  chemically synthesized
cagagttcagctggctgcatga

SEQ ID NO: 877797 - DNA, 22 bp, Artificial Sequence
  chemically synthesized
acagagttcagctggctgcatg

SEQ ID NO: 877798 - DNA, 22 bp, Artificial Sequence
  chemically synthesized
ctccttagaatcatgcagccag

SEQ ID NO: 877799 - DNA, 22 bp, Artificial Sequence
  chemically synthesized
ttacagagttcagctggctgca

SEQ ID NO: 877800 - DNA, 22 bp, Artificial Sequence
  chemically synthesized
cttacagagttcagctggctgc

SEQ ID NO: 877801 - DNA, 22 bp, Artificial Sequence
  chemically synthesized
cttagaatcatgcagccagctg

SEQ ID NO: 877802 - DNA, 22 bp, Artificial Sequence
  chemically synthesized
agaatcatgcagccagctgaac

SEQ ID NO: 877803 - DNA, 22 bp, Artificial Sequence
  chemically synthesized
gaatcatgcagccagctgaact

SEQ ID NO: 877804 - DNA, 22 bp, Artificial Sequence
  chemically synthesized
gaaaaagcttcttacagagttc

SEQ ID NO: 877805 - DNA, 22 bp, Artificial Sequence
  chemically synthesized
aactctgtaagaagctttttcc

SEQ ID NO: 877806 - DNA, 22 bp, Artificial Sequence
  chemically synthesized
agtaagagggcattggaaaaag

SEQ ID NO: 877807 - DNA, 22 bp, Artificial Sequence
  chemically synthesized
tgtaagaagctttttccaatgc

SEQ ID NO: 877808 - DNA, 22 bp, Artificial Sequence
  chemically synthesized
taagaagctttttccaatgccc

SEQ ID NO: 877809 - DNA, 22 bp, Artificial Sequence
  chemically synthesized
tttccaatgccctcttactgag

SEQ ID NO: 877810 - DNA, 22 bp, Artificial Sequence
  chemically synthesized
ttccaatgccctcttactgaga

SEQ ID NO: 877811 - DNA, 22 bp, Artificial Sequence
  chemically synthesized
agagtgtgggcatctcagtaag

SEQ ID NO: 877812 - DNA, 22 bp, Artificial Sequence
  chemically synthesized
tccaatgccctcttactgagat

SEQ ID NO: 877813 - DNA, 22 bp, Artificial Sequence
  chemically synthesized
cagagtgtgggcatctcagtaa

SEQ ID NO: 877814 - DNA, 22 bp, Artificial Sequence
  chemically synthesized
ccaatgccctcttactgagatg

SEQ ID NO: 877815 - DNA, 22 bp, Artificial Sequence
  chemically synthesized
caatgccctcttactgagatgc

SEQ ID NO: 877816 - DNA, 22 bp, Artificial Sequence
  chemically synthesized
ttactgagatgcccacactctg

SEQ ID NO: 877817 - DNA, 22 bp, Artificial Sequence
  chemically synthesized
actgagatgcccacactctgaa

SEQ ID NO: 877818 - DNA, 22 bp, Artificial Sequence
  chemically synthesized
ctgagatgcccacactctgaag

SEQ ID NO: 877819 - DNA, 22 bp, Artificial Sequence
  chemically synthesized
agatgcccacactctgaagtgt

SEQ ID NO: 877820 - DNA, 22 bp, Artificial Sequence
  chemically synthesized
cagcaagagcgtaaaacacttc

SEQ ID NO: 877821 - DNA, 22 bp, Artificial Sequence
  chemically synthesized
ttgcagcaagagcgtaaaacac

SEQ ID NO: 877822 - DNA, 22 bp, Artificial Sequence
  chemically synthesized
attgcagcaagagcgtaaaaca

SEQ ID NO: 877823 - DNA, 22 bp, Artificial Sequence
  chemically synthesized
ccttattgcagcaagagcgtaa

SEQ ID NO: 877824 - DNA, 22 bp, Artificial Sequence
  chemically synthesized
accttattgcagcaagagcgta

SEQ ID NO: 877825 - DNA, 22 bp, Artificial Sequence
  chemically synthesized
tgaagtgttttacgctcttgct

SEQ ID NO: 877826 - DNA, 22 bp, Artificial Sequence
  chemically synthesized
aagtgttttacgctcttgctgc

SEQ ID NO: 877827 - DNA, 22 bp, Artificial Sequence
  chemically synthesized
agaatatttaccttattgcagc

SEQ ID NO: 877828 - DNA, 22 bp, Artificial Sequence
  chemically synthesized
tacgctcttgctgcaataaggt

SEQ ID NO: 877829 - DNA, 22 bp, Artificial Sequence
  chemically synthesized
acgctcttgctgcaataaggta

SEQ ID NO: 877830 - DNA, 22 bp, Artificial Sequence
  chemically synthesized
cgctcttgctgcaataaggtaa

SEQ ID NO: 877831 - DNA, 22 bp, Artificial Sequence
  chemically synthesized
ttgctgcaataaggtaaatatt

SEQ ID NO: 877832 - DNA, 22 bp, Artificial Sequence
  chemically synthesized
gctgcaataaggtaaatattct

SEQ ID NO: 877833 - DNA, 22 bp, Artificial Sequence
  chemically synthesized
ctgcaataaggtaaatattctt

SEQ ID NO: 877834 - DNA, 22 bp, Artificial Sequence
  chemically synthesized
taatcaaaaaattaagaatatt

SEQ ID NO: 877835 - DNA, 22 bp, Artificial Sequence
  chemically synthesized
caataaggtaaatattcttaat

SEQ ID NO: 877836 - DNA, 22 bp, Artificial Sequence
  chemically synthesized
caagcaacatatctgtaatcaa

SEQ ID NO: 877837 - DNA, 22 bp, Artificial Sequence
  chemically synthesized
ttaattttttgattacagatat

SEQ ID NO: 877838 - DNA, 22 bp, Artificial Sequence
  chemically synthesized
aattttttgattacagatatgt

SEQ ID NO: 877839 - DNA, 22 bp, Artificial Sequence
  chemically synthesized
attttttgattacagatatgtt

SEQ ID NO: 877840 - DNA, 22 bp, Artificial Sequence
  chemically synthesized
gccaagattacaagcaacatat

SEQ ID NO: 877841 - DNA, 22 bp, Artificial Sequence
  chemically synthesized
tttgattacagatatgttgctt

SEQ ID NO: 877842 - DNA, 22 bp, Artificial Sequence
  chemically synthesized
ttgattacagatatgttgcttg

SEQ ID NO: 877843 - DNA, 22 bp, Artificial Sequence
  chemically synthesized
tggccaagattacaagcaacat

SEQ ID NO: 877844 - DNA, 22 bp, Artificial Sequence
  chemically synthesized
tgattacagatatgttgcttgt

SEQ ID NO: 877845 - DNA, 22 bp, Artificial Sequence
  chemically synthesized
gattacagatatgttgcttgta

SEQ ID NO: 877846 - DNA, 22 bp, Artificial Sequence
  chemically synthesized
attacagatatgttgcttgtaa

SEQ ID NO: 877847 - DNA, 22 bp, Artificial Sequence
  chemically synthesized
cagatatgttgcttgtaatctt

SEQ ID NO: 877848 - DNA, 22 bp, Artificial Sequence
  chemically synthesized
aaagccctctggccaagattac

SEQ ID NO: 877849 - DNA, 22 bp, Artificial Sequence
  chemically synthesized
tgaaagccctctggccaagatt

SEQ ID NO: 877850 - DNA, 22 bp, Artificial Sequence
  chemically synthesized
cttgtaatcttggccagagggc

SEQ ID NO: 877851 - DNA, 22 bp, Artificial Sequence
  chemically synthesized
gtaatcttggccagagggcttt

SEQ ID NO: 877852 - DNA, 22 bp, Artificial Sequence
  chemically synthesized
cataatactctgaaagccctct

SEQ ID NO: 877853 - DNA, 22 bp, Artificial Sequence
  chemically synthesized
taatcttggccagagggctttc

SEQ ID NO: 877854 - DNA, 22 bp, Artificial Sequence
  chemically synthesized
ggccagagggctttcagagtat

SEQ ID NO: 877855 - DNA, 22 bp, Artificial Sequence
  chemically synthesized
aatccctacataatactctgaa

SEQ ID NO: 877856 - DNA, 22 bp, Artificial Sequence
  chemically synthesized
gccagagggctttcagagtatt

SEQ ID NO: 877857 - DNA, 22 bp, Artificial Sequence
  chemically synthesized
gaatccctacataatactctga

SEQ ID NO: 877858 - DNA, 22 bp, Artificial Sequence
  chemically synthesized
tttgaatccctacataatactc

SEQ ID NO: 877859 - DNA, 22 bp, Artificial Sequence
  chemically synthesized
tcagagtattatgtagggattc

SEQ ID NO: 877860 - DNA, 22 bp, Artificial Sequence
  chemically synthesized
cagagtattatgtagggattca

SEQ ID NO: 877861 - DNA, 22 bp, Artificial Sequence
  chemically synthesized
agagtattatgtagggattcaa

SEQ ID NO: 877862 - DNA, 22 bp, Artificial Sequence
  chemically synthesized
taatatggcattgtttgaatcc

SEQ ID NO: 877863 - DNA, 22 bp, Artificial Sequence
  chemically synthesized
gtaatatggcattgtttgaatc

SEQ ID NO: 877864 - DNA, 22 bp, Artificial Sequence
  chemically synthesized
tttgtaatatggcattgtttga

SEQ ID NO: 877865 - DNA, 22 bp, Artificial Sequence
  chemically synthesized
tgtagggattcaaacaatgcca

SEQ ID NO: 877866 - DNA, 22 bp, Artificial Sequence
  chemically synthesized
agttatttgtaatatggcattg

SEQ ID NO: 877867 - DNA, 22 bp, Artificial Sequence
  chemically synthesized
ctaagttatttgtaatatggca

SEQ ID NO: 877868 - DNA, 22 bp, Artificial Sequence
  chemically synthesized
gctaagttatttgtaatatggc

SEQ ID NO: 877869 - DNA, 22 bp, Artificial Sequence
  chemically synthesized
aaacaatgccatattacaaata

SEQ ID NO: 877870 - DNA, 22 bp, Artificial Sequence
  chemically synthesized
atcaccttgctaagttatttgt

SEQ ID NO: 877871 - DNA, 22 bp, Artificial Sequence
  chemically synthesized
tagagctcatcaccttgctaag

SEQ ID NO: 877872 - DNA, 22 bp, Artificial Sequence
  chemically synthesized
caaataacttagcaaggtgatg

SEQ ID NO: 877873 - DNA, 22 bp, Artificial Sequence
  chemically synthesized
gaattgtagagctcatcacctt

SEQ ID NO: 877874 - DNA, 22 bp, Artificial Sequence
  chemically synthesized
tagaattgtagagctcatcacc

SEQ ID NO: 877875 - DNA, 22 bp, Artificial Sequence
  chemically synthesized
agcaaggtgatgagctctacaa

SEQ ID NO: 877876 - DNA, 22 bp, Artificial Sequence
  chemically synthesized
gcaaggtgatgagctctacaat

SEQ ID NO: 877877 - DNA, 22 bp, Artificial Sequence
  chemically synthesized
gtatgtatattctagaattgta

SEQ ID NO: 877878 - DNA, 22 bp, Artificial Sequence
  chemically synthesized
cgtatgtatattctagaattgt

SEQ ID NO: 877879 - DNA, 22 bp, Artificial Sequence
  chemically synthesized
aaacccttcgtatgtatattct

SEQ ID NO: 877880 - DNA, 22 bp, Artificial Sequence
  chemically synthesized
tacaattctagaatatacatac

SEQ ID NO: 877881 - DNA, 22 bp, Artificial Sequence
  chemically synthesized
attcaaacccttcgtatgtata

SEQ ID NO: 877882 - DNA, 22 bp, Artificial Sequence
  chemically synthesized
caattctagaatatacatacga

SEQ ID NO: 877883 - DNA, 22 bp, Artificial Sequence
  chemically synthesized
cattcaaacccttcgtatgtat

SEQ ID NO: 877884 - DNA, 22 bp, Artificial Sequence
  chemically synthesized
tagaatatacatacgaagggtt

SEQ ID NO: 877885 - DNA, 22 bp, Artificial Sequence
  chemically synthesized
gaatatacatacgaagggtttg

SEQ ID NO: 877886 - DNA, 22 bp, Artificial Sequence
  chemically synthesized
tgaaacaatttcattcaaaccc

SEQ ID NO: 877887 - DNA, 22 bp, Artificial Sequence
  chemically synthesized
atgaaacaatttcattcaaacc

SEQ ID NO: 877888 - DNA, 22 bp, Artificial Sequence
  chemically synthesized
tatgaaacaatttcattcaaac

SEQ ID NO: 877889 - DNA, 22 bp, Artificial Sequence
  chemically synthesized
tattttatgaaacaatttcatt

SEQ ID NO: 877890 - DNA, 22 bp, Artificial Sequence
  chemically synthesized
atattttatgaaacaatttcat

SEQ ID NO: 877891 - DNA, 22 bp, Artificial Sequence
  chemically synthesized
gcacatttatattttatgaaac

SEQ ID NO: 877892 - DNA, 22 bp, Artificial Sequence
  chemically synthesized
gaatgaaattgtttcataaaat

SEQ ID NO: 877893 - DNA, 22 bp, Artificial Sequence
  chemically synthesized
aatgaaattgtttcataaaata

SEQ ID NO: 877894 - DNA, 22 bp, Artificial Sequence
  chemically synthesized
gaaatacctggcacatttatat

SEQ ID NO: 877895 - DNA, 22 bp, Artificial Sequence
  chemically synthesized
agaaatacctggcacatttata

SEQ ID NO: 877896 - DNA, 22 bp, Artificial Sequence
  chemically synthesized
tttcataaaatataaatgtgcc

SEQ ID NO: 877897 - DNA, 22 bp, Artificial Sequence
  chemically synthesized
atttagaaatacctggcacatt

SEQ ID NO: 877898 - DNA, 22 bp, Artificial Sequence
  chemically synthesized
cataaaatataaatgtgccagg

SEQ ID NO: 877899 - DNA, 22 bp, Artificial Sequence
  chemically synthesized
ataaaatataaatgtgccaggt

SEQ ID NO: 877900 - DNA, 22 bp, Artificial Sequence
  chemically synthesized
taaaataacacactcatttaga

SEQ ID NO: 877901 - DNA, 22 bp, Artificial Sequence
  chemically synthesized
ataaaataacacactcatttag

SEQ ID NO: 877902 - DNA, 22 bp, Artificial Sequence
  chemically synthesized
tataaaataacacactcattta

SEQ ID NO: 877903 - DNA, 22 bp, Artificial Sequence
  chemically synthesized
cattttataaaataacacactc

SEQ ID NO: 877904 - DNA, 22 bp, Artificial Sequence
  chemically synthesized
acattttataaaataacacact

SEQ ID NO: 877905 - DNA, 22 bp, Artificial Sequence
  chemically synthesized
ctaaatgagtgtgttattttat

SEQ ID NO: 877906 - DNA, 22 bp, Artificial Sequence
  chemically synthesized
taaatgagtgtgttattttata

SEQ ID NO: 877907 - DNA, 22 bp, Artificial Sequence
  chemically synthesized
cagtcttacattttataaaata

SEQ ID NO: 877908 - DNA, 22 bp, Artificial Sequence
  chemically synthesized
aatgagtgtgttattttataaa

SEQ ID NO: 877909 - DNA, 22 bp, Artificial Sequence
  chemically synthesized
gcagtcttacattttataaaat

SEQ ID NO: 877910 - DNA, 22 bp, Artificial Sequence
  chemically synthesized
catatttgcagtcttacatttt

SEQ ID NO: 877911 - DNA, 22 bp, Artificial Sequence
  chemically synthesized
ccatatttgcagtcttacattt

SEQ ID NO: 877912 - DNA, 22 bp, Artificial Sequence
  chemically synthesized
ttttataaaatgtaagactgca

SEQ ID NO: 877913 - DNA, 22 bp, Artificial Sequence
  chemically synthesized
tataaaatgtaagactgcaaat

SEQ ID NO: 877914 - DNA, 22 bp, Artificial Sequence
  chemically synthesized
ataaaatgtaagactgcaaata

SEQ ID NO: 877915 - DNA, 22 bp, Artificial Sequence
  chemically synthesized
taaaatgtaagactgcaaatat

SEQ ID NO: 877916 - DNA, 22 bp, Artificial Sequence
  chemically synthesized
agtagcatttccatatttgcag

SEQ ID NO: 877917 - DNA, 22 bp, Artificial Sequence
  chemically synthesized
attgagtagcatttccatattt

SEQ ID NO: 877918 - DNA, 22 bp, Artificial Sequence
  chemically synthesized
aattgagtagcatttccatatt

SEQ ID NO: 877919 - DNA, 22 bp, Artificial Sequence
  chemically synthesized
ttaattgagtagcatttccata

SEQ ID NO: 877920 - DNA, 22 bp, Artificial Sequence
  chemically synthesized
cttaattgagtagcatttccat

SEQ ID NO: 877921 - DNA, 22 bp, Artificial Sequence
  chemically synthesized
aatttcttaattgagtagcatt

SEQ ID NO: 877922 - DNA, 22 bp, Artificial Sequence
  chemically synthesized
caaatatggaaatgctactcaa

SEQ ID NO: 877923 - DNA, 22 bp, Artificial Sequence
  chemically synthesized
tattcaatttcttaattgagta

SEQ ID NO: 877924 - DNA, 22 bp, Artificial Sequence
  chemically synthesized
attatattcaatttcttaattg

SEQ ID NO: 877925 - DNA, 22 bp, Artificial Sequence
  chemically synthesized
ctcaattaagaaattgaatata

SEQ ID NO: 877926 - DNA, 22 bp, Artificial Sequence
  chemically synthesized
tcaaatgtctaattatattcaa

SEQ ID NO: 877927 - DNA, 22 bp, Artificial Sequence
  chemically synthesized
aattaagaaattgaatataatt

SEQ ID NO: 877928 - DNA, 22 bp, Artificial Sequence
  chemically synthesized
agaaattgaatataattagaca

SEQ ID NO: 877929 - DNA, 22 bp, Artificial Sequence
  chemically synthesized
aatataattagacatttgacaa

SEQ ID NO: 877930 - DNA, 22 bp, Artificial Sequence
  chemically synthesized
gaaatatggatgagattgtcaa

SEQ ID NO: 877931 - DNA, 22 bp, Artificial Sequence
  chemically synthesized
agaaatatggatgagattgtca

SEQ ID NO: 877932 - DNA, 22 bp, Artificial Sequence
  chemically synthesized
gacatttgacaatctcatccat

SEQ ID NO: 877933 - DNA, 22 bp, Artificial Sequence
  chemically synthesized
gacaatctcatccatatttcta

SEQ ID NO: 877934 - DNA, 22 bp, Artificial Sequence
  chemically synthesized
acaatctcatccatatttctaa

SEQ ID NO: 877935 - DNA, 22 bp, Artificial Sequence
  chemically synthesized
taaacataaacatttagaaata

SEQ ID NO: 877936 - DNA, 22 bp, Artificial Sequence
  chemically synthesized
gtaaacataaacatttagaaat

SEQ ID NO: 877937 - DNA, 22 bp, Artificial Sequence
  chemically synthesized
atccatatttctaaatgtttat

SEQ ID NO: 877938 - DNA, 22 bp, Artificial Sequence
  chemically synthesized
ggcaacttgtaaacataaacat

SEQ ID NO: 877939 - DNA, 22 bp, Artificial Sequence
  chemically synthesized
gggcaacttgtaaacataaaca

SEQ ID NO: 877940 - DNA, 22 bp, Artificial Sequence
  chemically synthesized
tgggcaacttgtaaacataaac

SEQ ID NO: 877941 - DNA, 22 bp, Artificial Sequence
  chemically synthesized
ttgggcaacttgtaaacataaa

SEQ ID NO: 877942 - DNA, 22 bp, Artificial Sequence
  chemically synthesized
ctaaatgtttatgtttacaagt

SEQ ID NO: 877943 - DNA, 22 bp, Artificial Sequence
  chemically synthesized
taaatgtttatgtttacaagtt

SEQ ID NO: 877944 - DNA, 22 bp, Artificial Sequence
  chemically synthesized
aatgtttatgtttacaagttgc

SEQ ID NO: 877945 - DNA, 22 bp, Artificial Sequence
  chemically synthesized
taatagatttttgggcaacttg

SEQ ID NO: 877946 - DNA, 22 bp, Artificial Sequence
  chemically synthesized
ataatagatttttgggcaactt

SEQ ID NO: 877947 - DNA, 22 bp, Artificial Sequence
  chemically synthesized
atgtttacaagttgcccaaaaa

SEQ ID NO: 877948 - DNA, 22 bp, Artificial Sequence
  chemically synthesized
tgtttacaagttgcccaaaaat

SEQ ID NO: 877949 - DNA, 22 bp, Artificial Sequence
  chemically synthesized
acaagttgcccaaaaatctatt

SEQ ID NO: 877950 - DNA, 22 bp, Artificial Sequence
  chemically synthesized
caagttgcccaaaaatctatta

SEQ ID NO: 877951 - DNA, 22 bp, Artificial Sequence
  chemically synthesized
cccaaaaatctattataaattt

SEQ ID NO: 877952 - DNA, 22 bp, Artificial Sequence
  chemically synthesized
ccaatgagaagagaaaaaattt

SEQ ID NO: 877953 - DNA, 22 bp, Artificial Sequence
  chemically synthesized
cccaatgagaagagaaaaaatt

SEQ ID NO: 877954 - DNA, 22 bp, Artificial Sequence
  chemically synthesized
tcccaatgagaagagaaaaaat

SEQ ID NO: 877955 - DNA, 22 bp, Artificial Sequence
  chemically synthesized
actttcccaatgagaagagaaa

SEQ ID NO: 877956 - DNA, 22 bp, Artificial Sequence
  chemically synthesized
cactttcccaatgagaagagaa

SEQ ID NO: 877957 - DNA, 22 bp, Artificial Sequence
  chemically synthesized
ttataaattttttctcttctca

SEQ ID NO: 877958 - DNA, 22 bp, Artificial Sequence
  chemically synthesized
taaattttttctcttctcattg

SEQ ID NO: 877959 - DNA, 22 bp, Artificial Sequence
  chemically synthesized
aggagagcttcactttcccaat

SEQ ID NO: 877960 - DNA, 22 bp, Artificial Sequence
  chemically synthesized
tttctcttctcattgggaaagt

SEQ ID NO: 877961 - DNA, 22 bp, Artificial Sequence
  chemically synthesized
gaggagagcttcactttcccaa

SEQ ID NO: 877962 - DNA, 22 bp, Artificial Sequence
  chemically synthesized
ttctcttctcattgggaaagtg

SEQ ID NO: 877963 - DNA, 22 bp, Artificial Sequence
  chemically synthesized
tctcttctcattgggaaagtga

SEQ ID NO: 877964 - DNA, 22 bp, Artificial Sequence
  chemically synthesized
ctcttctcattgggaaagtgaa

SEQ ID NO: 877965 - DNA, 22 bp, Artificial Sequence
  chemically synthesized
tcttctcattgggaaagtgaag

SEQ ID NO: 877966 - DNA, 22 bp, Artificial Sequence
  chemically synthesized
ttctcattgggaaagtgaagct

SEQ ID NO: 877967 - DNA, 22 bp, Artificial Sequence
  chemically synthesized
ctcattgggaaagtgaagctct

SEQ ID NO: 877968 - DNA, 22 bp, Artificial Sequence
  chemically synthesized
tcattgggaaagtgaagctctc

SEQ ID NO: 877969 - DNA, 22 bp, Artificial Sequence
  chemically synthesized
attgggaaagtgaagctctcct

SEQ ID NO: 877970 - DNA, 22 bp, Artificial Sequence
  chemically synthesized
ggaaagtgaagctctcctcaag

SEQ ID NO: 877971 - DNA, 22 bp, Artificial Sequence
  chemically synthesized
atcccaatgcataaacttgagg

SEQ ID NO: 877972 - DNA, 22 bp, Artificial Sequence
  chemically synthesized
tcctcaagtttatgcattggga

SEQ ID NO: 877973 - DNA, 22 bp, Artificial Sequence
  chemically synthesized
aataaatgctaatcccaatgca

SEQ ID NO: 877974 - DNA, 22 bp, Artificial Sequence
  chemically synthesized
ctcaagtttatgcattgggatt

SEQ ID NO: 877975 - DNA, 22 bp, Artificial Sequence
  chemically synthesized
aagtttatgcattgggattagc

SEQ ID NO: 877976 - DNA, 22 bp, Artificial Sequence
  chemically synthesized
atgcattgggattagcatttat

SEQ ID NO: 877977 - DNA, 22 bp, Artificial Sequence
  chemically synthesized
tgcattgggattagcatttatt

SEQ ID NO: 877978 - DNA, 22 bp, Artificial Sequence
  chemically synthesized
gagtataagaggttgaataaat

SEQ ID NO: 877979 - DNA, 22 bp, Artificial Sequence
  chemically synthesized
ggagtataagaggttgaataaa

SEQ ID NO: 877980 - DNA, 22 bp, Artificial Sequence
  chemically synthesized
ggattagcatttattcaacctc

SEQ ID NO: 877981 - DNA, 22 bp, Artificial Sequence
  chemically synthesized
gcatttattcaacctcttatac

SEQ ID NO: 877982 - DNA, 22 bp, Artificial Sequence
  chemically synthesized
aaaaaaaagtcttggagtataa

SEQ ID NO: 877983 - DNA, 22 bp, Artificial Sequence
  chemically synthesized
attcaacctcttatactccaag

SEQ ID NO: 877984 - DNA, 22 bp, Artificial Sequence
  chemically synthesized
ttcaacctcttatactccaaga

SEQ ID NO: 877985 - DNA, 22 bp, Artificial Sequence
  chemically synthesized
aacctcttatactccaagactt

SEQ ID NO: 877986 - DNA, 22 bp, Artificial Sequence
  chemically synthesized
caactgaaaaaaaagtcttgga

SEQ ID NO: 877987 - DNA, 22 bp, Artificial Sequence
  chemically synthesized
acaactgaaaaaaaagtcttgg

SEQ ID NO: 877988 - DNA, 22 bp, Artificial Sequence
  chemically synthesized
tacaactgaaaaaaaagtcttg

SEQ ID NO: 877989 - DNA, 22 bp, Artificial Sequence
  chemically synthesized
ctttacaactgaaaaaaaagtc

SEQ ID NO: 877990 - DNA, 22 bp, Artificial Sequence
  chemically synthesized
ttatactccaagactttttttt

SEQ ID NO: 877991 - DNA, 22 bp, Artificial Sequence
  chemically synthesized
gctttacaactgaaaaaaaagt

SEQ ID NO: 877992 - DNA, 22 bp, Artificial Sequence
  chemically synthesized
atactccaagacttttttttca

SEQ ID NO: 877993 - DNA, 22 bp, Artificial Sequence
  chemically synthesized
tactccaagacttttttttcag

SEQ ID NO: 877994 - DNA, 22 bp, Artificial Sequence
  chemically synthesized
caagacttttttttcagttgta

SEQ ID NO: 877995 - DNA, 22 bp, Artificial Sequence
  chemically synthesized
ttttttcagttgtaaagcaaac

SEQ ID NO: 877996 - DNA, 22 bp, Artificial Sequence
  chemically synthesized
tttttcagttgtaaagcaaact

SEQ ID NO: 877997 - DNA, 22 bp, Artificial Sequence
  chemically synthesized
ttttcagttgtaaagcaaactt

SEQ ID NO: 877998 - DNA, 22 bp, Artificial Sequence
  chemically synthesized
tttcagttgtaaagcaaacttg

SEQ ID NO: 877999 - DNA, 22 bp, Artificial Sequence
  chemically synthesized
ttcagttgtaaagcaaacttgt

SEQ ID NO: 878000 - DNA, 22 bp, Artificial Sequence
  chemically synthesized
tcagttgtaaagcaaacttgta

SEQ ID NO: 878001 - DNA, 22 bp, Artificial Sequence
  chemically synthesized
cagttgtaaagcaaacttgtat

SEQ ID NO: 878002 - DNA, 22 bp, Artificial Sequence
  chemically synthesized
agttgtaaagcaaacttgtatt

SEQ ID NO: 878003 - DNA, 22 bp, Artificial Sequence
  chemically synthesized
ataaataaataaataaatacaa

SEQ ID NO: 878004 - DNA, 22 bp, Artificial Sequence
  chemically synthesized
taaagcaaacttgtatttattt

SEQ ID NO: 878005 - DNA, 22 bp, Artificial Sequence
  chemically synthesized
catctcataaataaataaataa

SEQ ID NO: 878006 - DNA, 22 bp, Artificial Sequence
  chemically synthesized
gtatttatttatttatttatga

SEQ ID NO: 878007 - DNA, 22 bp, Artificial Sequence
  chemically synthesized
tatttatttatttatttatgag

SEQ ID NO: 878008 - DNA, 22 bp, Artificial Sequence
  chemically synthesized
atttatttatttatgagatgga

SEQ ID NO: 878009 - DNA, 22 bp, Artificial Sequence
  chemically synthesized
tttatttatttatgagatggag

SEQ ID NO: 878010 - DNA, 22 bp, Artificial Sequence
  chemically synthesized
atttatttatgagatggagtct

SEQ ID NO: 878011 - DNA, 22 bp, Artificial Sequence
  chemically synthesized
ggtgacagagtgagactccatc

SEQ ID NO: 878012 - DNA, 22 bp, Artificial Sequence
  chemically synthesized
tttatttatgagatggagtctc

SEQ ID NO: 878013 - DNA, 22 bp, Artificial Sequence
  chemically synthesized
atttatgagatggagtctcact

SEQ ID NO: 878014 - DNA, 22 bp, Artificial Sequence
  chemically synthesized
tttatgagatggagtctcactc

SEQ ID NO: 878015 - DNA, 22 bp, Artificial Sequence
  chemically synthesized
cagcctgggtgacagagtgaga

SEQ ID NO: 878016 - DNA, 22 bp, Artificial Sequence
  chemically synthesized
atgagatggagtctcactctgt

SEQ ID NO: 878017 - DNA, 22 bp, Artificial Sequence
  chemically synthesized
tgagatggagtctcactctgtc

SEQ ID NO: 878018 - DNA, 22 bp, Artificial Sequence
  chemically synthesized
cactccagcctgggtgacagag

SEQ ID NO: 878019 - DNA, 22 bp, Artificial Sequence
  chemically synthesized
actctgtcacccaggctggagt

SEQ ID NO: 878020 - DNA, 22 bp, Artificial Sequence
  chemically synthesized
agatcacgccactgcactccag

SEQ ID NO: 878021 - DNA, 22 bp, Artificial Sequence
  chemically synthesized
tgtcacccaggctggagtgcag

SEQ ID NO: 878022 - DNA, 22 bp, Artificial Sequence
  chemically synthesized
tcacccaggctggagtgcagtg

SEQ ID NO: 878023 - DNA, 22 bp, Artificial Sequence
  chemically synthesized
cagtgagctgagatcacgccac

SEQ ID NO: 878024 - DNA, 22 bp, Artificial Sequence
  chemically synthesized
gcagtgagctgagatcacgcca

SEQ ID NO: 878025 - DNA, 22 bp, Artificial Sequence
  chemically synthesized
gagtgcagtggcgtgatctcag

SEQ ID NO: 878026 - DNA, 22 bp, Artificial Sequence
  chemically synthesized
agctcactgcaagctctgcctc

SEQ ID NO: 878027 - DNA, 22 bp, Artificial Sequence
  chemically synthesized
actgcaagctctgcctcccggg

SEQ ID NO: 878028 - DNA, 22 bp, Artificial Sequence
  chemically synthesized
caagctctgcctcccgggttca

SEQ ID NO: 878029 - DNA, 22 bp, Artificial Sequence
  chemically synthesized
aggcaggagaatggcatgaacc

SEQ ID NO: 878030 - DNA, 22 bp, Artificial Sequence
  chemically synthesized
tgcctcccgggttcatgccatt

SEQ ID NO: 878031 - DNA, 22 bp, Artificial Sequence
  chemically synthesized
cctcccgggttcatgccattct

SEQ ID NO: 878032 - DNA, 22 bp, Artificial Sequence
  chemically synthesized
ccgggttcatgccattctcctg

SEQ ID NO: 878033 - DNA, 22 bp, Artificial Sequence
  chemically synthesized
gggaggctgaggcaggagaatg

SEQ ID NO: 878034 - DNA, 22 bp, Artificial Sequence
  chemically synthesized
ctcgggaggctgaggcaggaga

SEQ ID NO: 878035 - DNA, 22 bp, Artificial Sequence
  chemically synthesized
atgccattctcctgcctcagcc

SEQ ID NO: 878036 - DNA, 22 bp, Artificial Sequence
  chemically synthesized
tagtcccagctactcgggaggc

SEQ ID NO: 878037 - DNA, 22 bp, Artificial Sequence
  chemically synthesized
tcctgcctcagcctcccgagta

SEQ ID NO: 878038 - DNA, 22 bp, Artificial Sequence
  chemically synthesized
ctgcctcagcctcccgagtagc

SEQ ID NO: 878039 - DNA, 22 bp, Artificial Sequence
  chemically synthesized
cctcagcctcccgagtagctgg

SEQ ID NO: 878040 - DNA, 22 bp, Artificial Sequence
  chemically synthesized
agcctcccgagtagctgggact

SEQ ID NO: 878041 - DNA, 22 bp, Artificial Sequence
  chemically synthesized
gtggcaggcatctgtagtccca

SEQ ID NO: 878042 - DNA, 22 bp, Artificial Sequence
  chemically synthesized
ggtggcaggcatctgtagtccc

SEQ ID NO: 878043 - DNA, 22 bp, Artificial Sequence
  chemically synthesized
ccgagtagctgggactacagat

SEQ ID NO: 878044 - DNA, 22 bp, Artificial Sequence
  chemically synthesized
gccgggcttggtggcaggcatc

SEQ ID NO: 878045 - DNA, 22 bp, Artificial Sequence
  chemically synthesized
ggactacagatgcctgccacca

SEQ ID NO: 878046 - DNA, 22 bp, Artificial Sequence
  chemically synthesized
cagatgcctgccaccaagcccg

SEQ ID NO: 878047 - DNA, 22 bp, Artificial Sequence
  chemically synthesized
ccaccaagcccggctaattttg

SEQ ID NO: 878048 - DNA, 22 bp, Artificial Sequence
  chemically synthesized
aaaatacaaaaacaaaattagc

SEQ ID NO: 878049 - DNA, 22 bp, Artificial Sequence
  chemically synthesized
ctaaaaatacaaaaacaaaatt

SEQ ID NO: 878050 - DNA, 22 bp, Artificial Sequence
  chemically synthesized
tactaaaaatacaaaaacaaaa

SEQ ID NO: 878051 - DNA, 22 bp, Artificial Sequence
  chemically synthesized
attttgtttttgtatttttagt

SEQ ID NO: 878052 - DNA, 22 bp, Artificial Sequence
  chemically synthesized
tgtttttgtatttttagtagag

SEQ ID NO: 878053 - DNA, 22 bp, Artificial Sequence
  chemically synthesized
gtttttgtatttttagtagaga

SEQ ID NO: 878054 - DNA, 22 bp, Artificial Sequence
  chemically synthesized
tttttgtatttttagtagagat

SEQ ID NO: 878055 - DNA, 22 bp, Artificial Sequence
  chemically synthesized
ttgtatttttagtagagatggg

SEQ ID NO: 878056 - DNA, 22 bp, Artificial Sequence
  chemically synthesized
acatggtgaaaccccatctcta

SEQ ID NO: 878057 - DNA, 22 bp, Artificial Sequence
  chemically synthesized
tgtatttttagtagagatgggg

SEQ ID NO: 878058 - DNA, 22 bp, Artificial Sequence
  chemically synthesized
gtatttttagtagagatggggt

SEQ ID NO: 878059 - DNA, 22 bp, Artificial Sequence
  chemically synthesized
tatttttagtagagatggggtt

SEQ ID NO: 878060 - DNA, 22 bp, Artificial Sequence
  chemically synthesized
gctaacatggtgaaaccccatc

SEQ ID NO: 878061 - DNA, 22 bp, Artificial Sequence
  chemically synthesized
ttagtagagatggggtttcacc

SEQ ID NO: 878062 - DNA, 22 bp, Artificial Sequence
  chemically synthesized
tagtagagatggggtttcacca

SEQ ID NO: 878063 - DNA, 22 bp, Artificial Sequence
  chemically synthesized
agtagagatggggtttcaccat

SEQ ID NO: 878064 - DNA, 22 bp, Artificial Sequence
  chemically synthesized
gtagagatggggtttcaccatg

SEQ ID NO: 878065 - DNA, 22 bp, Artificial Sequence
  chemically synthesized
caccatgttagccaggatggtc

SEQ ID NO: 878066 - DNA, 22 bp, Artificial Sequence
  chemically synthesized
accatgttagccaggatggtct

SEQ ID NO: 878067 - DNA, 22 bp, Artificial Sequence
  chemically synthesized
gccaggatggtctcgatctcct

SEQ ID NO: 878068 - DNA, 22 bp, Artificial Sequence
  chemically synthesized
gatctcctgactttgtgatccg

SEQ ID NO: 878069 - DNA, 22 bp, Artificial Sequence
  chemically synthesized
ggaggccaaggtgggcggatca

SEQ ID NO: 878070 - DNA, 22 bp, Artificial Sequence
  chemically synthesized
gggaggccaaggtgggcggatc

SEQ ID NO: 878071 - DNA, 22 bp, Artificial Sequence
  chemically synthesized
tgggaggccaaggtgggcggat

SEQ ID NO: 878072 - DNA, 22 bp, Artificial Sequence
  chemically synthesized
ctgactttgtgatccgcccacc

SEQ ID NO: 878073 - DNA, 22 bp, Artificial Sequence
  chemically synthesized
actttgtgatccgcccaccttg

SEQ ID NO: 878074 - DNA, 22 bp, Artificial Sequence
  chemically synthesized
tgtgatccgcccaccttggcct

SEQ ID NO: 878075 - DNA, 22 bp, Artificial Sequence
  chemically synthesized
gtgatccgcccaccttggcctc

SEQ ID NO: 878076 - DNA, 22 bp, Artificial Sequence
  chemically synthesized
tgatccgcccaccttggcctcc

SEQ ID NO: 878077 - DNA, 22 bp, Artificial Sequence
  chemically synthesized
taataccagcactttgggaggc

SEQ ID NO: 878078 - DNA, 22 bp, Artificial Sequence
  chemically synthesized
gcgcctgtaataccagcacttt

SEQ ID NO: 878079 - DNA, 22 bp, Artificial Sequence
  chemically synthesized
ggcctcccaaagtgctggtatt

SEQ ID NO: 878080 - DNA, 22 bp, Artificial Sequence
  chemically synthesized
gcctcccaaagtgctggtatta

SEQ ID NO: 878081 - DNA, 22 bp, Artificial Sequence
  chemically synthesized
ccaaagtgctggtattacaggc

SEQ ID NO: 878082 - DNA, 22 bp, Artificial Sequence
  chemically synthesized
ggcgcggtggctcgcgcctgta

SEQ ID NO: 878083 - DNA, 22 bp, Artificial Sequence
  chemically synthesized
cgactgggcgcggtggctcgcg

SEQ ID NO: 878084 - DNA, 22 bp, Artificial Sequence
  chemically synthesized
gcgactgggcgcggtggctcgc

SEQ ID NO: 878085 - DNA, 22 bp, Artificial Sequence
  chemically synthesized
gtattacaggcgcgagccaccg

SEQ ID NO: 878086 - DNA, 22 bp, Artificial Sequence
  chemically synthesized
caggcgcgagccaccgcgccca

SEQ ID NO: 878087 - DNA, 22 bp, Artificial Sequence
  chemically synthesized
caagtttgcgactgggcgcggt

SEQ ID NO: 878088 - DNA, 22 bp, Artificial Sequence
  chemically synthesized
aattacaagtttgcgactgggc

SEQ ID NO: 878089 - DNA, 22 bp, Artificial Sequence
  chemically synthesized
aaattacaagtttgcgactggg

SEQ ID NO: 878090 - DNA, 22 bp, Artificial Sequence
  chemically synthesized
taaattacaagtttgcgactgg

SEQ ID NO: 878091 - DNA, 22 bp, Artificial Sequence
  chemically synthesized
ttaaattacaagtttgcgactg

SEQ ID NO: 878092 - DNA, 22 bp, Artificial Sequence
  chemically synthesized
tttaaattacaagtttgcgact

SEQ ID NO: 878093 - DNA, 22 bp, Artificial Sequence
  chemically synthesized
ttttaaattacaagtttgcgac

SEQ ID NO: 878094 - DNA, 22 bp, Artificial Sequence
  chemically synthesized
tttttttaaattacaagtttgc

SEQ ID NO: 878095 - DNA, 22 bp, Artificial Sequence
  chemically synthesized
atttttttaaattacaagtttg

SEQ ID NO: 878096 - DNA, 22 bp, Artificial Sequence
  chemically synthesized
tatttttttaaattacaagttt

SEQ ID NO: 878097 - DNA, 22 bp, Artificial Sequence
  chemically synthesized
gtaatttaaaaaaataaaatgt

SEQ ID NO: 878098 - DNA, 22 bp, Artificial Sequence
  chemically synthesized
taatttaaaaaaataaaatgtt

SEQ ID NO: 878099 - DNA, 22 bp, Artificial Sequence
  chemically synthesized
taagtaaatgcatagcaacatt

SEQ ID NO: 878100 - DNA, 22 bp, Artificial Sequence
  chemically synthesized
ataagtaaatgcatagcaacat

SEQ ID NO: 878101 - DNA, 22 bp, Artificial Sequence
  chemically synthesized
aaaaaaataaaatgttgctatg

SEQ ID NO: 878102 - DNA, 22 bp, Artificial Sequence
  chemically synthesized
aaaaaataaaatgttgctatgc

SEQ ID NO: 878103 - DNA, 22 bp, Artificial Sequence
  chemically synthesized
ataatttataagtaaatgcata

SEQ ID NO: 878104 - DNA, 22 bp, Artificial Sequence
  chemically synthesized
aataatttataagtaaatgcat

SEQ ID NO: 878105 - DNA, 22 bp, Artificial Sequence
  chemically synthesized
gaggcatttaataatttataag

SEQ ID NO: 878106 - DNA, 22 bp, Artificial Sequence
  chemically synthesized
ctatgcatttacttataaatta

SEQ ID NO: 878107 - DNA, 22 bp, Artificial Sequence
  chemically synthesized
tgcatttacttataaattatta

SEQ ID NO: 878108 - DNA, 22 bp, Artificial Sequence
  chemically synthesized
acttataaattattaaatgcct

SEQ ID NO: 878109 - DNA, 22 bp, Artificial Sequence
  chemically synthesized
cttataaattattaaatgcctc

SEQ ID NO: 878110 - DNA, 22 bp, Artificial Sequence
  chemically synthesized
ataaattattaaatgcctctaa

SEQ ID NO: 878111 - DNA, 22 bp, Artificial Sequence
  chemically synthesized
taaattattaaatgcctctaat

SEQ ID NO: 878112 - DNA, 22 bp, Artificial Sequence
  chemically synthesized
gaaagaagataacaatattaga

SEQ ID NO: 878113 - DNA, 22 bp, Artificial Sequence
  chemically synthesized
tagaaagaagataacaatatta

SEQ ID NO: 878114 - DNA, 22 bp, Artificial Sequence
  chemically synthesized
ttaaatgcctctaatattgtta

SEQ ID NO: 878115 - DNA, 22 bp, Artificial Sequence
  chemically synthesized
ctagaaagaagataacaatatt

SEQ ID NO: 878116 - DNA, 22 bp, Artificial Sequence
  chemically synthesized
aatgcctctaatattgttatct

SEQ ID NO: 878117 - DNA, 22 bp, Artificial Sequence
  chemically synthesized
taatattgttatcttctttcta

SEQ ID NO: 878118 - DNA, 22 bp, Artificial Sequence
  chemically synthesized
ggagaggacttctagaaagaag

SEQ ID NO: 878119 - DNA, 22 bp, Artificial Sequence
  chemically synthesized
atattgttatcttctttctaga

SEQ ID NO: 878120 - DNA, 22 bp, Artificial Sequence
  chemically synthesized
ttatcttctttctagaagtcct

SEQ ID NO: 878121 - DNA, 22 bp, Artificial Sequence
  chemically synthesized
tcttctttctagaagtcctctc

SEQ ID NO: 878122 - DNA, 22 bp, Artificial Sequence
  chemically synthesized
ctttctagaagtcctctcccaa

SEQ ID NO: 878123 - DNA, 22 bp, Artificial Sequence
  chemically synthesized
tttctagaagtcctctcccaac

SEQ ID NO: 878124 - DNA, 22 bp, Artificial Sequence
  chemically synthesized
tctagaagtcctctcccaactt

SEQ ID NO: 878125 - DNA, 22 bp, Artificial Sequence
  chemically synthesized
ctagaagtcctctcccaactta

SEQ ID NO: 878126 - DNA, 22 bp, Artificial Sequence
  chemically synthesized
tagaagtcctctcccaacttat

SEQ ID NO: 878127 - DNA, 22 bp, Artificial Sequence
  chemically synthesized
gaagtcctctcccaacttattc

SEQ ID NO: 878128 - DNA, 22 bp, Artificial Sequence
  chemically synthesized
catgccaataacaccagaataa

SEQ ID NO: 878129 - DNA, 22 bp, Artificial Sequence
  chemically synthesized
ccatgccaataacaccagaata

SEQ ID NO: 878130 - DNA, 22 bp, Artificial Sequence
  chemically synthesized
tcccaacttattctggtgttat

SEQ ID NO: 878131 - DNA, 22 bp, Artificial Sequence
  chemically synthesized
ccaacttattctggtgttattg

SEQ ID NO: 878132 - DNA, 22 bp, Artificial Sequence
  chemically synthesized
agcacaatttccatgccaataa

SEQ ID NO: 878133 - DNA, 22 bp, Artificial Sequence
  chemically synthesized
attctggtgttattggcatgga

SEQ ID NO: 878134 - DNA, 22 bp, Artificial Sequence
  chemically synthesized
ttgagcacaatttccatgccaa

SEQ ID NO: 878135 - DNA, 22 bp, Artificial Sequence
  chemically synthesized
ttctggtgttattggcatggaa

SEQ ID NO: 878136 - DNA, 22 bp, Artificial Sequence
  chemically synthesized
attgagcacaatttccatgcca

SEQ ID NO: 878137 - DNA, 22 bp, Artificial Sequence
  chemically synthesized
tggtgttattggcatggaaatt

SEQ ID NO: 878138 - DNA, 22 bp, Artificial Sequence
  chemically synthesized
atttattgagcacaatttccat

SEQ ID NO: 878139 - DNA, 22 bp, Artificial Sequence
  chemically synthesized
gtgttattggcatggaaattgt

SEQ ID NO: 878140 - DNA, 22 bp, Artificial Sequence
  chemically synthesized
actcatttattgagcacaattt

SEQ ID NO: 878141 - DNA, 22 bp, Artificial Sequence
  chemically synthesized
ttggcatggaaattgtgctcaa

SEQ ID NO: 878142 - DNA, 22 bp, Artificial Sequence
  chemically synthesized
actgactcatttattgagcaca

SEQ ID NO: 878143 - DNA, 22 bp, Artificial Sequence
  chemically synthesized
gactgactcatttattgagcac

SEQ ID NO: 878144 - DNA, 22 bp, Artificial Sequence
  chemically synthesized
gcatggaaattgtgctcaataa

SEQ ID NO: 878145 - DNA, 22 bp, Artificial Sequence
  chemically synthesized
tgactgactcatttattgagca

SEQ ID NO: 878146 - DNA, 22 bp, Artificial Sequence
  chemically synthesized
ttttgactgactcatttattga

SEQ ID NO: 878147 - DNA, 22 bp, Artificial Sequence
  chemically synthesized
tgctcaataaatgagtcagtca

SEQ ID NO: 878148 - DNA, 22 bp, Artificial Sequence
  chemically synthesized
aataaatgagtcagtcaaaata

SEQ ID NO: 878149 - DNA, 22 bp, Artificial Sequence
  chemically synthesized
aaatgaacaagtctattttgac

SEQ ID NO: 878150 - DNA, 22 bp, Artificial Sequence
  chemically synthesized
tcccctgaaatgaacaagtcta

SEQ ID NO: 878151 - DNA, 22 bp, Artificial Sequence
  chemically synthesized
gttcatttcaggggacaatttt

SEQ ID NO: 878152 - DNA, 22 bp, Artificial Sequence
  chemically synthesized
ttcatttcaggggacaattttt

SEQ ID NO: 878153 - DNA, 22 bp, Artificial Sequence
  chemically synthesized
atttcaggggacaatttttgtc

SEQ ID NO: 878154 - DNA, 22 bp, Artificial Sequence
  chemically synthesized
caggggacaatttttgtctgtt

SEQ ID NO: 878155 - DNA, 22 bp, Artificial Sequence
  chemically synthesized
aggggacaatttttgtctgtta

SEQ ID NO: 878156 - DNA, 22 bp, Artificial Sequence
  chemically synthesized
ttgtctgttatctctctattga

SEQ ID NO: 878157 - DNA, 22 bp, Artificial Sequence
  chemically synthesized
tagcaacagaaatcaatagaga

SEQ ID NO: 878158 - DNA, 22 bp, Artificial Sequence
  chemically synthesized
tgtctgttatctctctattgat

SEQ ID NO: 878159 - DNA, 22 bp, Artificial Sequence
  chemically synthesized
gtagcaacagaaatcaatagag

SEQ ID NO: 878160 - DNA, 22 bp, Artificial Sequence
  chemically synthesized
gtctgttatctctctattgatt

SEQ ID NO: 878161 - DNA, 22 bp, Artificial Sequence
  chemically synthesized
tctgttatctctctattgattt

SEQ ID NO: 878162 - DNA, 22 bp, Artificial Sequence
  chemically synthesized
acttgtagcaacagaaatcaat

SEQ ID NO: 878163 - DNA, 22 bp, Artificial Sequence
  chemically synthesized
cacttgtagcaacagaaatcaa

SEQ ID NO: 878164 - DNA, 22 bp, Artificial Sequence
  chemically synthesized
ttatctctctattgatttctgt

SEQ ID NO: 878165 - DNA, 22 bp, Artificial Sequence
  chemically synthesized
tctctctattgatttctgttgc

SEQ ID NO: 878166 - DNA, 22 bp, Artificial Sequence
  chemically synthesized
tctattgatttctgttgctaca

SEQ ID NO: 878167 - DNA, 22 bp, Artificial Sequence
  chemically synthesized
gtgtaacttcacttgtagcaac

SEQ ID NO: 878168 - DNA, 22 bp, Artificial Sequence
  chemically synthesized
tattgatttctgttgctacaag

SEQ ID NO: 878169 - DNA, 22 bp, Artificial Sequence
  chemically synthesized
ttgatttctgttgctacaagtg

SEQ ID NO: 878170 - DNA, 22 bp, Artificial Sequence
  chemically synthesized
cctggtgtaacttcacttgtag

SEQ ID NO: 878171 - DNA, 22 bp, Artificial Sequence
  chemically synthesized
acctggtgtaacttcacttgta

SEQ ID NO: 878172 - DNA, 22 bp, Artificial Sequence
  chemically synthesized
atttctgttgctacaagtgaag

SEQ ID NO: 878173 - DNA, 22 bp, Artificial Sequence
  chemically synthesized
atttacctggtgtaacttcact

SEQ ID NO: 878174 - DNA, 22 bp, Artificial Sequence
  chemically synthesized
ctgttgctacaagtgaagttac

SEQ ID NO: 878175 - DNA, 22 bp, Artificial Sequence
  chemically synthesized
tgttgctacaagtgaagttaca

SEQ ID NO: 878176 - DNA, 22 bp, Artificial Sequence
  chemically synthesized
ttgctacaagtgaagttacacc

SEQ ID NO: 878177 - DNA, 22 bp, Artificial Sequence
  chemically synthesized
ctacaagtgaagttacaccagg

SEQ ID NO: 878178 - DNA, 22 bp, Artificial Sequence
  chemically synthesized
caagtgaagttacaccaggtaa

SEQ ID NO: 878179 - DNA, 22 bp, Artificial Sequence
  chemically synthesized
ccatgcgtacaatctcatttac

SEQ ID NO: 878180 - DNA, 22 bp, Artificial Sequence
  chemically synthesized
caccaggtaaatgagattgtac

SEQ ID NO: 878181 - DNA, 22 bp, Artificial Sequence
  chemically synthesized
ataaatcatctgccatgcgtac

SEQ ID NO: 878182 - DNA, 22 bp, Artificial Sequence
  chemically synthesized
cataaatcatctgccatgcgta

SEQ ID NO: 878183 - DNA, 22 bp, Artificial Sequence
  chemically synthesized
gatttcataaatcatctgccat

SEQ ID NO: 878184 - DNA, 22 bp, Artificial Sequence
  chemically synthesized
ggatttcataaatcatctgcca

SEQ ID NO: 878185 - DNA, 22 bp, Artificial Sequence
  chemically synthesized
tacgcatggcagatgatttatg

SEQ ID NO: 878186 - DNA, 22 bp, Artificial Sequence
  chemically synthesized
aaacaatacttggatttcataa

SEQ ID NO: 878187 - DNA, 22 bp, Artificial Sequence
  chemically synthesized
aaaacaatacttggatttcata

SEQ ID NO: 878188 - DNA, 22 bp, Artificial Sequence
  chemically synthesized
cacttaaaacaatacttggatt

SEQ ID NO: 878189 - DNA, 22 bp, Artificial Sequence
  chemically synthesized
atgaaatccaagtattgtttta

SEQ ID NO: 878190 - DNA, 22 bp, Artificial Sequence
  chemically synthesized
tgaaatccaagtattgttttaa

SEQ ID NO: 878191 - DNA, 22 bp, Artificial Sequence
  chemically synthesized
ccgaaataaatataattacact

SEQ ID NO: 878192 - DNA, 22 bp, Artificial Sequence
  chemically synthesized
ttttaagtgtaattatatttat

SEQ ID NO: 878193 - DNA, 22 bp, Artificial Sequence
  chemically synthesized
taagtgtaattatatttatttc

SEQ ID NO: 878194 - DNA, 22 bp, Artificial Sequence
  chemically synthesized
aagtgtaattatatttatttcg

SEQ ID NO: 878195 - DNA, 22 bp, Artificial Sequence
  chemically synthesized
agtgtaattatatttatttcgg

SEQ ID NO: 878196 - DNA, 22 bp, Artificial Sequence
  chemically synthesized
gtcgaaatgttgccgaaataaa

SEQ ID NO: 878197 - DNA, 22 bp, Artificial Sequence
  chemically synthesized
attggtcgaaatgttgccgaaa

SEQ ID NO: 878198 - DNA, 22 bp, Artificial Sequence
  chemically synthesized
cattggtcgaaatgttgccgaa

SEQ ID NO: 878199 - DNA, 22 bp, Artificial Sequence
  chemically synthesized
tatttatttcggcaacatttcg

SEQ ID NO: 878200 - DNA, 22 bp, Artificial Sequence
  chemically synthesized
atttcggcaacatttcgaccaa

SEQ ID NO: 878201 - DNA, 22 bp, Artificial Sequence
  chemically synthesized
tttcggcaacatttcgaccaat

SEQ ID NO: 878202 - DNA, 22 bp, Artificial Sequence
  chemically synthesized
cggcaacatttcgaccaatgaa

SEQ ID NO: 878203 - DNA, 22 bp, Artificial Sequence
  chemically synthesized
ggcaacatttcgaccaatgaaa

SEQ ID NO: 878204 - DNA, 22 bp, Artificial Sequence
  chemically synthesized
cgaccaatgaaataccatttga

SEQ ID NO: 878205 - DNA, 22 bp, Artificial Sequence
  chemically synthesized
gaccaatgaaataccatttgac

SEQ ID NO: 878206 - DNA, 22 bp, Artificial Sequence
  chemically synthesized
tccacggtatagcaggtcaaat

SEQ ID NO: 878207 - DNA, 22 bp, Artificial Sequence
  chemically synthesized
atccacggtatagcaggtcaaa

SEQ ID NO: 878208 - DNA, 22 bp, Artificial Sequence
  chemically synthesized
aagatttatccacggtatagca

SEQ ID NO: 878209 - DNA, 22 bp, Artificial Sequence
  chemically synthesized
gacctgctataccgtggataaa

SEQ ID NO: 878210 - DNA, 22 bp, Artificial Sequence
  chemically synthesized
acctgctataccgtggataaat

SEQ ID NO: 878211 - DNA, 22 bp, Artificial Sequence
  chemically synthesized
ctataccgtggataaatcttga

SEQ ID NO: 878212 - DNA, 22 bp, Artificial Sequence
  chemically synthesized
taccgtggataaatcttgagat

SEQ ID NO: 878213 - DNA, 22 bp, Artificial Sequence
  chemically synthesized
acaaaagatgtgcatctcaaga

SEQ ID NO: 878214 - DNA, 22 bp, Artificial Sequence
  chemically synthesized
ctcacaaaagatgtgcatctca

SEQ ID NO: 878215 - DNA, 22 bp, Artificial Sequence
  chemically synthesized
atatattactcacaaaagatgt

SEQ ID NO: 878216 - DNA, 22 bp, Artificial Sequence
  chemically synthesized
aatatattactcacaaaagatg

SEQ ID NO: 878217 - DNA, 22 bp, Artificial Sequence
  chemically synthesized
taatatattactcacaaaagat

SEQ ID NO: 878218 - DNA, 22 bp, Artificial Sequence
  chemically synthesized
gagatgcacatcttttgtgagt

SEQ ID NO: 878219 - DNA, 22 bp, Artificial Sequence
  chemically synthesized
agatgcacatcttttgtgagta

SEQ ID NO: 878220 - DNA, 22 bp, Artificial Sequence
  chemically synthesized
acaatctttaatatattactca

SEQ ID NO: 878221 - DNA, 22 bp, Artificial Sequence
  chemically synthesized
cctaacaatctttaatatatta

SEQ ID NO: 878222 - DNA, 22 bp, Artificial Sequence
  chemically synthesized
gcctaacaatctttaatatatt

SEQ ID NO: 878223 - DNA, 22 bp, Artificial Sequence
  chemically synthesized
tgcctaacaatctttaatatat

SEQ ID NO: 878224 - DNA, 22 bp, Artificial Sequence
  chemically synthesized
ttgcctaacaatctttaatata

SEQ ID NO: 878225 - DNA, 22 bp, Artificial Sequence
  chemically synthesized
tttgcctaacaatctttaatat

SEQ ID NO: 878226 - DNA, 22 bp, Artificial Sequence
  chemically synthesized
ttgtgagtaatatattaaagat

SEQ ID NO: 878227 - DNA, 22 bp, Artificial Sequence
  chemically synthesized
tgtgagtaatatattaaagatt

SEQ ID NO: 878228 - DNA, 22 bp, Artificial Sequence
  chemically synthesized
gtgagtaatatattaaagattg

SEQ ID NO: 878229 - DNA, 22 bp, Artificial Sequence
  chemically synthesized
ttttttgcctaacaatctttaa

SEQ ID NO: 878230 - DNA, 22 bp, Artificial Sequence
  chemically synthesized
tgagtaatatattaaagattgt

SEQ ID NO: 878231 - DNA, 22 bp, Artificial Sequence
  chemically synthesized
attttttgcctaacaatcttta

SEQ ID NO: 878232 - DNA, 22 bp, Artificial Sequence
  chemically synthesized
gggtttattttttgcctaacaa

SEQ ID NO: 878233 - DNA, 22 bp, Artificial Sequence
  chemically synthesized
agggtttattttttgcctaaca

SEQ ID NO: 878234 - DNA, 22 bp, Artificial Sequence
  chemically synthesized
cttagggtttattttttgccta

SEQ ID NO: 878235 - DNA, 22 bp, Artificial Sequence
  chemically synthesized
ccttagggtttattttttgcct

SEQ ID NO: 878236 - DNA, 22 bp, Artificial Sequence
  chemically synthesized
aagattgttaggcaaaaaataa

SEQ ID NO: 878237 - DNA, 22 bp, Artificial Sequence
  chemically synthesized
aaaacttccttagggtttattt

SEQ ID NO: 878238 - DNA, 22 bp, Artificial Sequence
  chemically synthesized
aaaaacttccttagggtttatt

SEQ ID NO: 878239 - DNA, 22 bp, Artificial Sequence
  chemically synthesized
taaaaacttccttagggtttat

SEQ ID NO: 878240 - DNA, 22 bp, Artificial Sequence
  chemically synthesized
ttaggcaaaaaataaaccctaa

SEQ ID NO: 878241 - DNA, 22 bp, Artificial Sequence
  chemically synthesized
ttaaaaacttccttagggttta

SEQ ID NO: 878242 - DNA, 22 bp, Artificial Sequence
  chemically synthesized
ggcaaaaaataaaccctaagga

SEQ ID NO: 878243 - DNA, 22 bp, Artificial Sequence
  chemically synthesized
acatttttaaaaacttccttag

SEQ ID NO: 878244 - DNA, 22 bp, Artificial Sequence
  chemically synthesized
aacatttttaaaaacttcctta

SEQ ID NO: 878245 - DNA, 22 bp, Artificial Sequence
  chemically synthesized
aggaagtttttaaaaatgttaa

SEQ ID NO: 878246 - DNA, 22 bp, Artificial Sequence
  chemically synthesized
ccaacatcaacatcttaacatt

SEQ ID NO: 878247 - DNA, 22 bp, Artificial Sequence
  chemically synthesized
ctgccaacatcaacatcttaac

SEQ ID NO: 878248 - DNA, 22 bp, Artificial Sequence
  chemically synthesized
tactgccaacatcaacatctta

SEQ ID NO: 878249 - DNA, 22 bp, Artificial Sequence
  chemically synthesized
ttaaaaatgttaagatgttgat

SEQ ID NO: 878250 - DNA, 22 bp, Artificial Sequence
  chemically synthesized
taaaaatgttaagatgttgatg

SEQ ID NO: 878251 - DNA, 22 bp, Artificial Sequence
  chemically synthesized
ttctactgccaacatcaacatc

SEQ ID NO: 878252 - DNA, 22 bp, Artificial Sequence
  chemically synthesized
aaaaatgttaagatgttgatgt

SEQ ID NO: 878253 - DNA, 22 bp, Artificial Sequence
  chemically synthesized
gttctactgccaacatcaacat

SEQ ID NO: 878254 - DNA, 22 bp, Artificial Sequence
  chemically synthesized
aaaatgttaagatgttgatgtt

SEQ ID NO: 878255 - DNA, 22 bp, Artificial Sequence
  chemically synthesized
agatgttgatgttggcagtaga

SEQ ID NO: 878256 - DNA, 22 bp, Artificial Sequence
  chemically synthesized
ccaatgagtttgttctactgcc

SEQ ID NO: 878257 - DNA, 22 bp, Artificial Sequence
  chemically synthesized
tcccaatgagtttgttctactg

SEQ ID NO: 878258 - DNA, 22 bp, Artificial Sequence
  chemically synthesized
ctcccaatgagtttgttctact

SEQ ID NO: 878259 - DNA, 22 bp, Artificial Sequence
  chemically synthesized
tctcccaatgagtttgttctac

SEQ ID NO: 878260 - DNA, 22 bp, Artificial Sequence
  chemically synthesized
ttctcccaatgagtttgttcta

SEQ ID NO: 878261 - DNA, 22 bp, Artificial Sequence
  chemically synthesized
tttctcccaatgagtttgttct

SEQ ID NO: 878262 - DNA, 22 bp, Artificial Sequence
  chemically synthesized
atgttggcagtagaacaaactc

SEQ ID NO: 878263 - DNA, 22 bp, Artificial Sequence
  chemically synthesized
ttttctcccaatgagtttgttc

SEQ ID NO: 878264 - DNA, 22 bp, Artificial Sequence
  chemically synthesized
tttttctcccaatgagtttgtt

SEQ ID NO: 878265 - DNA, 22 bp, Artificial Sequence
  chemically synthesized
ttttttctcccaatgagtttgt

SEQ ID NO: 878266 - DNA, 22 bp, Artificial Sequence
  chemically synthesized
tttttttttctcccaatgagtt

SEQ ID NO: 878267 - DNA, 22 bp, Artificial Sequence
  chemically synthesized
gcagtagaacaaactcattggg

SEQ ID NO: 878268 - DNA, 22 bp, Artificial Sequence
  chemically synthesized
gatgaagctgtttttttttctc

SEQ ID NO: 878269 - DNA, 22 bp, Artificial Sequence
  chemically synthesized
actagatgaagctgtttttttt

SEQ ID NO: 878270 - DNA, 22 bp, Artificial Sequence
  chemically synthesized
attgggagaaaaaaaaacagct

SEQ ID NO: 878271 - DNA, 22 bp, Artificial Sequence
  chemically synthesized
attaactagatgaagctgtttt

SEQ ID NO: 878272 - DNA, 22 bp, Artificial Sequence
  chemically synthesized
ggagaaaaaaaaacagcttcat

SEQ ID NO: 878273 - DNA, 22 bp, Artificial Sequence
  chemically synthesized
ttaattaactagatgaagctgt

SEQ ID NO: 878274 - DNA, 22 bp, Artificial Sequence
  chemically synthesized
ttgttaattaactagatgaagc

SEQ ID NO: 878275 - DNA, 22 bp, Artificial Sequence
  chemically synthesized
gttgttaattaactagatgaag

SEQ ID NO: 878276 - DNA, 22 bp, Artificial Sequence
  chemically synthesized
tgttgttaattaactagatgaa

SEQ ID NO: 878277 - DNA, 22 bp, Artificial Sequence
  chemically synthesized
ttttgttgttaattaactagat

SEQ ID NO: 878278 - DNA, 22 bp, Artificial Sequence
  chemically synthesized
ccagctgttttgttgttaatta

SEQ ID NO: 878279 - DNA, 22 bp, Artificial Sequence
  chemically synthesized
cccagctgttttgttgttaatt

SEQ ID NO: 878280 - DNA, 22 bp, Artificial Sequence
  chemically synthesized
tcccagctgttttgttgttaat

SEQ ID NO: 878281 - DNA, 22 bp, Artificial Sequence
  chemically synthesized
catctagttaattaacaacaaa

SEQ ID NO: 878282 - DNA, 22 bp, Artificial Sequence
  chemically synthesized
atctagttaattaacaacaaaa

SEQ ID NO: 878283 - DNA, 22 bp, Artificial Sequence
  chemically synthesized
attttcccagctgttttgttgt

SEQ ID NO: 878284 - DNA, 22 bp, Artificial Sequence
  chemically synthesized
gttaattaacaacaaaacagct

SEQ ID NO: 878285 - DNA, 22 bp, Artificial Sequence
  chemically synthesized
attaacaacaaaacagctggga

SEQ ID NO: 878286 - DNA, 22 bp, Artificial Sequence
  chemically synthesized
acaacaaaacagctgggaaaat

SEQ ID NO: 878287 - DNA, 22 bp, Artificial Sequence
  chemically synthesized
cagtcagtcacaaccagggatg

SEQ ID NO: 878288 - DNA, 22 bp, Artificial Sequence
  chemically synthesized
ggaaaatgaatcatccctggtt

SEQ ID NO: 878289 - DNA, 22 bp, Artificial Sequence
  chemically synthesized
aattacagtcagtcacaaccag

SEQ ID NO: 878290 - DNA, 22 bp, Artificial Sequence
  chemically synthesized
caattacagtcagtcacaacca

SEQ ID NO: 878291 - DNA, 22 bp, Artificial Sequence
  chemically synthesized
tcaattacagtcagtcacaacc

SEQ ID NO: 878292 - DNA, 22 bp, Artificial Sequence
  chemically synthesized
gtcattttcaattacagtcagt

SEQ ID NO: 878293 - DNA, 22 bp, Artificial Sequence
  chemically synthesized
gttgtgactgactgtaattgaa

SEQ ID NO: 878294 - DNA, 22 bp, Artificial Sequence
  chemically synthesized
tgactgactgtaattgaaaatg

SEQ ID NO: 878295 - DNA, 22 bp, Artificial Sequence
  chemically synthesized
actgtaattgaaaatgactaat

SEQ ID NO: 878296 - DNA, 22 bp, Artificial Sequence
  chemically synthesized
caaaatgacagcatcattagtc

SEQ ID NO: 878297 - DNA, 22 bp, Artificial Sequence
  chemically synthesized
taattgaaaatgactaatgatg

SEQ ID NO: 878298 - DNA, 22 bp, Artificial Sequence
  chemically synthesized
aaaatgactaatgatgctgtca

SEQ ID NO: 878299 - DNA, 22 bp, Artificial Sequence
  chemically synthesized
agatatgaactgcaaaatgaca

SEQ ID NO: 878300 - DNA, 22 bp, Artificial Sequence
  chemically synthesized
ctcagatatgaactgcaaaatg

SEQ ID NO: 878301 - DNA, 22 bp, Artificial Sequence
  chemically synthesized
cctcagatatgaactgcaaaat

SEQ ID NO: 878302 - DNA, 22 bp, Artificial Sequence
  chemically synthesized
atgatgctgtcattttgcagtt

SEQ ID NO: 878303 - DNA, 22 bp, Artificial Sequence
  chemically synthesized
tcattttgcagttcatatctga

SEQ ID NO: 878304 - DNA, 22 bp, Artificial Sequence
  chemically synthesized
caggcatcatttcctcagatat

SEQ ID NO: 878305 - DNA, 22 bp, Artificial Sequence
  chemically synthesized
ccaggcatcatttcctcagata

SEQ ID NO: 878306 - DNA, 22 bp, Artificial Sequence
  chemically synthesized
tgcagttcatatctgaggaaat

SEQ ID NO: 878307 - DNA, 22 bp, Artificial Sequence
  chemically synthesized
gcagttcatatctgaggaaatg

SEQ ID NO: 878308 - DNA, 22 bp, Artificial Sequence
  chemically synthesized
cagttcatatctgaggaaatga

SEQ ID NO: 878309 - DNA, 22 bp, Artificial Sequence
  chemically synthesized
taatcttccaggcatcatttcc

SEQ ID NO: 878310 - DNA, 22 bp, Artificial Sequence
  chemically synthesized
atatctgaggaaatgatgcctg

SEQ ID NO: 878311 - DNA, 22 bp, Artificial Sequence
  chemically synthesized
aggaaatgatgcctggaagatt

SEQ ID NO: 878312 - DNA, 22 bp, Artificial Sequence
  chemically synthesized
gaagattataattgccctcttg

SEQ ID NO: 878313 - DNA, 22 bp, Artificial Sequence
  chemically synthesized
tagacaaatggtcaagagggca

SEQ ID NO: 878314 - DNA, 22 bp, Artificial Sequence
  chemically synthesized
ctgtagacaaatggtcaagagg

SEQ ID NO: 878315 - DNA, 22 bp, Artificial Sequence
  chemically synthesized
taattgccctcttgaccatttg

SEQ ID NO: 878316 - DNA, 22 bp, Artificial Sequence
  chemically synthesized
ccctcttgaccatttgtctaca

SEQ ID NO: 878317 - DNA, 22 bp, Artificial Sequence
  chemically synthesized
acacaaaataattgctgtagac

SEQ ID NO: 878318 - DNA, 22 bp, Artificial Sequence
  chemically synthesized
aacacaaaataattgctgtaga

SEQ ID NO: 878319 - DNA, 22 bp, Artificial Sequence
  chemically synthesized
ttgaccatttgtctacagcaat

SEQ ID NO: 878320 - DNA, 22 bp, Artificial Sequence
  chemically synthesized
taacacaaaataattgctgtag

SEQ ID NO: 878321 - DNA, 22 bp, Artificial Sequence
  chemically synthesized
gaccatttgtctacagcaatta

SEQ ID NO: 878322 - DNA, 22 bp, Artificial Sequence
  chemically synthesized
accatttgtctacagcaattat

SEQ ID NO: 878323 - DNA, 22 bp, Artificial Sequence
  chemically synthesized
gtctacagcaattattttgtgt

SEQ ID NO: 878324 - DNA, 22 bp, Artificial Sequence
  chemically synthesized
tctacagcaattattttgtgtt

SEQ ID NO: 878325 - DNA, 22 bp, Artificial Sequence
  chemically synthesized
catcccaacctttaacacaaaa

SEQ ID NO: 878326 - DNA, 22 bp, Artificial Sequence
  chemically synthesized
cagcaattattttgtgttaaag

SEQ ID NO: 878327 - DNA, 22 bp, Artificial Sequence
  chemically synthesized
ttttgtgttaaaggttgggatg

SEQ ID NO: 878328 - DNA, 22 bp, Artificial Sequence
  chemically synthesized
gccaaagcgttccatcccaacc

SEQ ID NO: 878329 - DNA, 22 bp, Artificial Sequence
  chemically synthesized
ggccaaagcgttccatcccaac

SEQ ID NO: 878330 - DNA, 22 bp, Artificial Sequence
  chemically synthesized
tgtgttaaaggttgggatggaa

SEQ ID NO: 878331 - DNA, 22 bp, Artificial Sequence
  chemically synthesized
gtgttaaaggttgggatggaac

SEQ ID NO: 878332 - DNA, 22 bp, Artificial Sequence
  chemically synthesized
tgttaaaggttgggatggaacg

SEQ ID NO: 878333 - DNA, 22 bp, Artificial Sequence
  chemically synthesized
tatttggccaaagcgttccatc

SEQ ID NO: 878334 - DNA, 22 bp, Artificial Sequence
  chemically synthesized
tgtatttggccaaagcgttcca

SEQ ID NO: 878335 - DNA, 22 bp, Artificial Sequence
  chemically synthesized
ctgtatttggccaaagcgttcc

SEQ ID NO: 878336 - DNA, 22 bp, Artificial Sequence
  chemically synthesized
aaggttgggatggaacgctttg

SEQ ID NO: 878337 - DNA, 22 bp, Artificial Sequence
  chemically synthesized
tctgtatttggccaaagcgttc

SEQ ID NO: 878338 - DNA, 22 bp, Artificial Sequence
  chemically synthesized
ggatggaacgctttggccaaat

SEQ ID NO: 878339 - DNA, 22 bp, Artificial Sequence
  chemically synthesized
tggccaaatacagaaagttcct

SEQ ID NO: 878340 - DNA, 22 bp, Artificial Sequence
  chemically synthesized
ggccaaatacagaaagttcctc

SEQ ID NO: 878341 - DNA, 22 bp, Artificial Sequence
  chemically synthesized
gccaaatacagaaagttcctca

SEQ ID NO: 878342 - DNA, 22 bp, Artificial Sequence
  chemically synthesized
aatgtaacagaaaaaggtgtga

SEQ ID NO: 878343 - DNA, 22 bp, Artificial Sequence
  chemically synthesized
caatgtaacagaaaaaggtgtg

SEQ ID NO: 878344 - DNA, 22 bp, Artificial Sequence
  chemically synthesized
tcaatgtaacagaaaaaggtgt

SEQ ID NO: 878345 - DNA, 22 bp, Artificial Sequence
  chemically synthesized
ttcaatgtaacagaaaaaggtg

SEQ ID NO: 878346 - DNA, 22 bp, Artificial Sequence
  chemically synthesized
tttttcaatgtaacagaaaaag

SEQ ID NO: 878347 - DNA, 22 bp, Artificial Sequence
  chemically synthesized
ctcacacctttttctgttacat

SEQ ID NO: 878348 - DNA, 22 bp, Artificial Sequence
  chemically synthesized
aattatttttcaatgtaacaga

SEQ ID NO: 878349 - DNA, 22 bp, Artificial Sequence
  chemically synthesized
gaattatttttcaatgtaacag

SEQ ID NO: 878350 - DNA, 22 bp, Artificial Sequence
  chemically synthesized
acacctttttctgttacattga

SEQ ID NO: 878351 - DNA, 22 bp, Artificial Sequence
  chemically synthesized
ttgaattatttttcaatgtaac

SEQ ID NO: 878352 - DNA, 22 bp, Artificial Sequence
  chemically synthesized
ctcttgaattatttttcaatgt

SEQ ID NO: 878353 - DNA, 22 bp, Artificial Sequence
  chemically synthesized
ctgctcttgaattatttttcaa

SEQ ID NO: 878354 - DNA, 22 bp, Artificial Sequence
  chemically synthesized
tttctgttacattgaaaaataa

SEQ ID NO: 878355 - DNA, 22 bp, Artificial Sequence
  chemically synthesized
actgctcttgaattatttttca

SEQ ID NO: 878356 - DNA, 22 bp, Artificial Sequence
  chemically synthesized
ttctgttacattgaaaaataat

SEQ ID NO: 878357 - DNA, 22 bp, Artificial Sequence
  chemically synthesized
tctgttacattgaaaaataatt

SEQ ID NO: 878358 - DNA, 22 bp, Artificial Sequence
  chemically synthesized
ctgttacattgaaaaataattc

SEQ ID NO: 878359 - DNA, 22 bp, Artificial Sequence
  chemically synthesized
cttactgctcttgaattatttt

SEQ ID NO: 878360 - DNA, 22 bp, Artificial Sequence
  chemically synthesized
tgttacattgaaaaataattca

SEQ ID NO: 878361 - DNA, 22 bp, Artificial Sequence
  chemically synthesized
acttactgctcttgaattattt

SEQ ID NO: 878362 - DNA, 22 bp, Artificial Sequence
  chemically synthesized
tacttactgctcttgaattatt

SEQ ID NO: 878363 - DNA, 22 bp, Artificial Sequence
  chemically synthesized
ttacattgaaaaataattcaag

SEQ ID NO: 878364 - DNA, 22 bp, Artificial Sequence
  chemically synthesized
cattgaaaaataattcaagagc

SEQ ID NO: 878365 - DNA, 22 bp, Artificial Sequence
  chemically synthesized
aaaaataattcaagagcagtaa

SEQ ID NO: 878366 - DNA, 22 bp, Artificial Sequence
  chemically synthesized
gtaatatgttttacttactgct

SEQ ID NO: 878367 - DNA, 22 bp, Artificial Sequence
  chemically synthesized
aagagcagtaagtaaaacatat

SEQ ID NO: 878368 - DNA, 22 bp, Artificial Sequence
  chemically synthesized
cacaaacctagtaatatgtttt

SEQ ID NO: 878369 - DNA, 22 bp, Artificial Sequence
  chemically synthesized
acacaaacctagtaatatgttt

SEQ ID NO: 878370 - DNA, 22 bp, Artificial Sequence
  chemically synthesized
cttacacaaacctagtaatatg

SEQ ID NO: 878371 - DNA, 22 bp, Artificial Sequence
  chemically synthesized
tcaaaaaatgttacttacacaa

SEQ ID NO: 878372 - DNA, 22 bp, Artificial Sequence
  chemically synthesized
tattatcaaaaaatgttactta

SEQ ID NO: 878373 - DNA, 22 bp, Artificial Sequence
  chemically synthesized
ctaggtttgtgtaagtaacatt

SEQ ID NO: 878374 - DNA, 22 bp, Artificial Sequence
  chemically synthesized
atattatcaaaaaatgttactt

SEQ ID NO: 878375 - DNA, 22 bp, Artificial Sequence
  chemically synthesized
tatattatcaaaaaatgttact

SEQ ID NO: 878376 - DNA, 22 bp, Artificial Sequence
  chemically synthesized
ttatattatcaaaaaatgttac

SEQ ID NO: 878377 - DNA, 22 bp, Artificial Sequence
  chemically synthesized
ggtttgtgtaagtaacattttt

SEQ ID NO: 878378 - DNA, 22 bp, Artificial Sequence
  chemically synthesized
tttatattatcaaaaaatgtta

SEQ ID NO: 878379 - DNA, 22 bp, Artificial Sequence
  chemically synthesized
actttttatattatcaaaaaat

SEQ ID NO: 878380 - DNA, 22 bp, Artificial Sequence
  chemically synthesized
gtgtaagtaacattttttgata

SEQ ID NO: 878381 - DNA, 22 bp, Artificial Sequence
  chemically synthesized
tgtaagtaacattttttgataa

SEQ ID NO: 878382 - DNA, 22 bp, Artificial Sequence
  chemically synthesized
ctaactttttatattatcaaaa

SEQ ID NO: 878383 - DNA, 22 bp, Artificial Sequence
  chemically synthesized
gctaactttttatattatcaaa

SEQ ID NO: 878384 - DNA, 22 bp, Artificial Sequence
  chemically synthesized
tgctaactttttatattatcaa

SEQ ID NO: 878385 - DNA, 22 bp, Artificial Sequence
  chemically synthesized
ctttgctaactttttatattat

SEQ ID NO: 878386 - DNA, 22 bp, Artificial Sequence
  chemically synthesized
gctttgctaactttttatatta

SEQ ID NO: 878387 - DNA, 22 bp, Artificial Sequence
  chemically synthesized
gtttgctttgctaactttttat

SEQ ID NO: 878388 - DNA, 22 bp, Artificial Sequence
  chemically synthesized
tttgataatataaaaagttagc

SEQ ID NO: 878389 - DNA, 22 bp, Artificial Sequence
  chemically synthesized
ttgataatataaaaagttagca

SEQ ID NO: 878390 - DNA, 22 bp, Artificial Sequence
  chemically synthesized
tgataatataaaaagttagcaa

SEQ ID NO: 878391 - DNA, 22 bp, Artificial Sequence
  chemically synthesized
gataatataaaaagttagcaaa

SEQ ID NO: 878392 - DNA, 22 bp, Artificial Sequence
  chemically synthesized
ataatataaaaagttagcaaag

SEQ ID NO: 878393 - DNA, 22 bp, Artificial Sequence
  chemically synthesized
gcaaagcaaaccagctggcttc

SEQ ID NO: 878394 - DNA, 22 bp, Artificial Sequence
  chemically synthesized
aagtgataaaatgaagccagct

SEQ ID NO: 878395 - DNA, 22 bp, Artificial Sequence
  chemically synthesized
taaagtgataaaatgaagccag

SEQ ID NO: 878396 - DNA, 22 bp, Artificial Sequence
  chemically synthesized
ctaaagtgataaaatgaagcca

SEQ ID NO: 878397 - DNA, 22 bp, Artificial Sequence
  chemically synthesized
tctaaagtgataaaatgaagcc

SEQ ID NO: 878398 - DNA, 22 bp, Artificial Sequence
  chemically synthesized
ctttctaaagtgataaaatgaa

SEQ ID NO: 878399 - DNA, 22 bp, Artificial Sequence
  chemically synthesized
gttactttctaaagtgataaaa

SEQ ID NO: 878400 - DNA, 22 bp, Artificial Sequence
  chemically synthesized
ggttactttctaaagtgataaa

SEQ ID NO: 878401 - DNA, 22 bp, Artificial Sequence
  chemically synthesized
gcttcattttatcactttagaa

SEQ ID NO: 878402 - DNA, 22 bp, Artificial Sequence
  chemically synthesized
aatgtcttggttactttctaaa

SEQ ID NO: 878403 - DNA, 22 bp, Artificial Sequence
  chemically synthesized
cattttatcactttagaaagta

SEQ ID NO: 878404 - DNA, 22 bp, Artificial Sequence
  chemically synthesized
aaatgtcttggttactttctaa

SEQ ID NO: 878405 - DNA, 22 bp, Artificial Sequence
  chemically synthesized
attttatcactttagaaagtaa

SEQ ID NO: 878406 - DNA, 22 bp, Artificial Sequence
  chemically synthesized
taaatgtcttggttactttcta

SEQ ID NO: 878407 - DNA, 22 bp, Artificial Sequence
  chemically synthesized
tatcactttagaaagtaaccaa

SEQ ID NO: 878408 - DNA, 22 bp, Artificial Sequence
  chemically synthesized
atcactttagaaagtaaccaag

SEQ ID NO: 878409 - DNA, 22 bp, Artificial Sequence
  chemically synthesized
tcactttagaaagtaaccaaga

SEQ ID NO: 878410 - DNA, 22 bp, Artificial Sequence
  chemically synthesized
atggaattttaaatgtcttggt

SEQ ID NO: 878411 - DNA, 22 bp, Artificial Sequence
  chemically synthesized
tagaaagtaaccaagacattta

SEQ ID NO: 878412 - DNA, 22 bp, Artificial Sequence
  chemically synthesized
agaaagtaaccaagacatttaa

SEQ ID NO: 878413 - DNA, 22 bp, Artificial Sequence
  chemically synthesized
gaaagtaaccaagacatttaaa

SEQ ID NO: 878414 - DNA, 22 bp, Artificial Sequence
  chemically synthesized
agagcattaatggaattttaaa

SEQ ID NO: 878415 - DNA, 22 bp, Artificial Sequence
  chemically synthesized
gaactgagagcattaatggaat

SEQ ID NO: 878416 - DNA, 22 bp, Artificial Sequence
  chemically synthesized
aaaattccattaatgctctcag

SEQ ID NO: 878417 - DNA, 22 bp, Artificial Sequence
  chemically synthesized
aaattccattaatgctctcagt

SEQ ID NO: 878418 - DNA, 22 bp, Artificial Sequence
  chemically synthesized
ccatgtattagaactgagagca

SEQ ID NO: 878419 - DNA, 22 bp, Artificial Sequence
  chemically synthesized
cattaatgctctcagttctaat

SEQ ID NO: 878420 - DNA, 22 bp, Artificial Sequence
  chemically synthesized
catcacctgccatgtattagaa

SEQ ID NO: 878421 - DNA, 22 bp, Artificial Sequence
  chemically synthesized
acatcacctgccatgtattaga

SEQ ID NO: 878422 - DNA, 22 bp, Artificial Sequence
  chemically synthesized
atgctctcagttctaatacatg

SEQ ID NO: 878423 - DNA, 22 bp, Artificial Sequence
  chemically synthesized
tcagttctaatacatggcaggt

SEQ ID NO: 878424 - DNA, 22 bp, Artificial Sequence
  chemically synthesized
aatgcttacatcacctgccatg

SEQ ID NO: 878425 - DNA, 22 bp, Artificial Sequence
  chemically synthesized
caatgcttacatcacctgccat

SEQ ID NO: 878426 - DNA, 22 bp, Artificial Sequence
  chemically synthesized
agttctaatacatggcaggtga

SEQ ID NO: 878427 - DNA, 22 bp, Artificial Sequence
  chemically synthesized
tcaatgcttacatcacctgcca

SEQ ID NO: 878428 - DNA, 22 bp, Artificial Sequence
  chemically synthesized
taatacatggcaggtgatgtaa

SEQ ID NO: 878429 - DNA, 22 bp, Artificial Sequence
  chemically synthesized
atacatggcaggtgatgtaagc

SEQ ID NO: 878430 - DNA, 22 bp, Artificial Sequence
  chemically synthesized
tgtactttcaatgcttacatca

SEQ ID NO: 878431 - DNA, 22 bp, Artificial Sequence
  chemically synthesized
atgtactttcaatgcttacatc

SEQ ID NO: 878432 - DNA, 22 bp, Artificial Sequence
  chemically synthesized
aaaatatgtttatgtactttca

SEQ ID NO: 878433 - DNA, 22 bp, Artificial Sequence
  chemically synthesized
aaaaatatgtttatgtactttc

SEQ ID NO: 878434 - DNA, 22 bp, Artificial Sequence
  chemically synthesized
taaaaatatgtttatgtacttt

SEQ ID NO: 878435 - DNA, 22 bp, Artificial Sequence
  chemically synthesized
ttaaaaatatgtttatgtactt

SEQ ID NO: 878436 - DNA, 22 bp, Artificial Sequence
  chemically synthesized
acttttaaaaatatgtttatgt

SEQ ID NO: 878437 - DNA, 22 bp, Artificial Sequence
  chemically synthesized
agttaacttttaaaaatatgtt

SEQ ID NO: 878438 - DNA, 22 bp, Artificial Sequence
  chemically synthesized
cagttaacttttaaaaatatgt

SEQ ID NO: 878439 - DNA, 22 bp, Artificial Sequence
  chemically synthesized
aaagtacataaacatattttta

SEQ ID NO: 878440 - DNA, 22 bp, Artificial Sequence
  chemically synthesized
tcagttaacttttaaaaatatg

SEQ ID NO: 878441 - DNA, 22 bp, Artificial Sequence
  chemically synthesized
cactttcagttaacttttaaaa

SEQ ID NO: 878442 - DNA, 22 bp, Artificial Sequence
  chemically synthesized
gaaaactacactttcagttaac

SEQ ID NO: 878443 - DNA, 22 bp, Artificial Sequence
  chemically synthesized
agttggaaaactacactttcag

SEQ ID NO: 878444 - DNA, 22 bp, Artificial Sequence
  chemically synthesized
ttaaaagttaactgaaagtgta

SEQ ID NO: 878445 - DNA, 22 bp, Artificial Sequence
  chemically synthesized
aagttggaaaactacactttca

SEQ ID NO: 878446 - DNA, 22 bp, Artificial Sequence
  chemically synthesized
taaaagttaactgaaagtgtag

SEQ ID NO: 878447 - DNA, 22 bp, Artificial Sequence
  chemically synthesized
aaaagttaactgaaagtgtagt

SEQ ID NO: 878448 - DNA, 22 bp, Artificial Sequence
  chemically synthesized
aaagttaactgaaagtgtagtt

SEQ ID NO: 878449 - DNA, 22 bp, Artificial Sequence
  chemically synthesized
acttaagttggaaaactacact

SEQ ID NO: 878450 - DNA, 22 bp, Artificial Sequence
  chemically synthesized
aacttaagttggaaaactacac

SEQ ID NO: 878451 - DNA, 22 bp, Artificial Sequence
  chemically synthesized
taacttaagttggaaaactaca

SEQ ID NO: 878452 - DNA, 22 bp, Artificial Sequence
  chemically synthesized
ttaacttaagttggaaaactac

SEQ ID NO: 878453 - DNA, 22 bp, Artificial Sequence
  chemically synthesized
actgaaagtgtagttttccaac

SEQ ID NO: 878454 - DNA, 22 bp, Artificial Sequence
  chemically synthesized
atttttaacttaagttggaaaa

SEQ ID NO: 878455 - DNA, 22 bp, Artificial Sequence
  chemically synthesized
aaagtgtagttttccaacttaa

SEQ ID NO: 878456 - DNA, 22 bp, Artificial Sequence
  chemically synthesized
atactcatttttaacttaagtt

SEQ ID NO: 878457 - DNA, 22 bp, Artificial Sequence
  chemically synthesized
tattcatactcatttttaactt

SEQ ID NO: 878458 - DNA, 22 bp, Artificial Sequence
  chemically synthesized
gtattcatactcatttttaact

SEQ ID NO: 878459 - DNA, 22 bp, Artificial Sequence
  chemically synthesized
ttgtattcatactcatttttaa

SEQ ID NO: 878460 - DNA, 22 bp, Artificial Sequence
  chemically synthesized
tccaacttaagttaaaaatgag

SEQ ID NO: 878461 - DNA, 22 bp, Artificial Sequence
  chemically synthesized
cttgtattcatactcattttta

SEQ ID NO: 878462 - DNA, 22 bp, Artificial Sequence
  chemically synthesized
ccaacttaagttaaaaatgagt

SEQ ID NO: 878463 - DNA, 22 bp, Artificial Sequence
  chemically synthesized
tcttgtattcatactcattttt

SEQ ID NO: 878464 - DNA, 22 bp, Artificial Sequence
  chemically synthesized
caacttaagttaaaaatgagta

SEQ ID NO: 878465 - DNA, 22 bp, Artificial Sequence
  chemically synthesized
aagttaaaaatgagtatgaata

SEQ ID NO: 878466 - DNA, 22 bp, Artificial Sequence
  chemically synthesized
agttaaaaatgagtatgaatac

SEQ ID NO: 878467 - DNA, 22 bp, Artificial Sequence
  chemically synthesized
ggtgccattttcttgtattcat

SEQ ID NO: 878468 - DNA, 22 bp, Artificial Sequence
  chemically synthesized
aggtgccattttcttgtattca

SEQ ID NO: 878469 - DNA, 22 bp, Artificial Sequence
  chemically synthesized
aaaatgagtatgaatacaagaa

SEQ ID NO: 878470 - DNA, 22 bp, Artificial Sequence
  chemically synthesized
agcatttaggtgccattttctt

SEQ ID NO: 878471 - DNA, 22 bp, Artificial Sequence
  chemically synthesized
aagcatttaggtgccattttct

SEQ ID NO: 878472 - DNA, 22 bp, Artificial Sequence
  chemically synthesized
agcttaagcatttaggtgccat

SEQ ID NO: 878473 - DNA, 22 bp, Artificial Sequence
  chemically synthesized
gagcttaagcatttaggtgcca

SEQ ID NO: 878474 - DNA, 22 bp, Artificial Sequence
  chemically synthesized
tcttgagcttaagcatttaggt

SEQ ID NO: 878475 - DNA, 22 bp, Artificial Sequence
  chemically synthesized
actgtcttgagcttaagcattt

SEQ ID NO: 878476 - DNA, 22 bp, Artificial Sequence
  chemically synthesized
aactgtcttgagcttaagcatt

SEQ ID NO: 878477 - DNA, 22 bp, Artificial Sequence
  chemically synthesized
taactgtcttgagcttaagcat

SEQ ID NO: 878478 - DNA, 22 bp, Artificial Sequence
  chemically synthesized
ttaactgtcttgagcttaagca

SEQ ID NO: 878479 - DNA, 22 bp, Artificial Sequence
  chemically synthesized
tatttttaactgtcttgagctt

SEQ ID NO: 878480 - DNA, 22 bp, Artificial Sequence
  chemically synthesized
aatgcttaagctcaagacagtt

SEQ ID NO: 878481 - DNA, 22 bp, Artificial Sequence
  chemically synthesized
taaaattgtatttttaactgtc

SEQ ID NO: 878482 - DNA, 22 bp, Artificial Sequence
  chemically synthesized
ttataaaattgtatttttaact

SEQ ID NO: 878483 - DNA, 22 bp, Artificial Sequence
  chemically synthesized
aagctcaagacagttaaaaata

SEQ ID NO: 878484 - DNA, 22 bp, Artificial Sequence
  chemically synthesized
attataaaattgtatttttaac

SEQ ID NO: 878485 - DNA, 22 bp, Artificial Sequence
  chemically synthesized
agctcaagacagttaaaaatac

SEQ ID NO: 878486 - DNA, 22 bp, Artificial Sequence
  chemically synthesized
tattataaaattgtatttttaa

SEQ ID NO: 878487 - DNA, 22 bp, Artificial Sequence
  chemically synthesized
ttattataaaattgtattttta

SEQ ID NO: 878488 - DNA, 22 bp, Artificial Sequence
  chemically synthesized
aagacagttaaaaatacaattt

SEQ ID NO: 878489 - DNA, 22 bp, Artificial Sequence
  chemically synthesized
atttttattataaaattgtatt

SEQ ID NO: 878490 - DNA, 22 bp, Artificial Sequence
  chemically synthesized
gatttttattataaaattgtat

SEQ ID NO: 878491 - DNA, 22 bp, Artificial Sequence
  chemically synthesized
tttgatttttattataaaattg

SEQ ID NO: 878492 - DNA, 22 bp, Artificial Sequence
  chemically synthesized
ttatttgatttttattataaaa

SEQ ID NO: 878493 - DNA, 22 bp, Artificial Sequence
  chemically synthesized
gttatttgatttttattataaa

SEQ ID NO: 878494 - DNA, 22 bp, Artificial Sequence
  chemically synthesized
aaaatacaattttataataaaa

SEQ ID NO: 878495 - DNA, 22 bp, Artificial Sequence
  chemically synthesized
tataataaaaatcaaataacaa

SEQ ID NO: 878496 - DNA, 22 bp, Artificial Sequence
  chemically synthesized
ataataaaaatcaaataacaaa

SEQ ID NO: 878497 - DNA, 22 bp, Artificial Sequence
  chemically synthesized
caaaagaagccatttgttattt

SEQ ID NO: 878498 - DNA, 22 bp, Artificial Sequence
  chemically synthesized
taataaaaatcaaataacaaat

SEQ ID NO: 878499 - DNA, 22 bp, Artificial Sequence
  chemically synthesized
tcagtaacaacaatataaacta

SEQ ID NO: 878500 - DNA, 22 bp, Artificial Sequence
  chemically synthesized
ctatcagtaacaacaatataaa

SEQ ID NO: 878501 - DNA, 22 bp, Artificial Sequence
  chemically synthesized
cttttgtagtttatattgttgt

SEQ ID NO: 878502 - DNA, 22 bp, Artificial Sequence
  chemically synthesized
ttttgtagtttatattgttgtt

SEQ ID NO: 878503 - DNA, 22 bp, Artificial Sequence
  chemically synthesized
ttgtagtttatattgttgttac

SEQ ID NO: 878504 - DNA, 22 bp, Artificial Sequence
  chemically synthesized
tgtagtttatattgttgttact

SEQ ID NO: 878505 - DNA, 22 bp, Artificial Sequence
  chemically synthesized
gtagtttatattgttgttactg

SEQ ID NO: 878506 - DNA, 22 bp, Artificial Sequence
  chemically synthesized
tagtttatattgttgttactga

SEQ ID NO: 878507 - DNA, 22 bp, Artificial Sequence
  chemically synthesized
atattgttgttactgatagcag

SEQ ID NO: 878508 - DNA, 22 bp, Artificial Sequence
  chemically synthesized
tattgttgttactgatagcagt

SEQ ID NO: 878509 - DNA, 22 bp, Artificial Sequence
  chemically synthesized
aaagcagcaaaaacaactgcta

SEQ ID NO: 878510 - DNA, 22 bp, Artificial Sequence
  chemically synthesized
aaaagcagcaaaaacaactgct

SEQ ID NO: 878511 - DNA, 22 bp, Artificial Sequence
  chemically synthesized
ttgttactgatagcagttgttt

SEQ ID NO: 878512 - DNA, 22 bp, Artificial Sequence
  chemically synthesized
ttactgatagcagttgtttttg

SEQ ID NO: 878513 - DNA, 22 bp, Artificial Sequence
  chemically synthesized
ctgatagcagttgtttttgctg

SEQ ID NO: 878514 - DNA, 22 bp, Artificial Sequence
  chemically synthesized
gcagtttaaaagcagcaaaaac

SEQ ID NO: 878515 - DNA, 22 bp, Artificial Sequence
  chemically synthesized
agcagtttaaaagcagcaaaaa

SEQ ID NO: 878516 - DNA, 22 bp, Artificial Sequence
  chemically synthesized
atagcagttgtttttgctgctt

SEQ ID NO: 878517 - DNA, 22 bp, Artificial Sequence
  chemically synthesized
tttttgctgcttttaaactgct

SEQ ID NO: 878518 - DNA, 22 bp, Artificial Sequence
  chemically synthesized
ttgctgcttttaaactgctaaa

SEQ ID NO: 878519 - DNA, 22 bp, Artificial Sequence
  chemically synthesized
aatagcaccccatttagcagtt

SEQ ID NO: 878520 - DNA, 22 bp, Artificial Sequence
  chemically synthesized
tgctgcttttaaactgctaaat

SEQ ID NO: 878521 - DNA, 22 bp, Artificial Sequence
  chemically synthesized
gctgcttttaaactgctaaatg

SEQ ID NO: 878522 - DNA, 22 bp, Artificial Sequence
  chemically synthesized
ctgcttttaaactgctaaatgg

SEQ ID NO: 878523 - DNA, 22 bp, Artificial Sequence
  chemically synthesized
cttttaaactgctaaatggggt

SEQ ID NO: 878524 - DNA, 22 bp, Artificial Sequence
  chemically synthesized
ggtcctcaatagcaccccattt

SEQ ID NO: 878525 - DNA, 22 bp, Artificial Sequence
  chemically synthesized
ttaaactgctaaatggggtgct

SEQ ID NO: 878526 - DNA, 22 bp, Artificial Sequence
  chemically synthesized
taaactgctaaatggggtgcta

SEQ ID NO: 878527 - DNA, 22 bp, Artificial Sequence
  chemically synthesized
aaactgctaaatggggtgctat

SEQ ID NO: 878528 - DNA, 22 bp, Artificial Sequence
  chemically synthesized
aactgctaaatggggtgctatt

SEQ ID NO: 878529 - DNA, 22 bp, Artificial Sequence
  chemically synthesized
ctaaatggggtgctattgagga

SEQ ID NO: 878530 - DNA, 22 bp, Artificial Sequence
  chemically synthesized
aatggggtgctattgaggacct

SEQ ID NO: 878531 - DNA, 22 bp, Artificial Sequence
  chemically synthesized
cacacagtaataactaggtcct

SEQ ID NO: 878532 - DNA, 22 bp, Artificial Sequence
  chemically synthesized
ccacacagtaataactaggtcc

SEQ ID NO: 878533 - DNA, 22 bp, Artificial Sequence
  chemically synthesized
tccacacagtaataactaggtc

SEQ ID NO: 878534 - DNA, 22 bp, Artificial Sequence
  chemically synthesized
ttccacacagtaataactaggt

SEQ ID NO: 878535 - DNA, 22 bp, Artificial Sequence
  chemically synthesized
catttttccacacagtaataac

SEQ ID NO: 878536 - DNA, 22 bp, Artificial Sequence
  chemically synthesized
ttgaggacctagttattactgt

SEQ ID NO: 878537 - DNA, 22 bp, Artificial Sequence
  chemically synthesized
aggacctagttattactgtgtg

SEQ ID NO: 878538 - DNA, 22 bp, Artificial Sequence
  chemically synthesized
atgtgttccatttttccacaca

SEQ ID NO: 878539 - DNA, 22 bp, Artificial Sequence
  chemically synthesized
aatgtgttccatttttccacac

SEQ ID NO: 878540 - DNA, 22 bp, Artificial Sequence
  chemically synthesized
taatgtgttccatttttccaca

SEQ ID NO: 878541 - DNA, 22 bp, Artificial Sequence
  chemically synthesized
gttattactgtgtggaaaaatg

SEQ ID NO: 878542 - DNA, 22 bp, Artificial Sequence
  chemically synthesized
ttactgtgtggaaaaatggaac

SEQ ID NO: 878543 - DNA, 22 bp, Artificial Sequence
  chemically synthesized
ctgtgtggaaaaatggaacaca

SEQ ID NO: 878544 - DNA, 22 bp, Artificial Sequence
  chemically synthesized
tgtggaaaaatggaacacatta

SEQ ID NO: 878545 - DNA, 22 bp, Artificial Sequence
  chemically synthesized
atgccatagatgaaatagtctt

SEQ ID NO: 878546 - DNA, 22 bp, Artificial Sequence
  chemically synthesized
cattaatgccatagatgaaata

SEQ ID NO: 878547 - DNA, 22 bp, Artificial Sequence
  chemically synthesized
aagactatttcatctatggcat

SEQ ID NO: 878548 - DNA, 22 bp, Artificial Sequence
  chemically synthesized
gtataatatattacattaatgc

SEQ ID NO: 878549 - DNA, 22 bp, Artificial Sequence
  chemically synthesized
tttcatctatggcattaatgta

SEQ ID NO: 878550 - DNA, 22 bp, Artificial Sequence
  chemically synthesized
ggtataatatattacattaatg

SEQ ID NO: 878551 - DNA, 22 bp, Artificial Sequence
  chemically synthesized
tggtataatatattacattaat

SEQ ID NO: 878552 - DNA, 22 bp, Artificial Sequence
  chemically synthesized
catctatggcattaatgtaata

SEQ ID NO: 878553 - DNA, 22 bp, Artificial Sequence
  chemically synthesized
atctatggcattaatgtaatat

SEQ ID NO: 878554 - DNA, 22 bp, Artificial Sequence
  chemically synthesized
tagttttggtataatatattac

SEQ ID NO: 878555 - DNA, 22 bp, Artificial Sequence
  chemically synthesized
tggcattaatgtaatatattat

SEQ ID NO: 878556 - DNA, 22 bp, Artificial Sequence
  chemically synthesized
aagttatagttttggtataata

SEQ ID NO: 878557 - DNA, 22 bp, Artificial Sequence
  chemically synthesized
ctaaagttatagttttggtata

SEQ ID NO: 878558 - DNA, 22 bp, Artificial Sequence
  chemically synthesized
atgtaatatattataccaaaac

SEQ ID NO: 878559 - DNA, 22 bp, Artificial Sequence
  chemically synthesized
gctaaagttatagttttggtat

SEQ ID NO: 878560 - DNA, 22 bp, Artificial Sequence
  chemically synthesized
tgctaaagttatagttttggta

SEQ ID NO: 878561 - DNA, 22 bp, Artificial Sequence
  chemically synthesized
aaattttgctaaagttatagtt

SEQ ID NO: 878562 - DNA, 22 bp, Artificial Sequence
  chemically synthesized
aaaattttgctaaagttatagt

SEQ ID NO: 878563 - DNA, 22 bp, Artificial Sequence
  chemically synthesized
tttaaaattttgctaaagttat

SEQ ID NO: 878564 - DNA, 22 bp, Artificial Sequence
  chemically synthesized
taccaaaactataactttagca

SEQ ID NO: 878565 - DNA, 22 bp, Artificial Sequence
  chemically synthesized
tataaattgtttaaaattttgc

SEQ ID NO: 878566 - DNA, 22 bp, Artificial Sequence
  chemically synthesized
taactttagcaaaattttaaac

SEQ ID NO: 878567 - DNA, 22 bp, Artificial Sequence
  chemically synthesized
tatgagttatataaattgttta

SEQ ID NO: 878568 - DNA, 22 bp, Artificial Sequence
  chemically synthesized
tagcaaaattttaaacaattta

SEQ ID NO: 878569 - DNA, 22 bp, Artificial Sequence
  chemically synthesized
agcaaaattttaaacaatttat

SEQ ID NO: 878570 - DNA, 22 bp, Artificial Sequence
  chemically synthesized
gcaaaattttaaacaatttata

SEQ ID NO: 878571 - DNA, 22 bp, Artificial Sequence
  chemically synthesized
actatatgagttatataaattg

SEQ ID NO: 878572 - DNA, 22 bp, Artificial Sequence
  chemically synthesized
aagactgactatatgagttata

SEQ ID NO: 878573 - DNA, 22 bp, Artificial Sequence
  chemically synthesized
taaacaatttatataactcata

SEQ ID NO: 878574 - DNA, 22 bp, Artificial Sequence
  chemically synthesized
aaacaatttatataactcatat

SEQ ID NO: 878575 - DNA, 22 bp, Artificial Sequence
  chemically synthesized
aacaatttatataactcatata

SEQ ID NO: 878576 - DNA, 22 bp, Artificial Sequence
  chemically synthesized
ctgaagactgactatatgagtt

SEQ ID NO: 878577 - DNA, 22 bp, Artificial Sequence
  chemically synthesized
atataactcatatagtcagtct

SEQ ID NO: 878578 - DNA, 22 bp, Artificial Sequence
  chemically synthesized
agaaattactgaagactgacta

SEQ ID NO: 878579 - DNA, 22 bp, Artificial Sequence
  chemically synthesized
tataactcatatagtcagtctt

SEQ ID NO: 878580 - DNA, 22 bp, Artificial Sequence
  chemically synthesized
cagaaattactgaagactgact

SEQ ID NO: 878581 - DNA, 22 bp, Artificial Sequence
  chemically synthesized
acttcagaaattactgaagact

SEQ ID NO: 878582 - DNA, 22 bp, Artificial Sequence
  chemically synthesized
aacttcagaaattactgaagac

SEQ ID NO: 878583 - DNA, 22 bp, Artificial Sequence
  chemically synthesized
atatagtcagtcttcagtaatt

SEQ ID NO: 878584 - DNA, 22 bp, Artificial Sequence
  chemically synthesized
atcttaacttcagaaattactg

SEQ ID NO: 878585 - DNA, 22 bp, Artificial Sequence
  chemically synthesized
catcttaacttcagaaattact

SEQ ID NO: 878586 - DNA, 22 bp, Artificial Sequence
  chemically synthesized
ttcatcttaacttcagaaatta

SEQ ID NO: 878587 - DNA, 22 bp, Artificial Sequence
  chemically synthesized
cttcatcttaacttcagaaatt

SEQ ID NO: 878588 - DNA, 22 bp, Artificial Sequence
  chemically synthesized
tttcttcatcttaacttcagaa

SEQ ID NO: 878589 - DNA, 22 bp, Artificial Sequence
  chemically synthesized
cagtaatttctgaagttaagat

SEQ ID NO: 878590 - DNA, 22 bp, Artificial Sequence
  chemically synthesized
agtaatttctgaagttaagatg

SEQ ID NO: 878591 - DNA, 22 bp, Artificial Sequence
  chemically synthesized
tatgttatttcttcatcttaac

SEQ ID NO: 878592 - DNA, 22 bp, Artificial Sequence
  chemically synthesized
gtatgttatttcttcatcttaa

SEQ ID NO: 878593 - DNA, 22 bp, Artificial Sequence
  chemically synthesized
tttgtatgttatttcttcatct

SEQ ID NO: 878594 - DNA, 22 bp, Artificial Sequence
  chemically synthesized
atttgtatgttatttcttcatc

SEQ ID NO: 878595 - DNA, 22 bp, Artificial Sequence
  chemically synthesized
ctgaagttaagatgaagaaata

SEQ ID NO: 878596 - DNA, 22 bp, Artificial Sequence
  chemically synthesized
tgaagttaagatgaagaaataa

SEQ ID NO: 878597 - DNA, 22 bp, Artificial Sequence
  chemically synthesized
tttatttgtatgttatttcttc

SEQ ID NO: 878598 - DNA, 22 bp, Artificial Sequence
  chemically synthesized
atttatttgtatgttatttctt

SEQ ID NO: 878599 - DNA, 22 bp, Artificial Sequence
  chemically synthesized
aagttaagatgaagaaataaca

SEQ ID NO: 878600 - DNA, 22 bp, Artificial Sequence
  chemically synthesized
tatttatttgtatgttatttct

SEQ ID NO: 878601 - DNA, 22 bp, Artificial Sequence
  chemically synthesized
ttatttatttgtatgttatttc

SEQ ID NO: 878602 - DNA, 22 bp, Artificial Sequence
  chemically synthesized
agatgaagaaataacatacaaa

SEQ ID NO: 878603 - DNA, 22 bp, Artificial Sequence
  chemically synthesized
cacacatacttttatttatttg

SEQ ID NO: 878604 - DNA, 22 bp, Artificial Sequence
  chemically synthesized
ccccatctacacacatactttt

SEQ ID NO: 878605 - DNA, 22 bp, Artificial Sequence
  chemically synthesized
ctcccccatctacacacatact

SEQ ID NO: 878606 - DNA, 22 bp, Artificial Sequence
  chemically synthesized
cctcccccatctacacacatac

SEQ ID NO: 878607 - DNA, 22 bp, Artificial Sequence
  chemically synthesized
ccccttcctcccccatctacac

SEQ ID NO: 878608 - DNA, 22 bp, Artificial Sequence
  chemically synthesized
tcccccttcctcccccatctac

SEQ ID NO: 878609 - DNA, 22 bp, Artificial Sequence
  chemically synthesized
tctcccccttcctcccccatct

SEQ ID NO: 878610 - DNA, 22 bp, Artificial Sequence
  chemically synthesized
tctctcccccttcctcccccat

SEQ ID NO: 878611 - DNA, 22 bp, Artificial Sequence
  chemically synthesized
tctctctcccccttcctccccc

SEQ ID NO: 878612 - DNA, 22 bp, Artificial Sequence
  chemically synthesized
tctctctctcccccttcctccc

SEQ ID NO: 878613 - DNA, 22 bp, Artificial Sequence
  chemically synthesized
tctctctctctcccccttcctc

SEQ ID NO: 878614 - DNA, 22 bp, Artificial Sequence
  chemically synthesized
tctctctctctctcccccttcc

SEQ ID NO: 878615 - DNA, 22 bp, Artificial Sequence
  chemically synthesized
tctctctctctctctccccctt

SEQ ID NO: 878616 - DNA, 22 bp, Artificial Sequence
  chemically synthesized
cctctctctctctctctctccc

SEQ ID NO: 878617 - DNA, 22 bp, Artificial Sequence
  chemically synthesized
tccctctctctctctctctctc

SEQ ID NO: 878618 - DNA, 22 bp, Artificial Sequence
  chemically synthesized
tctccctctctctctctctctc

SEQ ID NO: 878619 - DNA, 22 bp, Artificial Sequence
  chemically synthesized
cctctctccctctctctctctc

SEQ ID NO: 878620 - DNA, 22 bp, Artificial Sequence
  chemically synthesized
tccctctctccctctctctctc

SEQ ID NO: 878621 - DNA, 22 bp, Artificial Sequence
  chemically synthesized
tctccctctctccctctctctc

SEQ ID NO: 878622 - DNA, 22 bp, Artificial Sequence
  chemically synthesized
cctctctccctctctccctctc

SEQ ID NO: 878623 - DNA, 22 bp, Artificial Sequence
  chemically synthesized
tccctctctccctctctccctc

SEQ ID NO: 878624 - DNA, 22 bp, Artificial Sequence
  chemically synthesized
tctccctctctccctctctccc

SEQ ID NO: 878625 - DNA, 22 bp, Artificial Sequence
  chemically synthesized
cctctctccctctctccctctc

SEQ ID NO: 878626 - DNA, 22 bp, Artificial Sequence
  chemically synthesized
tccctctctccctctctccctc

SEQ ID NO: 878627 - DNA, 22 bp, Artificial Sequence
  chemically synthesized
tctccctctctccctctctccc

SEQ ID NO: 878628 - DNA, 22 bp, Artificial Sequence
  chemically synthesized
cctctctccctctctccctctc

SEQ ID NO: 878629 - DNA, 22 bp, Artificial Sequence
  chemically synthesized
tccctctctccctctctccctc

SEQ ID NO: 878630 - DNA, 22 bp, Artificial Sequence
  chemically synthesized
tctccctctctccctctctccc

SEQ ID NO: 878631 - DNA, 22 bp, Artificial Sequence
  chemically synthesized
cctctctccctctctccctctc

SEQ ID NO: 878632 - DNA, 22 bp, Artificial Sequence
  chemically synthesized
tccctctctccctctctccctc

SEQ ID NO: 878633 - DNA, 22 bp, Artificial Sequence
  chemically synthesized
tctccctctctccctctctccc

SEQ ID NO: 878634 - DNA, 22 bp, Artificial Sequence
  chemically synthesized
cactctctccctctctccctct

SEQ ID NO: 878635 - DNA, 22 bp, Artificial Sequence
  chemically synthesized
tccactctctccctctctccct

SEQ ID NO: 878636 - DNA, 22 bp, Artificial Sequence
  chemically synthesized
cctctccactctctccctctct

SEQ ID NO: 878637 - DNA, 22 bp, Artificial Sequence
  chemically synthesized
cctccctctccactctctccct

SEQ ID NO: 878638 - DNA, 22 bp, Artificial Sequence
  chemically synthesized
cctccctccctctccactctct

SEQ ID NO: 878639 - DNA, 22 bp, Artificial Sequence
  chemically synthesized
ccctccctccctctccactctc

SEQ ID NO: 878640 - DNA, 22 bp, Artificial Sequence
  chemically synthesized
tccctccctccctctccactct

SEQ ID NO: 878641 - DNA, 22 bp, Artificial Sequence
  chemically synthesized
tttccctccctccctctccact

SEQ ID NO: 878642 - DNA, 22 bp, Artificial Sequence
  chemically synthesized
tctttccctccctccctctcca

SEQ ID NO: 878643 - DNA, 22 bp, Artificial Sequence
  chemically synthesized
tctctttccctccctccctctc

SEQ ID NO: 878644 - DNA, 22 bp, Artificial Sequence
  chemically synthesized
tctctctttccctccctccctc

SEQ ID NO: 878645 - DNA, 22 bp, Artificial Sequence
  chemically synthesized
tctctctctttccctccctccc

SEQ ID NO: 878646 - DNA, 22 bp, Artificial Sequence
  chemically synthesized
tctctctctctttccctccctc

SEQ ID NO: 878647 - DNA, 22 bp, Artificial Sequence
  chemically synthesized
tctctctctctctttccctccc

SEQ ID NO: 878648 - DNA, 22 bp, Artificial Sequence
  chemically synthesized
tctctctctctctctttccctc

SEQ ID NO: 878649 - DNA, 22 bp, Artificial Sequence
  chemically synthesized
tctctctctctctctctttccc

SEQ ID NO: 878650 - DNA, 22 bp, Artificial Sequence
  chemically synthesized
tctctctctctctctctctttc

SEQ ID NO: 878651 - DNA, 22 bp, Artificial Sequence
  chemically synthesized
tctctctctctctctctctctc

SEQ ID NO: 878652 - DNA, 22 bp, Artificial Sequence
  chemically synthesized
tgtctctctctctctctctctc

SEQ ID NO: 878653 - DNA, 22 bp, Artificial Sequence
  chemically synthesized
tctgtctctctctctctctctc

SEQ ID NO: 878654 - DNA, 22 bp, Artificial Sequence
  chemically synthesized
tctctgtctctctctctctctc

SEQ ID NO: 878655 - DNA, 22 bp, Artificial Sequence
  chemically synthesized
tctctctgtctctctctctctc

SEQ ID NO: 878656 - DNA, 22 bp, Artificial Sequence
  chemically synthesized
tctctctctgtctctctctctc

SEQ ID NO: 878657 - DNA, 22 bp, Artificial Sequence
  chemically synthesized
ctctctctctgtctctctctct

SEQ ID NO: 878658 - DNA, 22 bp, Artificial Sequence
  chemically synthesized
tctctctctctgtctctctctc

SEQ ID NO: 878659 - DNA, 22 bp, Artificial Sequence
  chemically synthesized
tttctctctctctgtctctctc

SEQ ID NO: 878660 - DNA, 22 bp, Artificial Sequence
  chemically synthesized
tctttctctctctctgtctctc

SEQ ID NO: 878661 - DNA, 22 bp, Artificial Sequence
  chemically synthesized
aactctctttctctctctctgt

SEQ ID NO: 878662 - DNA, 22 bp, Artificial Sequence
  chemically synthesized
caactctctttctctctctctg

SEQ ID NO: 878663 - DNA, 22 bp, Artificial Sequence
  chemically synthesized
gcacttcaactctctttctctc

SEQ ID NO: 878664 - DNA, 22 bp, Artificial Sequence
  chemically synthesized
agcacttcaactctctttctct

SEQ ID NO: 878665 - DNA, 22 bp, Artificial Sequence
  chemically synthesized
tttagcacttcaactctctttc

SEQ ID NO: 878666 - DNA, 22 bp, Artificial Sequence
  chemically synthesized
gtttagcacttcaactctcttt

SEQ ID NO: 878667 - DNA, 22 bp, Artificial Sequence
  chemically synthesized
tgtttagcacttcaactctctt

SEQ ID NO: 878668 - DNA, 22 bp, Artificial Sequence
  chemically synthesized
catctttgtttagcacttcaac

SEQ ID NO: 878669 - DNA, 22 bp, Artificial Sequence
  chemically synthesized
tccatctttgtttagcacttca

SEQ ID NO: 878670 - DNA, 22 bp, Artificial Sequence
  chemically synthesized
aagtgctaaacaaagatggaga

SEQ ID NO: 878671 - DNA, 22 bp, Artificial Sequence
  chemically synthesized
aacaaagatggagaggtatttg

SEQ ID NO: 878672 - DNA, 22 bp, Artificial Sequence
  chemically synthesized
ggatcgtatgatcaaatacctc

SEQ ID NO: 878673 - DNA, 22 bp, Artificial Sequence
  chemically synthesized
aggatcgtatgatcaaatacct

SEQ ID NO: 878674 - DNA, 22 bp, Artificial Sequence
  chemically synthesized
gaaaaatcttaggatcgtatga

SEQ ID NO: 878675 - DNA, 22 bp, Artificial Sequence
  chemically synthesized
gatcatacgatcctaagatttt

SEQ ID NO: 878676 - DNA, 22 bp, Artificial Sequence
  chemically synthesized
atcatacgatcctaagattttt

SEQ ID NO: 878677 - DNA, 22 bp, Artificial Sequence
  chemically synthesized
caaaataactggaaaaatctta

SEQ ID NO: 878678 - DNA, 22 bp, Artificial Sequence
  chemically synthesized
ctgcaaaataactggaaaaatc

SEQ ID NO: 878679 - DNA, 22 bp, Artificial Sequence
  chemically synthesized
tgctgcaaaataactggaaaaa

SEQ ID NO: 878680 - DNA, 22 bp, Artificial Sequence
  chemically synthesized
atctctgctgcaaaataactgg

SEQ ID NO: 878681 - DNA, 22 bp, Artificial Sequence
  chemically synthesized
agatttttccagttattttgca

SEQ ID NO: 878682 - DNA, 22 bp, Artificial Sequence
  chemically synthesized
ttccagttattttgcagcagag

SEQ ID NO: 878683 - DNA, 22 bp, Artificial Sequence
  chemically synthesized
tccagttattttgcagcagaga

SEQ ID NO: 878684 - DNA, 22 bp, Artificial Sequence
  chemically synthesized
ccagttattttgcagcagagat

SEQ ID NO: 878685 - DNA, 22 bp, Artificial Sequence
  chemically synthesized
cagttattttgcagcagagatt

SEQ ID NO: 878686 - DNA, 22 bp, Artificial Sequence
  chemically synthesized
ttttgcagcagagattagtact

SEQ ID NO: 878687 - DNA, 22 bp, Artificial Sequence
  chemically synthesized
atgacgtataggtagtactaat

SEQ ID NO: 878688 - DNA, 22 bp, Artificial Sequence
  chemically synthesized
tgcagcagagattagtactacc

SEQ ID NO: 878689 - DNA, 22 bp, Artificial Sequence
  chemically synthesized
gcagcagagattagtactacct

SEQ ID NO: 878690 - DNA, 22 bp, Artificial Sequence
  chemically synthesized
cagcagagattagtactaccta

SEQ ID NO: 878691 - DNA, 22 bp, Artificial Sequence
  chemically synthesized
gtactacctatacgtcattagt

SEQ ID NO: 878692 - DNA, 22 bp, Artificial Sequence
  chemically synthesized
tgaaatgataatactaatgacg

SEQ ID NO: 878693 - DNA, 22 bp, Artificial Sequence
  chemically synthesized
cctatacgtcattagtattatc

SEQ ID NO: 878694 - DNA, 22 bp, Artificial Sequence
  chemically synthesized
tacgtcattagtattatcattt

SEQ ID NO: 878695 - DNA, 22 bp, Artificial Sequence
  chemically synthesized
gtattatcatttcataatatgt

SEQ ID NO: 878696 - DNA, 22 bp, Artificial Sequence
  chemically synthesized
taaaaggtcaaatacatattat

SEQ ID NO: 878697 - DNA, 22 bp, Artificial Sequence
  chemically synthesized
ctgtaaaaggtcaaatacatat

SEQ ID NO: 878698 - DNA, 22 bp, Artificial Sequence
  chemically synthesized
cctgtaaaaggtcaaatacata

SEQ ID NO: 878699 - DNA, 22 bp, Artificial Sequence
  chemically synthesized
tcatttcataatatgtatttga

SEQ ID NO: 878700 - DNA, 22 bp, Artificial Sequence
  chemically synthesized
cataatatgtatttgacctttt

SEQ ID NO: 878701 - DNA, 22 bp, Artificial Sequence
  chemically synthesized
aggacttcctgtaaaaggtcaa

SEQ ID NO: 878702 - DNA, 22 bp, Artificial Sequence
  chemically synthesized
ataatatgtatttgacctttta

SEQ ID NO: 878703 - DNA, 22 bp, Artificial Sequence
  chemically synthesized
gaggacttcctgtaaaaggtca

SEQ ID NO: 878704 - DNA, 22 bp, Artificial Sequence
  chemically synthesized
tgaggacttcctgtaaaaggtc

SEQ ID NO: 878705 - DNA, 22 bp, Artificial Sequence
  chemically synthesized
tttgaggacttcctgtaaaagg

SEQ ID NO: 878706 - DNA, 22 bp, Artificial Sequence
  chemically synthesized
ctttgaggacttcctgtaaaag

SEQ ID NO: 878707 - DNA, 22 bp, Artificial Sequence
  chemically synthesized
tctttgaggacttcctgtaaaa

SEQ ID NO: 878708 - DNA, 22 bp, Artificial Sequence
  chemically synthesized
ttttctttgaggacttcctgta

SEQ ID NO: 878709 - DNA, 22 bp, Artificial Sequence
  chemically synthesized
attttctttgaggacttcctgt

SEQ ID NO: 878710 - DNA, 22 bp, Artificial Sequence
  chemically synthesized
tattttctttgaggacttcctg

SEQ ID NO: 878711 - DNA, 22 bp, Artificial Sequence
  chemically synthesized
tttattttctttgaggacttcc

SEQ ID NO: 878712 - DNA, 22 bp, Artificial Sequence
  chemically synthesized
gaccttttacaggaagtcctca

SEQ ID NO: 878713 - DNA, 22 bp, Artificial Sequence
  chemically synthesized
ctttattttctttgaggacttc

SEQ ID NO: 878714 - DNA, 22 bp, Artificial Sequence
  chemically synthesized
accttttacaggaagtcctcaa

SEQ ID NO: 878715 - DNA, 22 bp, Artificial Sequence
  chemically synthesized
ttacaggaagtcctcaaagaaa

SEQ ID NO: 878716 - DNA, 22 bp, Artificial Sequence
  chemically synthesized
tacaggaagtcctcaaagaaaa

SEQ ID NO: 878717 - DNA, 22 bp, Artificial Sequence
  chemically synthesized
acaggaagtcctcaaagaaaat

SEQ ID NO: 878718 - DNA, 22 bp, Artificial Sequence
  chemically synthesized
accaacttctttattttctttg

SEQ ID NO: 878719 - DNA, 22 bp, Artificial Sequence
  chemically synthesized
caggaagtcctcaaagaaaata

SEQ ID NO: 878720 - DNA, 22 bp, Artificial Sequence
  chemically synthesized
actaaccaacttctttattttc

SEQ ID NO: 878721 - DNA, 22 bp, Artificial Sequence
  chemically synthesized
tgactaaccaacttctttattt

SEQ ID NO: 878722 - DNA, 22 bp, Artificial Sequence
  chemically synthesized
aaagaaaataaagaagttggtt

SEQ ID NO: 878723 - DNA, 22 bp, Artificial Sequence
  chemically synthesized
aaatctctgactaaccaacttc

SEQ ID NO: 878724 - DNA, 22 bp, Artificial Sequence
  chemically synthesized
aaaatctctgactaaccaactt

SEQ ID NO: 878725 - DNA, 22 bp, Artificial Sequence
  chemically synthesized
taaaatctctgactaaccaact

SEQ ID NO: 878726 - DNA, 22 bp, Artificial Sequence
  chemically synthesized
ttaaaatctctgactaaccaac

SEQ ID NO: 878727 - DNA, 22 bp, Artificial Sequence
  chemically synthesized
tttaaaatctctgactaaccaa

SEQ ID NO: 878728 - DNA, 22 bp, Artificial Sequence
  chemically synthesized
ttttaaaatctctgactaacca

SEQ ID NO: 878729 - DNA, 22 bp, Artificial Sequence
  chemically synthesized
ttttttaaaatctctgactaac

SEQ ID NO: 878730 - DNA, 22 bp, Artificial Sequence
  chemically synthesized
cttttttaaaatctctgactaa

SEQ ID NO: 878731 - DNA, 22 bp, Artificial Sequence
  chemically synthesized
gtttcttttttaaaatctctga

SEQ ID NO: 878732 - DNA, 22 bp, Artificial Sequence
  chemically synthesized
tggtttcttttttaaaatctct

SEQ ID NO: 878733 - DNA, 22 bp, Artificial Sequence
  chemically synthesized
ctggtttcttttttaaaatctc

SEQ ID NO: 878734 - DNA, 22 bp, Artificial Sequence
  chemically synthesized
gttagtcagagattttaaaaaa

SEQ ID NO: 878735 - DNA, 22 bp, Artificial Sequence
  chemically synthesized
gtcagagattttaaaaaagaaa

SEQ ID NO: 878736 - DNA, 22 bp, Artificial Sequence
  chemically synthesized
aaagatggtatatttctggttt

SEQ ID NO: 878737 - DNA, 22 bp, Artificial Sequence
  chemically synthesized
caaagatggtatatttctggtt

SEQ ID NO: 878738 - DNA, 22 bp, Artificial Sequence
  chemically synthesized
tcaaagatggtatatttctggt

SEQ ID NO: 878739 - DNA, 22 bp, Artificial Sequence
  chemically synthesized
taaaaaagaaaccagaaatata

SEQ ID NO: 878740 - DNA, 22 bp, Artificial Sequence
  chemically synthesized
aaaaaagaaaccagaaatatac

SEQ ID NO: 878741 - DNA, 22 bp, Artificial Sequence
  chemically synthesized
ttttcaaagatggtatatttct

SEQ ID NO: 878742 - DNA, 22 bp, Artificial Sequence
  chemically synthesized
aaaaagaaaccagaaatatacc

SEQ ID NO: 878743 - DNA, 22 bp, Artificial Sequence
  chemically synthesized
attttcaaagatggtatatttc

SEQ ID NO: 878744 - DNA, 22 bp, Artificial Sequence
  chemically synthesized
tattttcaaagatggtatattt

SEQ ID NO: 878745 - DNA, 22 bp, Artificial Sequence
  chemically synthesized
ttattttcaaagatggtatatt

SEQ ID NO: 878746 - DNA, 22 bp, Artificial Sequence
  chemically synthesized
ttttattttcaaagatggtata

SEQ ID NO: 878747 - DNA, 22 bp, Artificial Sequence
  chemically synthesized
cttttattttcaaagatggtat

SEQ ID NO: 878748 - DNA, 22 bp, Artificial Sequence
  chemically synthesized
agatttcttttattttcaaaga

SEQ ID NO: 878749 - DNA, 22 bp, Artificial Sequence
  chemically synthesized
aagatttcttttattttcaaag

SEQ ID NO: 878750 - DNA, 22 bp, Artificial Sequence
  chemically synthesized
taagatttcttttattttcaaa

SEQ ID NO: 878751 - DNA, 22 bp, Artificial Sequence
  chemically synthesized
tttaagatttcttttattttca

SEQ ID NO: 878752 - DNA, 22 bp, Artificial Sequence
  chemically synthesized
ctttaagatttcttttattttc

SEQ ID NO: 878753 - DNA, 22 bp, Artificial Sequence
  chemically synthesized
gtcaacttctttaagatttctt

SEQ ID NO: 878754 - DNA, 22 bp, Artificial Sequence
  chemically synthesized
cgtcaacttctttaagatttct

SEQ ID NO: 878755 - DNA, 22 bp, Artificial Sequence
  chemically synthesized
tgaaaataaaagaaatcttaaa

SEQ ID NO: 878756 - DNA, 22 bp, Artificial Sequence
  chemically synthesized
gaaaataaaagaaatcttaaag

SEQ ID NO: 878757 - DNA, 22 bp, Artificial Sequence
  chemically synthesized
aaaataaaagaaatcttaaaga

SEQ ID NO: 878758 - DNA, 22 bp, Artificial Sequence
  chemically synthesized
acttcgtcaacttctttaagat

SEQ ID NO: 878759 - DNA, 22 bp, Artificial Sequence
  chemically synthesized
cacttcgtcaacttctttaaga

SEQ ID NO: 878760 - DNA, 22 bp, Artificial Sequence
  chemically synthesized
cttcacttcgtcaacttcttta

SEQ ID NO: 878761 - DNA, 22 bp, Artificial Sequence
  chemically synthesized
ccttcacttcgtcaacttcttt

SEQ ID NO: 878762 - DNA, 22 bp, Artificial Sequence
  chemically synthesized
tccttcacttcgtcaacttctt

SEQ ID NO: 878763 - DNA, 22 bp, Artificial Sequence
  chemically synthesized
tttccttcacttcgtcaacttc

SEQ ID NO: 878764 - DNA, 22 bp, Artificial Sequence
  chemically synthesized
ctttccttcacttcgtcaactt

SEQ ID NO: 878765 - DNA, 22 bp, Artificial Sequence
  chemically synthesized
ttctttccttcacttcgtcaac

SEQ ID NO: 878766 - DNA, 22 bp, Artificial Sequence
  chemically synthesized
cttctttccttcacttcgtcaa

SEQ ID NO: 878767 - DNA, 22 bp, Artificial Sequence
  chemically synthesized
tcttctttccttcacttcgtca

SEQ ID NO: 878768 - DNA, 22 bp, Artificial Sequence
  chemically synthesized
tttcttctttccttcacttcgt

SEQ ID NO: 878769 - DNA, 22 bp, Artificial Sequence
  chemically synthesized
aaagaagttgacgaagtgaagg

SEQ ID NO: 878770 - DNA, 22 bp, Artificial Sequence
  chemically synthesized
aagaagttgacgaagtgaagga

SEQ ID NO: 878771 - DNA, 22 bp, Artificial Sequence
  chemically synthesized
ctctttcttctttccttcactt

SEQ ID NO: 878772 - DNA, 22 bp, Artificial Sequence
  chemically synthesized
cctctttcttctttccttcact

SEQ ID NO: 878773 - DNA, 22 bp, Artificial Sequence
  chemically synthesized
tcctctttcttctttccttcac

SEQ ID NO: 878774 - DNA, 22 bp, Artificial Sequence
  chemically synthesized
tttcctctttcttctttccttc

SEQ ID NO: 878775 - DNA, 22 bp, Artificial Sequence
  chemically synthesized
ctttcctctttcttctttcctt

SEQ ID NO: 878776 - DNA, 22 bp, Artificial Sequence
  chemically synthesized
acgaagtgaaggaaagaagaaa

SEQ ID NO: 878777 - DNA, 22 bp, Artificial Sequence
  chemically synthesized
agtttctttcctctttcttctt

SEQ ID NO: 878778 - DNA, 22 bp, Artificial Sequence
  chemically synthesized
ctcagtttctttcctctttctt

SEQ ID NO: 878779 - DNA, 22 bp, Artificial Sequence
  chemically synthesized
atccctgctcagtttctttcct

SEQ ID NO: 878780 - DNA, 22 bp, Artificial Sequence
  chemically synthesized
ggttcatccctgctcagtttct

SEQ ID NO: 878781 - DNA, 22 bp, Artificial Sequence
  chemically synthesized
gaagctgggttcatccctgctc

SEQ ID NO: 878782 - DNA, 22 bp, Artificial Sequence
  chemically synthesized
attggaagctgggttcatccct

SEQ ID NO: 878783 - DNA, 22 bp, Artificial Sequence
  chemically synthesized
tgattggaagctgggttcatcc

SEQ ID NO: 878784 - DNA, 22 bp, Artificial Sequence
  chemically synthesized
agttctgattggaagctgggtt

SEQ ID NO: 878785 - DNA, 22 bp, Artificial Sequence
  chemically synthesized
agcagggatgaacccagcttcc

SEQ ID NO: 878786 - DNA, 22 bp, Artificial Sequence
  chemically synthesized
ccaagctgagttctgattggaa

SEQ ID NO: 878787 - DNA, 22 bp, Artificial Sequence
  chemically synthesized
acctcccaagctgagttctgat

SEQ ID NO: 878788 - DNA, 22 bp, Artificial Sequence
  chemically synthesized
cgctcacctcccaagctgagtt

SEQ ID NO: 878789 - DNA, 22 bp, Artificial Sequence
  chemically synthesized
ctacgctcacctcccaagctga

SEQ ID NO: 878790 - DNA, 22 bp, Artificial Sequence
  chemically synthesized
ccaatcagaactcagcttggga

SEQ ID NO: 878791 - DNA, 22 bp, Artificial Sequence
  chemically synthesized
caatcagaactcagcttgggag

SEQ ID NO: 878792 - DNA, 22 bp, Artificial Sequence
  chemically synthesized
tccagctcctacgctcacctcc

SEQ ID NO: 878793 - DNA, 22 bp, Artificial Sequence
  chemically synthesized
tctgtccagctcctacgctcac

SEQ ID NO: 878794 - DNA, 22 bp, Artificial Sequence
  chemically synthesized
agcttgggaggtgagcgtagga

SEQ ID NO: 878795 - DNA, 22 bp, Artificial Sequence
  chemically synthesized
gggaggtgagcgtaggagctgg

SEQ ID NO: 878796 - DNA, 22 bp, Artificial Sequence
  chemically synthesized
ggaggtgagcgtaggagctgga

SEQ ID NO: 878797 - DNA, 22 bp, Artificial Sequence
  chemically synthesized
catcagacagcctgtctgtcca

SEQ ID NO: 878798 - DNA, 22 bp, Artificial Sequence
  chemically synthesized
tgcatcagacagcctgtctgtc

SEQ ID NO: 878799 - DNA, 22 bp, Artificial Sequence
  chemically synthesized
cgcattctgcatcagacagcct

SEQ ID NO: 878800 - DNA, 22 bp, Artificial Sequence
  chemically synthesized
gacagacaggctgtctgatgca

SEQ ID NO: 878801 - DNA, 22 bp, Artificial Sequence
  chemically synthesized
gcacctccgcattctgcatcag

SEQ ID NO: 878802 - DNA, 22 bp, Artificial Sequence
  chemically synthesized
ttggcacctccgcattctgcat

SEQ ID NO: 878803 - DNA, 22 bp, Artificial Sequence
  chemically synthesized
tctattggcacctccgcattct

SEQ ID NO: 878804 - DNA, 22 bp, Artificial Sequence
  chemically synthesized
gtctattggcacctccgcattc

SEQ ID NO: 878805 - DNA, 22 bp, Artificial Sequence
  chemically synthesized
tctgatgcagaatgcggaggtg

SEQ ID NO: 878806 - DNA, 22 bp, Artificial Sequence
  chemically synthesized
acttgtctattggcacctccgc

SEQ ID NO: 878807 - DNA, 22 bp, Artificial Sequence
  chemically synthesized
atgcagaatgcggaggtgccaa

SEQ ID NO: 878808 - DNA, 22 bp, Artificial Sequence
  chemically synthesized
ggaaattgacttgtctattggc

SEQ ID NO: 878809 - DNA, 22 bp, Artificial Sequence
  chemically synthesized
aggaaattgacttgtctattgg

SEQ ID NO: 878810 - DNA, 22 bp, Artificial Sequence
  chemically synthesized
ttaggaaattgacttgtctatt

SEQ ID NO: 878811 - DNA, 22 bp, Artificial Sequence
  chemically synthesized
cttaggaaattgacttgtctat

SEQ ID NO: 878812 - DNA, 22 bp, Artificial Sequence
  chemically synthesized
tttcttaggaaattgacttgtc

SEQ ID NO: 878813 - DNA, 22 bp, Artificial Sequence
  chemically synthesized
tgtttcttaggaaattgacttg

SEQ ID NO: 878814 - DNA, 22 bp, Artificial Sequence
  chemically synthesized
aagacacatcagggagcaattc

SEQ ID NO: 878815 - DNA, 22 bp, Artificial Sequence
  chemically synthesized
cctaagaaacagaattgctccc

SEQ ID NO: 878816 - DNA, 22 bp, Artificial Sequence
  chemically synthesized
ctaagaaacagaattgctccct

SEQ ID NO: 878817 - DNA, 22 bp, Artificial Sequence
  chemically synthesized
attaaagacacatcagggagca

SEQ ID NO: 878818 - DNA, 22 bp, Artificial Sequence
  chemically synthesized
agaaacagaattgctccctgat

SEQ ID NO: 878819 - DNA, 22 bp, Artificial Sequence
  chemically synthesized
taattaaagacacatcagggag

SEQ ID NO: 878820 - DNA, 22 bp, Artificial Sequence
  chemically synthesized
caaacattctaattaaagacac

SEQ ID NO: 878821 - DNA, 22 bp, Artificial Sequence
  chemically synthesized
acaaacattctaattaaagaca

SEQ ID NO: 878822 - DNA, 22 bp, Artificial Sequence
  chemically synthesized
ctccctgatgtgtctttaatta

SEQ ID NO: 878823 - DNA, 22 bp, Artificial Sequence
  chemically synthesized
cctgatgtgtctttaattagaa

SEQ ID NO: 878824 - DNA, 22 bp, Artificial Sequence
  chemically synthesized
atgtgtctttaattagaatgtt

SEQ ID NO: 878825 - DNA, 22 bp, Artificial Sequence
  chemically synthesized
gtgtgtccaccgcttacaaaca

SEQ ID NO: 878826 - DNA, 22 bp, Artificial Sequence
  chemically synthesized
taattagaatgtttgtaagcgg

SEQ ID NO: 878827 - DNA, 22 bp, Artificial Sequence
  chemically synthesized
aattagaatgtttgtaagcggt

SEQ ID NO: 878828 - DNA, 22 bp, Artificial Sequence
  chemically synthesized
attagaatgtttgtaagcggtg

SEQ ID NO: 878829 - DNA, 22 bp, Artificial Sequence
  chemically synthesized
gaatgtttgtaagcggtggaca

SEQ ID NO: 878830 - DNA, 22 bp, Artificial Sequence
  chemically synthesized
aatgcataattagtgtgtccac

SEQ ID NO: 878831 - DNA, 22 bp, Artificial Sequence
  chemically synthesized
aaatgcataattagtgtgtcca

SEQ ID NO: 878832 - DNA, 22 bp, Artificial Sequence
  chemically synthesized
gtaagcggtggacacactaatt

SEQ ID NO: 878833 - DNA, 22 bp, Artificial Sequence
  chemically synthesized
taagcggtggacacactaatta

SEQ ID NO: 878834 - DNA, 22 bp, Artificial Sequence
  chemically synthesized
gtatttaaatgcataattagtg

SEQ ID NO: 878835 - DNA, 22 bp, Artificial Sequence
  chemically synthesized
attatgcatttaaatactagat

SEQ ID NO: 878836 - DNA, 22 bp, Artificial Sequence
  chemically synthesized
tgcatttaaatactagatcttg

SEQ ID NO: 878837 - DNA, 22 bp, Artificial Sequence
  chemically synthesized
acgatgtatatgcaagatctag

SEQ ID NO: 878838 - DNA, 22 bp, Artificial Sequence
  chemically synthesized
tcacgatgtatatgcaagatct

SEQ ID NO: 878839 - DNA, 22 bp, Artificial Sequence
  chemically synthesized
aaatactagatcttgcatatac

SEQ ID NO: 878840 - DNA, 22 bp, Artificial Sequence
  chemically synthesized
aatactagatcttgcatataca

SEQ ID NO: 878841 - DNA, 22 bp, Artificial Sequence
  chemically synthesized
gatcttgcatatacatcgtgag

SEQ ID NO: 878842 - DNA, 22 bp, Artificial Sequence
  chemically synthesized
gcatatacatcgtgagagattt

SEQ ID NO: 878843 - DNA, 22 bp, Artificial Sequence
  chemically synthesized
aaaagaaaatgaaaatctctca

SEQ ID NO: 878844 - DNA, 22 bp, Artificial Sequence
  chemically synthesized
catatacatcgtgagagatttt

SEQ ID NO: 878845 - DNA, 22 bp, Artificial Sequence
  chemically synthesized
aaaaagaaaatgaaaatctctc

SEQ ID NO: 878846 - DNA, 22 bp, Artificial Sequence
  chemically synthesized
taaaaagaaaatgaaaatctct

SEQ ID NO: 878847 - DNA, 22 bp, Artificial Sequence
  chemically synthesized
tttaaaaagaaaatgaaaatct

SEQ ID NO: 878848 - DNA, 22 bp, Artificial Sequence
  chemically synthesized
tgaagaaaatgatattctttaa

SEQ ID NO: 878849 - DNA, 22 bp, Artificial Sequence
  chemically synthesized
tcattttctttttaaagaatat

SEQ ID NO: 878850 - DNA, 22 bp, Artificial Sequence
  chemically synthesized
cattttctttttaaagaatatc

SEQ ID NO: 878851 - DNA, 22 bp, Artificial Sequence
  chemically synthesized
attttctttttaaagaatatca

SEQ ID NO: 878852 - DNA, 22 bp, Artificial Sequence
  chemically synthesized
tctttttaaagaatatcatttt

SEQ ID NO: 878853 - DNA, 22 bp, Artificial Sequence
  chemically synthesized
ctttttaaagaatatcattttc

SEQ ID NO: 878854 - DNA, 22 bp, Artificial Sequence
  chemically synthesized
tttttaaagaatatcattttct

SEQ ID NO: 878855 - DNA, 22 bp, Artificial Sequence
  chemically synthesized
taataattatgaagaaaatgat

SEQ ID NO: 878856 - DNA, 22 bp, Artificial Sequence
  chemically synthesized
tttaaagaatatcattttcttc

SEQ ID NO: 878857 - DNA, 22 bp, Artificial Sequence
  chemically synthesized
ttaaagaatatcattttcttca

SEQ ID NO: 878858 - DNA, 22 bp, Artificial Sequence
  chemically synthesized
taaagaatatcattttcttcat

SEQ ID NO: 878859 - DNA, 22 bp, Artificial Sequence
  chemically synthesized
aaagaatatcattttcttcata

SEQ ID NO: 878860 - DNA, 22 bp, Artificial Sequence
  chemically synthesized
aagaatatcattttcttcataa

SEQ ID NO: 878861 - DNA, 22 bp, Artificial Sequence
  chemically synthesized
gaaactgtaataattatgaaga

SEQ ID NO: 878862 - DNA, 22 bp, Artificial Sequence
  chemically synthesized
ggaaactgtaataattatgaag

SEQ ID NO: 878863 - DNA, 22 bp, Artificial Sequence
  chemically synthesized
tcttcataattattacagtttc

SEQ ID NO: 878864 - DNA, 22 bp, Artificial Sequence
  chemically synthesized
cttcataattattacagtttcc

SEQ ID NO: 878865 - DNA, 22 bp, Artificial Sequence
  chemically synthesized
ttcataattattacagtttcca

SEQ ID NO: 878866 - DNA, 22 bp, Artificial Sequence
  chemically synthesized
ggggaggtgcatttggaaactg

SEQ ID NO: 878867 - DNA, 22 bp, Artificial Sequence
  chemically synthesized
cataattattacagtttccaaa

SEQ ID NO: 878868 - DNA, 22 bp, Artificial Sequence
  chemically synthesized
gggggaggtgcatttggaaact

SEQ ID NO: 878869 - DNA, 22 bp, Artificial Sequence
  chemically synthesized
ataattattacagtttccaaat

SEQ ID NO: 878870 - DNA, 22 bp, Artificial Sequence
  chemically synthesized
tgggggaggtgcatttggaaac

SEQ ID NO: 878871 - DNA, 22 bp, Artificial Sequence
  chemically synthesized
ttgggggaggtgcatttggaaa

SEQ ID NO: 878872 - DNA, 22 bp, Artificial Sequence
  chemically synthesized
tttgggggaggtgcatttggaa

SEQ ID NO: 878873 - DNA, 22 bp, Artificial Sequence
  chemically synthesized
ttttttgggggaggtgcatttg

SEQ ID NO: 878874 - DNA, 22 bp, Artificial Sequence
  chemically synthesized
gttttttgggggaggtgcattt

SEQ ID NO: 878875 - DNA, 22 bp, Artificial Sequence
  chemically synthesized
ttacagtttccaaatgcacctc

SEQ ID NO: 878876 - DNA, 22 bp, Artificial Sequence
  chemically synthesized
tgttttttgggggaggtgcatt

SEQ ID NO: 878877 - DNA, 22 bp, Artificial Sequence
  chemically synthesized
ttgttttttgggggaggtgcat

SEQ ID NO: 878878 - DNA, 22 bp, Artificial Sequence
  chemically synthesized
cagtttccaaatgcacctcccc

SEQ ID NO: 878879 - DNA, 22 bp, Artificial Sequence
  chemically synthesized
tttttgttttttgggggaggtg

SEQ ID NO: 878880 - DNA, 22 bp, Artificial Sequence
  chemically synthesized
tgtttttgttttttgggggagg

SEQ ID NO: 878881 - DNA, 22 bp, Artificial Sequence
  chemically synthesized
ctgtttttgttttttgggggag

SEQ ID NO: 878882 - DNA, 22 bp, Artificial Sequence
  chemically synthesized
ccaaatgcacctcccccaaaaa

SEQ ID NO: 878883 - DNA, 22 bp, Artificial Sequence
  chemically synthesized
caaatgcacctcccccaaaaaa

SEQ ID NO: 878884 - DNA, 22 bp, Artificial Sequence
  chemically synthesized
tgtttctgtttttgttttttgg

SEQ ID NO: 878885 - DNA, 22 bp, Artificial Sequence
  chemically synthesized
ccccaaaaaacaaaaacagaaa

SEQ ID NO: 878886 - DNA, 22 bp, Artificial Sequence
  chemically synthesized
atgagagaattgtgtttctgtt

SEQ ID NO: 878887 - DNA, 22 bp, Artificial Sequence
  chemically synthesized
catgagagaattgtgtttctgt

SEQ ID NO: 878888 - DNA, 22 bp, Artificial Sequence
  chemically synthesized
tcatgagagaattgtgtttctg

SEQ ID NO: 878889 - DNA, 22 bp, Artificial Sequence
  chemically synthesized
cagcacattttcatgagagaat

SEQ ID NO: 878890 - DNA, 22 bp, Artificial Sequence
  chemically synthesized
agtagcctgcagcacattttca

SEQ ID NO: 878891 - DNA, 22 bp, Artificial Sequence
  chemically synthesized
tctcatgaaaatgtgctgcagg

SEQ ID NO: 878892 - DNA, 22 bp, Artificial Sequence
  chemically synthesized
tcatgaaaatgtgctgcaggct

SEQ ID NO: 878893 - DNA, 22 bp, Artificial Sequence
  chemically synthesized
atgaaaatgtgctgcaggctac

SEQ ID NO: 878894 - DNA, 22 bp, Artificial Sequence
  chemically synthesized
atagaagaggaaatgagtctga

SEQ ID NO: 878895 - DNA, 22 bp, Artificial Sequence
  chemically synthesized
aatagaagaggaaatgagtctg

SEQ ID NO: 878896 - DNA, 22 bp, Artificial Sequence
  chemically synthesized
ttaatagaagaggaaatgagtc

SEQ ID NO: 878897 - DNA, 22 bp, Artificial Sequence
  chemically synthesized
caggctactcagactcatttcc

SEQ ID NO: 878898 - DNA, 22 bp, Artificial Sequence
  chemically synthesized
cctcttaatagaagaggaaatg

SEQ ID NO: 878899 - DNA, 22 bp, Artificial Sequence
  chemically synthesized
ttacctcttaatagaagaggaa

SEQ ID NO: 878900 - DNA, 22 bp, Artificial Sequence
  chemically synthesized
ctcagactcatttcctcttcta

SEQ ID NO: 878901 - DNA, 22 bp, Artificial Sequence
  chemically synthesized
gttacctcttaatagaagagga

SEQ ID NO: 878902 - DNA, 22 bp, Artificial Sequence
  chemically synthesized
agactcatttcctcttctatta

SEQ ID NO: 878903 - DNA, 22 bp, Artificial Sequence
  chemically synthesized
ggtcttgttacctcttaataga

SEQ ID NO: 878904 - DNA, 22 bp, Artificial Sequence
  chemically synthesized
tgggtcttgttacctcttaata

SEQ ID NO: 878905 - DNA, 22 bp, Artificial Sequence
  chemically synthesized
atttcctcttctattaagaggt

SEQ ID NO: 878906 - DNA, 22 bp, Artificial Sequence
  chemically synthesized
actctgggtcttgttacctctt

SEQ ID NO: 878907 - DNA, 22 bp, Artificial Sequence
  chemically synthesized
cctcttctattaagaggtaaca

SEQ ID NO: 878908 - DNA, 22 bp, Artificial Sequence
  chemically synthesized
cactctgggtcttgttacctct

SEQ ID NO: 878909 - DNA, 22 bp, Artificial Sequence
  chemically synthesized
ctcttctattaagaggtaacaa

SEQ ID NO: 878910 - DNA, 22 bp, Artificial Sequence
  chemically synthesized
ttcactctgggtcttgttacct

SEQ ID NO: 878911 - DNA, 22 bp, Artificial Sequence
  chemically synthesized
cttcactctgggtcttgttacc

SEQ ID NO: 878912 - DNA, 22 bp, Artificial Sequence
  chemically synthesized
ttctattaagaggtaacaagac

SEQ ID NO: 878913 - DNA, 22 bp, Artificial Sequence
  chemically synthesized
ttcttcactctgggtcttgtta

SEQ ID NO: 878914 - DNA, 22 bp, Artificial Sequence
  chemically synthesized
ctattaagaggtaacaagaccc

SEQ ID NO: 878915 - DNA, 22 bp, Artificial Sequence
  chemically synthesized
tattaagaggtaacaagaccca

SEQ ID NO: 878916 - DNA, 22 bp, Artificial Sequence
  chemically synthesized
ttaagaggtaacaagacccaga

SEQ ID NO: 878917 - DNA, 22 bp, Artificial Sequence
  chemically synthesized
agaggtaacaagacccagagtg

SEQ ID NO: 878918 - DNA, 22 bp, Artificial Sequence
  chemically synthesized
taatgcctcttcttcactctgg

SEQ ID NO: 878919 - DNA, 22 bp, Artificial Sequence
  chemically synthesized
ataatgcctcttcttcactctg

SEQ ID NO: 878920 - DNA, 22 bp, Artificial Sequence
  chemically synthesized
tttataatgcctcttcttcact

SEQ ID NO: 878921 - DNA, 22 bp, Artificial Sequence
  chemically synthesized
tcctatttataatgcctcttct

SEQ ID NO: 878922 - DNA, 22 bp, Artificial Sequence
  chemically synthesized
gtcctatttataatgcctcttc

SEQ ID NO: 878923 - DNA, 22 bp, Artificial Sequence
  chemically synthesized
aaatttgtcctatttataatgc

SEQ ID NO: 878924 - DNA, 22 bp, Artificial Sequence
  chemically synthesized
aaaatttgtcctatttataatg

SEQ ID NO: 878925 - DNA, 22 bp, Artificial Sequence
  chemically synthesized
taaataggacaaattttaaatt

SEQ ID NO: 878926 - DNA, 22 bp, Artificial Sequence
  chemically synthesized
agtccatatatcaaaatttaaa

SEQ ID NO: 878927 - DNA, 22 bp, Artificial Sequence
  chemically synthesized
gagtccatatatcaaaatttaa

SEQ ID NO: 878928 - DNA, 22 bp, Artificial Sequence
  chemically synthesized
tgagtccatatatcaaaattta

SEQ ID NO: 878929 - DNA, 22 bp, Artificial Sequence
  chemically synthesized
aactttgagtccatatatcaaa

SEQ ID NO: 878930 - DNA, 22 bp, Artificial Sequence
  chemically synthesized
aaactttgagtccatatatcaa

SEQ ID NO: 878931 - DNA, 22 bp, Artificial Sequence
  chemically synthesized
taaactttgagtccatatatca

SEQ ID NO: 878932 - DNA, 22 bp, Artificial Sequence
  chemically synthesized
ttaaactttgagtccatatatc

SEQ ID NO: 878933 - DNA, 22 bp, Artificial Sequence
  chemically synthesized
tttaaactttgagtccatatat

SEQ ID NO: 878934 - DNA, 22 bp, Artificial Sequence
  chemically synthesized
taaattttgatatatggactca

SEQ ID NO: 878935 - DNA, 22 bp, Artificial Sequence
  chemically synthesized
aaattttgatatatggactcaa

SEQ ID NO: 878936 - DNA, 22 bp, Artificial Sequence
  chemically synthesized
aattttgatatatggactcaaa

SEQ ID NO: 878937 - DNA, 22 bp, Artificial Sequence
  chemically synthesized
tgatatatggactcaaagttta

SEQ ID NO: 878938 - DNA, 22 bp, Artificial Sequence
  chemically synthesized
gatatatggactcaaagtttaa

SEQ ID NO: 878939 - DNA, 22 bp, Artificial Sequence
  chemically synthesized
atatatggactcaaagtttaaa

SEQ ID NO: 878940 - DNA, 22 bp, Artificial Sequence
  chemically synthesized
atagaacgtgaacaaagccttt

SEQ ID NO: 878941 - DNA, 22 bp, Artificial Sequence
  chemically synthesized
tgatagaacgtgaacaaagcct

SEQ ID NO: 878942 - DNA, 22 bp, Artificial Sequence
  chemically synthesized
aaagtttaaaaaggctttgttc

SEQ ID NO: 878943 - DNA, 22 bp, Artificial Sequence
  chemically synthesized
ctctgatagaacgtgaacaaag

SEQ ID NO: 878944 - DNA, 22 bp, Artificial Sequence
  chemically synthesized
aaaaaggctttgttcacgttct

SEQ ID NO: 878945 - DNA, 22 bp, Artificial Sequence
  chemically synthesized
cattgctctgatagaacgtgaa

SEQ ID NO: 878946 - DNA, 22 bp, Artificial Sequence
  chemically synthesized
aaaaggctttgttcacgttcta

SEQ ID NO: 878947 - DNA, 22 bp, Artificial Sequence
  chemically synthesized
tgttcacgttctatcagagcaa

SEQ ID NO: 878948 - DNA, 22 bp, Artificial Sequence
  chemically synthesized
aaggacactccattgctctgat

SEQ ID NO: 878949 - DNA, 22 bp, Artificial Sequence
  chemically synthesized
gttcacgttctatcagagcaat

SEQ ID NO: 878950 - DNA, 22 bp, Artificial Sequence
  chemically synthesized
ttcacgttctatcagagcaatg

SEQ ID NO: 878951 - DNA, 22 bp, Artificial Sequence
  chemically synthesized
tgaaggacactccattgctctg

SEQ ID NO: 878952 - DNA, 22 bp, Artificial Sequence
  chemically synthesized
ctgaaggacactccattgctct

SEQ ID NO: 878953 - DNA, 22 bp, Artificial Sequence
  chemically synthesized
tctgaaggacactccattgctc

SEQ ID NO: 878954 - DNA, 22 bp, Artificial Sequence
  chemically synthesized
acgttctatcagagcaatggag

SEQ ID NO: 878955 - DNA, 22 bp, Artificial Sequence
  chemically synthesized
ttctgaaggacactccattgct

SEQ ID NO: 878956 - DNA, 22 bp, Artificial Sequence
  chemically synthesized
tatcagagcaatggagtgtcct

SEQ ID NO: 878957 - DNA, 22 bp, Artificial Sequence
  chemically synthesized
tcagagcaatggagtgtccttc

SEQ ID NO: 878958 - DNA, 22 bp, Artificial Sequence
  chemically synthesized
gagatgatttttctgaaggaca

SEQ ID NO: 878959 - DNA, 22 bp, Artificial Sequence
  chemically synthesized
aaggttagagatgatttttctg

SEQ ID NO: 878960 - DNA, 22 bp, Artificial Sequence
  chemically synthesized
aaaggttagagatgatttttct

SEQ ID NO: 878961 - DNA, 22 bp, Artificial Sequence
  chemically synthesized
taaaggttagagatgatttttc

SEQ ID NO: 878962 - DNA, 22 bp, Artificial Sequence
  chemically synthesized
ttaaaggttagagatgattttt

SEQ ID NO: 878963 - DNA, 22 bp, Artificial Sequence
  chemically synthesized
tttttaaaggttagagatgatt

SEQ ID NO: 878964 - DNA, 22 bp, Artificial Sequence
  chemically synthesized
atttttaaaggttagagatgat

SEQ ID NO: 878965 - DNA, 22 bp, Artificial Sequence
  chemically synthesized
cagaaaaatcatctctaacctt

SEQ ID NO: 878966 - DNA, 22 bp, Artificial Sequence
  chemically synthesized
agaaaaatcatctctaaccttt

SEQ ID NO: 878967 - DNA, 22 bp, Artificial Sequence
  chemically synthesized
catggatcaaaaatttattttt

SEQ ID NO: 878968 - DNA, 22 bp, Artificial Sequence
  chemically synthesized
tgcatggatcaaaaatttattt

SEQ ID NO: 878969 - DNA, 22 bp, Artificial Sequence
  chemically synthesized
taacctttaaaaataaattttt

SEQ ID NO: 878970 - DNA, 22 bp, Artificial Sequence
  chemically synthesized
acctttaaaaataaatttttga

SEQ ID NO: 878971 - DNA, 22 bp, Artificial Sequence
  chemically synthesized
aatctctgcatggatcaaaaat

SEQ ID NO: 878972 - DNA, 22 bp, Artificial Sequence
  chemically synthesized
aaatctctgcatggatcaaaaa

SEQ ID NO: 878973 - DNA, 22 bp, Artificial Sequence
  chemically synthesized
taaaaataaatttttgatccat

SEQ ID NO: 878974 - DNA, 22 bp, Artificial Sequence
  chemically synthesized
aaaaataaatttttgatccatg

SEQ ID NO: 878975 - DNA, 22 bp, Artificial Sequence
  chemically synthesized
tttaaatctctgcatggatcaa

SEQ ID NO: 878976 - DNA, 22 bp, Artificial Sequence
  chemically synthesized
aaaataaatttttgatccatgc

SEQ ID NO: 878977 - DNA, 22 bp, Artificial Sequence
  chemically synthesized
tgagggctgtttaaatctctgc

SEQ ID NO: 878978 - DNA, 22 bp, Artificial Sequence
  chemically synthesized
ttgatccatgcagagatttaaa

SEQ ID NO: 878979 - DNA, 22 bp, Artificial Sequence
  chemically synthesized
tgatccatgcagagatttaaac

SEQ ID NO: 878980 - DNA, 22 bp, Artificial Sequence
  chemically synthesized
gatccatgcagagatttaaaca

SEQ ID NO: 878981 - DNA, 22 bp, Artificial Sequence
  chemically synthesized
atccatgcagagatttaaacag

SEQ ID NO: 878982 - DNA, 22 bp, Artificial Sequence
  chemically synthesized
aaacagccctcacagctttctg

SEQ ID NO: 878983 - DNA, 22 bp, Artificial Sequence
  chemically synthesized
aacagccctcacagctttctgc

SEQ ID NO: 878984 - DNA, 22 bp, Artificial Sequence
  chemically synthesized
acagctttctgccttgtattgc

SEQ ID NO: 878985 - DNA, 22 bp, Artificial Sequence
  chemically synthesized
aacatgacacccagcaatacaa

SEQ ID NO: 878986 - DNA, 22 bp, Artificial Sequence
  chemically synthesized
gaacatgacacccagcaataca

SEQ ID NO: 878987 - DNA, 22 bp, Artificial Sequence
  chemically synthesized
tgaacatgacacccagcaatac

SEQ ID NO: 878988 - DNA, 22 bp, Artificial Sequence
  chemically synthesized
tctgccttgtattgctgggtgt

SEQ ID NO: 878989 - DNA, 22 bp, Artificial Sequence
  chemically synthesized
ctgccttgtattgctgggtgtc

SEQ ID NO: 878990 - DNA, 22 bp, Artificial Sequence
  chemically synthesized
tgccttgtattgctgggtgtca

SEQ ID NO: 878991 - DNA, 22 bp, Artificial Sequence
  chemically synthesized
acagttttgaacatgacaccca

SEQ ID NO: 878992 - DNA, 22 bp, Artificial Sequence
  chemically synthesized
ccttgtattgctgggtgtcatg

SEQ ID NO: 878993 - DNA, 22 bp, Artificial Sequence
  chemically synthesized
gtattgctgggtgtcatgttca

SEQ ID NO: 878994 - DNA, 22 bp, Artificial Sequence
  chemically synthesized
tattgctgggtgtcatgttcaa

SEQ ID NO: 878995 - DNA, 22 bp, Artificial Sequence
  chemically synthesized
ctgggtgtcatgttcaaaactg

SEQ ID NO: 878996 - DNA, 22 bp, Artificial Sequence
  chemically synthesized
aaaaaatgacctcacagttttg

SEQ ID NO: 878997 - DNA, 22 bp, Artificial Sequence
  chemically synthesized
ggtgtcatgttcaaaactgtga

SEQ ID NO: 878998 - DNA, 22 bp, Artificial Sequence
  chemically synthesized
gaggctcaaaaaatgacctcac

SEQ ID NO: 878999 - DNA, 22 bp, Artificial Sequence
  chemically synthesized
aaaactgtgaggtcattttttg

SEQ ID NO: 879000 - DNA, 22 bp, Artificial Sequence
  chemically synthesized
aaacacctagaggctcaaaaaa

SEQ ID NO: 879001 - DNA, 22 bp, Artificial Sequence
  chemically synthesized
tgaggtcattttttgagcctct

SEQ ID NO: 879002 - DNA, 22 bp, Artificial Sequence
  chemically synthesized
cggtagcctgaaacacctagag

SEQ ID NO: 879003 - DNA, 22 bp, Artificial Sequence
  chemically synthesized
gcggtagcctgaaacacctaga

SEQ ID NO: 879004 - DNA, 22 bp, Artificial Sequence
  chemically synthesized
tttgagcctctaggtgtttcag

SEQ ID NO: 879005 - DNA, 22 bp, Artificial Sequence
  chemically synthesized
ttgagcctctaggtgtttcagg

SEQ ID NO: 879006 - DNA, 22 bp, Artificial Sequence
  chemically synthesized
tgagcctctaggtgtttcaggc

SEQ ID NO: 879007 - DNA, 22 bp, Artificial Sequence
  chemically synthesized
gggtttgcggtagcctgaaaca

SEQ ID NO: 879008 - DNA, 22 bp, Artificial Sequence
  chemically synthesized
gagcctctaggtgtttcaggct

SEQ ID NO: 879009 - DNA, 22 bp, Artificial Sequence
  chemically synthesized
agcctctaggtgtttcaggcta

SEQ ID NO: 879010 - DNA, 22 bp, Artificial Sequence
  chemically synthesized
gctggggtttgcggtagcctga

SEQ ID NO: 879011 - DNA, 22 bp, Artificial Sequence
  chemically synthesized
taggtgtttcaggctaccgcaa

SEQ ID NO: 879012 - DNA, 22 bp, Artificial Sequence
  chemically synthesized
ggtgtttcaggctaccgcaaac

SEQ ID NO: 879013 - DNA, 22 bp, Artificial Sequence
  chemically synthesized
aagattagctggggtttgcggt

SEQ ID NO: 879014 - DNA, 22 bp, Artificial Sequence
  chemically synthesized
caggctaccgcaaaccccagct

SEQ ID NO: 879015 - DNA, 22 bp, Artificial Sequence
  chemically synthesized
aggctaccgcaaaccccagcta

SEQ ID NO: 879016 - DNA, 22 bp, Artificial Sequence
  chemically synthesized
gaaacatctgaagattagctgg

SEQ ID NO: 879017 - DNA, 22 bp, Artificial Sequence
  chemically synthesized
ggaaacatctgaagattagctg

SEQ ID NO: 879018 - DNA, 22 bp, Artificial Sequence
  chemically synthesized
ccgcaaaccccagctaatcttc

SEQ ID NO: 879019 - DNA, 22 bp, Artificial Sequence
  chemically synthesized
tggaccatgaccttggaaacat

SEQ ID NO: 879020 - DNA, 22 bp, Artificial Sequence
  chemically synthesized
ctgtggaccatgaccttggaaa

SEQ ID NO: 879021 - DNA, 22 bp, Artificial Sequence
  chemically synthesized
atcttcagatgtttccaaggtc

SEQ ID NO: 879022 - DNA, 22 bp, Artificial Sequence
  chemically synthesized
gctgtggaccatgaccttggaa

SEQ ID NO: 879023 - DNA, 22 bp, Artificial Sequence
  chemically synthesized
tgctgtggaccatgaccttgga

SEQ ID NO: 879024 - DNA, 22 bp, Artificial Sequence
  chemically synthesized
ttgctgtggaccatgaccttgg

SEQ ID NO: 879025 - DNA, 22 bp, Artificial Sequence
  chemically synthesized
cagatgtttccaaggtcatggt

SEQ ID NO: 879026 - DNA, 22 bp, Artificial Sequence
  chemically synthesized
agatgtttccaaggtcatggtc

SEQ ID NO: 879027 - DNA, 22 bp, Artificial Sequence
  chemically synthesized
acgcacaacttttgctgtggac

SEQ ID NO: 879028 - DNA, 22 bp, Artificial Sequence
  chemically synthesized
ccaaggtcatggtccacagcaa

SEQ ID NO: 879029 - DNA, 22 bp, Artificial Sequence
  chemically synthesized
caaggtcatggtccacagcaaa

SEQ ID NO: 879030 - DNA, 22 bp, Artificial Sequence
  chemically synthesized
actcacgcacaacttttgctgt

SEQ ID NO: 879031 - DNA, 22 bp, Artificial Sequence
  chemically synthesized
aaaaaatagttgactcacgcac

SEQ ID NO: 879032 - DNA, 22 bp, Artificial Sequence
  chemically synthesized
aaaaaaatagttgactcacgca

SEQ ID NO: 879033 - DNA, 22 bp, Artificial Sequence
  chemically synthesized
tggggtttaaaaaaatagttga

SEQ ID NO: 879034 - DNA, 22 bp, Artificial Sequence
  chemically synthesized
tgcgtgagtcaactattttttt

SEQ ID NO: 879035 - DNA, 22 bp, Artificial Sequence
  chemically synthesized
agaattatggggtttaaaaaaa

SEQ ID NO: 879036 - DNA, 22 bp, Artificial Sequence
  chemically synthesized
gagaattatggggtttaaaaaa

SEQ ID NO: 879037 - DNA, 22 bp, Artificial Sequence
  chemically synthesized
tttttttaaaccccataattct

SEQ ID NO: 879038 - DNA, 22 bp, Artificial Sequence
  chemically synthesized
ttttaaaccccataattctcaa

SEQ ID NO: 879039 - DNA, 22 bp, Artificial Sequence
  chemically synthesized
tttaaaccccataattctcaaa

SEQ ID NO: 879040 - DNA, 22 bp, Artificial Sequence
  chemically synthesized
ttaaaccccataattctcaaat

SEQ ID NO: 879041 - DNA, 22 bp, Artificial Sequence
  chemically synthesized
taaaccccataattctcaaatc

SEQ ID NO: 879042 - DNA, 22 bp, Artificial Sequence
  chemically synthesized
aaaccccataattctcaaatca

SEQ ID NO: 879043 - DNA, 22 bp, Artificial Sequence
  chemically synthesized
aaccccataattctcaaatcat

SEQ ID NO: 879044 - DNA, 22 bp, Artificial Sequence
  chemically synthesized
ataggggcaaaaatgcaagaat

SEQ ID NO: 879045 - DNA, 22 bp, Artificial Sequence
  chemically synthesized
tcaaatcattcttgcatttttg

SEQ ID NO: 879046 - DNA, 22 bp, Artificial Sequence
  chemically synthesized
aaatcattcttgcatttttgcc

SEQ ID NO: 879047 - DNA, 22 bp, Artificial Sequence
  chemically synthesized
ttgcatttttgcccctatcaac

SEQ ID NO: 879048 - DNA, 22 bp, Artificial Sequence
  chemically synthesized
gcatttttgcccctatcaactt

SEQ ID NO: 879049 - DNA, 22 bp, Artificial Sequence
  chemically synthesized
catttttgcccctatcaacttg

SEQ ID NO: 879050 - DNA, 22 bp, Artificial Sequence
  chemically synthesized
aaaatatatatatatcaagttg

SEQ ID NO: 879051 - DNA, 22 bp, Artificial Sequence
  chemically synthesized
ttgcccctatcaacttgatata

SEQ ID NO: 879052 - DNA, 22 bp, Artificial Sequence
  chemically synthesized
tgcccctatcaacttgatatat

SEQ ID NO: 879053 - DNA, 22 bp, Artificial Sequence
  chemically synthesized
gcccctatcaacttgatatata

SEQ ID NO: 879054 - DNA, 22 bp, Artificial Sequence
  chemically synthesized
cccctatcaacttgatatatat

SEQ ID NO: 879055 - DNA, 22 bp, Artificial Sequence
  chemically synthesized
cgtctcaaaatatatatatatc

SEQ ID NO: 879056 - DNA, 22 bp, Artificial Sequence
  chemically synthesized
tcaacttgatatatatatattt

SEQ ID NO: 879057 - DNA, 22 bp, Artificial Sequence
  chemically synthesized
gatatatatatattttgagacg

SEQ ID NO: 879058 - DNA, 22 bp, Artificial Sequence
  chemically synthesized
atatatatatattttgagacgg

SEQ ID NO: 879059 - DNA, 22 bp, Artificial Sequence
  chemically synthesized
ggcgacacgagcgaaactccgt

SEQ ID NO: 879060 - DNA, 22 bp, Artificial Sequence
  chemically synthesized
cagcctgggcgacacgagcgaa

SEQ ID NO: 879061 - DNA, 22 bp, Artificial Sequence
  chemically synthesized
tgagacggagtttcgctcgtgt

SEQ ID NO: 879062 - DNA, 22 bp, Artificial Sequence
  chemically synthesized
gagacggagtttcgctcgtgtc

SEQ ID NO: 879063 - DNA, 22 bp, Artificial Sequence
  chemically synthesized
agacggagtttcgctcgtgtcg

SEQ ID NO: 879064 - DNA, 22 bp, Artificial Sequence
  chemically synthesized
cactccagcctgggcgacacga

SEQ ID NO: 879065 - DNA, 22 bp, Artificial Sequence
  chemically synthesized
ttgcactccagcctgggcgaca

SEQ ID NO: 879066 - DNA, 22 bp, Artificial Sequence
  chemically synthesized
cgctcgtgtcgcccaggctgga

SEQ ID NO: 879067 - DNA, 22 bp, Artificial Sequence
  chemically synthesized
gctcgtgtcgcccaggctggag

SEQ ID NO: 879068 - DNA, 22 bp, Artificial Sequence
  chemically synthesized
gtgtcgcccaggctggagtgca

SEQ ID NO: 879069 - DNA, 22 bp, Artificial Sequence
  chemically synthesized
cagtgagccgagatcgcgctgt

SEQ ID NO: 879070 - DNA, 22 bp, Artificial Sequence
  chemically synthesized
gagtgcaacagcgcgatctcgg

SEQ ID NO: 879071 - DNA, 22 bp, Artificial Sequence
  chemically synthesized
aacccgagaggcagaagttgca

SEQ ID NO: 879072 - DNA, 22 bp, Artificial Sequence
  chemically synthesized
gaacccgagaggcagaagttgc

SEQ ID NO: 879073 - DNA, 22 bp, Artificial Sequence
  chemically synthesized
ggctcactgcaacttctgcctc

SEQ ID NO: 879074 - DNA, 22 bp, Artificial Sequence
  chemically synthesized
actgcaacttctgcctctcggg

SEQ ID NO: 879075 - DNA, 22 bp, Artificial Sequence
  chemically synthesized
caacttctgcctctcgggttca

SEQ ID NO: 879076 - DNA, 22 bp, Artificial Sequence
  chemically synthesized
aggcaggagaatcacttgaacc

SEQ ID NO: 879077 - DNA, 22 bp, Artificial Sequence
  chemically synthesized
ctgcctctcgggttcaagtgat

SEQ ID NO: 879078 - DNA, 22 bp, Artificial Sequence
  chemically synthesized
tgcctctcgggttcaagtgatt

SEQ ID NO: 879079 - DNA, 22 bp, Artificial Sequence
  chemically synthesized
cctctcgggttcaagtgattct

SEQ ID NO: 879080 - DNA, 22 bp, Artificial Sequence
  chemically synthesized
ggaggctgaggcaggagaatca

SEQ ID NO: 879081 - DNA, 22 bp, Artificial Sequence
  chemically synthesized
tcgggttcaagtgattctcctg

SEQ ID NO: 879082 - DNA, 22 bp, Artificial Sequence
  chemically synthesized
gggaggctgaggcaggagaatc

SEQ ID NO: 879083 - DNA, 22 bp, Artificial Sequence
  chemically synthesized
gggttcaagtgattctcctgcc

SEQ ID NO: 879084 - DNA, 22 bp, Artificial Sequence
  chemically synthesized
cttgggaggctgaggcaggaga

SEQ ID NO: 879085 - DNA, 22 bp, Artificial Sequence
  chemically synthesized
aagtgattctcctgcctcagcc

SEQ ID NO: 879086 - DNA, 22 bp, Artificial Sequence
  chemically synthesized
taatcccagctacttgggaggc

SEQ ID NO: 879087 - DNA, 22 bp, Artificial Sequence
  chemically synthesized
tcctgcctcagcctcccaagta

SEQ ID NO: 879088 - DNA, 22 bp, Artificial Sequence
  chemically synthesized
ctgcctcagcctcccaagtagc

SEQ ID NO: 879089 - DNA, 22 bp, Artificial Sequence
  chemically synthesized
cctcagcctcccaagtagctgg

SEQ ID NO: 879090 - DNA, 22 bp, Artificial Sequence
  chemically synthesized
agcctcccaagtagctgggatt

SEQ ID NO: 879091 - DNA, 22 bp, Artificial Sequence
  chemically synthesized
tggtggcaggcgcctgtaatcc

SEQ ID NO: 879092 - DNA, 22 bp, Artificial Sequence
  chemically synthesized
ccaagtagctgggattacaggc

SEQ ID NO: 879093 - DNA, 22 bp, Artificial Sequence
  chemically synthesized
ggattacaggcgcctgccacca

SEQ ID NO: 879094 - DNA, 22 bp, Artificial Sequence
  chemically synthesized
caggcgcctgccaccacagctg

SEQ ID NO: 879095 - DNA, 22 bp, Artificial Sequence
  chemically synthesized
aaaatatgaaaatgagccagct

SEQ ID NO: 879096 - DNA, 22 bp, Artificial Sequence
  chemically synthesized
ctaaaaatatgaaaatgagcca

SEQ ID NO: 879097 - DNA, 22 bp, Artificial Sequence
  chemically synthesized
ccaccacagctggctcattttc

SEQ ID NO: 879098 - DNA, 22 bp, Artificial Sequence
  chemically synthesized
tactaaaaatatgaaaatgagc

SEQ ID NO: 879099 - DNA, 22 bp, Artificial Sequence
  chemically synthesized
tctctactaaaaatatgaaaat

SEQ ID NO: 879100 - DNA, 22 bp, Artificial Sequence
  chemically synthesized
gctcattttcatatttttagta

SEQ ID NO: 879101 - DNA, 22 bp, Artificial Sequence
  chemically synthesized
attttcatatttttagtagaga

SEQ ID NO: 879102 - DNA, 22 bp, Artificial Sequence
  chemically synthesized
tcatatttttagtagagacagg

SEQ ID NO: 879103 - DNA, 22 bp, Artificial Sequence
  chemically synthesized
catatttttagtagagacaggg

SEQ ID NO: 879104 - DNA, 22 bp, Artificial Sequence
  chemically synthesized
atatttttagtagagacagggt

SEQ ID NO: 879105 - DNA, 22 bp, Artificial Sequence
  chemically synthesized
gccaacatggtgaaaccctgtc

SEQ ID NO: 879106 - DNA, 22 bp, Artificial Sequence
  chemically synthesized
ttagtagagacagggtttcacc

SEQ ID NO: 879107 - DNA, 22 bp, Artificial Sequence
  chemically synthesized
cctggccaacatggtgaaaccc

SEQ ID NO: 879108 - DNA, 22 bp, Artificial Sequence
  chemically synthesized
tagtagagacagggtttcacca

SEQ ID NO: 879109 - DNA, 22 bp, Artificial Sequence
  chemically synthesized
agtagagacagggtttcaccat

SEQ ID NO: 879110 - DNA, 22 bp, Artificial Sequence
  chemically synthesized
gtagagacagggtttcaccatg

SEQ ID NO: 879111 - DNA, 22 bp, Artificial Sequence
  chemically synthesized
gagacctgcctggccaacatgg

SEQ ID NO: 879112 - DNA, 22 bp, Artificial Sequence
  chemically synthesized
caccatgttggccaggcaggtc

SEQ ID NO: 879113 - DNA, 22 bp, Artificial Sequence
  chemically synthesized
accatgttggccaggcaggtct

SEQ ID NO: 879114 - DNA, 22 bp, Artificial Sequence
  chemically synthesized
aggtcaggagttcgagacctgc

SEQ ID NO: 879115 - DNA, 22 bp, Artificial Sequence
  chemically synthesized
gccaggcaggtctcgaactcct

SEQ ID NO: 879116 - DNA, 22 bp, Artificial Sequence
  chemically synthesized
gaactcctgacctcaggtgatc

SEQ ID NO: 879117 - DNA, 22 bp, Artificial Sequence
  chemically synthesized
cgaggccgaggcaggcggatca

SEQ ID NO: 879118 - DNA, 22 bp, Artificial Sequence
  chemically synthesized
ctgacctcaggtgatccgcctg

SEQ ID NO: 879119 - DNA, 22 bp, Artificial Sequence
  chemically synthesized
gcgaggccgaggcaggcggatc

SEQ ID NO: 879120 - DNA, 22 bp, Artificial Sequence
  chemically synthesized
tgcgaggccgaggcaggcggat

SEQ ID NO: 879121 - DNA, 22 bp, Artificial Sequence
  chemically synthesized
acctcaggtgatccgcctgcct

SEQ ID NO: 879122 - DNA, 22 bp, Artificial Sequence
  chemically synthesized
aggtgatccgcctgcctcggcc

SEQ ID NO: 879123 - DNA, 22 bp, Artificial Sequence
  chemically synthesized
taatcccagcactttgcgaggc

SEQ ID NO: 879124 - DNA, 22 bp, Artificial Sequence
  chemically synthesized
cctcggcctcgcaaagtgctgg

SEQ ID NO: 879125 - DNA, 22 bp, Artificial Sequence
  chemically synthesized
atgcctataatcccagcacttt

SEQ ID NO: 879126 - DNA, 22 bp, Artificial Sequence
  chemically synthesized
ggcctcgcaaagtgctgggatt

SEQ ID NO: 879127 - DNA, 22 bp, Artificial Sequence
  chemically synthesized
gcaaagtgctgggattataggc

SEQ ID NO: 879128 - DNA, 22 bp, Artificial Sequence
  chemically synthesized
ggcatggtggctcatgcctata

SEQ ID NO: 879129 - DNA, 22 bp, Artificial Sequence
  chemically synthesized
gctgggcatggtggctcatgcc

SEQ ID NO: 879130 - DNA, 22 bp, Artificial Sequence
  chemically synthesized
ggattataggcatgagccacca

SEQ ID NO: 879131 - DNA, 22 bp, Artificial Sequence
  chemically synthesized
taggcatgagccaccatgccca

SEQ ID NO: 879132 - DNA, 22 bp, Artificial Sequence
  chemically synthesized
gagaaaaatcaacatatcaagt

SEQ ID NO: 879133 - DNA, 22 bp, Artificial Sequence
  chemically synthesized
ggagaaaaatcaacatatcaag

SEQ ID NO: 879134 - DNA, 22 bp, Artificial Sequence
  chemically synthesized
gatttggagaaaaatcaacata

SEQ ID NO: 879135 - DNA, 22 bp, Artificial Sequence
  chemically synthesized
ggatttggagaaaaatcaacat

SEQ ID NO: 879136 - DNA, 22 bp, Artificial Sequence
  chemically synthesized
ccttggatttggagaaaaatca

SEQ ID NO: 879137 - DNA, 22 bp, Artificial Sequence
  chemically synthesized
tcccttggatttggagaaaaat

SEQ ID NO: 879138 - DNA, 22 bp, Artificial Sequence
  chemically synthesized
ctcccttggatttggagaaaaa

SEQ ID NO: 879139 - DNA, 22 bp, Artificial Sequence
  chemically synthesized
gatatgttgatttttctccaaa

SEQ ID NO: 879140 - DNA, 22 bp, Artificial Sequence
  chemically synthesized
atatgttgatttttctccaaat

SEQ ID NO: 879141 - DNA, 22 bp, Artificial Sequence
  chemically synthesized
ccatttctcccttggatttgga

SEQ ID NO: 879142 - DNA, 22 bp, Artificial Sequence
  chemically synthesized
cccatttctcccttggatttgg

SEQ ID NO: 879143 - DNA, 22 bp, Artificial Sequence
  chemically synthesized
atttttctccaaatccaaggga

SEQ ID NO: 879144 - DNA, 22 bp, Artificial Sequence
  chemically synthesized
tcttcccatttctcccttggat

SEQ ID NO: 879145 - DNA, 22 bp, Artificial Sequence
  chemically synthesized
ctgtcttcccatttctcccttg

SEQ ID NO: 879146 - DNA, 22 bp, Artificial Sequence
  chemically synthesized
ttctccaaatccaagggagaaa

SEQ ID NO: 879147 - DNA, 22 bp, Artificial Sequence
  chemically synthesized
tctccaaatccaagggagaaat

SEQ ID NO: 879148 - DNA, 22 bp, Artificial Sequence
  chemically synthesized
ctccaaatccaagggagaaatg

SEQ ID NO: 879149 - DNA, 22 bp, Artificial Sequence
  chemically synthesized
ttcctgtcttcccatttctccc

SEQ ID NO: 879150 - DNA, 22 bp, Artificial Sequence
  chemically synthesized
tccaaatccaagggagaaatgg

SEQ ID NO: 879151 - DNA, 22 bp, Artificial Sequence
  chemically synthesized
attcctgtcttcccatttctcc

SEQ ID NO: 879152 - DNA, 22 bp, Artificial Sequence
  chemically synthesized
caaatccaagggagaaatggga

SEQ ID NO: 879153 - DNA, 22 bp, Artificial Sequence
  chemically synthesized
agggaaaatttattcctgtctt

SEQ ID NO: 879154 - DNA, 22 bp, Artificial Sequence
  chemically synthesized
aagggaaaatttattcctgtct

SEQ ID NO: 879155 - DNA, 22 bp, Artificial Sequence
  chemically synthesized
aacttaagggaaaatttattcc

SEQ ID NO: 879156 - DNA, 22 bp, Artificial Sequence
  chemically synthesized
ggagaagctgaacttaagggaa

SEQ ID NO: 879157 - DNA, 22 bp, Artificial Sequence
  chemically synthesized
acacattgggagaagctgaact

SEQ ID NO: 879158 - DNA, 22 bp, Artificial Sequence
  chemically synthesized
gacacattgggagaagctgaac

SEQ ID NO: 879159 - DNA, 22 bp, Artificial Sequence
  chemically synthesized
tcccttaagttcagcttctccc

SEQ ID NO: 879160 - DNA, 22 bp, Artificial Sequence
  chemically synthesized
cccttaagttcagcttctccca

SEQ ID NO: 879161 - DNA, 22 bp, Artificial Sequence
  chemically synthesized
aatttgacacattgggagaagc

SEQ ID NO: 879162 - DNA, 22 bp, Artificial Sequence
  chemically synthesized
ccttaagttcagcttctcccaa

SEQ ID NO: 879163 - DNA, 22 bp, Artificial Sequence
  chemically synthesized
tcaatttgacacattgggagaa

SEQ ID NO: 879164 - DNA, 22 bp, Artificial Sequence
  chemically synthesized
tctcaatttgacacattgggag

SEQ ID NO: 879165 - DNA, 22 bp, Artificial Sequence
  chemically synthesized
aagttcagcttctcccaatgtg

SEQ ID NO: 879166 - DNA, 22 bp, Artificial Sequence
  chemically synthesized
ctctcaatttgacacattggga

SEQ ID NO: 879167 - DNA, 22 bp, Artificial Sequence
  chemically synthesized
agttcagcttctcccaatgtgt

SEQ ID NO: 879168 - DNA, 22 bp, Artificial Sequence
  chemically synthesized
tctctcaatttgacacattggg

SEQ ID NO: 879169 - DNA, 22 bp, Artificial Sequence
  chemically synthesized
ttttctctcaatttgacacatt

SEQ ID NO: 879170 - DNA, 22 bp, Artificial Sequence
  chemically synthesized
agcttctcccaatgtgtcaaat

SEQ ID NO: 879171 - DNA, 22 bp, Artificial Sequence
  chemically synthesized
cctattttctctcaatttgaca

SEQ ID NO: 879172 - DNA, 22 bp, Artificial Sequence
  chemically synthesized
ccctattttctctcaatttgac

SEQ ID NO: 879173 - DNA, 22 bp, Artificial Sequence
  chemically synthesized
ctcccaatgtgtcaaattgaga

SEQ ID NO: 879174 - DNA, 22 bp, Artificial Sequence
  chemically synthesized
tcccaatgtgtcaaattgagag

SEQ ID NO: 879175 - DNA, 22 bp, Artificial Sequence
  chemically synthesized
tttccctattttctctcaattt

SEQ ID NO: 879176 - DNA, 22 bp, Artificial Sequence
  chemically synthesized
ccaatgtgtcaaattgagagaa

SEQ ID NO: 879177 - DNA, 22 bp, Artificial Sequence
  chemically synthesized
cctgtttccctattttctctca

SEQ ID NO: 879178 - DNA, 22 bp, Artificial Sequence
  chemically synthesized
ccctgtttccctattttctctc

SEQ ID NO: 879179 - DNA, 22 bp, Artificial Sequence
  chemically synthesized
cttccctgtttccctattttct

SEQ ID NO: 879180 - DNA, 22 bp, Artificial Sequence
  chemically synthesized
tccttccctgtttccctatttt

SEQ ID NO: 879181 - DNA, 22 bp, Artificial Sequence
  chemically synthesized
ctccttccctgtttccctattt

SEQ ID NO: 879182 - DNA, 22 bp, Artificial Sequence
  chemically synthesized
tctccttccctgtttccctatt

SEQ ID NO: 879183 - DNA, 22 bp, Artificial Sequence
  chemically synthesized
ttctccttccctgtttccctat

SEQ ID NO: 879184 - DNA, 22 bp, Artificial Sequence
  chemically synthesized
tttctccttccctgtttcccta

SEQ ID NO: 879185 - DNA, 22 bp, Artificial Sequence
  chemically synthesized
ttttctccttccctgtttccct

SEQ ID NO: 879186 - DNA, 22 bp, Artificial Sequence
  chemically synthesized
tttttctccttccctgtttccc

SEQ ID NO: 879187 - DNA, 22 bp, Artificial Sequence
  chemically synthesized
ttttttctccttccctgtttcc

SEQ ID NO: 879188 - DNA, 22 bp, Artificial Sequence
  chemically synthesized
agagaaaatagggaaacaggga

SEQ ID NO: 879189 - DNA, 22 bp, Artificial Sequence
  chemically synthesized
tttttttctccttccctgtttc

SEQ ID NO: 879190 - DNA, 22 bp, Artificial Sequence
  chemically synthesized
ttttttttctccttccctgttt

SEQ ID NO: 879191 - DNA, 22 bp, Artificial Sequence
  chemically synthesized
tttttttttctccttccctgtt

SEQ ID NO: 879192 - DNA, 22 bp, Artificial Sequence
  chemically synthesized
ctttttttttttctccttccct

SEQ ID NO: 879193 - DNA, 22 bp, Artificial Sequence
  chemically synthesized
cctttttttttttctccttccc

SEQ ID NO: 879194 - DNA, 22 bp, Artificial Sequence
  chemically synthesized
cttcctttttttttttctcctt

SEQ ID NO: 879195 - DNA, 22 bp, Artificial Sequence
  chemically synthesized
ccttcctttttttttttctcct

SEQ ID NO: 879196 - DNA, 22 bp, Artificial Sequence
  chemically synthesized
tccttcctttttttttttctcc

SEQ ID NO: 879197 - DNA, 22 bp, Artificial Sequence
  chemically synthesized
ttccttcctttttttttttctc

SEQ ID NO: 879198 - DNA, 22 bp, Artificial Sequence
  chemically synthesized
tttccttcctttttttttttct

SEQ ID NO: 879199 - DNA, 22 bp, Artificial Sequence
  chemically synthesized
ttttccttcctttttttttttc

SEQ ID NO: 879200 - DNA, 22 bp, Artificial Sequence
  chemically synthesized
tttttttccttccttttttttt

SEQ ID NO: 879201 - DNA, 22 bp, Artificial Sequence
  chemically synthesized
tagcagacagcactgttttttt

SEQ ID NO: 879202 - DNA, 22 bp, Artificial Sequence
  chemically synthesized
gtagcagacagcactgtttttt

SEQ ID NO: 879203 - DNA, 22 bp, Artificial Sequence
  chemically synthesized
tgtagcagacagcactgttttt

SEQ ID NO: 879204 - DNA, 22 bp, Artificial Sequence
  chemically synthesized
ttgtagcagacagcactgtttt

SEQ ID NO: 879205 - DNA, 22 bp, Artificial Sequence
  chemically synthesized
aaaccatttttgtagcagacag

SEQ ID NO: 879206 - DNA, 22 bp, Artificial Sequence
  chemically synthesized
aaaaccatttttgtagcagaca

SEQ ID NO: 879207 - DNA, 22 bp, Artificial Sequence
  chemically synthesized
acaacccttaaaaccatttttg

SEQ ID NO: 879208 - DNA, 22 bp, Artificial Sequence
  chemically synthesized
cacaacccttaaaaccattttt

SEQ ID NO: 879209 - DNA, 22 bp, Artificial Sequence
  chemically synthesized
tcacaacccttaaaaccatttt

SEQ ID NO: 879210 - DNA, 22 bp, Artificial Sequence
  chemically synthesized
tttcacaacccttaaaaccatt

SEQ ID NO: 879211 - DNA, 22 bp, Artificial Sequence
  chemically synthesized
tctgctacaaaaatggttttaa

SEQ ID NO: 879212 - DNA, 22 bp, Artificial Sequence
  chemically synthesized
tctttcacaacccttaaaacca

SEQ ID NO: 879213 - DNA, 22 bp, Artificial Sequence
  chemically synthesized
ctctttcacaacccttaaaacc

SEQ ID NO: 879214 - DNA, 22 bp, Artificial Sequence
  chemically synthesized
ctacaaaaatggttttaagggt

SEQ ID NO: 879215 - DNA, 22 bp, Artificial Sequence
  chemically synthesized
cttctctttcacaacccttaaa

SEQ ID NO: 879216 - DNA, 22 bp, Artificial Sequence
  chemically synthesized
ccttctctttcacaacccttaa

SEQ ID NO: 879217 - DNA, 22 bp, Artificial Sequence
  chemically synthesized
caaaaatggttttaagggttgt

SEQ ID NO: 879218 - DNA, 22 bp, Artificial Sequence
  chemically synthesized
tccttctctttcacaaccctta

SEQ ID NO: 879219 - DNA, 22 bp, Artificial Sequence
  chemically synthesized
ctttccttctctttcacaaccc

SEQ ID NO: 879220 - DNA, 22 bp, Artificial Sequence
  chemically synthesized
ttgctttccttctctttcacaa

SEQ ID NO: 879221 - DNA, 22 bp, Artificial Sequence
  chemically synthesized
taagggttgtgaaagagaagga

SEQ ID NO: 879222 - DNA, 22 bp, Artificial Sequence
  chemically synthesized
aagggttgtgaaagagaaggaa

SEQ ID NO: 879223 - DNA, 22 bp, Artificial Sequence
  chemically synthesized
agggttgtgaaagagaaggaaa

SEQ ID NO: 879224 - DNA, 22 bp, Artificial Sequence
  chemically synthesized
tgaaagagaaggaaagcaacag

SEQ ID NO: 879225 - DNA, 22 bp, Artificial Sequence
  chemically synthesized
aaataaaaagaaagaaccagga

SEQ ID NO: 879226 - DNA, 22 bp, Artificial Sequence
  chemically synthesized
tgaaataaaaagaaagaaccag

SEQ ID NO: 879227 - DNA, 22 bp, Artificial Sequence
  chemically synthesized
ctgaaataaaaagaaagaacca

SEQ ID NO: 879228 - DNA, 22 bp, Artificial Sequence
  chemically synthesized
tctgaaataaaaagaaagaacc

SEQ ID NO: 879229 - DNA, 22 bp, Artificial Sequence
  chemically synthesized
ttctgaaataaaaagaaagaac

SEQ ID NO: 879230 - DNA, 22 bp, Artificial Sequence
  chemically synthesized
cttttctgaaataaaaagaaag

SEQ ID NO: 879231 - DNA, 22 bp, Artificial Sequence
  chemically synthesized
ctggttctttctttttatttca

SEQ ID NO: 879232 - DNA, 22 bp, Artificial Sequence
  chemically synthesized
gttctttctttttatttcagaa

SEQ ID NO: 879233 - DNA, 22 bp, Artificial Sequence
  chemically synthesized
tttctttttatttcagaaaagt

SEQ ID NO: 879234 - DNA, 22 bp, Artificial Sequence
  chemically synthesized
tctttttatttcagaaaagtaa

SEQ ID NO: 879235 - DNA, 22 bp, Artificial Sequence
  chemically synthesized
ctttttatttcagaaaagtaat

SEQ ID NO: 879236 - DNA, 22 bp, Artificial Sequence
  chemically synthesized
tttttatttcagaaaagtaatt

SEQ ID NO: 879237 - DNA, 22 bp, Artificial Sequence
  chemically synthesized
tttatttcagaaaagtaattct

SEQ ID NO: 879238 - DNA, 22 bp, Artificial Sequence
  chemically synthesized
ttatttcagaaaagtaattctc

SEQ ID NO: 879239 - DNA, 22 bp, Artificial Sequence
  chemically synthesized
gtgatgtaaaaggagaattact

SEQ ID NO: 879240 - DNA, 22 bp, Artificial Sequence
  chemically synthesized
tatttcagaaaagtaattctcc

SEQ ID NO: 879241 - DNA, 22 bp, Artificial Sequence
  chemically synthesized
atttcagaaaagtaattctcct

SEQ ID NO: 879242 - DNA, 22 bp, Artificial Sequence
  chemically synthesized
tttcagaaaagtaattctcctt

SEQ ID NO: 879243 - DNA, 22 bp, Artificial Sequence
  chemically synthesized
cagaaaagtaattctcctttta

SEQ ID NO: 879244 - DNA, 22 bp, Artificial Sequence
  chemically synthesized
agaaaagtaattctccttttac

SEQ ID NO: 879245 - DNA, 22 bp, Artificial Sequence
  chemically synthesized
atgcattagtgatgtaaaagga

SEQ ID NO: 879246 - DNA, 22 bp, Artificial Sequence
  chemically synthesized
ctgatgcattagtgatgtaaaa

SEQ ID NO: 879247 - DNA, 22 bp, Artificial Sequence
  chemically synthesized
ctgctgatgcattagtgatgta

SEQ ID NO: 879248 - DNA, 22 bp, Artificial Sequence
  chemically synthesized
cctgctgatgcattagtgatgt

SEQ ID NO: 879249 - DNA, 22 bp, Artificial Sequence
  chemically synthesized
cttcctgctgatgcattagtga

SEQ ID NO: 879250 - DNA, 22 bp, Artificial Sequence
  chemically synthesized
tccttttacatcactaatgcat

SEQ ID NO: 879251 - DNA, 22 bp, Artificial Sequence
  chemically synthesized
cttttacatcactaatgcatca

SEQ ID NO: 879252 - DNA, 22 bp, Artificial Sequence
  chemically synthesized
ttacatcactaatgcatcagca

SEQ ID NO: 879253 - DNA, 22 bp, Artificial Sequence
  chemically synthesized
tacatcactaatgcatcagcag

SEQ ID NO: 879254 - DNA, 22 bp, Artificial Sequence
  chemically synthesized
acatcactaatgcatcagcagg

SEQ ID NO: 879255 - DNA, 22 bp, Artificial Sequence
  chemically synthesized
catcactaatgcatcagcagga

SEQ ID NO: 879256 - DNA, 22 bp, Artificial Sequence
  chemically synthesized
agcatatctgcttcctgctgat

SEQ ID NO: 879257 - DNA, 22 bp, Artificial Sequence
  chemically synthesized
atgcatcagcaggaagcagata

SEQ ID NO: 879258 - DNA, 22 bp, Artificial Sequence
  chemically synthesized
ccatgcctgagcatatctgctt

SEQ ID NO: 879259 - DNA, 22 bp, Artificial Sequence
  chemically synthesized
ggatctgccatgcctgagcata

SEQ ID NO: 879260 - DNA, 22 bp, Artificial Sequence
  chemically synthesized
gagatcagaactgggatctgcc

SEQ ID NO: 879261 - DNA, 22 bp, Artificial Sequence
  chemically synthesized
ggagatcagaactgggatctgc

SEQ ID NO: 879262 - DNA, 22 bp, Artificial Sequence
  chemically synthesized
aggcatggcagatcccagttct

SEQ ID NO: 879263 - DNA, 22 bp, Artificial Sequence
  chemically synthesized
ggccacttggagatcagaactg

SEQ ID NO: 879264 - DNA, 22 bp, Artificial Sequence
  chemically synthesized
ctgggccacttggagatcagaa

SEQ ID NO: 879265 - DNA, 22 bp, Artificial Sequence
  chemically synthesized
aactactgggccacttggagat

SEQ ID NO: 879266 - DNA, 22 bp, Artificial Sequence
  chemically synthesized
tgatctccaagtggcccagtag

SEQ ID NO: 879267 - DNA, 22 bp, Artificial Sequence
  chemically synthesized
atctccaagtggcccagtagtt

SEQ ID NO: 879268 - DNA, 22 bp, Artificial Sequence
  chemically synthesized
cacccacacactcaactactgg

SEQ ID NO: 879269 - DNA, 22 bp, Artificial Sequence
  chemically synthesized
caagtggcccagtagttgagtg

SEQ ID NO: 879270 - DNA, 22 bp, Artificial Sequence
  chemically synthesized
tcgcacctccacccacacactc

SEQ ID NO: 879271 - DNA, 22 bp, Artificial Sequence
  chemically synthesized
atcgcacctccacccacacact

SEQ ID NO: 879272 - DNA, 22 bp, Artificial Sequence
  chemically synthesized
acttatcgcacctccacccaca

SEQ ID NO: 879273 - DNA, 22 bp, Artificial Sequence
  chemically synthesized
atgctaacttatcgcacctcca

SEQ ID NO: 879274 - DNA, 22 bp, Artificial Sequence
  chemically synthesized
gatgctaacttatcgcacctcc

SEQ ID NO: 879275 - DNA, 22 bp, Artificial Sequence
  chemically synthesized
agtgtgtgggtggaggtgcgat

SEQ ID NO: 879276 - DNA, 22 bp, Artificial Sequence
  chemically synthesized
tgtataaaacaatccaaatgct

SEQ ID NO: 879277 - DNA, 22 bp, Artificial Sequence
  chemically synthesized
attatgtataaaacaatccaaa

SEQ ID NO: 879278 - DNA, 22 bp, Artificial Sequence
  chemically synthesized
cattatgtataaaacaatccaa

SEQ ID NO: 879279 - DNA, 22 bp, Artificial Sequence
  chemically synthesized
gcatcaagcatttggattgttt

SEQ ID NO: 879280 - DNA, 22 bp, Artificial Sequence
  chemically synthesized
tcattatgtataaaacaatcca

SEQ ID NO: 879281 - DNA, 22 bp, Artificial Sequence
  chemically synthesized
ctttcattatgtataaaacaat

SEQ ID NO: 879282 - DNA, 22 bp, Artificial Sequence
  chemically synthesized
gctttcattatgtataaaacaa

SEQ ID NO: 879283 - DNA, 22 bp, Artificial Sequence
  chemically synthesized
tgctttcattatgtataaaaca

SEQ ID NO: 879284 - DNA, 22 bp, Artificial Sequence
  chemically synthesized
ttgctttcattatgtataaaac

SEQ ID NO: 879285 - DNA, 22 bp, Artificial Sequence
  chemically synthesized
ggattgttttatacataatgaa

SEQ ID NO: 879286 - DNA, 22 bp, Artificial Sequence
  chemically synthesized
gattgttttatacataatgaaa

SEQ ID NO: 879287 - DNA, 22 bp, Artificial Sequence
  chemically synthesized
agaaaatttttgctttcattat

SEQ ID NO: 879288 - DNA, 22 bp, Artificial Sequence
  chemically synthesized
ttttatacataatgaaagcaaa

SEQ ID NO: 879289 - DNA, 22 bp, Artificial Sequence
  chemically synthesized
tatacataatgaaagcaaaaat

SEQ ID NO: 879290 - DNA, 22 bp, Artificial Sequence
  chemically synthesized
atacataatgaaagcaaaaatt

SEQ ID NO: 879291 - DNA, 22 bp, Artificial Sequence
  chemically synthesized
tacataatgaaagcaaaaattt

SEQ ID NO: 879292 - DNA, 22 bp, Artificial Sequence
  chemically synthesized
aaagccactgagaaaatttttg

SEQ ID NO: 879293 - DNA, 22 bp, Artificial Sequence
  chemically synthesized
attaaaagccactgagaaaatt

SEQ ID NO: 879294 - DNA, 22 bp, Artificial Sequence
  chemically synthesized
aattaaaagccactgagaaaat

SEQ ID NO: 879295 - DNA, 22 bp, Artificial Sequence
  chemically synthesized
tctcagtggcttttaattaaga

SEQ ID NO: 879296 - DNA, 22 bp, Artificial Sequence
  chemically synthesized
ctcagtggcttttaattaagat

SEQ ID NO: 879297 - DNA, 22 bp, Artificial Sequence
  chemically synthesized
tcagtggcttttaattaagatc

SEQ ID NO: 879298 - DNA, 22 bp, Artificial Sequence
  chemically synthesized
agtggcttttaattaagatctc

SEQ ID NO: 879299 - DNA, 22 bp, Artificial Sequence
  chemically synthesized
taaaagagagagagagagatct

SEQ ID NO: 879300 - DNA, 22 bp, Artificial Sequence
  chemically synthesized
gtaaaagagagagagagagatc

SEQ ID NO: 879301 - DNA, 22 bp, Artificial Sequence
  chemically synthesized
tgtaaaagagagagagagagat

SEQ ID NO: 879302 - DNA, 22 bp, Artificial Sequence
  chemically synthesized
ttaattaagatctctctctctc

SEQ ID NO: 879303 - DNA, 22 bp, Artificial Sequence
  chemically synthesized
taattaagatctctctctctct

SEQ ID NO: 879304 - DNA, 22 bp, Artificial Sequence
  chemically synthesized
aattaagatctctctctctctc

SEQ ID NO: 879305 - DNA, 22 bp, Artificial Sequence
  chemically synthesized
attaagatctctctctctctct

SEQ ID NO: 879306 - DNA, 22 bp, Artificial Sequence
  chemically synthesized
tgcctttgtaaaagagagagag

SEQ ID NO: 879307 - DNA, 22 bp, Artificial Sequence
  chemically synthesized
gtgcctttgtaaaagagagaga

SEQ ID NO: 879308 - DNA, 22 bp, Artificial Sequence
  chemically synthesized
tgtgcctttgtaaaagagagag

SEQ ID NO: 879309 - DNA, 22 bp, Artificial Sequence
  chemically synthesized
ttgtgcctttgtaaaagagaga

SEQ ID NO: 879310 - DNA, 22 bp, Artificial Sequence
  chemically synthesized
agatctctctctctctctttta

SEQ ID NO: 879311 - DNA, 22 bp, Artificial Sequence
  chemically synthesized
cttttgtgcctttgtaaaagag

SEQ ID NO: 879312 - DNA, 22 bp, Artificial Sequence
  chemically synthesized
acttttgtgcctttgtaaaaga

SEQ ID NO: 879313 - DNA, 22 bp, Artificial Sequence
  chemically synthesized
tacttttgtgcctttgtaaaag

SEQ ID NO: 879314 - DNA, 22 bp, Artificial Sequence
  chemically synthesized
ttacttttgtgcctttgtaaaa

SEQ ID NO: 879315 - DNA, 22 bp, Artificial Sequence
  chemically synthesized
tctctctctcttttacaaaggc

SEQ ID NO: 879316 - DNA, 22 bp, Artificial Sequence
  chemically synthesized
tctctctcttttacaaaggcac

SEQ ID NO: 879317 - DNA, 22 bp, Artificial Sequence
  chemically synthesized
gcttttacttttgtgcctttgt

SEQ ID NO: 879318 - DNA, 22 bp, Artificial Sequence
  chemically synthesized
ggcttttacttttgtgcctttg

SEQ ID NO: 879319 - DNA, 22 bp, Artificial Sequence
  chemically synthesized
tctctcttttacaaaggcacaa

SEQ ID NO: 879320 - DNA, 22 bp, Artificial Sequence
  chemically synthesized
tctcttttacaaaggcacaaaa

SEQ ID NO: 879321 - DNA, 22 bp, Artificial Sequence
  chemically synthesized
tcttttacaaaggcacaaaagt

SEQ ID NO: 879322 - DNA, 22 bp, Artificial Sequence
  chemically synthesized
ttttacaaaggcacaaaagtaa

SEQ ID NO: 879323 - DNA, 22 bp, Artificial Sequence
  chemically synthesized
ttacaaaggcacaaaagtaaaa

SEQ ID NO: 879324 - DNA, 22 bp, Artificial Sequence
  chemically synthesized
tacaaaggcacaaaagtaaaag

SEQ ID NO: 879325 - DNA, 22 bp, Artificial Sequence
  chemically synthesized
acaaaggcacaaaagtaaaagc

SEQ ID NO: 879326 - DNA, 22 bp, Artificial Sequence
  chemically synthesized
caaaggcacaaaagtaaaagcc

SEQ ID NO: 879327 - DNA, 22 bp, Artificial Sequence
  chemically synthesized
gagatcacaaaggtacatgtaa

SEQ ID NO: 879328 - DNA, 22 bp, Artificial Sequence
  chemically synthesized
ttagagatcacaaaggtacatg

SEQ ID NO: 879329 - DNA, 22 bp, Artificial Sequence
  chemically synthesized
attgttagagatcacaaaggta

SEQ ID NO: 879330 - DNA, 22 bp, Artificial Sequence
  chemically synthesized
tcactaattgttagagatcaca

SEQ ID NO: 879331 - DNA, 22 bp, Artificial Sequence
  chemically synthesized
gtcactaattgttagagatcac

SEQ ID NO: 879332 - DNA, 22 bp, Artificial Sequence
  chemically synthesized
catgtacctttgtgatctctaa

SEQ ID NO: 879333 - DNA, 22 bp, Artificial Sequence
  chemically synthesized
aggtttgtcactaattgttaga

SEQ ID NO: 879334 - DNA, 22 bp, Artificial Sequence
  chemically synthesized
tgtgatctctaacaattagtga

SEQ ID NO: 879335 - DNA, 22 bp, Artificial Sequence
  chemically synthesized
gtgatctctaacaattagtgac

SEQ ID NO: 879336 - DNA, 22 bp, Artificial Sequence
  chemically synthesized
tgatctctaacaattagtgaca

SEQ ID NO: 879337 - DNA, 22 bp, Artificial Sequence
  chemically synthesized
tgaattaaggtttgtcactaat

SEQ ID NO: 879338 - DNA, 22 bp, Artificial Sequence
  chemically synthesized
taacaattagtgacaaacctta

SEQ ID NO: 879339 - DNA, 22 bp, Artificial Sequence
  chemically synthesized
acaattagtgacaaaccttaat

SEQ ID NO: 879340 - DNA, 22 bp, Artificial Sequence
  chemically synthesized
tggtgtatgactatgaattaag

SEQ ID NO: 879341 - DNA, 22 bp, Artificial Sequence
  chemically synthesized
atggtgtatgactatgaattaa

SEQ ID NO: 879342 - DNA, 22 bp, Artificial Sequence
  chemically synthesized
gtgacaaaccttaattcatagt

SEQ ID NO: 879343 - DNA, 22 bp, Artificial Sequence
  chemically synthesized
tgccttatggtgtatgactatg

SEQ ID NO: 879344 - DNA, 22 bp, Artificial Sequence
  chemically synthesized
atgccttatggtgtatgactat

SEQ ID NO: 879345 - DNA, 22 bp, Artificial Sequence
  chemically synthesized
tatgccttatggtgtatgacta

SEQ ID NO: 879346 - DNA, 22 bp, Artificial Sequence
  chemically synthesized
aattcatagtcatacaccataa

SEQ ID NO: 879347 - DNA, 22 bp, Artificial Sequence
  chemically synthesized
attcatagtcatacaccataag

SEQ ID NO: 879348 - DNA, 22 bp, Artificial Sequence
  chemically synthesized
aaagactttatgccttatggtg

SEQ ID NO: 879349 - DNA, 22 bp, Artificial Sequence
  chemically synthesized
atagtcatacaccataaggcat

SEQ ID NO: 879350 - DNA, 22 bp, Artificial Sequence
  chemically synthesized
atcctcaaagactttatgcctt

SEQ ID NO: 879351 - DNA, 22 bp, Artificial Sequence
  chemically synthesized
ttgatcctcaaagactttatgc

SEQ ID NO: 879352 - DNA, 22 bp, Artificial Sequence
  chemically synthesized
gttgatcctcaaagactttatg

SEQ ID NO: 879353 - DNA, 22 bp, Artificial Sequence
  chemically synthesized
tgttgatcctcaaagactttat

SEQ ID NO: 879354 - DNA, 22 bp, Artificial Sequence
  chemically synthesized
tttgttgatcctcaaagacttt

SEQ ID NO: 879355 - DNA, 22 bp, Artificial Sequence
  chemically synthesized
ctctttgttgatcctcaaagac

SEQ ID NO: 879356 - DNA, 22 bp, Artificial Sequence
  chemically synthesized
tctactctttgttgatcctcaa

SEQ ID NO: 879357 - DNA, 22 bp, Artificial Sequence
  chemically synthesized
tatctactctttgttgatcctc

SEQ ID NO: 879358 - DNA, 22 bp, Artificial Sequence
  chemically synthesized
ctatctactctttgttgatcct

SEQ ID NO: 879359 - DNA, 22 bp, Artificial Sequence
  chemically synthesized
catacgtttctatctactcttt

SEQ ID NO: 879360 - DNA, 22 bp, Artificial Sequence
  chemically synthesized
tgaggatcaacaaagagtagat

SEQ ID NO: 879361 - DNA, 22 bp, Artificial Sequence
  chemically synthesized
gaggatcaacaaagagtagata

SEQ ID NO: 879362 - DNA, 22 bp, Artificial Sequence
  chemically synthesized
aggatcaacaaagagtagatag

SEQ ID NO: 879363 - DNA, 22 bp, Artificial Sequence
  chemically synthesized
tagcaagccatgcagtgcacaa

SEQ ID NO: 879364 - DNA, 22 bp, Artificial Sequence
  chemically synthesized
attgtagcaagccatgcagtgc

SEQ ID NO: 879365 - DNA, 22 bp, Artificial Sequence
  chemically synthesized
cattgtagcaagccatgcagtg

SEQ ID NO: 879366 - DNA, 22 bp, Artificial Sequence
  chemically synthesized
tcattgtagcaagccatgcagt

SEQ ID NO: 879367 - DNA, 22 bp, Artificial Sequence
  chemically synthesized
tccatttgtgcactgcatggct

SEQ ID NO: 879368 - DNA, 22 bp, Artificial Sequence
  chemically synthesized
gtgcactgcatggcttgctaca

SEQ ID NO: 879369 - DNA, 22 bp, Artificial Sequence
  chemically synthesized
tgcactgcatggcttgctacaa

SEQ ID NO: 879370 - DNA, 22 bp, Artificial Sequence
  chemically synthesized
atatggtgactttcattgtagc

SEQ ID NO: 879371 - DNA, 22 bp, Artificial Sequence
  chemically synthesized
catggcttgctacaatgaaagt

SEQ ID NO: 879372 - DNA, 22 bp, Artificial Sequence
  chemically synthesized
agagcagttaatatggtgactt

SEQ ID NO: 879373 - DNA, 22 bp, Artificial Sequence
  chemically synthesized
gctacaatgaaagtcaccatat

SEQ ID NO: 879374 - DNA, 22 bp, Artificial Sequence
  chemically synthesized
ctacaatgaaagtcaccatatt

SEQ ID NO: 879375 - DNA, 22 bp, Artificial Sequence
  chemically synthesized
caatgaaagtcaccatattaac

SEQ ID NO: 879376 - DNA, 22 bp, Artificial Sequence
  chemically synthesized
aagaaagccagccctcagagca

SEQ ID NO: 879377 - DNA, 22 bp, Artificial Sequence
  chemically synthesized
tgaagaaagccagccctcagag

SEQ ID NO: 879378 - DNA, 22 bp, Artificial Sequence
  chemically synthesized
atgttctgaagaaagccagccc

SEQ ID NO: 879379 - DNA, 22 bp, Artificial Sequence
  chemically synthesized
actgctctgagggctggctttc

SEQ ID NO: 879380 - DNA, 22 bp, Artificial Sequence
  chemically synthesized
cgttgatgttctgaagaaagcc

SEQ ID NO: 879381 - DNA, 22 bp, Artificial Sequence
  chemically synthesized
ctctgagggctggctttcttca

SEQ ID NO: 879382 - DNA, 22 bp, Artificial Sequence
  chemically synthesized
ccgttgatgttctgaagaaagc

SEQ ID NO: 879383 - DNA, 22 bp, Artificial Sequence
  chemically synthesized
tgagggctggctttcttcagaa

SEQ ID NO: 879384 - DNA, 22 bp, Artificial Sequence
  chemically synthesized
agggctggctttcttcagaaca

SEQ ID NO: 879385 - DNA, 22 bp, Artificial Sequence
  chemically synthesized
agagtttccgttgatgttctga

SEQ ID NO: 879386 - DNA, 22 bp, Artificial Sequence
  chemically synthesized
cagagtttccgttgatgttctg

SEQ ID NO: 879387 - DNA, 22 bp, Artificial Sequence
  chemically synthesized
gctttcttcagaacatcaacgg

SEQ ID NO: 879388 - DNA, 22 bp, Artificial Sequence
  chemically synthesized
tcttcagaacatcaacggaaac

SEQ ID NO: 879389 - DNA, 22 bp, Artificial Sequence
  chemically synthesized
cttcagaacatcaacggaaact

SEQ ID NO: 879390 - DNA, 22 bp, Artificial Sequence
  chemically synthesized
ttcagaacatcaacggaaactc

SEQ ID NO: 879391 - DNA, 22 bp, Artificial Sequence
  chemically synthesized
cagaacatcaacggaaactctg

SEQ ID NO: 879392 - DNA, 22 bp, Artificial Sequence
  chemically synthesized
agaacatcaacggaaactctga

SEQ ID NO: 879393 - DNA, 22 bp, Artificial Sequence
  chemically synthesized
aaagcagcaaatttcagagttt

SEQ ID NO: 879394 - DNA, 22 bp, Artificial Sequence
  chemically synthesized
ggcaaagtcctgaaagcagcaa

SEQ ID NO: 879395 - DNA, 22 bp, Artificial Sequence
  chemically synthesized
tgaaatttgctgctttcaggac

SEQ ID NO: 879396 - DNA, 22 bp, Artificial Sequence
  chemically synthesized
aaatttgctgctttcaggactt

SEQ ID NO: 879397 - DNA, 22 bp, Artificial Sequence
  chemically synthesized
gaagagctaggcaaagtcctga

SEQ ID NO: 879398 - DNA, 22 bp, Artificial Sequence
  chemically synthesized
gttggaagagctaggcaaagtc

SEQ ID NO: 879399 - DNA, 22 bp, Artificial Sequence
  chemically synthesized
gctgctttcaggactttgccta

SEQ ID NO: 879400 - DNA, 22 bp, Artificial Sequence
  chemically synthesized
agttggaagagctaggcaaagt

SEQ ID NO: 879401 - DNA, 22 bp, Artificial Sequence
  chemically synthesized
ctgctttcaggactttgcctag

SEQ ID NO: 879402 - DNA, 22 bp, Artificial Sequence
  chemically synthesized
ctttcaggactttgcctagctc

SEQ ID NO: 879403 - DNA, 22 bp, Artificial Sequence
  chemically synthesized
tcaggactttgcctagctcttc

SEQ ID NO: 879404 - DNA, 22 bp, Artificial Sequence
  chemically synthesized
agtatttagttggaagagctag

SEQ ID NO: 879405 - DNA, 22 bp, Artificial Sequence
  chemically synthesized
caggactttgcctagctcttcc

SEQ ID NO: 879406 - DNA, 22 bp, Artificial Sequence
  chemically synthesized
aggactttgcctagctcttcca

SEQ ID NO: 879407 - DNA, 22 bp, Artificial Sequence
  chemically synthesized
tgcctagctcttccaactaaat

SEQ ID NO: 879408 - DNA, 22 bp, Artificial Sequence
  chemically synthesized
gcctagctcttccaactaaata

SEQ ID NO: 879409 - DNA, 22 bp, Artificial Sequence
  chemically synthesized
cctagctcttccaactaaatac

SEQ ID NO: 879410 - DNA, 22 bp, Artificial Sequence
  chemically synthesized
acaatgtgctcagtatttagtt

SEQ ID NO: 879411 - DNA, 22 bp, Artificial Sequence
  chemically synthesized
gctcttccaactaaatactgag

SEQ ID NO: 879412 - DNA, 22 bp, Artificial Sequence
  chemically synthesized
ttccaactaaatactgagcaca

SEQ ID NO: 879413 - DNA, 22 bp, Artificial Sequence
  chemically synthesized
ataagctaacaatgtgctcagt

SEQ ID NO: 879414 - DNA, 22 bp, Artificial Sequence
  chemically synthesized
cataagctaacaatgtgctcag

SEQ ID NO: 879415 - DNA, 22 bp, Artificial Sequence
  chemically synthesized
ccaactaaatactgagcacatt

SEQ ID NO: 879416 - DNA, 22 bp, Artificial Sequence
  chemically synthesized
tcataagctaacaatgtgctca

SEQ ID NO: 879417 - DNA, 22 bp, Artificial Sequence
  chemically synthesized
caactaaatactgagcacattg

SEQ ID NO: 879418 - DNA, 22 bp, Artificial Sequence
  chemically synthesized
ttcataagctaacaatgtgctc

SEQ ID NO: 879419 - DNA, 22 bp, Artificial Sequence
  chemically synthesized
aatactgagcacattgttagct

SEQ ID NO: 879420 - DNA, 22 bp, Artificial Sequence
  chemically synthesized
agcacattgttagcttatgaaa

SEQ ID NO: 879421 - DNA, 22 bp, Artificial Sequence
  chemically synthesized
aagcccagtataatcatttttc

SEQ ID NO: 879422 - DNA, 22 bp, Artificial Sequence
  chemically synthesized
ttagcttatgaaaaatgattat

SEQ ID NO: 879423 - DNA, 22 bp, Artificial Sequence
  chemically synthesized
gcttatgaaaaatgattatact

SEQ ID NO: 879424 - DNA, 22 bp, Artificial Sequence
  chemically synthesized
atgaaaaatgattatactgggc

SEQ ID NO: 879425 - DNA, 22 bp, Artificial Sequence
  chemically synthesized
tatccagttcaagcccagtata

SEQ ID NO: 879426 - DNA, 22 bp, Artificial Sequence
  chemically synthesized
tgaaaaatgattatactgggct

SEQ ID NO: 879427 - DNA, 22 bp, Artificial Sequence
  chemically synthesized
gtatccagttcaagcccagtat

SEQ ID NO: 879428 - DNA, 22 bp, Artificial Sequence
  chemically synthesized
gaaaagtagtttgtatccagtt

SEQ ID NO: 879429 - DNA, 22 bp, Artificial Sequence
  chemically synthesized
tactgggcttgaactggataca

SEQ ID NO: 879430 - DNA, 22 bp, Artificial Sequence
  chemically synthesized
ggcttgaactggatacaaacta

SEQ ID NO: 879431 - DNA, 22 bp, Artificial Sequence
  chemically synthesized
caaaaatctagaaaagtagttt

SEQ ID NO: 879432 - DNA, 22 bp, Artificial Sequence
  chemically synthesized
gaactggatacaaactactttt

SEQ ID NO: 879433 - DNA, 22 bp, Artificial Sequence
  chemically synthesized
aactggatacaaactacttttc

SEQ ID NO: 879434 - DNA, 22 bp, Artificial Sequence
  chemically synthesized
gatacaaactacttttctagat

SEQ ID NO: 879435 - DNA, 22 bp, Artificial Sequence
  chemically synthesized
caaccactccaaaaatctagaa

SEQ ID NO: 879436 - DNA, 22 bp, Artificial Sequence
  chemically synthesized
cttttctagatttttggagtgg

SEQ ID NO: 879437 - DNA, 22 bp, Artificial Sequence
  chemically synthesized
ttctagatttttggagtggttg

SEQ ID NO: 879438 - DNA, 22 bp, Artificial Sequence
  chemically synthesized
agaaatatattgcaaccactcc

SEQ ID NO: 879439 - DNA, 22 bp, Artificial Sequence
  chemically synthesized
tctagatttttggagtggttgc

SEQ ID NO: 879440 - DNA, 22 bp, Artificial Sequence
  chemically synthesized
ctagatttttggagtggttgca

SEQ ID NO: 879441 - DNA, 22 bp, Artificial Sequence
  chemically synthesized
tagatttttggagtggttgcaa

SEQ ID NO: 879442 - DNA, 22 bp, Artificial Sequence
  chemically synthesized
ttcagaaatatattgcaaccac

SEQ ID NO: 879443 - DNA, 22 bp, Artificial Sequence
  chemically synthesized
attcagaaatatattgcaacca

SEQ ID NO: 879444 - DNA, 22 bp, Artificial Sequence
  chemically synthesized
gatttttggagtggttgcaata

SEQ ID NO: 879445 - DNA, 22 bp, Artificial Sequence
  chemically synthesized
tattcagaaatatattgcaacc

SEQ ID NO: 879446 - DNA, 22 bp, Artificial Sequence
  chemically synthesized
ttattcagaaatatattgcaac

SEQ ID NO: 879447 - DNA, 22 bp, Artificial Sequence
  chemically synthesized
ttggagtggttgcaatatattt

SEQ ID NO: 879448 - DNA, 22 bp, Artificial Sequence
  chemically synthesized
tggagtggttgcaatatatttc

SEQ ID NO: 879449 - DNA, 22 bp, Artificial Sequence
  chemically synthesized
ggagtggttgcaatatatttct

SEQ ID NO: 879450 - DNA, 22 bp, Artificial Sequence
  chemically synthesized
gagtggttgcaatatatttctg

SEQ ID NO: 879451 - DNA, 22 bp, Artificial Sequence
  chemically synthesized
caatatatttctgaataaaagt

SEQ ID NO: 879452 - DNA, 22 bp, Artificial Sequence
  chemically synthesized
tagatatcaacatacttttatt

SEQ ID NO: 879453 - DNA, 22 bp, Artificial Sequence
  chemically synthesized
tgtagatatcaacatactttta

SEQ ID NO: 879454 - DNA, 22 bp, Artificial Sequence
  chemically synthesized
tctgtagatatcaacatacttt

SEQ ID NO: 879455 - DNA, 22 bp, Artificial Sequence
  chemically synthesized
ctctgtagatatcaacatactt

SEQ ID NO: 879456 - DNA, 22 bp, Artificial Sequence
  chemically synthesized
ctgaataaaagtatgttgatat

SEQ ID NO: 879457 - DNA, 22 bp, Artificial Sequence
  chemically synthesized
tgaataaaagtatgttgatatc

SEQ ID NO: 879458 - DNA, 22 bp, Artificial Sequence
  chemically synthesized
aataaaagtatgttgatatcta

SEQ ID NO: 879459 - DNA, 22 bp, Artificial Sequence
  chemically synthesized
aaaatcacaggtttctctgtag

SEQ ID NO: 879460 - DNA, 22 bp, Artificial Sequence
  chemically synthesized
atatctacagagaaacctgtga

SEQ ID NO: 879461 - DNA, 22 bp, Artificial Sequence
  chemically synthesized
cagagaaacctgtgattttcag

SEQ ID NO: 879462 - DNA, 22 bp, Artificial Sequence
  chemically synthesized
atgtccaaacaccagacactga

SEQ ID NO: 879463 - DNA, 22 bp, Artificial Sequence
  chemically synthesized
aatgtccaaacaccagacactg

SEQ ID NO: 879464 - DNA, 22 bp, Artificial Sequence
  chemically synthesized
tgattttcagtgtctggtgttt

SEQ ID NO: 879465 - DNA, 22 bp, Artificial Sequence
  chemically synthesized
agcttaatgtccaaacaccaga

SEQ ID NO: 879466 - DNA, 22 bp, Artificial Sequence
  chemically synthesized
tcagtgtctggtgtttggacat

SEQ ID NO: 879467 - DNA, 22 bp, Artificial Sequence
  chemically synthesized
cacctgagcttaatgtccaaac

SEQ ID NO: 879468 - DNA, 22 bp, Artificial Sequence
  chemically synthesized
cagtgtctggtgtttggacatt

SEQ ID NO: 879469 - DNA, 22 bp, Artificial Sequence
  chemically synthesized
gcacctgagcttaatgtccaaa

SEQ ID NO: 879470 - DNA, 22 bp, Artificial Sequence
  chemically synthesized
agtgtctggtgtttggacatta

SEQ ID NO: 879471 - DNA, 22 bp, Artificial Sequence
  chemically synthesized
aagtttgcacctgagcttaatg

SEQ ID NO: 879472 - DNA, 22 bp, Artificial Sequence
  chemically synthesized
gtgtttggacattaagctcagg

SEQ ID NO: 879473 - DNA, 22 bp, Artificial Sequence
  chemically synthesized
ggacattaagctcaggtgcaaa

SEQ ID NO: 879474 - DNA, 22 bp, Artificial Sequence
  chemically synthesized
gacattaagctcaggtgcaaac

SEQ ID NO: 879475 - DNA, 22 bp, Artificial Sequence
  chemically synthesized
ggtagagttgaagtttgcacct

SEQ ID NO: 879476 - DNA, 22 bp, Artificial Sequence
  chemically synthesized
aggtagagttgaagtttgcacc

SEQ ID NO: 879477 - DNA, 22 bp, Artificial Sequence
  chemically synthesized
cttaggtagagttgaagtttgc

SEQ ID NO: 879478 - DNA, 22 bp, Artificial Sequence
  chemically synthesized
ccttaggtagagttgaagtttg

SEQ ID NO: 879479 - DNA, 22 bp, Artificial Sequence
  chemically synthesized
tccttaggtagagttgaagttt

SEQ ID NO: 879480 - DNA, 22 bp, Artificial Sequence
  chemically synthesized
agctcaggtgcaaacttcaact

SEQ ID NO: 879481 - DNA, 22 bp, Artificial Sequence
  chemically synthesized
ttccttaggtagagttgaagtt

SEQ ID NO: 879482 - DNA, 22 bp, Artificial Sequence
  chemically synthesized
aggtgcaaacttcaactctacc

SEQ ID NO: 879483 - DNA, 22 bp, Artificial Sequence
  chemically synthesized
caagagacttttccttaggtag

SEQ ID NO: 879484 - DNA, 22 bp, Artificial Sequence
  chemically synthesized
acaagagacttttccttaggta

SEQ ID NO: 879485 - DNA, 22 bp, Artificial Sequence
  chemically synthesized
caactctacctaaggaaaagtc

SEQ ID NO: 879486 - DNA, 22 bp, Artificial Sequence
  chemically synthesized
cagcttacaagagacttttcct

SEQ ID NO: 879487 - DNA, 22 bp, Artificial Sequence
  chemically synthesized
aactctacctaaggaaaagtct

SEQ ID NO: 879488 - DNA, 22 bp, Artificial Sequence
  chemically synthesized
acagcttacaagagacttttcc

SEQ ID NO: 879489 - DNA, 22 bp, Artificial Sequence
  chemically synthesized
cttacagcttacaagagacttt

SEQ ID NO: 879490 - DNA, 22 bp, Artificial Sequence
  chemically synthesized
ccttacagcttacaagagactt

SEQ ID NO: 879491 - DNA, 22 bp, Artificial Sequence
  chemically synthesized
tacctaaggaaaagtctcttgt

SEQ ID NO: 879492 - DNA, 22 bp, Artificial Sequence
  chemically synthesized
tccttacagcttacaagagact

SEQ ID NO: 879493 - DNA, 22 bp, Artificial Sequence
  chemically synthesized
cctaaggaaaagtctcttgtaa

SEQ ID NO: 879494 - DNA, 22 bp, Artificial Sequence
  chemically synthesized
ttttccttacagcttacaagag

SEQ ID NO: 879495 - DNA, 22 bp, Artificial Sequence
  chemically synthesized
gttttccttacagcttacaaga

SEQ ID NO: 879496 - DNA, 22 bp, Artificial Sequence
  chemically synthesized
aggaaaagtctcttgtaagctg

SEQ ID NO: 879497 - DNA, 22 bp, Artificial Sequence
  chemically synthesized
tttgttttccttacagcttaca

SEQ ID NO: 879498 - DNA, 22 bp, Artificial Sequence
  chemically synthesized
gaagattgtttgttttccttac

SEQ ID NO: 879499 - DNA, 22 bp, Artificial Sequence
  chemically synthesized
tagaagattgtttgttttcctt

SEQ ID NO: 879500 - DNA, 22 bp, Artificial Sequence
  chemically synthesized
ttgtaagctgtaaggaaaacaa

SEQ ID NO: 879501 - DNA, 22 bp, Artificial Sequence
  chemically synthesized
ctagaagattgtttgttttcct

SEQ ID NO: 879502 - DNA, 22 bp, Artificial Sequence
  chemically synthesized
gtaagctgtaaggaaaacaaac

SEQ ID NO: 879503 - DNA, 22 bp, Artificial Sequence
  chemically synthesized
taagctgtaaggaaaacaaaca

SEQ ID NO: 879504 - DNA, 22 bp, Artificial Sequence
  chemically synthesized
atttctagaagattgtttgttt

SEQ ID NO: 879505 - DNA, 22 bp, Artificial Sequence
  chemically synthesized
catttctagaagattgtttgtt

SEQ ID NO: 879506 - DNA, 22 bp, Artificial Sequence
  chemically synthesized
taaggaaaacaaacaatcttct

SEQ ID NO: 879507 - DNA, 22 bp, Artificial Sequence
  chemically synthesized
gcccaagcttcatttctagaag

SEQ ID NO: 879508 - DNA, 22 bp, Artificial Sequence
  chemically synthesized
ggcccaagcttcatttctagaa

SEQ ID NO: 879509 - DNA, 22 bp, Artificial Sequence
  chemically synthesized
cgcttggcccaagcttcatttc

SEQ ID NO: 879510 - DNA, 22 bp, Artificial Sequence
  chemically synthesized
gcgcttggcccaagcttcattt

SEQ ID NO: 879511 - DNA, 22 bp, Artificial Sequence
  chemically synthesized
ccttgcgcttggcccaagcttc

SEQ ID NO: 879512 - DNA, 22 bp, Artificial Sequence
  chemically synthesized
cccttgcgcttggcccaagctt

SEQ ID NO: 879513 - DNA, 22 bp, Artificial Sequence
  chemically synthesized
ctagaaatgaagcttgggccaa

SEQ ID NO: 879514 - DNA, 22 bp, Artificial Sequence
  chemically synthesized
tagaaatgaagcttgggccaag

SEQ ID NO: 879515 - DNA, 22 bp, Artificial Sequence
  chemically synthesized
gtttcccttgcgcttggcccaa

SEQ ID NO: 879516 - DNA, 22 bp, Artificial Sequence
  chemically synthesized
agtttcccttgcgcttggccca

SEQ ID NO: 879517 - DNA, 22 bp, Artificial Sequence
  chemically synthesized
gaaatgaagcttgggccaagcg

SEQ ID NO: 879518 - DNA, 22 bp, Artificial Sequence
  chemically synthesized
cttagtttcccttgcgcttggc

SEQ ID NO: 879519 - DNA, 22 bp, Artificial Sequence
  chemically synthesized
aggtcgctgcttagtttccctt

SEQ ID NO: 879520 - DNA, 22 bp, Artificial Sequence
  chemically synthesized
gggccaagcgcaagggaaacta

SEQ ID NO: 879521 - DNA, 22 bp, Artificial Sequence
  chemically synthesized
ggccaagcgcaagggaaactaa

SEQ ID NO: 879522 - DNA, 22 bp, Artificial Sequence
  chemically synthesized
taaggtcgctgcttagtttccc

SEQ ID NO: 879523 - DNA, 22 bp, Artificial Sequence
  chemically synthesized
tctctaaggtcgctgcttagtt

SEQ ID NO: 879524 - DNA, 22 bp, Artificial Sequence
  chemically synthesized
tgtctctaaggtcgctgcttag

SEQ ID NO: 879525 - DNA, 22 bp, Artificial Sequence
  chemically synthesized
gattctgtctctaaggtcgctg

SEQ ID NO: 879526 - DNA, 22 bp, Artificial Sequence
  chemically synthesized
agattctgtctctaaggtcgct

SEQ ID NO: 879527 - DNA, 22 bp, Artificial Sequence
  chemically synthesized
agcagcgaccttagagacagaa

SEQ ID NO: 879528 - DNA, 22 bp, Artificial Sequence
  chemically synthesized
ccatgacttagattctgtctct

SEQ ID NO: 879529 - DNA, 22 bp, Artificial Sequence
  chemically synthesized
agagacagaatctaagtcatgg

SEQ ID NO: 879530 - DNA, 22 bp, Artificial Sequence
  chemically synthesized
caaacaacattaccatgactta

SEQ ID NO: 879531 - DNA, 22 bp, Artificial Sequence
  chemically synthesized
gagacagaatctaagtcatggt

SEQ ID NO: 879532 - DNA, 22 bp, Artificial Sequence
  chemically synthesized
gcaaacaacattaccatgactt

SEQ ID NO: 879533 - DNA, 22 bp, Artificial Sequence
  chemically synthesized
tccttgcaaacaacattaccat

SEQ ID NO: 879534 - DNA, 22 bp, Artificial Sequence
  chemically synthesized
gtccttgcaaacaacattacca

SEQ ID NO: 879535 - DNA, 22 bp, Artificial Sequence
  chemically synthesized
agtcatggtaatgttgtttgca

SEQ ID NO: 879536 - DNA, 22 bp, Artificial Sequence
  chemically synthesized
tacagaaccagtttgtccttgc

SEQ ID NO: 879537 - DNA, 22 bp, Artificial Sequence
  chemically synthesized
attatacagaaccagtttgtcc

SEQ ID NO: 879538 - DNA, 22 bp, Artificial Sequence
  chemically synthesized
tttgcaaggacaaactggttct

SEQ ID NO: 879539 - DNA, 22 bp, Artificial Sequence
  chemically synthesized
gcaaggacaaactggttctgta

SEQ ID NO: 879540 - DNA, 22 bp, Artificial Sequence
  chemically synthesized
caaggacaaactggttctgtat

SEQ ID NO: 879541 - DNA, 22 bp, Artificial Sequence
  chemically synthesized
aggtcaataacctcattataca

SEQ ID NO: 879542 - DNA, 22 bp, Artificial Sequence
  chemically synthesized
gttctgtataatgaggttattg

SEQ ID NO: 879543 - DNA, 22 bp, Artificial Sequence
  chemically synthesized
aaaacagttcaggtcaataacc

SEQ ID NO: 879544 - DNA, 22 bp, Artificial Sequence
  chemically synthesized
gaaaacagttcaggtcaataac

SEQ ID NO: 879545 - DNA, 22 bp, Artificial Sequence
  chemically synthesized
tgtataatgaggttattgacct

SEQ ID NO: 879546 - DNA, 22 bp, Artificial Sequence
  chemically synthesized
tataatgaggttattgacctga

SEQ ID NO: 879547 - DNA, 22 bp, Artificial Sequence
  chemically synthesized
cttgaaaacagttcaggtcaat

SEQ ID NO: 879548 - DNA, 22 bp, Artificial Sequence
  chemically synthesized
aaactgcttgaaaacagttcag

SEQ ID NO: 879549 - DNA, 22 bp, Artificial Sequence
  chemically synthesized
aaaactgcttgaaaacagttca

SEQ ID NO: 879550 - DNA, 22 bp, Artificial Sequence
  chemically synthesized
ttgacctgaactgttttcaagc

SEQ ID NO: 879551 - DNA, 22 bp, Artificial Sequence
  chemically synthesized
atgtttaaaactgcttgaaaac

SEQ ID NO: 879552 - DNA, 22 bp, Artificial Sequence
  chemically synthesized
acctgaactgttttcaagcagt

SEQ ID NO: 879553 - DNA, 22 bp, Artificial Sequence
  chemically synthesized
gtcctcatgtttaaaactgctt

SEQ ID NO: 879554 - DNA, 22 bp, Artificial Sequence
  chemically synthesized
aactgttttcaagcagttttaa

SEQ ID NO: 879555 - DNA, 22 bp, Artificial Sequence
  chemically synthesized
ttttcaagcagttttaaacatg

SEQ ID NO: 879556 - DNA, 22 bp, Artificial Sequence
  chemically synthesized
tcaagcagttttaaacatgagg

SEQ ID NO: 879557 - DNA, 22 bp, Artificial Sequence
  chemically synthesized
caagcagttttaaacatgagga

SEQ ID NO: 879558 - DNA, 22 bp, Artificial Sequence
  chemically synthesized
aagcagttttaaacatgaggac

SEQ ID NO: 879559 - DNA, 22 bp, Artificial Sequence
  chemically synthesized
gatacaatgaacctcgtcctca

SEQ ID NO: 879560 - DNA, 22 bp, Artificial Sequence
  chemically synthesized
ggatacaatgaacctcgtcctc

SEQ ID NO: 879561 - DNA, 22 bp, Artificial Sequence
  chemically synthesized
taaacatgaggacgaggttcat

SEQ ID NO: 879562 - DNA, 22 bp, Artificial Sequence
  chemically synthesized
aaacatgaggacgaggttcatt

SEQ ID NO: 879563 - DNA, 22 bp, Artificial Sequence
  chemically synthesized
aacatgaggacgaggttcattg

SEQ ID NO: 879564 - DNA, 22 bp, Artificial Sequence
  chemically synthesized
caggcttggatacaatgaacct

SEQ ID NO: 879565 - DNA, 22 bp, Artificial Sequence
  chemically synthesized
atgttgcaggcttggatacaat

SEQ ID NO: 879566 - DNA, 22 bp, Artificial Sequence
  chemically synthesized
agttaatgttgcaggcttggat

SEQ ID NO: 879567 - DNA, 22 bp, Artificial Sequence
  chemically synthesized
tcagttaatgttgcaggcttgg

SEQ ID NO: 879568 - DNA, 22 bp, Artificial Sequence
  chemically synthesized
ctcagttaatgttgcaggcttg

SEQ ID NO: 879569 - DNA, 22 bp, Artificial Sequence
  chemically synthesized
attgtatccaagcctgcaacat

SEQ ID NO: 879570 - DNA, 22 bp, Artificial Sequence
  chemically synthesized
gtttctcagttaatgttgcagg

SEQ ID NO: 879571 - DNA, 22 bp, Artificial Sequence
  chemically synthesized
ggtttctcagttaatgttgcag

SEQ ID NO: 879572 - DNA, 22 bp, Artificial Sequence
  chemically synthesized
tatccaagcctgcaacattaac

SEQ ID NO: 879573 - DNA, 22 bp, Artificial Sequence
  chemically synthesized
atcagtcttggtttctcagtta

SEQ ID NO: 879574 - DNA, 22 bp, Artificial Sequence
  chemically synthesized
ttgatcagtcttggtttctcag

SEQ ID NO: 879575 - DNA, 22 bp, Artificial Sequence
  chemically synthesized
attgatcagtcttggtttctca

SEQ ID NO: 879576 - DNA, 22 bp, Artificial Sequence
  chemically synthesized
caacattaactgagaaaccaag

SEQ ID NO: 879577 - DNA, 22 bp, Artificial Sequence
  chemically synthesized
tttattgatcagtcttggtttc

SEQ ID NO: 879578 - DNA, 22 bp, Artificial Sequence
  chemically synthesized
actgagaaaccaagactgatca

SEQ ID NO: 879579 - DNA, 22 bp, Artificial Sequence
  chemically synthesized
agaaaccaagactgatcaataa

SEQ ID NO: 879580 - DNA, 22 bp, Artificial Sequence
  chemically synthesized
taatcatggctgtttattgatc

SEQ ID NO: 879581 - DNA, 22 bp, Artificial Sequence
  chemically synthesized
agatcctgtaatcatggctgtt

SEQ ID NO: 879582 - DNA, 22 bp, Artificial Sequence
  chemically synthesized
ctgagatcctgtaatcatggct

SEQ ID NO: 879583 - DNA, 22 bp, Artificial Sequence
  chemically synthesized
atcaataaacagccatgattac

SEQ ID NO: 879584 - DNA, 22 bp, Artificial Sequence
  chemically synthesized
tgatgaaggttcctgagatcct

SEQ ID NO: 879585 - DNA, 22 bp, Artificial Sequence
  chemically synthesized
ccattatgatgaaggttcctga

SEQ ID NO: 879586 - DNA, 22 bp, Artificial Sequence
  chemically synthesized
caggatctcaggaaccttcatc

SEQ ID NO: 879587 - DNA, 22 bp, Artificial Sequence
  chemically synthesized
taatggctcccattatgatgaa

SEQ ID NO: 879588 - DNA, 22 bp, Artificial Sequence
  chemically synthesized
aggaaccttcatcataatggga

SEQ ID NO: 879589 - DNA, 22 bp, Artificial Sequence
  chemically synthesized
accagaattataatggctccca

SEQ ID NO: 879590 - DNA, 22 bp, Artificial Sequence
  chemically synthesized
catcataatgggagccattata

SEQ ID NO: 879591 - DNA, 22 bp, Artificial Sequence
  chemically synthesized
atcataatgggagccattataa

SEQ ID NO: 879592 - DNA, 22 bp, Artificial Sequence
  chemically synthesized
tacctgaccagaattataatgg

SEQ ID NO: 879593 - DNA, 22 bp, Artificial Sequence
  chemically synthesized
tgtacctgaccagaattataat

SEQ ID NO: 879594 - DNA, 22 bp, Artificial Sequence
  chemically synthesized
tctgtacctgaccagaattata

SEQ ID NO: 879595 - DNA, 22 bp, Artificial Sequence
  chemically synthesized
attctctgtacctgaccagaat

SEQ ID NO: 879596 - DNA, 22 bp, Artificial Sequence
  chemically synthesized
cctgattctctgtacctgacca

SEQ ID NO: 879597 - DNA, 22 bp, Artificial Sequence
  chemically synthesized
taattctggtcaggtacagaga

SEQ ID NO: 879598 - DNA, 22 bp, Artificial Sequence
  chemically synthesized
gcagtaggttacctgattctct

SEQ ID NO: 879599 - DNA, 22 bp, Artificial Sequence
  chemically synthesized
tggtcaggtacagagaatcagg

SEQ ID NO: 879600 - DNA, 22 bp, Artificial Sequence
  chemically synthesized
gtcaggtacagagaatcaggta

SEQ ID NO: 879601 - DNA, 22 bp, Artificial Sequence
  chemically synthesized
aatatacgttagcagtaggtta

SEQ ID NO: 879602 - DNA, 22 bp, Artificial Sequence
  chemically synthesized
ctgctaacgtatatttagcact

SEQ ID NO: 879603 - DNA, 22 bp, Artificial Sequence
  chemically synthesized
caaatgagagtccagtgctaaa

SEQ ID NO: 879604 - DNA, 22 bp, Artificial Sequence
  chemically synthesized
gcaaatgagagtccagtgctaa

SEQ ID NO: 879605 - DNA, 22 bp, Artificial Sequence
  chemically synthesized
ctaacgtatatttagcactgga

SEQ ID NO: 879606 - DNA, 22 bp, Artificial Sequence
  chemically synthesized
acgtatatttagcactggactc

SEQ ID NO: 879607 - DNA, 22 bp, Artificial Sequence
  chemically synthesized
catttgcaaatgagagtccagt

SEQ ID NO: 879608 - DNA, 22 bp, Artificial Sequence
  chemically synthesized
ccatttgcaaatgagagtccag

SEQ ID NO: 879609 - DNA, 22 bp, Artificial Sequence
  chemically synthesized
agcactggactctcatttgcaa

SEQ ID NO: 879610 - DNA, 22 bp, Artificial Sequence
  chemically synthesized
gcactggactctcatttgcaaa

SEQ ID NO: 879611 - DNA, 22 bp, Artificial Sequence
  chemically synthesized
atcaatggcttccatttgcaaa

SEQ ID NO: 879612 - DNA, 22 bp, Artificial Sequence
  chemically synthesized
gactctcatttgcaaatggaag

SEQ ID NO: 879613 - DNA, 22 bp, Artificial Sequence
  chemically synthesized
tcatttgcaaatggaagccatt

SEQ ID NO: 879614 - DNA, 22 bp, Artificial Sequence
  chemically synthesized
atttgcaaatggaagccattga

SEQ ID NO: 879615 - DNA, 22 bp, Artificial Sequence
  chemically synthesized
aaaaaatagctaatcaatggct

SEQ ID NO: 879616 - DNA, 22 bp, Artificial Sequence
  chemically synthesized
caaaaaatagctaatcaatggc

SEQ ID NO: 879617 - DNA, 22 bp, Artificial Sequence
  chemically synthesized
tcaaaaaatagctaatcaatgg

SEQ ID NO: 879618 - DNA, 22 bp, Artificial Sequence
  chemically synthesized
gcaaatggaagccattgattag

SEQ ID NO: 879619 - DNA, 22 bp, Artificial Sequence
  chemically synthesized
caaatggaagccattgattagc

SEQ ID NO: 879620 - DNA, 22 bp, Artificial Sequence
  chemically synthesized
attagctattttttgaaaactg

SEQ ID NO: 879621 - DNA, 22 bp, Artificial Sequence
  chemically synthesized
gctattttttgaaaactgacct

SEQ ID NO: 879622 - DNA, 22 bp, Artificial Sequence
  chemically synthesized
ttttttgaaaactgacctggct

SEQ ID NO: 879623 - DNA, 22 bp, Artificial Sequence
  chemically synthesized
tttgaaaactgacctggctttc

SEQ ID NO: 879624 - DNA, 22 bp, Artificial Sequence
  chemically synthesized
ttgaaaactgacctggctttcc

SEQ ID NO: 879625 - DNA, 22 bp, Artificial Sequence
  chemically synthesized
tgaaaactgacctggctttcca

SEQ ID NO: 879626 - DNA, 22 bp, Artificial Sequence
  chemically synthesized
gaaaactgacctggctttccat

SEQ ID NO: 879627 - DNA, 22 bp, Artificial Sequence
  chemically synthesized
aaaactgacctggctttccatc

SEQ ID NO: 879628 - DNA, 22 bp, Artificial Sequence
  chemically synthesized
cataaggagggagatggaaagc

SEQ ID NO: 879629 - DNA, 22 bp, Artificial Sequence
  chemically synthesized
ttacataaggagggagatggaa

SEQ ID NO: 879630 - DNA, 22 bp, Artificial Sequence
  chemically synthesized
acctggctttccatctccctcc

SEQ ID NO: 879631 - DNA, 22 bp, Artificial Sequence
  chemically synthesized
acaggctattacataaggaggg

SEQ ID NO: 879632 - DNA, 22 bp, Artificial Sequence
  chemically synthesized
gctttccatctccctccttatg

SEQ ID NO: 879633 - DNA, 22 bp, Artificial Sequence
  chemically synthesized
ttcacaggctattacataagga

SEQ ID NO: 879634 - DNA, 22 bp, Artificial Sequence
  chemically synthesized
attcacaggctattacataagg

SEQ ID NO: 879635 - DNA, 22 bp, Artificial Sequence
  chemically synthesized
tccatctccctccttatgtaat

SEQ ID NO: 879636 - DNA, 22 bp, Artificial Sequence
  chemically synthesized
ccatctccctccttatgtaata

SEQ ID NO: 879637 - DNA, 22 bp, Artificial Sequence
  chemically synthesized
catctccctccttatgtaatag

SEQ ID NO: 879638 - DNA, 22 bp, Artificial Sequence
  chemically synthesized
cctccttatgtaatagcctgtg

SEQ ID NO: 879639 - DNA, 22 bp, Artificial Sequence
  chemically synthesized
ggtcacatttattcacaggcta

SEQ ID NO: 879640 - DNA, 22 bp, Artificial Sequence
  chemically synthesized
cttatgtaatagcctgtgaata

SEQ ID NO: 879641 - DNA, 22 bp, Artificial Sequence
  chemically synthesized
atgtaatagcctgtgaataaat

SEQ ID NO: 879642 - DNA, 22 bp, Artificial Sequence
  chemically synthesized
tgtaatagcctgtgaataaatg

SEQ ID NO: 879643 - DNA, 22 bp, Artificial Sequence
  chemically synthesized
aagtctaggtcacatttattca

SEQ ID NO: 879644 - DNA, 22 bp, Artificial Sequence
  chemically synthesized
tgaataaatgtgacctagactt

SEQ ID NO: 879645 - DNA, 22 bp, Artificial Sequence
  chemically synthesized
catatccatgttgaagtctagg

SEQ ID NO: 879646 - DNA, 22 bp, Artificial Sequence
  chemically synthesized
tccatatccatgttgaagtcta

SEQ ID NO: 879647 - DNA, 22 bp, Artificial Sequence
  chemically synthesized
ctccatatccatgttgaagtct

SEQ ID NO: 879648 - DNA, 22 bp, Artificial Sequence
  chemically synthesized
ttctccatatccatgttgaagt

SEQ ID NO: 879649 - DNA, 22 bp, Artificial Sequence
  chemically synthesized
cttctccatatccatgttgaag

SEQ ID NO: 879650 - DNA, 22 bp, Artificial Sequence
  chemically synthesized
tcttctccatatccatgttgaa

SEQ ID NO: 879651 - DNA, 22 bp, Artificial Sequence
  chemically synthesized
ttcttctccatatccatgttga

SEQ ID NO: 879652 - DNA, 22 bp, Artificial Sequence
  chemically synthesized
tttcttctccatatccatgttg

SEQ ID NO: 879653 - DNA, 22 bp, Artificial Sequence
  chemically synthesized
ttttcttctccatatccatgtt

SEQ ID NO: 879654 - DNA, 22 bp, Artificial Sequence
  chemically synthesized
tttttcttctccatatccatgt

SEQ ID NO: 879655 - DNA, 22 bp, Artificial Sequence
  chemically synthesized
ttttttcttctccatatccatg

SEQ ID NO: 879656 - DNA, 22 bp, Artificial Sequence
  chemically synthesized
cttttttttcttctccatatcc

SEQ ID NO: 879657 - DNA, 22 bp, Artificial Sequence
  chemically synthesized
gacttcaacatggatatggaga

SEQ ID NO: 879658 - DNA, 22 bp, Artificial Sequence
  chemically synthesized
tacttttttttcttctccatat

SEQ ID NO: 879659 - DNA, 22 bp, Artificial Sequence
  chemically synthesized
ctacttttttttcttctccata

SEQ ID NO: 879660 - DNA, 22 bp, Artificial Sequence
  chemically synthesized
tctacttttttttcttctccat

SEQ ID NO: 879661 - DNA, 22 bp, Artificial Sequence
  chemically synthesized
caacatggatatggagaagaaa

SEQ ID NO: 879662 - DNA, 22 bp, Artificial Sequence
  chemically synthesized
aacatggatatggagaagaaaa

SEQ ID NO: 879663 - DNA, 22 bp, Artificial Sequence
  chemically synthesized
ggataaacctttctactttttt

SEQ ID NO: 879664 - DNA, 22 bp, Artificial Sequence
  chemically synthesized
gcctgggataaacctttctact

SEQ ID NO: 879665 - DNA, 22 bp, Artificial Sequence
  chemically synthesized
gcaaaaagctggcctgggataa

SEQ ID NO: 879666 - DNA, 22 bp, Artificial Sequence
  chemically synthesized
ggcaaaaagctggcctgggata

SEQ ID NO: 879667 - DNA, 22 bp, Artificial Sequence
  chemically synthesized
tggcaaaaagctggcctgggat

SEQ ID NO: 879668 - DNA, 22 bp, Artificial Sequence
  chemically synthesized
tttggcaaaaagctggcctggg

SEQ ID NO: 879669 - DNA, 22 bp, Artificial Sequence
  chemically synthesized
ctttggcaaaaagctggcctgg

SEQ ID NO: 879670 - DNA, 22 bp, Artificial Sequence
  chemically synthesized
tttctttggcaaaaagctggcc

SEQ ID NO: 879671 - DNA, 22 bp, Artificial Sequence
  chemically synthesized
atttctttggcaaaaagctggc

SEQ ID NO: 879672 - DNA, 22 bp, Artificial Sequence
  chemically synthesized
cttatttctttggcaaaaagct

SEQ ID NO: 879673 - DNA, 22 bp, Artificial Sequence
  chemically synthesized
atcccaggccagctttttgcca

SEQ ID NO: 879674 - DNA, 22 bp, Artificial Sequence
  chemically synthesized
tcccaggccagctttttgccaa

SEQ ID NO: 879675 - DNA, 22 bp, Artificial Sequence
  chemically synthesized
tttgccaaagaaataagcaatt

SEQ ID NO: 879676 - DNA, 22 bp, Artificial Sequence
  chemically synthesized
ttgccaaagaaataagcaatta

SEQ ID NO: 879677 - DNA, 22 bp, Artificial Sequence
  chemically synthesized
tgccaaagaaataagcaattac

SEQ ID NO: 879678 - DNA, 22 bp, Artificial Sequence
  chemically synthesized
gtgaaatgtcatgtaattgctt

SEQ ID NO: 879679 - DNA, 22 bp, Artificial Sequence
  chemically synthesized
gccaaagaaataagcaattaca

SEQ ID NO: 879680 - DNA, 22 bp, Artificial Sequence
  chemically synthesized
agtgaaatgtcatgtaattgct

SEQ ID NO: 879681 - DNA, 22 bp, Artificial Sequence
  chemically synthesized
ccaaagaaataagcaattacat

SEQ ID NO: 879682 - DNA, 22 bp, Artificial Sequence
  chemically synthesized
tagtgaaatgtcatgtaattgc

SEQ ID NO: 879683 - DNA, 22 bp, Artificial Sequence
  chemically synthesized
ttagtgaaatgtcatgtaattg

SEQ ID NO: 879684 - DNA, 22 bp, Artificial Sequence
  chemically synthesized
ggtcaagaatttttagtgaaat

SEQ ID NO: 879685 - DNA, 22 bp, Artificial Sequence
  chemically synthesized
ttgggtcaagaatttttagtga

SEQ ID NO: 879686 - DNA, 22 bp, Artificial Sequence
  chemically synthesized
attgggtcaagaatttttagtg

SEQ ID NO: 879687 - DNA, 22 bp, Artificial Sequence
  chemically synthesized
tattgggtcaagaatttttagt

SEQ ID NO: 879688 - DNA, 22 bp, Artificial Sequence
  chemically synthesized
catgacatttcactaaaaattc

SEQ ID NO: 879689 - DNA, 22 bp, Artificial Sequence
  chemically synthesized
agtattttattgggtcaagaat

SEQ ID NO: 879690 - DNA, 22 bp, Artificial Sequence
  chemically synthesized
cagtattttattgggtcaagaa

SEQ ID NO: 879691 - DNA, 22 bp, Artificial Sequence
  chemically synthesized
cactaaaaattcttgacccaat

SEQ ID NO: 879692 - DNA, 22 bp, Artificial Sequence
  chemically synthesized
actaaaaattcttgacccaata

SEQ ID NO: 879693 - DNA, 22 bp, Artificial Sequence
  chemically synthesized
aggcttcagtattttattgggt

SEQ ID NO: 879694 - DNA, 22 bp, Artificial Sequence
  chemically synthesized
aaaattcttgacccaataaaat

SEQ ID NO: 879695 - DNA, 22 bp, Artificial Sequence
  chemically synthesized
ttgacccaataaaatactgaag

SEQ ID NO: 879696 - DNA, 22 bp, Artificial Sequence
  chemically synthesized
gacccaataaaatactgaagcc

SEQ ID NO: 879697 - DNA, 22 bp, Artificial Sequence
  chemically synthesized
acccaataaaatactgaagcct

SEQ ID NO: 879698 - DNA, 22 bp, Artificial Sequence
  chemically synthesized
taaaagagtaaaatcggcattg

SEQ ID NO: 879699 - DNA, 22 bp, Artificial Sequence
  chemically synthesized
ataaaagagtaaaatcggcatt

SEQ ID NO: 879700 - DNA, 22 bp, Artificial Sequence
  chemically synthesized
ttataaaagagtaaaatcggca

SEQ ID NO: 879701 - DNA, 22 bp, Artificial Sequence
  chemically synthesized
cttataaaagagtaaaatcggc

SEQ ID NO: 879702 - DNA, 22 bp, Artificial Sequence
  chemically synthesized
tcttataaaagagtaaaatcgg

SEQ ID NO: 879703 - DNA, 22 bp, Artificial Sequence
  chemically synthesized
aagcctcaatgccgattttact

SEQ ID NO: 879704 - DNA, 22 bp, Artificial Sequence
  chemically synthesized
tttcttataaaagagtaaaatc

SEQ ID NO: 879705 - DNA, 22 bp, Artificial Sequence
  chemically synthesized
ctctttcttataaaagagtaaa

SEQ ID NO: 879706 - DNA, 22 bp, Artificial Sequence
  chemically synthesized
aatgccgattttactcttttat

SEQ ID NO: 879707 - DNA, 22 bp, Artificial Sequence
  chemically synthesized
ttgctctttcttataaaagagt

SEQ ID NO: 879708 - DNA, 22 bp, Artificial Sequence
  chemically synthesized
gttgctctttcttataaaagag

SEQ ID NO: 879709 - DNA, 22 bp, Artificial Sequence
  chemically synthesized
tgttgctctttcttataaaaga

SEQ ID NO: 879710 - DNA, 22 bp, Artificial Sequence
  chemically synthesized
tttgttgctctttcttataaaa

SEQ ID NO: 879711 - DNA, 22 bp, Artificial Sequence
  chemically synthesized
ctttgttgctctttcttataaa

SEQ ID NO: 879712 - DNA, 22 bp, Artificial Sequence
  chemically synthesized
tctttgttgctctttcttataa

SEQ ID NO: 879713 - DNA, 22 bp, Artificial Sequence
  chemically synthesized
ttctttgttgctctttcttata

SEQ ID NO: 879714 - DNA, 22 bp, Artificial Sequence
  chemically synthesized
ttttctttgttgctctttctta

SEQ ID NO: 879715 - DNA, 22 bp, Artificial Sequence
  chemically synthesized
cttttctttgttgctctttctt

SEQ ID NO: 879716 - DNA, 22 bp, Artificial Sequence
  chemically synthesized
tactcttttataagaaagagca

SEQ ID NO: 879717 - DNA, 22 bp, Artificial Sequence
  chemically synthesized
tcttttctttgttgctctttct

SEQ ID NO: 879718 - DNA, 22 bp, Artificial Sequence
  chemically synthesized
actcttttataagaaagagcaa

SEQ ID NO: 879719 - DNA, 22 bp, Artificial Sequence
  chemically synthesized
ctcttttataagaaagagcaac

SEQ ID NO: 879720 - DNA, 22 bp, Artificial Sequence
  chemically synthesized
ttttataagaaagagcaacaaa

SEQ ID NO: 879721 - DNA, 22 bp, Artificial Sequence
  chemically synthesized
ttataagaaagagcaacaaaga

SEQ ID NO: 879722 - DNA, 22 bp, Artificial Sequence
  chemically synthesized
tataagaaagagcaacaaagaa

SEQ ID NO: 879723 - DNA, 22 bp, Artificial Sequence
  chemically synthesized
ataagaaagagcaacaaagaaa

SEQ ID NO: 879724 - DNA, 22 bp, Artificial Sequence
  chemically synthesized
taagaaagagcaacaaagaaaa

SEQ ID NO: 879725 - DNA, 22 bp, Artificial Sequence
  chemically synthesized
taaagaatcacaatatggtccg

SEQ ID NO: 879726 - DNA, 22 bp, Artificial Sequence
  chemically synthesized
caacagctgtaaagaatcacaa

SEQ ID NO: 879727 - DNA, 22 bp, Artificial Sequence
  chemically synthesized
tctccaacagctgtaaagaatc

SEQ ID NO: 879728 - DNA, 22 bp, Artificial Sequence
  chemically synthesized
tgattctttacagctgttggag

SEQ ID NO: 879729 - DNA, 22 bp, Artificial Sequence
  chemically synthesized
catcatagtgtctgtctccaac

SEQ ID NO: 879730 - DNA, 22 bp, Artificial Sequence
  chemically synthesized
tttacagctgttggagacagac

SEQ ID NO: 879731 - DNA, 22 bp, Artificial Sequence
  chemically synthesized
ctgcatcatagtgtctgtctcc

SEQ ID NO: 879732 - DNA, 22 bp, Artificial Sequence
  chemically synthesized
tacagctgttggagacagacac

SEQ ID NO: 879733 - DNA, 22 bp, Artificial Sequence
  chemically synthesized
acagctgttggagacagacact

SEQ ID NO: 879734 - DNA, 22 bp, Artificial Sequence
  chemically synthesized
cagctgttggagacagacacta

SEQ ID NO: 879735 - DNA, 22 bp, Artificial Sequence
  chemically synthesized
ttggagacagacactatgatgc

SEQ ID NO: 879736 - DNA, 22 bp, Artificial Sequence
  chemically synthesized
aaatcaagctactgcatcatag

SEQ ID NO: 879737 - DNA, 22 bp, Artificial Sequence
  chemically synthesized
gagacagacactatgatgcagt

SEQ ID NO: 879738 - DNA, 22 bp, Artificial Sequence
  chemically synthesized
attcaaatcaagctactgcatc

SEQ ID NO: 879739 - DNA, 22 bp, Artificial Sequence
  chemically synthesized
aattcaaatcaagctactgcat

SEQ ID NO: 879740 - DNA, 22 bp, Artificial Sequence
  chemically synthesized
gtttaattcaaatcaagctact

SEQ ID NO: 879741 - DNA, 22 bp, Artificial Sequence
  chemically synthesized
ggtttaattcaaatcaagctac

SEQ ID NO: 879742 - DNA, 22 bp, Artificial Sequence
  chemically synthesized
tttggtttaattcaaatcaagc

SEQ ID NO: 879743 - DNA, 22 bp, Artificial Sequence
  chemically synthesized
tgatgcagtagcttgatttgaa

SEQ ID NO: 879744 - DNA, 22 bp, Artificial Sequence
  chemically synthesized
atattgtttggtttaattcaaa

SEQ ID NO: 879745 - DNA, 22 bp, Artificial Sequence
  chemically synthesized
catattgtttggtttaattcaa

SEQ ID NO: 879746 - DNA, 22 bp, Artificial Sequence
  chemically synthesized
tcatattgtttggtttaattca

SEQ ID NO: 879747 - DNA, 22 bp, Artificial Sequence
  chemically synthesized
ttcatattgtttggtttaattc

SEQ ID NO: 879748 - DNA, 22 bp, Artificial Sequence
  chemically synthesized
atgcttttcatattgtttggtt

SEQ ID NO: 879749 - DNA, 22 bp, Artificial Sequence
  chemically synthesized
gatttgaattaaaccaaacaat

SEQ ID NO: 879750 - DNA, 22 bp, Artificial Sequence
  chemically synthesized
gatgcttttcatattgtttggt

SEQ ID NO: 879751 - DNA, 22 bp, Artificial Sequence
  chemically synthesized
atttgaattaaaccaaacaata

SEQ ID NO: 879752 - DNA, 22 bp, Artificial Sequence
  chemically synthesized
gaattaaaccaaacaatatgaa

SEQ ID NO: 879753 - DNA, 22 bp, Artificial Sequence
  chemically synthesized
aattaaaccaaacaatatgaaa

SEQ ID NO: 879754 - DNA, 22 bp, Artificial Sequence
  chemically synthesized
ccagccttgatgcttttcatat

SEQ ID NO: 879755 - DNA, 22 bp, Artificial Sequence
  chemically synthesized
gccagccttgatgcttttcata

SEQ ID NO: 879756 - DNA, 22 bp, Artificial Sequence
  chemically synthesized
aaccaaacaatatgaaaagcat

SEQ ID NO: 879757 - DNA, 22 bp, Artificial Sequence
  chemically synthesized
cttgccagccttgatgcttttc

SEQ ID NO: 879758 - DNA, 22 bp, Artificial Sequence
  chemically synthesized
gcttgccagccttgatgctttt

SEQ ID NO: 879759 - DNA, 22 bp, Artificial Sequence
  chemically synthesized
tgcttgccagccttgatgcttt

SEQ ID NO: 879760 - DNA, 22 bp, Artificial Sequence
  chemically synthesized
ctttgcttgccagccttgatgc

SEQ ID NO: 879761 - DNA, 22 bp, Artificial Sequence
  chemically synthesized
ttgctttgcttgccagccttga

SEQ ID NO: 879762 - DNA, 22 bp, Artificial Sequence
  chemically synthesized
attgctttgcttgccagccttg

SEQ ID NO: 879763 - DNA, 22 bp, Artificial Sequence
  chemically synthesized
tattgctttgcttgccagcctt

SEQ ID NO: 879764 - DNA, 22 bp, Artificial Sequence
  chemically synthesized
gggctttattgctttgcttgcc

SEQ ID NO: 879765 - DNA, 22 bp, Artificial Sequence
  chemically synthesized
ggggctttattgctttgcttgc

SEQ ID NO: 879766 - DNA, 22 bp, Artificial Sequence
  chemically synthesized
tggggctttattgctttgcttg

SEQ ID NO: 879767 - DNA, 22 bp, Artificial Sequence
  chemically synthesized
tttggggctttattgctttgct

SEQ ID NO: 879768 - DNA, 22 bp, Artificial Sequence
  chemically synthesized
aattctttggggctttattgct

SEQ ID NO: 879769 - DNA, 22 bp, Artificial Sequence
  chemically synthesized
gcaagcaaagcaataaagcccc

SEQ ID NO: 879770 - DNA, 22 bp, Artificial Sequence
  chemically synthesized
aaggtagattaaattctttggg

SEQ ID NO: 879771 - DNA, 22 bp, Artificial Sequence
  chemically synthesized
caaggtagattaaattctttgg

SEQ ID NO: 879772 - DNA, 22 bp, Artificial Sequence
  chemically synthesized
aatctaccttgaaggtgggact

SEQ ID NO: 879773 - DNA, 22 bp, Artificial Sequence
  chemically synthesized
atctaccttgaaggtgggacta

SEQ ID NO: 879774 - DNA, 22 bp, Artificial Sequence
  chemically synthesized
ccatcaatacaaaagtagtccc

SEQ ID NO: 879775 - DNA, 22 bp, Artificial Sequence
  chemically synthesized
ccttgaaggtgggactactttt

SEQ ID NO: 879776 - DNA, 22 bp, Artificial Sequence
  chemically synthesized
gaaggtgggactacttttgtat

SEQ ID NO: 879777 - DNA, 22 bp, Artificial Sequence
  chemically synthesized
aaggtgggactacttttgtatt

SEQ ID NO: 879778 - DNA, 22 bp, Artificial Sequence
  chemically synthesized
gtgtgctgccatcaatacaaaa

SEQ ID NO: 879779 - DNA, 22 bp, Artificial Sequence
  chemically synthesized
tcctggtgtgctgccatcaata

SEQ ID NO: 879780 - DNA, 22 bp, Artificial Sequence
  chemically synthesized
tgtcctggtgtgctgccatcaa

SEQ ID NO: 879781 - DNA, 22 bp, Artificial Sequence
  chemically synthesized
ctgtcctggtgtgctgccatca

SEQ ID NO: 879782 - DNA, 22 bp, Artificial Sequence
  chemically synthesized
cttttgtattgatggcagcaca

SEQ ID NO: 879783 - DNA, 22 bp, Artificial Sequence
  chemically synthesized
atttctgtcctggtgtgctgcc

SEQ ID NO: 879784 - DNA, 22 bp, Artificial Sequence
  chemically synthesized
ttgtattgatggcagcacacca

SEQ ID NO: 879785 - DNA, 22 bp, Artificial Sequence
  chemically synthesized
tgtattgatggcagcacaccag

SEQ ID NO: 879786 - DNA, 22 bp, Artificial Sequence
  chemically synthesized
gtattgatggcagcacaccagg

SEQ ID NO: 879787 - DNA, 22 bp, Artificial Sequence
  chemically synthesized
tattgatggcagcacaccagga

SEQ ID NO: 879788 - DNA, 22 bp, Artificial Sequence
  chemically synthesized
aaggactcatttctgtcctggt

SEQ ID NO: 879789 - DNA, 22 bp, Artificial Sequence
  chemically synthesized
aaaggactcatttctgtcctgg

SEQ ID NO: 879790 - DNA, 22 bp, Artificial Sequence
  chemically synthesized
atggcagcacaccaggacagaa

SEQ ID NO: 879791 - DNA, 22 bp, Artificial Sequence
  chemically synthesized
taaaggactcatttctgtcctg

SEQ ID NO: 879792 - DNA, 22 bp, Artificial Sequence
  chemically synthesized
ctttaaaggactcatttctgtc

SEQ ID NO: 879793 - DNA, 22 bp, Artificial Sequence
  chemically synthesized
acgagtcattgctttaaaggac

SEQ ID NO: 879794 - DNA, 22 bp, Artificial Sequence
  chemically synthesized
ttaacgagtcattgctttaaag

SEQ ID NO: 879795 - DNA, 22 bp, Artificial Sequence
  chemically synthesized
aggctattaacgagtcattgct

SEQ ID NO: 879796 - DNA, 22 bp, Artificial Sequence
  chemically synthesized
aaggctattaacgagtcattgc

SEQ ID NO: 879797 - DNA, 22 bp, Artificial Sequence
  chemically synthesized
tgatcttaaggctattaacgag

SEQ ID NO: 879798 - DNA, 22 bp, Artificial Sequence
  chemically synthesized
taaagcaatgactcgttaatag

SEQ ID NO: 879799 - DNA, 22 bp, Artificial Sequence
  chemically synthesized
aaagcaatgactcgttaatagc

SEQ ID NO: 879800 - DNA, 22 bp, Artificial Sequence
  chemically synthesized
aagcaatgactcgttaatagcc

SEQ ID NO: 879801 - DNA, 22 bp, Artificial Sequence
  chemically synthesized
tatattgtgatcttaaggctat

SEQ ID NO: 879802 - DNA, 22 bp, Artificial Sequence
  chemically synthesized
atatattgtgatcttaaggcta

SEQ ID NO: 879803 - DNA, 22 bp, Artificial Sequence
  chemically synthesized
tttatatattgtgatcttaagg

SEQ ID NO: 879804 - DNA, 22 bp, Artificial Sequence
  chemically synthesized
gttaatagccttaagatcacaa

SEQ ID NO: 879805 - DNA, 22 bp, Artificial Sequence
  chemically synthesized
atagccttaagatcacaatata

SEQ ID NO: 879806 - DNA, 22 bp, Artificial Sequence
  chemically synthesized
atcagcatatcctatttatata

SEQ ID NO: 879807 - DNA, 22 bp, Artificial Sequence
  chemically synthesized
gatcagcatatcctatttatat

SEQ ID NO: 879808 - DNA, 22 bp, Artificial Sequence
  chemically synthesized
aagatcacaatatataaatagg

SEQ ID NO: 879809 - DNA, 22 bp, Artificial Sequence
  chemically synthesized
tgatcagcatatcctatttata

SEQ ID NO: 879810 - DNA, 22 bp, Artificial Sequence
  chemically synthesized
agatcacaatatataaatagga

SEQ ID NO: 879811 - DNA, 22 bp, Artificial Sequence
  chemically synthesized
ttgatcagcatatcctatttat

SEQ ID NO: 879812 - DNA, 22 bp, Artificial Sequence
  chemically synthesized
tttgatcagcatatcctattta

SEQ ID NO: 879813 - DNA, 22 bp, Artificial Sequence
  chemically synthesized
tctttttgatcagcatatccta

SEQ ID NO: 879814 - DNA, 22 bp, Artificial Sequence
  chemically synthesized
taatagcagaggcaaagctgtc

SEQ ID NO: 879815 - DNA, 22 bp, Artificial Sequence
  chemically synthesized
atcaaaaagacagctttgcctc

SEQ ID NO: 879816 - DNA, 22 bp, Artificial Sequence
  chemically synthesized
gccatactgtaatagcagaggc

SEQ ID NO: 879817 - DNA, 22 bp, Artificial Sequence
  chemically synthesized
tgcctctgctattacagtatgg

SEQ ID NO: 879818 - DNA, 22 bp, Artificial Sequence
  chemically synthesized
gcctctgctattacagtatggc

SEQ ID NO: 879819 - DNA, 22 bp, Artificial Sequence
  chemically synthesized
cctctgctattacagtatggcc

SEQ ID NO: 879820 - DNA, 22 bp, Artificial Sequence
  chemically synthesized
taaggaaatactggccatactg

SEQ ID NO: 879821 - DNA, 22 bp, Artificial Sequence
  chemically synthesized
gtaaggaaatactggccatact

SEQ ID NO: 879822 - DNA, 22 bp, Artificial Sequence
  chemically synthesized
tgctattacagtatggccagta

SEQ ID NO: 879823 - DNA, 22 bp, Artificial Sequence
  chemically synthesized
ctattacagtatggccagtatt

SEQ ID NO: 879824 - DNA, 22 bp, Artificial Sequence
  chemically synthesized
ttacagtatggccagtatttcc

SEQ ID NO: 879825 - DNA, 22 bp, Artificial Sequence
  chemically synthesized
cagtatggccagtatttcctta

SEQ ID NO: 879826 - DNA, 22 bp, Artificial Sequence
  chemically synthesized
taatcagtgaaataacttgtaa

SEQ ID NO: 879827 - DNA, 22 bp, Artificial Sequence
  chemically synthesized
ataatcagtgaaataacttgta

SEQ ID NO: 879828 - DNA, 22 bp, Artificial Sequence
  chemically synthesized
tttataatcagtgaaataactt

SEQ ID NO: 879829 - DNA, 22 bp, Artificial Sequence
  chemically synthesized
ccttacaagttatttcactgat

SEQ ID NO: 879830 - DNA, 22 bp, Artificial Sequence
  chemically synthesized
cttacaagttatttcactgatt

SEQ ID NO: 879831 - DNA, 22 bp, Artificial Sequence
  chemically synthesized
acaagttatttcactgattata

SEQ ID NO: 879832 - DNA, 22 bp, Artificial Sequence
  chemically synthesized
acgtggactatttataatcagt

SEQ ID NO: 879833 - DNA, 22 bp, Artificial Sequence
  chemically synthesized
caagttatttcactgattataa

SEQ ID NO: 879834 - DNA, 22 bp, Artificial Sequence
  chemically synthesized
ccattgacgtggactatttata

SEQ ID NO: 879835 - DNA, 22 bp, Artificial Sequence
  chemically synthesized
gccattgacgtggactatttat

SEQ ID NO: 879836 - DNA, 22 bp, Artificial Sequence
  chemically synthesized
tttcactgattataaatagtcc

SEQ ID NO: 879837 - DNA, 22 bp, Artificial Sequence
  chemically synthesized
cactgattataaatagtccacg

SEQ ID NO: 879838 - DNA, 22 bp, Artificial Sequence
  chemically synthesized
actgattataaatagtccacgt

SEQ ID NO: 879839 - DNA, 22 bp, Artificial Sequence
  chemically synthesized
tacatttgccattgacgtggac

SEQ ID NO: 879840 - DNA, 22 bp, Artificial Sequence
  chemically synthesized
attataaatagtccacgtcaat

SEQ ID NO: 879841 - DNA, 22 bp, Artificial Sequence
  chemically synthesized
ttgtacatttgccattgacgtg

SEQ ID NO: 879842 - DNA, 22 bp, Artificial Sequence
  chemically synthesized
taaatagtccacgtcaatggca

SEQ ID NO: 879843 - DNA, 22 bp, Artificial Sequence
  chemically synthesized
ccctgttgtacatttgccattg

SEQ ID NO: 879844 - DNA, 22 bp, Artificial Sequence
  chemically synthesized
cccctgttgtacatttgccatt

SEQ ID NO: 879845 - DNA, 22 bp, Artificial Sequence
  chemically synthesized
tgcttcccctgttgtacatttg

SEQ ID NO: 879846 - DNA, 22 bp, Artificial Sequence
  chemically synthesized
ataatgggttatgcttcccctg

SEQ ID NO: 879847 - DNA, 22 bp, Artificial Sequence
  chemically synthesized
cctcataatgggttatgcttcc

SEQ ID NO: 879848 - DNA, 22 bp, Artificial Sequence
  chemically synthesized
gcaatatccattacctcataat

SEQ ID NO: 879849 - DNA, 22 bp, Artificial Sequence
  chemically synthesized
tagcaatatccattacctcata

SEQ ID NO: 879850 - DNA, 22 bp, Artificial Sequence
  chemically synthesized
tgaggtaatggatattgctaga

SEQ ID NO: 879851 - DNA, 22 bp, Artificial Sequence
  chemically synthesized
agccagtgaaggtaatgaagca

SEQ ID NO: 879852 - DNA, 22 bp, Artificial Sequence
  chemically synthesized
ctagaggttgcttcattacctt

SEQ ID NO: 879853 - DNA, 22 bp, Artificial Sequence
  chemically synthesized
gaggttgcttcattaccttcac

SEQ ID NO: 879854 - DNA, 22 bp, Artificial Sequence
  chemically synthesized
cttcattaccttcactggctga

SEQ ID NO: 879855 - DNA, 22 bp, Artificial Sequence
  chemically synthesized
cattaccttcactggctgagtg

SEQ ID NO: 879856 - DNA, 22 bp, Artificial Sequence
  chemically synthesized
attaccttcactggctgagtgg

SEQ ID NO: 879857 - DNA, 22 bp, Artificial Sequence
  chemically synthesized
ccttcactggctgagtggctgg

SEQ ID NO: 879858 - DNA, 22 bp, Artificial Sequence
  chemically synthesized
tacaaggaaaaaccagccactc

SEQ ID NO: 879859 - DNA, 22 bp, Artificial Sequence
  chemically synthesized
gtacaaggaaaaaccagccact

SEQ ID NO: 879860 - DNA, 22 bp, Artificial Sequence
  chemically synthesized
cactggctgagtggctggtttt

SEQ ID NO: 879861 - DNA, 22 bp, Artificial Sequence
  chemically synthesized
actggctgagtggctggttttt

SEQ ID NO: 879862 - DNA, 22 bp, Artificial Sequence
  chemically synthesized
gctgagtggctggtttttcctt

SEQ ID NO: 879863 - DNA, 22 bp, Artificial Sequence
  chemically synthesized
agtggctggtttttccttgtac

SEQ ID NO: 879864 - DNA, 22 bp, Artificial Sequence
  chemically synthesized
aagggcagcatttgtacaagga

SEQ ID NO: 879865 - DNA, 22 bp, Artificial Sequence
  chemically synthesized
tctaaagggcagcatttgtaca

SEQ ID NO: 879866 - DNA, 22 bp, Artificial Sequence
  chemically synthesized
gtctaaagggcagcatttgtac

SEQ ID NO: 879867 - DNA, 22 bp, Artificial Sequence
  chemically synthesized
tgtctaaagggcagcatttgta

SEQ ID NO: 879868 - DNA, 22 bp, Artificial Sequence
  chemically synthesized
gtttttccttgtacaaatgctg

SEQ ID NO: 879869 - DNA, 22 bp, Artificial Sequence
  chemically synthesized
ttccttgtacaaatgctgccct

SEQ ID NO: 879870 - DNA, 22 bp, Artificial Sequence
  chemically synthesized
tccttgtacaaatgctgccctt

SEQ ID NO: 879871 - DNA, 22 bp, Artificial Sequence
  chemically synthesized
ccttgtacaaatgctgcccttt

SEQ ID NO: 879872 - DNA, 22 bp, Artificial Sequence
  chemically synthesized
cttgtacaaatgctgcccttta

SEQ ID NO: 879873 - DNA, 22 bp, Artificial Sequence
  chemically synthesized
gtacaaatgctgccctttagac

SEQ ID NO: 879874 - DNA, 22 bp, Artificial Sequence
  chemically synthesized
tacaaatgctgccctttagaca

SEQ ID NO: 879875 - DNA, 22 bp, Artificial Sequence
  chemically synthesized
ccctttagacaaaatctcttcc

SEQ ID NO: 879876 - DNA, 22 bp, Artificial Sequence
  chemically synthesized
aacaaccggatgtggaagagat

SEQ ID NO: 879877 - DNA, 22 bp, Artificial Sequence
  chemically synthesized
tagacaaaatctcttccacatc

SEQ ID NO: 879878 - DNA, 22 bp, Artificial Sequence
  chemically synthesized
agacaaaatctcttccacatcc

SEQ ID NO: 879879 - DNA, 22 bp, Artificial Sequence
  chemically synthesized
gacaaaatctcttccacatccg

SEQ ID NO: 879880 - DNA, 22 bp, Artificial Sequence
  chemically synthesized
aagctaaacaaccggatgtgga

SEQ ID NO: 879881 - DNA, 22 bp, Artificial Sequence
  chemically synthesized
ttccacatccggttgtttagct

SEQ ID NO: 879882 - DNA, 22 bp, Artificial Sequence
  chemically synthesized
aaatagcagttcaagctaaaca

SEQ ID NO: 879883 - DNA, 22 bp, Artificial Sequence
  chemically synthesized
ccacatccggttgtttagcttg

SEQ ID NO: 879884 - DNA, 22 bp, Artificial Sequence
  chemically synthesized
cacatccggttgtttagcttga

SEQ ID NO: 879885 - DNA, 22 bp, Artificial Sequence
  chemically synthesized
cccaggaaactgaaatagcagt

SEQ ID NO: 879886 - DNA, 22 bp, Artificial Sequence
  chemically synthesized
ccccaggaaactgaaatagcag

SEQ ID NO: 879887 - DNA, 22 bp, Artificial Sequence
  chemically synthesized
tttagcttgaactgctatttca

SEQ ID NO: 879888 - DNA, 22 bp, Artificial Sequence
  chemically synthesized
tccccaggaaactgaaatagca

SEQ ID NO: 879889 - DNA, 22 bp, Artificial Sequence
  chemically synthesized
ttccccaggaaactgaaatagc

SEQ ID NO: 879890 - DNA, 22 bp, Artificial Sequence
  chemically synthesized
agcttgaactgctatttcagtt

SEQ ID NO: 879891 - DNA, 22 bp, Artificial Sequence
  chemically synthesized
ttttccccaggaaactgaaata

SEQ ID NO: 879892 - DNA, 22 bp, Artificial Sequence
  chemically synthesized
gcttgaactgctatttcagttt

SEQ ID NO: 879893 - DNA, 22 bp, Artificial Sequence
  chemically synthesized
gaactgctatttcagtttcctg

SEQ ID NO: 879894 - DNA, 22 bp, Artificial Sequence
  chemically synthesized
aactgctatttcagtttcctgg

SEQ ID NO: 879895 - DNA, 22 bp, Artificial Sequence
  chemically synthesized
tatgggttcttttccccaggaa

SEQ ID NO: 879896 - DNA, 22 bp, Artificial Sequence
  chemically synthesized
ctatttcagtttcctggggaaa

SEQ ID NO: 879897 - DNA, 22 bp, Artificial Sequence
  chemically synthesized
tttcagtttcctggggaaaaga

SEQ ID NO: 879898 - DNA, 22 bp, Artificial Sequence
  chemically synthesized
cactatatgggttcttttcccc

SEQ ID NO: 879899 - DNA, 22 bp, Artificial Sequence
  chemically synthesized
cagtttcctggggaaaagaacc

SEQ ID NO: 879900 - DNA, 22 bp, Artificial Sequence
  chemically synthesized
agtttcctggggaaaagaaccc

SEQ ID NO: 879901 - DNA, 22 bp, Artificial Sequence
  chemically synthesized
atctgcactatatgggttcttt

SEQ ID NO: 879902 - DNA, 22 bp, Artificial Sequence
  chemically synthesized
cctggggaaaagaacccatata

SEQ ID NO: 879903 - DNA, 22 bp, Artificial Sequence
  chemically synthesized
ctggggaaaagaacccatatag

SEQ ID NO: 879904 - DNA, 22 bp, Artificial Sequence
  chemically synthesized
gggaaaagaacccatatagtgc

SEQ ID NO: 879905 - DNA, 22 bp, Artificial Sequence
  chemically synthesized
tgaagttaatctgcactatatg

SEQ ID NO: 879906 - DNA, 22 bp, Artificial Sequence
  chemically synthesized
actgtgaagttaatctgcacta

SEQ ID NO: 879907 - DNA, 22 bp, Artificial Sequence
  chemically synthesized
ctaactgtgaagttaatctgca

SEQ ID NO: 879908 - DNA, 22 bp, Artificial Sequence
  chemically synthesized
ttgctaactgtgaagttaatct

SEQ ID NO: 879909 - DNA, 22 bp, Artificial Sequence
  chemically synthesized
attgctaactgtgaagttaatc

SEQ ID NO: 879910 - DNA, 22 bp, Artificial Sequence
  chemically synthesized
tattgctaactgtgaagttaat

SEQ ID NO: 879911 - DNA, 22 bp, Artificial Sequence
  chemically synthesized
gtaattttattgctaactgtga

SEQ ID NO: 879912 - DNA, 22 bp, Artificial Sequence
  chemically synthesized
agtaattttattgctaactgtg

SEQ ID NO: 879913 - DNA, 22 bp, Artificial Sequence
  chemically synthesized
aatttagtaattttattgctaa

SEQ ID NO: 879914 - DNA, 22 bp, Artificial Sequence
  chemically synthesized
aaatttagtaattttattgcta

SEQ ID NO: 879915 - DNA, 22 bp, Artificial Sequence
  chemically synthesized
acttcacagttagcaataaaat

SEQ ID NO: 879916 - DNA, 22 bp, Artificial Sequence
  chemically synthesized
cacagttagcaataaaattact

SEQ ID NO: 879917 - DNA, 22 bp, Artificial Sequence
  chemically synthesized
acagttagcaataaaattacta

SEQ ID NO: 879918 - DNA, 22 bp, Artificial Sequence
  chemically synthesized
caagggtatatttaaatttagt

SEQ ID NO: 879919 - DNA, 22 bp, Artificial Sequence
  chemically synthesized
gcaataaaattactaaatttaa

SEQ ID NO: 879920 - DNA, 22 bp, Artificial Sequence
  chemically synthesized
ctaaatttaaatatacccttgg

SEQ ID NO: 879921 - DNA, 22 bp, Artificial Sequence
  chemically synthesized
aatttaaatatacccttggaga

SEQ ID NO: 879922 - DNA, 22 bp, Artificial Sequence
  chemically synthesized
caatacatgtggagtctccaag

SEQ ID NO: 879923 - DNA, 22 bp, Artificial Sequence
  chemically synthesized
aaatatacccttggagactcca

SEQ ID NO: 879924 - DNA, 22 bp, Artificial Sequence
  chemically synthesized
aatatacccttggagactccac

SEQ ID NO: 879925 - DNA, 22 bp, Artificial Sequence
  chemically synthesized
atctgcaatacatgtggagtct

SEQ ID NO: 879926 - DNA, 22 bp, Artificial Sequence
  chemically synthesized
ggagactccacatgtattgcag

SEQ ID NO: 879927 - DNA, 22 bp, Artificial Sequence
  chemically synthesized
gagactccacatgtattgcaga

SEQ ID NO: 879928 - DNA, 22 bp, Artificial Sequence
  chemically synthesized
cacatgtattgcagatcaattt

SEQ ID NO: 879929 - DNA, 22 bp, Artificial Sequence
  chemically synthesized
tgtaccaggcagaaattgatct

SEQ ID NO: 879930 - DNA, 22 bp, Artificial Sequence
  chemically synthesized
atgtaccaggcagaaattgatc

SEQ ID NO: 879931 - DNA, 22 bp, Artificial Sequence
  chemically synthesized
tgcccttatgtaccaggcagaa

SEQ ID NO: 879932 - DNA, 22 bp, Artificial Sequence
  chemically synthesized
gtgcccttatgtaccaggcaga

SEQ ID NO: 879933 - DNA, 22 bp, Artificial Sequence
  chemically synthesized
tgtgcccttatgtaccaggcag

SEQ ID NO: 879934 - DNA, 22 bp, Artificial Sequence
  chemically synthesized
cagatcaatttctgcctggtac

SEQ ID NO: 879935 - DNA, 22 bp, Artificial Sequence
  chemically synthesized
ttgtgcccttatgtaccaggca

SEQ ID NO: 879936 - DNA, 22 bp, Artificial Sequence
  chemically synthesized
catttttgtgcccttatgtacc

SEQ ID NO: 879937 - DNA, 22 bp, Artificial Sequence
  chemically synthesized
ctgcctggtacataagggcaca

SEQ ID NO: 879938 - DNA, 22 bp, Artificial Sequence
  chemically synthesized
tgcctggtacataagggcacaa

SEQ ID NO: 879939 - DNA, 22 bp, Artificial Sequence
  chemically synthesized
cctggtacataagggcacaaaa

SEQ ID NO: 879940 - DNA, 22 bp, Artificial Sequence
  chemically synthesized
caccaaaagctacatttttgtg

SEQ ID NO: 879941 - DNA, 22 bp, Artificial Sequence
  chemically synthesized
gtacataagggcacaaaaatgt

SEQ ID NO: 879942 - DNA, 22 bp, Artificial Sequence
  chemically synthesized
tgcaccaaaagctacatttttg

SEQ ID NO: 879943 - DNA, 22 bp, Artificial Sequence
  chemically synthesized
tctgcaccaaaagctacatttt

SEQ ID NO: 879944 - DNA, 22 bp, Artificial Sequence
  chemically synthesized
ctctgcaccaaaagctacattt

SEQ ID NO: 879945 - DNA, 22 bp, Artificial Sequence
  chemically synthesized
tctctgcaccaaaagctacatt

SEQ ID NO: 879946 - DNA, 22 bp, Artificial Sequence
  chemically synthesized
ttctctgcaccaaaagctacat

SEQ ID NO: 879947 - DNA, 22 bp, Artificial Sequence
  chemically synthesized
ttttctctgcaccaaaagctac

SEQ ID NO: 879948 - DNA, 22 bp, Artificial Sequence
  chemically synthesized
cttttctctgcaccaaaagcta

SEQ ID NO: 879949 - DNA, 22 bp, Artificial Sequence
  chemically synthesized
tttcttttctctgcaccaaaag

SEQ ID NO: 879950 - DNA, 22 bp, Artificial Sequence
  chemically synthesized
tgtttcttttctctgcaccaaa

SEQ ID NO: 879951 - DNA, 22 bp, Artificial Sequence
  chemically synthesized
acatctctgtttcttttctctg

SEQ ID NO: 879952 - DNA, 22 bp, Artificial Sequence
  chemically synthesized
cacatctctgtttcttttctct

SEQ ID NO: 879953 - DNA, 22 bp, Artificial Sequence
  chemically synthesized
ttggtgcagagaaaagaaacag

SEQ ID NO: 879954 - DNA, 22 bp, Artificial Sequence
  chemically synthesized
tggtgcagagaaaagaaacaga

SEQ ID NO: 879955 - DNA, 22 bp, Artificial Sequence
  chemically synthesized
ggtgcagagaaaagaaacagag

SEQ ID NO: 879956 - DNA, 22 bp, Artificial Sequence
  chemically synthesized
gtgcagagaaaagaaacagaga

SEQ ID NO: 879957 - DNA, 22 bp, Artificial Sequence
  chemically synthesized
atgtgtttcacatctctgtttc

SEQ ID NO: 879958 - DNA, 22 bp, Artificial Sequence
  chemically synthesized
aatgtgtttcacatctctgttt

SEQ ID NO: 879959 - DNA, 22 bp, Artificial Sequence
  chemically synthesized
agtttaatgtgtttcacatctc

SEQ ID NO: 879960 - DNA, 22 bp, Artificial Sequence
  chemically synthesized
aagtttaatgtgtttcacatct

SEQ ID NO: 879961 - DNA, 22 bp, Artificial Sequence
  chemically synthesized
taagtttaatgtgtttcacatc

SEQ ID NO: 879962 - DNA, 22 bp, Artificial Sequence
  chemically synthesized
ttaagtttaatgtgtttcacat

SEQ ID NO: 879963 - DNA, 22 bp, Artificial Sequence
  chemically synthesized
tttaagtttaatgtgtttcaca

SEQ ID NO: 879964 - DNA, 22 bp, Artificial Sequence
  chemically synthesized
ttttaagtttaatgtgtttcac

SEQ ID NO: 879965 - DNA, 22 bp, Artificial Sequence
  chemically synthesized
tttttaagtttaatgtgtttca

SEQ ID NO: 879966 - DNA, 22 bp, Artificial Sequence
  chemically synthesized
gatgaattttttttaagtttaa

SEQ ID NO: 879967 - DNA, 22 bp, Artificial Sequence
  chemically synthesized
aagaagatattggatgaatttt

SEQ ID NO: 879968 - DNA, 22 bp, Artificial Sequence
  chemically synthesized
aacttaaaaaaaattcatccaa

SEQ ID NO: 879969 - DNA, 22 bp, Artificial Sequence
  chemically synthesized
aaaaaaaattcatccaatatct

SEQ ID NO: 879970 - DNA, 22 bp, Artificial Sequence
  chemically synthesized
tataattcaagaagatattgga

SEQ ID NO: 879971 - DNA, 22 bp, Artificial Sequence
  chemically synthesized
aaaaaaattcatccaatatctt

SEQ ID NO: 879972 - DNA, 22 bp, Artificial Sequence
  chemically synthesized
atccaatatcttcttgaattat

SEQ ID NO: 879973 - DNA, 22 bp, Artificial Sequence
  chemically synthesized
tatgagtattatataattcaag

SEQ ID NO: 879974 - DNA, 22 bp, Artificial Sequence
  chemically synthesized
tatatgagtattatataattca

SEQ ID NO: 879975 - DNA, 22 bp, Artificial Sequence
  chemically synthesized
ctatatgagtattatataattc

SEQ ID NO: 879976 - DNA, 22 bp, Artificial Sequence
  chemically synthesized
tgtttctatatgagtattatat

SEQ ID NO: 879977 - DNA, 22 bp, Artificial Sequence
  chemically synthesized
cttgaattatataatactcata

SEQ ID NO: 879978 - DNA, 22 bp, Artificial Sequence
  chemically synthesized
ttgaattatataatactcatat

SEQ ID NO: 879979 - DNA, 22 bp, Artificial Sequence
  chemically synthesized
gaattatataatactcatatag

SEQ ID NO: 879980 - DNA, 22 bp, Artificial Sequence
  chemically synthesized
atgcctgtgtttctatatgagt

SEQ ID NO: 879981 - DNA, 22 bp, Artificial Sequence
  chemically synthesized
aattatataatactcatataga

SEQ ID NO: 879982 - DNA, 22 bp, Artificial Sequence
  chemically synthesized
tataatactcatatagaaacac

SEQ ID NO: 879983 - DNA, 22 bp, Artificial Sequence
  chemically synthesized
aaaagtagttaatgcctgtgtt

SEQ ID NO: 879984 - DNA, 22 bp, Artificial Sequence
  chemically synthesized
gaaaagtagttaatgcctgtgt

SEQ ID NO: 879985 - DNA, 22 bp, Artificial Sequence
  chemically synthesized
tgaaaagtagttaatgcctgtg

SEQ ID NO: 879986 - DNA, 22 bp, Artificial Sequence
  chemically synthesized
ttgaaaagtagttaatgcctgt

SEQ ID NO: 879987 - DNA, 22 bp, Artificial Sequence
  chemically synthesized
tttgaaaagtagttaatgcctg

SEQ ID NO: 879988 - DNA, 22 bp, Artificial Sequence
  chemically synthesized
atatagaaacacaggcattaac

SEQ ID NO: 879989 - DNA, 22 bp, Artificial Sequence
  chemically synthesized
ttttgaaaagtagttaatgcct

SEQ ID NO: 879990 - DNA, 22 bp, Artificial Sequence
  chemically synthesized
cttttttgaaaagtagttaatg

SEQ ID NO: 879991 - DNA, 22 bp, Artificial Sequence
  chemically synthesized
acttttttgaaaagtagttaat

SEQ ID NO: 879992 - DNA, 22 bp, Artificial Sequence
  chemically synthesized
tacttttttgaaaagtagttaa

SEQ ID NO: 879993 - DNA, 22 bp, Artificial Sequence
  chemically synthesized
cattttacttttttgaaaagta

SEQ ID NO: 879994 - DNA, 22 bp, Artificial Sequence
  chemically synthesized
ttgcattttacttttttgaaaa

SEQ ID NO: 879995 - DNA, 22 bp, Artificial Sequence
  chemically synthesized
tcattattgcattttacttttt

SEQ ID NO: 879996 - DNA, 22 bp, Artificial Sequence
  chemically synthesized
actacttttcaaaaaagtaaaa

SEQ ID NO: 879997 - DNA, 22 bp, Artificial Sequence
  chemically synthesized
cttttcaaaaaagtaaaatgca

SEQ ID NO: 879998 - DNA, 22 bp, Artificial Sequence
  chemically synthesized
tattgtcattattgcattttac

SEQ ID NO: 879999 - DNA, 22 bp, Artificial Sequence
  chemically synthesized
ttcaaaaaagtaaaatgcaata

SEQ ID NO: 880000 - DNA, 22 bp, Artificial Sequence
  chemically synthesized
tcaaaaaagtaaaatgcaataa

SEQ ID NO: 880001 - DNA, 22 bp, Artificial Sequence
  chemically synthesized
caaaaaagtaaaatgcaataat

SEQ ID NO: 880002 - DNA, 22 bp, Artificial Sequence
  chemically synthesized
aaaaaagtaaaatgcaataatg

SEQ ID NO: 880003 - DNA, 22 bp, Artificial Sequence
  chemically synthesized
ataaattgtattgtcattattg

SEQ ID NO: 880004 - DNA, 22 bp, Artificial Sequence
  chemically synthesized
tgttaataaattgtattgtcat

SEQ ID NO: 880005 - DNA, 22 bp, Artificial Sequence
  chemically synthesized
atataaattatgttaataaatt

SEQ ID NO: 880006 - DNA, 22 bp, Artificial Sequence
  chemically synthesized
ttcatataaattatgttaataa

SEQ ID NO: 880007 - DNA, 22 bp, Artificial Sequence
  chemically synthesized
attcatataaattatgttaata

SEQ ID NO: 880008 - DNA, 22 bp, Artificial Sequence
  chemically synthesized
gtgtttattcatataaattatg

SEQ ID NO: 880009 - DNA, 22 bp, Artificial Sequence
  chemically synthesized
aaactagtgtttattcatataa

SEQ ID NO: 880010 - DNA, 22 bp, Artificial Sequence
  chemically synthesized
attaacataatttatatgaata

SEQ ID NO: 880011 - DNA, 22 bp, Artificial Sequence
  chemically synthesized
ttaacataatttatatgaataa

SEQ ID NO: 880012 - DNA, 22 bp, Artificial Sequence
  chemically synthesized
acataatttatatgaataaaca

SEQ ID NO: 880013 - DNA, 22 bp, Artificial Sequence
  chemically synthesized
tagctaaaactagtgtttattc

SEQ ID NO: 880014 - DNA, 22 bp, Artificial Sequence
  chemically synthesized
ttgtagctaaaactagtgttta

SEQ ID NO: 880015 - DNA, 22 bp, Artificial Sequence
  chemically synthesized
atatgaataaacactagtttta

SEQ ID NO: 880016 - DNA, 22 bp, Artificial Sequence
  chemically synthesized
tatgaataaacactagttttag

SEQ ID NO: 880017 - DNA, 22 bp, Artificial Sequence
  chemically synthesized
agattattgtagctaaaactag

SEQ ID NO: 880018 - DNA, 22 bp, Artificial Sequence
  chemically synthesized
ttgagattattgtagctaaaac

SEQ ID NO: 880019 - DNA, 22 bp, Artificial Sequence
  chemically synthesized
ggattattgagattattgtagc

SEQ ID NO: 880020 - DNA, 22 bp, Artificial Sequence
  chemically synthesized
gttttagctacaataatctcaa

SEQ ID NO: 880021 - DNA, 22 bp, Artificial Sequence
  chemically synthesized
tagctacaataatctcaataat

SEQ ID NO: 880022 - DNA, 22 bp, Artificial Sequence
  chemically synthesized
agctacaataatctcaataatc

SEQ ID NO: 880023 - DNA, 22 bp, Artificial Sequence
  chemically synthesized
gctacaataatctcaataatcc

SEQ ID NO: 880024 - DNA, 22 bp, Artificial Sequence
  chemically synthesized
caataatctcaataatcctaat

SEQ ID NO: 880025 - DNA, 22 bp, Artificial Sequence
  chemically synthesized
aataatcctaatgttcatttta

SEQ ID NO: 880026 - DNA, 22 bp, Artificial Sequence
  chemically synthesized
taaaacaataagtgtataaagt

SEQ ID NO: 880027 - DNA, 22 bp, Artificial Sequence
  chemically synthesized
atgttcattttactttatacac

SEQ ID NO: 880028 - DNA, 22 bp, Artificial Sequence
  chemically synthesized
gtaaaacaataagtgtataaag

SEQ ID NO: 880029 - DNA, 22 bp, Artificial Sequence
  chemically synthesized
tgtaaaacaataagtgtataaa

SEQ ID NO: 880030 - DNA, 22 bp, Artificial Sequence
  chemically synthesized
attttactttatacacttattg

SEQ ID NO: 880031 - DNA, 22 bp, Artificial Sequence
  chemically synthesized
tactttatacacttattgtttt

SEQ ID NO: 880032 - DNA, 22 bp, Artificial Sequence
  chemically synthesized
actttatacacttattgtttta

SEQ ID NO: 880033 - DNA, 22 bp, Artificial Sequence
  chemically synthesized
ctttatacacttattgttttac

SEQ ID NO: 880034 - DNA, 22 bp, Artificial Sequence
  chemically synthesized
aacacagaattttgtaaaacaa

SEQ ID NO: 880035 - DNA, 22 bp, Artificial Sequence
  chemically synthesized
tatacacttattgttttacaaa

SEQ ID NO: 880036 - DNA, 22 bp, Artificial Sequence
  chemically synthesized
atacacttattgttttacaaaa

SEQ ID NO: 880037 - DNA, 22 bp, Artificial Sequence
  chemically synthesized
tacacttattgttttacaaaat

SEQ ID NO: 880038 - DNA, 22 bp, Artificial Sequence
  chemically synthesized
attgttttacaaaattctgtgt

SEQ ID NO: 880039 - DNA, 22 bp, Artificial Sequence
  chemically synthesized
ttgttttacaaaattctgtgtt

SEQ ID NO: 880040 - DNA, 22 bp, Artificial Sequence
  chemically synthesized
tatccaatactaaacacagaat

SEQ ID NO: 880041 - DNA, 22 bp, Artificial Sequence
  chemically synthesized
atatccaatactaaacacagaa

SEQ ID NO: 880042 - DNA, 22 bp, Artificial Sequence
  chemically synthesized
ttttacaaaattctgtgtttag

SEQ ID NO: 880043 - DNA, 22 bp, Artificial Sequence
  chemically synthesized
tacaaaattctgtgtttagtat

SEQ ID NO: 880044 - DNA, 22 bp, Artificial Sequence
  chemically synthesized
acaaaattctgtgtttagtatt

SEQ ID NO: 880045 - DNA, 22 bp, Artificial Sequence
  chemically synthesized
caaaattctgtgtttagtattg

SEQ ID NO: 880046 - DNA, 22 bp, Artificial Sequence
  chemically synthesized
aaaacaaaatttatatccaata

SEQ ID NO: 880047 - DNA, 22 bp, Artificial Sequence
  chemically synthesized
caaaacaaaatttatatccaat

SEQ ID NO: 880048 - DNA, 22 bp, Artificial Sequence
  chemically synthesized
tgtgtttagtattggatataaa

SEQ ID NO: 880049 - DNA, 22 bp, Artificial Sequence
  chemically synthesized
tttcaaaacaaaatttatatcc

SEQ ID NO: 880050 - DNA, 22 bp, Artificial Sequence
  chemically synthesized
tgtttagtattggatataaatt

SEQ ID NO: 880051 - DNA, 22 bp, Artificial Sequence
  chemically synthesized
atttcaaaacaaaatttatatc

SEQ ID NO: 880052 - DNA, 22 bp, Artificial Sequence
  chemically synthesized
agtattggatataaattttgtt

SEQ ID NO: 880053 - DNA, 22 bp, Artificial Sequence
  chemically synthesized
gtattggatataaattttgttt

SEQ ID NO: 880054 - DNA, 22 bp, Artificial Sequence
  chemically synthesized
atatttatttcaaaacaaaatt

SEQ ID NO: 880055 - DNA, 22 bp, Artificial Sequence
  chemically synthesized
gatatttatttcaaaacaaaat

SEQ ID NO: 880056 - DNA, 22 bp, Artificial Sequence
  chemically synthesized
tttgatatttatttcaaaacaa

SEQ ID NO: 880057 - DNA, 22 bp, Artificial Sequence
  chemically synthesized
gatataaattttgttttgaaat

SEQ ID NO: 880058 - DNA, 22 bp, Artificial Sequence
  chemically synthesized
tgttttgaaataaatatcaaat

SEQ ID NO: 880059 - DNA, 22 bp, Artificial Sequence
  chemically synthesized
gttttgaaataaatatcaaata

SEQ ID NO: 880060 - DNA, 22 bp, Artificial Sequence
  chemically synthesized
ttttgaaataaatatcaaataa

SEQ ID NO: 880061 - DNA, 22 bp, Artificial Sequence
  chemically synthesized
tgaaataaatatcaaataatta

SEQ ID NO: 880062 - DNA, 22 bp, Artificial Sequence
  chemically synthesized
gaaataaatatcaaataattat

SEQ ID NO: 880063 - DNA, 22 bp, Artificial Sequence
  chemically synthesized
aaataaatatcaaataattatt

SEQ ID NO: 880064 - DNA, 22 bp, Artificial Sequence
  chemically synthesized
acagtgatgtagaaataattat

SEQ ID NO: 880065 - DNA, 22 bp, Artificial Sequence
  chemically synthesized
gacagtgatgtagaaataatta

SEQ ID NO: 880066 - DNA, 22 bp, Artificial Sequence
  chemically synthesized
tgacagtgatgtagaaataatt

SEQ ID NO: 880067 - DNA, 22 bp, Artificial Sequence
  chemically synthesized
gaaagaaaataattttgacagt

SEQ ID NO: 880068 - DNA, 22 bp, Artificial Sequence
  chemically synthesized
ggaaagaaaataattttgacag

SEQ ID NO: 880069 - DNA, 22 bp, Artificial Sequence
  chemically synthesized
tttctacatcactgtcaaaatt

SEQ ID NO: 880070 - DNA, 22 bp, Artificial Sequence
  chemically synthesized
tggaaagaaaataattttgaca

SEQ ID NO: 880071 - DNA, 22 bp, Artificial Sequence
  chemically synthesized
ctacatcactgtcaaaattatt

SEQ ID NO: 880072 - DNA, 22 bp, Artificial Sequence
  chemically synthesized
tacatcactgtcaaaattattt

SEQ ID NO: 880073 - DNA, 22 bp, Artificial Sequence
  chemically synthesized
ccctttggaaagaaaataattt

SEQ ID NO: 880074 - DNA, 22 bp, Artificial Sequence
  chemically synthesized
catcactgtcaaaattattttc

SEQ ID NO: 880075 - DNA, 22 bp, Artificial Sequence
  chemically synthesized
accctttggaaagaaaataatt

SEQ ID NO: 880076 - DNA, 22 bp, Artificial Sequence
  chemically synthesized
agtgtttaccctttggaaagaa

SEQ ID NO: 880077 - DNA, 22 bp, Artificial Sequence
  chemically synthesized
tcaaaattattttctttccaaa

SEQ ID NO: 880078 - DNA, 22 bp, Artificial Sequence
  chemically synthesized
aagtgtttaccctttggaaaga

SEQ ID NO: 880079 - DNA, 22 bp, Artificial Sequence
  chemically synthesized
taagtgtttaccctttggaaag

SEQ ID NO: 880080 - DNA, 22 bp, Artificial Sequence
  chemically synthesized
tgctttaagtgtttaccctttg

SEQ ID NO: 880081 - DNA, 22 bp, Artificial Sequence
  chemically synthesized
ttttctttccaaagggtaaaca

SEQ ID NO: 880082 - DNA, 22 bp, Artificial Sequence
  chemically synthesized
tctttccaaagggtaaacactt

SEQ ID NO: 880083 - DNA, 22 bp, Artificial Sequence
  chemically synthesized
atactgtgctttaagtgtttac

SEQ ID NO: 880084 - DNA, 22 bp, Artificial Sequence
  chemically synthesized
ctttccaaagggtaaacactta

SEQ ID NO: 880085 - DNA, 22 bp, Artificial Sequence
  chemically synthesized
gatactgtgctttaagtgttta

SEQ ID NO: 880086 - DNA, 22 bp, Artificial Sequence
  chemically synthesized
tttccaaagggtaaacacttaa

SEQ ID NO: 880087 - DNA, 22 bp, Artificial Sequence
  chemically synthesized
tgatactgtgctttaagtgttt

SEQ ID NO: 880088 - DNA, 22 bp, Artificial Sequence
  chemically synthesized
tccaaagggtaaacacttaaag

SEQ ID NO: 880089 - DNA, 22 bp, Artificial Sequence
  chemically synthesized
ccaaagggtaaacacttaaagc

SEQ ID NO: 880090 - DNA, 22 bp, Artificial Sequence
  chemically synthesized
caaagggtaaacacttaaagca

SEQ ID NO: 880091 - DNA, 22 bp, Artificial Sequence
  chemically synthesized
ataaataataagctttgatact

SEQ ID NO: 880092 - DNA, 22 bp, Artificial Sequence
  chemically synthesized
attaataaataataagctttga

SEQ ID NO: 880093 - DNA, 22 bp, Artificial Sequence
  chemically synthesized
aaagcacagtatcaaagcttat

SEQ ID NO: 880094 - DNA, 22 bp, Artificial Sequence
  chemically synthesized
aagcacagtatcaaagcttatt

SEQ ID NO: 880095 - DNA, 22 bp, Artificial Sequence
  chemically synthesized
actcattaataaataataagct

SEQ ID NO: 880096 - DNA, 22 bp, Artificial Sequence
  chemically synthesized
gactcattaataaataataagc

SEQ ID NO: 880097 - DNA, 22 bp, Artificial Sequence
  chemically synthesized
tttgactcattaataaataata

SEQ ID NO: 880098 - DNA, 22 bp, Artificial Sequence
  chemically synthesized
agaaggcctgtttgactcatta

SEQ ID NO: 880099 - DNA, 22 bp, Artificial Sequence
  chemically synthesized
cagaaggcctgtttgactcatt

SEQ ID NO: 880100 - DNA, 22 bp, Artificial Sequence
  chemically synthesized
attatttattaatgagtcaaac

SEQ ID NO: 880101 - DNA, 22 bp, Artificial Sequence
  chemically synthesized
ttcagaaggcctgtttgactca

SEQ ID NO: 880102 - DNA, 22 bp, Artificial Sequence
  chemically synthesized
ttatttattaatgagtcaaaca

SEQ ID NO: 880103 - DNA, 22 bp, Artificial Sequence
  chemically synthesized
tttattaatgagtcaaacaggc

SEQ ID NO: 880104 - DNA, 22 bp, Artificial Sequence
  chemically synthesized
attaatgagtcaaacaggcctt

SEQ ID NO: 880105 - DNA, 22 bp, Artificial Sequence
  chemically synthesized
atcgttcttcagaaggcctgtt

SEQ ID NO: 880106 - DNA, 22 bp, Artificial Sequence
  chemically synthesized
ttaatgagtcaaacaggccttc

SEQ ID NO: 880107 - DNA, 22 bp, Artificial Sequence
  chemically synthesized
atgagtcaaacaggccttctga

SEQ ID NO: 880108 - DNA, 22 bp, Artificial Sequence
  chemically synthesized
ctgaagaacgattaattttgtt

SEQ ID NO: 880109 - DNA, 22 bp, Artificial Sequence
  chemically synthesized
tgaagaacgattaattttgttt

SEQ ID NO: 880110 - DNA, 22 bp, Artificial Sequence
  chemically synthesized
aagaacgattaattttgtttat

SEQ ID NO: 880111 - DNA, 22 bp, Artificial Sequence
  chemically synthesized
aagaaaagcaaataataaacaa

SEQ ID NO: 880112 - DNA, 22 bp, Artificial Sequence
  chemically synthesized
cagactgaagaaaagcaaataa

SEQ ID NO: 880113 - DNA, 22 bp, Artificial Sequence
  chemically synthesized
attttgtttattatttgctttt

SEQ ID NO: 880114 - DNA, 22 bp, Artificial Sequence
  chemically synthesized
tccagactgaagaaaagcaaat

SEQ ID NO: 880115 - DNA, 22 bp, Artificial Sequence
  chemically synthesized
ctccagactgaagaaaagcaaa

SEQ ID NO: 880116 - DNA, 22 bp, Artificial Sequence
  chemically synthesized
tgtttattatttgcttttcttc

SEQ ID NO: 880117 - DNA, 22 bp, Artificial Sequence
  chemically synthesized
gtttattatttgcttttcttca

SEQ ID NO: 880118 - DNA, 22 bp, Artificial Sequence
  chemically synthesized
tttattatttgcttttcttcag

SEQ ID NO: 880119 - DNA, 22 bp, Artificial Sequence
  chemically synthesized
agccttctccagactgaagaaa

SEQ ID NO: 880120 - DNA, 22 bp, Artificial Sequence
  chemically synthesized
cagccttctccagactgaagaa

SEQ ID NO: 880121 - DNA, 22 bp, Artificial Sequence
  chemically synthesized
attatttgcttttcttcagtct

SEQ ID NO: 880122 - DNA, 22 bp, Artificial Sequence
  chemically synthesized
ttatttgcttttcttcagtctg

SEQ ID NO: 880123 - DNA, 22 bp, Artificial Sequence
  chemically synthesized
tttgcttttcttcagtctggag

SEQ ID NO: 880124 - DNA, 22 bp, Artificial Sequence
  chemically synthesized
gcttttcttcagtctggagaag

SEQ ID NO: 880125 - DNA, 22 bp, Artificial Sequence
  chemically synthesized
tcatgcttcagccttctccaga

SEQ ID NO: 880126 - DNA, 22 bp, Artificial Sequence
  chemically synthesized
cttttcttcagtctggagaagg

SEQ ID NO: 880127 - DNA, 22 bp, Artificial Sequence
  chemically synthesized
gtcatgcttcagccttctccag

SEQ ID NO: 880128 - DNA, 22 bp, Artificial Sequence
  chemically synthesized
tgtcatgcttcagccttctcca

SEQ ID NO: 880129 - DNA, 22 bp, Artificial Sequence
  chemically synthesized
ttgtcatgcttcagccttctcc

SEQ ID NO: 880130 - DNA, 22 bp, Artificial Sequence
  chemically synthesized
ttcttcagtctggagaaggctg

SEQ ID NO: 880131 - DNA, 22 bp, Artificial Sequence
  chemically synthesized
tttgtcatgcttcagccttctc

SEQ ID NO: 880132 - DNA, 22 bp, Artificial Sequence
  chemically synthesized
tcttcagtctggagaaggctga

SEQ ID NO: 880133 - DNA, 22 bp, Artificial Sequence
  chemically synthesized
ttttgtcatgcttcagccttct

SEQ ID NO: 880134 - DNA, 22 bp, Artificial Sequence
  chemically synthesized
cttcagtctggagaaggctgaa

SEQ ID NO: 880135 - DNA, 22 bp, Artificial Sequence
  chemically synthesized
tttttgtcatgcttcagccttc

SEQ ID NO: 880136 - DNA, 22 bp, Artificial Sequence
  chemically synthesized
ttcagtctggagaaggctgaag

SEQ ID NO: 880137 - DNA, 22 bp, Artificial Sequence
  chemically synthesized
ttttttgtcatgcttcagcctt

SEQ ID NO: 880138 - DNA, 22 bp, Artificial Sequence
  chemically synthesized
cagtctggagaaggctgaagca

SEQ ID NO: 880139 - DNA, 22 bp, Artificial Sequence
  chemically synthesized
agtctggagaaggctgaagcat

SEQ ID NO: 880140 - DNA, 22 bp, Artificial Sequence
  chemically synthesized
aaggatttttttttgtcatgct

SEQ ID NO: 880141 - DNA, 22 bp, Artificial Sequence
  chemically synthesized
gagaaggctgaagcatgacaaa

SEQ ID NO: 880142 - DNA, 22 bp, Artificial Sequence
  chemically synthesized
atatacctgaaggatttttttt

SEQ ID NO: 880143 - DNA, 22 bp, Artificial Sequence
  chemically synthesized
aagcatgacaaaaaaaaatcct

SEQ ID NO: 880144 - DNA, 22 bp, Artificial Sequence
  chemically synthesized
tattcatatacctgaaggattt

SEQ ID NO: 880145 - DNA, 22 bp, Artificial Sequence
  chemically synthesized
atattcatatacctgaaggatt

SEQ ID NO: 880146 - DNA, 22 bp, Artificial Sequence
  chemically synthesized
caggtatatgaatataagcatt

SEQ ID NO: 880147 - DNA, 22 bp, Artificial Sequence
  chemically synthesized
aggtatatgaatataagcattt

SEQ ID NO: 880148 - DNA, 22 bp, Artificial Sequence
  chemically synthesized
gtcagcagacagtaacaaaatg

SEQ ID NO: 880149 - DNA, 22 bp, Artificial Sequence
  chemically synthesized
atcaagagagctagtcagcaga

SEQ ID NO: 880150 - DNA, 22 bp, Artificial Sequence
  chemically synthesized
tgttactgtctgctgactagct

SEQ ID NO: 880151 - DNA, 22 bp, Artificial Sequence
  chemically synthesized
gttactgtctgctgactagctc

SEQ ID NO: 880152 - DNA, 22 bp, Artificial Sequence
  chemically synthesized
ttactgtctgctgactagctct

SEQ ID NO: 880153 - DNA, 22 bp, Artificial Sequence
  chemically synthesized
tcgtctcatcaagagagctagt

SEQ ID NO: 880154 - DNA, 22 bp, Artificial Sequence
  chemically synthesized
gtcgtctcatcaagagagctag

SEQ ID NO: 880155 - DNA, 22 bp, Artificial Sequence
  chemically synthesized
ctgtctgctgactagctctctt

SEQ ID NO: 880156 - DNA, 22 bp, Artificial Sequence
  chemically synthesized
tgtcgtctcatcaagagagcta

SEQ ID NO: 880157 - DNA, 22 bp, Artificial Sequence
  chemically synthesized
ttgtcgtctcatcaagagagct

SEQ ID NO: 880158 - DNA, 22 bp, Artificial Sequence
  chemically synthesized
tctgctgactagctctcttgat

SEQ ID NO: 880159 - DNA, 22 bp, Artificial Sequence
  chemically synthesized
ttttgtcgtctcatcaagagag

SEQ ID NO: 880160 - DNA, 22 bp, Artificial Sequence
  chemically synthesized
ctgactagctctcttgatgaga

SEQ ID NO: 880161 - DNA, 22 bp, Artificial Sequence
  chemically synthesized
actagctctcttgatgagacga

SEQ ID NO: 880162 - DNA, 22 bp, Artificial Sequence
  chemically synthesized
cacaattcttttgtcgtctcat

SEQ ID NO: 880163 - DNA, 22 bp, Artificial Sequence
  chemically synthesized
tgcacaattcttttgtcgtctc

SEQ ID NO: 880164 - DNA, 22 bp, Artificial Sequence
  chemically synthesized
gctctcttgatgagacgacaaa

SEQ ID NO: 880165 - DNA, 22 bp, Artificial Sequence
  chemically synthesized
ctgcacaattcttttgtcgtct

SEQ ID NO: 880166 - DNA, 22 bp, Artificial Sequence
  chemically synthesized
tcttgatgagacgacaaaagaa

SEQ ID NO: 880167 - DNA, 22 bp, Artificial Sequence
  chemically synthesized
aatttctgcacaattcttttgt

SEQ ID NO: 880168 - DNA, 22 bp, Artificial Sequence
  chemically synthesized
ttgatgagacgacaaaagaatt

SEQ ID NO: 880169 - DNA, 22 bp, Artificial Sequence
  chemically synthesized
caatttctgcacaattcttttg

SEQ ID NO: 880170 - DNA, 22 bp, Artificial Sequence
  chemically synthesized
gatgagacgacaaaagaattgt

SEQ ID NO: 880171 - DNA, 22 bp, Artificial Sequence
  chemically synthesized
atgagacgacaaaagaattgtg

SEQ ID NO: 880172 - DNA, 22 bp, Artificial Sequence
  chemically synthesized
agcttcaatttctgcacaattc

SEQ ID NO: 880173 - DNA, 22 bp, Artificial Sequence
  chemically synthesized
cagcttcaatttctgcacaatt

SEQ ID NO: 880174 - DNA, 22 bp, Artificial Sequence
  chemically synthesized
cttcagcttcaatttctgcaca

SEQ ID NO: 880175 - DNA, 22 bp, Artificial Sequence
  chemically synthesized
ccttcagcttcaatttctgcac

SEQ ID NO: 880176 - DNA, 22 bp, Artificial Sequence
  chemically synthesized
acttccttcagcttcaatttct

SEQ ID NO: 880177 - DNA, 22 bp, Artificial Sequence
  chemically synthesized
cacttccttcagcttcaatttc

SEQ ID NO: 880178 - DNA, 22 bp, Artificial Sequence
  chemically synthesized
acttcacttccttcagcttcaa

SEQ ID NO: 880179 - DNA, 22 bp, Artificial Sequence
  chemically synthesized
aacttcacttccttcagcttca

SEQ ID NO: 880180 - DNA, 22 bp, Artificial Sequence
  chemically synthesized
tgcagaaattgaagctgaagga

SEQ ID NO: 880181 - DNA, 22 bp, Artificial Sequence
  chemically synthesized
taatatttaacttcacttcctt

SEQ ID NO: 880182 - DNA, 22 bp, Artificial Sequence
  chemically synthesized
tgtaatatttaacttcacttcc

SEQ ID NO: 880183 - DNA, 22 bp, Artificial Sequence
  chemically synthesized
ctgtaatatttaacttcacttc

SEQ ID NO: 880184 - DNA, 22 bp, Artificial Sequence
  chemically synthesized
aagctgaaggaagtgaagttaa

SEQ ID NO: 880185 - DNA, 22 bp, Artificial Sequence
  chemically synthesized
aaggaagtgaagttaaatatta

SEQ ID NO: 880186 - DNA, 22 bp, Artificial Sequence
  chemically synthesized
catccaaaaagtcttctgtaat

SEQ ID NO: 880187 - DNA, 22 bp, Artificial Sequence
  chemically synthesized
aatattacagaagactttttgg

SEQ ID NO: 880188 - DNA, 22 bp, Artificial Sequence
  chemically synthesized
acaagtgttccatccaaaaagt

SEQ ID NO: 880189 - DNA, 22 bp, Artificial Sequence
  chemically synthesized
aacaagtgttccatccaaaaag

SEQ ID NO: 880190 - DNA, 22 bp, Artificial Sequence
  chemically synthesized
cagaagactttttggatggaac

SEQ ID NO: 880191 - DNA, 22 bp, Artificial Sequence
  chemically synthesized
gtgtttaacaagtgttccatcc

SEQ ID NO: 880192 - DNA, 22 bp, Artificial Sequence
  chemically synthesized
tcctagtgtttaacaagtgttc

SEQ ID NO: 880193 - DNA, 22 bp, Artificial Sequence
  chemically synthesized
tatcctagtgtttaacaagtgt

SEQ ID NO: 880194 - DNA, 22 bp, Artificial Sequence
  chemically synthesized
tttggatggaacacttgttaaa

SEQ ID NO: 880195 - DNA, 22 bp, Artificial Sequence
  chemically synthesized
ttggatggaacacttgttaaac

SEQ ID NO: 880196 - DNA, 22 bp, Artificial Sequence
  chemically synthesized
tggatggaacacttgttaaaca

SEQ ID NO: 880197 - DNA, 22 bp, Artificial Sequence
  chemically synthesized
ggatggaacacttgttaaacac

SEQ ID NO: 880198 - DNA, 22 bp, Artificial Sequence
  chemically synthesized
gatggaacacttgttaaacact

SEQ ID NO: 880199 - DNA, 22 bp, Artificial Sequence
  chemically synthesized
atactctatcctagtgtttaac

SEQ ID NO: 880200 - DNA, 22 bp, Artificial Sequence
  chemically synthesized
attgatactctatcctagtgtt

SEQ ID NO: 880201 - DNA, 22 bp, Artificial Sequence
  chemically synthesized
attaattgatactctatcctag

SEQ ID NO: 880202 - DNA, 22 bp, Artificial Sequence
  chemically synthesized
gttaaacactaggatagagtat

SEQ ID NO: 880203 - DNA, 22 bp, Artificial Sequence
  chemically synthesized
ttaaacactaggatagagtatc

SEQ ID NO: 880204 - DNA, 22 bp, Artificial Sequence
  chemically synthesized
acattgattaattgatactcta

SEQ ID NO: 880205 - DNA, 22 bp, Artificial Sequence
  chemically synthesized
aacactaggatagagtatcaat

SEQ ID NO: 880206 - DNA, 22 bp, Artificial Sequence
  chemically synthesized
atgcctgacattgattaattga

SEQ ID NO: 880207 - DNA, 22 bp, Artificial Sequence
  chemically synthesized
ggatagagtatcaattaatcaa

SEQ ID NO: 880208 - DNA, 22 bp, Artificial Sequence
  chemically synthesized
actgatgcctgacattgattaa

SEQ ID NO: 880209 - DNA, 22 bp, Artificial Sequence
  chemically synthesized
cccaggccctgactgatgcctg

SEQ ID NO: 880210 - DNA, 22 bp, Artificial Sequence
  chemically synthesized
atcaatgtcaggcatcagtcag

SEQ ID NO: 880211 - DNA, 22 bp, Artificial Sequence
  chemically synthesized
gggaagattgcccaggccctga

SEQ ID NO: 880212 - DNA, 22 bp, Artificial Sequence
  chemically synthesized
tggggaagattgcccaggccct

SEQ ID NO: 880213 - DNA, 22 bp, Artificial Sequence
  chemically synthesized
tctggggaagattgcccaggcc

SEQ ID NO: 880214 - DNA, 22 bp, Artificial Sequence
  chemically synthesized
ctctctggggaagattgcccag

SEQ ID NO: 880215 - DNA, 22 bp, Artificial Sequence
  chemically synthesized
atcaggagctgctctctgggga

SEQ ID NO: 880216 - DNA, 22 bp, Artificial Sequence
  chemically synthesized
ggcaatcttccccagagagcag

SEQ ID NO: 880217 - DNA, 22 bp, Artificial Sequence
  chemically synthesized
ccccagagagcagctcctgatt

SEQ ID NO: 880218 - DNA, 22 bp, Artificial Sequence
  chemically synthesized
cccagagagcagctcctgatta

SEQ ID NO: 880219 - DNA, 22 bp, Artificial Sequence
  chemically synthesized
ctgattaacccgtatctctctt

SEQ ID NO: 880220 - DNA, 22 bp, Artificial Sequence
  chemically synthesized
attaacccgtatctctcttcct

SEQ ID NO: 880221 - DNA, 22 bp, Artificial Sequence
  chemically synthesized
cggggtaggggagggaggaaga

SEQ ID NO: 880222 - DNA, 22 bp, Artificial Sequence
  chemically synthesized
acccgtatctctcttcctccct

SEQ ID NO: 880223 - DNA, 22 bp, Artificial Sequence
  chemically synthesized
ggaggctccggggtaggggagg

SEQ ID NO: 880224 - DNA, 22 bp, Artificial Sequence
  chemically synthesized
tcttcctccctcccctaccccg

SEQ ID NO: 880225 - DNA, 22 bp, Artificial Sequence
  chemically synthesized
ttcctccctcccctaccccgga

SEQ ID NO: 880226 - DNA, 22 bp, Artificial Sequence
  chemically synthesized
cctccctcccctaccccggagc

SEQ ID NO: 880227 - DNA, 22 bp, Artificial Sequence
  chemically synthesized
ctccctcccctaccccggagcc

SEQ ID NO: 880228 - DNA, 22 bp, Artificial Sequence
  chemically synthesized
cctcccctaccccggagcctcc

SEQ ID NO: 880229 - DNA, 22 bp, Artificial Sequence
  chemically synthesized
aacacagcagtgctgggaggct

SEQ ID NO: 880230 - DNA, 22 bp, Artificial Sequence
  chemically synthesized
ccctaccccggagcctcccagc

SEQ ID NO: 880231 - DNA, 22 bp, Artificial Sequence
  chemically synthesized
aaacacagcagtgctgggaggc

SEQ ID NO: 880232 - DNA, 22 bp, Artificial Sequence
  chemically synthesized
ccccggagcctcccagcactgc

SEQ ID NO: 880233 - DNA, 22 bp, Artificial Sequence
  chemically synthesized
ccagcactgctgtgtttaagtg

SEQ ID NO: 880234 - DNA, 22 bp, Artificial Sequence
  chemically synthesized
ctgtgtttaagtgtctccgtgc

SEQ ID NO: 880235 - DNA, 22 bp, Artificial Sequence
  chemically synthesized
tgtttaagtgtctccgtgccac

SEQ ID NO: 880236 - DNA, 22 bp, Artificial Sequence
  chemically synthesized
aagtgtctccgtgccactgttt

SEQ ID NO: 880237 - DNA, 22 bp, Artificial Sequence
  chemically synthesized
agtgtctccgtgccactgtttc

SEQ ID NO: 880238 - DNA, 22 bp, Artificial Sequence
  chemically synthesized
cgtgccactgtttccttcgtat

SEQ ID NO: 880239 - DNA, 22 bp, Artificial Sequence
  chemically synthesized
tttccttcgtatactgtgtttg

SEQ ID NO: 880240 - DNA, 22 bp, Artificial Sequence
  chemically synthesized
agagggaacaggtacaaacaca

SEQ ID NO: 880241 - DNA, 22 bp, Artificial Sequence
  chemically synthesized
ccttcgtatactgtgtttgtac

SEQ ID NO: 880242 - DNA, 22 bp, Artificial Sequence
  chemically synthesized
cttcgtatactgtgtttgtacc

SEQ ID NO: 880243 - DNA, 22 bp, Artificial Sequence
  chemically synthesized
cgtatactgtgtttgtacctgt

SEQ ID NO: 880244 - DNA, 22 bp, Artificial Sequence
  chemically synthesized
gtatactgtgtttgtacctgtt

SEQ ID NO: 880245 - DNA, 22 bp, Artificial Sequence
  chemically synthesized
atgaactgagagggaacaggta

SEQ ID NO: 880246 - DNA, 22 bp, Artificial Sequence
  chemically synthesized
ctaatgaactgagagggaacag

SEQ ID NO: 880247 - DNA, 22 bp, Artificial Sequence
  chemically synthesized
tgtttgtacctgttccctctca

SEQ ID NO: 880248 - DNA, 22 bp, Artificial Sequence
  chemically synthesized
ctactaatgaactgagagggaa

SEQ ID NO: 880249 - DNA, 22 bp, Artificial Sequence
  chemically synthesized
cctactaatgaactgagaggga

SEQ ID NO: 880250 - DNA, 22 bp, Artificial Sequence
  chemically synthesized
gtacctgttccctctcagttca

SEQ ID NO: 880251 - DNA, 22 bp, Artificial Sequence
  chemically synthesized
tacctgttccctctcagttcat

SEQ ID NO: 880252 - DNA, 22 bp, Artificial Sequence
  chemically synthesized
ggatttcctactaatgaactga

SEQ ID NO: 880253 - DNA, 22 bp, Artificial Sequence
  chemically synthesized
gggatttcctactaatgaactg

SEQ ID NO: 880254 - DNA, 22 bp, Artificial Sequence
  chemically synthesized
ttccctctcagttcattagtag

SEQ ID NO: 880255 - DNA, 22 bp, Artificial Sequence
  chemically synthesized
cctctcagttcattagtaggaa

SEQ ID NO: 880256 - DNA, 22 bp, Artificial Sequence
  chemically synthesized
tagtaatttgggatttcctact

SEQ ID NO: 880257 - DNA, 22 bp, Artificial Sequence
  chemically synthesized
tcagttcattagtaggaaatcc

SEQ ID NO: 880258 - DNA, 22 bp, Artificial Sequence
  chemically synthesized
agttcattagtaggaaatccca

SEQ ID NO: 880259 - DNA, 22 bp, Artificial Sequence
  chemically synthesized
attagtaggaaatcccaaatta

SEQ ID NO: 880260 - DNA, 22 bp, Artificial Sequence
  chemically synthesized
gtaggaaatcccaaattactat

SEQ ID NO: 880261 - DNA, 22 bp, Artificial Sequence
  chemically synthesized
ggcagtatgagattatagtaat

SEQ ID NO: 880262 - DNA, 22 bp, Artificial Sequence
  chemically synthesized
tactgggcagtatgagattata

SEQ ID NO: 880263 - DNA, 22 bp, Artificial Sequence
  chemically synthesized
caagagactgtactgggcagta

SEQ ID NO: 880264 - DNA, 22 bp, Artificial Sequence
  chemically synthesized
ctataatctcatactgcccagt

SEQ ID NO: 880265 - DNA, 22 bp, Artificial Sequence
  chemically synthesized
taatctcatactgcccagtaca

SEQ ID NO: 880266 - DNA, 22 bp, Artificial Sequence
  chemically synthesized
atactgcccagtacagtctctt

SEQ ID NO: 880267 - DNA, 22 bp, Artificial Sequence
  chemically synthesized
agcacccgtaaattgcaagaga

SEQ ID NO: 880268 - DNA, 22 bp, Artificial Sequence
  chemically synthesized
cccagtacagtctcttgcaatt

SEQ ID NO: 880269 - DNA, 22 bp, Artificial Sequence
  chemically synthesized
aagagcatgtgctgagcacccg

SEQ ID NO: 880270 - DNA, 22 bp, Artificial Sequence
  chemically synthesized
ttgcaatttacgggtgctcagc

SEQ ID NO: 880271 - DNA, 22 bp, Artificial Sequence
  chemically synthesized
gcaatttacgggtgctcagcac

SEQ ID NO: 880272 - DNA, 22 bp, Artificial Sequence
  chemically synthesized
tctcaagagcatgtgctgagca

SEQ ID NO: 880273 - DNA, 22 bp, Artificial Sequence
  chemically synthesized
caatttacgggtgctcagcaca

SEQ ID NO: 880274 - DNA, 22 bp, Artificial Sequence
  chemically synthesized
acgggtgctcagcacatgctct

SEQ ID NO: 880275 - DNA, 22 bp, Artificial Sequence
  chemically synthesized
cgggtgctcagcacatgctctt

SEQ ID NO: 880276 - DNA, 22 bp, Artificial Sequence
  chemically synthesized
gaaaaaaatagtctatctcaag

SEQ ID NO: 880277 - DNA, 22 bp, Artificial Sequence
  chemically synthesized
agcacatgctcttgagatagac

SEQ ID NO: 880278 - DNA, 22 bp, Artificial Sequence
  chemically synthesized
taataagaactggaaaaaaata

SEQ ID NO: 880279 - DNA, 22 bp, Artificial Sequence
  chemically synthesized
ttgagatagactatttttttcc

SEQ ID NO: 880280 - DNA, 22 bp, Artificial Sequence
  chemically synthesized
gagatagactatttttttccag

SEQ ID NO: 880281 - DNA, 22 bp, Artificial Sequence
  chemically synthesized
ttataataagaactggaaaaaa

SEQ ID NO: 880282 - DNA, 22 bp, Artificial Sequence
  chemically synthesized
agatagactatttttttccagt

SEQ ID NO: 880283 - DNA, 22 bp, Artificial Sequence
  chemically synthesized
attataataagaactggaaaaa

SEQ ID NO: 880284 - DNA, 22 bp, Artificial Sequence
  chemically synthesized
gtatttattataataagaactg

SEQ ID NO: 880285 - DNA, 22 bp, Artificial Sequence
  chemically synthesized
ctggtatttattataataagaa

SEQ ID NO: 880286 - DNA, 22 bp, Artificial Sequence
  chemically synthesized
tttttttccagttcttattata

SEQ ID NO: 880287 - DNA, 22 bp, Artificial Sequence
  chemically synthesized
ctgctggtatttattataataa

SEQ ID NO: 880288 - DNA, 22 bp, Artificial Sequence
  chemically synthesized
ttttccagttcttattataata

SEQ ID NO: 880289 - DNA, 22 bp, Artificial Sequence
  chemically synthesized
gctgctggtatttattataata

SEQ ID NO: 880290 - DNA, 22 bp, Artificial Sequence
  chemically synthesized
tttccagttcttattataataa

SEQ ID NO: 880291 - DNA, 22 bp, Artificial Sequence
  chemically synthesized
ttccagttcttattataataaa

SEQ ID NO: 880292 - DNA, 22 bp, Artificial Sequence
  chemically synthesized
tccagttcttattataataaat

SEQ ID NO: 880293 - DNA, 22 bp, Artificial Sequence
  chemically synthesized
tttgctgctggtatttattata

SEQ ID NO: 880294 - DNA, 22 bp, Artificial Sequence
  chemically synthesized
ccagttcttattataataaata

SEQ ID NO: 880295 - DNA, 22 bp, Artificial Sequence
  chemically synthesized
cagttcttattataataaatac

SEQ ID NO: 880296 - DNA, 22 bp, Artificial Sequence
  chemically synthesized
ttattataataaataccagcag

SEQ ID NO: 880297 - DNA, 22 bp, Artificial Sequence
  chemically synthesized
attataataaataccagcagca

SEQ ID NO: 880298 - DNA, 22 bp, Artificial Sequence
  chemically synthesized
ttataataaataccagcagcaa

SEQ ID NO: 880299 - DNA, 22 bp, Artificial Sequence
  chemically synthesized
accaaagtgcctgtttgctgct

SEQ ID NO: 880300 - DNA, 22 bp, Artificial Sequence
  chemically synthesized
taataaataccagcagcaaaca

SEQ ID NO: 880301 - DNA, 22 bp, Artificial Sequence
  chemically synthesized
gaccaaagtgcctgtttgctgc

SEQ ID NO: 880302 - DNA, 22 bp, Artificial Sequence
  chemically synthesized
tgaccaaagtgcctgtttgctg

SEQ ID NO: 880303 - DNA, 22 bp, Artificial Sequence
  chemically synthesized
tgtacaattttgaccaaagtgc

SEQ ID NO: 880304 - DNA, 22 bp, Artificial Sequence
  chemically synthesized
gttatgtacaattttgaccaaa

SEQ ID NO: 880305 - DNA, 22 bp, Artificial Sequence
  chemically synthesized
acacatgaggttagttatgtac

SEQ ID NO: 880306 - DNA, 22 bp, Artificial Sequence
  chemically synthesized
tggtcaaaattgtacataacta

SEQ ID NO: 880307 - DNA, 22 bp, Artificial Sequence
  chemically synthesized
ggtcaaaattgtacataactaa

SEQ ID NO: 880308 - DNA, 22 bp, Artificial Sequence
  chemically synthesized
gtcaaaattgtacataactaac

SEQ ID NO: 880309 - DNA, 22 bp, Artificial Sequence
  chemically synthesized
tacataactaacctcatgtgtt

SEQ ID NO: 880310 - DNA, 22 bp, Artificial Sequence
  chemically synthesized
catacataaccattaacacatg

SEQ ID NO: 880311 - DNA, 22 bp, Artificial Sequence
  chemically synthesized
gcatacataaccattaacacat

SEQ ID NO: 880312 - DNA, 22 bp, Artificial Sequence
  chemically synthesized
acctcatgtgttaatggttatg

SEQ ID NO: 880313 - DNA, 22 bp, Artificial Sequence
  chemically synthesized
atgtgttaatggttatgtatgc

SEQ ID NO: 880314 - DNA, 22 bp, Artificial Sequence
  chemically synthesized
taaaggaagtgaaatttgcata

SEQ ID NO: 880315 - DNA, 22 bp, Artificial Sequence
  chemically synthesized
atggttatgtatgcaaatttca

SEQ ID NO: 880316 - DNA, 22 bp, Artificial Sequence
  chemically synthesized
ttataaaggaagtgaaatttgc

SEQ ID NO: 880317 - DNA, 22 bp, Artificial Sequence
  chemically synthesized
ctgttataaaggaagtgaaatt

SEQ ID NO: 880318 - DNA, 22 bp, Artificial Sequence
  chemically synthesized
tgtatgcaaatttcacttcctt

SEQ ID NO: 880319 - DNA, 22 bp, Artificial Sequence
  chemically synthesized
aactactgttataaaggaagtg

SEQ ID NO: 880320 - DNA, 22 bp, Artificial Sequence
  chemically synthesized
cacttcctttataacagtagtt

SEQ ID NO: 880321 - DNA, 22 bp, Artificial Sequence
  chemically synthesized
acttcctttataacagtagttt

SEQ ID NO: 880322 - DNA, 22 bp, Artificial Sequence
  chemically synthesized
atgtaaagtagctaaactactg

SEQ ID NO: 880323 - DNA, 22 bp, Artificial Sequence
  chemically synthesized
catgtaaagtagctaaactact

SEQ ID NO: 880324 - DNA, 22 bp, Artificial Sequence
  chemically synthesized
cctttataacagtagtttagct

SEQ ID NO: 880325 - DNA, 22 bp, Artificial Sequence
  chemically synthesized
ttcatgtaaagtagctaaacta

SEQ ID NO: 880326 - DNA, 22 bp, Artificial Sequence
  chemically synthesized
ctttataacagtagtttagcta

SEQ ID NO: 880327 - DNA, 22 bp, Artificial Sequence
  chemically synthesized
tataacagtagtttagctactt

SEQ ID NO: 880328 - DNA, 22 bp, Artificial Sequence
  chemically synthesized
ataacagtagtttagctacttt

SEQ ID NO: 880329 - DNA, 22 bp, Artificial Sequence
  chemically synthesized
taacagtagtttagctacttta

SEQ ID NO: 880330 - DNA, 22 bp, Artificial Sequence
  chemically synthesized
atagttcttcatgtaaagtagc

SEQ ID NO: 880331 - DNA, 22 bp, Artificial Sequence
  chemically synthesized
agctactttacatgaagaacta

SEQ ID NO: 880332 - DNA, 22 bp, Artificial Sequence
  chemically synthesized
gctactttacatgaagaactat

SEQ ID NO: 880333 - DNA, 22 bp, Artificial Sequence
  chemically synthesized
ctttacatgaagaactattaat

SEQ ID NO: 880334 - DNA, 22 bp, Artificial Sequence
  chemically synthesized
tacatgaagaactattaattga

SEQ ID NO: 880335 - DNA, 22 bp, Artificial Sequence
  chemically synthesized
acatgaagaactattaattgat

SEQ ID NO: 880336 - DNA, 22 bp, Artificial Sequence
  chemically synthesized
catgaagaactattaattgatg

SEQ ID NO: 880337 - DNA, 22 bp, Artificial Sequence
  chemically synthesized
gcaaggggcagtaagaccatca

SEQ ID NO: 880338 - DNA, 22 bp, Artificial Sequence
  chemically synthesized
ggcaaggggcagtaagaccatc

SEQ ID NO: 880339 - DNA, 22 bp, Artificial Sequence
  chemically synthesized
ttggcaaggggcagtaagacca

SEQ ID NO: 880340 - DNA, 22 bp, Artificial Sequence
  chemically synthesized
cttggcaaggggcagtaagacc

SEQ ID NO: 880341 - DNA, 22 bp, Artificial Sequence
  chemically synthesized
tcttggcaaggggcagtaagac

SEQ ID NO: 880342 - DNA, 22 bp, Artificial Sequence
  chemically synthesized
ttaattgatggtcttactgccc

SEQ ID NO: 880343 - DNA, 22 bp, Artificial Sequence
  chemically synthesized
attgatggtcttactgcccctt

SEQ ID NO: 880344 - DNA, 22 bp, Artificial Sequence
  chemically synthesized
atggtcttactgccccttgcca

SEQ ID NO: 880345 - DNA, 22 bp, Artificial Sequence
  chemically synthesized
agggaacaatgtgttttcttgg

SEQ ID NO: 880346 - DNA, 22 bp, Artificial Sequence
  chemically synthesized
actgccccttgccaagaaaaca

SEQ ID NO: 880347 - DNA, 22 bp, Artificial Sequence
  chemically synthesized
cagggaacaatgtgttttcttg

SEQ ID NO: 880348 - DNA, 22 bp, Artificial Sequence
  chemically synthesized
ctgccccttgccaagaaaacac

SEQ ID NO: 880349 - DNA, 22 bp, Artificial Sequence
  chemically synthesized
tcagggaacaatgtgttttctt

SEQ ID NO: 880350 - DNA, 22 bp, Artificial Sequence
  chemically synthesized
ccccttgccaagaaaacacatt

SEQ ID NO: 880351 - DNA, 22 bp, Artificial Sequence
  chemically synthesized
cattttcagggaacaatgtgtt

SEQ ID NO: 880352 - DNA, 22 bp, Artificial Sequence
  chemically synthesized
gccaagaaaacacattgttccc

SEQ ID NO: 880353 - DNA, 22 bp, Artificial Sequence
  chemically synthesized
ccaagaaaacacattgttccct

SEQ ID NO: 880354 - DNA, 22 bp, Artificial Sequence
  chemically synthesized
cgggtgctgcattttcagggaa

SEQ ID NO: 880355 - DNA, 22 bp, Artificial Sequence
  chemically synthesized
ttccctgaaaatgcagcacccg

SEQ ID NO: 880356 - DNA, 22 bp, Artificial Sequence
  chemically synthesized
cctgaaaatgcagcacccggaa

SEQ ID NO: 880357 - DNA, 22 bp, Artificial Sequence
  chemically synthesized
aaaatgcagcacccggaatgac

SEQ ID NO: 880358 - DNA, 22 bp, Artificial Sequence
  chemically synthesized
gcaaagacatacagtcattccg

SEQ ID NO: 880359 - DNA, 22 bp, Artificial Sequence
  chemically synthesized
tagcaaagacatacagtcattc

SEQ ID NO: 880360 - DNA, 22 bp, Artificial Sequence
  chemically synthesized
cctctagcaaagacatacagtc

SEQ ID NO: 880361 - DNA, 22 bp, Artificial Sequence
  chemically synthesized
tacctctagcaaagacatacag

SEQ ID NO: 880362 - DNA, 22 bp, Artificial Sequence
  chemically synthesized
ctacctctagcaaagacataca

SEQ ID NO: 880363 - DNA, 22 bp, Artificial Sequence
  chemically synthesized
tttctacctctagcaaagacat

SEQ ID NO: 880364 - DNA, 22 bp, Artificial Sequence
  chemically synthesized
tatgtctttgctagaggtagaa

SEQ ID NO: 880365 - DNA, 22 bp, Artificial Sequence
  chemically synthesized
agatcagagctatttctacctc

SEQ ID NO: 880366 - DNA, 22 bp, Artificial Sequence
  chemically synthesized
atctgagatcagagctatttct

SEQ ID NO: 880367 - DNA, 22 bp, Artificial Sequence
  chemically synthesized
tgctagaggtagaaatagctct

SEQ ID NO: 880368 - DNA, 22 bp, Artificial Sequence
  chemically synthesized
gctagaggtagaaatagctctg

SEQ ID NO: 880369 - DNA, 22 bp, Artificial Sequence
  chemically synthesized
ctcatctgagatcagagctatt

SEQ ID NO: 880370 - DNA, 22 bp, Artificial Sequence
  chemically synthesized
ctagaggtagaaatagctctga

SEQ ID NO: 880371 - DNA, 22 bp, Artificial Sequence
  chemically synthesized
ttcctcatctgagatcagagct

SEQ ID NO: 880372 - DNA, 22 bp, Artificial Sequence
  chemically synthesized
gaggtagaaatagctctgatct

SEQ ID NO: 880373 - DNA, 22 bp, Artificial Sequence
  chemically synthesized
attcctcatctgagatcagagc

SEQ ID NO: 880374 - DNA, 22 bp, Artificial Sequence
  chemically synthesized
cttattcctcatctgagatcag

SEQ ID NO: 880375 - DNA, 22 bp, Artificial Sequence
  chemically synthesized
ccttattcctcatctgagatca

SEQ ID NO: 880376 - DNA, 22 bp, Artificial Sequence
  chemically synthesized
tccttattcctcatctgagatc

SEQ ID NO: 880377 - DNA, 22 bp, Artificial Sequence
  chemically synthesized
gattttccttattcctcatctg

SEQ ID NO: 880378 - DNA, 22 bp, Artificial Sequence
  chemically synthesized
tgatctcagatgaggaataagg

SEQ ID NO: 880379 - DNA, 22 bp, Artificial Sequence
  chemically synthesized
atctcagatgaggaataaggaa

SEQ ID NO: 880380 - DNA, 22 bp, Artificial Sequence
  chemically synthesized
agatgaggaataaggaaaatct

SEQ ID NO: 880381 - DNA, 22 bp, Artificial Sequence
  chemically synthesized
agtaagtaaaactagattttcc

SEQ ID NO: 880382 - DNA, 22 bp, Artificial Sequence
  chemically synthesized
gaattcagtaagtaaaactaga

SEQ ID NO: 880383 - DNA, 22 bp, Artificial Sequence
  chemically synthesized
ggaattcagtaagtaaaactag

SEQ ID NO: 880384 - DNA, 22 bp, Artificial Sequence
  chemically synthesized
tttggaattcagtaagtaaaac

SEQ ID NO: 880385 - DNA, 22 bp, Artificial Sequence
  chemically synthesized
gggacctatttggaattcagta

SEQ ID NO: 880386 - DNA, 22 bp, Artificial Sequence
  chemically synthesized
gttttacttactgaattccaaa

SEQ ID NO: 880387 - DNA, 22 bp, Artificial Sequence
  chemically synthesized
tacttactgaattccaaatagg

SEQ ID NO: 880388 - DNA, 22 bp, Artificial Sequence
  chemically synthesized
acttactgaattccaaataggt

SEQ ID NO: 880389 - DNA, 22 bp, Artificial Sequence
  chemically synthesized
tagtggctggggacctatttgg

SEQ ID NO: 880390 - DNA, 22 bp, Artificial Sequence
  chemically synthesized
cttactgaattccaaataggtc

SEQ ID NO: 880391 - DNA, 22 bp, Artificial Sequence
  chemically synthesized
atagtggctggggacctatttg

SEQ ID NO: 880392 - DNA, 22 bp, Artificial Sequence
  chemically synthesized
actgaattccaaataggtcccc

SEQ ID NO: 880393 - DNA, 22 bp, Artificial Sequence
  chemically synthesized
ctgaattccaaataggtcccca

SEQ ID NO: 880394 - DNA, 22 bp, Artificial Sequence
  chemically synthesized
aattccaaataggtccccagcc

SEQ ID NO: 880395 - DNA, 22 bp, Artificial Sequence
  chemically synthesized
caaataggtccccagccactat

SEQ ID NO: 880396 - DNA, 22 bp, Artificial Sequence
  chemically synthesized
aagggtgaatttatagtggctg

SEQ ID NO: 880397 - DNA, 22 bp, Artificial Sequence
  chemically synthesized
caaatgcggtattcaagggtga

SEQ ID NO: 880398 - DNA, 22 bp, Artificial Sequence
  chemically synthesized
gcaaatgcggtattcaagggtg

SEQ ID NO: 880399 - DNA, 22 bp, Artificial Sequence
  chemically synthesized
tgcaaatgcggtattcaagggt

SEQ ID NO: 880400 - DNA, 22 bp, Artificial Sequence
  chemically synthesized
ttgcaaatgcggtattcaaggg

SEQ ID NO: 880401 - DNA, 22 bp, Artificial Sequence
  chemically synthesized
tttgcaaatgcggtattcaagg

SEQ ID NO: 880402 - DNA, 22 bp, Artificial Sequence
  chemically synthesized
ttttgcaaatgcggtattcaag

SEQ ID NO: 880403 - DNA, 22 bp, Artificial Sequence
  chemically synthesized
taaattcacccttgaataccgc

SEQ ID NO: 880404 - DNA, 22 bp, Artificial Sequence
  chemically synthesized
acccttgaataccgcatttgca

SEQ ID NO: 880405 - DNA, 22 bp, Artificial Sequence
  chemically synthesized
caccaaaatgtttttttgcaaa

SEQ ID NO: 880406 - DNA, 22 bp, Artificial Sequence
  chemically synthesized
gaataccgcatttgcaaaaaaa

SEQ ID NO: 880407 - DNA, 22 bp, Artificial Sequence
  chemically synthesized
aataccgcatttgcaaaaaaac

SEQ ID NO: 880408 - DNA, 22 bp, Artificial Sequence
  chemically synthesized
ctacaccaaaatgtttttttgc

SEQ ID NO: 880409 - DNA, 22 bp, Artificial Sequence
  chemically synthesized
actacaccaaaatgtttttttg

SEQ ID NO: 880410 - DNA, 22 bp, Artificial Sequence
  chemically synthesized
gcaaaaaaacattttggtgtag

SEQ ID NO: 880411 - DNA, 22 bp, Artificial Sequence
  chemically synthesized
caaaaaaacattttggtgtagt

SEQ ID NO: 880412 - DNA, 22 bp, Artificial Sequence
  chemically synthesized
agaccatatcaccatttactac

SEQ ID NO: 880413 - DNA, 22 bp, Artificial Sequence
  chemically synthesized
gagaccatatcaccatttacta

SEQ ID NO: 880414 - DNA, 22 bp, Artificial Sequence
  chemically synthesized
tgagaccatatcaccatttact

SEQ ID NO: 880415 - DNA, 22 bp, Artificial Sequence
  chemically synthesized
tggtgtagtaaatggtgatatg

SEQ ID NO: 880416 - DNA, 22 bp, Artificial Sequence
  chemically synthesized
ggtgtagtaaatggtgatatgg

SEQ ID NO: 880417 - DNA, 22 bp, Artificial Sequence
  chemically synthesized
gtgtagtaaatggtgatatggt

SEQ ID NO: 880418 - DNA, 22 bp, Artificial Sequence
  chemically synthesized
aagtattttgagaccatatcac

SEQ ID NO: 880419 - DNA, 22 bp, Artificial Sequence
  chemically synthesized
aaagtattttgagaccatatca

SEQ ID NO: 880420 - DNA, 22 bp, Artificial Sequence
  chemically synthesized
ttaaagtattttgagaccatat

SEQ ID NO: 880421 - DNA, 22 bp, Artificial Sequence
  chemically synthesized
tcttaaagtattttgagaccat

SEQ ID NO: 880422 - DNA, 22 bp, Artificial Sequence
  chemically synthesized
ctcttaaagtattttgagacca

SEQ ID NO: 880423 - DNA, 22 bp, Artificial Sequence
  chemically synthesized
tctcttaaagtattttgagacc

SEQ ID NO: 880424 - DNA, 22 bp, Artificial Sequence
  chemically synthesized
ttttctcttaaagtattttgag

SEQ ID NO: 880425 - DNA, 22 bp, Artificial Sequence
  chemically synthesized
attttctcttaaagtattttga

SEQ ID NO: 880426 - DNA, 22 bp, Artificial Sequence
  chemically synthesized
tattttctcttaaagtattttg

SEQ ID NO: 880427 - DNA, 22 bp, Artificial Sequence
  chemically synthesized
aaaatactttaagagaaaataa

SEQ ID NO: 880428 - DNA, 22 bp, Artificial Sequence
  chemically synthesized
gaataatatattttattttctc

SEQ ID NO: 880429 - DNA, 22 bp, Artificial Sequence
  chemically synthesized
agaataatatattttattttct

SEQ ID NO: 880430 - DNA, 22 bp, Artificial Sequence
  chemically synthesized
cttagaataatatattttattt

SEQ ID NO: 880431 - DNA, 22 bp, Artificial Sequence
  chemically synthesized
ccttagaataatatattttatt

SEQ ID NO: 880432 - DNA, 22 bp, Artificial Sequence
  chemically synthesized
cttccttagaataatatatttt

SEQ ID NO: 880433 - DNA, 22 bp, Artificial Sequence
  chemically synthesized
taagagaaaataaaatatatta

SEQ ID NO: 880434 - DNA, 22 bp, Artificial Sequence
  chemically synthesized
aagagaaaataaaatatattat

SEQ ID NO: 880435 - DNA, 22 bp, Artificial Sequence
  chemically synthesized
tacttccttagaataatatatt

SEQ ID NO: 880436 - DNA, 22 bp, Artificial Sequence
  chemically synthesized
agagaaaataaaatatattatt

SEQ ID NO: 880437 - DNA, 22 bp, Artificial Sequence
  chemically synthesized
tctacttccttagaataatata

SEQ ID NO: 880438 - DNA, 22 bp, Artificial Sequence
  chemically synthesized
ctctacttccttagaataatat

SEQ ID NO: 880439 - DNA, 22 bp, Artificial Sequence
  chemically synthesized
tctctacttccttagaataata

SEQ ID NO: 880440 - DNA, 22 bp, Artificial Sequence
  chemically synthesized
ttctctacttccttagaataat

SEQ ID NO: 880441 - DNA, 22 bp, Artificial Sequence
  chemically synthesized
ttttctctacttccttagaata

SEQ ID NO: 880442 - DNA, 22 bp, Artificial Sequence
  chemically synthesized
aagatatgctcttttctctact

SEQ ID NO: 880443 - DNA, 22 bp, Artificial Sequence
  chemically synthesized
ttctaaggaagtagagaaaaga

SEQ ID NO: 880444 - DNA, 22 bp, Artificial Sequence
  chemically synthesized
ctgaagatatgctcttttctct

SEQ ID NO: 880445 - DNA, 22 bp, Artificial Sequence
  chemically synthesized
gctgaagatatgctcttttctc

SEQ ID NO: 880446 - DNA, 22 bp, Artificial Sequence
  chemically synthesized
taaggaagtagagaaaagagca

SEQ ID NO: 880447 - DNA, 22 bp, Artificial Sequence
  chemically synthesized
aggaagtagagaaaagagcata

SEQ ID NO: 880448 - DNA, 22 bp, Artificial Sequence
  chemically synthesized
ccttgctgaagatatgctcttt

SEQ ID NO: 880449 - DNA, 22 bp, Artificial Sequence
  chemically synthesized
accttgctgaagatatgctctt

SEQ ID NO: 880450 - DNA, 22 bp, Artificial Sequence
  chemically synthesized
taccttgctgaagatatgctct

SEQ ID NO: 880451 - DNA, 22 bp, Artificial Sequence
  chemically synthesized
ttaccttgctgaagatatgctc

SEQ ID NO: 880452 - DNA, 22 bp, Artificial Sequence
  chemically synthesized
aatcatttttaccttgctgaag

SEQ ID NO: 880453 - DNA, 22 bp, Artificial Sequence
  chemically synthesized
aaatcatttttaccttgctgaa

SEQ ID NO: 880454 - DNA, 22 bp, Artificial Sequence
  chemically synthesized
ttaaatcatttttaccttgctg

SEQ ID NO: 880455 - DNA, 22 bp, Artificial Sequence
  chemically synthesized
cttaaatcatttttaccttgct

SEQ ID NO: 880456 - DNA, 22 bp, Artificial Sequence
  chemically synthesized
tcttaaatcatttttaccttgc

SEQ ID NO: 880457 - DNA, 22 bp, Artificial Sequence
  chemically synthesized
ttcttaaatcatttttaccttg

SEQ ID NO: 880458 - DNA, 22 bp, Artificial Sequence
  chemically synthesized
cttttcttaaatcatttttacc

SEQ ID NO: 880459 - DNA, 22 bp, Artificial Sequence
  chemically synthesized
ccttttcttaaatcatttttac

SEQ ID NO: 880460 - DNA, 22 bp, Artificial Sequence
  chemically synthesized
tccttttcttaaatcattttta

SEQ ID NO: 880461 - DNA, 22 bp, Artificial Sequence
  chemically synthesized
ttccttttcttaaatcattttt

SEQ ID NO: 880462 - DNA, 22 bp, Artificial Sequence
  chemically synthesized
tttccttttcttaaatcatttt

SEQ ID NO: 880463 - DNA, 22 bp, Artificial Sequence
  chemically synthesized
ttttccttttcttaaatcattt

SEQ ID NO: 880464 - DNA, 22 bp, Artificial Sequence
  chemically synthesized
cagcaaggtaaaaatgatttaa

SEQ ID NO: 880465 - DNA, 22 bp, Artificial Sequence
  chemically synthesized
tttttccttttcttaaatcatt

SEQ ID NO: 880466 - DNA, 22 bp, Artificial Sequence
  chemically synthesized
agcaaggtaaaaatgatttaag

SEQ ID NO: 880467 - DNA, 22 bp, Artificial Sequence
  chemically synthesized
ctttttttccttttcttaaatc

SEQ ID NO: 880468 - DNA, 22 bp, Artificial Sequence
  chemically synthesized
agttactttttttccttttctt

SEQ ID NO: 880469 - DNA, 22 bp, Artificial Sequence
  chemically synthesized
aaaattcagttactttttttcc

SEQ ID NO: 880470 - DNA, 22 bp, Artificial Sequence
  chemically synthesized
aagaaaaggaaaaaaagtaact

SEQ ID NO: 880471 - DNA, 22 bp, Artificial Sequence
  chemically synthesized
agaaaaggaaaaaaagtaactg

SEQ ID NO: 880472 - DNA, 22 bp, Artificial Sequence
  chemically synthesized
aattttcaacctatacatttat

SEQ ID NO: 880473 - DNA, 22 bp, Artificial Sequence
  chemically synthesized
tggtatacataaatgataaatg

SEQ ID NO: 880474 - DNA, 22 bp, Artificial Sequence
  chemically synthesized
atggtatacataaatgataaat

SEQ ID NO: 880475 - DNA, 22 bp, Artificial Sequence
  chemically synthesized
tcaacctatacatttatcattt

SEQ ID NO: 880476 - DNA, 22 bp, Artificial Sequence
  chemically synthesized
caacctatacatttatcattta

SEQ ID NO: 880477 - DNA, 22 bp, Artificial Sequence
  chemically synthesized
aacctatacatttatcatttat

SEQ ID NO: 880478 - DNA, 22 bp, Artificial Sequence
  chemically synthesized
gtaatttatggtatacataaat

SEQ ID NO: 880479 - DNA, 22 bp, Artificial Sequence
  chemically synthesized
tacatttatcatttatgtatac

SEQ ID NO: 880480 - DNA, 22 bp, Artificial Sequence
  chemically synthesized
gcctggtaatttatggtataca

SEQ ID NO: 880481 - DNA, 22 bp, Artificial Sequence
  chemically synthesized
ggcctggtaatttatggtatac

SEQ ID NO: 880482 - DNA, 22 bp, Artificial Sequence
  chemically synthesized
atcatttatgtataccataaat

SEQ ID NO: 880483 - DNA, 22 bp, Artificial Sequence
  chemically synthesized
tcatttatgtataccataaatt

SEQ ID NO: 880484 - DNA, 22 bp, Artificial Sequence
  chemically synthesized
atgtataccataaattaccagg

SEQ ID NO: 880485 - DNA, 22 bp, Artificial Sequence
  chemically synthesized
tgtataccataaattaccaggc

SEQ ID NO: 880486 - DNA, 22 bp, Artificial Sequence
  chemically synthesized
tacatgtatatttggcctggta

SEQ ID NO: 880487 - DNA, 22 bp, Artificial Sequence
  chemically synthesized
gacattgtacatgtatatttgg

SEQ ID NO: 880488 - DNA, 22 bp, Artificial Sequence
  chemically synthesized
agacattgtacatgtatatttg

SEQ ID NO: 880489 - DNA, 22 bp, Artificial Sequence
  chemically synthesized
ccaggccaaatatacatgtaca

SEQ ID NO: 880490 - DNA, 22 bp, Artificial Sequence
  chemically synthesized
aaatgtataatttagacattgt

SEQ ID NO: 880491 - DNA, 22 bp, Artificial Sequence
  chemically synthesized
caaatgtataatttagacattg

SEQ ID NO: 880492 - DNA, 22 bp, Artificial Sequence
  chemically synthesized
aattatacatttgaaattatat

SEQ ID NO: 880493 - DNA, 22 bp, Artificial Sequence
  chemically synthesized
tatgtgtaatgcatatataatt

SEQ ID NO: 880494 - DNA, 22 bp, Artificial Sequence
  chemically synthesized
atatgtgtaatgcatatataat

SEQ ID NO: 880495 - DNA, 22 bp, Artificial Sequence
  chemically synthesized
tacatttgaaattatatatgca

SEQ ID NO: 880496 - DNA, 22 bp, Artificial Sequence
  chemically synthesized
tcagtttatatgtgtaatgcat

SEQ ID NO: 880497 - DNA, 22 bp, Artificial Sequence
  chemically synthesized
gtcagtttatatgtgtaatgca

SEQ ID NO: 880498 - DNA, 22 bp, Artificial Sequence
  chemically synthesized
gaaattatatatgcattacaca

SEQ ID NO: 880499 - DNA, 22 bp, Artificial Sequence
  chemically synthesized
aaattatatatgcattacacat

SEQ ID NO: 880500 - DNA, 22 bp, Artificial Sequence
  chemically synthesized
acttgtcagtttatatgtgtaa

SEQ ID NO: 880501 - DNA, 22 bp, Artificial Sequence
  chemically synthesized
tatatgcattacacatataaac

SEQ ID NO: 880502 - DNA, 22 bp, Artificial Sequence
  chemically synthesized
agttaacttgtcagtttatatg

SEQ ID NO: 880503 - DNA, 22 bp, Artificial Sequence
  chemically synthesized
aagttaacttgtcagtttatat

SEQ ID NO: 880504 - DNA, 22 bp, Artificial Sequence
  chemically synthesized
taagttaacttgtcagtttata

SEQ ID NO: 880505 - DNA, 22 bp, Artificial Sequence
  chemically synthesized
cacatataaactgacaagttaa

SEQ ID NO: 880506 - DNA, 22 bp, Artificial Sequence
  chemically synthesized
acaagttaacttaaagcactgt

SEQ ID NO: 880507 - DNA, 22 bp, Artificial Sequence
  chemically synthesized
acttaaagcactgtcaccacca

SEQ ID NO: 880508 - DNA, 22 bp, Artificial Sequence
  chemically synthesized
aaagcactgtcaccaccattca

SEQ ID NO: 880509 - DNA, 22 bp, Artificial Sequence
  chemically synthesized
aagcactgtcaccaccattcat

SEQ ID NO: 880510 - DNA, 22 bp, Artificial Sequence
  chemically synthesized
gagaaacacatacaaaatgaat

SEQ ID NO: 880511 - DNA, 22 bp, Artificial Sequence
  chemically synthesized
agagaaacacatacaaaatgaa

SEQ ID NO: 880512 - DNA, 22 bp, Artificial Sequence
  chemically synthesized
tcaccaccattcattttgtatg

SEQ ID NO: 880513 - DNA, 22 bp, Artificial Sequence
  chemically synthesized
tcttagagaaacacatacaaaa

SEQ ID NO: 880514 - DNA, 22 bp, Artificial Sequence
  chemically synthesized
gtcttagagaaacacatacaaa

SEQ ID NO: 880515 - DNA, 22 bp, Artificial Sequence
  chemically synthesized
tgtcttagagaaacacatacaa

SEQ ID NO: 880516 - DNA, 22 bp, Artificial Sequence
  chemically synthesized
attttgtatgtgtttctctaag

SEQ ID NO: 880517 - DNA, 22 bp, Artificial Sequence
  chemically synthesized
tgtatgtgtttctctaagacaa

SEQ ID NO: 880518 - DNA, 22 bp, Artificial Sequence
  chemically synthesized
gtatgtgtttctctaagacaaa

SEQ ID NO: 880519 - DNA, 22 bp, Artificial Sequence
  chemically synthesized
tatgtgtttctctaagacaaag

SEQ ID NO: 880520 - DNA, 22 bp, Artificial Sequence
  chemically synthesized
ctctaagacaaagcactatttt

SEQ ID NO: 880521 - DNA, 22 bp, Artificial Sequence
  chemically synthesized
tctaagacaaagcactattttc

SEQ ID NO: 880522 - DNA, 22 bp, Artificial Sequence
  chemically synthesized
taagacaaagcactattttcta

SEQ ID NO: 880523 - DNA, 22 bp, Artificial Sequence
  chemically synthesized
tcagtgaataaatagaaaatag

SEQ ID NO: 880524 - DNA, 22 bp, Artificial Sequence
  chemically synthesized
agacaaagcactattttctatt

SEQ ID NO: 880525 - DNA, 22 bp, Artificial Sequence
  chemically synthesized
ttttctatttattcactgacag

SEQ ID NO: 880526 - DNA, 22 bp, Artificial Sequence
  chemically synthesized
tctatttattcactgacagctg

SEQ ID NO: 880527 - DNA, 22 bp, Artificial Sequence
  chemically synthesized
ctatttattcactgacagctgg

SEQ ID NO: 880528 - DNA, 22 bp, Artificial Sequence
  chemically synthesized
tatttattcactgacagctggg

SEQ ID NO: 880529 - DNA, 22 bp, Artificial Sequence
  chemically synthesized
tcacaagaaaagtcccagctgt

SEQ ID NO: 880530 - DNA, 22 bp, Artificial Sequence
  chemically synthesized
tttattcactgacagctgggac

SEQ ID NO: 880531 - DNA, 22 bp, Artificial Sequence
  chemically synthesized
attcactgacagctgggacttt

SEQ ID NO: 880532 - DNA, 22 bp, Artificial Sequence
  chemically synthesized
ttcactgacagctgggactttt

SEQ ID NO: 880533 - DNA, 22 bp, Artificial Sequence
  chemically synthesized
actgacagctgggacttttctt

SEQ ID NO: 880534 - DNA, 22 bp, Artificial Sequence
  chemically synthesized
acagctgggacttttcttgtga

SEQ ID NO: 880535 - DNA, 22 bp, Artificial Sequence
  chemically synthesized
tatcaataactatcacaagaaa

SEQ ID NO: 880536 - DNA, 22 bp, Artificial Sequence
  chemically synthesized
gctatatcaataactatcacaa

SEQ ID NO: 880537 - DNA, 22 bp, Artificial Sequence
  chemically synthesized
ggacttttcttgtgatagttat

SEQ ID NO: 880538 - DNA, 22 bp, Artificial Sequence
  chemically synthesized
ttcttgtgatagttattgatat

SEQ ID NO: 880539 - DNA, 22 bp, Artificial Sequence
  chemically synthesized
tcttgtgatagttattgatata

SEQ ID NO: 880540 - DNA, 22 bp, Artificial Sequence
  chemically synthesized
ccagtaattagctatatcaata

SEQ ID NO: 880541 - DNA, 22 bp, Artificial Sequence
  chemically synthesized
cttgtgatagttattgatatag

SEQ ID NO: 880542 - DNA, 22 bp, Artificial Sequence
  chemically synthesized
ttgtgatagttattgatatagc

SEQ ID NO: 880543 - DNA, 22 bp, Artificial Sequence
  chemically synthesized
ttaccagtaattagctatatca

SEQ ID NO: 880544 - DNA, 22 bp, Artificial Sequence
  chemically synthesized
gtgatagttattgatatagcta

SEQ ID NO: 880545 - DNA, 22 bp, Artificial Sequence
  chemically synthesized
tgatagttattgatatagctaa

SEQ ID NO: 880546 - DNA, 22 bp, Artificial Sequence
  chemically synthesized
tctattaccagtaattagctat

SEQ ID NO: 880547 - DNA, 22 bp, Artificial Sequence
  chemically synthesized
ttgatatagctaattactggta

SEQ ID NO: 880548 - DNA, 22 bp, Artificial Sequence
  chemically synthesized
atatagctaattactggtaata

SEQ ID NO: 880549 - DNA, 22 bp, Artificial Sequence
  chemically synthesized
atcagaaaacattgtctattac

SEQ ID NO: 880550 - DNA, 22 bp, Artificial Sequence
  chemically synthesized
attactggtaatagacaatgtt

SEQ ID NO: 880551 - DNA, 22 bp, Artificial Sequence
  chemically synthesized
ctggtaatagacaatgttttct

SEQ ID NO: 880552 - DNA, 22 bp, Artificial Sequence
  chemically synthesized
tgatgaagctaatcagaaaaca

SEQ ID NO: 880553 - DNA, 22 bp, Artificial Sequence
  chemically synthesized
gtaatagacaatgttttctgat

SEQ ID NO: 880554 - DNA, 22 bp, Artificial Sequence
  chemically synthesized
cagctatgatgaagctaatcag

SEQ ID NO: 880555 - DNA, 22 bp, Artificial Sequence
  chemically synthesized
tctgattagcttcatcatagct

SEQ ID NO: 880556 - DNA, 22 bp, Artificial Sequence
  chemically synthesized
ctgattagcttcatcatagctg

SEQ ID NO: 880557 - DNA, 22 bp, Artificial Sequence
  chemically synthesized
tgattagcttcatcatagctgt

SEQ ID NO: 880558 - DNA, 22 bp, Artificial Sequence
  chemically synthesized
attagcttcatcatagctgtag

SEQ ID NO: 880559 - DNA, 22 bp, Artificial Sequence
  chemically synthesized
gcttcatcatagctgtagacta

SEQ ID NO: 880560 - DNA, 22 bp, Artificial Sequence
  chemically synthesized
tcatcaataatatagtctacag

SEQ ID NO: 880561 - DNA, 22 bp, Artificial Sequence
  chemically synthesized
catcatagctgtagactatatt

SEQ ID NO: 880562 - DNA, 22 bp, Artificial Sequence
  chemically synthesized
atcatagctgtagactatatta

SEQ ID NO: 880563 - DNA, 22 bp, Artificial Sequence
  chemically synthesized
tgctatcatcaataatatagtc

SEQ ID NO: 880564 - DNA, 22 bp, Artificial Sequence
  chemically synthesized
tagactatattattgatgatag

SEQ ID NO: 880565 - DNA, 22 bp, Artificial Sequence
  chemically synthesized
tacgaatggtaactatgctatc

SEQ ID NO: 880566 - DNA, 22 bp, Artificial Sequence
  chemically synthesized
tattattgatgatagcatagtt

SEQ ID NO: 880567 - DNA, 22 bp, Artificial Sequence
  chemically synthesized
ttgatgatagcatagttaccat

SEQ ID NO: 880568 - DNA, 22 bp, Artificial Sequence
  chemically synthesized
atgatagcatagttaccattcg

SEQ ID NO: 880569 - DNA, 22 bp, Artificial Sequence
  chemically synthesized
gggaaggcaaatagtagtcatt

SEQ ID NO: 880570 - DNA, 22 bp, Artificial Sequence
  chemically synthesized
ccattcgtataatgactactat

SEQ ID NO: 880571 - DNA, 22 bp, Artificial Sequence
  chemically synthesized
gtataatgactactatttgcct

SEQ ID NO: 880572 - DNA, 22 bp, Artificial Sequence
  chemically synthesized
gaatcagggttggggaaggcaa

SEQ ID NO: 880573 - DNA, 22 bp, Artificial Sequence
  chemically synthesized
ttggaatcagggttggggaagg

SEQ ID NO: 880574 - DNA, 22 bp, Artificial Sequence
  chemically synthesized
ctatttgccttccccaaccctg

SEQ ID NO: 880575 - DNA, 22 bp, Artificial Sequence
  chemically synthesized
tttgccttccccaaccctgatt

SEQ ID NO: 880576 - DNA, 22 bp, Artificial Sequence
  chemically synthesized
gccttccccaaccctgattcca

SEQ ID NO: 880577 - DNA, 22 bp, Artificial Sequence
  chemically synthesized
ccttccccaaccctgattccaa

SEQ ID NO: 880578 - DNA, 22 bp, Artificial Sequence
  chemically synthesized
taaagtggcaatctgttggaat

SEQ ID NO: 880579 - DNA, 22 bp, Artificial Sequence
  chemically synthesized
ccccaaccctgattccaacaga

SEQ ID NO: 880580 - DNA, 22 bp, Artificial Sequence
  chemically synthesized
cccaaccctgattccaacagat

SEQ ID NO: 880581 - DNA, 22 bp, Artificial Sequence
  chemically synthesized
tctgtaaagtggcaatctgttg

SEQ ID NO: 880582 - DNA, 22 bp, Artificial Sequence
  chemically synthesized
atctgtaaagtggcaatctgtt

SEQ ID NO: 880583 - DNA, 22 bp, Artificial Sequence
  chemically synthesized
ttatctgtaaagtggcaatctg

SEQ ID NO: 880584 - DNA, 22 bp, Artificial Sequence
  chemically synthesized
cttatctgtaaagtggcaatct

SEQ ID NO: 880585 - DNA, 22 bp, Artificial Sequence
  chemically synthesized
tcttatctgtaaagtggcaatc

SEQ ID NO: 880586 - DNA, 22 bp, Artificial Sequence
  chemically synthesized
attccaacagattgccacttta

SEQ ID NO: 880587 - DNA, 22 bp, Artificial Sequence
  chemically synthesized
attttcttatctgtaaagtggc

SEQ ID NO: 880588 - DNA, 22 bp, Artificial Sequence
  chemically synthesized
cattttcttatctgtaaagtgg

SEQ ID NO: 880589 - DNA, 22 bp, Artificial Sequence
  chemically synthesized
caacagattgccactttacaga

SEQ ID NO: 880590 - DNA, 22 bp, Artificial Sequence
  chemically synthesized
cttcattttcttatctgtaaag

SEQ ID NO: 880591 - DNA, 22 bp, Artificial Sequence
  chemically synthesized
gcttcattttcttatctgtaaa

SEQ ID NO: 880592 - DNA, 22 bp, Artificial Sequence
  chemically synthesized
ccactttacagataagaaaatg

SEQ ID NO: 880593 - DNA, 22 bp, Artificial Sequence
  chemically synthesized
tacagataagaaaatgaagcaa

SEQ ID NO: 880594 - DNA, 22 bp, Artificial Sequence
  chemically synthesized
tcccacccacccttgcttcatt

SEQ ID NO: 880595 - DNA, 22 bp, Artificial Sequence
  chemically synthesized
acagataagaaaatgaagcaag

SEQ ID NO: 880596 - DNA, 22 bp, Artificial Sequence
  chemically synthesized
cagataagaaaatgaagcaagg

SEQ ID NO: 880597 - DNA, 22 bp, Artificial Sequence
  chemically synthesized
ctatcccacccacccttgcttc

SEQ ID NO: 880598 - DNA, 22 bp, Artificial Sequence
  chemically synthesized
ccgtcactactatcccacccac

SEQ ID NO: 880599 - DNA, 22 bp, Artificial Sequence
  chemically synthesized
tcactaccgtcactactatccc

SEQ ID NO: 880600 - DNA, 22 bp, Artificial Sequence
  chemically synthesized
acatcattgtcactaccgtcac

SEQ ID NO: 880601 - DNA, 22 bp, Artificial Sequence
  chemically synthesized
ttcacatcattgtcactaccgt

SEQ ID NO: 880602 - DNA, 22 bp, Artificial Sequence
  chemically synthesized
tgggcaagctattcacatcatt

SEQ ID NO: 880603 - DNA, 22 bp, Artificial Sequence
  chemically synthesized
ccacatcccacgaggttgtggg

SEQ ID NO: 880604 - DNA, 22 bp, Artificial Sequence
  chemically synthesized
tcccacatcccacgaggttgtg

SEQ ID NO: 880605 - DNA, 22 bp, Artificial Sequence
  chemically synthesized
actctcccacatcccacgaggt

SEQ ID NO: 880606 - DNA, 22 bp, Artificial Sequence
  chemically synthesized
gcccacaacctcgtgggatgtg

SEQ ID NO: 880607 - DNA, 22 bp, Artificial Sequence
  chemically synthesized
cccacaacctcgtgggatgtgg

SEQ ID NO: 880608 - DNA, 22 bp, Artificial Sequence
  chemically synthesized
aatattaactctcccacatccc

SEQ ID NO: 880609 - DNA, 22 bp, Artificial Sequence
  chemically synthesized
gaatattaactctcccacatcc

SEQ ID NO: 880610 - DNA, 22 bp, Artificial Sequence
  chemically synthesized
tgtttgaatattaactctccca

SEQ ID NO: 880611 - DNA, 22 bp, Artificial Sequence
  chemically synthesized
gtgggatgtgggagagttaata

SEQ ID NO: 880612 - DNA, 22 bp, Artificial Sequence
  chemically synthesized
gctgtgtttgaatattaactct

SEQ ID NO: 880613 - DNA, 22 bp, Artificial Sequence
  chemically synthesized
agacctagctgtgtttgaatat

SEQ ID NO: 880614 - DNA, 22 bp, Artificial Sequence
  chemically synthesized
gattcagacctagctgtgtttg

SEQ ID NO: 880615 - DNA, 22 bp, Artificial Sequence
  chemically synthesized
ggattcagacctagctgtgttt

SEQ ID NO: 880616 - DNA, 22 bp, Artificial Sequence
  chemically synthesized
tggattcagacctagctgtgtt

SEQ ID NO: 880617 - DNA, 22 bp, Artificial Sequence
  chemically synthesized
atattcaaacacagctaggtct

SEQ ID NO: 880618 - DNA, 22 bp, Artificial Sequence
  chemically synthesized
aaacacagctaggtctgaatcc

SEQ ID NO: 880619 - DNA, 22 bp, Artificial Sequence
  chemically synthesized
ccaatagtataaactttggatt

SEQ ID NO: 880620 - DNA, 22 bp, Artificial Sequence
  chemically synthesized
ctgccaatagtataaactttgg

SEQ ID NO: 880621 - DNA, 22 bp, Artificial Sequence
  chemically synthesized
ggtctgaatccaaagtttatac

SEQ ID NO: 880622 - DNA, 22 bp, Artificial Sequence
  chemically synthesized
ctactgccaatagtataaactt

SEQ ID NO: 880623 - DNA, 22 bp, Artificial Sequence
  chemically synthesized
ttactactgccaatagtataaa

SEQ ID NO: 880624 - DNA, 22 bp, Artificial Sequence
  chemically synthesized
aatccaaagtttatactattgg

SEQ ID NO: 880625 - DNA, 22 bp, Artificial Sequence
  chemically synthesized
atactattggcagtagtaacag

SEQ ID NO: 880626 - DNA, 22 bp, Artificial Sequence
  chemically synthesized
tactattggcagtagtaacagc

SEQ ID NO: 880627 - DNA, 22 bp, Artificial Sequence
  chemically synthesized
ttggcagtagtaacagctacgt

SEQ ID NO: 880628 - DNA, 22 bp, Artificial Sequence
  chemically synthesized
taagatatgaagacgtagctgt

SEQ ID NO: 880629 - DNA, 22 bp, Artificial Sequence
  chemically synthesized
gcagtagtaacagctacgtctt

SEQ ID NO: 880630 - DNA, 22 bp, Artificial Sequence
  chemically synthesized
ttgtaagatatgaagacgtagc

SEQ ID NO: 880631 - DNA, 22 bp, Artificial Sequence
  chemically synthesized
agttgttgtaagatatgaagac

SEQ ID NO: 880632 - DNA, 22 bp, Artificial Sequence
  chemically synthesized
ttaagttgttgtaagatatgaa

SEQ ID NO: 880633 - DNA, 22 bp, Artificial Sequence
  chemically synthesized
cgtcttcatatcttacaacaac

SEQ ID NO: 880634 - DNA, 22 bp, Artificial Sequence
  chemically synthesized
gatatgttattaagttgttgta

SEQ ID NO: 880635 - DNA, 22 bp, Artificial Sequence
  chemically synthesized
ggatatgttattaagttgttgt

SEQ ID NO: 880636 - DNA, 22 bp, Artificial Sequence
  chemically synthesized
catatcttacaacaacttaata

SEQ ID NO: 880637 - DNA, 22 bp, Artificial Sequence
  chemically synthesized
atatcttacaacaacttaataa

SEQ ID NO: 880638 - DNA, 22 bp, Artificial Sequence
  chemically synthesized
acaacaacttaataacatatcc

SEQ ID NO: 880639 - DNA, 22 bp, Artificial Sequence
  chemically synthesized
atcaaatcatttggatatgtta

SEQ ID NO: 880640 - DNA, 22 bp, Artificial Sequence
  chemically synthesized
caacaacttaataacatatcca

SEQ ID NO: 880641 - DNA, 22 bp, Artificial Sequence
  chemically synthesized
gatcaaatcatttggatatgtt

SEQ ID NO: 880642 - DNA, 22 bp, Artificial Sequence
  chemically synthesized
aataacatatccaaatgatttg

SEQ ID NO: 880643 - DNA, 22 bp, Artificial Sequence
  chemically synthesized
ataacatatccaaatgatttga

SEQ ID NO: 880644 - DNA, 22 bp, Artificial Sequence
  chemically synthesized
gaaataacataatttgatcaaa

SEQ ID NO: 880645 - DNA, 22 bp, Artificial Sequence
  chemically synthesized
agaaataacataatttgatcaa

SEQ ID NO: 880646 - DNA, 22 bp, Artificial Sequence
  chemically synthesized
atgcttagaaataacataattt

SEQ ID NO: 880647 - DNA, 22 bp, Artificial Sequence
  chemically synthesized
aatgcttagaaataacataatt

SEQ ID NO: 880648 - DNA, 22 bp, Artificial Sequence
  chemically synthesized
ttaatgcttagaaataacataa

SEQ ID NO: 880649 - DNA, 22 bp, Artificial Sequence
  chemically synthesized
cttaatgcttagaaataacata

SEQ ID NO: 880650 - DNA, 22 bp, Artificial Sequence
  chemically synthesized
gatcaaattatgttatttctaa

SEQ ID NO: 880651 - DNA, 22 bp, Artificial Sequence
  chemically synthesized
atcaaattatgttatttctaag

SEQ ID NO: 880652 - DNA, 22 bp, Artificial Sequence
  chemically synthesized
tgttatttctaagcattaagaa

SEQ ID NO: 880653 - DNA, 22 bp, Artificial Sequence
  chemically synthesized
tttctaagcattaagaaatttt

SEQ ID NO: 880654 - DNA, 22 bp, Artificial Sequence
  chemically synthesized
agatggtgaaagtaaaatttct

SEQ ID NO: 880655 - DNA, 22 bp, Artificial Sequence
  chemically synthesized
ctaagcattaagaaattttact

SEQ ID NO: 880656 - DNA, 22 bp, Artificial Sequence
  chemically synthesized
taagcattaagaaattttactt

SEQ ID NO: 880657 - DNA, 22 bp, Artificial Sequence
  chemically synthesized
agcattaagaaattttactttc

SEQ ID NO: 880658 - DNA, 22 bp, Artificial Sequence
  chemically synthesized
agaaattttactttcaccatct

SEQ ID NO: 880659 - DNA, 22 bp, Artificial Sequence
  chemically synthesized
tactttcaccatctgaatctgt

SEQ ID NO: 880660 - DNA, 22 bp, Artificial Sequence
  chemically synthesized
actttcaccatctgaatctgtt

SEQ ID NO: 880661 - DNA, 22 bp, Artificial Sequence
  chemically synthesized
ctttcaccatctgaatctgttt

SEQ ID NO: 880662 - DNA, 22 bp, Artificial Sequence
  chemically synthesized
tcaccatctgaatctgtttgat

SEQ ID NO: 880663 - DNA, 22 bp, Artificial Sequence
  chemically synthesized
caccatctgaatctgtttgata

SEQ ID NO: 880664 - DNA, 22 bp, Artificial Sequence
  chemically synthesized
accatctgaatctgtttgatat

SEQ ID NO: 880665 - DNA, 22 bp, Artificial Sequence
  chemically synthesized
agcatatgtgataatatcaaac

SEQ ID NO: 880666 - DNA, 22 bp, Artificial Sequence
  chemically synthesized
cagcatatgtgataatatcaaa

SEQ ID NO: 880667 - DNA, 22 bp, Artificial Sequence
  chemically synthesized
tcagcatatgtgataatatcaa

SEQ ID NO: 880668 - DNA, 22 bp, Artificial Sequence
  chemically synthesized
ttcagcatatgtgataatatca

SEQ ID NO: 880669 - DNA, 22 bp, Artificial Sequence
  chemically synthesized
aatctgtttgatattatcacat

SEQ ID NO: 880670 - DNA, 22 bp, Artificial Sequence
  chemically synthesized
tttgatattatcacatatgctg

SEQ ID NO: 880671 - DNA, 22 bp, Artificial Sequence
  chemically synthesized
gatattatcacatatgctgaaa

SEQ ID NO: 880672 - DNA, 22 bp, Artificial Sequence
  chemically synthesized
atattatcacatatgctgaaaa

SEQ ID NO: 880673 - DNA, 22 bp, Artificial Sequence
  chemically synthesized
tcacatatgctgaaaaacatgc

SEQ ID NO: 880674 - DNA, 22 bp, Artificial Sequence
  chemically synthesized
tcagagaggtagggcatgtttt

SEQ ID NO: 880675 - DNA, 22 bp, Artificial Sequence
  chemically synthesized
ttatcagagaggtagggcatgt

SEQ ID NO: 880676 - DNA, 22 bp, Artificial Sequence
  chemically synthesized
tattatcagagaggtagggcat

SEQ ID NO: 880677 - DNA, 22 bp, Artificial Sequence
  chemically synthesized
tctattatcagagaggtagggc

SEQ ID NO: 880678 - DNA, 22 bp, Artificial Sequence
  chemically synthesized
aaaaacatgccctacctctctg

SEQ ID NO: 880679 - DNA, 22 bp, Artificial Sequence
  chemically synthesized
acccatagtgattctctattat

SEQ ID NO: 880680 - DNA, 22 bp, Artificial Sequence
  chemically synthesized
tgacccatagtgattctctatt

SEQ ID NO: 880681 - DNA, 22 bp, Artificial Sequence
  chemically synthesized
cctctctgataatagagaatca

SEQ ID NO: 880682 - DNA, 22 bp, Artificial Sequence
  chemically synthesized
cctctgacccatagtgattctc

SEQ ID NO: 880683 - DNA, 22 bp, Artificial Sequence
  chemically synthesized
tctgataatagagaatcactat

SEQ ID NO: 880684 - DNA, 22 bp, Artificial Sequence
  chemically synthesized
tgataatagagaatcactatgg

SEQ ID NO: 880685 - DNA, 22 bp, Artificial Sequence
  chemically synthesized
tctccctctgacccatagtgat

SEQ ID NO: 880686 - DNA, 22 bp, Artificial Sequence
  chemically synthesized
ataatagagaatcactatgggt

SEQ ID NO: 880687 - DNA, 22 bp, Artificial Sequence
  chemically synthesized
cctgtctccctctgacccatag

SEQ ID NO: 880688 - DNA, 22 bp, Artificial Sequence
  chemically synthesized
agttgcctgtctccctctgacc

SEQ ID NO: 880689 - DNA, 22 bp, Artificial Sequence
  chemically synthesized
cattaagttgcctgtctccctc

SEQ ID NO: 880690 - DNA, 22 bp, Artificial Sequence
  chemically synthesized
ttgcattaagttgcctgtctcc

SEQ ID NO: 880691 - DNA, 22 bp, Artificial Sequence
  chemically synthesized
tgggtcagagggagacaggcaa

SEQ ID NO: 880692 - DNA, 22 bp, Artificial Sequence
  chemically synthesized
caatgaatgggaatgacgactg

SEQ ID NO: 880693 - DNA, 22 bp, Artificial Sequence
  chemically synthesized
aatgcaacagtcgtcattccca

SEQ ID NO: 880694 - DNA, 22 bp, Artificial Sequence
  chemically synthesized
atgcaacagtcgtcattcccat

SEQ ID NO: 880695 - DNA, 22 bp, Artificial Sequence
  chemically synthesized
aaaaattccaatgaatgggaat

SEQ ID NO: 880696 - DNA, 22 bp, Artificial Sequence
  chemically synthesized
caaaaattccaatgaatgggaa

SEQ ID NO: 880697 - DNA, 22 bp, Artificial Sequence
  chemically synthesized
tcaaaaattccaatgaatggga

SEQ ID NO: 880698 - DNA, 22 bp, Artificial Sequence
  chemically synthesized
ttcaaaaattccaatgaatggg

SEQ ID NO: 880699 - DNA, 22 bp, Artificial Sequence
  chemically synthesized
tcatttttcaaaaattccaatg

SEQ ID NO: 880700 - DNA, 22 bp, Artificial Sequence
  chemically synthesized
ctatcatttttcaaaaattcca

SEQ ID NO: 880701 - DNA, 22 bp, Artificial Sequence
  chemically synthesized
gctatcatttttcaaaaattcc

SEQ ID NO: 880702 - DNA, 22 bp, Artificial Sequence
  chemically synthesized
tgctatcatttttcaaaaattc

SEQ ID NO: 880703 - DNA, 22 bp, Artificial Sequence
  chemically synthesized
ccattcattggaatttttgaaa

SEQ ID NO: 880704 - DNA, 22 bp, Artificial Sequence
  chemically synthesized
attggaatttttgaaaaatgat

SEQ ID NO: 880705 - DNA, 22 bp, Artificial Sequence
  chemically synthesized
gaatttttgaaaaatgatagca

SEQ ID NO: 880706 - DNA, 22 bp, Artificial Sequence
  chemically synthesized
ttgaaaaatgatagcaaagacc

SEQ ID NO: 880707 - DNA, 22 bp, Artificial Sequence
  chemically synthesized
tgaaaaatgatagcaaagacca

SEQ ID NO: 880708 - DNA, 22 bp, Artificial Sequence
  chemically synthesized
gaaaaatgatagcaaagaccat

SEQ ID NO: 880709 - DNA, 22 bp, Artificial Sequence
  chemically synthesized
gcagtgggaacaatggtctttg

SEQ ID NO: 880710 - DNA, 22 bp, Artificial Sequence
  chemically synthesized
aaaaatgatagcaaagaccatt

SEQ ID NO: 880711 - DNA, 22 bp, Artificial Sequence
  chemically synthesized
taggttggcagtgggaacaatg

SEQ ID NO: 880712 - DNA, 22 bp, Artificial Sequence
  chemically synthesized
aataagactgtaggttggcagt

SEQ ID NO: 880713 - DNA, 22 bp, Artificial Sequence
  chemically synthesized
aaataagactgtaggttggcag

SEQ ID NO: 880714 - DNA, 22 bp, Artificial Sequence
  chemically synthesized
ttcccactgccaacctacagtc

SEQ ID NO: 880715 - DNA, 22 bp, Artificial Sequence
  chemically synthesized
ccactgccaacctacagtctta

SEQ ID NO: 880716 - DNA, 22 bp, Artificial Sequence
  chemically synthesized
gaacagtttaaataagactgta

SEQ ID NO: 880717 - DNA, 22 bp, Artificial Sequence
  chemically synthesized
ccaacctacagtcttatttaaa

SEQ ID NO: 880718 - DNA, 22 bp, Artificial Sequence
  chemically synthesized
cagtcttatttaaactgttcca

SEQ ID NO: 880719 - DNA, 22 bp, Artificial Sequence
  chemically synthesized
atttaaactgttccaactcctt

SEQ ID NO: 880720 - DNA, 22 bp, Artificial Sequence
  chemically synthesized
aaggaggaagcaaaggagttgg

SEQ ID NO: 880721 - DNA, 22 bp, Artificial Sequence
  chemically synthesized
tttaaactgttccaactccttt

SEQ ID NO: 880722 - DNA, 22 bp, Artificial Sequence
  chemically synthesized
gaaggaggaagcaaaggagttg

SEQ ID NO: 880723 - DNA, 22 bp, Artificial Sequence
  chemically synthesized
tgaaggaggaagcaaaggagtt

SEQ ID NO: 880724 - DNA, 22 bp, Artificial Sequence
  chemically synthesized
aaactgttccaactcctttgct

SEQ ID NO: 880725 - DNA, 22 bp, Artificial Sequence
  chemically synthesized
aactgttccaactcctttgctt

SEQ ID NO: 880726 - DNA, 22 bp, Artificial Sequence
  chemically synthesized
ttccaactcctttgcttcctcc

SEQ ID NO: 880727 - DNA, 22 bp, Artificial Sequence
  chemically synthesized
tgatgtgttttgaaggaggaag

SEQ ID NO: 880728 - DNA, 22 bp, Artificial Sequence
  chemically synthesized
caactcctttgcttcctccttc

SEQ ID NO: 880729 - DNA, 22 bp, Artificial Sequence
  chemically synthesized
attgtgatgtgttttgaaggag

SEQ ID NO: 880730 - DNA, 22 bp, Artificial Sequence
  chemically synthesized
ctttgcttcctccttcaaaaca

SEQ ID NO: 880731 - DNA, 22 bp, Artificial Sequence
  chemically synthesized
tgcttcctccttcaaaacacat

SEQ ID NO: 880732 - DNA, 22 bp, Artificial Sequence
  chemically synthesized
gcttcctccttcaaaacacatc

SEQ ID NO: 880733 - DNA, 22 bp, Artificial Sequence
  chemically synthesized
cttcctccttcaaaacacatca

SEQ ID NO: 880734 - DNA, 22 bp, Artificial Sequence
  chemically synthesized
cctccttcaaaacacatcacaa

SEQ ID NO: 880735 - DNA, 22 bp, Artificial Sequence
  chemically synthesized
ctccttcaaaacacatcacaat

SEQ ID NO: 880736 - DNA, 22 bp, Artificial Sequence
  chemically synthesized
cttcaaaacacatcacaattaa

SEQ ID NO: 880737 - DNA, 22 bp, Artificial Sequence
  chemically synthesized
caaaacacatcacaattaatca

SEQ ID NO: 880738 - DNA, 22 bp, Artificial Sequence
  chemically synthesized
aaaacacatcacaattaatcac

SEQ ID NO: 880739 - DNA, 22 bp, Artificial Sequence
  chemically synthesized
tacatatacacataatgtgatt

SEQ ID NO: 880740 - DNA, 22 bp, Artificial Sequence
  chemically synthesized
atcacattatgtgtatatgtat

SEQ ID NO: 880741 - DNA, 22 bp, Artificial Sequence
  chemically synthesized
ggaatggtcaaaactatacata

SEQ ID NO: 880742 - DNA, 22 bp, Artificial Sequence
  chemically synthesized
aggaatggtcaaaactatacat

SEQ ID NO: 880743 - DNA, 22 bp, Artificial Sequence
  chemically synthesized
taggaatggtcaaaactataca

SEQ ID NO: 880744 - DNA, 22 bp, Artificial Sequence
  chemically synthesized
tttaggaatggtcaaaactata

SEQ ID NO: 880745 - DNA, 22 bp, Artificial Sequence
  chemically synthesized
tgtgtatatgtatagttttgac

SEQ ID NO: 880746 - DNA, 22 bp, Artificial Sequence
  chemically synthesized
atagaggataattctttaggaa

SEQ ID NO: 880747 - DNA, 22 bp, Artificial Sequence
  chemically synthesized
tcatagaggataattctttagg

SEQ ID NO: 880748 - DNA, 22 bp, Artificial Sequence
  chemically synthesized
ctctcatagaggataattcttt

SEQ ID NO: 880749 - DNA, 22 bp, Artificial Sequence
  chemically synthesized
tgaccattcctaaagaattatc

SEQ ID NO: 880750 - DNA, 22 bp, Artificial Sequence
  chemically synthesized
actctcatagaggataattctt

SEQ ID NO: 880751 - DNA, 22 bp, Artificial Sequence
  chemically synthesized
gaccattcctaaagaattatcc

SEQ ID NO: 880752 - DNA, 22 bp, Artificial Sequence
  chemically synthesized
accattcctaaagaattatcct

SEQ ID NO: 880753 - DNA, 22 bp, Artificial Sequence
  chemically synthesized
tgggtcttactctcatagagga

SEQ ID NO: 880754 - DNA, 22 bp, Artificial Sequence
  chemically synthesized
ctaaagaattatcctctatgag

SEQ ID NO: 880755 - DNA, 22 bp, Artificial Sequence
  chemically synthesized
aagaattatcctctatgagagt

SEQ ID NO: 880756 - DNA, 22 bp, Artificial Sequence
  chemically synthesized
tcctctatgagagtaagaccca

SEQ ID NO: 880757 - DNA, 22 bp, Artificial Sequence
  chemically synthesized
tatgagagtaagacccataact

SEQ ID NO: 880758 - DNA, 22 bp, Artificial Sequence
  chemically synthesized
tgagagtaagacccataactac

SEQ ID NO: 880759 - DNA, 22 bp, Artificial Sequence
  chemically synthesized
cagggatatgagtgaacaaggt

SEQ ID NO: 880760 - DNA, 22 bp, Artificial Sequence
  chemically synthesized
ccagggatatgagtgaacaagg

SEQ ID NO: 880761 - DNA, 22 bp, Artificial Sequence
  chemically synthesized
ggcacttccagggatatgagtg

SEQ ID NO: 880762 - DNA, 22 bp, Artificial Sequence
  chemically synthesized
ccttgttcactcatatccctgg

SEQ ID NO: 880763 - DNA, 22 bp, Artificial Sequence
  chemically synthesized
tgtgttaggcacttccagggat

SEQ ID NO: 880764 - DNA, 22 bp, Artificial Sequence
  chemically synthesized
gttcactcatatccctggaagt

SEQ ID NO: 880765 - DNA, 22 bp, Artificial Sequence
  chemically synthesized
ttcactcatatccctggaagtg

SEQ ID NO: 880766 - DNA, 22 bp, Artificial Sequence
  chemically synthesized
ctatgtgttaggcacttccagg

SEQ ID NO: 880767 - DNA, 22 bp, Artificial Sequence
  chemically synthesized
actatgtgttaggcacttccag

SEQ ID NO: 880768 - DNA, 22 bp, Artificial Sequence
  chemically synthesized
actcatatccctggaagtgcct

SEQ ID NO: 880769 - DNA, 22 bp, Artificial Sequence
  chemically synthesized
atatccctggaagtgcctaaca

SEQ ID NO: 880770 - DNA, 22 bp, Artificial Sequence
  chemically synthesized
gcacttactatgtgttaggcac

SEQ ID NO: 880771 - DNA, 22 bp, Artificial Sequence
  chemically synthesized
agcacttactatgtgttaggca

SEQ ID NO: 880772 - DNA, 22 bp, Artificial Sequence
  chemically synthesized
tttagcacttactatgtgttag

SEQ ID NO: 880773 - DNA, 22 bp, Artificial Sequence
  chemically synthesized
gtttagcacttactatgtgtta

SEQ ID NO: 880774 - DNA, 22 bp, Artificial Sequence
  chemically synthesized
tgtttagcacttactatgtgtt

SEQ ID NO: 880775 - DNA, 22 bp, Artificial Sequence
  chemically synthesized
ttgtttagcacttactatgtgt

SEQ ID NO: 880776 - DNA, 22 bp, Artificial Sequence
  chemically synthesized
tttgtttagcacttactatgtg

SEQ ID NO: 880777 - DNA, 22 bp, Artificial Sequence
  chemically synthesized
gaagtgcctaacacatagtaag

SEQ ID NO: 880778 - DNA, 22 bp, Artificial Sequence
  chemically synthesized
aacggttttttgtttagcactt

SEQ ID NO: 880779 - DNA, 22 bp, Artificial Sequence
  chemically synthesized
acacatagtaagtgctaaacaa

SEQ ID NO: 880780 - DNA, 22 bp, Artificial Sequence
  chemically synthesized
cccgttcaacggttttttgttt

SEQ ID NO: 880781 - DNA, 22 bp, Artificial Sequence
  chemically synthesized
gcccgttcaacggttttttgtt

SEQ ID NO: 880782 - DNA, 22 bp, Artificial Sequence
  chemically synthesized
tttgcccgttcaacggtttttt

SEQ ID NO: 880783 - DNA, 22 bp, Artificial Sequence
  chemically synthesized
atttgcccgttcaacggttttt

SEQ ID NO: 880784 - DNA, 22 bp, Artificial Sequence
  chemically synthesized
aacaaaaaaccgttgaacgggc

SEQ ID NO: 880785 - DNA, 22 bp, Artificial Sequence
  chemically synthesized
caacagtatttatttgcccgtt

SEQ ID NO: 880786 - DNA, 22 bp, Artificial Sequence
  chemically synthesized
aaagttgcaacagtatttattt

SEQ ID NO: 880787 - DNA, 22 bp, Artificial Sequence
  chemically synthesized
aacgggcaaataaatactgttg

SEQ ID NO: 880788 - DNA, 22 bp, Artificial Sequence
  chemically synthesized
ccataggctcaaagttgcaaca

SEQ ID NO: 880789 - DNA, 22 bp, Artificial Sequence
  chemically synthesized
aattcccataggctcaaagttg

SEQ ID NO: 880790 - DNA, 22 bp, Artificial Sequence
  chemically synthesized
actcaattcccataggctcaaa

SEQ ID NO: 880791 - DNA, 22 bp, Artificial Sequence
  chemically synthesized
aactcaattcccataggctcaa

SEQ ID NO: 880792 - DNA, 22 bp, Artificial Sequence
  chemically synthesized
ttaactcaattcccataggctc

SEQ ID NO: 880793 - DNA, 22 bp, Artificial Sequence
  chemically synthesized
ttgcaactttgagcctatggga

SEQ ID NO: 880794 - DNA, 22 bp, Artificial Sequence
  chemically synthesized
caactttgagcctatgggaatt

SEQ ID NO: 880795 - DNA, 22 bp, Artificial Sequence
  chemically synthesized
tgagcctatgggaattgagtta

SEQ ID NO: 880796 - DNA, 22 bp, Artificial Sequence
  chemically synthesized
gagcctatgggaattgagttaa

SEQ ID NO: 880797 - DNA, 22 bp, Artificial Sequence
  chemically synthesized
agcctatgggaattgagttaag

SEQ ID NO: 880798 - DNA, 22 bp, Artificial Sequence
  chemically synthesized
gtaatacacactcttaactcaa

SEQ ID NO: 880799 - DNA, 22 bp, Artificial Sequence
  chemically synthesized
tagtaatacacactcttaactc

SEQ ID NO: 880800 - DNA, 22 bp, Artificial Sequence
  chemically synthesized
tgggaattgagttaagagtgtg

SEQ ID NO: 880801 - DNA, 22 bp, Artificial Sequence
  chemically synthesized
agttaagagtgtgtattactag

SEQ ID NO: 880802 - DNA, 22 bp, Artificial Sequence
  chemically synthesized
cgtgaacaaatgtctctagtaa

SEQ ID NO: 880803 - DNA, 22 bp, Artificial Sequence
  chemically synthesized
agagtgtgtattactagagaca

SEQ ID NO: 880804 - DNA, 22 bp, Artificial Sequence
  chemically synthesized
tctgcgtgaacaaatgtctcta

SEQ ID NO: 880805 - DNA, 22 bp, Artificial Sequence
  chemically synthesized
gactgtctgcgtgaacaaatgt

SEQ ID NO: 880806 - DNA, 22 bp, Artificial Sequence
  chemically synthesized
cgactgtctgcgtgaacaaatg

SEQ ID NO: 880807 - DNA, 22 bp, Artificial Sequence
  chemically synthesized
tcgactgtctgcgtgaacaaat

SEQ ID NO: 880808 - DNA, 22 bp, Artificial Sequence
  chemically synthesized
ctagagacatttgttcacgcag

SEQ ID NO: 880809 - DNA, 22 bp, Artificial Sequence
  chemically synthesized
gagacatttgttcacgcagaca

SEQ ID NO: 880810 - DNA, 22 bp, Artificial Sequence
  chemically synthesized
tgccatgaacctttcgactgtc

SEQ ID NO: 880811 - DNA, 22 bp, Artificial Sequence
  chemically synthesized
gttcacgcagacagtcgaaagg

SEQ ID NO: 880812 - DNA, 22 bp, Artificial Sequence
  chemically synthesized
ttcacgcagacagtcgaaaggt

SEQ ID NO: 880813 - DNA, 22 bp, Artificial Sequence
  chemically synthesized
acgcagacagtcgaaaggttca

SEQ ID NO: 880814 - DNA, 22 bp, Artificial Sequence
  chemically synthesized
gaaagaaaatagtctatgccat

SEQ ID NO: 880815 - DNA, 22 bp, Artificial Sequence
  chemically synthesized
agaaagaaaatagtctatgcca

SEQ ID NO: 880816 - DNA, 22 bp, Artificial Sequence
  chemically synthesized
tttagaaagaaaatagtctatg

SEQ ID NO: 880817 - DNA, 22 bp, Artificial Sequence
  chemically synthesized
atggcatagactattttctttc

SEQ ID NO: 880818 - DNA, 22 bp, Artificial Sequence
  chemically synthesized
gcagattatttagaaagaaaat

SEQ ID NO: 880819 - DNA, 22 bp, Artificial Sequence
  chemically synthesized
tagcagattatttagaaagaaa

SEQ ID NO: 880820 - DNA, 22 bp, Artificial Sequence
  chemically synthesized
actctagcagattatttagaaa

SEQ ID NO: 880821 - DNA, 22 bp, Artificial Sequence
  chemically synthesized
aactctagcagattatttagaa

SEQ ID NO: 880822 - DNA, 22 bp, Artificial Sequence
  chemically synthesized
tatttaactctagcagattatt

SEQ ID NO: 880823 - DNA, 22 bp, Artificial Sequence
  chemically synthesized
ttttctttctaaataatctgct

SEQ ID NO: 880824 - DNA, 22 bp, Artificial Sequence
  chemically synthesized
tgtatttaactctagcagatta

SEQ ID NO: 880825 - DNA, 22 bp, Artificial Sequence
  chemically synthesized
tctttctaaataatctgctaga

SEQ ID NO: 880826 - DNA, 22 bp, Artificial Sequence
  chemically synthesized
ctttctaaataatctgctagag

SEQ ID NO: 880827 - DNA, 22 bp, Artificial Sequence
  chemically synthesized
tttctaaataatctgctagagt

SEQ ID NO: 880828 - DNA, 22 bp, Artificial Sequence
  chemically synthesized
tctaaataatctgctagagtta

SEQ ID NO: 880829 - DNA, 22 bp, Artificial Sequence
  chemically synthesized
ctaaataatctgctagagttaa

SEQ ID NO: 880830 - DNA, 22 bp, Artificial Sequence
  chemically synthesized
taaataatctgctagagttaaa

SEQ ID NO: 880831 - DNA, 22 bp, Artificial Sequence
  chemically synthesized
aataatctgctagagttaaata

SEQ ID NO: 880832 - DNA, 22 bp, Artificial Sequence
  chemically synthesized
ctagagttaaatacagagtcta

SEQ ID NO: 880833 - DNA, 22 bp, Artificial Sequence
  chemically synthesized
gagttaaatacagagtctactc

SEQ ID NO: 880834 - DNA, 22 bp, Artificial Sequence
  chemically synthesized
aatacagagtctactcttctgc

SEQ ID NO: 880835 - DNA, 22 bp, Artificial Sequence
  chemically synthesized
cgggaaatccaaaagcagaaga

SEQ ID NO: 880836 - DNA, 22 bp, Artificial Sequence
  chemically synthesized
ctcttctgcttttggatttccc

SEQ ID NO: 880837 - DNA, 22 bp, Artificial Sequence
  chemically synthesized
ttctgcttttggatttcccgta

SEQ ID NO: 880838 - DNA, 22 bp, Artificial Sequence
  chemically synthesized
caaaaaaaatcattacgggaaa

SEQ ID NO: 880839 - DNA, 22 bp, Artificial Sequence
  chemically synthesized
ctgcttttggatttcccgtaat

SEQ ID NO: 880840 - DNA, 22 bp, Artificial Sequence
  chemically synthesized
gcaaaaaaaatcattacgggaa

SEQ ID NO: 880841 - DNA, 22 bp, Artificial Sequence
  chemically synthesized
tgcttttggatttcccgtaatg

SEQ ID NO: 880842 - DNA, 22 bp, Artificial Sequence
  chemically synthesized
tgcaaaaaaaatcattacggga

SEQ ID NO: 880843 - DNA, 22 bp, Artificial Sequence
  chemically synthesized
cttttggatttcccgtaatgat

SEQ ID NO: 880844 - DNA, 22 bp, Artificial Sequence
  chemically synthesized
ttggatttcccgtaatgatttt

SEQ ID NO: 880845 - DNA, 22 bp, Artificial Sequence
  chemically synthesized
tggatttcccgtaatgattttt

SEQ ID NO: 880846 - DNA, 22 bp, Artificial Sequence
  chemically synthesized
ggatttcccgtaatgatttttt

SEQ ID NO: 880847 - DNA, 22 bp, Artificial Sequence
  chemically synthesized
gatttcccgtaatgattttttt

SEQ ID NO: 880848 - DNA, 22 bp, Artificial Sequence
  chemically synthesized
cccgtaatgattttttttgcaa

SEQ ID NO: 880849 - DNA, 22 bp, Artificial Sequence
  chemically synthesized
ccgtaatgattttttttgcaaa

SEQ ID NO: 880850 - DNA, 22 bp, Artificial Sequence
  chemically synthesized
tttttgcaaaattttacatctt

SEQ ID NO: 880851 - DNA, 22 bp, Artificial Sequence
  chemically synthesized
ttttgcaaaattttacatcttc

SEQ ID NO: 880852 - DNA, 22 bp, Artificial Sequence
  chemically synthesized
tttgcaaaattttacatcttca

SEQ ID NO: 880853 - DNA, 22 bp, Artificial Sequence
  chemically synthesized
taatcaataacgtgaagatgta

SEQ ID NO: 880854 - DNA, 22 bp, Artificial Sequence
  chemically synthesized
ttgcaaaattttacatcttcac

SEQ ID NO: 880855 - DNA, 22 bp, Artificial Sequence
  chemically synthesized
tgcaaaattttacatcttcacg

SEQ ID NO: 880856 - DNA, 22 bp, Artificial Sequence
  chemically synthesized
gcaaaattttacatcttcacgt

SEQ ID NO: 880857 - DNA, 22 bp, Artificial Sequence
  chemically synthesized
ttgtaatcaataacgtgaagat

SEQ ID NO: 880858 - DNA, 22 bp, Artificial Sequence
  chemically synthesized
caaaattttacatcttcacgtt

SEQ ID NO: 880859 - DNA, 22 bp, Artificial Sequence
  chemically synthesized
agacattgttgtaatcaataac

SEQ ID NO: 880860 - DNA, 22 bp, Artificial Sequence
  chemically synthesized
tacatcttcacgttattgatta

SEQ ID NO: 880861 - DNA, 22 bp, Artificial Sequence
  chemically synthesized
acatcttcacgttattgattac

SEQ ID NO: 880862 - DNA, 22 bp, Artificial Sequence
  chemically synthesized
tgagacattgttgtaatcaata

SEQ ID NO: 880863 - DNA, 22 bp, Artificial Sequence
  chemically synthesized
catcttcacgttattgattaca

SEQ ID NO: 880864 - DNA, 22 bp, Artificial Sequence
  chemically synthesized
ctgagacattgttgtaatcaat

SEQ ID NO: 880865 - DNA, 22 bp, Artificial Sequence
  chemically synthesized
tctgagacattgttgtaatcaa

SEQ ID NO: 880866 - DNA, 22 bp, Artificial Sequence
  chemically synthesized
cacgttattgattacaacaatg

SEQ ID NO: 880867 - DNA, 22 bp, Artificial Sequence
  chemically synthesized
acgttattgattacaacaatgt

SEQ ID NO: 880868 - DNA, 22 bp, Artificial Sequence
  chemically synthesized
ttgattacaacaatgtctcaga

SEQ ID NO: 880869 - DNA, 22 bp, Artificial Sequence
  chemically synthesized
attacaacaatgtctcagaaaa

SEQ ID NO: 880870 - DNA, 22 bp, Artificial Sequence
  chemically synthesized
tcatagaaatgagttttctgag

SEQ ID NO: 880871 - DNA, 22 bp, Artificial Sequence
  chemically synthesized
gtcatagaaatgagttttctga

SEQ ID NO: 880872 - DNA, 22 bp, Artificial Sequence
  chemically synthesized
caacaatgtctcagaaaactca

SEQ ID NO: 880873 - DNA, 22 bp, Artificial Sequence
  chemically synthesized
atttgtcatagaaatgagtttt

SEQ ID NO: 880874 - DNA, 22 bp, Artificial Sequence
  chemically synthesized
aatttgtcatagaaatgagttt

SEQ ID NO: 880875 - DNA, 22 bp, Artificial Sequence
  chemically synthesized
taatttgtcatagaaatgagtt

SEQ ID NO: 880876 - DNA, 22 bp, Artificial Sequence
  chemically synthesized
agaaaactcatttctatgacaa

SEQ ID NO: 880877 - DNA, 22 bp, Artificial Sequence
  chemically synthesized
atttctatgacaaattaaaatg

SEQ ID NO: 880878 - DNA, 22 bp, Artificial Sequence
  chemically synthesized
agtataaaataatcccatttta

SEQ ID NO: 880879 - DNA, 22 bp, Artificial Sequence
  chemically synthesized
ctatgacaaattaaaatgggat

SEQ ID NO: 880880 - DNA, 22 bp, Artificial Sequence
  chemically synthesized
tatgacaaattaaaatgggatt

SEQ ID NO: 880881 - DNA, 22 bp, Artificial Sequence
  chemically synthesized
tgacaaattaaaatgggattat

SEQ ID NO: 880882 - DNA, 22 bp, Artificial Sequence
  chemically synthesized
attaagtataaaataatcccat

SEQ ID NO: 880883 - DNA, 22 bp, Artificial Sequence
  chemically synthesized
aaatgggattattttatactta

SEQ ID NO: 880884 - DNA, 22 bp, Artificial Sequence
  chemically synthesized
ttttatacttaattaatccttt

SEQ ID NO: 880885 - DNA, 22 bp, Artificial Sequence
  chemically synthesized
aaggaagtcaatgaaaggatta

SEQ ID NO: 880886 - DNA, 22 bp, Artificial Sequence
  chemically synthesized
aaaggaagtcaatgaaaggatt

SEQ ID NO: 880887 - DNA, 22 bp, Artificial Sequence
  chemically synthesized
tatacttaattaatcctttcat

SEQ ID NO: 880888 - DNA, 22 bp, Artificial Sequence
  chemically synthesized
atacttaattaatcctttcatt

SEQ ID NO: 880889 - DNA, 22 bp, Artificial Sequence
  chemically synthesized
tacttaattaatcctttcattg

SEQ ID NO: 880890 - DNA, 22 bp, Artificial Sequence
  chemically synthesized
gtttaaaggaagtcaatgaaag

SEQ ID NO: 880891 - DNA, 22 bp, Artificial Sequence
  chemically synthesized
agtttaaaggaagtcaatgaaa

SEQ ID NO: 880892 - DNA, 22 bp, Artificial Sequence
  chemically synthesized
tagtttaaaggaagtcaatgaa

SEQ ID NO: 880893 - DNA, 22 bp, Artificial Sequence
  chemically synthesized
aattaatcctttcattgacttc

SEQ ID NO: 880894 - DNA, 22 bp, Artificial Sequence
  chemically synthesized
attaatcctttcattgacttcc

SEQ ID NO: 880895 - DNA, 22 bp, Artificial Sequence
  chemically synthesized
atcctttcattgacttccttta

SEQ ID NO: 880896 - DNA, 22 bp, Artificial Sequence
  chemically synthesized
tcattgacttcctttaaactaa

SEQ ID NO: 880897 - DNA, 22 bp, Artificial Sequence
  chemically synthesized
cattgacttcctttaaactaaa

SEQ ID NO: 880898 - DNA, 22 bp, Artificial Sequence
  chemically synthesized
attgacttcctttaaactaaaa

SEQ ID NO: 880899 - DNA, 22 bp, Artificial Sequence
  chemically synthesized
acttcctttaaactaaaattcc

SEQ ID NO: 880900 - DNA, 22 bp, Artificial Sequence
  chemically synthesized
cctttaaactaaaattccattt

SEQ ID NO: 880901 - DNA, 22 bp, Artificial Sequence
  chemically synthesized
ctttaaactaaaattccattta

SEQ ID NO: 880902 - DNA, 22 bp, Artificial Sequence
  chemically synthesized
taaactaaaattccatttatcc

SEQ ID NO: 880903 - DNA, 22 bp, Artificial Sequence
  chemically synthesized
aaactaaaattccatttatccc

SEQ ID NO: 880904 - DNA, 22 bp, Artificial Sequence
  chemically synthesized
aactaaaattccatttatccca

SEQ ID NO: 880905 - DNA, 22 bp, Artificial Sequence
  chemically synthesized
agaagaaaaatgtgggataaat

SEQ ID NO: 880906 - DNA, 22 bp, Artificial Sequence
  chemically synthesized
aaattccatttatcccacattt

SEQ ID NO: 880907 - DNA, 22 bp, Artificial Sequence
  chemically synthesized
agctaagaagaaaaatgtggga

SEQ ID NO: 880908 - DNA, 22 bp, Artificial Sequence
  chemically synthesized
catttatcccacatttttcttc

SEQ ID NO: 880909 - DNA, 22 bp, Artificial Sequence
  chemically synthesized
tacaaattcagctaagaagaaa

SEQ ID NO: 880910 - DNA, 22 bp, Artificial Sequence
  chemically synthesized
atcccacatttttcttcttagc

SEQ ID NO: 880911 - DNA, 22 bp, Artificial Sequence
  chemically synthesized
tcccacatttttcttcttagct

SEQ ID NO: 880912 - DNA, 22 bp, Artificial Sequence
  chemically synthesized
aattatacaaattcagctaaga

SEQ ID NO: 880913 - DNA, 22 bp, Artificial Sequence
  chemically synthesized
ttcttcttagctgaatttgtat

SEQ ID NO: 880914 - DNA, 22 bp, Artificial Sequence
  chemically synthesized
tcttcttagctgaatttgtata

SEQ ID NO: 880915 - DNA, 22 bp, Artificial Sequence
  chemically synthesized
cttcttagctgaatttgtataa

SEQ ID NO: 880916 - DNA, 22 bp, Artificial Sequence
  chemically synthesized
ttcttagctgaatttgtataat

SEQ ID NO: 880917 - DNA, 22 bp, Artificial Sequence
  chemically synthesized
gatggagattaaattatacaaa

SEQ ID NO: 880918 - DNA, 22 bp, Artificial Sequence
  chemically synthesized
cttagctgaatttgtataattt

SEQ ID NO: 880919 - DNA, 22 bp, Artificial Sequence
  chemically synthesized
ttagctgaatttgtataattta

SEQ ID NO: 880920 - DNA, 22 bp, Artificial Sequence
  chemically synthesized
ctagatggagattaaattatac

SEQ ID NO: 880921 - DNA, 22 bp, Artificial Sequence
  chemically synthesized
agctgaatttgtataatttaat

SEQ ID NO: 880922 - DNA, 22 bp, Artificial Sequence
  chemically synthesized
gctgaatttgtataatttaatc

SEQ ID NO: 880923 - DNA, 22 bp, Artificial Sequence
  chemically synthesized
gattgctagatggagattaaat

SEQ ID NO: 880924 - DNA, 22 bp, Artificial Sequence
  chemically synthesized
ggattgctagatggagattaaa

SEQ ID NO: 880925 - DNA, 22 bp, Artificial Sequence
  chemically synthesized
aatttgtataatttaatctcca

SEQ ID NO: 880926 - DNA, 22 bp, Artificial Sequence
  chemically synthesized
ttggattgctagatggagatta

SEQ ID NO: 880927 - DNA, 22 bp, Artificial Sequence
  chemically synthesized
tcttggattgctagatggagat

SEQ ID NO: 880928 - DNA, 22 bp, Artificial Sequence
  chemically synthesized
gtataatttaatctccatctag

SEQ ID NO: 880929 - DNA, 22 bp, Artificial Sequence
  chemically synthesized
tataatttaatctccatctagc

SEQ ID NO: 880930 - DNA, 22 bp, Artificial Sequence
  chemically synthesized
tgatgttctcttggattgctag

SEQ ID NO: 880931 - DNA, 22 bp, Artificial Sequence
  chemically synthesized
gtgatgttctcttggattgcta

SEQ ID NO: 880932 - DNA, 22 bp, Artificial Sequence
  chemically synthesized
aatctccatctagcaatccaag

SEQ ID NO: 880933 - DNA, 22 bp, Artificial Sequence
  chemically synthesized
atctccatctagcaatccaaga

SEQ ID NO: 880934 - DNA, 22 bp, Artificial Sequence
  chemically synthesized
tatttgtgatgttctcttggat

SEQ ID NO: 880935 - DNA, 22 bp, Artificial Sequence
  chemically synthesized
gtatttgtgatgttctcttgga

SEQ ID NO: 880936 - DNA, 22 bp, Artificial Sequence
  chemically synthesized
catctagcaatccaagagaaca

SEQ ID NO: 880937 - DNA, 22 bp, Artificial Sequence
  chemically synthesized
gcaatccaagagaacatcacaa

SEQ ID NO: 880938 - DNA, 22 bp, Artificial Sequence
  chemically synthesized
aaacatttgtatttgtgatgtt

SEQ ID NO: 880939 - DNA, 22 bp, Artificial Sequence
  chemically synthesized
aatcatataaatgctaaaacat

SEQ ID NO: 880940 - DNA, 22 bp, Artificial Sequence
  chemically synthesized
atgctaaatcatataaatgcta

SEQ ID NO: 880941 - DNA, 22 bp, Artificial Sequence
  chemically synthesized
tagcatttatatgatttagcat

SEQ ID NO: 880942 - DNA, 22 bp, Artificial Sequence
  chemically synthesized
tataaaatattcatgctaaatc

SEQ ID NO: 880943 - DNA, 22 bp, Artificial Sequence
  chemically synthesized
agcatttatatgatttagcatg

SEQ ID NO: 880944 - DNA, 22 bp, Artificial Sequence
  chemically synthesized
gcatttatatgatttagcatga

SEQ ID NO: 880945 - DNA, 22 bp, Artificial Sequence
  chemically synthesized
gttatataaaatattcatgcta

SEQ ID NO: 880946 - DNA, 22 bp, Artificial Sequence
  chemically synthesized
atatgatttagcatgaatattt

SEQ ID NO: 880947 - DNA, 22 bp, Artificial Sequence
  chemically synthesized
tatgatttagcatgaatatttt

SEQ ID NO: 880948 - DNA, 22 bp, Artificial Sequence
  chemically synthesized
agatgttggttatataaaatat

SEQ ID NO: 880949 - DNA, 22 bp, Artificial Sequence
  chemically synthesized
agcatgaatattttatataacc

SEQ ID NO: 880950 - DNA, 22 bp, Artificial Sequence
  chemically synthesized
gcatgaatattttatataacca

SEQ ID NO: 880951 - DNA, 22 bp, Artificial Sequence
  chemically synthesized
gaggtcccacattcagatgttg

SEQ ID NO: 880952 - DNA, 22 bp, Artificial Sequence
  chemically synthesized
tatataaccaacatctgaatgt

SEQ ID NO: 880953 - DNA, 22 bp, Artificial Sequence
  chemically synthesized
attagaggtcccacattcagat

SEQ ID NO: 880954 - DNA, 22 bp, Artificial Sequence
  chemically synthesized
atataaccaacatctgaatgtg

SEQ ID NO: 880955 - DNA, 22 bp, Artificial Sequence
  chemically synthesized
tataaccaacatctgaatgtgg

SEQ ID NO: 880956 - DNA, 22 bp, Artificial Sequence
  chemically synthesized
taaagtacctgattagaggtcc

SEQ ID NO: 880957 - DNA, 22 bp, Artificial Sequence
  chemically synthesized
aatgtgggacctctaatcaggt

SEQ ID NO: 880958 - DNA, 22 bp, Artificial Sequence
  chemically synthesized
aagtgcaatagttataaagtac

SEQ ID NO: 880959 - DNA, 22 bp, Artificial Sequence
  chemically synthesized
caagtgcaatagttataaagta

SEQ ID NO: 880960 - DNA, 22 bp, Artificial Sequence
  chemically synthesized
taatcaggtactttataactat

SEQ ID NO: 880961 - DNA, 22 bp, Artificial Sequence
  chemically synthesized
tgcttcaagtgcaatagttata

SEQ ID NO: 880962 - DNA, 22 bp, Artificial Sequence
  chemically synthesized
atcaggtactttataactattg

SEQ ID NO: 880963 - DNA, 22 bp, Artificial Sequence
  chemically synthesized
ctatgcttcaagtgcaatagtt

SEQ ID NO: 880964 - DNA, 22 bp, Artificial Sequence
  chemically synthesized
actatgcttcaagtgcaatagt

SEQ ID NO: 880965 - DNA, 22 bp, Artificial Sequence
  chemically synthesized
tataactattgcacttgaagca

SEQ ID NO: 880966 - DNA, 22 bp, Artificial Sequence
  chemically synthesized
ataactattgcacttgaagcat

SEQ ID NO: 880967 - DNA, 22 bp, Artificial Sequence
  chemically synthesized
taactattgcacttgaagcata

SEQ ID NO: 880968 - DNA, 22 bp, Artificial Sequence
  chemically synthesized
ataaatgtttactatgcttcaa

SEQ ID NO: 880969 - DNA, 22 bp, Artificial Sequence
  chemically synthesized
ttgcacttgaagcatagtaaac

SEQ ID NO: 880970 - DNA, 22 bp, Artificial Sequence
  chemically synthesized
cacttgaagcatagtaaacatt

SEQ ID NO: 880971 - DNA, 22 bp, Artificial Sequence
  chemically synthesized
caaatcaaaactaataaatgtt

SEQ ID NO: 880972 - DNA, 22 bp, Artificial Sequence
  chemically synthesized
gaagcatagtaaacatttatta

SEQ ID NO: 880973 - DNA, 22 bp, Artificial Sequence
  chemically synthesized
aagcatagtaaacatttattag

SEQ ID NO: 880974 - DNA, 22 bp, Artificial Sequence
  chemically synthesized
gaattacaaatcaaaactaata

SEQ ID NO: 880975 - DNA, 22 bp, Artificial Sequence
  chemically synthesized
ctggaattacaaatcaaaacta

SEQ ID NO: 880976 - DNA, 22 bp, Artificial Sequence
  chemically synthesized
tactggaattacaaatcaaaac

SEQ ID NO: 880977 - DNA, 22 bp, Artificial Sequence
  chemically synthesized
ctactggaattacaaatcaaaa

SEQ ID NO: 880978 - DNA, 22 bp, Artificial Sequence
  chemically synthesized
ttctactggaattacaaatcaa

SEQ ID NO: 880979 - DNA, 22 bp, Artificial Sequence
  chemically synthesized
ctcttctactggaattacaaat

SEQ ID NO: 880980 - DNA, 22 bp, Artificial Sequence
  chemically synthesized
actcttctactggaattacaaa

SEQ ID NO: 880981 - DNA, 22 bp, Artificial Sequence
  chemically synthesized
attagttttgatttgtaattcc

SEQ ID NO: 880982 - DNA, 22 bp, Artificial Sequence
  chemically synthesized
ttagttttgatttgtaattcca

SEQ ID NO: 880983 - DNA, 22 bp, Artificial Sequence
  chemically synthesized
gttttgatttgtaattccagta

SEQ ID NO: 880984 - DNA, 22 bp, Artificial Sequence
  chemically synthesized
caagtttactcttctactggaa

SEQ ID NO: 880985 - DNA, 22 bp, Artificial Sequence
  chemically synthesized
ccaagtttactcttctactgga

SEQ ID NO: 880986 - DNA, 22 bp, Artificial Sequence
  chemically synthesized
tgatttgtaattccagtagaag

SEQ ID NO: 880987 - DNA, 22 bp, Artificial Sequence
  chemically synthesized
tccaagtttactcttctactgg

SEQ ID NO: 880988 - DNA, 22 bp, Artificial Sequence
  chemically synthesized
gatttgtaattccagtagaaga

SEQ ID NO: 880989 - DNA, 22 bp, Artificial Sequence
  chemically synthesized
atttgtaattccagtagaagag

SEQ ID NO: 880990 - DNA, 22 bp, Artificial Sequence
  chemically synthesized
gtaattccagtagaagagtaaa

SEQ ID NO: 880991 - DNA, 22 bp, Artificial Sequence
  chemically synthesized
taattccagtagaagagtaaac

SEQ ID NO: 880992 - DNA, 22 bp, Artificial Sequence
  chemically synthesized
cagcctttccaagtttactctt

SEQ ID NO: 880993 - DNA, 22 bp, Artificial Sequence
  chemically synthesized
cagtagaagagtaaacttggaa

SEQ ID NO: 880994 - DNA, 22 bp, Artificial Sequence
  chemically synthesized
tataggaaatatgatcctccag

SEQ ID NO: 880995 - DNA, 22 bp, Artificial Sequence
  chemically synthesized
gtataggaaatatgatcctcca

SEQ ID NO: 880996 - DNA, 22 bp, Artificial Sequence
  chemically synthesized
ggaaaggctggaggatcatatt

SEQ ID NO: 880997 - DNA, 22 bp, Artificial Sequence
  chemically synthesized
gaaaggctggaggatcatattt

SEQ ID NO: 880998 - DNA, 22 bp, Artificial Sequence
  chemically synthesized
gatttgtataggaaatatgatc

SEQ ID NO: 880999 - DNA, 22 bp, Artificial Sequence
  chemically synthesized
agatttgtataggaaatatgat

SEQ ID NO: 881000 - DNA, 22 bp, Artificial Sequence
  chemically synthesized
tagatttgtataggaaatatga

SEQ ID NO: 881001 - DNA, 22 bp, Artificial Sequence
  chemically synthesized
ttagatttgtataggaaatatg

SEQ ID NO: 881002 - DNA, 22 bp, Artificial Sequence
  chemically synthesized
gaggatcatatttcctatacaa

SEQ ID NO: 881003 - DNA, 22 bp, Artificial Sequence
  chemically synthesized
atagaagtttttagatttgtat

SEQ ID NO: 881004 - DNA, 22 bp, Artificial Sequence
  chemically synthesized
atactcatagaagtttttagat

SEQ ID NO: 881005 - DNA, 22 bp, Artificial Sequence
  chemically synthesized
aatactcatagaagtttttaga

SEQ ID NO: 881006 - DNA, 22 bp, Artificial Sequence
  chemically synthesized
taatactcatagaagtttttag

SEQ ID NO: 881007 - DNA, 22 bp, Artificial Sequence
  chemically synthesized
cctatacaaatctaaaaacttc

SEQ ID NO: 881008 - DNA, 22 bp, Artificial Sequence
  chemically synthesized
ctatacaaatctaaaaacttct

SEQ ID NO: 881009 - DNA, 22 bp, Artificial Sequence
  chemically synthesized
tacaaatctaaaaacttctatg

SEQ ID NO: 881010 - DNA, 22 bp, Artificial Sequence
  chemically synthesized
aaaacttctatgagtattaaaa

SEQ ID NO: 881011 - DNA, 22 bp, Artificial Sequence
  chemically synthesized
gtacatcacaggttttaatact

SEQ ID NO: 881012 - DNA, 22 bp, Artificial Sequence
  chemically synthesized
ctatgagtattaaaacctgtga

SEQ ID NO: 881013 - DNA, 22 bp, Artificial Sequence
  chemically synthesized
catgctagtacatcacaggttt

SEQ ID NO: 881014 - DNA, 22 bp, Artificial Sequence
  chemically synthesized
tatgagtattaaaacctgtgat

SEQ ID NO: 881015 - DNA, 22 bp, Artificial Sequence
  chemically synthesized
ccatgctagtacatcacaggtt

SEQ ID NO: 881016 - DNA, 22 bp, Artificial Sequence
  chemically synthesized
tccatgctagtacatcacaggt

SEQ ID NO: 881017 - DNA, 22 bp, Artificial Sequence
  chemically synthesized
tgagtattaaaacctgtgatgt

SEQ ID NO: 881018 - DNA, 22 bp, Artificial Sequence
  chemically synthesized
ttccatgctagtacatcacagg

SEQ ID NO: 881019 - DNA, 22 bp, Artificial Sequence
  chemically synthesized
aaacctgtgatgtactagcatg

SEQ ID NO: 881020 - DNA, 22 bp, Artificial Sequence
  chemically synthesized
tgatgtactagcatggaaaagc

SEQ ID NO: 881021 - DNA, 22 bp, Artificial Sequence
  chemically synthesized
aaaggaaagatgagcttttcca

SEQ ID NO: 881022 - DNA, 22 bp, Artificial Sequence
  chemically synthesized
gaaaggaaagatgagcttttcc

SEQ ID NO: 881023 - DNA, 22 bp, Artificial Sequence
  chemically synthesized
gcatggaaaagctcatctttcc

SEQ ID NO: 881024 - DNA, 22 bp, Artificial Sequence
  chemically synthesized
atctttcctttcaaacactccc

SEQ ID NO: 881025 - DNA, 22 bp, Artificial Sequence
  chemically synthesized
tcctttcaaacactcccacttc

SEQ ID NO: 881026 - DNA, 22 bp, Artificial Sequence
  chemically synthesized
cctttcaaacactcccacttca

SEQ ID NO: 881027 - DNA, 22 bp, Artificial Sequence
  chemically synthesized
ctttcaaacactcccacttcac

SEQ ID NO: 881028 - DNA, 22 bp, Artificial Sequence
  chemically synthesized
tcaaacactcccacttcacttt

SEQ ID NO: 881029 - DNA, 22 bp, Artificial Sequence
  chemically synthesized
caaacactcccacttcactttt

SEQ ID NO: 881030 - DNA, 22 bp, Artificial Sequence
  chemically synthesized
aaacactcccacttcacttttc

SEQ ID NO: 881031 - DNA, 22 bp, Artificial Sequence
  chemically synthesized
gatgagtgaaaaagaaaagtga

SEQ ID NO: 881032 - DNA, 22 bp, Artificial Sequence
  chemically synthesized
tgctcgatgagtgaaaaagaaa

SEQ ID NO: 881033 - DNA, 22 bp, Artificial Sequence
  chemically synthesized
ccacttcacttttctttttcac

SEQ ID NO: 881034 - DNA, 22 bp, Artificial Sequence
  chemically synthesized
ctatgctcgatgagtgaaaaag

SEQ ID NO: 881035 - DNA, 22 bp, Artificial Sequence
  chemically synthesized
cctatgctcgatgagtgaaaaa

SEQ ID NO: 881036 - DNA, 22 bp, Artificial Sequence
  chemically synthesized
cacttttctttttcactcatcg

SEQ ID NO: 881037 - DNA, 22 bp, Artificial Sequence
  chemically synthesized
acttcctatgctcgatgagtga

SEQ ID NO: 881038 - DNA, 22 bp, Artificial Sequence
  chemically synthesized
acttttctttttcactcatcga

SEQ ID NO: 881039 - DNA, 22 bp, Artificial Sequence
  chemically synthesized
ttctttttcactcatcgagcat

SEQ ID NO: 881040 - DNA, 22 bp, Artificial Sequence
  chemically synthesized
tctttttcactcatcgagcata

SEQ ID NO: 881041 - DNA, 22 bp, Artificial Sequence
  chemically synthesized
ctttttcactcatcgagcatag

SEQ ID NO: 881042 - DNA, 22 bp, Artificial Sequence
  chemically synthesized
tttttcactcatcgagcatagg

SEQ ID NO: 881043 - DNA, 22 bp, Artificial Sequence
  chemically synthesized
tttcactcatcgagcataggaa

SEQ ID NO: 881044 - DNA, 22 bp, Artificial Sequence
  chemically synthesized
ttcactcatcgagcataggaag

SEQ ID NO: 881045 - DNA, 22 bp, Artificial Sequence
  chemically synthesized
tcactcatcgagcataggaagt

SEQ ID NO: 881046 - DNA, 22 bp, Artificial Sequence
  chemically synthesized
cactcatcgagcataggaagtc

SEQ ID NO: 881047 - DNA, 22 bp, Artificial Sequence
  chemically synthesized
actcatcgagcataggaagtca

SEQ ID NO: 881048 - DNA, 22 bp, Artificial Sequence
  chemically synthesized
atcgagcataggaagtcaatat

SEQ ID NO: 881049 - DNA, 22 bp, Artificial Sequence
  chemically synthesized
agggaatatgaggagaatattg

SEQ ID NO: 881050 - DNA, 22 bp, Artificial Sequence
  chemically synthesized
aagggaatatgaggagaatatt

SEQ ID NO: 881051 - DNA, 22 bp, Artificial Sequence
  chemically synthesized
aatttaagggaatatgaggaga

SEQ ID NO: 881052 - DNA, 22 bp, Artificial Sequence
  chemically synthesized
tcctcatattcccttaaattta

SEQ ID NO: 881053 - DNA, 22 bp, Artificial Sequence
  chemically synthesized
ctcatattcccttaaatttaat

SEQ ID NO: 881054 - DNA, 22 bp, Artificial Sequence
  chemically synthesized
atattcccttaaatttaatgtg

SEQ ID NO: 881055 - DNA, 22 bp, Artificial Sequence
  chemically synthesized
ggggacagagggacacattaaa

SEQ ID NO: 881056 - DNA, 22 bp, Artificial Sequence
  chemically synthesized
ccttaaatttaatgtgtccctc

SEQ ID NO: 881057 - DNA, 22 bp, Artificial Sequence
  chemically synthesized
tattgggggacagagggacaca

SEQ ID NO: 881058 - DNA, 22 bp, Artificial Sequence
  chemically synthesized
aaatttaatgtgtccctctgtc

SEQ ID NO: 881059 - DNA, 22 bp, Artificial Sequence
  chemically synthesized
aatttaatgtgtccctctgtcc

SEQ ID NO: 881060 - DNA, 22 bp, Artificial Sequence
  chemically synthesized
aatgtgtccctctgtcccccaa

SEQ ID NO: 881061 - DNA, 22 bp, Artificial Sequence
  chemically synthesized
atgtgtccctctgtcccccaat

SEQ ID NO: 881062 - DNA, 22 bp, Artificial Sequence
  chemically synthesized
tgtcccccaatacagatcattt

SEQ ID NO: 881063 - DNA, 22 bp, Artificial Sequence
  chemically synthesized
tcccccaatacagatcatttgt

SEQ ID NO: 881064 - DNA, 22 bp, Artificial Sequence
  chemically synthesized
gatcaaatgtatcaaatacaaa

SEQ ID NO: 881065 - DNA, 22 bp, Artificial Sequence
  chemically synthesized
gtatttgatacatttgatctaa

SEQ ID NO: 881066 - DNA, 22 bp, Artificial Sequence
  chemically synthesized
tgaaaacaaaagttagatcaaa

SEQ ID NO: 881067 - DNA, 22 bp, Artificial Sequence
  chemically synthesized
tatttgatacatttgatctaac

SEQ ID NO: 881068 - DNA, 22 bp, Artificial Sequence
  chemically synthesized
gatacatttgatctaacttttg

SEQ ID NO: 881069 - DNA, 22 bp, Artificial Sequence
  chemically synthesized
atacatttgatctaacttttgt

SEQ ID NO: 881070 - DNA, 22 bp, Artificial Sequence
  chemically synthesized
atgtataaatactatgaaaaca

SEQ ID NO: 881071 - DNA, 22 bp, Artificial Sequence
  chemically synthesized
gatctaacttttgttttcatag

SEQ ID NO: 881072 - DNA, 22 bp, Artificial Sequence
  chemically synthesized
aatgtataaatactatgaaaac

SEQ ID NO: 881073 - DNA, 22 bp, Artificial Sequence
  chemically synthesized
atctaacttttgttttcatagt

SEQ ID NO: 881074 - DNA, 22 bp, Artificial Sequence
  chemically synthesized
taatgtataaatactatgaaaa

SEQ ID NO: 881075 - DNA, 22 bp, Artificial Sequence
  chemically synthesized
acttttgttttcatagtattta

SEQ ID NO: 881076 - DNA, 22 bp, Artificial Sequence
  chemically synthesized
ttgttttcatagtatttataca

SEQ ID NO: 881077 - DNA, 22 bp, Artificial Sequence
  chemically synthesized
tgttttcatagtatttatacat

SEQ ID NO: 881078 - DNA, 22 bp, Artificial Sequence
  chemically synthesized
gttttcatagtatttatacatt

SEQ ID NO: 881079 - DNA, 22 bp, Artificial Sequence
  chemically synthesized
ttttcatagtatttatacatta

SEQ ID NO: 881080 - DNA, 22 bp, Artificial Sequence
  chemically synthesized
agtgcaaaaggttttaatgtat

SEQ ID NO: 881081 - DNA, 22 bp, Artificial Sequence
  chemically synthesized
tcatagtatttatacattaaaa

SEQ ID NO: 881082 - DNA, 22 bp, Artificial Sequence
  chemically synthesized
catagtatttatacattaaaac

SEQ ID NO: 881083 - DNA, 22 bp, Artificial Sequence
  chemically synthesized
atagtatttatacattaaaacc

SEQ ID NO: 881084 - DNA, 22 bp, Artificial Sequence
  chemically synthesized
gtgttcagtgcaaaaggtttta

SEQ ID NO: 881085 - DNA, 22 bp, Artificial Sequence
  chemically synthesized
ggtgttcagtgcaaaaggtttt

SEQ ID NO: 881086 - DNA, 22 bp, Artificial Sequence
  chemically synthesized
atacattaaaaccttttgcact

SEQ ID NO: 881087 - DNA, 22 bp, Artificial Sequence
  chemically synthesized
tacattaaaaccttttgcactg

SEQ ID NO: 881088 - DNA, 22 bp, Artificial Sequence
  chemically synthesized
aaaccttttgcactgaacacca

SEQ ID NO: 881089 - DNA, 22 bp, Artificial Sequence
  chemically synthesized
gaataatataagtagtttggtg

SEQ ID NO: 881090 - DNA, 22 bp, Artificial Sequence
  chemically synthesized
ttgcactgaacaccaaactact

SEQ ID NO: 881091 - DNA, 22 bp, Artificial Sequence
  chemically synthesized
tgcactgaacaccaaactactt

SEQ ID NO: 881092 - DNA, 22 bp, Artificial Sequence
  chemically synthesized
gcactgaacaccaaactactta

SEQ ID NO: 881093 - DNA, 22 bp, Artificial Sequence
  chemically synthesized
cactgaacaccaaactacttat

SEQ ID NO: 881094 - DNA, 22 bp, Artificial Sequence
  chemically synthesized
aaggttggaataatataagtag

SEQ ID NO: 881095 - DNA, 22 bp, Artificial Sequence
  chemically synthesized
aaaggttggaataatataagta

SEQ ID NO: 881096 - DNA, 22 bp, Artificial Sequence
  chemically synthesized
taaaggttggaataatataagt

SEQ ID NO: 881097 - DNA, 22 bp, Artificial Sequence
  chemically synthesized
aacaccaaactacttatattat

SEQ ID NO: 881098 - DNA, 22 bp, Artificial Sequence
  chemically synthesized
ttaaaggttggaataatataag

SEQ ID NO: 881099 - DNA, 22 bp, Artificial Sequence
  chemically synthesized
tttaaaggttggaataatataa

SEQ ID NO: 881100 - DNA, 22 bp, Artificial Sequence
  chemically synthesized
ttttaaaggttggaataatata

SEQ ID NO: 881101 - DNA, 22 bp, Artificial Sequence
  chemically synthesized
cttatattattccaacctttaa

SEQ ID NO: 881102 - DNA, 22 bp, Artificial Sequence
  chemically synthesized
atattattccaacctttaaaaa

SEQ ID NO: 881103 - DNA, 22 bp, Artificial Sequence
  chemically synthesized
tattattccaacctttaaaaaa

SEQ ID NO: 881104 - DNA, 22 bp, Artificial Sequence
  chemically synthesized
gaaatataaatcttttttaaag

SEQ ID NO: 881105 - DNA, 22 bp, Artificial Sequence
  chemically synthesized
agaaatataaatcttttttaaa

SEQ ID NO: 881106 - DNA, 22 bp, Artificial Sequence
  chemically synthesized
tagaaatataaatcttttttaa

SEQ ID NO: 881107 - DNA, 22 bp, Artificial Sequence
  chemically synthesized
ttccaacctttaaaaaagattt

SEQ ID NO: 881108 - DNA, 22 bp, Artificial Sequence
  chemically synthesized
caacctttaaaaaagatttata

SEQ ID NO: 881109 - DNA, 22 bp, Artificial Sequence
  chemically synthesized
caattttagaaatataaatctt

SEQ ID NO: 881110 - DNA, 22 bp, Artificial Sequence
  chemically synthesized
taaaaaagatttatatttctaa

SEQ ID NO: 881111 - DNA, 22 bp, Artificial Sequence
  chemically synthesized
aaaaaagatttatatttctaaa

SEQ ID NO: 881112 - DNA, 22 bp, Artificial Sequence
  chemically synthesized
aaaaagatttatatttctaaaa

SEQ ID NO: 881113 - DNA, 22 bp, Artificial Sequence
  chemically synthesized
aatacgcactccaattttagaa

SEQ ID NO: 881114 - DNA, 22 bp, Artificial Sequence
  chemically synthesized
gaatacgcactccaattttaga

SEQ ID NO: 881115 - DNA, 22 bp, Artificial Sequence
  chemically synthesized
tgaatacgcactccaattttag

SEQ ID NO: 881116 - DNA, 22 bp, Artificial Sequence
  chemically synthesized
ttgaatacgcactccaatttta

SEQ ID NO: 881117 - DNA, 22 bp, Artificial Sequence
  chemically synthesized
atatttctaaaattggagtgcg

SEQ ID NO: 881118 - DNA, 22 bp, Artificial Sequence
  chemically synthesized
tatttctaaaattggagtgcgt

SEQ ID NO: 881119 - DNA, 22 bp, Artificial Sequence
  chemically synthesized
ctaaaattggagtgcgtattca

SEQ ID NO: 881120 - DNA, 22 bp, Artificial Sequence
  chemically synthesized
taaaattggagtgcgtattcaa

SEQ ID NO: 881121 - DNA, 22 bp, Artificial Sequence
  chemically synthesized
aaattggagtgcgtattcaaaa

SEQ ID NO: 881122 - DNA, 22 bp, Artificial Sequence
  chemically synthesized
gagtgcgtattcaaaagatacc

SEQ ID NO: 881123 - DNA, 22 bp, Artificial Sequence
  chemically synthesized
aatagatgatgcagcaggtatc

SEQ ID NO: 881124 - DNA, 22 bp, Artificial Sequence
  chemically synthesized
aaaagatacctgctgcatcatc

SEQ ID NO: 881125 - DNA, 22 bp, Artificial Sequence
  chemically synthesized
taaatatattgaatagatgatg

SEQ ID NO: 881126 - DNA, 22 bp, Artificial Sequence
  chemically synthesized
ataaatatattgaatagatgat

SEQ ID NO: 881127 - DNA, 22 bp, Artificial Sequence
  chemically synthesized
gcttataaatatattgaataga

SEQ ID NO: 881128 - DNA, 22 bp, Artificial Sequence
  chemically synthesized
tagcttataaatatattgaata

SEQ ID NO: 881129 - DNA, 22 bp, Artificial Sequence
  chemically synthesized
ctgcatcatctattcaatatat

SEQ ID NO: 881130 - DNA, 22 bp, Artificial Sequence
  chemically synthesized
catcatctattcaatatattta

SEQ ID NO: 881131 - DNA, 22 bp, Artificial Sequence
  chemically synthesized
tatcccaatctctagcttataa

SEQ ID NO: 881132 - DNA, 22 bp, Artificial Sequence
  chemically synthesized
ttcaatatatttataagctaga

SEQ ID NO: 881133 - DNA, 22 bp, Artificial Sequence
  chemically synthesized
aatatatttataagctagagat

SEQ ID NO: 881134 - DNA, 22 bp, Artificial Sequence
  chemically synthesized
gtgctgtatcccaatctctagc

SEQ ID NO: 881135 - DNA, 22 bp, Artificial Sequence
  chemically synthesized
tagtgctgtatcccaatctcta

SEQ ID NO: 881136 - DNA, 22 bp, Artificial Sequence
  chemically synthesized
ctagtgctgtatcccaatctct

SEQ ID NO: 881137 - DNA, 22 bp, Artificial Sequence
  chemically synthesized
tctagtgctgtatcccaatctc

SEQ ID NO: 881138 - DNA, 22 bp, Artificial Sequence
  chemically synthesized
ataagctagagattgggataca

SEQ ID NO: 881139 - DNA, 22 bp, Artificial Sequence
  chemically synthesized
taagctagagattgggatacag

SEQ ID NO: 881140 - DNA, 22 bp, Artificial Sequence
  chemically synthesized
aaaattttctagtgctgtatcc

SEQ ID NO: 881141 - DNA, 22 bp, Artificial Sequence
  chemically synthesized
gagattgggatacagcactaga

SEQ ID NO: 881142 - DNA, 22 bp, Artificial Sequence
  chemically synthesized
taaattgaaaattttctagtgc

SEQ ID NO: 881143 - DNA, 22 bp, Artificial Sequence
  chemically synthesized
ggatacagcactagaaaatttt

SEQ ID NO: 881144 - DNA, 22 bp, Artificial Sequence
  chemically synthesized
atattgtaaattgaaaattttc

SEQ ID NO: 881145 - DNA, 22 bp, Artificial Sequence
  chemically synthesized
gaaaattttcaatttacaatat

SEQ ID NO: 881146 - DNA, 22 bp, Artificial Sequence
  chemically synthesized
tcaatttacaatatgaatatat

SEQ ID NO: 881147 - DNA, 22 bp, Artificial Sequence
  chemically synthesized
caatttacaatatgaatatatg

SEQ ID NO: 881148 - DNA, 22 bp, Artificial Sequence
  chemically synthesized
aatttacaatatgaatatatgt

SEQ ID NO: 881149 - DNA, 22 bp, Artificial Sequence
  chemically synthesized
acaatatgaatatatgtgtgtg

SEQ ID NO: 881150 - DNA, 22 bp, Artificial Sequence
  chemically synthesized
caatatgaatatatgtgtgtga

SEQ ID NO: 881151 - DNA, 22 bp, Artificial Sequence
  chemically synthesized
atacacatatatgtatatacat

SEQ ID NO: 881152 - DNA, 22 bp, Artificial Sequence
  chemically synthesized
tcatatctaatacacatatatg

SEQ ID NO: 881153 - DNA, 22 bp, Artificial Sequence
  chemically synthesized
atcatatctaatacacatatat

SEQ ID NO: 881154 - DNA, 22 bp, Artificial Sequence
  chemically synthesized
atatgtgtatttatcatatcta

SEQ ID NO: 881155 - DNA, 22 bp, Artificial Sequence
  chemically synthesized
tacatatatgttgatatgtgta

SEQ ID NO: 881156 - DNA, 22 bp, Artificial Sequence
  chemically synthesized
gatatgataaatacacatatca

SEQ ID NO: 881157 - DNA, 22 bp, Artificial Sequence
  chemically synthesized
tatgtgcatattatacatatat

SEQ ID NO: 881158 - DNA, 22 bp, Artificial Sequence
  chemically synthesized
acacatatgtgtatgtgtatta

SEQ ID NO: 881159 - DNA, 22 bp, Artificial Sequence
  chemically synthesized
tatatccactcacacatatgtg

SEQ ID NO: 881160 - DNA, 22 bp, Artificial Sequence
  chemically synthesized
tacatatacatacatgtgtcta

SEQ ID NO: 881161 - DNA, 22 bp, Artificial Sequence
  chemically synthesized
agtaaaatgaggtatacctgta

SEQ ID NO: 881162 - DNA, 22 bp, Artificial Sequence
  chemically synthesized
cagagccaataaggcaaaactc

SEQ ID NO: 881163 - DNA, 22 bp, Artificial Sequence
  chemically synthesized
attttactgagttttgccttat

SEQ ID NO: 881164 - DNA, 22 bp, Artificial Sequence
  chemically synthesized
tactgagttttgccttattggc

SEQ ID NO: 881165 - DNA, 22 bp, Artificial Sequence
  chemically synthesized
actgagttttgccttattggct

SEQ ID NO: 881166 - DNA, 22 bp, Artificial Sequence
  chemically synthesized
ctgagttttgccttattggctc

SEQ ID NO: 881167 - DNA, 22 bp, Artificial Sequence
  chemically synthesized
agttttgccttattggctctgc

SEQ ID NO: 881168 - DNA, 22 bp, Artificial Sequence
  chemically synthesized
tgccttattggctctgcagata

SEQ ID NO: 881169 - DNA, 22 bp, Artificial Sequence
  chemically synthesized
gccttattggctctgcagatac

SEQ ID NO: 881170 - DNA, 22 bp, Artificial Sequence
  chemically synthesized
ccttattggctctgcagatact

SEQ ID NO: 881171 - DNA, 22 bp, Artificial Sequence
  chemically synthesized
attggctctgcagatactgctt

SEQ ID NO: 881172 - DNA, 22 bp, Artificial Sequence
  chemically synthesized
ttggctctgcagatactgcttt

SEQ ID NO: 881173 - DNA, 22 bp, Artificial Sequence
  chemically synthesized
gctctgcagatactgctttttt

SEQ ID NO: 881174 - DNA, 22 bp, Artificial Sequence
  chemically synthesized
tgcagatactgctttttttttt

SEQ ID NO: 881175 - DNA, 22 bp, Artificial Sequence
  chemically synthesized
taaaaaaaaaaaaaaaaaaaaa

SEQ ID NO: 881176 - DNA, 22 bp, Artificial Sequence
  chemically synthesized
gtaaaaaaaaaaaaaaaaaaaa

SEQ ID NO: 881177 - DNA, 22 bp, Artificial Sequence
  chemically synthesized
cagatactgctttttttttttt

SEQ ID NO: 881178 - DNA, 22 bp, Artificial Sequence
  chemically synthesized
agtttgtaaaaaaaaaaaaaaa

SEQ ID NO: 881179 - DNA, 22 bp, Artificial Sequence
  chemically synthesized
cagtttgtaaaaaaaaaaaaaa

SEQ ID NO: 881180 - DNA, 22 bp, Artificial Sequence
  chemically synthesized
cttttttttttttttttttttt

SEQ ID NO: 881181 - DNA, 22 bp, Artificial Sequence
  chemically synthesized
tttttttttttttttttttaca

SEQ ID NO: 881182 - DNA, 22 bp, Artificial Sequence
  chemically synthesized
ttttttttttttttttttacaa

SEQ ID NO: 881183 - DNA, 22 bp, Artificial Sequence
  chemically synthesized
caaaccttcagtttgtaaaaaa

SEQ ID NO: 881184 - DNA, 22 bp, Artificial Sequence
  chemically synthesized
tttttttttttttttttacaaa

SEQ ID NO: 881185 - DNA, 22 bp, Artificial Sequence
  chemically synthesized
ttttttttttttttttacaaac

SEQ ID NO: 881186 - DNA, 22 bp, Artificial Sequence
  chemically synthesized
tttttttttttttttacaaact

SEQ ID NO: 881187 - DNA, 22 bp, Artificial Sequence
  chemically synthesized
ctacaaaccttcagtttgtaaa

SEQ ID NO: 881188 - DNA, 22 bp, Artificial Sequence
  chemically synthesized
ttttttttttttttacaaactg

SEQ ID NO: 881189 - DNA, 22 bp, Artificial Sequence
  chemically synthesized
tttttttttttttacaaactga

SEQ ID NO: 881190 - DNA, 22 bp, Artificial Sequence
  chemically synthesized
ttttttttttttacaaactgaa

SEQ ID NO: 881191 - DNA, 22 bp, Artificial Sequence
  chemically synthesized
tttttttttttacaaactgaag

SEQ ID NO: 881192 - DNA, 22 bp, Artificial Sequence
  chemically synthesized
ttttttttttacaaactgaagg

SEQ ID NO: 881193 - DNA, 22 bp, Artificial Sequence
  chemically synthesized
tttttttttacaaactgaaggt

SEQ ID NO: 881194 - DNA, 22 bp, Artificial Sequence
  chemically synthesized
ttttttttacaaactgaaggtt

SEQ ID NO: 881195 - DNA, 22 bp, Artificial Sequence
  chemically synthesized
tttttttacaaactgaaggttt

SEQ ID NO: 881196 - DNA, 22 bp, Artificial Sequence
  chemically synthesized
ttttttacaaactgaaggtttg

SEQ ID NO: 881197 - DNA, 22 bp, Artificial Sequence
  chemically synthesized
tttttacaaactgaaggtttgt

SEQ ID NO: 881198 - DNA, 22 bp, Artificial Sequence
  chemically synthesized
ttttacaaactgaaggtttgta

SEQ ID NO: 881199 - DNA, 22 bp, Artificial Sequence
  chemically synthesized
atgcagggttgctacaaacctt

SEQ ID NO: 881200 - DNA, 22 bp, Artificial Sequence
  chemically synthesized
tttacaaactgaaggtttgtag

SEQ ID NO: 881201 - DNA, 22 bp, Artificial Sequence
  chemically synthesized
gatgcagggttgctacaaacct

SEQ ID NO: 881202 - DNA, 22 bp, Artificial Sequence
  chemically synthesized
ttacaaactgaaggtttgtagc

SEQ ID NO: 881203 - DNA, 22 bp, Artificial Sequence
  chemically synthesized
tacaaactgaaggtttgtagca

SEQ ID NO: 881204 - DNA, 22 bp, Artificial Sequence
  chemically synthesized
acaaactgaaggtttgtagcaa

SEQ ID NO: 881205 - DNA, 22 bp, Artificial Sequence
  chemically synthesized
cttgatgcagggttgctacaaa

SEQ ID NO: 881206 - DNA, 22 bp, Artificial Sequence
  chemically synthesized
caaactgaaggtttgtagcaac

SEQ ID NO: 881207 - DNA, 22 bp, Artificial Sequence
  chemically synthesized
gcttgatgcagggttgctacaa

SEQ ID NO: 881208 - DNA, 22 bp, Artificial Sequence
  chemically synthesized
aaggtttgtagcaaccctgcat

SEQ ID NO: 881209 - DNA, 22 bp, Artificial Sequence
  chemically synthesized
atagacttgcttgatgcagggt

SEQ ID NO: 881210 - DNA, 22 bp, Artificial Sequence
  chemically synthesized
ctgatagacttgcttgatgcag

SEQ ID NO: 881211 - DNA, 22 bp, Artificial Sequence
  chemically synthesized
gtagcaaccctgcatcaagcaa

SEQ ID NO: 881212 - DNA, 22 bp, Artificial Sequence
  chemically synthesized
tagcaaccctgcatcaagcaag

SEQ ID NO: 881213 - DNA, 22 bp, Artificial Sequence
  chemically synthesized
gaaatgttgctgatagacttgc

SEQ ID NO: 881214 - DNA, 22 bp, Artificial Sequence
  chemically synthesized
catcaagcaagtctatcagcaa

SEQ ID NO: 881215 - DNA, 22 bp, Artificial Sequence
  chemically synthesized
tcagcaacatttccaacaccat

SEQ ID NO: 881216 - DNA, 22 bp, Artificial Sequence
  chemically synthesized
ccaacaccatgtgcttacttca

SEQ ID NO: 881217 - DNA, 22 bp, Artificial Sequence
  chemically synthesized
caacaccatgtgcttacttcat

SEQ ID NO: 881218 - DNA, 22 bp, Artificial Sequence
  chemically synthesized
tgacacagagacatgaagtaag

SEQ ID NO: 881219 - DNA, 22 bp, Artificial Sequence
  chemically synthesized
tcaaattgtgacacagagacat

SEQ ID NO: 881220 - DNA, 22 bp, Artificial Sequence
  chemically synthesized
acttcatgtctctgtgtcacaa

SEQ ID NO: 881221 - DNA, 22 bp, Artificial Sequence
  chemically synthesized
cttcatgtctctgtgtcacaat

SEQ ID NO: 881222 - DNA, 22 bp, Artificial Sequence
  chemically synthesized
tgagaattatcaaattgtgaca

SEQ ID NO: 881223 - DNA, 22 bp, Artificial Sequence
  chemically synthesized
catgtctctgtgtcacaatttg

SEQ ID NO: 881224 - DNA, 22 bp, Artificial Sequence
  chemically synthesized
atgtctctgtgtcacaatttga

SEQ ID NO: 881225 - DNA, 22 bp, Artificial Sequence
  chemically synthesized
aaatattgtgagaattatcaaa

SEQ ID NO: 881226 - DNA, 22 bp, Artificial Sequence
  chemically synthesized
gaaatattgtgagaattatcaa

SEQ ID NO: 881227 - DNA, 22 bp, Artificial Sequence
  chemically synthesized
tgtgtcacaatttgataattct

SEQ ID NO: 881228 - DNA, 22 bp, Artificial Sequence
  chemically synthesized
tgtcacaatttgataattctca

SEQ ID NO: 881229 - DNA, 22 bp, Artificial Sequence
  chemically synthesized
aaaaagcttgaaatattgtgag

SEQ ID NO: 881230 - DNA, 22 bp, Artificial Sequence
  chemically synthesized
gataattctcacaatatttcaa

SEQ ID NO: 881231 - DNA, 22 bp, Artificial Sequence
  chemically synthesized
ataattctcacaatatttcaag

SEQ ID NO: 881232 - DNA, 22 bp, Artificial Sequence
  chemically synthesized
taaaaatattgaaaaagcttga

SEQ ID NO: 881233 - DNA, 22 bp, Artificial Sequence
  chemically synthesized
tcacaatatttcaagctttttc

SEQ ID NO: 881234 - DNA, 22 bp, Artificial Sequence
  chemically synthesized
acaatatttcaagctttttcaa

SEQ ID NO: 881235 - DNA, 22 bp, Artificial Sequence
  chemically synthesized
caagctttttcaatatttttat

SEQ ID NO: 881236 - DNA, 22 bp, Artificial Sequence
  chemically synthesized
aagctttttcaatatttttata

SEQ ID NO: 881237 - DNA, 22 bp, Artificial Sequence
  chemically synthesized
cccatcaccataacagttataa

SEQ ID NO: 881238 - DNA, 22 bp, Artificial Sequence
  chemically synthesized
tttcaatatttttataactgtt

SEQ ID NO: 881239 - DNA, 22 bp, Artificial Sequence
  chemically synthesized
ttcaatatttttataactgtta

SEQ ID NO: 881240 - DNA, 22 bp, Artificial Sequence
  chemically synthesized
tcaatatttttataactgttat

SEQ ID NO: 881241 - DNA, 22 bp, Artificial Sequence
  chemically synthesized
caatatttttataactgttatg

SEQ ID NO: 881242 - DNA, 22 bp, Artificial Sequence
  chemically synthesized
attacccatcaccataacagtt

SEQ ID NO: 881243 - DNA, 22 bp, Artificial Sequence
  chemically synthesized
aatatttttataactgttatgg

SEQ ID NO: 881244 - DNA, 22 bp, Artificial Sequence
  chemically synthesized
ctgattacccatcaccataaca

SEQ ID NO: 881245 - DNA, 22 bp, Artificial Sequence
  chemically synthesized
ttataactgttatggtgatggg

SEQ ID NO: 881246 - DNA, 22 bp, Artificial Sequence
  chemically synthesized
tataactgttatggtgatgggt

SEQ ID NO: 881247 - DNA, 22 bp, Artificial Sequence
  chemically synthesized
ataactgttatggtgatgggta

SEQ ID NO: 881248 - DNA, 22 bp, Artificial Sequence
  chemically synthesized
taactgttatggtgatgggtaa

SEQ ID NO: 881249 - DNA, 22 bp, Artificial Sequence
  chemically synthesized
ttatggtgatgggtaatcagta

SEQ ID NO: 881250 - DNA, 22 bp, Artificial Sequence
  chemically synthesized
tggtgatgggtaatcagtaatc

SEQ ID NO: 881251 - DNA, 22 bp, Artificial Sequence
  chemically synthesized
aaatagtaacatcaaagattac

SEQ ID NO: 881252 - DNA, 22 bp, Artificial Sequence
  chemically synthesized
ttaaaatagtaacatcaaagat

SEQ ID NO: 881253 - DNA, 22 bp, Artificial Sequence
  chemically synthesized
aaactattaaaatagtaacatc

SEQ ID NO: 881254 - DNA, 22 bp, Artificial Sequence
  chemically synthesized
tggcaccctgaaactattaaaa

SEQ ID NO: 881255 - DNA, 22 bp, Artificial Sequence
  chemically synthesized
tgatgttactattttaatagtt

SEQ ID NO: 881256 - DNA, 22 bp, Artificial Sequence
  chemically synthesized
gtggcaccctgaaactattaaa

SEQ ID NO: 881257 - DNA, 22 bp, Artificial Sequence
  chemically synthesized
gatgttactattttaatagttt

SEQ ID NO: 881258 - DNA, 22 bp, Artificial Sequence
  chemically synthesized
atgttactattttaatagtttc

SEQ ID NO: 881259 - DNA, 22 bp, Artificial Sequence
  chemically synthesized
tttgtggcaccctgaaactatt

SEQ ID NO: 881260 - DNA, 22 bp, Artificial Sequence
  chemically synthesized
ctattttaatagtttcagggtg

SEQ ID NO: 881261 - DNA, 22 bp, Artificial Sequence
  chemically synthesized
ttttaatagtttcagggtgcca

SEQ ID NO: 881262 - DNA, 22 bp, Artificial Sequence
  chemically synthesized
taatagtttcagggtgccacaa

SEQ ID NO: 881263 - DNA, 22 bp, Artificial Sequence
  chemically synthesized
tatgggcactgtttgtggcacc

SEQ ID NO: 881264 - DNA, 22 bp, Artificial Sequence
  chemically synthesized
aatagtttcagggtgccacaaa

SEQ ID NO: 881265 - DNA, 22 bp, Artificial Sequence
  chemically synthesized
atagtttcagggtgccacaaac

SEQ ID NO: 881266 - DNA, 22 bp, Artificial Sequence
  chemically synthesized
ccatcctatatgggcactgttt

SEQ ID NO: 881267 - DNA, 22 bp, Artificial Sequence
  chemically synthesized
cagggtgccacaaacagtgccc

SEQ ID NO: 881268 - DNA, 22 bp, Artificial Sequence
  chemically synthesized
gccatcctatatgggcactgtt

SEQ ID NO: 881269 - DNA, 22 bp, Artificial Sequence
  chemically synthesized
agggtgccacaaacagtgccca

SEQ ID NO: 881270 - DNA, 22 bp, Artificial Sequence
  chemically synthesized
agtttgccatcctatatgggca

SEQ ID NO: 881271 - DNA, 22 bp, Artificial Sequence
  chemically synthesized
atggattaagtttgccatccta

SEQ ID NO: 881272 - DNA, 22 bp, Artificial Sequence
  chemically synthesized
agaatacatacattaatggatt

SEQ ID NO: 881273 - DNA, 22 bp, Artificial Sequence
  chemically synthesized
aatccattaatgtatgtattct

SEQ ID NO: 881274 - DNA, 22 bp, Artificial Sequence
  chemically synthesized
atccattaatgtatgtattctg

SEQ ID NO: 881275 - DNA, 22 bp, Artificial Sequence
  chemically synthesized
gtcagtggagcgttcagaatac

SEQ ID NO: 881276 - DNA, 22 bp, Artificial Sequence
  chemically synthesized
atgtatgtattctgaacgctcc

SEQ ID NO: 881277 - DNA, 22 bp, Artificial Sequence
  chemically synthesized
tgaacgctccactgaccagtca

SEQ ID NO: 881278 - DNA, 22 bp, Artificial Sequence
  chemically synthesized
aacgctccactgaccagtcatc

SEQ ID NO: 881279 - DNA, 22 bp, Artificial Sequence
  chemically synthesized
cactgaccagtcatccccctac

SEQ ID NO: 881280 - DNA, 22 bp, Artificial Sequence
  chemically synthesized
accagtcatccccctacctctc

SEQ ID NO: 881281 - DNA, 22 bp, Artificial Sequence
  chemically synthesized
agaatagggaggcccaaggaga

SEQ ID NO: 881282 - DNA, 22 bp, Artificial Sequence
  chemically synthesized
cctctcttcctctccttgggcc

SEQ ID NO: 881283 - DNA, 22 bp, Artificial Sequence
  chemically synthesized
tcttcctctccttgggcctccc

SEQ ID NO: 881284 - DNA, 22 bp, Artificial Sequence
  chemically synthesized
tgtctcagaatagggaggccca

SEQ ID NO: 881285 - DNA, 22 bp, Artificial Sequence
  chemically synthesized
ttcctctccttgggcctcccta

SEQ ID NO: 881286 - DNA, 22 bp, Artificial Sequence
  chemically synthesized
ttgtgtctcagaatagggaggc

SEQ ID NO: 881287 - DNA, 22 bp, Artificial Sequence
  chemically synthesized
cctctccttgggcctccctatt

SEQ ID NO: 881288 - DNA, 22 bp, Artificial Sequence
  chemically synthesized
ctctccttgggcctccctattc

SEQ ID NO: 881289 - DNA, 22 bp, Artificial Sequence
  chemically synthesized
tccttgggcctccctattctga

SEQ ID NO: 881290 - DNA, 22 bp, Artificial Sequence
  chemically synthesized
cttgggcctccctattctgaga

SEQ ID NO: 881291 - DNA, 22 bp, Artificial Sequence
  chemically synthesized
aatattgttgtgtctcagaata

SEQ ID NO: 881292 - DNA, 22 bp, Artificial Sequence
  chemically synthesized
caatattgttgtgtctcagaat

SEQ ID NO: 881293 - DNA, 22 bp, Artificial Sequence
  chemically synthesized
gggcctccctattctgagacac

SEQ ID NO: 881294 - DNA, 22 bp, Artificial Sequence
  chemically synthesized
ggcctccctattctgagacaca

SEQ ID NO: 881295 - DNA, 22 bp, Artificial Sequence
  chemically synthesized
cctattctgagacacaacaata

SEQ ID NO: 881296 - DNA, 22 bp, Artificial Sequence
  chemically synthesized
gcataatttcaatattgttgtg

SEQ ID NO: 881297 - DNA, 22 bp, Artificial Sequence
  chemically synthesized
ttctgagacacaacaatattga

SEQ ID NO: 881298 - DNA, 22 bp, Artificial Sequence
  chemically synthesized
actggcataatttcaatattgt

SEQ ID NO: 881299 - DNA, 22 bp, Artificial Sequence
  chemically synthesized
tgagacacaacaatattgaaat

SEQ ID NO: 881300 - DNA, 22 bp, Artificial Sequence
  chemically synthesized
ttaactggcataatttcaatat

SEQ ID NO: 881301 - DNA, 22 bp, Artificial Sequence
  chemically synthesized
agacacaacaatattgaaatta

SEQ ID NO: 881302 - DNA, 22 bp, Artificial Sequence
  chemically synthesized
aaattatgccagttaataaccg

SEQ ID NO: 881303 - DNA, 22 bp, Artificial Sequence
  chemically synthesized
gaggccatagtacggttattaa

SEQ ID NO: 881304 - DNA, 22 bp, Artificial Sequence
  chemically synthesized
agaggccatagtacggttatta

SEQ ID NO: 881305 - DNA, 22 bp, Artificial Sequence
  chemically synthesized
tgccagttaataaccgtactat

SEQ ID NO: 881306 - DNA, 22 bp, Artificial Sequence
  chemically synthesized
aacatttagaggccatagtacg

SEQ ID NO: 881307 - DNA, 22 bp, Artificial Sequence
  chemically synthesized
gaacatttagaggccatagtac

SEQ ID NO: 881308 - DNA, 22 bp, Artificial Sequence
  chemically synthesized
ccttgaacatttagaggccata

SEQ ID NO: 881309 - DNA, 22 bp, Artificial Sequence
  chemically synthesized
cccttgaacatttagaggccat

SEQ ID NO: 881310 - DNA, 22 bp, Artificial Sequence
  chemically synthesized
ataaccgtactatggcctctaa

SEQ ID NO: 881311 - DNA, 22 bp, Artificial Sequence
  chemically synthesized
tcccttgaacatttagaggcca

SEQ ID NO: 881312 - DNA, 22 bp, Artificial Sequence
  chemically synthesized
ttttcccttgaacatttagagg

SEQ ID NO: 881313 - DNA, 22 bp, Artificial Sequence
  chemically synthesized
gttttcccttgaacatttagag

SEQ ID NO: 881314 - DNA, 22 bp, Artificial Sequence
  chemically synthesized
ttgttttcccttgaacatttag

SEQ ID NO: 881315 - DNA, 22 bp, Artificial Sequence
  chemically synthesized
tggcctctaaatgttcaaggga

SEQ ID NO: 881316 - DNA, 22 bp, Artificial Sequence
  chemically synthesized
taaatgttcaagggaaaacaag

SEQ ID NO: 881317 - DNA, 22 bp, Artificial Sequence
  chemically synthesized
aatgttcaagggaaaacaagag

SEQ ID NO: 881318 - DNA, 22 bp, Artificial Sequence
  chemically synthesized
aagtgagagacatgcaactctt

SEQ ID NO: 881319 - DNA, 22 bp, Artificial Sequence
  chemically synthesized
aaagtgagagacatgcaactct

SEQ ID NO: 881320 - DNA, 22 bp, Artificial Sequence
  chemically synthesized
aagggaaaacaagagttgcatg

SEQ ID NO: 881321 - DNA, 22 bp, Artificial Sequence
  chemically synthesized
atttaaagtgagagacatgcaa

SEQ ID NO: 881322 - DNA, 22 bp, Artificial Sequence
  chemically synthesized
gatttaaagtgagagacatgca

SEQ ID NO: 881323 - DNA, 22 bp, Artificial Sequence
  chemically synthesized
tgatttaaagtgagagacatgc

SEQ ID NO: 881324 - DNA, 22 bp, Artificial Sequence
  chemically synthesized
ttgatttaaagtgagagacatg

SEQ ID NO: 881325 - DNA, 22 bp, Artificial Sequence
  chemically synthesized
gcttttgatttaaagtgagaga

SEQ ID NO: 881326 - DNA, 22 bp, Artificial Sequence
  chemically synthesized
tagcttttgatttaaagtgaga

SEQ ID NO: 881327 - DNA, 22 bp, Artificial Sequence
  chemically synthesized
ctagcttttgatttaaagtgag

SEQ ID NO: 881328 - DNA, 22 bp, Artificial Sequence
  chemically synthesized
catgtctctcactttaaatcaa

SEQ ID NO: 881329 - DNA, 22 bp, Artificial Sequence
  chemically synthesized
atcatttctagcttttgattta

SEQ ID NO: 881330 - DNA, 22 bp, Artificial Sequence
  chemically synthesized
aatcatttctagcttttgattt

SEQ ID NO: 881331 - DNA, 22 bp, Artificial Sequence
  chemically synthesized
tcactttaaatcaaaagctaga

SEQ ID NO: 881332 - DNA, 22 bp, Artificial Sequence
  chemically synthesized
actttaaatcaaaagctagaaa

SEQ ID NO: 881333 - DNA, 22 bp, Artificial Sequence
  chemically synthesized
accaagcttaatcatttctagc

SEQ ID NO: 881334 - DNA, 22 bp, Artificial Sequence
  chemically synthesized
taaatcaaaagctagaaatgat

SEQ ID NO: 881335 - DNA, 22 bp, Artificial Sequence
  chemically synthesized
aaatcaaaagctagaaatgatt

SEQ ID NO: 881336 - DNA, 22 bp, Artificial Sequence
  chemically synthesized
ctaaccaagcttaatcatttct

SEQ ID NO: 881337 - DNA, 22 bp, Artificial Sequence
  chemically synthesized
aatcaaaagctagaaatgatta

SEQ ID NO: 881338 - DNA, 22 bp, Artificial Sequence
  chemically synthesized
cctaaccaagcttaatcatttc

SEQ ID NO: 881339 - DNA, 22 bp, Artificial Sequence
  chemically synthesized
gacatgccttcctaaccaagct

SEQ ID NO: 881340 - DNA, 22 bp, Artificial Sequence
  chemically synthesized
cgacatgccttcctaaccaagc

SEQ ID NO: 881341 - DNA, 22 bp, Artificial Sequence
  chemically synthesized
gaaatgattaagcttggttagg

SEQ ID NO: 881342 - DNA, 22 bp, Artificial Sequence
  chemically synthesized
tcgacatgccttcctaaccaag

SEQ ID NO: 881343 - DNA, 22 bp, Artificial Sequence
  chemically synthesized
gctttcgacatgccttcctaac

SEQ ID NO: 881344 - DNA, 22 bp, Artificial Sequence
  chemically synthesized
ggctttcgacatgccttcctaa

SEQ ID NO: 881345 - DNA, 22 bp, Artificial Sequence
  chemically synthesized
ttggctttcgacatgccttcct

SEQ ID NO: 881346 - DNA, 22 bp, Artificial Sequence
  chemically synthesized
tcttggctttcgacatgccttc

SEQ ID NO: 881347 - DNA, 22 bp, Artificial Sequence
  chemically synthesized
agcttggttaggaaggcatgtc

SEQ ID NO: 881348 - DNA, 22 bp, Artificial Sequence
  chemically synthesized
ggttaggaaggcatgtcgaaag

SEQ ID NO: 881349 - DNA, 22 bp, Artificial Sequence
  chemically synthesized
gttaggaaggcatgtcgaaagc

SEQ ID NO: 881350 - DNA, 22 bp, Artificial Sequence
  chemically synthesized
cagcctctcttggctttcgaca

SEQ ID NO: 881351 - DNA, 22 bp, Artificial Sequence
  chemically synthesized
ccagcctctcttggctttcgac

SEQ ID NO: 881352 - DNA, 22 bp, Artificial Sequence
  chemically synthesized
ggaaggcatgtcgaaagccaag

SEQ ID NO: 881353 - DNA, 22 bp, Artificial Sequence
  chemically synthesized
gcttccagcctctcttggcttt

SEQ ID NO: 881354 - DNA, 22 bp, Artificial Sequence
  chemically synthesized
acgggcacaagaggcctagctt

SEQ ID NO: 881355 - DNA, 22 bp, Artificial Sequence
  chemically synthesized
gctaacgggcacaagaggccta

SEQ ID NO: 881356 - DNA, 22 bp, Artificial Sequence
  chemically synthesized
agctaacgggcacaagaggcct

SEQ ID NO: 881357 - DNA, 22 bp, Artificial Sequence
  chemically synthesized
gaagctaggcctcttgtgcccg

SEQ ID NO: 881358 - DNA, 22 bp, Artificial Sequence
  chemically synthesized
acaacttagctaacgggcacaa

SEQ ID NO: 881359 - DNA, 22 bp, Artificial Sequence
  chemically synthesized
cattcacaacttagctaacggg

SEQ ID NO: 881360 - DNA, 22 bp, Artificial Sequence
  chemically synthesized
ggcctcttgtgcccgttagcta

SEQ ID NO: 881361 - DNA, 22 bp, Artificial Sequence
  chemically synthesized
gcattcacaacttagctaacgg

SEQ ID NO: 881362 - DNA, 22 bp, Artificial Sequence
  chemically synthesized
tgcattcacaacttagctaacg

SEQ ID NO: 881363 - DNA, 22 bp, Artificial Sequence
  chemically synthesized
ctttgcattcacaacttagcta

SEQ ID NO: 881364 - DNA, 22 bp, Artificial Sequence
  chemically synthesized
cctttgcattcacaacttagct

SEQ ID NO: 881365 - DNA, 22 bp, Artificial Sequence
  chemically synthesized
ttgtgcccgttagctaagttgt

SEQ ID NO: 881366 - DNA, 22 bp, Artificial Sequence
  chemically synthesized
tcctttgcattcacaacttagc

SEQ ID NO: 881367 - DNA, 22 bp, Artificial Sequence
  chemically synthesized
ttcctttgcattcacaacttag

SEQ ID NO: 881368 - DNA, 22 bp, Artificial Sequence
  chemically synthesized
gtgcccgttagctaagttgtga

SEQ ID NO: 881369 - DNA, 22 bp, Artificial Sequence
  chemically synthesized
tgcccgttagctaagttgtgaa

SEQ ID NO: 881370 - DNA, 22 bp, Artificial Sequence
  chemically synthesized
aagaatttttcctttgcattca

SEQ ID NO: 881371 - DNA, 22 bp, Artificial Sequence
  chemically synthesized
caagaatttttcctttgcattc

SEQ ID NO: 881372 - DNA, 22 bp, Artificial Sequence
  chemically synthesized
gctaagttgtgaatgcaaagga

SEQ ID NO: 881373 - DNA, 22 bp, Artificial Sequence
  chemically synthesized
ttcaagaatttttcctttgcat

SEQ ID NO: 881374 - DNA, 22 bp, Artificial Sequence
  chemically synthesized
cttcaagaatttttcctttgca

SEQ ID NO: 881375 - DNA, 22 bp, Artificial Sequence
  chemically synthesized
tcttcaagaatttttcctttgc

SEQ ID NO: 881376 - DNA, 22 bp, Artificial Sequence
  chemically synthesized
agttgtgaatgcaaaggaaaaa

SEQ ID NO: 881377 - DNA, 22 bp, Artificial Sequence
  chemically synthesized
attttcttcaagaatttttcct

SEQ ID NO: 881378 - DNA, 22 bp, Artificial Sequence
  chemically synthesized
aattttcttcaagaatttttcc

SEQ ID NO: 881379 - DNA, 22 bp, Artificial Sequence
  chemically synthesized
taattttcttcaagaatttttc

SEQ ID NO: 881380 - DNA, 22 bp, Artificial Sequence
  chemically synthesized
tgaatgcaaaggaaaaattctt

SEQ ID NO: 881381 - DNA, 22 bp, Artificial Sequence
  chemically synthesized
ttaattttcttcaagaattttt

SEQ ID NO: 881382 - DNA, 22 bp, Artificial Sequence
  chemically synthesized
gcacttttaattttcttcaaga

SEQ ID NO: 881383 - DNA, 22 bp, Artificial Sequence
  chemically synthesized
gactggcacttttaattttctt

SEQ ID NO: 881384 - DNA, 22 bp, Artificial Sequence
  chemically synthesized
actagactggcacttttaattt

SEQ ID NO: 881385 - DNA, 22 bp, Artificial Sequence
  chemically synthesized
ttgaagaaaattaaaagtgcca

SEQ ID NO: 881386 - DNA, 22 bp, Artificial Sequence
  chemically synthesized
gaagaaaattaaaagtgccagt

SEQ ID NO: 881387 - DNA, 22 bp, Artificial Sequence
  chemically synthesized
catgttcactagactggcactt

SEQ ID NO: 881388 - DNA, 22 bp, Artificial Sequence
  chemically synthesized
aagaaaattaaaagtgccagtc

SEQ ID NO: 881389 - DNA, 22 bp, Artificial Sequence
  chemically synthesized
gcatgttcactagactggcact

SEQ ID NO: 881390 - DNA, 22 bp, Artificial Sequence
  chemically synthesized
tcatttgcatgttcactagact

SEQ ID NO: 881391 - DNA, 22 bp, Artificial Sequence
  chemically synthesized
ttatcatttgcatgttcactag

SEQ ID NO: 881392 - DNA, 22 bp, Artificial Sequence
  chemically synthesized
aaagtgccagtctagtgaacat

SEQ ID NO: 881393 - DNA, 22 bp, Artificial Sequence
  chemically synthesized
gttatcatttgcatgttcacta

SEQ ID NO: 881394 - DNA, 22 bp, Artificial Sequence
  chemically synthesized
tgttatcatttgcatgttcact

SEQ ID NO: 881395 - DNA, 22 bp, Artificial Sequence
  chemically synthesized
ctttgttatcatttgcatgttc

SEQ ID NO: 881396 - DNA, 22 bp, Artificial Sequence
  chemically synthesized
tgctttgttatcatttgcatgt

SEQ ID NO: 881397 - DNA, 22 bp, Artificial Sequence
  chemically synthesized
ttctgctttgttatcatttgca

SEQ ID NO: 881398 - DNA, 22 bp, Artificial Sequence
  chemically synthesized
gtgaacatgcaaatgataacaa

SEQ ID NO: 881399 - DNA, 22 bp, Artificial Sequence
  chemically synthesized
acaataaggctgttctgctttg

SEQ ID NO: 881400 - DNA, 22 bp, Artificial Sequence
  chemically synthesized
catattaacaataaggctgttc

SEQ ID NO: 881401 - DNA, 22 bp, Artificial Sequence
  chemically synthesized
tccatattaacaataaggctgt

SEQ ID NO: 881402 - DNA, 22 bp, Artificial Sequence
  chemically synthesized
agacattctccatattaacaat

SEQ ID NO: 881403 - DNA, 22 bp, Artificial Sequence
  chemically synthesized
attgttaatatggagaatgtct

SEQ ID NO: 881404 - DNA, 22 bp, Artificial Sequence
  chemically synthesized
tccagaccactaagacattctc

SEQ ID NO: 881405 - DNA, 22 bp, Artificial Sequence
  chemically synthesized
ttgttaatatggagaatgtctt

SEQ ID NO: 881406 - DNA, 22 bp, Artificial Sequence
  chemically synthesized
tgtccagaccactaagacattc

SEQ ID NO: 881407 - DNA, 22 bp, Artificial Sequence
  chemically synthesized
ctgtccagaccactaagacatt

SEQ ID NO: 881408 - DNA, 22 bp, Artificial Sequence
  chemically synthesized
ttaatatggagaatgtcttagt

SEQ ID NO: 881409 - DNA, 22 bp, Artificial Sequence
  chemically synthesized
atatggagaatgtcttagtggt

SEQ ID NO: 881410 - DNA, 22 bp, Artificial Sequence
  chemically synthesized
atcttctgtccagaccactaag

SEQ ID NO: 881411 - DNA, 22 bp, Artificial Sequence
  chemically synthesized
gatcttctgtccagaccactaa

SEQ ID NO: 881412 - DNA, 22 bp, Artificial Sequence
  chemically synthesized
tgatcttctgtccagaccacta

SEQ ID NO: 881413 - DNA, 22 bp, Artificial Sequence
  chemically synthesized
ttttgatcttctgtccagacca

SEQ ID NO: 881414 - DNA, 22 bp, Artificial Sequence
  chemically synthesized
tggctgttttgatcttctgtcc

SEQ ID NO: 881415 - DNA, 22 bp, Artificial Sequence
  chemically synthesized
agtggtctggacagaagatcaa

SEQ ID NO: 881416 - DNA, 22 bp, Artificial Sequence
  chemically synthesized
gtggtctggacagaagatcaaa

SEQ ID NO: 881417 - DNA, 22 bp, Artificial Sequence
  chemically synthesized
ggagaatgttgtggctgttttg

SEQ ID NO: 881418 - DNA, 22 bp, Artificial Sequence
  chemically synthesized
aggagaatgttgtggctgtttt

SEQ ID NO: 881419 - DNA, 22 bp, Artificial Sequence
  chemically synthesized
gacagaagatcaaaacagccac

SEQ ID NO: 881420 - DNA, 22 bp, Artificial Sequence
  chemically synthesized
gcttaggagaatgttgtggctg

SEQ ID NO: 881421 - DNA, 22 bp, Artificial Sequence
  chemically synthesized
ggcttaggagaatgttgtggct

SEQ ID NO: 881422 - DNA, 22 bp, Artificial Sequence
  chemically synthesized
tggcttaggagaatgttgtggc

SEQ ID NO: 881423 - DNA, 22 bp, Artificial Sequence
  chemically synthesized
ggctttggcttaggagaatgtt

SEQ ID NO: 881424 - DNA, 22 bp, Artificial Sequence
  chemically synthesized
gattaggctttggcttaggaga

SEQ ID NO: 881425 - DNA, 22 bp, Artificial Sequence
  chemically synthesized
tggattaggctttggcttagga

SEQ ID NO: 881426 - DNA, 22 bp, Artificial Sequence
  chemically synthesized
ctctggattaggctttggctta

SEQ ID NO: 881427 - DNA, 22 bp, Artificial Sequence
  chemically synthesized
gctctggattaggctttggctt

SEQ ID NO: 881428 - DNA, 22 bp, Artificial Sequence
  chemically synthesized
ggccttgctctggattaggctt

SEQ ID NO: 881429 - DNA, 22 bp, Artificial Sequence
  chemically synthesized
tcctaagccaaagcctaatcca

SEQ ID NO: 881430 - DNA, 22 bp, Artificial Sequence
  chemically synthesized
ctaagccaaagcctaatccaga

SEQ ID NO: 881431 - DNA, 22 bp, Artificial Sequence
  chemically synthesized
agccaaagcctaatccagagca

SEQ ID NO: 881432 - DNA, 22 bp, Artificial Sequence
  chemically synthesized
aacagaattgggccttgctctg

SEQ ID NO: 881433 - DNA, 22 bp, Artificial Sequence
  chemically synthesized
atccagagcaaggcccaattct

SEQ ID NO: 881434 - DNA, 22 bp, Artificial Sequence
  chemically synthesized
atacaactgaacagaattgggc

SEQ ID NO: 881435 - DNA, 22 bp, Artificial Sequence
  chemically synthesized
agcattcatacaactgaacaga

SEQ ID NO: 881436 - DNA, 22 bp, Artificial Sequence
  chemically synthesized
tcagcattcatacaactgaaca

SEQ ID NO: 881437 - DNA, 22 bp, Artificial Sequence
  chemically synthesized
tctcagcattcatacaactgaa

SEQ ID NO: 881438 - DNA, 22 bp, Artificial Sequence
  chemically synthesized
acctctctcagcattcatacaa

SEQ ID NO: 881439 - DNA, 22 bp, Artificial Sequence
  chemically synthesized
ctcacctctctcagcattcata

SEQ ID NO: 881440 - DNA, 22 bp, Artificial Sequence
  chemically synthesized
cctcacctctctcagcattcat

SEQ ID NO: 881441 - DNA, 22 bp, Artificial Sequence
  chemically synthesized
tgttcagttgtatgaatgctga

SEQ ID NO: 881442 - DNA, 22 bp, Artificial Sequence
  chemically synthesized
ttcagttgtatgaatgctgaga

SEQ ID NO: 881443 - DNA, 22 bp, Artificial Sequence
  chemically synthesized
agttgtatgaatgctgagagag

SEQ ID NO: 881444 - DNA, 22 bp, Artificial Sequence
  chemically synthesized
caatttcctcacctctctcagc

SEQ ID NO: 881445 - DNA, 22 bp, Artificial Sequence
  chemically synthesized
tacaatttcctcacctctctca

SEQ ID NO: 881446 - DNA, 22 bp, Artificial Sequence
  chemically synthesized
ctacaatttcctcacctctctc

SEQ ID NO: 881447 - DNA, 22 bp, Artificial Sequence
  chemically synthesized
tatgaatgctgagagaggtgag

SEQ ID NO: 881448 - DNA, 22 bp, Artificial Sequence
  chemically synthesized
ttctacaatttcctcacctctc

SEQ ID NO: 881449 - DNA, 22 bp, Artificial Sequence
  chemically synthesized
cttctacaatttcctcacctct

SEQ ID NO: 881450 - DNA, 22 bp, Artificial Sequence
  chemically synthesized
tcttctacaatttcctcacctc

SEQ ID NO: 881451 - DNA, 22 bp, Artificial Sequence
  chemically synthesized
ttcttctacaatttcctcacct

SEQ ID NO: 881452 - DNA, 22 bp, Artificial Sequence
  chemically synthesized
caacttttcttctacaatttcc

SEQ ID NO: 881453 - DNA, 22 bp, Artificial Sequence
  chemically synthesized
ccaacttttcttctacaatttc

SEQ ID NO: 881454 - DNA, 22 bp, Artificial Sequence
  chemically synthesized
agagaggtgaggaaattgtaga

SEQ ID NO: 881455 - DNA, 22 bp, Artificial Sequence
  chemically synthesized
gcttccaacttttcttctacaa

SEQ ID NO: 881456 - DNA, 22 bp, Artificial Sequence
  chemically synthesized
ctggcttccaacttttcttcta

SEQ ID NO: 881457 - DNA, 22 bp, Artificial Sequence
  chemically synthesized
tgctggcttccaacttttcttc

SEQ ID NO: 881458 - DNA, 22 bp, Artificial Sequence
  chemically synthesized
tagaagaaaagttggaagccag

SEQ ID NO: 881459 - DNA, 22 bp, Artificial Sequence
  chemically synthesized
atgaacaaacctctgctggctt

SEQ ID NO: 881460 - DNA, 22 bp, Artificial Sequence
  chemically synthesized
aagcctcatgaacaaacctctg

SEQ ID NO: 881461 - DNA, 22 bp, Artificial Sequence
  chemically synthesized
gaagccagcagaggtttgttca

SEQ ID NO: 881462 - DNA, 22 bp, Artificial Sequence
  chemically synthesized
gtcctaaagcctcatgaacaaa

SEQ ID NO: 881463 - DNA, 22 bp, Artificial Sequence
  chemically synthesized
cgtcctaaagcctcatgaacaa

SEQ ID NO: 881464 - DNA, 22 bp, Artificial Sequence
  chemically synthesized
cggagagggcttcgtcctaaag

SEQ ID NO: 881465 - DNA, 22 bp, Artificial Sequence
  chemically synthesized
gttcatgaggctttaggacgaa

SEQ ID NO: 881466 - DNA, 22 bp, Artificial Sequence
  chemically synthesized
ttcatgaggctttaggacgaag

SEQ ID NO: 881467 - DNA, 22 bp, Artificial Sequence
  chemically synthesized
tgttacggagagggcttcgtcc

SEQ ID NO: 881468 - DNA, 22 bp, Artificial Sequence
  chemically synthesized
atgaggctttaggacgaagccc

SEQ ID NO: 881469 - DNA, 22 bp, Artificial Sequence
  chemically synthesized
atgttacggagagggcttcgtc

SEQ ID NO: 881470 - DNA, 22 bp, Artificial Sequence
  chemically synthesized
tatgttacggagagggcttcgt

SEQ ID NO: 881471 - DNA, 22 bp, Artificial Sequence
  chemically synthesized
ttatgttacggagagggcttcg

SEQ ID NO: 881472 - DNA, 22 bp, Artificial Sequence
  chemically synthesized
acttttatgttacggagagggc

SEQ ID NO: 881473 - DNA, 22 bp, Artificial Sequence
  chemically synthesized
cacttttatgttacggagaggg

SEQ ID NO: 881474 - DNA, 22 bp, Artificial Sequence
  chemically synthesized
tcacttttatgttacggagagg

SEQ ID NO: 881475 - DNA, 22 bp, Artificial Sequence
  chemically synthesized
taggacgaagccctctccgtaa

SEQ ID NO: 881476 - DNA, 22 bp, Artificial Sequence
  chemically synthesized
aggacgaagccctctccgtaac

SEQ ID NO: 881477 - DNA, 22 bp, Artificial Sequence
  chemically synthesized
ggacgaagccctctccgtaaca

SEQ ID NO: 881478 - DNA, 22 bp, Artificial Sequence
  chemically synthesized
cacctttcacttttatgttacg

SEQ ID NO: 881479 - DNA, 22 bp, Artificial Sequence
  chemically synthesized
ctccacctttcacttttatgtt

SEQ ID NO: 881480 - DNA, 22 bp, Artificial Sequence
  chemically synthesized
ttgctccacctttcacttttat

SEQ ID NO: 881481 - DNA, 22 bp, Artificial Sequence
  chemically synthesized
gttgctccacctttcactttta

SEQ ID NO: 881482 - DNA, 22 bp, Artificial Sequence
  chemically synthesized
tccgtaacataaaagtgaaagg

SEQ ID NO: 881483 - DNA, 22 bp, Artificial Sequence
  chemically synthesized
cgtaacataaaagtgaaaggtg

SEQ ID NO: 881484 - DNA, 22 bp, Artificial Sequence
  chemically synthesized
catcagcacttgttgctccacc

SEQ ID NO: 881485 - DNA, 22 bp, Artificial Sequence
  chemically synthesized
tccatcagcacttgttgctcca

SEQ ID NO: 881486 - DNA, 22 bp, Artificial Sequence
  chemically synthesized
ctccatcagcacttgttgctcc

SEQ ID NO: 881487 - DNA, 22 bp, Artificial Sequence
  chemically synthesized
cagcttctccatcagcacttgt

SEQ ID NO: 881488 - DNA, 22 bp, Artificial Sequence
  chemically synthesized
ctgcagcttctccatcagcact

SEQ ID NO: 881489 - DNA, 22 bp, Artificial Sequence
  chemically synthesized
gctgcagcttctccatcagcac

SEQ ID NO: 881490 - DNA, 22 bp, Artificial Sequence
  chemically synthesized
gatagtttgctgcagcttctcc

SEQ ID NO: 881491 - DNA, 22 bp, Artificial Sequence
  chemically synthesized
tggatagtttgctgcagcttct

SEQ ID NO: 881492 - DNA, 22 bp, Artificial Sequence
  chemically synthesized
ctggatagtttgctgcagcttc

SEQ ID NO: 881493 - DNA, 22 bp, Artificial Sequence
  chemically synthesized
atcttctggatagtttgctgca

SEQ ID NO: 881494 - DNA, 22 bp, Artificial Sequence
  chemically synthesized
gatcttctggatagtttgctgc

SEQ ID NO: 881495 - DNA, 22 bp, Artificial Sequence
  chemically synthesized
atggagaagctgcagcaaacta

SEQ ID NO: 881496 - DNA, 22 bp, Artificial Sequence
  chemically synthesized
gcttgatcttctggatagtttg

SEQ ID NO: 881497 - DNA, 22 bp, Artificial Sequence
  chemically synthesized
gatattagcttgatcttctgga

SEQ ID NO: 881498 - DNA, 22 bp, Artificial Sequence
  chemically synthesized
agatattagcttgatcttctgg

SEQ ID NO: 881499 - DNA, 22 bp, Artificial Sequence
  chemically synthesized
cagcaaactatccagaagatca

SEQ ID NO: 881500 - DNA, 22 bp, Artificial Sequence
  chemically synthesized
atcatcttagatattagcttga

SEQ ID NO: 881501 - DNA, 22 bp, Artificial Sequence
  chemically synthesized
catcatcttagatattagcttg

SEQ ID NO: 881502 - DNA, 22 bp, Artificial Sequence
  chemically synthesized
tccagaagatcaagctaatatc

SEQ ID NO: 881503 - DNA, 22 bp, Artificial Sequence
  chemically synthesized
ccttcatcatcttagatattag

SEQ ID NO: 881504 - DNA, 22 bp, Artificial Sequence
  chemically synthesized
gtgtagctaccttcatcatctt

SEQ ID NO: 881505 - DNA, 22 bp, Artificial Sequence
  chemically synthesized
agtgtagctaccttcatcatct

SEQ ID NO: 881506 - DNA, 22 bp, Artificial Sequence
  chemically synthesized
tttagtgtagctaccttcatca

SEQ ID NO: 881507 - DNA, 22 bp, Artificial Sequence
  chemically synthesized
atatctaagatgatgaaggtag

SEQ ID NO: 881508 - DNA, 22 bp, Artificial Sequence
  chemically synthesized
ttgtttagtgtagctaccttca

SEQ ID NO: 881509 - DNA, 22 bp, Artificial Sequence
  chemically synthesized
agatgatgaaggtagctacact

SEQ ID NO: 881510 - DNA, 22 bp, Artificial Sequence
  chemically synthesized
aaaatctgttgtttagtgtagc

SEQ ID NO: 881511 - DNA, 22 bp, Artificial Sequence
  chemically synthesized
cactgaaaatctgttgtttagt

SEQ ID NO: 881512 - DNA, 22 bp, Artificial Sequence
  chemically synthesized
atctacactgaaaatctgttgt

SEQ ID NO: 881513 - DNA, 22 bp, Artificial Sequence
  chemically synthesized
catctacactgaaaatctgttg

SEQ ID NO: 881514 - DNA, 22 bp, Artificial Sequence
  chemically synthesized
cttcatctacactgaaaatctg

SEQ ID NO: 881515 - DNA, 22 bp, Artificial Sequence
  chemically synthesized
cactaaacaacagattttcagt

SEQ ID NO: 881516 - DNA, 22 bp, Artificial Sequence
  chemically synthesized
aacaacagattttcagtgtaga

SEQ ID NO: 881517 - DNA, 22 bp, Artificial Sequence
  chemically synthesized
caatagaagactgcttcatcta

SEQ ID NO: 881518 - DNA, 22 bp, Artificial Sequence
  chemically synthesized
ccaatagaagactgcttcatct

SEQ ID NO: 881519 - DNA, 22 bp, Artificial Sequence
  chemically synthesized
tccaatagaagactgcttcatc

SEQ ID NO: 881520 - DNA, 22 bp, Artificial Sequence
  chemically synthesized
ttccaatagaagactgcttcat

SEQ ID NO: 881521 - DNA, 22 bp, Artificial Sequence
  chemically synthesized
tttccaatagaagactgcttca

SEQ ID NO: 881522 - DNA, 22 bp, Artificial Sequence
  chemically synthesized
tcagtgtagatgaagcagtctt

SEQ ID NO: 881523 - DNA, 22 bp, Artificial Sequence
  chemically synthesized
cagtgtagatgaagcagtcttc

SEQ ID NO: 881524 - DNA, 22 bp, Artificial Sequence
  chemically synthesized
agtgtagatgaagcagtcttct

SEQ ID NO: 881525 - DNA, 22 bp, Artificial Sequence
  chemically synthesized
gatggcatctttttccaataga

SEQ ID NO: 881526 - DNA, 22 bp, Artificial Sequence
  chemically synthesized
tgaaagtcctagatggcatctt

SEQ ID NO: 881527 - DNA, 22 bp, Artificial Sequence
  chemically synthesized
ctattggaaaaagatgccatct

SEQ ID NO: 881528 - DNA, 22 bp, Artificial Sequence
  chemically synthesized
tattggaaaaagatgccatcta

SEQ ID NO: 881529 - DNA, 22 bp, Artificial Sequence
  chemically synthesized
gctatgaaagtcctagatggca

SEQ ID NO: 881530 - DNA, 22 bp, Artificial Sequence
  chemically synthesized
ttggaaaaagatgccatctagg

SEQ ID NO: 881531 - DNA, 22 bp, Artificial Sequence
  chemically synthesized
tagctatgaaagtcctagatgg

SEQ ID NO: 881532 - DNA, 22 bp, Artificial Sequence
  chemically synthesized
gaaaaagatgccatctaggact

SEQ ID NO: 881533 - DNA, 22 bp, Artificial Sequence
  chemically synthesized
tctagctatgaaagtcctagat

SEQ ID NO: 881534 - DNA, 22 bp, Artificial Sequence
  chemically synthesized
tctctagctatgaaagtcctag

SEQ ID NO: 881535 - DNA, 22 bp, Artificial Sequence
  chemically synthesized
ctctctagctatgaaagtccta

SEQ ID NO: 881536 - DNA, 22 bp, Artificial Sequence
  chemically synthesized
acttctctctagctatgaaagt

SEQ ID NO: 881537 - DNA, 22 bp, Artificial Sequence
  chemically synthesized
ggactttcatagctagagagaa

SEQ ID NO: 881538 - DNA, 22 bp, Artificial Sequence
  chemically synthesized
gaagccaggcattgacttctct

SEQ ID NO: 881539 - DNA, 22 bp, Artificial Sequence
  chemically synthesized
cgaagccaggcattgacttctc

SEQ ID NO: 881540 - DNA, 22 bp, Artificial Sequence
  chemically synthesized
tcatagctagagagaagtcaat

SEQ ID NO: 881541 - DNA, 22 bp, Artificial Sequence
  chemically synthesized
tcgaagccaggcattgacttct

SEQ ID NO: 881542 - DNA, 22 bp, Artificial Sequence
  chemically synthesized
catagctagagagaagtcaatg

SEQ ID NO: 881543 - DNA, 22 bp, Artificial Sequence
  chemically synthesized
atagctagagagaagtcaatgc

SEQ ID NO: 881544 - DNA, 22 bp, Artificial Sequence
  chemically synthesized
aactttcgaagccaggcattga

SEQ ID NO: 881545 - DNA, 22 bp, Artificial Sequence
  chemically synthesized
gaactttcgaagccaggcattg

SEQ ID NO: 881546 - DNA, 22 bp, Artificial Sequence
  chemically synthesized
tgaactttcgaagccaggcatt

SEQ ID NO: 881547 - DNA, 22 bp, Artificial Sequence
  chemically synthesized
gagagaagtcaatgcctggctt

SEQ ID NO: 881548 - DNA, 22 bp, Artificial Sequence
  chemically synthesized
tcctttgaactttcgaagccag

SEQ ID NO: 881549 - DNA, 22 bp, Artificial Sequence
  chemically synthesized
gcttcgaaagttcaaaggacag

SEQ ID NO: 881550 - DNA, 22 bp, Artificial Sequence
  chemically synthesized
aaaagagagtcagcctgtcctt

SEQ ID NO: 881551 - DNA, 22 bp, Artificial Sequence
  chemically synthesized
cgaaagttcaaaggacaggctg

SEQ ID NO: 881552 - DNA, 22 bp, Artificial Sequence
  chemically synthesized
gaaagttcaaaggacaggctga

SEQ ID NO: 881553 - DNA, 22 bp, Artificial Sequence
  chemically synthesized
gcccctcaaaagagagtcagcc

SEQ ID NO: 881554 - DNA, 22 bp, Artificial Sequence
  chemically synthesized
aaaggacaggctgactctcttt

SEQ ID NO: 881555 - DNA, 22 bp, Artificial Sequence
  chemically synthesized
cattagcccctcaaaagagagt

SEQ ID NO: 881556 - DNA, 22 bp, Artificial Sequence
  chemically synthesized
actctcttttgaggggctaatg

SEQ ID NO: 881557 - DNA, 22 bp, Artificial Sequence
  chemically synthesized
aaagtcatcaattgcattagcc

SEQ ID NO: 881558 - DNA, 22 bp, Artificial Sequence
  chemically synthesized
tcttttgaggggctaatgcaat

SEQ ID NO: 881559 - DNA, 22 bp, Artificial Sequence
  chemically synthesized
ttttgaggggctaatgcaattg

SEQ ID NO: 881560 - DNA, 22 bp, Artificial Sequence
  chemically synthesized
aattgaaagtcatcaattgcat

SEQ ID NO: 881561 - DNA, 22 bp, Artificial Sequence
  chemically synthesized
ttgaggggctaatgcaattgat

SEQ ID NO: 881562 - DNA, 22 bp, Artificial Sequence
  chemically synthesized
caattgaaagtcatcaattgca

SEQ ID NO: 881563 - DNA, 22 bp, Artificial Sequence
  chemically synthesized
tgaggggctaatgcaattgatg

SEQ ID NO: 881564 - DNA, 22 bp, Artificial Sequence
  chemically synthesized
gaggggctaatgcaattgatga

SEQ ID NO: 881565 - DNA, 22 bp, Artificial Sequence
  chemically synthesized
aggggctaatgcaattgatgac

SEQ ID NO: 881566 - DNA, 22 bp, Artificial Sequence
  chemically synthesized
tcttcaattgaaagtcatcaat

SEQ ID NO: 881567 - DNA, 22 bp, Artificial Sequence
  chemically synthesized
atgcaattgatgactttcaatt

SEQ ID NO: 881568 - DNA, 22 bp, Artificial Sequence
  chemically synthesized
atgactttcaattgaagacaat

SEQ ID NO: 881569 - DNA, 22 bp, Artificial Sequence
  chemically synthesized
gaatagtaaatgagcattgtct

SEQ ID NO: 881570 - DNA, 22 bp, Artificial Sequence
  chemically synthesized
ggaatagtaaatgagcattgtc

SEQ ID NO: 881571 - DNA, 22 bp, Artificial Sequence
  chemically synthesized
tggaatagtaaatgagcattgt

SEQ ID NO: 881572 - DNA, 22 bp, Artificial Sequence
  chemically synthesized
ttggaatagtaaatgagcattg

SEQ ID NO: 881573 - DNA, 22 bp, Artificial Sequence
  chemically synthesized
tcaattgaagacaatgctcatt

SEQ ID NO: 881574 - DNA, 22 bp, Artificial Sequence
  chemically synthesized
caattgaagacaatgctcattt

SEQ ID NO: 881575 - DNA, 22 bp, Artificial Sequence
  chemically synthesized
aattgaagacaatgctcattta

SEQ ID NO: 881576 - DNA, 22 bp, Artificial Sequence
  chemically synthesized
ggatttttggaatagtaaatga

SEQ ID NO: 881577 - DNA, 22 bp, Artificial Sequence
  chemically synthesized
aagacaatgctcatttactatt

SEQ ID NO: 881578 - DNA, 22 bp, Artificial Sequence
  chemically synthesized
agggccctaggatttttggaat

SEQ ID NO: 881579 - DNA, 22 bp, Artificial Sequence
  chemically synthesized
aagggccctaggatttttggaa

SEQ ID NO: 881580 - DNA, 22 bp, Artificial Sequence
  chemically synthesized
atttactattccaaaaatccta

SEQ ID NO: 881581 - DNA, 22 bp, Artificial Sequence
  chemically synthesized
actattccaaaaatcctagggc

SEQ ID NO: 881582 - DNA, 22 bp, Artificial Sequence
  chemically synthesized
ctattccaaaaatcctagggcc

SEQ ID NO: 881583 - DNA, 22 bp, Artificial Sequence
  chemically synthesized
gcataatcttaagggccctagg

SEQ ID NO: 881584 - DNA, 22 bp, Artificial Sequence
  chemically synthesized
ttccaaaaatcctagggccctt

SEQ ID NO: 881585 - DNA, 22 bp, Artificial Sequence
  chemically synthesized
ttagcataatcttaagggccct

SEQ ID NO: 881586 - DNA, 22 bp, Artificial Sequence
  chemically synthesized
caaaaatcctagggcccttaag

SEQ ID NO: 881587 - DNA, 22 bp, Artificial Sequence
  chemically synthesized
gggcccttaagattatgctaat

SEQ ID NO: 881588 - DNA, 22 bp, Artificial Sequence
  chemically synthesized
tagagcataggcagagtctatt

SEQ ID NO: 881589 - DNA, 22 bp, Artificial Sequence
  chemically synthesized
aagattatgctaatagactctg

SEQ ID NO: 881590 - DNA, 22 bp, Artificial Sequence
  chemically synthesized
atagagcataggcagagtctat

SEQ ID NO: 881591 - DNA, 22 bp, Artificial Sequence
  chemically synthesized
agattatgctaatagactctgc

SEQ ID NO: 881592 - DNA, 22 bp, Artificial Sequence
  chemically synthesized
tatagagcataggcagagtcta

SEQ ID NO: 881593 - DNA, 22 bp, Artificial Sequence
  chemically synthesized
cctttatagagcataggcagag

SEQ ID NO: 881594 - DNA, 22 bp, Artificial Sequence
  chemically synthesized
tgctaatagactctgcctatgc

SEQ ID NO: 881595 - DNA, 22 bp, Artificial Sequence
  chemically synthesized
ttccctttatagagcataggca

SEQ ID NO: 881596 - DNA, 22 bp, Artificial Sequence
  chemically synthesized
ttgttccctttatagagcatag

SEQ ID NO: 881597 - DNA, 22 bp, Artificial Sequence
  chemically synthesized
atagactctgcctatgctctat

SEQ ID NO: 881598 - DNA, 22 bp, Artificial Sequence
  chemically synthesized
gttgttccctttatagagcata

SEQ ID NO: 881599 - DNA, 22 bp, Artificial Sequence
  chemically synthesized
tgttgttccctttatagagcat

SEQ ID NO: 881600 - DNA, 22 bp, Artificial Sequence
  chemically synthesized
tgcctatgctctataaagggaa

SEQ ID NO: 881601 - DNA, 22 bp, Artificial Sequence
  chemically synthesized
cctatgctctataaagggaaca

SEQ ID NO: 881602 - DNA, 22 bp, Artificial Sequence
  chemically synthesized
tcatccaggctttgttgttccc

SEQ ID NO: 881603 - DNA, 22 bp, Artificial Sequence
  chemically synthesized
tgctctataaagggaacaacaa

SEQ ID NO: 881604 - DNA, 22 bp, Artificial Sequence
  chemically synthesized
tataaagggaacaacaaagcct

SEQ ID NO: 881605 - DNA, 22 bp, Artificial Sequence
  chemically synthesized
taaagggaacaacaaagcctgg

SEQ ID NO: 881606 - DNA, 22 bp, Artificial Sequence
  chemically synthesized
taaagagatgtgctatcatcca

SEQ ID NO: 881607 - DNA, 22 bp, Artificial Sequence
  chemically synthesized
gatgatagcacatctctttaca

SEQ ID NO: 881608 - DNA, 22 bp, Artificial Sequence
  chemically synthesized
agtaagtaaaccatgctgtaaa

SEQ ID NO: 881609 - DNA, 22 bp, Artificial Sequence
  chemically synthesized
aaatattcagtaagtaaaccat

SEQ ID NO: 881610 - DNA, 22 bp, Artificial Sequence
  chemically synthesized
tttacagcatggtttacttact

SEQ ID NO: 881611 - DNA, 22 bp, Artificial Sequence
  chemically synthesized
tacagcatggtttacttactga

SEQ ID NO: 881612 - DNA, 22 bp, Artificial Sequence
  chemically synthesized
acagcatggtttacttactgaa

SEQ ID NO: 881613 - DNA, 22 bp, Artificial Sequence
  chemically synthesized
cagcatggtttacttactgaat

SEQ ID NO: 881614 - DNA, 22 bp, Artificial Sequence
  chemically synthesized
acttactgaatattttaggccc

SEQ ID NO: 881615 - DNA, 22 bp, Artificial Sequence
  chemically synthesized
cttactgaatattttaggccca

SEQ ID NO: 881616 - DNA, 22 bp, Artificial Sequence
  chemically synthesized
actgaatattttaggcccactg

SEQ ID NO: 881617 - DNA, 22 bp, Artificial Sequence
  chemically synthesized
ctgaatattttaggcccactgg

SEQ ID NO: 881618 - DNA, 22 bp, Artificial Sequence
  chemically synthesized
tgcaataggtatggccagtggg

SEQ ID NO: 881619 - DNA, 22 bp, Artificial Sequence
  chemically synthesized
aatattttaggcccactggcca

SEQ ID NO: 881620 - DNA, 22 bp, Artificial Sequence
  chemically synthesized
tgtgcaataggtatggccagtg

SEQ ID NO: 881621 - DNA, 22 bp, Artificial Sequence
  chemically synthesized
ctgtgcaataggtatggccagt

SEQ ID NO: 881622 - DNA, 22 bp, Artificial Sequence
  chemically synthesized
ttctgtgcaataggtatggcca

SEQ ID NO: 881623 - DNA, 22 bp, Artificial Sequence
  chemically synthesized
cttctgtgcaataggtatggcc

SEQ ID NO: 881624 - DNA, 22 bp, Artificial Sequence
  chemically synthesized
tcttctgtgcaataggtatggc

SEQ ID NO: 881625 - DNA, 22 bp, Artificial Sequence
  chemically synthesized
taggcccactggccatacctat

SEQ ID NO: 881626 - DNA, 22 bp, Artificial Sequence
  chemically synthesized
ttcttctgtgcaataggtatgg

SEQ ID NO: 881627 - DNA, 22 bp, Artificial Sequence
  chemically synthesized
aggcccactggccatacctatt

SEQ ID NO: 881628 - DNA, 22 bp, Artificial Sequence
  chemically synthesized
tttcttctgtgcaataggtatg

SEQ ID NO: 881629 - DNA, 22 bp, Artificial Sequence
  chemically synthesized
ggcccactggccatacctattg

SEQ ID NO: 881630 - DNA, 22 bp, Artificial Sequence
  chemically synthesized
gccatacctattgcacagaaga

SEQ ID NO: 881631 - DNA, 22 bp, Artificial Sequence
  chemically synthesized
aaagagattttttcttctgtgc

SEQ ID NO: 881632 - DNA, 22 bp, Artificial Sequence
  chemically synthesized
ttgcacagaagaaaaaatctct

SEQ ID NO: 881633 - DNA, 22 bp, Artificial Sequence
  chemically synthesized
cacagaagaaaaaatctctttc

SEQ ID NO: 881634 - DNA, 22 bp, Artificial Sequence
  chemically synthesized
tcaacaagcagtaatatattga

SEQ ID NO: 881635 - DNA, 22 bp, Artificial Sequence
  chemically synthesized
tttcaatatattactgcttgtt

SEQ ID NO: 881636 - DNA, 22 bp, Artificial Sequence
  chemically synthesized
tcaatatattactgcttgttga

SEQ ID NO: 881637 - DNA, 22 bp, Artificial Sequence
  chemically synthesized
caatatattactgcttgttgat

SEQ ID NO: 881638 - DNA, 22 bp, Artificial Sequence
  chemically synthesized
accaggtgcattatcaacaagc

SEQ ID NO: 881639 - DNA, 22 bp, Artificial Sequence
  chemically synthesized
aatatattactgcttgttgata

SEQ ID NO: 881640 - DNA, 22 bp, Artificial Sequence
  chemically synthesized
gctgaccaggtgcattatcaac

SEQ ID NO: 881641 - DNA, 22 bp, Artificial Sequence
  chemically synthesized
ggctgaccaggtgcattatcaa

SEQ ID NO: 881642 - DNA, 22 bp, Artificial Sequence
  chemically synthesized
ttggctgaccaggtgcattatc

SEQ ID NO: 881643 - DNA, 22 bp, Artificial Sequence
  chemically synthesized
ctgcttgttgataatgcacctg

SEQ ID NO: 881644 - DNA, 22 bp, Artificial Sequence
  chemically synthesized
cttgttgataatgcacctggtc

SEQ ID NO: 881645 - DNA, 22 bp, Artificial Sequence
  chemically synthesized
gttgataatgcacctggtcagc

SEQ ID NO: 881646 - DNA, 22 bp, Artificial Sequence
  chemically synthesized
ttgataatgcacctggtcagcc

SEQ ID NO: 881647 - DNA, 22 bp, Artificial Sequence
  chemically synthesized
atcagacctcttggctgaccag

SEQ ID NO: 881648 - DNA, 22 bp, Artificial Sequence
  chemically synthesized
catcagacctcttggctgacca

SEQ ID NO: 881649 - DNA, 22 bp, Artificial Sequence
  chemically synthesized
ataatgcacctggtcagccaag

SEQ ID NO: 881650 - DNA, 22 bp, Artificial Sequence
  chemically synthesized
gtacatcttcatcagacctctt

SEQ ID NO: 881651 - DNA, 22 bp, Artificial Sequence
  chemically synthesized
ggtacatcttcatcagacctct

SEQ ID NO: 881652 - DNA, 22 bp, Artificial Sequence
  chemically synthesized
ttggtacatcttcatcagacct

SEQ ID NO: 881653 - DNA, 22 bp, Artificial Sequence
  chemically synthesized
gtcagccaagaggtctgatgaa

SEQ ID NO: 881654 - DNA, 22 bp, Artificial Sequence
  chemically synthesized
atgaagatgtaccaagagattt

SEQ ID NO: 881655 - DNA, 22 bp, Artificial Sequence
  chemically synthesized
gcaggcataaaaacaaaatctc

SEQ ID NO: 881656 - DNA, 22 bp, Artificial Sequence
  chemically synthesized
tgttagcaggcataaaaacaaa

SEQ ID NO: 881657 - DNA, 22 bp, Artificial Sequence
  chemically synthesized
tgtttttatgcctgctaacaca

SEQ ID NO: 881658 - DNA, 22 bp, Artificial Sequence
  chemically synthesized
cagaatggatgttgtgttagca

SEQ ID NO: 881659 - DNA, 22 bp, Artificial Sequence
  chemically synthesized
gtttttatgcctgctaacacaa

SEQ ID NO: 881660 - DNA, 22 bp, Artificial Sequence
  chemically synthesized
tttttatgcctgctaacacaac

SEQ ID NO: 881661 - DNA, 22 bp, Artificial Sequence
  chemically synthesized
ttatgcctgctaacacaacatc

SEQ ID NO: 881662 - DNA, 22 bp, Artificial Sequence
  chemically synthesized
tatgcctgctaacacaacatcc

SEQ ID NO: 881663 - DNA, 22 bp, Artificial Sequence
  chemically synthesized
atgcctgctaacacaacatcca

SEQ ID NO: 881664 - DNA, 22 bp, Artificial Sequence
  chemically synthesized
tgcctgctaacacaacatccat

SEQ ID NO: 881665 - DNA, 22 bp, Artificial Sequence
  chemically synthesized
tccaaggactgcagaatggatg

SEQ ID NO: 881666 - DNA, 22 bp, Artificial Sequence
  chemically synthesized
gtccaaggactgcagaatggat

SEQ ID NO: 881667 - DNA, 22 bp, Artificial Sequence
  chemically synthesized
tgtccaaggactgcagaatgga

SEQ ID NO: 881668 - DNA, 22 bp, Artificial Sequence
  chemically synthesized
ctaacacaacatccattctgca

SEQ ID NO: 881669 - DNA, 22 bp, Artificial Sequence
  chemically synthesized
ctttgtccaaggactgcagaat

SEQ ID NO: 881670 - DNA, 22 bp, Artificial Sequence
  chemically synthesized
acacaacatccattctgcagtc

SEQ ID NO: 881671 - DNA, 22 bp, Artificial Sequence
  chemically synthesized
aaatgactcctttgtccaagga

SEQ ID NO: 881672 - DNA, 22 bp, Artificial Sequence
  chemically synthesized
tgcagtccttggacaaaggagt

SEQ ID NO: 881673 - DNA, 22 bp, Artificial Sequence
  chemically synthesized
agagctgaaatgactcctttgt

SEQ ID NO: 881674 - DNA, 22 bp, Artificial Sequence
  chemically synthesized
gagagctgaaatgactcctttg

SEQ ID NO: 881675 - DNA, 22 bp, Artificial Sequence
  chemically synthesized
cagtccttggacaaaggagtca

SEQ ID NO: 881676 - DNA, 22 bp, Artificial Sequence
  chemically synthesized
ggacaaaggagtcatttcagct

SEQ ID NO: 881677 - DNA, 22 bp, Artificial Sequence
  chemically synthesized
gacaaaggagtcatttcagctc

SEQ ID NO: 881678 - DNA, 22 bp, Artificial Sequence
  chemically synthesized
aagaataagacttgagagctga

SEQ ID NO: 881679 - DNA, 22 bp, Artificial Sequence
  chemically synthesized
aaagaataagacttgagagctg

SEQ ID NO: 881680 - DNA, 22 bp, Artificial Sequence
  chemically synthesized
taaagaataagacttgagagct

SEQ ID NO: 881681 - DNA, 22 bp, Artificial Sequence
  chemically synthesized
ttaaagaataagacttgagagc

SEQ ID NO: 881682 - DNA, 22 bp, Artificial Sequence
  chemically synthesized
tttaaagaataagacttgagag

SEQ ID NO: 881683 - DNA, 22 bp, Artificial Sequence
  chemically synthesized
cagctctcaagtcttattcttt

SEQ ID NO: 881684 - DNA, 22 bp, Artificial Sequence
  chemically synthesized
agctctcaagtcttattcttta

SEQ ID NO: 881685 - DNA, 22 bp, Artificial Sequence
  chemically synthesized
caaaatgtactttttaaagaat

SEQ ID NO: 881686 - DNA, 22 bp, Artificial Sequence
  chemically synthesized
acaaaatgtactttttaaagaa

SEQ ID NO: 881687 - DNA, 22 bp, Artificial Sequence
  chemically synthesized
tcaagtcttattctttaaaaag

SEQ ID NO: 881688 - DNA, 22 bp, Artificial Sequence
  chemically synthesized
aagtcttattctttaaaaagta

SEQ ID NO: 881689 - DNA, 22 bp, Artificial Sequence
  chemically synthesized
tagccttacaaaatgtactttt

SEQ ID NO: 881690 - DNA, 22 bp, Artificial Sequence
  chemically synthesized
attctttaaaaagtacattttg

SEQ ID NO: 881691 - DNA, 22 bp, Artificial Sequence
  chemically synthesized
ttctttaaaaagtacattttgt

SEQ ID NO: 881692 - DNA, 22 bp, Artificial Sequence
  chemically synthesized
tttaaaaagtacattttgtaag

SEQ ID NO: 881693 - DNA, 22 bp, Artificial Sequence
  chemically synthesized
gggcagctatagccttacaaaa

SEQ ID NO: 881694 - DNA, 22 bp, Artificial Sequence
  chemically synthesized
taaaaagtacattttgtaaggc

SEQ ID NO: 881695 - DNA, 22 bp, Artificial Sequence
  chemically synthesized
aaaaagtacattttgtaaggct

SEQ ID NO: 881696 - DNA, 22 bp, Artificial Sequence
  chemically synthesized
aaaagtacattttgtaaggcta

SEQ ID NO: 881697 - DNA, 22 bp, Artificial Sequence
  chemically synthesized
cctagggcagctatagccttac

SEQ ID NO: 881698 - DNA, 22 bp, Artificial Sequence
  chemically synthesized
tgtaaggctatagctgccctag

SEQ ID NO: 881699 - DNA, 22 bp, Artificial Sequence
  chemically synthesized
gtaaggctatagctgccctagg

SEQ ID NO: 881700 - DNA, 22 bp, Artificial Sequence
  chemically synthesized
taaggctatagctgccctaggt

SEQ ID NO: 881701 - DNA, 22 bp, Artificial Sequence
  chemically synthesized
tagctgccctaggtagcgattc

SEQ ID NO: 881702 - DNA, 22 bp, Artificial Sequence
  chemically synthesized
cccagatccatcagaggaatcg

SEQ ID NO: 881703 - DNA, 22 bp, Artificial Sequence
  chemically synthesized
acccagatccatcagaggaatc

SEQ ID NO: 881704 - DNA, 22 bp, Artificial Sequence
  chemically synthesized
ccctaggtagcgattcctctga

SEQ ID NO: 881705 - DNA, 22 bp, Artificial Sequence
  chemically synthesized
agtttacccagatccatcagag

SEQ ID NO: 881706 - DNA, 22 bp, Artificial Sequence
  chemically synthesized
ggtagcgattcctctgatggat

SEQ ID NO: 881707 - DNA, 22 bp, Artificial Sequence
  chemically synthesized
cagtttacccagatccatcaga

SEQ ID NO: 881708 - DNA, 22 bp, Artificial Sequence
  chemically synthesized
tcagtttacccagatccatcag

SEQ ID NO: 881709 - DNA, 22 bp, Artificial Sequence
  chemically synthesized
ctctgatggatctgggtaaact

SEQ ID NO: 881710 - DNA, 22 bp, Artificial Sequence
  chemically synthesized
cagaagattttcagtttaccca

SEQ ID NO: 881711 - DNA, 22 bp, Artificial Sequence
  chemically synthesized
ccagaagattttcagtttaccc

SEQ ID NO: 881712 - DNA, 22 bp, Artificial Sequence
  chemically synthesized
tccagaagattttcagtttacc

SEQ ID NO: 881713 - DNA, 22 bp, Artificial Sequence
  chemically synthesized
tgatggatctgggtaaactgaa

SEQ ID NO: 881714 - DNA, 22 bp, Artificial Sequence
  chemically synthesized
atggatctgggtaaactgaaaa

SEQ ID NO: 881715 - DNA, 22 bp, Artificial Sequence
  chemically synthesized
ggtaaactgaaaatcttctgga

SEQ ID NO: 881716 - DNA, 22 bp, Artificial Sequence
  chemically synthesized
gaatggtgagtcctttccagaa

SEQ ID NO: 881717 - DNA, 22 bp, Artificial Sequence
  chemically synthesized
aaaatcttctggaaaggactca

SEQ ID NO: 881718 - DNA, 22 bp, Artificial Sequence
  chemically synthesized
atggcatctggaatggtgagtc

SEQ ID NO: 881719 - DNA, 22 bp, Artificial Sequence
  chemically synthesized
aatggcatctggaatggtgagt

SEQ ID NO: 881720 - DNA, 22 bp, Artificial Sequence
  chemically synthesized
ttaatggcatctggaatggtga

SEQ ID NO: 881721 - DNA, 22 bp, Artificial Sequence
  chemically synthesized
ctggaaaggactcaccattcca

SEQ ID NO: 881722 - DNA, 22 bp, Artificial Sequence
  chemically synthesized
cttaatggcatctggaatggtg

SEQ ID NO: 881723 - DNA, 22 bp, Artificial Sequence
  chemically synthesized
tggaaaggactcaccattccag

SEQ ID NO: 881724 - DNA, 22 bp, Artificial Sequence
  chemically synthesized
tcttaatggcatctggaatggt

SEQ ID NO: 881725 - DNA, 22 bp, Artificial Sequence
  chemically synthesized
gaaaggactcaccattccagat

SEQ ID NO: 881726 - DNA, 22 bp, Artificial Sequence
  chemically synthesized
accattccagatgccattaaga

SEQ ID NO: 881727 - DNA, 22 bp, Artificial Sequence
  chemically synthesized
tgaatcacaaattttcttaatg

SEQ ID NO: 881728 - DNA, 22 bp, Artificial Sequence
  chemically synthesized
tatgaatcacaaattttcttaa

SEQ ID NO: 881729 - DNA, 22 bp, Artificial Sequence
  chemically synthesized
ctatgaatcacaaattttctta

SEQ ID NO: 881730 - DNA, 22 bp, Artificial Sequence
  chemically synthesized
tctatgaatcacaaattttctt

SEQ ID NO: 881731 - DNA, 22 bp, Artificial Sequence
  chemically synthesized
cagatgccattaagaaaatttg

SEQ ID NO: 881732 - DNA, 22 bp, Artificial Sequence
  chemically synthesized
tttctatgaatcacaaattttc

SEQ ID NO: 881733 - DNA, 22 bp, Artificial Sequence
  chemically synthesized
cctctttctatgaatcacaaat

SEQ ID NO: 881734 - DNA, 22 bp, Artificial Sequence
  chemically synthesized
acctctttctatgaatcacaaa

SEQ ID NO: 881735 - DNA, 22 bp, Artificial Sequence
  chemically synthesized
agaaaatttgtgattcatagaa

SEQ ID NO: 881736 - DNA, 22 bp, Artificial Sequence
  chemically synthesized
atatttacctctttctatgaat

SEQ ID NO: 881737 - DNA, 22 bp, Artificial Sequence
  chemically synthesized
taatgttgatatttacctcttt

SEQ ID NO: 881738 - DNA, 22 bp, Artificial Sequence
  chemically synthesized
gtgattcatagaaagaggtaaa

SEQ ID NO: 881739 - DNA, 22 bp, Artificial Sequence
  chemically synthesized
gtaatgttgatatttacctctt

SEQ ID NO: 881740 - DNA, 22 bp, Artificial Sequence
  chemically synthesized
tgattcatagaaagaggtaaat

SEQ ID NO: 881741 - DNA, 22 bp, Artificial Sequence
  chemically synthesized
atagaaagaggtaaatatcaac

SEQ ID NO: 881742 - DNA, 22 bp, Artificial Sequence
  chemically synthesized
caaacaccttgtaatgttgata

SEQ ID NO: 881743 - DNA, 22 bp, Artificial Sequence
  chemically synthesized
ccaaacaccttgtaatgttgat

SEQ ID NO: 881744 - DNA, 22 bp, Artificial Sequence
  chemically synthesized
ttccaaacaccttgtaatgttg

SEQ ID NO: 881745 - DNA, 22 bp, Artificial Sequence
  chemically synthesized
cttccaaacaccttgtaatgtt

SEQ ID NO: 881746 - DNA, 22 bp, Artificial Sequence
  chemically synthesized
gaataaacttcttccaaacacc

SEQ ID NO: 881747 - DNA, 22 bp, Artificial Sequence
  chemically synthesized
caaggtgtttggaagaagttta

SEQ ID NO: 881748 - DNA, 22 bp, Artificial Sequence
  chemically synthesized
atgagggttggaataaacttct

SEQ ID NO: 881749 - DNA, 22 bp, Artificial Sequence
  chemically synthesized
ggaagaagtttattccaaccct

SEQ ID NO: 881750 - DNA, 22 bp, Artificial Sequence
  chemically synthesized
gaagaagtttattccaaccctc

SEQ ID NO: 881751 - DNA, 22 bp, Artificial Sequence
  chemically synthesized
ataggcattcatgagggttgga

SEQ ID NO: 881752 - DNA, 22 bp, Artificial Sequence
  chemically synthesized
gaccctcataggcattcatgag

SEQ ID NO: 881753 - DNA, 22 bp, Artificial Sequence
  chemically synthesized
ggaccctcataggcattcatga

SEQ ID NO: 881754 - DNA, 22 bp, Artificial Sequence
  chemically synthesized
attccaaccctcatgaatgcct

SEQ ID NO: 881755 - DNA, 22 bp, Artificial Sequence
  chemically synthesized
ttccaaccctcatgaatgccta

SEQ ID NO: 881756 - DNA, 22 bp, Artificial Sequence
  chemically synthesized
caaccctcatgaatgcctatga

SEQ ID NO: 881757 - DNA, 22 bp, Artificial Sequence
  chemically synthesized
aagtcttggaccctcataggca

SEQ ID NO: 881758 - DNA, 22 bp, Artificial Sequence
  chemically synthesized
ctaaagtcttggaccctcatag

SEQ ID NO: 881759 - DNA, 22 bp, Artificial Sequence
  chemically synthesized
atgaatgcctatgagggtccaa

SEQ ID NO: 881760 - DNA, 22 bp, Artificial Sequence
  chemically synthesized
ccctactaaagtcttggaccct

SEQ ID NO: 881761 - DNA, 22 bp, Artificial Sequence
  chemically synthesized
cccctactaaagtcttggaccc

SEQ ID NO: 881762 - DNA, 22 bp, Artificial Sequence
  chemically synthesized
tgagggtccaagactttagtag

SEQ ID NO: 881763 - DNA, 22 bp, Artificial Sequence
  chemically synthesized
cacatccagtgacttcccctac

SEQ ID NO: 881764 - DNA, 22 bp, Artificial Sequence
  chemically synthesized
tccacatccagtgacttcccct

SEQ ID NO: 881765 - DNA, 22 bp, Artificial Sequence
  chemically synthesized
ctccacatccagtgacttcccc

SEQ ID NO: 881766 - DNA, 22 bp, Artificial Sequence
  chemically synthesized
tctccacatccagtgacttccc

SEQ ID NO: 881767 - DNA, 22 bp, Artificial Sequence
  chemically synthesized
tagtaggggaagtcactggatg

SEQ ID NO: 881768 - DNA, 22 bp, Artificial Sequence
  chemically synthesized
caattttctccacatccagtga

SEQ ID NO: 881769 - DNA, 22 bp, Artificial Sequence
  chemically synthesized
agtaggggaagtcactggatgt

SEQ ID NO: 881770 - DNA, 22 bp, Artificial Sequence
  chemically synthesized
gcaattttctccacatccagtg

SEQ ID NO: 881771 - DNA, 22 bp, Artificial Sequence
  chemically synthesized
gtaggggaagtcactggatgtg

SEQ ID NO: 881772 - DNA, 22 bp, Artificial Sequence
  chemically synthesized
ttgcaattttctccacatccag

SEQ ID NO: 881773 - DNA, 22 bp, Artificial Sequence
  chemically synthesized
tcttgcaattttctccacatcc

SEQ ID NO: 881774 - DNA, 22 bp, Artificial Sequence
  chemically synthesized
gttctcttgcaattttctccac

SEQ ID NO: 881775 - DNA, 22 bp, Artificial Sequence
  chemically synthesized
tagttctcttgcaattttctcc

SEQ ID NO: 881776 - DNA, 22 bp, Artificial Sequence
  chemically synthesized
ttctagttctcttgcaattttc

SEQ ID NO: 881777 - DNA, 22 bp, Artificial Sequence
  chemically synthesized
attctagttctcttgcaatttt

SEQ ID NO: 881778 - DNA, 22 bp, Artificial Sequence
  chemically synthesized
tattctagttctcttgcaattt

SEQ ID NO: 881779 - DNA, 22 bp, Artificial Sequence
  chemically synthesized
gatgtggagaaaattgcaagag

SEQ ID NO: 881780 - DNA, 22 bp, Artificial Sequence
  chemically synthesized
cactttattctagttctcttgc

SEQ ID NO: 881781 - DNA, 22 bp, Artificial Sequence
  chemically synthesized
aggctccactttattctagttc

SEQ ID NO: 881782 - DNA, 22 bp, Artificial Sequence
  chemically synthesized
caggctccactttattctagtt

SEQ ID NO: 881783 - DNA, 22 bp, Artificial Sequence
  chemically synthesized
caagagaactagaataaagtgg

SEQ ID NO: 881784 - DNA, 22 bp, Artificial Sequence
  chemically synthesized
caccttcaggctccactttatt

SEQ ID NO: 881785 - DNA, 22 bp, Artificial Sequence
  chemically synthesized
agttacaccttcaggctccact

SEQ ID NO: 881786 - DNA, 22 bp, Artificial Sequence
  chemically synthesized
gaataaagtggagcctgaaggt

SEQ ID NO: 881787 - DNA, 22 bp, Artificial Sequence
  chemically synthesized
tgagatgacggccattcagtta

SEQ ID NO: 881788 - DNA, 22 bp, Artificial Sequence
  chemically synthesized
attatgagatgacggccattca

SEQ ID NO: 881789 - DNA, 22 bp, Artificial Sequence
  chemically synthesized
cattatgagatgacggccattc

SEQ ID NO: 881790 - DNA, 22 bp, Artificial Sequence
  chemically synthesized
aaggtgtaactgaatggccgtc

SEQ ID NO: 881791 - DNA, 22 bp, Artificial Sequence
  chemically synthesized
aagtttcattatgagatgacgg

SEQ ID NO: 881792 - DNA, 22 bp, Artificial Sequence
  chemically synthesized
aatggccgtcatctcataatga

SEQ ID NO: 881793 - DNA, 22 bp, Artificial Sequence
  chemically synthesized
atccattgaagtttcattatga

SEQ ID NO: 881794 - DNA, 22 bp, Artificial Sequence
  chemically synthesized
catccattgaagtttcattatg

SEQ ID NO: 881795 - DNA, 22 bp, Artificial Sequence
  chemically synthesized
ttcatccattgaagtttcatta

SEQ ID NO: 881796 - DNA, 22 bp, Artificial Sequence
  chemically synthesized
ataatgaaacttcaatggatga

SEQ ID NO: 881797 - DNA, 22 bp, Artificial Sequence
  chemically synthesized
taagtagcaactcttcatccat

SEQ ID NO: 881798 - DNA, 22 bp, Artificial Sequence
  chemically synthesized
atctataagtagcaactcttca

SEQ ID NO: 881799 - DNA, 22 bp, Artificial Sequence
  chemically synthesized
ctcatctataagtagcaactct

SEQ ID NO: 881800 - DNA, 22 bp, Artificial Sequence
  chemically synthesized
gctcatctataagtagcaactc

SEQ ID NO: 881801 - DNA, 22 bp, Artificial Sequence
  chemically synthesized
caatggatgaagagttgctact

SEQ ID NO: 881802 - DNA, 22 bp, Artificial Sequence
  chemically synthesized
tgctcatctataagtagcaact

SEQ ID NO: 881803 - DNA, 22 bp, Artificial Sequence
  chemically synthesized
aatggatgaagagttgctactt

SEQ ID NO: 881804 - DNA, 22 bp, Artificial Sequence
  chemically synthesized
ttttgctcatctataagtagca

SEQ ID NO: 881805 - DNA, 22 bp, Artificial Sequence
  chemically synthesized
gttttgctcatctataagtagc

SEQ ID NO: 881806 - DNA, 22 bp, Artificial Sequence
  chemically synthesized
tgttttgctcatctataagtag

SEQ ID NO: 881807 - DNA, 22 bp, Artificial Sequence
  chemically synthesized
ctacttatagatgagcaaaaca

SEQ ID NO: 881808 - DNA, 22 bp, Artificial Sequence
  chemically synthesized
atgaaaacactttgttttgctc

SEQ ID NO: 881809 - DNA, 22 bp, Artificial Sequence
  chemically synthesized
cttatagatgagcaaaacaaag

SEQ ID NO: 881810 - DNA, 22 bp, Artificial Sequence
  chemically synthesized
tctcatgaaaacactttgtttt

SEQ ID NO: 881811 - DNA, 22 bp, Artificial Sequence
  chemically synthesized
atagatgagcaaaacaaagtgt

SEQ ID NO: 881812 - DNA, 22 bp, Artificial Sequence
  chemically synthesized
tgtctcatgaaaacactttgtt

SEQ ID NO: 881813 - DNA, 22 bp, Artificial Sequence
  chemically synthesized
tagatgagcaaaacaaagtgtt

SEQ ID NO: 881814 - DNA, 22 bp, Artificial Sequence
  chemically synthesized
accaggagtagattctgtctca

SEQ ID NO: 881815 - DNA, 22 bp, Artificial Sequence
  chemically synthesized
caccaggagtagattctgtctc

SEQ ID NO: 881816 - DNA, 22 bp, Artificial Sequence
  chemically synthesized
tcatgagacagaatctactcct

SEQ ID NO: 881817 - DNA, 22 bp, Artificial Sequence
  chemically synthesized
catgagacagaatctactcctg

SEQ ID NO: 881818 - DNA, 22 bp, Artificial Sequence
  chemically synthesized
cagcgtcttcaccaggagtaga

SEQ ID NO: 881819 - DNA, 22 bp, Artificial Sequence
  chemically synthesized
atgagacagaatctactcctgg

SEQ ID NO: 881820 - DNA, 22 bp, Artificial Sequence
  chemically synthesized
acagcgtcttcaccaggagtag

SEQ ID NO: 881821 - DNA, 22 bp, Artificial Sequence
  chemically synthesized
tttacagcgtcttcaccaggag

SEQ ID NO: 881822 - DNA, 22 bp, Artificial Sequence
  chemically synthesized
aacattgtttacagcgtcttca

SEQ ID NO: 881823 - DNA, 22 bp, Artificial Sequence
  chemically synthesized
caacattgtttacagcgtcttc

SEQ ID NO: 881824 - DNA, 22 bp, Artificial Sequence
  chemically synthesized
ctcctggtgaagacgctgtaaa

SEQ ID NO: 881825 - DNA, 22 bp, Artificial Sequence
  chemically synthesized
tcatttcaacattgtttacagc

SEQ ID NO: 881826 - DNA, 22 bp, Artificial Sequence
  chemically synthesized
ctggtgaagacgctgtaaacaa

SEQ ID NO: 881827 - DNA, 22 bp, Artificial Sequence
  chemically synthesized
ttgtcatttcaacattgtttac

SEQ ID NO: 881828 - DNA, 22 bp, Artificial Sequence
  chemically synthesized
gtgaagacgctgtaaacaatgt

SEQ ID NO: 881829 - DNA, 22 bp, Artificial Sequence
  chemically synthesized
gttgtcatttcaacattgttta

SEQ ID NO: 881830 - DNA, 22 bp, Artificial Sequence
  chemically synthesized
tgttgtcatttcaacattgttt

SEQ ID NO: 881831 - DNA, 22 bp, Artificial Sequence
  chemically synthesized
aaccctttgttgtcatttcaac

SEQ ID NO: 881832 - DNA, 22 bp, Artificial Sequence
  chemically synthesized
taaaccctttgttgtcatttca

SEQ ID NO: 881833 - DNA, 22 bp, Artificial Sequence
  chemically synthesized
taaacaatgttgaaatgacaac

SEQ ID NO: 881834 - DNA, 22 bp, Artificial Sequence
  chemically synthesized
cagaatattctaaaccctttgt

SEQ ID NO: 881835 - DNA, 22 bp, Artificial Sequence
  chemically synthesized
acagaatattctaaaccctttg

SEQ ID NO: 881836 - DNA, 22 bp, Artificial Sequence
  chemically synthesized
aaatgacaacaaagggtttaga

SEQ ID NO: 881837 - DNA, 22 bp, Artificial Sequence
  chemically synthesized
agtttacagaatattctaaacc

SEQ ID NO: 881838 - DNA, 22 bp, Artificial Sequence
  chemically synthesized
ccaactaagtttacagaatatt

SEQ ID NO: 881839 - DNA, 22 bp, Artificial Sequence
  chemically synthesized
accaactaagtttacagaatat

SEQ ID NO: 881840 - DNA, 22 bp, Artificial Sequence
  chemically synthesized
taccaactaagtttacagaata

SEQ ID NO: 881841 - DNA, 22 bp, Artificial Sequence
  chemically synthesized
ctttaccaactaagtttacaga

SEQ ID NO: 881842 - DNA, 22 bp, Artificial Sequence
  chemically synthesized
ctgctttaccaactaagtttac

SEQ ID NO: 881843 - DNA, 22 bp, Artificial Sequence
  chemically synthesized
agaatattctgtaaacttagtt

SEQ ID NO: 881844 - DNA, 22 bp, Artificial Sequence
  chemically synthesized
gaatattctgtaaacttagttg

SEQ ID NO: 881845 - DNA, 22 bp, Artificial Sequence
  chemically synthesized
ctgctgctttaccaactaagtt

SEQ ID NO: 881846 - DNA, 22 bp, Artificial Sequence
  chemically synthesized
tgtaaacttagttggtaaagca

SEQ ID NO: 881847 - DNA, 22 bp, Artificial Sequence
  chemically synthesized
ataccctgctgctgctttacca

SEQ ID NO: 881848 - DNA, 22 bp, Artificial Sequence
  chemically synthesized
taaacttagttggtaaagcagc

SEQ ID NO: 881849 - DNA, 22 bp, Artificial Sequence
  chemically synthesized
tcataccctgctgctgctttac

SEQ ID NO: 881850 - DNA, 22 bp, Artificial Sequence
  chemically synthesized
agttggtaaagcagcagcaggg

SEQ ID NO: 881851 - DNA, 22 bp, Artificial Sequence
  chemically synthesized
gttggtaaagcagcagcagggt

SEQ ID NO: 881852 - DNA, 22 bp, Artificial Sequence
  chemically synthesized
gtaaagcagcagcagggtatga

SEQ ID NO: 881853 - DNA, 22 bp, Artificial Sequence
  chemically synthesized
aaaaatgaggtcaaggctctca

SEQ ID NO: 881854 - DNA, 22 bp, Artificial Sequence
  chemically synthesized
caaaaatgaggtcaaggctctc

SEQ ID NO: 881855 - DNA, 22 bp, Artificial Sequence
  chemically synthesized
tcaaaaatgaggtcaaggctct

SEQ ID NO: 881856 - DNA, 22 bp, Artificial Sequence
  chemically synthesized
cccacagtagatctttcaaaaa

SEQ ID NO: 881857 - DNA, 22 bp, Artificial Sequence
  chemically synthesized
acccacagtagatctttcaaaa

SEQ ID NO: 881858 - DNA, 22 bp, Artificial Sequence
  chemically synthesized
tacccacagtagatctttcaaa

SEQ ID NO: 881859 - DNA, 22 bp, Artificial Sequence
  chemically synthesized
gacctcatttttgaaagatcta

SEQ ID NO: 881860 - DNA, 22 bp, Artificial Sequence
  chemically synthesized
acctcatttttgaaagatctac

SEQ ID NO: 881861 - DNA, 22 bp, Artificial Sequence
  chemically synthesized
atttttgaaagatctactgtgg

SEQ ID NO: 881862 - DNA, 22 bp, Artificial Sequence
  chemically synthesized
ataacattttacccacagtaga

SEQ ID NO: 881863 - DNA, 22 bp, Artificial Sequence
  chemically synthesized
gataacattttacccacagtag

SEQ ID NO: 881864 - DNA, 22 bp, Artificial Sequence
  chemically synthesized
ttgaaagatctactgtgggtaa

SEQ ID NO: 881865 - DNA, 22 bp, Artificial Sequence
  chemically synthesized
tttgataacattttacccacag

SEQ ID NO: 881866 - DNA, 22 bp, Artificial Sequence
  chemically synthesized
tgaaagatctactgtgggtaaa

SEQ ID NO: 881867 - DNA, 22 bp, Artificial Sequence
  chemically synthesized
gaaagatctactgtgggtaaaa

SEQ ID NO: 881868 - DNA, 22 bp, Artificial Sequence
  chemically synthesized
aaagatctactgtgggtaaaat

SEQ ID NO: 881869 - DNA, 22 bp, Artificial Sequence
  chemically synthesized
ctgtgggtaaaatgttatcaaa

SEQ ID NO: 881870 - DNA, 22 bp, Artificial Sequence
  chemically synthesized
tgggtaaaatgttatcaaataa

SEQ ID NO: 881871 - DNA, 22 bp, Artificial Sequence
  chemically synthesized
tgtagtgtgtgatgttatttga

SEQ ID NO: 881872 - DNA, 22 bp, Artificial Sequence
  chemically synthesized
atgtagtgtgtgatgttatttg

SEQ ID NO: 881873 - DNA, 22 bp, Artificial Sequence
  chemically synthesized
tatgtagtgtgtgatgttattt

SEQ ID NO: 881874 - DNA, 22 bp, Artificial Sequence
  chemically synthesized
ttatgtagtgtgtgatgttatt

SEQ ID NO: 881875 - DNA, 22 bp, Artificial Sequence
  chemically synthesized
tcaaataacatcacacactaca

SEQ ID NO: 881876 - DNA, 22 bp, Artificial Sequence
  chemically synthesized
acaaaagatttttatgtagtgt

SEQ ID NO: 881877 - DNA, 22 bp, Artificial Sequence
  chemically synthesized
cacaaaagatttttatgtagtg

SEQ ID NO: 881878 - DNA, 22 bp, Artificial Sequence
  chemically synthesized
tcacaaaagatttttatgtagt

SEQ ID NO: 881879 - DNA, 22 bp, Artificial Sequence
  chemically synthesized
ttcacaaaagatttttatgtag

SEQ ID NO: 881880 - DNA, 22 bp, Artificial Sequence
  chemically synthesized
tttcacaaaagatttttatgta

SEQ ID NO: 881881 - DNA, 22 bp, Artificial Sequence
  chemically synthesized
ttttcacaaaagatttttatgt

SEQ ID NO: 881882 - DNA, 22 bp, Artificial Sequence
  chemically synthesized
atttttttcacaaaagattttt

SEQ ID NO: 881883 - DNA, 22 bp, Artificial Sequence
  chemically synthesized
gttgatttttttcacaaaagat

SEQ ID NO: 881884 - DNA, 22 bp, Artificial Sequence
  chemically synthesized
cataaaaatcttttgtgaaaaa

SEQ ID NO: 881885 - DNA, 22 bp, Artificial Sequence
  chemically synthesized
tgttggttgatttttttcacaa

SEQ ID NO: 881886 - DNA, 22 bp, Artificial Sequence
  chemically synthesized
ctatgttggttgatttttttca

SEQ ID NO: 881887 - DNA, 22 bp, Artificial Sequence
  chemically synthesized
gctatgttggttgatttttttc

SEQ ID NO: 881888 - DNA, 22 bp, Artificial Sequence
  chemically synthesized
ttgtgaaaaaaatcaaccaaca

SEQ ID NO: 881889 - DNA, 22 bp, Artificial Sequence
  chemically synthesized
tgtgaaaaaaatcaaccaacat

SEQ ID NO: 881890 - DNA, 22 bp, Artificial Sequence
  chemically synthesized
gtgaaaaaaatcaaccaacata

SEQ ID NO: 881891 - DNA, 22 bp, Artificial Sequence
  chemically synthesized
tgaaaaaaatcaaccaacatag

SEQ ID NO: 881892 - DNA, 22 bp, Artificial Sequence
  chemically synthesized
gaataaaacaaccatgaggttt

SEQ ID NO: 881893 - DNA, 22 bp, Artificial Sequence
  chemically synthesized
agaataaaacaaccatgaggtt

SEQ ID NO: 881894 - DNA, 22 bp, Artificial Sequence
  chemically synthesized
ttagaataaaacaaccatgagg

SEQ ID NO: 881895 - DNA, 22 bp, Artificial Sequence
  chemically synthesized
cttagaataaaacaaccatgag

SEQ ID NO: 881896 - DNA, 22 bp, Artificial Sequence
  chemically synthesized
tgccaatttcttagaataaaac

SEQ ID NO: 881897 - DNA, 22 bp, Artificial Sequence
  chemically synthesized
atggttgttttattctaagaaa

SEQ ID NO: 881898 - DNA, 22 bp, Artificial Sequence
  chemically synthesized
gagtgactatgccaatttctta

SEQ ID NO: 881899 - DNA, 22 bp, Artificial Sequence
  chemically synthesized
ttttattctaagaaattggcat

SEQ ID NO: 881900 - DNA, 22 bp, Artificial Sequence
  chemically synthesized
tattctaagaaattggcatagt

SEQ ID NO: 881901 - DNA, 22 bp, Artificial Sequence
  chemically synthesized
attctaagaaattggcatagtc

SEQ ID NO: 881902 - DNA, 22 bp, Artificial Sequence
  chemically synthesized
aaaggttggagtgactatgcca

SEQ ID NO: 881903 - DNA, 22 bp, Artificial Sequence
  chemically synthesized
ttctaagaaattggcatagtca

SEQ ID NO: 881904 - DNA, 22 bp, Artificial Sequence
  chemically synthesized
ttgaaaggttggagtgactatg

SEQ ID NO: 881905 - DNA, 22 bp, Artificial Sequence
  chemically synthesized
taagaaattggcatagtcactc

SEQ ID NO: 881906 - DNA, 22 bp, Artificial Sequence
  chemically synthesized
agaaattggcatagtcactcca

SEQ ID NO: 881907 - DNA, 22 bp, Artificial Sequence
  chemically synthesized
gcatagtcactccaacctttca

SEQ ID NO: 881908 - DNA, 22 bp, Artificial Sequence
  chemically synthesized
accgatcagagtagtaactgtt

SEQ ID NO: 881909 - DNA, 22 bp, Artificial Sequence
  chemically synthesized
caacctttcaacagttactact

SEQ ID NO: 881910 - DNA, 22 bp, Artificial Sequence
  chemically synthesized
ctgaccgatcagagtagtaact

SEQ ID NO: 881911 - DNA, 22 bp, Artificial Sequence
  chemically synthesized
tcaacagttactactctgatcg

SEQ ID NO: 881912 - DNA, 22 bp, Artificial Sequence
  chemically synthesized
caacagttactactctgatcgg

SEQ ID NO: 881913 - DNA, 22 bp, Artificial Sequence
  chemically synthesized
aacagttactactctgatcggt

SEQ ID NO: 881914 - DNA, 22 bp, Artificial Sequence
  chemically synthesized
acggagatagctgctgaccgat

SEQ ID NO: 881915 - DNA, 22 bp, Artificial Sequence
  chemically synthesized
gacggagatagctgctgaccga

SEQ ID NO: 881916 - DNA, 22 bp, Artificial Sequence
  chemically synthesized
ctactctgatcggtcagcagct

SEQ ID NO: 881917 - DNA, 22 bp, Artificial Sequence
  chemically synthesized
ccttgacggagatagctgctga

SEQ ID NO: 881918 - DNA, 22 bp, Artificial Sequence
  chemically synthesized
gccttgacggagatagctgctg

SEQ ID NO: 881919 - DNA, 22 bp, Artificial Sequence
  chemically synthesized
ctctgatcggtcagcagctatc

SEQ ID NO: 881920 - DNA, 22 bp, Artificial Sequence
  chemically synthesized
tgatcggtcagcagctatctcc

SEQ ID NO: 881921 - DNA, 22 bp, Artificial Sequence
  chemically synthesized
atcggtcagcagctatctccgt

SEQ ID NO: 881922 - DNA, 22 bp, Artificial Sequence
  chemically synthesized
atggagggtcttgccttgacgg

SEQ ID NO: 881923 - DNA, 22 bp, Artificial Sequence
  chemically synthesized
ctgatggagggtcttgccttga

SEQ ID NO: 881924 - DNA, 22 bp, Artificial Sequence
  chemically synthesized
gctgatggagggtcttgccttg

SEQ ID NO: 881925 - DNA, 22 bp, Artificial Sequence
  chemically synthesized
tgctgatggagggtcttgcctt

SEQ ID NO: 881926 - DNA, 22 bp, Artificial Sequence
  chemically synthesized
ttgctgatggagggtcttgcct

SEQ ID NO: 881927 - DNA, 22 bp, Artificial Sequence
  chemically synthesized
tttgctgatggagggtcttgcc

SEQ ID NO: 881928 - DNA, 22 bp, Artificial Sequence
  chemically synthesized
tctccgtcaaggcaagaccctc

SEQ ID NO: 881929 - DNA, 22 bp, Artificial Sequence
  chemically synthesized
atctttttgctgatggagggtc

SEQ ID NO: 881930 - DNA, 22 bp, Artificial Sequence
  chemically synthesized
cgtcaaggcaagaccctccatc

SEQ ID NO: 881931 - DNA, 22 bp, Artificial Sequence
  chemically synthesized
aatctttttgctgatggagggt

SEQ ID NO: 881932 - DNA, 22 bp, Artificial Sequence
  chemically synthesized
aatgagtcttaatctttttgct

SEQ ID NO: 881933 - DNA, 22 bp, Artificial Sequence
  chemically synthesized
caatgagtcttaatctttttgc

SEQ ID NO: 881934 - DNA, 22 bp, Artificial Sequence
  chemically synthesized
agccttcaatgagtcttaatct

SEQ ID NO: 881935 - DNA, 22 bp, Artificial Sequence
  chemically synthesized
catcagcaaaaagattaagact

SEQ ID NO: 881936 - DNA, 22 bp, Artificial Sequence
  chemically synthesized
gcagtcatctgagccttcaatg

SEQ ID NO: 881937 - DNA, 22 bp, Artificial Sequence
  chemically synthesized
ctagcagtcatctgagccttca

SEQ ID NO: 881938 - DNA, 22 bp, Artificial Sequence
  chemically synthesized
gctagcagtcatctgagccttc

SEQ ID NO: 881939 - DNA, 22 bp, Artificial Sequence
  chemically synthesized
agactcattgaaggctcagatg

SEQ ID NO: 881940 - DNA, 22 bp, Artificial Sequence
  chemically synthesized
aagcttgctagcagtcatctga

SEQ ID NO: 881941 - DNA, 22 bp, Artificial Sequence
  chemically synthesized
attgaaggctcagatgactgct

SEQ ID NO: 881942 - DNA, 22 bp, Artificial Sequence
  chemically synthesized
ctaaagcttgctagcagtcatc

SEQ ID NO: 881943 - DNA, 22 bp, Artificial Sequence
  chemically synthesized
ttgctaaagcttgctagcagtc

SEQ ID NO: 881944 - DNA, 22 bp, Artificial Sequence
  chemically synthesized
aaggctcagatgactgctagca

SEQ ID NO: 881945 - DNA, 22 bp, Artificial Sequence
  chemically synthesized
gttgctaaagcttgctagcagt

SEQ ID NO: 881946 - DNA, 22 bp, Artificial Sequence
  chemically synthesized
tgttgctaaagcttgctagcag

SEQ ID NO: 881947 - DNA, 22 bp, Artificial Sequence
  chemically synthesized
agatgactgctagcaagcttta

SEQ ID NO: 881948 - DNA, 22 bp, Artificial Sequence
  chemically synthesized
aaaaaatactttgttgctaaag

SEQ ID NO: 881949 - DNA, 22 bp, Artificial Sequence
  chemically synthesized
aaaaaaatactttgttgctaaa

SEQ ID NO: 881950 - DNA, 22 bp, Artificial Sequence
  chemically synthesized
ctagcaagctttagcaacaaag

SEQ ID NO: 881951 - DNA, 22 bp, Artificial Sequence
  chemically synthesized
tttaaaaaaatactttgttgct

SEQ ID NO: 881952 - DNA, 22 bp, Artificial Sequence
  chemically synthesized
gcaagctttagcaacaaagtat

SEQ ID NO: 881953 - DNA, 22 bp, Artificial Sequence
  chemically synthesized
aaattatttaaaaaaatacttt

SEQ ID NO: 881954 - DNA, 22 bp, Artificial Sequence
  chemically synthesized
tagcaacaaagtatttttttaa

SEQ ID NO: 881955 - DNA, 22 bp, Artificial Sequence
  chemically synthesized
agcaacaaagtatttttttaaa

SEQ ID NO: 881956 - DNA, 22 bp, Artificial Sequence
  chemically synthesized
gcaacaaagtatttttttaaat

SEQ ID NO: 881957 - DNA, 22 bp, Artificial Sequence
  chemically synthesized
aaacaatagttgaaattattta

SEQ ID NO: 881958 - DNA, 22 bp, Artificial Sequence
  chemically synthesized
aatctaaaacaatagttgaaat

SEQ ID NO: 881959 - DNA, 22 bp, Artificial Sequence
  chemically synthesized
aaatctaaaacaatagttgaaa

SEQ ID NO: 881960 - DNA, 22 bp, Artificial Sequence
  chemically synthesized
ttttaaataatttcaactattg

SEQ ID NO: 881961 - DNA, 22 bp, Artificial Sequence
  chemically synthesized
tttaaataatttcaactattgt

SEQ ID NO: 881962 - DNA, 22 bp, Artificial Sequence
  chemically synthesized
ttaaataatttcaactattgtt

SEQ ID NO: 881963 - DNA, 22 bp, Artificial Sequence
  chemically synthesized
taaataatttcaactattgttt

SEQ ID NO: 881964 - DNA, 22 bp, Artificial Sequence
  chemically synthesized
aaataatttcaactattgtttt

SEQ ID NO: 881965 - DNA, 22 bp, Artificial Sequence
  chemically synthesized
aataatttcaactattgtttta

SEQ ID NO: 881966 - DNA, 22 bp, Artificial Sequence
  chemically synthesized
cacatgtaccccttaaatctaa

SEQ ID NO: 881967 - DNA, 22 bp, Artificial Sequence
  chemically synthesized
caactattgttttagatttaag

SEQ ID NO: 881968 - DNA, 22 bp, Artificial Sequence
  chemically synthesized
aactattgttttagatttaagg

SEQ ID NO: 881969 - DNA, 22 bp, Artificial Sequence
  chemically synthesized
ttgttttagatttaaggggtac

SEQ ID NO: 881970 - DNA, 22 bp, Artificial Sequence
  chemically synthesized
ttttagatttaaggggtacatg

SEQ ID NO: 881971 - DNA, 22 bp, Artificial Sequence
  chemically synthesized
tagatttaaggggtacatgtgc

SEQ ID NO: 881972 - DNA, 22 bp, Artificial Sequence
  chemically synthesized
agatttaaggggtacatgtgca

SEQ ID NO: 881973 - DNA, 22 bp, Artificial Sequence
  chemically synthesized
gatttaaggggtacatgtgcag

SEQ ID NO: 881974 - DNA, 22 bp, Artificial Sequence
  chemically synthesized
aaggggtacatgtgcaggtttg

SEQ ID NO: 881975 - DNA, 22 bp, Artificial Sequence
  chemically synthesized
aggggtacatgtgcaggtttgt

SEQ ID NO: 881976 - DNA, 22 bp, Artificial Sequence
  chemically synthesized
agtatcacccaataaatatata

SEQ ID NO: 881977 - DNA, 22 bp, Artificial Sequence
  chemically synthesized
gttacatttatatatttattgg

SEQ ID NO: 881978 - DNA, 22 bp, Artificial Sequence
  chemically synthesized
ttacatttatatatttattggg

SEQ ID NO: 881979 - DNA, 22 bp, Artificial Sequence
  chemically synthesized
catttatatatttattgggtga

SEQ ID NO: 881980 - DNA, 22 bp, Artificial Sequence
  chemically synthesized
caaacctcagtatcacccaata

SEQ ID NO: 881981 - DNA, 22 bp, Artificial Sequence
  chemically synthesized
atatatttattgggtgatactg

SEQ ID NO: 881982 - DNA, 22 bp, Artificial Sequence
  chemically synthesized
tatatttattgggtgatactga

SEQ ID NO: 881983 - DNA, 22 bp, Artificial Sequence
  chemically synthesized
attgggtgatactgaggtttgg

SEQ ID NO: 881984 - DNA, 22 bp, Artificial Sequence
  chemically synthesized
ttgggtgatactgaggtttgga

SEQ ID NO: 881985 - DNA, 22 bp, Artificial Sequence
  chemically synthesized
ggtgatactgaggtttggagta

SEQ ID NO: 881986 - DNA, 22 bp, Artificial Sequence
  chemically synthesized
agtgacaggatccatcatactc

SEQ ID NO: 881987 - DNA, 22 bp, Artificial Sequence
  chemically synthesized
tctcagtgacaggatccatcat

SEQ ID NO: 881988 - DNA, 22 bp, Artificial Sequence
  chemically synthesized
aggtttggagtatgatggatcc

SEQ ID NO: 881989 - DNA, 22 bp, Artificial Sequence
  chemically synthesized
ggagtatgatggatcctgtcac

SEQ ID NO: 881990 - DNA, 22 bp, Artificial Sequence
  chemically synthesized
gagtatgatggatcctgtcact

SEQ ID NO: 881991 - DNA, 22 bp, Artificial Sequence
  chemically synthesized
gatacggtgcgcactatctcag

SEQ ID NO: 881992 - DNA, 22 bp, Artificial Sequence
  chemically synthesized
ttagatacggtgcgcactatct

SEQ ID NO: 881993 - DNA, 22 bp, Artificial Sequence
  chemically synthesized
actattagatacggtgcgcact

SEQ ID NO: 881994 - DNA, 22 bp, Artificial Sequence
  chemically synthesized
tcactgagatagtgcgcaccgt

SEQ ID NO: 881995 - DNA, 22 bp, Artificial Sequence
  chemically synthesized
agatagtgcgcaccgtatctaa

SEQ ID NO: 881996 - DNA, 22 bp, Artificial Sequence
  chemically synthesized
aaaaactaactattagatacgg

SEQ ID NO: 881997 - DNA, 22 bp, Artificial Sequence
  chemically synthesized
atagttagtttttcaactcttg

SEQ ID NO: 881998 - DNA, 22 bp, Artificial Sequence
  chemically synthesized
gtttttcaactcttgccccttc

SEQ ID NO: 881999 - DNA, 22 bp, Artificial Sequence
  chemically synthesized
ttcaactcttgccccttcctta

SEQ ID NO: 882000 - DNA, 22 bp, Artificial Sequence
  chemically synthesized
tcaactcttgccccttccttat

SEQ ID NO: 882001 - DNA, 22 bp, Artificial Sequence
  chemically synthesized
gtaggggaagagataaggaagg

SEQ ID NO: 882002 - DNA, 22 bp, Artificial Sequence
  chemically synthesized
caactcttgccccttccttatc

SEQ ID NO: 882003 - DNA, 22 bp, Artificial Sequence
  chemically synthesized
aactcttgccccttccttatct

SEQ ID NO: 882004 - DNA, 22 bp, Artificial Sequence
  chemically synthesized
ttgccccttccttatctcttcc

SEQ ID NO: 882005 - DNA, 22 bp, Artificial Sequence
  chemically synthesized
gaaactagtaggggaagagata

SEQ ID NO: 882006 - DNA, 22 bp, Artificial Sequence
  chemically synthesized
gccccttccttatctcttcccc

SEQ ID NO: 882007 - DNA, 22 bp, Artificial Sequence
  chemically synthesized
ccccttccttatctcttcccct

SEQ ID NO: 882008 - DNA, 22 bp, Artificial Sequence
  chemically synthesized
ccttatctcttcccctactagt

SEQ ID NO: 882009 - DNA, 22 bp, Artificial Sequence
  chemically synthesized
cttatctcttcccctactagtt

SEQ ID NO: 882010 - DNA, 22 bp, Artificial Sequence
  chemically synthesized
atctcttcccctactagtttcc

SEQ ID NO: 882011 - DNA, 22 bp, Artificial Sequence
  chemically synthesized
tctcttcccctactagtttcca

SEQ ID NO: 882012 - DNA, 22 bp, Artificial Sequence
  chemically synthesized
ttcccctactagtttccagtat

SEQ ID NO: 882013 - DNA, 22 bp, Artificial Sequence
  chemically synthesized
cccctactagtttccagtatgt

SEQ ID NO: 882014 - DNA, 22 bp, Artificial Sequence
  chemically synthesized
ccctactagtttccagtatgta

SEQ ID NO: 882015 - DNA, 22 bp, Artificial Sequence
  chemically synthesized
ctagtttccagtatgtactgtt

SEQ ID NO: 882016 - DNA, 22 bp, Artificial Sequence
  chemically synthesized
gtttccagtatgtactgttgcc

SEQ ID NO: 882017 - DNA, 22 bp, Artificial Sequence
  chemically synthesized
atggacataaagatggcaacag

SEQ ID NO: 882018 - DNA, 22 bp, Artificial Sequence
  chemically synthesized
ccagtatgtactgttgccatct

SEQ ID NO: 882019 - DNA, 22 bp, Artificial Sequence
  chemically synthesized
cagtatgtactgttgccatctt

SEQ ID NO: 882020 - DNA, 22 bp, Artificial Sequence
  chemically synthesized
ggcactcatggacataaagatg

SEQ ID NO: 882021 - DNA, 22 bp, Artificial Sequence
  chemically synthesized
aacattgggcactcatggacat

SEQ ID NO: 882022 - DNA, 22 bp, Artificial Sequence
  chemically synthesized
ttgccatctttatgtccatgag

SEQ ID NO: 882023 - DNA, 22 bp, Artificial Sequence
  chemically synthesized
ccatctttatgtccatgagtgc

SEQ ID NO: 882024 - DNA, 22 bp, Artificial Sequence
  chemically synthesized
tatgtccatgagtgcccaatgt

SEQ ID NO: 882025 - DNA, 22 bp, Artificial Sequence
  chemically synthesized
atgtccatgagtgcccaatgtt

SEQ ID NO: 882026 - DNA, 22 bp, Artificial Sequence
  chemically synthesized
taagtgggcctaaacattgggc

SEQ ID NO: 882027 - DNA, 22 bp, Artificial Sequence
  chemically synthesized
tgtccatgagtgcccaatgttt

SEQ ID NO: 882028 - DNA, 22 bp, Artificial Sequence
  chemically synthesized
ataagtgggcctaaacattggg

SEQ ID NO: 882029 - DNA, 22 bp, Artificial Sequence
  chemically synthesized
acttataagtgggcctaaacat

SEQ ID NO: 882030 - DNA, 22 bp, Artificial Sequence
  chemically synthesized
tcacttataagtgggcctaaac

SEQ ID NO: 882031 - DNA, 22 bp, Artificial Sequence
  chemically synthesized
ttctcacttataagtgggccta

SEQ ID NO: 882032 - DNA, 22 bp, Artificial Sequence
  chemically synthesized
gttctcacttataagtgggcct

SEQ ID NO: 882033 - DNA, 22 bp, Artificial Sequence
  chemically synthesized
tgttctcacttataagtgggcc

SEQ ID NO: 882034 - DNA, 22 bp, Artificial Sequence
  chemically synthesized
aggcccacttataagtgagaac

SEQ ID NO: 882035 - DNA, 22 bp, Artificial Sequence
  chemically synthesized
ggcccacttataagtgagaaca

SEQ ID NO: 882036 - DNA, 22 bp, Artificial Sequence
  chemically synthesized
ataagtgagaacaaagtggtat

SEQ ID NO: 882037 - DNA, 22 bp, Artificial Sequence
  chemically synthesized
taagtgagaacaaagtggtatt

SEQ ID NO: 882038 - DNA, 22 bp, Artificial Sequence
  chemically synthesized
gtaggaacagaaaaccaaatac

SEQ ID NO: 882039 - DNA, 22 bp, Artificial Sequence
  chemically synthesized
tcgtaaatgaattagtaggaac

SEQ ID NO: 882040 - DNA, 22 bp, Artificial Sequence
  chemically synthesized
ggttttctgttcctactaattc

SEQ ID NO: 882041 - DNA, 22 bp, Artificial Sequence
  chemically synthesized
gttttctgttcctactaattca

SEQ ID NO: 882042 - DNA, 22 bp, Artificial Sequence
  chemically synthesized
tctgttcctactaattcattta

SEQ ID NO: 882043 - DNA, 22 bp, Artificial Sequence
  chemically synthesized
ctgttcctactaattcatttac

SEQ ID NO: 882044 - DNA, 22 bp, Artificial Sequence
  chemically synthesized
gaggccattatcgtaaatgaat

SEQ ID NO: 882045 - DNA, 22 bp, Artificial Sequence
  chemically synthesized
tgttcctactaattcatttacg

SEQ ID NO: 882046 - DNA, 22 bp, Artificial Sequence
  chemically synthesized
ttcctactaattcatttacgat

SEQ ID NO: 882047 - DNA, 22 bp, Artificial Sequence
  chemically synthesized
ctactaattcatttacgataat

SEQ ID NO: 882048 - DNA, 22 bp, Artificial Sequence
  chemically synthesized
ctaattcatttacgataatggc

SEQ ID NO: 882049 - DNA, 22 bp, Artificial Sequence
  chemically synthesized
attcatttacgataatggcctc

SEQ ID NO: 882050 - DNA, 22 bp, Artificial Sequence
  chemically synthesized
atttacgataatggcctccagt

SEQ ID NO: 882051 - DNA, 22 bp, Artificial Sequence
  chemically synthesized
acgataatggcctccagttgca

SEQ ID NO: 882052 - DNA, 22 bp, Artificial Sequence
  chemically synthesized
tagcaacatgcatgcaactgga

SEQ ID NO: 882053 - DNA, 22 bp, Artificial Sequence
  chemically synthesized
cgataatggcctccagttgcat

SEQ ID NO: 882054 - DNA, 22 bp, Artificial Sequence
  chemically synthesized
gtagcaacatgcatgcaactgg

SEQ ID NO: 882055 - DNA, 22 bp, Artificial Sequence
  chemically synthesized
tgtagcaacatgcatgcaactg

SEQ ID NO: 882056 - DNA, 22 bp, Artificial Sequence
  chemically synthesized
tgtcctttgtagcaacatgcat

SEQ ID NO: 882057 - DNA, 22 bp, Artificial Sequence
  chemically synthesized
cagttgcatgcatgttgctaca

SEQ ID NO: 882058 - DNA, 22 bp, Artificial Sequence
  chemically synthesized
catgcatgttgctacaaaggac

SEQ ID NO: 882059 - DNA, 22 bp, Artificial Sequence
  chemically synthesized
aaaagaatgaaattatgtcctt

SEQ ID NO: 882060 - DNA, 22 bp, Artificial Sequence
  chemically synthesized
ctacaaaggacataatttcatt

SEQ ID NO: 882061 - DNA, 22 bp, Artificial Sequence
  chemically synthesized
caaaggacataatttcattctt

SEQ ID NO: 882062 - DNA, 22 bp, Artificial Sequence
  chemically synthesized
cacaaccattaaaaagaatgaa

SEQ ID NO: 882063 - DNA, 22 bp, Artificial Sequence
  chemically synthesized
cattctttttaatggttgtgta

SEQ ID NO: 882064 - DNA, 22 bp, Artificial Sequence
  chemically synthesized
attctttttaatggttgtgtag

SEQ ID NO: 882065 - DNA, 22 bp, Artificial Sequence
  chemically synthesized
tttttaatggttgtgtagtatt

SEQ ID NO: 882066 - DNA, 22 bp, Artificial Sequence
  chemically synthesized
tttaatggttgtgtagtatttc

SEQ ID NO: 882067 - DNA, 22 bp, Artificial Sequence
  chemically synthesized
ttaatggttgtgtagtatttca

SEQ ID NO: 882068 - DNA, 22 bp, Artificial Sequence
  chemically synthesized
taatggttgtgtagtatttcat

SEQ ID NO: 882069 - DNA, 22 bp, Artificial Sequence
  chemically synthesized
aatggttgtgtagtatttcata

SEQ ID NO: 882070 - DNA, 22 bp, Artificial Sequence
  chemically synthesized
atggttgtgtagtatttcatat

SEQ ID NO: 882071 - DNA, 22 bp, Artificial Sequence
  chemically synthesized
tgtagtatttcatattgtatgt

SEQ ID NO: 882072 - DNA, 22 bp, Artificial Sequence
  chemically synthesized
gatgaagaaaatgtggtacaca

SEQ ID NO: 882073 - DNA, 22 bp, Artificial Sequence
  chemically synthesized
catattgtatgtgtaccacatt

SEQ ID NO: 882074 - DNA, 22 bp, Artificial Sequence
  chemically synthesized
atattgtatgtgtaccacattt

SEQ ID NO: 882075 - DNA, 22 bp, Artificial Sequence
  chemically synthesized
tatgtgtaccacattttcttca

SEQ ID NO: 882076 - DNA, 22 bp, Artificial Sequence
  chemically synthesized
gatgaccatcaatggtggactg

SEQ ID NO: 882077 - DNA, 22 bp, Artificial Sequence
  chemically synthesized
tcttcatccagtccaccattga

SEQ ID NO: 882078 - DNA, 22 bp, Artificial Sequence
  chemically synthesized
cttcatccagtccaccattgat

SEQ ID NO: 882079 - DNA, 22 bp, Artificial Sequence
  chemically synthesized
ttcatccagtccaccattgatg

SEQ ID NO: 882080 - DNA, 22 bp, Artificial Sequence
  chemically synthesized
catccagtccaccattgatggt

SEQ ID NO: 882081 - DNA, 22 bp, Artificial Sequence
  chemically synthesized
atccagtccaccattgatggtc

SEQ ID NO: 882082 - DNA, 22 bp, Artificial Sequence
  chemically synthesized
atggtcatctaggttgattcct

SEQ ID NO: 882083 - DNA, 22 bp, Artificial Sequence
  chemically synthesized
acaatagaaaagccaaggaatc

SEQ ID NO: 882084 - DNA, 22 bp, Artificial Sequence
  chemically synthesized
ttcacaatagaaaagccaagga

SEQ ID NO: 882085 - DNA, 22 bp, Artificial Sequence
  chemically synthesized
ggttgattccttggcttttcta

SEQ ID NO: 882086 - DNA, 22 bp, Artificial Sequence
  chemically synthesized
cagcactattcacaatagaaaa

SEQ ID NO: 882087 - DNA, 22 bp, Artificial Sequence
  chemically synthesized
attccttggcttttctattgtg

SEQ ID NO: 882088 - DNA, 22 bp, Artificial Sequence
  chemically synthesized
actgcagcactattcacaatag

SEQ ID NO: 882089 - DNA, 22 bp, Artificial Sequence
  chemically synthesized
cttggcttttctattgtgaata

SEQ ID NO: 882090 - DNA, 22 bp, Artificial Sequence
  chemically synthesized
ggcttttctattgtgaatagtg

SEQ ID NO: 882091 - DNA, 22 bp, Artificial Sequence
  chemically synthesized
gcttttctattgtgaatagtgc

SEQ ID NO: 882092 - DNA, 22 bp, Artificial Sequence
  chemically synthesized
tatgttcactgcagcactattc

SEQ ID NO: 882093 - DNA, 22 bp, Artificial Sequence
  chemically synthesized
gtatgttcactgcagcactatt

SEQ ID NO: 882094 - DNA, 22 bp, Artificial Sequence
  chemically synthesized
ttctattgtgaatagtgctgca

SEQ ID NO: 882095 - DNA, 22 bp, Artificial Sequence
  chemically synthesized
tctattgtgaatagtgctgcag

SEQ ID NO: 882096 - DNA, 22 bp, Artificial Sequence
  chemically synthesized
ctattgtgaatagtgctgcagt

SEQ ID NO: 882097 - DNA, 22 bp, Artificial Sequence
  chemically synthesized
tattgtgaatagtgctgcagtg

SEQ ID NO: 882098 - DNA, 22 bp, Artificial Sequence
  chemically synthesized
ttgtgaatagtgctgcagtgaa

SEQ ID NO: 882099 - DNA, 22 bp, Artificial Sequence
  chemically synthesized
tgaatagtgctgcagtgaacat

SEQ ID NO: 882100 - DNA, 22 bp, Artificial Sequence
  chemically synthesized
ccaaaaagacacatgcacttgt

SEQ ID NO: 882101 - DNA, 22 bp, Artificial Sequence
  chemically synthesized
cagtgaacatacaagtgcatgt

SEQ ID NO: 882102 - DNA, 22 bp, Artificial Sequence
  chemically synthesized
taccaaaaagacacatgcactt

SEQ ID NO: 882103 - DNA, 22 bp, Artificial Sequence
  chemically synthesized
tttggtagaatgatttatttac

SEQ ID NO: 882104 - DNA, 22 bp, Artificial Sequence
  chemically synthesized
ttggtagaatgatttatttact

SEQ ID NO: 882105 - DNA, 22 bp, Artificial Sequence
  chemically synthesized
tggtagaatgatttatttactt

SEQ ID NO: 882106 - DNA, 22 bp, Artificial Sequence
  chemically synthesized
ggtagaatgatttatttacttt

SEQ ID NO: 882107 - DNA, 22 bp, Artificial Sequence
  chemically synthesized
agtatatatccaaaagtaaata

SEQ ID NO: 882108 - DNA, 22 bp, Artificial Sequence
  chemically synthesized
gtagaatgatttatttactttt

SEQ ID NO: 882109 - DNA, 22 bp, Artificial Sequence
  chemically synthesized
ctgagtatatatccaaaagtaa

SEQ ID NO: 882110 - DNA, 22 bp, Artificial Sequence
  chemically synthesized
atttacttttggatatatactc

SEQ ID NO: 882111 - DNA, 22 bp, Artificial Sequence
  chemically synthesized
tttacttttggatatatactca

SEQ ID NO: 882112 - DNA, 22 bp, Artificial Sequence
  chemically synthesized
acttttggatatatactcagta

SEQ ID NO: 882113 - DNA, 22 bp, Artificial Sequence
  chemically synthesized
cttttggatatatactcagtaa

SEQ ID NO: 882114 - DNA, 22 bp, Artificial Sequence
  chemically synthesized
ttggatatatactcagtaatgg

SEQ ID NO: 882115 - DNA, 22 bp, Artificial Sequence
  chemically synthesized
aacccagcaatcccattactga

SEQ ID NO: 882116 - DNA, 22 bp, Artificial Sequence
  chemically synthesized
tggatatatactcagtaatggg

SEQ ID NO: 882117 - DNA, 22 bp, Artificial Sequence
  chemically synthesized
ggatatatactcagtaatggga

SEQ ID NO: 882118 - DNA, 22 bp, Artificial Sequence
  chemically synthesized
gatatatactcagtaatgggat

SEQ ID NO: 882119 - DNA, 22 bp, Artificial Sequence
  chemically synthesized
tcattcaacccagcaatcccat

SEQ ID NO: 882120 - DNA, 22 bp, Artificial Sequence
  chemically synthesized
agtaatgggattgctgggttga

SEQ ID NO: 882121 - DNA, 22 bp, Artificial Sequence
  chemically synthesized
aaatgcactgtcattcaaccca

SEQ ID NO: 882122 - DNA, 22 bp, Artificial Sequence
  chemically synthesized
aaaatgcactgtcattcaaccc

SEQ ID NO: 882123 - DNA, 22 bp, Artificial Sequence
  chemically synthesized
aacttaaaatgcactgtcattc

SEQ ID NO: 882124 - DNA, 22 bp, Artificial Sequence
  chemically synthesized
tcaacttaaaatgcactgtcat

SEQ ID NO: 882125 - DNA, 22 bp, Artificial Sequence
  chemically synthesized
ctcaacttaaaatgcactgtca

SEQ ID NO: 882126 - DNA, 22 bp, Artificial Sequence
  chemically synthesized
ctgggttgaatgacagtgcatt

SEQ ID NO: 882127 - DNA, 22 bp, Artificial Sequence
  chemically synthesized
ggttgaatgacagtgcatttta

SEQ ID NO: 882128 - DNA, 22 bp, Artificial Sequence
  chemically synthesized
gggatttctcaacttaaaatgc

SEQ ID NO: 882129 - DNA, 22 bp, Artificial Sequence
  chemically synthesized
ggggatttctcaacttaaaatg

SEQ ID NO: 882130 - DNA, 22 bp, Artificial Sequence
  chemically synthesized
aatgacagtgcattttaagttg

SEQ ID NO: 882131 - DNA, 22 bp, Artificial Sequence
  chemically synthesized
tggaaagcagtttggggatttc

SEQ ID NO: 882132 - DNA, 22 bp, Artificial Sequence
  chemically synthesized
taagttgagaaatccccaaact

SEQ ID NO: 882133 - DNA, 22 bp, Artificial Sequence
  chemically synthesized
aagttgagaaatccccaaactg

SEQ ID NO: 882134 - DNA, 22 bp, Artificial Sequence
  chemically synthesized
agttgagaaatccccaaactgc

SEQ ID NO: 882135 - DNA, 22 bp, Artificial Sequence
  chemically synthesized
acccactgtggaaagcagtttg

SEQ ID NO: 882136 - DNA, 22 bp, Artificial Sequence
  chemically synthesized
agaaatccccaaactgctttcc

SEQ ID NO: 882137 - DNA, 22 bp, Artificial Sequence
  chemically synthesized
gttcacccactgtggaaagcag

SEQ ID NO: 882138 - DNA, 22 bp, Artificial Sequence
  chemically synthesized
ctttccacagtgggtgaactaa

SEQ ID NO: 882139 - DNA, 22 bp, Artificial Sequence
  chemically synthesized
gtgggagtgtacattagttcac

SEQ ID NO: 882140 - DNA, 22 bp, Artificial Sequence
  chemically synthesized
tccacagtgggtgaactaatgt

SEQ ID NO: 882141 - DNA, 22 bp, Artificial Sequence
  chemically synthesized
ccacagtgggtgaactaatgta

SEQ ID NO: 882142 - DNA, 22 bp, Artificial Sequence
  chemically synthesized
ttggtgggagtgtacattagtt

SEQ ID NO: 882143 - DNA, 22 bp, Artificial Sequence
  chemically synthesized
cacagtgggtgaactaatgtac

SEQ ID NO: 882144 - DNA, 22 bp, Artificial Sequence
  chemically synthesized
tacgctgttggtgggagtgtac

SEQ ID NO: 882145 - DNA, 22 bp, Artificial Sequence
  chemically synthesized
atgtacactcccaccaacagcg

SEQ ID NO: 882146 - DNA, 22 bp, Artificial Sequence
  chemically synthesized
cagagaaaagggaacattatac

SEQ ID NO: 882147 - DNA, 22 bp, Artificial Sequence
  chemically synthesized
ccaccaacagcgtataatgttc

SEQ ID NO: 882148 - DNA, 22 bp, Artificial Sequence
  chemically synthesized
gtgaggctgcagagaaaaggga

SEQ ID NO: 882149 - DNA, 22 bp, Artificial Sequence
  chemically synthesized
ccttttctctgcagcctcacca

SEQ ID NO: 882150 - DNA, 22 bp, Artificial Sequence
  chemically synthesized
ttctctgcagcctcaccaacat

SEQ ID NO: 882151 - DNA, 22 bp, Artificial Sequence
  chemically synthesized
aaaacacaatagatgttggtga

SEQ ID NO: 882152 - DNA, 22 bp, Artificial Sequence
  chemically synthesized
tctctgcagcctcaccaacatc

SEQ ID NO: 882153 - DNA, 22 bp, Artificial Sequence
  chemically synthesized
ctctgcagcctcaccaacatct

SEQ ID NO: 882154 - DNA, 22 bp, Artificial Sequence
  chemically synthesized
tctgcagcctcaccaacatcta

SEQ ID NO: 882155 - DNA, 22 bp, Artificial Sequence
  chemically synthesized
tgcagcctcaccaacatctatt

SEQ ID NO: 882156 - DNA, 22 bp, Artificial Sequence
  chemically synthesized
cagcctcaccaacatctattgt

SEQ ID NO: 882157 - DNA, 22 bp, Artificial Sequence
  chemically synthesized
tcaaaaactcaaaacacaatag

SEQ ID NO: 882158 - DNA, 22 bp, Artificial Sequence
  chemically synthesized
ttatcaaaaactcaaaacacaa

SEQ ID NO: 882159 - DNA, 22 bp, Artificial Sequence
  chemically synthesized
accaacatctattgtgttttga

SEQ ID NO: 882160 - DNA, 22 bp, Artificial Sequence
  chemically synthesized
ttgtgttttgagtttttgataa

SEQ ID NO: 882161 - DNA, 22 bp, Artificial Sequence
  chemically synthesized
tgttttgagtttttgataatag

SEQ ID NO: 882162 - DNA, 22 bp, Artificial Sequence
  chemically synthesized
acaccagtcagaatgcctatta

SEQ ID NO: 882163 - DNA, 22 bp, Artificial Sequence
  chemically synthesized
tgagtttttgataataggcatt

SEQ ID NO: 882164 - DNA, 22 bp, Artificial Sequence
  chemically synthesized
gagtttttgataataggcattc

SEQ ID NO: 882165 - DNA, 22 bp, Artificial Sequence
  chemically synthesized
agtttttgataataggcattct

SEQ ID NO: 882166 - DNA, 22 bp, Artificial Sequence
  chemically synthesized
ttgataataggcattctgactg

SEQ ID NO: 882167 - DNA, 22 bp, Artificial Sequence
  chemically synthesized
tgataataggcattctgactgg

SEQ ID NO: 882168 - DNA, 22 bp, Artificial Sequence
  chemically synthesized
gataataggcattctgactggt

SEQ ID NO: 882169 - DNA, 22 bp, Artificial Sequence
  chemically synthesized
ataataggcattctgactggtg

SEQ ID NO: 882170 - DNA, 22 bp, Artificial Sequence
  chemically synthesized
tgactggtgtgagatggtatct

SEQ ID NO: 882171 - DNA, 22 bp, Artificial Sequence
  chemically synthesized
actggtgtgagatggtatctca

SEQ ID NO: 882172 - DNA, 22 bp, Artificial Sequence
  chemically synthesized
gtgtgagatggtatctcattgt

SEQ ID NO: 882173 - DNA, 22 bp, Artificial Sequence
  chemically synthesized
gagaaatgcaaatcaaaaccac

SEQ ID NO: 882174 - DNA, 22 bp, Artificial Sequence
  chemically synthesized
atcattagagaaatgcaaatca

SEQ ID NO: 882175 - DNA, 22 bp, Artificial Sequence
  chemically synthesized
attgtggttttgatttgcattt

SEQ ID NO: 882176 - DNA, 22 bp, Artificial Sequence
  chemically synthesized
tggttttgatttgcatttctct

SEQ ID NO: 882177 - DNA, 22 bp, Artificial Sequence
  chemically synthesized
cacatcactcatcattagagaa

SEQ ID NO: 882178 - DNA, 22 bp, Artificial Sequence
  chemically synthesized
tgatttgcatttctctaatgat

SEQ ID NO: 882179 - DNA, 22 bp, Artificial Sequence
  chemically synthesized
gatttgcatttctctaatgatg

SEQ ID NO: 882180 - DNA, 22 bp, Artificial Sequence
  chemically synthesized
atttgcatttctctaatgatga

SEQ ID NO: 882181 - DNA, 22 bp, Artificial Sequence
  chemically synthesized
gcatttctctaatgatgagtga

SEQ ID NO: 882182 - DNA, 22 bp, Artificial Sequence
  chemically synthesized
catttctctaatgatgagtgat

SEQ ID NO: 882183 - DNA, 22 bp, Artificial Sequence
  chemically synthesized
ctctaatgatgagtgatgtgga

SEQ ID NO: 882184 - DNA, 22 bp, Artificial Sequence
  chemically synthesized
tctaatgatgagtgatgtggag

SEQ ID NO: 882185 - DNA, 22 bp, Artificial Sequence
  chemically synthesized
taatgatgagtgatgtggagca

SEQ ID NO: 882186 - DNA, 22 bp, Artificial Sequence
  chemically synthesized
atgatgagtgatgtggagcatt

SEQ ID NO: 882187 - DNA, 22 bp, Artificial Sequence
  chemically synthesized
acagatatgaaaaaatgctcca

SEQ ID NO: 882188 - DNA, 22 bp, Artificial Sequence
  chemically synthesized
tttcatatctgttagccacccg

SEQ ID NO: 882189 - DNA, 22 bp, Artificial Sequence
  chemically synthesized
ttcatatctgttagccacccgt

SEQ ID NO: 882190 - DNA, 22 bp, Artificial Sequence
  chemically synthesized
aaaagaagacaaacgggtggct

SEQ ID NO: 882191 - DNA, 22 bp, Artificial Sequence
  chemically synthesized
tcatatctgttagccacccgtt

SEQ ID NO: 882192 - DNA, 22 bp, Artificial Sequence
  chemically synthesized
catatctgttagccacccgttt

SEQ ID NO: 882193 - DNA, 22 bp, Artificial Sequence
  chemically synthesized
tcaaaagaagacaaacgggtgg

SEQ ID NO: 882194 - DNA, 22 bp, Artificial Sequence
  chemically synthesized
atatctgttagccacccgtttg

SEQ ID NO: 882195 - DNA, 22 bp, Artificial Sequence
  chemically synthesized
ctcaaaagaagacaaacgggtg

SEQ ID NO: 882196 - DNA, 22 bp, Artificial Sequence
  chemically synthesized
ttagccacccgtttgtcttctt

SEQ ID NO: 882197 - DNA, 22 bp, Artificial Sequence
  chemically synthesized
gccacccgtttgtcttcttttg

SEQ ID NO: 882198 - DNA, 22 bp, Artificial Sequence
  chemically synthesized
gtcttcttttgagaagtatcta

SEQ ID NO: 882199 - DNA, 22 bp, Artificial Sequence
  chemically synthesized
tcttcttttgagaagtatctat

SEQ ID NO: 882200 - DNA, 22 bp, Artificial Sequence
  chemically synthesized
cttttgagaagtatctatatat

SEQ ID NO: 882201 - DNA, 22 bp, Artificial Sequence
  chemically synthesized
ttttgagaagtatctatatatt

SEQ ID NO: 882202 - DNA, 22 bp, Artificial Sequence
  chemically synthesized
ttgagaagtatctatatattca

SEQ ID NO: 882203 - DNA, 22 bp, Artificial Sequence
  chemically synthesized
tgagaagtatctatatattcat

SEQ ID NO: 882204 - DNA, 22 bp, Artificial Sequence
  chemically synthesized
gagaagtatctatatattcatg

SEQ ID NO: 882205 - DNA, 22 bp, Artificial Sequence
  chemically synthesized
agaagtatctatatattcatgt

SEQ ID NO: 882206 - DNA, 22 bp, Artificial Sequence
  chemically synthesized
tatattcatgtcttttgcccac

SEQ ID NO: 882207 - DNA, 22 bp, Artificial Sequence
  chemically synthesized
atgtcttttgcccactttttac

SEQ ID NO: 882208 - DNA, 22 bp, Artificial Sequence
  chemically synthesized
ttgcccactttttacatggggt

SEQ ID NO: 882209 - DNA, 22 bp, Artificial Sequence
  chemically synthesized
tgcccactttttacatggggtt

SEQ ID NO: 882210 - DNA, 22 bp, Artificial Sequence
  chemically synthesized
gcccactttttacatggggtta

SEQ ID NO: 882211 - DNA, 22 bp, Artificial Sequence
  chemically synthesized
cccactttttacatggggttat

SEQ ID NO: 882212 - DNA, 22 bp, Artificial Sequence
  chemically synthesized
acaagcaaaacgcagataaccc

SEQ ID NO: 882213 - DNA, 22 bp, Artificial Sequence
  chemically synthesized
aacaagcaaaacgcagataacc

SEQ ID NO: 882214 - DNA, 22 bp, Artificial Sequence
  chemically synthesized
tttacatggggttatctgcgtt

SEQ ID NO: 882215 - DNA, 22 bp, Artificial Sequence
  chemically synthesized
ttacatggggttatctgcgttt

SEQ ID NO: 882216 - DNA, 22 bp, Artificial Sequence
  chemically synthesized
tacatggggttatctgcgtttt

SEQ ID NO: 882217 - DNA, 22 bp, Artificial Sequence
  chemically synthesized
acatggggttatctgcgttttg

SEQ ID NO: 882218 - DNA, 22 bp, Artificial Sequence
  chemically synthesized
catggggttatctgcgttttgc

SEQ ID NO: 882219 - DNA, 22 bp, Artificial Sequence
  chemically synthesized
tagggaacttaacaagcaaaac

SEQ ID NO: 882220 - DNA, 22 bp, Artificial Sequence
  chemically synthesized
tctgcgttttgcttgttaagtt

SEQ ID NO: 882221 - DNA, 22 bp, Artificial Sequence
  chemically synthesized
cgttttgcttgttaagttccct

SEQ ID NO: 882222 - DNA, 22 bp, Artificial Sequence
  chemically synthesized
atatccataatctatagggaac

SEQ ID NO: 882223 - DNA, 22 bp, Artificial Sequence
  chemically synthesized
tgcttgttaagttccctataga

SEQ ID NO: 882224 - DNA, 22 bp, Artificial Sequence
  chemically synthesized
gcttgttaagttccctatagat

SEQ ID NO: 882225 - DNA, 22 bp, Artificial Sequence
  chemically synthesized
cttgttaagttccctatagatt

SEQ ID NO: 882226 - DNA, 22 bp, Artificial Sequence
  chemically synthesized
gttaagttccctatagattatg

SEQ ID NO: 882227 - DNA, 22 bp, Artificial Sequence
  chemically synthesized
ttaagttccctatagattatgg

SEQ ID NO: 882228 - DNA, 22 bp, Artificial Sequence
  chemically synthesized
agttccctatagattatggata

SEQ ID NO: 882229 - DNA, 22 bp, Artificial Sequence
  chemically synthesized
cctatagattatggatattaga

SEQ ID NO: 882230 - DNA, 22 bp, Artificial Sequence
  chemically synthesized
tccatcagacaaagatctaata

SEQ ID NO: 882231 - DNA, 22 bp, Artificial Sequence
  chemically synthesized
tagattatggatattagatctt

SEQ ID NO: 882232 - DNA, 22 bp, Artificial Sequence
  chemically synthesized
tggatattagatctttgtctga

SEQ ID NO: 882233 - DNA, 22 bp, Artificial Sequence
  chemically synthesized
gatctttgtctgatggatagtt

SEQ ID NO: 882234 - DNA, 22 bp, Artificial Sequence
  chemically synthesized
tgtctgatggatagtttgtgta

SEQ ID NO: 882235 - DNA, 22 bp, Artificial Sequence
  chemically synthesized
gtctgatggatagtttgtgtat

SEQ ID NO: 882236 - DNA, 22 bp, Artificial Sequence
  chemically synthesized
tctgatggatagtttgtgtata

SEQ ID NO: 882237 - DNA, 22 bp, Artificial Sequence
  chemically synthesized
atggatagtttgtgtatatttt

SEQ ID NO: 882238 - DNA, 22 bp, Artificial Sequence
  chemically synthesized
gtgtatattttctctcatcttg

SEQ ID NO: 882239 - DNA, 22 bp, Artificial Sequence
  chemically synthesized
tgtatattttctctcatcttgt

SEQ ID NO: 882240 - DNA, 22 bp, Artificial Sequence
  chemically synthesized
tctctcatcttgtgggttgtct

SEQ ID NO: 882241 - DNA, 22 bp, Artificial Sequence
  chemically synthesized
ctctcatcttgtgggttgtctg

SEQ ID NO: 882242 - DNA, 22 bp, Artificial Sequence
  chemically synthesized
tctcatcttgtgggttgtctgt

SEQ ID NO: 882243 - DNA, 22 bp, Artificial Sequence
  chemically synthesized
tcaacagagtaaacagacaacc

SEQ ID NO: 882244 - DNA, 22 bp, Artificial Sequence
  chemically synthesized
tcatcttgtgggttgtctgttt

SEQ ID NO: 882245 - DNA, 22 bp, Artificial Sequence
  chemically synthesized
atcttgtgggttgtctgtttac

SEQ ID NO: 882246 - DNA, 22 bp, Artificial Sequence
  chemically synthesized
gtgggttgtctgtttactctgt

SEQ ID NO: 882247 - DNA, 22 bp, Artificial Sequence
  chemically synthesized
tgggttgtctgtttactctgtt

SEQ ID NO: 882248 - DNA, 22 bp, Artificial Sequence
  chemically synthesized
tctgtttactctgttgatagtt

SEQ ID NO: 882249 - DNA, 22 bp, Artificial Sequence
  chemically synthesized
cacagcaaaagaaactatcaac

SEQ ID NO: 882250 - DNA, 22 bp, Artificial Sequence
  chemically synthesized
tacacagcaaaagaaactatca

SEQ ID NO: 882251 - DNA, 22 bp, Artificial Sequence
  chemically synthesized
ctacacagcaaaagaaactatc

SEQ ID NO: 882252 - DNA, 22 bp, Artificial Sequence
  chemically synthesized
tttactctgttgatagtttctt

SEQ ID NO: 882253 - DNA, 22 bp, Artificial Sequence
  chemically synthesized
actctgttgatagtttcttttg

SEQ ID NO: 882254 - DNA, 22 bp, Artificial Sequence
  chemically synthesized
ctctgttgatagtttcttttgc

SEQ ID NO: 882255 - DNA, 22 bp, Artificial Sequence
  chemically synthesized
tgttgatagtttcttttgctgt

SEQ ID NO: 882256 - DNA, 22 bp, Artificial Sequence
  chemically synthesized
aagagcttctacacagcaaaag

SEQ ID NO: 882257 - DNA, 22 bp, Artificial Sequence
  chemically synthesized
ttgatagtttcttttgctgtgt

SEQ ID NO: 882258 - DNA, 22 bp, Artificial Sequence
  chemically synthesized
atagtttcttttgctgtgtaga

SEQ ID NO: 882259 - DNA, 22 bp, Artificial Sequence
  chemically synthesized
aactaaagagcttctacacagc

SEQ ID NO: 882260 - DNA, 22 bp, Artificial Sequence
  chemically synthesized
attaaactaaagagcttctaca

SEQ ID NO: 882261 - DNA, 22 bp, Artificial Sequence
  chemically synthesized
cttttgctgtgtagaagctctt

SEQ ID NO: 882262 - DNA, 22 bp, Artificial Sequence
  chemically synthesized
ttttgctgtgtagaagctcttt

SEQ ID NO: 882263 - DNA, 22 bp, Artificial Sequence
  chemically synthesized
ttgctgtgtagaagctctttag

SEQ ID NO: 882264 - DNA, 22 bp, Artificial Sequence
  chemically synthesized
tgctgtgtagaagctctttagt

SEQ ID NO: 882265 - DNA, 22 bp, Artificial Sequence
  chemically synthesized
gctgtgtagaagctctttagtt

SEQ ID NO: 882266 - DNA, 22 bp, Artificial Sequence
  chemically synthesized
ctgtgtagaagctctttagttt

SEQ ID NO: 882267 - DNA, 22 bp, Artificial Sequence
  chemically synthesized
tgtagaagctctttagtttaat

SEQ ID NO: 882268 - DNA, 22 bp, Artificial Sequence
  chemically synthesized
acaagtgggatctaattaaact

SEQ ID NO: 882269 - DNA, 22 bp, Artificial Sequence
  chemically synthesized
tttagtttaattagatcccact

SEQ ID NO: 882270 - DNA, 22 bp, Artificial Sequence
  chemically synthesized
tagtttaattagatcccacttg

SEQ ID NO: 882271 - DNA, 22 bp, Artificial Sequence
  chemically synthesized
agtttaattagatcccacttgt

SEQ ID NO: 882272 - DNA, 22 bp, Artificial Sequence
  chemically synthesized
gtttaattagatcccacttgtt

SEQ ID NO: 882273 - DNA, 22 bp, Artificial Sequence
  chemically synthesized
aattagatcccacttgttaatt

SEQ ID NO: 882274 - DNA, 22 bp, Artificial Sequence
  chemically synthesized
attagatcccacttgttaattt

SEQ ID NO: 882275 - DNA, 22 bp, Artificial Sequence
  chemically synthesized
gatcccacttgttaatttttgg

SEQ ID NO: 882276 - DNA, 22 bp, Artificial Sequence
  chemically synthesized
aaagcaaatgtaacaaaaccaa

SEQ ID NO: 882277 - DNA, 22 bp, Artificial Sequence
  chemically synthesized
aaaagcaaatgtaacaaaacca

SEQ ID NO: 882278 - DNA, 22 bp, Artificial Sequence
  chemically synthesized
gttaatttttggttttgttaca

SEQ ID NO: 882279 - DNA, 22 bp, Artificial Sequence
  chemically synthesized
ttaatttttggttttgttacat

SEQ ID NO: 882280 - DNA, 22 bp, Artificial Sequence
  chemically synthesized
atttttggttttgttacatttg

SEQ ID NO: 882281 - DNA, 22 bp, Artificial Sequence
  chemically synthesized
agtccttaaaagcaaatgtaac

SEQ ID NO: 882282 - DNA, 22 bp, Artificial Sequence
  chemically synthesized
ttggttttgttacatttgcttt

SEQ ID NO: 882283 - DNA, 22 bp, Artificial Sequence
  chemically synthesized
tggttttgttacatttgctttt

SEQ ID NO: 882284 - DNA, 22 bp, Artificial Sequence
  chemically synthesized
ggttttgttacatttgctttta

SEQ ID NO: 882285 - DNA, 22 bp, Artificial Sequence
  chemically synthesized
gttttgttacatttgcttttaa

SEQ ID NO: 882286 - DNA, 22 bp, Artificial Sequence
  chemically synthesized
atgactaagtccttaaaagcaa

SEQ ID NO: 882287 - DNA, 22 bp, Artificial Sequence
  chemically synthesized
tgttacatttgcttttaaggac

SEQ ID NO: 882288 - DNA, 22 bp, Artificial Sequence
  chemically synthesized
gttacatttgcttttaaggact

SEQ ID NO: 882289 - DNA, 22 bp, Artificial Sequence
  chemically synthesized
ttacatttgcttttaaggactt

SEQ ID NO: 882290 - DNA, 22 bp, Artificial Sequence
  chemically synthesized
catttgcttttaaggacttagt

SEQ ID NO: 882291 - DNA, 22 bp, Artificial Sequence
  chemically synthesized
agaaagaattcatgactaagtc

SEQ ID NO: 882292 - DNA, 22 bp, Artificial Sequence
  chemically synthesized
cagaaagaattcatgactaagt

SEQ ID NO: 882293 - DNA, 22 bp, Artificial Sequence
  chemically synthesized
gcttttaaggacttagtcatga

SEQ ID NO: 882294 - DNA, 22 bp, Artificial Sequence
  chemically synthesized
cttttaaggacttagtcatgaa

SEQ ID NO: 882295 - DNA, 22 bp, Artificial Sequence
  chemically synthesized
ttaaggacttagtcatgaattc

SEQ ID NO: 882296 - DNA, 22 bp, Artificial Sequence
  chemically synthesized
taaggacttagtcatgaattct

SEQ ID NO: 882297 - DNA, 22 bp, Artificial Sequence
  chemically synthesized
aaggacttagtcatgaattctt

SEQ ID NO: 882298 - DNA, 22 bp, Artificial Sequence
  chemically synthesized
aggacttagtcatgaattcttt

SEQ ID NO: 882299 - DNA, 22 bp, Artificial Sequence
  chemically synthesized
gacatcagccttcagaaagaat

SEQ ID NO: 882300 - DNA, 22 bp, Artificial Sequence
  chemically synthesized
tggacatcagccttcagaaaga

SEQ ID NO: 882301 - DNA, 22 bp, Artificial Sequence
  chemically synthesized
agtcatgaattctttctgaagg

SEQ ID NO: 882302 - DNA, 22 bp, Artificial Sequence
  chemically synthesized
gtcatgaattctttctgaaggc

SEQ ID NO: 882303 - DNA, 22 bp, Artificial Sequence
  chemically synthesized
ttctggacatcagccttcagaa

SEQ ID NO: 882304 - DNA, 22 bp, Artificial Sequence
  chemically synthesized
ggaaatactattctggacatca

SEQ ID NO: 882305 - DNA, 22 bp, Artificial Sequence
  chemically synthesized
tttctgaaggctgatgtccaga

SEQ ID NO: 882306 - DNA, 22 bp, Artificial Sequence
  chemically synthesized
tctgaaggctgatgtccagaat

SEQ ID NO: 882307 - DNA, 22 bp, Artificial Sequence
  chemically synthesized
ctgaaggctgatgtccagaata

SEQ ID NO: 882308 - DNA, 22 bp, Artificial Sequence
  chemically synthesized
tgaaggctgatgtccagaatag

SEQ ID NO: 882309 - DNA, 22 bp, Artificial Sequence
  chemically synthesized
aaggctgatgtccagaatagta

SEQ ID NO: 882310 - DNA, 22 bp, Artificial Sequence
  chemically synthesized
atgtccagaatagtatttccta

SEQ ID NO: 882311 - DNA, 22 bp, Artificial Sequence
  chemically synthesized
gaagaatcgcagaagaaaacct

SEQ ID NO: 882312 - DNA, 22 bp, Artificial Sequence
  chemically synthesized
aaactagaagaatcgcagaaga

SEQ ID NO: 882313 - DNA, 22 bp, Artificial Sequence
  chemically synthesized
cctaggttttcttctgcgattc

SEQ ID NO: 882314 - DNA, 22 bp, Artificial Sequence
  chemically synthesized
ctaggttttcttctgcgattct

SEQ ID NO: 882315 - DNA, 22 bp, Artificial Sequence
  chemically synthesized
ggttttcttctgcgattcttct

SEQ ID NO: 882316 - DNA, 22 bp, Artificial Sequence
  chemically synthesized
tcttctgcgattcttctagttt

SEQ ID NO: 882317 - DNA, 22 bp, Artificial Sequence
  chemically synthesized
cttctgcgattcttctagtttg

SEQ ID NO: 882318 - DNA, 22 bp, Artificial Sequence
  chemically synthesized
ttctgcgattcttctagtttga

SEQ ID NO: 882319 - DNA, 22 bp, Artificial Sequence
  chemically synthesized
ctgcgattcttctagtttgaga

SEQ ID NO: 882320 - DNA, 22 bp, Artificial Sequence
  chemically synthesized
tgcgattcttctagtttgagat

SEQ ID NO: 882321 - DNA, 22 bp, Artificial Sequence
  chemically synthesized
cgattcttctagtttgagattt

SEQ ID NO: 882322 - DNA, 22 bp, Artificial Sequence
  chemically synthesized
ttctagtttgagattttattgt

SEQ ID NO: 882323 - DNA, 22 bp, Artificial Sequence
  chemically synthesized
ctagtttgagattttattgtat

SEQ ID NO: 882324 - DNA, 22 bp, Artificial Sequence
  chemically synthesized
tagtttgagattttattgtatt

SEQ ID NO: 882325 - DNA, 22 bp, Artificial Sequence
  chemically synthesized
gtttgagattttattgtattgt

SEQ ID NO: 882326 - DNA, 22 bp, Artificial Sequence
  chemically synthesized
aataaatacaatacaatacaat

SEQ ID NO: 882327 - DNA, 22 bp, Artificial Sequence
  chemically synthesized
gagattttattgtattgtattg

SEQ ID NO: 882328 - DNA, 22 bp, Artificial Sequence
  chemically synthesized
agattttattgtattgtattgt

SEQ ID NO: 882329 - DNA, 22 bp, Artificial Sequence
  chemically synthesized
cgtccctaaataaatacaatac

SEQ ID NO: 882330 - DNA, 22 bp, Artificial Sequence
  chemically synthesized
tattgtattgtattgtatttat

SEQ ID NO: 882331 - DNA, 22 bp, Artificial Sequence
  chemically synthesized
attgtattgtattgtatttatt

SEQ ID NO: 882332 - DNA, 22 bp, Artificial Sequence
  chemically synthesized
ttgtattgtattgtatttattt

SEQ ID NO: 882333 - DNA, 22 bp, Artificial Sequence
  chemically synthesized
tattgtattgtatttatttagg

SEQ ID NO: 882334 - DNA, 22 bp, Artificial Sequence
  chemically synthesized
tattgtatttatttagggacgg

SEQ ID NO: 882335 - DNA, 22 bp, Artificial Sequence
  chemically synthesized
acaacagagcgagactccgtcc

SEQ ID NO: 882336 - DNA, 22 bp, Artificial Sequence
  chemically synthesized
tatttatttagggacggagtct

SEQ ID NO: 882337 - DNA, 22 bp, Artificial Sequence
  chemically synthesized
atttagggacggagtctcgctc

SEQ ID NO: 882338 - DNA, 22 bp, Artificial Sequence
  chemically synthesized
agcctgacaacagagcgagact

SEQ ID NO: 882339 - DNA, 22 bp, Artificial Sequence
  chemically synthesized
tttagggacggagtctcgctct

SEQ ID NO: 882340 - DNA, 22 bp, Artificial Sequence
  chemically synthesized
cagcctgacaacagagcgagac

SEQ ID NO: 882341 - DNA, 22 bp, Artificial Sequence
  chemically synthesized
agggacggagtctcgctctgtt

SEQ ID NO: 882342 - DNA, 22 bp, Artificial Sequence
  chemically synthesized
gggacggagtctcgctctgttg

SEQ ID NO: 882343 - DNA, 22 bp, Artificial Sequence
  chemically synthesized
cacttcagcctgacaacagagc

SEQ ID NO: 882344 - DNA, 22 bp, Artificial Sequence
  chemically synthesized
cgccactgcacttcagcctgac

SEQ ID NO: 882345 - DNA, 22 bp, Artificial Sequence
  chemically synthesized
gctctgttgtcaggctgaagtg

SEQ ID NO: 882346 - DNA, 22 bp, Artificial Sequence
  chemically synthesized
cactgcgccactgcacttcagc

SEQ ID NO: 882347 - DNA, 22 bp, Artificial Sequence
  chemically synthesized
tgttgtcaggctgaagtgcagt

SEQ ID NO: 882348 - DNA, 22 bp, Artificial Sequence
  chemically synthesized
ttgtcaggctgaagtgcagtgg

SEQ ID NO: 882349 - DNA, 22 bp, Artificial Sequence
  chemically synthesized
tcaggctgaagtgcagtggcgc

SEQ ID NO: 882350 - DNA, 22 bp, Artificial Sequence
  chemically synthesized
aagtgcagtggcgcagtgcaat

SEQ ID NO: 882351 - DNA, 22 bp, Artificial Sequence
  chemically synthesized
cagtgagcccagattgcactgc

SEQ ID NO: 882352 - DNA, 22 bp, Artificial Sequence
  chemically synthesized
agccagggagtcggaggttgca

SEQ ID NO: 882353 - DNA, 22 bp, Artificial Sequence
  chemically synthesized
gagccagggagtcggaggttgc

SEQ ID NO: 882354 - DNA, 22 bp, Artificial Sequence
  chemically synthesized
ggctcactgcaacctccgactc

SEQ ID NO: 882355 - DNA, 22 bp, Artificial Sequence
  chemically synthesized
actgcaacctccgactccctgg

SEQ ID NO: 882356 - DNA, 22 bp, Artificial Sequence
  chemically synthesized
caacctccgactccctggctca

SEQ ID NO: 882357 - DNA, 22 bp, Artificial Sequence
  chemically synthesized
aggcaggagaaccgcttgagcc

SEQ ID NO: 882358 - DNA, 22 bp, Artificial Sequence
  chemically synthesized
cgactccctggctcaagcggtt

SEQ ID NO: 882359 - DNA, 22 bp, Artificial Sequence
  chemically synthesized
ggaggctgaggcaggagaaccg

SEQ ID NO: 882360 - DNA, 22 bp, Artificial Sequence
  chemically synthesized
cctggctcaagcggttctcctg

SEQ ID NO: 882361 - DNA, 22 bp, Artificial Sequence
  chemically synthesized
gggaggctgaggcaggagaacc

SEQ ID NO: 882362 - DNA, 22 bp, Artificial Sequence
  chemically synthesized
cttgggaggctgaggcaggaga

SEQ ID NO: 882363 - DNA, 22 bp, Artificial Sequence
  chemically synthesized
gctcaagcggttctcctgcctc

SEQ ID NO: 882364 - DNA, 22 bp, Artificial Sequence
  chemically synthesized
aagcggttctcctgcctcagcc

SEQ ID NO: 882365 - DNA, 22 bp, Artificial Sequence
  chemically synthesized
taatcccagctacttgggaggc

SEQ ID NO: 882366 - DNA, 22 bp, Artificial Sequence
  chemically synthesized
tcctgcctcagcctcccaagta

SEQ ID NO: 882367 - DNA, 22 bp, Artificial Sequence
  chemically synthesized
ctgcctcagcctcccaagtagc

SEQ ID NO: 882368 - DNA, 22 bp, Artificial Sequence
  chemically synthesized
cctcagcctcccaagtagctgg

SEQ ID NO: 882369 - DNA, 22 bp, Artificial Sequence
  chemically synthesized
agcctcccaagtagctgggatt

SEQ ID NO: 882370 - DNA, 22 bp, Artificial Sequence
  chemically synthesized
gcgcatccctgtaatcccagct

SEQ ID NO: 882371 - DNA, 22 bp, Artificial Sequence
  chemically synthesized
ccaagtagctgggattacaggg

SEQ ID NO: 882372 - DNA, 22 bp, Artificial Sequence
  chemically synthesized
ggcatgctggcgcatccctgta

SEQ ID NO: 882373 - DNA, 22 bp, Artificial Sequence
  chemically synthesized
gctgggcatgctggcgcatccc

SEQ ID NO: 882374 - DNA, 22 bp, Artificial Sequence
  chemically synthesized
ggattacagggatgcgccagca

SEQ ID NO: 882375 - DNA, 22 bp, Artificial Sequence
  chemically synthesized
cagggatgcgccagcatgccca

SEQ ID NO: 882376 - DNA, 22 bp, Artificial Sequence
  chemically synthesized
aaaatacaaaaaaattagctgg

SEQ ID NO: 882377 - DNA, 22 bp, Artificial Sequence
  chemically synthesized
ctaaaaatacaaaaaaattagc

SEQ ID NO: 882378 - DNA, 22 bp, Artificial Sequence
  chemically synthesized
tactaaaaatacaaaaaaatta

SEQ ID NO: 882379 - DNA, 22 bp, Artificial Sequence
  chemically synthesized
atttttttgtatttttagtaga

SEQ ID NO: 882380 - DNA, 22 bp, Artificial Sequence
  chemically synthesized
ttttgtatttttagtagagacg

SEQ ID NO: 882381 - DNA, 22 bp, Artificial Sequence
  chemically synthesized
tttgtatttttagtagagacgg

SEQ ID NO: 882382 - DNA, 22 bp, Artificial Sequence
  chemically synthesized
ttgtatttttagtagagacggg

SEQ ID NO: 882383 - DNA, 22 bp, Artificial Sequence
  chemically synthesized
tgtatttttagtagagacgggg

SEQ ID NO: 882384 - DNA, 22 bp, Artificial Sequence
  chemically synthesized
gtatttttagtagagacggggt

SEQ ID NO: 882385 - DNA, 22 bp, Artificial Sequence
  chemically synthesized
tatttttagtagagacggggtt

SEQ ID NO: 882386 - DNA, 22 bp, Artificial Sequence
  chemically synthesized
gccaacatggtgaaaccccgtc

SEQ ID NO: 882387 - DNA, 22 bp, Artificial Sequence
  chemically synthesized
ttagtagagacggggtttcacc

SEQ ID NO: 882388 - DNA, 22 bp, Artificial Sequence
  chemically synthesized
tagtagagacggggtttcacca

SEQ ID NO: 882389 - DNA, 22 bp, Artificial Sequence
  chemically synthesized
agtagagacggggtttcaccat

SEQ ID NO: 882390 - DNA, 22 bp, Artificial Sequence
  chemically synthesized
gtagagacggggtttcaccatg

SEQ ID NO: 882391 - DNA, 22 bp, Artificial Sequence
  chemically synthesized
acaccatcctggccaacatggt

SEQ ID NO: 882392 - DNA, 22 bp, Artificial Sequence
  chemically synthesized
caccatgttggccaggatggtg

SEQ ID NO: 882393 - DNA, 22 bp, Artificial Sequence
  chemically synthesized
accatgttggccaggatggtgt

SEQ ID NO: 882394 - DNA, 22 bp, Artificial Sequence
  chemically synthesized
gccaggatggtgtcaatctcct

SEQ ID NO: 882395 - DNA, 22 bp, Artificial Sequence
  chemically synthesized
aagcaggtggatcacgaggtca

SEQ ID NO: 882396 - DNA, 22 bp, Artificial Sequence
  chemically synthesized
ggaggctgaagcaggtggatca

SEQ ID NO: 882397 - DNA, 22 bp, Artificial Sequence
  chemically synthesized
gggaggctgaagcaggtggatc

SEQ ID NO: 882398 - DNA, 22 bp, Artificial Sequence
  chemically synthesized
tgggaggctgaagcaggtggat

SEQ ID NO: 882399 - DNA, 22 bp, Artificial Sequence
  chemically synthesized
ctgacctcgtgatccacctgct

SEQ ID NO: 882400 - DNA, 22 bp, Artificial Sequence
  chemically synthesized
acctcgtgatccacctgcttca

SEQ ID NO: 882401 - DNA, 22 bp, Artificial Sequence
  chemically synthesized
gtgatccacctgcttcagcctc

SEQ ID NO: 882402 - DNA, 22 bp, Artificial Sequence
  chemically synthesized
taatcccagcactttgggaggc

SEQ ID NO: 882403 - DNA, 22 bp, Artificial Sequence
  chemically synthesized
cttcagcctcccaaagtgctgg

SEQ ID NO: 882404 - DNA, 22 bp, Artificial Sequence
  chemically synthesized
acgcctgtaatcccagcacttt

SEQ ID NO: 882405 - DNA, 22 bp, Artificial Sequence
  chemically synthesized
cagcctcccaaagtgctgggat

SEQ ID NO: 882406 - DNA, 22 bp, Artificial Sequence
  chemically synthesized
agcctcccaaagtgctgggatt

SEQ ID NO: 882407 - DNA, 22 bp, Artificial Sequence
  chemically synthesized
ccaaagtgctgggattacaggc

SEQ ID NO: 882408 - DNA, 22 bp, Artificial Sequence
  chemically synthesized
agccaggtgcggtggctcacgc

SEQ ID NO: 882409 - DNA, 22 bp, Artificial Sequence
  chemically synthesized
ggattacaggcgtgagccaccg

SEQ ID NO: 882410 - DNA, 22 bp, Artificial Sequence
  chemically synthesized
caggcgtgagccaccgcacctg

SEQ ID NO: 882411 - DNA, 22 bp, Artificial Sequence
  chemically synthesized
aaaaaataaaatctcagccagg

SEQ ID NO: 882412 - DNA, 22 bp, Artificial Sequence
  chemically synthesized
aaaaaaataaaatctcagccag

SEQ ID NO: 882413 - DNA, 22 bp, Artificial Sequence
  chemically synthesized
aagatttaaaaaaataaaatct

SEQ ID NO: 882414 - DNA, 22 bp, Artificial Sequence
  chemically synthesized
gctgagattttatttttttaaa

SEQ ID NO: 882415 - DNA, 22 bp, Artificial Sequence
  chemically synthesized
aagatggattaaagatttaaaa

SEQ ID NO: 882416 - DNA, 22 bp, Artificial Sequence
  chemically synthesized
agattttatttttttaaatctt

SEQ ID NO: 882417 - DNA, 22 bp, Artificial Sequence
  chemically synthesized
actcaagatggattaaagattt

SEQ ID NO: 882418 - DNA, 22 bp, Artificial Sequence
  chemically synthesized
tatttttttaaatctttaatcc

SEQ ID NO: 882419 - DNA, 22 bp, Artificial Sequence
  chemically synthesized
atttttttaaatctttaatcca

SEQ ID NO: 882420 - DNA, 22 bp, Artificial Sequence
  chemically synthesized
tttttttaaatctttaatccat

SEQ ID NO: 882421 - DNA, 22 bp, Artificial Sequence
  chemically synthesized
ttttaaatctttaatccatctt

SEQ ID NO: 882422 - DNA, 22 bp, Artificial Sequence
  chemically synthesized
tttaaatctttaatccatcttg

SEQ ID NO: 882423 - DNA, 22 bp, Artificial Sequence
  chemically synthesized
ttaaatctttaatccatcttga

SEQ ID NO: 882424 - DNA, 22 bp, Artificial Sequence
  chemically synthesized
taaatctttaatccatcttgag

SEQ ID NO: 882425 - DNA, 22 bp, Artificial Sequence
  chemically synthesized
aaatctttaatccatcttgagt

SEQ ID NO: 882426 - DNA, 22 bp, Artificial Sequence
  chemically synthesized
aatctttaatccatcttgagtt

SEQ ID NO: 882427 - DNA, 22 bp, Artificial Sequence
  chemically synthesized
tatacaaaaattaactcaagat

SEQ ID NO: 882428 - DNA, 22 bp, Artificial Sequence
  chemically synthesized
actatatacaaaaattaactca

SEQ ID NO: 882429 - DNA, 22 bp, Artificial Sequence
  chemically synthesized
cactatatacaaaaattaactc

SEQ ID NO: 882430 - DNA, 22 bp, Artificial Sequence
  chemically synthesized
taatccatcttgagttaatttt

SEQ ID NO: 882431 - DNA, 22 bp, Artificial Sequence
  chemically synthesized
tcactatatacaaaaattaact

SEQ ID NO: 882432 - DNA, 22 bp, Artificial Sequence
  chemically synthesized
aatccatcttgagttaattttt

SEQ ID NO: 882433 - DNA, 22 bp, Artificial Sequence
  chemically synthesized
atccatcttgagttaatttttg

SEQ ID NO: 882434 - DNA, 22 bp, Artificial Sequence
  chemically synthesized
cctttcactatatacaaaaatt

SEQ ID NO: 882435 - DNA, 22 bp, Artificial Sequence
  chemically synthesized
ctacctttcactatatacaaaa

SEQ ID NO: 882436 - DNA, 22 bp, Artificial Sequence
  chemically synthesized
gagttaatttttgtatatagtg

SEQ ID NO: 882437 - DNA, 22 bp, Artificial Sequence
  chemically synthesized
agttaatttttgtatatagtga

SEQ ID NO: 882438 - DNA, 22 bp, Artificial Sequence
  chemically synthesized
gactcctacctttcactatata

SEQ ID NO: 882439 - DNA, 22 bp, Artificial Sequence
  chemically synthesized
atttttgtatatagtgaaaggt

SEQ ID NO: 882440 - DNA, 22 bp, Artificial Sequence
  chemically synthesized
ttgtatatagtgaaaggtagga

SEQ ID NO: 882441 - DNA, 22 bp, Artificial Sequence
  chemically synthesized
tgtatatagtgaaaggtaggag

SEQ ID NO: 882442 - DNA, 22 bp, Artificial Sequence
  chemically synthesized
gtatatagtgaaaggtaggagt

SEQ ID NO: 882443 - DNA, 22 bp, Artificial Sequence
  chemically synthesized
tatatagtgaaaggtaggagtc

SEQ ID NO: 882444 - DNA, 22 bp, Artificial Sequence
  chemically synthesized
accgtatccagaggaatgaaac

SEQ ID NO: 882445 - DNA, 22 bp, Artificial Sequence
  chemically synthesized
gctaaccgtatccagaggaatg

SEQ ID NO: 882446 - DNA, 22 bp, Artificial Sequence
  chemically synthesized
ggatagctggctaaccgtatcc

SEQ ID NO: 882447 - DNA, 22 bp, Artificial Sequence
  chemically synthesized
cattcctctggatacggttagc

SEQ ID NO: 882448 - DNA, 22 bp, Artificial Sequence
  chemically synthesized
attcctctggatacggttagcc

SEQ ID NO: 882449 - DNA, 22 bp, Artificial Sequence
  chemically synthesized
ctctggatacggttagccagct

SEQ ID NO: 882450 - DNA, 22 bp, Artificial Sequence
  chemically synthesized
tggatacggttagccagctatc

SEQ ID NO: 882451 - DNA, 22 bp, Artificial Sequence
  chemically synthesized
gatacggttagccagctatccc

SEQ ID NO: 882452 - DNA, 22 bp, Artificial Sequence
  chemically synthesized
aataaacggtgctgggatagct

SEQ ID NO: 882453 - DNA, 22 bp, Artificial Sequence
  chemically synthesized
ctcaataaacggtgctgggata

SEQ ID NO: 882454 - DNA, 22 bp, Artificial Sequence
  chemically synthesized
cctactcaataaacggtgctgg

SEQ ID NO: 882455 - DNA, 22 bp, Artificial Sequence
  chemically synthesized
gccagctatcccagcaccgttt

SEQ ID NO: 882456 - DNA, 22 bp, Artificial Sequence
  chemically synthesized
tcccagcaccgtttattgagta

SEQ ID NO: 882457 - DNA, 22 bp, Artificial Sequence
  chemically synthesized
attgagtagggagtcctttccc

SEQ ID NO: 882458 - DNA, 22 bp, Artificial Sequence
  chemically synthesized
ttgagtagggagtcctttcccc

SEQ ID NO: 882459 - DNA, 22 bp, Artificial Sequence
  chemically synthesized
agtagggagtcctttccccatt

SEQ ID NO: 882460 - DNA, 22 bp, Artificial Sequence
  chemically synthesized
acaaagtaaacaaaaaaaaaaa

SEQ ID NO: 882461 - DNA, 22 bp, Artificial Sequence
  chemically synthesized
aacaaagtaaacaaaaaaaaaa

SEQ ID NO: 882462 - DNA, 22 bp, Artificial Sequence
  chemically synthesized
taacaaagtaaacaaaaaaaaa

SEQ ID NO: 882463 - DNA, 22 bp, Artificial Sequence
  chemically synthesized
tccccattttttttttttttgt

SEQ ID NO: 882464 - DNA, 22 bp, Artificial Sequence
  chemically synthesized
ccccattttttttttttttgtt

SEQ ID NO: 882465 - DNA, 22 bp, Artificial Sequence
  chemically synthesized
cccattttttttttttttgttt

SEQ ID NO: 882466 - DNA, 22 bp, Artificial Sequence
  chemically synthesized
atctttaacaaagtaaacaaaa

SEQ ID NO: 882467 - DNA, 22 bp, Artificial Sequence
  chemically synthesized
tttttttttttgtttactttgt

SEQ ID NO: 882468 - DNA, 22 bp, Artificial Sequence
  chemically synthesized
ttttttttttgtttactttgtt

SEQ ID NO: 882469 - DNA, 22 bp, Artificial Sequence
  chemically synthesized
tttttttttgtttactttgtta

SEQ ID NO: 882470 - DNA, 22 bp, Artificial Sequence
  chemically synthesized
ttttttttgtttactttgttaa

SEQ ID NO: 882471 - DNA, 22 bp, Artificial Sequence
  chemically synthesized
tttttttgtttactttgttaaa

SEQ ID NO: 882472 - DNA, 22 bp, Artificial Sequence
  chemically synthesized
ttttttgtttactttgttaaag

SEQ ID NO: 882473 - DNA, 22 bp, Artificial Sequence
  chemically synthesized
cagccatctgatctttaacaaa

SEQ ID NO: 882474 - DNA, 22 bp, Artificial Sequence
  chemically synthesized
tttttgtttactttgttaaaga

SEQ ID NO: 882475 - DNA, 22 bp, Artificial Sequence
  chemically synthesized
ttttgtttactttgttaaagat

SEQ ID NO: 882476 - DNA, 22 bp, Artificial Sequence
  chemically synthesized
tttgtttactttgttaaagatc

SEQ ID NO: 882477 - DNA, 22 bp, Artificial Sequence
  chemically synthesized
ttgtttactttgttaaagatca

SEQ ID NO: 882478 - DNA, 22 bp, Artificial Sequence
  chemically synthesized
tgtttactttgttaaagatcag

SEQ ID NO: 882479 - DNA, 22 bp, Artificial Sequence
  chemically synthesized
gtttactttgttaaagatcaga

SEQ ID NO: 882480 - DNA, 22 bp, Artificial Sequence
  chemically synthesized
tttactttgttaaagatcagat

SEQ ID NO: 882481 - DNA, 22 bp, Artificial Sequence
  chemically synthesized
actttgttaaagatcagatggc

SEQ ID NO: 882482 - DNA, 22 bp, Artificial Sequence
  chemically synthesized
ctttgttaaagatcagatggct

SEQ ID NO: 882483 - DNA, 22 bp, Artificial Sequence
  chemically synthesized
tgttaaagatcagatggctgta

SEQ ID NO: 882484 - DNA, 22 bp, Artificial Sequence
  chemically synthesized
gttaaagatcagatggctgtag

SEQ ID NO: 882485 - DNA, 22 bp, Artificial Sequence
  chemically synthesized
ttaaagatcagatggctgtagg

SEQ ID NO: 882486 - DNA, 22 bp, Artificial Sequence
  chemically synthesized
aagatcagatggctgtaggtat

SEQ ID NO: 882487 - DNA, 22 bp, Artificial Sequence
  chemically synthesized
agaaataaagccgcatacctac

SEQ ID NO: 882488 - DNA, 22 bp, Artificial Sequence
  chemically synthesized
taggtatgcggctttatttctg

SEQ ID NO: 882489 - DNA, 22 bp, Artificial Sequence
  chemically synthesized
gaccagtagaacagaatagaga

SEQ ID NO: 882490 - DNA, 22 bp, Artificial Sequence
  chemically synthesized
tatttctgagttctctattctg

SEQ ID NO: 882491 - DNA, 22 bp, Artificial Sequence
  chemically synthesized
ggaccagtagaacagaatagag

SEQ ID NO: 882492 - DNA, 22 bp, Artificial Sequence
  chemically synthesized
atttctgagttctctattctgt

SEQ ID NO: 882493 - DNA, 22 bp, Artificial Sequence
  chemically synthesized
tttctgagttctctattctgtt

SEQ ID NO: 882494 - DNA, 22 bp, Artificial Sequence
  chemically synthesized
ctgagttctctattctgttcta

SEQ ID NO: 882495 - DNA, 22 bp, Artificial Sequence
  chemically synthesized
tgagttctctattctgttctac

SEQ ID NO: 882496 - DNA, 22 bp, Artificial Sequence
  chemically synthesized
agttctctattctgttctactg

SEQ ID NO: 882497 - DNA, 22 bp, Artificial Sequence
  chemically synthesized
tctattctgttctactggtcca

SEQ ID NO: 882498 - DNA, 22 bp, Artificial Sequence
  chemically synthesized
tattctgttctactggtccaag

SEQ ID NO: 882499 - DNA, 22 bp, Artificial Sequence
  chemically synthesized
caaaaacagaaacttggaccag

SEQ ID NO: 882500 - DNA, 22 bp, Artificial Sequence
  chemically synthesized
ttctgttctactggtccaagtt

SEQ ID NO: 882501 - DNA, 22 bp, Artificial Sequence
  chemically synthesized
tacaaaaacagaaacttggacc

SEQ ID NO: 882502 - DNA, 22 bp, Artificial Sequence
  chemically synthesized
ctacaaaaacagaaacttggac

SEQ ID NO: 882503 - DNA, 22 bp, Artificial Sequence
  chemically synthesized
tgttctactggtccaagtttct

SEQ ID NO: 882504 - DNA, 22 bp, Artificial Sequence
  chemically synthesized
ttctactggtccaagtttctgt

SEQ ID NO: 882505 - DNA, 22 bp, Artificial Sequence
  chemically synthesized
tactggtccaagtttctgtttt

SEQ ID NO: 882506 - DNA, 22 bp, Artificial Sequence
  chemically synthesized
ctggtccaagtttctgtttttg

SEQ ID NO: 882507 - DNA, 22 bp, Artificial Sequence
  chemically synthesized
gtccaagtttctgtttttgtag

SEQ ID NO: 882508 - DNA, 22 bp, Artificial Sequence
  chemically synthesized
cccaaagagaatgggacttcta

SEQ ID NO: 882509 - DNA, 22 bp, Artificial Sequence
  chemically synthesized
ctgtttttgtagaagtcccatt

SEQ ID NO: 882510 - DNA, 22 bp, Artificial Sequence
  chemically synthesized
tgtttttgtagaagtcccattc

SEQ ID NO: 882511 - DNA, 22 bp, Artificial Sequence
  chemically synthesized
tttttgtagaagtcccattctc

SEQ ID NO: 882512 - DNA, 22 bp, Artificial Sequence
  chemically synthesized
cagttacccaaagagaatggga

SEQ ID NO: 882513 - DNA, 22 bp, Artificial Sequence
  chemically synthesized
ttgtagaagtcccattctcttt

SEQ ID NO: 882514 - DNA, 22 bp, Artificial Sequence
  chemically synthesized
tgtagaagtcccattctctttg

SEQ ID NO: 882515 - DNA, 22 bp, Artificial Sequence
  chemically synthesized
gtagaagtcccattctctttgg

SEQ ID NO: 882516 - DNA, 22 bp, Artificial Sequence
  chemically synthesized
tagaagtcccattctctttggg

SEQ ID NO: 882517 - DNA, 22 bp, Artificial Sequence
  chemically synthesized
taaggctacagttacccaaaga

SEQ ID NO: 882518 - DNA, 22 bp, Artificial Sequence
  chemically synthesized
tactataaggctacagttaccc

SEQ ID NO: 882519 - DNA, 22 bp, Artificial Sequence
  chemically synthesized
aaactatactataaggctacag

SEQ ID NO: 882520 - DNA, 22 bp, Artificial Sequence
  chemically synthesized
tctttgggtaactgtagcctta

SEQ ID NO: 882521 - DNA, 22 bp, Artificial Sequence
  chemically synthesized
caaactatactataaggctaca

SEQ ID NO: 882522 - DNA, 22 bp, Artificial Sequence
  chemically synthesized
tttgggtaactgtagccttata

SEQ ID NO: 882523 - DNA, 22 bp, Artificial Sequence
  chemically synthesized
tgggtaactgtagccttatagt

SEQ ID NO: 882524 - DNA, 22 bp, Artificial Sequence
  chemically synthesized
gggtaactgtagccttatagta

SEQ ID NO: 882525 - DNA, 22 bp, Artificial Sequence
  chemically synthesized
ggtaactgtagccttatagtat

SEQ ID NO: 882526 - DNA, 22 bp, Artificial Sequence
  chemically synthesized
accaacttcaaactatactata

SEQ ID NO: 882527 - DNA, 22 bp, Artificial Sequence
  chemically synthesized
tagccttatagtatagtttgaa

SEQ ID NO: 882528 - DNA, 22 bp, Artificial Sequence
  chemically synthesized
atagtatagtttgaagttggtt

SEQ ID NO: 882529 - DNA, 22 bp, Artificial Sequence
  chemically synthesized
tagtatagtttgaagttggtta

SEQ ID NO: 882530 - DNA, 22 bp, Artificial Sequence
  chemically synthesized
gaagttggttaatatcatgctt

SEQ ID NO: 882531 - DNA, 22 bp, Artificial Sequence
  chemically synthesized
aagttggttaatatcatgcttt

SEQ ID NO: 882532 - DNA, 22 bp, Artificial Sequence
  chemically synthesized
agtgaaaagaataaagcatgat

SEQ ID NO: 882533 - DNA, 22 bp, Artificial Sequence
  chemically synthesized
gttaatatcatgctttattctt

SEQ ID NO: 882534 - DNA, 22 bp, Artificial Sequence
  chemically synthesized
atatcatgctttattcttttca

SEQ ID NO: 882535 - DNA, 22 bp, Artificial Sequence
  chemically synthesized
aagagtaaaaacaatgctaagt

SEQ ID NO: 882536 - DNA, 22 bp, Artificial Sequence
  chemically synthesized
tattcttttcacttagcattgt

SEQ ID NO: 882537 - DNA, 22 bp, Artificial Sequence
  chemically synthesized
attcttttcacttagcattgtt

SEQ ID NO: 882538 - DNA, 22 bp, Artificial Sequence
  chemically synthesized
ttcttttcacttagcattgttt

SEQ ID NO: 882539 - DNA, 22 bp, Artificial Sequence
  chemically synthesized
ttttcacttagcattgttttta

SEQ ID NO: 882540 - DNA, 22 bp, Artificial Sequence
  chemically synthesized
ttcacttagcattgtttttact

SEQ ID NO: 882541 - DNA, 22 bp, Artificial Sequence
  chemically synthesized
tcacttagcattgtttttactc

SEQ ID NO: 882542 - DNA, 22 bp, Artificial Sequence
  chemically synthesized
cacttagcattgtttttactct

SEQ ID NO: 882543 - DNA, 22 bp, Artificial Sequence
  chemically synthesized
acttagcattgtttttactctt

SEQ ID NO: 882544 - DNA, 22 bp, Artificial Sequence
  chemically synthesized
aaaaacagtctgaagagtaaaa

SEQ ID NO: 882545 - DNA, 22 bp, Artificial Sequence
  chemically synthesized
agcattgtttttactcttcaga

SEQ ID NO: 882546 - DNA, 22 bp, Artificial Sequence
  chemically synthesized
gcattgtttttactcttcagac

SEQ ID NO: 882547 - DNA, 22 bp, Artificial Sequence
  chemically synthesized
tttttactcttcagactgtttt

SEQ ID NO: 882548 - DNA, 22 bp, Artificial Sequence
  chemically synthesized
atatgaatctaaaaaacagtct

SEQ ID NO: 882549 - DNA, 22 bp, Artificial Sequence
  chemically synthesized
ttactcttcagactgtttttta

SEQ ID NO: 882550 - DNA, 22 bp, Artificial Sequence
  chemically synthesized
tactcttcagactgttttttag

SEQ ID NO: 882551 - DNA, 22 bp, Artificial Sequence
  chemically synthesized
actcttcagactgttttttaga

SEQ ID NO: 882552 - DNA, 22 bp, Artificial Sequence
  chemically synthesized
ctcttcagactgttttttagat

SEQ ID NO: 882553 - DNA, 22 bp, Artificial Sequence
  chemically synthesized
aaattcatatgaatctaaaaaa

SEQ ID NO: 882554 - DNA, 22 bp, Artificial Sequence
  chemically synthesized
ttcagactgttttttagattca

SEQ ID NO: 882555 - DNA, 22 bp, Artificial Sequence
  chemically synthesized
cagactgttttttagattcata

SEQ ID NO: 882556 - DNA, 22 bp, Artificial Sequence
  chemically synthesized
tcctaaaattcatatgaatcta

SEQ ID NO: 882557 - DNA, 22 bp, Artificial Sequence
  chemically synthesized
agactgttttttagattcatat

SEQ ID NO: 882558 - DNA, 22 bp, Artificial Sequence
  chemically synthesized
ttttttagattcatatgaattt

SEQ ID NO: 882559 - DNA, 22 bp, Artificial Sequence
  chemically synthesized
tttagattcatatgaattttag

SEQ ID NO: 882560 - DNA, 22 bp, Artificial Sequence
  chemically synthesized
taaaaaactatcctaaaattca

SEQ ID NO: 882561 - DNA, 22 bp, Artificial Sequence
  chemically synthesized
ttagattcatatgaattttagg

SEQ ID NO: 882562 - DNA, 22 bp, Artificial Sequence
  chemically synthesized
tagattcatatgaattttagga

SEQ ID NO: 882563 - DNA, 22 bp, Artificial Sequence
  chemically synthesized
agattcatatgaattttaggat

SEQ ID NO: 882564 - DNA, 22 bp, Artificial Sequence
  chemically synthesized
gattcatatgaattttaggata

SEQ ID NO: 882565 - DNA, 22 bp, Artificial Sequence
  chemically synthesized
atatgaattttaggatagtttt

SEQ ID NO: 882566 - DNA, 22 bp, Artificial Sequence
  chemically synthesized
acagaattataaaaaactatcc

SEQ ID NO: 882567 - DNA, 22 bp, Artificial Sequence
  chemically synthesized
cacagaattataaaaaactatc

SEQ ID NO: 882568 - DNA, 22 bp, Artificial Sequence
  chemically synthesized
tcacagaattataaaaaactat

SEQ ID NO: 882569 - DNA, 22 bp, Artificial Sequence
  chemically synthesized
ttcacagaattataaaaaacta

SEQ ID NO: 882570 - DNA, 22 bp, Artificial Sequence
  chemically synthesized
taggatagttttttataattct

SEQ ID NO: 882571 - DNA, 22 bp, Artificial Sequence
  chemically synthesized
aggatagttttttataattctg

SEQ ID NO: 882572 - DNA, 22 bp, Artificial Sequence
  chemically synthesized
ggatagttttttataattctgt

SEQ ID NO: 882573 - DNA, 22 bp, Artificial Sequence
  chemically synthesized
gcaatgtcatttttcacagaat

SEQ ID NO: 882574 - DNA, 22 bp, Artificial Sequence
  chemically synthesized
tttataattctgtgaaaaatga

SEQ ID NO: 882575 - DNA, 22 bp, Artificial Sequence
  chemically synthesized
ttataattctgtgaaaaatgac

SEQ ID NO: 882576 - DNA, 22 bp, Artificial Sequence
  chemically synthesized
tataattctgtgaaaaatgaca

SEQ ID NO: 882577 - DNA, 22 bp, Artificial Sequence
  chemically synthesized
tcaaactagcaatgtcattttt

SEQ ID NO: 882578 - DNA, 22 bp, Artificial Sequence
  chemically synthesized
ataattctgtgaaaaatgacat

SEQ ID NO: 882579 - DNA, 22 bp, Artificial Sequence
  chemically synthesized
taattctgtgaaaaatgacatt

SEQ ID NO: 882580 - DNA, 22 bp, Artificial Sequence
  chemically synthesized
ctatcaaactagcaatgtcatt

SEQ ID NO: 882581 - DNA, 22 bp, Artificial Sequence
  chemically synthesized
ttcctatcaaactagcaatgtc

SEQ ID NO: 882582 - DNA, 22 bp, Artificial Sequence
  chemically synthesized
tgtgaaaaatgacattgctagt

SEQ ID NO: 882583 - DNA, 22 bp, Artificial Sequence
  chemically synthesized
tgaaaaatgacattgctagttt

SEQ ID NO: 882584 - DNA, 22 bp, Artificial Sequence
  chemically synthesized
aatgctattcctatcaaactag

SEQ ID NO: 882585 - DNA, 22 bp, Artificial Sequence
  chemically synthesized
cagattcaatgctattcctatc

SEQ ID NO: 882586 - DNA, 22 bp, Artificial Sequence
  chemically synthesized
ctagtttgataggaatagcatt

SEQ ID NO: 882587 - DNA, 22 bp, Artificial Sequence
  chemically synthesized
gtttgataggaatagcattgaa

SEQ ID NO: 882588 - DNA, 22 bp, Artificial Sequence
  chemically synthesized
aagcaatctacagattcaatgc

SEQ ID NO: 882589 - DNA, 22 bp, Artificial Sequence
  chemically synthesized
aaagcaatctacagattcaatg

SEQ ID NO: 882590 - DNA, 22 bp, Artificial Sequence
  chemically synthesized
gataggaatagcattgaatctg

SEQ ID NO: 882591 - DNA, 22 bp, Artificial Sequence
  chemically synthesized
ataggaatagcattgaatctgt

SEQ ID NO: 882592 - DNA, 22 bp, Artificial Sequence
  chemically synthesized
cttaaagcaatctacagattca

SEQ ID NO: 882593 - DNA, 22 bp, Artificial Sequence
  chemically synthesized
aatctgtagattgctttaagca

SEQ ID NO: 882594 - DNA, 22 bp, Artificial Sequence
  chemically synthesized
aaatggacatactgcttaaagc

SEQ ID NO: 882595 - DNA, 22 bp, Artificial Sequence
  chemically synthesized
tagattgctttaagcagtatgt

SEQ ID NO: 882596 - DNA, 22 bp, Artificial Sequence
  chemically synthesized
ctttaagcagtatgtccatttt

SEQ ID NO: 882597 - DNA, 22 bp, Artificial Sequence
  chemically synthesized
taagcagtatgtccattttaat

SEQ ID NO: 882598 - DNA, 22 bp, Artificial Sequence
  chemically synthesized
aagcagtatgtccattttaatg

SEQ ID NO: 882599 - DNA, 22 bp, Artificial Sequence
  chemically synthesized
agcagtatgtccattttaatga

SEQ ID NO: 882600 - DNA, 22 bp, Artificial Sequence
  chemically synthesized
atggaaaggaagaatcaatatc

SEQ ID NO: 882601 - DNA, 22 bp, Artificial Sequence
  chemically synthesized
catgttaatggaaaggaagaat

SEQ ID NO: 882602 - DNA, 22 bp, Artificial Sequence
  chemically synthesized
taatgatattgattcttccttt

SEQ ID NO: 882603 - DNA, 22 bp, Artificial Sequence
  chemically synthesized
aatgatattgattcttcctttc

SEQ ID NO: 882604 - DNA, 22 bp, Artificial Sequence
  chemically synthesized
atgatattgattcttcctttcc

SEQ ID NO: 882605 - DNA, 22 bp, Artificial Sequence
  chemically synthesized
attcttcctttccattaacatg

SEQ ID NO: 882606 - DNA, 22 bp, Artificial Sequence
  chemically synthesized
ttcctttccattaacatggaat

SEQ ID NO: 882607 - DNA, 22 bp, Artificial Sequence
  chemically synthesized
cctttccattaacatggaatgt

SEQ ID NO: 882608 - DNA, 22 bp, Artificial Sequence
  chemically synthesized
ctttccattaacatggaatgtt

SEQ ID NO: 882609 - DNA, 22 bp, Artificial Sequence
  chemically synthesized
tccattaacatggaatgtttct

SEQ ID NO: 882610 - DNA, 22 bp, Artificial Sequence
  chemically synthesized
ccattaacatggaatgtttctc

SEQ ID NO: 882611 - DNA, 22 bp, Artificial Sequence
  chemically synthesized
cattaacatggaatgtttctcc

SEQ ID NO: 882612 - DNA, 22 bp, Artificial Sequence
  chemically synthesized
acatggaatgtttctccatttg

SEQ ID NO: 882613 - DNA, 22 bp, Artificial Sequence
  chemically synthesized
aaagaaaccatagataacacaa

SEQ ID NO: 882614 - DNA, 22 bp, Artificial Sequence
  chemically synthesized
ctccatttgtttgtgttatcta

SEQ ID NO: 882615 - DNA, 22 bp, Artificial Sequence
  chemically synthesized
tccatttgtttgtgttatctat

SEQ ID NO: 882616 - DNA, 22 bp, Artificial Sequence
  chemically synthesized
ctgaaagaaaccatagataaca

SEQ ID NO: 882617 - DNA, 22 bp, Artificial Sequence
  chemically synthesized
catttgtttgtgttatctatgg

SEQ ID NO: 882618 - DNA, 22 bp, Artificial Sequence
  chemically synthesized
gtttgtgttatctatggtttct

SEQ ID NO: 882619 - DNA, 22 bp, Artificial Sequence
  chemically synthesized
tttgtgttatctatggtttctt

SEQ ID NO: 882620 - DNA, 22 bp, Artificial Sequence
  chemically synthesized
caaaacactgctgaaagaaacc

SEQ ID NO: 882621 - DNA, 22 bp, Artificial Sequence
  chemically synthesized
gtgttatctatggtttctttca

SEQ ID NO: 882622 - DNA, 22 bp, Artificial Sequence
  chemically synthesized
tgttatctatggtttctttcag

SEQ ID NO: 882623 - DNA, 22 bp, Artificial Sequence
  chemically synthesized
actacaaaacactgctgaaaga

SEQ ID NO: 882624 - DNA, 22 bp, Artificial Sequence
  chemically synthesized
tctatggtttctttcagcagtg

SEQ ID NO: 882625 - DNA, 22 bp, Artificial Sequence
  chemically synthesized
tggtttctttcagcagtgtttt

SEQ ID NO: 882626 - DNA, 22 bp, Artificial Sequence
  chemically synthesized
cagggctaactacaaaacactg

SEQ ID NO: 882627 - DNA, 22 bp, Artificial Sequence
  chemically synthesized
tacagggctaactacaaaacac

SEQ ID NO: 882628 - DNA, 22 bp, Artificial Sequence
  chemically synthesized
ctttcagcagtgttttgtagtt

SEQ ID NO: 882629 - DNA, 22 bp, Artificial Sequence
  chemically synthesized
tttcagcagtgttttgtagtta

SEQ ID NO: 882630 - DNA, 22 bp, Artificial Sequence
  chemically synthesized
tcagcagtgttttgtagttagc

SEQ ID NO: 882631 - DNA, 22 bp, Artificial Sequence
  chemically synthesized
cagcagtgttttgtagttagcc

SEQ ID NO: 882632 - DNA, 22 bp, Artificial Sequence
  chemically synthesized
agcagtgttttgtagttagccc

SEQ ID NO: 882633 - DNA, 22 bp, Artificial Sequence
  chemically synthesized
tgtagttagccctgtagagatc

SEQ ID NO: 882634 - DNA, 22 bp, Artificial Sequence
  chemically synthesized
gtagttagccctgtagagatct

SEQ ID NO: 882635 - DNA, 22 bp, Artificial Sequence
  chemically synthesized
tagttagccctgtagagatctt

SEQ ID NO: 882636 - DNA, 22 bp, Artificial Sequence
  chemically synthesized
accaaagaagtgaaagatctct

SEQ ID NO: 882637 - DNA, 22 bp, Artificial Sequence
  chemically synthesized
gccctgtagagatctttcactt

SEQ ID NO: 882638 - DNA, 22 bp, Artificial Sequence
  chemically synthesized
tagagatctttcacttctttgg

SEQ ID NO: 882639 - DNA, 22 bp, Artificial Sequence
  chemically synthesized
ggaatacatctaaccaaagaag

SEQ ID NO: 882640 - DNA, 22 bp, Artificial Sequence
  chemically synthesized
tcacttctttggttagatgtat

SEQ ID NO: 882641 - DNA, 22 bp, Artificial Sequence
  chemically synthesized
cacttctttggttagatgtatt

SEQ ID NO: 882642 - DNA, 22 bp, Artificial Sequence
  chemically synthesized
acttctttggttagatgtattc

SEQ ID NO: 882643 - DNA, 22 bp, Artificial Sequence
  chemically synthesized
ctttggttagatgtattcctag

SEQ ID NO: 882644 - DNA, 22 bp, Artificial Sequence
  chemically synthesized
tttggttagatgtattcctaga

SEQ ID NO: 882645 - DNA, 22 bp, Artificial Sequence
  chemically synthesized
tggttagatgtattcctagata

SEQ ID NO: 882646 - DNA, 22 bp, Artificial Sequence
  chemically synthesized
ggttagatgtattcctagatat

SEQ ID NO: 882647 - DNA, 22 bp, Artificial Sequence
  chemically synthesized
gttagatgtattcctagatatt

SEQ ID NO: 882648 - DNA, 22 bp, Artificial Sequence
  chemically synthesized
gatgtattcctagatattttat

SEQ ID NO: 882649 - DNA, 22 bp, Artificial Sequence
  chemically synthesized
caataaccacaaaaaataaaat

SEQ ID NO: 882650 - DNA, 22 bp, Artificial Sequence
  chemically synthesized
acaataaccacaaaaaataaaa

SEQ ID NO: 882651 - DNA, 22 bp, Artificial Sequence
  chemically synthesized
tttacaataaccacaaaaaata

SEQ ID NO: 882652 - DNA, 22 bp, Artificial Sequence
  chemically synthesized
ctagatattttattttttgtgg

SEQ ID NO: 882653 - DNA, 22 bp, Artificial Sequence
  chemically synthesized
gatattttattttttgtggtta

SEQ ID NO: 882654 - DNA, 22 bp, Artificial Sequence
  chemically synthesized
tattttttgtggttattgtaaa

SEQ ID NO: 882655 - DNA, 22 bp, Artificial Sequence
  chemically synthesized
attttttgtggttattgtaaat

SEQ ID NO: 882656 - DNA, 22 bp, Artificial Sequence
  chemically synthesized
ttttttgtggttattgtaaata

SEQ ID NO: 882657 - DNA, 22 bp, Artificial Sequence
  chemically synthesized
tttgtggttattgtaaatagtt

SEQ ID NO: 882658 - DNA, 22 bp, Artificial Sequence
  chemically synthesized
ttgtggttattgtaaatagttt

SEQ ID NO: 882659 - DNA, 22 bp, Artificial Sequence
  chemically synthesized
tgtggttattgtaaatagtttg

SEQ ID NO: 882660 - DNA, 22 bp, Artificial Sequence
  chemically synthesized
gtggttattgtaaatagtttgc

SEQ ID NO: 882661 - DNA, 22 bp, Artificial Sequence
  chemically synthesized
tggttattgtaaatagtttgca

SEQ ID NO: 882662 - DNA, 22 bp, Artificial Sequence
  chemically synthesized
agagccaaatcaagaatgcaaa

SEQ ID NO: 882663 - DNA, 22 bp, Artificial Sequence
  chemically synthesized
ttgtaaatagtttgcattcttg

SEQ ID NO: 882664 - DNA, 22 bp, Artificial Sequence
  chemically synthesized
taaatagtttgcattcttgatt

SEQ ID NO: 882665 - DNA, 22 bp, Artificial Sequence
  chemically synthesized
aagctgagagccaaatcaagaa

SEQ ID NO: 882666 - DNA, 22 bp, Artificial Sequence
  chemically synthesized
cagtgttcaagctgagagccaa

SEQ ID NO: 882667 - DNA, 22 bp, Artificial Sequence
  chemically synthesized
gcattcttgatttggctctcag

SEQ ID NO: 882668 - DNA, 22 bp, Artificial Sequence
  chemically synthesized
cattcttgatttggctctcagc

SEQ ID NO: 882669 - DNA, 22 bp, Artificial Sequence
  chemically synthesized
ttgcagtgttcaagctgagagc

SEQ ID NO: 882670 - DNA, 22 bp, Artificial Sequence
  chemically synthesized
ttgatttggctctcagcttgaa

SEQ ID NO: 882671 - DNA, 22 bp, Artificial Sequence
  chemically synthesized
gatttggctctcagcttgaaca

SEQ ID NO: 882672 - DNA, 22 bp, Artificial Sequence
  chemically synthesized
atttggctctcagcttgaacac

SEQ ID NO: 882673 - DNA, 22 bp, Artificial Sequence
  chemically synthesized
ggctctcagcttgaacactgca

SEQ ID NO: 882674 - DNA, 22 bp, Artificial Sequence
  chemically synthesized
aaaatatgttattgcagtgttc

SEQ ID NO: 882675 - DNA, 22 bp, Artificial Sequence
  chemically synthesized
gctctcagcttgaacactgcaa

SEQ ID NO: 882676 - DNA, 22 bp, Artificial Sequence
  chemically synthesized
aaaaatatgttattgcagtgtt

SEQ ID NO: 882677 - DNA, 22 bp, Artificial Sequence
  chemically synthesized
tcagcttgaacactgcaataac

SEQ ID NO: 882678 - DNA, 22 bp, Artificial Sequence
  chemically synthesized
atttaaaaatatgttattgcag

SEQ ID NO: 882679 - DNA, 22 bp, Artificial Sequence
  chemically synthesized
aatttaaaaatatgttattgca

SEQ ID NO: 882680 - DNA, 22 bp, Artificial Sequence
  chemically synthesized
agcttgaacactgcaataacat

SEQ ID NO: 882681 - DNA, 22 bp, Artificial Sequence
  chemically synthesized
gaacactgcaataacatatttt

SEQ ID NO: 882682 - DNA, 22 bp, Artificial Sequence
  chemically synthesized
aacactgcaataacatattttt

SEQ ID NO: 882683 - DNA, 22 bp, Artificial Sequence
  chemically synthesized
atgtacatgccttaatttaaaa

SEQ ID NO: 882684 - DNA, 22 bp, Artificial Sequence
  chemically synthesized
caataacatatttttaaattaa

SEQ ID NO: 882685 - DNA, 22 bp, Artificial Sequence
  chemically synthesized
aaaactaatgtacatgccttaa

SEQ ID NO: 882686 - DNA, 22 bp, Artificial Sequence
  chemically synthesized
ttaaattaaggcatgtacatta

SEQ ID NO: 882687 - DNA, 22 bp, Artificial Sequence
  chemically synthesized
taaattaaggcatgtacattag

SEQ ID NO: 882688 - DNA, 22 bp, Artificial Sequence
  chemically synthesized
aaattaaggcatgtacattagt

SEQ ID NO: 882689 - DNA, 22 bp, Artificial Sequence
  chemically synthesized
aattaaggcatgtacattagtt

SEQ ID NO: 882690 - DNA, 22 bp, Artificial Sequence
  chemically synthesized
aggcatgtacattagtttttag

SEQ ID NO: 882691 - DNA, 22 bp, Artificial Sequence
  chemically synthesized
agtatacaatagtgtatgccta

SEQ ID NO: 882692 - DNA, 22 bp, Artificial Sequence
  chemically synthesized
ttaagtatacaatagtgtatgc

SEQ ID NO: 882693 - DNA, 22 bp, Artificial Sequence
  chemically synthesized
gtttttaggcatacactattgt

SEQ ID NO: 882694 - DNA, 22 bp, Artificial Sequence
  chemically synthesized
taatctattaagtatacaatag

SEQ ID NO: 882695 - DNA, 22 bp, Artificial Sequence
  chemically synthesized
ttaggcatacactattgtatac

SEQ ID NO: 882696 - DNA, 22 bp, Artificial Sequence
  chemically synthesized
taggcatacactattgtatact

SEQ ID NO: 882697 - DNA, 22 bp, Artificial Sequence
  chemically synthesized
aggcatacactattgtatactt

SEQ ID NO: 882698 - DNA, 22 bp, Artificial Sequence
  chemically synthesized
ggcatacactattgtatactta

SEQ ID NO: 882699 - DNA, 22 bp, Artificial Sequence
  chemically synthesized
cactgtaatctattaagtatac

SEQ ID NO: 882700 - DNA, 22 bp, Artificial Sequence
  chemically synthesized
ttgtatacttaatagattacag

SEQ ID NO: 882701 - DNA, 22 bp, Artificial Sequence
  chemically synthesized
tatacttaatagattacagtgt

SEQ ID NO: 882702 - DNA, 22 bp, Artificial Sequence
  chemically synthesized
aatagattacagtgtagtgtac

SEQ ID NO: 882703 - DNA, 22 bp, Artificial Sequence
  chemically synthesized
atagattacagtgtagtgtaca

SEQ ID NO: 882704 - DNA, 22 bp, Artificial Sequence
  chemically synthesized
gtacatatagaagtcaggtgta

SEQ ID NO: 882705 - DNA, 22 bp, Artificial Sequence
  chemically synthesized
cagtgtagtgtacacctgactt

SEQ ID NO: 882706 - DNA, 22 bp, Artificial Sequence
  chemically synthesized
ctggtacatatagaagtcaggt

SEQ ID NO: 882707 - DNA, 22 bp, Artificial Sequence
  chemically synthesized
cctggtacatatagaagtcagg

SEQ ID NO: 882708 - DNA, 22 bp, Artificial Sequence
  chemically synthesized
gtttcctggtacatatagaagt

SEQ ID NO: 882709 - DNA, 22 bp, Artificial Sequence
  chemically synthesized
ggtttcctggtacatatagaag

SEQ ID NO: 882710 - DNA, 22 bp, Artificial Sequence
  chemically synthesized
tggtttcctggtacatatagaa

SEQ ID NO: 882711 - DNA, 22 bp, Artificial Sequence
  chemically synthesized
ttggtttcctggtacatataga

SEQ ID NO: 882712 - DNA, 22 bp, Artificial Sequence
  chemically synthesized
tttggtttcctggtacatatag

SEQ ID NO: 882713 - DNA, 22 bp, Artificial Sequence
  chemically synthesized
acttctatatgtaccaggaaac

SEQ ID NO: 882714 - DNA, 22 bp, Artificial Sequence
  chemically synthesized
ctatatgtaccaggaaaccaaa

SEQ ID NO: 882715 - DNA, 22 bp, Artificial Sequence
  chemically synthesized
tatatgtaccaggaaaccaaaa

SEQ ID NO: 882716 - DNA, 22 bp, Artificial Sequence
  chemically synthesized
tatgtaccaggaaaccaaaaag

SEQ ID NO: 882717 - DNA, 22 bp, Artificial Sequence
  chemically synthesized
cagaccaccataataaagtgag

SEQ ID NO: 882718 - DNA, 22 bp, Artificial Sequence
  chemically synthesized
agttccagaccaccataataaa

SEQ ID NO: 882719 - DNA, 22 bp, Artificial Sequence
  chemically synthesized
atgtgactcactttattatggt

SEQ ID NO: 882720 - DNA, 22 bp, Artificial Sequence
  chemically synthesized
aaggttcagttccagaccacca

SEQ ID NO: 882721 - DNA, 22 bp, Artificial Sequence
  chemically synthesized
actttattatggtggtctggaa

SEQ ID NO: 882722 - DNA, 22 bp, Artificial Sequence
  chemically synthesized
tattatggtggtctggaactga

SEQ ID NO: 882723 - DNA, 22 bp, Artificial Sequence
  chemically synthesized
attatggtggtctggaactgaa

SEQ ID NO: 882724 - DNA, 22 bp, Artificial Sequence
  chemically synthesized
agacactgaaggttcagttcca

SEQ ID NO: 882725 - DNA, 22 bp, Artificial Sequence
  chemically synthesized
ttatggtggtctggaactgaac

SEQ ID NO: 882726 - DNA, 22 bp, Artificial Sequence
  chemically synthesized
tgagacactgaaggttcagttc

SEQ ID NO: 882727 - DNA, 22 bp, Artificial Sequence
  chemically synthesized
tggtggtctggaactgaacctt

SEQ ID NO: 882728 - DNA, 22 bp, Artificial Sequence
  chemically synthesized
gaactgaaccttcagtgtctca

SEQ ID NO: 882729 - DNA, 22 bp, Artificial Sequence
  chemically synthesized
aaccttcagtgtctcagaggta

SEQ ID NO: 882730 - DNA, 22 bp, Artificial Sequence
  chemically synthesized
cagtgtctcagaggtatgcctg

SEQ ID NO: 882731 - DNA, 22 bp, Artificial Sequence
  chemically synthesized
agtgtctcagaggtatgcctgt

SEQ ID NO: 882732 - DNA, 22 bp, Artificial Sequence
  chemically synthesized
agaggtatgcctgtatatgtgt

SEQ ID NO: 882733 - DNA, 22 bp, Artificial Sequence
  chemically synthesized
tatatgtgtatacatatatata

SEQ ID NO: 882734 - DNA, 22 bp, Artificial Sequence
  chemically synthesized
atagcatacatatacatatata

SEQ ID NO: 882735 - DNA, 22 bp, Artificial Sequence
  chemically synthesized
catagcatacatatacatatat

SEQ ID NO: 882736 - DNA, 22 bp, Artificial Sequence
  chemically synthesized
ttcatagcatacatatacatat

SEQ ID NO: 882737 - DNA, 22 bp, Artificial Sequence
  chemically synthesized
cttcatagcatacatatacata

SEQ ID NO: 882738 - DNA, 22 bp, Artificial Sequence
  chemically synthesized
tcttcatagcatacatatacat

SEQ ID NO: 882739 - DNA, 22 bp, Artificial Sequence
  chemically synthesized
atctttcttcatagcatacata

SEQ ID NO: 882740 - DNA, 22 bp, Artificial Sequence
  chemically synthesized
aatctttcttcatagcatacat

SEQ ID NO: 882741 - DNA, 22 bp, Artificial Sequence
  chemically synthesized
taatctttcttcatagcataca

SEQ ID NO: 882742 - DNA, 22 bp, Artificial Sequence
  chemically synthesized
ttaatctttcttcatagcatac

SEQ ID NO: 882743 - DNA, 22 bp, Artificial Sequence
  chemically synthesized
tttaatctttcttcatagcata

SEQ ID NO: 882744 - DNA, 22 bp, Artificial Sequence
  chemically synthesized
tttttaatctttcttcatagca

SEQ ID NO: 882745 - DNA, 22 bp, Artificial Sequence
  chemically synthesized
ctctttttaatctttcttcata

SEQ ID NO: 882746 - DNA, 22 bp, Artificial Sequence
  chemically synthesized
actctttttaatctttcttcat

SEQ ID NO: 882747 - DNA, 22 bp, Artificial Sequence
  chemically synthesized
cttactctttttaatctttctt

SEQ ID NO: 882748 - DNA, 22 bp, Artificial Sequence
  chemically synthesized
tacttactctttttaatctttc

SEQ ID NO: 882749 - DNA, 22 bp, Artificial Sequence
  chemically synthesized
tctacttactctttttaatctt

SEQ ID NO: 882750 - DNA, 22 bp, Artificial Sequence
  chemically synthesized
tgaagaaagattaaaaagagta

SEQ ID NO: 882751 - DNA, 22 bp, Artificial Sequence
  chemically synthesized
tcactctctacttactcttttt

SEQ ID NO: 882752 - DNA, 22 bp, Artificial Sequence
  chemically synthesized
aaaagagtaagtagagagtgac

SEQ ID NO: 882753 - DNA, 22 bp, Artificial Sequence
  chemically synthesized
aaatagagcccactgtcactct

SEQ ID NO: 882754 - DNA, 22 bp, Artificial Sequence
  chemically synthesized
cctaaaatagagcccactgtca

SEQ ID NO: 882755 - DNA, 22 bp, Artificial Sequence
  chemically synthesized
acattgcctaaaatagagccca

SEQ ID NO: 882756 - DNA, 22 bp, Artificial Sequence
  chemically synthesized
tgctcacattgcctaaaataga

SEQ ID NO: 882757 - DNA, 22 bp, Artificial Sequence
  chemically synthesized
tgtgctcacattgcctaaaata

SEQ ID NO: 882758 - DNA, 22 bp, Artificial Sequence
  chemically synthesized
ctgtgctcacattgcctaaaat

SEQ ID NO: 882759 - DNA, 22 bp, Artificial Sequence
  chemically synthesized
tattttaggcaatgtgagcaca

SEQ ID NO: 882760 - DNA, 22 bp, Artificial Sequence
  chemically synthesized
ttttaggcaatgtgagcacaga

SEQ ID NO: 882761 - DNA, 22 bp, Artificial Sequence
  chemically synthesized
taggcaatgtgagcacagaaga

SEQ ID NO: 882762 - DNA, 22 bp, Artificial Sequence
  chemically synthesized
aggcaatgtgagcacagaagac

SEQ ID NO: 882763 - DNA, 22 bp, Artificial Sequence
  chemically synthesized
aagagaggagcagtcttctgtg

SEQ ID NO: 882764 - DNA, 22 bp, Artificial Sequence
  chemically synthesized
ggcaatgtgagcacagaagact

SEQ ID NO: 882765 - DNA, 22 bp, Artificial Sequence
  chemically synthesized
ctgaagagaggagcagtcttct

SEQ ID NO: 882766 - DNA, 22 bp, Artificial Sequence
  chemically synthesized
cctgaagagaggagcagtcttc

SEQ ID NO: 882767 - DNA, 22 bp, Artificial Sequence
  chemically synthesized
catttcctgaagagaggagcag

SEQ ID NO: 882768 - DNA, 22 bp, Artificial Sequence
  chemically synthesized
attccatttcctgaagagagga

SEQ ID NO: 882769 - DNA, 22 bp, Artificial Sequence
  chemically synthesized
cattccatttcctgaagagagg

SEQ ID NO: 882770 - DNA, 22 bp, Artificial Sequence
  chemically synthesized
acttcattccatttcctgaaga

SEQ ID NO: 882771 - DNA, 22 bp, Artificial Sequence
  chemically synthesized
cacttcattccatttcctgaag

SEQ ID NO: 882772 - DNA, 22 bp, Artificial Sequence
  chemically synthesized
ttcacttcattccatttcctga

SEQ ID NO: 882773 - DNA, 22 bp, Artificial Sequence
  chemically synthesized
cttcacttcattccatttcctg

SEQ ID NO: 882774 - DNA, 22 bp, Artificial Sequence
  chemically synthesized
ctcctctcttcaggaaatggaa

SEQ ID NO: 882775 - DNA, 22 bp, Artificial Sequence
  chemically synthesized
atttcttcacttcattccattt

SEQ ID NO: 882776 - DNA, 22 bp, Artificial Sequence
  chemically synthesized
ctctcttcaggaaatggaatga

SEQ ID NO: 882777 - DNA, 22 bp, Artificial Sequence
  chemically synthesized
tcttcaggaaatggaatgaagt

SEQ ID NO: 882778 - DNA, 22 bp, Artificial Sequence
  chemically synthesized
ttcaggaaatggaatgaagtga

SEQ ID NO: 882779 - DNA, 22 bp, Artificial Sequence
  chemically synthesized
caggaaatggaatgaagtgaag

SEQ ID NO: 882780 - DNA, 22 bp, Artificial Sequence
  chemically synthesized
aggaaatggaatgaagtgaaga

SEQ ID NO: 882781 - DNA, 22 bp, Artificial Sequence
  chemically synthesized
acatgactcatttcttcacttc

SEQ ID NO: 882782 - DNA, 22 bp, Artificial Sequence
  chemically synthesized
agtatgttgacatgactcattt

SEQ ID NO: 882783 - DNA, 22 bp, Artificial Sequence
  chemically synthesized
cagtatgttgacatgactcatt

SEQ ID NO: 882784 - DNA, 22 bp, Artificial Sequence
  chemically synthesized
aaatagtcttcagtatgttgac

SEQ ID NO: 882785 - DNA, 22 bp, Artificial Sequence
  chemically synthesized
cctgaaatagtcttcagtatgt

SEQ ID NO: 882786 - DNA, 22 bp, Artificial Sequence
  chemically synthesized
tgcctgaaatagtcttcagtat

SEQ ID NO: 882787 - DNA, 22 bp, Artificial Sequence
  chemically synthesized
cctctgcctgaaatagtcttca

SEQ ID NO: 882788 - DNA, 22 bp, Artificial Sequence
  chemically synthesized
ccctctgcctgaaatagtcttc

SEQ ID NO: 882789 - DNA, 22 bp, Artificial Sequence
  chemically synthesized
tccctctgcctgaaatagtctt

SEQ ID NO: 882790 - DNA, 22 bp, Artificial Sequence
  chemically synthesized
ttccctctgcctgaaatagtct

SEQ ID NO: 882791 - DNA, 22 bp, Artificial Sequence
  chemically synthesized
cttttccctctgcctgaaatag

SEQ ID NO: 882792 - DNA, 22 bp, Artificial Sequence
  chemically synthesized
gcttttccctctgcctgaaata

SEQ ID NO: 882793 - DNA, 22 bp, Artificial Sequence
  chemically synthesized
aagactatttcaggcagaggga

SEQ ID NO: 882794 - DNA, 22 bp, Artificial Sequence
  chemically synthesized
gcaatggaacttgcttttccct

SEQ ID NO: 882795 - DNA, 22 bp, Artificial Sequence
  chemically synthesized
ggcaatggaacttgcttttccc

SEQ ID NO: 882796 - DNA, 22 bp, Artificial Sequence
  chemically synthesized
tttcaggcagagggaaaagcaa

SEQ ID NO: 882797 - DNA, 22 bp, Artificial Sequence
  chemically synthesized
tggcaatggaacttgcttttcc

SEQ ID NO: 882798 - DNA, 22 bp, Artificial Sequence
  chemically synthesized
ttggcaatggaacttgcttttc

SEQ ID NO: 882799 - DNA, 22 bp, Artificial Sequence
  chemically synthesized
caggcagagggaaaagcaagtt

SEQ ID NO: 882800 - DNA, 22 bp, Artificial Sequence
  chemically synthesized
aggcagagggaaaagcaagttc

SEQ ID NO: 882801 - DNA, 22 bp, Artificial Sequence
  chemically synthesized
accgccttttggcaatggaact

SEQ ID NO: 882802 - DNA, 22 bp, Artificial Sequence
  chemically synthesized
ctcaccgccttttggcaatgga

SEQ ID NO: 882803 - DNA, 22 bp, Artificial Sequence
  chemically synthesized
cattgccaaaaggcggtgagga

SEQ ID NO: 882804 - DNA, 22 bp, Artificial Sequence
  chemically synthesized
tacaagcaaaactcctcaccgc

SEQ ID NO: 882805 - DNA, 22 bp, Artificial Sequence
  chemically synthesized
atacaagcaaaactcctcaccg

SEQ ID NO: 882806 - DNA, 22 bp, Artificial Sequence
  chemically synthesized
ccaaaaggcggtgaggagtttt

SEQ ID NO: 882807 - DNA, 22 bp, Artificial Sequence
  chemically synthesized
aaatccttatacaagcaaaact

SEQ ID NO: 882808 - DNA, 22 bp, Artificial Sequence
  chemically synthesized
caaatccttatacaagcaaaac

SEQ ID NO: 882809 - DNA, 22 bp, Artificial Sequence
  chemically synthesized
cttcaaatccttatacaagcaa

SEQ ID NO: 882810 - DNA, 22 bp, Artificial Sequence
  chemically synthesized
tactacttcaaatccttataca

SEQ ID NO: 882811 - DNA, 22 bp, Artificial Sequence
  chemically synthesized
tgcttgtataaggatttgaagt

SEQ ID NO: 882812 - DNA, 22 bp, Artificial Sequence
  chemically synthesized
gcttgtataaggatttgaagta

SEQ ID NO: 882813 - DNA, 22 bp, Artificial Sequence
  chemically synthesized
cttgtataaggatttgaagtag

SEQ ID NO: 882814 - DNA, 22 bp, Artificial Sequence
  chemically synthesized
acagagcattgtactacttcaa

SEQ ID NO: 882815 - DNA, 22 bp, Artificial Sequence
  chemically synthesized
gtataaggatttgaagtagtac

SEQ ID NO: 882816 - DNA, 22 bp, Artificial Sequence
  chemically synthesized
tataaggatttgaagtagtaca

SEQ ID NO: 882817 - DNA, 22 bp, Artificial Sequence
  chemically synthesized
tgttaacagagcattgtactac

SEQ ID NO: 882818 - DNA, 22 bp, Artificial Sequence
  chemically synthesized
atgttaacagagcattgtacta

SEQ ID NO: 882819 - DNA, 22 bp, Artificial Sequence
  chemically synthesized
gaagtagtacaatgctctgtta

SEQ ID NO: 882820 - DNA, 22 bp, Artificial Sequence
  chemically synthesized
aagtagtacaatgctctgttaa

SEQ ID NO: 882821 - DNA, 22 bp, Artificial Sequence
  chemically synthesized
tacatatttatgttaacagagc

SEQ ID NO: 882822 - DNA, 22 bp, Artificial Sequence
  chemically synthesized
tgtacatatttatgttaacaga

SEQ ID NO: 882823 - DNA, 22 bp, Artificial Sequence
  chemically synthesized
aatgattctgtacatatttatg

SEQ ID NO: 882824 - DNA, 22 bp, Artificial Sequence
  chemically synthesized
tgttaacataaatatgtacaga

SEQ ID NO: 882825 - DNA, 22 bp, Artificial Sequence
  chemically synthesized
ttaacataaatatgtacagaat

SEQ ID NO: 882826 - DNA, 22 bp, Artificial Sequence
  chemically synthesized
taacacctgaatgattctgtac

SEQ ID NO: 882827 - DNA, 22 bp, Artificial Sequence
  chemically synthesized
acataaatatgtacagaatcat

SEQ ID NO: 882828 - DNA, 22 bp, Artificial Sequence
  chemically synthesized
tataacacctgaatgattctgt

SEQ ID NO: 882829 - DNA, 22 bp, Artificial Sequence
  chemically synthesized
tcctctataacacctgaatgat

SEQ ID NO: 882830 - DNA, 22 bp, Artificial Sequence
  chemically synthesized
tgtcctctataacacctgaatg

SEQ ID NO: 882831 - DNA, 22 bp, Artificial Sequence
  chemically synthesized
ttctgtcctctataacacctga

SEQ ID NO: 882832 - DNA, 22 bp, Artificial Sequence
  chemically synthesized
attctgtcctctataacacctg

SEQ ID NO: 882833 - DNA, 22 bp, Artificial Sequence
  chemically synthesized
tattctgtcctctataacacct

SEQ ID NO: 882834 - DNA, 22 bp, Artificial Sequence
  chemically synthesized
aggtgttatagaggacagaata

SEQ ID NO: 882835 - DNA, 22 bp, Artificial Sequence
  chemically synthesized
tagaggacagaataaagtctct

SEQ ID NO: 882836 - DNA, 22 bp, Artificial Sequence
  chemically synthesized
tctctctctctctctctctctc

SEQ ID NO: 882837 - DNA, 22 bp, Artificial Sequence
  chemically synthesized
tctctctctctctctctctctc

SEQ ID NO: 882838 - DNA, 22 bp, Artificial Sequence
  chemically synthesized
tctctctctctctctctctctc

SEQ ID NO: 882839 - DNA, 22 bp, Artificial Sequence
  chemically synthesized
tctctctctctctctctctctc

SEQ ID NO: 882840 - DNA, 22 bp, Artificial Sequence
  chemically synthesized
tctctctctctctctctctctc

SEQ ID NO: 882841 - DNA, 22 bp, Artificial Sequence
  chemically synthesized
tctctctctctctctctctctc

SEQ ID NO: 882842 - DNA, 22 bp, Artificial Sequence
  chemically synthesized
tctctctctctctctctctctc

SEQ ID NO: 882843 - DNA, 22 bp, Artificial Sequence
  chemically synthesized
tctctctctctctctctctctc

SEQ ID NO: 882844 - DNA, 22 bp, Artificial Sequence
  chemically synthesized
tctctctctctctctctctctc

SEQ ID NO: 882845 - DNA, 22 bp, Artificial Sequence
  chemically synthesized
tctctctctctctctctctctc

SEQ ID NO: 882846 - DNA, 22 bp, Artificial Sequence
  chemically synthesized
tctctctctctctctctctctc

SEQ ID NO: 882847 - DNA, 22 bp, Artificial Sequence
  chemically synthesized
tctctctctctctctctctctc

SEQ ID NO: 882848 - DNA, 22 bp, Artificial Sequence
  chemically synthesized
tctctctctctctctctctctc

SEQ ID NO: 882849 - DNA, 22 bp, Artificial Sequence
  chemically synthesized
tctctctctctctctctctccc

SEQ ID NO: 882850 - DNA, 22 bp, Artificial Sequence
  chemically synthesized
tctctctctctctctctccctc

SEQ ID NO: 882851 - DNA, 22 bp, Artificial Sequence
  chemically synthesized
tctctctctctctctccctctc

SEQ ID NO: 882852 - DNA, 22 bp, Artificial Sequence
  chemically synthesized
tctctctctctctccctctcct

SEQ ID NO: 882853 - DNA, 22 bp, Artificial Sequence
  chemically synthesized
tctctctctctccctctcctcc

SEQ ID NO: 882854 - DNA, 22 bp, Artificial Sequence
  chemically synthesized
tctctctctccctctcctcccg

SEQ ID NO: 882855 - DNA, 22 bp, Artificial Sequence
  chemically synthesized
tctctctccctctcctcccgtc

SEQ ID NO: 882856 - DNA, 22 bp, Artificial Sequence
  chemically synthesized
agagaaagagagggacgggagg

SEQ ID NO: 882857 - DNA, 22 bp, Artificial Sequence
  chemically synthesized
tctctccctctcctcccgtccc

SEQ ID NO: 882858 - DNA, 22 bp, Artificial Sequence
  chemically synthesized
gagagaaagagagggacgggag

SEQ ID NO: 882859 - DNA, 22 bp, Artificial Sequence
  chemically synthesized
tctccctctcctcccgtccctc

SEQ ID NO: 882860 - DNA, 22 bp, Artificial Sequence
  chemically synthesized
tccctctcctcccgtccctctc

SEQ ID NO: 882861 - DNA, 22 bp, Artificial Sequence
  chemically synthesized
cctctcctcccgtccctctctt

SEQ ID NO: 882862 - DNA, 22 bp, Artificial Sequence
  chemically synthesized
tcctcccgtccctctctttctc

SEQ ID NO: 882863 - DNA, 22 bp, Artificial Sequence
  chemically synthesized
ctcccgtccctctctttctctc

SEQ ID NO: 882864 - DNA, 22 bp, Artificial Sequence
  chemically synthesized
ccgtccctctctttctctcaag

SEQ ID NO: 882865 - DNA, 22 bp, Artificial Sequence
  chemically synthesized
gtatatacaatcaacttgagag

SEQ ID NO: 882866 - DNA, 22 bp, Artificial Sequence
  chemically synthesized
ggtatatacaatcaacttgaga

SEQ ID NO: 882867 - DNA, 22 bp, Artificial Sequence
  chemically synthesized
ttggtatatacaatcaacttga

SEQ ID NO: 882868 - DNA, 22 bp, Artificial Sequence
  chemically synthesized
tctttctctcaagttgattgta

SEQ ID NO: 882869 - DNA, 22 bp, Artificial Sequence
  chemically synthesized
agctcttggtatatacaatcaa

SEQ ID NO: 882870 - DNA, 22 bp, Artificial Sequence
  chemically synthesized
tttctctcaagttgattgtata

SEQ ID NO: 882871 - DNA, 22 bp, Artificial Sequence
  chemically synthesized
tctctcaagttgattgtatata

SEQ ID NO: 882872 - DNA, 22 bp, Artificial Sequence
  chemically synthesized
ctctcaagttgattgtatatac

SEQ ID NO: 882873 - DNA, 22 bp, Artificial Sequence
  chemically synthesized
tctcaagttgattgtatatacc

SEQ ID NO: 882874 - DNA, 22 bp, Artificial Sequence
  chemically synthesized
tcaagttgattgtatataccaa

SEQ ID NO: 882875 - DNA, 22 bp, Artificial Sequence
  chemically synthesized
aagttgattgtatataccaaga

SEQ ID NO: 882876 - DNA, 22 bp, Artificial Sequence
  chemically synthesized
caaagtactaagctcttggtat

SEQ ID NO: 882877 - DNA, 22 bp, Artificial Sequence
  chemically synthesized
attgtatataccaagagcttag

SEQ ID NO: 882878 - DNA, 22 bp, Artificial Sequence
  chemically synthesized
tatataccaagagcttagtact

SEQ ID NO: 882879 - DNA, 22 bp, Artificial Sequence
  chemically synthesized
gtatccaagaaatattacaaag

SEQ ID NO: 882880 - DNA, 22 bp, Artificial Sequence
  chemically synthesized
agtactttgtaatatttcttgg

SEQ ID NO: 882881 - DNA, 22 bp, Artificial Sequence
  chemically synthesized
gtactttgtaatatttcttgga

SEQ ID NO: 882882 - DNA, 22 bp, Artificial Sequence
  chemically synthesized
tgtaatatttcttggataccaa

SEQ ID NO: 882883 - DNA, 22 bp, Artificial Sequence
  chemically synthesized
gtaatatttcttggataccaac

SEQ ID NO: 882884 - DNA, 22 bp, Artificial Sequence
  chemically synthesized
taatatttcttggataccaacc

SEQ ID NO: 882885 - DNA, 22 bp, Artificial Sequence
  chemically synthesized
aaagagtcaaatcagggttggt

SEQ ID NO: 882886 - DNA, 22 bp, Artificial Sequence
  chemically synthesized
aaaagagtcaaatcagggttgg

SEQ ID NO: 882887 - DNA, 22 bp, Artificial Sequence
  chemically synthesized
cttggataccaaccctgatttg

SEQ ID NO: 882888 - DNA, 22 bp, Artificial Sequence
  chemically synthesized
ttggataccaaccctgatttga

SEQ ID NO: 882889 - DNA, 22 bp, Artificial Sequence
  chemically synthesized
ggataccaaccctgatttgact

SEQ ID NO: 882890 - DNA, 22 bp, Artificial Sequence
  chemically synthesized
tcatcttaaaagagtcaaatca

SEQ ID NO: 882891 - DNA, 22 bp, Artificial Sequence
  chemically synthesized
gataccaaccctgatttgactc

SEQ ID NO: 882892 - DNA, 22 bp, Artificial Sequence
  chemically synthesized
gagttatcatcttaaaagagtc

SEQ ID NO: 882893 - DNA, 22 bp, Artificial Sequence
  chemically synthesized
ccgctagagttatcatcttaaa

SEQ ID NO: 882894 - DNA, 22 bp, Artificial Sequence
  chemically synthesized
atttgactcttttaagatgata

SEQ ID NO: 882895 - DNA, 22 bp, Artificial Sequence
  chemically synthesized
gactcttttaagatgataactc

SEQ ID NO: 882896 - DNA, 22 bp, Artificial Sequence
  chemically synthesized
actcttttaagatgataactct

SEQ ID NO: 882897 - DNA, 22 bp, Artificial Sequence
  chemically synthesized
caatctgccgctagagttatca

SEQ ID NO: 882898 - DNA, 22 bp, Artificial Sequence
  chemically synthesized
ttttaagatgataactctagcg

SEQ ID NO: 882899 - DNA, 22 bp, Artificial Sequence
  chemically synthesized
cctccaatctgccgctagagtt

SEQ ID NO: 882900 - DNA, 22 bp, Artificial Sequence
  chemically synthesized
gcctccaatctgccgctagagt

SEQ ID NO: 882901 - DNA, 22 bp, Artificial Sequence
  chemically synthesized
ttaagatgataactctagcggc

SEQ ID NO: 882902 - DNA, 22 bp, Artificial Sequence
  chemically synthesized
taagatgataactctagcggca

SEQ ID NO: 882903 - DNA, 22 bp, Artificial Sequence
  chemically synthesized
aagatgataactctagcggcag

SEQ ID NO: 882904 - DNA, 22 bp, Artificial Sequence
  chemically synthesized
agatgataactctagcggcaga

SEQ ID NO: 882905 - DNA, 22 bp, Artificial Sequence
  chemically synthesized
aaatcttgcctccaatctgccg

SEQ ID NO: 882906 - DNA, 22 bp, Artificial Sequence
  chemically synthesized
aaaatcttgcctccaatctgcc

SEQ ID NO: 882907 - DNA, 22 bp, Artificial Sequence
  chemically synthesized
tccttaaaatcttgcctccaat

SEQ ID NO: 882908 - DNA, 22 bp, Artificial Sequence
  chemically synthesized
atccttaaaatcttgcctccaa

SEQ ID NO: 882909 - DNA, 22 bp, Artificial Sequence
  chemically synthesized
tagcggcagattggaggcaaga

SEQ ID NO: 882910 - DNA, 22 bp, Artificial Sequence
  chemically synthesized
gcggcagattggaggcaagatt

SEQ ID NO: 882911 - DNA, 22 bp, Artificial Sequence
  chemically synthesized
caccagccccttatccttaaaa

SEQ ID NO: 882912 - DNA, 22 bp, Artificial Sequence
  chemically synthesized
ccaccagccccttatccttaaa

SEQ ID NO: 882913 - DNA, 22 bp, Artificial Sequence
  chemically synthesized
gaggcaagattttaaggataag

SEQ ID NO: 882914 - DNA, 22 bp, Artificial Sequence
  chemically synthesized
ttccaccagccccttatcctta

SEQ ID NO: 882915 - DNA, 22 bp, Artificial Sequence
  chemically synthesized
cttccaccagccccttatcctt

SEQ ID NO: 882916 - DNA, 22 bp, Artificial Sequence
  chemically synthesized
tgtttcttccaccagcccctta

SEQ ID NO: 882917 - DNA, 22 bp, Artificial Sequence
  chemically synthesized
ctatgtttcttccaccagcccc

SEQ ID NO: 882918 - DNA, 22 bp, Artificial Sequence
  chemically synthesized
cctatgtttcttccaccagccc

SEQ ID NO: 882919 - DNA, 22 bp, Artificial Sequence
  chemically synthesized
taaggataaggggctggtggaa

SEQ ID NO: 882920 - DNA, 22 bp, Artificial Sequence
  chemically synthesized
aaggataaggggctggtggaag

SEQ ID NO: 882921 - DNA, 22 bp, Artificial Sequence
  chemically synthesized
aggataaggggctggtggaaga

SEQ ID NO: 882922 - DNA, 22 bp, Artificial Sequence
  chemically synthesized
aaggcatttcctatgtttcttc

SEQ ID NO: 882923 - DNA, 22 bp, Artificial Sequence
  chemically synthesized
taaaggcatttcctatgtttct

SEQ ID NO: 882924 - DNA, 22 bp, Artificial Sequence
  chemically synthesized
gtggaagaaacataggaaatgc

SEQ ID NO: 882925 - DNA, 22 bp, Artificial Sequence
  chemically synthesized
ggacctctaaaggcatttccta

SEQ ID NO: 882926 - DNA, 22 bp, Artificial Sequence
  chemically synthesized
aataagtactcggacctctaaa

SEQ ID NO: 882927 - DNA, 22 bp, Artificial Sequence
  chemically synthesized
ttcaataagtactcggacctct

SEQ ID NO: 882928 - DNA, 22 bp, Artificial Sequence
  chemically synthesized
gttcaataagtactcggacctc

SEQ ID NO: 882929 - DNA, 22 bp, Artificial Sequence
  chemically synthesized
tttgttcaataagtactcggac

SEQ ID NO: 882930 - DNA, 22 bp, Artificial Sequence
  chemically synthesized
ctgtttgttcaataagtactcg

SEQ ID NO: 882931 - DNA, 22 bp, Artificial Sequence
  chemically synthesized
ctcctgtttgttcaataagtac

SEQ ID NO: 882932 - DNA, 22 bp, Artificial Sequence
  chemically synthesized
tagaggtccgagtacttattga

SEQ ID NO: 882933 - DNA, 22 bp, Artificial Sequence
  chemically synthesized
agaggtccgagtacttattgaa

SEQ ID NO: 882934 - DNA, 22 bp, Artificial Sequence
  chemically synthesized
gaggtccgagtacttattgaac

SEQ ID NO: 882935 - DNA, 22 bp, Artificial Sequence
  chemically synthesized
aacatccgtgctgctcctgttt

SEQ ID NO: 882936 - DNA, 22 bp, Artificial Sequence
  chemically synthesized
ctgaacatccgtgctgctcctg

SEQ ID NO: 882937 - DNA, 22 bp, Artificial Sequence
  chemically synthesized
cctgaacatccgtgctgctcct

SEQ ID NO: 882938 - DNA, 22 bp, Artificial Sequence
  chemically synthesized
attgaacaaacaggagcagcac

SEQ ID NO: 882939 - DNA, 22 bp, Artificial Sequence
  chemically synthesized
ttgaacaaacaggagcagcacg

SEQ ID NO: 882940 - DNA, 22 bp, Artificial Sequence
  chemically synthesized
aacaaacaggagcagcacggat

SEQ ID NO: 882941 - DNA, 22 bp, Artificial Sequence
  chemically synthesized
tccacaacataggaataatact

SEQ ID NO: 882942 - DNA, 22 bp, Artificial Sequence
  chemically synthesized
atccacaacataggaataatac

SEQ ID NO: 882943 - DNA, 22 bp, Artificial Sequence
  chemically synthesized
tatccacaacataggaataata

SEQ ID NO: 882944 - DNA, 22 bp, Artificial Sequence
  chemically synthesized
aggaagtattattcctatgttg

SEQ ID NO: 882945 - DNA, 22 bp, Artificial Sequence
  chemically synthesized
ccagtcctttatccacaacata

SEQ ID NO: 882946 - DNA, 22 bp, Artificial Sequence
  chemically synthesized
ttcctatgttgtggataaagga

SEQ ID NO: 882947 - DNA, 22 bp, Artificial Sequence
  chemically synthesized
ctatgttgtggataaaggactg

SEQ ID NO: 882948 - DNA, 22 bp, Artificial Sequence
  chemically synthesized
tgttgtggataaaggactggca

SEQ ID NO: 882949 - DNA, 22 bp, Artificial Sequence
  chemically synthesized
cccatcaagtcctgccagtcct

SEQ ID NO: 882950 - DNA, 22 bp, Artificial Sequence
  chemically synthesized
ccccatcaagtcctgccagtcc

SEQ ID NO: 882951 - DNA, 22 bp, Artificial Sequence
  chemically synthesized
tccccatcaagtcctgccagtc

SEQ ID NO: 882952 - DNA, 22 bp, Artificial Sequence
  chemically synthesized
ttccccatcaagtcctgccagt

SEQ ID NO: 882953 - DNA, 22 bp, Artificial Sequence
  chemically synthesized
tttccccatcaagtcctgccag

SEQ ID NO: 882954 - DNA, 22 bp, Artificial Sequence
  chemically synthesized
tggataaaggactggcaggact

SEQ ID NO: 882955 - DNA, 22 bp, Artificial Sequence
  chemically synthesized
tttttccccatcaagtcctgcc

SEQ ID NO: 882956 - DNA, 22 bp, Artificial Sequence
  chemically synthesized
ctttttccccatcaagtcctgc

SEQ ID NO: 882957 - DNA, 22 bp, Artificial Sequence
  chemically synthesized
tctttttccccatcaagtcctg

SEQ ID NO: 882958 - DNA, 22 bp, Artificial Sequence
  chemically synthesized
aaaattttctttttccccatca

SEQ ID NO: 882959 - DNA, 22 bp, Artificial Sequence
  chemically synthesized
tgaaaattttctttttccccat

SEQ ID NO: 882960 - DNA, 22 bp, Artificial Sequence
  chemically synthesized
gcaggacttgatggggaaaaag

SEQ ID NO: 882961 - DNA, 22 bp, Artificial Sequence
  chemically synthesized
gtgattctgaaaattttctttt

SEQ ID NO: 882962 - DNA, 22 bp, Artificial Sequence
  chemically synthesized
ggtgattctgaaaattttcttt

SEQ ID NO: 882963 - DNA, 22 bp, Artificial Sequence
  chemically synthesized
gatggggaaaaagaaaattttc

SEQ ID NO: 882964 - DNA, 22 bp, Artificial Sequence
  chemically synthesized
atggggaaaaagaaaattttca

SEQ ID NO: 882965 - DNA, 22 bp, Artificial Sequence
  chemically synthesized
taaaatcttggtgattctgaaa

SEQ ID NO: 882966 - DNA, 22 bp, Artificial Sequence
  chemically synthesized
ccaagttataaaatcttggtga

SEQ ID NO: 882967 - DNA, 22 bp, Artificial Sequence
  chemically synthesized
tcccaagttataaaatcttggt

SEQ ID NO: 882968 - DNA, 22 bp, Artificial Sequence
  chemically synthesized
ctcccaagttataaaatcttgg

SEQ ID NO: 882969 - DNA, 22 bp, Artificial Sequence
  chemically synthesized
tcagaatcaccaagattttata

SEQ ID NO: 882970 - DNA, 22 bp, Artificial Sequence
  chemically synthesized
cagaatcaccaagattttataa

SEQ ID NO: 882971 - DNA, 22 bp, Artificial Sequence
  chemically synthesized
agaatcaccaagattttataac

SEQ ID NO: 882972 - DNA, 22 bp, Artificial Sequence
  chemically synthesized
gacagtttctcccaagttataa

SEQ ID NO: 882973 - DNA, 22 bp, Artificial Sequence
  chemically synthesized
tacccctagacagtttctccca

SEQ ID NO: 882974 - DNA, 22 bp, Artificial Sequence
  chemically synthesized
cctgtacccctagacagtttct

SEQ ID NO: 882975 - DNA, 22 bp, Artificial Sequence
  chemically synthesized
tataacttgggagaaactgtct

SEQ ID NO: 882976 - DNA, 22 bp, Artificial Sequence
  chemically synthesized
ccctgtacccctagacagtttc

SEQ ID NO: 882977 - DNA, 22 bp, Artificial Sequence
  chemically synthesized
ataacttgggagaaactgtcta

SEQ ID NO: 882978 - DNA, 22 bp, Artificial Sequence
  chemically synthesized
taacttgggagaaactgtctag

SEQ ID NO: 882979 - DNA, 22 bp, Artificial Sequence
  chemically synthesized
tcttccctgtacccctagacag

SEQ ID NO: 882980 - DNA, 22 bp, Artificial Sequence
  chemically synthesized
tgtcttccctgtacccctagac

SEQ ID NO: 882981 - DNA, 22 bp, Artificial Sequence
  chemically synthesized
gggagaaactgtctaggggtac

SEQ ID NO: 882982 - DNA, 22 bp, Artificial Sequence
  chemically synthesized
ggagaaactgtctaggggtaca

SEQ ID NO: 882983 - DNA, 22 bp, Artificial Sequence
  chemically synthesized
ctctgtcttccctgtaccccta

SEQ ID NO: 882984 - DNA, 22 bp, Artificial Sequence
  chemically synthesized
tctaggggtacagggaagacag

SEQ ID NO: 882985 - DNA, 22 bp, Artificial Sequence
  chemically synthesized
ggggtacagggaagacagagga

SEQ ID NO: 882986 - DNA, 22 bp, Artificial Sequence
  chemically synthesized
catatagggacaggctcctctg

SEQ ID NO: 882987 - DNA, 22 bp, Artificial Sequence
  chemically synthesized
ccatatagggacaggctcctct

SEQ ID NO: 882988 - DNA, 22 bp, Artificial Sequence
  chemically synthesized
cttccatatagggacaggctcc

SEQ ID NO: 882989 - DNA, 22 bp, Artificial Sequence
  chemically synthesized
ttccttccatatagggacaggc

SEQ ID NO: 882990 - DNA, 22 bp, Artificial Sequence
  chemically synthesized
aaaacattattccttccatata

SEQ ID NO: 882991 - DNA, 22 bp, Artificial Sequence
  chemically synthesized
caacctgaaaacattattcctt

SEQ ID NO: 882992 - DNA, 22 bp, Artificial Sequence
  chemically synthesized
tccctatatggaaggaataatg

SEQ ID NO: 882993 - DNA, 22 bp, Artificial Sequence
  chemically synthesized
tatggaaggaataatgttttca

SEQ ID NO: 882994 - DNA, 22 bp, Artificial Sequence
  chemically synthesized
atgtctccaacctgaaaacatt

SEQ ID NO: 882995 - DNA, 22 bp, Artificial Sequence
  chemically synthesized
actcatgtctccaacctgaaaa

SEQ ID NO: 882996 - DNA, 22 bp, Artificial Sequence
  chemically synthesized
gactcatgtctccaacctgaaa

SEQ ID NO: 882997 - DNA, 22 bp, Artificial Sequence
  chemically synthesized
tcaggttggagacatgagtcaa

SEQ ID NO: 882998 - DNA, 22 bp, Artificial Sequence
  chemically synthesized
atcacaggcatcttgactcatg

SEQ ID NO: 882999 - DNA, 22 bp, Artificial Sequence
  chemically synthesized
caggttggagacatgagtcaag

SEQ ID NO: 883000 - DNA, 22 bp, Artificial Sequence
  chemically synthesized
aggttggagacatgagtcaaga

SEQ ID NO: 883001 - DNA, 22 bp, Artificial Sequence
  chemically synthesized
gagacatgagtcaagatgcctg

SEQ ID NO: 883002 - DNA, 22 bp, Artificial Sequence
  chemically synthesized
catcagtgttaatcacaggcat

SEQ ID NO: 883003 - DNA, 22 bp, Artificial Sequence
  chemically synthesized
gcatcagtgttaatcacaggca

SEQ ID NO: 883004 - DNA, 22 bp, Artificial Sequence
  chemically synthesized
tacatttgcatcagtgttaatc

SEQ ID NO: 883005 - DNA, 22 bp, Artificial Sequence
  chemically synthesized
tgtacatttgcatcagtgttaa

SEQ ID NO: 883006 - DNA, 22 bp, Artificial Sequence
  chemically synthesized
ctgtacatttgcatcagtgtta

SEQ ID NO: 883007 - DNA, 22 bp, Artificial Sequence
  chemically synthesized
tctgtacatttgcatcagtgtt

SEQ ID NO: 883008 - DNA, 22 bp, Artificial Sequence
  chemically synthesized
ctttctgtacatttgcatcagt

SEQ ID NO: 883009 - DNA, 22 bp, Artificial Sequence
  chemically synthesized
tgattaacactgatgcaaatgt

SEQ ID NO: 883010 - DNA, 22 bp, Artificial Sequence
  chemically synthesized
caattactttctgtacatttgc

SEQ ID NO: 883011 - DNA, 22 bp, Artificial Sequence
  chemically synthesized
gcaattactttctgtacatttg

SEQ ID NO: 883012 - DNA, 22 bp, Artificial Sequence
  chemically synthesized
tgcaattactttctgtacattt

SEQ ID NO: 883013 - DNA, 22 bp, Artificial Sequence
  chemically synthesized
ttgcaattactttctgtacatt

SEQ ID NO: 883014 - DNA, 22 bp, Artificial Sequence
  chemically synthesized
acactgatgcaaatgtacagaa

SEQ ID NO: 883015 - DNA, 22 bp, Artificial Sequence
  chemically synthesized
tttgcaattactttctgtacat

SEQ ID NO: 883016 - DNA, 22 bp, Artificial Sequence
  chemically synthesized
tttttgcaattactttctgtac

SEQ ID NO: 883017 - DNA, 22 bp, Artificial Sequence
  chemically synthesized
ctttttgcaattactttctgta

SEQ ID NO: 883018 - DNA, 22 bp, Artificial Sequence
  chemically synthesized
atgcaaatgtacagaaagtaat

SEQ ID NO: 883019 - DNA, 22 bp, Artificial Sequence
  chemically synthesized
cgcttctttttgcaattacttt

SEQ ID NO: 883020 - DNA, 22 bp, Artificial Sequence
  chemically synthesized
cacactacgcttctttttgcaa

SEQ ID NO: 883021 - DNA, 22 bp, Artificial Sequence
  chemically synthesized
atctgcacactacgcttctttt

SEQ ID NO: 883022 - DNA, 22 bp, Artificial Sequence
  chemically synthesized
cccctaatctgcacactacgct

SEQ ID NO: 883023 - DNA, 22 bp, Artificial Sequence
  chemically synthesized
acccctaatctgcacactacgc

SEQ ID NO: 883024 - DNA, 22 bp, Artificial Sequence
  chemically synthesized
caaaaagaagcgtagtgtgcag

SEQ ID NO: 883025 - DNA, 22 bp, Artificial Sequence
  chemically synthesized
gccttacccctaatctgcacac

SEQ ID NO: 883026 - DNA, 22 bp, Artificial Sequence
  chemically synthesized
agccttacccctaatctgcaca

SEQ ID NO: 883027 - DNA, 22 bp, Artificial Sequence
  chemically synthesized
ttagccttacccctaatctgca

SEQ ID NO: 883028 - DNA, 22 bp, Artificial Sequence
  chemically synthesized
tattcttagccttacccctaat

SEQ ID NO: 883029 - DNA, 22 bp, Artificial Sequence
  chemically synthesized
caaacctgtattcttagcctta

SEQ ID NO: 883030 - DNA, 22 bp, Artificial Sequence
  chemically synthesized
cctccaaacctgtattcttagc

SEQ ID NO: 883031 - DNA, 22 bp, Artificial Sequence
  chemically synthesized
acctccaaacctgtattcttag

SEQ ID NO: 883032 - DNA, 22 bp, Artificial Sequence
  chemically synthesized
tacctccaaacctgtattctta

SEQ ID NO: 883033 - DNA, 22 bp, Artificial Sequence
  chemically synthesized
ttacctccaaacctgtattctt

SEQ ID NO: 883034 - DNA, 22 bp, Artificial Sequence
  chemically synthesized
ggggtaaggctaagaatacagg

SEQ ID NO: 883035 - DNA, 22 bp, Artificial Sequence
  chemically synthesized
tttttacctccaaacctgtatt

SEQ ID NO: 883036 - DNA, 22 bp, Artificial Sequence
  chemically synthesized
ctatttttacctccaaacctgt

SEQ ID NO: 883037 - DNA, 22 bp, Artificial Sequence
  chemically synthesized
agaatacaggtttggaggtaaa

SEQ ID NO: 883038 - DNA, 22 bp, Artificial Sequence
  chemically synthesized
tccaactactatttttacctcc

SEQ ID NO: 883039 - DNA, 22 bp, Artificial Sequence
  chemically synthesized
ggacaatattgtccaactacta

SEQ ID NO: 883040 - DNA, 22 bp, Artificial Sequence
  chemically synthesized
ggaggtaaaaatagtagttgga

SEQ ID NO: 883041 - DNA, 22 bp, Artificial Sequence
  chemically synthesized
gaggtaaaaatagtagttggac

SEQ ID NO: 883042 - DNA, 22 bp, Artificial Sequence
  chemically synthesized
caagtatcactgggacaatatt

SEQ ID NO: 883043 - DNA, 22 bp, Artificial Sequence
  chemically synthesized
tacaagtatcactgggacaata

SEQ ID NO: 883044 - DNA, 22 bp, Artificial Sequence
  chemically synthesized
gacaatattgtcccagtgatac

SEQ ID NO: 883045 - DNA, 22 bp, Artificial Sequence
  chemically synthesized
agtcactctacaagtatcactg

SEQ ID NO: 883046 - DNA, 22 bp, Artificial Sequence
  chemically synthesized
cagtcactctacaagtatcact

SEQ ID NO: 883047 - DNA, 22 bp, Artificial Sequence
  chemically synthesized
ttcagtcactctacaagtatca

SEQ ID NO: 883048 - DNA, 22 bp, Artificial Sequence
  chemically synthesized
tcctcttcagtcactctacaag

SEQ ID NO: 883049 - DNA, 22 bp, Artificial Sequence
  chemically synthesized
tcccagtgatacttgtagagtg

SEQ ID NO: 883050 - DNA, 22 bp, Artificial Sequence
  chemically synthesized
tatcctcttcagtcactctaca

SEQ ID NO: 883051 - DNA, 22 bp, Artificial Sequence
  chemically synthesized
gctctatcctcttcagtcactc

SEQ ID NO: 883052 - DNA, 22 bp, Artificial Sequence
  chemically synthesized
tggctctatcctcttcagtcac

SEQ ID NO: 883053 - DNA, 22 bp, Artificial Sequence
  chemically synthesized
attctggctctatcctcttcag

SEQ ID NO: 883054 - DNA, 22 bp, Artificial Sequence
  chemically synthesized
gtagagtgactgaagaggatag

SEQ ID NO: 883055 - DNA, 22 bp, Artificial Sequence
  chemically synthesized
tagagtgactgaagaggataga

SEQ ID NO: 883056 - DNA, 22 bp, Artificial Sequence
  chemically synthesized
aagaggatagagccagaattag

SEQ ID NO: 883057 - DNA, 22 bp, Artificial Sequence
  chemically synthesized
tggaggcgaatacctaattctg

SEQ ID NO: 883058 - DNA, 22 bp, Artificial Sequence
  chemically synthesized
tcctgtggaggcgaatacctaa

SEQ ID NO: 883059 - DNA, 22 bp, Artificial Sequence
  chemically synthesized
atcctgtggaggcgaataccta

SEQ ID NO: 883060 - DNA, 22 bp, Artificial Sequence
  chemically synthesized
ttatcctgtggaggcgaatacc

SEQ ID NO: 883061 - DNA, 22 bp, Artificial Sequence
  chemically synthesized
tcttatcctgtggaggcgaata

SEQ ID NO: 883062 - DNA, 22 bp, Artificial Sequence
  chemically synthesized
ctcttatcctgtggaggcgaat

SEQ ID NO: 883063 - DNA, 22 bp, Artificial Sequence
  chemically synthesized
ttctcttatcctgtggaggcga

SEQ ID NO: 883064 - DNA, 22 bp, Artificial Sequence
  chemically synthesized
cttctcttatcctgtggaggcg

SEQ ID NO: 883065 - DNA, 22 bp, Artificial Sequence
  chemically synthesized
tcttctcttatcctgtggaggc

SEQ ID NO: 883066 - DNA, 22 bp, Artificial Sequence
  chemically synthesized
ggtattcgcctccacaggataa

SEQ ID NO: 883067 - DNA, 22 bp, Artificial Sequence
  chemically synthesized
aactttcttctcttatcctgtg

SEQ ID NO: 883068 - DNA, 22 bp, Artificial Sequence
  chemically synthesized
gttcaactttcttctcttatcc

SEQ ID NO: 883069 - DNA, 22 bp, Artificial Sequence
  chemically synthesized
ggttcaactttcttctcttatc

SEQ ID NO: 883070 - DNA, 22 bp, Artificial Sequence
  chemically synthesized
gcctccacaggataagagaaga

SEQ ID NO: 883071 - DNA, 22 bp, Artificial Sequence
  chemically synthesized
ttggttcaactttcttctctta

SEQ ID NO: 883072 - DNA, 22 bp, Artificial Sequence
  chemically synthesized
cttggttcaactttcttctctt

SEQ ID NO: 883073 - DNA, 22 bp, Artificial Sequence
  chemically synthesized
tcttggttcaactttcttctct

SEQ ID NO: 883074 - DNA, 22 bp, Artificial Sequence
  chemically synthesized
ttcttggttcaactttcttctc

SEQ ID NO: 883075 - DNA, 22 bp, Artificial Sequence
  chemically synthesized
cacaggataagagaagaaagtt

SEQ ID NO: 883076 - DNA, 22 bp, Artificial Sequence
  chemically synthesized
tcttttcttggttcaactttct

SEQ ID NO: 883077 - DNA, 22 bp, Artificial Sequence
  chemically synthesized
tatcttttcttggttcaacttt

SEQ ID NO: 883078 - DNA, 22 bp, Artificial Sequence
  chemically synthesized
ctatcttttcttggttcaactt

SEQ ID NO: 883079 - DNA, 22 bp, Artificial Sequence
  chemically synthesized
tctatcttttcttggttcaact

SEQ ID NO: 883080 - DNA, 22 bp, Artificial Sequence
  chemically synthesized
tttctatcttttcttggttcaa

SEQ ID NO: 883081 - DNA, 22 bp, Artificial Sequence
  chemically synthesized
ctctttctatcttttcttggtt

SEQ ID NO: 883082 - DNA, 22 bp, Artificial Sequence
  chemically synthesized
tgctctttctatcttttcttgg

SEQ ID NO: 883083 - DNA, 22 bp, Artificial Sequence
  chemically synthesized
ctgctctttctatcttttcttg

SEQ ID NO: 883084 - DNA, 22 bp, Artificial Sequence
  chemically synthesized
ttctgctctttctatcttttct

SEQ ID NO: 883085 - DNA, 22 bp, Artificial Sequence
  chemically synthesized
agtctcttctgctctttctatc

SEQ ID NO: 883086 - DNA, 22 bp, Artificial Sequence
  chemically synthesized
aaccaagaaaagatagaaagag

SEQ ID NO: 883087 - DNA, 22 bp, Artificial Sequence
  chemically synthesized
cagtctcttctgctctttctat

SEQ ID NO: 883088 - DNA, 22 bp, Artificial Sequence
  chemically synthesized
tttcagtctcttctgctctttc

SEQ ID NO: 883089 - DNA, 22 bp, Artificial Sequence
  chemically synthesized
gtttcagtctcttctgctcttt

SEQ ID NO: 883090 - DNA, 22 bp, Artificial Sequence
  chemically synthesized
ttgtttcagtctcttctgctct

SEQ ID NO: 883091 - DNA, 22 bp, Artificial Sequence
  chemically synthesized
catgttcttgtttcagtctctt

SEQ ID NO: 883092 - DNA, 22 bp, Artificial Sequence
  chemically synthesized
acatgttcttgtttcagtctct

SEQ ID NO: 883093 - DNA, 22 bp, Artificial Sequence
  chemically synthesized
tacatgttcttgtttcagtctc

SEQ ID NO: 883094 - DNA, 22 bp, Artificial Sequence
  chemically synthesized
ttacatgttcttgtttcagtct

SEQ ID NO: 883095 - DNA, 22 bp, Artificial Sequence
  chemically synthesized
ggtttttacatgttcttgtttc

SEQ ID NO: 883096 - DNA, 22 bp, Artificial Sequence
  chemically synthesized
gggtttttacatgttcttgttt

SEQ ID NO: 883097 - DNA, 22 bp, Artificial Sequence
  chemically synthesized
tgggtttttacatgttcttgtt

SEQ ID NO: 883098 - DNA, 22 bp, Artificial Sequence
  chemically synthesized
ttttgggtttttacatgttctt

SEQ ID NO: 883099 - DNA, 22 bp, Artificial Sequence
  chemically synthesized
tattttgggtttttacatgttc

SEQ ID NO: 883100 - DNA, 22 bp, Artificial Sequence
  chemically synthesized
ctattttgggtttttacatgtt

SEQ ID NO: 883101 - DNA, 22 bp, Artificial Sequence
  chemically synthesized
acttctattttgggtttttaca

SEQ ID NO: 883102 - DNA, 22 bp, Artificial Sequence
  chemically synthesized
aaacaagaacatgtaaaaaccc

SEQ ID NO: 883103 - DNA, 22 bp, Artificial Sequence
  chemically synthesized
ctcacttctattttgggttttt

SEQ ID NO: 883104 - DNA, 22 bp, Artificial Sequence
  chemically synthesized
tcctcacttctattttgggttt

SEQ ID NO: 883105 - DNA, 22 bp, Artificial Sequence
  chemically synthesized
tctcctcacttctattttgggt

SEQ ID NO: 883106 - DNA, 22 bp, Artificial Sequence
  chemically synthesized
atataattctctcctcacttct

SEQ ID NO: 883107 - DNA, 22 bp, Artificial Sequence
  chemically synthesized
catataattctctcctcacttc

SEQ ID NO: 883108 - DNA, 22 bp, Artificial Sequence
  chemically synthesized
tcatataattctctcctcactt

SEQ ID NO: 883109 - DNA, 22 bp, Artificial Sequence
  chemically synthesized
ttcatataattctctcctcact

SEQ ID NO: 883110 - DNA, 22 bp, Artificial Sequence
  chemically synthesized
taatatgtaacatggtggcacc

SEQ ID NO: 883111 - DNA, 22 bp, Artificial Sequence
  chemically synthesized
tatgaaaaggggtgccaccatg

SEQ ID NO: 883112 - DNA, 22 bp, Artificial Sequence
  chemically synthesized
tctgtaatatgtaacatggtgg

SEQ ID NO: 883113 - DNA, 22 bp, Artificial Sequence
  chemically synthesized
atctgtaatatgtaacatggtg

SEQ ID NO: 883114 - DNA, 22 bp, Artificial Sequence
  chemically synthesized
cttatctgtaatatgtaacatg

SEQ ID NO: 883115 - DNA, 22 bp, Artificial Sequence
  chemically synthesized
gcttatctgtaatatgtaacat

SEQ ID NO: 883116 - DNA, 22 bp, Artificial Sequence
  chemically synthesized
cttgcttatctgtaatatgtaa

SEQ ID NO: 883117 - DNA, 22 bp, Artificial Sequence
  chemically synthesized
ccttgcttatctgtaatatgta

SEQ ID NO: 883118 - DNA, 22 bp, Artificial Sequence
  chemically synthesized
agcttccttgcttatctgtaat

SEQ ID NO: 883119 - DNA, 22 bp, Artificial Sequence
  chemically synthesized
gagcttccttgcttatctgtaa

SEQ ID NO: 883120 - DNA, 22 bp, Artificial Sequence
  chemically synthesized
ttgagcttccttgcttatctgt

SEQ ID NO: 883121 - DNA, 22 bp, Artificial Sequence
  chemically synthesized
cttgagcttccttgcttatctg

SEQ ID NO: 883122 - DNA, 22 bp, Artificial Sequence
  chemically synthesized
tttcttgagcttccttgcttat

SEQ ID NO: 883123 - DNA, 22 bp, Artificial Sequence
  chemically synthesized
catattacagataagcaaggaa

SEQ ID NO: 883124 - DNA, 22 bp, Artificial Sequence
  chemically synthesized
tattatttcttgagcttccttg

SEQ ID NO: 883125 - DNA, 22 bp, Artificial Sequence
  chemically synthesized
gtattatttcttgagcttcctt

SEQ ID NO: 883126 - DNA, 22 bp, Artificial Sequence
  chemically synthesized
cagataagcaaggaagctcaag

SEQ ID NO: 883127 - DNA, 22 bp, Artificial Sequence
  chemically synthesized
tttgtattatttcttgagcttc

SEQ ID NO: 883128 - DNA, 22 bp, Artificial Sequence
  chemically synthesized
ttatttgtattatttcttgagc

SEQ ID NO: 883129 - DNA, 22 bp, Artificial Sequence
  chemically synthesized
agtattattatttgtattattt

SEQ ID NO: 883130 - DNA, 22 bp, Artificial Sequence
  chemically synthesized
aagaaataatacaaataataat

SEQ ID NO: 883131 - DNA, 22 bp, Artificial Sequence
  chemically synthesized
caatgaaggatatattcagtat

SEQ ID NO: 883132 - DNA, 22 bp, Artificial Sequence
  chemically synthesized
acctccaatgaaggatatattc

SEQ ID NO: 883133 - DNA, 22 bp, Artificial Sequence
  chemically synthesized
aacctccaatgaaggatatatt

SEQ ID NO: 883134 - DNA, 22 bp, Artificial Sequence
  chemically synthesized
atttaacctccaatgaaggata

SEQ ID NO: 883135 - DNA, 22 bp, Artificial Sequence
  chemically synthesized
catttaacctccaatgaaggat

SEQ ID NO: 883136 - DNA, 22 bp, Artificial Sequence
  chemically synthesized
tttcatttaacctccaatgaag

SEQ ID NO: 883137 - DNA, 22 bp, Artificial Sequence
  chemically synthesized
atttcatttaacctccaatgaa

SEQ ID NO: 883138 - DNA, 22 bp, Artificial Sequence
  chemically synthesized
aatatatccttcattggaggtt

SEQ ID NO: 883139 - DNA, 22 bp, Artificial Sequence
  chemically synthesized
gatataaaaccttatttcattt

SEQ ID NO: 883140 - DNA, 22 bp, Artificial Sequence
  chemically synthesized
cattggaggttaaatgaaataa

SEQ ID NO: 883141 - DNA, 22 bp, Artificial Sequence
  chemically synthesized
attggaggttaaatgaaataag

SEQ ID NO: 883142 - DNA, 22 bp, Artificial Sequence
  chemically synthesized
gaggttaaatgaaataaggttt

SEQ ID NO: 883143 - DNA, 22 bp, Artificial Sequence
  chemically synthesized
aatgaaataaggttttatatcc

SEQ ID NO: 883144 - DNA, 22 bp, Artificial Sequence
  chemically synthesized
caaagtaaaccgagaacattgg

SEQ ID NO: 883145 - DNA, 22 bp, Artificial Sequence
  chemically synthesized
acaaagtaaaccgagaacattg

SEQ ID NO: 883146 - DNA, 22 bp, Artificial Sequence
  chemically synthesized
tatatccaatgttctcggttta

SEQ ID NO: 883147 - DNA, 22 bp, Artificial Sequence
  chemically synthesized
gtatttacaaagtaaaccgaga

SEQ ID NO: 883148 - DNA, 22 bp, Artificial Sequence
  chemically synthesized
atatccaatgttctcggtttac

SEQ ID NO: 883149 - DNA, 22 bp, Artificial Sequence
  chemically synthesized
tatccaatgttctcggtttact

SEQ ID NO: 883150 - DNA, 22 bp, Artificial Sequence
  chemically synthesized
tcggtttactttgtaaatacta

SEQ ID NO: 883151 - DNA, 22 bp, Artificial Sequence
  chemically synthesized
ggggaccacgagctagtattta

SEQ ID NO: 883152 - DNA, 22 bp, Artificial Sequence
  chemically synthesized
ggtttactttgtaaatactagc

SEQ ID NO: 883153 - DNA, 22 bp, Artificial Sequence
  chemically synthesized
gggggaccacgagctagtattt

SEQ ID NO: 883154 - DNA, 22 bp, Artificial Sequence
  chemically synthesized
actttgtaaatactagctcgtg

SEQ ID NO: 883155 - DNA, 22 bp, Artificial Sequence
  chemically synthesized
ctttgtaaatactagctcgtgg

SEQ ID NO: 883156 - DNA, 22 bp, Artificial Sequence
  chemically synthesized
tgtaaatactagctcgtggtcc

SEQ ID NO: 883157 - DNA, 22 bp, Artificial Sequence
  chemically synthesized
gtaaatactagctcgtggtccc

SEQ ID NO: 883158 - DNA, 22 bp, Artificial Sequence
  chemically synthesized
taaatactagctcgtggtcccc

SEQ ID NO: 883159 - DNA, 22 bp, Artificial Sequence
  chemically synthesized
gctcgtggtcccccaaatttac

SEQ ID NO: 883160 - DNA, 22 bp, Artificial Sequence
  chemically synthesized
gtggtcccccaaatttactaca

SEQ ID NO: 883161 - DNA, 22 bp, Artificial Sequence
  chemically synthesized
aaaatgggaacatgtagtaaat

SEQ ID NO: 883162 - DNA, 22 bp, Artificial Sequence
  chemically synthesized
aaaaatgggaacatgtagtaaa

SEQ ID NO: 883163 - DNA, 22 bp, Artificial Sequence
  chemically synthesized
taaaaatgggaacatgtagtaa

SEQ ID NO: 883164 - DNA, 22 bp, Artificial Sequence
  chemically synthesized
aattttaaaaatgggaacatgt

SEQ ID NO: 883165 - DNA, 22 bp, Artificial Sequence
  chemically synthesized
ctgaattttaaaaatgggaaca

SEQ ID NO: 883166 - DNA, 22 bp, Artificial Sequence
  chemically synthesized
gctgaattttaaaaatgggaac

SEQ ID NO: 883167 - DNA, 22 bp, Artificial Sequence
  chemically synthesized
tttgctgaattttaaaaatggg

SEQ ID NO: 883168 - DNA, 22 bp, Artificial Sequence
  chemically synthesized
actacatgttcccatttttaaa

SEQ ID NO: 883169 - DNA, 22 bp, Artificial Sequence
  chemically synthesized
ctacatgttcccatttttaaaa

SEQ ID NO: 883170 - DNA, 22 bp, Artificial Sequence
  chemically synthesized
catgttcccatttttaaaattc

SEQ ID NO: 883171 - DNA, 22 bp, Artificial Sequence
  chemically synthesized
aatctgtttgctgaattttaaa

SEQ ID NO: 883172 - DNA, 22 bp, Artificial Sequence
  chemically synthesized
cctaaatctgtttgctgaattt

SEQ ID NO: 883173 - DNA, 22 bp, Artificial Sequence
  chemically synthesized
ccatttttaaaattcagcaaac

SEQ ID NO: 883174 - DNA, 22 bp, Artificial Sequence
  chemically synthesized
ttacctaaatctgtttgctgaa

SEQ ID NO: 883175 - DNA, 22 bp, Artificial Sequence
  chemically synthesized
ttgttacctaaatctgtttgct

SEQ ID NO: 883176 - DNA, 22 bp, Artificial Sequence
  chemically synthesized
ttaaaattcagcaaacagattt

SEQ ID NO: 883177 - DNA, 22 bp, Artificial Sequence
  chemically synthesized
ctgttgttacctaaatctgttt

SEQ ID NO: 883178 - DNA, 22 bp, Artificial Sequence
  chemically synthesized
taaaattcagcaaacagattta

SEQ ID NO: 883179 - DNA, 22 bp, Artificial Sequence
  chemically synthesized
actgttgttacctaaatctgtt

SEQ ID NO: 883180 - DNA, 22 bp, Artificial Sequence
  chemically synthesized
aaaattcagcaaacagatttag

SEQ ID NO: 883181 - DNA, 22 bp, Artificial Sequence
  chemically synthesized
aaattcagcaaacagatttagg

SEQ ID NO: 883182 - DNA, 22 bp, Artificial Sequence
  chemically synthesized
agcaaacagatttaggtaacaa

SEQ ID NO: 883183 - DNA, 22 bp, Artificial Sequence
  chemically synthesized
gtaagtttactgttgttaccta

SEQ ID NO: 883184 - DNA, 22 bp, Artificial Sequence
  chemically synthesized
aggtaacaacagtaaacttact

SEQ ID NO: 883185 - DNA, 22 bp, Artificial Sequence
  chemically synthesized
taagatatatctagtaagttta

SEQ ID NO: 883186 - DNA, 22 bp, Artificial Sequence
  chemically synthesized
ggtaacaacagtaaacttacta

SEQ ID NO: 883187 - DNA, 22 bp, Artificial Sequence
  chemically synthesized
ccattgtaagatatatctagta

SEQ ID NO: 883188 - DNA, 22 bp, Artificial Sequence
  chemically synthesized
ctcccattgtaagatatatcta

SEQ ID NO: 883189 - DNA, 22 bp, Artificial Sequence
  chemically synthesized
tagttgctcccattgtaagata

SEQ ID NO: 883190 - DNA, 22 bp, Artificial Sequence
  chemically synthesized
ttatagttgctcccattgtaag

SEQ ID NO: 883191 - DNA, 22 bp, Artificial Sequence
  chemically synthesized
actagatatatcttacaatggg

SEQ ID NO: 883192 - DNA, 22 bp, Artificial Sequence
  chemically synthesized
gttatagttgctcccattgtaa

SEQ ID NO: 883193 - DNA, 22 bp, Artificial Sequence
  chemically synthesized
ctagatatatcttacaatggga

SEQ ID NO: 883194 - DNA, 22 bp, Artificial Sequence
  chemically synthesized
gatatatcttacaatgggagca

SEQ ID NO: 883195 - DNA, 22 bp, Artificial Sequence
  chemically synthesized
accttgttatagttgctcccat

SEQ ID NO: 883196 - DNA, 22 bp, Artificial Sequence
  chemically synthesized
ctcaccttgttatagttgctcc

SEQ ID NO: 883197 - DNA, 22 bp, Artificial Sequence
  chemically synthesized
actcaccttgttatagttgctc

SEQ ID NO: 883198 - DNA, 22 bp, Artificial Sequence
  chemically synthesized
tactcaccttgttatagttgct

SEQ ID NO: 883199 - DNA, 22 bp, Artificial Sequence
  chemically synthesized
ttttactcaccttgttatagtt

SEQ ID NO: 883200 - DNA, 22 bp, Artificial Sequence
  chemically synthesized
acaatgggagcaactataacaa

SEQ ID NO: 883201 - DNA, 22 bp, Artificial Sequence
  chemically synthesized
gttttactcaccttgttatagt

SEQ ID NO: 883202 - DNA, 22 bp, Artificial Sequence
  chemically synthesized
caatgggagcaactataacaag

SEQ ID NO: 883203 - DNA, 22 bp, Artificial Sequence
  chemically synthesized
atttgttttactcaccttgtta

SEQ ID NO: 883204 - DNA, 22 bp, Artificial Sequence
  chemically synthesized
ccattcatttgttttactcacc

SEQ ID NO: 883205 - DNA, 22 bp, Artificial Sequence
  chemically synthesized
taacaaggtgagtaaaacaaat

SEQ ID NO: 883206 - DNA, 22 bp, Artificial Sequence
  chemically synthesized
cagagcaaacgttcccattcat

SEQ ID NO: 883207 - DNA, 22 bp, Artificial Sequence
  chemically synthesized
ccagagcaaacgttcccattca

SEQ ID NO: 883208 - DNA, 22 bp, Artificial Sequence
  chemically synthesized
tccagagcaaacgttcccattc

SEQ ID NO: 883209 - DNA, 22 bp, Artificial Sequence
  chemically synthesized
attttccagagcaaacgttccc

SEQ ID NO: 883210 - DNA, 22 bp, Artificial Sequence
  chemically synthesized
gattttccagagcaaacgttcc

SEQ ID NO: 883211 - DNA, 22 bp, Artificial Sequence
  chemically synthesized
ttgattttccagagcaaacgtt

SEQ ID NO: 883212 - DNA, 22 bp, Artificial Sequence
  chemically synthesized
cttgattttccagagcaaacgt

SEQ ID NO: 883213 - DNA, 22 bp, Artificial Sequence
  chemically synthesized
gctctggaaaatcaagaaatac

SEQ ID NO: 883214 - DNA, 22 bp, Artificial Sequence
  chemically synthesized
ctctggaaaatcaagaaataca

SEQ ID NO: 883215 - DNA, 22 bp, Artificial Sequence
  chemically synthesized
tggaaaatcaagaaatacacac

SEQ ID NO: 883216 - DNA, 22 bp, Artificial Sequence
  chemically synthesized
gaaaatcaagaaatacacacac

SEQ ID NO: 883217 - DNA, 22 bp, Artificial Sequence
  chemically synthesized
tgtgtgtgtgtgtgtgtgtgtg

SEQ ID NO: 883218 - DNA, 22 bp, Artificial Sequence
  chemically synthesized
aagattgtgtgtgtgtgtgtgt

SEQ ID NO: 883219 - DNA, 22 bp, Artificial Sequence
  chemically synthesized
aaagattgtgtgtgtgtgtgtg

SEQ ID NO: 883220 - DNA, 22 bp, Artificial Sequence
  chemically synthesized
tccttaaagattgtgtgtgtgt

SEQ ID NO: 883221 - DNA, 22 bp, Artificial Sequence
  chemically synthesized
ataactatccttaaagattgtg

SEQ ID NO: 883222 - DNA, 22 bp, Artificial Sequence
  chemically synthesized
cataattaataactatccttaa

SEQ ID NO: 883223 - DNA, 22 bp, Artificial Sequence
  chemically synthesized
ccataattaataactatcctta

SEQ ID NO: 883224 - DNA, 22 bp, Artificial Sequence
  chemically synthesized
ttccataattaataactatcct

SEQ ID NO: 883225 - DNA, 22 bp, Artificial Sequence
  chemically synthesized
cttccataattaataactatcc

SEQ ID NO: 883226 - DNA, 22 bp, Artificial Sequence
  chemically synthesized
tttcttccataattaataacta

SEQ ID NO: 883227 - DNA, 22 bp, Artificial Sequence
  chemically synthesized
gtttcttccataattaataact

SEQ ID NO: 883228 - DNA, 22 bp, Artificial Sequence
  chemically synthesized
taaggatagttattaattatgg

SEQ ID NO: 883229 - DNA, 22 bp, Artificial Sequence
  chemically synthesized
ggtttgtttcttccataattaa

SEQ ID NO: 883230 - DNA, 22 bp, Artificial Sequence
  chemically synthesized
aaggatagttattaattatgga

SEQ ID NO: 883231 - DNA, 22 bp, Artificial Sequence
  chemically synthesized
aggtttgtttcttccataatta

SEQ ID NO: 883232 - DNA, 22 bp, Artificial Sequence
  chemically synthesized
aggatagttattaattatggaa

SEQ ID NO: 883233 - DNA, 22 bp, Artificial Sequence
  chemically synthesized
taggtttgtttcttccataatt

SEQ ID NO: 883234 - DNA, 22 bp, Artificial Sequence
  chemically synthesized
ataattttaggtttgtttcttc

SEQ ID NO: 883235 - DNA, 22 bp, Artificial Sequence
  chemically synthesized
tcataattttaggtttgtttct

SEQ ID NO: 883236 - DNA, 22 bp, Artificial Sequence
  chemically synthesized
ttaattatggaagaaacaaacc

SEQ ID NO: 883237 - DNA, 22 bp, Artificial Sequence
  chemically synthesized
attatggaagaaacaaacctaa

SEQ ID NO: 883238 - DNA, 22 bp, Artificial Sequence
  chemically synthesized
atactctcataattttaggttt

SEQ ID NO: 883239 - DNA, 22 bp, Artificial Sequence
  chemically synthesized
tggaagaaacaaacctaaaatt

SEQ ID NO: 883240 - DNA, 22 bp, Artificial Sequence
  chemically synthesized
tcatataggatgaattaatact

SEQ ID NO: 883241 - DNA, 22 bp, Artificial Sequence
  chemically synthesized
atcatataggatgaattaatac

SEQ ID NO: 883242 - DNA, 22 bp, Artificial Sequence
  chemically synthesized
aaattatgagagtattaattca

SEQ ID NO: 883243 - DNA, 22 bp, Artificial Sequence
  chemically synthesized
tatcatataggatgaattaata

SEQ ID NO: 883244 - DNA, 22 bp, Artificial Sequence
  chemically synthesized
ttatcatataggatgaattaat

SEQ ID NO: 883245 - DNA, 22 bp, Artificial Sequence
  chemically synthesized
tgagagtattaattcatcctat

SEQ ID NO: 883246 - DNA, 22 bp, Artificial Sequence
  chemically synthesized
agaatttttatcatataggatg

SEQ ID NO: 883247 - DNA, 22 bp, Artificial Sequence
  chemically synthesized
aaatgttaagaatttttatcat

SEQ ID NO: 883248 - DNA, 22 bp, Artificial Sequence
  chemically synthesized
attcatcctatatgataaaaat

SEQ ID NO: 883249 - DNA, 22 bp, Artificial Sequence
  chemically synthesized
aaaatgttaagaatttttatca

SEQ ID NO: 883250 - DNA, 22 bp, Artificial Sequence
  chemically synthesized
taaaatgttaagaatttttatc

SEQ ID NO: 883251 - DNA, 22 bp, Artificial Sequence
  chemically synthesized
ttaaaatgttaagaatttttat

SEQ ID NO: 883252 - DNA, 22 bp, Artificial Sequence
  chemically synthesized
tttaaaatgttaagaattttta

SEQ ID NO: 883253 - DNA, 22 bp, Artificial Sequence
  chemically synthesized
atcctatatgataaaaattctt

SEQ ID NO: 883254 - DNA, 22 bp, Artificial Sequence
  chemically synthesized
ttttaaaatgttaagaattttt

SEQ ID NO: 883255 - DNA, 22 bp, Artificial Sequence
  chemically synthesized
tatgataaaaattcttaacatt

SEQ ID NO: 883256 - DNA, 22 bp, Artificial Sequence
  chemically synthesized
caagacttttttaaaatgttaa

SEQ ID NO: 883257 - DNA, 22 bp, Artificial Sequence
  chemically synthesized
cagtgttgcaagacttttttaa

SEQ ID NO: 883258 - DNA, 22 bp, Artificial Sequence
  chemically synthesized
ttacagtgttgcaagacttttt

SEQ ID NO: 883259 - DNA, 22 bp, Artificial Sequence
  chemically synthesized
ttaacattttaaaaaagtcttg

SEQ ID NO: 883260 - DNA, 22 bp, Artificial Sequence
  chemically synthesized
gttacagtgttgcaagactttt

SEQ ID NO: 883261 - DNA, 22 bp, Artificial Sequence
  chemically synthesized
aacattttaaaaaagtcttgca

SEQ ID NO: 883262 - DNA, 22 bp, Artificial Sequence
  chemically synthesized
acattttaaaaaagtcttgcaa

SEQ ID NO: 883263 - DNA, 22 bp, Artificial Sequence
  chemically synthesized
aatttgttacagtgttgcaaga

SEQ ID NO: 883264 - DNA, 22 bp, Artificial Sequence
  chemically synthesized
gaatttgttacagtgttgcaag

SEQ ID NO: 883265 - DNA, 22 bp, Artificial Sequence
  chemically synthesized
tgaatttgttacagtgttgcaa

SEQ ID NO: 883266 - DNA, 22 bp, Artificial Sequence
  chemically synthesized
ttgaatttgttacagtgttgca

SEQ ID NO: 883267 - DNA, 22 bp, Artificial Sequence
  chemically synthesized
taaaaaagtcttgcaacactgt

SEQ ID NO: 883268 - DNA, 22 bp, Artificial Sequence
  chemically synthesized
aaaaaagtcttgcaacactgta

SEQ ID NO: 883269 - DNA, 22 bp, Artificial Sequence
  chemically synthesized
aaaaagtcttgcaacactgtaa

SEQ ID NO: 883270 - DNA, 22 bp, Artificial Sequence
  chemically synthesized
gcaacactgtaacaaattcaaa

SEQ ID NO: 883271 - DNA, 22 bp, Artificial Sequence
  chemically synthesized
caacactgtaacaaattcaaaa

SEQ ID NO: 883272 - DNA, 22 bp, Artificial Sequence
  chemically synthesized
aaggaagaaatatccagccttt

SEQ ID NO: 883273 - DNA, 22 bp, Artificial Sequence
  chemically synthesized
taacaaattcaaaaggctggat

SEQ ID NO: 883274 - DNA, 22 bp, Artificial Sequence
  chemically synthesized
aaaggaagaaatatccagcctt

SEQ ID NO: 883275 - DNA, 22 bp, Artificial Sequence
  chemically synthesized
taaaggaagaaatatccagcct

SEQ ID NO: 883276 - DNA, 22 bp, Artificial Sequence
  chemically synthesized
aaaaggctggatatttcttcct

SEQ ID NO: 883277 - DNA, 22 bp, Artificial Sequence
  chemically synthesized
taagcaattttaaaggaagaaa

SEQ ID NO: 883278 - DNA, 22 bp, Artificial Sequence
  chemically synthesized
gtaagcaattttaaaggaagaa

SEQ ID NO: 883279 - DNA, 22 bp, Artificial Sequence
  chemically synthesized
tacttgtaagcaattttaaagg

SEQ ID NO: 883280 - DNA, 22 bp, Artificial Sequence
  chemically synthesized
gatatttcttcctttaaaattg

SEQ ID NO: 883281 - DNA, 22 bp, Artificial Sequence
  chemically synthesized
gattgtacttgtaagcaatttt

SEQ ID NO: 883282 - DNA, 22 bp, Artificial Sequence
  chemically synthesized
cttcctttaaaattgcttacaa

SEQ ID NO: 883283 - DNA, 22 bp, Artificial Sequence
  chemically synthesized
actggattgtacttgtaagcaa

SEQ ID NO: 883284 - DNA, 22 bp, Artificial Sequence
  chemically synthesized
ttcctttaaaattgcttacaag

SEQ ID NO: 883285 - DNA, 22 bp, Artificial Sequence
  chemically synthesized
cactggattgtacttgtaagca

SEQ ID NO: 883286 - DNA, 22 bp, Artificial Sequence
  chemically synthesized
tcactggattgtacttgtaagc

SEQ ID NO: 883287 - DNA, 22 bp, Artificial Sequence
  chemically synthesized
cctttaaaattgcttacaagta

SEQ ID NO: 883288 - DNA, 22 bp, Artificial Sequence
  chemically synthesized
ctttaaaattgcttacaagtac

SEQ ID NO: 883289 - DNA, 22 bp, Artificial Sequence
  chemically synthesized
taaaattgcttacaagtacaat

SEQ ID NO: 883290 - DNA, 22 bp, Artificial Sequence
  chemically synthesized
aaaattgcttacaagtacaatc

SEQ ID NO: 883291 - DNA, 22 bp, Artificial Sequence
  chemically synthesized
aaattgcttacaagtacaatcc

SEQ ID NO: 883292 - DNA, 22 bp, Artificial Sequence
  chemically synthesized
cttacaagtacaatccagtgaa

SEQ ID NO: 883293 - DNA, 22 bp, Artificial Sequence
  chemically synthesized
aaggtacagaattttcactgga

SEQ ID NO: 883294 - DNA, 22 bp, Artificial Sequence
  chemically synthesized
acaagtacaatccagtgaaaat

SEQ ID NO: 883295 - DNA, 22 bp, Artificial Sequence
  chemically synthesized
taaaggtacagaattttcactg

SEQ ID NO: 883296 - DNA, 22 bp, Artificial Sequence
  chemically synthesized
caagtacaatccagtgaaaatt

SEQ ID NO: 883297 - DNA, 22 bp, Artificial Sequence
  chemically synthesized
ctaaaggtacagaattttcact

SEQ ID NO: 883298 - DNA, 22 bp, Artificial Sequence
  chemically synthesized
tctaaaggtacagaattttcac

SEQ ID NO: 883299 - DNA, 22 bp, Artificial Sequence
  chemically synthesized
attttctaaaggtacagaattt

SEQ ID NO: 883300 - DNA, 22 bp, Artificial Sequence
  chemically synthesized
ttcattttctaaaggtacagaa

SEQ ID NO: 883301 - DNA, 22 bp, Artificial Sequence
  chemically synthesized
tgttcattttctaaaggtacag

SEQ ID NO: 883302 - DNA, 22 bp, Artificial Sequence
  chemically synthesized
ctgttcattttctaaaggtaca

SEQ ID NO: 883303 - DNA, 22 bp, Artificial Sequence
  chemically synthesized
tttctgttcattttctaaaggt

SEQ ID NO: 883304 - DNA, 22 bp, Artificial Sequence
  chemically synthesized
actatttctgttcattttctaa

SEQ ID NO: 883305 - DNA, 22 bp, Artificial Sequence
  chemically synthesized
gactatttctgttcattttcta

SEQ ID NO: 883306 - DNA, 22 bp, Artificial Sequence
  chemically synthesized
tgactatttctgttcattttct

SEQ ID NO: 883307 - DNA, 22 bp, Artificial Sequence
  chemically synthesized
ttgactatttctgttcattttc

SEQ ID NO: 883308 - DNA, 22 bp, Artificial Sequence
  chemically synthesized
tgtacctttagaaaatgaacag

SEQ ID NO: 883309 - DNA, 22 bp, Artificial Sequence
  chemically synthesized
tacctttagaaaatgaacagaa

SEQ ID NO: 883310 - DNA, 22 bp, Artificial Sequence
  chemically synthesized
tagaaaatgaacagaaatagtc

SEQ ID NO: 883311 - DNA, 22 bp, Artificial Sequence
  chemically synthesized
agaaaatgaacagaaatagtca

SEQ ID NO: 883312 - DNA, 22 bp, Artificial Sequence
  chemically synthesized
gaaaatgaacagaaatagtcaa

SEQ ID NO: 883313 - DNA, 22 bp, Artificial Sequence
  chemically synthesized
cacacaagaaacacagatgaaa

SEQ ID NO: 883314 - DNA, 22 bp, Artificial Sequence
  chemically synthesized
gctgcacacaagaaacacagat

SEQ ID NO: 883315 - DNA, 22 bp, Artificial Sequence
  chemically synthesized
ggctgcacacaagaaacacaga

SEQ ID NO: 883316 - DNA, 22 bp, Artificial Sequence
  chemically synthesized
gtcatttggctgcacacaagaa

SEQ ID NO: 883317 - DNA, 22 bp, Artificial Sequence
  chemically synthesized
catctgtgtttcttgtgtgcag

SEQ ID NO: 883318 - DNA, 22 bp, Artificial Sequence
  chemically synthesized
atctgtgtttcttgtgtgcagc

SEQ ID NO: 883319 - DNA, 22 bp, Artificial Sequence
  chemically synthesized
tgtttcttgtgtgcagccaaat

SEQ ID NO: 883320 - DNA, 22 bp, Artificial Sequence
  chemically synthesized
cttgtgtgcagccaaatgacta

SEQ ID NO: 883321 - DNA, 22 bp, Artificial Sequence
  chemically synthesized
ttgtgtgcagccaaatgactag

SEQ ID NO: 883322 - DNA, 22 bp, Artificial Sequence
  chemically synthesized
gtgtgcagccaaatgactagca

SEQ ID NO: 883323 - DNA, 22 bp, Artificial Sequence
  chemically synthesized
tgtgcagccaaatgactagcat

SEQ ID NO: 883324 - DNA, 22 bp, Artificial Sequence
  chemically synthesized
aagaatatggagtggatagaga

SEQ ID NO: 883325 - DNA, 22 bp, Artificial Sequence
  chemically synthesized
gcatccttctctatccactcca

SEQ ID NO: 883326 - DNA, 22 bp, Artificial Sequence
  chemically synthesized
tgggtgattgaagaatatggag

SEQ ID NO: 883327 - DNA, 22 bp, Artificial Sequence
  chemically synthesized
atgggtgattgaagaatatgga

SEQ ID NO: 883328 - DNA, 22 bp, Artificial Sequence
  chemically synthesized
ctctatccactccatattcttc

SEQ ID NO: 883329 - DNA, 22 bp, Artificial Sequence
  chemically synthesized
tctatccactccatattcttca

SEQ ID NO: 883330 - DNA, 22 bp, Artificial Sequence
  chemically synthesized
tttatgggtgattgaagaatat

SEQ ID NO: 883331 - DNA, 22 bp, Artificial Sequence
  chemically synthesized
tatccactccatattcttcaat

SEQ ID NO: 883332 - DNA, 22 bp, Artificial Sequence
  chemically synthesized
tccactccatattcttcaatca

SEQ ID NO: 883333 - DNA, 22 bp, Artificial Sequence
  chemically synthesized
gaactatttatgggtgattgaa

SEQ ID NO: 883334 - DNA, 22 bp, Artificial Sequence
  chemically synthesized
ggaactatttatgggtgattga

SEQ ID NO: 883335 - DNA, 22 bp, Artificial Sequence
  chemically synthesized
tggaactatttatgggtgattg

SEQ ID NO: 883336 - DNA, 22 bp, Artificial Sequence
  chemically synthesized
ttggaactatttatgggtgatt

SEQ ID NO: 883337 - DNA, 22 bp, Artificial Sequence
  chemically synthesized
catattcttcaatcacccataa

SEQ ID NO: 883338 - DNA, 22 bp, Artificial Sequence
  chemically synthesized
atgatttttggaactatttatg

SEQ ID NO: 883339 - DNA, 22 bp, Artificial Sequence
  chemically synthesized
catgatttttggaactatttat

SEQ ID NO: 883340 - DNA, 22 bp, Artificial Sequence
  chemically synthesized
ttcaatcacccataaatagttc

SEQ ID NO: 883341 - DNA, 22 bp, Artificial Sequence
  chemically synthesized
ttcatgatttttggaactattt

SEQ ID NO: 883342 - DNA, 22 bp, Artificial Sequence
  chemically synthesized
caatcacccataaatagttcca

SEQ ID NO: 883343 - DNA, 22 bp, Artificial Sequence
  chemically synthesized
aatcacccataaatagttccaa

SEQ ID NO: 883344 - DNA, 22 bp, Artificial Sequence
  chemically synthesized
ttcttcatgatttttggaacta

SEQ ID NO: 883345 - DNA, 22 bp, Artificial Sequence
  chemically synthesized
agtagtggtatctattcttcat

SEQ ID NO: 883346 - DNA, 22 bp, Artificial Sequence
  chemically synthesized
tgagtagtggtatctattcttc

SEQ ID NO: 883347 - DNA, 22 bp, Artificial Sequence
  chemically synthesized
ctgagtagtggtatctattctt

SEQ ID NO: 883348 - DNA, 22 bp, Artificial Sequence
  chemically synthesized
caaaaatcatgaagaatagata

SEQ ID NO: 883349 - DNA, 22 bp, Artificial Sequence
  chemically synthesized
ccagtgccttctgagtagtggt

SEQ ID NO: 883350 - DNA, 22 bp, Artificial Sequence
  chemically synthesized
tctgccagtgccttctgagtag

SEQ ID NO: 883351 - DNA, 22 bp, Artificial Sequence
  chemically synthesized
tctatctgccagtgccttctga

SEQ ID NO: 883352 - DNA, 22 bp, Artificial Sequence
  chemically synthesized
atcctatctatctgccagtgcc

SEQ ID NO: 883353 - DNA, 22 bp, Artificial Sequence
  chemically synthesized
ctgatcctatctatctgccagt

SEQ ID NO: 883354 - DNA, 22 bp, Artificial Sequence
  chemically synthesized
ctcagaaggcactggcagatag

SEQ ID NO: 883355 - DNA, 22 bp, Artificial Sequence
  chemically synthesized
agaaggcactggcagatagata

SEQ ID NO: 883356 - DNA, 22 bp, Artificial Sequence
  chemically synthesized
tcaaagcagactcctgatccta

SEQ ID NO: 883357 - DNA, 22 bp, Artificial Sequence
  chemically synthesized
gcagatagataggatcaggagt

SEQ ID NO: 883358 - DNA, 22 bp, Artificial Sequence
  chemically synthesized
tagttgtcaaagcagactcctg

SEQ ID NO: 883359 - DNA, 22 bp, Artificial Sequence
  chemically synthesized
gtagttgtcaaagcagactcct

SEQ ID NO: 883360 - DNA, 22 bp, Artificial Sequence
  chemically synthesized
cttgtagttgtcaaagcagact

SEQ ID NO: 883361 - DNA, 22 bp, Artificial Sequence
  chemically synthesized
aggaaattccttgtagttgtca

SEQ ID NO: 883362 - DNA, 22 bp, Artificial Sequence
  chemically synthesized
aaggaaattccttgtagttgtc

SEQ ID NO: 883363 - DNA, 22 bp, Artificial Sequence
  chemically synthesized
ctttgacaactacaaggaattt

SEQ ID NO: 883364 - DNA, 22 bp, Artificial Sequence
  chemically synthesized
tgacaactacaaggaatttcct

SEQ ID NO: 883365 - DNA, 22 bp, Artificial Sequence
  chemically synthesized
gacaactacaaggaatttcctt

SEQ ID NO: 883366 - DNA, 22 bp, Artificial Sequence
  chemically synthesized
acaactacaaggaatttcctta

SEQ ID NO: 883367 - DNA, 22 bp, Artificial Sequence
  chemically synthesized
tatgtggatgtcttaaggaaat

SEQ ID NO: 883368 - DNA, 22 bp, Artificial Sequence
  chemically synthesized
gtatgtggatgtcttaaggaaa

SEQ ID NO: 883369 - DNA, 22 bp, Artificial Sequence
  chemically synthesized
caaggaatttccttaagacatc

SEQ ID NO: 883370 - DNA, 22 bp, Artificial Sequence
  chemically synthesized
aaatttgtatgtggatgtctta

SEQ ID NO: 883371 - DNA, 22 bp, Artificial Sequence
  chemically synthesized
attaaaatttgtatgtggatgt

SEQ ID NO: 883372 - DNA, 22 bp, Artificial Sequence
  chemically synthesized
ttaattaaaatttgtatgtgga

SEQ ID NO: 883373 - DNA, 22 bp, Artificial Sequence
  chemically synthesized
attaattaaaatttgtatgtgg

SEQ ID NO: 883374 - DNA, 22 bp, Artificial Sequence
  chemically synthesized
ccttaagacatccacatacaaa

SEQ ID NO: 883375 - DNA, 22 bp, Artificial Sequence
  chemically synthesized
tattaattaaaatttgtatgtg

SEQ ID NO: 883376 - DNA, 22 bp, Artificial Sequence
  chemically synthesized
cttaagacatccacatacaaat

SEQ ID NO: 883377 - DNA, 22 bp, Artificial Sequence
  chemically synthesized
aagacatccacatacaaatttt

SEQ ID NO: 883378 - DNA, 22 bp, Artificial Sequence
  chemically synthesized
agacatccacatacaaatttta

SEQ ID NO: 883379 - DNA, 22 bp, Artificial Sequence
  chemically synthesized
gccaataacaattttattaatt

SEQ ID NO: 883380 - DNA, 22 bp, Artificial Sequence
  chemically synthesized
ttcgccaataacaattttatta

SEQ ID NO: 883381 - DNA, 22 bp, Artificial Sequence
  chemically synthesized
attcgccaataacaattttatt

SEQ ID NO: 883382 - DNA, 22 bp, Artificial Sequence
  chemically synthesized
tttattcgccaataacaatttt

SEQ ID NO: 883383 - DNA, 22 bp, Artificial Sequence
  chemically synthesized
tgtttattcgccaataacaatt

SEQ ID NO: 883384 - DNA, 22 bp, Artificial Sequence
  chemically synthesized
ctgtttattcgccaataacaat

SEQ ID NO: 883385 - DNA, 22 bp, Artificial Sequence
  chemically synthesized
taattaataaaattgttattgg

SEQ ID NO: 883386 - DNA, 22 bp, Artificial Sequence
  chemically synthesized
aattaataaaattgttattggc

SEQ ID NO: 883387 - DNA, 22 bp, Artificial Sequence
  chemically synthesized
attaataaaattgttattggcg

SEQ ID NO: 883388 - DNA, 22 bp, Artificial Sequence
  chemically synthesized
ccatttctgtttattcgccaat

SEQ ID NO: 883389 - DNA, 22 bp, Artificial Sequence
  chemically synthesized
ataaaattgttattggcgaata

SEQ ID NO: 883390 - DNA, 22 bp, Artificial Sequence
  chemically synthesized
ttgccatttctgtttattcgcc

SEQ ID NO: 883391 - DNA, 22 bp, Artificial Sequence
  chemically synthesized
gttgccatttctgtttattcgc

SEQ ID NO: 883392 - DNA, 22 bp, Artificial Sequence
  chemically synthesized
ttattggcgaataaacagaaat

SEQ ID NO: 883393 - DNA, 22 bp, Artificial Sequence
  chemically synthesized
ttggcgaataaacagaaatggc

SEQ ID NO: 883394 - DNA, 22 bp, Artificial Sequence
  chemically synthesized
gcgaataaacagaaatggcaac

SEQ ID NO: 883395 - DNA, 22 bp, Artificial Sequence
  chemically synthesized
aaatgccagccttgttgccatt

SEQ ID NO: 883396 - DNA, 22 bp, Artificial Sequence
  chemically synthesized
ctcaaatgccagccttgttgcc

SEQ ID NO: 883397 - DNA, 22 bp, Artificial Sequence
  chemically synthesized
gactactcaaatgccagccttg

SEQ ID NO: 883398 - DNA, 22 bp, Artificial Sequence
  chemically synthesized
ggactactcaaatgccagcctt

SEQ ID NO: 883399 - DNA, 22 bp, Artificial Sequence
  chemically synthesized
agtaatacttggactactcaaa

SEQ ID NO: 883400 - DNA, 22 bp, Artificial Sequence
  chemically synthesized
taagtaatacttggactactca

SEQ ID NO: 883401 - DNA, 22 bp, Artificial Sequence
  chemically synthesized
gagctctaagtaatacttggac

SEQ ID NO: 883402 - DNA, 22 bp, Artificial Sequence
  chemically synthesized
gcatttgagtagtccaagtatt

SEQ ID NO: 883403 - DNA, 22 bp, Artificial Sequence
  chemically synthesized
ggagctctaagtaatacttgga

SEQ ID NO: 883404 - DNA, 22 bp, Artificial Sequence
  chemically synthesized
tggagctctaagtaatacttgg

SEQ ID NO: 883405 - DNA, 22 bp, Artificial Sequence
  chemically synthesized
gagtagtccaagtattacttag

SEQ ID NO: 883406 - DNA, 22 bp, Artificial Sequence
  chemically synthesized
agtagtccaagtattacttaga

SEQ ID NO: 883407 - DNA, 22 bp, Artificial Sequence
  chemically synthesized
gtactttggagctctaagtaat

SEQ ID NO: 883408 - DNA, 22 bp, Artificial Sequence
  chemically synthesized
agtactttggagctctaagtaa

SEQ ID NO: 883409 - DNA, 22 bp, Artificial Sequence
  chemically synthesized
cttagagctccaaagtactaag

SEQ ID NO: 883410 - DNA, 22 bp, Artificial Sequence
  chemically synthesized
agagctccaaagtactaagtgg

SEQ ID NO: 883411 - DNA, 22 bp, Artificial Sequence
  chemically synthesized
gagctccaaagtactaagtggg

SEQ ID NO: 883412 - DNA, 22 bp, Artificial Sequence
  chemically synthesized
caaagtactaagtgggtgcttg

SEQ ID NO: 883413 - DNA, 22 bp, Artificial Sequence
  chemically synthesized
agtccatcatgtagcaagcacc

SEQ ID NO: 883414 - DNA, 22 bp, Artificial Sequence
  chemically synthesized
cagtccatcatgtagcaagcac

SEQ ID NO: 883415 - DNA, 22 bp, Artificial Sequence
  chemically synthesized
ttcagtccatcatgtagcaagc

SEQ ID NO: 883416 - DNA, 22 bp, Artificial Sequence
  chemically synthesized
ctcttcagtccatcatgtagca

SEQ ID NO: 883417 - DNA, 22 bp, Artificial Sequence
  chemically synthesized
agtgggtgcttgctacatgatg

SEQ ID NO: 883418 - DNA, 22 bp, Artificial Sequence
  chemically synthesized
gcatgccacctgctcttcagtc

SEQ ID NO: 883419 - DNA, 22 bp, Artificial Sequence
  chemically synthesized
gctacatgatggactgaagagc

SEQ ID NO: 883420 - DNA, 22 bp, Artificial Sequence
  chemically synthesized
ggcatgccacctgctcttcagt

SEQ ID NO: 883421 - DNA, 22 bp, Artificial Sequence
  chemically synthesized
ctacatgatggactgaagagca

SEQ ID NO: 883422 - DNA, 22 bp, Artificial Sequence
  chemically synthesized
catgatggactgaagagcaggt

SEQ ID NO: 883423 - DNA, 22 bp, Artificial Sequence
  chemically synthesized
atttggcatgccacctgctctt

SEQ ID NO: 883424 - DNA, 22 bp, Artificial Sequence
  chemically synthesized
catttggcatgccacctgctct

SEQ ID NO: 883425 - DNA, 22 bp, Artificial Sequence
  chemically synthesized
aagagcaggtggcatgccaaat

SEQ ID NO: 883426 - DNA, 22 bp, Artificial Sequence
  chemically synthesized
caagtgaaaaatatggacattt

SEQ ID NO: 883427 - DNA, 22 bp, Artificial Sequence
  chemically synthesized
ctgcaagtgaaaaatatggaca

SEQ ID NO: 883428 - DNA, 22 bp, Artificial Sequence
  chemically synthesized
cctgcaagtgaaaaatatggac

SEQ ID NO: 883429 - DNA, 22 bp, Artificial Sequence
  chemically synthesized
cttcctgcaagtgaaaaatatg

SEQ ID NO: 883430 - DNA, 22 bp, Artificial Sequence
  chemically synthesized
tacttcctgcaagtgaaaaata

SEQ ID NO: 883431 - DNA, 22 bp, Artificial Sequence
  chemically synthesized
aacagggaatattctacttcct

SEQ ID NO: 883432 - DNA, 22 bp, Artificial Sequence
  chemically synthesized
gaacagggaatattctacttcc

SEQ ID NO: 883433 - DNA, 22 bp, Artificial Sequence
  chemically synthesized
ttcacttgcaggaagtagaata

SEQ ID NO: 883434 - DNA, 22 bp, Artificial Sequence
  chemically synthesized
tcacttgcaggaagtagaatat

SEQ ID NO: 883435 - DNA, 22 bp, Artificial Sequence
  chemically synthesized
cacttgcaggaagtagaatatt

SEQ ID NO: 883436 - DNA, 22 bp, Artificial Sequence
  chemically synthesized
acttgcaggaagtagaatattc

SEQ ID NO: 883437 - DNA, 22 bp, Artificial Sequence
  chemically synthesized
gtgacttgaacagggaatattc

SEQ ID NO: 883438 - DNA, 22 bp, Artificial Sequence
  chemically synthesized
ggtgacttgaacagggaatatt

SEQ ID NO: 883439 - DNA, 22 bp, Artificial Sequence
  chemically synthesized
gcaggaagtagaatattccctg

SEQ ID NO: 883440 - DNA, 22 bp, Artificial Sequence
  chemically synthesized
tggtgacttgaacagggaatat

SEQ ID NO: 883441 - DNA, 22 bp, Artificial Sequence
  chemically synthesized
caggaagtagaatattccctgt

SEQ ID NO: 883442 - DNA, 22 bp, Artificial Sequence
  chemically synthesized
ttttggtgacttgaacagggaa

SEQ ID NO: 883443 - DNA, 22 bp, Artificial Sequence
  chemically synthesized
gggctattttggtgacttgaac

SEQ ID NO: 883444 - DNA, 22 bp, Artificial Sequence
  chemically synthesized
aatctagggctattttggtgac

SEQ ID NO: 883445 - DNA, 22 bp, Artificial Sequence
  chemically synthesized
cctgttcaagtcaccaaaatag

SEQ ID NO: 883446 - DNA, 22 bp, Artificial Sequence
  chemically synthesized
ttcaagtcaccaaaatagccct

SEQ ID NO: 883447 - DNA, 22 bp, Artificial Sequence
  chemically synthesized
aagtcaccaaaatagccctaga

SEQ ID NO: 883448 - DNA, 22 bp, Artificial Sequence
  chemically synthesized
accagaggactaaatctagggc

SEQ ID NO: 883449 - DNA, 22 bp, Artificial Sequence
  chemically synthesized
attcaccagaggactaaatcta

SEQ ID NO: 883450 - DNA, 22 bp, Artificial Sequence
  chemically synthesized
gatttagtcctctggtgaatga

SEQ ID NO: 883451 - DNA, 22 bp, Artificial Sequence
  chemically synthesized
agtcctctggtgaatgaacatt

SEQ ID NO: 883452 - DNA, 22 bp, Artificial Sequence
  chemically synthesized
gtcctctggtgaatgaacattg

SEQ ID NO: 883453 - DNA, 22 bp, Artificial Sequence
  chemically synthesized
tggtgaatgaacattgcatact

SEQ ID NO: 883454 - DNA, 22 bp, Artificial Sequence
  chemically synthesized
gtgaatgaacattgcatactca

SEQ ID NO: 883455 - DNA, 22 bp, Artificial Sequence
  chemically synthesized
aatagagggaaatgatgtgagt

SEQ ID NO: 883456 - DNA, 22 bp, Artificial Sequence
  chemically synthesized
caatagagggaaatgatgtgag

SEQ ID NO: 883457 - DNA, 22 bp, Artificial Sequence
  chemically synthesized
catactcacatcatttccctct

SEQ ID NO: 883458 - DNA, 22 bp, Artificial Sequence
  chemically synthesized
acatcatttccctctattgaaa

SEQ ID NO: 883459 - DNA, 22 bp, Artificial Sequence
  chemically synthesized
ccctctattgaaatgtttccta

SEQ ID NO: 883460 - DNA, 22 bp, Artificial Sequence
  chemically synthesized
cctctattgaaatgtttcctat

SEQ ID NO: 883461 - DNA, 22 bp, Artificial Sequence
  chemically synthesized
tattgaaatgtttcctattacc

SEQ ID NO: 883462 - DNA, 22 bp, Artificial Sequence
  chemically synthesized
ttgaaatgtttcctattaccgt

SEQ ID NO: 883463 - DNA, 22 bp, Artificial Sequence
  chemically synthesized
aaatgtttcctattaccgtgtc

SEQ ID NO: 883464 - DNA, 22 bp, Artificial Sequence
  chemically synthesized
cctattaccgtgtccttctatc

SEQ ID NO: 883465 - DNA, 22 bp, Artificial Sequence
  chemically synthesized
ctattaccgtgtccttctatca

SEQ ID NO: 883466 - DNA, 22 bp, Artificial Sequence
  chemically synthesized
ttaccgtgtccttctatcatca

SEQ ID NO: 883467 - DNA, 22 bp, Artificial Sequence
  chemically synthesized
ccgtgtccttctatcatcacta

SEQ ID NO: 883468 - DNA, 22 bp, Artificial Sequence
  chemically synthesized
aaggatgaaaagatgacaatag

SEQ ID NO: 883469 - DNA, 22 bp, Artificial Sequence
  chemically synthesized
ctatcatcactattgtcatctt

SEQ ID NO: 883470 - DNA, 22 bp, Artificial Sequence
  chemically synthesized
tatcatcactattgtcatcttt

SEQ ID NO: 883471 - DNA, 22 bp, Artificial Sequence
  chemically synthesized
tcatcactattgtcatcttttc

SEQ ID NO: 883472 - DNA, 22 bp, Artificial Sequence
  chemically synthesized
tgtcattgaaggatgaaaagat

SEQ ID NO: 883473 - DNA, 22 bp, Artificial Sequence
  chemically synthesized
tactatgtcattgaaggatgaa

SEQ ID NO: 883474 - DNA, 22 bp, Artificial Sequence
  chemically synthesized
ttgtcatcttttcatccttcaa

SEQ ID NO: 883475 - DNA, 22 bp, Artificial Sequence
  chemically synthesized
tcatcttttcatccttcaatga

SEQ ID NO: 883476 - DNA, 22 bp, Artificial Sequence
  chemically synthesized
aaatctgtactatgtcattgaa

SEQ ID NO: 883477 - DNA, 22 bp, Artificial Sequence
  chemically synthesized
aaaatctgtactatgtcattga

SEQ ID NO: 883478 - DNA, 22 bp, Artificial Sequence
  chemically synthesized
ttcatccttcaatgacatagta

SEQ ID NO: 883479 - DNA, 22 bp, Artificial Sequence
  chemically synthesized
tcatccttcaatgacatagtac

SEQ ID NO: 883480 - DNA, 22 bp, Artificial Sequence
  chemically synthesized
catccttcaatgacatagtaca

SEQ ID NO: 883481 - DNA, 22 bp, Artificial Sequence
  chemically synthesized
atccttcaatgacatagtacag

SEQ ID NO: 883482 - DNA, 22 bp, Artificial Sequence
  chemically synthesized
atatgggtacttaaaatctgta

SEQ ID NO: 883483 - DNA, 22 bp, Artificial Sequence
  chemically synthesized
caatgacatagtacagatttta

SEQ ID NO: 883484 - DNA, 22 bp, Artificial Sequence
  chemically synthesized
aatgacatagtacagattttaa

SEQ ID NO: 883485 - DNA, 22 bp, Artificial Sequence
  chemically synthesized
agaataaatctcatatgggtac

SEQ ID NO: 883486 - DNA, 22 bp, Artificial Sequence
  chemically synthesized
tagaactgagaataaatctcat

SEQ ID NO: 883487 - DNA, 22 bp, Artificial Sequence
  chemically synthesized
taagtacccatatgagatttat

SEQ ID NO: 883488 - DNA, 22 bp, Artificial Sequence
  chemically synthesized
aagtacccatatgagatttatt

SEQ ID NO: 883489 - DNA, 22 bp, Artificial Sequence
  chemically synthesized
tatagaactgagaataaatctc

SEQ ID NO: 883490 - DNA, 22 bp, Artificial Sequence
  chemically synthesized
agtacccatatgagatttattc

SEQ ID NO: 883491 - DNA, 22 bp, Artificial Sequence
  chemically synthesized
ctatagaactgagaataaatct

SEQ ID NO: 883492 - DNA, 22 bp, Artificial Sequence
  chemically synthesized
tttctatagaactgagaataaa

SEQ ID NO: 883493 - DNA, 22 bp, Artificial Sequence
  chemically synthesized
tgtttctatagaactgagaata

SEQ ID NO: 883494 - DNA, 22 bp, Artificial Sequence
  chemically synthesized
ctctgtttctatagaactgaga

SEQ ID NO: 883495 - DNA, 22 bp, Artificial Sequence
  chemically synthesized
acccattgctctgtttctatag

SEQ ID NO: 883496 - DNA, 22 bp, Artificial Sequence
  chemically synthesized
cacccattgctctgtttctata

SEQ ID NO: 883497 - DNA, 22 bp, Artificial Sequence
  chemically synthesized
attctcagttctatagaaacag

SEQ ID NO: 883498 - DNA, 22 bp, Artificial Sequence
  chemically synthesized
tcacccattgctctgtttctat

SEQ ID NO: 883499 - DNA, 22 bp, Artificial Sequence
  chemically synthesized
ttctcagttctatagaaacaga

SEQ ID NO: 883500 - DNA, 22 bp, Artificial Sequence
  chemically synthesized
tttcacccattgctctgtttct

SEQ ID NO: 883501 - DNA, 22 bp, Artificial Sequence
  chemically synthesized
tcagttctatagaaacagagca

SEQ ID NO: 883502 - DNA, 22 bp, Artificial Sequence
  chemically synthesized
agttctatagaaacagagcaat

SEQ ID NO: 883503 - DNA, 22 bp, Artificial Sequence
  chemically synthesized
tatagaaacagagcaatgggtg

SEQ ID NO: 883504 - DNA, 22 bp, Artificial Sequence
  chemically synthesized
aaatgaattctttcacccattg

SEQ ID NO: 883505 - DNA, 22 bp, Artificial Sequence
  chemically synthesized
tagaaacagagcaatgggtgaa

SEQ ID NO: 883506 - DNA, 22 bp, Artificial Sequence
  chemically synthesized
gagctgaaatgaattctttcac

SEQ ID NO: 883507 - DNA, 22 bp, Artificial Sequence
  chemically synthesized
agagctgaaatgaattctttca

SEQ ID NO: 883508 - DNA, 22 bp, Artificial Sequence
  chemically synthesized
atttcagctctaaattctttgt

SEQ ID NO: 883509 - DNA, 22 bp, Artificial Sequence
  chemically synthesized
cagctctaaattctttgtggct

SEQ ID NO: 883510 - DNA, 22 bp, Artificial Sequence
  chemically synthesized
agctctaaattctttgtggcta

SEQ ID NO: 883511 - DNA, 22 bp, Artificial Sequence
  chemically synthesized
taaattctttgtggctactttt

SEQ ID NO: 883512 - DNA, 22 bp, Artificial Sequence
  chemically synthesized
aattctttgtggctacttttcc

SEQ ID NO: 883513 - DNA, 22 bp, Artificial Sequence
  chemically synthesized
caaaaatgtgccaaggaaaagt

SEQ ID NO: 883514 - DNA, 22 bp, Artificial Sequence
  chemically synthesized
tccaaaaatgtgccaaggaaaa

SEQ ID NO: 883515 - DNA, 22 bp, Artificial Sequence
  chemically synthesized
tttgtggctacttttccttggc

SEQ ID NO: 883516 - DNA, 22 bp, Artificial Sequence
  chemically synthesized
tgtggctacttttccttggcac

SEQ ID NO: 883517 - DNA, 22 bp, Artificial Sequence
  chemically synthesized
gtggctacttttccttggcaca

SEQ ID NO: 883518 - DNA, 22 bp, Artificial Sequence
  chemically synthesized
tggctacttttccttggcacat

SEQ ID NO: 883519 - DNA, 22 bp, Artificial Sequence
  chemically synthesized
cttttccttggcacatttttgg

SEQ ID NO: 883520 - DNA, 22 bp, Artificial Sequence
  chemically synthesized
gaggtccagttctccaaaaatg

SEQ ID NO: 883521 - DNA, 22 bp, Artificial Sequence
  chemically synthesized
ttccttggcacatttttggaga

SEQ ID NO: 883522 - DNA, 22 bp, Artificial Sequence
  chemically synthesized
tccttggcacatttttggagaa

SEQ ID NO: 883523 - DNA, 22 bp, Artificial Sequence
  chemically synthesized
ccttggcacatttttggagaac

SEQ ID NO: 883524 - DNA, 22 bp, Artificial Sequence
  chemically synthesized
attagaggtccagttctccaaa

SEQ ID NO: 883525 - DNA, 22 bp, Artificial Sequence
  chemically synthesized
cttggcacatttttggagaact

SEQ ID NO: 883526 - DNA, 22 bp, Artificial Sequence
  chemically synthesized
aattagaggtccagttctccaa

SEQ ID NO: 883527 - DNA, 22 bp, Artificial Sequence
  chemically synthesized
ggcacatttttggagaactgga

SEQ ID NO: 883528 - DNA, 22 bp, Artificial Sequence
  chemically synthesized
gcacatttttggagaactggac

SEQ ID NO: 883529 - DNA, 22 bp, Artificial Sequence
  chemically synthesized
ttggagaactggacctctaatt

SEQ ID NO: 883530 - DNA, 22 bp, Artificial Sequence
  chemically synthesized
tggagaactggacctctaatta

SEQ ID NO: 883531 - DNA, 22 bp, Artificial Sequence
  chemically synthesized
ggagaactggacctctaattaa

SEQ ID NO: 883532 - DNA, 22 bp, Artificial Sequence
  chemically synthesized
tcaaaggtgcatttaattagag

SEQ ID NO: 883533 - DNA, 22 bp, Artificial Sequence
  chemically synthesized
gagaactggacctctaattaaa

SEQ ID NO: 883534 - DNA, 22 bp, Artificial Sequence
  chemically synthesized
gacctctaattaaatgcacctt

SEQ ID NO: 883535 - DNA, 22 bp, Artificial Sequence
  chemically synthesized
aagtgatctatcaaaggtgcat

SEQ ID NO: 883536 - DNA, 22 bp, Artificial Sequence
  chemically synthesized
taaagtgatctatcaaaggtgc

SEQ ID NO: 883537 - DNA, 22 bp, Artificial Sequence
  chemically synthesized
ctaaagtgatctatcaaaggtg

SEQ ID NO: 883538 - DNA, 22 bp, Artificial Sequence
  chemically synthesized
tctaaagtgatctatcaaaggt

SEQ ID NO: 883539 - DNA, 22 bp, Artificial Sequence
  chemically synthesized
taattaaatgcacctttgatag

SEQ ID NO: 883540 - DNA, 22 bp, Artificial Sequence
  chemically synthesized
attaaatgcacctttgatagat

SEQ ID NO: 883541 - DNA, 22 bp, Artificial Sequence
  chemically synthesized
aatgcacctttgatagatcact

SEQ ID NO: 883542 - DNA, 22 bp, Artificial Sequence
  chemically synthesized
aaaatggtctttctaaagtgat

SEQ ID NO: 883543 - DNA, 22 bp, Artificial Sequence
  chemically synthesized
caaaatggtctttctaaagtga

SEQ ID NO: 883544 - DNA, 22 bp, Artificial Sequence
  chemically synthesized
tcttcaaaatggtctttctaaa

SEQ ID NO: 883545 - DNA, 22 bp, Artificial Sequence
  chemically synthesized
tgatagatcactttagaaagac

SEQ ID NO: 883546 - DNA, 22 bp, Artificial Sequence
  chemically synthesized
atcttcaaaatggtctttctaa

SEQ ID NO: 883547 - DNA, 22 bp, Artificial Sequence
  chemically synthesized
gatagatcactttagaaagacc

SEQ ID NO: 883548 - DNA, 22 bp, Artificial Sequence
  chemically synthesized
atagatcactttagaaagacca

SEQ ID NO: 883549 - DNA, 22 bp, Artificial Sequence
  chemically synthesized
tagaaatttatcttcaaaatgg

SEQ ID NO: 883550 - DNA, 22 bp, Artificial Sequence
  chemically synthesized
tagaaagaccattttgaagata

SEQ ID NO: 883551 - DNA, 22 bp, Artificial Sequence
  chemically synthesized
agaaagaccattttgaagataa

SEQ ID NO: 883552 - DNA, 22 bp, Artificial Sequence
  chemically synthesized
gaaagaccattttgaagataaa

SEQ ID NO: 883553 - DNA, 22 bp, Artificial Sequence
  chemically synthesized
tgaagataaatttctacaattt

SEQ ID NO: 883554 - DNA, 22 bp, Artificial Sequence
  chemically synthesized
gaagataaatttctacaattta

SEQ ID NO: 883555 - DNA, 22 bp, Artificial Sequence
  chemically synthesized
aagataaatttctacaatttac

SEQ ID NO: 883556 - DNA, 22 bp, Artificial Sequence
  chemically synthesized
caaataaatgtagtgaggtaaa

SEQ ID NO: 883557 - DNA, 22 bp, Artificial Sequence
  chemically synthesized
ctacaatttacctcactacatt

SEQ ID NO: 883558 - DNA, 22 bp, Artificial Sequence
  chemically synthesized
aacctgcaaataaatgtagtga

SEQ ID NO: 883559 - DNA, 22 bp, Artificial Sequence
  chemically synthesized
tacaatttacctcactacattt

SEQ ID NO: 883560 - DNA, 22 bp, Artificial Sequence
  chemically synthesized
caatttacctcactacatttat

SEQ ID NO: 883561 - DNA, 22 bp, Artificial Sequence
  chemically synthesized
ataaattcaacctgcaaataaa

SEQ ID NO: 883562 - DNA, 22 bp, Artificial Sequence
  chemically synthesized
acctcactacatttatttgcag

SEQ ID NO: 883563 - DNA, 22 bp, Artificial Sequence
  chemically synthesized
cctcactacatttatttgcagg

SEQ ID NO: 883564 - DNA, 22 bp, Artificial Sequence
  chemically synthesized
aactaataaattcaacctgcaa

SEQ ID NO: 883565 - DNA, 22 bp, Artificial Sequence
  chemically synthesized
actacatttatttgcaggttga

SEQ ID NO: 883566 - DNA, 22 bp, Artificial Sequence
  chemically synthesized
gaactaataaattcaacctgca

SEQ ID NO: 883567 - DNA, 22 bp, Artificial Sequence
  chemically synthesized
tgaactaataaattcaacctgc

SEQ ID NO: 883568 - DNA, 22 bp, Artificial Sequence
  chemically synthesized
catttatttgcaggttgaattt

SEQ ID NO: 883569 - DNA, 22 bp, Artificial Sequence
  chemically synthesized
tctttgaactaataaattcaac

SEQ ID NO: 883570 - DNA, 22 bp, Artificial Sequence
  chemically synthesized
atttgcaggttgaatttattag

SEQ ID NO: 883571 - DNA, 22 bp, Artificial Sequence
  chemically synthesized
tttgcaggttgaatttattagt

SEQ ID NO: 883572 - DNA, 22 bp, Artificial Sequence
  chemically synthesized
acctatctttgaactaataaat

SEQ ID NO: 883573 - DNA, 22 bp, Artificial Sequence
  chemically synthesized
gcaggttgaatttattagttca

SEQ ID NO: 883574 - DNA, 22 bp, Artificial Sequence
  chemically synthesized
caggttgaatttattagttcaa

SEQ ID NO: 883575 - DNA, 22 bp, Artificial Sequence
  chemically synthesized
ataactgacctatctttgaact

SEQ ID NO: 883576 - DNA, 22 bp, Artificial Sequence
  chemically synthesized
aataactgacctatctttgaac

SEQ ID NO: 883577 - DNA, 22 bp, Artificial Sequence
  chemically synthesized
aatttattagttcaaagatagg

SEQ ID NO: 883578 - DNA, 22 bp, Artificial Sequence
  chemically synthesized
cccttaataactgacctatctt

SEQ ID NO: 883579 - DNA, 22 bp, Artificial Sequence
  chemically synthesized
gcccttaataactgacctatct

SEQ ID NO: 883580 - DNA, 22 bp, Artificial Sequence
  chemically synthesized
attagttcaaagataggtcagt

SEQ ID NO: 883581 - DNA, 22 bp, Artificial Sequence
  chemically synthesized
ttagttcaaagataggtcagtt

SEQ ID NO: 883582 - DNA, 22 bp, Artificial Sequence
  chemically synthesized
gttcaaagataggtcagttatt

SEQ ID NO: 883583 - DNA, 22 bp, Artificial Sequence
  chemically synthesized
aaagataggtcagttattaagg

SEQ ID NO: 883584 - DNA, 22 bp, Artificial Sequence
  chemically synthesized
aagcaatagtatcttgccctta

SEQ ID NO: 883585 - DNA, 22 bp, Artificial Sequence
  chemically synthesized
caagcaatagtatcttgccctt

SEQ ID NO: 883586 - DNA, 22 bp, Artificial Sequence
  chemically synthesized
acccttcaagcaatagtatctt

SEQ ID NO: 883587 - DNA, 22 bp, Artificial Sequence
  chemically synthesized
ttaagggcaagatactattgct

SEQ ID NO: 883588 - DNA, 22 bp, Artificial Sequence
  chemically synthesized
cagttgacccttcaagcaatag

SEQ ID NO: 883589 - DNA, 22 bp, Artificial Sequence
  chemically synthesized
agggcaagatactattgcttga

SEQ ID NO: 883590 - DNA, 22 bp, Artificial Sequence
  chemically synthesized
ctacagttgacccttcaagcaa

SEQ ID NO: 883591 - DNA, 22 bp, Artificial Sequence
  chemically synthesized
actacagttgacccttcaagca

SEQ ID NO: 883592 - DNA, 22 bp, Artificial Sequence
  chemically synthesized
gatttactacagttgacccttc

SEQ ID NO: 883593 - DNA, 22 bp, Artificial Sequence
  chemically synthesized
attggatttactacagttgacc

SEQ ID NO: 883594 - DNA, 22 bp, Artificial Sequence
  chemically synthesized
ttgcttgaagggtcaactgtag

SEQ ID NO: 883595 - DNA, 22 bp, Artificial Sequence
  chemically synthesized
cttgaagggtcaactgtagtaa

SEQ ID NO: 883596 - DNA, 22 bp, Artificial Sequence
  chemically synthesized
gaagggtcaactgtagtaaatc

SEQ ID NO: 883597 - DNA, 22 bp, Artificial Sequence
  chemically synthesized
aagggtcaactgtagtaaatcc

SEQ ID NO: 883598 - DNA, 22 bp, Artificial Sequence
  chemically synthesized
agtgaagttaattggatttact

SEQ ID NO: 883599 - DNA, 22 bp, Artificial Sequence
  chemically synthesized
cagtgaagttaattggatttac

SEQ ID NO: 883600 - DNA, 22 bp, Artificial Sequence
  chemically synthesized
tcagtgaagttaattggattta

SEQ ID NO: 883601 - DNA, 22 bp, Artificial Sequence
  chemically synthesized
tagtaaatccaattaacttcac

SEQ ID NO: 883602 - DNA, 22 bp, Artificial Sequence
  chemically synthesized
acttcactgaaaatattctttc

SEQ ID NO: 883603 - DNA, 22 bp, Artificial Sequence
  chemically synthesized
aagaaaatatgtacgaaagaat

SEQ ID NO: 883604 - DNA, 22 bp, Artificial Sequence
  chemically synthesized
cactgaaaatattctttcgtac

SEQ ID NO: 883605 - DNA, 22 bp, Artificial Sequence
  chemically synthesized
actgaaaatattctttcgtaca

SEQ ID NO: 883606 - DNA, 22 bp, Artificial Sequence
  chemically synthesized
actgaagaaaatatgtacgaaa

SEQ ID NO: 883607 - DNA, 22 bp, Artificial Sequence
  chemically synthesized
aaaatattctttcgtacatatt

SEQ ID NO: 883608 - DNA, 22 bp, Artificial Sequence
  chemically synthesized
tactcactgaagaaaatatgta

SEQ ID NO: 883609 - DNA, 22 bp, Artificial Sequence
  chemically synthesized
atactcactgaagaaaatatgt

SEQ ID NO: 883610 - DNA, 22 bp, Artificial Sequence
  chemically synthesized
cttatactcactgaagaaaata

SEQ ID NO: 883611 - DNA, 22 bp, Artificial Sequence
  chemically synthesized
ccttatactcactgaagaaaat

SEQ ID NO: 883612 - DNA, 22 bp, Artificial Sequence
  chemically synthesized
tccttatactcactgaagaaaa

SEQ ID NO: 883613 - DNA, 22 bp, Artificial Sequence
  chemically synthesized
tttcgtacatattttcttcagt

SEQ ID NO: 883614 - DNA, 22 bp, Artificial Sequence
  chemically synthesized
tcgtacatattttcttcagtga

SEQ ID NO: 883615 - DNA, 22 bp, Artificial Sequence
  chemically synthesized
ttttccttatactcactgaaga

SEQ ID NO: 883616 - DNA, 22 bp, Artificial Sequence
  chemically synthesized
cgtacatattttcttcagtgag

SEQ ID NO: 883617 - DNA, 22 bp, Artificial Sequence
  chemically synthesized
attttccttatactcactgaag

SEQ ID NO: 883618 - DNA, 22 bp, Artificial Sequence
  chemically synthesized
gtacatattttcttcagtgagt

SEQ ID NO: 883619 - DNA, 22 bp, Artificial Sequence
  chemically synthesized
cagtttattttccttatactca

SEQ ID NO: 883620 - DNA, 22 bp, Artificial Sequence
  chemically synthesized
acagtttattttccttatactc

SEQ ID NO: 883621 - DNA, 22 bp, Artificial Sequence
  chemically synthesized
ttacagtttattttccttatac

SEQ ID NO: 883622 - DNA, 22 bp, Artificial Sequence
  chemically synthesized
cttacagtttattttccttata

SEQ ID NO: 883623 - DNA, 22 bp, Artificial Sequence
  chemically synthesized
tcttcagtgagtataaggaaaa

SEQ ID NO: 883624 - DNA, 22 bp, Artificial Sequence
  chemically synthesized
cttcagtgagtataaggaaaat

SEQ ID NO: 883625 - DNA, 22 bp, Artificial Sequence
  chemically synthesized
ttcagtgagtataaggaaaata

SEQ ID NO: 883626 - DNA, 22 bp, Artificial Sequence
  chemically synthesized
cagtgagtataaggaaaataaa

SEQ ID NO: 883627 - DNA, 22 bp, Artificial Sequence
  chemically synthesized
agtgagtataaggaaaataaac

SEQ ID NO: 883628 - DNA, 22 bp, Artificial Sequence
  chemically synthesized
tcagtttcttacagtttatttt

SEQ ID NO: 883629 - DNA, 22 bp, Artificial Sequence
  chemically synthesized
ggataattgtcagtttcttaca

SEQ ID NO: 883630 - DNA, 22 bp, Artificial Sequence
  chemically synthesized
aggataattgtcagtttcttac

SEQ ID NO: 883631 - DNA, 22 bp, Artificial Sequence
  chemically synthesized
taggataattgtcagtttctta

SEQ ID NO: 883632 - DNA, 22 bp, Artificial Sequence
  chemically synthesized
ttaggataattgtcagtttctt

SEQ ID NO: 883633 - DNA, 22 bp, Artificial Sequence
  chemically synthesized
atttttaggataattgtcagtt

SEQ ID NO: 883634 - DNA, 22 bp, Artificial Sequence
  chemically synthesized
aatttttaggataattgtcagt

SEQ ID NO: 883635 - DNA, 22 bp, Artificial Sequence
  chemically synthesized
taatttttaggataattgtcag

SEQ ID NO: 883636 - DNA, 22 bp, Artificial Sequence
  chemically synthesized
tttaatttttaggataattgtc

SEQ ID NO: 883637 - DNA, 22 bp, Artificial Sequence
  chemically synthesized
taagaaactgacaattatccta

SEQ ID NO: 883638 - DNA, 22 bp, Artificial Sequence
  chemically synthesized
acatattctttaatttttagga

SEQ ID NO: 883639 - DNA, 22 bp, Artificial Sequence
  chemically synthesized
cacatattctttaatttttagg

SEQ ID NO: 883640 - DNA, 22 bp, Artificial Sequence
  chemically synthesized
tttcacatattctttaattttt

SEQ ID NO: 883641 - DNA, 22 bp, Artificial Sequence
  chemically synthesized
acaattatcctaaaaattaaag

SEQ ID NO: 883642 - DNA, 22 bp, Artificial Sequence
  chemically synthesized
atttcacatattctttaatttt

SEQ ID NO: 883643 - DNA, 22 bp, Artificial Sequence
  chemically synthesized
caatttatttcacatattcttt

SEQ ID NO: 883644 - DNA, 22 bp, Artificial Sequence
  chemically synthesized
tcctaaaaattaaagaatatgt

SEQ ID NO: 883645 - DNA, 22 bp, Artificial Sequence
  chemically synthesized
acaatttatttcacatattctt

SEQ ID NO: 883646 - DNA, 22 bp, Artificial Sequence
  chemically synthesized
tacaatttatttcacatattct

SEQ ID NO: 883647 - DNA, 22 bp, Artificial Sequence
  chemically synthesized
aaaattaaagaatatgtgaaat

SEQ ID NO: 883648 - DNA, 22 bp, Artificial Sequence
  chemically synthesized
aagaatatgtgaaataaattgt

SEQ ID NO: 883649 - DNA, 22 bp, Artificial Sequence
  chemically synthesized
catggagaaataacaaatttta

SEQ ID NO: 883650 - DNA, 22 bp, Artificial Sequence
  chemically synthesized
gcatggagaaataacaaatttt

SEQ ID NO: 883651 - DNA, 22 bp, Artificial Sequence
  chemically synthesized
tttgcatggagaaataacaaat

SEQ ID NO: 883652 - DNA, 22 bp, Artificial Sequence
  chemically synthesized
atttgcatggagaaataacaaa

SEQ ID NO: 883653 - DNA, 22 bp, Artificial Sequence
  chemically synthesized
tatttgcatggagaaataacaa

SEQ ID NO: 883654 - DNA, 22 bp, Artificial Sequence
  chemically synthesized
taaaatttgttatttctccatg

SEQ ID NO: 883655 - DNA, 22 bp, Artificial Sequence
  chemically synthesized
tgtcacattttatttgcatgga

SEQ ID NO: 883656 - DNA, 22 bp, Artificial Sequence
  chemically synthesized
tatgtcacattttatttgcatg

SEQ ID NO: 883657 - DNA, 22 bp, Artificial Sequence
  chemically synthesized
ctatgtcacattttatttgcat

SEQ ID NO: 883658 - DNA, 22 bp, Artificial Sequence
  chemically synthesized
gttatttctccatgcaaataaa

SEQ ID NO: 883659 - DNA, 22 bp, Artificial Sequence
  chemically synthesized
tctatgtcacattttatttgca

SEQ ID NO: 883660 - DNA, 22 bp, Artificial Sequence
  chemically synthesized
ttatttctccatgcaaataaaa

SEQ ID NO: 883661 - DNA, 22 bp, Artificial Sequence
  chemically synthesized
ttctatgtcacattttatttgc

SEQ ID NO: 883662 - DNA, 22 bp, Artificial Sequence
  chemically synthesized
tttctccatgcaaataaaatgt

SEQ ID NO: 883663 - DNA, 22 bp, Artificial Sequence
  chemically synthesized
gcttttctatgtcacattttat

SEQ ID NO: 883664 - DNA, 22 bp, Artificial Sequence
  chemically synthesized
agcttttctatgtcacatttta

SEQ ID NO: 883665 - DNA, 22 bp, Artificial Sequence
  chemically synthesized
ctccatgcaaataaaatgtgac

SEQ ID NO: 883666 - DNA, 22 bp, Artificial Sequence
  chemically synthesized
tagcttttctatgtcacatttt

SEQ ID NO: 883667 - DNA, 22 bp, Artificial Sequence
  chemically synthesized
tccatgcaaataaaatgtgaca

SEQ ID NO: 883668 - DNA, 22 bp, Artificial Sequence
  chemically synthesized
ttagcttttctatgtcacattt

SEQ ID NO: 883669 - DNA, 22 bp, Artificial Sequence
  chemically synthesized
tttagcttttctatgtcacatt

SEQ ID NO: 883670 - DNA, 22 bp, Artificial Sequence
  chemically synthesized
catgcaaataaaatgtgacata

SEQ ID NO: 883671 - DNA, 22 bp, Artificial Sequence
  chemically synthesized
ttttttagcttttctatgtcac

SEQ ID NO: 883672 - DNA, 22 bp, Artificial Sequence
  chemically synthesized
gttttttagcttttctatgtca

SEQ ID NO: 883673 - DNA, 22 bp, Artificial Sequence
  chemically synthesized
tgttttttagcttttctatgtc

SEQ ID NO: 883674 - DNA, 22 bp, Artificial Sequence
  chemically synthesized
ctttgttttttagcttttctat

SEQ ID NO: 883675 - DNA, 22 bp, Artificial Sequence
  chemically synthesized
gctttgttttttagcttttcta

SEQ ID NO: 883676 - DNA, 22 bp, Artificial Sequence
  chemically synthesized
ttgctttgttttttagcttttc

SEQ ID NO: 883677 - DNA, 22 bp, Artificial Sequence
  chemically synthesized
cttgctttgttttttagctttt

SEQ ID NO: 883678 - DNA, 22 bp, Artificial Sequence
  chemically synthesized
tttcttgctttgttttttagct

SEQ ID NO: 883679 - DNA, 22 bp, Artificial Sequence
  chemically synthesized
gagttgtttcttgctttgtttt

SEQ ID NO: 883680 - DNA, 22 bp, Artificial Sequence
  chemically synthesized
ggagttgtttcttgctttgttt

SEQ ID NO: 883681 - DNA, 22 bp, Artificial Sequence
  chemically synthesized
tggagttgtttcttgctttgtt

SEQ ID NO: 883682 - DNA, 22 bp, Artificial Sequence
  chemically synthesized
tttggagttgtttcttgctttg

SEQ ID NO: 883683 - DNA, 22 bp, Artificial Sequence
  chemically synthesized
ctttggagttgtttcttgcttt

SEQ ID NO: 883684 - DNA, 22 bp, Artificial Sequence
  chemically synthesized
aaaaacaaagcaagaaacaact

SEQ ID NO: 883685 - DNA, 22 bp, Artificial Sequence
  chemically synthesized
atgtggtttctttggagttgtt

SEQ ID NO: 883686 - DNA, 22 bp, Artificial Sequence
  chemically synthesized
catctcatgtggtttctttgga

SEQ ID NO: 883687 - DNA, 22 bp, Artificial Sequence
  chemically synthesized
ccatctcatgtggtttctttgg

SEQ ID NO: 883688 - DNA, 22 bp, Artificial Sequence
  chemically synthesized
tccatctcatgtggtttctttg

SEQ ID NO: 883689 - DNA, 22 bp, Artificial Sequence
  chemically synthesized
atctttccatctcatgtggttt

SEQ ID NO: 883690 - DNA, 22 bp, Artificial Sequence
  chemically synthesized
tgatctttccatctcatgtggt

SEQ ID NO: 883691 - DNA, 22 bp, Artificial Sequence
  chemically synthesized
ctgatctttccatctcatgtgg

SEQ ID NO: 883692 - DNA, 22 bp, Artificial Sequence
  chemically synthesized
tctgatctttccatctcatgtg

SEQ ID NO: 883693 - DNA, 22 bp, Artificial Sequence
  chemically synthesized
caaagaaaccacatgagatgga

SEQ ID NO: 883694 - DNA, 22 bp, Artificial Sequence
  chemically synthesized
gtagcattttctgatctttcca

SEQ ID NO: 883695 - DNA, 22 bp, Artificial Sequence
  chemically synthesized
agtagcattttctgatctttcc

SEQ ID NO: 883696 - DNA, 22 bp, Artificial Sequence
  chemically synthesized
tagtagcattttctgatctttc

SEQ ID NO: 883697 - DNA, 22 bp, Artificial Sequence
  chemically synthesized
ataattttagtagcattttctg

SEQ ID NO: 883698 - DNA, 22 bp, Artificial Sequence
  chemically synthesized
agcacagctaataattttagta

SEQ ID NO: 883699 - DNA, 22 bp, Artificial Sequence
  chemically synthesized
cagcacagctaataattttagt

SEQ ID NO: 883700 - DNA, 22 bp, Artificial Sequence
  chemically synthesized
tcagcacagctaataattttag

SEQ ID NO: 883701 - DNA, 22 bp, Artificial Sequence
  chemically synthesized
ccattttcagcacagctaataa

SEQ ID NO: 883702 - DNA, 22 bp, Artificial Sequence
  chemically synthesized
gttgccattttcagcacagcta

SEQ ID NO: 883703 - DNA, 22 bp, Artificial Sequence
  chemically synthesized
ctaaaattattagctgtgctga

SEQ ID NO: 883704 - DNA, 22 bp, Artificial Sequence
  chemically synthesized
aaattattagctgtgctgaaaa

SEQ ID NO: 883705 - DNA, 22 bp, Artificial Sequence
  chemically synthesized
tagcagttagttgccattttca

SEQ ID NO: 883706 - DNA, 22 bp, Artificial Sequence
  chemically synthesized
ttagctgtgctgaaaatggcaa

SEQ ID NO: 883707 - DNA, 22 bp, Artificial Sequence
  chemically synthesized
gctgtgctgaaaatggcaacta

SEQ ID NO: 883708 - DNA, 22 bp, Artificial Sequence
  chemically synthesized
tgctgaaaatggcaactaactg

SEQ ID NO: 883709 - DNA, 22 bp, Artificial Sequence
  chemically synthesized
atatcactatagcagttagttg

SEQ ID NO: 883710 - DNA, 22 bp, Artificial Sequence
  chemically synthesized
aaaatggcaactaactgctata

SEQ ID NO: 883711 - DNA, 22 bp, Artificial Sequence
  chemically synthesized
tcacagcagttaatatcactat

SEQ ID NO: 883712 - DNA, 22 bp, Artificial Sequence
  chemically synthesized
actgctatagtgatattaactg

SEQ ID NO: 883713 - DNA, 22 bp, Artificial Sequence
  chemically synthesized
atattatcacagcagttaatat

SEQ ID NO: 883714 - DNA, 22 bp, Artificial Sequence
  chemically synthesized
ttaatattatcacagcagttaa

SEQ ID NO: 883715 - DNA, 22 bp, Artificial Sequence
  chemically synthesized
ctatagtgatattaactgctgt

SEQ ID NO: 883716 - DNA, 22 bp, Artificial Sequence
  chemically synthesized
gttaatattatcacagcagtta

SEQ ID NO: 883717 - DNA, 22 bp, Artificial Sequence
  chemically synthesized
tagtgatattaactgctgtgat

SEQ ID NO: 883718 - DNA, 22 bp, Artificial Sequence
  chemically synthesized
tagcttgttaatattatcacag

SEQ ID NO: 883719 - DNA, 22 bp, Artificial Sequence
  chemically synthesized
gcaactgtagcttgttaatatt

SEQ ID NO: 883720 - DNA, 22 bp, Artificial Sequence
  chemically synthesized
actgctgtgataatattaacaa

SEQ ID NO: 883721 - DNA, 22 bp, Artificial Sequence
  chemically synthesized
agcaactgtagcttgttaatat

SEQ ID NO: 883722 - DNA, 22 bp, Artificial Sequence
  chemically synthesized
tagcaactgtagcttgttaata

SEQ ID NO: 883723 - DNA, 22 bp, Artificial Sequence
  chemically synthesized
ctgtgataatattaacaagcta

SEQ ID NO: 883724 - DNA, 22 bp, Artificial Sequence
  chemically synthesized
tgataatattaacaagctacag

SEQ ID NO: 883725 - DNA, 22 bp, Artificial Sequence
  chemically synthesized
acaagctacagttgctaaaaca

SEQ ID NO: 883726 - DNA, 22 bp, Artificial Sequence
  chemically synthesized
acatataataaatgttttagca

SEQ ID NO: 883727 - DNA, 22 bp, Artificial Sequence
  chemically synthesized
gacatataataaatgttttagc

SEQ ID NO: 883728 - DNA, 22 bp, Artificial Sequence
  chemically synthesized
cagttgctaaaacatttattat

SEQ ID NO: 883729 - DNA, 22 bp, Artificial Sequence
  chemically synthesized
ctaaaacatttattatatgtca

SEQ ID NO: 883730 - DNA, 22 bp, Artificial Sequence
  chemically synthesized
aaacatttattatatgtcaaac

SEQ ID NO: 883731 - DNA, 22 bp, Artificial Sequence
  chemically synthesized
attatatgtcaaacactgtgct

SEQ ID NO: 883732 - DNA, 22 bp, Artificial Sequence
  chemically synthesized
ttatatgtcaaacactgtgctt

SEQ ID NO: 883733 - DNA, 22 bp, Artificial Sequence
  chemically synthesized
tatgtcaaacactgtgcttttc

SEQ ID NO: 883734 - DNA, 22 bp, Artificial Sequence
  chemically synthesized
taggagtgtatgtgtgtatgaa

SEQ ID NO: 883735 - DNA, 22 bp, Artificial Sequence
  chemically synthesized
gtaggagtgtatgtgtgtatga

SEQ ID NO: 883736 - DNA, 22 bp, Artificial Sequence
  chemically synthesized
tgtaggagtgtatgtgtgtatg

SEQ ID NO: 883737 - DNA, 22 bp, Artificial Sequence
  chemically synthesized
tttgtaggagtgtatgtgtgta

SEQ ID NO: 883738 - DNA, 22 bp, Artificial Sequence
  chemically synthesized
ctttgtaggagtgtatgtgtgt

SEQ ID NO: 883739 - DNA, 22 bp, Artificial Sequence
  chemically synthesized
tctttgtaggagtgtatgtgtg

SEQ ID NO: 883740 - DNA, 22 bp, Artificial Sequence
  chemically synthesized
tgcttttcatacacacatacac

SEQ ID NO: 883741 - DNA, 22 bp, Artificial Sequence
  chemically synthesized
ttcatacacacatacactccta

SEQ ID NO: 883742 - DNA, 22 bp, Artificial Sequence
  chemically synthesized
tcatacacacatacactcctac

SEQ ID NO: 883743 - DNA, 22 bp, Artificial Sequence
  chemically synthesized
catacacacatacactcctaca

SEQ ID NO: 883744 - DNA, 22 bp, Artificial Sequence
  chemically synthesized
atacacacatacactcctacaa

SEQ ID NO: 883745 - DNA, 22 bp, Artificial Sequence
  chemically synthesized
gataaaactttctttgtaggag

SEQ ID NO: 883746 - DNA, 22 bp, Artificial Sequence
  chemically synthesized
tgaaattagataaaactttctt

SEQ ID NO: 883747 - DNA, 22 bp, Artificial Sequence
  chemically synthesized
ctacaaagaaagttttatctaa

SEQ ID NO: 883748 - DNA, 22 bp, Artificial Sequence
  chemically synthesized
cagcatctgtgaaattagataa

SEQ ID NO: 883749 - DNA, 22 bp, Artificial Sequence
  chemically synthesized
caaagaaagttttatctaattt

SEQ ID NO: 883750 - DNA, 22 bp, Artificial Sequence
  chemically synthesized
aattgcagcatctgtgaaatta

SEQ ID NO: 883751 - DNA, 22 bp, Artificial Sequence
  chemically synthesized
tcaattgcagcatctgtgaaat

SEQ ID NO: 883752 - DNA, 22 bp, Artificial Sequence
  chemically synthesized
tctcaattgcagcatctgtgaa

SEQ ID NO: 883753 - DNA, 22 bp, Artificial Sequence
  chemically synthesized
tatctaatttcacagatgctgc

SEQ ID NO: 883754 - DNA, 22 bp, Artificial Sequence
  chemically synthesized
atctaatttcacagatgctgca

SEQ ID NO: 883755 - DNA, 22 bp, Artificial Sequence
  chemically synthesized
atctctctcaattgcagcatct

SEQ ID NO: 883756 - DNA, 22 bp, Artificial Sequence
  chemically synthesized
tctaatttcacagatgctgcaa

SEQ ID NO: 883757 - DNA, 22 bp, Artificial Sequence
  chemically synthesized
atttcacagatgctgcaattga

SEQ ID NO: 883758 - DNA, 22 bp, Artificial Sequence
  chemically synthesized
acctaatctctctcaattgcag

SEQ ID NO: 883759 - DNA, 22 bp, Artificial Sequence
  chemically synthesized
cacagatgctgcaattgagaga

SEQ ID NO: 883760 - DNA, 22 bp, Artificial Sequence
  chemically synthesized
acagatgctgcaattgagagag

SEQ ID NO: 883761 - DNA, 22 bp, Artificial Sequence
  chemically synthesized
gataattgacctaatctctctc

SEQ ID NO: 883762 - DNA, 22 bp, Artificial Sequence
  chemically synthesized
ggataattgacctaatctctct

SEQ ID NO: 883763 - DNA, 22 bp, Artificial Sequence
  chemically synthesized
caattgagagagattaggtcaa

SEQ ID NO: 883764 - DNA, 22 bp, Artificial Sequence
  chemically synthesized
agagagattaggtcaattatcc

SEQ ID NO: 883765 - DNA, 22 bp, Artificial Sequence
  chemically synthesized
caagccacatggtcttggataa

SEQ ID NO: 883766 - DNA, 22 bp, Artificial Sequence
  chemically synthesized
gcaagccacatggtcttggata

SEQ ID NO: 883767 - DNA, 22 bp, Artificial Sequence
  chemically synthesized
ggtcaattatccaagaccatgt

SEQ ID NO: 883768 - DNA, 22 bp, Artificial Sequence
  chemically synthesized
ccatttgcaagccacatggtct

SEQ ID NO: 883769 - DNA, 22 bp, Artificial Sequence
  chemically synthesized
tgccatttgcaagccacatggt

SEQ ID NO: 883770 - DNA, 22 bp, Artificial Sequence
  chemically synthesized
aactctgccatttgcaagccac

SEQ ID NO: 883771 - DNA, 22 bp, Artificial Sequence
  chemically synthesized
tccaagaccatgtggcttgcaa

SEQ ID NO: 883772 - DNA, 22 bp, Artificial Sequence
  chemically synthesized
gatataatctcaactctgccat

SEQ ID NO: 883773 - DNA, 22 bp, Artificial Sequence
  chemically synthesized
ctggatataatctcaactctgc

SEQ ID NO: 883774 - DNA, 22 bp, Artificial Sequence
  chemically synthesized
cctggatataatctcaactctg

SEQ ID NO: 883775 - DNA, 22 bp, Artificial Sequence
  chemically synthesized
gcaaatggcagagttgagatta

SEQ ID NO: 883776 - DNA, 22 bp, Artificial Sequence
  chemically synthesized
caaatggcagagttgagattat

SEQ ID NO: 883777 - DNA, 22 bp, Artificial Sequence
  chemically synthesized
gtgacacatacttcctggatat

SEQ ID NO: 883778 - DNA, 22 bp, Artificial Sequence
  chemically synthesized
ggtgacacatacttcctggata

SEQ ID NO: 883779 - DNA, 22 bp, Artificial Sequence
  chemically synthesized
agattatatccaggaagtatgt

SEQ ID NO: 883780 - DNA, 22 bp, Artificial Sequence
  chemically synthesized
tatccaggaagtatgtgtcacc

SEQ ID NO: 883781 - DNA, 22 bp, Artificial Sequence
  chemically synthesized
agaaagaaggaaatagagattt

SEQ ID NO: 883782 - DNA, 22 bp, Artificial Sequence
  chemically synthesized
tatttccttctttctgaatctg

SEQ ID NO: 883783 - DNA, 22 bp, Artificial Sequence
  chemically synthesized
tttccttctttctgaatctgtt

SEQ ID NO: 883784 - DNA, 22 bp, Artificial Sequence
  chemically synthesized
ccttctttctgaatctgttgtg

SEQ ID NO: 883785 - DNA, 22 bp, Artificial Sequence
  chemically synthesized
cttctttctgaatctgttgtgt

SEQ ID NO: 883786 - DNA, 22 bp, Artificial Sequence
  chemically synthesized
ctttctgaatctgttgtgtata

SEQ ID NO: 883787 - DNA, 22 bp, Artificial Sequence
  chemically synthesized
tttctgaatctgttgtgtatac

SEQ ID NO: 883788 - DNA, 22 bp, Artificial Sequence
  chemically synthesized
tctgaatctgttgtgtatactg

SEQ ID NO: 883789 - DNA, 22 bp, Artificial Sequence
  chemically synthesized
ctgaatctgttgtgtatactgt

SEQ ID NO: 883790 - DNA, 22 bp, Artificial Sequence
  chemically synthesized
tgaatctgttgtgtatactgtg

SEQ ID NO: 883791 - DNA, 22 bp, Artificial Sequence
  chemically synthesized
aatctgttgtgtatactgtgtg

SEQ ID NO: 883792 - DNA, 22 bp, Artificial Sequence
  chemically synthesized
ttgtgtatactgtgtgtgtgtg

SEQ ID NO: 883793 - DNA, 22 bp, Artificial Sequence
  chemically synthesized
tgtatactgtgtgtgtgtgtgc

SEQ ID NO: 883794 - DNA, 22 bp, Artificial Sequence
  chemically synthesized
tgtgtgtgtgtgcatacacgca

SEQ ID NO: 883795 - DNA, 22 bp, Artificial Sequence
  chemically synthesized
gaaagaaataataagcatatat

SEQ ID NO: 883796 - DNA, 22 bp, Artificial Sequence
  chemically synthesized
ggaaagaaataataagcatata

SEQ ID NO: 883797 - DNA, 22 bp, Artificial Sequence
  chemically synthesized
tggaaagaaataataagcatat

SEQ ID NO: 883798 - DNA, 22 bp, Artificial Sequence
  chemically synthesized
agaaacgtcaattttggaaaga

SEQ ID NO: 883799 - DNA, 22 bp, Artificial Sequence
  chemically synthesized
attatttctttccaaaattgac

SEQ ID NO: 883800 - DNA, 22 bp, Artificial Sequence
  chemically synthesized
ttatttctttccaaaattgacg

SEQ ID NO: 883801 - DNA, 22 bp, Artificial Sequence
  chemically synthesized
tttctttccaaaattgacgttt

SEQ ID NO: 883802 - DNA, 22 bp, Artificial Sequence
  chemically synthesized
acataatattaagaaacgtcaa

SEQ ID NO: 883803 - DNA, 22 bp, Artificial Sequence
  chemically synthesized
ctttccaaaattgacgtttctt

SEQ ID NO: 883804 - DNA, 22 bp, Artificial Sequence
  chemically synthesized
tttccaaaattgacgtttctta

SEQ ID NO: 883805 - DNA, 22 bp, Artificial Sequence
  chemically synthesized
tccaaaattgacgtttcttaat

SEQ ID NO: 883806 - DNA, 22 bp, Artificial Sequence
  chemically synthesized
ccaaaattgacgtttcttaata

SEQ ID NO: 883807 - DNA, 22 bp, Artificial Sequence
  chemically synthesized
caaaattgacgtttcttaatat

SEQ ID NO: 883808 - DNA, 22 bp, Artificial Sequence
  chemically synthesized
acgtttcttaatattatgttaa

SEQ ID NO: 883809 - DNA, 22 bp, Artificial Sequence
  chemically synthesized
aagaggaggagaaataattaac

SEQ ID NO: 883810 - DNA, 22 bp, Artificial Sequence
  chemically synthesized
cttaatattatgttaattattt

SEQ ID NO: 883811 - DNA, 22 bp, Artificial Sequence
  chemically synthesized
ttaatattatgttaattatttc

SEQ ID NO: 883812 - DNA, 22 bp, Artificial Sequence
  chemically synthesized
aatattatgttaattatttctc

SEQ ID NO: 883813 - DNA, 22 bp, Artificial Sequence
  chemically synthesized
atattatgttaattatttctcc

SEQ ID NO: 883814 - DNA, 22 bp, Artificial Sequence
  chemically synthesized
agttcaagaggaggagaaataa

SEQ ID NO: 883815 - DNA, 22 bp, Artificial Sequence
  chemically synthesized
gagttcaagaggaggagaaata

SEQ ID NO: 883816 - DNA, 22 bp, Artificial Sequence
  chemically synthesized
tgttaattatttctcctcctct

SEQ ID NO: 883817 - DNA, 22 bp, Artificial Sequence
  chemically synthesized
attatttctcctcctcttgaac

SEQ ID NO: 883818 - DNA, 22 bp, Artificial Sequence
  chemically synthesized
tagaatgtatttgagttcaaga

SEQ ID NO: 883819 - DNA, 22 bp, Artificial Sequence
  chemically synthesized
tttctcctcctcttgaactcaa

SEQ ID NO: 883820 - DNA, 22 bp, Artificial Sequence
  chemically synthesized
ctcctcctcttgaactcaaata

SEQ ID NO: 883821 - DNA, 22 bp, Artificial Sequence
  chemically synthesized
tcctcctcttgaactcaaatac

SEQ ID NO: 883822 - DNA, 22 bp, Artificial Sequence
  chemically synthesized
ctcctcttgaactcaaatacat

SEQ ID NO: 883823 - DNA, 22 bp, Artificial Sequence
  chemically synthesized
ctcttgaactcaaatacattct

SEQ ID NO: 883824 - DNA, 22 bp, Artificial Sequence
  chemically synthesized
gaagaatattgtagaatgtatt

SEQ ID NO: 883825 - DNA, 22 bp, Artificial Sequence
  chemically synthesized
tggaagaatattgtagaatgta

SEQ ID NO: 883826 - DNA, 22 bp, Artificial Sequence
  chemically synthesized
ttgaactcaaatacattctaca

SEQ ID NO: 883827 - DNA, 22 bp, Artificial Sequence
  chemically synthesized
gaactcaaatacattctacaat

SEQ ID NO: 883828 - DNA, 22 bp, Artificial Sequence
  chemically synthesized
aactcaaatacattctacaata

SEQ ID NO: 883829 - DNA, 22 bp, Artificial Sequence
  chemically synthesized
tattctggaagaatattgtaga

SEQ ID NO: 883830 - DNA, 22 bp, Artificial Sequence
  chemically synthesized
atattctggaagaatattgtag

SEQ ID NO: 883831 - DNA, 22 bp, Artificial Sequence
  chemically synthesized
aaatacattctacaatattctt

SEQ ID NO: 883832 - DNA, 22 bp, Artificial Sequence
  chemically synthesized
atttatattctggaagaatatt

SEQ ID NO: 883833 - DNA, 22 bp, Artificial Sequence
  chemically synthesized
tcatttatattctggaagaata

SEQ ID NO: 883834 - DNA, 22 bp, Artificial Sequence
  chemically synthesized
tctcatttatattctggaagaa

SEQ ID NO: 883835 - DNA, 22 bp, Artificial Sequence
  chemically synthesized
ctctcatttatattctggaaga

SEQ ID NO: 883836 - DNA, 22 bp, Artificial Sequence
  chemically synthesized
tctctcatttatattctggaag

SEQ ID NO: 883837 - DNA, 22 bp, Artificial Sequence
  chemically synthesized
tacaatattcttccagaatata

SEQ ID NO: 883838 - DNA, 22 bp, Artificial Sequence
  chemically synthesized
caatattcttccagaatataaa

SEQ ID NO: 883839 - DNA, 22 bp, Artificial Sequence
  chemically synthesized
ttccagaatataaatgagagaa

SEQ ID NO: 883840 - DNA, 22 bp, Artificial Sequence
  chemically synthesized
ccagaatataaatgagagaaaa

SEQ ID NO: 883841 - DNA, 22 bp, Artificial Sequence
  chemically synthesized
cagaatataaatgagagaaaat

SEQ ID NO: 883842 - DNA, 22 bp, Artificial Sequence
  chemically synthesized
tgagaagggacaggattttctc

SEQ ID NO: 883843 - DNA, 22 bp, Artificial Sequence
  chemically synthesized
gtgagaagggacaggattttct

SEQ ID NO: 883844 - DNA, 22 bp, Artificial Sequence
  chemically synthesized
tgtgagaagggacaggattttc

SEQ ID NO: 883845 - DNA, 22 bp, Artificial Sequence
  chemically synthesized
ttgtgagaagggacaggatttt

SEQ ID NO: 883846 - DNA, 22 bp, Artificial Sequence
  chemically synthesized
tttgtgagaagggacaggattt

SEQ ID NO: 883847 - DNA, 22 bp, Artificial Sequence
  chemically synthesized
attttttgtgagaagggacagg

SEQ ID NO: 883848 - DNA, 22 bp, Artificial Sequence
  chemically synthesized
cattttttgtgagaagggacag

SEQ ID NO: 883849 - DNA, 22 bp, Artificial Sequence
  chemically synthesized
tttcattttttgtgagaaggga

SEQ ID NO: 883850 - DNA, 22 bp, Artificial Sequence
  chemically synthesized
atttcattttttgtgagaaggg

SEQ ID NO: 883851 - DNA, 22 bp, Artificial Sequence
  chemically synthesized
tatttcattttttgtgagaagg

SEQ ID NO: 883852 - DNA, 22 bp, Artificial Sequence
  chemically synthesized
tcccttctcacaaaaaatgaaa

SEQ ID NO: 883853 - DNA, 22 bp, Artificial Sequence
  chemically synthesized
tgtaaaactttatttcattttt

SEQ ID NO: 883854 - DNA, 22 bp, Artificial Sequence
  chemically synthesized
ctcacaaaaaatgaaataaagt

SEQ ID NO: 883855 - DNA, 22 bp, Artificial Sequence
  chemically synthesized
tcacaaaaaatgaaataaagtt

SEQ ID NO: 883856 - DNA, 22 bp, Artificial Sequence
  chemically synthesized
caaggctatgtaaaactttatt

SEQ ID NO: 883857 - DNA, 22 bp, Artificial Sequence
  chemically synthesized
acaaaaaatgaaataaagtttt

SEQ ID NO: 883858 - DNA, 22 bp, Artificial Sequence
  chemically synthesized
ttacaaggctatgtaaaacttt

SEQ ID NO: 883859 - DNA, 22 bp, Artificial Sequence
  chemically synthesized
agagctattacaaggctatgta

SEQ ID NO: 883860 - DNA, 22 bp, Artificial Sequence
  chemically synthesized
tacatagccttgtaatagctct

SEQ ID NO: 883861 - DNA, 22 bp, Artificial Sequence
  chemically synthesized
agagaaaccctcagagctatta

SEQ ID NO: 883862 - DNA, 22 bp, Artificial Sequence
  chemically synthesized
acatagccttgtaatagctctg

SEQ ID NO: 883863 - DNA, 22 bp, Artificial Sequence
  chemically synthesized
catagccttgtaatagctctga

SEQ ID NO: 883864 - DNA, 22 bp, Artificial Sequence
  chemically synthesized
gtaatagctctgagggtttctc

SEQ ID NO: 883865 - DNA, 22 bp, Artificial Sequence
  chemically synthesized
taatagctctgagggtttctct

SEQ ID NO: 883866 - DNA, 22 bp, Artificial Sequence
  chemically synthesized
gcaatcataaacccactaagag

SEQ ID NO: 883867 - DNA, 22 bp, Artificial Sequence
  chemically synthesized
ggcaatcataaacccactaaga

SEQ ID NO: 883868 - DNA, 22 bp, Artificial Sequence
  chemically synthesized
tgagggtttctcttagtgggtt

SEQ ID NO: 883869 - DNA, 22 bp, Artificial Sequence
  chemically synthesized
agggtttctcttagtgggttta

SEQ ID NO: 883870 - DNA, 22 bp, Artificial Sequence
  chemically synthesized
ctcttagtgggtttatgattgc

SEQ ID NO: 883871 - DNA, 22 bp, Artificial Sequence
  chemically synthesized
tcttagtgggtttatgattgcc

SEQ ID NO: 883872 - DNA, 22 bp, Artificial Sequence
  chemically synthesized
ttagtgggtttatgattgccaa

SEQ ID NO: 883873 - DNA, 22 bp, Artificial Sequence
  chemically synthesized
gatatcagaggtttggcaatca

SEQ ID NO: 883874 - DNA, 22 bp, Artificial Sequence
  chemically synthesized
agtgggtttatgattgccaaac

SEQ ID NO: 883875 - DNA, 22 bp, Artificial Sequence
  chemically synthesized
gtgggtttatgattgccaaacc

SEQ ID NO: 883876 - DNA, 22 bp, Artificial Sequence
  chemically synthesized
acctggatatcagaggtttggc

SEQ ID NO: 883877 - DNA, 22 bp, Artificial Sequence
  chemically synthesized
tgacctggatatcagaggtttg

SEQ ID NO: 883878 - DNA, 22 bp, Artificial Sequence
  chemically synthesized
tctgacctggatatcagaggtt

SEQ ID NO: 883879 - DNA, 22 bp, Artificial Sequence
  chemically synthesized
atgattgccaaacctctgatat

SEQ ID NO: 883880 - DNA, 22 bp, Artificial Sequence
  chemically synthesized
tgattgccaaacctctgatatc

SEQ ID NO: 883881 - DNA, 22 bp, Artificial Sequence
  chemically synthesized
ccaaacctctgatatccaggtc

SEQ ID NO: 883882 - DNA, 22 bp, Artificial Sequence
  chemically synthesized
aaaccagttctctgacctggat

SEQ ID NO: 883883 - DNA, 22 bp, Artificial Sequence
  chemically synthesized
ctcaaaccagttctctgacctg

SEQ ID NO: 883884 - DNA, 22 bp, Artificial Sequence
  chemically synthesized
gctcaaaccagttctctgacct

SEQ ID NO: 883885 - DNA, 22 bp, Artificial Sequence
  chemically synthesized
tgatatccaggtcagagaactg

SEQ ID NO: 883886 - DNA, 22 bp, Artificial Sequence
  chemically synthesized
atatccaggtcagagaactggt

SEQ ID NO: 883887 - DNA, 22 bp, Artificial Sequence
  chemically synthesized
cgagataaaaggtttgctcaaa

SEQ ID NO: 883888 - DNA, 22 bp, Artificial Sequence
  chemically synthesized
gcgagataaaaggtttgctcaa

SEQ ID NO: 883889 - DNA, 22 bp, Artificial Sequence
  chemically synthesized
gtttgagcaaaccttttatctc

SEQ ID NO: 883890 - DNA, 22 bp, Artificial Sequence
  chemically synthesized
gagcaaaccttttatctcgcaa

SEQ ID NO: 883891 - DNA, 22 bp, Artificial Sequence
  chemically synthesized
agcaaaccttttatctcgcaaa

SEQ ID NO: 883892 - DNA, 22 bp, Artificial Sequence
  chemically synthesized
ttatctcgcaaatggcctcaca

SEQ ID NO: 883893 - DNA, 22 bp, Artificial Sequence
  chemically synthesized
tatctcgcaaatggcctcacat

SEQ ID NO: 883894 - DNA, 22 bp, Artificial Sequence
  chemically synthesized
atctcgcaaatggcctcacatc

SEQ ID NO: 883895 - DNA, 22 bp, Artificial Sequence
  chemically synthesized
aaatcatataaagatgtgaggc

SEQ ID NO: 883896 - DNA, 22 bp, Artificial Sequence
  chemically synthesized
tctcgcaaatggcctcacatct

SEQ ID NO: 883897 - DNA, 22 bp, Artificial Sequence
  chemically synthesized
tctgaaatcatataaagatgtg

SEQ ID NO: 883898 - DNA, 22 bp, Artificial Sequence
  chemically synthesized
gcaaatggcctcacatctttat

SEQ ID NO: 883899 - DNA, 22 bp, Artificial Sequence
  chemically synthesized
atctgaaatcatataaagatgt

SEQ ID NO: 883900 - DNA, 22 bp, Artificial Sequence
  chemically synthesized
accttatctgaaatcatataaa

SEQ ID NO: 883901 - DNA, 22 bp, Artificial Sequence
  chemically synthesized
caccttatctgaaatcatataa

SEQ ID NO: 883902 - DNA, 22 bp, Artificial Sequence
  chemically synthesized
ttcaccttatctgaaatcatat

SEQ ID NO: 883903 - DNA, 22 bp, Artificial Sequence
  chemically synthesized
cttcaccttatctgaaatcata

SEQ ID NO: 883904 - DNA, 22 bp, Artificial Sequence
  chemically synthesized
acatctttatatgatttcagat

SEQ ID NO: 883905 - DNA, 22 bp, Artificial Sequence
  chemically synthesized
tatatgatttcagataaggtga

SEQ ID NO: 883906 - DNA, 22 bp, Artificial Sequence
  chemically synthesized
atatgatttcagataaggtgaa

SEQ ID NO: 883907 - DNA, 22 bp, Artificial Sequence
  chemically synthesized
gtggtggccttcttcaccttat

SEQ ID NO: 883908 - DNA, 22 bp, Artificial Sequence
  chemically synthesized
tatgatttcagataaggtgaag

SEQ ID NO: 883909 - DNA, 22 bp, Artificial Sequence
  chemically synthesized
agtggtggccttcttcacctta

SEQ ID NO: 883910 - DNA, 22 bp, Artificial Sequence
  chemically synthesized
tagtggtggccttcttcacctt

SEQ ID NO: 883911 - DNA, 22 bp, Artificial Sequence
  chemically synthesized
cattttagtggtggccttcttc

SEQ ID NO: 883912 - DNA, 22 bp, Artificial Sequence
  chemically synthesized
ccattttagtggtggccttctt

SEQ ID NO: 883913 - DNA, 22 bp, Artificial Sequence
  chemically synthesized
cagataaggtgaagaaggccac

SEQ ID NO: 883914 - DNA, 22 bp, Artificial Sequence
  chemically synthesized
agataaggtgaagaaggccacc

SEQ ID NO: 883915 - DNA, 22 bp, Artificial Sequence
  chemically synthesized
tgtttccattttagtggtggcc

SEQ ID NO: 883916 - DNA, 22 bp, Artificial Sequence
  chemically synthesized
gctatgtttccattttagtggt

SEQ ID NO: 883917 - DNA, 22 bp, Artificial Sequence
  chemically synthesized
taattagctatgtttccatttt

SEQ ID NO: 883918 - DNA, 22 bp, Artificial Sequence
  chemically synthesized
aaatggaaacatagctaattat

SEQ ID NO: 883919 - DNA, 22 bp, Artificial Sequence
  chemically synthesized
cacaagccggccactataatta

SEQ ID NO: 883920 - DNA, 22 bp, Artificial Sequence
  chemically synthesized
acacaagccggccactataatt

SEQ ID NO: 883921 - DNA, 22 bp, Artificial Sequence
  chemically synthesized
cttacacaagccggccactata

SEQ ID NO: 883922 - DNA, 22 bp, Artificial Sequence
  chemically synthesized
tccttacacaagccggccacta

SEQ ID NO: 883923 - DNA, 22 bp, Artificial Sequence
  chemically synthesized
ctccttacacaagccggccact

SEQ ID NO: 883924 - DNA, 22 bp, Artificial Sequence
  chemically synthesized
tctccttacacaagccggccac

SEQ ID NO: 883925 - DNA, 22 bp, Artificial Sequence
  chemically synthesized
attatagtggccggcttgtgta

SEQ ID NO: 883926 - DNA, 22 bp, Artificial Sequence
  chemically synthesized
aacactttctccttacacaagc

SEQ ID NO: 883927 - DNA, 22 bp, Artificial Sequence
  chemically synthesized
tagtggccggcttgtgtaagga

SEQ ID NO: 883928 - DNA, 22 bp, Artificial Sequence
  chemically synthesized
aagttgaacactttctccttac

SEQ ID NO: 883929 - DNA, 22 bp, Artificial Sequence
  chemically synthesized
gaagttgaacactttctcctta

SEQ ID NO: 883930 - DNA, 22 bp, Artificial Sequence
  chemically synthesized
tgaagttgaacactttctcctt

SEQ ID NO: 883931 - DNA, 22 bp, Artificial Sequence
  chemically synthesized
tttgaagttgaacactttctcc

SEQ ID NO: 883932 - DNA, 22 bp, Artificial Sequence
  chemically synthesized
gtgtaaggagaaagtgttcaac

SEQ ID NO: 883933 - DNA, 22 bp, Artificial Sequence
  chemically synthesized
tgtaaggagaaagtgttcaact

SEQ ID NO: 883934 - DNA, 22 bp, Artificial Sequence
  chemically synthesized
aatgttctttgaagttgaacac

SEQ ID NO: 883935 - DNA, 22 bp, Artificial Sequence
  chemically synthesized
tctgaatgttctttgaagttga

SEQ ID NO: 883936 - DNA, 22 bp, Artificial Sequence
  chemically synthesized
gtctgaatgttctttgaagttg

SEQ ID NO: 883937 - DNA, 22 bp, Artificial Sequence
  chemically synthesized
ttgtctgaatgttctttgaagt

SEQ ID NO: 883938 - DNA, 22 bp, Artificial Sequence
  chemically synthesized
cttgtctgaatgttctttgaag

SEQ ID NO: 883939 - DNA, 22 bp, Artificial Sequence
  chemically synthesized
tcttgtctgaatgttctttgaa

SEQ ID NO: 883940 - DNA, 22 bp, Artificial Sequence
  chemically synthesized
aacttcaaagaacattcagaca

SEQ ID NO: 883941 - DNA, 22 bp, Artificial Sequence
  chemically synthesized
caaagaacattcagacaagaaa

SEQ ID NO: 883942 - DNA, 22 bp, Artificial Sequence
  chemically synthesized
aaagaacattcagacaagaaag

SEQ ID NO: 883943 - DNA, 22 bp, Artificial Sequence
  chemically synthesized
gtggaaatcccatgacgacttt

SEQ ID NO: 883944 - DNA, 22 bp, Artificial Sequence
  chemically synthesized
ggtggaaatcccatgacgactt

SEQ ID NO: 883945 - DNA, 22 bp, Artificial Sequence
  chemically synthesized
tggtggaaatcccatgacgact

SEQ ID NO: 883946 - DNA, 22 bp, Artificial Sequence
  chemically synthesized
ttggtggaaatcccatgacgac

SEQ ID NO: 883947 - DNA, 22 bp, Artificial Sequence
  chemically synthesized
tttggtggaaatcccatgacga

SEQ ID NO: 883948 - DNA, 22 bp, Artificial Sequence
  chemically synthesized
agacaagaaagtcgtcatggga

SEQ ID NO: 883949 - DNA, 22 bp, Artificial Sequence
  chemically synthesized
gaaatgagactttttggtggaa

SEQ ID NO: 883950 - DNA, 22 bp, Artificial Sequence
  chemically synthesized
ttagaaatgagactttttggtg

SEQ ID NO: 883951 - DNA, 22 bp, Artificial Sequence
  chemically synthesized
ttattagaaatgagactttttg

SEQ ID NO: 883952 - DNA, 22 bp, Artificial Sequence
  chemically synthesized
tgttattagaaatgagactttt

SEQ ID NO: 883953 - DNA, 22 bp, Artificial Sequence
  chemically synthesized
ccaccaaaaagtctcatttcta

SEQ ID NO: 883954 - DNA, 22 bp, Artificial Sequence
  chemically synthesized
caccaaaaagtctcatttctaa

SEQ ID NO: 883955 - DNA, 22 bp, Artificial Sequence
  chemically synthesized
atggaaatgttctgttattaga

SEQ ID NO: 883956 - DNA, 22 bp, Artificial Sequence
  chemically synthesized
aatggaaatgttctgttattag

SEQ ID NO: 883957 - DNA, 22 bp, Artificial Sequence
  chemically synthesized
atttctaataacagaacatttc

SEQ ID NO: 883958 - DNA, 22 bp, Artificial Sequence
  chemically synthesized
ctaataacagaacatttccatt

SEQ ID NO: 883959 - DNA, 22 bp, Artificial Sequence
  chemically synthesized
taataacagaacatttccatta

SEQ ID NO: 883960 - DNA, 22 bp, Artificial Sequence
  chemically synthesized
ataacagaacatttccattaag

SEQ ID NO: 883961 - DNA, 22 bp, Artificial Sequence
  chemically synthesized
ccattaaggtttttttttcctc

SEQ ID NO: 883962 - DNA, 22 bp, Artificial Sequence
  chemically synthesized
cattaaggtttttttttcctcc

SEQ ID NO: 883963 - DNA, 22 bp, Artificial Sequence
  chemically synthesized
agaataaggcatggaggaaaaa

SEQ ID NO: 883964 - DNA, 22 bp, Artificial Sequence
  chemically synthesized
aggtttttttttcctccatgcc

SEQ ID NO: 883965 - DNA, 22 bp, Artificial Sequence
  chemically synthesized
ttttttcctccatgccttattc

SEQ ID NO: 883966 - DNA, 22 bp, Artificial Sequence
  chemically synthesized
tttttcctccatgccttattct

SEQ ID NO: 883967 - DNA, 22 bp, Artificial Sequence
  chemically synthesized
gaggggacattaagaataaggc

SEQ ID NO: 883968 - DNA, 22 bp, Artificial Sequence
  chemically synthesized
ttttcctccatgccttattctt

SEQ ID NO: 883969 - DNA, 22 bp, Artificial Sequence
  chemically synthesized
tttcctccatgccttattctta

SEQ ID NO: 883970 - DNA, 22 bp, Artificial Sequence
  chemically synthesized
ttcctccatgccttattcttaa

SEQ ID NO: 883971 - DNA, 22 bp, Artificial Sequence
  chemically synthesized
tcctccatgccttattcttaat

SEQ ID NO: 883972 - DNA, 22 bp, Artificial Sequence
  chemically synthesized
cctccatgccttattcttaatg

SEQ ID NO: 883973 - DNA, 22 bp, Artificial Sequence
  chemically synthesized
cattggaggggacattaagaat

SEQ ID NO: 883974 - DNA, 22 bp, Artificial Sequence
  chemically synthesized
ctccatgccttattcttaatgt

SEQ ID NO: 883975 - DNA, 22 bp, Artificial Sequence
  chemically synthesized
gcattggaggggacattaagaa

SEQ ID NO: 883976 - DNA, 22 bp, Artificial Sequence
  chemically synthesized
catgccttattcttaatgtccc

SEQ ID NO: 883977 - DNA, 22 bp, Artificial Sequence
  chemically synthesized
attcttaatgtcccctccaatg

SEQ ID NO: 883978 - DNA, 22 bp, Artificial Sequence
  chemically synthesized
ttcttaatgtcccctccaatgc

SEQ ID NO: 883979 - DNA, 22 bp, Artificial Sequence
  chemically synthesized
gtacacaatcttgcattggagg

SEQ ID NO: 883980 - DNA, 22 bp, Artificial Sequence
  chemically synthesized
ttaatgtcccctccaatgcaag

SEQ ID NO: 883981 - DNA, 22 bp, Artificial Sequence
  chemically synthesized
aatgtcccctccaatgcaagat

SEQ ID NO: 883982 - DNA, 22 bp, Artificial Sequence
  chemically synthesized
atgtcccctccaatgcaagatt

SEQ ID NO: 883983 - DNA, 22 bp, Artificial Sequence
  chemically synthesized
acacctggtacacaatcttgca

SEQ ID NO: 883984 - DNA, 22 bp, Artificial Sequence
  chemically synthesized
aacacctggtacacaatcttgc

SEQ ID NO: 883985 - DNA, 22 bp, Artificial Sequence
  chemically synthesized
caatgcaagattgtgtaccagg

SEQ ID NO: 883986 - DNA, 22 bp, Artificial Sequence
  chemically synthesized
gtatcataaggatcttaacacc

SEQ ID NO: 883987 - DNA, 22 bp, Artificial Sequence
  chemically synthesized
ctcgtatcataaggatcttaac

SEQ ID NO: 883988 - DNA, 22 bp, Artificial Sequence
  chemically synthesized
tgtaccaggtgttaagatcctt

SEQ ID NO: 883989 - DNA, 22 bp, Artificial Sequence
  chemically synthesized
tcctcgtatcataaggatctta

SEQ ID NO: 883990 - DNA, 22 bp, Artificial Sequence
  chemically synthesized
agatccttatgatacgaggaga

SEQ ID NO: 883991 - DNA, 22 bp, Artificial Sequence
  chemically synthesized
tgaagaaaatcaaactctcctc

SEQ ID NO: 883992 - DNA, 22 bp, Artificial Sequence
  chemically synthesized
atgatacgaggagagtttgatt

SEQ ID NO: 883993 - DNA, 22 bp, Artificial Sequence
  chemically synthesized
tgatacgaggagagtttgattt

SEQ ID NO: 883994 - DNA, 22 bp, Artificial Sequence
  chemically synthesized
tcaatactatgaagaaaatcaa

SEQ ID NO: 883995 - DNA, 22 bp, Artificial Sequence
  chemically synthesized
tagtgaactatcaatactatga

SEQ ID NO: 883996 - DNA, 22 bp, Artificial Sequence
  chemically synthesized
gattttcttcatagtattgata

SEQ ID NO: 883997 - DNA, 22 bp, Artificial Sequence
  chemically synthesized
attttcttcatagtattgatag

SEQ ID NO: 883998 - DNA, 22 bp, Artificial Sequence
  chemically synthesized
acattgtagtgaactatcaata

SEQ ID NO: 883999 - DNA, 22 bp, Artificial Sequence
  chemically synthesized
tcttcatagtattgatagttca

SEQ ID NO: 884000 - DNA, 22 bp, Artificial Sequence
  chemically synthesized
cttcatagtattgatagttcac

SEQ ID NO: 884001 - DNA, 22 bp, Artificial Sequence
  chemically synthesized
ttcatagtattgatagttcact

SEQ ID NO: 884002 - DNA, 22 bp, Artificial Sequence
  chemically synthesized
tacctgacattgtagtgaacta

SEQ ID NO: 884003 - DNA, 22 bp, Artificial Sequence
  chemically synthesized
catagtattgatagttcactac

SEQ ID NO: 884004 - DNA, 22 bp, Artificial Sequence
  chemically synthesized
atagtattgatagttcactaca

SEQ ID NO: 884005 - DNA, 22 bp, Artificial Sequence
  chemically synthesized
aaattatacctgacattgtagt

SEQ ID NO: 884006 - DNA, 22 bp, Artificial Sequence
  chemically synthesized
aaaattatacctgacattgtag

SEQ ID NO: 884007 - DNA, 22 bp, Artificial Sequence
  chemically synthesized
ttaaaattatacctgacattgt

SEQ ID NO: 884008 - DNA, 22 bp, Artificial Sequence
  chemically synthesized
cttaaaattatacctgacattg

SEQ ID NO: 884009 - DNA, 22 bp, Artificial Sequence
  chemically synthesized
atagttcactacaatgtcaggt

SEQ ID NO: 884010 - DNA, 22 bp, Artificial Sequence
  chemically synthesized
tcttaaaattatacctgacatt

SEQ ID NO: 884011 - DNA, 22 bp, Artificial Sequence
  chemically synthesized
ttttcttaaaattatacctgac

SEQ ID NO: 884012 - DNA, 22 bp, Artificial Sequence
  chemically synthesized
actacaatgtcaggtataattt

SEQ ID NO: 884013 - DNA, 22 bp, Artificial Sequence
  chemically synthesized
caatgtcaggtataattttaag

SEQ ID NO: 884014 - DNA, 22 bp, Artificial Sequence
  chemically synthesized
atacaagttattttcttaaaat

SEQ ID NO: 884015 - DNA, 22 bp, Artificial Sequence
  chemically synthesized
attaatacaagttattttctta

SEQ ID NO: 884016 - DNA, 22 bp, Artificial Sequence
  chemically synthesized
cctaattaatacaagttatttt

SEQ ID NO: 884017 - DNA, 22 bp, Artificial Sequence
  chemically synthesized
ttacctaattaatacaagttat

SEQ ID NO: 884018 - DNA, 22 bp, Artificial Sequence
  chemically synthesized
cctattacctaattaatacaag

SEQ ID NO: 884019 - DNA, 22 bp, Artificial Sequence
  chemically synthesized
taagaaaataacttgtattaat

SEQ ID NO: 884020 - DNA, 22 bp, Artificial Sequence
  chemically synthesized
aagaaaataacttgtattaatt

SEQ ID NO: 884021 - DNA, 22 bp, Artificial Sequence
  chemically synthesized
agaaaataacttgtattaatta

SEQ ID NO: 884022 - DNA, 22 bp, Artificial Sequence
  chemically synthesized
ctccctattacctaattaatac

SEQ ID NO: 884023 - DNA, 22 bp, Artificial Sequence
  chemically synthesized
aaccattactccctattaccta

SEQ ID NO: 884024 - DNA, 22 bp, Artificial Sequence
  chemically synthesized
ttgaaccattactccctattac

SEQ ID NO: 884025 - DNA, 22 bp, Artificial Sequence
  chemically synthesized
gtattaattaggtaatagggag

SEQ ID NO: 884026 - DNA, 22 bp, Artificial Sequence
  chemically synthesized
tattaattaggtaatagggagt

SEQ ID NO: 884027 - DNA, 22 bp, Artificial Sequence
  chemically synthesized
ttattgaaccattactccctat

SEQ ID NO: 884028 - DNA, 22 bp, Artificial Sequence
  chemically synthesized
ctgttattgaaccattactccc

SEQ ID NO: 884029 - DNA, 22 bp, Artificial Sequence
  chemically synthesized
attaggtaatagggagtaatgg

SEQ ID NO: 884030 - DNA, 22 bp, Artificial Sequence
  chemically synthesized
ctactgttattgaaccattact

SEQ ID NO: 884031 - DNA, 22 bp, Artificial Sequence
  chemically synthesized
ggtaatagggagtaatggttca

SEQ ID NO: 884032 - DNA, 22 bp, Artificial Sequence
  chemically synthesized
tcctactgttattgaaccatta

SEQ ID NO: 884033 - DNA, 22 bp, Artificial Sequence
  chemically synthesized
agaagagaccatgaaattctcc

SEQ ID NO: 884034 - DNA, 22 bp, Artificial Sequence
  chemically synthesized
cagaagagaccatgaaattctc

SEQ ID NO: 884035 - DNA, 22 bp, Artificial Sequence
  chemically synthesized
aataacagtaggagaatttcat

SEQ ID NO: 884036 - DNA, 22 bp, Artificial Sequence
  chemically synthesized
gatttcagaagagaccatgaaa

SEQ ID NO: 884037 - DNA, 22 bp, Artificial Sequence
  chemically synthesized
tcagggctggatttcagaagag

SEQ ID NO: 884038 - DNA, 22 bp, Artificial Sequence
  chemically synthesized
catggtctcttctgaaatccag

SEQ ID NO: 884039 - DNA, 22 bp, Artificial Sequence
  chemically synthesized
atggtctcttctgaaatccagc

SEQ ID NO: 884040 - DNA, 22 bp, Artificial Sequence
  chemically synthesized
aaaaacctatcagggctggatt

SEQ ID NO: 884041 - DNA, 22 bp, Artificial Sequence
  chemically synthesized
caaaaacctatcagggctggat

SEQ ID NO: 884042 - DNA, 22 bp, Artificial Sequence
  chemically synthesized
ttctgaaatccagccctgatag

SEQ ID NO: 884043 - DNA, 22 bp, Artificial Sequence
  chemically synthesized
catttcaaaaacctatcagggc

SEQ ID NO: 884044 - DNA, 22 bp, Artificial Sequence
  chemically synthesized
ctgaaatccagccctgataggt

SEQ ID NO: 884045 - DNA, 22 bp, Artificial Sequence
  chemically synthesized
tgaaatccagccctgataggtt

SEQ ID NO: 884046 - DNA, 22 bp, Artificial Sequence
  chemically synthesized
ctccatttcaaaaacctatcag

SEQ ID NO: 884047 - DNA, 22 bp, Artificial Sequence
  chemically synthesized
aaatccagccctgataggtttt

SEQ ID NO: 884048 - DNA, 22 bp, Artificial Sequence
  chemically synthesized
gagttactccatttcaaaaacc

SEQ ID NO: 884049 - DNA, 22 bp, Artificial Sequence
  chemically synthesized
agagttactccatttcaaaaac

SEQ ID NO: 884050 - DNA, 22 bp, Artificial Sequence
  chemically synthesized
ataggtttttgaaatggagtaa

SEQ ID NO: 884051 - DNA, 22 bp, Artificial Sequence
  chemically synthesized
ttgaaatggagtaactctaagc

SEQ ID NO: 884052 - DNA, 22 bp, Artificial Sequence
  chemically synthesized
tgaaatggagtaactctaagca

SEQ ID NO: 884053 - DNA, 22 bp, Artificial Sequence
  chemically synthesized
gaaatggagtaactctaagcac

SEQ ID NO: 884054 - DNA, 22 bp, Artificial Sequence
  chemically synthesized
aaatggagtaactctaagcacc

SEQ ID NO: 884055 - DNA, 22 bp, Artificial Sequence
  chemically synthesized
ataagagataaataaaagtaaa

SEQ ID NO: 884056 - DNA, 22 bp, Artificial Sequence
  chemically synthesized
aataagagataaataaaagtaa

SEQ ID NO: 884057 - DNA, 22 bp, Artificial Sequence
  chemically synthesized
taagcacctttacttttattta

SEQ ID NO: 884058 - DNA, 22 bp, Artificial Sequence
  chemically synthesized
agcacctttacttttatttatc

SEQ ID NO: 884059 - DNA, 22 bp, Artificial Sequence
  chemically synthesized
gtaatgccatttaataagagat

SEQ ID NO: 884060 - DNA, 22 bp, Artificial Sequence
  chemically synthesized
tacttttatttatctcttatta

SEQ ID NO: 884061 - DNA, 22 bp, Artificial Sequence
  chemically synthesized
acttttatttatctcttattaa

SEQ ID NO: 884062 - DNA, 22 bp, Artificial Sequence
  chemically synthesized
cttttatttatctcttattaaa

SEQ ID NO: 884063 - DNA, 22 bp, Artificial Sequence
  chemically synthesized
ttagtaatgccatttaataaga

SEQ ID NO: 884064 - DNA, 22 bp, Artificial Sequence
  chemically synthesized
ttatttatctcttattaaatgg

SEQ ID NO: 884065 - DNA, 22 bp, Artificial Sequence
  chemically synthesized
tatttatctcttattaaatggc

SEQ ID NO: 884066 - DNA, 22 bp, Artificial Sequence
  chemically synthesized
atttatctcttattaaatggca

SEQ ID NO: 884067 - DNA, 22 bp, Artificial Sequence
  chemically synthesized
tttatctcttattaaatggcat

SEQ ID NO: 884068 - DNA, 22 bp, Artificial Sequence
  chemically synthesized
cccattattagtaatgccattt

SEQ ID NO: 884069 - DNA, 22 bp, Artificial Sequence
  chemically synthesized
atctcttattaaatggcattac

SEQ ID NO: 884070 - DNA, 22 bp, Artificial Sequence
  chemically synthesized
tctcttattaaatggcattact

SEQ ID NO: 884071 - DNA, 22 bp, Artificial Sequence
  chemically synthesized
ttattaaatggcattactaata

SEQ ID NO: 884072 - DNA, 22 bp, Artificial Sequence
  chemically synthesized
attaaatggcattactaataat

SEQ ID NO: 884073 - DNA, 22 bp, Artificial Sequence
  chemically synthesized
ttaaatggcattactaataatg

SEQ ID NO: 884074 - DNA, 22 bp, Artificial Sequence
  chemically synthesized
aatggcattactaataatgggc

SEQ ID NO: 884075 - DNA, 22 bp, Artificial Sequence
  chemically synthesized
tcagatcagcaactgcccatta

SEQ ID NO: 884076 - DNA, 22 bp, Artificial Sequence
  chemically synthesized
gtcagatcagcaactgcccatt

SEQ ID NO: 884077 - DNA, 22 bp, Artificial Sequence
  chemically synthesized
cttgtcagatcagcaactgccc

SEQ ID NO: 884078 - DNA, 22 bp, Artificial Sequence
  chemically synthesized
ctaataatgggcagttgctgat

SEQ ID NO: 884079 - DNA, 22 bp, Artificial Sequence
  chemically synthesized
actgcttgtcagatcagcaact

SEQ ID NO: 884080 - DNA, 22 bp, Artificial Sequence
  chemically synthesized
cactgcttgtcagatcagcaac

SEQ ID NO: 884081 - DNA, 22 bp, Artificial Sequence
  chemically synthesized
ataatgggcagttgctgatctg

SEQ ID NO: 884082 - DNA, 22 bp, Artificial Sequence
  chemically synthesized
cttcactgcttgtcagatcagc

SEQ ID NO: 884083 - DNA, 22 bp, Artificial Sequence
  chemically synthesized
gcttcactgcttgtcagatcag

SEQ ID NO: 884084 - DNA, 22 bp, Artificial Sequence
  chemically synthesized
tgcttcactgcttgtcagatca

SEQ ID NO: 884085 - DNA, 22 bp, Artificial Sequence
  chemically synthesized
atctttgcttcactgcttgtca

SEQ ID NO: 884086 - DNA, 22 bp, Artificial Sequence
  chemically synthesized
ctgatctgacaagcagtgaagc

SEQ ID NO: 884087 - DNA, 22 bp, Artificial Sequence
  chemically synthesized
atcactaatctttgcttcactg

SEQ ID NO: 884088 - DNA, 22 bp, Artificial Sequence
  chemically synthesized
catcactaatctttgcttcact

SEQ ID NO: 884089 - DNA, 22 bp, Artificial Sequence
  chemically synthesized
atctgacaagcagtgaagcaaa

SEQ ID NO: 884090 - DNA, 22 bp, Artificial Sequence
  chemically synthesized
tcatcactaatctttgcttcac

SEQ ID NO: 884091 - DNA, 22 bp, Artificial Sequence
  chemically synthesized
ttcatcactaatctttgcttca

SEQ ID NO: 884092 - DNA, 22 bp, Artificial Sequence
  chemically synthesized
ttttcatcactaatctttgctt

SEQ ID NO: 884093 - DNA, 22 bp, Artificial Sequence
  chemically synthesized
acaagcagtgaagcaaagatta

SEQ ID NO: 884094 - DNA, 22 bp, Artificial Sequence
  chemically synthesized
cctcttttcatcactaatcttt

SEQ ID NO: 884095 - DNA, 22 bp, Artificial Sequence
  chemically synthesized
tacctcttttcatcactaatct

SEQ ID NO: 884096 - DNA, 22 bp, Artificial Sequence
  chemically synthesized
ctacctcttttcatcactaatc

SEQ ID NO: 884097 - DNA, 22 bp, Artificial Sequence
  chemically synthesized
tctacctcttttcatcactaat

SEQ ID NO: 884098 - DNA, 22 bp, Artificial Sequence
  chemically synthesized
ttctacctcttttcatcactaa

SEQ ID NO: 884099 - DNA, 22 bp, Artificial Sequence
  chemically synthesized
tttctacctcttttcatcacta

SEQ ID NO: 884100 - DNA, 22 bp, Artificial Sequence
  chemically synthesized
ttttctacctcttttcatcact

SEQ ID NO: 884101 - DNA, 22 bp, Artificial Sequence
  chemically synthesized
tttttctacctcttttcatcac

SEQ ID NO: 884102 - DNA, 22 bp, Artificial Sequence
  chemically synthesized
ttttttctacctcttttcatca

SEQ ID NO: 884103 - DNA, 22 bp, Artificial Sequence
  chemically synthesized
tttttttctacctcttttcatc

SEQ ID NO: 884104 - DNA, 22 bp, Artificial Sequence
  chemically synthesized
aagggttttttttttctacctc

SEQ ID NO: 884105 - DNA, 22 bp, Artificial Sequence
  chemically synthesized
gtgatgaaaagaggtagaaaaa

SEQ ID NO: 884106 - DNA, 22 bp, Artificial Sequence
  chemically synthesized
ccctcaagggttttttttttct

SEQ ID NO: 884107 - DNA, 22 bp, Artificial Sequence
  chemically synthesized
accctcaagggttttttttttc

SEQ ID NO: 884108 - DNA, 22 bp, Artificial Sequence
  chemically synthesized
taccctcaagggtttttttttt

SEQ ID NO: 884109 - DNA, 22 bp, Artificial Sequence
  chemically synthesized
ttaccctcaagggttttttttt

SEQ ID NO: 884110 - DNA, 22 bp, Artificial Sequence
  chemically synthesized
cttttaccctcaagggtttttt

SEQ ID NO: 884111 - DNA, 22 bp, Artificial Sequence
  chemically synthesized
ctacttttaccctcaagggttt

SEQ ID NO: 884112 - DNA, 22 bp, Artificial Sequence
  chemically synthesized
gctacttttaccctcaagggtt

SEQ ID NO: 884113 - DNA, 22 bp, Artificial Sequence
  chemically synthesized
acttgctacttttaccctcaag

SEQ ID NO: 884114 - DNA, 22 bp, Artificial Sequence
  chemically synthesized
tgacttgctacttttaccctca

SEQ ID NO: 884115 - DNA, 22 bp, Artificial Sequence
  chemically synthesized
cctctgacttgctacttttacc

SEQ ID NO: 884116 - DNA, 22 bp, Artificial Sequence
  chemically synthesized
gcctctgacttgctacttttac

SEQ ID NO: 884117 - DNA, 22 bp, Artificial Sequence
  chemically synthesized
atttgcctctgacttgctactt

SEQ ID NO: 884118 - DNA, 22 bp, Artificial Sequence
  chemically synthesized
gagggtaaaagtagcaagtcag

SEQ ID NO: 884119 - DNA, 22 bp, Artificial Sequence
  chemically synthesized
agggtaaaagtagcaagtcaga

SEQ ID NO: 884120 - DNA, 22 bp, Artificial Sequence
  chemically synthesized
gaaaatgtaaatatatattaat

SEQ ID NO: 884121 - DNA, 22 bp, Artificial Sequence
  chemically synthesized
ttagaaaatgtaaatatatatt

SEQ ID NO: 884122 - DNA, 22 bp, Artificial Sequence
  chemically synthesized
atatatatttacattttctaat

SEQ ID NO: 884123 - DNA, 22 bp, Artificial Sequence
  chemically synthesized
aataaatcaattattagaaaat

SEQ ID NO: 884124 - DNA, 22 bp, Artificial Sequence
  chemically synthesized
acattttctaataattgattta

SEQ ID NO: 884125 - DNA, 22 bp, Artificial Sequence
  chemically synthesized
cattttctaataattgatttat

SEQ ID NO: 884126 - DNA, 22 bp, Artificial Sequence
  chemically synthesized
gaaatatgttgaataaatcaat

SEQ ID NO: 884127 - DNA, 22 bp, Artificial Sequence
  chemically synthesized
tctaataattgatttattcaac

SEQ ID NO: 884128 - DNA, 22 bp, Artificial Sequence
  chemically synthesized
ctaataattgatttattcaaca

SEQ ID NO: 884129 - DNA, 22 bp, Artificial Sequence
  chemically synthesized
taataattgatttattcaacat

SEQ ID NO: 884130 - DNA, 22 bp, Artificial Sequence
  chemically synthesized
ataattgatttattcaacatat

SEQ ID NO: 884131 - DNA, 22 bp, Artificial Sequence
  chemically synthesized
atttattcaacatatttctaat

SEQ ID NO: 884132 - DNA, 22 bp, Artificial Sequence
  chemically synthesized
attcaacatatttctaattcta

SEQ ID NO: 884133 - DNA, 22 bp, Artificial Sequence
  chemically synthesized
ttcaacatatttctaattctac

SEQ ID NO: 884134 - DNA, 22 bp, Artificial Sequence
  chemically synthesized
aacatatttctaattctacatc

SEQ ID NO: 884135 - DNA, 22 bp, Artificial Sequence
  chemically synthesized
ctaattctacatcatgccgatt

SEQ ID NO: 884136 - DNA, 22 bp, Artificial Sequence
  chemically synthesized
taattctacatcatgccgattg

SEQ ID NO: 884137 - DNA, 22 bp, Artificial Sequence
  chemically synthesized
attctacatcatgccgattgtg

SEQ ID NO: 884138 - DNA, 22 bp, Artificial Sequence
  chemically synthesized
aacacacgcacacacaatcggc

SEQ ID NO: 884139 - DNA, 22 bp, Artificial Sequence
  chemically synthesized
tacatcatgccgattgtgtgtg

SEQ ID NO: 884140 - DNA, 22 bp, Artificial Sequence
  chemically synthesized
gttaaacacacgcacacacaat

SEQ ID NO: 884141 - DNA, 22 bp, Artificial Sequence
  chemically synthesized
catcatgccgattgtgtgtgcg

SEQ ID NO: 884142 - DNA, 22 bp, Artificial Sequence
  chemically synthesized
tagttaaacacacgcacacaca

SEQ ID NO: 884143 - DNA, 22 bp, Artificial Sequence
  chemically synthesized
ctagttaaacacacgcacacac

SEQ ID NO: 884144 - DNA, 22 bp, Artificial Sequence
  chemically synthesized
tgtgtgcgtgtgtttaactaga

SEQ ID NO: 884145 - DNA, 22 bp, Artificial Sequence
  chemically synthesized
agaacaccaaatttctagttaa

SEQ ID NO: 884146 - DNA, 22 bp, Artificial Sequence
  chemically synthesized
taagaacaccaaatttctagtt

SEQ ID NO: 884147 - DNA, 22 bp, Artificial Sequence
  chemically synthesized
ctaagaacaccaaatttctagt

SEQ ID NO: 884148 - DNA, 22 bp, Artificial Sequence
  chemically synthesized
tttctaagaacaccaaatttct

SEQ ID NO: 884149 - DNA, 22 bp, Artificial Sequence
  chemically synthesized
tactatttctaagaacaccaaa

SEQ ID NO: 884150 - DNA, 22 bp, Artificial Sequence
  chemically synthesized
gtactatttctaagaacaccaa

SEQ ID NO: 884151 - DNA, 22 bp, Artificial Sequence
  chemically synthesized
tgtactatttctaagaacacca

SEQ ID NO: 884152 - DNA, 22 bp, Artificial Sequence
  chemically synthesized
aactagaaatttggtgttctta

SEQ ID NO: 884153 - DNA, 22 bp, Artificial Sequence
  chemically synthesized
ttgtactatttctaagaacacc

SEQ ID NO: 884154 - DNA, 22 bp, Artificial Sequence
  chemically synthesized
actagaaatttggtgttcttag

SEQ ID NO: 884155 - DNA, 22 bp, Artificial Sequence
  chemically synthesized
tttgtactatttctaagaacac

SEQ ID NO: 884156 - DNA, 22 bp, Artificial Sequence
  chemically synthesized
ctttttgtactatttctaagaa

SEQ ID NO: 884157 - DNA, 22 bp, Artificial Sequence
  chemically synthesized
gaaatttggtgttcttagaaat

SEQ ID NO: 884158 - DNA, 22 bp, Artificial Sequence
  chemically synthesized
cctttttgtactatttctaaga

SEQ ID NO: 884159 - DNA, 22 bp, Artificial Sequence
  chemically synthesized
tcctttttgtactatttctaag

SEQ ID NO: 884160 - DNA, 22 bp, Artificial Sequence
  chemically synthesized
ttcctttttgtactatttctaa

SEQ ID NO: 884161 - DNA, 22 bp, Artificial Sequence
  chemically synthesized
tttcctttttgtactatttcta

SEQ ID NO: 884162 - DNA, 22 bp, Artificial Sequence
  chemically synthesized
ggtgttcttagaaatagtacaa

SEQ ID NO: 884163 - DNA, 22 bp, Artificial Sequence
  chemically synthesized
gtgttcttagaaatagtacaaa

SEQ ID NO: 884164 - DNA, 22 bp, Artificial Sequence
  chemically synthesized
ttagaaatagtacaaaaaggaa

SEQ ID NO: 884165 - DNA, 22 bp, Artificial Sequence
  chemically synthesized
agaaatagtacaaaaaggaaaa

SEQ ID NO: 884166 - DNA, 22 bp, Artificial Sequence
  chemically synthesized
gaaatagtacaaaaaggaaaaa

SEQ ID NO: 884167 - DNA, 22 bp, Artificial Sequence
  chemically synthesized
agtacaagaaaggaaaacaagg

SEQ ID NO: 884168 - DNA, 22 bp, Artificial Sequence
  chemically synthesized
aagaaattgagtacaagaaagg

SEQ ID NO: 884169 - DNA, 22 bp, Artificial Sequence
  chemically synthesized
ttccttgttttcctttcttgta

SEQ ID NO: 884170 - DNA, 22 bp, Artificial Sequence
  chemically synthesized
aaagaaattgagtacaagaaag

SEQ ID NO: 884171 - DNA, 22 bp, Artificial Sequence
  chemically synthesized
ccttgttttcctttcttgtact

SEQ ID NO: 884172 - DNA, 22 bp, Artificial Sequence
  chemically synthesized
cttgttttcctttcttgtactc

SEQ ID NO: 884173 - DNA, 22 bp, Artificial Sequence
  chemically synthesized
gttttcctttcttgtactcaat

SEQ ID NO: 884174 - DNA, 22 bp, Artificial Sequence
  chemically synthesized
ttttcctttcttgtactcaatt

SEQ ID NO: 884175 - DNA, 22 bp, Artificial Sequence
  chemically synthesized
tcctttcttgtactcaatttct

SEQ ID NO: 884176 - DNA, 22 bp, Artificial Sequence
  chemically synthesized
cctttcttgtactcaatttctt

SEQ ID NO: 884177 - DNA, 22 bp, Artificial Sequence
  chemically synthesized
ctttcttgtactcaatttcttt

SEQ ID NO: 884178 - DNA, 22 bp, Artificial Sequence
  chemically synthesized
tcttgtactcaatttctttaaa

SEQ ID NO: 884179 - DNA, 22 bp, Artificial Sequence
  chemically synthesized
cttgtactcaatttctttaaat

SEQ ID NO: 884180 - DNA, 22 bp, Artificial Sequence
  chemically synthesized
ttgtactcaatttctttaaatt

SEQ ID NO: 884181 - DNA, 22 bp, Artificial Sequence
  chemically synthesized
gtactcaatttctttaaatttt

SEQ ID NO: 884182 - DNA, 22 bp, Artificial Sequence
  chemically synthesized
gtaggtaaaatgaaaatttaaa

SEQ ID NO: 884183 - DNA, 22 bp, Artificial Sequence
  chemically synthesized
tactcaatttctttaaattttc

SEQ ID NO: 884184 - DNA, 22 bp, Artificial Sequence
  chemically synthesized
ttagtaggtaaaatgaaaattt

SEQ ID NO: 884185 - DNA, 22 bp, Artificial Sequence
  chemically synthesized
aatttctttaaattttcatttt

SEQ ID NO: 884186 - DNA, 22 bp, Artificial Sequence
  chemically synthesized
aggttattagtaggtaaaatga

SEQ ID NO: 884187 - DNA, 22 bp, Artificial Sequence
  chemically synthesized
ctttaaattttcattttaccta

SEQ ID NO: 884188 - DNA, 22 bp, Artificial Sequence
  chemically synthesized
taaggttattagtaggtaaaat

SEQ ID NO: 884189 - DNA, 22 bp, Artificial Sequence
  chemically synthesized
tttaaattttcattttacctac

SEQ ID NO: 884190 - DNA, 22 bp, Artificial Sequence
  chemically synthesized
taaattttcattttacctacta

SEQ ID NO: 884191 - DNA, 22 bp, Artificial Sequence
  chemically synthesized
aaattttcattttacctactaa

SEQ ID NO: 884192 - DNA, 22 bp, Artificial Sequence
  chemically synthesized
aattttcattttacctactaat

SEQ ID NO: 884193 - DNA, 22 bp, Artificial Sequence
  chemically synthesized
tcattttacctactaataacct

SEQ ID NO: 884194 - DNA, 22 bp, Artificial Sequence
  chemically synthesized
cattttacctactaataacctt

SEQ ID NO: 884195 - DNA, 22 bp, Artificial Sequence
  chemically synthesized
attttacctactaataacctta

SEQ ID NO: 884196 - DNA, 22 bp, Artificial Sequence
  chemically synthesized
tacctactaataaccttagaat

SEQ ID NO: 884197 - DNA, 22 bp, Artificial Sequence
  chemically synthesized
acctactaataaccttagaata

SEQ ID NO: 884198 - DNA, 22 bp, Artificial Sequence
  chemically synthesized
cctactaataaccttagaatat

SEQ ID NO: 884199 - DNA, 22 bp, Artificial Sequence
  chemically synthesized
ctaataaccttagaatatatga

SEQ ID NO: 884200 - DNA, 22 bp, Artificial Sequence
  chemically synthesized
atatatatataatcatatattc

SEQ ID NO: 884201 - DNA, 22 bp, Artificial Sequence
  chemically synthesized
aatatatatataatcatatatt

SEQ ID NO: 884202 - DNA, 22 bp, Artificial Sequence
  chemically synthesized
ataaccttagaatatatgatta

SEQ ID NO: 884203 - DNA, 22 bp, Artificial Sequence
  chemically synthesized
ttaatatatatataatcatata

SEQ ID NO: 884204 - DNA, 22 bp, Artificial Sequence
  chemically synthesized
agaatatatgattatatatata

SEQ ID NO: 884205 - DNA, 22 bp, Artificial Sequence
  chemically synthesized
gaatatatgattatatatatat

SEQ ID NO: 884206 - DNA, 22 bp, Artificial Sequence
  chemically synthesized
agatatatattcttaatatata

SEQ ID NO: 884207 - DNA, 22 bp, Artificial Sequence
  chemically synthesized
gagatatatattcttaatatat

SEQ ID NO: 884208 - DNA, 22 bp, Artificial Sequence
  chemically synthesized
tgagatatatattcttaatata

SEQ ID NO: 884209 - DNA, 22 bp, Artificial Sequence
  chemically synthesized
tatatatattaagaatatatat

SEQ ID NO: 884210 - DNA, 22 bp, Artificial Sequence
  chemically synthesized
taatgtgctttgagatatatat

SEQ ID NO: 884211 - DNA, 22 bp, Artificial Sequence
  chemically synthesized
ataatgtgctttgagatatata

SEQ ID NO: 884212 - DNA, 22 bp, Artificial Sequence
  chemically synthesized
cttataatgtgctttgagatat

SEQ ID NO: 884213 - DNA, 22 bp, Artificial Sequence
  chemically synthesized
agaatatatatctcaaagcaca

SEQ ID NO: 884214 - DNA, 22 bp, Artificial Sequence
  chemically synthesized
tgtcctccttataatgtgcttt

SEQ ID NO: 884215 - DNA, 22 bp, Artificial Sequence
  chemically synthesized
atgtcctccttataatgtgctt

SEQ ID NO: 884216 - DNA, 22 bp, Artificial Sequence
  chemically synthesized
tttatgtcctccttataatgtg

SEQ ID NO: 884217 - DNA, 22 bp, Artificial Sequence
  chemically synthesized
aaagcacattataaggaggaca

SEQ ID NO: 884218 - DNA, 22 bp, Artificial Sequence
  chemically synthesized
taaggaggacataaacaacctt

SEQ ID NO: 884219 - DNA, 22 bp, Artificial Sequence
  chemically synthesized
aacatacatggaaaggttgttt

SEQ ID NO: 884220 - DNA, 22 bp, Artificial Sequence
  chemically synthesized
gaacatacatggaaaggttgtt

SEQ ID NO: 884221 - DNA, 22 bp, Artificial Sequence
  chemically synthesized
tccatgtatgttcaaacattta

SEQ ID NO: 884222 - DNA, 22 bp, Artificial Sequence
  chemically synthesized
ccatgtatgttcaaacatttat

SEQ ID NO: 884223 - DNA, 22 bp, Artificial Sequence
  chemically synthesized
catgtatgttcaaacatttatt

SEQ ID NO: 884224 - DNA, 22 bp, Artificial Sequence
  chemically synthesized
aaacatttatttatttatttat

SEQ ID NO: 884225 - DNA, 22 bp, Artificial Sequence
  chemically synthesized
atttatttatttatttatttat

SEQ ID NO: 884226 - DNA, 22 bp, Artificial Sequence
  chemically synthesized
tcgaatgagcaaataaataaat

SEQ ID NO: 884227 - DNA, 22 bp, Artificial Sequence
  chemically synthesized
tttatttatttatttatttatt

SEQ ID NO: 884228 - DNA, 22 bp, Artificial Sequence
  chemically synthesized
gtcgaatgagcaaataaataaa

SEQ ID NO: 884229 - DNA, 22 bp, Artificial Sequence
  chemically synthesized
atttatttatttatttatttgc

SEQ ID NO: 884230 - DNA, 22 bp, Artificial Sequence
  chemically synthesized
tttatttatttatttatttgct

SEQ ID NO: 884231 - DNA, 22 bp, Artificial Sequence
  chemically synthesized
atttatttatttatttgctcat

SEQ ID NO: 884232 - DNA, 22 bp, Artificial Sequence
  chemically synthesized
tttatttatttatttgctcatt

SEQ ID NO: 884233 - DNA, 22 bp, Artificial Sequence
  chemically synthesized
atttatttatttgctcattcga

SEQ ID NO: 884234 - DNA, 22 bp, Artificial Sequence
  chemically synthesized
aataaatgtttgtcgaatgagc

SEQ ID NO: 884235 - DNA, 22 bp, Artificial Sequence
  chemically synthesized
tttatttatttgctcattcgac

SEQ ID NO: 884236 - DNA, 22 bp, Artificial Sequence
  chemically synthesized
atttatttgctcattcgacaaa

SEQ ID NO: 884237 - DNA, 22 bp, Artificial Sequence
  chemically synthesized
tttatttgctcattcgacaaac

SEQ ID NO: 884238 - DNA, 22 bp, Artificial Sequence
  chemically synthesized
atttgctcattcgacaaacatt

SEQ ID NO: 884239 - DNA, 22 bp, Artificial Sequence
  chemically synthesized
tttgctcattcgacaaacattt

SEQ ID NO: 884240 - DNA, 22 bp, Artificial Sequence
  chemically synthesized
gctcattcgacaaacatttatt

SEQ ID NO: 884241 - DNA, 22 bp, Artificial Sequence
  chemically synthesized
ctcattcgacaaacatttattc

SEQ ID NO: 884242 - DNA, 22 bp, Artificial Sequence
  chemically synthesized
attcgacaaacatttattcagt

SEQ ID NO: 884243 - DNA, 22 bp, Artificial Sequence
  chemically synthesized
gacaaacatttattcagtgctt

SEQ ID NO: 884244 - DNA, 22 bp, Artificial Sequence
  chemically synthesized
ccccagtgaaacatagtaagca

SEQ ID NO: 884245 - DNA, 22 bp, Artificial Sequence
  chemically synthesized
ctaccccagtgaaacatagtaa

SEQ ID NO: 884246 - DNA, 22 bp, Artificial Sequence
  chemically synthesized
attcagtgcttactatgtttca

SEQ ID NO: 884247 - DNA, 22 bp, Artificial Sequence
  chemically synthesized
ttcagtgcttactatgtttcac

SEQ ID NO: 884248 - DNA, 22 bp, Artificial Sequence
  chemically synthesized
agtgcttactatgtttcactgg

SEQ ID NO: 884249 - DNA, 22 bp, Artificial Sequence
  chemically synthesized
cccattcctaccccagtgaaac

SEQ ID NO: 884250 - DNA, 22 bp, Artificial Sequence
  chemically synthesized
cactccccattcctaccccagt

SEQ ID NO: 884251 - DNA, 22 bp, Artificial Sequence
  chemically synthesized
actatgtttcactggggtagga

SEQ ID NO: 884252 - DNA, 22 bp, Artificial Sequence
  chemically synthesized
ctatgtttcactggggtaggaa

SEQ ID NO: 884253 - DNA, 22 bp, Artificial Sequence
  chemically synthesized
tgtttcactggggtaggaatgg

SEQ ID NO: 884254 - DNA, 22 bp, Artificial Sequence
  chemically synthesized
tgtgtctgcactccccattcct

SEQ ID NO: 884255 - DNA, 22 bp, Artificial Sequence
  chemically synthesized
gtgtgtctgcactccccattcc

SEQ ID NO: 884256 - DNA, 22 bp, Artificial Sequence
  chemically synthesized
cactggggtaggaatggggagt

SEQ ID NO: 884257 - DNA, 22 bp, Artificial Sequence
  chemically synthesized
actggggtaggaatggggagtg

SEQ ID NO: 884258 - DNA, 22 bp, Artificial Sequence
  chemically synthesized
gggtaggaatggggagtgcaga

SEQ ID NO: 884259 - DNA, 22 bp, Artificial Sequence
  chemically synthesized
aatgtagtatatatttgtgtgt

SEQ ID NO: 884260 - DNA, 22 bp, Artificial Sequence
  chemically synthesized
taaatgtagtatatatttgtgt

SEQ ID NO: 884261 - DNA, 22 bp, Artificial Sequence
  chemically synthesized
ctctaaatgtagtatatatttg

SEQ ID NO: 884262 - DNA, 22 bp, Artificial Sequence
  chemically synthesized
acctgctctaaatgtagtatat

SEQ ID NO: 884263 - DNA, 22 bp, Artificial Sequence
  chemically synthesized
tacctgacctgctctaaatgta

SEQ ID NO: 884264 - DNA, 22 bp, Artificial Sequence
  chemically synthesized
ttatacctgacctgctctaaat

SEQ ID NO: 884265 - DNA, 22 bp, Artificial Sequence
  chemically synthesized
gttgttatacctgacctgctct

SEQ ID NO: 884266 - DNA, 22 bp, Artificial Sequence
  chemically synthesized
ctagttgttatacctgacctgc

SEQ ID NO: 884267 - DNA, 22 bp, Artificial Sequence
  chemically synthesized
actagttgttatacctgacctg

SEQ ID NO: 884268 - DNA, 22 bp, Artificial Sequence
  chemically synthesized
tactagttgttatacctgacct

SEQ ID NO: 884269 - DNA, 22 bp, Artificial Sequence
  chemically synthesized
catttagagcaggtcaggtata

SEQ ID NO: 884270 - DNA, 22 bp, Artificial Sequence
  chemically synthesized
cactttactagttgttatacct

SEQ ID NO: 884271 - DNA, 22 bp, Artificial Sequence
  chemically synthesized
agagcaggtcaggtataacaac

SEQ ID NO: 884272 - DNA, 22 bp, Artificial Sequence
  chemically synthesized
gagcaggtcaggtataacaact

SEQ ID NO: 884273 - DNA, 22 bp, Artificial Sequence
  chemically synthesized
tacattgcactttactagttgt

SEQ ID NO: 884274 - DNA, 22 bp, Artificial Sequence
  chemically synthesized
cattatacattgcactttacta

SEQ ID NO: 884275 - DNA, 22 bp, Artificial Sequence
  chemically synthesized
tgctccattatacattgcactt

SEQ ID NO: 884276 - DNA, 22 bp, Artificial Sequence
  chemically synthesized
tgtgctccattatacattgcac

SEQ ID NO: 884277 - DNA, 22 bp, Artificial Sequence
  chemically synthesized
ctctgtgctccattatacattg

SEQ ID NO: 884278 - DNA, 22 bp, Artificial Sequence
  chemically synthesized
ctgctctgtgctccattataca

SEQ ID NO: 884279 - DNA, 22 bp, Artificial Sequence
  chemically synthesized
gtaaagtgcaatgtataatgga

SEQ ID NO: 884280 - DNA, 22 bp, Artificial Sequence
  chemically synthesized
tcaaacacaaaagtgatcagtt

SEQ ID NO: 884281 - DNA, 22 bp, Artificial Sequence
  chemically synthesized
tctatcaaacacaaaagtgatc

SEQ ID NO: 884282 - DNA, 22 bp, Artificial Sequence
  chemically synthesized
gtctatcaaacacaaaagtgat

SEQ ID NO: 884283 - DNA, 22 bp, Artificial Sequence
  chemically synthesized
ttgtctatcaaacacaaaagtg

SEQ ID NO: 884284 - DNA, 22 bp, Artificial Sequence
  chemically synthesized
cttgtctatcaaacacaaaagt

SEQ ID NO: 884285 - DNA, 22 bp, Artificial Sequence
  chemically synthesized
accttcttgtctatcaaacaca

SEQ ID NO: 884286 - DNA, 22 bp, Artificial Sequence
  chemically synthesized
atcacttttgtgtttgatagac

SEQ ID NO: 884287 - DNA, 22 bp, Artificial Sequence
  chemically synthesized
tcctgaccttcttgtctatcaa

SEQ ID NO: 884288 - DNA, 22 bp, Artificial Sequence
  chemically synthesized
tgtcctgaccttcttgtctatc

SEQ ID NO: 884289 - DNA, 22 bp, Artificial Sequence
  chemically synthesized
ctgtcctgaccttcttgtctat

SEQ ID NO: 884290 - DNA, 22 bp, Artificial Sequence
  chemically synthesized
tctgtcctgaccttcttgtcta

SEQ ID NO: 884291 - DNA, 22 bp, Artificial Sequence
  chemically synthesized
ttgtgtttgatagacaagaagg

SEQ ID NO: 884292 - DNA, 22 bp, Artificial Sequence
  chemically synthesized
tgtgtttgatagacaagaaggt

SEQ ID NO: 884293 - DNA, 22 bp, Artificial Sequence
  chemically synthesized
gtgtttgatagacaagaaggtc

SEQ ID NO: 884294 - DNA, 22 bp, Artificial Sequence
  chemically synthesized
tgtttgatagacaagaaggtca

SEQ ID NO: 884295 - DNA, 22 bp, Artificial Sequence
  chemically synthesized
ccagcctttctgtcctgacctt

SEQ ID NO: 884296 - DNA, 22 bp, Artificial Sequence
  chemically synthesized
gatagacaagaaggtcaggaca

SEQ ID NO: 884297 - DNA, 22 bp, Artificial Sequence
  chemically synthesized
atagacaagaaggtcaggacag

SEQ ID NO: 884298 - DNA, 22 bp, Artificial Sequence
  chemically synthesized
ctcccagcctttctgtcctgac

SEQ ID NO: 884299 - DNA, 22 bp, Artificial Sequence
  chemically synthesized
tgctcccagcctttctgtcctg

SEQ ID NO: 884300 - DNA, 22 bp, Artificial Sequence
  chemically synthesized
ctgctcccagcctttctgtcct

SEQ ID NO: 884301 - DNA, 22 bp, Artificial Sequence
  chemically synthesized
tttctgctcccagcctttctgt

SEQ ID NO: 884302 - DNA, 22 bp, Artificial Sequence
  chemically synthesized
taatgaggtgcatgagctgttt

SEQ ID NO: 884303 - DNA, 22 bp, Artificial Sequence
  chemically synthesized
ataatgaggtgcatgagctgtt

SEQ ID NO: 884304 - DNA, 22 bp, Artificial Sequence
  chemically synthesized
ggagcagaaacagctcatgcac

SEQ ID NO: 884305 - DNA, 22 bp, Artificial Sequence
  chemically synthesized
ccgtccatccccttataatgag

SEQ ID NO: 884306 - DNA, 22 bp, Artificial Sequence
  chemically synthesized
tgccgtccatccccttataatg

SEQ ID NO: 884307 - DNA, 22 bp, Artificial Sequence
  chemically synthesized
tctgccgtccatccccttataa

SEQ ID NO: 884308 - DNA, 22 bp, Artificial Sequence
  chemically synthesized
atgcacctcattataaggggat

SEQ ID NO: 884309 - DNA, 22 bp, Artificial Sequence
  chemically synthesized
tctctgccgtccatccccttat

SEQ ID NO: 884310 - DNA, 22 bp, Artificial Sequence
  chemically synthesized
attataaggggatggacggcag

SEQ ID NO: 884311 - DNA, 22 bp, Artificial Sequence
  chemically synthesized
gaatacattctctctgccgtcc

SEQ ID NO: 884312 - DNA, 22 bp, Artificial Sequence
  chemically synthesized
ggaatacattctctctgccgtc

SEQ ID NO: 884313 - DNA, 22 bp, Artificial Sequence
  chemically synthesized
taaggggatggacggcagagag

SEQ ID NO: 884314 - DNA, 22 bp, Artificial Sequence
  chemically synthesized
ttggaatacattctctctgccg

SEQ ID NO: 884315 - DNA, 22 bp, Artificial Sequence
  chemically synthesized
cctcttggaatacattctctct

SEQ ID NO: 884316 - DNA, 22 bp, Artificial Sequence
  chemically synthesized
catgttccctcttggaatacat

SEQ ID NO: 884317 - DNA, 22 bp, Artificial Sequence
  chemically synthesized
catgttccatgttccctcttgg

SEQ ID NO: 884318 - DNA, 22 bp, Artificial Sequence
  chemically synthesized
gcatgttccatgttccctcttg

SEQ ID NO: 884319 - DNA, 22 bp, Artificial Sequence
  chemically synthesized
tgcatgttccatgttccctctt

SEQ ID NO: 884320 - DNA, 22 bp, Artificial Sequence
  chemically synthesized
tctttgcatgttccatgttccc

SEQ ID NO: 884321 - DNA, 22 bp, Artificial Sequence
  chemically synthesized
ctgtctttgcatgttccatgtt

SEQ ID NO: 884322 - DNA, 22 bp, Artificial Sequence
  chemically synthesized
cctgtctttgcatgttccatgt

SEQ ID NO: 884323 - DNA, 22 bp, Artificial Sequence
  chemically synthesized
caagagggaacatggaacatgc

SEQ ID NO: 884324 - DNA, 22 bp, Artificial Sequence
  chemically synthesized
cttcctgtctttgcatgttcca

SEQ ID NO: 884325 - DNA, 22 bp, Artificial Sequence
  chemically synthesized
tgcttcctgtctttgcatgttc

SEQ ID NO: 884326 - DNA, 22 bp, Artificial Sequence
  chemically synthesized
ctgcttcctgtctttgcatgtt

SEQ ID NO: 884327 - DNA, 22 bp, Artificial Sequence
  chemically synthesized
ttctgcttcctgtctttgcatg

SEQ ID NO: 884328 - DNA, 22 bp, Artificial Sequence
  chemically synthesized
cttctgcttcctgtctttgcat

SEQ ID NO: 884329 - DNA, 22 bp, Artificial Sequence
  chemically synthesized
cgtacttcttctgcttcctgtc

SEQ ID NO: 884330 - DNA, 22 bp, Artificial Sequence
  chemically synthesized
cgtgatagctccgtacttcttc

SEQ ID NO: 884331 - DNA, 22 bp, Artificial Sequence
  chemically synthesized
ccctacgtgatagctccgtact

SEQ ID NO: 884332 - DNA, 22 bp, Artificial Sequence
  chemically synthesized
ccattcccctacgtgatagctc

SEQ ID NO: 884333 - DNA, 22 bp, Artificial Sequence
  chemically synthesized
cccattcccctacgtgatagct

SEQ ID NO: 884334 - DNA, 22 bp, Artificial Sequence
  chemically synthesized
cttcccattcccctacgtgata

SEQ ID NO: 884335 - DNA, 22 bp, Artificial Sequence
  chemically synthesized
cattacttcccattcccctacg

SEQ ID NO: 884336 - DNA, 22 bp, Artificial Sequence
  chemically synthesized
ctccattacttcccattcccct

SEQ ID NO: 884337 - DNA, 22 bp, Artificial Sequence
  chemically synthesized
tactccattacttcccattccc

SEQ ID NO: 884338 - DNA, 22 bp, Artificial Sequence
  chemically synthesized
ctactccattacttcccattcc

SEQ ID NO: 884339 - DNA, 22 bp, Artificial Sequence
  chemically synthesized
tcacgtaggggaatgggaagta

SEQ ID NO: 884340 - DNA, 22 bp, Artificial Sequence
  chemically synthesized
tttctactccattacttcccat

SEQ ID NO: 884341 - DNA, 22 bp, Artificial Sequence
  chemically synthesized
tatttctactccattacttccc

SEQ ID NO: 884342 - DNA, 22 bp, Artificial Sequence
  chemically synthesized
ctatttctactccattacttcc

SEQ ID NO: 884343 - DNA, 22 bp, Artificial Sequence
  chemically synthesized
tctatttctactccattacttc

SEQ ID NO: 884344 - DNA, 22 bp, Artificial Sequence
  chemically synthesized
ctttctatttctactccattac

SEQ ID NO: 884345 - DNA, 22 bp, Artificial Sequence
  chemically synthesized
gctttctatttctactccatta

SEQ ID NO: 884346 - DNA, 22 bp, Artificial Sequence
  chemically synthesized
tgctttctatttctactccatt

SEQ ID NO: 884347 - DNA, 22 bp, Artificial Sequence
  chemically synthesized
ttgctttctatttctactccat

SEQ ID NO: 884348 - DNA, 22 bp, Artificial Sequence
  chemically synthesized
gcttttgctttctatttctact

SEQ ID NO: 884349 - DNA, 22 bp, Artificial Sequence
  chemically synthesized
tggcttttgctttctatttcta

SEQ ID NO: 884350 - DNA, 22 bp, Artificial Sequence
  chemically synthesized
tctggcttttgctttctatttc

SEQ ID NO: 884351 - DNA, 22 bp, Artificial Sequence
  chemically synthesized
ctctggcttttgctttctattt

SEQ ID NO: 884352 - DNA, 22 bp, Artificial Sequence
  chemically synthesized
tctctggcttttgctttctatt

SEQ ID NO: 884353 - DNA, 22 bp, Artificial Sequence
  chemically synthesized
ttctctggcttttgctttctat

SEQ ID NO: 884354 - DNA, 22 bp, Artificial Sequence
  chemically synthesized
ttttctctggcttttgctttct

SEQ ID NO: 884355 - DNA, 22 bp, Artificial Sequence
  chemically synthesized
cttttctctggcttttgctttc

SEQ ID NO: 884356 - DNA, 22 bp, Artificial Sequence
  chemically synthesized
agggtggtatacaagatccttc

SEQ ID NO: 884357 - DNA, 22 bp, Artificial Sequence
  chemically synthesized
tgagggtggtatacaagatcct

SEQ ID NO: 884358 - DNA, 22 bp, Artificial Sequence
  chemically synthesized
cagttctgagggtggtatacaa

SEQ ID NO: 884359 - DNA, 22 bp, Artificial Sequence
  chemically synthesized
cactacagttctgagggtggta

SEQ ID NO: 884360 - DNA, 22 bp, Artificial Sequence
  chemically synthesized
tccactacagttctgagggtgg

SEQ ID NO: 884361 - DNA, 22 bp, Artificial Sequence
  chemically synthesized
ctccactacagttctgagggtg

SEQ ID NO: 884362 - DNA, 22 bp, Artificial Sequence
  chemically synthesized
gtataccaccctcagaactgta

SEQ ID NO: 884363 - DNA, 22 bp, Artificial Sequence
  chemically synthesized
tagcttctccactacagttctg

SEQ ID NO: 884364 - DNA, 22 bp, Artificial Sequence
  chemically synthesized
tataccaccctcagaactgtag

SEQ ID NO: 884365 - DNA, 22 bp, Artificial Sequence
  chemically synthesized
gtagcttctccactacagttct

SEQ ID NO: 884366 - DNA, 22 bp, Artificial Sequence
  chemically synthesized
ttgtagcttctccactacagtt

SEQ ID NO: 884367 - DNA, 22 bp, Artificial Sequence
  chemically synthesized
aaactcttgtagcttctccact

SEQ ID NO: 884368 - DNA, 22 bp, Artificial Sequence
  chemically synthesized
aaaactcttgtagcttctccac

SEQ ID NO: 884369 - DNA, 22 bp, Artificial Sequence
  chemically synthesized
agaactgtagtggagaagctac

SEQ ID NO: 884370 - DNA, 22 bp, Artificial Sequence
  chemically synthesized
tttaaaactcttgtagcttctc

SEQ ID NO: 884371 - DNA, 22 bp, Artificial Sequence
  chemically synthesized
atttaaaactcttgtagcttct

SEQ ID NO: 884372 - DNA, 22 bp, Artificial Sequence
  chemically synthesized
ccttatttaaaactcttgtagc

SEQ ID NO: 884373 - DNA, 22 bp, Artificial Sequence
  chemically synthesized
tagtggagaagctacaagagtt

SEQ ID NO: 884374 - DNA, 22 bp, Artificial Sequence
  chemically synthesized
caagagttttaaataagggaat

SEQ ID NO: 884375 - DNA, 22 bp, Artificial Sequence
  chemically synthesized
gaaaacataagtgccattccct

SEQ ID NO: 884376 - DNA, 22 bp, Artificial Sequence
  chemically synthesized
taaataagggaatggcacttat

SEQ ID NO: 884377 - DNA, 22 bp, Artificial Sequence
  chemically synthesized
aaataagggaatggcacttatg

SEQ ID NO: 884378 - DNA, 22 bp, Artificial Sequence
  chemically synthesized
aataagggaatggcacttatgt

SEQ ID NO: 884379 - DNA, 22 bp, Artificial Sequence
  chemically synthesized
gaagatcaattggaaaacataa

SEQ ID NO: 884380 - DNA, 22 bp, Artificial Sequence
  chemically synthesized
agaagatcaattggaaaacata

SEQ ID NO: 884381 - DNA, 22 bp, Artificial Sequence
  chemically synthesized
atatatatttagaagatcaatt

SEQ ID NO: 884382 - DNA, 22 bp, Artificial Sequence
  chemically synthesized
atgttttccaattgatcttcta

SEQ ID NO: 884383 - DNA, 22 bp, Artificial Sequence
  chemically synthesized
tgttttccaattgatcttctaa

SEQ ID NO: 884384 - DNA, 22 bp, Artificial Sequence
  chemically synthesized
tccaattgatcttctaaatata

SEQ ID NO: 884385 - DNA, 22 bp, Artificial Sequence
  chemically synthesized
ccaattgatcttctaaatatat

SEQ ID NO: 884386 - DNA, 22 bp, Artificial Sequence
  chemically synthesized
caattgatcttctaaatatata

SEQ ID NO: 884387 - DNA, 22 bp, Artificial Sequence
  chemically synthesized
taaatatatattcatatatatt

SEQ ID NO: 884388 - DNA, 22 bp, Artificial Sequence
  chemically synthesized
ataaatatatattcatatatat

SEQ ID NO: 884389 - DNA, 22 bp, Artificial Sequence
  chemically synthesized
atcttctaaatatatatgaata

SEQ ID NO: 884390 - DNA, 22 bp, Artificial Sequence
  chemically synthesized
atttataaatatatattcatat

SEQ ID NO: 884391 - DNA, 22 bp, Artificial Sequence
  chemically synthesized
catttataaatatatattcata

SEQ ID NO: 884392 - DNA, 22 bp, Artificial Sequence
  chemically synthesized
ctaaatatatatgaatatatat

SEQ ID NO: 884393 - DNA, 22 bp, Artificial Sequence
  chemically synthesized
taaatatatatgaatatatatt

SEQ ID NO: 884394 - DNA, 22 bp, Artificial Sequence
  chemically synthesized
aatatatatgaatatatattta

SEQ ID NO: 884395 - DNA, 22 bp, Artificial Sequence
  chemically synthesized
atataccttcatttataaatat

SEQ ID NO: 884396 - DNA, 22 bp, Artificial Sequence
  chemically synthesized
acatattcatataccttcattt

SEQ ID NO: 884397 - DNA, 22 bp, Artificial Sequence
  chemically synthesized
ttcacatattcatataccttca

SEQ ID NO: 884398 - DNA, 22 bp, Artificial Sequence
  chemically synthesized
attcacatattcatataccttc

SEQ ID NO: 884399 - DNA, 22 bp, Artificial Sequence
  chemically synthesized
tttattcacatattcatatacc

SEQ ID NO: 884400 - DNA, 22 bp, Artificial Sequence
  chemically synthesized
ataaatgaaggtatatgaatat

SEQ ID NO: 884401 - DNA, 22 bp, Artificial Sequence
  chemically synthesized
taaatgaaggtatatgaatatg

SEQ ID NO: 884402 - DNA, 22 bp, Artificial Sequence
  chemically synthesized
tgtctatttattcacatattca

SEQ ID NO: 884403 - DNA, 22 bp, Artificial Sequence
  chemically synthesized
atgtctatttattcacatattc

SEQ ID NO: 884404 - DNA, 22 bp, Artificial Sequence
  chemically synthesized
atagtagatcttatgtctattt

SEQ ID NO: 884405 - DNA, 22 bp, Artificial Sequence
  chemically synthesized
gaaaaccaagcattaatagtag

SEQ ID NO: 884406 - DNA, 22 bp, Artificial Sequence
  chemically synthesized
attagaaaaccaagcattaata

SEQ ID NO: 884407 - DNA, 22 bp, Artificial Sequence
  chemically synthesized
gattagaaaaccaagcattaat

SEQ ID NO: 884408 - DNA, 22 bp, Artificial Sequence
  chemically synthesized
tttgattagaaaaccaagcatt

SEQ ID NO: 884409 - DNA, 22 bp, Artificial Sequence
  chemically synthesized
atttgattagaaaaccaagcat

SEQ ID NO: 884410 - DNA, 22 bp, Artificial Sequence
  chemically synthesized
ctattaatgcttggttttctaa

SEQ ID NO: 884411 - DNA, 22 bp, Artificial Sequence
  chemically synthesized
ttaatgcttggttttctaatca

SEQ ID NO: 884412 - DNA, 22 bp, Artificial Sequence
  chemically synthesized
agatcagcttatttgattagaa

SEQ ID NO: 884413 - DNA, 22 bp, Artificial Sequence
  chemically synthesized
atgcttggttttctaatcaaat

SEQ ID NO: 884414 - DNA, 22 bp, Artificial Sequence
  chemically synthesized
attcagatcagcttatttgatt

SEQ ID NO: 884415 - DNA, 22 bp, Artificial Sequence
  chemically synthesized
ggttttctaatcaaataagctg

SEQ ID NO: 884416 - DNA, 22 bp, Artificial Sequence
  chemically synthesized
gttttctaatcaaataagctga

SEQ ID NO: 884417 - DNA, 22 bp, Artificial Sequence
  chemically synthesized
tatctcattcagatcagcttat

SEQ ID NO: 884418 - DNA, 22 bp, Artificial Sequence
  chemically synthesized
atatctcattcagatcagctta

SEQ ID NO: 884419 - DNA, 22 bp, Artificial Sequence
  chemically synthesized
tctaatcaaataagctgatctg

SEQ ID NO: 884420 - DNA, 22 bp, Artificial Sequence
  chemically synthesized
ctaatcaaataagctgatctga

SEQ ID NO: 884421 - DNA, 22 bp, Artificial Sequence
  chemically synthesized
taatcaaataagctgatctgaa

SEQ ID NO: 884422 - DNA, 22 bp, Artificial Sequence
  chemically synthesized
atcaaataagctgatctgaatg

SEQ ID NO: 884423 - DNA, 22 bp, Artificial Sequence
  chemically synthesized
tagcaatatttatatctcattc

SEQ ID NO: 884424 - DNA, 22 bp, Artificial Sequence
  chemically synthesized
tgtagcaatatttatatctcat

SEQ ID NO: 884425 - DNA, 22 bp, Artificial Sequence
  chemically synthesized
ctgtagcaatatttatatctca

SEQ ID NO: 884426 - DNA, 22 bp, Artificial Sequence
  chemically synthesized
tctgtagcaatatttatatctc

SEQ ID NO: 884427 - DNA, 22 bp, Artificial Sequence
  chemically synthesized
ttctgtagcaatatttatatct

SEQ ID NO: 884428 - DNA, 22 bp, Artificial Sequence
  chemically synthesized
tttctgtagcaatatttatatc

SEQ ID NO: 884429 - DNA, 22 bp, Artificial Sequence
  chemically synthesized
ttttctgtagcaatatttatat

SEQ ID NO: 884430 - DNA, 22 bp, Artificial Sequence
  chemically synthesized
atctgaatgagatataaatatt

SEQ ID NO: 884431 - DNA, 22 bp, Artificial Sequence
  chemically synthesized
ttttttctgtagcaatatttat

SEQ ID NO: 884432 - DNA, 22 bp, Artificial Sequence
  chemically synthesized
cttttttctgtagcaatattta

SEQ ID NO: 884433 - DNA, 22 bp, Artificial Sequence
  chemically synthesized
aatgagatataaatattgctac

SEQ ID NO: 884434 - DNA, 22 bp, Artificial Sequence
  chemically synthesized
aatttcttttttctgtagcaat

SEQ ID NO: 884435 - DNA, 22 bp, Artificial Sequence
  chemically synthesized
gaatttcttttttctgtagcaa

SEQ ID NO: 884436 - DNA, 22 bp, Artificial Sequence
  chemically synthesized
tcttgaatttcttttttctgta

SEQ ID NO: 884437 - DNA, 22 bp, Artificial Sequence
  chemically synthesized
atcttgaatttcttttttctgt

SEQ ID NO: 884438 - DNA, 22 bp, Artificial Sequence
  chemically synthesized
tatcttgaatttcttttttctg

SEQ ID NO: 884439 - DNA, 22 bp, Artificial Sequence
  chemically synthesized
ttatcttgaatttcttttttct

SEQ ID NO: 884440 - DNA, 22 bp, Artificial Sequence
  chemically synthesized
tcatttttatcttgaatttctt

SEQ ID NO: 884441 - DNA, 22 bp, Artificial Sequence
  chemically synthesized
ctacagaaaaaagaaattcaag

SEQ ID NO: 884442 - DNA, 22 bp, Artificial Sequence
  chemically synthesized
cagaaaaaagaaattcaagata

SEQ ID NO: 884443 - DNA, 22 bp, Artificial Sequence
  chemically synthesized
caaaaaagttgtcatttttatc

SEQ ID NO: 884444 - DNA, 22 bp, Artificial Sequence
  chemically synthesized
acaaaaaagttgtcatttttat

SEQ ID NO: 884445 - DNA, 22 bp, Artificial Sequence
  chemically synthesized
atgtttacaaaaaagttgtcat

SEQ ID NO: 884446 - DNA, 22 bp, Artificial Sequence
  chemically synthesized
aatgtttacaaaaaagttgtca

SEQ ID NO: 884447 - DNA, 22 bp, Artificial Sequence
  chemically synthesized
aagataaaaatgacaacttttt

SEQ ID NO: 884448 - DNA, 22 bp, Artificial Sequence
  chemically synthesized
agtgaatggacacttaatgttt

SEQ ID NO: 884449 - DNA, 22 bp, Artificial Sequence
  chemically synthesized
ttttgtaaacattaagtgtcca

SEQ ID NO: 884450 - DNA, 22 bp, Artificial Sequence
  chemically synthesized
tttgtaaacattaagtgtccat

SEQ ID NO: 884451 - DNA, 22 bp, Artificial Sequence
  chemically synthesized
ttgtaaacattaagtgtccatt

SEQ ID NO: 884452 - DNA, 22 bp, Artificial Sequence
  chemically synthesized
tgtaaacattaagtgtccattc

SEQ ID NO: 884453 - DNA, 22 bp, Artificial Sequence
  chemically synthesized
gtaaacattaagtgtccattca

SEQ ID NO: 884454 - DNA, 22 bp, Artificial Sequence
  chemically synthesized
aaaaaaattaagtgaatggaca

SEQ ID NO: 884455 - DNA, 22 bp, Artificial Sequence
  chemically synthesized
taaacattaagtgtccattcac

SEQ ID NO: 884456 - DNA, 22 bp, Artificial Sequence
  chemically synthesized
agtgtccattcacttaattttt

SEQ ID NO: 884457 - DNA, 22 bp, Artificial Sequence
  chemically synthesized
aaataaaagttaaaaaaaatta

SEQ ID NO: 884458 - DNA, 22 bp, Artificial Sequence
  chemically synthesized
aaaataaaagttaaaaaaaatt

SEQ ID NO: 884459 - DNA, 22 bp, Artificial Sequence
  chemically synthesized
acttaattttttttaactttta

SEQ ID NO: 884460 - DNA, 22 bp, Artificial Sequence
  chemically synthesized
cacgtgtacttaaaataaaagt

SEQ ID NO: 884461 - DNA, 22 bp, Artificial Sequence
  chemically synthesized
aattttttttaacttttatttt

SEQ ID NO: 884462 - DNA, 22 bp, Artificial Sequence
  chemically synthesized
gcacgtgtacttaaaataaaag

SEQ ID NO: 884463 - DNA, 22 bp, Artificial Sequence
  chemically synthesized
attttttttaacttttatttta

SEQ ID NO: 884464 - DNA, 22 bp, Artificial Sequence
  chemically synthesized
tttttaacttttattttaagta

SEQ ID NO: 884465 - DNA, 22 bp, Artificial Sequence
  chemically synthesized
ttttaacttttattttaagtac

SEQ ID NO: 884466 - DNA, 22 bp, Artificial Sequence
  chemically synthesized
tttaacttttattttaagtaca

SEQ ID NO: 884467 - DNA, 22 bp, Artificial Sequence
  chemically synthesized
ttaacttttattttaagtacac

SEQ ID NO: 884468 - DNA, 22 bp, Artificial Sequence
  chemically synthesized
taacttttattttaagtacacg

SEQ ID NO: 884469 - DNA, 22 bp, Artificial Sequence
  chemically synthesized
aacttttattttaagtacacgt

SEQ ID NO: 884470 - DNA, 22 bp, Artificial Sequence
  chemically synthesized
acttttattttaagtacacgtg

SEQ ID NO: 884471 - DNA, 22 bp, Artificial Sequence
  chemically synthesized
tgtaacaaacttgcacgtgtac

SEQ ID NO: 884472 - DNA, 22 bp, Artificial Sequence
  chemically synthesized
ttattttaagtacacgtgcaag

SEQ ID NO: 884473 - DNA, 22 bp, Artificial Sequence
  chemically synthesized
tattttaagtacacgtgcaagt

SEQ ID NO: 884474 - DNA, 22 bp, Artificial Sequence
  chemically synthesized
cctatgtaacaaacttgcacgt

SEQ ID NO: 884475 - DNA, 22 bp, Artificial Sequence
  chemically synthesized
attttaagtacacgtgcaagtt

SEQ ID NO: 884476 - DNA, 22 bp, Artificial Sequence
  chemically synthesized
acctatgtaacaaacttgcacg

SEQ ID NO: 884477 - DNA, 22 bp, Artificial Sequence
  chemically synthesized
ttttaagtacacgtgcaagttt

SEQ ID NO: 884478 - DNA, 22 bp, Artificial Sequence
  chemically synthesized
taagtacacgtgcaagtttgtt

SEQ ID NO: 884479 - DNA, 22 bp, Artificial Sequence
  chemically synthesized
aagtacacgtgcaagtttgtta

SEQ ID NO: 884480 - DNA, 22 bp, Artificial Sequence
  chemically synthesized
agtacacgtgcaagtttgttac

SEQ ID NO: 884481 - DNA, 22 bp, Artificial Sequence
  chemically synthesized
atgacacaagtttacctatgta

SEQ ID NO: 884482 - DNA, 22 bp, Artificial Sequence
  chemically synthesized
gttacataggtaaacttgtgtc

SEQ ID NO: 884483 - DNA, 22 bp, Artificial Sequence
  chemically synthesized
ttacataggtaaacttgtgtca

SEQ ID NO: 884484 - DNA, 22 bp, Artificial Sequence
  chemically synthesized
cataggtaaacttgtgtcatga

SEQ ID NO: 884485 - DNA, 22 bp, Artificial Sequence
  chemically synthesized
tacaacaggccctcatgacaca

SEQ ID NO: 884486 - DNA, 22 bp, Artificial Sequence
  chemically synthesized
gtgtcatgagggcctgttgtac

SEQ ID NO: 884487 - DNA, 22 bp, Artificial Sequence
  chemically synthesized
tgtcatgagggcctgttgtaca

SEQ ID NO: 884488 - DNA, 22 bp, Artificial Sequence
  chemically synthesized
ggtgacaacataatctgtacaa

SEQ ID NO: 884489 - DNA, 22 bp, Artificial Sequence
  chemically synthesized
atatctgggtgacaacataatc

SEQ ID NO: 884490 - DNA, 22 bp, Artificial Sequence
  chemically synthesized
aatatctgggtgacaacataat

SEQ ID NO: 884491 - DNA, 22 bp, Artificial Sequence
  chemically synthesized
ttgtacagattatgttgtcacc

SEQ ID NO: 884492 - DNA, 22 bp, Artificial Sequence
  chemically synthesized
ggcttaatatctgggtgacaac

SEQ ID NO: 884493 - DNA, 22 bp, Artificial Sequence
  chemically synthesized
tacagattatgttgtcacccag

SEQ ID NO: 884494 - DNA, 22 bp, Artificial Sequence
  chemically synthesized
atgggtactaggcttaatatct

SEQ ID NO: 884495 - DNA, 22 bp, Artificial Sequence
  chemically synthesized
tgttgtcacccagatattaagc

SEQ ID NO: 884496 - DNA, 22 bp, Artificial Sequence
  chemically synthesized
tcacccagatattaagcctagt

SEQ ID NO: 884497 - DNA, 22 bp, Artificial Sequence
  chemically synthesized
agcctagtacccattagttatt

SEQ ID NO: 884498 - DNA, 22 bp, Artificial Sequence
  chemically synthesized
gtacccattagttattttttct

SEQ ID NO: 884499 - DNA, 22 bp, Artificial Sequence
  chemically synthesized
ggcggagggagagaaccagaaa

SEQ ID NO: 884500 - DNA, 22 bp, Artificial Sequence
  chemically synthesized
gttattttttctggttctctcc

SEQ ID NO: 884501 - DNA, 22 bp, Artificial Sequence
  chemically synthesized
ttttttctggttctctccctcc

SEQ ID NO: 884502 - DNA, 22 bp, Artificial Sequence
  chemically synthesized
tttctggttctctccctccgcc

SEQ ID NO: 884503 - DNA, 22 bp, Artificial Sequence
  chemically synthesized
ttctggttctctccctccgccc

SEQ ID NO: 884504 - DNA, 22 bp, Artificial Sequence
  chemically synthesized
tctggttctctccctccgccca

SEQ ID NO: 884505 - DNA, 22 bp, Artificial Sequence
  chemically synthesized
ctggttctctccctccgcccaa

SEQ ID NO: 884506 - DNA, 22 bp, Artificial Sequence
  chemically synthesized
tggttctctccctccgcccaac

SEQ ID NO: 884507 - DNA, 22 bp, Artificial Sequence
  chemically synthesized
tcagagggtggaggttgggcgg

SEQ ID NO: 884508 - DNA, 22 bp, Artificial Sequence
  chemically synthesized
gttctctccctccgcccaacct

SEQ ID NO: 884509 - DNA, 22 bp, Artificial Sequence
  chemically synthesized
tctccctccgcccaacctccac

SEQ ID NO: 884510 - DNA, 22 bp, Artificial Sequence
  chemically synthesized
tccctccgcccaacctccaccc

SEQ ID NO: 884511 - DNA, 22 bp, Artificial Sequence
  chemically synthesized
cctccgcccaacctccaccctc

SEQ ID NO: 884512 - DNA, 22 bp, Artificial Sequence
  chemically synthesized
cgcccaacctccaccctctgat

SEQ ID NO: 884513 - DNA, 22 bp, Artificial Sequence
  chemically synthesized
caccctctgataggccccattg

SEQ ID NO: 884514 - DNA, 22 bp, Artificial Sequence
  chemically synthesized
tgataggccccattgtgtgttg

SEQ ID NO: 884515 - DNA, 22 bp, Artificial Sequence
  chemically synthesized
ataggccccattgtgtgttgtt

SEQ ID NO: 884516 - DNA, 22 bp, Artificial Sequence
  chemically synthesized
tgtgttgttcccctgtatgtgt

SEQ ID NO: 884517 - DNA, 22 bp, Artificial Sequence
  chemically synthesized
agtgatgagaacacatggacac

SEQ ID NO: 884518 - DNA, 22 bp, Artificial Sequence
  chemically synthesized
ttcccctgtatgtgtccatgtg

SEQ ID NO: 884519 - DNA, 22 bp, Artificial Sequence
  chemically synthesized
ccctgtatgtgtccatgtgttc

SEQ ID NO: 884520 - DNA, 22 bp, Artificial Sequence
  chemically synthesized
tatgtgtccatgtgttctcatc

SEQ ID NO: 884521 - DNA, 22 bp, Artificial Sequence
  chemically synthesized
tgagtgggagctaagtgatgag

SEQ ID NO: 884522 - DNA, 22 bp, Artificial Sequence
  chemically synthesized
tcatcacttagctcccactcat

SEQ ID NO: 884523 - DNA, 22 bp, Artificial Sequence
  chemically synthesized
atcacttagctcccactcataa

SEQ ID NO: 884524 - DNA, 22 bp, Artificial Sequence
  chemically synthesized
taagtaagtaagttatgagtgg

SEQ ID NO: 884525 - DNA, 22 bp, Artificial Sequence
  chemically synthesized
ataagtaagtaagttatgagtg

SEQ ID NO: 884526 - DNA, 22 bp, Artificial Sequence
  chemically synthesized
cttataagtaagtaagttatga

SEQ ID NO: 884527 - DNA, 22 bp, Artificial Sequence
  chemically synthesized
agctcccactcataacttactt

SEQ ID NO: 884528 - DNA, 22 bp, Artificial Sequence
  chemically synthesized
gctcccactcataacttactta

SEQ ID NO: 884529 - DNA, 22 bp, Artificial Sequence
  chemically synthesized
ccactcataacttacttactta

SEQ ID NO: 884530 - DNA, 22 bp, Artificial Sequence
  chemically synthesized
ataacttacttacttataagga

SEQ ID NO: 884531 - DNA, 22 bp, Artificial Sequence
  chemically synthesized
acttacttataaggagtgcctt

SEQ ID NO: 884532 - DNA, 22 bp, Artificial Sequence
  chemically synthesized
cttacttataaggagtgccttc

SEQ ID NO: 884533 - DNA, 22 bp, Artificial Sequence
  chemically synthesized
acttataaggagtgccttctac

SEQ ID NO: 884534 - DNA, 22 bp, Artificial Sequence
  chemically synthesized
cttataaggagtgccttctacc

SEQ ID NO: 884535 - DNA, 22 bp, Artificial Sequence
  chemically synthesized
ataaggagtgccttctaccatt

SEQ ID NO: 884536 - DNA, 22 bp, Artificial Sequence
  chemically synthesized
acaaaatagccaaatggtagaa

SEQ ID NO: 884537 - DNA, 22 bp, Artificial Sequence
  chemically synthesized
taaggagtgccttctaccattt

SEQ ID NO: 884538 - DNA, 22 bp, Artificial Sequence
  chemically synthesized
tggggttgacaaaatagccaaa

SEQ ID NO: 884539 - DNA, 22 bp, Artificial Sequence
  chemically synthesized
attgtggggttgacaaaatagc

SEQ ID NO: 884540 - DNA, 22 bp, Artificial Sequence
  chemically synthesized
ctaccatttggctattttgtca

SEQ ID NO: 884541 - DNA, 22 bp, Artificial Sequence
  chemically synthesized
taccatttggctattttgtcaa

SEQ ID NO: 884542 - DNA, 22 bp, Artificial Sequence
  chemically synthesized
ttaattgtggggttgacaaaat

SEQ ID NO: 884543 - DNA, 22 bp, Artificial Sequence
  chemically synthesized
ccatttggctattttgtcaacc

SEQ ID NO: 884544 - DNA, 22 bp, Artificial Sequence
  chemically synthesized
ggctattttgtcaaccccacaa

SEQ ID NO: 884545 - DNA, 22 bp, Artificial Sequence
  chemically synthesized
gctattttgtcaaccccacaat

SEQ ID NO: 884546 - DNA, 22 bp, Artificial Sequence
  chemically synthesized
ttttgtcaaccccacaattaac

SEQ ID NO: 884547 - DNA, 22 bp, Artificial Sequence
  chemically synthesized
gatagaaaaactgttaattgtg

SEQ ID NO: 884548 - DNA, 22 bp, Artificial Sequence
  chemically synthesized
tgtcaaccccacaattaacagt

SEQ ID NO: 884549 - DNA, 22 bp, Artificial Sequence
  chemically synthesized
gtcaaccccacaattaacagtt

SEQ ID NO: 884550 - DNA, 22 bp, Artificial Sequence
  chemically synthesized
tcaaccccacaattaacagttt

SEQ ID NO: 884551 - DNA, 22 bp, Artificial Sequence
  chemically synthesized
tcatcaatgatagattagatag

SEQ ID NO: 884552 - DNA, 22 bp, Artificial Sequence
  chemically synthesized
atcatcaatgatagattagata

SEQ ID NO: 884553 - DNA, 22 bp, Artificial Sequence
  chemically synthesized
acagtttttctatctaatctat

SEQ ID NO: 884554 - DNA, 22 bp, Artificial Sequence
  chemically synthesized
ttctatctaatctatcattgat

SEQ ID NO: 884555 - DNA, 22 bp, Artificial Sequence
  chemically synthesized
tctatctaatctatcattgatg

SEQ ID NO: 884556 - DNA, 22 bp, Artificial Sequence
  chemically synthesized
ctatctaatctatcattgatga

SEQ ID NO: 884557 - DNA, 22 bp, Artificial Sequence
  chemically synthesized
tatctaatctatcattgatgat

SEQ ID NO: 884558 - DNA, 22 bp, Artificial Sequence
  chemically synthesized
tctaatctatcattgatgataa

SEQ ID NO: 884559 - DNA, 22 bp, Artificial Sequence
  chemically synthesized
atctatcattgatgataagggc

SEQ ID NO: 884560 - DNA, 22 bp, Artificial Sequence
  chemically synthesized
cataacaatagtggcccttatc

SEQ ID NO: 884561 - DNA, 22 bp, Artificial Sequence
  chemically synthesized
acataacaatagtggcccttat

SEQ ID NO: 884562 - DNA, 22 bp, Artificial Sequence
  chemically synthesized
tcattgatgataagggccacta

SEQ ID NO: 884563 - DNA, 22 bp, Artificial Sequence
  chemically synthesized
gtttacataacaatagtggccc

SEQ ID NO: 884564 - DNA, 22 bp, Artificial Sequence
  chemically synthesized
agtttacataacaatagtggcc

SEQ ID NO: 884565 - DNA, 22 bp, Artificial Sequence
  chemically synthesized
ttagtttacataacaatagtgg

SEQ ID NO: 884566 - DNA, 22 bp, Artificial Sequence
  chemically synthesized
cttagtttacataacaatagtg

SEQ ID NO: 884567 - DNA, 22 bp, Artificial Sequence
  chemically synthesized
atgataagggccactattgtta

SEQ ID NO: 884568 - DNA, 22 bp, Artificial Sequence
  chemically synthesized
tcttagtttacataacaatagt

SEQ ID NO: 884569 - DNA, 22 bp, Artificial Sequence
  chemically synthesized
gctttcttagtttacataacaa

SEQ ID NO: 884570 - DNA, 22 bp, Artificial Sequence
  chemically synthesized
ggctttcttagtttacataaca

SEQ ID NO: 884571 - DNA, 22 bp, Artificial Sequence
  chemically synthesized
tggctttcttagtttacataac

SEQ ID NO: 884572 - DNA, 22 bp, Artificial Sequence
  chemically synthesized
ttggctttcttagtttacataa

SEQ ID NO: 884573 - DNA, 22 bp, Artificial Sequence
  chemically synthesized
tttggctttcttagtttacata

SEQ ID NO: 884574 - DNA, 22 bp, Artificial Sequence
  chemically synthesized
ttttttggctttcttagtttac

SEQ ID NO: 884575 - DNA, 22 bp, Artificial Sequence
  chemically synthesized
gttttttggctttcttagttta

SEQ ID NO: 884576 - DNA, 22 bp, Artificial Sequence
  chemically synthesized
tgttttttggctttcttagttt

SEQ ID NO: 884577 - DNA, 22 bp, Artificial Sequence
  chemically synthesized
ttgttttttggctttcttagtt

SEQ ID NO: 884578 - DNA, 22 bp, Artificial Sequence
  chemically synthesized
tttgttttttggctttcttagt

SEQ ID NO: 884579 - DNA, 22 bp, Artificial Sequence
  chemically synthesized
ttgttatgtaaactaagaaagc

SEQ ID NO: 884580 - DNA, 22 bp, Artificial Sequence
  chemically synthesized
ttttgttttttggctttcttag

SEQ ID NO: 884581 - DNA, 22 bp, Artificial Sequence
  chemically synthesized
ttatgtaaactaagaaagccaa

SEQ ID NO: 884582 - DNA, 22 bp, Artificial Sequence
  chemically synthesized
tgtaaactaagaaagccaaaaa

SEQ ID NO: 884583 - DNA, 22 bp, Artificial Sequence
  chemically synthesized
caaagtgtaggtttttttgttt

SEQ ID NO: 884584 - DNA, 22 bp, Artificial Sequence
  chemically synthesized
agaaagccaaaaaacaaaaaaa

SEQ ID NO: 884585 - DNA, 22 bp, Artificial Sequence
  chemically synthesized
acaaagtgtaggtttttttgtt

SEQ ID NO: 884586 - DNA, 22 bp, Artificial Sequence
  chemically synthesized
cactttgtaaacattatctatt

SEQ ID NO: 884587 - DNA, 22 bp, Artificial Sequence
  chemically synthesized
agatatatcgtacaatagataa

SEQ ID NO: 884588 - DNA, 22 bp, Artificial Sequence
  chemically synthesized
gagatatatcgtacaatagata

SEQ ID NO: 884589 - DNA, 22 bp, Artificial Sequence
  chemically synthesized
tgtaaacattatctattgtacg

SEQ ID NO: 884590 - DNA, 22 bp, Artificial Sequence
  chemically synthesized
gtaaacattatctattgtacga

SEQ ID NO: 884591 - DNA, 22 bp, Artificial Sequence
  chemically synthesized
taaacattatctattgtacgat

SEQ ID NO: 884592 - DNA, 22 bp, Artificial Sequence
  chemically synthesized
aacttgagatatatcgtacaat

SEQ ID NO: 884593 - DNA, 22 bp, Artificial Sequence
  chemically synthesized
tgaacttgagatatatcgtaca

SEQ ID NO: 884594 - DNA, 22 bp, Artificial Sequence
  chemically synthesized
tctattgtacgatatatctcaa

SEQ ID NO: 884595 - DNA, 22 bp, Artificial Sequence
  chemically synthesized
aacacctctgaacttgagatat

SEQ ID NO: 884596 - DNA, 22 bp, Artificial Sequence
  chemically synthesized
caacacctctgaacttgagata

SEQ ID NO: 884597 - DNA, 22 bp, Artificial Sequence
  chemically synthesized
ttgtacgatatatctcaagttc

SEQ ID NO: 884598 - DNA, 22 bp, Artificial Sequence
  chemically synthesized
tacgatatatctcaagttcaga

SEQ ID NO: 884599 - DNA, 22 bp, Artificial Sequence
  chemically synthesized
gtatttcaacacctctgaactt

SEQ ID NO: 884600 - DNA, 22 bp, Artificial Sequence
  chemically synthesized
agtatttcaacacctctgaact

SEQ ID NO: 884601 - DNA, 22 bp, Artificial Sequence
  chemically synthesized
tagtatttcaacacctctgaac

SEQ ID NO: 884602 - DNA, 22 bp, Artificial Sequence
  chemically synthesized
ttagtatttcaacacctctgaa

SEQ ID NO: 884603 - DNA, 22 bp, Artificial Sequence
  chemically synthesized
tttagtatttcaacacctctga

SEQ ID NO: 884604 - DNA, 22 bp, Artificial Sequence
  chemically synthesized
aagttcagaggtgttgaaatac

SEQ ID NO: 884605 - DNA, 22 bp, Artificial Sequence
  chemically synthesized
ccaaatgcattttttagtattt

SEQ ID NO: 884606 - DNA, 22 bp, Artificial Sequence
  chemically synthesized
agaggtgttgaaatactaaaaa

SEQ ID NO: 884607 - DNA, 22 bp, Artificial Sequence
  chemically synthesized
attcccaaatgcattttttagt

SEQ ID NO: 884608 - DNA, 22 bp, Artificial Sequence
  chemically synthesized
attgattcccaaatgcattttt

SEQ ID NO: 884609 - DNA, 22 bp, Artificial Sequence
  chemically synthesized
cattgattcccaaatgcatttt

SEQ ID NO: 884610 - DNA, 22 bp, Artificial Sequence
  chemically synthesized
aaatactaaaaaatgcatttgg

SEQ ID NO: 884611 - DNA, 22 bp, Artificial Sequence
  chemically synthesized
ggatttcattgattcccaaatg

SEQ ID NO: 884612 - DNA, 22 bp, Artificial Sequence
  chemically synthesized
aggatttcattgattcccaaat

SEQ ID NO: 884613 - DNA, 22 bp, Artificial Sequence
  chemically synthesized
aaaaatgcatttgggaatcaat

SEQ ID NO: 884614 - DNA, 22 bp, Artificial Sequence
  chemically synthesized
gggaatcaatgaaatcctaaga

SEQ ID NO: 884615 - DNA, 22 bp, Artificial Sequence
  chemically synthesized
ggaatcaatgaaatcctaagac

SEQ ID NO: 884616 - DNA, 22 bp, Artificial Sequence
  chemically synthesized
acaaatcaaccatagtatccac

SEQ ID NO: 884617 - DNA, 22 bp, Artificial Sequence
  chemically synthesized
agacatttgtggatactatggt

SEQ ID NO: 884618 - DNA, 22 bp, Artificial Sequence
  chemically synthesized
gtggatactatggttgatttgt

SEQ ID NO: 884619 - DNA, 22 bp, Artificial Sequence
  chemically synthesized
tggatactatggttgatttgtc

SEQ ID NO: 884620 - DNA, 22 bp, Artificial Sequence
  chemically synthesized
tggttgatttgtcagttcatta

SEQ ID NO: 884621 - DNA, 22 bp, Artificial Sequence
  chemically synthesized
agagaggaaatgaataataatg

SEQ ID NO: 884622 - DNA, 22 bp, Artificial Sequence
  chemically synthesized
atttgtcagttcattattattc

SEQ ID NO: 884623 - DNA, 22 bp, Artificial Sequence
  chemically synthesized
gtcagttcattattattcattt

SEQ ID NO: 884624 - DNA, 22 bp, Artificial Sequence
  chemically synthesized
tcagttcattattattcatttc

SEQ ID NO: 884625 - DNA, 22 bp, Artificial Sequence
  chemically synthesized
attattattcatttcctctctt

SEQ ID NO: 884626 - DNA, 22 bp, Artificial Sequence
  chemically synthesized
cagggcagccatattaagagag

SEQ ID NO: 884627 - DNA, 22 bp, Artificial Sequence
  chemically synthesized
ttattcatttcctctcttaata

SEQ ID NO: 884628 - DNA, 22 bp, Artificial Sequence
  chemically synthesized
ttcatttcctctcttaatatgg

SEQ ID NO: 884629 - DNA, 22 bp, Artificial Sequence
  chemically synthesized
actgcagggcagccatattaag

SEQ ID NO: 884630 - DNA, 22 bp, Artificial Sequence
  chemically synthesized
atttcctctcttaatatggctg

SEQ ID NO: 884631 - DNA, 22 bp, Artificial Sequence
  chemically synthesized
cctctcttaatatggctgccct

SEQ ID NO: 884632 - DNA, 22 bp, Artificial Sequence
  chemically synthesized
ctctcttaatatggctgccctg

SEQ ID NO: 884633 - DNA, 22 bp, Artificial Sequence
  chemically synthesized
tcttaatatggctgccctgcag

SEQ ID NO: 884634 - DNA, 22 bp, Artificial Sequence
  chemically synthesized
ttaatatggctgccctgcagtg

SEQ ID NO: 884635 - DNA, 22 bp, Artificial Sequence
  chemically synthesized
aatatggctgccctgcagtgaa

SEQ ID NO: 884636 - DNA, 22 bp, Artificial Sequence
  chemically synthesized
atatggctgccctgcagtgaat

SEQ ID NO: 884637 - DNA, 22 bp, Artificial Sequence
  chemically synthesized
ccctgcagtgaatatacttccc

SEQ ID NO: 884638 - DNA, 22 bp, Artificial Sequence
  chemically synthesized
cagtgaatatacttcccttccc

SEQ ID NO: 884639 - DNA, 22 bp, Artificial Sequence
  chemically synthesized
cccttcccattgactttgggct

SEQ ID NO: 884640 - DNA, 22 bp, Artificial Sequence
  chemically synthesized
ccttcccattgactttgggctt

SEQ ID NO: 884641 - DNA, 22 bp, Artificial Sequence
  chemically synthesized
cccattgactttgggcttgact

SEQ ID NO: 884642 - DNA, 22 bp, Artificial Sequence
  chemically synthesized
ccattgactttgggcttgactg

SEQ ID NO: 884643 - DNA, 22 bp, Artificial Sequence
  chemically synthesized
gtcaaaggtacacagtcaagcc

SEQ ID NO: 884644 - DNA, 22 bp, Artificial Sequence
  chemically synthesized
ttggtcaaaggtacacagtcaa

SEQ ID NO: 884645 - DNA, 22 bp, Artificial Sequence
  chemically synthesized
actttgggcttgactgtgtacc

SEQ ID NO: 884646 - DNA, 22 bp, Artificial Sequence
  chemically synthesized
tgggcttgactgtgtacctttg

SEQ ID NO: 884647 - DNA, 22 bp, Artificial Sequence
  chemically synthesized
gggcttgactgtgtacctttga

SEQ ID NO: 884648 - DNA, 22 bp, Artificial Sequence
  chemically synthesized
ggcttgactgtgtacctttgac

SEQ ID NO: 884649 - DNA, 22 bp, Artificial Sequence
  chemically synthesized
tccatggtctattggtcaaagg

SEQ ID NO: 884650 - DNA, 22 bp, Artificial Sequence
  chemically synthesized
gactgtgtacctttgaccaata

SEQ ID NO: 884651 - DNA, 22 bp, Artificial Sequence
  chemically synthesized
actgtgtacctttgaccaatag

SEQ ID NO: 884652 - DNA, 22 bp, Artificial Sequence
  chemically synthesized
tctgtccatggtctattggtca

SEQ ID NO: 884653 - DNA, 22 bp, Artificial Sequence
  chemically synthesized
tgtctgtccatggtctattggt

SEQ ID NO: 884654 - DNA, 22 bp, Artificial Sequence
  chemically synthesized
ctgtctgtccatggtctattgg

SEQ ID NO: 884655 - DNA, 22 bp, Artificial Sequence
  chemically synthesized
tgtacctttgaccaatagacca

SEQ ID NO: 884656 - DNA, 22 bp, Artificial Sequence
  chemically synthesized
tgaccaatagaccatggacaga

SEQ ID NO: 884657 - DNA, 22 bp, Artificial Sequence
  chemically synthesized
gaccaatagaccatggacagac

SEQ ID NO: 884658 - DNA, 22 bp, Artificial Sequence
  chemically synthesized
accaatagaccatggacagaca

SEQ ID NO: 884659 - DNA, 22 bp, Artificial Sequence
  chemically synthesized
ccacacagtcccttctgtctgt

SEQ ID NO: 884660 - DNA, 22 bp, Artificial Sequence
  chemically synthesized
agagctgccacacagtcccttc

SEQ ID NO: 884661 - DNA, 22 bp, Artificial Sequence
  chemically synthesized
cagctaagagctgccacacagt

SEQ ID NO: 884662 - DNA, 22 bp, Artificial Sequence
  chemically synthesized
aagttccagctaagagctgcca

SEQ ID NO: 884663 - DNA, 22 bp, Artificial Sequence
  chemically synthesized
aaagttccagctaagagctgcc

SEQ ID NO: 884664 - DNA, 22 bp, Artificial Sequence
  chemically synthesized
taaagttccagctaagagctgc

SEQ ID NO: 884665 - DNA, 22 bp, Artificial Sequence
  chemically synthesized
cctttaaagttccagctaagag

SEQ ID NO: 884666 - DNA, 22 bp, Artificial Sequence
  chemically synthesized
tgtggcagctcttagctggaac

SEQ ID NO: 884667 - DNA, 22 bp, Artificial Sequence
  chemically synthesized
aactgcctttaaagttccagct

SEQ ID NO: 884668 - DNA, 22 bp, Artificial Sequence
  chemically synthesized
gaactgcctttaaagttccagc

SEQ ID NO: 884669 - DNA, 22 bp, Artificial Sequence
  chemically synthesized
ttagctggaactttaaaggcag

SEQ ID NO: 884670 - DNA, 22 bp, Artificial Sequence
  chemically synthesized
agctggaactttaaaggcagtt

SEQ ID NO: 884671 - DNA, 22 bp, Artificial Sequence
  chemically synthesized
gctggaactttaaaggcagttc

SEQ ID NO: 884672 - DNA, 22 bp, Artificial Sequence
  chemically synthesized
gaactttaaaggcagttcaaga

SEQ ID NO: 884673 - DNA, 22 bp, Artificial Sequence
  chemically synthesized
taaaggcagttcaagatttgct

SEQ ID NO: 884674 - DNA, 22 bp, Artificial Sequence
  chemically synthesized
aaaggcagttcaagatttgctg

SEQ ID NO: 884675 - DNA, 22 bp, Artificial Sequence
  chemically synthesized
aaggcagttcaagatttgctgg

SEQ ID NO: 884676 - DNA, 22 bp, Artificial Sequence
  chemically synthesized
aagatttgctggttccccttgt

SEQ ID NO: 884677 - DNA, 22 bp, Artificial Sequence
  chemically synthesized
atgatggaagataagaacaagg

SEQ ID NO: 884678 - DNA, 22 bp, Artificial Sequence
  chemically synthesized
tcatgatggaagataagaacaa

SEQ ID NO: 884679 - DNA, 22 bp, Artificial Sequence
  chemically synthesized
gctggttccccttgttcttatc

SEQ ID NO: 884680 - DNA, 22 bp, Artificial Sequence
  chemically synthesized
ctggttccccttgttcttatct

SEQ ID NO: 884681 - DNA, 22 bp, Artificial Sequence
  chemically synthesized
tctcatgatggaagataagaac

SEQ ID NO: 884682 - DNA, 22 bp, Artificial Sequence
  chemically synthesized
gttccccttgttcttatcttcc

SEQ ID NO: 884683 - DNA, 22 bp, Artificial Sequence
  chemically synthesized
ttctctcatgatggaagataag

SEQ ID NO: 884684 - DNA, 22 bp, Artificial Sequence
  chemically synthesized
cccttgttcttatcttccatca

SEQ ID NO: 884685 - DNA, 22 bp, Artificial Sequence
  chemically synthesized
gttcttatcttccatcatgaga

SEQ ID NO: 884686 - DNA, 22 bp, Artificial Sequence
  chemically synthesized
ttcttatcttccatcatgagag

SEQ ID NO: 884687 - DNA, 22 bp, Artificial Sequence
  chemically synthesized
tatggcatattattctctcatg

SEQ ID NO: 884688 - DNA, 22 bp, Artificial Sequence
  chemically synthesized
ttatcttccatcatgagagaat

SEQ ID NO: 884689 - DNA, 22 bp, Artificial Sequence
  chemically synthesized
atatggcatattattctctcat

SEQ ID NO: 884690 - DNA, 22 bp, Artificial Sequence
  chemically synthesized
tatatggcatattattctctca

SEQ ID NO: 884691 - DNA, 22 bp, Artificial Sequence
  chemically synthesized
atcttccatcatgagagaataa

SEQ ID NO: 884692 - DNA, 22 bp, Artificial Sequence
  chemically synthesized
ttatatggcatattattctctc

SEQ ID NO: 884693 - DNA, 22 bp, Artificial Sequence
  chemically synthesized
tcttccatcatgagagaataat

SEQ ID NO: 884694 - DNA, 22 bp, Artificial Sequence
  chemically synthesized
ccatcatgagagaataatatgc

SEQ ID NO: 884695 - DNA, 22 bp, Artificial Sequence
  chemically synthesized
catcatgagagaataatatgcc

SEQ ID NO: 884696 - DNA, 22 bp, Artificial Sequence
  chemically synthesized
gcggaaagagcagcttttatat

SEQ ID NO: 884697 - DNA, 22 bp, Artificial Sequence
  chemically synthesized
atcccaggaccctagcggaaag

SEQ ID NO: 884698 - DNA, 22 bp, Artificial Sequence
  chemically synthesized
tcatcccaggaccctagcggaa

SEQ ID NO: 884699 - DNA, 22 bp, Artificial Sequence
  chemically synthesized
ctcatcccaggaccctagcgga

SEQ ID NO: 884700 - DNA, 22 bp, Artificial Sequence
  chemically synthesized
ctctttccgctagggtcctggg

SEQ ID NO: 884701 - DNA, 22 bp, Artificial Sequence
  chemically synthesized
aatgtcttctcatcccaggacc

SEQ ID NO: 884702 - DNA, 22 bp, Artificial Sequence
  chemically synthesized
tttccgctagggtcctgggatg

SEQ ID NO: 884703 - DNA, 22 bp, Artificial Sequence
  chemically synthesized
taaatgtcttctcatcccagga

SEQ ID NO: 884704 - DNA, 22 bp, Artificial Sequence
  chemically synthesized
tccgctagggtcctgggatgag

SEQ ID NO: 884705 - DNA, 22 bp, Artificial Sequence
  chemically synthesized
ccgctagggtcctgggatgaga

SEQ ID NO: 884706 - DNA, 22 bp, Artificial Sequence
  chemically synthesized
ctctaaatgtcttctcatccca

SEQ ID NO: 884707 - DNA, 22 bp, Artificial Sequence
  chemically synthesized
cgctagggtcctgggatgagaa

SEQ ID NO: 884708 - DNA, 22 bp, Artificial Sequence
  chemically synthesized
gggtcctgggatgagaagacat

SEQ ID NO: 884709 - DNA, 22 bp, Artificial Sequence
  chemically synthesized
gaatatggatctgctctaaatg

SEQ ID NO: 884710 - DNA, 22 bp, Artificial Sequence
  chemically synthesized
ggatgagaagacatttagagca

SEQ ID NO: 884711 - DNA, 22 bp, Artificial Sequence
  chemically synthesized
tagaatatggatctgctctaaa

SEQ ID NO: 884712 - DNA, 22 bp, Artificial Sequence
  chemically synthesized
attctagaatatggatctgctc

SEQ ID NO: 884713 - DNA, 22 bp, Artificial Sequence
  chemically synthesized
cattctagaatatggatctgct

SEQ ID NO: 884714 - DNA, 22 bp, Artificial Sequence
  chemically synthesized
tcattctagaatatggatctgc

SEQ ID NO: 884715 - DNA, 22 bp, Artificial Sequence
  chemically synthesized
ttcattctagaatatggatctg

SEQ ID NO: 884716 - DNA, 22 bp, Artificial Sequence
  chemically synthesized
aggtcttttcattctagaatat

SEQ ID NO: 884717 - DNA, 22 bp, Artificial Sequence
  chemically synthesized
agagcagatccatattctagaa

SEQ ID NO: 884718 - DNA, 22 bp, Artificial Sequence
  chemically synthesized
gagcagatccatattctagaat

SEQ ID NO: 884719 - DNA, 22 bp, Artificial Sequence
  chemically synthesized
tgaatcaagttaaggtcttttc

SEQ ID NO: 884720 - DNA, 22 bp, Artificial Sequence
  chemically synthesized
tagaatgaaaagaccttaactt

SEQ ID NO: 884721 - DNA, 22 bp, Artificial Sequence
  chemically synthesized
cacactatgaatcaagttaagg

SEQ ID NO: 884722 - DNA, 22 bp, Artificial Sequence
  chemically synthesized
gaatgaaaagaccttaacttga

SEQ ID NO: 884723 - DNA, 22 bp, Artificial Sequence
  chemically synthesized
ctccacactatgaatcaagtta

SEQ ID NO: 884724 - DNA, 22 bp, Artificial Sequence
  chemically synthesized
actccacactatgaatcaagtt

SEQ ID NO: 884725 - DNA, 22 bp, Artificial Sequence
  chemically synthesized
tactccacactatgaatcaagt

SEQ ID NO: 884726 - DNA, 22 bp, Artificial Sequence
  chemically synthesized
cagctttactccacactatgaa

SEQ ID NO: 884727 - DNA, 22 bp, Artificial Sequence
  chemically synthesized
aacttgattcatagtgtggagt

SEQ ID NO: 884728 - DNA, 22 bp, Artificial Sequence
  chemically synthesized
acttgattcatagtgtggagta

SEQ ID NO: 884729 - DNA, 22 bp, Artificial Sequence
  chemically synthesized
gattcatagtgtggagtaaagc

SEQ ID NO: 884730 - DNA, 22 bp, Artificial Sequence
  chemically synthesized
attcatagtgtggagtaaagct

SEQ ID NO: 884731 - DNA, 22 bp, Artificial Sequence
  chemically synthesized
cagatcagctgcagctttactc

SEQ ID NO: 884732 - DNA, 22 bp, Artificial Sequence
  chemically synthesized
atagtgtggagtaaagctgcag

SEQ ID NO: 884733 - DNA, 22 bp, Artificial Sequence
  chemically synthesized
atgtgtctgcagatcagctgca

SEQ ID NO: 884734 - DNA, 22 bp, Artificial Sequence
  chemically synthesized
actcatgtgtctgcagatcagc

SEQ ID NO: 884735 - DNA, 22 bp, Artificial Sequence
  chemically synthesized
ctcactcatgtgtctgcagatc

SEQ ID NO: 884736 - DNA, 22 bp, Artificial Sequence
  chemically synthesized
ttactcactcatgtgtctgcag

SEQ ID NO: 884737 - DNA, 22 bp, Artificial Sequence
  chemically synthesized
attactcactcatgtgtctgca

SEQ ID NO: 884738 - DNA, 22 bp, Artificial Sequence
  chemically synthesized
cagctgatctgcagacacatga

SEQ ID NO: 884739 - DNA, 22 bp, Artificial Sequence
  chemically synthesized
atctgcagacacatgagtgagt

SEQ ID NO: 884740 - DNA, 22 bp, Artificial Sequence
  chemically synthesized
cagacacatgagtgagtaataa

SEQ ID NO: 884741 - DNA, 22 bp, Artificial Sequence
  chemically synthesized
cagtgacatataacaacaaaca

SEQ ID NO: 884742 - DNA, 22 bp, Artificial Sequence
  chemically synthesized
gttgttatatgtcactggaatt

SEQ ID NO: 884743 - DNA, 22 bp, Artificial Sequence
  chemically synthesized
ttgttatatgtcactggaattt

SEQ ID NO: 884744 - DNA, 22 bp, Artificial Sequence
  chemically synthesized
ttatatgtcactggaattttgt

SEQ ID NO: 884745 - DNA, 22 bp, Artificial Sequence
  chemically synthesized
tatgtcactggaattttgtcat

SEQ ID NO: 884746 - DNA, 22 bp, Artificial Sequence
  chemically synthesized
cagtaacaaacaatgacaaaat

SEQ ID NO: 884747 - DNA, 22 bp, Artificial Sequence
  chemically synthesized
ctgcagtaacaaacaatgacaa

SEQ ID NO: 884748 - DNA, 22 bp, Artificial Sequence
  chemically synthesized
gctgcagtaacaaacaatgaca

SEQ ID NO: 884749 - DNA, 22 bp, Artificial Sequence
  chemically synthesized
ttgctgcagtaacaaacaatga

SEQ ID NO: 884750 - DNA, 22 bp, Artificial Sequence
  chemically synthesized
gaattttgtcattgtttgttac

SEQ ID NO: 884751 - DNA, 22 bp, Artificial Sequence
  chemically synthesized
tcagctcttgctgcagtaacaa

SEQ ID NO: 884752 - DNA, 22 bp, Artificial Sequence
  chemically synthesized
tgtcattgtttgttactgcagc

SEQ ID NO: 884753 - DNA, 22 bp, Artificial Sequence
  chemically synthesized
gtcattgtttgttactgcagca

SEQ ID NO: 884754 - DNA, 22 bp, Artificial Sequence
  chemically synthesized
tcattgtttgttactgcagcaa

SEQ ID NO: 884755 - DNA, 22 bp, Artificial Sequence
  chemically synthesized
taattgtcagctcttgctgcag

SEQ ID NO: 884756 - DNA, 22 bp, Artificial Sequence
  chemically synthesized
tttgttactgcagcaagagctg

SEQ ID NO: 884757 - DNA, 22 bp, Artificial Sequence
  chemically synthesized
gttactgcagcaagagctgaca

SEQ ID NO: 884758 - DNA, 22 bp, Artificial Sequence
  chemically synthesized
taatattgtaattgtcagctct

SEQ ID NO: 884759 - DNA, 22 bp, Artificial Sequence
  chemically synthesized
ttactgcagcaagagctgacaa

SEQ ID NO: 884760 - DNA, 22 bp, Artificial Sequence
  chemically synthesized
ctataatattgtaattgtcagc

SEQ ID NO: 884761 - DNA, 22 bp, Artificial Sequence
  chemically synthesized
ctgcagcaagagctgacaatta

SEQ ID NO: 884762 - DNA, 22 bp, Artificial Sequence
  chemically synthesized
actataatattgtaattgtcag

SEQ ID NO: 884763 - DNA, 22 bp, Artificial Sequence
  chemically synthesized
tactataatattgtaattgtca

SEQ ID NO: 884764 - DNA, 22 bp, Artificial Sequence
  chemically synthesized
cagcaagagctgacaattacaa

SEQ ID NO: 884765 - DNA, 22 bp, Artificial Sequence
  chemically synthesized
ttttactataatattgtaattg

SEQ ID NO: 884766 - DNA, 22 bp, Artificial Sequence
  chemically synthesized
gttttactataatattgtaatt

SEQ ID NO: 884767 - DNA, 22 bp, Artificial Sequence
  chemically synthesized
tttgttttactataatattgta

SEQ ID NO: 884768 - DNA, 22 bp, Artificial Sequence
  chemically synthesized
gtttgttttactataatattgt

SEQ ID NO: 884769 - DNA, 22 bp, Artificial Sequence
  chemically synthesized
tttgtttgttttactataatat

SEQ ID NO: 884770 - DNA, 22 bp, Artificial Sequence
  chemically synthesized
acaattacaatattatagtaaa

SEQ ID NO: 884771 - DNA, 22 bp, Artificial Sequence
  chemically synthesized
caatattatagtaaaacaaaca

SEQ ID NO: 884772 - DNA, 22 bp, Artificial Sequence
  chemically synthesized
tagtaaaacaaacaaacaatat

SEQ ID NO: 884773 - DNA, 22 bp, Artificial Sequence
  chemically synthesized
tcccagaaatcacatattgttt

SEQ ID NO: 884774 - DNA, 22 bp, Artificial Sequence
  chemically synthesized
gtcccagaaatcacatattgtt

SEQ ID NO: 884775 - DNA, 22 bp, Artificial Sequence
  chemically synthesized
tgtcccagaaatcacatattgt

SEQ ID NO: 884776 - DNA, 22 bp, Artificial Sequence
  chemically synthesized
ttgtcccagaaatcacatattg

SEQ ID NO: 884777 - DNA, 22 bp, Artificial Sequence
  chemically synthesized
tttgtcccagaaatcacatatt

SEQ ID NO: 884778 - DNA, 22 bp, Artificial Sequence
  chemically synthesized
ttttgtcccagaaatcacatat

SEQ ID NO: 884779 - DNA, 22 bp, Artificial Sequence
  chemically synthesized
gtttttttgtcccagaaatcac

SEQ ID NO: 884780 - DNA, 22 bp, Artificial Sequence
  chemically synthesized
ggtttttttgtcccagaaatca

SEQ ID NO: 884781 - DNA, 22 bp, Artificial Sequence
  chemically synthesized
tggtttttttgtcccagaaatc

SEQ ID NO: 884782 - DNA, 22 bp, Artificial Sequence
  chemically synthesized
ctttggtttttttgtcccagaa

SEQ ID NO: 884783 - DNA, 22 bp, Artificial Sequence
  chemically synthesized
actttggtttttttgtcccaga

SEQ ID NO: 884784 - DNA, 22 bp, Artificial Sequence
  chemically synthesized
aaggcttactttggtttttttg

SEQ ID NO: 884785 - DNA, 22 bp, Artificial Sequence
  chemically synthesized
tattaaaggcttactttggttt

SEQ ID NO: 884786 - DNA, 22 bp, Artificial Sequence
  chemically synthesized
ctgggacaaaaaaaccaaagta

SEQ ID NO: 884787 - DNA, 22 bp, Artificial Sequence
  chemically synthesized
atattaaaggcttactttggtt

SEQ ID NO: 884788 - DNA, 22 bp, Artificial Sequence
  chemically synthesized
tgggacaaaaaaaccaaagtaa

SEQ ID NO: 884789 - DNA, 22 bp, Artificial Sequence
  chemically synthesized
ggacaaaaaaaccaaagtaagc

SEQ ID NO: 884790 - DNA, 22 bp, Artificial Sequence
  chemically synthesized
taatataaatgtgccctggtcg

SEQ ID NO: 884791 - DNA, 22 bp, Artificial Sequence
  chemically synthesized
aatataaatgtgccctggtcgc

SEQ ID NO: 884792 - DNA, 22 bp, Artificial Sequence
  chemically synthesized
atataaatgtgccctggtcgca

SEQ ID NO: 884793 - DNA, 22 bp, Artificial Sequence
  chemically synthesized
gtcgcatatattgactgcacta

SEQ ID NO: 884794 - DNA, 22 bp, Artificial Sequence
  chemically synthesized
tatggaatgagagatagtgcag

SEQ ID NO: 884795 - DNA, 22 bp, Artificial Sequence
  chemically synthesized
tgtatggaatgagagatagtgc

SEQ ID NO: 884796 - DNA, 22 bp, Artificial Sequence
  chemically synthesized
ctgtatggaatgagagatagtg

SEQ ID NO: 884797 - DNA, 22 bp, Artificial Sequence
  chemically synthesized
actgcactatctctcattccat

SEQ ID NO: 884798 - DNA, 22 bp, Artificial Sequence
  chemically synthesized
gcaaacagtttctgtatggaat

SEQ ID NO: 884799 - DNA, 22 bp, Artificial Sequence
  chemically synthesized
cactatctctcattccatacag

SEQ ID NO: 884800 - DNA, 22 bp, Artificial Sequence
  chemically synthesized
agcaaacagtttctgtatggaa

SEQ ID NO: 884801 - DNA, 22 bp, Artificial Sequence
  chemically synthesized
tagcaaacagtttctgtatgga

SEQ ID NO: 884802 - DNA, 22 bp, Artificial Sequence
  chemically synthesized
ttagcaaacagtttctgtatgg

SEQ ID NO: 884803 - DNA, 22 bp, Artificial Sequence
  chemically synthesized
tttagcaaacagtttctgtatg

SEQ ID NO: 884804 - DNA, 22 bp, Artificial Sequence
  chemically synthesized
tctctcattccatacagaaact

SEQ ID NO: 884805 - DNA, 22 bp, Artificial Sequence
  chemically synthesized
cactttttagcaaacagtttct

SEQ ID NO: 884806 - DNA, 22 bp, Artificial Sequence
  chemically synthesized
tcattccatacagaaactgttt

SEQ ID NO: 884807 - DNA, 22 bp, Artificial Sequence
  chemically synthesized
attccatacagaaactgtttgc

SEQ ID NO: 884808 - DNA, 22 bp, Artificial Sequence
  chemically synthesized
ctacactttttagcaaacagtt

SEQ ID NO: 884809 - DNA, 22 bp, Artificial Sequence
  chemically synthesized
gctacactttttagcaaacagt

SEQ ID NO: 884810 - DNA, 22 bp, Artificial Sequence
  chemically synthesized
ttgctacactttttagcaaaca

SEQ ID NO: 884811 - DNA, 22 bp, Artificial Sequence
  chemically synthesized
catacagaaactgtttgctaaa

SEQ ID NO: 884812 - DNA, 22 bp, Artificial Sequence
  chemically synthesized
cttgctacactttttagcaaac

SEQ ID NO: 884813 - DNA, 22 bp, Artificial Sequence
  chemically synthesized
tttcttgctacactttttagca

SEQ ID NO: 884814 - DNA, 22 bp, Artificial Sequence
  chemically synthesized
gtttcttgctacactttttagc

SEQ ID NO: 884815 - DNA, 22 bp, Artificial Sequence
  chemically synthesized
tgtttcttgctacactttttag

SEQ ID NO: 884816 - DNA, 22 bp, Artificial Sequence
  chemically synthesized
atattttgtttcttgctacact

SEQ ID NO: 884817 - DNA, 22 bp, Artificial Sequence
  chemically synthesized
catattttgtttcttgctacac

SEQ ID NO: 884818 - DNA, 22 bp, Artificial Sequence
  chemically synthesized
tttgctaaaaagtgtagcaaga

SEQ ID NO: 884819 - DNA, 22 bp, Artificial Sequence
  chemically synthesized
gctaaaaagtgtagcaagaaac

SEQ ID NO: 884820 - DNA, 22 bp, Artificial Sequence
  chemically synthesized
ctaaaaagtgtagcaagaaaca

SEQ ID NO: 884821 - DNA, 22 bp, Artificial Sequence
  chemically synthesized
catttcatattttgtttcttgc

SEQ ID NO: 884822 - DNA, 22 bp, Artificial Sequence
  chemically synthesized
aaaagtgtagcaagaaacaaaa

SEQ ID NO: 884823 - DNA, 22 bp, Artificial Sequence
  chemically synthesized
attccatttcatattttgtttc

SEQ ID NO: 884824 - DNA, 22 bp, Artificial Sequence
  chemically synthesized
acacaatattgattccatttca

SEQ ID NO: 884825 - DNA, 22 bp, Artificial Sequence
  chemically synthesized
taacacaatattgattccattt

SEQ ID NO: 884826 - DNA, 22 bp, Artificial Sequence
  chemically synthesized
cagaaatcaggctctaacacaa

SEQ ID NO: 884827 - DNA, 22 bp, Artificial Sequence
  chemically synthesized
gactgcagaaatcaggctctaa

SEQ ID NO: 884828 - DNA, 22 bp, Artificial Sequence
  chemically synthesized
acaatctggactgcagaaatca

SEQ ID NO: 884829 - DNA, 22 bp, Artificial Sequence
  chemically synthesized
tgttagagcctgatttctgcag

SEQ ID NO: 884830 - DNA, 22 bp, Artificial Sequence
  chemically synthesized
actgacaatctggactgcagaa

SEQ ID NO: 884831 - DNA, 22 bp, Artificial Sequence
  chemically synthesized
gagcctgatttctgcagtccag

SEQ ID NO: 884832 - DNA, 22 bp, Artificial Sequence
  chemically synthesized
atttctgcagtccagattgtca

SEQ ID NO: 884833 - DNA, 22 bp, Artificial Sequence
  chemically synthesized
tcagagtctgactgacaatctg

SEQ ID NO: 884834 - DNA, 22 bp, Artificial Sequence
  chemically synthesized
gtcagagtctgactgacaatct

SEQ ID NO: 884835 - DNA, 22 bp, Artificial Sequence
  chemically synthesized
ctgcagtccagattgtcagtca

SEQ ID NO: 884836 - DNA, 22 bp, Artificial Sequence
  chemically synthesized
tgcagtccagattgtcagtcag

SEQ ID NO: 884837 - DNA, 22 bp, Artificial Sequence
  chemically synthesized
atttgtcagagtctgactgaca

SEQ ID NO: 884838 - DNA, 22 bp, Artificial Sequence
  chemically synthesized
catttgtcagagtctgactgac

SEQ ID NO: 884839 - DNA, 22 bp, Artificial Sequence
  chemically synthesized
cagtccagattgtcagtcagac

SEQ ID NO: 884840 - DNA, 22 bp, Artificial Sequence
  chemically synthesized
tcagtcagactctgacaaatga

SEQ ID NO: 884841 - DNA, 22 bp, Artificial Sequence
  chemically synthesized
catccatcagccttcatttgtc

SEQ ID NO: 884842 - DNA, 22 bp, Artificial Sequence
  chemically synthesized
ccatccatcagccttcatttgt

SEQ ID NO: 884843 - DNA, 22 bp, Artificial Sequence
  chemically synthesized
tccatccatcagccttcatttg

SEQ ID NO: 884844 - DNA, 22 bp, Artificial Sequence
  chemically synthesized
ttccatccatcagccttcattt

SEQ ID NO: 884845 - DNA, 22 bp, Artificial Sequence
  chemically synthesized
tgtttttccatccatcagcctt

SEQ ID NO: 884846 - DNA, 22 bp, Artificial Sequence
  chemically synthesized
tgacaaatgaaggctgatggat

SEQ ID NO: 884847 - DNA, 22 bp, Artificial Sequence
  chemically synthesized
acaaatgaaggctgatggatgg

SEQ ID NO: 884848 - DNA, 22 bp, Artificial Sequence
  chemically synthesized
aacaatgttgtgtttttccatc

SEQ ID NO: 884849 - DNA, 22 bp, Artificial Sequence
  chemically synthesized
aactgaacaatgttgtgttttt

SEQ ID NO: 884850 - DNA, 22 bp, Artificial Sequence
  chemically synthesized
atggatggaaaaacacaacatt

SEQ ID NO: 884851 - DNA, 22 bp, Artificial Sequence
  chemically synthesized
ttcagttgagtttctttgtctt

SEQ ID NO: 884852 - DNA, 22 bp, Artificial Sequence
  chemically synthesized
agttgagtttctttgtctttcc

SEQ ID NO: 884853 - DNA, 22 bp, Artificial Sequence
  chemically synthesized
agtttctttgtctttcctctca

SEQ ID NO: 884854 - DNA, 22 bp, Artificial Sequence
  chemically synthesized
ctttgtctttcctctcatgttg

SEQ ID NO: 884855 - DNA, 22 bp, Artificial Sequence
  chemically synthesized
tttgtctttcctctcatgttgg

SEQ ID NO: 884856 - DNA, 22 bp, Artificial Sequence
  chemically synthesized
tgtctttcctctcatgttgggt

SEQ ID NO: 884857 - DNA, 22 bp, Artificial Sequence
  chemically synthesized
gtctttcctctcatgttgggtg

SEQ ID NO: 884858 - DNA, 22 bp, Artificial Sequence
  chemically synthesized
tctttcctctcatgttgggtga

SEQ ID NO: 884859 - DNA, 22 bp, Artificial Sequence
  chemically synthesized
agtaaaagaacagtcacccaac

SEQ ID NO: 884860 - DNA, 22 bp, Artificial Sequence
  chemically synthesized
tcctctcatgttgggtgactgt

SEQ ID NO: 884861 - DNA, 22 bp, Artificial Sequence
  chemically synthesized
cctctcatgttgggtgactgtt

SEQ ID NO: 884862 - DNA, 22 bp, Artificial Sequence
  chemically synthesized
ctctcatgttgggtgactgttc

SEQ ID NO: 884863 - DNA, 22 bp, Artificial Sequence
  chemically synthesized
tagttaagtaaaagaacagtca

SEQ ID NO: 884864 - DNA, 22 bp, Artificial Sequence
  chemically synthesized
tcatgttgggtgactgttcttt

SEQ ID NO: 884865 - DNA, 22 bp, Artificial Sequence
  chemically synthesized
atgttgggtgactgttctttta

SEQ ID NO: 884866 - DNA, 22 bp, Artificial Sequence
  chemically synthesized
attgtagttaagtaaaagaaca

SEQ ID NO: 884867 - DNA, 22 bp, Artificial Sequence
  chemically synthesized
ggtgactgttcttttacttaac

SEQ ID NO: 884868 - DNA, 22 bp, Artificial Sequence
  chemically synthesized
gcaaacctaattgtagttaagt

SEQ ID NO: 884869 - DNA, 22 bp, Artificial Sequence
  chemically synthesized
ttcttttacttaactacaatta

SEQ ID NO: 884870 - DNA, 22 bp, Artificial Sequence
  chemically synthesized
ttttacttaactacaattaggt

SEQ ID NO: 884871 - DNA, 22 bp, Artificial Sequence
  chemically synthesized
ttacttaactacaattaggttt

SEQ ID NO: 884872 - DNA, 22 bp, Artificial Sequence
  chemically synthesized
cagtggtctagcaaacctaatt

SEQ ID NO: 884873 - DNA, 22 bp, Artificial Sequence
  chemically synthesized
tacttaactacaattaggtttg

SEQ ID NO: 884874 - DNA, 22 bp, Artificial Sequence
  chemically synthesized
acttaactacaattaggtttgc

SEQ ID NO: 884875 - DNA, 22 bp, Artificial Sequence
  chemically synthesized
cttaactacaattaggtttgct

SEQ ID NO: 884876 - DNA, 22 bp, Artificial Sequence
  chemically synthesized
tgttgcagtggtctagcaaacc

SEQ ID NO: 884877 - DNA, 22 bp, Artificial Sequence
  chemically synthesized
aactacaattaggtttgctaga

SEQ ID NO: 884878 - DNA, 22 bp, Artificial Sequence
  chemically synthesized
actacaattaggtttgctagac

SEQ ID NO: 884879 - DNA, 22 bp, Artificial Sequence
  chemically synthesized
caattaggtttgctagaccact

SEQ ID NO: 884880 - DNA, 22 bp, Artificial Sequence
  chemically synthesized
ggtttgctagaccactgcaaca

SEQ ID NO: 884881 - DNA, 22 bp, Artificial Sequence
  chemically synthesized
tagtgaaagagagctgtgttgc

SEQ ID NO: 884882 - DNA, 22 bp, Artificial Sequence
  chemically synthesized
gctagaccactgcaacacagct

SEQ ID NO: 884883 - DNA, 22 bp, Artificial Sequence
  chemically synthesized
ctagaccactgcaacacagctc

SEQ ID NO: 884884 - DNA, 22 bp, Artificial Sequence
  chemically synthesized
gaccactgcaacacagctctct

SEQ ID NO: 884885 - DNA, 22 bp, Artificial Sequence
  chemically synthesized
caacacagctctctttcactat

SEQ ID NO: 884886 - DNA, 22 bp, Artificial Sequence
  chemically synthesized
acagcatgcagttatagtgaaa

SEQ ID NO: 884887 - DNA, 22 bp, Artificial Sequence
  chemically synthesized
gacagcatgcagttatagtgaa

SEQ ID NO: 884888 - DNA, 22 bp, Artificial Sequence
  chemically synthesized
tctttcactataactgcatgct

SEQ ID NO: 884889 - DNA, 22 bp, Artificial Sequence
  chemically synthesized
gcacgtacttgacagcatgcag

SEQ ID NO: 884890 - DNA, 22 bp, Artificial Sequence
  chemically synthesized
tttcactataactgcatgctgt

SEQ ID NO: 884891 - DNA, 22 bp, Artificial Sequence
  chemically synthesized
tcactataactgcatgctgtca

SEQ ID NO: 884892 - DNA, 22 bp, Artificial Sequence
  chemically synthesized
cactataactgcatgctgtcaa

SEQ ID NO: 884893 - DNA, 22 bp, Artificial Sequence
  chemically synthesized
actataactgcatgctgtcaag

SEQ ID NO: 884894 - DNA, 22 bp, Artificial Sequence
  chemically synthesized
taactgcatgctgtcaagtacg

SEQ ID NO: 884895 - DNA, 22 bp, Artificial Sequence
  chemically synthesized
tcaatcaggttggcacgtactt

SEQ ID NO: 884896 - DNA, 22 bp, Artificial Sequence
  chemically synthesized
gtcaatcaggttggcacgtact

SEQ ID NO: 884897 - DNA, 22 bp, Artificial Sequence
  chemically synthesized
tgtcaatcaggttggcacgtac

SEQ ID NO: 884898 - DNA, 22 bp, Artificial Sequence
  chemically synthesized
catgctgtcaagtacgtgccaa

SEQ ID NO: 884899 - DNA, 22 bp, Artificial Sequence
  chemically synthesized
tttgtcaatcaggttggcacgt

SEQ ID NO: 884900 - DNA, 22 bp, Artificial Sequence
  chemically synthesized
tcaagtacgtgccaacctgatt

SEQ ID NO: 884901 - DNA, 22 bp, Artificial Sequence
  chemically synthesized
tcattctttgtcaatcaggttg

SEQ ID NO: 884902 - DNA, 22 bp, Artificial Sequence
  chemically synthesized
attgacaaagaatgacaggttc

SEQ ID NO: 884903 - DNA, 22 bp, Artificial Sequence
  chemically synthesized
aaaatgggaagagagaacctgt

SEQ ID NO: 884904 - DNA, 22 bp, Artificial Sequence
  chemically synthesized
acaaagaatgacaggttctctc

SEQ ID NO: 884905 - DNA, 22 bp, Artificial Sequence
  chemically synthesized
gttcaaaatgggaagagagaac

SEQ ID NO: 884906 - DNA, 22 bp, Artificial Sequence
  chemically synthesized
attagttcaaaatgggaagaga

SEQ ID NO: 884907 - DNA, 22 bp, Artificial Sequence
  chemically synthesized
gattagttcaaaatgggaagag

SEQ ID NO: 884908 - DNA, 22 bp, Artificial Sequence
  chemically synthesized
cccttgattagttcaaaatggg

SEQ ID NO: 884909 - DNA, 22 bp, Artificial Sequence
  chemically synthesized
tctcttcccattttgaactaat

SEQ ID NO: 884910 - DNA, 22 bp, Artificial Sequence
  chemically synthesized
tcttcccattttgaactaatca

SEQ ID NO: 884911 - DNA, 22 bp, Artificial Sequence
  chemically synthesized
gtgagctgcccttgattagttc

SEQ ID NO: 884912 - DNA, 22 bp, Artificial Sequence
  chemically synthesized
ggtgagctgcccttgattagtt

SEQ ID NO: 884913 - DNA, 22 bp, Artificial Sequence
  chemically synthesized
ttcccattttgaactaatcaag

SEQ ID NO: 884914 - DNA, 22 bp, Artificial Sequence
  chemically synthesized
tggtgagctgcccttgattagt

SEQ ID NO: 884915 - DNA, 22 bp, Artificial Sequence
  chemically synthesized
cccattttgaactaatcaaggg

SEQ ID NO: 884916 - DNA, 22 bp, Artificial Sequence
  chemically synthesized
ccattttgaactaatcaagggc

SEQ ID NO: 884917 - DNA, 22 bp, Artificial Sequence
  chemically synthesized
cctttggtgagctgcccttgat

SEQ ID NO: 884918 - DNA, 22 bp, Artificial Sequence
  chemically synthesized
tgaactaatcaagggcagctca

SEQ ID NO: 884919 - DNA, 22 bp, Artificial Sequence
  chemically synthesized
gaactaatcaagggcagctcac

SEQ ID NO: 884920 - DNA, 22 bp, Artificial Sequence
  chemically synthesized
agtctccctttggtgagctgcc

SEQ ID NO: 884921 - DNA, 22 bp, Artificial Sequence
  chemically synthesized
aactaatcaagggcagctcacc

SEQ ID NO: 884922 - DNA, 22 bp, Artificial Sequence
  chemically synthesized
aagtctccctttggtgagctgc

SEQ ID NO: 884923 - DNA, 22 bp, Artificial Sequence
  chemically synthesized
taagtctccctttggtgagctg

SEQ ID NO: 884924 - DNA, 22 bp, Artificial Sequence
  chemically synthesized
ttaagtctccctttggtgagct

SEQ ID NO: 884925 - DNA, 22 bp, Artificial Sequence
  chemically synthesized
tttaagtctccctttggtgagc

SEQ ID NO: 884926 - DNA, 22 bp, Artificial Sequence
  chemically synthesized
ttttaagtctccctttggtgag

SEQ ID NO: 884927 - DNA, 22 bp, Artificial Sequence
  chemically synthesized
atcaagggcagctcaccaaagg

SEQ ID NO: 884928 - DNA, 22 bp, Artificial Sequence
  chemically synthesized
tttttaagtctccctttggtga

SEQ ID NO: 884929 - DNA, 22 bp, Artificial Sequence
  chemically synthesized
ttttttaagtctccctttggtg

SEQ ID NO: 884930 - DNA, 22 bp, Artificial Sequence
  chemically synthesized
tttttttaagtctccctttggt

SEQ ID NO: 884931 - DNA, 22 bp, Artificial Sequence
  chemically synthesized
ttttttttaagtctccctttgg

SEQ ID NO: 884932 - DNA, 22 bp, Artificial Sequence
  chemically synthesized
tttttttttaagtctccctttg

SEQ ID NO: 884933 - DNA, 22 bp, Artificial Sequence
  chemically synthesized
agttttttttttttaagtctcc

SEQ ID NO: 884934 - DNA, 22 bp, Artificial Sequence
  chemically synthesized
taagttttttttttttaagtct

SEQ ID NO: 884935 - DNA, 22 bp, Artificial Sequence
  chemically synthesized
accaaagggagacttaaaaaaa

SEQ ID NO: 884936 - DNA, 22 bp, Artificial Sequence
  chemically synthesized
aaatccataaatctctaagttt

SEQ ID NO: 884937 - DNA, 22 bp, Artificial Sequence
  chemically synthesized
gaaatccataaatctctaagtt

SEQ ID NO: 884938 - DNA, 22 bp, Artificial Sequence
  chemically synthesized
tgaaatccataaatctctaagt

SEQ ID NO: 884939 - DNA, 22 bp, Artificial Sequence
  chemically synthesized
aaaaaaaaaaaacttagagatt

SEQ ID NO: 884940 - DNA, 22 bp, Artificial Sequence
  chemically synthesized
ttgaaatccataaatctctaag

SEQ ID NO: 884941 - DNA, 22 bp, Artificial Sequence
  chemically synthesized
aaaaaaaaaaacttagagattt

SEQ ID NO: 884942 - DNA, 22 bp, Artificial Sequence
  chemically synthesized
tttttgaaatccataaatctct

SEQ ID NO: 884943 - DNA, 22 bp, Artificial Sequence
  chemically synthesized
gacagattatttttgaaatcca

SEQ ID NO: 884944 - DNA, 22 bp, Artificial Sequence
  chemically synthesized
ggacagattatttttgaaatcc

SEQ ID NO: 884945 - DNA, 22 bp, Artificial Sequence
  chemically synthesized
agagatttatggatttcaaaaa

SEQ ID NO: 884946 - DNA, 22 bp, Artificial Sequence
  chemically synthesized
gagatttatggatttcaaaaat

SEQ ID NO: 884947 - DNA, 22 bp, Artificial Sequence
  chemically synthesized
tatatttggacagattattttt

SEQ ID NO: 884948 - DNA, 22 bp, Artificial Sequence
  chemically synthesized
gtatatttggacagattatttt

SEQ ID NO: 884949 - DNA, 22 bp, Artificial Sequence
  chemically synthesized
tgtatatttggacagattattt

SEQ ID NO: 884950 - DNA, 22 bp, Artificial Sequence
  chemically synthesized
atggatttcaaaaataatctgt

SEQ ID NO: 884951 - DNA, 22 bp, Artificial Sequence
  chemically synthesized
tggatttcaaaaataatctgtc

SEQ ID NO: 884952 - DNA, 22 bp, Artificial Sequence
  chemically synthesized
tgctttgtatatttggacagat

SEQ ID NO: 884953 - DNA, 22 bp, Artificial Sequence
  chemically synthesized
caaaaataatctgtccaaatat

SEQ ID NO: 884954 - DNA, 22 bp, Artificial Sequence
  chemically synthesized
aaaaataatctgtccaaatata

SEQ ID NO: 884955 - DNA, 22 bp, Artificial Sequence
  chemically synthesized
cattatgctttgtatatttgga

SEQ ID NO: 884956 - DNA, 22 bp, Artificial Sequence
  chemically synthesized
tccaaatatacaaagcataatg

SEQ ID NO: 884957 - DNA, 22 bp, Artificial Sequence
  chemically synthesized
aaaatcaatgctgcattatgct

SEQ ID NO: 884958 - DNA, 22 bp, Artificial Sequence
  chemically synthesized
aaaaatcaatgctgcattatgc

SEQ ID NO: 884959 - DNA, 22 bp, Artificial Sequence
  chemically synthesized
cagtttaaaaatcaatgctgca

SEQ ID NO: 884960 - DNA, 22 bp, Artificial Sequence
  chemically synthesized
ccagtttaaaaatcaatgctgc

SEQ ID NO: 884961 - DNA, 22 bp, Artificial Sequence
  chemically synthesized
tccagtttaaaaatcaatgctg

SEQ ID NO: 884962 - DNA, 22 bp, Artificial Sequence
  chemically synthesized
acaacactttccagtttaaaaa

SEQ ID NO: 884963 - DNA, 22 bp, Artificial Sequence
  chemically synthesized
cacaacactttccagtttaaaa

SEQ ID NO: 884964 - DNA, 22 bp, Artificial Sequence
  chemically synthesized
acagtttcacaacactttccag

SEQ ID NO: 884965 - DNA, 22 bp, Artificial Sequence
  chemically synthesized
cacagtttcacaacactttcca

SEQ ID NO: 884966 - DNA, 22 bp, Artificial Sequence
  chemically synthesized
atttttaaactggaaagtgttg

SEQ ID NO: 884967 - DNA, 22 bp, Artificial Sequence
  chemically synthesized
ttaaactggaaagtgttgtgaa

SEQ ID NO: 884968 - DNA, 22 bp, Artificial Sequence
  chemically synthesized
tatcttcacagtttcacaacac

SEQ ID NO: 884969 - DNA, 22 bp, Artificial Sequence
  chemically synthesized
taaactggaaagtgttgtgaaa

SEQ ID NO: 884970 - DNA, 22 bp, Artificial Sequence
  chemically synthesized
aaactggaaagtgttgtgaaac

SEQ ID NO: 884971 - DNA, 22 bp, Artificial Sequence
  chemically synthesized
aactggaaagtgttgtgaaact

SEQ ID NO: 884972 - DNA, 22 bp, Artificial Sequence
  chemically synthesized
gaaagtgttgtgaaactgtgaa

SEQ ID NO: 884973 - DNA, 22 bp, Artificial Sequence
  chemically synthesized
gtagattatatcttcacagttt

SEQ ID NO: 884974 - DNA, 22 bp, Artificial Sequence
  chemically synthesized
agtagattatatcttcacagtt

SEQ ID NO: 884975 - DNA, 22 bp, Artificial Sequence
  chemically synthesized
tgaaactgtgaagatataatct

SEQ ID NO: 884976 - DNA, 22 bp, Artificial Sequence
  chemically synthesized
aagtatgcagcttagtagatta

SEQ ID NO: 884977 - DNA, 22 bp, Artificial Sequence
  chemically synthesized
caagtatgcagcttagtagatt

SEQ ID NO: 884978 - DNA, 22 bp, Artificial Sequence
  chemically synthesized
tgaagatataatctactaagct

SEQ ID NO: 884979 - DNA, 22 bp, Artificial Sequence
  chemically synthesized
aacatttcaagtatgcagctta

SEQ ID NO: 884980 - DNA, 22 bp, Artificial Sequence
  chemically synthesized
gaacatttcaagtatgcagctt

SEQ ID NO: 884981 - DNA, 22 bp, Artificial Sequence
  chemically synthesized
gccttgaacatttcaagtatgc

SEQ ID NO: 884982 - DNA, 22 bp, Artificial Sequence
  chemically synthesized
actggccttgaacatttcaagt

SEQ ID NO: 884983 - DNA, 22 bp, Artificial Sequence
  chemically synthesized
ctaagctgcatacttgaaatgt

SEQ ID NO: 884984 - DNA, 22 bp, Artificial Sequence
  chemically synthesized
cactggccttgaacatttcaag

SEQ ID NO: 884985 - DNA, 22 bp, Artificial Sequence
  chemically synthesized
tcactggccttgaacatttcaa

SEQ ID NO: 884986 - DNA, 22 bp, Artificial Sequence
  chemically synthesized
agctgcatacttgaaatgttca

SEQ ID NO: 884987 - DNA, 22 bp, Artificial Sequence
  chemically synthesized
tttcactggccttgaacatttc

SEQ ID NO: 884988 - DNA, 22 bp, Artificial Sequence
  chemically synthesized
catacttgaaatgttcaaggcc

SEQ ID NO: 884989 - DNA, 22 bp, Artificial Sequence
  chemically synthesized
tgcccactctttcactggcctt

SEQ ID NO: 884990 - DNA, 22 bp, Artificial Sequence
  chemically synthesized
gaaatgttcaaggccagtgaaa

SEQ ID NO: 884991 - DNA, 22 bp, Artificial Sequence
  chemically synthesized
aaatgttcaaggccagtgaaag

SEQ ID NO: 884992 - DNA, 22 bp, Artificial Sequence
  chemically synthesized
aaggccagtgaaagagtgggca

SEQ ID NO: 884993 - DNA, 22 bp, Artificial Sequence
  chemically synthesized
atggtcacacctatgcccactc

SEQ ID NO: 884994 - DNA, 22 bp, Artificial Sequence
  chemically synthesized
gatggtcacacctatgcccact

SEQ ID NO: 884995 - DNA, 22 bp, Artificial Sequence
  chemically synthesized
cttgatggtcacacctatgccc

SEQ ID NO: 884996 - DNA, 22 bp, Artificial Sequence
  chemically synthesized
gatgttacttgatggtcacacc

SEQ ID NO: 884997 - DNA, 22 bp, Artificial Sequence
  chemically synthesized
tggatgttacttgatggtcaca

SEQ ID NO: 884998 - DNA, 22 bp, Artificial Sequence
  chemically synthesized
ctggatgttacttgatggtcac

SEQ ID NO: 884999 - DNA, 22 bp, Artificial Sequence
  chemically synthesized
catagaggcttctggatgttac

SEQ ID NO: 885000 - DNA, 22 bp, Artificial Sequence
  chemically synthesized
ccatagaggcttctggatgtta

SEQ ID NO: 885001 - DNA, 22 bp, Artificial Sequence
  chemically synthesized
aggtggagagcttccatagagg

SEQ ID NO: 885002 - DNA, 22 bp, Artificial Sequence
  chemically synthesized
aaggtggagagcttccatagag

SEQ ID NO: 885003 - DNA, 22 bp, Artificial Sequence
  chemically synthesized
taaggtggagagcttccataga

SEQ ID NO: 885004 - DNA, 22 bp, Artificial Sequence
  chemically synthesized
aaacccccactttaaggtggag

SEQ ID NO: 885005 - DNA, 22 bp, Artificial Sequence
  chemically synthesized
gaaacccccactttaaggtgga

SEQ ID NO: 885006 - DNA, 22 bp, Artificial Sequence
  chemically synthesized
tatggaagctctccaccttaaa

SEQ ID NO: 885007 - DNA, 22 bp, Artificial Sequence
  chemically synthesized
tgaaacccccactttaaggtgg

SEQ ID NO: 885008 - DNA, 22 bp, Artificial Sequence
  chemically synthesized
tggaagctctccaccttaaagt

SEQ ID NO: 885009 - DNA, 22 bp, Artificial Sequence
  chemically synthesized
tccaccttaaagtgggggtttc

SEQ ID NO: 885010 - DNA, 22 bp, Artificial Sequence
  chemically synthesized
ccaaaaagactttgaaaccccc

SEQ ID NO: 885011 - DNA, 22 bp, Artificial Sequence
  chemically synthesized
caccttaaagtgggggtttcaa

SEQ ID NO: 885012 - DNA, 22 bp, Artificial Sequence
  chemically synthesized
tgccaaaaagactttgaaaccc

SEQ ID NO: 885013 - DNA, 22 bp, Artificial Sequence
  chemically synthesized
aaagtgggggtttcaaagtctt

SEQ ID NO: 885014 - DNA, 22 bp, Artificial Sequence
  chemically synthesized
aagtgggggtttcaaagtcttt

SEQ ID NO: 885015 - DNA, 22 bp, Artificial Sequence
  chemically synthesized
ccaaaagaattctgccaaaaag

SEQ ID NO: 885016 - DNA, 22 bp, Artificial Sequence
  chemically synthesized
gccaaaagaattctgccaaaaa

SEQ ID NO: 885017 - DNA, 22 bp, Artificial Sequence
  chemically synthesized
atttgccaaaagaattctgcca

SEQ ID NO: 885018 - DNA, 22 bp, Artificial Sequence
  chemically synthesized
caaagtctttttggcagaattc

SEQ ID NO: 885019 - DNA, 22 bp, Artificial Sequence
  chemically synthesized
catttgccaaaagaattctgcc

SEQ ID NO: 885020 - DNA, 22 bp, Artificial Sequence
  chemically synthesized
aaagtctttttggcagaattct

SEQ ID NO: 885021 - DNA, 22 bp, Artificial Sequence
  chemically synthesized
tttggcagaattcttttggcaa

SEQ ID NO: 885022 - DNA, 22 bp, Artificial Sequence
  chemically synthesized
gtaatatttcatttgccaaaag

SEQ ID NO: 885023 - DNA, 22 bp, Artificial Sequence
  chemically synthesized
ttggcagaattcttttggcaaa

SEQ ID NO: 885024 - DNA, 22 bp, Artificial Sequence
  chemically synthesized
ggtaatatttcatttgccaaaa

SEQ ID NO: 885025 - DNA, 22 bp, Artificial Sequence
  chemically synthesized
tggcagaattcttttggcaaat

SEQ ID NO: 885026 - DNA, 22 bp, Artificial Sequence
  chemically synthesized
tggtaatatttcatttgccaaa

SEQ ID NO: 885027 - DNA, 22 bp, Artificial Sequence
  chemically synthesized
ggcagaattcttttggcaaatg

SEQ ID NO: 885028 - DNA, 22 bp, Artificial Sequence
  chemically synthesized
gcagaattcttttggcaaatga

SEQ ID NO: 885029 - DNA, 22 bp, Artificial Sequence
  chemically synthesized
gaagagttttggtaatatttca

SEQ ID NO: 885030 - DNA, 22 bp, Artificial Sequence
  chemically synthesized
ggaagagttttggtaatatttc

SEQ ID NO: 885031 - DNA, 22 bp, Artificial Sequence
  chemically synthesized
ttttggcaaatgaaatattacc

SEQ ID NO: 885032 - DNA, 22 bp, Artificial Sequence
  chemically synthesized
tggaagagttttggtaatattt

SEQ ID NO: 885033 - DNA, 22 bp, Artificial Sequence
  chemically synthesized
ttggaagagttttggtaatatt

SEQ ID NO: 885034 - DNA, 22 bp, Artificial Sequence
  chemically synthesized
ttggcaaatgaaatattaccaa

SEQ ID NO: 885035 - DNA, 22 bp, Artificial Sequence
  chemically synthesized
tttggaagagttttggtaatat

SEQ ID NO: 885036 - DNA, 22 bp, Artificial Sequence
  chemically synthesized
tggcaaatgaaatattaccaaa

SEQ ID NO: 885037 - DNA, 22 bp, Artificial Sequence
  chemically synthesized
ggcaaatgaaatattaccaaaa

SEQ ID NO: 885038 - DNA, 22 bp, Artificial Sequence
  chemically synthesized
gcaaatgaaatattaccaaaac

SEQ ID NO: 885039 - DNA, 22 bp, Artificial Sequence
  chemically synthesized
aagtgattttttggaagagttt

SEQ ID NO: 885040 - DNA, 22 bp, Artificial Sequence
  chemically synthesized
ccaaaactcttccaaaaaatca

SEQ ID NO: 885041 - DNA, 22 bp, Artificial Sequence
  chemically synthesized
tggaatgactcaagtgattttt

SEQ ID NO: 885042 - DNA, 22 bp, Artificial Sequence
  chemically synthesized
atggaatgactcaagtgatttt

SEQ ID NO: 885043 - DNA, 22 bp, Artificial Sequence
  chemically synthesized
ttccaaaaaatcacttgagtca

SEQ ID NO: 885044 - DNA, 22 bp, Artificial Sequence
  chemically synthesized
ccaaaaaatcacttgagtcatt

SEQ ID NO: 885045 - DNA, 22 bp, Artificial Sequence
  chemically synthesized
caaaaaatcacttgagtcattc

SEQ ID NO: 885046 - DNA, 22 bp, Artificial Sequence
  chemically synthesized
tcaatatttatggaatgactca

SEQ ID NO: 885047 - DNA, 22 bp, Artificial Sequence
  chemically synthesized
gagtcattccataaatattgac

SEQ ID NO: 885048 - DNA, 22 bp, Artificial Sequence
  chemically synthesized
agtcattccataaatattgaca

SEQ ID NO: 885049 - DNA, 22 bp, Artificial Sequence
  chemically synthesized
gcagacaataagtaatctgtca

SEQ ID NO: 885050 - DNA, 22 bp, Artificial Sequence
  chemically synthesized
agcagacaataagtaatctgtc

SEQ ID NO: 885051 - DNA, 22 bp, Artificial Sequence
  chemically synthesized
cataaatattgacagattactt

SEQ ID NO: 885052 - DNA, 22 bp, Artificial Sequence
  chemically synthesized
aaacaatgtttagcagacaata

SEQ ID NO: 885053 - DNA, 22 bp, Artificial Sequence
  chemically synthesized
acagattacttattgtctgcta

SEQ ID NO: 885054 - DNA, 22 bp, Artificial Sequence
  chemically synthesized
gtacctcaaacaatgtttagca

SEQ ID NO: 885055 - DNA, 22 bp, Artificial Sequence
  chemically synthesized
cttattgtctgctaaacattgt

SEQ ID NO: 885056 - DNA, 22 bp, Artificial Sequence
  chemically synthesized
attgtctgctaaacattgtttg

SEQ ID NO: 885057 - DNA, 22 bp, Artificial Sequence
  chemically synthesized
ttgtctgctaaacattgtttga

SEQ ID NO: 885058 - DNA, 22 bp, Artificial Sequence
  chemically synthesized
catatctagtacctcaaacaat

SEQ ID NO: 885059 - DNA, 22 bp, Artificial Sequence
  chemically synthesized
tctgctaaacattgtttgaggt

SEQ ID NO: 885060 - DNA, 22 bp, Artificial Sequence
  chemically synthesized
ttacatatctagtacctcaaac

SEQ ID NO: 885061 - DNA, 22 bp, Artificial Sequence
  chemically synthesized
ctaaacattgtttgaggtacta

SEQ ID NO: 885062 - DNA, 22 bp, Artificial Sequence
  chemically synthesized
gctgttacatatctagtacctc

SEQ ID NO: 885063 - DNA, 22 bp, Artificial Sequence
  chemically synthesized
aacattgtttgaggtactagat

SEQ ID NO: 885064 - DNA, 22 bp, Artificial Sequence
  chemically synthesized
ttcgctgttacatatctagtac

SEQ ID NO: 885065 - DNA, 22 bp, Artificial Sequence
  chemically synthesized
attcgctgttacatatctagta

SEQ ID NO: 885066 - DNA, 22 bp, Artificial Sequence
  chemically synthesized
tattcgctgttacatatctagt

SEQ ID NO: 885067 - DNA, 22 bp, Artificial Sequence
  chemically synthesized
ttttattcgctgttacatatct

SEQ ID NO: 885068 - DNA, 22 bp, Artificial Sequence
  chemically synthesized
tttgaggtactagatatgtaac

SEQ ID NO: 885069 - DNA, 22 bp, Artificial Sequence
  chemically synthesized
gaggtactagatatgtaacagc

SEQ ID NO: 885070 - DNA, 22 bp, Artificial Sequence
  chemically synthesized
tctgttttattcgctgttacat

SEQ ID NO: 885071 - DNA, 22 bp, Artificial Sequence
  chemically synthesized
aggtactagatatgtaacagcg

SEQ ID NO: 885072 - DNA, 22 bp, Artificial Sequence
  chemically synthesized
gtctgttttattcgctgttaca

SEQ ID NO: 885073 - DNA, 22 bp, Artificial Sequence
  chemically synthesized
gatatgtaacagcgaataaaac

SEQ ID NO: 885074 - DNA, 22 bp, Artificial Sequence
  chemically synthesized
tgaggacacaaaaagtttgtct

SEQ ID NO: 885075 - DNA, 22 bp, Artificial Sequence
  chemically synthesized
atgaggacacaaaaagtttgtc

SEQ ID NO: 885076 - DNA, 22 bp, Artificial Sequence
  chemically synthesized
tatgaggacacaaaaagtttgt

SEQ ID NO: 885077 - DNA, 22 bp, Artificial Sequence
  chemically synthesized
gaatgtaagttttatgaggaca

SEQ ID NO: 885078 - DNA, 22 bp, Artificial Sequence
  chemically synthesized
tttgtgtcctcataaaacttac

SEQ ID NO: 885079 - DNA, 22 bp, Artificial Sequence
  chemically synthesized
ttgtgtcctcataaaacttaca

SEQ ID NO: 885080 - DNA, 22 bp, Artificial Sequence
  chemically synthesized
tcaccattagaatgtaagtttt

SEQ ID NO: 885081 - DNA, 22 bp, Artificial Sequence
  chemically synthesized
tgtgtcctcataaaacttacat

SEQ ID NO: 885082 - DNA, 22 bp, Artificial Sequence
  chemically synthesized
gtgtcctcataaaacttacatt

SEQ ID NO: 885083 - DNA, 22 bp, Artificial Sequence
  chemically synthesized
tgtcctcataaaacttacattc

SEQ ID NO: 885084 - DNA, 22 bp, Artificial Sequence
  chemically synthesized
cacattatcaccattagaatgt

SEQ ID NO: 885085 - DNA, 22 bp, Artificial Sequence
  chemically synthesized
ataaaacttacattctaatggt

SEQ ID NO: 885086 - DNA, 22 bp, Artificial Sequence
  chemically synthesized
ctacacattatcaccattagaa

SEQ ID NO: 885087 - DNA, 22 bp, Artificial Sequence
  chemically synthesized
actacacattatcaccattaga

SEQ ID NO: 885088 - DNA, 22 bp, Artificial Sequence
  chemically synthesized
tactacacattatcaccattag

SEQ ID NO: 885089 - DNA, 22 bp, Artificial Sequence
  chemically synthesized
ttactacacattatcaccatta

SEQ ID NO: 885090 - DNA, 22 bp, Artificial Sequence
  chemically synthesized
ttttactacacattatcaccat

SEQ ID NO: 885091 - DNA, 22 bp, Artificial Sequence
  chemically synthesized
tcttttactacacattatcacc

SEQ ID NO: 885092 - DNA, 22 bp, Artificial Sequence
  chemically synthesized
ctcttttactacacattatcac

SEQ ID NO: 885093 - DNA, 22 bp, Artificial Sequence
  chemically synthesized
acattctaatggtgataatgtg

SEQ ID NO: 885094 - DNA, 22 bp, Artificial Sequence
  chemically synthesized
cattctaatggtgataatgtgt

SEQ ID NO: 885095 - DNA, 22 bp, Artificial Sequence
  chemically synthesized
atttctcttttactacacatta

SEQ ID NO: 885096 - DNA, 22 bp, Artificial Sequence
  chemically synthesized
aatttctcttttactacacatt

SEQ ID NO: 885097 - DNA, 22 bp, Artificial Sequence
  chemically synthesized
taatggtgataatgtgtagtaa

SEQ ID NO: 885098 - DNA, 22 bp, Artificial Sequence
  chemically synthesized
atggtgataatgtgtagtaaaa

SEQ ID NO: 885099 - DNA, 22 bp, Artificial Sequence
  chemically synthesized
caaagcaccttaatttctcttt

SEQ ID NO: 885100 - DNA, 22 bp, Artificial Sequence
  chemically synthesized
tccaaagcaccttaatttctct

SEQ ID NO: 885101 - DNA, 22 bp, Artificial Sequence
  chemically synthesized
actctccaaagcaccttaattt

SEQ ID NO: 885102 - DNA, 22 bp, Artificial Sequence
  chemically synthesized
cactctccaaagcaccttaatt

SEQ ID NO: 885103 - DNA, 22 bp, Artificial Sequence
  chemically synthesized
tcactctccaaagcaccttaat

SEQ ID NO: 885104 - DNA, 22 bp, Artificial Sequence
  chemically synthesized
ttcactctccaaagcaccttaa

SEQ ID NO: 885105 - DNA, 22 bp, Artificial Sequence
  chemically synthesized
gcacttttcactctccaaagca

SEQ ID NO: 885106 - DNA, 22 bp, Artificial Sequence
  chemically synthesized
agcacttttcactctccaaagc

SEQ ID NO: 885107 - DNA, 22 bp, Artificial Sequence
  chemically synthesized
tagcacttttcactctccaaag

SEQ ID NO: 885108 - DNA, 22 bp, Artificial Sequence
  chemically synthesized
tttagcacttttcactctccaa

SEQ ID NO: 885109 - DNA, 22 bp, Artificial Sequence
  chemically synthesized
ttctttagcacttttcactctc

SEQ ID NO: 885110 - DNA, 22 bp, Artificial Sequence
  chemically synthesized
gttctttagcacttttcactct

SEQ ID NO: 885111 - DNA, 22 bp, Artificial Sequence
  chemically synthesized
aggtgctttggagagtgaaaag

SEQ ID NO: 885112 - DNA, 22 bp, Artificial Sequence
  chemically synthesized
tgttctttagcacttttcactc

SEQ ID NO: 885113 - DNA, 22 bp, Artificial Sequence
  chemically synthesized
cattttgttctttagcactttt

SEQ ID NO: 885114 - DNA, 22 bp, Artificial Sequence
  chemically synthesized
acattttgttctttagcacttt

SEQ ID NO: 885115 - DNA, 22 bp, Artificial Sequence
  chemically synthesized
tacattttgttctttagcactt

SEQ ID NO: 885116 - DNA, 22 bp, Artificial Sequence
  chemically synthesized
tggagagtgaaaagtgctaaag

SEQ ID NO: 885117 - DNA, 22 bp, Artificial Sequence
  chemically synthesized
ggagagtgaaaagtgctaaaga

SEQ ID NO: 885118 - DNA, 22 bp, Artificial Sequence
  chemically synthesized
gagagtgaaaagtgctaaagaa

SEQ ID NO: 885119 - DNA, 22 bp, Artificial Sequence
  chemically synthesized
tccagtgctttacattttgttc

SEQ ID NO: 885120 - DNA, 22 bp, Artificial Sequence
  chemically synthesized
ctatccagtgctttacattttg

SEQ ID NO: 885121 - DNA, 22 bp, Artificial Sequence
  chemically synthesized
ttcctatccagtgctttacatt

SEQ ID NO: 885122 - DNA, 22 bp, Artificial Sequence
  chemically synthesized
attcctatccagtgctttacat

SEQ ID NO: 885123 - DNA, 22 bp, Artificial Sequence
  chemically synthesized
ttattcctatccagtgctttac

SEQ ID NO: 885124 - DNA, 22 bp, Artificial Sequence
  chemically synthesized
aagaacaaaatgtaaagcactg

SEQ ID NO: 885125 - DNA, 22 bp, Artificial Sequence
  chemically synthesized
agtctcttattcctatccagtg

SEQ ID NO: 885126 - DNA, 22 bp, Artificial Sequence
  chemically synthesized
ccccatacctaagtctcttatt

SEQ ID NO: 885127 - DNA, 22 bp, Artificial Sequence
  chemically synthesized
gccccatacctaagtctcttat

SEQ ID NO: 885128 - DNA, 22 bp, Artificial Sequence
  chemically synthesized
tgccccatacctaagtctctta

SEQ ID NO: 885129 - DNA, 22 bp, Artificial Sequence
  chemically synthesized
gataggaataagagacttaggt

SEQ ID NO: 885130 - DNA, 22 bp, Artificial Sequence
  chemically synthesized
cctttgccccatacctaagtct

SEQ ID NO: 885131 - DNA, 22 bp, Artificial Sequence
  chemically synthesized
cacatgccacctccctttgccc

SEQ ID NO: 885132 - DNA, 22 bp, Artificial Sequence
  chemically synthesized
tccacatgccacctccctttgc

SEQ ID NO: 885133 - DNA, 22 bp, Artificial Sequence
  chemically synthesized
aggtatggggcaaagggaggtg

SEQ ID NO: 885134 - DNA, 22 bp, Artificial Sequence
  chemically synthesized
ggtatggggcaaagggaggtgg

SEQ ID NO: 885135 - DNA, 22 bp, Artificial Sequence
  chemically synthesized
aactctccacatgccacctccc

SEQ ID NO: 885136 - DNA, 22 bp, Artificial Sequence
  chemically synthesized
taaactctccacatgccacctc

SEQ ID NO: 885137 - DNA, 22 bp, Artificial Sequence
  chemically synthesized
ctaaactctccacatgccacct

SEQ ID NO: 885138 - DNA, 22 bp, Artificial Sequence
  chemically synthesized
tctaaactctccacatgccacc

SEQ ID NO: 885139 - DNA, 22 bp, Artificial Sequence
  chemically synthesized
caggcactttctaaactctcca

SEQ ID NO: 885140 - DNA, 22 bp, Artificial Sequence
  chemically synthesized
cctgcaggcactttctaaactc

SEQ ID NO: 885141 - DNA, 22 bp, Artificial Sequence
  chemically synthesized
ccctgcaggcactttctaaact

SEQ ID NO: 885142 - DNA, 22 bp, Artificial Sequence
  chemically synthesized
tccctgcaggcactttctaaac

SEQ ID NO: 885143 - DNA, 22 bp, Artificial Sequence
  chemically synthesized
agtgaggctttccctgcaggca

SEQ ID NO: 885144 - DNA, 22 bp, Artificial Sequence
  chemically synthesized
ctcagtgaggctttccctgcag

SEQ ID NO: 885145 - DNA, 22 bp, Artificial Sequence
  chemically synthesized
agaaagtgcctgcagggaaagc

SEQ ID NO: 885146 - DNA, 22 bp, Artificial Sequence
  chemically synthesized
gaaagtgcctgcagggaaagcc

SEQ ID NO: 885147 - DNA, 22 bp, Artificial Sequence
  chemically synthesized
aataccacctactcagtgaggc

SEQ ID NO: 885148 - DNA, 22 bp, Artificial Sequence
  chemically synthesized
aaataccacctactcagtgagg

SEQ ID NO: 885149 - DNA, 22 bp, Artificial Sequence
  chemically synthesized
cagggaaagcctcactgagtag

SEQ ID NO: 885150 - DNA, 22 bp, Artificial Sequence
  chemically synthesized
tttaaataccacctactcagtg

SEQ ID NO: 885151 - DNA, 22 bp, Artificial Sequence
  chemically synthesized
atttaaataccacctactcagt

SEQ ID NO: 885152 - DNA, 22 bp, Artificial Sequence
  chemically synthesized
tatttaaataccacctactcag

SEQ ID NO: 885153 - DNA, 22 bp, Artificial Sequence
  chemically synthesized
agatctttatttaaataccacc

SEQ ID NO: 885154 - DNA, 22 bp, Artificial Sequence
  chemically synthesized
cagatctttatttaaataccac

SEQ ID NO: 885155 - DNA, 22 bp, Artificial Sequence
  chemically synthesized
actgagtaggtggtatttaaat

SEQ ID NO: 885156 - DNA, 22 bp, Artificial Sequence
  chemically synthesized
cttcagatctttatttaaatac

SEQ ID NO: 885157 - DNA, 22 bp, Artificial Sequence
  chemically synthesized
ccttcagatctttatttaaata

SEQ ID NO: 885158 - DNA, 22 bp, Artificial Sequence
  chemically synthesized
agtaggtggtatttaaataaag

SEQ ID NO: 885159 - DNA, 22 bp, Artificial Sequence
  chemically synthesized
acttccttcagatctttattta

SEQ ID NO: 885160 - DNA, 22 bp, Artificial Sequence
  chemically synthesized
cctcacttccttcagatcttta

SEQ ID NO: 885161 - DNA, 22 bp, Artificial Sequence
  chemically synthesized
aatcgttccctcacttccttca

SEQ ID NO: 885162 - DNA, 22 bp, Artificial Sequence
  chemically synthesized
aaataaagatctgaaggaagtg

SEQ ID NO: 885163 - DNA, 22 bp, Artificial Sequence
  chemically synthesized
gaatcgttccctcacttccttc

SEQ ID NO: 885164 - DNA, 22 bp, Artificial Sequence
  chemically synthesized
aataaagatctgaaggaagtga

SEQ ID NO: 885165 - DNA, 22 bp, Artificial Sequence
  chemically synthesized
cttgaatcgttccctcacttcc

SEQ ID NO: 885166 - DNA, 22 bp, Artificial Sequence
  chemically synthesized
agatagctacttgaatcgttcc

SEQ ID NO: 885167 - DNA, 22 bp, Artificial Sequence
  chemically synthesized
aaggaagtgagggaacgattca

SEQ ID NO: 885168 - DNA, 22 bp, Artificial Sequence
  chemically synthesized
ctgagatagctacttgaatcgt

SEQ ID NO: 885169 - DNA, 22 bp, Artificial Sequence
  chemically synthesized
cctgagatagctacttgaatcg

SEQ ID NO: 885170 - DNA, 22 bp, Artificial Sequence
  chemically synthesized
tcctgagatagctacttgaatc

SEQ ID NO: 885171 - DNA, 22 bp, Artificial Sequence
  chemically synthesized
tttcctgagatagctacttgaa

SEQ ID NO: 885172 - DNA, 22 bp, Artificial Sequence
  chemically synthesized
ttctttcctgagatagctactt

SEQ ID NO: 885173 - DNA, 22 bp, Artificial Sequence
  chemically synthesized
cacagattgttctttcctgaga

SEQ ID NO: 885174 - DNA, 22 bp, Artificial Sequence
  chemically synthesized
tgcacagattgttctttcctga

SEQ ID NO: 885175 - DNA, 22 bp, Artificial Sequence
  chemically synthesized
aagtagctatctcaggaaagaa

SEQ ID NO: 885176 - DNA, 22 bp, Artificial Sequence
  chemically synthesized
tctctgcacagattgttctttc

SEQ ID NO: 885177 - DNA, 22 bp, Artificial Sequence
  chemically synthesized
ctgtctctgcacagattgttct

SEQ ID NO: 885178 - DNA, 22 bp, Artificial Sequence
  chemically synthesized
gctgtctctgcacagattgttc

SEQ ID NO: 885179 - DNA, 22 bp, Artificial Sequence
  chemically synthesized
tctcaggaaagaacaatctgtg

SEQ ID NO: 885180 - DNA, 22 bp, Artificial Sequence
  chemically synthesized
cacttgctgtctctgcacagat

SEQ ID NO: 885181 - DNA, 22 bp, Artificial Sequence
  chemically synthesized
aggaaagaacaatctgtgcaga

SEQ ID NO: 885182 - DNA, 22 bp, Artificial Sequence
  chemically synthesized
gcacttgctgtctctgcacaga

SEQ ID NO: 885183 - DNA, 22 bp, Artificial Sequence
  chemically synthesized
tgcacttgctgtctctgcacag

SEQ ID NO: 885184 - DNA, 22 bp, Artificial Sequence
  chemically synthesized
ccccagggcctttgcacttgct

SEQ ID NO: 885185 - DNA, 22 bp, Artificial Sequence
  chemically synthesized
tgcagagacagcaagtgcaaag

SEQ ID NO: 885186 - DNA, 22 bp, Artificial Sequence
  chemically synthesized
ctgccccagggcctttgcactt

SEQ ID NO: 885187 - DNA, 22 bp, Artificial Sequence
  chemically synthesized
aacatacacatacactcctgcc

SEQ ID NO: 885188 - DNA, 22 bp, Artificial Sequence
  chemically synthesized
attgaacatacacatacactcc

SEQ ID NO: 885189 - DNA, 22 bp, Artificial Sequence
  chemically synthesized
aattgaacatacacatacactc

SEQ ID NO: 885190 - DNA, 22 bp, Artificial Sequence
  chemically synthesized
taattgaacatacacatacact

SEQ ID NO: 885191 - DNA, 22 bp, Artificial Sequence
  chemically synthesized
ttaattgaacatacacatacac

SEQ ID NO: 885192 - DNA, 22 bp, Artificial Sequence
  chemically synthesized
tttaattgaacatacacataca

SEQ ID NO: 885193 - DNA, 22 bp, Artificial Sequence
  chemically synthesized
ttttaattgaacatacacatac

SEQ ID NO: 885194 - DNA, 22 bp, Artificial Sequence
  chemically synthesized
tttttaattgaacatacacata

SEQ ID NO: 885195 - DNA, 22 bp, Artificial Sequence
  chemically synthesized
gggcaggagtgtatgtgtatgt

SEQ ID NO: 885196 - DNA, 22 bp, Artificial Sequence
  chemically synthesized
ttttttaattgaacatacacat

SEQ ID NO: 885197 - DNA, 22 bp, Artificial Sequence
  chemically synthesized
tttttttaattgaacatacaca

SEQ ID NO: 885198 - DNA, 22 bp, Artificial Sequence
  chemically synthesized
ttttttttaattgaacatacac

SEQ ID NO: 885199 - DNA, 22 bp, Artificial Sequence
  chemically synthesized
gtgtccttttttttttaattga

SEQ ID NO: 885200 - DNA, 22 bp, Artificial Sequence
  chemically synthesized
accctggtgtcctttttttttt

SEQ ID NO: 885201 - DNA, 22 bp, Artificial Sequence
  chemically synthesized
cactcaccctggtgtccttttt

SEQ ID NO: 885202 - DNA, 22 bp, Artificial Sequence
  chemically synthesized
aattaaaaaaaaaaggacacca

SEQ ID NO: 885203 - DNA, 22 bp, Artificial Sequence
  chemically synthesized
gattccactcaccctggtgtcc

SEQ ID NO: 885204 - DNA, 22 bp, Artificial Sequence
  chemically synthesized
aaaaaaaaaggacaccagggtg

SEQ ID NO: 885205 - DNA, 22 bp, Artificial Sequence
  chemically synthesized
actagattccactcaccctggt

SEQ ID NO: 885206 - DNA, 22 bp, Artificial Sequence
  chemically synthesized
ctcactagattccactcaccct

SEQ ID NO: 885207 - DNA, 22 bp, Artificial Sequence
  chemically synthesized
gctcactagattccactcaccc

SEQ ID NO: 885208 - DNA, 22 bp, Artificial Sequence
  chemically synthesized
cccttgctcactagattccact

SEQ ID NO: 885209 - DNA, 22 bp, Artificial Sequence
  chemically synthesized
tccccttgctcactagattcca

SEQ ID NO: 885210 - DNA, 22 bp, Artificial Sequence
  chemically synthesized
ctctccccttgctcactagatt

SEQ ID NO: 885211 - DNA, 22 bp, Artificial Sequence
  chemically synthesized
ctactctccccttgctcactag

SEQ ID NO: 885212 - DNA, 22 bp, Artificial Sequence
  chemically synthesized
ctactactctccccttgctcac

SEQ ID NO: 885213 - DNA, 22 bp, Artificial Sequence
  chemically synthesized
tcattcctactactctcccctt

SEQ ID NO: 885214 - DNA, 22 bp, Artificial Sequence
  chemically synthesized
gtgagcaaggggagagtagtag

SEQ ID NO: 885215 - DNA, 22 bp, Artificial Sequence
  chemically synthesized
tgactatcattcctactactct

SEQ ID NO: 885216 - DNA, 22 bp, Artificial Sequence
  chemically synthesized
tatgactatcattcctactact

SEQ ID NO: 885217 - DNA, 22 bp, Artificial Sequence
  chemically synthesized
catccccaactctatgactatc

SEQ ID NO: 885218 - DNA, 22 bp, Artificial Sequence
  chemically synthesized
ctccatccccaactctatgact

SEQ ID NO: 885219 - DNA, 22 bp, Artificial Sequence
  chemically synthesized
tcctcctccatccccaactcta

SEQ ID NO: 885220 - DNA, 22 bp, Artificial Sequence
  chemically synthesized
caaagatgcaggacctatcctc

SEQ ID NO: 885221 - DNA, 22 bp, Artificial Sequence
  chemically synthesized
ccaaagatgcaggacctatcct

SEQ ID NO: 885222 - DNA, 22 bp, Artificial Sequence
  chemically synthesized
gggatggaggaggataggtcct

SEQ ID NO: 885223 - DNA, 22 bp, Artificial Sequence
  chemically synthesized
aggataacagccaagatccttc

SEQ ID NO: 885224 - DNA, 22 bp, Artificial Sequence
  chemically synthesized
catctttggaaggatcttggct

SEQ ID NO: 885225 - DNA, 22 bp, Artificial Sequence
  chemically synthesized
actcaggataacagccaagatc

SEQ ID NO: 885226 - DNA, 22 bp, Artificial Sequence
  chemically synthesized
atctcactcaggataacagcca

SEQ ID NO: 885227 - DNA, 22 bp, Artificial Sequence
  chemically synthesized
tggaaggatcttggctgttatc

SEQ ID NO: 885228 - DNA, 22 bp, Artificial Sequence
  chemically synthesized
ggaaggatcttggctgttatcc

SEQ ID NO: 885229 - DNA, 22 bp, Artificial Sequence
  chemically synthesized
gaaggatcttggctgttatcct

SEQ ID NO: 885230 - DNA, 22 bp, Artificial Sequence
  chemically synthesized
ctaatctcactcaggataacag

SEQ ID NO: 885231 - DNA, 22 bp, Artificial Sequence
  chemically synthesized
cctaatctcactcaggataaca

SEQ ID NO: 885232 - DNA, 22 bp, Artificial Sequence
  chemically synthesized
tgcttcctaatctcactcagga

SEQ ID NO: 885233 - DNA, 22 bp, Artificial Sequence
  chemically synthesized
ctatgcttcctaatctcactca

SEQ ID NO: 885234 - DNA, 22 bp, Artificial Sequence
  chemically synthesized
ggctgttatcctgagtgagatt

SEQ ID NO: 885235 - DNA, 22 bp, Artificial Sequence
  chemically synthesized
gctgttatcctgagtgagatta

SEQ ID NO: 885236 - DNA, 22 bp, Artificial Sequence
  chemically synthesized
tcctatgcttcctaatctcact

SEQ ID NO: 885237 - DNA, 22 bp, Artificial Sequence
  chemically synthesized
ttatcctgagtgagattaggaa

SEQ ID NO: 885238 - DNA, 22 bp, Artificial Sequence
  chemically synthesized
tcctgagtgagattaggaagca

SEQ ID NO: 885239 - DNA, 22 bp, Artificial Sequence
  chemically synthesized
aaaactctcctatgcttcctaa

SEQ ID NO: 885240 - DNA, 22 bp, Artificial Sequence
  chemically synthesized
ctgaaaactctcctatgcttcc

SEQ ID NO: 885241 - DNA, 22 bp, Artificial Sequence
  chemically synthesized
agtgagattaggaagcatagga

SEQ ID NO: 885242 - DNA, 22 bp, Artificial Sequence
  chemically synthesized
tgctgaaaactctcctatgctt

SEQ ID NO: 885243 - DNA, 22 bp, Artificial Sequence
  chemically synthesized
ctctgctgaaaactctcctatg

SEQ ID NO: 885244 - DNA, 22 bp, Artificial Sequence
  chemically synthesized
ggaagcataggagagttttcag

SEQ ID NO: 885245 - DNA, 22 bp, Artificial Sequence
  chemically synthesized
aaaataagtcagatcacatcac

SEQ ID NO: 885246 - DNA, 22 bp, Artificial Sequence
  chemically synthesized
tcagcagaggagtgatgtgatc

SEQ ID NO: 885247 - DNA, 22 bp, Artificial Sequence
  chemically synthesized
aaaaataagtcagatcacatca

SEQ ID NO: 885248 - DNA, 22 bp, Artificial Sequence
  chemically synthesized
cagcagaggagtgatgtgatct

SEQ ID NO: 885249 - DNA, 22 bp, Artificial Sequence
  chemically synthesized
agcagaggagtgatgtgatctg

SEQ ID NO: 885250 - DNA, 22 bp, Artificial Sequence
  chemically synthesized
tttaaaaataagtcagatcaca

SEQ ID NO: 885251 - DNA, 22 bp, Artificial Sequence
  chemically synthesized
acttatttttaaacagatcatt

SEQ ID NO: 885252 - DNA, 22 bp, Artificial Sequence
  chemically synthesized
atacagcagccagaatgatctg

SEQ ID NO: 885253 - DNA, 22 bp, Artificial Sequence
  chemically synthesized
aatacagcagccagaatgatct

SEQ ID NO: 885254 - DNA, 22 bp, Artificial Sequence
  chemically synthesized
atttttaaacagatcattctgg

SEQ ID NO: 885255 - DNA, 22 bp, Artificial Sequence
  chemically synthesized
tttttaaacagatcattctggc

SEQ ID NO: 885256 - DNA, 22 bp, Artificial Sequence
  chemically synthesized
atcttaatacagcagccagaat

SEQ ID NO: 885257 - DNA, 22 bp, Artificial Sequence
  chemically synthesized
ttaaacagatcattctggctgc

SEQ ID NO: 885258 - DNA, 22 bp, Artificial Sequence
  chemically synthesized
taaacagatcattctggctgct

SEQ ID NO: 885259 - DNA, 22 bp, Artificial Sequence
  chemically synthesized
aaacagatcattctggctgctg

SEQ ID NO: 885260 - DNA, 22 bp, Artificial Sequence
  chemically synthesized
aacagatcattctggctgctgt

SEQ ID NO: 885261 - DNA, 22 bp, Artificial Sequence
  chemically synthesized
aagtctaatcttaatacagcag

SEQ ID NO: 885262 - DNA, 22 bp, Artificial Sequence
  chemically synthesized
aaagtctaatcttaatacagca

SEQ ID NO: 885263 - DNA, 22 bp, Artificial Sequence
  chemically synthesized
ttaaagtctaatcttaatacag

SEQ ID NO: 885264 - DNA, 22 bp, Artificial Sequence
  chemically synthesized
cattcttaaagtctaatcttaa

SEQ ID NO: 885265 - DNA, 22 bp, Artificial Sequence
  chemically synthesized
tggctgctgtattaagattaga

SEQ ID NO: 885266 - DNA, 22 bp, Artificial Sequence
  chemically synthesized
tgcattcttaaagtctaatctt

SEQ ID NO: 885267 - DNA, 22 bp, Artificial Sequence
  chemically synthesized
gctgctgtattaagattagact

SEQ ID NO: 885268 - DNA, 22 bp, Artificial Sequence
  chemically synthesized
tctgcattcttaaagtctaatc

SEQ ID NO: 885269 - DNA, 22 bp, Artificial Sequence
  chemically synthesized
ctgtattaagattagactttaa

SEQ ID NO: 885270 - DNA, 22 bp, Artificial Sequence
  chemically synthesized
ttctctgcattcttaaagtcta

SEQ ID NO: 885271 - DNA, 22 bp, Artificial Sequence
  chemically synthesized
tattaagattagactttaagaa

SEQ ID NO: 885272 - DNA, 22 bp, Artificial Sequence
  chemically synthesized
ccatctgttctctgcattctta

SEQ ID NO: 885273 - DNA, 22 bp, Artificial Sequence
  chemically synthesized
agattagactttaagaatgcag

SEQ ID NO: 885274 - DNA, 22 bp, Artificial Sequence
  chemically synthesized
actgccatctgttctctgcatt

SEQ ID NO: 885275 - DNA, 22 bp, Artificial Sequence
  chemically synthesized
aactgccatctgttctctgcat

SEQ ID NO: 885276 - DNA, 22 bp, Artificial Sequence
  chemically synthesized
gactttaagaatgcagagaaca

SEQ ID NO: 885277 - DNA, 22 bp, Artificial Sequence
  chemically synthesized
ttaactgccatctgttctctgc

SEQ ID NO: 885278 - DNA, 22 bp, Artificial Sequence
  chemically synthesized
ttcttaactgccatctgttctc

SEQ ID NO: 885279 - DNA, 22 bp, Artificial Sequence
  chemically synthesized
taagaatgcagagaacagatgg

SEQ ID NO: 885280 - DNA, 22 bp, Artificial Sequence
  chemically synthesized
aagaatgcagagaacagatggc

SEQ ID NO: 885281 - DNA, 22 bp, Artificial Sequence
  chemically synthesized
agaatgcagagaacagatggca

SEQ ID NO: 885282 - DNA, 22 bp, Artificial Sequence
  chemically synthesized
agaatctgttcttaactgccat

SEQ ID NO: 885283 - DNA, 22 bp, Artificial Sequence
  chemically synthesized
aagaatctgttcttaactgcca

SEQ ID NO: 885284 - DNA, 22 bp, Artificial Sequence
  chemically synthesized
tacccccttaagaatctgttct

SEQ ID NO: 885285 - DNA, 22 bp, Artificial Sequence
  chemically synthesized
agaacagattcttaagggggta

SEQ ID NO: 885286 - DNA, 22 bp, Artificial Sequence
  chemically synthesized
catccaaacaatgcagattgta

SEQ ID NO: 885287 - DNA, 22 bp, Artificial Sequence
  chemically synthesized
ccatccaaacaatgcagattgt

SEQ ID NO: 885288 - DNA, 22 bp, Artificial Sequence
  chemically synthesized
ttaagggggtacaatctgcatt

SEQ ID NO: 885289 - DNA, 22 bp, Artificial Sequence
  chemically synthesized
aagggggtacaatctgcattgt

SEQ ID NO: 885290 - DNA, 22 bp, Artificial Sequence
  chemically synthesized
agggggtacaatctgcattgtt

SEQ ID NO: 885291 - DNA, 22 bp, Artificial Sequence
  chemically synthesized
acaaagtccttccatccaaaca

SEQ ID NO: 885292 - DNA, 22 bp, Artificial Sequence
  chemically synthesized
cacaaagtccttccatccaaac

SEQ ID NO: 885293 - DNA, 22 bp, Artificial Sequence
  chemically synthesized
tcacaaagtccttccatccaaa

SEQ ID NO: 885294 - DNA, 22 bp, Artificial Sequence
  chemically synthesized
aggttttcacaaagtccttcca

SEQ ID NO: 885295 - DNA, 22 bp, Artificial Sequence
  chemically synthesized
cattgtttggatggaaggactt

SEQ ID NO: 885296 - DNA, 22 bp, Artificial Sequence
  chemically synthesized
caggttttcacaaagtccttcc

SEQ ID NO: 885297 - DNA, 22 bp, Artificial Sequence
  chemically synthesized
tttggatggaaggactttgtga

SEQ ID NO: 885298 - DNA, 22 bp, Artificial Sequence
  chemically synthesized
ggatggaaggactttgtgaaaa

SEQ ID NO: 885299 - DNA, 22 bp, Artificial Sequence
  chemically synthesized
gatggaaggactttgtgaaaac

SEQ ID NO: 885300 - DNA, 22 bp, Artificial Sequence
  chemically synthesized
caaaataatggcttcaggtttt

SEQ ID NO: 885301 - DNA, 22 bp, Artificial Sequence
  chemically synthesized
ccaaaataatggcttcaggttt

SEQ ID NO: 885302 - DNA, 22 bp, Artificial Sequence
  chemically synthesized
tccaaaataatggcttcaggtt

SEQ ID NO: 885303 - DNA, 22 bp, Artificial Sequence
  chemically synthesized
tgtgaaaacctgaagccattat

SEQ ID NO: 885304 - DNA, 22 bp, Artificial Sequence
  chemically synthesized
gtgaaaacctgaagccattatt

SEQ ID NO: 885305 - DNA, 22 bp, Artificial Sequence
  chemically synthesized
tgaaaacctgaagccattattt

SEQ ID NO: 885306 - DNA, 22 bp, Artificial Sequence
  chemically synthesized
tatgtataaagttttccaaaat

SEQ ID NO: 885307 - DNA, 22 bp, Artificial Sequence
  chemically synthesized
aagccattattttggaaaactt

SEQ ID NO: 885308 - DNA, 22 bp, Artificial Sequence
  chemically synthesized
agaactgtatgtataaagtttt

SEQ ID NO: 885309 - DNA, 22 bp, Artificial Sequence
  chemically synthesized
gttaagaactgtatgtataaag

SEQ ID NO: 885310 - DNA, 22 bp, Artificial Sequence
  chemically synthesized
agttaagaactgtatgtataaa

SEQ ID NO: 885311 - DNA, 22 bp, Artificial Sequence
  chemically synthesized
ttttggaaaactttatacatac

SEQ ID NO: 885312 - DNA, 22 bp, Artificial Sequence
  chemically synthesized
tggaaaactttatacatacagt

SEQ ID NO: 885313 - DNA, 22 bp, Artificial Sequence
  chemically synthesized
ggaaaactttatacatacagtt

SEQ ID NO: 885314 - DNA, 22 bp, Artificial Sequence
  chemically synthesized
gaaaactttatacatacagttc

SEQ ID NO: 885315 - DNA, 22 bp, Artificial Sequence
  chemically synthesized
gcccttagttaagaactgtatg

SEQ ID NO: 885316 - DNA, 22 bp, Artificial Sequence
  chemically synthesized
ggcccttagttaagaactgtat

SEQ ID NO: 885317 - DNA, 22 bp, Artificial Sequence
  chemically synthesized
tggcccttagttaagaactgta

SEQ ID NO: 885318 - DNA, 22 bp, Artificial Sequence
  chemically synthesized
tatacatacagttcttaactaa

SEQ ID NO: 885319 - DNA, 22 bp, Artificial Sequence
  chemically synthesized
atacatacagttcttaactaag

SEQ ID NO: 885320 - DNA, 22 bp, Artificial Sequence
  chemically synthesized
tacatacagttcttaactaagg

SEQ ID NO: 885321 - DNA, 22 bp, Artificial Sequence
  chemically synthesized
aaccagaccagagctttggccc

SEQ ID NO: 885322 - DNA, 22 bp, Artificial Sequence
  chemically synthesized
ttaaaccagaccagagctttgg

SEQ ID NO: 885323 - DNA, 22 bp, Artificial Sequence
  chemically synthesized
ttaactaagggccaaagctctg

SEQ ID NO: 885324 - DNA, 22 bp, Artificial Sequence
  chemically synthesized
aactaagggccaaagctctggt

SEQ ID NO: 885325 - DNA, 22 bp, Artificial Sequence
  chemically synthesized
ctattaaaccagaccagagctt

SEQ ID NO: 885326 - DNA, 22 bp, Artificial Sequence
  chemically synthesized
actaagggccaaagctctggtc

SEQ ID NO: 885327 - DNA, 22 bp, Artificial Sequence
  chemically synthesized
agggccaaagctctggtctggt

SEQ ID NO: 885328 - DNA, 22 bp, Artificial Sequence
  chemically synthesized
tgctgctattaaaccagaccag

SEQ ID NO: 885329 - DNA, 22 bp, Artificial Sequence
  chemically synthesized
agcagtgtcctgtgctgctatt

SEQ ID NO: 885330 - DNA, 22 bp, Artificial Sequence
  chemically synthesized
tggtctggtttaatagcagcac

SEQ ID NO: 885331 - DNA, 22 bp, Artificial Sequence
  chemically synthesized
taagcagtgtcctgtgctgcta

SEQ ID NO: 885332 - DNA, 22 bp, Artificial Sequence
  chemically synthesized
gtctggtttaatagcagcacag

SEQ ID NO: 885333 - DNA, 22 bp, Artificial Sequence
  chemically synthesized
ctaagcagtgtcctgtgctgct

SEQ ID NO: 885334 - DNA, 22 bp, Artificial Sequence
  chemically synthesized
ttctaagcagtgtcctgtgctg

SEQ ID NO: 885335 - DNA, 22 bp, Artificial Sequence
  chemically synthesized
gtttaatagcagcacaggacac

SEQ ID NO: 885336 - DNA, 22 bp, Artificial Sequence
  chemically synthesized
aatagcagcacaggacactgct

SEQ ID NO: 885337 - DNA, 22 bp, Artificial Sequence
  chemically synthesized
atagcagcacaggacactgctt

SEQ ID NO: 885338 - DNA, 22 bp, Artificial Sequence
  chemically synthesized
aatgaatgttcttctaagcagt

SEQ ID NO: 885339 - DNA, 22 bp, Artificial Sequence
  chemically synthesized
aaatgaatgttcttctaagcag

SEQ ID NO: 885340 - DNA, 22 bp, Artificial Sequence
  chemically synthesized
ggagtaccagtttaaatgaatg

SEQ ID NO: 885341 - DNA, 22 bp, Artificial Sequence
  chemically synthesized
cttagaagaacattcatttaaa

SEQ ID NO: 885342 - DNA, 22 bp, Artificial Sequence
  chemically synthesized
agaagaacattcatttaaactg

SEQ ID NO: 885343 - DNA, 22 bp, Artificial Sequence
  chemically synthesized
gaagaacattcatttaaactgg

SEQ ID NO: 885344 - DNA, 22 bp, Artificial Sequence
  chemically synthesized
atttaaactggtactcccaggt

SEQ ID NO: 885345 - DNA, 22 bp, Artificial Sequence
  chemically synthesized
ggaaggcagcaagacctgggag

SEQ ID NO: 885346 - DNA, 22 bp, Artificial Sequence
  chemically synthesized
aggaaggcagcaagacctggga

SEQ ID NO: 885347 - DNA, 22 bp, Artificial Sequence
  chemically synthesized
aaactggtactcccaggtcttg

SEQ ID NO: 885348 - DNA, 22 bp, Artificial Sequence
  chemically synthesized
aactggtactcccaggtcttgc

SEQ ID NO: 885349 - DNA, 22 bp, Artificial Sequence
  chemically synthesized
gtactcccaggtcttgctgcct

SEQ ID NO: 885350 - DNA, 22 bp, Artificial Sequence
  chemically synthesized
ccaggtcttgctgccttcctaa

SEQ ID NO: 885351 - DNA, 22 bp, Artificial Sequence
  chemically synthesized
accagtaaggacttaggaaggc

SEQ ID NO: 885352 - DNA, 22 bp, Artificial Sequence
  chemically synthesized
caccagtaaggacttaggaagg

SEQ ID NO: 885353 - DNA, 22 bp, Artificial Sequence
  chemically synthesized
ttcaccagtaaggacttaggaa

SEQ ID NO: 885354 - DNA, 22 bp, Artificial Sequence
  chemically synthesized
gctgccttcctaagtccttact

SEQ ID NO: 885355 - DNA, 22 bp, Artificial Sequence
  chemically synthesized
ctgccttcctaagtccttactg

SEQ ID NO: 885356 - DNA, 22 bp, Artificial Sequence
  chemically synthesized
ccttcctaagtccttactggtg

SEQ ID NO: 885357 - DNA, 22 bp, Artificial Sequence
  chemically synthesized
cctaagtccttactggtgaaga

SEQ ID NO: 885358 - DNA, 22 bp, Artificial Sequence
  chemically synthesized
aagagcccatactcttcaccag

SEQ ID NO: 885359 - DNA, 22 bp, Artificial Sequence
  chemically synthesized
ctaagtccttactggtgaagag

SEQ ID NO: 885360 - DNA, 22 bp, Artificial Sequence
  chemically synthesized
agtccttactggtgaagagtat

SEQ ID NO: 885361 - DNA, 22 bp, Artificial Sequence
  chemically synthesized
actggtgaagagtatgggctct

SEQ ID NO: 885362 - DNA, 22 bp, Artificial Sequence
  chemically synthesized
ctggtgaagagtatgggctctt

SEQ ID NO: 885363 - DNA, 22 bp, Artificial Sequence
  chemically synthesized
gataaccagactcaagagccca

SEQ ID NO: 885364 - DNA, 22 bp, Artificial Sequence
  chemically synthesized
gtgaagagtatgggctcttgag

SEQ ID NO: 885365 - DNA, 22 bp, Artificial Sequence
  chemically synthesized
gaacctagataaccagactcaa

SEQ ID NO: 885366 - DNA, 22 bp, Artificial Sequence
  chemically synthesized
ggattggaacctagataaccag

SEQ ID NO: 885367 - DNA, 22 bp, Artificial Sequence
  chemically synthesized
ttgagtctggttatctaggttc

SEQ ID NO: 885368 - DNA, 22 bp, Artificial Sequence
  chemically synthesized
atgctaggattggaacctagat

SEQ ID NO: 885369 - DNA, 22 bp, Artificial Sequence
  chemically synthesized
gagtctggttatctaggttcca

SEQ ID NO: 885370 - DNA, 22 bp, Artificial Sequence
  chemically synthesized
agtctggttatctaggttccaa

SEQ ID NO: 885371 - DNA, 22 bp, Artificial Sequence
  chemically synthesized
gttatctaggttccaatcctag

SEQ ID NO: 885372 - DNA, 22 bp, Artificial Sequence
  chemically synthesized
tctaggttccaatcctagcatg

SEQ ID NO: 885373 - DNA, 22 bp, Artificial Sequence
  chemically synthesized
gaaatagtcaattcatgctagg

SEQ ID NO: 885374 - DNA, 22 bp, Artificial Sequence
  chemically synthesized
ggttccaatcctagcatgaatt

SEQ ID NO: 885375 - DNA, 22 bp, Artificial Sequence
  chemically synthesized
ttggaaatagtcaattcatgct

SEQ ID NO: 885376 - DNA, 22 bp, Artificial Sequence
  chemically synthesized
tgttggaaatagtcaattcatg

SEQ ID NO: 885377 - DNA, 22 bp, Artificial Sequence
  chemically synthesized
caatcctagcatgaattgacta

SEQ ID NO: 885378 - DNA, 22 bp, Artificial Sequence
  chemically synthesized
gtctctgttggaaatagtcaat

SEQ ID NO: 885379 - DNA, 22 bp, Artificial Sequence
  chemically synthesized
ggtctctgttggaaatagtcaa

SEQ ID NO: 885380 - DNA, 22 bp, Artificial Sequence
  chemically synthesized
gcatgaattgactatttccaac

SEQ ID NO: 885381 - DNA, 22 bp, Artificial Sequence
  chemically synthesized
atgggccatttggtctctgttg

SEQ ID NO: 885382 - DNA, 22 bp, Artificial Sequence
  chemically synthesized
catgggccatttggtctctgtt

SEQ ID NO: 885383 - DNA, 22 bp, Artificial Sequence
  chemically synthesized
actatttccaacagagaccaaa

SEQ ID NO: 885384 - DNA, 22 bp, Artificial Sequence
  chemically synthesized
aggcttcatgggccatttggtc

SEQ ID NO: 885385 - DNA, 22 bp, Artificial Sequence
  chemically synthesized
tttccaacagagaccaaatggc

SEQ ID NO: 885386 - DNA, 22 bp, Artificial Sequence
  chemically synthesized
gaggcttcatgggccatttggt

SEQ ID NO: 885387 - DNA, 22 bp, Artificial Sequence
  chemically synthesized
tgaggcttcatgggccatttgg

SEQ ID NO: 885388 - DNA, 22 bp, Artificial Sequence
  chemically synthesized
ttgaggcttcatgggccatttg

SEQ ID NO: 885389 - DNA, 22 bp, Artificial Sequence
  chemically synthesized
ccaacagagaccaaatggccca

SEQ ID NO: 885390 - DNA, 22 bp, Artificial Sequence
  chemically synthesized
caacagagaccaaatggcccat

SEQ ID NO: 885391 - DNA, 22 bp, Artificial Sequence
  chemically synthesized
agtcagtttttgaggcttcatg

SEQ ID NO: 885392 - DNA, 22 bp, Artificial Sequence
  chemically synthesized
cagtcagtttttgaggcttcat

SEQ ID NO: 885393 - DNA, 22 bp, Artificial Sequence
  chemically synthesized
aaaggccaaatagaaaaatttc

SEQ ID NO: 885394 - DNA, 22 bp, Artificial Sequence
  chemically synthesized
aaaaactgactgaaatttttct

SEQ ID NO: 885395 - DNA, 22 bp, Artificial Sequence
  chemically synthesized
aaaaggccaaatagaaaaattt

SEQ ID NO: 885396 - DNA, 22 bp, Artificial Sequence
  chemically synthesized
taaaaggccaaatagaaaaatt

SEQ ID NO: 885397 - DNA, 22 bp, Artificial Sequence
  chemically synthesized
tttaaaaggccaaatagaaaaa

SEQ ID NO: 885398 - DNA, 22 bp, Artificial Sequence
  chemically synthesized
ctttaaaaggccaaatagaaaa

SEQ ID NO: 885399 - DNA, 22 bp, Artificial Sequence
  chemically synthesized
tctttaaaaggccaaatagaaa

SEQ ID NO: 885400 - DNA, 22 bp, Artificial Sequence
  chemically synthesized
ttctttaaaaggccaaatagaa

SEQ ID NO: 885401 - DNA, 22 bp, Artificial Sequence
  chemically synthesized
tttctttaaaaggccaaataga

SEQ ID NO: 885402 - DNA, 22 bp, Artificial Sequence
  chemically synthesized
actgaaatttttctatttggcc

SEQ ID NO: 885403 - DNA, 22 bp, Artificial Sequence
  chemically synthesized
ttttctttaaaaggccaaatag

SEQ ID NO: 885404 - DNA, 22 bp, Artificial Sequence
  chemically synthesized
aaatttttctatttggcctttt

SEQ ID NO: 885405 - DNA, 22 bp, Artificial Sequence
  chemically synthesized
gccaacttttttctttaaaagg

SEQ ID NO: 885406 - DNA, 22 bp, Artificial Sequence
  chemically synthesized
ttctatttggccttttaaagaa

SEQ ID NO: 885407 - DNA, 22 bp, Artificial Sequence
  chemically synthesized
tctatttggccttttaaagaaa

SEQ ID NO: 885408 - DNA, 22 bp, Artificial Sequence
  chemically synthesized
ctatttggccttttaaagaaaa

SEQ ID NO: 885409 - DNA, 22 bp, Artificial Sequence
  chemically synthesized
tatttggccttttaaagaaaaa

SEQ ID NO: 885410 - DNA, 22 bp, Artificial Sequence
  chemically synthesized
tttggccttttaaagaaaaaag

SEQ ID NO: 885411 - DNA, 22 bp, Artificial Sequence
  chemically synthesized
ggccttttaaagaaaaaagttg

SEQ ID NO: 885412 - DNA, 22 bp, Artificial Sequence
  chemically synthesized
gccttttaaagaaaaaagttgg

SEQ ID NO: 885413 - DNA, 22 bp, Artificial Sequence
  chemically synthesized
catcagtgttggccaacttttt

SEQ ID NO: 885414 - DNA, 22 bp, Artificial Sequence
  chemically synthesized
tacatcagtgttggccaacttt

SEQ ID NO: 885415 - DNA, 22 bp, Artificial Sequence
  chemically synthesized
tctacatcagtgttggccaact

SEQ ID NO: 885416 - DNA, 22 bp, Artificial Sequence
  chemically synthesized
ttaaagaaaaaagttggccaac

SEQ ID NO: 885417 - DNA, 22 bp, Artificial Sequence
  chemically synthesized
ctctacatcagtgttggccaac

SEQ ID NO: 885418 - DNA, 22 bp, Artificial Sequence
  chemically synthesized
taaagaaaaaagttggccaaca

SEQ ID NO: 885419 - DNA, 22 bp, Artificial Sequence
  chemically synthesized
aaagaaaaaagttggccaacac

SEQ ID NO: 885420 - DNA, 22 bp, Artificial Sequence
  chemically synthesized
aagaaaaaagttggccaacact

SEQ ID NO: 885421 - DNA, 22 bp, Artificial Sequence
  chemically synthesized
accgtttctctacatcagtgtt

SEQ ID NO: 885422 - DNA, 22 bp, Artificial Sequence
  chemically synthesized
aacctaaccgtttctctacatc

SEQ ID NO: 885423 - DNA, 22 bp, Artificial Sequence
  chemically synthesized
gccaacactgatgtagagaaac

SEQ ID NO: 885424 - DNA, 22 bp, Artificial Sequence
  chemically synthesized
atgtagagaaacggttaggttc

SEQ ID NO: 885425 - DNA, 22 bp, Artificial Sequence
  chemically synthesized
gagccacagagcctgaacctaa

SEQ ID NO: 885426 - DNA, 22 bp, Artificial Sequence
  chemically synthesized
agagccacagagcctgaaccta

SEQ ID NO: 885427 - DNA, 22 bp, Artificial Sequence
  chemically synthesized
tagagccacagagcctgaacct

SEQ ID NO: 885428 - DNA, 22 bp, Artificial Sequence
  chemically synthesized
aaggattttagagccacagagc

SEQ ID NO: 885429 - DNA, 22 bp, Artificial Sequence
  chemically synthesized
gaaggattttagagccacagag

SEQ ID NO: 885430 - DNA, 22 bp, Artificial Sequence
  chemically synthesized
ggttcaggctctgtggctctaa

SEQ ID NO: 885431 - DNA, 22 bp, Artificial Sequence
  chemically synthesized
aggctctgtggctctaaaatcc

SEQ ID NO: 885432 - DNA, 22 bp, Artificial Sequence
  chemically synthesized
tgcatacttgaaggattttaga

SEQ ID NO: 885433 - DNA, 22 bp, Artificial Sequence
  chemically synthesized
tgtggctctaaaatccttcaag

SEQ ID NO: 885434 - DNA, 22 bp, Artificial Sequence
  chemically synthesized
tggctctaaaatccttcaagta

SEQ ID NO: 885435 - DNA, 22 bp, Artificial Sequence
  chemically synthesized
tggaataattatgcatacttga

SEQ ID NO: 885436 - DNA, 22 bp, Artificial Sequence
  chemically synthesized
taaaatccttcaagtatgcata

SEQ ID NO: 885437 - DNA, 22 bp, Artificial Sequence
  chemically synthesized
aaatccttcaagtatgcataat

SEQ ID NO: 885438 - DNA, 22 bp, Artificial Sequence
  chemically synthesized
cattgtggaataattatgcata

SEQ ID NO: 885439 - DNA, 22 bp, Artificial Sequence
  chemically synthesized
acattgtggaataattatgcat

SEQ ID NO: 885440 - DNA, 22 bp, Artificial Sequence
  chemically synthesized
caagtatgcataattattccac

SEQ ID NO: 885441 - DNA, 22 bp, Artificial Sequence
  chemically synthesized
aagtatgcataattattccaca

SEQ ID NO: 885442 - DNA, 22 bp, Artificial Sequence
  chemically synthesized
atatatgtttacattgtggaat

SEQ ID NO: 885443 - DNA, 22 bp, Artificial Sequence
  chemically synthesized
gatatatgtttacattgtggaa

SEQ ID NO: 885444 - DNA, 22 bp, Artificial Sequence
  chemically synthesized
tgatatatgtttacattgtgga

SEQ ID NO: 885445 - DNA, 22 bp, Artificial Sequence
  chemically synthesized
ttccacaatgtaaacatatatc

SEQ ID NO: 885446 - DNA, 22 bp, Artificial Sequence
  chemically synthesized
cacaatgtaaacatatatcaaa

SEQ ID NO: 885447 - DNA, 22 bp, Artificial Sequence
  chemically synthesized
tgaggtacaatgtgatgttttg

SEQ ID NO: 885448 - DNA, 22 bp, Artificial Sequence
  chemically synthesized
atgaggtacaatgtgatgtttt

SEQ ID NO: 885449 - DNA, 22 bp, Artificial Sequence
  chemically synthesized
acaaataataagtacatatatt

SEQ ID NO: 885450 - DNA, 22 bp, Artificial Sequence
  chemically synthesized
tacctcataaatatatgtactt

SEQ ID NO: 885451 - DNA, 22 bp, Artificial Sequence
  chemically synthesized
attgacaaataataagtacata

SEQ ID NO: 885452 - DNA, 22 bp, Artificial Sequence
  chemically synthesized
aattgacaaataataagtacat

SEQ ID NO: 885453 - DNA, 22 bp, Artificial Sequence
  chemically synthesized
taattgacaaataataagtaca

SEQ ID NO: 885454 - DNA, 22 bp, Artificial Sequence
  chemically synthesized
ataaatatatgtacttattatt

SEQ ID NO: 885455 - DNA, 22 bp, Artificial Sequence
  chemically synthesized
ttttaattgacaaataataagt

SEQ ID NO: 885456 - DNA, 22 bp, Artificial Sequence
  chemically synthesized
attttaattgacaaataataag

SEQ ID NO: 885457 - DNA, 22 bp, Artificial Sequence
  chemically synthesized
tattttaattgacaaataataa

SEQ ID NO: 885458 - DNA, 22 bp, Artificial Sequence
  chemically synthesized
ttttattttaattgacaaataa

SEQ ID NO: 885459 - DNA, 22 bp, Artificial Sequence
  chemically synthesized
attttattttaattgacaaata

SEQ ID NO: 885460 - DNA, 22 bp, Artificial Sequence
  chemically synthesized
tattttattttaattgacaaat

SEQ ID NO: 885461 - DNA, 22 bp, Artificial Sequence
  chemically synthesized
ttattttattttaattgacaaa

SEQ ID NO: 885462 - DNA, 22 bp, Artificial Sequence
  chemically synthesized
tttattttattttaattgacaa

SEQ ID NO: 885463 - DNA, 22 bp, Artificial Sequence
  chemically synthesized
tattttttattttattttaatt

SEQ ID NO: 885464 - DNA, 22 bp, Artificial Sequence
  chemically synthesized
attatttgtcaattaaaataaa

SEQ ID NO: 885465 - DNA, 22 bp, Artificial Sequence
  chemically synthesized
ttatttgtcaattaaaataaaa

SEQ ID NO: 885466 - DNA, 22 bp, Artificial Sequence
  chemically synthesized
tttgtcaattaaaataaaataa

SEQ ID NO: 885467 - DNA, 22 bp, Artificial Sequence
  chemically synthesized
gtcaattaaaataaaataaaaa

SEQ ID NO: 885468 - DNA, 22 bp, Artificial Sequence
  chemically synthesized
tcaattaaaataaaataaaaaa

SEQ ID NO: 885469 - DNA, 22 bp, Artificial Sequence
  chemically synthesized
aaaatacccctgtattttttat

SEQ ID NO: 885470 - DNA, 22 bp, Artificial Sequence
  chemically synthesized
ttaaaaatacccctgtattttt

SEQ ID NO: 885471 - DNA, 22 bp, Artificial Sequence
  chemically synthesized
aaataaaataaaaaatacaggg

SEQ ID NO: 885472 - DNA, 22 bp, Artificial Sequence
  chemically synthesized
attattaaaaatacccctgtat

SEQ ID NO: 885473 - DNA, 22 bp, Artificial Sequence
  chemically synthesized
gattattaaaaatacccctgta

SEQ ID NO: 885474 - DNA, 22 bp, Artificial Sequence
  chemically synthesized
atgtttgattattaaaaatacc

SEQ ID NO: 885475 - DNA, 22 bp, Artificial Sequence
  chemically synthesized
taatgtttgattattaaaaata

SEQ ID NO: 885476 - DNA, 22 bp, Artificial Sequence
  chemically synthesized
ctaatgtttgattattaaaaat

SEQ ID NO: 885477 - DNA, 22 bp, Artificial Sequence
  chemically synthesized
tttctaatgtttgattattaaa

SEQ ID NO: 885478 - DNA, 22 bp, Artificial Sequence
  chemically synthesized
gtttctaatgtttgattattaa

SEQ ID NO: 885479 - DNA, 22 bp, Artificial Sequence
  chemically synthesized
ttaataatcaaacattagaaac

SEQ ID NO: 885480 - DNA, 22 bp, Artificial Sequence
  chemically synthesized
taataatcaaacattagaaaca

SEQ ID NO: 885481 - DNA, 22 bp, Artificial Sequence
  chemically synthesized
tagaaaagcatttgtttctaat

SEQ ID NO: 885482 - DNA, 22 bp, Artificial Sequence
  chemically synthesized
aataatcaaacattagaaacaa

SEQ ID NO: 885483 - DNA, 22 bp, Artificial Sequence
  chemically synthesized
atagaaaagcatttgtttctaa

SEQ ID NO: 885484 - DNA, 22 bp, Artificial Sequence
  chemically synthesized
ataatcaaacattagaaacaaa

SEQ ID NO: 885485 - DNA, 22 bp, Artificial Sequence
  chemically synthesized
tataaggagtttatagaaaagc

SEQ ID NO: 885486 - DNA, 22 bp, Artificial Sequence
  chemically synthesized
gaaacaaatgcttttctataaa

SEQ ID NO: 885487 - DNA, 22 bp, Artificial Sequence
  chemically synthesized
tgagtctatataaggagtttat

SEQ ID NO: 885488 - DNA, 22 bp, Artificial Sequence
  chemically synthesized
tatgagtctatataaggagttt

SEQ ID NO: 885489 - DNA, 22 bp, Artificial Sequence
  chemically synthesized
ctatgagtctatataaggagtt

SEQ ID NO: 885490 - DNA, 22 bp, Artificial Sequence
  chemically synthesized
tctatgagtctatataaggagt

SEQ ID NO: 885491 - DNA, 22 bp, Artificial Sequence
  chemically synthesized
tttctatgagtctatataagga

SEQ ID NO: 885492 - DNA, 22 bp, Artificial Sequence
  chemically synthesized
ttctataaactccttatataga

SEQ ID NO: 885493 - DNA, 22 bp, Artificial Sequence
  chemically synthesized
tctataaactccttatatagac

SEQ ID NO: 885494 - DNA, 22 bp, Artificial Sequence
  chemically synthesized
ctataaactccttatatagact

SEQ ID NO: 885495 - DNA, 22 bp, Artificial Sequence
  chemically synthesized
actctttctatgagtctatata

SEQ ID NO: 885496 - DNA, 22 bp, Artificial Sequence
  chemically synthesized
tataaactccttatatagactc

SEQ ID NO: 885497 - DNA, 22 bp, Artificial Sequence
  chemically synthesized
aactctttctatgagtctatat

SEQ ID NO: 885498 - DNA, 22 bp, Artificial Sequence
  chemically synthesized
taaactccttatatagactcat

SEQ ID NO: 885499 - DNA, 22 bp, Artificial Sequence
  chemically synthesized
tttaactctttctatgagtcta

SEQ ID NO: 885500 - DNA, 22 bp, Artificial Sequence
  chemically synthesized
cttatatagactcatagaaaga

SEQ ID NO: 885501 - DNA, 22 bp, Artificial Sequence
  chemically synthesized
taaattgtttaactctttctat

SEQ ID NO: 885502 - DNA, 22 bp, Artificial Sequence
  chemically synthesized
atatagactcatagaaagagtt

SEQ ID NO: 885503 - DNA, 22 bp, Artificial Sequence
  chemically synthesized
tatagactcatagaaagagtta

SEQ ID NO: 885504 - DNA, 22 bp, Artificial Sequence
  chemically synthesized
attataaattgtttaactcttt

SEQ ID NO: 885505 - DNA, 22 bp, Artificial Sequence
  chemically synthesized
taattataaattgtttaactct

SEQ ID NO: 885506 - DNA, 22 bp, Artificial Sequence
  chemically synthesized
atagaaagagttaaacaattta

SEQ ID NO: 885507 - DNA, 22 bp, Artificial Sequence
  chemically synthesized
aacaatttataattagaattta

SEQ ID NO: 885508 - DNA, 22 bp, Artificial Sequence
  chemically synthesized
ataattagaatttatttgttta

SEQ ID NO: 885509 - DNA, 22 bp, Artificial Sequence
  chemically synthesized
taattagaatttatttgtttat

SEQ ID NO: 885510 - DNA, 22 bp, Artificial Sequence
  chemically synthesized
gaatttatttgtttatttattt

SEQ ID NO: 885511 - DNA, 22 bp, Artificial Sequence
  chemically synthesized
tgtcaaaatagtaaataaataa

SEQ ID NO: 885512 - DNA, 22 bp, Artificial Sequence
  chemically synthesized
atttgtttatttatttactatt

SEQ ID NO: 885513 - DNA, 22 bp, Artificial Sequence
  chemically synthesized
tttgtttatttatttactattt

SEQ ID NO: 885514 - DNA, 22 bp, Artificial Sequence
  chemically synthesized
gtttatttatttactattttga

SEQ ID NO: 885515 - DNA, 22 bp, Artificial Sequence
  chemically synthesized
tttatttatttactattttgac

SEQ ID NO: 885516 - DNA, 22 bp, Artificial Sequence
  chemically synthesized
atttatttactattttgacaca

SEQ ID NO: 885517 - DNA, 22 bp, Artificial Sequence
  chemically synthesized
tttatttactattttgacacag

SEQ ID NO: 885518 - DNA, 22 bp, Artificial Sequence
  chemically synthesized
atttactattttgacacagtct

SEQ ID NO: 885519 - DNA, 22 bp, Artificial Sequence
  chemically synthesized
ggcgacagagcgagactgtgtc

SEQ ID NO: 885520 - DNA, 22 bp, Artificial Sequence
  chemically synthesized
tttactattttgacacagtctc

SEQ ID NO: 885521 - DNA, 22 bp, Artificial Sequence
  chemically synthesized
actattttgacacagtctcgct

SEQ ID NO: 885522 - DNA, 22 bp, Artificial Sequence
  chemically synthesized
ctattttgacacagtctcgctc

SEQ ID NO: 885523 - DNA, 22 bp, Artificial Sequence
  chemically synthesized
cagcctgggcgacagagcgaga

SEQ ID NO: 885524 - DNA, 22 bp, Artificial Sequence
  chemically synthesized
ttttgacacagtctcgctctgt

SEQ ID NO: 885525 - DNA, 22 bp, Artificial Sequence
  chemically synthesized
tgacacagtctcgctctgtcgc

SEQ ID NO: 885526 - DNA, 22 bp, Artificial Sequence
  chemically synthesized
gacacagtctcgctctgtcgcc

SEQ ID NO: 885527 - DNA, 22 bp, Artificial Sequence
  chemically synthesized
cactccagcctgggcgacagag

SEQ ID NO: 885528 - DNA, 22 bp, Artificial Sequence
  chemically synthesized
acacagtctcgctctgtcgccc

SEQ ID NO: 885529 - DNA, 22 bp, Artificial Sequence
  chemically synthesized
gctctgtcgcccaggctggagt

SEQ ID NO: 885530 - DNA, 22 bp, Artificial Sequence
  chemically synthesized
tgtcgcccaggctggagtgcag

SEQ ID NO: 885531 - DNA, 22 bp, Artificial Sequence
  chemically synthesized
tcgcccaggctggagtgcagtg

SEQ ID NO: 885532 - DNA, 22 bp, Artificial Sequence
  chemically synthesized
cagtgagccgagatcatgccac

SEQ ID NO: 885533 - DNA, 22 bp, Artificial Sequence
  chemically synthesized
gagtgcagtggcatgatctcgg

SEQ ID NO: 885534 - DNA, 22 bp, Artificial Sequence
  chemically synthesized
gggaggcagaggttgcagtgag

SEQ ID NO: 885535 - DNA, 22 bp, Artificial Sequence
  chemically synthesized
agctggggaggcagaggttgca

SEQ ID NO: 885536 - DNA, 22 bp, Artificial Sequence
  chemically synthesized
gagctggggaggcagaggttgc

SEQ ID NO: 885537 - DNA, 22 bp, Artificial Sequence
  chemically synthesized
ggctcactgcaacctctgcctc

SEQ ID NO: 885538 - DNA, 22 bp, Artificial Sequence
  chemically synthesized
actgcaacctctgcctccccag

SEQ ID NO: 885539 - DNA, 22 bp, Artificial Sequence
  chemically synthesized
caacctctgcctccccagctca

SEQ ID NO: 885540 - DNA, 22 bp, Artificial Sequence
  chemically synthesized
aggcacaagaaccgcttgagct

SEQ ID NO: 885541 - DNA, 22 bp, Artificial Sequence
  chemically synthesized
tgcctccccagctcaagcggtt

SEQ ID NO: 885542 - DNA, 22 bp, Artificial Sequence
  chemically synthesized
cctccccagctcaagcggttct

SEQ ID NO: 885543 - DNA, 22 bp, Artificial Sequence
  chemically synthesized
gaggctgaggcacaagaaccgc

SEQ ID NO: 885544 - DNA, 22 bp, Artificial Sequence
  chemically synthesized
cccagctcaagcggttcttgtg

SEQ ID NO: 885545 - DNA, 22 bp, Artificial Sequence
  chemically synthesized
tggaggctgaggcacaagaacc

SEQ ID NO: 885546 - DNA, 22 bp, Artificial Sequence
  chemically synthesized
ctctggaggctgaggcacaaga

SEQ ID NO: 885547 - DNA, 22 bp, Artificial Sequence
  chemically synthesized
aagcggttcttgtgcctcagcc

SEQ ID NO: 885548 - DNA, 22 bp, Artificial Sequence
  chemically synthesized
agctactctggaggctgaggca

SEQ ID NO: 885549 - DNA, 22 bp, Artificial Sequence
  chemically synthesized
taatctcagctactctggaggc

SEQ ID NO: 885550 - DNA, 22 bp, Artificial Sequence
  chemically synthesized
ttgtgcctcagcctccagagta

SEQ ID NO: 885551 - DNA, 22 bp, Artificial Sequence
  chemically synthesized
gtgcctcagcctccagagtagc

SEQ ID NO: 885552 - DNA, 22 bp, Artificial Sequence
  chemically synthesized
tgcctcagcctccagagtagct

SEQ ID NO: 885553 - DNA, 22 bp, Artificial Sequence
  chemically synthesized
agcctccagagtagctgagatt

SEQ ID NO: 885554 - DNA, 22 bp, Artificial Sequence
  chemically synthesized
gtggtgcatgcctgtaatctca

SEQ ID NO: 885555 - DNA, 22 bp, Artificial Sequence
  chemically synthesized
ggtggtgcatgcctgtaatctc

SEQ ID NO: 885556 - DNA, 22 bp, Artificial Sequence
  chemically synthesized
cagagtagctgagattacaggc

SEQ ID NO: 885557 - DNA, 22 bp, Artificial Sequence
  chemically synthesized
gccaggcttggtggtgcatgcc

SEQ ID NO: 885558 - DNA, 22 bp, Artificial Sequence
  chemically synthesized
agattacaggcatgcaccacca

SEQ ID NO: 885559 - DNA, 22 bp, Artificial Sequence
  chemically synthesized
caggcatgcaccaccaagcctg

SEQ ID NO: 885560 - DNA, 22 bp, Artificial Sequence
  chemically synthesized
aaaacacaaaaattagccaggc

SEQ ID NO: 885561 - DNA, 22 bp, Artificial Sequence
  chemically synthesized
tactaaaaacacaaaaattagc

SEQ ID NO: 885562 - DNA, 22 bp, Artificial Sequence
  chemically synthesized
gctaatttttgtgtttttagta

SEQ ID NO: 885563 - DNA, 22 bp, Artificial Sequence
  chemically synthesized
atttttgtgtttttagtacaga

SEQ ID NO: 885564 - DNA, 22 bp, Artificial Sequence
  chemically synthesized
ttgtgtttttagtacagacggg

SEQ ID NO: 885565 - DNA, 22 bp, Artificial Sequence
  chemically synthesized
tgtgtttttagtacagacgggg

SEQ ID NO: 885566 - DNA, 22 bp, Artificial Sequence
  chemically synthesized
gtgtttttagtacagacggggt

SEQ ID NO: 885567 - DNA, 22 bp, Artificial Sequence
  chemically synthesized
tgtttttagtacagacggggtt

SEQ ID NO: 885568 - DNA, 22 bp, Artificial Sequence
  chemically synthesized
gccaacatggcaaaaccccgtc

SEQ ID NO: 885569 - DNA, 22 bp, Artificial Sequence
  chemically synthesized
ttagtacagacggggttttgcc

SEQ ID NO: 885570 - DNA, 22 bp, Artificial Sequence
  chemically synthesized
tagtacagacggggttttgcca

SEQ ID NO: 885571 - DNA, 22 bp, Artificial Sequence
  chemically synthesized
agtacagacggggttttgccat

SEQ ID NO: 885572 - DNA, 22 bp, Artificial Sequence
  chemically synthesized
gtacagacggggttttgccatg

SEQ ID NO: 885573 - DNA, 22 bp, Artificial Sequence
  chemically synthesized
gagacgagcctggccaacatgg

SEQ ID NO: 885574 - DNA, 22 bp, Artificial Sequence
  chemically synthesized
tgccatgttggccaggctcgtc

SEQ ID NO: 885575 - DNA, 22 bp, Artificial Sequence
  chemically synthesized
gccatgttggccaggctcgtct

SEQ ID NO: 885576 - DNA, 22 bp, Artificial Sequence
  chemically synthesized
ccatgttggccaggctcgtctc

SEQ ID NO: 885577 - DNA, 22 bp, Artificial Sequence
  chemically synthesized
aggccaggagttcgagacgagc

SEQ ID NO: 885578 - DNA, 22 bp, Artificial Sequence
  chemically synthesized
gaggccaggagttcgagacgag

SEQ ID NO: 885579 - DNA, 22 bp, Artificial Sequence
  chemically synthesized
gccaggctcgtctcgaactcct

SEQ ID NO: 885580 - DNA, 22 bp, Artificial Sequence
  chemically synthesized
gtctcgaactcctggcctcaag

SEQ ID NO: 885581 - DNA, 22 bp, Artificial Sequence
  chemically synthesized
gaactcctggcctcaagtgatc

SEQ ID NO: 885582 - DNA, 22 bp, Artificial Sequence
  chemically synthesized
agaggccgaaatgggtggatca

SEQ ID NO: 885583 - DNA, 22 bp, Artificial Sequence
  chemically synthesized
ctggcctcaagtgatccaccca

SEQ ID NO: 885584 - DNA, 22 bp, Artificial Sequence
  chemically synthesized
gagaggccgaaatgggtggatc

SEQ ID NO: 885585 - DNA, 22 bp, Artificial Sequence
  chemically synthesized
tgagaggccgaaatgggtggat

SEQ ID NO: 885586 - DNA, 22 bp, Artificial Sequence
  chemically synthesized
gcctcaagtgatccacccattt

SEQ ID NO: 885587 - DNA, 22 bp, Artificial Sequence
  chemically synthesized
aagtgatccacccatttcggcc

SEQ ID NO: 885588 - DNA, 22 bp, Artificial Sequence
  chemically synthesized
taatcccagcactttgagaggc

SEQ ID NO: 885589 - DNA, 22 bp, Artificial Sequence
  chemically synthesized
acacctgtaatcccagcacttt

SEQ ID NO: 885590 - DNA, 22 bp, Artificial Sequence
  chemically synthesized
cggcctctcaaagtgctgggat

SEQ ID NO: 885591 - DNA, 22 bp, Artificial Sequence
  chemically synthesized
ggcctctcaaagtgctgggatt

SEQ ID NO: 885592 - DNA, 22 bp, Artificial Sequence
  chemically synthesized
tcaaagtgctgggattacaggt

SEQ ID NO: 885593 - DNA, 22 bp, Artificial Sequence
  chemically synthesized
aaagtgctgggattacaggtgt

SEQ ID NO: 885594 - DNA, 22 bp, Artificial Sequence
  chemically synthesized
gccaggtgcagtggctcacacc

SEQ ID NO: 885595 - DNA, 22 bp, Artificial Sequence
  chemically synthesized
ggattacaggtgtgagccactg

SEQ ID NO: 885596 - DNA, 22 bp, Artificial Sequence
  chemically synthesized
caaattggccaggtgcagtggc

SEQ ID NO: 885597 - DNA, 22 bp, Artificial Sequence
  chemically synthesized
caggtgtgagccactgcacctg

SEQ ID NO: 885598 - DNA, 22 bp, Artificial Sequence
  chemically synthesized
aagtataattacaaattggcca

SEQ ID NO: 885599 - DNA, 22 bp, Artificial Sequence
  chemically synthesized
taaagtataattacaaattggc

SEQ ID NO: 885600 - DNA, 22 bp, Artificial Sequence
  chemically synthesized
ctctaaagtataattacaaatt

SEQ ID NO: 885601 - DNA, 22 bp, Artificial Sequence
  chemically synthesized
tgctctaaagtataattacaaa

SEQ ID NO: 885602 - DNA, 22 bp, Artificial Sequence
  chemically synthesized
cacctggccaatttgtaattat

SEQ ID NO: 885603 - DNA, 22 bp, Artificial Sequence
  chemically synthesized
acctctgctctaaagtataatt

SEQ ID NO: 885604 - DNA, 22 bp, Artificial Sequence
  chemically synthesized
gccaatttgtaattatacttta

SEQ ID NO: 885605 - DNA, 22 bp, Artificial Sequence
  chemically synthesized
ctaacctctgctctaaagtata

SEQ ID NO: 885606 - DNA, 22 bp, Artificial Sequence
  chemically synthesized
gctaacctctgctctaaagtat

SEQ ID NO: 885607 - DNA, 22 bp, Artificial Sequence
  chemically synthesized
gtaattatactttagagcagag

SEQ ID NO: 885608 - DNA, 22 bp, Artificial Sequence
  chemically synthesized
taattatactttagagcagagg

SEQ ID NO: 885609 - DNA, 22 bp, Artificial Sequence
  chemically synthesized
tagaaaatgtttgctaacctct

SEQ ID NO: 885610 - DNA, 22 bp, Artificial Sequence
  chemically synthesized
tactttagagcagaggttagca

SEQ ID NO: 885611 - DNA, 22 bp, Artificial Sequence
  chemically synthesized
atagaaaatgtttgctaacctc

SEQ ID NO: 885612 - DNA, 22 bp, Artificial Sequence
  chemically synthesized
tatagaaaatgtttgctaacct

SEQ ID NO: 885613 - DNA, 22 bp, Artificial Sequence
  chemically synthesized
tagagcagaggttagcaaacat

SEQ ID NO: 885614 - DNA, 22 bp, Artificial Sequence
  chemically synthesized
agagcagaggttagcaaacatt

SEQ ID NO: 885615 - DNA, 22 bp, Artificial Sequence
  chemically synthesized
gagcagaggttagcaaacattt

SEQ ID NO: 885616 - DNA, 22 bp, Artificial Sequence
  chemically synthesized
tatggtgttttatagaaaatgt

SEQ ID NO: 885617 - DNA, 22 bp, Artificial Sequence
  chemically synthesized
ctatatggtgttttatagaaaa

SEQ ID NO: 885618 - DNA, 22 bp, Artificial Sequence
  chemically synthesized
actatatggtgttttatagaaa

SEQ ID NO: 885619 - DNA, 22 bp, Artificial Sequence
  chemically synthesized
gcaaacattttctataaaacac

SEQ ID NO: 885620 - DNA, 22 bp, Artificial Sequence
  chemically synthesized
aaatatttactatatggtgttt

SEQ ID NO: 885621 - DNA, 22 bp, Artificial Sequence
  chemically synthesized
tctataaaacaccatatagtaa

SEQ ID NO: 885622 - DNA, 22 bp, Artificial Sequence
  chemically synthesized
ctataaaacaccatatagtaaa

SEQ ID NO: 885623 - DNA, 22 bp, Artificial Sequence
  chemically synthesized
tataaaacaccatatagtaaat

SEQ ID NO: 885624 - DNA, 22 bp, Artificial Sequence
  chemically synthesized
taaaacaccatatagtaaatat

SEQ ID NO: 885625 - DNA, 22 bp, Artificial Sequence
  chemically synthesized
gcccacaaagtctaaaatattt

SEQ ID NO: 885626 - DNA, 22 bp, Artificial Sequence
  chemically synthesized
ggcccacaaagtctaaaatatt

SEQ ID NO: 885627 - DNA, 22 bp, Artificial Sequence
  chemically synthesized
agtttggcccacaaagtctaaa

SEQ ID NO: 885628 - DNA, 22 bp, Artificial Sequence
  chemically synthesized
gagtttggcccacaaagtctaa

SEQ ID NO: 885629 - DNA, 22 bp, Artificial Sequence
  chemically synthesized
gcagaatttgagtttggcccac

SEQ ID NO: 885630 - DNA, 22 bp, Artificial Sequence
  chemically synthesized
tagactttgtgggccaaactca

SEQ ID NO: 885631 - DNA, 22 bp, Artificial Sequence
  chemically synthesized
agactttgtgggccaaactcaa

SEQ ID NO: 885632 - DNA, 22 bp, Artificial Sequence
  chemically synthesized
gactttgtgggccaaactcaaa

SEQ ID NO: 885633 - DNA, 22 bp, Artificial Sequence
  chemically synthesized
tgtgggccaaactcaaattctg

SEQ ID NO: 885634 - DNA, 22 bp, Artificial Sequence
  chemically synthesized
atgccacattggcagaatttga

SEQ ID NO: 885635 - DNA, 22 bp, Artificial Sequence
  chemically synthesized
gtgggccaaactcaaattctgc

SEQ ID NO: 885636 - DNA, 22 bp, Artificial Sequence
  chemically synthesized
catgccacattggcagaatttg

SEQ ID NO: 885637 - DNA, 22 bp, Artificial Sequence
  chemically synthesized
tgggccaaactcaaattctgcc

SEQ ID NO: 885638 - DNA, 22 bp, Artificial Sequence
  chemically synthesized
tcatgccacattggcagaattt

SEQ ID NO: 885639 - DNA, 22 bp, Artificial Sequence
  chemically synthesized
ctttcatgccacattggcagaa

SEQ ID NO: 885640 - DNA, 22 bp, Artificial Sequence
  chemically synthesized
actactttcatgccacattggc

SEQ ID NO: 885641 - DNA, 22 bp, Artificial Sequence
  chemically synthesized
aaattctgccaatgtggcatga

SEQ ID NO: 885642 - DNA, 22 bp, Artificial Sequence
  chemically synthesized
gacctgactactttcatgccac

SEQ ID NO: 885643 - DNA, 22 bp, Artificial Sequence
  chemically synthesized
tgccaatgtggcatgaaagtag

SEQ ID NO: 885644 - DNA, 22 bp, Artificial Sequence
  chemically synthesized
ccaatgtggcatgaaagtagtc

SEQ ID NO: 885645 - DNA, 22 bp, Artificial Sequence
  chemically synthesized
atgtattagacctgactacttt

SEQ ID NO: 885646 - DNA, 22 bp, Artificial Sequence
  chemically synthesized
ttcatgtattagacctgactac

SEQ ID NO: 885647 - DNA, 22 bp, Artificial Sequence
  chemically synthesized
gttcatgtattagacctgacta

SEQ ID NO: 885648 - DNA, 22 bp, Artificial Sequence
  chemically synthesized
tttgttcatgtattagacctga

SEQ ID NO: 885649 - DNA, 22 bp, Artificial Sequence
  chemically synthesized
atttgttcatgtattagacctg

SEQ ID NO: 885650 - DNA, 22 bp, Artificial Sequence
  chemically synthesized
gaacacagccacatttatttgt

SEQ ID NO: 885651 - DNA, 22 bp, Artificial Sequence
  chemically synthesized
ttggaacacagccacatttatt

SEQ ID NO: 885652 - DNA, 22 bp, Artificial Sequence
  chemically synthesized
atacatgaacaaataaatgtgg

SEQ ID NO: 885653 - DNA, 22 bp, Artificial Sequence
  chemically synthesized
agaaataaagagttattggaac

SEQ ID NO: 885654 - DNA, 22 bp, Artificial Sequence
  chemically synthesized
cagaaataaagagttattggaa

SEQ ID NO: 885655 - DNA, 22 bp, Artificial Sequence
  chemically synthesized
tcagaaataaagagttattgga

SEQ ID NO: 885656 - DNA, 22 bp, Artificial Sequence
  chemically synthesized
ttttcagaaataaagagttatt

SEQ ID NO: 885657 - DNA, 22 bp, Artificial Sequence
  chemically synthesized
tgttccaataactctttatttc

SEQ ID NO: 885658 - DNA, 22 bp, Artificial Sequence
  chemically synthesized
cacctattttcagaaataaaga

SEQ ID NO: 885659 - DNA, 22 bp, Artificial Sequence
  chemically synthesized
caataactctttatttctgaaa

SEQ ID NO: 885660 - DNA, 22 bp, Artificial Sequence
  chemically synthesized
gtcctccacctattttcagaaa

SEQ ID NO: 885661 - DNA, 22 bp, Artificial Sequence
  chemically synthesized
agtcctccacctattttcagaa

SEQ ID NO: 885662 - DNA, 22 bp, Artificial Sequence
  chemically synthesized
tttatttctgaaaataggtgga

SEQ ID NO: 885663 - DNA, 22 bp, Artificial Sequence
  chemically synthesized
tatttctgaaaataggtggagg

SEQ ID NO: 885664 - DNA, 22 bp, Artificial Sequence
  chemically synthesized
atttctgaaaataggtggagga

SEQ ID NO: 885665 - DNA, 22 bp, Artificial Sequence
  chemically synthesized
tttctgaaaataggtggaggac

SEQ ID NO: 885666 - DNA, 22 bp, Artificial Sequence
  chemically synthesized
ctgaaaataggtggaggactaa

SEQ ID NO: 885667 - DNA, 22 bp, Artificial Sequence
  chemically synthesized
tgaaaataggtggaggactaaa

SEQ ID NO: 885668 - DNA, 22 bp, Artificial Sequence
  chemically synthesized
aaaataggtggaggactaaatg

SEQ ID NO: 885669 - DNA, 22 bp, Artificial Sequence
  chemically synthesized
tggtccaagggccacatttagt

SEQ ID NO: 885670 - DNA, 22 bp, Artificial Sequence
  chemically synthesized
aatgtggcccttggaccatagt

SEQ ID NO: 885671 - DNA, 22 bp, Artificial Sequence
  chemically synthesized
aagcaagagtcagcaaactatg

SEQ ID NO: 885672 - DNA, 22 bp, Artificial Sequence
  chemically synthesized
ggaccatagtttgctgactctt

SEQ ID NO: 885673 - DNA, 22 bp, Artificial Sequence
  chemically synthesized
gaccatagtttgctgactcttg

SEQ ID NO: 885674 - DNA, 22 bp, Artificial Sequence
  chemically synthesized
taatatcctaaagcaagagtca

SEQ ID NO: 885675 - DNA, 22 bp, Artificial Sequence
  chemically synthesized
gctgactcttgctttaggatat

SEQ ID NO: 885676 - DNA, 22 bp, Artificial Sequence
  chemically synthesized
ctgactcttgctttaggatatt

SEQ ID NO: 885677 - DNA, 22 bp, Artificial Sequence
  chemically synthesized
caacaacactgtaatatcctaa

SEQ ID NO: 885678 - DNA, 22 bp, Artificial Sequence
  chemically synthesized
ccaacaacactgtaatatccta

SEQ ID NO: 885679 - DNA, 22 bp, Artificial Sequence
  chemically synthesized
actcttgctttaggatattaca

SEQ ID NO: 885680 - DNA, 22 bp, Artificial Sequence
  chemically synthesized
tttccaacaacactgtaatatc

SEQ ID NO: 885681 - DNA, 22 bp, Artificial Sequence
  chemically synthesized
ttgctttaggatattacagtgt

SEQ ID NO: 885682 - DNA, 22 bp, Artificial Sequence
  chemically synthesized
attatttccaacaacactgtaa

SEQ ID NO: 885683 - DNA, 22 bp, Artificial Sequence
  chemically synthesized
gctttaggatattacagtgttg

SEQ ID NO: 885684 - DNA, 22 bp, Artificial Sequence
  chemically synthesized
ctttaggatattacagtgttgt

SEQ ID NO: 885685 - DNA, 22 bp, Artificial Sequence
  chemically synthesized
taggatattacagtgttgttgg

SEQ ID NO: 885686 - DNA, 22 bp, Artificial Sequence
  chemically synthesized
gactgattatttccaacaacac

SEQ ID NO: 885687 - DNA, 22 bp, Artificial Sequence
  chemically synthesized
aggatattacagtgttgttgga

SEQ ID NO: 885688 - DNA, 22 bp, Artificial Sequence
  chemically synthesized
ggatattacagtgttgttggaa

SEQ ID NO: 885689 - DNA, 22 bp, Artificial Sequence
  chemically synthesized
tagactgattatttccaacaac

SEQ ID NO: 885690 - DNA, 22 bp, Artificial Sequence
  chemically synthesized
ctagactgattatttccaacaa

SEQ ID NO: 885691 - DNA, 22 bp, Artificial Sequence
  chemically synthesized
tttctagactgattatttccaa

SEQ ID NO: 885692 - DNA, 22 bp, Artificial Sequence
  chemically synthesized
atttctagactgattatttcca

SEQ ID NO: 885693 - DNA, 22 bp, Artificial Sequence
  chemically synthesized
ttatttctagactgattatttc

SEQ ID NO: 885694 - DNA, 22 bp, Artificial Sequence
  chemically synthesized
cagtgttgttggaaataatcag

SEQ ID NO: 885695 - DNA, 22 bp, Artificial Sequence
  chemically synthesized
ttggaaataatcagtctagaaa

SEQ ID NO: 885696 - DNA, 22 bp, Artificial Sequence
  chemically synthesized
gaaataatcagtctagaaataa

SEQ ID NO: 885697 - DNA, 22 bp, Artificial Sequence
  chemically synthesized
gaacccagatgttcttatttct

SEQ ID NO: 885698 - DNA, 22 bp, Artificial Sequence
  chemically synthesized
ataagcctagaacccagatgtt

SEQ ID NO: 885699 - DNA, 22 bp, Artificial Sequence
  chemically synthesized
gaaataagaacatctgggttct

SEQ ID NO: 885700 - DNA, 22 bp, Artificial Sequence
  chemically synthesized
atgggctaataagcctagaacc

SEQ ID NO: 885701 - DNA, 22 bp, Artificial Sequence
  chemically synthesized
ccccaactcatgggctaataag

SEQ ID NO: 885702 - DNA, 22 bp, Artificial Sequence
  chemically synthesized
gccccaactcatgggctaataa

SEQ ID NO: 885703 - DNA, 22 bp, Artificial Sequence
  chemically synthesized
ggttctaggcttattagcccat

SEQ ID NO: 885704 - DNA, 22 bp, Artificial Sequence
  chemically synthesized
taggcttattagcccatgagtt

SEQ ID NO: 885705 - DNA, 22 bp, Artificial Sequence
  chemically synthesized
aatgacttgccccaactcatgg

SEQ ID NO: 885706 - DNA, 22 bp, Artificial Sequence
  chemically synthesized
ggcttattagcccatgagttgg

SEQ ID NO: 885707 - DNA, 22 bp, Artificial Sequence
  chemically synthesized
attagcccatgagttggggcaa

SEQ ID NO: 885708 - DNA, 22 bp, Artificial Sequence
  chemically synthesized
ttagcccatgagttggggcaag

SEQ ID NO: 885709 - DNA, 22 bp, Artificial Sequence
  chemically synthesized
gagcagttaaatgacttgcccc

SEQ ID NO: 885710 - DNA, 22 bp, Artificial Sequence
  chemically synthesized
gcccatgagttggggcaagtca

SEQ ID NO: 885711 - DNA, 22 bp, Artificial Sequence
  chemically synthesized
agagcagttaaatgacttgccc

SEQ ID NO: 885712 - DNA, 22 bp, Artificial Sequence
  chemically synthesized
aaacttagagcagttaaatgac

SEQ ID NO: 885713 - DNA, 22 bp, Artificial Sequence
  chemically synthesized
gggcaagtcatttaactgctct

SEQ ID NO: 885714 - DNA, 22 bp, Artificial Sequence
  chemically synthesized
aaacctgaaacttagagcagtt

SEQ ID NO: 885715 - DNA, 22 bp, Artificial Sequence
  chemically synthesized
aagatactgaaacctgaaactt

SEQ ID NO: 885716 - DNA, 22 bp, Artificial Sequence
  chemically synthesized
aaagatactgaaacctgaaact

SEQ ID NO: 885717 - DNA, 22 bp, Artificial Sequence
  chemically synthesized
aactgctctaagtttcaggttt

SEQ ID NO: 885718 - DNA, 22 bp, Artificial Sequence
  chemically synthesized
actgctctaagtttcaggtttc

SEQ ID NO: 885719 - DNA, 22 bp, Artificial Sequence
  chemically synthesized
tatttaaagatactgaaacctg

SEQ ID NO: 885720 - DNA, 22 bp, Artificial Sequence
  chemically synthesized
atatttaaagatactgaaacct

SEQ ID NO: 885721 - DNA, 22 bp, Artificial Sequence
  chemically synthesized
ctctaagtttcaggtttcagta

SEQ ID NO: 885722 - DNA, 22 bp, Artificial Sequence
  chemically synthesized
tatatttaaagatactgaaacc

SEQ ID NO: 885723 - DNA, 22 bp, Artificial Sequence
  chemically synthesized
taagtttcaggtttcagtatct

SEQ ID NO: 885724 - DNA, 22 bp, Artificial Sequence
  chemically synthesized
ttttatatttaaagatactgaa

SEQ ID NO: 885725 - DNA, 22 bp, Artificial Sequence
  chemically synthesized
attttatatttaaagatactga

SEQ ID NO: 885726 - DNA, 22 bp, Artificial Sequence
  chemically synthesized
agtttcaggtttcagtatcttt

SEQ ID NO: 885727 - DNA, 22 bp, Artificial Sequence
  chemically synthesized
atttattttatatttaaagata

SEQ ID NO: 885728 - DNA, 22 bp, Artificial Sequence
  chemically synthesized
catttattttatatttaaagat

SEQ ID NO: 885729 - DNA, 22 bp, Artificial Sequence
  chemically synthesized
caggtttcagtatctttaaata

SEQ ID NO: 885730 - DNA, 22 bp, Artificial Sequence
  chemically synthesized
aggtttcagtatctttaaatat

SEQ ID NO: 885731 - DNA, 22 bp, Artificial Sequence
  chemically synthesized
gtttcatttattttatatttaa

SEQ ID NO: 885732 - DNA, 22 bp, Artificial Sequence
  chemically synthesized
ttagtttcatttattttatatt

SEQ ID NO: 885733 - DNA, 22 bp, Artificial Sequence
  chemically synthesized
cagtatctttaaatataaaata

SEQ ID NO: 885734 - DNA, 22 bp, Artificial Sequence
  chemically synthesized
agtatctttaaatataaaataa

SEQ ID NO: 885735 - DNA, 22 bp, Artificial Sequence
  chemically synthesized
taaatataaaataaatgaaact

SEQ ID NO: 885736 - DNA, 22 bp, Artificial Sequence
  chemically synthesized
aaatataaaataaatgaaacta

SEQ ID NO: 885737 - DNA, 22 bp, Artificial Sequence
  chemically synthesized
aatataaaataaatgaaactaa

SEQ ID NO: 885738 - DNA, 22 bp, Artificial Sequence
  chemically synthesized
acagtaatatctgttagtttca

SEQ ID NO: 885739 - DNA, 22 bp, Artificial Sequence
  chemically synthesized
ctcacagtaatatctgttagtt

SEQ ID NO: 885740 - DNA, 22 bp, Artificial Sequence
  chemically synthesized
actcacagtaatatctgttagt

SEQ ID NO: 885741 - DNA, 22 bp, Artificial Sequence
  chemically synthesized
tactcacagtaatatctgttag

SEQ ID NO: 885742 - DNA, 22 bp, Artificial Sequence
  chemically synthesized
accctttactcacagtaatatc

SEQ ID NO: 885743 - DNA, 22 bp, Artificial Sequence
  chemically synthesized
aaccctttactcacagtaatat

SEQ ID NO: 885744 - DNA, 22 bp, Artificial Sequence
  chemically synthesized
taaccctttactcacagtaata

SEQ ID NO: 885745 - DNA, 22 bp, Artificial Sequence
  chemically synthesized
ttaaccctttactcacagtaat

SEQ ID NO: 885746 - DNA, 22 bp, Artificial Sequence
  chemically synthesized
acagatattactgtgagtaaag

SEQ ID NO: 885747 - DNA, 22 bp, Artificial Sequence
  chemically synthesized
ctgtgagtaaagggttaaaaac

SEQ ID NO: 885748 - DNA, 22 bp, Artificial Sequence
  chemically synthesized
tgagtaaagggttaaaaacacc

SEQ ID NO: 885749 - DNA, 22 bp, Artificial Sequence
  chemically synthesized
atacagatggacaaagggtgtt

SEQ ID NO: 885750 - DNA, 22 bp, Artificial Sequence
  chemically synthesized
tcatacagatggacaaagggtg

SEQ ID NO: 885751 - DNA, 22 bp, Artificial Sequence
  chemically synthesized
aaaacaccctttgtccatctgt

SEQ ID NO: 885752 - DNA, 22 bp, Artificial Sequence
  chemically synthesized
atcaaagtacaaattctcatac

SEQ ID NO: 885753 - DNA, 22 bp, Artificial Sequence
  chemically synthesized
tgtccatctgtatgagaatttg

SEQ ID NO: 885754 - DNA, 22 bp, Artificial Sequence
  chemically synthesized
gtccatctgtatgagaatttgt

SEQ ID NO: 885755 - DNA, 22 bp, Artificial Sequence
  chemically synthesized
tccatctgtatgagaatttgta

SEQ ID NO: 885756 - DNA, 22 bp, Artificial Sequence
  chemically synthesized
gaaagttgatcaaagtacaaat

SEQ ID NO: 885757 - DNA, 22 bp, Artificial Sequence
  chemically synthesized
tatgagaatttgtactttgatc

SEQ ID NO: 885758 - DNA, 22 bp, Artificial Sequence
  chemically synthesized
gggagaagggagctagaaagtt

SEQ ID NO: 885759 - DNA, 22 bp, Artificial Sequence
  chemically synthesized
gtactttgatcaactttctagc

SEQ ID NO: 885760 - DNA, 22 bp, Artificial Sequence
  chemically synthesized
tactttgatcaactttctagct

SEQ ID NO: 885761 - DNA, 22 bp, Artificial Sequence
  chemically synthesized
tagggagaagggagctagaaag

SEQ ID NO: 885762 - DNA, 22 bp, Artificial Sequence
  chemically synthesized
ctagggagaagggagctagaaa

SEQ ID NO: 885763 - DNA, 22 bp, Artificial Sequence
  chemically synthesized
tctagggagaagggagctagaa

SEQ ID NO: 885764 - DNA, 22 bp, Artificial Sequence
  chemically synthesized
tgatcaactttctagctccctt

SEQ ID NO: 885765 - DNA, 22 bp, Artificial Sequence
  chemically synthesized
gatcaactttctagctcccttc

SEQ ID NO: 885766 - DNA, 22 bp, Artificial Sequence
  chemically synthesized
atcaactttctagctcccttct

SEQ ID NO: 885767 - DNA, 22 bp, Artificial Sequence
  chemically synthesized
tcagttttctagggagaaggga

SEQ ID NO: 885768 - DNA, 22 bp, Artificial Sequence
  chemically synthesized
atcagttttctagggagaaggg

SEQ ID NO: 885769 - DNA, 22 bp, Artificial Sequence
  chemically synthesized
tatcagttttctagggagaagg

SEQ ID NO: 885770 - DNA, 22 bp, Artificial Sequence
  chemically synthesized
tctagctcccttctccctagaa

SEQ ID NO: 885771 - DNA, 22 bp, Artificial Sequence
  chemically synthesized
ctagctcccttctccctagaaa

SEQ ID NO: 885772 - DNA, 22 bp, Artificial Sequence
  chemically synthesized
tagctcccttctccctagaaaa

SEQ ID NO: 885773 - DNA, 22 bp, Artificial Sequence
  chemically synthesized
caactttatcagttttctaggg

SEQ ID NO: 885774 - DNA, 22 bp, Artificial Sequence
  chemically synthesized
gctcccttctccctagaaaact

SEQ ID NO: 885775 - DNA, 22 bp, Artificial Sequence
  chemically synthesized
ccttctccctagaaaactgata

SEQ ID NO: 885776 - DNA, 22 bp, Artificial Sequence
  chemically synthesized
acattccaactttatcagtttt

SEQ ID NO: 885777 - DNA, 22 bp, Artificial Sequence
  chemically synthesized
gacattccaactttatcagttt

SEQ ID NO: 885778 - DNA, 22 bp, Artificial Sequence
  chemically synthesized
ctccctagaaaactgataaagt

SEQ ID NO: 885779 - DNA, 22 bp, Artificial Sequence
  chemically synthesized
tccctagaaaactgataaagtt

SEQ ID NO: 885780 - DNA, 22 bp, Artificial Sequence
  chemically synthesized
cctagaaaactgataaagttgg

SEQ ID NO: 885781 - DNA, 22 bp, Artificial Sequence
  chemically synthesized
acacatttgacattccaacttt

SEQ ID NO: 885782 - DNA, 22 bp, Artificial Sequence
  chemically synthesized
gaaaactgataaagttggaatg

SEQ ID NO: 885783 - DNA, 22 bp, Artificial Sequence
  chemically synthesized
ctcacacatttgacattccaac

SEQ ID NO: 885784 - DNA, 22 bp, Artificial Sequence
  chemically synthesized
cctgctcacacatttgacattc

SEQ ID NO: 885785 - DNA, 22 bp, Artificial Sequence
  chemically synthesized
ataaagttggaatgtcaaatgt

SEQ ID NO: 885786 - DNA, 22 bp, Artificial Sequence
  chemically synthesized
aagcaatgttgcctgctcacac

SEQ ID NO: 885787 - DNA, 22 bp, Artificial Sequence
  chemically synthesized
gaatgtcaaatgtgtgagcagg

SEQ ID NO: 885788 - DNA, 22 bp, Artificial Sequence
  chemically synthesized
atctgaagcaatgttgcctgct

SEQ ID NO: 885789 - DNA, 22 bp, Artificial Sequence
  chemically synthesized
aatctgaagcaatgttgcctgc

SEQ ID NO: 885790 - DNA, 22 bp, Artificial Sequence
  chemically synthesized
taatctgaagcaatgttgcctg

SEQ ID NO: 885791 - DNA, 22 bp, Artificial Sequence
  chemically synthesized
ttaatctgaagcaatgttgcct

SEQ ID NO: 885792 - DNA, 22 bp, Artificial Sequence
  chemically synthesized
tttaatctgaagcaatgttgcc

SEQ ID NO: 885793 - DNA, 22 bp, Artificial Sequence
  chemically synthesized
ttttaatctgaagcaatgttgc

SEQ ID NO: 885794 - DNA, 22 bp, Artificial Sequence
  chemically synthesized
tttttaatctgaagcaatgttg

SEQ ID NO: 885795 - DNA, 22 bp, Artificial Sequence
  chemically synthesized
ttttttaatctgaagcaatgtt

SEQ ID NO: 885796 - DNA, 22 bp, Artificial Sequence
  chemically synthesized
tttttttaatctgaagcaatgt

SEQ ID NO: 885797 - DNA, 22 bp, Artificial Sequence
  chemically synthesized
ttttttttaatctgaagcaatg

SEQ ID NO: 885798 - DNA, 22 bp, Artificial Sequence
  chemically synthesized
ccagtccccatcattttttttt

SEQ ID NO: 885799 - DNA, 22 bp, Artificial Sequence
  chemically synthesized
cttcagattaaaaaaaaaaatg

SEQ ID NO: 885800 - DNA, 22 bp, Artificial Sequence
  chemically synthesized
accagtccccatcatttttttt

SEQ ID NO: 885801 - DNA, 22 bp, Artificial Sequence
  chemically synthesized
cagattaaaaaaaaaaatgatg

SEQ ID NO: 885802 - DNA, 22 bp, Artificial Sequence
  chemically synthesized
agattaaaaaaaaaaatgatgg

SEQ ID NO: 885803 - DNA, 22 bp, Artificial Sequence
  chemically synthesized
aaaaaaaaaatgatggggactg

SEQ ID NO: 885804 - DNA, 22 bp, Artificial Sequence
  chemically synthesized
accaaggtgtaatttaccagtc

SEQ ID NO: 885805 - DNA, 22 bp, Artificial Sequence
  chemically synthesized
atatgtagaacacctaaccaag

SEQ ID NO: 885806 - DNA, 22 bp, Artificial Sequence
  chemically synthesized
gtaaattacaccttggttaggt

SEQ ID NO: 885807 - DNA, 22 bp, Artificial Sequence
  chemically synthesized
tagttcatatgtagaacaccta

SEQ ID NO: 885808 - DNA, 22 bp, Artificial Sequence
  chemically synthesized
atagttcatatgtagaacacct

SEQ ID NO: 885809 - DNA, 22 bp, Artificial Sequence
  chemically synthesized
caccttggttaggtgttctaca

SEQ ID NO: 885810 - DNA, 22 bp, Artificial Sequence
  chemically synthesized
ggtatttatagttcatatgtag

SEQ ID NO: 885811 - DNA, 22 bp, Artificial Sequence
  chemically synthesized
ggttaggtgttctacatatgaa

SEQ ID NO: 885812 - DNA, 22 bp, Artificial Sequence
  chemically synthesized
gttaggtgttctacatatgaac

SEQ ID NO: 885813 - DNA, 22 bp, Artificial Sequence
  chemically synthesized
cattaggtatttatagttcata

SEQ ID NO: 885814 - DNA, 22 bp, Artificial Sequence
  chemically synthesized
ggtgttctacatatgaactata

SEQ ID NO: 885815 - DNA, 22 bp, Artificial Sequence
  chemically synthesized
ccattaggtatttatagttcat

SEQ ID NO: 885816 - DNA, 22 bp, Artificial Sequence
  chemically synthesized
tccattaggtatttatagttca

SEQ ID NO: 885817 - DNA, 22 bp, Artificial Sequence
  chemically synthesized
tacatatgaactataaatacct

SEQ ID NO: 885818 - DNA, 22 bp, Artificial Sequence
  chemically synthesized
tggttttccattaggtatttat

SEQ ID NO: 885819 - DNA, 22 bp, Artificial Sequence
  chemically synthesized
catatgaactataaatacctaa

SEQ ID NO: 885820 - DNA, 22 bp, Artificial Sequence
  chemically synthesized
taaatacctaatggaaaaccat

SEQ ID NO: 885821 - DNA, 22 bp, Artificial Sequence
  chemically synthesized
gggacgccccacaattatggtt

SEQ ID NO: 885822 - DNA, 22 bp, Artificial Sequence
  chemically synthesized
ggggacgccccacaattatggt

SEQ ID NO: 885823 - DNA, 22 bp, Artificial Sequence
  chemically synthesized
atggaaaaccataattgtgggg

SEQ ID NO: 885824 - DNA, 22 bp, Artificial Sequence
  chemically synthesized
tacttggggacgccccacaatt

SEQ ID NO: 885825 - DNA, 22 bp, Artificial Sequence
  chemically synthesized
ttgtacttggggacgccccaca

SEQ ID NO: 885826 - DNA, 22 bp, Artificial Sequence
  chemically synthesized
caagaattgttgtacttgggga

SEQ ID NO: 885827 - DNA, 22 bp, Artificial Sequence
  chemically synthesized
gttacaagaattgttgtacttg

SEQ ID NO: 885828 - DNA, 22 bp, Artificial Sequence
  chemically synthesized
tggggcgtccccaagtacaaca

SEQ ID NO: 885829 - DNA, 22 bp, Artificial Sequence
  chemically synthesized
agttacaagaattgttgtactt

SEQ ID NO: 885830 - DNA, 22 bp, Artificial Sequence
  chemically synthesized
aaaaaggacatgcttagttaca

SEQ ID NO: 885831 - DNA, 22 bp, Artificial Sequence
  chemically synthesized
caaggtcctcaaaaaggacatg

SEQ ID NO: 885832 - DNA, 22 bp, Artificial Sequence
  chemically synthesized
ttgtaactaagcatgtcctttt

SEQ ID NO: 885833 - DNA, 22 bp, Artificial Sequence
  chemically synthesized
ccaaggtcctcaaaaaggacat

SEQ ID NO: 885834 - DNA, 22 bp, Artificial Sequence
  chemically synthesized
gtaactaagcatgtcctttttg

SEQ ID NO: 885835 - DNA, 22 bp, Artificial Sequence
  chemically synthesized
taactaagcatgtcctttttga

SEQ ID NO: 885836 - DNA, 22 bp, Artificial Sequence
  chemically synthesized
agcatgtcctttttgaggacct

SEQ ID NO: 885837 - DNA, 22 bp, Artificial Sequence
  chemically synthesized
taacatagtttccaaggtcctc

SEQ ID NO: 885838 - DNA, 22 bp, Artificial Sequence
  chemically synthesized
gtaacatagtttccaaggtcct

SEQ ID NO: 885839 - DNA, 22 bp, Artificial Sequence
  chemically synthesized
tttgaggaccttggaaactatg

SEQ ID NO: 885840 - DNA, 22 bp, Artificial Sequence
  chemically synthesized
ttgaggaccttggaaactatgt

SEQ ID NO: 885841 - DNA, 22 bp, Artificial Sequence
  chemically synthesized
tgaggaccttggaaactatgtt

SEQ ID NO: 885842 - DNA, 22 bp, Artificial Sequence
  chemically synthesized
gaggaccttggaaactatgtta

SEQ ID NO: 885843 - DNA, 22 bp, Artificial Sequence
  chemically synthesized
aggaccttggaaactatgttac

SEQ ID NO: 885844 - DNA, 22 bp, Artificial Sequence
  chemically synthesized
ggaaactatgttacaaggcatt

SEQ ID NO: 885845 - DNA, 22 bp, Artificial Sequence
  chemically synthesized
gaaactatgttacaaggcattg

SEQ ID NO: 885846 - DNA, 22 bp, Artificial Sequence
  chemically synthesized
tgcatcccagaggccaatgcct

SEQ ID NO: 885847 - DNA, 22 bp, Artificial Sequence
  chemically synthesized
atgcatcccagaggccaatgcc

SEQ ID NO: 885848 - DNA, 22 bp, Artificial Sequence
  chemically synthesized
tgttacaaggcattggcctctg

SEQ ID NO: 885849 - DNA, 22 bp, Artificial Sequence
  chemically synthesized
gaagccttatgcatcccagagg

SEQ ID NO: 885850 - DNA, 22 bp, Artificial Sequence
  chemically synthesized
caaggcattggcctctgggatg

SEQ ID NO: 885851 - DNA, 22 bp, Artificial Sequence
  chemically synthesized
gcctagaagccttatgcatccc

SEQ ID NO: 885852 - DNA, 22 bp, Artificial Sequence
  chemically synthesized
gcctctgggatgcataaggctt

SEQ ID NO: 885853 - DNA, 22 bp, Artificial Sequence
  chemically synthesized
tgggatgcataaggcttctagg

SEQ ID NO: 885854 - DNA, 22 bp, Artificial Sequence
  chemically synthesized
ggtcaaccctggcctagaagcc

SEQ ID NO: 885855 - DNA, 22 bp, Artificial Sequence
  chemically synthesized
ggatgcataaggcttctaggcc

SEQ ID NO: 885856 - DNA, 22 bp, Artificial Sequence
  chemically synthesized
ctaggccagggttgacccagca

SEQ ID NO: 885857 - DNA, 22 bp, Artificial Sequence
  chemically synthesized
taggccagggttgacccagcat

SEQ ID NO: 885858 - DNA, 22 bp, Artificial Sequence
  chemically synthesized
ggccagggttgacccagcatct

SEQ ID NO: 885859 - DNA, 22 bp, Artificial Sequence
  chemically synthesized
acccagcatctcgatttgtttc

SEQ ID NO: 885860 - DNA, 22 bp, Artificial Sequence
  chemically synthesized
aggtgcacaggaaggaaacaaa

SEQ ID NO: 885861 - DNA, 22 bp, Artificial Sequence
  chemically synthesized
gatttgtttccttcctgtgcac

SEQ ID NO: 885862 - DNA, 22 bp, Artificial Sequence
  chemically synthesized
atgacatctcaggtgcacagga

SEQ ID NO: 885863 - DNA, 22 bp, Artificial Sequence
  chemically synthesized
tcatgacatctcaggtgcacag

SEQ ID NO: 885864 - DNA, 22 bp, Artificial Sequence
  chemically synthesized
tctcatgacatctcaggtgcac

SEQ ID NO: 885865 - DNA, 22 bp, Artificial Sequence
  chemically synthesized
gtttccttcctgtgcacctgag

SEQ ID NO: 885866 - DNA, 22 bp, Artificial Sequence
  chemically synthesized
tttccttcctgtgcacctgaga

SEQ ID NO: 885867 - DNA, 22 bp, Artificial Sequence
  chemically synthesized
ccttcctgtgcacctgagatgt

SEQ ID NO: 885868 - DNA, 22 bp, Artificial Sequence
  chemically synthesized
cttcctgtgcacctgagatgtc

SEQ ID NO: 885869 - DNA, 22 bp, Artificial Sequence
  chemically synthesized
tccactctctcatgacatctca

SEQ ID NO: 885870 - DNA, 22 bp, Artificial Sequence
  chemically synthesized
cctgtgcacctgagatgtcatg

SEQ ID NO: 885871 - DNA, 22 bp, Artificial Sequence
  chemically synthesized
ctgtgcacctgagatgtcatga

SEQ ID NO: 885872 - DNA, 22 bp, Artificial Sequence
  chemically synthesized
tgcacctgagatgtcatgagag

SEQ ID NO: 885873 - DNA, 22 bp, Artificial Sequence
  chemically synthesized
cagcacctgtccactctctcat

SEQ ID NO: 885874 - DNA, 22 bp, Artificial Sequence
  chemically synthesized
gcagcacctgtccactctctca

SEQ ID NO: 885875 - DNA, 22 bp, Artificial Sequence
  chemically synthesized
tgcagcacctgtccactctctc

SEQ ID NO: 885876 - DNA, 22 bp, Artificial Sequence
  chemically synthesized
agatgtcatgagagagtggaca

SEQ ID NO: 885877 - DNA, 22 bp, Artificial Sequence
  chemically synthesized
actttgcagcacctgtccactc

SEQ ID NO: 885878 - DNA, 22 bp, Artificial Sequence
  chemically synthesized
ttcactttgcagcacctgtcca

SEQ ID NO: 885879 - DNA, 22 bp, Artificial Sequence
  chemically synthesized
caaagtgaatagctcttggatg

SEQ ID NO: 885880 - DNA, 22 bp, Artificial Sequence
  chemically synthesized
aagcacccagggagccatccaa

SEQ ID NO: 885881 - DNA, 22 bp, Artificial Sequence
  chemically synthesized
tgaagcacccagggagccatcc

SEQ ID NO: 885882 - DNA, 22 bp, Artificial Sequence
  chemically synthesized
ttggatggctccctgggtgctt

SEQ ID NO: 885883 - DNA, 22 bp, Artificial Sequence
  chemically synthesized
ggatggctccctgggtgcttca

SEQ ID NO: 885884 - DNA, 22 bp, Artificial Sequence
  chemically synthesized
gatggctccctgggtgcttcag

SEQ ID NO: 885885 - DNA, 22 bp, Artificial Sequence
  chemically synthesized
cctgggtgcttcagagattgct

SEQ ID NO: 885886 - DNA, 22 bp, Artificial Sequence
  chemically synthesized
ggtgcttcagagattgctacgc

SEQ ID NO: 885887 - DNA, 22 bp, Artificial Sequence
  chemically synthesized
gtaggatgagtatgcgtagcaa

SEQ ID NO: 885888 - DNA, 22 bp, Artificial Sequence
  chemically synthesized
agtaggatgagtatgcgtagca

SEQ ID NO: 885889 - DNA, 22 bp, Artificial Sequence
  chemically synthesized
tagtaggatgagtatgcgtagc

SEQ ID NO: 885890 - DNA, 22 bp, Artificial Sequence
  chemically synthesized
tttagtaggatgagtatgcgta

SEQ ID NO: 885891 - DNA, 22 bp, Artificial Sequence
  chemically synthesized
cagagattgctacgcatactca

SEQ ID NO: 885892 - DNA, 22 bp, Artificial Sequence
  chemically synthesized
tctttagtaggatgagtatgcg

SEQ ID NO: 885893 - DNA, 22 bp, Artificial Sequence
  chemically synthesized
agagattgctacgcatactcat

SEQ ID NO: 885894 - DNA, 22 bp, Artificial Sequence
  chemically synthesized
ctacgcatactcatcctactaa

SEQ ID NO: 885895 - DNA, 22 bp, Artificial Sequence
  chemically synthesized
cgcatactcatcctactaaaga

SEQ ID NO: 885896 - DNA, 22 bp, Artificial Sequence
  chemically synthesized
atcctactaaagagagataccc

SEQ ID NO: 885897 - DNA, 22 bp, Artificial Sequence
  chemically synthesized
gcaggaaggtagcatcgggtat

SEQ ID NO: 885898 - DNA, 22 bp, Artificial Sequence
  chemically synthesized
agcaggaaggtagcatcgggta

SEQ ID NO: 885899 - DNA, 22 bp, Artificial Sequence
  chemically synthesized
ctaaagagagatacccgatgct

SEQ ID NO: 885900 - DNA, 22 bp, Artificial Sequence
  chemically synthesized
aagagagatacccgatgctacc

SEQ ID NO: 885901 - DNA, 22 bp, Artificial Sequence
  chemically synthesized
gaaggatataggaatatagctt

SEQ ID NO: 885902 - DNA, 22 bp, Artificial Sequence
  chemically synthesized
agaaggatataggaatatagct

SEQ ID NO: 885903 - DNA, 22 bp, Artificial Sequence
  chemically synthesized
ccttcctgctaagctatattcc

SEQ ID NO: 885904 - DNA, 22 bp, Artificial Sequence
  chemically synthesized
cctgctaagctatattcctata

SEQ ID NO: 885905 - DNA, 22 bp, Artificial Sequence
  chemically synthesized
ctgctaagctatattcctatat

SEQ ID NO: 885906 - DNA, 22 bp, Artificial Sequence
  chemically synthesized
ctaagctatattcctatatcct

SEQ ID NO: 885907 - DNA, 22 bp, Artificial Sequence
  chemically synthesized
agctatattcctatatccttct

SEQ ID NO: 885908 - DNA, 22 bp, Artificial Sequence
  chemically synthesized
agtagcaaaggcacttagaagg

SEQ ID NO: 885909 - DNA, 22 bp, Artificial Sequence
  chemically synthesized
tattcctatatccttctaagtg

SEQ ID NO: 885910 - DNA, 22 bp, Artificial Sequence
  chemically synthesized
ctatatccttctaagtgccttt

SEQ ID NO: 885911 - DNA, 22 bp, Artificial Sequence
  chemically synthesized
tatccttctaagtgcctttgct

SEQ ID NO: 885912 - DNA, 22 bp, Artificial Sequence
  chemically synthesized
tgaccacattcagtagcaaagg

SEQ ID NO: 885913 - DNA, 22 bp, Artificial Sequence
  chemically synthesized
ctaagtgcctttgctactgaat

SEQ ID NO: 885914 - DNA, 22 bp, Artificial Sequence
  chemically synthesized
taagtgcctttgctactgaatg

SEQ ID NO: 885915 - DNA, 22 bp, Artificial Sequence
  chemically synthesized
agtgcctttgctactgaatgtg

SEQ ID NO: 885916 - DNA, 22 bp, Artificial Sequence
  chemically synthesized
aacaatactatgaccacattca

SEQ ID NO: 885917 - DNA, 22 bp, Artificial Sequence
  chemically synthesized
tgctactgaatgtggtcatagt

SEQ ID NO: 885918 - DNA, 22 bp, Artificial Sequence
  chemically synthesized
gctactgaatgtggtcatagta

SEQ ID NO: 885919 - DNA, 22 bp, Artificial Sequence
  chemically synthesized
ctactgaatgtggtcatagtat

SEQ ID NO: 885920 - DNA, 22 bp, Artificial Sequence
  chemically synthesized
ggtgcaactgaacaatactatg

SEQ ID NO: 885921 - DNA, 22 bp, Artificial Sequence
  chemically synthesized
ctgaatgtggtcatagtattgt

SEQ ID NO: 885922 - DNA, 22 bp, Artificial Sequence
  chemically synthesized
aatgtggtcatagtattgttca

SEQ ID NO: 885923 - DNA, 22 bp, Artificial Sequence
  chemically synthesized
attaggtgcaactgaacaatac

SEQ ID NO: 885924 - DNA, 22 bp, Artificial Sequence
  chemically synthesized
gattaggtgcaactgaacaata

SEQ ID NO: 885925 - DNA, 22 bp, Artificial Sequence
  chemically synthesized
tgattaggtgcaactgaacaat

SEQ ID NO: 885926 - DNA, 22 bp, Artificial Sequence
  chemically synthesized
tttgattaggtgcaactgaaca

SEQ ID NO: 885927 - DNA, 22 bp, Artificial Sequence
  chemically synthesized
ctttgattaggtgcaactgaac

SEQ ID NO: 885928 - DNA, 22 bp, Artificial Sequence
  chemically synthesized
ttcagttgcacctaatcaaaga

SEQ ID NO: 885929 - DNA, 22 bp, Artificial Sequence
  chemically synthesized
agttgcacctaatcaaagaaga

SEQ ID NO: 885930 - DNA, 22 bp, Artificial Sequence
  chemically synthesized
cacctaatcaaagaagacttac

SEQ ID NO: 885931 - DNA, 22 bp, Artificial Sequence
  chemically synthesized
taaaacacaacagtaagtcttc

SEQ ID NO: 885932 - DNA, 22 bp, Artificial Sequence
  chemically synthesized
ttgtaaaacacaacagtaagtc

SEQ ID NO: 885933 - DNA, 22 bp, Artificial Sequence
  chemically synthesized
atcaaagaagacttactgttgt

SEQ ID NO: 885934 - DNA, 22 bp, Artificial Sequence
  chemically synthesized
attattgtaaaacacaacagta

SEQ ID NO: 885935 - DNA, 22 bp, Artificial Sequence
  chemically synthesized
taattgattattgtaaaacaca

SEQ ID NO: 885936 - DNA, 22 bp, Artificial Sequence
  chemically synthesized
ataattgattattgtaaaacac

SEQ ID NO: 885937 - DNA, 22 bp, Artificial Sequence
  chemically synthesized
actgttgtgttttacaataatc

SEQ ID NO: 885938 - DNA, 22 bp, Artificial Sequence
  chemically synthesized
ctgttgtgttttacaataatca

SEQ ID NO: 885939 - DNA, 22 bp, Artificial Sequence
  chemically synthesized
ttgtgttttacaataatcaatt

SEQ ID NO: 885940 - DNA, 22 bp, Artificial Sequence
  chemically synthesized
tgttttacaataatcaattata

SEQ ID NO: 885941 - DNA, 22 bp, Artificial Sequence
  chemically synthesized
tacaataatcaattataagact

SEQ ID NO: 885942 - DNA, 22 bp, Artificial Sequence
  chemically synthesized
aaataaaatgtgagtcttataa

SEQ ID NO: 885943 - DNA, 22 bp, Artificial Sequence
  chemically synthesized
acaataatcaattataagactc

SEQ ID NO: 885944 - DNA, 22 bp, Artificial Sequence
  chemically synthesized
caataatcaattataagactca

SEQ ID NO: 885945 - DNA, 22 bp, Artificial Sequence
  chemically synthesized
ttgaaataaaatgtgagtctta

SEQ ID NO: 885946 - DNA, 22 bp, Artificial Sequence
  chemically synthesized
acctgttgaaataaaatgtgag

SEQ ID NO: 885947 - DNA, 22 bp, Artificial Sequence
  chemically synthesized
taagactcacattttatttcaa

SEQ ID NO: 885948 - DNA, 22 bp, Artificial Sequence
  chemically synthesized
agagcagctaacctgttgaaat

SEQ ID NO: 885949 - DNA, 22 bp, Artificial Sequence
  chemically synthesized
cagagcagctaacctgttgaaa

SEQ ID NO: 885950 - DNA, 22 bp, Artificial Sequence
  chemically synthesized
acattttatttcaacaggttag

SEQ ID NO: 885951 - DNA, 22 bp, Artificial Sequence
  chemically synthesized
tatttcaacaggttagctgctc

SEQ ID NO: 885952 - DNA, 22 bp, Artificial Sequence
  chemically synthesized
atttcaacaggttagctgctct

SEQ ID NO: 885953 - DNA, 22 bp, Artificial Sequence
  chemically synthesized
tttcaacaggttagctgctctg

SEQ ID NO: 885954 - DNA, 22 bp, Artificial Sequence
  chemically synthesized
caacaggttagctgctctgaaa

SEQ ID NO: 885955 - DNA, 22 bp, Artificial Sequence
  chemically synthesized
aacaggttagctgctctgaaat

SEQ ID NO: 885956 - DNA, 22 bp, Artificial Sequence
  chemically synthesized
taaaacgtgtcccaatttcaga

SEQ ID NO: 885957 - DNA, 22 bp, Artificial Sequence
  chemically synthesized
ataaaacgtgtcccaatttcag

SEQ ID NO: 885958 - DNA, 22 bp, Artificial Sequence
  chemically synthesized
gctgctctgaaattgggacacg

SEQ ID NO: 885959 - DNA, 22 bp, Artificial Sequence
  chemically synthesized
tcatttataaaacgtgtcccaa

SEQ ID NO: 885960 - DNA, 22 bp, Artificial Sequence
  chemically synthesized
ctctgaaattgggacacgtttt

SEQ ID NO: 885961 - DNA, 22 bp, Artificial Sequence
  chemically synthesized
tgaaattgggacacgttttata

SEQ ID NO: 885962 - DNA, 22 bp, Artificial Sequence
  chemically synthesized
aaattgggacacgttttataaa

SEQ ID NO: 885963 - DNA, 22 bp, Artificial Sequence
  chemically synthesized
tgacacgctatcatttataaaa

SEQ ID NO: 885964 - DNA, 22 bp, Artificial Sequence
  chemically synthesized
ggacacgttttataaatgatag

SEQ ID NO: 885965 - DNA, 22 bp, Artificial Sequence
  chemically synthesized
gactatgacacgctatcattta

SEQ ID NO: 885966 - DNA, 22 bp, Artificial Sequence
  chemically synthesized
agactatgacacgctatcattt

SEQ ID NO: 885967 - DNA, 22 bp, Artificial Sequence
  chemically synthesized
tagactatgacacgctatcatt

SEQ ID NO: 885968 - DNA, 22 bp, Artificial Sequence
  chemically synthesized
ccgttttagactatgacacgct

SEQ ID NO: 885969 - DNA, 22 bp, Artificial Sequence
  chemically synthesized
tataaatgatagcgtgtcatag

SEQ ID NO: 885970 - DNA, 22 bp, Artificial Sequence
  chemically synthesized
ataaatgatagcgtgtcatagt

SEQ ID NO: 885971 - DNA, 22 bp, Artificial Sequence
  chemically synthesized
taaatgatagcgtgtcatagtc

SEQ ID NO: 885972 - DNA, 22 bp, Artificial Sequence
  chemically synthesized
accaagaaaaatgtgctgccgt

SEQ ID NO: 885973 - DNA, 22 bp, Artificial Sequence
  chemically synthesized
caccaagaaaaatgtgctgccg

SEQ ID NO: 885974 - DNA, 22 bp, Artificial Sequence
  chemically synthesized
tcaccaagaaaaatgtgctgcc

SEQ ID NO: 885975 - DNA, 22 bp, Artificial Sequence
  chemically synthesized
ttcaccaagaaaaatgtgctgc

SEQ ID NO: 885976 - DNA, 22 bp, Artificial Sequence
  chemically synthesized
tttttcaccaagaaaaatgtgc

SEQ ID NO: 885977 - DNA, 22 bp, Artificial Sequence
  chemically synthesized
atttttcaccaagaaaaatgtg

SEQ ID NO: 885978 - DNA, 22 bp, Artificial Sequence
  chemically synthesized
tatttttcaccaagaaaaatgt

SEQ ID NO: 885979 - DNA, 22 bp, Artificial Sequence
  chemically synthesized
aaacggcagcacatttttcttg

SEQ ID NO: 885980 - DNA, 22 bp, Artificial Sequence
  chemically synthesized
ttttatttttcaccaagaaaaa

SEQ ID NO: 885981 - DNA, 22 bp, Artificial Sequence
  chemically synthesized
ttattttatttttcaccaagaa

SEQ ID NO: 885982 - DNA, 22 bp, Artificial Sequence
  chemically synthesized
ttcttggtgaaaaataaaataa

SEQ ID NO: 885983 - DNA, 22 bp, Artificial Sequence
  chemically synthesized
gagtatgcattgttattttatt

SEQ ID NO: 885984 - DNA, 22 bp, Artificial Sequence
  chemically synthesized
tcttggtgaaaaataaaataac

SEQ ID NO: 885985 - DNA, 22 bp, Artificial Sequence
  chemically synthesized
cttggtgaaaaataaaataaca

SEQ ID NO: 885986 - DNA, 22 bp, Artificial Sequence
  chemically synthesized
ttggtgaaaaataaaataacaa

SEQ ID NO: 885987 - DNA, 22 bp, Artificial Sequence
  chemically synthesized
attagagtatgcattgttattt

SEQ ID NO: 885988 - DNA, 22 bp, Artificial Sequence
  chemically synthesized
ggtgaaaaataaaataacaatg

SEQ ID NO: 885989 - DNA, 22 bp, Artificial Sequence
  chemically synthesized
gtgaaaaataaaataacaatgc

SEQ ID NO: 885990 - DNA, 22 bp, Artificial Sequence
  chemically synthesized
agataccattgattagagtatg

SEQ ID NO: 885991 - DNA, 22 bp, Artificial Sequence
  chemically synthesized
aagataccattgattagagtat

SEQ ID NO: 885992 - DNA, 22 bp, Artificial Sequence
  chemically synthesized
taagataccattgattagagta

SEQ ID NO: 885993 - DNA, 22 bp, Artificial Sequence
  chemically synthesized
ttaagataccattgattagagt

SEQ ID NO: 885994 - DNA, 22 bp, Artificial Sequence
  chemically synthesized
tttttaagataccattgattag

SEQ ID NO: 885995 - DNA, 22 bp, Artificial Sequence
  chemically synthesized
ctgtttttaagataccattgat

SEQ ID NO: 885996 - DNA, 22 bp, Artificial Sequence
  chemically synthesized
actgtttttaagataccattga

SEQ ID NO: 885997 - DNA, 22 bp, Artificial Sequence
  chemically synthesized
tactgtttttaagataccattg

SEQ ID NO: 885998 - DNA, 22 bp, Artificial Sequence
  chemically synthesized
catattttactgtttttaagat

SEQ ID NO: 885999 - DNA, 22 bp, Artificial Sequence
  chemically synthesized
taatcaatggtatcttaaaaac

SEQ ID NO: 886000 - DNA, 22 bp, Artificial Sequence
  chemically synthesized
ccatattttactgtttttaaga

SEQ ID NO: 886001 - DNA, 22 bp, Artificial Sequence
  chemically synthesized
tccatattttactgtttttaag

SEQ ID NO: 886002 - DNA, 22 bp, Artificial Sequence
  chemically synthesized
atcaatggtatcttaaaaacag

SEQ ID NO: 886003 - DNA, 22 bp, Artificial Sequence
  chemically synthesized
atcactttccatattttactgt

SEQ ID NO: 886004 - DNA, 22 bp, Artificial Sequence
  chemically synthesized
aaaaacagtaaaatatggaaag

SEQ ID NO: 886005 - DNA, 22 bp, Artificial Sequence
  chemically synthesized
aaaacagtaaaatatggaaagt

SEQ ID NO: 886006 - DNA, 22 bp, Artificial Sequence
  chemically synthesized
tgaaaagcctgatcactttcca

SEQ ID NO: 886007 - DNA, 22 bp, Artificial Sequence
  chemically synthesized
ctatgaaaagcctgatcacttt

SEQ ID NO: 886008 - DNA, 22 bp, Artificial Sequence
  chemically synthesized
acctactatgaaaagcctgatc

SEQ ID NO: 886009 - DNA, 22 bp, Artificial Sequence
  chemically synthesized
atcctgacctactatgaaaagc

SEQ ID NO: 886010 - DNA, 22 bp, Artificial Sequence
  chemically synthesized
catcctgacctactatgaaaag

SEQ ID NO: 886011 - DNA, 22 bp, Artificial Sequence
  chemically synthesized
aatcatttcatcctgacctact

SEQ ID NO: 886012 - DNA, 22 bp, Artificial Sequence
  chemically synthesized
ttcatagtaggtcaggatgaaa

SEQ ID NO: 886013 - DNA, 22 bp, Artificial Sequence
  chemically synthesized
tcatagtaggtcaggatgaaat

SEQ ID NO: 886014 - DNA, 22 bp, Artificial Sequence
  chemically synthesized
catagtaggtcaggatgaaatg

SEQ ID NO: 886015 - DNA, 22 bp, Artificial Sequence
  chemically synthesized
catgtactaaatcatttcatcc

SEQ ID NO: 886016 - DNA, 22 bp, Artificial Sequence
  chemically synthesized
atagtaggtcaggatgaaatga

SEQ ID NO: 886017 - DNA, 22 bp, Artificial Sequence
  chemically synthesized
acatgtactaaatcatttcatc

SEQ ID NO: 886018 - DNA, 22 bp, Artificial Sequence
  chemically synthesized
tacatgtactaaatcatttcat

SEQ ID NO: 886019 - DNA, 22 bp, Artificial Sequence
  chemically synthesized
cctttacatgtactaaatcatt

SEQ ID NO: 886020 - DNA, 22 bp, Artificial Sequence
  chemically synthesized
agtacatgtaaaggtaatactg

SEQ ID NO: 886021 - DNA, 22 bp, Artificial Sequence
  chemically synthesized
gtacatgtaaaggtaatactgc

SEQ ID NO: 886022 - DNA, 22 bp, Artificial Sequence
  chemically synthesized
caacaaatggtagcagtattac

SEQ ID NO: 886023 - DNA, 22 bp, Artificial Sequence
  chemically synthesized
ccaacaaatggtagcagtatta

SEQ ID NO: 886024 - DNA, 22 bp, Artificial Sequence
  chemically synthesized
gtcagtttccaacaaatggtag

SEQ ID NO: 886025 - DNA, 22 bp, Artificial Sequence
  chemically synthesized
agtcagtttccaacaaatggta

SEQ ID NO: 886026 - DNA, 22 bp, Artificial Sequence
  chemically synthesized
cacttagtcagtttccaacaaa

SEQ ID NO: 886027 - DNA, 22 bp, Artificial Sequence
  chemically synthesized
gcacttagtcagtttccaacaa

SEQ ID NO: 886028 - DNA, 22 bp, Artificial Sequence
  chemically synthesized
ctaccatttgttggaaactgac

SEQ ID NO: 886029 - DNA, 22 bp, Artificial Sequence
  chemically synthesized
ccatttgttggaaactgactaa

SEQ ID NO: 886030 - DNA, 22 bp, Artificial Sequence
  chemically synthesized
gttggaaactgactaagtgcaa

SEQ ID NO: 886031 - DNA, 22 bp, Artificial Sequence
  chemically synthesized
ttggaaactgactaagtgcaaa

SEQ ID NO: 886032 - DNA, 22 bp, Artificial Sequence
  chemically synthesized
gaaactgactaagtgcaaacac

SEQ ID NO: 886033 - DNA, 22 bp, Artificial Sequence
  chemically synthesized
agtgcatagcagagtgtttgca

SEQ ID NO: 886034 - DNA, 22 bp, Artificial Sequence
  chemically synthesized
tgttaagtgcatagcagagtgt

SEQ ID NO: 886035 - DNA, 22 bp, Artificial Sequence
  chemically synthesized
actaagtgcaaacactctgcta

SEQ ID NO: 886036 - DNA, 22 bp, Artificial Sequence
  chemically synthesized
atgttaagtgcatagcagagtg

SEQ ID NO: 886037 - DNA, 22 bp, Artificial Sequence
  chemically synthesized
agtgcaaacactctgctatgca

SEQ ID NO: 886038 - DNA, 22 bp, Artificial Sequence
  chemically synthesized
agatgatttatgttaagtgcat

SEQ ID NO: 886039 - DNA, 22 bp, Artificial Sequence
  chemically synthesized
attaagatgatttatgttaagt

SEQ ID NO: 886040 - DNA, 22 bp, Artificial Sequence
  chemically synthesized
tgctatgcacttaacataaatc

SEQ ID NO: 886041 - DNA, 22 bp, Artificial Sequence
  chemically synthesized
ctatgcacttaacataaatcat

SEQ ID NO: 886042 - DNA, 22 bp, Artificial Sequence
  chemically synthesized
agattaattaagatgatttatg

SEQ ID NO: 886043 - DNA, 22 bp, Artificial Sequence
  chemically synthesized
tgcacttaacataaatcatctt

SEQ ID NO: 886044 - DNA, 22 bp, Artificial Sequence
  chemically synthesized
aacataaatcatcttaattaat

SEQ ID NO: 886045 - DNA, 22 bp, Artificial Sequence
  chemically synthesized
acataaatcatcttaattaatc

SEQ ID NO: 886046 - DNA, 22 bp, Artificial Sequence
  chemically synthesized
caatggagattgagattaatta

SEQ ID NO: 886047 - DNA, 22 bp, Artificial Sequence
  chemically synthesized
tgcaatggagattgagattaat

SEQ ID NO: 886048 - DNA, 22 bp, Artificial Sequence
  chemically synthesized
agaggctctgcaatggagattg

SEQ ID NO: 886049 - DNA, 22 bp, Artificial Sequence
  chemically synthesized
aattaatctcaatctccattgc

SEQ ID NO: 886050 - DNA, 22 bp, Artificial Sequence
  chemically synthesized
ctgagaggctctgcaatggaga

SEQ ID NO: 886051 - DNA, 22 bp, Artificial Sequence
  chemically synthesized
attaatctcaatctccattgca

SEQ ID NO: 886052 - DNA, 22 bp, Artificial Sequence
  chemically synthesized
atctcaatctccattgcagagc

SEQ ID NO: 886053 - DNA, 22 bp, Artificial Sequence
  chemically synthesized
aatctccattgcagagcctctc

SEQ ID NO: 886054 - DNA, 22 bp, Artificial Sequence
  chemically synthesized
cattgcagagcctctcagcaat

SEQ ID NO: 886055 - DNA, 22 bp, Artificial Sequence
  chemically synthesized
aaaaaatggtaatagtattgct

SEQ ID NO: 886056 - DNA, 22 bp, Artificial Sequence
  chemically synthesized
cagagcctctcagcaatactat

SEQ ID NO: 886057 - DNA, 22 bp, Artificial Sequence
  chemically synthesized
atctgaaaaaatggtaatagta

SEQ ID NO: 886058 - DNA, 22 bp, Artificial Sequence
  chemically synthesized
aatctgaaaaaatggtaatagt

SEQ ID NO: 886059 - DNA, 22 bp, Artificial Sequence
  chemically synthesized
taatctgaaaaaatggtaatag

SEQ ID NO: 886060 - DNA, 22 bp, Artificial Sequence
  chemically synthesized
ttaatctgaaaaaatggtaata

SEQ ID NO: 886061 - DNA, 22 bp, Artificial Sequence
  chemically synthesized
tttaatctgaaaaaatggtaat

SEQ ID NO: 886062 - DNA, 22 bp, Artificial Sequence
  chemically synthesized
tcagcaatactattaccatttt

SEQ ID NO: 886063 - DNA, 22 bp, Artificial Sequence
  chemically synthesized
agcaatactattaccatttttt

SEQ ID NO: 886064 - DNA, 22 bp, Artificial Sequence
  chemically synthesized
gttttttaatctgaaaaaatgg

SEQ ID NO: 886065 - DNA, 22 bp, Artificial Sequence
  chemically synthesized
tagttttttaatctgaaaaaat

SEQ ID NO: 886066 - DNA, 22 bp, Artificial Sequence
  chemically synthesized
ttaccattttttcagattaaaa

SEQ ID NO: 886067 - DNA, 22 bp, Artificial Sequence
  chemically synthesized
gtgactctagttttttaatctg

SEQ ID NO: 886068 - DNA, 22 bp, Artificial Sequence
  chemically synthesized
cgtgactctagttttttaatct

SEQ ID NO: 886069 - DNA, 22 bp, Artificial Sequence
  chemically synthesized
tcgtgactctagttttttaatc

SEQ ID NO: 886070 - DNA, 22 bp, Artificial Sequence
  chemically synthesized
ccattttttcagattaaaaaac

SEQ ID NO: 886071 - DNA, 22 bp, Artificial Sequence
  chemically synthesized
acctttcgtgactctagttttt

SEQ ID NO: 886072 - DNA, 22 bp, Artificial Sequence
  chemically synthesized
tttcagattaaaaaactagagt

SEQ ID NO: 886073 - DNA, 22 bp, Artificial Sequence
  chemically synthesized
tgacctttcgtgactctagttt

SEQ ID NO: 886074 - DNA, 22 bp, Artificial Sequence
  chemically synthesized
ttcagattaaaaaactagagtc

SEQ ID NO: 886075 - DNA, 22 bp, Artificial Sequence
  chemically synthesized
ctgacctttcgtgactctagtt

SEQ ID NO: 886076 - DNA, 22 bp, Artificial Sequence
  chemically synthesized
tcagattaaaaaactagagtca

SEQ ID NO: 886077 - DNA, 22 bp, Artificial Sequence
  chemically synthesized
cagattaaaaaactagagtcac

SEQ ID NO: 886078 - DNA, 22 bp, Artificial Sequence
  chemically synthesized
agattaaaaaactagagtcacg

SEQ ID NO: 886079 - DNA, 22 bp, Artificial Sequence
  chemically synthesized
aaaaactagagtcacgaaaggt

SEQ ID NO: 886080 - DNA, 22 bp, Artificial Sequence
  chemically synthesized
ggcaagtttctgacctttcgtg

SEQ ID NO: 886081 - DNA, 22 bp, Artificial Sequence
  chemically synthesized
tgccctaggcaagtttctgacc

SEQ ID NO: 886082 - DNA, 22 bp, Artificial Sequence
  chemically synthesized
gagtcacgaaaggtcagaaact

SEQ ID NO: 886083 - DNA, 22 bp, Artificial Sequence
  chemically synthesized
ggttgtgccctaggcaagtttc

SEQ ID NO: 886084 - DNA, 22 bp, Artificial Sequence
  chemically synthesized
accatatgttaggttgtgccct

SEQ ID NO: 886085 - DNA, 22 bp, Artificial Sequence
  chemically synthesized
agattcaccatatgttaggttg

SEQ ID NO: 886086 - DNA, 22 bp, Artificial Sequence
  chemically synthesized
gcctagggcacaacctaacata

SEQ ID NO: 886087 - DNA, 22 bp, Artificial Sequence
  chemically synthesized
cctagggcacaacctaacatat

SEQ ID NO: 886088 - DNA, 22 bp, Artificial Sequence
  chemically synthesized
gggcacaacctaacatatggtg

SEQ ID NO: 886089 - DNA, 22 bp, Artificial Sequence
  chemically synthesized
aaatctcagattcaccatatgt

SEQ ID NO: 886090 - DNA, 22 bp, Artificial Sequence
  chemically synthesized
gggttcaaatctcagattcacc

SEQ ID NO: 886091 - DNA, 22 bp, Artificial Sequence
  chemically synthesized
acatatggtgaatctgagattt

SEQ ID NO: 886092 - DNA, 22 bp, Artificial Sequence
  chemically synthesized
agaaagactagggttcaaatct

SEQ ID NO: 886093 - DNA, 22 bp, Artificial Sequence
  chemically synthesized
cctcagaaagactagggttcaa

SEQ ID NO: 886094 - DNA, 22 bp, Artificial Sequence
  chemically synthesized
gcctcagaaagactagggttca

SEQ ID NO: 886095 - DNA, 22 bp, Artificial Sequence
  chemically synthesized
agatttgaaccctagtctttct

SEQ ID NO: 886096 - DNA, 22 bp, Artificial Sequence
  chemically synthesized
gaaccctagtctttctgaggca

SEQ ID NO: 886097 - DNA, 22 bp, Artificial Sequence
  chemically synthesized
aaccctagtctttctgaggcaa

SEQ ID NO: 886098 - DNA, 22 bp, Artificial Sequence
  chemically synthesized
tgtatgcaggatttgcctcaga

SEQ ID NO: 886099 - DNA, 22 bp, Artificial Sequence
  chemically synthesized
gtctttctgaggcaaatcctgc

SEQ ID NO: 886100 - DNA, 22 bp, Artificial Sequence
  chemically synthesized
tctgaggcaaatcctgcataca

SEQ ID NO: 886101 - DNA, 22 bp, Artificial Sequence
  chemically synthesized
ctgaggcaaatcctgcatacat

SEQ ID NO: 886102 - DNA, 22 bp, Artificial Sequence
  chemically synthesized
tgaggcaaatcctgcatacata

SEQ ID NO: 886103 - DNA, 22 bp, Artificial Sequence
  chemically synthesized
tagcatagtaattatgtatgca

SEQ ID NO: 886104 - DNA, 22 bp, Artificial Sequence
  chemically synthesized
aggcaaatcctgcatacataat

SEQ ID NO: 886105 - DNA, 22 bp, Artificial Sequence
  chemically synthesized
catacataattactatgctaca

SEQ ID NO: 886106 - DNA, 22 bp, Artificial Sequence
  chemically synthesized
aatccagagaccctgtagcata

SEQ ID NO: 886107 - DNA, 22 bp, Artificial Sequence
  chemically synthesized
aaatccagagaccctgtagcat

SEQ ID NO: 886108 - DNA, 22 bp, Artificial Sequence
  chemically synthesized
ctatgctacagggtctctggat

SEQ ID NO: 886109 - DNA, 22 bp, Artificial Sequence
  chemically synthesized
gtacaatatttaaatccagaga

SEQ ID NO: 886110 - DNA, 22 bp, Artificial Sequence
  chemically synthesized
tgctacagggtctctggattta

SEQ ID NO: 886111 - DNA, 22 bp, Artificial Sequence
  chemically synthesized
ttggtacaatatttaaatccag

SEQ ID NO: 886112 - DNA, 22 bp, Artificial Sequence
  chemically synthesized
attggtacaatatttaaatcca

SEQ ID NO: 886113 - DNA, 22 bp, Artificial Sequence
  chemically synthesized
tattggtacaatatttaaatcc

SEQ ID NO: 886114 - DNA, 22 bp, Artificial Sequence
  chemically synthesized
ttattggtacaatatttaaatc

SEQ ID NO: 886115 - DNA, 22 bp, Artificial Sequence
  chemically synthesized
cagggtctctggatttaaatat

SEQ ID NO: 886116 - DNA, 22 bp, Artificial Sequence
  chemically synthesized
tttattggtacaatatttaaat

SEQ ID NO: 886117 - DNA, 22 bp, Artificial Sequence
  chemically synthesized
ctttttattggtacaatattta

SEQ ID NO: 886118 - DNA, 22 bp, Artificial Sequence
  chemically synthesized
tggatttaaatattgtaccaat

SEQ ID NO: 886119 - DNA, 22 bp, Artificial Sequence
  chemically synthesized
gatttaaatattgtaccaataa

SEQ ID NO: 886120 - DNA, 22 bp, Artificial Sequence
  chemically synthesized
aaatattgtaccaataaaaagt

SEQ ID NO: 886121 - DNA, 22 bp, Artificial Sequence
  chemically synthesized
aatattgtaccaataaaaagta

SEQ ID NO: 886122 - DNA, 22 bp, Artificial Sequence
  chemically synthesized
atcaaataaaacctacttttta

SEQ ID NO: 886123 - DNA, 22 bp, Artificial Sequence
  chemically synthesized
taccaataaaaagtaggtttta

SEQ ID NO: 886124 - DNA, 22 bp, Artificial Sequence
  chemically synthesized
agccgtaggattcatcaaataa

SEQ ID NO: 886125 - DNA, 22 bp, Artificial Sequence
  chemically synthesized
tgagccgtaggattcatcaaat

SEQ ID NO: 886126 - DNA, 22 bp, Artificial Sequence
  chemically synthesized
cgttctgagccgtaggattcat

SEQ ID NO: 886127 - DNA, 22 bp, Artificial Sequence
  chemically synthesized
ttccgttctgagccgtaggatt

SEQ ID NO: 886128 - DNA, 22 bp, Artificial Sequence
  chemically synthesized
gttccgttctgagccgtaggat

SEQ ID NO: 886129 - DNA, 22 bp, Artificial Sequence
  chemically synthesized
tgttccgttctgagccgtagga

SEQ ID NO: 886130 - DNA, 22 bp, Artificial Sequence
  chemically synthesized
tatttgatgaatcctacggctc

SEQ ID NO: 886131 - DNA, 22 bp, Artificial Sequence
  chemically synthesized
atttgatgaatcctacggctca

SEQ ID NO: 886132 - DNA, 22 bp, Artificial Sequence
  chemically synthesized
tttgatgaatcctacggctcag

SEQ ID NO: 886133 - DNA, 22 bp, Artificial Sequence
  chemically synthesized
ctttgttccgttctgagccgta

SEQ ID NO: 886134 - DNA, 22 bp, Artificial Sequence
  chemically synthesized
gatgaatcctacggctcagaac

SEQ ID NO: 886135 - DNA, 22 bp, Artificial Sequence
  chemically synthesized
atgaatcctacggctcagaacg

SEQ ID NO: 886136 - DNA, 22 bp, Artificial Sequence
  chemically synthesized
atcgaaactactttgttccgtt

SEQ ID NO: 886137 - DNA, 22 bp, Artificial Sequence
  chemically synthesized
cggctcagaacggaacaaagta

SEQ ID NO: 886138 - DNA, 22 bp, Artificial Sequence
  chemically synthesized
catcctaatcgaaactactttg

SEQ ID NO: 886139 - DNA, 22 bp, Artificial Sequence
  chemically synthesized
agaacggaacaaagtagtttcg

SEQ ID NO: 886140 - DNA, 22 bp, Artificial Sequence
  chemically synthesized
acattacatcctaatcgaaact

SEQ ID NO: 886141 - DNA, 22 bp, Artificial Sequence
  chemically synthesized
aaactcacattacatcctaatc

SEQ ID NO: 886142 - DNA, 22 bp, Artificial Sequence
  chemically synthesized
attgaaactcacattacatcct

SEQ ID NO: 886143 - DNA, 22 bp, Artificial Sequence
  chemically synthesized
cgattaggatgtaatgtgagtt

SEQ ID NO: 886144 - DNA, 22 bp, Artificial Sequence
  chemically synthesized
gattaggatgtaatgtgagttt

SEQ ID NO: 886145 - DNA, 22 bp, Artificial Sequence
  chemically synthesized
agaaaccctgattgaaactcac

SEQ ID NO: 886146 - DNA, 22 bp, Artificial Sequence
  chemically synthesized
ggatgtaatgtgagtttcaatc

SEQ ID NO: 886147 - DNA, 22 bp, Artificial Sequence
  chemically synthesized
aagctgagaaaccctgattgaa

SEQ ID NO: 886148 - DNA, 22 bp, Artificial Sequence
  chemically synthesized
caatcagggtttctcagcttca

SEQ ID NO: 886149 - DNA, 22 bp, Artificial Sequence
  chemically synthesized
aatcagggtttctcagcttcag

SEQ ID NO: 886150 - DNA, 22 bp, Artificial Sequence
  chemically synthesized
ctcagcttcagccctattgcca

SEQ ID NO: 886151 - DNA, 22 bp, Artificial Sequence
  chemically synthesized
tccagtcccaaatggcaatagg

SEQ ID NO: 886152 - DNA, 22 bp, Artificial Sequence
  chemically synthesized
tcagcttcagccctattgccat

SEQ ID NO: 886153 - DNA, 22 bp, Artificial Sequence
  chemically synthesized
agcttcagccctattgccattt

SEQ ID NO: 886154 - DNA, 22 bp, Artificial Sequence
  chemically synthesized
cagccctattgccatttgggac

SEQ ID NO: 886155 - DNA, 22 bp, Artificial Sequence
  chemically synthesized
agccctattgccatttgggact

SEQ ID NO: 886156 - DNA, 22 bp, Artificial Sequence
  chemically synthesized
ttgccatttgggactggataat

SEQ ID NO: 886157 - DNA, 22 bp, Artificial Sequence
  chemically synthesized
ccgacaagaaataattatccag

SEQ ID NO: 886158 - DNA, 22 bp, Artificial Sequence
  chemically synthesized
ccatttgggactggataattat

SEQ ID NO: 886159 - DNA, 22 bp, Artificial Sequence
  chemically synthesized
gggactggataattatttcttg

SEQ ID NO: 886160 - DNA, 22 bp, Artificial Sequence
  chemically synthesized
ggactggataattatttcttgt

SEQ ID NO: 886161 - DNA, 22 bp, Artificial Sequence
  chemically synthesized
gataattatttcttgtcgggag

SEQ ID NO: 886162 - DNA, 22 bp, Artificial Sequence
  chemically synthesized
cagtacacagggtagctcccga

SEQ ID NO: 886163 - DNA, 22 bp, Artificial Sequence
  chemically synthesized
tttcttgtcgggagctaccctg

SEQ ID NO: 886164 - DNA, 22 bp, Artificial Sequence
  chemically synthesized
cttgtcgggagctaccctgtgt

SEQ ID NO: 886165 - DNA, 22 bp, Artificial Sequence
  chemically synthesized
ttgtcgggagctaccctgtgta

SEQ ID NO: 886166 - DNA, 22 bp, Artificial Sequence
  chemically synthesized
gtcgggagctaccctgtgtact

SEQ ID NO: 886167 - DNA, 22 bp, Artificial Sequence
  chemically synthesized
tcgggagctaccctgtgtactg

SEQ ID NO: 886168 - DNA, 22 bp, Artificial Sequence
  chemically synthesized
caaaacaccctgcagtacacag

SEQ ID NO: 886169 - DNA, 22 bp, Artificial Sequence
  chemically synthesized
ccctgtgtactgcagggtgttt

SEQ ID NO: 886170 - DNA, 22 bp, Artificial Sequence
  chemically synthesized
tgtactgcagggtgttttgcag

SEQ ID NO: 886171 - DNA, 22 bp, Artificial Sequence
  chemically synthesized
cagggtgttttgcagcatgcct

SEQ ID NO: 886172 - DNA, 22 bp, Artificial Sequence
  chemically synthesized
tgcatagtgaccaggcatgctg

SEQ ID NO: 886173 - DNA, 22 bp, Artificial Sequence
  chemically synthesized
gtgcatagtgaccaggcatgct

SEQ ID NO: 886174 - DNA, 22 bp, Artificial Sequence
  chemically synthesized
gcatcttgtgcatagtgaccag

SEQ ID NO: 886175 - DNA, 22 bp, Artificial Sequence
  chemically synthesized
tgcagcatgcctggtcactatg

SEQ ID NO: 886176 - DNA, 22 bp, Artificial Sequence
  chemically synthesized
gcagcatgcctggtcactatgc

SEQ ID NO: 886177 - DNA, 22 bp, Artificial Sequence
  chemically synthesized
ctggcatcttgtgcatagtgac

SEQ ID NO: 886178 - DNA, 22 bp, Artificial Sequence
  chemically synthesized
cagcatgcctggtcactatgca

SEQ ID NO: 886179 - DNA, 22 bp, Artificial Sequence
  chemically synthesized
gtcactatgcacaagatgccag

SEQ ID NO: 886180 - DNA, 22 bp, Artificial Sequence
  chemically synthesized
tgcacaagatgccagtagcact

SEQ ID NO: 886181 - DNA, 22 bp, Artificial Sequence
  chemically synthesized
tcacacatgggggaggagaaag

SEQ ID NO: 886182 - DNA, 22 bp, Artificial Sequence
  chemically synthesized
tggttgtcacacatgggggagg

SEQ ID NO: 886183 - DNA, 22 bp, Artificial Sequence
  chemically synthesized
gtggttgtcacacatgggggag

SEQ ID NO: 886184 - DNA, 22 bp, Artificial Sequence
  chemically synthesized
tctcctcccccatgtgtgacaa

SEQ ID NO: 886185 - DNA, 22 bp, Artificial Sequence
  chemically synthesized
ctcctcccccatgtgtgacaac

SEQ ID NO: 886186 - DNA, 22 bp, Artificial Sequence
  chemically synthesized
gagatatttgtggttgtcacac

SEQ ID NO: 886187 - DNA, 22 bp, Artificial Sequence
  chemically synthesized
tcctcccccatgtgtgacaacc

SEQ ID NO: 886188 - DNA, 22 bp, Artificial Sequence
  chemically synthesized
ctcccccatgtgtgacaaccac

SEQ ID NO: 886189 - DNA, 22 bp, Artificial Sequence
  chemically synthesized
ctggagatatttgtggttgtca

SEQ ID NO: 886190 - DNA, 22 bp, Artificial Sequence
  chemically synthesized
ccccatgtgtgacaaccacaaa

SEQ ID NO: 886191 - DNA, 22 bp, Artificial Sequence
  chemically synthesized
gcaattgctggagatatttgtg

SEQ ID NO: 886192 - DNA, 22 bp, Artificial Sequence
  chemically synthesized
ggcaattgctggagatatttgt

SEQ ID NO: 886193 - DNA, 22 bp, Artificial Sequence
  chemically synthesized
caggggaatttggcaattgctg

SEQ ID NO: 886194 - DNA, 22 bp, Artificial Sequence
  chemically synthesized
cagcaattgccaaattcccctg

SEQ ID NO: 886195 - DNA, 22 bp, Artificial Sequence
  chemically synthesized
ccacagatgattccaggggaat

SEQ ID NO: 886196 - DNA, 22 bp, Artificial Sequence
  chemically synthesized
taccacagatgattccagggga

SEQ ID NO: 886197 - DNA, 22 bp, Artificial Sequence
  chemically synthesized
tctaccacagatgattccaggg

SEQ ID NO: 886198 - DNA, 22 bp, Artificial Sequence
  chemically synthesized
ctctaccacagatgattccagg

SEQ ID NO: 886199 - DNA, 22 bp, Artificial Sequence
  chemically synthesized
ccaaattcccctggaatcatct

SEQ ID NO: 886200 - DNA, 22 bp, Artificial Sequence
  chemically synthesized
ccctggaatcatctgtggtaga

SEQ ID NO: 886201 - DNA, 22 bp, Artificial Sequence
  chemically synthesized
aataatagaatgcttctctacc

SEQ ID NO: 886202 - DNA, 22 bp, Artificial Sequence
  chemically synthesized
gaatcatctgtggtagagaagc

SEQ ID NO: 886203 - DNA, 22 bp, Artificial Sequence
  chemically synthesized
atgtattcaataatagaatgct

SEQ ID NO: 886204 - DNA, 22 bp, Artificial Sequence
  chemically synthesized
catgtattcaataatagaatgc

SEQ ID NO: 886205 - DNA, 22 bp, Artificial Sequence
  chemically synthesized
tggtagagaagcattctattat

SEQ ID NO: 886206 - DNA, 22 bp, Artificial Sequence
  chemically synthesized
cttcatgtattcaataatagaa

SEQ ID NO: 886207 - DNA, 22 bp, Artificial Sequence
  chemically synthesized
ttccttcatgtattcaataata

SEQ ID NO: 886208 - DNA, 22 bp, Artificial Sequence
  chemically synthesized
gttccttcatgtattcaataat

SEQ ID NO: 886209 - DNA, 22 bp, Artificial Sequence
  chemically synthesized
atttgttccttcatgtattcaa

SEQ ID NO: 886210 - DNA, 22 bp, Artificial Sequence
  chemically synthesized
catttgttccttcatgtattca

SEQ ID NO: 886211 - DNA, 22 bp, Artificial Sequence
  chemically synthesized
tcatttgttccttcatgtattc

SEQ ID NO: 886212 - DNA, 22 bp, Artificial Sequence
  chemically synthesized
tttcatttgttccttcatgtat

SEQ ID NO: 886213 - DNA, 22 bp, Artificial Sequence
  chemically synthesized
tattattgaatacatgaaggaa

SEQ ID NO: 886214 - DNA, 22 bp, Artificial Sequence
  chemically synthesized
ttattgaatacatgaaggaaca

SEQ ID NO: 886215 - DNA, 22 bp, Artificial Sequence
  chemically synthesized
ttgaatacatgaaggaacaaat

SEQ ID NO: 886216 - DNA, 22 bp, Artificial Sequence
  chemically synthesized
aatacatgaaggaacaaatgaa

SEQ ID NO: 886217 - DNA, 22 bp, Artificial Sequence
  chemically synthesized
aaaatacagaccgtgaacagac

SEQ ID NO: 886218 - DNA, 22 bp, Artificial Sequence
  chemically synthesized
atgtacactgaaaatacagacc

SEQ ID NO: 886219 - DNA, 22 bp, Artificial Sequence
  chemically synthesized
attcatgtacactgaaaataca

SEQ ID NO: 886220 - DNA, 22 bp, Artificial Sequence
  chemically synthesized
ttcacggtctgtattttcagtg

SEQ ID NO: 886221 - DNA, 22 bp, Artificial Sequence
  chemically synthesized
acggtctgtattttcagtgtac

SEQ ID NO: 886222 - DNA, 22 bp, Artificial Sequence
  chemically synthesized
tattttcagtgtacatgaatta

SEQ ID NO: 886223 - DNA, 22 bp, Artificial Sequence
  chemically synthesized
atatcatgtcatattaattcat

SEQ ID NO: 886224 - DNA, 22 bp, Artificial Sequence
  chemically synthesized
tcagtgtacatgaattaatatg

SEQ ID NO: 886225 - DNA, 22 bp, Artificial Sequence
  chemically synthesized
cagtgtacatgaattaatatga

SEQ ID NO: 886226 - DNA, 22 bp, Artificial Sequence
  chemically synthesized
agtgtacatgaattaatatgac

SEQ ID NO: 886227 - DNA, 22 bp, Artificial Sequence
  chemically synthesized
atatgacatgatatgaatgtct

SEQ ID NO: 886228 - DNA, 22 bp, Artificial Sequence
  chemically synthesized
tatataagagaaaggaaggaaa

SEQ ID NO: 886229 - DNA, 22 bp, Artificial Sequence
  chemically synthesized
catacaatgttgtatataagag

SEQ ID NO: 886230 - DNA, 22 bp, Artificial Sequence
  chemically synthesized
tccttcctttctcttatataca

SEQ ID NO: 886231 - DNA, 22 bp, Artificial Sequence
  chemically synthesized
ccttcctttctcttatatacaa

SEQ ID NO: 886232 - DNA, 22 bp, Artificial Sequence
  chemically synthesized
cttcctttctcttatatacaac

SEQ ID NO: 886233 - DNA, 22 bp, Artificial Sequence
  chemically synthesized
cctttctcttatatacaacatt

SEQ ID NO: 886234 - DNA, 22 bp, Artificial Sequence
  chemically synthesized
ctttctcttatatacaacattg

SEQ ID NO: 886235 - DNA, 22 bp, Artificial Sequence
  chemically synthesized
tctcttatatacaacattgtat

SEQ ID NO: 886236 - DNA, 22 bp, Artificial Sequence
  chemically synthesized
ctcttatatacaacattgtatg

SEQ ID NO: 886237 - DNA, 22 bp, Artificial Sequence
  chemically synthesized
tcttatatacaacattgtatgt

SEQ ID NO: 886238 - DNA, 22 bp, Artificial Sequence
  chemically synthesized
ttatatacaacattgtatgtaa

SEQ ID NO: 886239 - DNA, 22 bp, Artificial Sequence
  chemically synthesized
atatacaacattgtatgtaatg

SEQ ID NO: 886240 - DNA, 22 bp, Artificial Sequence
  chemically synthesized
tatacaacattgtatgtaatgt

SEQ ID NO: 886241 - DNA, 22 bp, Artificial Sequence
  chemically synthesized
aaagagtatatgaacagatgac

SEQ ID NO: 886242 - DNA, 22 bp, Artificial Sequence
  chemically synthesized
tatgtaatgtcatctgttcata

SEQ ID NO: 886243 - DNA, 22 bp, Artificial Sequence
  chemically synthesized
ttcatatactctttcagatgca

SEQ ID NO: 886244 - DNA, 22 bp, Artificial Sequence
  chemically synthesized
atatactctttcagatgcactt

SEQ ID NO: 886245 - DNA, 22 bp, Artificial Sequence
  chemically synthesized
agagacatagcgtgataaaagt

SEQ ID NO: 886246 - DNA, 22 bp, Artificial Sequence
  chemically synthesized
tttcagatgcacttttatcacg

SEQ ID NO: 886247 - DNA, 22 bp, Artificial Sequence
  chemically synthesized
tcagatgcacttttatcacgct

SEQ ID NO: 886248 - DNA, 22 bp, Artificial Sequence
  chemically synthesized
cagatgcacttttatcacgcta

SEQ ID NO: 886249 - DNA, 22 bp, Artificial Sequence
  chemically synthesized
agatgcacttttatcacgctat

SEQ ID NO: 886250 - DNA, 22 bp, Artificial Sequence
  chemically synthesized
aaatgaatgttaagagacatag

SEQ ID NO: 886251 - DNA, 22 bp, Artificial Sequence
  chemically synthesized
ttatcacgctatgtctcttaac

SEQ ID NO: 886252 - DNA, 22 bp, Artificial Sequence
  chemically synthesized
tatcacgctatgtctcttaaca

SEQ ID NO: 886253 - DNA, 22 bp, Artificial Sequence
  chemically synthesized
atcacgctatgtctcttaacat

SEQ ID NO: 886254 - DNA, 22 bp, Artificial Sequence
  chemically synthesized
tcacgctatgtctcttaacatt

SEQ ID NO: 886255 - DNA, 22 bp, Artificial Sequence
  chemically synthesized
tgtctcttaacattcatttgag

SEQ ID NO: 886256 - DNA, 22 bp, Artificial Sequence
  chemically synthesized
atcagaaccacactcaaatgaa

SEQ ID NO: 886257 - DNA, 22 bp, Artificial Sequence
  chemically synthesized
ttaacattcatttgagtgtggt

SEQ ID NO: 886258 - DNA, 22 bp, Artificial Sequence
  chemically synthesized
gaattcatcagaaccacactca

SEQ ID NO: 886259 - DNA, 22 bp, Artificial Sequence
  chemically synthesized
aacattcatttgagtgtggttc

SEQ ID NO: 886260 - DNA, 22 bp, Artificial Sequence
  chemically synthesized
acattcatttgagtgtggttct

SEQ ID NO: 886261 - DNA, 22 bp, Artificial Sequence
  chemically synthesized
atttgagtgtggttctgatgaa

SEQ ID NO: 886262 - DNA, 22 bp, Artificial Sequence
  chemically synthesized
gagtgtggttctgatgaattct

SEQ ID NO: 886263 - DNA, 22 bp, Artificial Sequence
  chemically synthesized
agtgtggttctgatgaattcta

SEQ ID NO: 886264 - DNA, 22 bp, Artificial Sequence
  chemically synthesized
aaacatgccatgatggttagaa

SEQ ID NO: 886265 - DNA, 22 bp, Artificial Sequence
  chemically synthesized
tgatgaattctaaccatcatgg

SEQ ID NO: 886266 - DNA, 22 bp, Artificial Sequence
  chemically synthesized
atgaattctaaccatcatggca

SEQ ID NO: 886267 - DNA, 22 bp, Artificial Sequence
  chemically synthesized
agccagaaactgaaacatgcca

SEQ ID NO: 886268 - DNA, 22 bp, Artificial Sequence
  chemically synthesized
taaccatcatggcatgtttcag

SEQ ID NO: 886269 - DNA, 22 bp, Artificial Sequence
  chemically synthesized
accatcatggcatgtttcagtt

SEQ ID NO: 886270 - DNA, 22 bp, Artificial Sequence
  chemically synthesized
ggacccattcagccagaaactg

SEQ ID NO: 886271 - DNA, 22 bp, Artificial Sequence
  chemically synthesized
cagtttctggctgaatgggtcc

SEQ ID NO: 886272 - DNA, 22 bp, Artificial Sequence
  chemically synthesized
agtttctggctgaatgggtcct

SEQ ID NO: 886273 - DNA, 22 bp, Artificial Sequence
  chemically synthesized
ctggctgaatgggtcctaatat

SEQ ID NO: 886274 - DNA, 22 bp, Artificial Sequence
  chemically synthesized
tggctgaatgggtcctaatatc

SEQ ID NO: 886275 - DNA, 22 bp, Artificial Sequence
  chemically synthesized
gctgaatgggtcctaatatctc

SEQ ID NO: 886276 - DNA, 22 bp, Artificial Sequence
  chemically synthesized
gggtatataatccagagatatt

SEQ ID NO: 886277 - DNA, 22 bp, Artificial Sequence
  chemically synthesized
ggggtatataatccagagatat

SEQ ID NO: 886278 - DNA, 22 bp, Artificial Sequence
  chemically synthesized
aatgggtcctaatatctctgga

SEQ ID NO: 886279 - DNA, 22 bp, Artificial Sequence
  chemically synthesized
tggggtatataatccagagata

SEQ ID NO: 886280 - DNA, 22 bp, Artificial Sequence
  chemically synthesized
ttggggtatataatccagagat

SEQ ID NO: 886281 - DNA, 22 bp, Artificial Sequence
  chemically synthesized
atccttttggggtatataatcc

SEQ ID NO: 886282 - DNA, 22 bp, Artificial Sequence
  chemically synthesized
atatctctggattatatacccc

SEQ ID NO: 886283 - DNA, 22 bp, Artificial Sequence
  chemically synthesized
cctaatccttttggggtatata

SEQ ID NO: 886284 - DNA, 22 bp, Artificial Sequence
  chemically synthesized
tattccctaatccttttggggt

SEQ ID NO: 886285 - DNA, 22 bp, Artificial Sequence
  chemically synthesized
tggattatataccccaaaagga

SEQ ID NO: 886286 - DNA, 22 bp, Artificial Sequence
  chemically synthesized
ctgtattccctaatccttttgg

SEQ ID NO: 886287 - DNA, 22 bp, Artificial Sequence
  chemically synthesized
gattatataccccaaaaggatt

SEQ ID NO: 886288 - DNA, 22 bp, Artificial Sequence
  chemically synthesized
tataccccaaaaggattaggga

SEQ ID NO: 886289 - DNA, 22 bp, Artificial Sequence
  chemically synthesized
gatctactgtattccctaatcc

SEQ ID NO: 886290 - DNA, 22 bp, Artificial Sequence
  chemically synthesized
agatctactgtattccctaatc

SEQ ID NO: 886291 - DNA, 22 bp, Artificial Sequence
  chemically synthesized
gtccttagatctactgtattcc

SEQ ID NO: 886292 - DNA, 22 bp, Artificial Sequence
  chemically synthesized
tagtccttagatctactgtatt

SEQ ID NO: 886293 - DNA, 22 bp, Artificial Sequence
  chemically synthesized
ctagtccttagatctactgtat

SEQ ID NO: 886294 - DNA, 22 bp, Artificial Sequence
  chemically synthesized
tctagtccttagatctactgta

SEQ ID NO: 886295 - DNA, 22 bp, Artificial Sequence
  chemically synthesized
gggaatacagtagatctaagga

SEQ ID NO: 886296 - DNA, 22 bp, Artificial Sequence
  chemically synthesized
atatgtgcctttctagtcctta

SEQ ID NO: 886297 - DNA, 22 bp, Artificial Sequence
  chemically synthesized
aatatgtgcctttctagtcctt

SEQ ID NO: 886298 - DNA, 22 bp, Artificial Sequence
  chemically synthesized
tttaatatgtgcctttctagtc

SEQ ID NO: 886299 - DNA, 22 bp, Artificial Sequence
  chemically synthesized
gtttaatatgtgcctttctagt

SEQ ID NO: 886300 - DNA, 22 bp, Artificial Sequence
  chemically synthesized
tgtttaatatgtgcctttctag

SEQ ID NO: 886301 - DNA, 22 bp, Artificial Sequence
  chemically synthesized
ttgtttaatatgtgcctttcta

SEQ ID NO: 886302 - DNA, 22 bp, Artificial Sequence
  chemically synthesized
aggactagaaaggcacatatta

SEQ ID NO: 886303 - DNA, 22 bp, Artificial Sequence
  chemically synthesized
gaaaggcacatattaaacaaaa

SEQ ID NO: 886304 - DNA, 22 bp, Artificial Sequence
  chemically synthesized
agagatatgtcaaaatcacttt

SEQ ID NO: 886305 - DNA, 22 bp, Artificial Sequence
  chemically synthesized
ttcagagatatgtcaaaatcac

SEQ ID NO: 886306 - DNA, 22 bp, Artificial Sequence
  chemically synthesized
aacaaaagtgattttgacatat

SEQ ID NO: 886307 - DNA, 22 bp, Artificial Sequence
  chemically synthesized
gccactattcagagatatgtca

SEQ ID NO: 886308 - DNA, 22 bp, Artificial Sequence
  chemically synthesized
tgacatatctctgaatagtggc

SEQ ID NO: 886309 - DNA, 22 bp, Artificial Sequence
  chemically synthesized
gacatatctctgaatagtggcc

SEQ ID NO: 886310 - DNA, 22 bp, Artificial Sequence
  chemically synthesized
acatatctctgaatagtggcca

SEQ ID NO: 886311 - DNA, 22 bp, Artificial Sequence
  chemically synthesized
aaataatgcaaatatcactggc

SEQ ID NO: 886312 - DNA, 22 bp, Artificial Sequence
  chemically synthesized
aaaataatgcaaatatcactgg

SEQ ID NO: 886313 - DNA, 22 bp, Artificial Sequence
  chemically synthesized
tgaatagtggccagtgatattt

SEQ ID NO: 886314 - DNA, 22 bp, Artificial Sequence
  chemically synthesized
aatagtggccagtgatatttgc

SEQ ID NO: 886315 - DNA, 22 bp, Artificial Sequence
  chemically synthesized
gtttaaaataatgcaaatatca

SEQ ID NO: 886316 - DNA, 22 bp, Artificial Sequence
  chemically synthesized
tattggtttaaaataatgcaaa

SEQ ID NO: 886317 - DNA, 22 bp, Artificial Sequence
  chemically synthesized
tatattggtttaaaataatgca

SEQ ID NO: 886318 - DNA, 22 bp, Artificial Sequence
  chemically synthesized
gagatgctctatattggtttaa

SEQ ID NO: 886319 - DNA, 22 bp, Artificial Sequence
  chemically synthesized
agagatgctctatattggttta

SEQ ID NO: 886320 - DNA, 22 bp, Artificial Sequence
  chemically synthesized
gcattattttaaaccaatatag

SEQ ID NO: 886321 - DNA, 22 bp, Artificial Sequence
  chemically synthesized
cattattttaaaccaatataga

SEQ ID NO: 886322 - DNA, 22 bp, Artificial Sequence
  chemically synthesized
ttttaaaccaatatagagcatc

SEQ ID NO: 886323 - DNA, 22 bp, Artificial Sequence
  chemically synthesized
taaaccaatatagagcatctct

SEQ ID NO: 886324 - DNA, 22 bp, Artificial Sequence
  chemically synthesized
aaaccaatatagagcatctcta

SEQ ID NO: 886325 - DNA, 22 bp, Artificial Sequence
  chemically synthesized
aaccaatatagagcatctctaa

SEQ ID NO: 886326 - DNA, 22 bp, Artificial Sequence
  chemically synthesized
tatggataataacttagagatg

SEQ ID NO: 886327 - DNA, 22 bp, Artificial Sequence
  chemically synthesized
ctatatggataataacttagag

SEQ ID NO: 886328 - DNA, 22 bp, Artificial Sequence
  chemically synthesized
taagttattatccatatagtaa

SEQ ID NO: 886329 - DNA, 22 bp, Artificial Sequence
  chemically synthesized
agttattatccatatagtaatt

SEQ ID NO: 886330 - DNA, 22 bp, Artificial Sequence
  chemically synthesized
aagaaccatgtccaattactat

SEQ ID NO: 886331 - DNA, 22 bp, Artificial Sequence
  chemically synthesized
aaagaaccatgtccaattacta

SEQ ID NO: 886332 - DNA, 22 bp, Artificial Sequence
  chemically synthesized
ttatccatatagtaattggaca

SEQ ID NO: 886333 - DNA, 22 bp, Artificial Sequence
  chemically synthesized
tccatatagtaattggacatgg

SEQ ID NO: 886334 - DNA, 22 bp, Artificial Sequence
  chemically synthesized
agacttaaagaaccatgtccaa

SEQ ID NO: 886335 - DNA, 22 bp, Artificial Sequence
  chemically synthesized
ttaagacttaaagaaccatgtc

SEQ ID NO: 886336 - DNA, 22 bp, Artificial Sequence
  chemically synthesized
tgttaagacttaaagaaccatg

SEQ ID NO: 886337 - DNA, 22 bp, Artificial Sequence
  chemically synthesized
gacatggttctttaagtcttaa

SEQ ID NO: 886338 - DNA, 22 bp, Artificial Sequence
  chemically synthesized
agtaaatattctgttaagactt

SEQ ID NO: 886339 - DNA, 22 bp, Artificial Sequence
  chemically synthesized
aagtaaatattctgttaagact

SEQ ID NO: 886340 - DNA, 22 bp, Artificial Sequence
  chemically synthesized
tttaagtcttaacagaatattt

SEQ ID NO: 886341 - DNA, 22 bp, Artificial Sequence
  chemically synthesized
taagtcttaacagaatatttac

SEQ ID NO: 886342 - DNA, 22 bp, Artificial Sequence
  chemically synthesized
aagtcttaacagaatatttact

SEQ ID NO: 886343 - DNA, 22 bp, Artificial Sequence
  chemically synthesized
agtcttaacagaatatttactt

SEQ ID NO: 886344 - DNA, 22 bp, Artificial Sequence
  chemically synthesized
ataataacagatttaagtaaat

SEQ ID NO: 886345 - DNA, 22 bp, Artificial Sequence
  chemically synthesized
aataataacagatttaagtaaa

SEQ ID NO: 886346 - DNA, 22 bp, Artificial Sequence
  chemically synthesized
aacagaatatttacttaaatct

SEQ ID NO: 886347 - DNA, 22 bp, Artificial Sequence
  chemically synthesized
acagaatatttacttaaatctg

SEQ ID NO: 886348 - DNA, 22 bp, Artificial Sequence
  chemically synthesized
gtgtttaataataacagattta

SEQ ID NO: 886349 - DNA, 22 bp, Artificial Sequence
  chemically synthesized
tagtgtttaataataacagatt

SEQ ID NO: 886350 - DNA, 22 bp, Artificial Sequence
  chemically synthesized
ctagtgtttaataataacagat

SEQ ID NO: 886351 - DNA, 22 bp, Artificial Sequence
  chemically synthesized
acttaaatctgttattattaaa

SEQ ID NO: 886352 - DNA, 22 bp, Artificial Sequence
  chemically synthesized
cttaaatctgttattattaaac

SEQ ID NO: 886353 - DNA, 22 bp, Artificial Sequence
  chemically synthesized
aaatctgttattattaaacact

SEQ ID NO: 886354 - DNA, 22 bp, Artificial Sequence
  chemically synthesized
aatctgttattattaaacacta

SEQ ID NO: 886355 - DNA, 22 bp, Artificial Sequence
  chemically synthesized
aaaagcaacttctagtgtttaa

SEQ ID NO: 886356 - DNA, 22 bp, Artificial Sequence
  chemically synthesized
aaaaagcaacttctagtgttta

SEQ ID NO: 886357 - DNA, 22 bp, Artificial Sequence
  chemically synthesized
taaaaagcaacttctagtgttt

SEQ ID NO: 886358 - DNA, 22 bp, Artificial Sequence
  chemically synthesized
ttattattaaacactagaagtt

SEQ ID NO: 886359 - DNA, 22 bp, Artificial Sequence
  chemically synthesized
tctttaaaaagcaacttctagt

SEQ ID NO: 886360 - DNA, 22 bp, Artificial Sequence
  chemically synthesized
atctttaaaaagcaacttctag

SEQ ID NO: 886361 - DNA, 22 bp, Artificial Sequence
  chemically synthesized
tatctttaaaaagcaacttcta

SEQ ID NO: 886362 - DNA, 22 bp, Artificial Sequence
  chemically synthesized
ttattaaacactagaagttgct

SEQ ID NO: 886363 - DNA, 22 bp, Artificial Sequence
  chemically synthesized
ttttatctttaaaaagcaactt

SEQ ID NO: 886364 - DNA, 22 bp, Artificial Sequence
  chemically synthesized
ttaaacactagaagttgctttt

SEQ ID NO: 886365 - DNA, 22 bp, Artificial Sequence
  chemically synthesized
aacactagaagttgctttttaa

SEQ ID NO: 886366 - DNA, 22 bp, Artificial Sequence
  chemically synthesized
atggctgttttatctttaaaaa

SEQ ID NO: 886367 - DNA, 22 bp, Artificial Sequence
  chemically synthesized
gaagttgctttttaaagataaa

SEQ ID NO: 886368 - DNA, 22 bp, Artificial Sequence
  chemically synthesized
gcctaatggctgttttatcttt

SEQ ID NO: 886369 - DNA, 22 bp, Artificial Sequence
  chemically synthesized
ctttttaaagataaaacagcca

SEQ ID NO: 886370 - DNA, 22 bp, Artificial Sequence
  chemically synthesized
tttaaagataaaacagccatta

SEQ ID NO: 886371 - DNA, 22 bp, Artificial Sequence
  chemically synthesized
ttaaagataaaacagccattag

SEQ ID NO: 886372 - DNA, 22 bp, Artificial Sequence
  chemically synthesized
atgaaaattagcctaatggctg

SEQ ID NO: 886373 - DNA, 22 bp, Artificial Sequence
  chemically synthesized
taaagataaaacagccattagg

SEQ ID NO: 886374 - DNA, 22 bp, Artificial Sequence
  chemically synthesized
aatgaaaattagcctaatggct

SEQ ID NO: 886375 - DNA, 22 bp, Artificial Sequence
  chemically synthesized
aaagataaaacagccattaggc

SEQ ID NO: 886376 - DNA, 22 bp, Artificial Sequence
  chemically synthesized
taatgaaaattagcctaatggc

SEQ ID NO: 886377 - DNA, 22 bp, Artificial Sequence
  chemically synthesized
aagataaaacagccattaggct

SEQ ID NO: 886378 - DNA, 22 bp, Artificial Sequence
  chemically synthesized
ttaatgaaaattagcctaatgg

SEQ ID NO: 886379 - DNA, 22 bp, Artificial Sequence
  chemically synthesized
cttttaatgaaaattagcctaa

SEQ ID NO: 886380 - DNA, 22 bp, Artificial Sequence
  chemically synthesized
gcttttaatgaaaattagccta

SEQ ID NO: 886381 - DNA, 22 bp, Artificial Sequence
  chemically synthesized
tgcttttaatgaaaattagcct

SEQ ID NO: 886382 - DNA, 22 bp, Artificial Sequence
  chemically synthesized
tttgcttttaatgaaaattagc

SEQ ID NO: 886383 - DNA, 22 bp, Artificial Sequence
  chemically synthesized
ctttgcttttaatgaaaattag

SEQ ID NO: 886384 - DNA, 22 bp, Artificial Sequence
  chemically synthesized
tctttgcttttaatgaaaatta

SEQ ID NO: 886385 - DNA, 22 bp, Artificial Sequence
  chemically synthesized
ttctttgcttttaatgaaaatt

SEQ ID NO: 886386 - DNA, 22 bp, Artificial Sequence
  chemically synthesized
ttttctttgcttttaatgaaaa

SEQ ID NO: 886387 - DNA, 22 bp, Artificial Sequence
  chemically synthesized
ctcttttctttgcttttaatga

SEQ ID NO: 886388 - DNA, 22 bp, Artificial Sequence
  chemically synthesized
ggctaattttcattaaaagcaa

SEQ ID NO: 886389 - DNA, 22 bp, Artificial Sequence
  chemically synthesized
aattgctcttttctttgctttt

SEQ ID NO: 886390 - DNA, 22 bp, Artificial Sequence
  chemically synthesized
attttcattaaaagcaaagaaa

SEQ ID NO: 886391 - DNA, 22 bp, Artificial Sequence
  chemically synthesized
tcattaaaagcaaagaaaagag

SEQ ID NO: 886392 - DNA, 22 bp, Artificial Sequence
  chemically synthesized
cattaaaagcaaagaaaagagc

SEQ ID NO: 886393 - DNA, 22 bp, Artificial Sequence
  chemically synthesized
attaaaagcaaagaaaagagca

SEQ ID NO: 886394 - DNA, 22 bp, Artificial Sequence
  chemically synthesized
aaagcaaagaaaagagcaattc

SEQ ID NO: 886395 - DNA, 22 bp, Artificial Sequence
  chemically synthesized
aagtgcatgtcagtcatgaagt

SEQ ID NO: 886396 - DNA, 22 bp, Artificial Sequence
  chemically synthesized
aaagtgcatgtcagtcatgaag

SEQ ID NO: 886397 - DNA, 22 bp, Artificial Sequence
  chemically synthesized
tttaaagtgcatgtcagtcatg

SEQ ID NO: 886398 - DNA, 22 bp, Artificial Sequence
  chemically synthesized
aattctgacttcatgactgaca

SEQ ID NO: 886399 - DNA, 22 bp, Artificial Sequence
  chemically synthesized
atttaaagtgcatgtcagtcat

SEQ ID NO: 886400 - DNA, 22 bp, Artificial Sequence
  chemically synthesized
tatttaaagtgcatgtcagtca

SEQ ID NO: 886401 - DNA, 22 bp, Artificial Sequence
  chemically synthesized
tgacttcatgactgacatgcac

SEQ ID NO: 886402 - DNA, 22 bp, Artificial Sequence
  chemically synthesized
attttatttaaagtgcatgtca

SEQ ID NO: 886403 - DNA, 22 bp, Artificial Sequence
  chemically synthesized
aattttatttaaagtgcatgtc

SEQ ID NO: 886404 - DNA, 22 bp, Artificial Sequence
  chemically synthesized
acttcatgactgacatgcactt

SEQ ID NO: 886405 - DNA, 22 bp, Artificial Sequence
  chemically synthesized
taattttatttaaagtgcatgt

SEQ ID NO: 886406 - DNA, 22 bp, Artificial Sequence
  chemically synthesized
catgactgacatgcactttaaa

SEQ ID NO: 886407 - DNA, 22 bp, Artificial Sequence
  chemically synthesized
atgactgacatgcactttaaat

SEQ ID NO: 886408 - DNA, 22 bp, Artificial Sequence
  chemically synthesized
acatgcactttaaataaaatta

SEQ ID NO: 886409 - DNA, 22 bp, Artificial Sequence
  chemically synthesized
atagtaaaaacaaaacatcttt

SEQ ID NO: 886410 - DNA, 22 bp, Artificial Sequence
  chemically synthesized
taaataaaattaaagatgtttt

SEQ ID NO: 886411 - DNA, 22 bp, Artificial Sequence
  chemically synthesized
aaataaaattaaagatgttttg

SEQ ID NO: 886412 - DNA, 22 bp, Artificial Sequence
  chemically synthesized
aataaaattaaagatgttttgt

SEQ ID NO: 886413 - DNA, 22 bp, Artificial Sequence
  chemically synthesized
gtacagaacctaatagtaaaaa

SEQ ID NO: 886414 - DNA, 22 bp, Artificial Sequence
  chemically synthesized
aagatgttttgtttttactatt

SEQ ID NO: 886415 - DNA, 22 bp, Artificial Sequence
  chemically synthesized
ggtacagaacctaatagtaaaa

SEQ ID NO: 886416 - DNA, 22 bp, Artificial Sequence
  chemically synthesized
tggtacagaacctaatagtaaa

SEQ ID NO: 886417 - DNA, 22 bp, Artificial Sequence
  chemically synthesized
tgattttggtacagaacctaat

SEQ ID NO: 886418 - DNA, 22 bp, Artificial Sequence
  chemically synthesized
tgtttttactattaggttctgt

SEQ ID NO: 886419 - DNA, 22 bp, Artificial Sequence
  chemically synthesized
gtttttactattaggttctgta

SEQ ID NO: 886420 - DNA, 22 bp, Artificial Sequence
  chemically synthesized
tttttactattaggttctgtac

SEQ ID NO: 886421 - DNA, 22 bp, Artificial Sequence
  chemically synthesized
ttactattaggttctgtaccaa

SEQ ID NO: 886422 - DNA, 22 bp, Artificial Sequence
  chemically synthesized
tactattaggttctgtaccaaa

SEQ ID NO: 886423 - DNA, 22 bp, Artificial Sequence
  chemically synthesized
actattaggttctgtaccaaaa

SEQ ID NO: 886424 - DNA, 22 bp, Artificial Sequence
  chemically synthesized
ctattaggttctgtaccaaaat

SEQ ID NO: 886425 - DNA, 22 bp, Artificial Sequence
  chemically synthesized
gataatgactatgattttggta

SEQ ID NO: 886426 - DNA, 22 bp, Artificial Sequence
  chemically synthesized
agataatgactatgattttggt

SEQ ID NO: 886427 - DNA, 22 bp, Artificial Sequence
  chemically synthesized
ttaggttctgtaccaaaatcat

SEQ ID NO: 886428 - DNA, 22 bp, Artificial Sequence
  chemically synthesized
tagataatgactatgattttgg

SEQ ID NO: 886429 - DNA, 22 bp, Artificial Sequence
  chemically synthesized
ggttctgtaccaaaatcatagt

SEQ ID NO: 886430 - DNA, 22 bp, Artificial Sequence
  chemically synthesized
ttttagataatgactatgattt

SEQ ID NO: 886431 - DNA, 22 bp, Artificial Sequence
  chemically synthesized
tgtaccaaaatcatagtcatta

SEQ ID NO: 886432 - DNA, 22 bp, Artificial Sequence
  chemically synthesized
taccaaaatcatagtcattatc

SEQ ID NO: 886433 - DNA, 22 bp, Artificial Sequence
  chemically synthesized
gaaagagttgttttagataatg

SEQ ID NO: 886434 - DNA, 22 bp, Artificial Sequence
  chemically synthesized
agaaagagttgttttagataat

SEQ ID NO: 886435 - DNA, 22 bp, Artificial Sequence
  chemically synthesized
tggtagcacttagaaagagttg

SEQ ID NO: 886436 - DNA, 22 bp, Artificial Sequence
  chemically synthesized
gttatggtagcacttagaaaga

SEQ ID NO: 886437 - DNA, 22 bp, Artificial Sequence
  chemically synthesized
tctaaaacaactctttctaagt

SEQ ID NO: 886438 - DNA, 22 bp, Artificial Sequence
  chemically synthesized
ttagttatggtagcacttagaa

SEQ ID NO: 886439 - DNA, 22 bp, Artificial Sequence
  chemically synthesized
attagttatggtagcacttaga

SEQ ID NO: 886440 - DNA, 22 bp, Artificial Sequence
  chemically synthesized
aaacaactctttctaagtgcta

SEQ ID NO: 886441 - DNA, 22 bp, Artificial Sequence
  chemically synthesized
agtttattagttatggtagcac

SEQ ID NO: 886442 - DNA, 22 bp, Artificial Sequence
  chemically synthesized
gagtttattagttatggtagca

SEQ ID NO: 886443 - DNA, 22 bp, Artificial Sequence
  chemically synthesized
cttgagtttattagttatggta

SEQ ID NO: 886444 - DNA, 22 bp, Artificial Sequence
  chemically synthesized
tttctaagtgctaccataacta

SEQ ID NO: 886445 - DNA, 22 bp, Artificial Sequence
  chemically synthesized
tctaagtgctaccataactaat

SEQ ID NO: 886446 - DNA, 22 bp, Artificial Sequence
  chemically synthesized
ctaagtgctaccataactaata

SEQ ID NO: 886447 - DNA, 22 bp, Artificial Sequence
  chemically synthesized
attgcttgagtttattagttat

SEQ ID NO: 886448 - DNA, 22 bp, Artificial Sequence
  chemically synthesized
taagtgctaccataactaataa

SEQ ID NO: 886449 - DNA, 22 bp, Artificial Sequence
  chemically synthesized
gattgcttgagtttattagtta

SEQ ID NO: 886450 - DNA, 22 bp, Artificial Sequence
  chemically synthesized
agtgctaccataactaataaac

SEQ ID NO: 886451 - DNA, 22 bp, Artificial Sequence
  chemically synthesized
cccatttgattgcttgagttta

SEQ ID NO: 886452 - DNA, 22 bp, Artificial Sequence
  chemically synthesized
ccataactaataaactcaagca

SEQ ID NO: 886453 - DNA, 22 bp, Artificial Sequence
  chemically synthesized
aattacccatttgattgcttga

SEQ ID NO: 886454 - DNA, 22 bp, Artificial Sequence
  chemically synthesized
attcaattacccatttgattgc

SEQ ID NO: 886455 - DNA, 22 bp, Artificial Sequence
  chemically synthesized
aattcaattacccatttgattg

SEQ ID NO: 886456 - DNA, 22 bp, Artificial Sequence
  chemically synthesized
ataaactcaagcaatcaaatgg

SEQ ID NO: 886457 - DNA, 22 bp, Artificial Sequence
  chemically synthesized
aagcaatcaaatgggtaattga

SEQ ID NO: 886458 - DNA, 22 bp, Artificial Sequence
  chemically synthesized
aaaaaatacgagtttaattcaa

SEQ ID NO: 886459 - DNA, 22 bp, Artificial Sequence
  chemically synthesized
aaaaaaatacgagtttaattca

SEQ ID NO: 886460 - DNA, 22 bp, Artificial Sequence
  chemically synthesized
taaaaaaatacgagtttaattc

SEQ ID NO: 886461 - DNA, 22 bp, Artificial Sequence
  chemically synthesized
ttaaaaaaatacgagtttaatt

SEQ ID NO: 886462 - DNA, 22 bp, Artificial Sequence
  chemically synthesized
tttaaaaaaatacgagtttaat

SEQ ID NO: 886463 - DNA, 22 bp, Artificial Sequence
  chemically synthesized
ttttaaaaaaatacgagtttaa

SEQ ID NO: 886464 - DNA, 22 bp, Artificial Sequence
  chemically synthesized
tttttaaaaaaatacgagttta

SEQ ID NO: 886465 - DNA, 22 bp, Artificial Sequence
  chemically synthesized
ttttttaaaaaaatacgagttt

SEQ ID NO: 886466 - DNA, 22 bp, Artificial Sequence
  chemically synthesized
tttttttttaaaaaaatacgag

SEQ ID NO: 886467 - DNA, 22 bp, Artificial Sequence
  chemically synthesized
ctgtttttttttaaaaaaatac

SEQ ID NO: 886468 - DNA, 22 bp, Artificial Sequence
  chemically synthesized
aattaaactcgtatttttttaa

SEQ ID NO: 886469 - DNA, 22 bp, Artificial Sequence
  chemically synthesized
ttgctgtttttttttaaaaaaa

SEQ ID NO: 886470 - DNA, 22 bp, Artificial Sequence
  chemically synthesized
aactcgtatttttttaaaaaaa

SEQ ID NO: 886471 - DNA, 22 bp, Artificial Sequence
  chemically synthesized
gtatttttttaaaaaaaaacag

SEQ ID NO: 886472 - DNA, 22 bp, Artificial Sequence
  chemically synthesized
ttttaaaaaaaaacagcaacaa

SEQ ID NO: 886473 - DNA, 22 bp, Artificial Sequence
  chemically synthesized
tttaaaaaaaaacagcaacaat

SEQ ID NO: 886474 - DNA, 22 bp, Artificial Sequence
  chemically synthesized
ttaaaaaaaaacagcaacaata

SEQ ID NO: 886475 - DNA, 22 bp, Artificial Sequence
  chemically synthesized
taaaaaaaaacagcaacaatat

SEQ ID NO: 886476 - DNA, 22 bp, Artificial Sequence
  chemically synthesized
aaaaaaaaacagcaacaatata

SEQ ID NO: 886477 - DNA, 22 bp, Artificial Sequence
  chemically synthesized
aaaaaaaacagcaacaatatat

SEQ ID NO: 886478 - DNA, 22 bp, Artificial Sequence
  chemically synthesized
agaagagagaatgcagatatat

SEQ ID NO: 886479 - DNA, 22 bp, Artificial Sequence
  chemically synthesized
ggaagagtattcagaagagaga

SEQ ID NO: 886480 - DNA, 22 bp, Artificial Sequence
  chemically synthesized
aggaagagtattcagaagagag

SEQ ID NO: 886481 - DNA, 22 bp, Artificial Sequence
  chemically synthesized
cattctctcttctgaatactct

SEQ ID NO: 886482 - DNA, 22 bp, Artificial Sequence
  chemically synthesized
tacatgtttaggaagagtattc

SEQ ID NO: 886483 - DNA, 22 bp, Artificial Sequence
  chemically synthesized
ctgtacatgtttaggaagagta

SEQ ID NO: 886484 - DNA, 22 bp, Artificial Sequence
  chemically synthesized
tctcttctgaatactcttccta

SEQ ID NO: 886485 - DNA, 22 bp, Artificial Sequence
  chemically synthesized
cctgtacatgtttaggaagagt

SEQ ID NO: 886486 - DNA, 22 bp, Artificial Sequence
  chemically synthesized
tcttctgaatactcttcctaaa

SEQ ID NO: 886487 - DNA, 22 bp, Artificial Sequence
  chemically synthesized
tttcctgtacatgtttaggaag

SEQ ID NO: 886488 - DNA, 22 bp, Artificial Sequence
  chemically synthesized
ttctgaatactcttcctaaaca

SEQ ID NO: 886489 - DNA, 22 bp, Artificial Sequence
  chemically synthesized
ctgaatactcttcctaaacatg

SEQ ID NO: 886490 - DNA, 22 bp, Artificial Sequence
  chemically synthesized
ctgtttcctgtacatgtttagg

SEQ ID NO: 886491 - DNA, 22 bp, Artificial Sequence
  chemically synthesized
tgaatactcttcctaaacatgt

SEQ ID NO: 886492 - DNA, 22 bp, Artificial Sequence
  chemically synthesized
gctgtttcctgtacatgtttag

SEQ ID NO: 886493 - DNA, 22 bp, Artificial Sequence
  chemically synthesized
aatactcttcctaaacatgtac

SEQ ID NO: 886494 - DNA, 22 bp, Artificial Sequence
  chemically synthesized
ttcctaaacatgtacaggaaac

SEQ ID NO: 886495 - DNA, 22 bp, Artificial Sequence
  chemically synthesized
cctaaacatgtacaggaaacag

SEQ ID NO: 886496 - DNA, 22 bp, Artificial Sequence
  chemically synthesized
ctaaacatgtacaggaaacagc

SEQ ID NO: 886497 - DNA, 22 bp, Artificial Sequence
  chemically synthesized
aacatgtacaggaaacagcaaa

SEQ ID NO: 886498 - DNA, 22 bp, Artificial Sequence
  chemically synthesized
agaaacccatatatttgctgtt

SEQ ID NO: 886499 - DNA, 22 bp, Artificial Sequence
  chemically synthesized
cagaaacccatatatttgctgt

SEQ ID NO: 886500 - DNA, 22 bp, Artificial Sequence
  chemically synthesized
atttcagaaacccatatatttg

SEQ ID NO: 886501 - DNA, 22 bp, Artificial Sequence
  chemically synthesized
gatttcagaaacccatatattt

SEQ ID NO: 886502 - DNA, 22 bp, Artificial Sequence
  chemically synthesized
ttgatttcagaaacccatatat

SEQ ID NO: 886503 - DNA, 22 bp, Artificial Sequence
  chemically synthesized
cttgatttcagaaacccatata

SEQ ID NO: 886504 - DNA, 22 bp, Artificial Sequence
  chemically synthesized
tcttgatttcagaaacccatat

SEQ ID NO: 886505 - DNA, 22 bp, Artificial Sequence
  chemically synthesized
ttcttgatttcagaaacccata

SEQ ID NO: 886506 - DNA, 22 bp, Artificial Sequence
  chemically synthesized
tttcttgatttcagaaacccat

SEQ ID NO: 886507 - DNA, 22 bp, Artificial Sequence
  chemically synthesized
cataatgtgtcctttttcttga

SEQ ID NO: 886508 - DNA, 22 bp, Artificial Sequence
  chemically synthesized
ttacataatgtgtcctttttct

SEQ ID NO: 886509 - DNA, 22 bp, Artificial Sequence
  chemically synthesized
attacataatgtgtcctttttc

SEQ ID NO: 886510 - DNA, 22 bp, Artificial Sequence
  chemically synthesized
tattacataatgtgtccttttt

SEQ ID NO: 886511 - DNA, 22 bp, Artificial Sequence
  chemically synthesized
ctgaaatcaagaaaaaggacac

SEQ ID NO: 886512 - DNA, 22 bp, Artificial Sequence
  chemically synthesized
tgaaatcaagaaaaaggacaca

SEQ ID NO: 886513 - DNA, 22 bp, Artificial Sequence
  chemically synthesized
aaatcaagaaaaaggacacatt

SEQ ID NO: 886514 - DNA, 22 bp, Artificial Sequence
  chemically synthesized
gctttattacataatgtgtcct

SEQ ID NO: 886515 - DNA, 22 bp, Artificial Sequence
  chemically synthesized
agtaaaccaggaattggcttta

SEQ ID NO: 886516 - DNA, 22 bp, Artificial Sequence
  chemically synthesized
tgtaataaagccaattcctggt

SEQ ID NO: 886517 - DNA, 22 bp, Artificial Sequence
  chemically synthesized
acatattgagtaaaccaggaat

SEQ ID NO: 886518 - DNA, 22 bp, Artificial Sequence
  chemically synthesized
ctggtttactcaatatgtcagt

SEQ ID NO: 886519 - DNA, 22 bp, Artificial Sequence
  chemically synthesized
gtttactcaatatgtcagtctt

SEQ ID NO: 886520 - DNA, 22 bp, Artificial Sequence
  chemically synthesized
gtatcacagatgaagactgaca

SEQ ID NO: 886521 - DNA, 22 bp, Artificial Sequence
  chemically synthesized
actcaatatgtcagtcttcatc

SEQ ID NO: 886522 - DNA, 22 bp, Artificial Sequence
  chemically synthesized
ctcaatatgtcagtcttcatct

SEQ ID NO: 886523 - DNA, 22 bp, Artificial Sequence
  chemically synthesized
aatatgtcagtcttcatctgtg

SEQ ID NO: 886524 - DNA, 22 bp, Artificial Sequence
  chemically synthesized
aagacctggtatcacagatgaa

SEQ ID NO: 886525 - DNA, 22 bp, Artificial Sequence
  chemically synthesized
catctgtgataccaggtcttta

SEQ ID NO: 886526 - DNA, 22 bp, Artificial Sequence
  chemically synthesized
agtgcaacagtctaaagacctg

SEQ ID NO: 886527 - DNA, 22 bp, Artificial Sequence
  chemically synthesized
atctgtgataccaggtctttag

SEQ ID NO: 886528 - DNA, 22 bp, Artificial Sequence
  chemically synthesized
tgataccaggtctttagactgt

SEQ ID NO: 886529 - DNA, 22 bp, Artificial Sequence
  chemically synthesized
taagtgtataaaggctaagtgc

SEQ ID NO: 886530 - DNA, 22 bp, Artificial Sequence
  chemically synthesized
tagactgttgcacttagccttt

SEQ ID NO: 886531 - DNA, 22 bp, Artificial Sequence
  chemically synthesized
agactgttgcacttagccttta

SEQ ID NO: 886532 - DNA, 22 bp, Artificial Sequence
  chemically synthesized
gactgttgcacttagcctttat

SEQ ID NO: 886533 - DNA, 22 bp, Artificial Sequence
  chemically synthesized
ttgcacttagcctttatacact

SEQ ID NO: 886534 - DNA, 22 bp, Artificial Sequence
  chemically synthesized
cacttagcctttatacacttat

SEQ ID NO: 886535 - DNA, 22 bp, Artificial Sequence
  chemically synthesized
agcctttatacacttataactc

SEQ ID NO: 886536 - DNA, 22 bp, Artificial Sequence
  chemically synthesized
gcctttatacacttataactca

SEQ ID NO: 886537 - DNA, 22 bp, Artificial Sequence
  chemically synthesized
tatacacttataactcatgatt

SEQ ID NO: 886538 - DNA, 22 bp, Artificial Sequence
  chemically synthesized
atacacttataactcatgattt

SEQ ID NO: 886539 - DNA, 22 bp, Artificial Sequence
  chemically synthesized
tacacttataactcatgatttc

SEQ ID NO: 886540 - DNA, 22 bp, Artificial Sequence
  chemically synthesized
gtggaacatatggaaatcatga

SEQ ID NO: 886541 - DNA, 22 bp, Artificial Sequence
  chemically synthesized
agtggaacatatggaaatcatg

SEQ ID NO: 886542 - DNA, 22 bp, Artificial Sequence
  chemically synthesized
cttagtggaacatatggaaatc

SEQ ID NO: 886543 - DNA, 22 bp, Artificial Sequence
  chemically synthesized
ataactcatgatttccatatgt

SEQ ID NO: 886544 - DNA, 22 bp, Artificial Sequence
  chemically synthesized
taactcatgatttccatatgtt

SEQ ID NO: 886545 - DNA, 22 bp, Artificial Sequence
  chemically synthesized
atgatttccatatgttccacta

SEQ ID NO: 886546 - DNA, 22 bp, Artificial Sequence
  chemically synthesized
gtgaaaatggctacttagtgga

SEQ ID NO: 886547 - DNA, 22 bp, Artificial Sequence
  chemically synthesized
ccatatgttccactaagtagcc

SEQ ID NO: 886548 - DNA, 22 bp, Artificial Sequence
  chemically synthesized
catatgttccactaagtagcca

SEQ ID NO: 886549 - DNA, 22 bp, Artificial Sequence
  chemically synthesized
aggagactagtgaaaatggcta

SEQ ID NO: 886550 - DNA, 22 bp, Artificial Sequence
  chemically synthesized
caggagactagtgaaaatggct

SEQ ID NO: 886551 - DNA, 22 bp, Artificial Sequence
  chemically synthesized
tcaggagactagtgaaaatggc

SEQ ID NO: 886552 - DNA, 22 bp, Artificial Sequence
  chemically synthesized
ttcaggagactagtgaaaatgg

SEQ ID NO: 886553 - DNA, 22 bp, Artificial Sequence
  chemically synthesized
cactaagtagccattttcacta

SEQ ID NO: 886554 - DNA, 22 bp, Artificial Sequence
  chemically synthesized
acttttcaggagactagtgaaa

SEQ ID NO: 886555 - DNA, 22 bp, Artificial Sequence
  chemically synthesized
agtagccattttcactagtctc

SEQ ID NO: 886556 - DNA, 22 bp, Artificial Sequence
  chemically synthesized
tcgttgacttttcaggagacta

SEQ ID NO: 886557 - DNA, 22 bp, Artificial Sequence
  chemically synthesized
atcgttgacttttcaggagact

SEQ ID NO: 886558 - DNA, 22 bp, Artificial Sequence
  chemically synthesized
tcactagtctcctgaaaagtca

SEQ ID NO: 886559 - DNA, 22 bp, Artificial Sequence
  chemically synthesized
cactagtctcctgaaaagtcaa

SEQ ID NO: 886560 - DNA, 22 bp, Artificial Sequence
  chemically synthesized
actagtctcctgaaaagtcaac

SEQ ID NO: 886561 - DNA, 22 bp, Artificial Sequence
  chemically synthesized
tccaaaatcttatcgttgactt

SEQ ID NO: 886562 - DNA, 22 bp, Artificial Sequence
  chemically synthesized
atccaaaatcttatcgttgact

SEQ ID NO: 886563 - DNA, 22 bp, Artificial Sequence
  chemically synthesized
gtctcctgaaaagtcaacgata

SEQ ID NO: 886564 - DNA, 22 bp, Artificial Sequence
  chemically synthesized
cttatccaaaatcttatcgttg

SEQ ID NO: 886565 - DNA, 22 bp, Artificial Sequence
  chemically synthesized
ctgaaaagtcaacgataagatt

SEQ ID NO: 886566 - DNA, 22 bp, Artificial Sequence
  chemically synthesized
aaaagtcaacgataagattttg

SEQ ID NO: 886567 - DNA, 22 bp, Artificial Sequence
  chemically synthesized
caattccttatccaaaatctta

SEQ ID NO: 886568 - DNA, 22 bp, Artificial Sequence
  chemically synthesized
atatataagtctacaattcctt

SEQ ID NO: 886569 - DNA, 22 bp, Artificial Sequence
  chemically synthesized
tggataaggaattgtagactta

SEQ ID NO: 886570 - DNA, 22 bp, Artificial Sequence
  chemically synthesized
ggataaggaattgtagacttat

SEQ ID NO: 886571 - DNA, 22 bp, Artificial Sequence
  chemically synthesized
gataaggaattgtagacttata

SEQ ID NO: 886572 - DNA, 22 bp, Artificial Sequence
  chemically synthesized
tatgcacctaatatataagtct

SEQ ID NO: 886573 - DNA, 22 bp, Artificial Sequence
  chemically synthesized
gattatatgcacctaatatata

SEQ ID NO: 886574 - DNA, 22 bp, Artificial Sequence
  chemically synthesized
tggattatatgcacctaatata

SEQ ID NO: 886575 - DNA, 22 bp, Artificial Sequence
  chemically synthesized
tagacttatatattaggtgcat

SEQ ID NO: 886576 - DNA, 22 bp, Artificial Sequence
  chemically synthesized
gtagagttctggattatatgca

SEQ ID NO: 886577 - DNA, 22 bp, Artificial Sequence
  chemically synthesized
atatattaggtgcatataatcc

SEQ ID NO: 886578 - DNA, 22 bp, Artificial Sequence
  chemically synthesized
tagtagagttctggattatatg

SEQ ID NO: 886579 - DNA, 22 bp, Artificial Sequence
  chemically synthesized
tatattaggtgcatataatcca

SEQ ID NO: 886580 - DNA, 22 bp, Artificial Sequence
  chemically synthesized
gattctagtagagttctggatt

SEQ ID NO: 886581 - DNA, 22 bp, Artificial Sequence
  chemically synthesized
tagattctagtagagttctgga

SEQ ID NO: 886582 - DNA, 22 bp, Artificial Sequence
  chemically synthesized
ggtgcatataatccagaactct

SEQ ID NO: 886583 - DNA, 22 bp, Artificial Sequence
  chemically synthesized
tatattctagattctagtagag

SEQ ID NO: 886584 - DNA, 22 bp, Artificial Sequence
  chemically synthesized
tctgtatattctagattctagt

SEQ ID NO: 886585 - DNA, 22 bp, Artificial Sequence
  chemically synthesized
atatgagttgtctgtatattct

SEQ ID NO: 886586 - DNA, 22 bp, Artificial Sequence
  chemically synthesized
tactagaatctagaatatacag

SEQ ID NO: 886587 - DNA, 22 bp, Artificial Sequence
  chemically synthesized
ctagaatctagaatatacagac

SEQ ID NO: 886588 - DNA, 22 bp, Artificial Sequence
  chemically synthesized
gaatctagaatatacagacaac

SEQ ID NO: 886589 - DNA, 22 bp, Artificial Sequence
  chemically synthesized
ccgattaatatgagttgtctgt

SEQ ID NO: 886590 - DNA, 22 bp, Artificial Sequence
  chemically synthesized
accgattaatatgagttgtctg

SEQ ID NO: 886591 - DNA, 22 bp, Artificial Sequence
  chemically synthesized
ttaccgattaatatgagttgtc

SEQ ID NO: 886592 - DNA, 22 bp, Artificial Sequence
  chemically synthesized
tcttaccgattaatatgagttg

SEQ ID NO: 886593 - DNA, 22 bp, Artificial Sequence
  chemically synthesized
gaatatacagacaactcatatt

SEQ ID NO: 886594 - DNA, 22 bp, Artificial Sequence
  chemically synthesized
ctcttaccgattaatatgagtt

SEQ ID NO: 886595 - DNA, 22 bp, Artificial Sequence
  chemically synthesized
tctcttaccgattaatatgagt

SEQ ID NO: 886596 - DNA, 22 bp, Artificial Sequence
  chemically synthesized
ctttctcttaccgattaatatg

SEQ ID NO: 886597 - DNA, 22 bp, Artificial Sequence
  chemically synthesized
actttctcttaccgattaatat

SEQ ID NO: 886598 - DNA, 22 bp, Artificial Sequence
  chemically synthesized
tttactttctcttaccgattaa

SEQ ID NO: 886599 - DNA, 22 bp, Artificial Sequence
  chemically synthesized
gattgtttactttctcttaccg

SEQ ID NO: 886600 - DNA, 22 bp, Artificial Sequence
  chemically synthesized
atattaatcggtaagagaaagt

SEQ ID NO: 886601 - DNA, 22 bp, Artificial Sequence
  chemically synthesized
cgttggattgtttactttctct

SEQ ID NO: 886602 - DNA, 22 bp, Artificial Sequence
  chemically synthesized
ccgttggattgtttactttctc

SEQ ID NO: 886603 - DNA, 22 bp, Artificial Sequence
  chemically synthesized
tccgttggattgtttactttct

SEQ ID NO: 886604 - DNA, 22 bp, Artificial Sequence
  chemically synthesized
atcggtaagagaaagtaaacaa

SEQ ID NO: 886605 - DNA, 22 bp, Artificial Sequence
  chemically synthesized
ccccaattttccgttggattgt

SEQ ID NO: 886606 - DNA, 22 bp, Artificial Sequence
  chemically synthesized
accccaattttccgttggattg

SEQ ID NO: 886607 - DNA, 22 bp, Artificial Sequence
  chemically synthesized
atatatttaccccaattttccg

SEQ ID NO: 886608 - DNA, 22 bp, Artificial Sequence
  chemically synthesized
catatatttaccccaattttcc

SEQ ID NO: 886609 - DNA, 22 bp, Artificial Sequence
  chemically synthesized
ttcatatatttaccccaatttt

SEQ ID NO: 886610 - DNA, 22 bp, Artificial Sequence
  chemically synthesized
actcttcatatatttaccccaa

SEQ ID NO: 886611 - DNA, 22 bp, Artificial Sequence
  chemically synthesized
tgagttgactcttcatatattt

SEQ ID NO: 886612 - DNA, 22 bp, Artificial Sequence
  chemically synthesized
tgtgagttgactcttcatatat

SEQ ID NO: 886613 - DNA, 22 bp, Artificial Sequence
  chemically synthesized
ctgtgagttgactcttcatata

SEQ ID NO: 886614 - DNA, 22 bp, Artificial Sequence
  chemically synthesized
cttctgtgagttgactcttcat

SEQ ID NO: 886615 - DNA, 22 bp, Artificial Sequence
  chemically synthesized
ccttctgtgagttgactcttca

SEQ ID NO: 886616 - DNA, 22 bp, Artificial Sequence
  chemically synthesized
gggtaaatatatgaagagtcaa

SEQ ID NO: 886617 - DNA, 22 bp, Artificial Sequence
  chemically synthesized
tccttctgtgagttgactcttc

SEQ ID NO: 886618 - DNA, 22 bp, Artificial Sequence
  chemically synthesized
ttccttctgtgagttgactctt

SEQ ID NO: 886619 - DNA, 22 bp, Artificial Sequence
  chemically synthesized
gacagatttttccttctgtgag

SEQ ID NO: 886620 - DNA, 22 bp, Artificial Sequence
  chemically synthesized
ttggacagatttttccttctgt

SEQ ID NO: 886621 - DNA, 22 bp, Artificial Sequence
  chemically synthesized
gttggacagatttttccttctg

SEQ ID NO: 886622 - DNA, 22 bp, Artificial Sequence
  chemically synthesized
aagtttgttggacagatttttc

SEQ ID NO: 886623 - DNA, 22 bp, Artificial Sequence
  chemically synthesized
caagtttgttggacagattttt

SEQ ID NO: 886624 - DNA, 22 bp, Artificial Sequence
  chemically synthesized
tcaagtttgttggacagatttt

SEQ ID NO: 886625 - DNA, 22 bp, Artificial Sequence
  chemically synthesized
acagaaggaaaaatctgtccaa

SEQ ID NO: 886626 - DNA, 22 bp, Artificial Sequence
  chemically synthesized
aacaagttttcaagtttgttgg

SEQ ID NO: 886627 - DNA, 22 bp, Artificial Sequence
  chemically synthesized
gttgaacaagttttcaagtttg

SEQ ID NO: 886628 - DNA, 22 bp, Artificial Sequence
  chemically synthesized
tccaacaaacttgaaaacttgt

SEQ ID NO: 886629 - DNA, 22 bp, Artificial Sequence
  chemically synthesized
catatccctggttgaacaagtt

SEQ ID NO: 886630 - DNA, 22 bp, Artificial Sequence
  chemically synthesized
gcatatccctggttgaacaagt

SEQ ID NO: 886631 - DNA, 22 bp, Artificial Sequence
  chemically synthesized
atttgcatatccctggttgaac

SEQ ID NO: 886632 - DNA, 22 bp, Artificial Sequence
  chemically synthesized
aatttgcatatccctggttgaa

SEQ ID NO: 886633 - DNA, 22 bp, Artificial Sequence
  chemically synthesized
taatttgcatatccctggttga

SEQ ID NO: 886634 - DNA, 22 bp, Artificial Sequence
  chemically synthesized
gaaaacttgttcaaccagggat

SEQ ID NO: 886635 - DNA, 22 bp, Artificial Sequence
  chemically synthesized
aaaacttgttcaaccagggata

SEQ ID NO: 886636 - DNA, 22 bp, Artificial Sequence
  chemically synthesized
ttttaatttgcatatccctggt

SEQ ID NO: 886637 - DNA, 22 bp, Artificial Sequence
  chemically synthesized
ttattttaatttgcatatccct

SEQ ID NO: 886638 - DNA, 22 bp, Artificial Sequence
  chemically synthesized
attattttaatttgcatatccc

SEQ ID NO: 886639 - DNA, 22 bp, Artificial Sequence
  chemically synthesized
gttcaaccagggatatgcaaat

SEQ ID NO: 886640 - DNA, 22 bp, Artificial Sequence
  chemically synthesized
ttcaaccagggatatgcaaatt

SEQ ID NO: 886641 - DNA, 22 bp, Artificial Sequence
  chemically synthesized
aaccagggatatgcaaattaaa

SEQ ID NO: 886642 - DNA, 22 bp, Artificial Sequence
  chemically synthesized
aaataataaattcctgccactt

SEQ ID NO: 886643 - DNA, 22 bp, Artificial Sequence
  chemically synthesized
caccagcagcaagaagtggcag

SEQ ID NO: 886644 - DNA, 22 bp, Artificial Sequence
  chemically synthesized
ccaccagcagcaagaagtggca

SEQ ID NO: 886645 - DNA, 22 bp, Artificial Sequence
  chemically synthesized
tccaccagcagcaagaagtggc

SEQ ID NO: 886646 - DNA, 22 bp, Artificial Sequence
  chemically synthesized
ttccaccagcagcaagaagtgg

SEQ ID NO: 886647 - DNA, 22 bp, Artificial Sequence
  chemically synthesized
cttttccaccagcagcaagaag

SEQ ID NO: 886648 - DNA, 22 bp, Artificial Sequence
  chemically synthesized
ctgccacttcttgctgctggtg

SEQ ID NO: 886649 - DNA, 22 bp, Artificial Sequence
  chemically synthesized
caaattgcttttccaccagcag

SEQ ID NO: 886650 - DNA, 22 bp, Artificial Sequence
  chemically synthesized
ccacttcttgctgctggtggaa

SEQ ID NO: 886651 - DNA, 22 bp, Artificial Sequence
  chemically synthesized
cttgctgctggtggaaaagcaa

SEQ ID NO: 886652 - DNA, 22 bp, Artificial Sequence
  chemically synthesized
ttgctgctggtggaaaagcaat

SEQ ID NO: 886653 - DNA, 22 bp, Artificial Sequence
  chemically synthesized
tcatatattgcaaattgctttt

SEQ ID NO: 886654 - DNA, 22 bp, Artificial Sequence
  chemically synthesized
gctgctggtggaaaagcaattt

SEQ ID NO: 886655 - DNA, 22 bp, Artificial Sequence
  chemically synthesized
atcatatattgcaaattgcttt

SEQ ID NO: 886656 - DNA, 22 bp, Artificial Sequence
  chemically synthesized
ctgctggtggaaaagcaatttg

SEQ ID NO: 886657 - DNA, 22 bp, Artificial Sequence
  chemically synthesized
tatcatatattgcaaattgctt

SEQ ID NO: 886658 - DNA, 22 bp, Artificial Sequence
  chemically synthesized
ctggtggaaaagcaatttgcaa

SEQ ID NO: 886659 - DNA, 22 bp, Artificial Sequence
  chemically synthesized
attttatcatatattgcaaatt

SEQ ID NO: 886660 - DNA, 22 bp, Artificial Sequence
  chemically synthesized
aattttatcatatattgcaaat

SEQ ID NO: 886661 - DNA, 22 bp, Artificial Sequence
  chemically synthesized
gtggaaaagcaatttgcaatat

SEQ ID NO: 886662 - DNA, 22 bp, Artificial Sequence
  chemically synthesized
taattttatcatatattgcaaa

SEQ ID NO: 886663 - DNA, 22 bp, Artificial Sequence
  chemically synthesized
ttaattttatcatatattgcaa

SEQ ID NO: 886664 - DNA, 22 bp, Artificial Sequence
  chemically synthesized
acatttttaattttatcatata

SEQ ID NO: 886665 - DNA, 22 bp, Artificial Sequence
  chemically synthesized
gcaatatatgataaaattaaaa

SEQ ID NO: 886666 - DNA, 22 bp, Artificial Sequence
  chemically synthesized
gagtattcacatttttaatttt

SEQ ID NO: 886667 - DNA, 22 bp, Artificial Sequence
  chemically synthesized
caatatatgataaaattaaaaa

SEQ ID NO: 886668 - DNA, 22 bp, Artificial Sequence
  chemically synthesized
attagagtattcacatttttaa

SEQ ID NO: 886669 - DNA, 22 bp, Artificial Sequence
  chemically synthesized
cctcattagagtattcacattt

SEQ ID NO: 886670 - DNA, 22 bp, Artificial Sequence
  chemically synthesized
ttacctcattagagtattcaca

SEQ ID NO: 886671 - DNA, 22 bp, Artificial Sequence
  chemically synthesized
aaaatgtgaatactctaatgag

SEQ ID NO: 886672 - DNA, 22 bp, Artificial Sequence
  chemically synthesized
gaagtggaattgttacctcatt

SEQ ID NO: 886673 - DNA, 22 bp, Artificial Sequence
  chemically synthesized
taatgaggtaacaattccactt

SEQ ID NO: 886674 - DNA, 22 bp, Artificial Sequence
  chemically synthesized
atgaggtaacaattccacttct

SEQ ID NO: 886675 - DNA, 22 bp, Artificial Sequence
  chemically synthesized
agatagacatatgagaacacct

SEQ ID NO: 886676 - DNA, 22 bp, Artificial Sequence
  chemically synthesized
ctcagatagacatatgagaaca

SEQ ID NO: 886677 - DNA, 22 bp, Artificial Sequence
  chemically synthesized
cacttctaggtgttctcatatg

SEQ ID NO: 886678 - DNA, 22 bp, Artificial Sequence
  chemically synthesized
ctaggtgttctcatatgtctat

SEQ ID NO: 886679 - DNA, 22 bp, Artificial Sequence
  chemically synthesized
taggtgttctcatatgtctatc

SEQ ID NO: 886680 - DNA, 22 bp, Artificial Sequence
  chemically synthesized
taggtctcctcagatagacata

SEQ ID NO: 886681 - DNA, 22 bp, Artificial Sequence
  chemically synthesized
ggtgttctcatatgtctatctg

SEQ ID NO: 886682 - DNA, 22 bp, Artificial Sequence
  chemically synthesized
tgtaggtctcctcagatagaca

SEQ ID NO: 886683 - DNA, 22 bp, Artificial Sequence
  chemically synthesized
tctgtaggtctcctcagataga

SEQ ID NO: 886684 - DNA, 22 bp, Artificial Sequence
  chemically synthesized
tcatatgtctatctgaggagac

SEQ ID NO: 886685 - DNA, 22 bp, Artificial Sequence
  chemically synthesized
atatgtctatctgaggagacct

SEQ ID NO: 886686 - DNA, 22 bp, Artificial Sequence
  chemically synthesized
aaacaacattctctgtaggtct

SEQ ID NO: 886687 - DNA, 22 bp, Artificial Sequence
  chemically synthesized
tctgaggagacctacagagaat

SEQ ID NO: 886688 - DNA, 22 bp, Artificial Sequence
  chemically synthesized
aggagacctacagagaatgttg

SEQ ID NO: 886689 - DNA, 22 bp, Artificial Sequence
  chemically synthesized
atgaacaatgctgaaacaacat

SEQ ID NO: 886690 - DNA, 22 bp, Artificial Sequence
  chemically synthesized
actaatgaacaatgctgaaaca

SEQ ID NO: 886691 - DNA, 22 bp, Artificial Sequence
  chemically synthesized
cactaatgaacaatgctgaaac

SEQ ID NO: 886692 - DNA, 22 bp, Artificial Sequence
  chemically synthesized
cagagaatgttgtttcagcatt

SEQ ID NO: 886693 - DNA, 22 bp, Artificial Sequence
  chemically synthesized
ttcactaatgaacaatgctgaa

SEQ ID NO: 886694 - DNA, 22 bp, Artificial Sequence
  chemically synthesized
cagctcttcactaatgaacaat

SEQ ID NO: 886695 - DNA, 22 bp, Artificial Sequence
  chemically synthesized
ttccagctcttcactaatgaac

SEQ ID NO: 886696 - DNA, 22 bp, Artificial Sequence
  chemically synthesized
tttcagcattgttcattagtga

SEQ ID NO: 886697 - DNA, 22 bp, Artificial Sequence
  chemically synthesized
cagcattgttcattagtgaaga

SEQ ID NO: 886698 - DNA, 22 bp, Artificial Sequence
  chemically synthesized
agcattgttcattagtgaagag

SEQ ID NO: 886699 - DNA, 22 bp, Artificial Sequence
  chemically synthesized
ttcattagtgaagagctggaac

SEQ ID NO: 886700 - DNA, 22 bp, Artificial Sequence
  chemically synthesized
attagtgaagagctggaacaat

SEQ ID NO: 886701 - DNA, 22 bp, Artificial Sequence
  chemically synthesized
acagtgaataatcagattgttc

SEQ ID NO: 886702 - DNA, 22 bp, Artificial Sequence
  chemically synthesized
gtgaagagctggaacaatctga

SEQ ID NO: 886703 - DNA, 22 bp, Artificial Sequence
  chemically synthesized
gattaacagtgaataatcagat

SEQ ID NO: 886704 - DNA, 22 bp, Artificial Sequence
  chemically synthesized
gaacaatctgattattcactgt

SEQ ID NO: 886705 - DNA, 22 bp, Artificial Sequence
  chemically synthesized
attattcactgttaatctaacg

SEQ ID NO: 886706 - DNA, 22 bp, Artificial Sequence
  chemically synthesized
ttcactgttaatctaacgggca

SEQ ID NO: 886707 - DNA, 22 bp, Artificial Sequence
  chemically synthesized
actgttaatctaacgggcacat

SEQ ID NO: 886708 - DNA, 22 bp, Artificial Sequence
  chemically synthesized
ttaatctaacgggcacattgat

SEQ ID NO: 886709 - DNA, 22 bp, Artificial Sequence
  chemically synthesized
atagaaaccaaacaatcaatgt

SEQ ID NO: 886710 - DNA, 22 bp, Artificial Sequence
  chemically synthesized
atctaacgggcacattgattgt

SEQ ID NO: 886711 - DNA, 22 bp, Artificial Sequence
  chemically synthesized
aatagaaaccaaacaatcaatg

SEQ ID NO: 886712 - DNA, 22 bp, Artificial Sequence
  chemically synthesized
taatagaaaccaaacaatcaat

SEQ ID NO: 886713 - DNA, 22 bp, Artificial Sequence
  chemically synthesized
acgggcacattgattgtttggt

SEQ ID NO: 886714 - DNA, 22 bp, Artificial Sequence
  chemically synthesized
attttaatagaaaccaaacaat

SEQ ID NO: 886715 - DNA, 22 bp, Artificial Sequence
  chemically synthesized
gattttaatagaaaccaaacaa

SEQ ID NO: 886716 - DNA, 22 bp, Artificial Sequence
  chemically synthesized
ttgattttaatagaaaccaaac

SEQ ID NO: 886717 - DNA, 22 bp, Artificial Sequence
  chemically synthesized
attgtttggtttctattaaaat

SEQ ID NO: 886718 - DNA, 22 bp, Artificial Sequence
  chemically synthesized
gtaaaagtattcttgattttaa

SEQ ID NO: 886719 - DNA, 22 bp, Artificial Sequence
  chemically synthesized
tttggtttctattaaaatcaag

SEQ ID NO: 886720 - DNA, 22 bp, Artificial Sequence
  chemically synthesized
ggtttctattaaaatcaagaat

SEQ ID NO: 886721 - DNA, 22 bp, Artificial Sequence
  chemically synthesized
gtttctattaaaatcaagaata

SEQ ID NO: 886722 - DNA, 22 bp, Artificial Sequence
  chemically synthesized
ctattaaaatcaagaatacttt

SEQ ID NO: 886723 - DNA, 22 bp, Artificial Sequence
  chemically synthesized
tattaaaatcaagaatactttt

SEQ ID NO: 886724 - DNA, 22 bp, Artificial Sequence
  chemically synthesized
ttaaaatcaagaatacttttac

SEQ ID NO: 886725 - DNA, 22 bp, Artificial Sequence
  chemically synthesized
aaatcaagaatacttttaccag

SEQ ID NO: 886726 - DNA, 22 bp, Artificial Sequence
  chemically synthesized
gaatacagaagtaatctggtaa

SEQ ID NO: 886727 - DNA, 22 bp, Artificial Sequence
  chemically synthesized
agaatacagaagtaatctggta

SEQ ID NO: 886728 - DNA, 22 bp, Artificial Sequence
  chemically synthesized
tagaatacagaagtaatctggt

SEQ ID NO: 886729 - DNA, 22 bp, Artificial Sequence
  chemically synthesized
atggctttagaatacagaagta

SEQ ID NO: 886730 - DNA, 22 bp, Artificial Sequence
  chemically synthesized
aatggctttagaatacagaagt

SEQ ID NO: 886731 - DNA, 22 bp, Artificial Sequence
  chemically synthesized
taatggctttagaatacagaag

SEQ ID NO: 886732 - DNA, 22 bp, Artificial Sequence
  chemically synthesized
ttaccagattacttctgtattc

SEQ ID NO: 886733 - DNA, 22 bp, Artificial Sequence
  chemically synthesized
ttaatggctttagaatacagaa

SEQ ID NO: 886734 - DNA, 22 bp, Artificial Sequence
  chemically synthesized
taccagattacttctgtattct

SEQ ID NO: 886735 - DNA, 22 bp, Artificial Sequence
  chemically synthesized
accagattacttctgtattcta

SEQ ID NO: 886736 - DNA, 22 bp, Artificial Sequence
  chemically synthesized
ccagattacttctgtattctaa

SEQ ID NO: 886737 - DNA, 22 bp, Artificial Sequence
  chemically synthesized
cttctgtattctaaagccatta

SEQ ID NO: 886738 - DNA, 22 bp, Artificial Sequence
  chemically synthesized
ctgtattctaaagccattaaaa

SEQ ID NO: 886739 - DNA, 22 bp, Artificial Sequence
  chemically synthesized
tgtattctaaagccattaaaaa

SEQ ID NO: 886740 - DNA, 22 bp, Artificial Sequence
  chemically synthesized
tattctaaagccattaaaaatc

SEQ ID NO: 886741 - DNA, 22 bp, Artificial Sequence
  chemically synthesized
taaagccattaaaaatctttgt

SEQ ID NO: 886742 - DNA, 22 bp, Artificial Sequence
  chemically synthesized
cataaaaatacgaacaaagatt

SEQ ID NO: 886743 - DNA, 22 bp, Artificial Sequence
  chemically synthesized
aagccattaaaaatctttgttc

SEQ ID NO: 886744 - DNA, 22 bp, Artificial Sequence
  chemically synthesized
gactccataaaaatacgaacaa

SEQ ID NO: 886745 - DNA, 22 bp, Artificial Sequence
  chemically synthesized
ggactccataaaaatacgaaca

SEQ ID NO: 886746 - DNA, 22 bp, Artificial Sequence
  chemically synthesized
tggactccataaaaatacgaac

SEQ ID NO: 886747 - DNA, 22 bp, Artificial Sequence
  chemically synthesized
aaaatctttgttcgtattttta

SEQ ID NO: 886748 - DNA, 22 bp, Artificial Sequence
  chemically synthesized
aatagaactttggactccataa

SEQ ID NO: 886749 - DNA, 22 bp, Artificial Sequence
  chemically synthesized
tgttcgtatttttatggagtcc

SEQ ID NO: 886750 - DNA, 22 bp, Artificial Sequence
  chemically synthesized
aaatagaactttggactccata

SEQ ID NO: 886751 - DNA, 22 bp, Artificial Sequence
  chemically synthesized
gttcgtatttttatggagtcca

SEQ ID NO: 886752 - DNA, 22 bp, Artificial Sequence
  chemically synthesized
ttcgtatttttatggagtccaa

SEQ ID NO: 886753 - DNA, 22 bp, Artificial Sequence
  chemically synthesized
gcttaaatagaactttggactc

SEQ ID NO: 886754 - DNA, 22 bp, Artificial Sequence
  chemically synthesized
gtatttttatggagtccaaagt

SEQ ID NO: 886755 - DNA, 22 bp, Artificial Sequence
  chemically synthesized
tgactagcttaaatagaacttt

SEQ ID NO: 886756 - DNA, 22 bp, Artificial Sequence
  chemically synthesized
ttatggagtccaaagttctatt

SEQ ID NO: 886757 - DNA, 22 bp, Artificial Sequence
  chemically synthesized
atgactagcttaaatagaactt

SEQ ID NO: 886758 - DNA, 22 bp, Artificial Sequence
  chemically synthesized
tatggagtccaaagttctattt

SEQ ID NO: 886759 - DNA, 22 bp, Artificial Sequence
  chemically synthesized
atggagtccaaagttctattta

SEQ ID NO: 886760 - DNA, 22 bp, Artificial Sequence
  chemically synthesized
tggagtccaaagttctatttaa

SEQ ID NO: 886761 - DNA, 22 bp, Artificial Sequence
  chemically synthesized
cttatgactagcttaaatagaa

SEQ ID NO: 886762 - DNA, 22 bp, Artificial Sequence
  chemically synthesized
gcttatgactagcttaaataga

SEQ ID NO: 886763 - DNA, 22 bp, Artificial Sequence
  chemically synthesized
tgcttatgactagcttaaatag

SEQ ID NO: 886764 - DNA, 22 bp, Artificial Sequence
  chemically synthesized
actttgcttatgactagcttaa

SEQ ID NO: 886765 - DNA, 22 bp, Artificial Sequence
  chemically synthesized
tatttaagctagtcataagcaa

SEQ ID NO: 886766 - DNA, 22 bp, Artificial Sequence
  chemically synthesized
tttaagctagtcataagcaaag

SEQ ID NO: 886767 - DNA, 22 bp, Artificial Sequence
  chemically synthesized
aagctagtcataagcaaagtta

SEQ ID NO: 886768 - DNA, 22 bp, Artificial Sequence
  chemically synthesized
agctagtcataagcaaagttaa

SEQ ID NO: 886769 - DNA, 22 bp, Artificial Sequence
  chemically synthesized
tgaatagtagcattaactttgc

SEQ ID NO: 886770 - DNA, 22 bp, Artificial Sequence
  chemically synthesized
gtcataagcaaagttaatgcta

SEQ ID NO: 886771 - DNA, 22 bp, Artificial Sequence
  chemically synthesized
aatgagtccattatgaatagta

SEQ ID NO: 886772 - DNA, 22 bp, Artificial Sequence
  chemically synthesized
caatgagtccattatgaatagt

SEQ ID NO: 886773 - DNA, 22 bp, Artificial Sequence
  chemically synthesized
atgctactattcataatggact

SEQ ID NO: 886774 - DNA, 22 bp, Artificial Sequence
  chemically synthesized
gtatcttcaatgagtccattat

SEQ ID NO: 886775 - DNA, 22 bp, Artificial Sequence
  chemically synthesized
agtatcttcaatgagtccatta

SEQ ID NO: 886776 - DNA, 22 bp, Artificial Sequence
  chemically synthesized
tagtatcttcaatgagtccatt

SEQ ID NO: 886777 - DNA, 22 bp, Artificial Sequence
  chemically synthesized
ctattcataatggactcattga

SEQ ID NO: 886778 - DNA, 22 bp, Artificial Sequence
  chemically synthesized
tctttagtatcttcaatgagtc

SEQ ID NO: 886779 - DNA, 22 bp, Artificial Sequence
  chemically synthesized
ttcataatggactcattgaaga

SEQ ID NO: 886780 - DNA, 22 bp, Artificial Sequence
  chemically synthesized
ttatctttagtatcttcaatga

SEQ ID NO: 886781 - DNA, 22 bp, Artificial Sequence
  chemically synthesized
attatctttagtatcttcaatg

SEQ ID NO: 886782 - DNA, 22 bp, Artificial Sequence
  chemically synthesized
tattatctttagtatcttcaat

SEQ ID NO: 886783 - DNA, 22 bp, Artificial Sequence
  chemically synthesized
ataatggactcattgaagatac

SEQ ID NO: 886784 - DNA, 22 bp, Artificial Sequence
  chemically synthesized
ttttattatctttagtatcttc

SEQ ID NO: 886785 - DNA, 22 bp, Artificial Sequence
  chemically synthesized
ttattttattatctttagtatc

SEQ ID NO: 886786 - DNA, 22 bp, Artificial Sequence
  chemically synthesized
attgaagatactaaagataata

SEQ ID NO: 886787 - DNA, 22 bp, Artificial Sequence
  chemically synthesized
aagatactaaagataataaaat

SEQ ID NO: 886788 - DNA, 22 bp, Artificial Sequence
  chemically synthesized
gagatagtattgttattttatt

SEQ ID NO: 886789 - DNA, 22 bp, Artificial Sequence
  chemically synthesized
ttagagatagtattgttatttt

SEQ ID NO: 886790 - DNA, 22 bp, Artificial Sequence
  chemically synthesized
gttagagatagtattgttattt

SEQ ID NO: 886791 - DNA, 22 bp, Artificial Sequence
  chemically synthesized
aagataataaaataacaatact

SEQ ID NO: 886792 - DNA, 22 bp, Artificial Sequence
  chemically synthesized
aagtccaatttgttagagatag

SEQ ID NO: 886793 - DNA, 22 bp, Artificial Sequence
  chemically synthesized
taactaaagtccaatttgttag

SEQ ID NO: 886794 - DNA, 22 bp, Artificial Sequence
  chemically synthesized
tctctaacaaattggactttag

SEQ ID NO: 886795 - DNA, 22 bp, Artificial Sequence
  chemically synthesized
tgtatgccattgtaactaaagt

SEQ ID NO: 886796 - DNA, 22 bp, Artificial Sequence
  chemically synthesized
taacaaattggactttagttac

SEQ ID NO: 886797 - DNA, 22 bp, Artificial Sequence
  chemically synthesized
acaaattggactttagttacaa

SEQ ID NO: 886798 - DNA, 22 bp, Artificial Sequence
  chemically synthesized
tactgtgtatgccattgtaact

SEQ ID NO: 886799 - DNA, 22 bp, Artificial Sequence
  chemically synthesized
gactttagttacaatggcatac

SEQ ID NO: 886800 - DNA, 22 bp, Artificial Sequence
  chemically synthesized
gacattgtactgtgtatgccat

SEQ ID NO: 886801 - DNA, 22 bp, Artificial Sequence
  chemically synthesized
ggacattgtactgtgtatgcca

SEQ ID NO: 886802 - DNA, 22 bp, Artificial Sequence
  chemically synthesized
tagttacaatggcatacacagt

SEQ ID NO: 886803 - DNA, 22 bp, Artificial Sequence
  chemically synthesized
tttggacattgtactgtgtatg

SEQ ID NO: 886804 - DNA, 22 bp, Artificial Sequence
  chemically synthesized
agttacaatggcatacacagta

SEQ ID NO: 886805 - DNA, 22 bp, Artificial Sequence
  chemically synthesized
gttacaatggcatacacagtac

SEQ ID NO: 886806 - DNA, 22 bp, Artificial Sequence
  chemically synthesized
caatggcatacacagtacaatg

SEQ ID NO: 886807 - DNA, 22 bp, Artificial Sequence
  chemically synthesized
aacagatgttatttggacattg

SEQ ID NO: 886808 - DNA, 22 bp, Artificial Sequence
  chemically synthesized
aaaactgaacagatgttatttg

SEQ ID NO: 886809 - DNA, 22 bp, Artificial Sequence
  chemically synthesized
actcaaaactgaacagatgtta

SEQ ID NO: 886810 - DNA, 22 bp, Artificial Sequence
  chemically synthesized
cactcaaaactgaacagatgtt

SEQ ID NO: 886811 - DNA, 22 bp, Artificial Sequence
  chemically synthesized
tgcttcactcaaaactgaacag

SEQ ID NO: 886812 - DNA, 22 bp, Artificial Sequence
  chemically synthesized
ctgtgcttcactcaaaactgaa

SEQ ID NO: 886813 - DNA, 22 bp, Artificial Sequence
  chemically synthesized
ttcagttttgagtgaagcacag

SEQ ID NO: 886814 - DNA, 22 bp, Artificial Sequence
  chemically synthesized
agttttgagtgaagcacaggaa

SEQ ID NO: 886815 - DNA, 22 bp, Artificial Sequence
  chemically synthesized
tgagtgaagcacaggaacgtgt

SEQ ID NO: 886816 - DNA, 22 bp, Artificial Sequence
  chemically synthesized
gagtgaagcacaggaacgtgta

SEQ ID NO: 886817 - DNA, 22 bp, Artificial Sequence
  chemically synthesized
agtgaagcacaggaacgtgtat

SEQ ID NO: 886818 - DNA, 22 bp, Artificial Sequence
  chemically synthesized
tgcacacacacatacatacata

SEQ ID NO: 886819 - DNA, 22 bp, Artificial Sequence
  chemically synthesized
gagagataacacaaatacaaat

SEQ ID NO: 886820 - DNA, 22 bp, Artificial Sequence
  chemically synthesized
cataattggagagataacacaa

SEQ ID NO: 886821 - DNA, 22 bp, Artificial Sequence
  chemically synthesized
acataattggagagataacaca

SEQ ID NO: 886822 - DNA, 22 bp, Artificial Sequence
  chemically synthesized
gtatttgtgttatctctccaat

SEQ ID NO: 886823 - DNA, 22 bp, Artificial Sequence
  chemically synthesized
gtgatttacataattggagaga

SEQ ID NO: 886824 - DNA, 22 bp, Artificial Sequence
  chemically synthesized
tatttgtgttatctctccaatt

SEQ ID NO: 886825 - DNA, 22 bp, Artificial Sequence
  chemically synthesized
gtgttatctctccaattatgta

SEQ ID NO: 886826 - DNA, 22 bp, Artificial Sequence
  chemically synthesized
tgttatctctccaattatgtaa

SEQ ID NO: 886827 - DNA, 22 bp, Artificial Sequence
  chemically synthesized
tctctccaattatgtaaatcac

SEQ ID NO: 886828 - DNA, 22 bp, Artificial Sequence
  chemically synthesized
tccaattatgtaaatcactaat

SEQ ID NO: 886829 - DNA, 22 bp, Artificial Sequence
  chemically synthesized
caattatgtaaatcactaatac

SEQ ID NO: 886830 - DNA, 22 bp, Artificial Sequence
  chemically synthesized
gcatagtaataagtattagtga

SEQ ID NO: 886831 - DNA, 22 bp, Artificial Sequence
  chemically synthesized
tgtaaatcactaatacttatta

SEQ ID NO: 886832 - DNA, 22 bp, Artificial Sequence
  chemically synthesized
gtattagcatagtaataagtat

SEQ ID NO: 886833 - DNA, 22 bp, Artificial Sequence
  chemically synthesized
tggtattagcatagtaataagt

SEQ ID NO: 886834 - DNA, 22 bp, Artificial Sequence
  chemically synthesized
ctggtattagcatagtaataag

SEQ ID NO: 886835 - DNA, 22 bp, Artificial Sequence
  chemically synthesized
atacttattactatgctaatac

SEQ ID NO: 886836 - DNA, 22 bp, Artificial Sequence
  chemically synthesized
caatacgtcttctggtattagc

SEQ ID NO: 886837 - DNA, 22 bp, Artificial Sequence
  chemically synthesized
ttacaatacgtcttctggtatt

SEQ ID NO: 886838 - DNA, 22 bp, Artificial Sequence
  chemically synthesized
attactatgctaataccagaag

SEQ ID NO: 886839 - DNA, 22 bp, Artificial Sequence
  chemically synthesized
attacaatacgtcttctggtat

SEQ ID NO: 886840 - DNA, 22 bp, Artificial Sequence
  chemically synthesized
ttactatgctaataccagaaga

SEQ ID NO: 886841 - DNA, 22 bp, Artificial Sequence
  chemically synthesized
tattacaatacgtcttctggta

SEQ ID NO: 886842 - DNA, 22 bp, Artificial Sequence
  chemically synthesized
ctatgctaataccagaagacgt

SEQ ID NO: 886843 - DNA, 22 bp, Artificial Sequence
  chemically synthesized
tgctaataccagaagacgtatt

SEQ ID NO: 886844 - DNA, 22 bp, Artificial Sequence
  chemically synthesized
atgtgacctttattacaatacg

SEQ ID NO: 886845 - DNA, 22 bp, Artificial Sequence
  chemically synthesized
ataccagaagacgtattgtaat

SEQ ID NO: 886846 - DNA, 22 bp, Artificial Sequence
  chemically synthesized
ataattcatgtgacctttatta

SEQ ID NO: 886847 - DNA, 22 bp, Artificial Sequence
  chemically synthesized
taataaaggtcacatgaattat

SEQ ID NO: 886848 - DNA, 22 bp, Artificial Sequence
  chemically synthesized
atgaaataggtgataagaaaca

SEQ ID NO: 886849 - DNA, 22 bp, Artificial Sequence
  chemically synthesized
gatgaaataggtgataagaaac

SEQ ID NO: 886850 - DNA, 22 bp, Artificial Sequence
  chemically synthesized
ttaatttttgtgtttcttatca

SEQ ID NO: 886851 - DNA, 22 bp, Artificial Sequence
  chemically synthesized
tttgatgaaataggtgataaga

SEQ ID NO: 886852 - DNA, 22 bp, Artificial Sequence
  chemically synthesized
atttttgtgtttcttatcacct

SEQ ID NO: 886853 - DNA, 22 bp, Artificial Sequence
  chemically synthesized
ttgtgtttcttatcacctattt

SEQ ID NO: 886854 - DNA, 22 bp, Artificial Sequence
  chemically synthesized
tgtgtttcttatcacctatttc

SEQ ID NO: 886855 - DNA, 22 bp, Artificial Sequence
  chemically synthesized
aaattatttgatgaaataggtg

SEQ ID NO: 886856 - DNA, 22 bp, Artificial Sequence
  chemically synthesized
gtgtttcttatcacctatttca

SEQ ID NO: 886857 - DNA, 22 bp, Artificial Sequence
  chemically synthesized
aaaattatttgatgaaataggt

SEQ ID NO: 886858 - DNA, 22 bp, Artificial Sequence
  chemically synthesized
tgtttcttatcacctatttcat

SEQ ID NO: 886859 - DNA, 22 bp, Artificial Sequence
  chemically synthesized
taaaattatttgatgaaatagg

SEQ ID NO: 886860 - DNA, 22 bp, Artificial Sequence
  chemically synthesized
tctttaaaattatttgatgaaa

SEQ ID NO: 886861 - DNA, 22 bp, Artificial Sequence
  chemically synthesized
cttatcacctatttcatcaaat

SEQ ID NO: 886862 - DNA, 22 bp, Artificial Sequence
  chemically synthesized
ttatcacctatttcatcaaata

SEQ ID NO: 886863 - DNA, 22 bp, Artificial Sequence
  chemically synthesized
tgtctttaaaattatttgatga

SEQ ID NO: 886864 - DNA, 22 bp, Artificial Sequence
  chemically synthesized
atcacctatttcatcaaataat

SEQ ID NO: 886865 - DNA, 22 bp, Artificial Sequence
  chemically synthesized
tcacctatttcatcaaataatt

SEQ ID NO: 886866 - DNA, 22 bp, Artificial Sequence
  chemically synthesized
tttcatcaaataattttaaaga

SEQ ID NO: 886867 - DNA, 22 bp, Artificial Sequence
  chemically synthesized
catcaaataattttaaagacag

SEQ ID NO: 886868 - DNA, 22 bp, Artificial Sequence
  chemically synthesized
atcaaataattttaaagacaga

SEQ ID NO: 886869 - DNA, 22 bp, Artificial Sequence
  chemically synthesized
taaagacagagatgctatctat

SEQ ID NO: 886870 - DNA, 22 bp, Artificial Sequence
  chemically synthesized
aaagacagagatgctatctatc

SEQ ID NO: 886871 - DNA, 22 bp, Artificial Sequence
  chemically synthesized
aagacagagatgctatctatcc

SEQ ID NO: 886872 - DNA, 22 bp, Artificial Sequence
  chemically synthesized
tgaatgacaagtagagaaagtg

SEQ ID NO: 886873 - DNA, 22 bp, Artificial Sequence
  chemically synthesized
gtgaatgacaagtagagaaagt

SEQ ID NO: 886874 - DNA, 22 bp, Artificial Sequence
  chemically synthesized
tgtgaatgacaagtagagaaag

SEQ ID NO: 886875 - DNA, 22 bp, Artificial Sequence
  chemically synthesized
ttgtgaatgacaagtagagaaa

SEQ ID NO: 886876 - DNA, 22 bp, Artificial Sequence
  chemically synthesized
tctatccacactttctctactt

SEQ ID NO: 886877 - DNA, 22 bp, Artificial Sequence
  chemically synthesized
tccacactttctctacttgtca

SEQ ID NO: 886878 - DNA, 22 bp, Artificial Sequence
  chemically synthesized
aaggaacttttgtgaatgacaa

SEQ ID NO: 886879 - DNA, 22 bp, Artificial Sequence
  chemically synthesized
gaaggaacttttgtgaatgaca

SEQ ID NO: 886880 - DNA, 22 bp, Artificial Sequence
  chemically synthesized
tttgaaggaacttttgtgaatg

SEQ ID NO: 886881 - DNA, 22 bp, Artificial Sequence
  chemically synthesized
tctctacttgtcattcacaaaa

SEQ ID NO: 886882 - DNA, 22 bp, Artificial Sequence
  chemically synthesized
gtttgaaggaacttttgtgaat

SEQ ID NO: 886883 - DNA, 22 bp, Artificial Sequence
  chemically synthesized
ctctacttgtcattcacaaaag

SEQ ID NO: 886884 - DNA, 22 bp, Artificial Sequence
  chemically synthesized
tctacttgtcattcacaaaagt

SEQ ID NO: 886885 - DNA, 22 bp, Artificial Sequence
  chemically synthesized
tacttgtcattcacaaaagttc

SEQ ID NO: 886886 - DNA, 22 bp, Artificial Sequence
  chemically synthesized
cttgtcattcacaaaagttcct

SEQ ID NO: 886887 - DNA, 22 bp, Artificial Sequence
  chemically synthesized
agatttgtttgaaggaactttt

SEQ ID NO: 886888 - DNA, 22 bp, Artificial Sequence
  chemically synthesized
aagatttgtttgaaggaacttt

SEQ ID NO: 886889 - DNA, 22 bp, Artificial Sequence
  chemically synthesized
taagatttgtttgaaggaactt

SEQ ID NO: 886890 - DNA, 22 bp, Artificial Sequence
  chemically synthesized
gtcattcacaaaagttccttca

SEQ ID NO: 886891 - DNA, 22 bp, Artificial Sequence
  chemically synthesized
ttaagatttgtttgaaggaact

SEQ ID NO: 886892 - DNA, 22 bp, Artificial Sequence
  chemically synthesized
tcattcacaaaagttccttcaa

SEQ ID NO: 886893 - DNA, 22 bp, Artificial Sequence
  chemically synthesized
atttttaagatttgtttgaagg

SEQ ID NO: 886894 - DNA, 22 bp, Artificial Sequence
  chemically synthesized
aatttttaagatttgtttgaag

SEQ ID NO: 886895 - DNA, 22 bp, Artificial Sequence
  chemically synthesized
taatttttaagatttgtttgaa

SEQ ID NO: 886896 - DNA, 22 bp, Artificial Sequence
  chemically synthesized
acaaaagttccttcaaacaaat

SEQ ID NO: 886897 - DNA, 22 bp, Artificial Sequence
  chemically synthesized
ttaatttttaagatttgtttga

SEQ ID NO: 886898 - DNA, 22 bp, Artificial Sequence
  chemically synthesized
cttcaaacaaatcttaaaaatt

SEQ ID NO: 886899 - DNA, 22 bp, Artificial Sequence
  chemically synthesized
caaacaaatcttaaaaattaaa

SEQ ID NO: 886900 - DNA, 22 bp, Artificial Sequence
  chemically synthesized
aaacaaatcttaaaaattaaaa

SEQ ID NO: 886901 - DNA, 22 bp, Artificial Sequence
  chemically synthesized
caaagccatgtgcgcatacttt

SEQ ID NO: 886902 - DNA, 22 bp, Artificial Sequence
  chemically synthesized
aaaaattaaaagtatgcgcaca

SEQ ID NO: 886903 - DNA, 22 bp, Artificial Sequence
  chemically synthesized
aaaattaaaagtatgcgcacat

SEQ ID NO: 886904 - DNA, 22 bp, Artificial Sequence
  chemically synthesized
aaagtatgcgcacatggctttg

SEQ ID NO: 886905 - DNA, 22 bp, Artificial Sequence
  chemically synthesized
aaacatgaaactacaaagccat

SEQ ID NO: 886906 - DNA, 22 bp, Artificial Sequence
  chemically synthesized
ctgaaacatgaaactacaaagc

SEQ ID NO: 886907 - DNA, 22 bp, Artificial Sequence
  chemically synthesized
actgaaacatgaaactacaaag

SEQ ID NO: 886908 - DNA, 22 bp, Artificial Sequence
  chemically synthesized
cttactgaaacatgaaactaca

SEQ ID NO: 886909 - DNA, 22 bp, Artificial Sequence
  chemically synthesized
tccttactgaaacatgaaacta

SEQ ID NO: 886910 - DNA, 22 bp, Artificial Sequence
  chemically synthesized
tgtagtttcatgtttcagtaag

SEQ ID NO: 886911 - DNA, 22 bp, Artificial Sequence
  chemically synthesized
gtagtttcatgtttcagtaagg

SEQ ID NO: 886912 - DNA, 22 bp, Artificial Sequence
  chemically synthesized
tagtttcatgtttcagtaagga

SEQ ID NO: 886913 - DNA, 22 bp, Artificial Sequence
  chemically synthesized
catgtttcagtaaggagaattt

SEQ ID NO: 886914 - DNA, 22 bp, Artificial Sequence
  chemically synthesized
atgtttcagtaaggagaatttt

SEQ ID NO: 886915 - DNA, 22 bp, Artificial Sequence
  chemically synthesized
cagtaaggagaattttacttgg

SEQ ID NO: 886916 - DNA, 22 bp, Artificial Sequence
  chemically synthesized
agtaaggagaattttacttgga

SEQ ID NO: 886917 - DNA, 22 bp, Artificial Sequence
  chemically synthesized
acaataatgtataggatccaag

SEQ ID NO: 886918 - DNA, 22 bp, Artificial Sequence
  chemically synthesized
tacttggatcctatacattatt

SEQ ID NO: 886919 - DNA, 22 bp, Artificial Sequence
  chemically synthesized
acttggatcctatacattattg

SEQ ID NO: 886920 - DNA, 22 bp, Artificial Sequence
  chemically synthesized
cttggatcctatacattattgt

SEQ ID NO: 886921 - DNA, 22 bp, Artificial Sequence
  chemically synthesized
ggatcctatacattattgtgag

SEQ ID NO: 886922 - DNA, 22 bp, Artificial Sequence
  chemically synthesized
gatcctatacattattgtgagt

SEQ ID NO: 886923 - DNA, 22 bp, Artificial Sequence
  chemically synthesized
tacattattgtgagtgcttcca

SEQ ID NO: 886924 - DNA, 22 bp, Artificial Sequence
  chemically synthesized
agaaggcaaaacatggaagcac

SEQ ID NO: 886925 - DNA, 22 bp, Artificial Sequence
  chemically synthesized
ttgtgagtgcttccatgttttg

SEQ ID NO: 886926 - DNA, 22 bp, Artificial Sequence
  chemically synthesized
tgagtgcttccatgttttgcct

SEQ ID NO: 886927 - DNA, 22 bp, Artificial Sequence
  chemically synthesized
gtaagcattaagaaggcaaaac

SEQ ID NO: 886928 - DNA, 22 bp, Artificial Sequence
  chemically synthesized
ggtaagcattaagaaggcaaaa

SEQ ID NO: 886929 - DNA, 22 bp, Artificial Sequence
  chemically synthesized
tggtaagcattaagaaggcaaa

SEQ ID NO: 886930 - DNA, 22 bp, Artificial Sequence
  chemically synthesized
ccatgttttgccttcttaatgc

SEQ ID NO: 886931 - DNA, 22 bp, Artificial Sequence
  chemically synthesized
catgttttgccttcttaatgct

SEQ ID NO: 886932 - DNA, 22 bp, Artificial Sequence
  chemically synthesized
ataattttggtaagcattaaga

SEQ ID NO: 886933 - DNA, 22 bp, Artificial Sequence
  chemically synthesized
acattaataattttggtaagca

SEQ ID NO: 886934 - DNA, 22 bp, Artificial Sequence
  chemically synthesized
tgccttcttaatgcttaccaaa

SEQ ID NO: 886935 - DNA, 22 bp, Artificial Sequence
  chemically synthesized
gacattaataattttggtaagc

SEQ ID NO: 886936 - DNA, 22 bp, Artificial Sequence
  chemically synthesized
gccttcttaatgcttaccaaaa

SEQ ID NO: 886937 - DNA, 22 bp, Artificial Sequence
  chemically synthesized
ccttcttaatgcttaccaaaat

SEQ ID NO: 886938 - DNA, 22 bp, Artificial Sequence
  chemically synthesized
ttgacattaataattttggtaa

SEQ ID NO: 886939 - DNA, 22 bp, Artificial Sequence
  chemically synthesized
cttaatgcttaccaaaattatt

SEQ ID NO: 886940 - DNA, 22 bp, Artificial Sequence
  chemically synthesized
ttaatgcttaccaaaattatta

SEQ ID NO: 886941 - DNA, 22 bp, Artificial Sequence
  chemically synthesized
gtattcttgacattaataattt

SEQ ID NO: 886942 - DNA, 22 bp, Artificial Sequence
  chemically synthesized
aatgcttaccaaaattattaat

SEQ ID NO: 886943 - DNA, 22 bp, Artificial Sequence
  chemically synthesized
atgcttaccaaaattattaatg

SEQ ID NO: 886944 - DNA, 22 bp, Artificial Sequence
  chemically synthesized
accaaaattattaatgtcaaga

SEQ ID NO: 886945 - DNA, 22 bp, Artificial Sequence
  chemically synthesized
ccaaaattattaatgtcaagaa

SEQ ID NO: 886946 - DNA, 22 bp, Artificial Sequence
  chemically synthesized
gccaagattggtattcttgaca

SEQ ID NO: 886947 - DNA, 22 bp, Artificial Sequence
  chemically synthesized
ttaatgtcaagaataccaatct

SEQ ID NO: 886948 - DNA, 22 bp, Artificial Sequence
  chemically synthesized
atgtcaagaataccaatcttgg

SEQ ID NO: 886949 - DNA, 22 bp, Artificial Sequence
  chemically synthesized
caggcgtgagccaccatgcctg

SEQ ID NO: 886950 - DNA, 22 bp, Artificial Sequence
  chemically synthesized
ggattacaggcgtgagccacca

SEQ ID NO: 886951 - DNA, 22 bp, Artificial Sequence
  chemically synthesized
ggccaggcatggtggctcacgc

SEQ ID NO: 886952 - DNA, 22 bp, Artificial Sequence
  chemically synthesized
gccaggcatggtggctcacgcc

SEQ ID NO: 886953 - DNA, 22 bp, Artificial Sequence
  chemically synthesized
agcatccgaaagtgctgggatt

SEQ ID NO: 886954 - DNA, 22 bp, Artificial Sequence
  chemically synthesized
acgcctgtaatcccagcacttt

SEQ ID NO: 886955 - DNA, 22 bp, Artificial Sequence
  chemically synthesized
taatcccagcactttcggatgc

SEQ ID NO: 886956 - DNA, 22 bp, Artificial Sequence
  chemically synthesized
aagtgatccgtcagcctcagca

SEQ ID NO: 886957 - DNA, 22 bp, Artificial Sequence
  chemically synthesized
acctcaagtgatccgtcagcct

SEQ ID NO: 886958 - DNA, 22 bp, Artificial Sequence
  chemically synthesized
tcggatgctgaggctgacggat

SEQ ID NO: 886959 - DNA, 22 bp, Artificial Sequence
  chemically synthesized
cggatgctgaggctgacggatc

SEQ ID NO: 886960 - DNA, 22 bp, Artificial Sequence
  chemically synthesized
ctgacctcaagtgatccgtcag

SEQ ID NO: 886961 - DNA, 22 bp, Artificial Sequence
  chemically synthesized
ggatgctgaggctgacggatca

SEQ ID NO: 886962 - DNA, 22 bp, Artificial Sequence
  chemically synthesized
aaactcctgacctcaagtgatc

SEQ ID NO: 886963 - DNA, 22 bp, Artificial Sequence
  chemically synthesized
aggctgacggatcacttgaggt

SEQ ID NO: 886964 - DNA, 22 bp, Artificial Sequence
  chemically synthesized
gtctcaaactcctgacctcaag

SEQ ID NO: 886965 - DNA, 22 bp, Artificial Sequence
  chemically synthesized
acggatcacttgaggtcaggag

SEQ ID NO: 886966 - DNA, 22 bp, Artificial Sequence
  chemically synthesized
accaggctggtctcaaactcct

SEQ ID NO: 886967 - DNA, 22 bp, Artificial Sequence
  chemically synthesized
gaggtcaggagtttgagaccag

SEQ ID NO: 886968 - DNA, 22 bp, Artificial Sequence
  chemically synthesized
aggtcaggagtttgagaccagc

SEQ ID NO: 886969 - DNA, 22 bp, Artificial Sequence
  chemically synthesized
accatgttgaccaggctggtct

SEQ ID NO: 886970 - DNA, 22 bp, Artificial Sequence
  chemically synthesized
caccatgttgaccaggctggtc

SEQ ID NO: 886971 - DNA, 22 bp, Artificial Sequence
  chemically synthesized
gagaccagcctggtcaacatgg

SEQ ID NO: 886972 - DNA, 22 bp, Artificial Sequence
  chemically synthesized
agaccagcctggtcaacatggt

SEQ ID NO: 886973 - DNA, 22 bp, Artificial Sequence
  chemically synthesized
gtagagacagggtttcaccatg

SEQ ID NO: 886974 - DNA, 22 bp, Artificial Sequence
  chemically synthesized
agtagagacagggtttcaccat

SEQ ID NO: 886975 - DNA, 22 bp, Artificial Sequence
  chemically synthesized
tagtagagacagggtttcacca

SEQ ID NO: 886976 - DNA, 22 bp, Artificial Sequence
  chemically synthesized
ttagtagagacagggtttcacc

SEQ ID NO: 886977 - DNA, 22 bp, Artificial Sequence
  chemically synthesized
gtcaacatggtgaaaccctgtc

SEQ ID NO: 886978 - DNA, 22 bp, Artificial Sequence
  chemically synthesized
tatttttagtagagacagggtt

SEQ ID NO: 886979 - DNA, 22 bp, Artificial Sequence
  chemically synthesized
gtatttttagtagagacagggt

SEQ ID NO: 886980 - DNA, 22 bp, Artificial Sequence
  chemically synthesized
tgtatttttagtagagacaggg

SEQ ID NO: 886981 - DNA, 22 bp, Artificial Sequence
  chemically synthesized
ttgtatttttagtagagacagg

SEQ ID NO: 886982 - DNA, 22 bp, Artificial Sequence
  chemically synthesized
atttttgtatttttagtagaga

SEQ ID NO: 886983 - DNA, 22 bp, Artificial Sequence
  chemically synthesized
tctctactaaaaatacaaaaat

SEQ ID NO: 886984 - DNA, 22 bp, Artificial Sequence
  chemically synthesized
tactaaaaatacaaaaattagc

SEQ ID NO: 886985 - DNA, 22 bp, Artificial Sequence
  chemically synthesized
ctaaaaatacaaaaattagccg

SEQ ID NO: 886986 - DNA, 22 bp, Artificial Sequence
  chemically synthesized
aaaatacaaaaattagccgggt

SEQ ID NO: 886987 - DNA, 22 bp, Artificial Sequence
  chemically synthesized
gtgcccaccaccacacccggct

SEQ ID NO: 886988 - DNA, 22 bp, Artificial Sequence
  chemically synthesized
ctggtgcccaccaccacacccg

SEQ ID NO: 886989 - DNA, 22 bp, Artificial Sequence
  chemically synthesized
ggattactggtgcccaccacca

SEQ ID NO: 886990 - DNA, 22 bp, Artificial Sequence
  chemically synthesized
gccgggtgtggtggtgggcacc

SEQ ID NO: 886991 - DNA, 22 bp, Artificial Sequence
  chemically synthesized
ccaagtagctaggattactggt

SEQ ID NO: 886992 - DNA, 22 bp, Artificial Sequence
  chemically synthesized
agactgccaagtagctaggatt

SEQ ID NO: 886993 - DNA, 22 bp, Artificial Sequence
  chemically synthesized
cctcagactgccaagtagctag

SEQ ID NO: 886994 - DNA, 22 bp, Artificial Sequence
  chemically synthesized
ctgcctcagactgccaagtagc

SEQ ID NO: 886995 - DNA, 22 bp, Artificial Sequence
  chemically synthesized
tcctgcctcagactgccaagta

SEQ ID NO: 886996 - DNA, 22 bp, Artificial Sequence
  chemically synthesized
aagggattctcctgcctcagac

SEQ ID NO: 886997 - DNA, 22 bp, Artificial Sequence
  chemically synthesized
gctacttggcagtctgaggcag

SEQ ID NO: 886998 - DNA, 22 bp, Artificial Sequence
  chemically synthesized
cttggcagtctgaggcaggaga

SEQ ID NO: 886999 - DNA, 22 bp, Artificial Sequence
  chemically synthesized
ggttcaagggattctcctgcct

SEQ ID NO: 887000 - DNA, 22 bp, Artificial Sequence
  chemically synthesized
ggcagtctgaggcaggagaatc

SEQ ID NO: 887001 - DNA, 22 bp, Artificial Sequence
  chemically synthesized
ctgggttcaagggattctcctg

SEQ ID NO: 887002 - DNA, 22 bp, Artificial Sequence
  chemically synthesized
gcagtctgaggcaggagaatcc

SEQ ID NO: 887003 - DNA, 22 bp, Artificial Sequence
  chemically synthesized
cgcctcctgggttcaagggatt

SEQ ID NO: 887004 - DNA, 22 bp, Artificial Sequence
  chemically synthesized
aggcaggagaatcccttgaacc

SEQ ID NO: 887005 - DNA, 22 bp, Artificial Sequence
  chemically synthesized
cagcctccgcctcctgggttca

SEQ ID NO: 887006 - DNA, 22 bp, Artificial Sequence
  chemically synthesized
actgcagcctccgcctcctggg

SEQ ID NO: 887007 - DNA, 22 bp, Artificial Sequence
  chemically synthesized
agctcactgcagcctccgcctc

SEQ ID NO: 887008 - DNA, 22 bp, Artificial Sequence
  chemically synthesized
gaacccaggaggcggaggctgc

SEQ ID NO: 887009 - DNA, 22 bp, Artificial Sequence
  chemically synthesized
aacccaggaggcggaggctgca

SEQ ID NO: 887010 - DNA, 22 bp, Artificial Sequence
  chemically synthesized
cgatctcagctcactgcagcct

SEQ ID NO: 887011 - DNA, 22 bp, Artificial Sequence
  chemically synthesized
gagtgcagtgctgcgatctcag

SEQ ID NO: 887012 - DNA, 22 bp, Artificial Sequence
  chemically synthesized
cagtgagctgagatcgcagcac

SEQ ID NO: 887013 - DNA, 22 bp, Artificial Sequence
  chemically synthesized
catcacccaggctggagtgcag

SEQ ID NO: 887014 - DNA, 22 bp, Artificial Sequence
  chemically synthesized
agatcgcagcactgcactccag

SEQ ID NO: 887015 - DNA, 22 bp, Artificial Sequence
  chemically synthesized
ctccatcacccaggctggagtg

SEQ ID NO: 887016 - DNA, 22 bp, Artificial Sequence
  chemically synthesized
gctccatcacccaggctggagt

SEQ ID NO: 887017 - DNA, 22 bp, Artificial Sequence
  chemically synthesized
cactccagcctgggtgatggag

SEQ ID NO: 887018 - DNA, 22 bp, Artificial Sequence
  chemically synthesized
cgaggtggagtcttgctccatc

SEQ ID NO: 887019 - DNA, 22 bp, Artificial Sequence
  chemically synthesized
ccgaggtggagtcttgctccat

SEQ ID NO: 887020 - DNA, 22 bp, Artificial Sequence
  chemically synthesized
cagcctgggtgatggagcaaga

SEQ ID NO: 887021 - DNA, 22 bp, Artificial Sequence
  chemically synthesized
tccgaggtggagtcttgctcca

SEQ ID NO: 887022 - DNA, 22 bp, Artificial Sequence
  chemically synthesized
ttccgaggtggagtcttgctcc

SEQ ID NO: 887023 - DNA, 22 bp, Artificial Sequence
  chemically synthesized
tttccgaggtggagtcttgctc

SEQ ID NO: 887024 - DNA, 22 bp, Artificial Sequence
  chemically synthesized
ttttccgaggtggagtcttgct

SEQ ID NO: 887025 - DNA, 22 bp, Artificial Sequence
  chemically synthesized
tttttccgaggtggagtcttgc

SEQ ID NO: 887026 - DNA, 22 bp, Artificial Sequence
  chemically synthesized
ttttttccgaggtggagtcttg

SEQ ID NO: 887027 - DNA, 22 bp, Artificial Sequence
  chemically synthesized
tttttttccgaggtggagtctt

SEQ ID NO: 887028 - DNA, 22 bp, Artificial Sequence
  chemically synthesized
ggtgatggagcaagactccacc

SEQ ID NO: 887029 - DNA, 22 bp, Artificial Sequence
  chemically synthesized
ttttttttccgaggtggagtct

SEQ ID NO: 887030 - DNA, 22 bp, Artificial Sequence
  chemically synthesized
tttttttttccgaggtggagtc

SEQ ID NO: 887031 - DNA, 22 bp, Artificial Sequence
  chemically synthesized
ttttttttttccgaggtggagt

SEQ ID NO: 887032 - DNA, 22 bp, Artificial Sequence
  chemically synthesized
tttttttttttccgaggtggag

SEQ ID NO: 887033 - DNA, 22 bp, Artificial Sequence
  chemically synthesized
ttttttttttttccgaggtgga

SEQ ID NO: 887034 - DNA, 22 bp, Artificial Sequence
  chemically synthesized
tttttttttttttccgaggtgg

SEQ ID NO: 887035 - DNA, 22 bp, Artificial Sequence
  chemically synthesized
ttttttttttttttccgaggtg

SEQ ID NO: 887036 - DNA, 22 bp, Artificial Sequence
  chemically synthesized
tttttttttttttttccgaggt

SEQ ID NO: 887037 - DNA, 22 bp, Artificial Sequence
  chemically synthesized
ttttttttttttttttccgagg

SEQ ID NO: 887038 - DNA, 22 bp, Artificial Sequence
  chemically synthesized
tttttttttttttttttccgag

SEQ ID NO: 887039 - DNA, 22 bp, Artificial Sequence
  chemically synthesized
ttttttttttttttttttccga

SEQ ID NO: 887040 - DNA, 22 bp, Artificial Sequence
  chemically synthesized
tttttttttttttttttttccg

SEQ ID NO: 887041 - DNA, 22 bp, Artificial Sequence
  chemically synthesized
ttttttttttttttttttttcc

SEQ ID NO: 887042 - DNA, 22 bp, Artificial Sequence
  chemically synthesized
tttttttttttttttttttttc

SEQ ID NO: 887043 - DNA, 22 bp, Artificial Sequence
  chemically synthesized
tttttttttttttttttttttt

SEQ ID NO: 887044 - DNA, 22 bp, Artificial Sequence
  chemically synthesized
tttttttttttttttttttttt

SEQ ID NO: 887045 - DNA, 22 bp, Artificial Sequence
  chemically synthesized
tttttttttttttttttttttt

SEQ ID NO: 887046 - DNA, 22 bp, Artificial Sequence
  chemically synthesized
tttttttttttttttttttttt

SEQ ID NO: 887047 - DNA, 22 bp, Artificial Sequence
  chemically synthesized
cacctcggaaaaaaaaaaaaaa

SEQ ID NO: 887048 - DNA, 22 bp, Artificial Sequence
  chemically synthesized
tttttttttttttttttttttt

SEQ ID NO: 887049 - DNA, 22 bp, Artificial Sequence
  chemically synthesized
tttttttttttttttttttttt

SEQ ID NO: 887050 - DNA, 22 bp, Artificial Sequence
  chemically synthesized
tttttttttttttttttttttt

SEQ ID NO: 887051 - DNA, 22 bp, Artificial Sequence
  chemically synthesized
tctttttttttttttttttttt

SEQ ID NO: 887052 - DNA, 22 bp, Artificial Sequence
  chemically synthesized
ggaaaaaaaaaaaaaaaaaaaa

SEQ ID NO: 887053 - DNA, 22 bp, Artificial Sequence
  chemically synthesized
gtattctctttttttttttttt

SEQ ID NO: 887054 - DNA, 22 bp, Artificial Sequence
  chemically synthesized
aaatgagattggtattctcttt

SEQ ID NO: 887055 - DNA, 22 bp, Artificial Sequence
  chemically synthesized
gtcattaaaatgagattggtat

SEQ ID NO: 887056 - DNA, 22 bp, Artificial Sequence
  chemically synthesized
tgtaacatgctggtcattaaaa

SEQ ID NO: 887057 - DNA, 22 bp, Artificial Sequence
  chemically synthesized
attatgtaacatgctggtcatt

SEQ ID NO: 887058 - DNA, 22 bp, Artificial Sequence
  chemically synthesized
attttaatgaccagcatgttac

SEQ ID NO: 887059 - DNA, 22 bp, Artificial Sequence
  chemically synthesized
taataattgattatgtaacatg

SEQ ID NO: 887060 - DNA, 22 bp, Artificial Sequence
  chemically synthesized
ataataattgattatgtaacat

SEQ ID NO: 887061 - DNA, 22 bp, Artificial Sequence
  chemically synthesized
taatgaccagcatgttacataa

SEQ ID NO: 887062 - DNA, 22 bp, Artificial Sequence
  chemically synthesized
aatgaccagcatgttacataat

SEQ ID NO: 887063 - DNA, 22 bp, Artificial Sequence
  chemically synthesized
atgaccagcatgttacataatc

SEQ ID NO: 887064 - DNA, 22 bp, Artificial Sequence
  chemically synthesized
aaatcatttataataattgatt

SEQ ID NO: 887065 - DNA, 22 bp, Artificial Sequence
  chemically synthesized
aaaatcatttataataattgat

SEQ ID NO: 887066 - DNA, 22 bp, Artificial Sequence
  chemically synthesized
cataatcaattattataaatga

SEQ ID NO: 887067 - DNA, 22 bp, Artificial Sequence
  chemically synthesized
aacagcttaaaatcatttataa

SEQ ID NO: 887068 - DNA, 22 bp, Artificial Sequence
  chemically synthesized
aacattaaacagcttaaaatca

SEQ ID NO: 887069 - DNA, 22 bp, Artificial Sequence
  chemically synthesized
gaacattaaacagcttaaaatc

SEQ ID NO: 887070 - DNA, 22 bp, Artificial Sequence
  chemically synthesized
ttataaatgattttaagctgtt

SEQ ID NO: 887071 - DNA, 22 bp, Artificial Sequence
  chemically synthesized
atttgaacattaaacagcttaa

SEQ ID NO: 887072 - DNA, 22 bp, Artificial Sequence
  chemically synthesized
aatttgaacattaaacagctta

SEQ ID NO: 887073 - DNA, 22 bp, Artificial Sequence
  chemically synthesized
taatttgaacattaaacagctt

SEQ ID NO: 887074 - DNA, 22 bp, Artificial Sequence
  chemically synthesized
taaatgattttaagctgtttaa

SEQ ID NO: 887075 - DNA, 22 bp, Artificial Sequence
  chemically synthesized
agaaaagttttaatttgaacat

SEQ ID NO: 887076 - DNA, 22 bp, Artificial Sequence
  chemically synthesized
taagctgtttaatgttcaaatt

SEQ ID NO: 887077 - DNA, 22 bp, Artificial Sequence
  chemically synthesized
aagaaaagttttaatttgaaca

SEQ ID NO: 887078 - DNA, 22 bp, Artificial Sequence
  chemically synthesized
aagctgtttaatgttcaaatta

SEQ ID NO: 887079 - DNA, 22 bp, Artificial Sequence
  chemically synthesized
taagaaaagttttaatttgaac

SEQ ID NO: 887080 - DNA, 22 bp, Artificial Sequence
  chemically synthesized
agctgtttaatgttcaaattaa

SEQ ID NO: 887081 - DNA, 22 bp, Artificial Sequence
  chemically synthesized
ttttaagaaaagttttaatttg

SEQ ID NO: 887082 - DNA, 22 bp, Artificial Sequence
  chemically synthesized
tttaatgttcaaattaaaactt

SEQ ID NO: 887083 - DNA, 22 bp, Artificial Sequence
  chemically synthesized
ggctattttaagaaaagtttta

SEQ ID NO: 887084 - DNA, 22 bp, Artificial Sequence
  chemically synthesized
aatgttcaaattaaaacttttc

SEQ ID NO: 887085 - DNA, 22 bp, Artificial Sequence
  chemically synthesized
atgttcaaattaaaacttttct

SEQ ID NO: 887086 - DNA, 22 bp, Artificial Sequence
  chemically synthesized
aattaggctattttaagaaaag

SEQ ID NO: 887087 - DNA, 22 bp, Artificial Sequence
  chemically synthesized
aaattaggctattttaagaaaa

SEQ ID NO: 887088 - DNA, 22 bp, Artificial Sequence
  chemically synthesized
aaattaaaacttttcttaaaat

SEQ ID NO: 887089 - DNA, 22 bp, Artificial Sequence
  chemically synthesized
tttaaattaggctattttaaga

SEQ ID NO: 887090 - DNA, 22 bp, Artificial Sequence
  chemically synthesized
aaacttttcttaaaatagccta

SEQ ID NO: 887091 - DNA, 22 bp, Artificial Sequence
  chemically synthesized
ttcttaaaatagcctaatttaa

SEQ ID NO: 887092 - DNA, 22 bp, Artificial Sequence
  chemically synthesized
tcttaaaatagcctaatttaaa

SEQ ID NO: 887093 - DNA, 22 bp, Artificial Sequence
  chemically synthesized
cttaaaatagcctaatttaaat

SEQ ID NO: 887094 - DNA, 22 bp, Artificial Sequence
  chemically synthesized
ttaaaatagcctaatttaaata

SEQ ID NO: 887095 - DNA, 22 bp, Artificial Sequence
  chemically synthesized
aaaatagcctaatttaaataat

SEQ ID NO: 887096 - DNA, 22 bp, Artificial Sequence
  chemically synthesized
aaatagcctaatttaaataatt

SEQ ID NO: 887097 - DNA, 22 bp, Artificial Sequence
  chemically synthesized
atgaaaacatccataattattt

SEQ ID NO: 887098 - DNA, 22 bp, Artificial Sequence
  chemically synthesized
atttaaataattatggatgttt

SEQ ID NO: 887099 - DNA, 22 bp, Artificial Sequence
  chemically synthesized
aaataattatggatgttttcat

SEQ ID NO: 887100 - DNA, 22 bp, Artificial Sequence
  chemically synthesized
aataattatggatgttttcatt

SEQ ID NO: 887101 - DNA, 22 bp, Artificial Sequence
  chemically synthesized
tggatgttttcattaactatat

SEQ ID NO: 887102 - DNA, 22 bp, Artificial Sequence
  chemically synthesized
tcattaactatattatttgtgc

SEQ ID NO: 887103 - DNA, 22 bp, Artificial Sequence
  chemically synthesized
cattaactatattatttgtgcc

SEQ ID NO: 887104 - DNA, 22 bp, Artificial Sequence
  chemically synthesized
attaactatattatttgtgccc

SEQ ID NO: 887105 - DNA, 22 bp, Artificial Sequence
  chemically synthesized
ccgaacataacagggcacaaat

SEQ ID NO: 887106 - DNA, 22 bp, Artificial Sequence
  chemically synthesized
actatattatttgtgccctgtt

SEQ ID NO: 887107 - DNA, 22 bp, Artificial Sequence
  chemically synthesized
gcagttaccgaacataacaggg

SEQ ID NO: 887108 - DNA, 22 bp, Artificial Sequence
  chemically synthesized
tattatttgtgccctgttatgt

SEQ ID NO: 887109 - DNA, 22 bp, Artificial Sequence
  chemically synthesized
ggcagttaccgaacataacagg

SEQ ID NO: 887110 - DNA, 22 bp, Artificial Sequence
  chemically synthesized
tttgtgccctgttatgttcggt

SEQ ID NO: 887111 - DNA, 22 bp, Artificial Sequence
  chemically synthesized
gtgccctgttatgttcggtaac

SEQ ID NO: 887112 - DNA, 22 bp, Artificial Sequence
  chemically synthesized
tgccctgttatgttcggtaact

SEQ ID NO: 887113 - DNA, 22 bp, Artificial Sequence
  chemically synthesized
acacaatgaatatttggcagtt

SEQ ID NO: 887114 - DNA, 22 bp, Artificial Sequence
  chemically synthesized
ttatgttcggtaactgccaaat

SEQ ID NO: 887115 - DNA, 22 bp, Artificial Sequence
  chemically synthesized
gacacaatgaatatttggcagt

SEQ ID NO: 887116 - DNA, 22 bp, Artificial Sequence
  chemically synthesized
tgttcggtaactgccaaatatt

SEQ ID NO: 887117 - DNA, 22 bp, Artificial Sequence
  chemically synthesized
ggtaactgccaaatattcattg

SEQ ID NO: 887118 - DNA, 22 bp, Artificial Sequence
  chemically synthesized
gtgacccccttgacacaatgaa

SEQ ID NO: 887119 - DNA, 22 bp, Artificial Sequence
  chemically synthesized
ggtgacccccttgacacaatga

SEQ ID NO: 887120 - DNA, 22 bp, Artificial Sequence
  chemically synthesized
tggtgacccccttgacacaatg

SEQ ID NO: 887121 - DNA, 22 bp, Artificial Sequence
  chemically synthesized
ccaaatattcattgtgtcaagg

SEQ ID NO: 887122 - DNA, 22 bp, Artificial Sequence
  chemically synthesized
aacactttggtgacccccttga

SEQ ID NO: 887123 - DNA, 22 bp, Artificial Sequence
  chemically synthesized
tgaacactttggtgaccccctt

SEQ ID NO: 887124 - DNA, 22 bp, Artificial Sequence
  chemically synthesized
attgtgtcaagggggtcaccaa

SEQ ID NO: 887125 - DNA, 22 bp, Artificial Sequence
  chemically synthesized
caaattctgaacactttggtga

SEQ ID NO: 887126 - DNA, 22 bp, Artificial Sequence
  chemically synthesized
tgtcaagggggtcaccaaagtg

SEQ ID NO: 887127 - DNA, 22 bp, Artificial Sequence
  chemically synthesized
ccaaattctgaacactttggtg

SEQ ID NO: 887128 - DNA, 22 bp, Artificial Sequence
  chemically synthesized
cagtttccaaattctgaacact

SEQ ID NO: 887129 - DNA, 22 bp, Artificial Sequence
  chemically synthesized
aagctacagtttccaaattctg

SEQ ID NO: 887130 - DNA, 22 bp, Artificial Sequence
  chemically synthesized
atacatctgaagctacagtttc

SEQ ID NO: 887131 - DNA, 22 bp, Artificial Sequence
  chemically synthesized
aatacatctgaagctacagttt

SEQ ID NO: 887132 - DNA, 22 bp, Artificial Sequence
  chemically synthesized
agaatttggaaactgtagcttc

SEQ ID NO: 887133 - DNA, 22 bp, Artificial Sequence
  chemically synthesized
catgtttaatacatctgaagct

SEQ ID NO: 887134 - DNA, 22 bp, Artificial Sequence
  chemically synthesized
gcatgtttaatacatctgaagc

SEQ ID NO: 887135 - DNA, 22 bp, Artificial Sequence
  chemically synthesized
ggaaactgtagcttcagatgta

SEQ ID NO: 887136 - DNA, 22 bp, Artificial Sequence
  chemically synthesized
gaaactgtagcttcagatgtat

SEQ ID NO: 887137 - DNA, 22 bp, Artificial Sequence
  chemically synthesized
tagcttcagatgtattaaacat

SEQ ID NO: 887138 - DNA, 22 bp, Artificial Sequence
  chemically synthesized
cagatgtattaaacatgcaaac

SEQ ID NO: 887139 - DNA, 22 bp, Artificial Sequence
  chemically synthesized
agatgtattaaacatgcaaact

SEQ ID NO: 887140 - DNA, 22 bp, Artificial Sequence
  chemically synthesized
aacatgcaaactctactttttt

SEQ ID NO: 887141 - DNA, 22 bp, Artificial Sequence
  chemically synthesized
aaaatgatacatataaaaaagt

SEQ ID NO: 887142 - DNA, 22 bp, Artificial Sequence
  chemically synthesized
caaaatgatacatataaaaaag

SEQ ID NO: 887143 - DNA, 22 bp, Artificial Sequence
  chemically synthesized
taatttcaaaatgatacatata

SEQ ID NO: 887144 - DNA, 22 bp, Artificial Sequence
  chemically synthesized
tgtaatttcaaaatgatacata

SEQ ID NO: 887145 - DNA, 22 bp, Artificial Sequence
  chemically synthesized
tacttttttatatgtatcattt

SEQ ID NO: 887146 - DNA, 22 bp, Artificial Sequence
  chemically synthesized
ttctgtaatttcaaaatgatac

SEQ ID NO: 887147 - DNA, 22 bp, Artificial Sequence
  chemically synthesized
cttttttatatgtatcattttg

SEQ ID NO: 887148 - DNA, 22 bp, Artificial Sequence
  chemically synthesized
gttctgtaatttcaaaatgata

SEQ ID NO: 887149 - DNA, 22 bp, Artificial Sequence
  chemically synthesized
ttttatatgtatcattttgaaa

SEQ ID NO: 887150 - DNA, 22 bp, Artificial Sequence
  chemically synthesized
tttatatgtatcattttgaaat

SEQ ID NO: 887151 - DNA, 22 bp, Artificial Sequence
  chemically synthesized
ttatatgtatcattttgaaatt

SEQ ID NO: 887152 - DNA, 22 bp, Artificial Sequence
  chemically synthesized
agtttgttctgtaatttcaaaa

SEQ ID NO: 887153 - DNA, 22 bp, Artificial Sequence
  chemically synthesized
tatatgtatcattttgaaatta

SEQ ID NO: 887154 - DNA, 22 bp, Artificial Sequence
  chemically synthesized
atatgtatcattttgaaattac

SEQ ID NO: 887155 - DNA, 22 bp, Artificial Sequence
  chemically synthesized
tatgtatcattttgaaattaca

SEQ ID NO: 887156 - DNA, 22 bp, Artificial Sequence
  chemically synthesized
gtgtaaatgcattcagtttgtt

SEQ ID NO: 887157 - DNA, 22 bp, Artificial Sequence
  chemically synthesized
tgaaattacagaacaaactgaa

SEQ ID NO: 887158 - DNA, 22 bp, Artificial Sequence
  chemically synthesized
agtgtaaatgcattcagtttgt

SEQ ID NO: 887159 - DNA, 22 bp, Artificial Sequence
  chemically synthesized
gaaattacagaacaaactgaat

SEQ ID NO: 887160 - DNA, 22 bp, Artificial Sequence
  chemically synthesized
aaattacagaacaaactgaatg

SEQ ID NO: 887161 - DNA, 22 bp, Artificial Sequence
  chemically synthesized
cttagtgtaaatgcattcagtt

SEQ ID NO: 887162 - DNA, 22 bp, Artificial Sequence
  chemically synthesized
ttacttagtgtaaatgcattca

SEQ ID NO: 887163 - DNA, 22 bp, Artificial Sequence
  chemically synthesized
cagaacaaactgaatgcattta

SEQ ID NO: 887164 - DNA, 22 bp, Artificial Sequence
  chemically synthesized
aattattacttagtgtaaatgc

SEQ ID NO: 887165 - DNA, 22 bp, Artificial Sequence
  chemically synthesized
caattattacttagtgtaaatg

SEQ ID NO: 887166 - DNA, 22 bp, Artificial Sequence
  chemically synthesized
cttcaattattacttagtgtaa

SEQ ID NO: 887167 - DNA, 22 bp, Artificial Sequence
  chemically synthesized
actgcttcaattattacttagt

SEQ ID NO: 887168 - DNA, 22 bp, Artificial Sequence
  chemically synthesized
aatgcatttacactaagtaata

SEQ ID NO: 887169 - DNA, 22 bp, Artificial Sequence
  chemically synthesized
acactaagtaataattgaagca

SEQ ID NO: 887170 - DNA, 22 bp, Artificial Sequence
  chemically synthesized
cactaagtaataattgaagcag

SEQ ID NO: 887171 - DNA, 22 bp, Artificial Sequence
  chemically synthesized
agtaataattgaagcagttaac

SEQ ID NO: 887172 - DNA, 22 bp, Artificial Sequence
  chemically synthesized
aagcagttaacttggccctacg

SEQ ID NO: 887173 - DNA, 22 bp, Artificial Sequence
  chemically synthesized
aaaaggaaacaccgtagggcca

SEQ ID NO: 887174 - DNA, 22 bp, Artificial Sequence
  chemically synthesized
gaaaaggaaacaccgtagggcc

SEQ ID NO: 887175 - DNA, 22 bp, Artificial Sequence
  chemically synthesized
tgaaaaggaaacaccgtagggc

SEQ ID NO: 887176 - DNA, 22 bp, Artificial Sequence
  chemically synthesized
acttggccctacggtgtttcct

SEQ ID NO: 887177 - DNA, 22 bp, Artificial Sequence
  chemically synthesized
acatatattttgaaaaggaaac

SEQ ID NO: 887178 - DNA, 22 bp, Artificial Sequence
  chemically synthesized
ggccctacggtgtttccttttc

SEQ ID NO: 887179 - DNA, 22 bp, Artificial Sequence
  chemically synthesized
gccctacggtgtttccttttca

SEQ ID NO: 887180 - DNA, 22 bp, Artificial Sequence
  chemically synthesized
cggtgtttccttttcaaaatat

SEQ ID NO: 887181 - DNA, 22 bp, Artificial Sequence
  chemically synthesized
tatatatctgacatatattttg

SEQ ID NO: 887182 - DNA, 22 bp, Artificial Sequence
  chemically synthesized
tgtatatatctgacatatattt

SEQ ID NO: 887183 - DNA, 22 bp, Artificial Sequence
  chemically synthesized
tctgtatatatctgacatatat

SEQ ID NO: 887184 - DNA, 22 bp, Artificial Sequence
  chemically synthesized
ctctgtatatatctgacatata

SEQ ID NO: 887185 - DNA, 22 bp, Artificial Sequence
  chemically synthesized
ccttttcaaaatatatgtcaga

SEQ ID NO: 887186 - DNA, 22 bp, Artificial Sequence
  chemically synthesized
cttttcaaaatatatgtcagat

SEQ ID NO: 887187 - DNA, 22 bp, Artificial Sequence
  chemically synthesized
ttcaaaatatatgtcagatata

SEQ ID NO: 887188 - DNA, 22 bp, Artificial Sequence
  chemically synthesized
tcaaaatatatgtcagatatat

SEQ ID NO: 887189 - DNA, 22 bp, Artificial Sequence
  chemically synthesized
caaaatatatgtcagatatata

SEQ ID NO: 887190 - DNA, 22 bp, Artificial Sequence
  chemically synthesized
aacacttctctgtatatatctg

SEQ ID NO: 887191 - DNA, 22 bp, Artificial Sequence
  chemically synthesized
aaaatatatgtcagatatatac

SEQ ID NO: 887192 - DNA, 22 bp, Artificial Sequence
  chemically synthesized
tgcatataggggatattaaaca

SEQ ID NO: 887193 - DNA, 22 bp, Artificial Sequence
  chemically synthesized
aatatcccctatatgcacagat

SEQ ID NO: 887194 - DNA, 22 bp, Artificial Sequence
  chemically synthesized
atatcccctatatgcacagata

SEQ ID NO: 887195 - DNA, 22 bp, Artificial Sequence
  chemically synthesized
tatgcacagatacatatatcat

SEQ ID NO: 887196 - DNA, 22 bp, Artificial Sequence
  chemically synthesized
atatatcatatatatgatatat

SEQ ID NO: 887197 - DNA, 22 bp, Artificial Sequence
  chemically synthesized
catatatcatatatatgatata

SEQ ID NO: 887198 - DNA, 22 bp, Artificial Sequence
  chemically synthesized
tatatttcatatatcatatata

SEQ ID NO: 887199 - DNA, 22 bp, Artificial Sequence
  chemically synthesized
atatatttcatatatcatatat

SEQ ID NO: 887200 - DNA, 22 bp, Artificial Sequence
  chemically synthesized
cttatatatttcatatatcata

SEQ ID NO: 887201 - DNA, 22 bp, Artificial Sequence
  chemically synthesized
aattccttatatatttcatata

SEQ ID NO: 887202 - DNA, 22 bp, Artificial Sequence
  chemically synthesized
aaattccttatatatttcatat

SEQ ID NO: 887203 - DNA, 22 bp, Artificial Sequence
  chemically synthesized
atgatatagaaaatttaaattc

SEQ ID NO: 887204 - DNA, 22 bp, Artificial Sequence
  chemically synthesized
aaattttctatatcatgaatca

SEQ ID NO: 887205 - DNA, 22 bp, Artificial Sequence
  chemically synthesized
aattttctatatcatgaatcac

SEQ ID NO: 887206 - DNA, 22 bp, Artificial Sequence
  chemically synthesized
tctatatcatgaatcacatact

SEQ ID NO: 887207 - DNA, 22 bp, Artificial Sequence
  chemically synthesized
aatgaatgaatcagtatgtgat

SEQ ID NO: 887208 - DNA, 22 bp, Artificial Sequence
  chemically synthesized
ctatatcatgaatcacatactg

SEQ ID NO: 887209 - DNA, 22 bp, Artificial Sequence
  chemically synthesized
tatatcatgaatcacatactga

SEQ ID NO: 887210 - DNA, 22 bp, Artificial Sequence
  chemically synthesized
tatcatgaatcacatactgatt

SEQ ID NO: 887211 - DNA, 22 bp, Artificial Sequence
  chemically synthesized
acatactgaatgaatgaatcag

SEQ ID NO: 887212 - DNA, 22 bp, Artificial Sequence
  chemically synthesized
atgcattcacatactgaatgaa

SEQ ID NO: 887213 - DNA, 22 bp, Artificial Sequence
  chemically synthesized
gactcatgcattcacatactga

SEQ ID NO: 887214 - DNA, 22 bp, Artificial Sequence
  chemically synthesized
attcattcattcagtatgtgaa

SEQ ID NO: 887215 - DNA, 22 bp, Artificial Sequence
  chemically synthesized
attcattcagtatgtgaatgca

SEQ ID NO: 887216 - DNA, 22 bp, Artificial Sequence
  chemically synthesized
attcagtatgtgaatgcatgag

SEQ ID NO: 887217 - DNA, 22 bp, Artificial Sequence
  chemically synthesized
agtatgtgaatgcatgagtcta

SEQ ID NO: 887218 - DNA, 22 bp, Artificial Sequence
  chemically synthesized
agcaatagtgtcagtgggatta

SEQ ID NO: 887219 - DNA, 22 bp, Artificial Sequence
  chemically synthesized
gagcaatagtgtcagtgggatt

SEQ ID NO: 887220 - DNA, 22 bp, Artificial Sequence
  chemically synthesized
tgagcaatagtgtcagtgggat

SEQ ID NO: 887221 - DNA, 22 bp, Artificial Sequence
  chemically synthesized
ctttgagcaatagtgtcagtgg

SEQ ID NO: 887222 - DNA, 22 bp, Artificial Sequence
  chemically synthesized
accctcctttgagcaatagtgt

SEQ ID NO: 887223 - DNA, 22 bp, Artificial Sequence
  chemically synthesized
atcccactgacactattgctca

SEQ ID NO: 887224 - DNA, 22 bp, Artificial Sequence
  chemically synthesized
ctgaccctcctttgagcaatag

SEQ ID NO: 887225 - DNA, 22 bp, Artificial Sequence
  chemically synthesized
cctgaccctcctttgagcaata

SEQ ID NO: 887226 - DNA, 22 bp, Artificial Sequence
  chemically synthesized
ttcctgaccctcctttgagcaa

SEQ ID NO: 887227 - DNA, 22 bp, Artificial Sequence
  chemically synthesized
ttcttcctgaccctcctttgag

SEQ ID NO: 887228 - DNA, 22 bp, Artificial Sequence
  chemically synthesized
acactattgctcaaaggagggt

SEQ ID NO: 887229 - DNA, 22 bp, Artificial Sequence
  chemically synthesized
ccccctattcttcctgaccctc

SEQ ID NO: 887230 - DNA, 22 bp, Artificial Sequence
  chemically synthesized
cccccctattcttcctgaccct

SEQ ID NO: 887231 - DNA, 22 bp, Artificial Sequence
  chemically synthesized
ttgctcaaaggagggtcaggaa

SEQ ID NO: 887232 - DNA, 22 bp, Artificial Sequence
  chemically synthesized
tcccccctattcttcctgaccc

SEQ ID NO: 887233 - DNA, 22 bp, Artificial Sequence
  chemically synthesized
ctcaaaggagggtcaggaagaa

SEQ ID NO: 887234 - DNA, 22 bp, Artificial Sequence
  chemically synthesized
aaaggagggtcaggaagaatag

SEQ ID NO: 887235 - DNA, 22 bp, Artificial Sequence
  chemically synthesized
acatcattttcccccctattct

SEQ ID NO: 887236 - DNA, 22 bp, Artificial Sequence
  chemically synthesized
ttcacatcattttcccccctat

SEQ ID NO: 887237 - DNA, 22 bp, Artificial Sequence
  chemically synthesized
ctattcacatcattttcccccc

SEQ ID NO: 887238 - DNA, 22 bp, Artificial Sequence
  chemically synthesized
cctattcacatcattttccccc

SEQ ID NO: 887239 - DNA, 22 bp, Artificial Sequence
  chemically synthesized
tcctattcacatcattttcccc

SEQ ID NO: 887240 - DNA, 22 bp, Artificial Sequence
  chemically synthesized
ttttcctattcacatcattttc

SEQ ID NO: 887241 - DNA, 22 bp, Artificial Sequence
  chemically synthesized
ctgttttcctattcacatcatt

SEQ ID NO: 887242 - DNA, 22 bp, Artificial Sequence
  chemically synthesized
actgttttcctattcacatcat

SEQ ID NO: 887243 - DNA, 22 bp, Artificial Sequence
  chemically synthesized
ccatatgcttactgttttccta

SEQ ID NO: 887244 - DNA, 22 bp, Artificial Sequence
  chemically synthesized
aaaattgccatatgcttactgt

SEQ ID NO: 887245 - DNA, 22 bp, Artificial Sequence
  chemically synthesized
caaaattgccatatgcttactg

SEQ ID NO: 887246 - DNA, 22 bp, Artificial Sequence
  chemically synthesized
caaatacttcaaaattgccata

SEQ ID NO: 887247 - DNA, 22 bp, Artificial Sequence
  chemically synthesized
tattccaaatacttcaaaattg

SEQ ID NO: 887248 - DNA, 22 bp, Artificial Sequence
  chemically synthesized
gtattccaaatacttcaaaatt

SEQ ID NO: 887249 - DNA, 22 bp, Artificial Sequence
  chemically synthesized
tgtattccaaatacttcaaaat

SEQ ID NO: 887250 - DNA, 22 bp, Artificial Sequence
  chemically synthesized
taataactttgtattccaaata

SEQ ID NO: 887251 - DNA, 22 bp, Artificial Sequence
  chemically synthesized
ataataactttgtattccaaat

SEQ ID NO: 887252 - DNA, 22 bp, Artificial Sequence
  chemically synthesized
aacttataataactttgtattc

SEQ ID NO: 887253 - DNA, 22 bp, Artificial Sequence
  chemically synthesized
tgaagtatttggaatacaaagt

SEQ ID NO: 887254 - DNA, 22 bp, Artificial Sequence
  chemically synthesized
gaagtatttggaatacaaagtt

SEQ ID NO: 887255 - DNA, 22 bp, Artificial Sequence
  chemically synthesized
aagtatttggaatacaaagtta

SEQ ID NO: 887256 - DNA, 22 bp, Artificial Sequence
  chemically synthesized
tactcaacttataataactttg

SEQ ID NO: 887257 - DNA, 22 bp, Artificial Sequence
  chemically synthesized
ggaatacaaagttattataagt

SEQ ID NO: 887258 - DNA, 22 bp, Artificial Sequence
  chemically synthesized
gaatacaaagttattataagtt

SEQ ID NO: 887259 - DNA, 22 bp, Artificial Sequence
  chemically synthesized
tcagctgtactcaacttataat

SEQ ID NO: 887260 - DNA, 22 bp, Artificial Sequence
  chemically synthesized
gtcagctgtactcaacttataa

SEQ ID NO: 887261 - DNA, 22 bp, Artificial Sequence
  chemically synthesized
tgtcagctgtactcaacttata

SEQ ID NO: 887262 - DNA, 22 bp, Artificial Sequence
  chemically synthesized
ttgtcagctgtactcaacttat

SEQ ID NO: 887263 - DNA, 22 bp, Artificial Sequence
  chemically synthesized
tttgtcagctgtactcaactta

SEQ ID NO: 887264 - DNA, 22 bp, Artificial Sequence
  chemically synthesized
ttttgtcagctgtactcaactt

SEQ ID NO: 887265 - DNA, 22 bp, Artificial Sequence
  chemically synthesized
tgcatttttttgtcagctgtac

SEQ ID NO: 887266 - DNA, 22 bp, Artificial Sequence
  chemically synthesized
ttataagttgagtacagctgac

SEQ ID NO: 887267 - DNA, 22 bp, Artificial Sequence
  chemically synthesized
ctatgcatttttttgtcagctg

SEQ ID NO: 887268 - DNA, 22 bp, Artificial Sequence
  chemically synthesized
taagttgagtacagctgacaaa

SEQ ID NO: 887269 - DNA, 22 bp, Artificial Sequence
  chemically synthesized
atgttactatgcatttttttgt

SEQ ID NO: 887270 - DNA, 22 bp, Artificial Sequence
  chemically synthesized
agtacagctgacaaaaaaatgc

SEQ ID NO: 887271 - DNA, 22 bp, Artificial Sequence
  chemically synthesized
gctgatgttactatgcattttt

SEQ ID NO: 887272 - DNA, 22 bp, Artificial Sequence
  chemically synthesized
acaaaaaaatgcatagtaacat

SEQ ID NO: 887273 - DNA, 22 bp, Artificial Sequence
  chemically synthesized
ggcaaagttagctgatgttact

SEQ ID NO: 887274 - DNA, 22 bp, Artificial Sequence
  chemically synthesized
ctaggcaaagttagctgatgtt

SEQ ID NO: 887275 - DNA, 22 bp, Artificial Sequence
  chemically synthesized
tcatctactaggcaaagttagc

SEQ ID NO: 887276 - DNA, 22 bp, Artificial Sequence
  chemically synthesized
tataagtacccctatcatctac

SEQ ID NO: 887277 - DNA, 22 bp, Artificial Sequence
  chemically synthesized
atataagtacccctatcatcta

SEQ ID NO: 887278 - DNA, 22 bp, Artificial Sequence
  chemically synthesized
actttgcctagtagatgatagg

SEQ ID NO: 887279 - DNA, 22 bp, Artificial Sequence
  chemically synthesized
tatataagtacccctatcatct

SEQ ID NO: 887280 - DNA, 22 bp, Artificial Sequence
  chemically synthesized
ttttatataagtacccctatca

SEQ ID NO: 887281 - DNA, 22 bp, Artificial Sequence
  chemically synthesized
tgcctagtagatgataggggta

SEQ ID NO: 887282 - DNA, 22 bp, Artificial Sequence
  chemically synthesized
gcctagtagatgataggggtac

SEQ ID NO: 887283 - DNA, 22 bp, Artificial Sequence
  chemically synthesized
tattttatataagtacccctat

SEQ ID NO: 887284 - DNA, 22 bp, Artificial Sequence
  chemically synthesized
cctagtagatgataggggtact

SEQ ID NO: 887285 - DNA, 22 bp, Artificial Sequence
  chemically synthesized
gtagatgataggggtacttata

SEQ ID NO: 887286 - DNA, 22 bp, Artificial Sequence
  chemically synthesized
acaaatacaattctattttata

SEQ ID NO: 887287 - DNA, 22 bp, Artificial Sequence
  chemically synthesized
attaacaaatacaattctattt

SEQ ID NO: 887288 - DNA, 22 bp, Artificial Sequence
  chemically synthesized
taattaacaaatacaattctat

SEQ ID NO: 887289 - DNA, 22 bp, Artificial Sequence
  chemically synthesized
atataaaatagaattgtatttg

SEQ ID NO: 887290 - DNA, 22 bp, Artificial Sequence
  chemically synthesized
tataaaatagaattgtatttgt

SEQ ID NO: 887291 - DNA, 22 bp, Artificial Sequence
  chemically synthesized
tgattctaattaacaaatacaa

SEQ ID NO: 887292 - DNA, 22 bp, Artificial Sequence
  chemically synthesized
aagagtatattatgattctaat

SEQ ID NO: 887293 - DNA, 22 bp, Artificial Sequence
  chemically synthesized
tatttgttaattagaatcataa

SEQ ID NO: 887294 - DNA, 22 bp, Artificial Sequence
  chemically synthesized
gttaattagaatcataatatac

SEQ ID NO: 887295 - DNA, 22 bp, Artificial Sequence
  chemically synthesized
tatcactgaagagtatattatg

SEQ ID NO: 887296 - DNA, 22 bp, Artificial Sequence
  chemically synthesized
ttaattagaatcataatatact

SEQ ID NO: 887297 - DNA, 22 bp, Artificial Sequence
  chemically synthesized
tgtatcactgaagagtatatta

SEQ ID NO: 887298 - DNA, 22 bp, Artificial Sequence
  chemically synthesized
attagaatcataatatactctt

SEQ ID NO: 887299 - DNA, 22 bp, Artificial Sequence
  chemically synthesized
agttctgtatcactgaagagta

SEQ ID NO: 887300 - DNA, 22 bp, Artificial Sequence
  chemically synthesized
gaatcataatatactcttcagt

SEQ ID NO: 887301 - DNA, 22 bp, Artificial Sequence
  chemically synthesized
gtatattaagttctgtatcact

SEQ ID NO: 887302 - DNA, 22 bp, Artificial Sequence
  chemically synthesized
agtatattaagttctgtatcac

SEQ ID NO: 887303 - DNA, 22 bp, Artificial Sequence
  chemically synthesized
acttagtatattaagttctgta

SEQ ID NO: 887304 - DNA, 22 bp, Artificial Sequence
  chemically synthesized
cacttagtatattaagttctgt

SEQ ID NO: 887305 - DNA, 22 bp, Artificial Sequence
  chemically synthesized
ttcagtgatacagaacttaata

SEQ ID NO: 887306 - DNA, 22 bp, Artificial Sequence
  chemically synthesized
cagtgatacagaacttaatata

SEQ ID NO: 887307 - DNA, 22 bp, Artificial Sequence
  chemically synthesized
agtgatacagaacttaatatac

SEQ ID NO: 887308 - DNA, 22 bp, Artificial Sequence
  chemically synthesized
agatttcacttagtatattaag

SEQ ID NO: 887309 - DNA, 22 bp, Artificial Sequence
  chemically synthesized
tatactgagatttcacttagta

SEQ ID NO: 887310 - DNA, 22 bp, Artificial Sequence
  chemically synthesized
tatatactgagatttcacttag

SEQ ID NO: 887311 - DNA, 22 bp, Artificial Sequence
  chemically synthesized
aatatactaagtgaaatctcag

SEQ ID NO: 887312 - DNA, 22 bp, Artificial Sequence
  chemically synthesized
atatactaagtgaaatctcagt

SEQ ID NO: 887313 - DNA, 22 bp, Artificial Sequence
  chemically synthesized
aatatacaattctatatactga

SEQ ID NO: 887314 - DNA, 22 bp, Artificial Sequence
  chemically synthesized
gaatatacaattctatatactg

SEQ ID NO: 887315 - DNA, 22 bp, Artificial Sequence
  chemically synthesized
agtgaaatctcagtatatagaa

SEQ ID NO: 887316 - DNA, 22 bp, Artificial Sequence
  chemically synthesized
ttgaatatacaattctatatac

SEQ ID NO: 887317 - DNA, 22 bp, Artificial Sequence
  chemically synthesized
agtatatagaattgtatattca

SEQ ID NO: 887318 - DNA, 22 bp, Artificial Sequence
  chemically synthesized
gaaatgccatagcaatatgtcc

SEQ ID NO: 887319 - DNA, 22 bp, Artificial Sequence
  chemically synthesized
tatattcaagaggacatattgc

SEQ ID NO: 887320 - DNA, 22 bp, Artificial Sequence
  chemically synthesized
agaaatgccatagcaatatgtc

SEQ ID NO: 887321 - DNA, 22 bp, Artificial Sequence
  chemically synthesized
cggcttagaaatgccatagcaa

SEQ ID NO: 887322 - DNA, 22 bp, Artificial Sequence
  chemically synthesized
aagaggacatattgctatggca

SEQ ID NO: 887323 - DNA, 22 bp, Artificial Sequence
  chemically synthesized
acggcttagaaatgccatagca

SEQ ID NO: 887324 - DNA, 22 bp, Artificial Sequence
  chemically synthesized
aatttacggcttagaaatgcca

SEQ ID NO: 887325 - DNA, 22 bp, Artificial Sequence
  chemically synthesized
tgcgttgaatttacggcttaga

SEQ ID NO: 887326 - DNA, 22 bp, Artificial Sequence
  chemically synthesized
atgcgttgaatttacggcttag

SEQ ID NO: 887327 - DNA, 22 bp, Artificial Sequence
  chemically synthesized
ctatggcatttctaagccgtaa

SEQ ID NO: 887328 - DNA, 22 bp, Artificial Sequence
  chemically synthesized
tatgcgttgaatttacggctta

SEQ ID NO: 887329 - DNA, 22 bp, Artificial Sequence
  chemically synthesized
tggcatttctaagccgtaaatt

SEQ ID NO: 887330 - DNA, 22 bp, Artificial Sequence
  chemically synthesized
ctaagccgtaaattcaacgcat

SEQ ID NO: 887331 - DNA, 22 bp, Artificial Sequence
  chemically synthesized
taagccgtaaattcaacgcata

SEQ ID NO: 887332 - DNA, 22 bp, Artificial Sequence
  chemically synthesized
agccgtaaattcaacgcataaa

SEQ ID NO: 887333 - DNA, 22 bp, Artificial Sequence
  chemically synthesized
aacgcataaagtttggatgatt

SEQ ID NO: 887334 - DNA, 22 bp, Artificial Sequence
  chemically synthesized
caatgaagatgtaatcatccaa

SEQ ID NO: 887335 - DNA, 22 bp, Artificial Sequence
  chemically synthesized
tccaatgaagatgtaatcatcc

SEQ ID NO: 887336 - DNA, 22 bp, Artificial Sequence
  chemically synthesized
tctccaatgaagatgtaatcat

SEQ ID NO: 887337 - DNA, 22 bp, Artificial Sequence
  chemically synthesized
ggatgattacatcttcattgga

SEQ ID NO: 887338 - DNA, 22 bp, Artificial Sequence
  chemically synthesized
gatgattacatcttcattggag

SEQ ID NO: 887339 - DNA, 22 bp, Artificial Sequence
  chemically synthesized
catcttcattggagagaatcat

SEQ ID NO: 887340 - DNA, 22 bp, Artificial Sequence
  chemically synthesized
cattggagagaatcatgttact

SEQ ID NO: 887341 - DNA, 22 bp, Artificial Sequence
  chemically synthesized
attggagagaatcatgttactt

SEQ ID NO: 887342 - DNA, 22 bp, Artificial Sequence
  chemically synthesized
gagagaatcatgttactttatg

SEQ ID NO: 887343 - DNA, 22 bp, Artificial Sequence
  chemically synthesized
tcagtatgaaaatatatcataa

SEQ ID NO: 887344 - DNA, 22 bp, Artificial Sequence
  chemically synthesized
gatgttatcagtatgaaaatat

SEQ ID NO: 887345 - DNA, 22 bp, Artificial Sequence
  chemically synthesized
agatgttatcagtatgaaaata

SEQ ID NO: 887346 - DNA, 22 bp, Artificial Sequence
  chemically synthesized
ctttatgatatattttcatact

SEQ ID NO: 887347 - DNA, 22 bp, Artificial Sequence
  chemically synthesized
tatgatatattttcatactgat

SEQ ID NO: 887348 - DNA, 22 bp, Artificial Sequence
  chemically synthesized
atgatatattttcatactgata

SEQ ID NO: 887349 - DNA, 22 bp, Artificial Sequence
  chemically synthesized
tgatatattttcatactgataa

SEQ ID NO: 887350 - DNA, 22 bp, Artificial Sequence
  chemically synthesized
agaataaacttagatgttatca

SEQ ID NO: 887351 - DNA, 22 bp, Artificial Sequence
  chemically synthesized
attcagaataaacttagatgtt

SEQ ID NO: 887352 - DNA, 22 bp, Artificial Sequence
  chemically synthesized
tcatactgataacatctaagtt

SEQ ID NO: 887353 - DNA, 22 bp, Artificial Sequence
  chemically synthesized
catactgataacatctaagttt

SEQ ID NO: 887354 - DNA, 22 bp, Artificial Sequence
  chemically synthesized
atactgataacatctaagttta

SEQ ID NO: 887355 - DNA, 22 bp, Artificial Sequence
  chemically synthesized
ataacatctaagtttattctga

SEQ ID NO: 887356 - DNA, 22 bp, Artificial Sequence
  chemically synthesized
atatatcctaattcagaataaa

SEQ ID NO: 887357 - DNA, 22 bp, Artificial Sequence
  chemically synthesized
catatatcctaattcagaataa

SEQ ID NO: 887358 - DNA, 22 bp, Artificial Sequence
  chemically synthesized
agtttattctgaattaggatat

SEQ ID NO: 887359 - DNA, 22 bp, Artificial Sequence
  chemically synthesized
agtaatacttcatatatcctaa

SEQ ID NO: 887360 - DNA, 22 bp, Artificial Sequence
  chemically synthesized
aagtaatacttcatatatccta

SEQ ID NO: 887361 - DNA, 22 bp, Artificial Sequence
  chemically synthesized
taagtaatacttcatatatcct

SEQ ID NO: 887362 - DNA, 22 bp, Artificial Sequence
  chemically synthesized
attctgaattaggatatatgaa

SEQ ID NO: 887363 - DNA, 22 bp, Artificial Sequence
  chemically synthesized
ttctgaattaggatatatgaag

SEQ ID NO: 887364 - DNA, 22 bp, Artificial Sequence
  chemically synthesized
tgaattaggatatatgaagtat

SEQ ID NO: 887365 - DNA, 22 bp, Artificial Sequence
  chemically synthesized
aattaggatatatgaagtatta

SEQ ID NO: 887366 - DNA, 22 bp, Artificial Sequence
  chemically synthesized
aagggttttaagtaatacttca

SEQ ID NO: 887367 - DNA, 22 bp, Artificial Sequence
  chemically synthesized
tgaagggttttaagtaatactt

SEQ ID NO: 887368 - DNA, 22 bp, Artificial Sequence
  chemically synthesized
ggatatatgaagtattacttaa

SEQ ID NO: 887369 - DNA, 22 bp, Artificial Sequence
  chemically synthesized
tgtaacattctgaagggtttta

SEQ ID NO: 887370 - DNA, 22 bp, Artificial Sequence
  chemically synthesized
acaaaactatgtaacattctga

SEQ ID NO: 887371 - DNA, 22 bp, Artificial Sequence
  chemically synthesized
cttaaaacccttcagaatgtta

SEQ ID NO: 887372 - DNA, 22 bp, Artificial Sequence
  chemically synthesized
taacaaaactatgtaacattct

SEQ ID NO: 887373 - DNA, 22 bp, Artificial Sequence
  chemically synthesized
aaaacccttcagaatgttacat

SEQ ID NO: 887374 - DNA, 22 bp, Artificial Sequence
  chemically synthesized
aaacccttcagaatgttacata

SEQ ID NO: 887375 - DNA, 22 bp, Artificial Sequence
  chemically synthesized
cagaatgttacatagttttgtt

SEQ ID NO: 887376 - DNA, 22 bp, Artificial Sequence
  chemically synthesized
agaatgttacatagttttgtta

SEQ ID NO: 887377 - DNA, 22 bp, Artificial Sequence
  chemically synthesized
aagatgcatgtctctaacaaaa

SEQ ID NO: 887378 - DNA, 22 bp, Artificial Sequence
  chemically synthesized
aaagatgcatgtctctaacaaa

SEQ ID NO: 887379 - DNA, 22 bp, Artificial Sequence
  chemically synthesized
catagttttgttagagacatgc

SEQ ID NO: 887380 - DNA, 22 bp, Artificial Sequence
  chemically synthesized
aaaaataatttaaagatgcatg

SEQ ID NO: 887381 - DNA, 22 bp, Artificial Sequence
  chemically synthesized
tgttagagacatgcatctttaa

SEQ ID NO: 887382 - DNA, 22 bp, Artificial Sequence
  chemically synthesized
gttagagacatgcatctttaaa

SEQ ID NO: 887383 - DNA, 22 bp, Artificial Sequence
  chemically synthesized
tctaaaaaataatttaaagatg

SEQ ID NO: 887384 - DNA, 22 bp, Artificial Sequence
  chemically synthesized
ttagagacatgcatctttaaat

SEQ ID NO: 887385 - DNA, 22 bp, Artificial Sequence
  chemically synthesized
gagacatgcatctttaaattat

SEQ ID NO: 887386 - DNA, 22 bp, Artificial Sequence
  chemically synthesized
taaattattttttagataatat

SEQ ID NO: 887387 - DNA, 22 bp, Artificial Sequence
  chemically synthesized
aaattattttttagataatata

SEQ ID NO: 887388 - DNA, 22 bp, Artificial Sequence
  chemically synthesized
aattattttttagataatatat

SEQ ID NO: 887389 - DNA, 22 bp, Artificial Sequence
  chemically synthesized
ccaaatgataataatatattat

SEQ ID NO: 887390 - DNA, 22 bp, Artificial Sequence
  chemically synthesized
ttttttagataatatattatta

SEQ ID NO: 887391 - DNA, 22 bp, Artificial Sequence
  chemically synthesized
tttagataatatattattatca

SEQ ID NO: 887392 - DNA, 22 bp, Artificial Sequence
  chemically synthesized
ttagataatatattattatcat

SEQ ID NO: 887393 - DNA, 22 bp, Artificial Sequence
  chemically synthesized
tagataatatattattatcatt

SEQ ID NO: 887394 - DNA, 22 bp, Artificial Sequence
  chemically synthesized
agataatatattattatcattt

SEQ ID NO: 887395 - DNA, 22 bp, Artificial Sequence
  chemically synthesized
agaaaaattaccaaatgataat

SEQ ID NO: 887396 - DNA, 22 bp, Artificial Sequence
  chemically synthesized
gataatatattattatcatttg

SEQ ID NO: 887397 - DNA, 22 bp, Artificial Sequence
  chemically synthesized
agagttgagaaaaattaccaaa

SEQ ID NO: 887398 - DNA, 22 bp, Artificial Sequence
  chemically synthesized
gagagttgagaaaaattaccaa

SEQ ID NO: 887399 - DNA, 22 bp, Artificial Sequence
  chemically synthesized
ttatcatttggtaatttttctc

SEQ ID NO: 887400 - DNA, 22 bp, Artificial Sequence
  chemically synthesized
atatttgagagttgagaaaaat

SEQ ID NO: 887401 - DNA, 22 bp, Artificial Sequence
  chemically synthesized
tcatttggtaatttttctcaac

SEQ ID NO: 887402 - DNA, 22 bp, Artificial Sequence
  chemically synthesized
cactcatatttgagagttgaga

SEQ ID NO: 887403 - DNA, 22 bp, Artificial Sequence
  chemically synthesized
ccactcatatttgagagttgag

SEQ ID NO: 887404 - DNA, 22 bp, Artificial Sequence
  chemically synthesized
ggtaatttttctcaactctcaa

SEQ ID NO: 887405 - DNA, 22 bp, Artificial Sequence
  chemically synthesized
gtaatttttctcaactctcaaa

SEQ ID NO: 887406 - DNA, 22 bp, Artificial Sequence
  chemically synthesized
aacttccactcatatttgagag

SEQ ID NO: 887407 - DNA, 22 bp, Artificial Sequence
  chemically synthesized
aaacttccactcatatttgaga

SEQ ID NO: 887408 - DNA, 22 bp, Artificial Sequence
  chemically synthesized
ttctcaactctcaaatatgagt

SEQ ID NO: 887409 - DNA, 22 bp, Artificial Sequence
  chemically synthesized
tctcaactctcaaatatgagtg

SEQ ID NO: 887410 - DNA, 22 bp, Artificial Sequence
  chemically synthesized
ctcaactctcaaatatgagtgg

SEQ ID NO: 887411 - DNA, 22 bp, Artificial Sequence
  chemically synthesized
tcaactctcaaatatgagtgga

SEQ ID NO: 887412 - DNA, 22 bp, Artificial Sequence
  chemically synthesized
aactctcaaatatgagtggaag

SEQ ID NO: 887413 - DNA, 22 bp, Artificial Sequence
  chemically synthesized
ataccaatttaaacttccactc

SEQ ID NO: 887414 - DNA, 22 bp, Artificial Sequence
  chemically synthesized
tcaaatatgagtggaagtttaa

SEQ ID NO: 887415 - DNA, 22 bp, Artificial Sequence
  chemically synthesized
aaatatgagtggaagtttaaat

SEQ ID NO: 887416 - DNA, 22 bp, Artificial Sequence
  chemically synthesized
aagaactcataccaatttaaac

SEQ ID NO: 887417 - DNA, 22 bp, Artificial Sequence
  chemically synthesized
catctcaagaactcataccaat

SEQ ID NO: 887418 - DNA, 22 bp, Artificial Sequence
  chemically synthesized
ccatctcaagaactcataccaa

SEQ ID NO: 887419 - DNA, 22 bp, Artificial Sequence
  chemically synthesized
agtttccatctcaagaactcat

SEQ ID NO: 887420 - DNA, 22 bp, Artificial Sequence
  chemically synthesized
cagtttccatctcaagaactca

SEQ ID NO: 887421 - DNA, 22 bp, Artificial Sequence
  chemically synthesized
ttcagtttccatctcaagaact

SEQ ID NO: 887422 - DNA, 22 bp, Artificial Sequence
  chemically synthesized
aaattggtatgagttcttgaga

SEQ ID NO: 887423 - DNA, 22 bp, Artificial Sequence
  chemically synthesized
aattggtatgagttcttgagat

SEQ ID NO: 887424 - DNA, 22 bp, Artificial Sequence
  chemically synthesized
actcttcagtttccatctcaag

SEQ ID NO: 887425 - DNA, 22 bp, Artificial Sequence
  chemically synthesized
cactcttcagtttccatctcaa

SEQ ID NO: 887426 - DNA, 22 bp, Artificial Sequence
  chemically synthesized
gtatgagttcttgagatggaaa

SEQ ID NO: 887427 - DNA, 22 bp, Artificial Sequence
  chemically synthesized
tttcactcttcagtttccatct

SEQ ID NO: 887428 - DNA, 22 bp, Artificial Sequence
  chemically synthesized
ttgagatggaaactgaagagtg

SEQ ID NO: 887429 - DNA, 22 bp, Artificial Sequence
  chemically synthesized
aataaagctatttcactcttca

SEQ ID NO: 887430 - DNA, 22 bp, Artificial Sequence
  chemically synthesized
gagatggaaactgaagagtgaa

SEQ ID NO: 887431 - DNA, 22 bp, Artificial Sequence
  chemically synthesized
aaataaagctatttcactcttc

SEQ ID NO: 887432 - DNA, 22 bp, Artificial Sequence
  chemically synthesized
agatggaaactgaagagtgaaa

SEQ ID NO: 887433 - DNA, 22 bp, Artificial Sequence
  chemically synthesized
taaataaagctatttcactctt

SEQ ID NO: 887434 - DNA, 22 bp, Artificial Sequence
  chemically synthesized
ttttaaataaagctatttcact

SEQ ID NO: 887435 - DNA, 22 bp, Artificial Sequence
  chemically synthesized
aagagtgaaatagctttattta

SEQ ID NO: 887436 - DNA, 22 bp, Artificial Sequence
  chemically synthesized
ggagaagtatctattttaaata

SEQ ID NO: 887437 - DNA, 22 bp, Artificial Sequence
  chemically synthesized
gcattaggagaagtatctattt

SEQ ID NO: 887438 - DNA, 22 bp, Artificial Sequence
  chemically synthesized
agcattaggagaagtatctatt

SEQ ID NO: 887439 - DNA, 22 bp, Artificial Sequence
  chemically synthesized
tagcattaggagaagtatctat

SEQ ID NO: 887440 - DNA, 22 bp, Artificial Sequence
  chemically synthesized
tatttaaaatagatacttctcc

SEQ ID NO: 887441 - DNA, 22 bp, Artificial Sequence
  chemically synthesized
atttaaaatagatacttctcct

SEQ ID NO: 887442 - DNA, 22 bp, Artificial Sequence
  chemically synthesized
agttttagcattaggagaagta

SEQ ID NO: 887443 - DNA, 22 bp, Artificial Sequence
  chemically synthesized
tttaaaatagatacttctccta

SEQ ID NO: 887444 - DNA, 22 bp, Artificial Sequence
  chemically synthesized
aagttttagcattaggagaagt

SEQ ID NO: 887445 - DNA, 22 bp, Artificial Sequence
  chemically synthesized
taagttttagcattaggagaag

SEQ ID NO: 887446 - DNA, 22 bp, Artificial Sequence
  chemically synthesized
aaaatagatacttctcctaatg

SEQ ID NO: 887447 - DNA, 22 bp, Artificial Sequence
  chemically synthesized
aaatagatacttctcctaatgc

SEQ ID NO: 887448 - DNA, 22 bp, Artificial Sequence
  chemically synthesized
tactttaagttttagcattagg

SEQ ID NO: 887449 - DNA, 22 bp, Artificial Sequence
  chemically synthesized
ttatactttaagttttagcatt

SEQ ID NO: 887450 - DNA, 22 bp, Artificial Sequence
  chemically synthesized
attatactttaagttttagcat

SEQ ID NO: 887451 - DNA, 22 bp, Artificial Sequence
  chemically synthesized
tattatactttaagttttagca

SEQ ID NO: 887452 - DNA, 22 bp, Artificial Sequence
  chemically synthesized
ttattatactttaagttttagc

SEQ ID NO: 887453 - DNA, 22 bp, Artificial Sequence
  chemically synthesized
tttattatactttaagttttag

SEQ ID NO: 887454 - DNA, 22 bp, Artificial Sequence
  chemically synthesized
ttttattatactttaagtttta

SEQ ID NO: 887455 - DNA, 22 bp, Artificial Sequence
  chemically synthesized
tttttattatactttaagtttt

SEQ ID NO: 887456 - DNA, 22 bp, Artificial Sequence
  chemically synthesized
ctcctaatgctaaaacttaaag

SEQ ID NO: 887457 - DNA, 22 bp, Artificial Sequence
  chemically synthesized
tcctaatgctaaaacttaaagt

SEQ ID NO: 887458 - DNA, 22 bp, Artificial Sequence
  chemically synthesized
ttttttttattatactttaagt

SEQ ID NO: 887459 - DNA, 22 bp, Artificial Sequence
  chemically synthesized
ctaatgctaaaacttaaagtat

SEQ ID NO: 887460 - DNA, 22 bp, Artificial Sequence
  chemically synthesized
attttttttattatactttaag

SEQ ID NO: 887461 - DNA, 22 bp, Artificial Sequence
  chemically synthesized
tattttttttattatactttaa

SEQ ID NO: 887462 - DNA, 22 bp, Artificial Sequence
  chemically synthesized
atgctaaaacttaaagtataat

SEQ ID NO: 887463 - DNA, 22 bp, Artificial Sequence
  chemically synthesized
ttttattttttttattatactt

SEQ ID NO: 887464 - DNA, 22 bp, Artificial Sequence
  chemically synthesized
tctattttattttttttattat

SEQ ID NO: 887465 - DNA, 22 bp, Artificial Sequence
  chemically synthesized
aaacttaaagtataataaaaaa

SEQ ID NO: 887466 - DNA, 22 bp, Artificial Sequence
  chemically synthesized
aaagtataataaaaaaaataaa

SEQ ID NO: 887467 - DNA, 22 bp, Artificial Sequence
  chemically synthesized
agaattatctattttatttttt

SEQ ID NO: 887468 - DNA, 22 bp, Artificial Sequence
  chemically synthesized
aagtataataaaaaaaataaaa

SEQ ID NO: 887469 - DNA, 22 bp, Artificial Sequence
  chemically synthesized
aagaattatctattttattttt

SEQ ID NO: 887470 - DNA, 22 bp, Artificial Sequence
  chemically synthesized
taagaattatctattttatttt

SEQ ID NO: 887471 - DNA, 22 bp, Artificial Sequence
  chemically synthesized
aaaagaacactttaagaattat

SEQ ID NO: 887472 - DNA, 22 bp, Artificial Sequence
  chemically synthesized
aacactaaaaagaacactttaa

SEQ ID NO: 887473 - DNA, 22 bp, Artificial Sequence
  chemically synthesized
ttgaacactaaaaagaacactt

SEQ ID NO: 887474 - DNA, 22 bp, Artificial Sequence
  chemically synthesized
ttaaagtgttctttttagtgtt

SEQ ID NO: 887475 - DNA, 22 bp, Artificial Sequence
  chemically synthesized
aaagtgttctttttagtgttca

SEQ ID NO: 887476 - DNA, 22 bp, Artificial Sequence
  chemically synthesized
aagtgttctttttagtgttcaa

SEQ ID NO: 887477 - DNA, 22 bp, Artificial Sequence
  chemically synthesized
tttttagtgttcaataatttat

SEQ ID NO: 887478 - DNA, 22 bp, Artificial Sequence
  chemically synthesized
tttagtgttcaataatttatat

SEQ ID NO: 887479 - DNA, 22 bp, Artificial Sequence
  chemically synthesized
ttagtgttcaataatttatata

SEQ ID NO: 887480 - DNA, 22 bp, Artificial Sequence
  chemically synthesized
tagtgttcaataatttatatat

SEQ ID NO: 887481 - DNA, 22 bp, Artificial Sequence
  chemically synthesized
agtgttcaataatttatatata

SEQ ID NO: 887482 - DNA, 22 bp, Artificial Sequence
  chemically synthesized
gtgttcaataatttatatatat

SEQ ID NO: 887483 - DNA, 22 bp, Artificial Sequence
  chemically synthesized
taatgtatataatacatatata

SEQ ID NO: 887484 - DNA, 22 bp, Artificial Sequence
  chemically synthesized
aataatttatatatatgtatta

SEQ ID NO: 887485 - DNA, 22 bp, Artificial Sequence
  chemically synthesized
taactataatgtatataataca

SEQ ID NO: 887486 - DNA, 22 bp, Artificial Sequence
  chemically synthesized
atatatatgtattatatacatt

SEQ ID NO: 887487 - DNA, 22 bp, Artificial Sequence
  chemically synthesized
tatatatgtattatatacatta

SEQ ID NO: 887488 - DNA, 22 bp, Artificial Sequence
  chemically synthesized
tatatgccattataactataat

SEQ ID NO: 887489 - DNA, 22 bp, Artificial Sequence
  chemically synthesized
tactgtatatgccattataact

SEQ ID NO: 887490 - DNA, 22 bp, Artificial Sequence
  chemically synthesized
tatacattatagttataatggc

SEQ ID NO: 887491 - DNA, 22 bp, Artificial Sequence
  chemically synthesized
aacattatactgtatatgccat

SEQ ID NO: 887492 - DNA, 22 bp, Artificial Sequence
  chemically synthesized
gaacattatactgtatatgcca

SEQ ID NO: 887493 - DNA, 22 bp, Artificial Sequence
  chemically synthesized
tagttataatggcatatacagt

SEQ ID NO: 887494 - DNA, 22 bp, Artificial Sequence
  chemically synthesized
tttgaacattatactgtatatg

SEQ ID NO: 887495 - DNA, 22 bp, Artificial Sequence
  chemically synthesized
taatggcatatacagtataatg

SEQ ID NO: 887496 - DNA, 22 bp, Artificial Sequence
  chemically synthesized
aacagatgttatttgaacatta

SEQ ID NO: 887497 - DNA, 22 bp, Artificial Sequence
  chemically synthesized
tcaaaactgaacagatgttatt

SEQ ID NO: 887498 - DNA, 22 bp, Artificial Sequence
  chemically synthesized
gtcaaaactgaacagatgttat

SEQ ID NO: 887499 - DNA, 22 bp, Artificial Sequence
  chemically synthesized
aaataacatctgttcagttttg

SEQ ID NO: 887500 - DNA, 22 bp, Artificial Sequence
  chemically synthesized
ttcagttttgacaaatatatat

SEQ ID NO: 887501 - DNA, 22 bp, Artificial Sequence
  chemically synthesized
agttttgacaaatatatatatt

SEQ ID NO: 887502 - DNA, 22 bp, Artificial Sequence
  chemically synthesized
tgacaaatatatatatttgtct

SEQ ID NO: 887503 - DNA, 22 bp, Artificial Sequence
  chemically synthesized
gacaaatatatatatttgtctt

SEQ ID NO: 887504 - DNA, 22 bp, Artificial Sequence
  chemically synthesized
acaaatatatatatttgtcttt

SEQ ID NO: 887505 - DNA, 22 bp, Artificial Sequence
  chemically synthesized
ccaatggggagaaaaagacaaa

SEQ ID NO: 887506 - DNA, 22 bp, Artificial Sequence
  chemically synthesized
cccaatggggagaaaaagacaa

SEQ ID NO: 887507 - DNA, 22 bp, Artificial Sequence
  chemically synthesized
tttcccaatggggagaaaaaga

SEQ ID NO: 887508 - DNA, 22 bp, Artificial Sequence
  chemically synthesized
atttcccaatggggagaaaaag

SEQ ID NO: 887509 - DNA, 22 bp, Artificial Sequence
  chemically synthesized
tatttcccaatggggagaaaaa

SEQ ID NO: 887510 - DNA, 22 bp, Artificial Sequence
  chemically synthesized
ctttatttcccaatggggagaa

SEQ ID NO: 887511 - DNA, 22 bp, Artificial Sequence
  chemically synthesized
ttactttatttcccaatgggga

SEQ ID NO: 887512 - DNA, 22 bp, Artificial Sequence
  chemically synthesized
gttactttatttcccaatgggg

SEQ ID NO: 887513 - DNA, 22 bp, Artificial Sequence
  chemically synthesized
tgttactttatttcccaatggg

SEQ ID NO: 887514 - DNA, 22 bp, Artificial Sequence
  chemically synthesized
gtctttttctccccattgggaa

SEQ ID NO: 887515 - DNA, 22 bp, Artificial Sequence
  chemically synthesized
tctttttctccccattgggaaa

SEQ ID NO: 887516 - DNA, 22 bp, Artificial Sequence
  chemically synthesized
tttctccccattgggaaataaa

SEQ ID NO: 887517 - DNA, 22 bp, Artificial Sequence
  chemically synthesized
ttctccccattgggaaataaag

SEQ ID NO: 887518 - DNA, 22 bp, Artificial Sequence
  chemically synthesized
tctccccattgggaaataaagt

SEQ ID NO: 887519 - DNA, 22 bp, Artificial Sequence
  chemically synthesized
ctccccattgggaaataaagta

SEQ ID NO: 887520 - DNA, 22 bp, Artificial Sequence
  chemically synthesized
tccccattgggaaataaagtaa

SEQ ID NO: 887521 - DNA, 22 bp, Artificial Sequence
  chemically synthesized
cccattgggaaataaagtaaca

SEQ ID NO: 887522 - DNA, 22 bp, Artificial Sequence
  chemically synthesized
tggccataatctttgttacttt

SEQ ID NO: 887523 - DNA, 22 bp, Artificial Sequence
  chemically synthesized
ggaaataaagtaacaaagatta

SEQ ID NO: 887524 - DNA, 22 bp, Artificial Sequence
  chemically synthesized
tggccacagtttatcttgcttt

SEQ ID NO: 887525 - DNA, 22 bp, Artificial Sequence
  chemically synthesized
tgaggaaaaacaaaagcaagat

SEQ ID NO: 887526 - DNA, 22 bp, Artificial Sequence
  chemically synthesized
tcaggtgctgtgaggaaaaaca

SEQ ID NO: 887527 - DNA, 22 bp, Artificial Sequence
  chemically synthesized
atcttgcttttgtttttcctca

SEQ ID NO: 887528 - DNA, 22 bp, Artificial Sequence
  chemically synthesized
tatcaggtgctgtgaggaaaaa

SEQ ID NO: 887529 - DNA, 22 bp, Artificial Sequence
  chemically synthesized
tcttgcttttgtttttcctcac

SEQ ID NO: 887530 - DNA, 22 bp, Artificial Sequence
  chemically synthesized
tctatcaggtgctgtgaggaaa

SEQ ID NO: 887531 - DNA, 22 bp, Artificial Sequence
  chemically synthesized
gcttttgtttttcctcacagca

SEQ ID NO: 887532 - DNA, 22 bp, Artificial Sequence
  chemically synthesized
cttttgtttttcctcacagcac

SEQ ID NO: 887533 - DNA, 22 bp, Artificial Sequence
  chemically synthesized
ttgtttttcctcacagcacctg

SEQ ID NO: 887534 - DNA, 22 bp, Artificial Sequence
  chemically synthesized
tgtttttcctcacagcacctga

SEQ ID NO: 887535 - DNA, 22 bp, Artificial Sequence
  chemically synthesized
gtttttcctcacagcacctgat

SEQ ID NO: 887536 - DNA, 22 bp, Artificial Sequence
  chemically synthesized
tttttcctcacagcacctgata

SEQ ID NO: 887537 - DNA, 22 bp, Artificial Sequence
  chemically synthesized
caggtagaactctctatcaggt

SEQ ID NO: 887538 - DNA, 22 bp, Artificial Sequence
  chemically synthesized
ttcctcacagcacctgatagag

SEQ ID NO: 887539 - DNA, 22 bp, Artificial Sequence
  chemically synthesized
acaggtagaactctctatcagg

SEQ ID NO: 887540 - DNA, 22 bp, Artificial Sequence
  chemically synthesized
tcctcacagcacctgatagaga

SEQ ID NO: 887541 - DNA, 22 bp, Artificial Sequence
  chemically synthesized
cctcacagcacctgatagagag

SEQ ID NO: 887542 - DNA, 22 bp, Artificial Sequence
  chemically synthesized
ctcacagcacctgatagagagt

SEQ ID NO: 887543 - DNA, 22 bp, Artificial Sequence
  chemically synthesized
acagcacctgatagagagttct

SEQ ID NO: 887544 - DNA, 22 bp, Artificial Sequence
  chemically synthesized
gtgtttacaggtagaactctct

SEQ ID NO: 887545 - DNA, 22 bp, Artificial Sequence
  chemically synthesized
ggtgtttacaggtagaactctc

SEQ ID NO: 887546 - DNA, 22 bp, Artificial Sequence
  chemically synthesized
atagagagttctacctgtaaac

SEQ ID NO: 887547 - DNA, 22 bp, Artificial Sequence
  chemically synthesized
tacctgtaaacaccaagttcac

SEQ ID NO: 887548 - DNA, 22 bp, Artificial Sequence
  chemically synthesized
gtggaggagggagtgaacttgg

SEQ ID NO: 887549 - DNA, 22 bp, Artificial Sequence
  chemically synthesized
agtggaggagggagtgaacttg

SEQ ID NO: 887550 - DNA, 22 bp, Artificial Sequence
  chemically synthesized
cctgtaaacaccaagttcactc

SEQ ID NO: 887551 - DNA, 22 bp, Artificial Sequence
  chemically synthesized
taaacaccaagttcactccctc

SEQ ID NO: 887552 - DNA, 22 bp, Artificial Sequence
  chemically synthesized
tcatttagtggaggagggagtg

SEQ ID NO: 887553 - DNA, 22 bp, Artificial Sequence
  chemically synthesized
cattgtcatttagtggaggagg

SEQ ID NO: 887554 - DNA, 22 bp, Artificial Sequence
  chemically synthesized
ttacattgtcatttagtggagg

SEQ ID NO: 887555 - DNA, 22 bp, Artificial Sequence
  chemically synthesized
gttacattgtcatttagtggag

SEQ ID NO: 887556 - DNA, 22 bp, Artificial Sequence
  chemically synthesized
actccctcctccactaaatgac

SEQ ID NO: 887557 - DNA, 22 bp, Artificial Sequence
  chemically synthesized
cctcctccactaaatgacaatg

SEQ ID NO: 887558 - DNA, 22 bp, Artificial Sequence
  chemically synthesized
aagccacttgttacattgtcat

SEQ ID NO: 887559 - DNA, 22 bp, Artificial Sequence
  chemically synthesized
gaagccacttgttacattgtca

SEQ ID NO: 887560 - DNA, 22 bp, Artificial Sequence
  chemically synthesized
ctccactaaatgacaatgtaac

SEQ ID NO: 887561 - DNA, 22 bp, Artificial Sequence
  chemically synthesized
cactaaatgacaatgtaacaag

SEQ ID NO: 887562 - DNA, 22 bp, Artificial Sequence
  chemically synthesized
gagcaacttgaagccacttgtt

SEQ ID NO: 887563 - DNA, 22 bp, Artificial Sequence
  chemically synthesized
aatgacaatgtaacaagtggct

SEQ ID NO: 887564 - DNA, 22 bp, Artificial Sequence
  chemically synthesized
caaaaagttggagcaacttgaa

SEQ ID NO: 887565 - DNA, 22 bp, Artificial Sequence
  chemically synthesized
ccaaaaagttggagcaacttga

SEQ ID NO: 887566 - DNA, 22 bp, Artificial Sequence
  chemically synthesized
caagttgctccaactttttgga

SEQ ID NO: 887567 - DNA, 22 bp, Artificial Sequence
  chemically synthesized
aagttgctccaactttttggaa

SEQ ID NO: 887568 - DNA, 22 bp, Artificial Sequence
  chemically synthesized
tgtataaggatgccttccaaaa

SEQ ID NO: 887569 - DNA, 22 bp, Artificial Sequence
  chemically synthesized
ctccaactttttggaaggcatc

SEQ ID NO: 887570 - DNA, 22 bp, Artificial Sequence
  chemically synthesized
caactttttggaaggcatcctt

SEQ ID NO: 887571 - DNA, 22 bp, Artificial Sequence
  chemically synthesized
tccattatgtataaggatgcct

SEQ ID NO: 887572 - DNA, 22 bp, Artificial Sequence
  chemically synthesized
tttggaaggcatccttatacat

SEQ ID NO: 887573 - DNA, 22 bp, Artificial Sequence
  chemically synthesized
ttggaaggcatccttatacata

SEQ ID NO: 887574 - DNA, 22 bp, Artificial Sequence
  chemically synthesized
tggaaggcatccttatacataa

SEQ ID NO: 887575 - DNA, 22 bp, Artificial Sequence
  chemically synthesized
ggaaggcatccttatacataat

SEQ ID NO: 887576 - DNA, 22 bp, Artificial Sequence
  chemically synthesized
gaaggcatccttatacataatg

SEQ ID NO: 887577 - DNA, 22 bp, Artificial Sequence
  chemically synthesized
aaaacaagcgtgattatccatt

SEQ ID NO: 887578 - DNA, 22 bp, Artificial Sequence
  chemically synthesized
taaaaacaagcgtgattatcca

SEQ ID NO: 887579 - DNA, 22 bp, Artificial Sequence
  chemically synthesized
atacataatggataatcacgct

SEQ ID NO: 887580 - DNA, 22 bp, Artificial Sequence
  chemically synthesized
tacataatggataatcacgctt

SEQ ID NO: 887581 - DNA, 22 bp, Artificial Sequence
  chemically synthesized
tgatacctctaaaaacaagcgt

SEQ ID NO: 887582 - DNA, 22 bp, Artificial Sequence
  chemically synthesized
taattatgatacctctaaaaac

SEQ ID NO: 887583 - DNA, 22 bp, Artificial Sequence
  chemically synthesized
gtaattatgatacctctaaaaa

SEQ ID NO: 887584 - DNA, 22 bp, Artificial Sequence
  chemically synthesized
aatttgtaattatgatacctct

SEQ ID NO: 887585 - DNA, 22 bp, Artificial Sequence
  chemically synthesized
taaatttgtaattatgatacct

SEQ ID NO: 887586 - DNA, 22 bp, Artificial Sequence
  chemically synthesized
gtttttagaggtatcataatta

SEQ ID NO: 887587 - DNA, 22 bp, Artificial Sequence
  chemically synthesized
tttttagaggtatcataattac

SEQ ID NO: 887588 - DNA, 22 bp, Artificial Sequence
  chemically synthesized
gaattctaaatttgtaattatg

SEQ ID NO: 887589 - DNA, 22 bp, Artificial Sequence
  chemically synthesized
agaattctaaatttgtaattat

SEQ ID NO: 887590 - DNA, 22 bp, Artificial Sequence
  chemically synthesized
ttagaggtatcataattacaaa

SEQ ID NO: 887591 - DNA, 22 bp, Artificial Sequence
  chemically synthesized
tagaggtatcataattacaaat

SEQ ID NO: 887592 - DNA, 22 bp, Artificial Sequence
  chemically synthesized
agaggtatcataattacaaatt

SEQ ID NO: 887593 - DNA, 22 bp, Artificial Sequence
  chemically synthesized
gaggtatcataattacaaattt

SEQ ID NO: 887594 - DNA, 22 bp, Artificial Sequence
  chemically synthesized
aagaacacttagaattctaaat

SEQ ID NO: 887595 - DNA, 22 bp, Artificial Sequence
  chemically synthesized
ctgaagaacacttagaattcta

SEQ ID NO: 887596 - DNA, 22 bp, Artificial Sequence
  chemically synthesized
ctgctgaagaacacttagaatt

SEQ ID NO: 887597 - DNA, 22 bp, Artificial Sequence
  chemically synthesized
caaatttagaattctaagtgtt

SEQ ID NO: 887598 - DNA, 22 bp, Artificial Sequence
  chemically synthesized
agttactgctgaagaacactta

SEQ ID NO: 887599 - DNA, 22 bp, Artificial Sequence
  chemically synthesized
tgagttactgctgaagaacact

SEQ ID NO: 887600 - DNA, 22 bp, Artificial Sequence
  chemically synthesized
agaattctaagtgttcttcagc

SEQ ID NO: 887601 - DNA, 22 bp, Artificial Sequence
  chemically synthesized
gaattctaagtgttcttcagca

SEQ ID NO: 887602 - DNA, 22 bp, Artificial Sequence
  chemically synthesized
aatctctgagttactgctgaag

SEQ ID NO: 887603 - DNA, 22 bp, Artificial Sequence
  chemically synthesized
aaatctctgagttactgctgaa

SEQ ID NO: 887604 - DNA, 22 bp, Artificial Sequence
  chemically synthesized
ttaaatctctgagttactgctg

SEQ ID NO: 887605 - DNA, 22 bp, Artificial Sequence
  chemically synthesized
taagtgttcttcagcagtaact

SEQ ID NO: 887606 - DNA, 22 bp, Artificial Sequence
  chemically synthesized
agtgttcttcagcagtaactca

SEQ ID NO: 887607 - DNA, 22 bp, Artificial Sequence
  chemically synthesized
aagggattcttaaatctctgag

SEQ ID NO: 887608 - DNA, 22 bp, Artificial Sequence
  chemically synthesized
ttcagcagtaactcagagattt

SEQ ID NO: 887609 - DNA, 22 bp, Artificial Sequence
  chemically synthesized
cagcagtaactcagagatttaa

SEQ ID NO: 887610 - DNA, 22 bp, Artificial Sequence
  chemically synthesized
ctaaagggattcttaaatctct

SEQ ID NO: 887611 - DNA, 22 bp, Artificial Sequence
  chemically synthesized
agcagtaactcagagatttaag

SEQ ID NO: 887612 - DNA, 22 bp, Artificial Sequence
  chemically synthesized
tatcagttactaaagggattct

SEQ ID NO: 887613 - DNA, 22 bp, Artificial Sequence
  chemically synthesized
agagatttaagaatccctttag

SEQ ID NO: 887614 - DNA, 22 bp, Artificial Sequence
  chemically synthesized
actatatcagttactaaaggga

SEQ ID NO: 887615 - DNA, 22 bp, Artificial Sequence
  chemically synthesized
ctgactatatcagttactaaag

SEQ ID NO: 887616 - DNA, 22 bp, Artificial Sequence
  chemically synthesized
tgctgactatatcagttactaa

SEQ ID NO: 887617 - DNA, 22 bp, Artificial Sequence
  chemically synthesized
aagaatccctttagtaactgat

SEQ ID NO: 887618 - DNA, 22 bp, Artificial Sequence
  chemically synthesized
tctgctgactatatcagttact

SEQ ID NO: 887619 - DNA, 22 bp, Artificial Sequence
  chemically synthesized
agaatccctttagtaactgata

SEQ ID NO: 887620 - DNA, 22 bp, Artificial Sequence
  chemically synthesized
tagtaactgatatagtcagcag

SEQ ID NO: 887621 - DNA, 22 bp, Artificial Sequence
  chemically synthesized
agtaactgatatagtcagcaga

SEQ ID NO: 887622 - DNA, 22 bp, Artificial Sequence
  chemically synthesized
gtaactgatatagtcagcagag

SEQ ID NO: 887623 - DNA, 22 bp, Artificial Sequence
  chemically synthesized
atcaggaaatacggttctctgc

SEQ ID NO: 887624 - DNA, 22 bp, Artificial Sequence
  chemically synthesized
catcaggaaatacggttctctg

SEQ ID NO: 887625 - DNA, 22 bp, Artificial Sequence
  chemically synthesized
tcatcaggaaatacggttctct

SEQ ID NO: 887626 - DNA, 22 bp, Artificial Sequence
  chemically synthesized
atatagtcagcagagaaccgta

SEQ ID NO: 887627 - DNA, 22 bp, Artificial Sequence
  chemically synthesized
tattttcatcaggaaatacggt

SEQ ID NO: 887628 - DNA, 22 bp, Artificial Sequence
  chemically synthesized
gtattttcatcaggaaatacgg

SEQ ID NO: 887629 - DNA, 22 bp, Artificial Sequence
  chemically synthesized
agcttgtattttcatcaggaaa

SEQ ID NO: 887630 - DNA, 22 bp, Artificial Sequence
  chemically synthesized
tgagcttgtattttcatcagga

SEQ ID NO: 887631 - DNA, 22 bp, Artificial Sequence
  chemically synthesized
tggctctgagcttgtattttca

SEQ ID NO: 887632 - DNA, 22 bp, Artificial Sequence
  chemically synthesized
gtggctctgagcttgtattttc

SEQ ID NO: 887633 - DNA, 22 bp, Artificial Sequence
  chemically synthesized
accttgtggctctgagcttgta

SEQ ID NO: 887634 - DNA, 22 bp, Artificial Sequence
  chemically synthesized
cctgatgaaaatacaagctcag

SEQ ID NO: 887635 - DNA, 22 bp, Artificial Sequence
  chemically synthesized
ctgatgaaaatacaagctcaga

SEQ ID NO: 887636 - DNA, 22 bp, Artificial Sequence
  chemically synthesized
ctgaccttgtggctctgagctt

SEQ ID NO: 887637 - DNA, 22 bp, Artificial Sequence
  chemically synthesized
atgaaaatacaagctcagagcc

SEQ ID NO: 887638 - DNA, 22 bp, Artificial Sequence
  chemically synthesized
ccctgctgaccttgtggctctg

SEQ ID NO: 887639 - DNA, 22 bp, Artificial Sequence
  chemically synthesized
taccctgctgaccttgtggctc

SEQ ID NO: 887640 - DNA, 22 bp, Artificial Sequence
  chemically synthesized
ataagtctctaccctgctgacc

SEQ ID NO: 887641 - DNA, 22 bp, Artificial Sequence
  chemically synthesized
agagccacaaggtcagcagggt

SEQ ID NO: 887642 - DNA, 22 bp, Artificial Sequence
  chemically synthesized
cctgataagtctctaccctgct

SEQ ID NO: 887643 - DNA, 22 bp, Artificial Sequence
  chemically synthesized
tctgcctgataagtctctaccc

SEQ ID NO: 887644 - DNA, 22 bp, Artificial Sequence
  chemically synthesized
gtctgcctgataagtctctacc

SEQ ID NO: 887645 - DNA, 22 bp, Artificial Sequence
  chemically synthesized
ttgtctgcctgataagtctcta

SEQ ID NO: 887646 - DNA, 22 bp, Artificial Sequence
  chemically synthesized
gaacagtgcctcttgtctgcct

SEQ ID NO: 887647 - DNA, 22 bp, Artificial Sequence
  chemically synthesized
tggaacagtgcctcttgtctgc

SEQ ID NO: 887648 - DNA, 22 bp, Artificial Sequence
  chemically synthesized
tctggaacagtgcctcttgtct

SEQ ID NO: 887649 - DNA, 22 bp, Artificial Sequence
  chemically synthesized
ctctctggaacagtgcctcttg

SEQ ID NO: 887650 - DNA, 22 bp, Artificial Sequence
  chemically synthesized
atcaggcagacaagaggcactg

SEQ ID NO: 887651 - DNA, 22 bp, Artificial Sequence
  chemically synthesized
tgctctctggaacagtgcctct

SEQ ID NO: 887652 - DNA, 22 bp, Artificial Sequence
  chemically synthesized
tcaggcagacaagaggcactgt

SEQ ID NO: 887653 - DNA, 22 bp, Artificial Sequence
  chemically synthesized
accctctgctctctggaacagt

SEQ ID NO: 887654 - DNA, 22 bp, Artificial Sequence
  chemically synthesized
tgaccctctgctctctggaaca

SEQ ID NO: 887655 - DNA, 22 bp, Artificial Sequence
  chemically synthesized
ctctgaccctctgctctctgga

SEQ ID NO: 887656 - DNA, 22 bp, Artificial Sequence
  chemically synthesized
cagtctcctctgaccctctgct

SEQ ID NO: 887657 - DNA, 22 bp, Artificial Sequence
  chemically synthesized
gcagtctcctctgaccctctgc

SEQ ID NO: 887658 - DNA, 22 bp, Artificial Sequence
  chemically synthesized
ttccagagagcagagggtcaga

SEQ ID NO: 887659 - DNA, 22 bp, Artificial Sequence
  chemically synthesized
cagagagcagagggtcagagga

SEQ ID NO: 887660 - DNA, 22 bp, Artificial Sequence
  chemically synthesized
tgcaggtacttgcagtctcctc

SEQ ID NO: 887661 - DNA, 22 bp, Artificial Sequence
  chemically synthesized
tatgcaggtacttgcagtctcc

SEQ ID NO: 887662 - DNA, 22 bp, Artificial Sequence
  chemically synthesized
agatctctatgcaggtacttgc

SEQ ID NO: 887663 - DNA, 22 bp, Artificial Sequence
  chemically synthesized
tacatgacctgagatctctatg

SEQ ID NO: 887664 - DNA, 22 bp, Artificial Sequence
  chemically synthesized
caagtacctgcatagagatctc

SEQ ID NO: 887665 - DNA, 22 bp, Artificial Sequence
  chemically synthesized
catagagatctcaggtcatgta

SEQ ID NO: 887666 - DNA, 22 bp, Artificial Sequence
  chemically synthesized
acagatgaggaagcattataca

SEQ ID NO: 887667 - DNA, 22 bp, Artificial Sequence
  chemically synthesized
ggttgacagatgaggaagcatt

SEQ ID NO: 887668 - DNA, 22 bp, Artificial Sequence
  chemically synthesized
aggtcatgtataatgcttcctc

SEQ ID NO: 887669 - DNA, 22 bp, Artificial Sequence
  chemically synthesized
caaaatggcagctgggttgaca

SEQ ID NO: 887670 - DNA, 22 bp, Artificial Sequence
  chemically synthesized
tccaaaatggcagctgggttga

SEQ ID NO: 887671 - DNA, 22 bp, Artificial Sequence
  chemically synthesized
cctcatctgtcaacccagctgc

SEQ ID NO: 887672 - DNA, 22 bp, Artificial Sequence
  chemically synthesized
ctctccaaaatggcagctgggt

SEQ ID NO: 887673 - DNA, 22 bp, Artificial Sequence
  chemically synthesized
ctcatctgtcaacccagctgcc

SEQ ID NO: 887674 - DNA, 22 bp, Artificial Sequence
  chemically synthesized
ctcctctccaaaatggcagctg

SEQ ID NO: 887675 - DNA, 22 bp, Artificial Sequence
  chemically synthesized
atctgtcaacccagctgccatt

SEQ ID NO: 887676 - DNA, 22 bp, Artificial Sequence
  chemically synthesized
ctgctcctctccaaaatggcag

SEQ ID NO: 887677 - DNA, 22 bp, Artificial Sequence
  chemically synthesized
tcaacccagctgccattttgga

SEQ ID NO: 887678 - DNA, 22 bp, Artificial Sequence
  chemically synthesized
ctcctgctcctctccaaaatgg

SEQ ID NO: 887679 - DNA, 22 bp, Artificial Sequence
  chemically synthesized
tcctcctgctcctctccaaaat

SEQ ID NO: 887680 - DNA, 22 bp, Artificial Sequence
  chemically synthesized
ctctcctcctgctcctctccaa

SEQ ID NO: 887681 - DNA, 22 bp, Artificial Sequence
  chemically synthesized
gctctcctcctgctcctctcca

SEQ ID NO: 887682 - DNA, 22 bp, Artificial Sequence
  chemically synthesized
cttgctctcctcctgctcctct

SEQ ID NO: 887683 - DNA, 22 bp, Artificial Sequence
  chemically synthesized
ccttgctctcctcctgctcctc

SEQ ID NO: 887684 - DNA, 22 bp, Artificial Sequence
  chemically synthesized
ccattttggagaggagcaggag

SEQ ID NO: 887685 - DNA, 22 bp, Artificial Sequence
  chemically synthesized
gatttccttgctctcctcctgc

SEQ ID NO: 887686 - DNA, 22 bp, Artificial Sequence
  chemically synthesized
agatttccttgctctcctcctg

SEQ ID NO: 887687 - DNA, 22 bp, Artificial Sequence
  chemically synthesized
tagatttccttgctctcctcct

SEQ ID NO: 887688 - DNA, 22 bp, Artificial Sequence
  chemically synthesized
tggagaggagcaggaggagagc

SEQ ID NO: 887689 - DNA, 22 bp, Artificial Sequence
  chemically synthesized
ttagatttccttgctctcctcc

SEQ ID NO: 887690 - DNA, 22 bp, Artificial Sequence
  chemically synthesized
ggagaggagcaggaggagagca

SEQ ID NO: 887691 - DNA, 22 bp, Artificial Sequence
  chemically synthesized
gagaggagcaggaggagagcaa

SEQ ID NO: 887692 - DNA, 22 bp, Artificial Sequence
  chemically synthesized
atggataatgaccagtctttta

SEQ ID NO: 887693 - DNA, 22 bp, Artificial Sequence
  chemically synthesized
ggacctcatggataatgaccag

SEQ ID NO: 887694 - DNA, 22 bp, Artificial Sequence
  chemically synthesized
aaagactggtcattatccatga

SEQ ID NO: 887695 - DNA, 22 bp, Artificial Sequence
  chemically synthesized
tgggttgggacctcatggataa

SEQ ID NO: 887696 - DNA, 22 bp, Artificial Sequence
  chemically synthesized
atgggttgggacctcatggata

SEQ ID NO: 887697 - DNA, 22 bp, Artificial Sequence
  chemically synthesized
tatgggttgggacctcatggat

SEQ ID NO: 887698 - DNA, 22 bp, Artificial Sequence
  chemically synthesized
ttatgggttgggacctcatgga

SEQ ID NO: 887699 - DNA, 22 bp, Artificial Sequence
  chemically synthesized
tttatgggttgggacctcatgg

SEQ ID NO: 887700 - DNA, 22 bp, Artificial Sequence
  chemically synthesized
tttttatgggttgggacctcat

SEQ ID NO: 887701 - DNA, 22 bp, Artificial Sequence
  chemically synthesized
gtcattatccatgaggtcccaa

SEQ ID NO: 887702 - DNA, 22 bp, Artificial Sequence
  chemically synthesized
tccatgaggtcccaacccataa

SEQ ID NO: 887703 - DNA, 22 bp, Artificial Sequence
  chemically synthesized
accagtctctttttatgggttg

SEQ ID NO: 887704 - DNA, 22 bp, Artificial Sequence
  chemically synthesized
caccagtctctttttatgggtt

SEQ ID NO: 887705 - DNA, 22 bp, Artificial Sequence
  chemically synthesized
aaatagtgatttcaccagtctc

SEQ ID NO: 887706 - DNA, 22 bp, Artificial Sequence
  chemically synthesized
tgaaatagtgatttcaccagtc

SEQ ID NO: 887707 - DNA, 22 bp, Artificial Sequence
  chemically synthesized
actctgaaatagtgatttcacc

SEQ ID NO: 887708 - DNA, 22 bp, Artificial Sequence
  chemically synthesized
tcatctcactctgaaatagtga

SEQ ID NO: 887709 - DNA, 22 bp, Artificial Sequence
  chemically synthesized
gtgaaatcactatttcagagtg

SEQ ID NO: 887710 - DNA, 22 bp, Artificial Sequence
  chemically synthesized
tttcagagtgagatgataattt

SEQ ID NO: 887711 - DNA, 22 bp, Artificial Sequence
  chemically synthesized
ggcagtgagaaaaaattatcat

SEQ ID NO: 887712 - DNA, 22 bp, Artificial Sequence
  chemically synthesized
cagagtgagatgataatttttt

SEQ ID NO: 887713 - DNA, 22 bp, Artificial Sequence
  chemically synthesized
agagtgagatgataattttttc

SEQ ID NO: 887714 - DNA, 22 bp, Artificial Sequence
  chemically synthesized
ccatactgggcagtgagaaaaa

SEQ ID NO: 887715 - DNA, 22 bp, Artificial Sequence
  chemically synthesized
cccatactgggcagtgagaaaa

SEQ ID NO: 887716 - DNA, 22 bp, Artificial Sequence
  chemically synthesized
tcccatactgggcagtgagaaa

SEQ ID NO: 887717 - DNA, 22 bp, Artificial Sequence
  chemically synthesized
ataaccctttcccatactgggc

SEQ ID NO: 887718 - DNA, 22 bp, Artificial Sequence
  chemically synthesized
cataaccctttcccatactggg

SEQ ID NO: 887719 - DNA, 22 bp, Artificial Sequence
  chemically synthesized
tttctcactgcccagtatggga

SEQ ID NO: 887720 - DNA, 22 bp, Artificial Sequence
  chemically synthesized
ttctcactgcccagtatgggaa

SEQ ID NO: 887721 - DNA, 22 bp, Artificial Sequence
  chemically synthesized
tctcactgcccagtatgggaaa

SEQ ID NO: 887722 - DNA, 22 bp, Artificial Sequence
  chemically synthesized
ctcactgcccagtatgggaaag

SEQ ID NO: 887723 - DNA, 22 bp, Artificial Sequence
  chemically synthesized
tcactgcccagtatgggaaagg

SEQ ID NO: 887724 - DNA, 22 bp, Artificial Sequence
  chemically synthesized
actgcccagtatgggaaagggt

SEQ ID NO: 887725 - DNA, 22 bp, Artificial Sequence
  chemically synthesized
agtgatcttcataaccctttcc

SEQ ID NO: 887726 - DNA, 22 bp, Artificial Sequence
  chemically synthesized
tcagtgatcttcataacccttt

SEQ ID NO: 887727 - DNA, 22 bp, Artificial Sequence
  chemically synthesized
cccagtatgggaaagggttatg

SEQ ID NO: 887728 - DNA, 22 bp, Artificial Sequence
  chemically synthesized
ctcagtgatcttcataaccctt

SEQ ID NO: 887729 - DNA, 22 bp, Artificial Sequence
  chemically synthesized
tttctcagtgatcttcataacc

SEQ ID NO: 887730 - DNA, 22 bp, Artificial Sequence
  chemically synthesized
atttctcagtgatcttcataac

SEQ ID NO: 887731 - DNA, 22 bp, Artificial Sequence
  chemically synthesized
atttatttctcagtgatcttca

SEQ ID NO: 887732 - DNA, 22 bp, Artificial Sequence
  chemically synthesized
catttatttctcagtgatcttc

SEQ ID NO: 887733 - DNA, 22 bp, Artificial Sequence
  chemically synthesized
ttcatttatttctcagtgatct

SEQ ID NO: 887734 - DNA, 22 bp, Artificial Sequence
  chemically synthesized
cttcatttatttctcagtgatc

SEQ ID NO: 887735 - DNA, 22 bp, Artificial Sequence
  chemically synthesized
tgaagatcactgagaaataaat

SEQ ID NO: 887736 - DNA, 22 bp, Artificial Sequence
  chemically synthesized
agaatgaaaacttcttcattta

SEQ ID NO: 887737 - DNA, 22 bp, Artificial Sequence
  chemically synthesized
tcagaatgaaaacttcttcatt

SEQ ID NO: 887738 - DNA, 22 bp, Artificial Sequence
  chemically synthesized
attctcagaatgaaaacttctt

SEQ ID NO: 887739 - DNA, 22 bp, Artificial Sequence
  chemically synthesized
agaaataaatgaagaagttttc

SEQ ID NO: 887740 - DNA, 22 bp, Artificial Sequence
  chemically synthesized
tcattctgagaatcaatatttg

SEQ ID NO: 887741 - DNA, 22 bp, Artificial Sequence
  chemically synthesized
cattctgagaatcaatatttga

SEQ ID NO: 887742 - DNA, 22 bp, Artificial Sequence
  chemically synthesized
attctgagaatcaatatttgac

SEQ ID NO: 887743 - DNA, 22 bp, Artificial Sequence
  chemically synthesized
tgagaatcaatatttgactccc

SEQ ID NO: 887744 - DNA, 22 bp, Artificial Sequence
  chemically synthesized
aatgggtatgtccgggagtcaa

SEQ ID NO: 887745 - DNA, 22 bp, Artificial Sequence
  chemically synthesized
agaatcaatatttgactcccgg

SEQ ID NO: 887746 - DNA, 22 bp, Artificial Sequence
  chemically synthesized
gactcccggacatacccattta

SEQ ID NO: 887747 - DNA, 22 bp, Artificial Sequence
  chemically synthesized
actcccggacatacccatttaa

SEQ ID NO: 887748 - DNA, 22 bp, Artificial Sequence
  chemically synthesized
ccggacatacccatttaacttc

SEQ ID NO: 887749 - DNA, 22 bp, Artificial Sequence
  chemically synthesized
atgcatacaataaatatgcagg

SEQ ID NO: 887750 - DNA, 22 bp, Artificial Sequence
  chemically synthesized
catgcatacaataaatatgcag

SEQ ID NO: 887751 - DNA, 22 bp, Artificial Sequence
  chemically synthesized
tcatgcatacaataaatatgca

SEQ ID NO: 887752 - DNA, 22 bp, Artificial Sequence
  chemically synthesized
aacttctcctgcatatttattg

SEQ ID NO: 887753 - DNA, 22 bp, Artificial Sequence
  chemically synthesized
acttctcctgcatatttattgt

SEQ ID NO: 887754 - DNA, 22 bp, Artificial Sequence
  chemically synthesized
ctcctgcatatttattgtatgc

SEQ ID NO: 887755 - DNA, 22 bp, Artificial Sequence
  chemically synthesized
tcctgcatatttattgtatgca

SEQ ID NO: 887756 - DNA, 22 bp, Artificial Sequence
  chemically synthesized
ctgcatatttattgtatgcatg

SEQ ID NO: 887757 - DNA, 22 bp, Artificial Sequence
  chemically synthesized
agtagatacattttcatgcata

SEQ ID NO: 887758 - DNA, 22 bp, Artificial Sequence
  chemically synthesized
catatttattgtatgcatgaaa

SEQ ID NO: 887759 - DNA, 22 bp, Artificial Sequence
  chemically synthesized
aagtagatacattttcatgcat

SEQ ID NO: 887760 - DNA, 22 bp, Artificial Sequence
  chemically synthesized
ttaagtagatacattttcatgc

SEQ ID NO: 887761 - DNA, 22 bp, Artificial Sequence
  chemically synthesized
attgtatgcatgaaaatgtatc

SEQ ID NO: 887762 - DNA, 22 bp, Artificial Sequence
  chemically synthesized
ttgtatgcatgaaaatgtatct

SEQ ID NO: 887763 - DNA, 22 bp, Artificial Sequence
  chemically synthesized
tatgcatgaaaatgtatctact

SEQ ID NO: 887764 - DNA, 22 bp, Artificial Sequence
  chemically synthesized
tcatagattcttaagtagatac

SEQ ID NO: 887765 - DNA, 22 bp, Artificial Sequence
  chemically synthesized
aaaagcactgtcatagattctt

SEQ ID NO: 887766 - DNA, 22 bp, Artificial Sequence
  chemically synthesized
gaaaagcactgtcatagattct

SEQ ID NO: 887767 - DNA, 22 bp, Artificial Sequence
  chemically synthesized
cttaagaatctatgacagtgct

SEQ ID NO: 887768 - DNA, 22 bp, Artificial Sequence
  chemically synthesized
aagaatctatgacagtgctttt

SEQ ID NO: 887769 - DNA, 22 bp, Artificial Sequence
  chemically synthesized
agaatctatgacagtgcttttc

SEQ ID NO: 887770 - DNA, 22 bp, Artificial Sequence
  chemically synthesized
tggaaccacagtttgaaaagca

SEQ ID NO: 887771 - DNA, 22 bp, Artificial Sequence
  chemically synthesized
gtctgtggaaccacagtttgaa

SEQ ID NO: 887772 - DNA, 22 bp, Artificial Sequence
  chemically synthesized
tgacagtgcttttcaaactgtg

SEQ ID NO: 887773 - DNA, 22 bp, Artificial Sequence
  chemically synthesized
tggtctgtggaaccacagtttg

SEQ ID NO: 887774 - DNA, 22 bp, Artificial Sequence
  chemically synthesized
ctggtctgtggaaccacagttt

SEQ ID NO: 887775 - DNA, 22 bp, Artificial Sequence
  chemically synthesized
tttctggtctgtggaaccacag

SEQ ID NO: 887776 - DNA, 22 bp, Artificial Sequence
  chemically synthesized
ttatttctggtctgtggaacca

SEQ ID NO: 887777 - DNA, 22 bp, Artificial Sequence
  chemically synthesized
ttcaaactgtggttccacagac

SEQ ID NO: 887778 - DNA, 22 bp, Artificial Sequence
  chemically synthesized
tcaaactgtggttccacagacc

SEQ ID NO: 887779 - DNA, 22 bp, Artificial Sequence
  chemically synthesized
caaactgtggttccacagacca

SEQ ID NO: 887780 - DNA, 22 bp, Artificial Sequence
  chemically synthesized
aaactgtggttccacagaccag

SEQ ID NO: 887781 - DNA, 22 bp, Artificial Sequence
  chemically synthesized
atgtgaaactgttatttctggt

SEQ ID NO: 887782 - DNA, 22 bp, Artificial Sequence
  chemically synthesized
tggttccacagaccagaaataa

SEQ ID NO: 887783 - DNA, 22 bp, Artificial Sequence
  chemically synthesized
aatgtgaaactgttatttctgg

SEQ ID NO: 887784 - DNA, 22 bp, Artificial Sequence
  chemically synthesized
cacagaccagaaataacagttt

SEQ ID NO: 887785 - DNA, 22 bp, Artificial Sequence
  chemically synthesized
aaatttaatgtgaaactgttat

SEQ ID NO: 887786 - DNA, 22 bp, Artificial Sequence
  chemically synthesized
aaaatttaatgtgaaactgtta

SEQ ID NO: 887787 - DNA, 22 bp, Artificial Sequence
  chemically synthesized
ttaaaatttaatgtgaaactgt

SEQ ID NO: 887788 - DNA, 22 bp, Artificial Sequence
  chemically synthesized
cttaaaatttaatgtgaaactg

SEQ ID NO: 887789 - DNA, 22 bp, Artificial Sequence
  chemically synthesized
gagccatgcttcttaaaattta

SEQ ID NO: 887790 - DNA, 22 bp, Artificial Sequence
  chemically synthesized
tctagagccatgcttcttaaaa

SEQ ID NO: 887791 - DNA, 22 bp, Artificial Sequence
  chemically synthesized
cacattaaattttaagaagcat

SEQ ID NO: 887792 - DNA, 22 bp, Artificial Sequence
  chemically synthesized
acattaaattttaagaagcatg

SEQ ID NO: 887793 - DNA, 22 bp, Artificial Sequence
  chemically synthesized
tatcctatctagagccatgctt

SEQ ID NO: 887794 - DNA, 22 bp, Artificial Sequence
  chemically synthesized
aattttaagaagcatggctcta

SEQ ID NO: 887795 - DNA, 22 bp, Artificial Sequence
  chemically synthesized
ctatatcctatctagagccatg

SEQ ID NO: 887796 - DNA, 22 bp, Artificial Sequence
  chemically synthesized
tactatatcctatctagagcca

SEQ ID NO: 887797 - DNA, 22 bp, Artificial Sequence
  chemically synthesized
taagaagcatggctctagatag

SEQ ID NO: 887798 - DNA, 22 bp, Artificial Sequence
  chemically synthesized
ttctactatatcctatctagag

SEQ ID NO: 887799 - DNA, 22 bp, Artificial Sequence
  chemically synthesized
aagaagcatggctctagatagg

SEQ ID NO: 887800 - DNA, 22 bp, Artificial Sequence
  chemically synthesized
attctactatatcctatctaga

SEQ ID NO: 887801 - DNA, 22 bp, Artificial Sequence
  chemically synthesized
agaagcatggctctagatagga

SEQ ID NO: 887802 - DNA, 22 bp, Artificial Sequence
  chemically synthesized
cttattctactatatcctatct

SEQ ID NO: 887803 - DNA, 22 bp, Artificial Sequence
  chemically synthesized
tccattccttattctactatat

SEQ ID NO: 887804 - DNA, 22 bp, Artificial Sequence
  chemically synthesized
atccattccttattctactata

SEQ ID NO: 887805 - DNA, 22 bp, Artificial Sequence
  chemically synthesized
tagataggatatagtagaataa

SEQ ID NO: 887806 - DNA, 22 bp, Artificial Sequence
  chemically synthesized
gataggatatagtagaataagg

SEQ ID NO: 887807 - DNA, 22 bp, Artificial Sequence
  chemically synthesized
acacttatccattccttattct

SEQ ID NO: 887808 - DNA, 22 bp, Artificial Sequence
  chemically synthesized
ggaggctaacacttatccattc

SEQ ID NO: 887809 - DNA, 22 bp, Artificial Sequence
  chemically synthesized
aaatctgggaggctaacactta

SEQ ID NO: 887810 - DNA, 22 bp, Artificial Sequence
  chemically synthesized
gcctcccagattttaattcatt

SEQ ID NO: 887811 - DNA, 22 bp, Artificial Sequence
  chemically synthesized
tatccataagtatgtaaatgaa

SEQ ID NO: 887812 - DNA, 22 bp, Artificial Sequence
  chemically synthesized
ccagattttaattcatttacat

SEQ ID NO: 887813 - DNA, 22 bp, Artificial Sequence
  chemically synthesized
taattcatttacatacttatgg

SEQ ID NO: 887814 - DNA, 22 bp, Artificial Sequence
  chemically synthesized
aattcatttacatacttatgga

SEQ ID NO: 887815 - DNA, 22 bp, Artificial Sequence
  chemically synthesized
attcatttacatacttatggat

SEQ ID NO: 887816 - DNA, 22 bp, Artificial Sequence
  chemically synthesized
aagataagtgttatatccataa

SEQ ID NO: 887817 - DNA, 22 bp, Artificial Sequence
  chemically synthesized
aaagataagtgttatatccata

SEQ ID NO: 887818 - DNA, 22 bp, Artificial Sequence
  chemically synthesized
atttacatacttatggatataa

SEQ ID NO: 887819 - DNA, 22 bp, Artificial Sequence
  chemically synthesized
acatacttatggatataacact

SEQ ID NO: 887820 - DNA, 22 bp, Artificial Sequence
  chemically synthesized
catacttatggatataacactt

SEQ ID NO: 887821 - DNA, 22 bp, Artificial Sequence
  chemically synthesized
atggatataacacttatcttta

SEQ ID NO: 887822 - DNA, 22 bp, Artificial Sequence
  chemically synthesized
tggatataacacttatctttaa

SEQ ID NO: 887823 - DNA, 22 bp, Artificial Sequence
  chemically synthesized
acaaagtcgtatcatttaaaga

SEQ ID NO: 887824 - DNA, 22 bp, Artificial Sequence
  chemically synthesized
ttcacaaagtcgtatcatttaa

SEQ ID NO: 887825 - DNA, 22 bp, Artificial Sequence
  chemically synthesized
attcacaaagtcgtatcattta

SEQ ID NO: 887826 - DNA, 22 bp, Artificial Sequence
  chemically synthesized
tttattcacaaagtcgtatcat

SEQ ID NO: 887827 - DNA, 22 bp, Artificial Sequence
  chemically synthesized
atctttaaatgatacgactttg

SEQ ID NO: 887828 - DNA, 22 bp, Artificial Sequence
  chemically synthesized
tctttaaatgatacgactttgt

SEQ ID NO: 887829 - DNA, 22 bp, Artificial Sequence
  chemically synthesized
taaatgatacgactttgtgaat

SEQ ID NO: 887830 - DNA, 22 bp, Artificial Sequence
  chemically synthesized
atgaagctgtttattcacaaag

SEQ ID NO: 887831 - DNA, 22 bp, Artificial Sequence
  chemically synthesized
aaatgatacgactttgtgaata

SEQ ID NO: 887832 - DNA, 22 bp, Artificial Sequence
  chemically synthesized
aatgatacgactttgtgaataa

SEQ ID NO: 887833 - DNA, 22 bp, Artificial Sequence
  chemically synthesized
tattcatgaagctgtttattca

SEQ ID NO: 887834 - DNA, 22 bp, Artificial Sequence
  chemically synthesized
ataaagctatattcatgaagct

SEQ ID NO: 887835 - DNA, 22 bp, Artificial Sequence
  chemically synthesized
tgtgaataaacagcttcatgaa

SEQ ID NO: 887836 - DNA, 22 bp, Artificial Sequence
  chemically synthesized
gtgaataaacagcttcatgaat

SEQ ID NO: 887837 - DNA, 22 bp, Artificial Sequence
  chemically synthesized
tgaataaacagcttcatgaata

SEQ ID NO: 887838 - DNA, 22 bp, Artificial Sequence
  chemically synthesized
tctcataaagctatattcatga

SEQ ID NO: 887839 - DNA, 22 bp, Artificial Sequence
  chemically synthesized
cattgtctcataaagctatatt

SEQ ID NO: 887840 - DNA, 22 bp, Artificial Sequence
  chemically synthesized
tccattgtctcataaagctata

SEQ ID NO: 887841 - DNA, 22 bp, Artificial Sequence
  chemically synthesized
ctccattgtctcataaagctat

SEQ ID NO: 887842 - DNA, 22 bp, Artificial Sequence
  chemically synthesized
tctccattgtctcataaagcta

SEQ ID NO: 887843 - DNA, 22 bp, Artificial Sequence
  chemically synthesized
catgaatatagctttatgagac

SEQ ID NO: 887844 - DNA, 22 bp, Artificial Sequence
  chemically synthesized
atgaatatagctttatgagaca

SEQ ID NO: 887845 - DNA, 22 bp, Artificial Sequence
  chemically synthesized
gccacctttctccattgtctca

SEQ ID NO: 887846 - DNA, 22 bp, Artificial Sequence
  chemically synthesized
ggccacctttctccattgtctc

SEQ ID NO: 887847 - DNA, 22 bp, Artificial Sequence
  chemically synthesized
aaaaatttggccacctttctcc

SEQ ID NO: 887848 - DNA, 22 bp, Artificial Sequence
  chemically synthesized
tatgagacaatggagaaaggtg

SEQ ID NO: 887849 - DNA, 22 bp, Artificial Sequence
  chemically synthesized
aaaaaatttggccacctttctc

SEQ ID NO: 887850 - DNA, 22 bp, Artificial Sequence
  chemically synthesized
atgagacaatggagaaaggtgg

SEQ ID NO: 887851 - DNA, 22 bp, Artificial Sequence
  chemically synthesized
taaaaaatttggccacctttct

SEQ ID NO: 887852 - DNA, 22 bp, Artificial Sequence
  chemically synthesized
tgagacaatggagaaaggtggc

SEQ ID NO: 887853 - DNA, 22 bp, Artificial Sequence
  chemically synthesized
ttaaaaaatttggccacctttc

SEQ ID NO: 887854 - DNA, 22 bp, Artificial Sequence
  chemically synthesized
tttaaaaaatttggccaccttt

SEQ ID NO: 887855 - DNA, 22 bp, Artificial Sequence
  chemically synthesized
atcataactttttaaaaaattt

SEQ ID NO: 887856 - DNA, 22 bp, Artificial Sequence
  chemically synthesized
taatcataactttttaaaaaat

SEQ ID NO: 887857 - DNA, 22 bp, Artificial Sequence
  chemically synthesized
ctaatcataactttttaaaaaa

SEQ ID NO: 887858 - DNA, 22 bp, Artificial Sequence
  chemically synthesized
ttctaatcataactttttaaaa

SEQ ID NO: 887859 - DNA, 22 bp, Artificial Sequence
  chemically synthesized
tttaaaaagttatgattagaag

SEQ ID NO: 887860 - DNA, 22 bp, Artificial Sequence
  chemically synthesized
ttaaaaagttatgattagaaga

SEQ ID NO: 887861 - DNA, 22 bp, Artificial Sequence
  chemically synthesized
aaacaacacaattcttctaatc

SEQ ID NO: 887862 - DNA, 22 bp, Artificial Sequence
  chemically synthesized
taaaaagttatgattagaagaa

SEQ ID NO: 887863 - DNA, 22 bp, Artificial Sequence
  chemically synthesized
aaaacaacacaattcttctaat

SEQ ID NO: 887864 - DNA, 22 bp, Artificial Sequence
  chemically synthesized
aaaaagttatgattagaagaat

SEQ ID NO: 887865 - DNA, 22 bp, Artificial Sequence
  chemically synthesized
aaaagttatgattagaagaatt

SEQ ID NO: 887866 - DNA, 22 bp, Artificial Sequence
  chemically synthesized
caatacttaaaacaacacaatt

SEQ ID NO: 887867 - DNA, 22 bp, Artificial Sequence
  chemically synthesized
gcaatacttaaaacaacacaat

SEQ ID NO: 887868 - DNA, 22 bp, Artificial Sequence
  chemically synthesized
tgattagaagaattgtgttgtt

SEQ ID NO: 887869 - DNA, 22 bp, Artificial Sequence
  chemically synthesized
caatttgcaatacttaaaacaa

SEQ ID NO: 887870 - DNA, 22 bp, Artificial Sequence
  chemically synthesized
gaagaattgtgttgttttaagt

SEQ ID NO: 887871 - DNA, 22 bp, Artificial Sequence
  chemically synthesized
gcaatttgcaatacttaaaaca

SEQ ID NO: 887872 - DNA, 22 bp, Artificial Sequence
  chemically synthesized
cacttgcaatttgcaatactta

SEQ ID NO: 887873 - DNA, 22 bp, Artificial Sequence
  chemically synthesized
tgcacttgcaatttgcaatact

SEQ ID NO: 887874 - DNA, 22 bp, Artificial Sequence
  chemically synthesized
tgttgttttaagtattgcaaat

SEQ ID NO: 887875 - DNA, 22 bp, Artificial Sequence
  chemically synthesized
ttttaagtattgcaaattgcaa

SEQ ID NO: 887876 - DNA, 22 bp, Artificial Sequence
  chemically synthesized
taagtattgcaaattgcaagtg

SEQ ID NO: 887877 - DNA, 22 bp, Artificial Sequence
  chemically synthesized
agacatgctctgcacttgcaat

SEQ ID NO: 887878 - DNA, 22 bp, Artificial Sequence
  chemically synthesized
aagtattgcaaattgcaagtgc

SEQ ID NO: 887879 - DNA, 22 bp, Artificial Sequence
  chemically synthesized
agtattgcaaattgcaagtgca

SEQ ID NO: 887880 - DNA, 22 bp, Artificial Sequence
  chemically synthesized
caaattgcaagtgcagagcatg

SEQ ID NO: 887881 - DNA, 22 bp, Artificial Sequence
  chemically synthesized
agatacattcagacatgctctg

SEQ ID NO: 887882 - DNA, 22 bp, Artificial Sequence
  chemically synthesized
cagatacattcagacatgctct

SEQ ID NO: 887883 - DNA, 22 bp, Artificial Sequence
  chemically synthesized
caagtgcagagcatgtctgaat

SEQ ID NO: 887884 - DNA, 22 bp, Artificial Sequence
  chemically synthesized
ggatttcagatacattcagaca

SEQ ID NO: 887885 - DNA, 22 bp, Artificial Sequence
  chemically synthesized
aatgtatctgaaatcccaacgt

SEQ ID NO: 887886 - DNA, 22 bp, Artificial Sequence
  chemically synthesized
gtagaaaataacacgttgggat

SEQ ID NO: 887887 - DNA, 22 bp, Artificial Sequence
  chemically synthesized
ttggtagaaaataacacgttgg

SEQ ID NO: 887888 - DNA, 22 bp, Artificial Sequence
  chemically synthesized
actgttggtagaaaataacacg

SEQ ID NO: 887889 - DNA, 22 bp, Artificial Sequence
  chemically synthesized
aaatcccaacgtgttattttct

SEQ ID NO: 887890 - DNA, 22 bp, Artificial Sequence
  chemically synthesized
gtggcattgactgttggtagaa

SEQ ID NO: 887891 - DNA, 22 bp, Artificial Sequence
  chemically synthesized
ggtggcattgactgttggtaga

SEQ ID NO: 887892 - DNA, 22 bp, Artificial Sequence
  chemically synthesized
ccttggtggcattgactgttgg

SEQ ID NO: 887893 - DNA, 22 bp, Artificial Sequence
  chemically synthesized
cctcccttggtggcattgactg

SEQ ID NO: 887894 - DNA, 22 bp, Artificial Sequence
  chemically synthesized
ttttctaccaacagtcaatgcc

SEQ ID NO: 887895 - DNA, 22 bp, Artificial Sequence
  chemically synthesized
tctaccaacagtcaatgccacc

SEQ ID NO: 887896 - DNA, 22 bp, Artificial Sequence
  chemically synthesized
ctaccaacagtcaatgccacca

SEQ ID NO: 887897 - DNA, 22 bp, Artificial Sequence
  chemically synthesized
taccaacagtcaatgccaccaa

SEQ ID NO: 887898 - DNA, 22 bp, Artificial Sequence
  chemically synthesized
caagttacctcccttggtggca

SEQ ID NO: 887899 - DNA, 22 bp, Artificial Sequence
  chemically synthesized
ccaacagtcaatgccaccaagg

SEQ ID NO: 887900 - DNA, 22 bp, Artificial Sequence
  chemically synthesized
gcaagttacctcccttggtggc

SEQ ID NO: 887901 - DNA, 22 bp, Artificial Sequence
  chemically synthesized
aacttgcaagttacctcccttg

SEQ ID NO: 887902 - DNA, 22 bp, Artificial Sequence
  chemically synthesized
aaacttgcaagttacctccctt

SEQ ID NO: 887903 - DNA, 22 bp, Artificial Sequence
  chemically synthesized
taaacttgcaagttacctccct

SEQ ID NO: 887904 - DNA, 22 bp, Artificial Sequence
  chemically synthesized
aatgaggaaggttttaaacttg

SEQ ID NO: 887905 - DNA, 22 bp, Artificial Sequence
  chemically synthesized
gcaagtttaaaaccttcctcat

SEQ ID NO: 887906 - DNA, 22 bp, Artificial Sequence
  chemically synthesized
caagtttaaaaccttcctcatt

SEQ ID NO: 887907 - DNA, 22 bp, Artificial Sequence
  chemically synthesized
aaaaccttcctcatttaacttc

SEQ ID NO: 887908 - DNA, 22 bp, Artificial Sequence
  chemically synthesized
aaaccttcctcatttaacttcc

SEQ ID NO: 887909 - DNA, 22 bp, Artificial Sequence
  chemically synthesized
cctcatttaacttccattgttt

SEQ ID NO: 887910 - DNA, 22 bp, Artificial Sequence
  chemically synthesized
ctcatttaacttccattgtttc

SEQ ID NO: 887911 - DNA, 22 bp, Artificial Sequence
  chemically synthesized
atttaacttccattgtttctgc

SEQ ID NO: 887912 - DNA, 22 bp, Artificial Sequence
  chemically synthesized
aacttccattgtttctgcaccg

SEQ ID NO: 887913 - DNA, 22 bp, Artificial Sequence
  chemically synthesized
gcagacagaacgcggtgcagaa

SEQ ID NO: 887914 - DNA, 22 bp, Artificial Sequence
  chemically synthesized
acttccattgtttctgcaccgc

SEQ ID NO: 887915 - DNA, 22 bp, Artificial Sequence
  chemically synthesized
attggcagacagaacgcggtgc

SEQ ID NO: 887916 - DNA, 22 bp, Artificial Sequence
  chemically synthesized
ccattgtttctgcaccgcgttc

SEQ ID NO: 887917 - DNA, 22 bp, Artificial Sequence
  chemically synthesized
gattggcagacagaacgcggtg

SEQ ID NO: 887918 - DNA, 22 bp, Artificial Sequence
  chemically synthesized
cattgtttctgcaccgcgttct

SEQ ID NO: 887919 - DNA, 22 bp, Artificial Sequence
  chemically synthesized
tgattggcagacagaacgcggt

SEQ ID NO: 887920 - DNA, 22 bp, Artificial Sequence
  chemically synthesized
tttctgcaccgcgttctgtctg

SEQ ID NO: 887921 - DNA, 22 bp, Artificial Sequence
  chemically synthesized
ctgcaccgcgttctgtctgcca

SEQ ID NO: 887922 - DNA, 22 bp, Artificial Sequence
  chemically synthesized
tgcaccgcgttctgtctgccaa

SEQ ID NO: 887923 - DNA, 22 bp, Artificial Sequence
  chemically synthesized
caccgcgttctgtctgccaatc

SEQ ID NO: 887924 - DNA, 22 bp, Artificial Sequence
  chemically synthesized
taatgcccaggggatggctttg

SEQ ID NO: 887925 - DNA, 22 bp, Artificial Sequence
  chemically synthesized
tgtctgccaatcaaagccatcc

SEQ ID NO: 887926 - DNA, 22 bp, Artificial Sequence
  chemically synthesized
tctgccaatcaaagccatcccc

SEQ ID NO: 887927 - DNA, 22 bp, Artificial Sequence
  chemically synthesized
actataatgcccaggggatggc

SEQ ID NO: 887928 - DNA, 22 bp, Artificial Sequence
  chemically synthesized
ccaatcaaagccatcccctggg

SEQ ID NO: 887929 - DNA, 22 bp, Artificial Sequence
  chemically synthesized
ctaactataatgcccaggggat

SEQ ID NO: 887930 - DNA, 22 bp, Artificial Sequence
  chemically synthesized
actaactataatgcccagggga

SEQ ID NO: 887931 - DNA, 22 bp, Artificial Sequence
  chemically synthesized
gtttactaactataatgcccag

SEQ ID NO: 887932 - DNA, 22 bp, Artificial Sequence
  chemically synthesized
ggcattatagttagtaaaccag

SEQ ID NO: 887933 - DNA, 22 bp, Artificial Sequence
  chemically synthesized
agtggatgaatggaccacctgg

SEQ ID NO: 887934 - DNA, 22 bp, Artificial Sequence
  chemically synthesized
tagttagtaaaccaggtggtcc

SEQ ID NO: 887935 - DNA, 22 bp, Artificial Sequence
  chemically synthesized
aagtggatgaatggaccacctg

SEQ ID NO: 887936 - DNA, 22 bp, Artificial Sequence
  chemically synthesized
cttaagtggatgaatggaccac

SEQ ID NO: 887937 - DNA, 22 bp, Artificial Sequence
  chemically synthesized
tgcttaagtggatgaatggacc

SEQ ID NO: 887938 - DNA, 22 bp, Artificial Sequence
  chemically synthesized
gtaaaccaggtggtccattcat

SEQ ID NO: 887939 - DNA, 22 bp, Artificial Sequence
  chemically synthesized
ctgcttaagtggatgaatggac

SEQ ID NO: 887940 - DNA, 22 bp, Artificial Sequence
  chemically synthesized
aaacaatttctgcttaagtgga

SEQ ID NO: 887941 - DNA, 22 bp, Artificial Sequence
  chemically synthesized
caaacaatttctgcttaagtgg

SEQ ID NO: 887942 - DNA, 22 bp, Artificial Sequence
  chemically synthesized
tcaaacaatttctgcttaagtg

SEQ ID NO: 887943 - DNA, 22 bp, Artificial Sequence
  chemically synthesized
atccacttaagcagaaattgtt

SEQ ID NO: 887944 - DNA, 22 bp, Artificial Sequence
  chemically synthesized
caatcattttcaaacaatttct

SEQ ID NO: 887945 - DNA, 22 bp, Artificial Sequence
  chemically synthesized
ccaatcattttcaaacaatttc

SEQ ID NO: 887946 - DNA, 22 bp, Artificial Sequence
  chemically synthesized
aagcagaaattgtttgaaaatg

SEQ ID NO: 887947 - DNA, 22 bp, Artificial Sequence
  chemically synthesized
agcagaaattgtttgaaaatga

SEQ ID NO: 887948 - DNA, 22 bp, Artificial Sequence
  chemically synthesized
tttgaaaatgattggaagtgtt

SEQ ID NO: 887949 - DNA, 22 bp, Artificial Sequence
  chemically synthesized
gaaaatgattggaagtgttccc

SEQ ID NO: 887950 - DNA, 22 bp, Artificial Sequence
  chemically synthesized
aaaatgattggaagtgttccca

SEQ ID NO: 887951 - DNA, 22 bp, Artificial Sequence
  chemically synthesized
tgtggaggagaaaaatgggaac

SEQ ID NO: 887952 - DNA, 22 bp, Artificial Sequence
  chemically synthesized
tgtgtggaggagaaaaatggga

SEQ ID NO: 887953 - DNA, 22 bp, Artificial Sequence
  chemically synthesized
attctgtgtggaggagaaaaat

SEQ ID NO: 887954 - DNA, 22 bp, Artificial Sequence
  chemically synthesized
gaagtgttcccatttttctcct

SEQ ID NO: 887955 - DNA, 22 bp, Artificial Sequence
  chemically synthesized
tgattctgtgtggaggagaaaa

SEQ ID NO: 887956 - DNA, 22 bp, Artificial Sequence
  chemically synthesized
ctgattctgtgtggaggagaaa

SEQ ID NO: 887957 - DNA, 22 bp, Artificial Sequence
  chemically synthesized
tctgattctgtgtggaggagaa

SEQ ID NO: 887958 - DNA, 22 bp, Artificial Sequence
  chemically synthesized
tttctgattctgtgtggaggag

SEQ ID NO: 887959 - DNA, 22 bp, Artificial Sequence
  chemically synthesized
ccatttttctcctccacacaga

SEQ ID NO: 887960 - DNA, 22 bp, Artificial Sequence
  chemically synthesized
ttctcctccacacagaatcaga

SEQ ID NO: 887961 - DNA, 22 bp, Artificial Sequence
  chemically synthesized
tctcctccacacagaatcagaa

SEQ ID NO: 887962 - DNA, 22 bp, Artificial Sequence
  chemically synthesized
ctcctccacacagaatcagaaa

SEQ ID NO: 887963 - DNA, 22 bp, Artificial Sequence
  chemically synthesized
tcctccacacagaatcagaaag

SEQ ID NO: 887964 - DNA, 22 bp, Artificial Sequence
  chemically synthesized
ctccacacagaatcagaaagag

SEQ ID NO: 887965 - DNA, 22 bp, Artificial Sequence
  chemically synthesized
cccatgggtgtcatctctttct

SEQ ID NO: 887966 - DNA, 22 bp, Artificial Sequence
  chemically synthesized
cacacagaatcagaaagagatg

SEQ ID NO: 887967 - DNA, 22 bp, Artificial Sequence
  chemically synthesized
tgcccatgggtgtcatctcttt

SEQ ID NO: 887968 - DNA, 22 bp, Artificial Sequence
  chemically synthesized
ctctgcccatgggtgtcatctc

SEQ ID NO: 887969 - DNA, 22 bp, Artificial Sequence
  chemically synthesized
tgctctgcccatgggtgtcatc

SEQ ID NO: 887970 - DNA, 22 bp, Artificial Sequence
  chemically synthesized
aagaaaactctgctctgcccat

SEQ ID NO: 887971 - DNA, 22 bp, Artificial Sequence
  chemically synthesized
taaagaaaactctgctctgccc

SEQ ID NO: 887972 - DNA, 22 bp, Artificial Sequence
  chemically synthesized
tgtactctaaagaaaactctgc

SEQ ID NO: 887973 - DNA, 22 bp, Artificial Sequence
  chemically synthesized
atgtactctaaagaaaactctg

SEQ ID NO: 887974 - DNA, 22 bp, Artificial Sequence
  chemically synthesized
tatgtactctaaagaaaactct

SEQ ID NO: 887975 - DNA, 22 bp, Artificial Sequence
  chemically synthesized
ttatgtactctaaagaaaactc

SEQ ID NO: 887976 - DNA, 22 bp, Artificial Sequence
  chemically synthesized
tttatgtactctaaagaaaact

SEQ ID NO: 887977 - DNA, 22 bp, Artificial Sequence
  chemically synthesized
ttttatgtactctaaagaaaac

SEQ ID NO: 887978 - DNA, 22 bp, Artificial Sequence
  chemically synthesized
tttttatgtactctaaagaaaa

SEQ ID NO: 887979 - DNA, 22 bp, Artificial Sequence
  chemically synthesized
ttttttatgtactctaaagaaa

SEQ ID NO: 887980 - DNA, 22 bp, Artificial Sequence
  chemically synthesized
tttttttatgtactctaaagaa

SEQ ID NO: 887981 - DNA, 22 bp, Artificial Sequence
  chemically synthesized
ttttttttatgtactctaaaga

SEQ ID NO: 887982 - DNA, 22 bp, Artificial Sequence
  chemically synthesized
tttttttttatgtactctaaag

SEQ ID NO: 887983 - DNA, 22 bp, Artificial Sequence
  chemically synthesized
tcagttttttttttttatgtac

SEQ ID NO: 887984 - DNA, 22 bp, Artificial Sequence
  chemically synthesized
tctttagagtacataaaaaaaa

SEQ ID NO: 887985 - DNA, 22 bp, Artificial Sequence
  chemically synthesized
ctttagagtacataaaaaaaaa

SEQ ID NO: 887986 - DNA, 22 bp, Artificial Sequence
  chemically synthesized
tttagagtacataaaaaaaaaa

SEQ ID NO: 887987 - DNA, 22 bp, Artificial Sequence
  chemically synthesized
tagagtacataaaaaaaaaaaa

SEQ ID NO: 887988 - DNA, 22 bp, Artificial Sequence
  chemically synthesized
agagtacataaaaaaaaaaaac

SEQ ID NO: 887989 - DNA, 22 bp, Artificial Sequence
  chemically synthesized
gagtacataaaaaaaaaaaact

SEQ ID NO: 887990 - DNA, 22 bp, Artificial Sequence
  chemically synthesized
tgagagaacgtcagaagccatg

SEQ ID NO: 887991 - DNA, 22 bp, Artificial Sequence
  chemically synthesized
atagcatggcttctgacgttct

SEQ ID NO: 887992 - DNA, 22 bp, Artificial Sequence
  chemically synthesized
aaggaagttatgagagaacgtc

SEQ ID NO: 887993 - DNA, 22 bp, Artificial Sequence
  chemically synthesized
gaaggaagttatgagagaacgt

SEQ ID NO: 887994 - DNA, 22 bp, Artificial Sequence
  chemically synthesized
tgaaggaagttatgagagaacg

SEQ ID NO: 887995 - DNA, 22 bp, Artificial Sequence
  chemically synthesized
ctgacgttctctcataacttcc

SEQ ID NO: 887996 - DNA, 22 bp, Artificial Sequence
  chemically synthesized
tgacgttctctcataacttcct

SEQ ID NO: 887997 - DNA, 22 bp, Artificial Sequence
  chemically synthesized
gataatactttgaaggaagtta

SEQ ID NO: 887998 - DNA, 22 bp, Artificial Sequence
  chemically synthesized
acgttctctcataacttccttc

SEQ ID NO: 887999 - DNA, 22 bp, Artificial Sequence
  chemically synthesized
agataatactttgaaggaagtt

SEQ ID NO: 888000 - DNA, 22 bp, Artificial Sequence
  chemically synthesized
tctcataacttccttcaaagta

SEQ ID NO: 888001 - DNA, 22 bp, Artificial Sequence
  chemically synthesized
tcataacttccttcaaagtatt

SEQ ID NO: 888002 - DNA, 22 bp, Artificial Sequence
  chemically synthesized
ataacttccttcaaagtattat

SEQ ID NO: 888003 - DNA, 22 bp, Artificial Sequence
  chemically synthesized
gaaggaaatttagataatactt

SEQ ID NO: 888004 - DNA, 22 bp, Artificial Sequence
  chemically synthesized
agaaggaaatttagataatact

SEQ ID NO: 888005 - DNA, 22 bp, Artificial Sequence
  chemically synthesized
tagaaggaaatttagataatac

SEQ ID NO: 888006 - DNA, 22 bp, Artificial Sequence
  chemically synthesized
ctttagaaggaaatttagataa

SEQ ID NO: 888007 - DNA, 22 bp, Artificial Sequence
  chemically synthesized
ccttcaaagtattatctaaatt

SEQ ID NO: 888008 - DNA, 22 bp, Artificial Sequence
  chemically synthesized
cttcaaagtattatctaaattt

SEQ ID NO: 888009 - DNA, 22 bp, Artificial Sequence
  chemically synthesized
ctcctttagaaggaaatttaga

SEQ ID NO: 888010 - DNA, 22 bp, Artificial Sequence
  chemically synthesized
caaagtattatctaaatttcct

SEQ ID NO: 888011 - DNA, 22 bp, Artificial Sequence
  chemically synthesized
aaagtattatctaaatttcctt

SEQ ID NO: 888012 - DNA, 22 bp, Artificial Sequence
  chemically synthesized
actactcctttagaaggaaatt

SEQ ID NO: 888013 - DNA, 22 bp, Artificial Sequence
  chemically synthesized
cactactcctttagaaggaaat

SEQ ID NO: 888014 - DNA, 22 bp, Artificial Sequence
  chemically synthesized
tctaaatttccttctaaaggag

SEQ ID NO: 888015 - DNA, 22 bp, Artificial Sequence
  chemically synthesized
gcagtccttcactactccttta

SEQ ID NO: 888016 - DNA, 22 bp, Artificial Sequence
  chemically synthesized
agcagtccttcactactccttt

SEQ ID NO: 888017 - DNA, 22 bp, Artificial Sequence
  chemically synthesized
aatttccttctaaaggagtagt

SEQ ID NO: 888018 - DNA, 22 bp, Artificial Sequence
  chemically synthesized
cttagcagtccttcactactcc

SEQ ID NO: 888019 - DNA, 22 bp, Artificial Sequence
  chemically synthesized
acttagcagtccttcactactc

SEQ ID NO: 888020 - DNA, 22 bp, Artificial Sequence
  chemically synthesized
tacttagcagtccttcactact

SEQ ID NO: 888021 - DNA, 22 bp, Artificial Sequence
  chemically synthesized
ccttctaaaggagtagtgaagg

SEQ ID NO: 888022 - DNA, 22 bp, Artificial Sequence
  chemically synthesized
ttacttagcagtccttcactac

SEQ ID NO: 888023 - DNA, 22 bp, Artificial Sequence
  chemically synthesized
cttctaaaggagtagtgaagga

SEQ ID NO: 888024 - DNA, 22 bp, Artificial Sequence
  chemically synthesized
ctaaaggagtagtgaaggactg

SEQ ID NO: 888025 - DNA, 22 bp, Artificial Sequence
  chemically synthesized
gtttttacttagcagtccttca

SEQ ID NO: 888026 - DNA, 22 bp, Artificial Sequence
  chemically synthesized
taaaggagtagtgaaggactgc

SEQ ID NO: 888027 - DNA, 22 bp, Artificial Sequence
  chemically synthesized
agtttttacttagcagtccttc

SEQ ID NO: 888028 - DNA, 22 bp, Artificial Sequence
  chemically synthesized
tagtttttacttagcagtcctt

SEQ ID NO: 888029 - DNA, 22 bp, Artificial Sequence
  chemically synthesized
aaggagtagtgaaggactgcta

SEQ ID NO: 888030 - DNA, 22 bp, Artificial Sequence
  chemically synthesized
gaattttagtttttacttagca

SEQ ID NO: 888031 - DNA, 22 bp, Artificial Sequence
  chemically synthesized
catattagaattttagttttta

SEQ ID NO: 888032 - DNA, 22 bp, Artificial Sequence
  chemically synthesized
ctgcatattagaattttagttt

SEQ ID NO: 888033 - DNA, 22 bp, Artificial Sequence
  chemically synthesized
actgcatattagaattttagtt

SEQ ID NO: 888034 - DNA, 22 bp, Artificial Sequence
  chemically synthesized
tactgcatattagaattttagt

SEQ ID NO: 888035 - DNA, 22 bp, Artificial Sequence
  chemically synthesized
ttactgcatattagaattttag

SEQ ID NO: 888036 - DNA, 22 bp, Artificial Sequence
  chemically synthesized
ctaagtaaaaactaaaattcta

SEQ ID NO: 888037 - DNA, 22 bp, Artificial Sequence
  chemically synthesized
agtaaaaactaaaattctaata

SEQ ID NO: 888038 - DNA, 22 bp, Artificial Sequence
  chemically synthesized
aaataatgcttttactgcatat

SEQ ID NO: 888039 - DNA, 22 bp, Artificial Sequence
  chemically synthesized
gaaataatgcttttactgcata

SEQ ID NO: 888040 - DNA, 22 bp, Artificial Sequence
  chemically synthesized
ttgaaataatgcttttactgca

SEQ ID NO: 888041 - DNA, 22 bp, Artificial Sequence
  chemically synthesized
aaattctaatatgcagtaaaag

SEQ ID NO: 888042 - DNA, 22 bp, Artificial Sequence
  chemically synthesized
cttgaaataatgcttttactgc

SEQ ID NO: 888043 - DNA, 22 bp, Artificial Sequence
  chemically synthesized
tcttgaaataatgcttttactg

SEQ ID NO: 888044 - DNA, 22 bp, Artificial Sequence
  chemically synthesized
taatatgcagtaaaagcattat

SEQ ID NO: 888045 - DNA, 22 bp, Artificial Sequence
  chemically synthesized
tactttcttgaaataatgcttt

SEQ ID NO: 888046 - DNA, 22 bp, Artificial Sequence
  chemically synthesized
atactttcttgaaataatgctt

SEQ ID NO: 888047 - DNA, 22 bp, Artificial Sequence
  chemically synthesized
atatgcagtaaaagcattattt

SEQ ID NO: 888048 - DNA, 22 bp, Artificial Sequence
  chemically synthesized
aatatgtttatactttcttgaa

SEQ ID NO: 888049 - DNA, 22 bp, Artificial Sequence
  chemically synthesized
tcaccctaaatatgtttatact

SEQ ID NO: 888050 - DNA, 22 bp, Artificial Sequence
  chemically synthesized
gtcaccctaaatatgtttatac

SEQ ID NO: 888051 - DNA, 22 bp, Artificial Sequence
  chemically synthesized
tgtcaccctaaatatgtttata

SEQ ID NO: 888052 - DNA, 22 bp, Artificial Sequence
  chemically synthesized
tttcaagaaagtataaacatat

SEQ ID NO: 888053 - DNA, 22 bp, Artificial Sequence
  chemically synthesized
caagaaagtataaacatattta

SEQ ID NO: 888054 - DNA, 22 bp, Artificial Sequence
  chemically synthesized
aagaaagtataaacatatttag

SEQ ID NO: 888055 - DNA, 22 bp, Artificial Sequence
  chemically synthesized
aaaagtcattttgtcaccctaa

SEQ ID NO: 888056 - DNA, 22 bp, Artificial Sequence
  chemically synthesized
aaaaagtcattttgtcacccta

SEQ ID NO: 888057 - DNA, 22 bp, Artificial Sequence
  chemically synthesized
aaataaaccttaaaaagtcatt

SEQ ID NO: 888058 - DNA, 22 bp, Artificial Sequence
  chemically synthesized
gaaataaaccttaaaaagtcat

SEQ ID NO: 888059 - DNA, 22 bp, Artificial Sequence
  chemically synthesized
agggtgacaaaatgacttttta

SEQ ID NO: 888060 - DNA, 22 bp, Artificial Sequence
  chemically synthesized
tgaaataaaccttaaaaagtca

SEQ ID NO: 888061 - DNA, 22 bp, Artificial Sequence
  chemically synthesized
gggtgacaaaatgactttttaa

SEQ ID NO: 888062 - DNA, 22 bp, Artificial Sequence
  chemically synthesized
ttgaaataaaccttaaaaagtc

SEQ ID NO: 888063 - DNA, 22 bp, Artificial Sequence
  chemically synthesized
cttttgaaataaaccttaaaaa

SEQ ID NO: 888064 - DNA, 22 bp, Artificial Sequence
  chemically synthesized
gcttttgaaataaaccttaaaa

SEQ ID NO: 888065 - DNA, 22 bp, Artificial Sequence
  chemically synthesized
ttgcttttgaaataaaccttaa

SEQ ID NO: 888066 - DNA, 22 bp, Artificial Sequence
  chemically synthesized
tcttgcttttgaaataaacctt

SEQ ID NO: 888067 - DNA, 22 bp, Artificial Sequence
  chemically synthesized
gatcattctcttgcttttgaaa

SEQ ID NO: 888068 - DNA, 22 bp, Artificial Sequence
  chemically synthesized
tttaaggtttatttcaaaagca

SEQ ID NO: 888069 - DNA, 22 bp, Artificial Sequence
  chemically synthesized
ttaaggtttatttcaaaagcaa

SEQ ID NO: 888070 - DNA, 22 bp, Artificial Sequence
  chemically synthesized
taaggtttatttcaaaagcaag

SEQ ID NO: 888071 - DNA, 22 bp, Artificial Sequence
  chemically synthesized
ctagatcattctcttgcttttg

SEQ ID NO: 888072 - DNA, 22 bp, Artificial Sequence
  chemically synthesized
aaggtttatttcaaaagcaaga

SEQ ID NO: 888073 - DNA, 22 bp, Artificial Sequence
  chemically synthesized
aggtttatttcaaaagcaagag

SEQ ID NO: 888074 - DNA, 22 bp, Artificial Sequence
  chemically synthesized
tcctagatcattctcttgcttt

SEQ ID NO: 888075 - DNA, 22 bp, Artificial Sequence
  chemically synthesized
tctcctagatcattctcttgct

SEQ ID NO: 888076 - DNA, 22 bp, Artificial Sequence
  chemically synthesized
ctctctcctagatcattctctt

SEQ ID NO: 888077 - DNA, 22 bp, Artificial Sequence
  chemically synthesized
atttcaaaagcaagagaatgat

SEQ ID NO: 888078 - DNA, 22 bp, Artificial Sequence
  chemically synthesized
tttcaaaagcaagagaatgatc

SEQ ID NO: 888079 - DNA, 22 bp, Artificial Sequence
  chemically synthesized
tactctctcctagatcattctc

SEQ ID NO: 888080 - DNA, 22 bp, Artificial Sequence
  chemically synthesized
caaaagcaagagaatgatctag

SEQ ID NO: 888081 - DNA, 22 bp, Artificial Sequence
  chemically synthesized
aaaagcaagagaatgatctagg

SEQ ID NO: 888082 - DNA, 22 bp, Artificial Sequence
  chemically synthesized
aagcagttctactctctcctag

SEQ ID NO: 888083 - DNA, 22 bp, Artificial Sequence
  chemically synthesized
ctaaagcagttctactctctcc

SEQ ID NO: 888084 - DNA, 22 bp, Artificial Sequence
  chemically synthesized
tcctaaagcagttctactctct

SEQ ID NO: 888085 - DNA, 22 bp, Artificial Sequence
  chemically synthesized
ctcctaaagcagttctactctc

SEQ ID NO: 888086 - DNA, 22 bp, Artificial Sequence
  chemically synthesized
tctcctaaagcagttctactct

SEQ ID NO: 888087 - DNA, 22 bp, Artificial Sequence
  chemically synthesized
ggagagagtagaactgctttag

SEQ ID NO: 888088 - DNA, 22 bp, Artificial Sequence
  chemically synthesized
taccattttctcctaaagcagt

SEQ ID NO: 888089 - DNA, 22 bp, Artificial Sequence
  chemically synthesized
accaatattataccattttctc

SEQ ID NO: 888090 - DNA, 22 bp, Artificial Sequence
  chemically synthesized
cattcaccaatattataccatt

SEQ ID NO: 888091 - DNA, 22 bp, Artificial Sequence
  chemically synthesized
ctttaggagaaaatggtataat

SEQ ID NO: 888092 - DNA, 22 bp, Artificial Sequence
  chemically synthesized
ccattcaccaatattataccat

SEQ ID NO: 888093 - DNA, 22 bp, Artificial Sequence
  chemically synthesized
tccattcaccaatattatacca

SEQ ID NO: 888094 - DNA, 22 bp, Artificial Sequence
  chemically synthesized
taggagaaaatggtataatatt

SEQ ID NO: 888095 - DNA, 22 bp, Artificial Sequence
  chemically synthesized
aggagaaaatggtataatattg

SEQ ID NO: 888096 - DNA, 22 bp, Artificial Sequence
  chemically synthesized
ttttccattcaccaatattata

SEQ ID NO: 888097 - DNA, 22 bp, Artificial Sequence
  chemically synthesized
ggagaaaatggtataatattgg

SEQ ID NO: 888098 - DNA, 22 bp, Artificial Sequence
  chemically synthesized
tattttccattcaccaatatta

SEQ ID NO: 888099 - DNA, 22 bp, Artificial Sequence
  chemically synthesized
ctattttccattcaccaatatt

SEQ ID NO: 888100 - DNA, 22 bp, Artificial Sequence
  chemically synthesized
caatttctattttccattcacc

SEQ ID NO: 888101 - DNA, 22 bp, Artificial Sequence
  chemically synthesized
aaaggttccaatttctattttc

SEQ ID NO: 888102 - DNA, 22 bp, Artificial Sequence
  chemically synthesized
gtgaatggaaaatagaaattgg

SEQ ID NO: 888103 - DNA, 22 bp, Artificial Sequence
  chemically synthesized
gaaccttttaatttctattggg

SEQ ID NO: 888104 - DNA, 22 bp, Artificial Sequence
  chemically synthesized
acatacaagaaacaaacccaat

SEQ ID NO: 888105 - DNA, 22 bp, Artificial Sequence
  chemically synthesized
gacatacaagaaacaaacccaa

SEQ ID NO: 888106 - DNA, 22 bp, Artificial Sequence
  chemically synthesized
ttaatttctattgggtttgttt

SEQ ID NO: 888107 - DNA, 22 bp, Artificial Sequence
  chemically synthesized
ttgacatacaagaaacaaaccc

SEQ ID NO: 888108 - DNA, 22 bp, Artificial Sequence
  chemically synthesized
taatttctattgggtttgtttc

SEQ ID NO: 888109 - DNA, 22 bp, Artificial Sequence
  chemically synthesized
aatttctattgggtttgtttct

SEQ ID NO: 888110 - DNA, 22 bp, Artificial Sequence
  chemically synthesized
atttctattgggtttgtttctt

SEQ ID NO: 888111 - DNA, 22 bp, Artificial Sequence
  chemically synthesized
ctcttgacatacaagaaacaaa

SEQ ID NO: 888112 - DNA, 22 bp, Artificial Sequence
  chemically synthesized
ctattgggtttgtttcttgtat

SEQ ID NO: 888113 - DNA, 22 bp, Artificial Sequence
  chemically synthesized
tattgggtttgtttcttgtatg

SEQ ID NO: 888114 - DNA, 22 bp, Artificial Sequence
  chemically synthesized
ttgggtttgtttcttgtatgtc

SEQ ID NO: 888115 - DNA, 22 bp, Artificial Sequence
  chemically synthesized
ggtttgtttcttgtatgtcaag

SEQ ID NO: 888116 - DNA, 22 bp, Artificial Sequence
  chemically synthesized
gaataccattcctcttgacata

SEQ ID NO: 888117 - DNA, 22 bp, Artificial Sequence
  chemically synthesized
gtttcttgtatgtcaagaggaa

SEQ ID NO: 888118 - DNA, 22 bp, Artificial Sequence
  chemically synthesized
tttcttgtatgtcaagaggaat

SEQ ID NO: 888119 - DNA, 22 bp, Artificial Sequence
  chemically synthesized
cagttagaataccattcctctt

SEQ ID NO: 888120 - DNA, 22 bp, Artificial Sequence
  chemically synthesized
gcagttagaataccattcctct

SEQ ID NO: 888121 - DNA, 22 bp, Artificial Sequence
  chemically synthesized
cttgtatgtcaagaggaatggt

SEQ ID NO: 888122 - DNA, 22 bp, Artificial Sequence
  chemically synthesized
tgcagttagaataccattcctc

SEQ ID NO: 888123 - DNA, 22 bp, Artificial Sequence
  chemically synthesized
ttgtatgtcaagaggaatggta

SEQ ID NO: 888124 - DNA, 22 bp, Artificial Sequence
  chemically synthesized
tttgcagttagaataccattcc

SEQ ID NO: 888125 - DNA, 22 bp, Artificial Sequence
  chemically synthesized
gtatgtcaagaggaatggtatt

SEQ ID NO: 888126 - DNA, 22 bp, Artificial Sequence
  chemically synthesized
tatgtcaagaggaatggtattc

SEQ ID NO: 888127 - DNA, 22 bp, Artificial Sequence
  chemically synthesized
ttctttgcagttagaataccat

SEQ ID NO: 888128 - DNA, 22 bp, Artificial Sequence
  chemically synthesized
attctttgcagttagaatacca

SEQ ID NO: 888129 - DNA, 22 bp, Artificial Sequence
  chemically synthesized
tattctttgcagttagaatacc

SEQ ID NO: 888130 - DNA, 22 bp, Artificial Sequence
  chemically synthesized
ttttattctttgcagttagaat

SEQ ID NO: 888131 - DNA, 22 bp, Artificial Sequence
  chemically synthesized
gttttattctttgcagttagaa

SEQ ID NO: 888132 - DNA, 22 bp, Artificial Sequence
  chemically synthesized
tttgttttattctttgcagtta

SEQ ID NO: 888133 - DNA, 22 bp, Artificial Sequence
  chemically synthesized
ctatttgttttattctttgcag

SEQ ID NO: 888134 - DNA, 22 bp, Artificial Sequence
  chemically synthesized
actgctatttgttttattcttt

SEQ ID NO: 888135 - DNA, 22 bp, Artificial Sequence
  chemically synthesized
tcactgctatttgttttattct

SEQ ID NO: 888136 - DNA, 22 bp, Artificial Sequence
  chemically synthesized
taactgcaaagaataaaacaaa

SEQ ID NO: 888137 - DNA, 22 bp, Artificial Sequence
  chemically synthesized
cctctcactgctatttgtttta

SEQ ID NO: 888138 - DNA, 22 bp, Artificial Sequence
  chemically synthesized
actgcaaagaataaaacaaata

SEQ ID NO: 888139 - DNA, 22 bp, Artificial Sequence
  chemically synthesized
caaagaataaaacaaatagcag

SEQ ID NO: 888140 - DNA, 22 bp, Artificial Sequence
  chemically synthesized
gacaccagttccctctcactgc

SEQ ID NO: 888141 - DNA, 22 bp, Artificial Sequence
  chemically synthesized
ggacaccagttccctctcactg

SEQ ID NO: 888142 - DNA, 22 bp, Artificial Sequence
  chemically synthesized
cccatcttggacaccagttccc

SEQ ID NO: 888143 - DNA, 22 bp, Artificial Sequence
  chemically synthesized
acccatcttggacaccagttcc

SEQ ID NO: 888144 - DNA, 22 bp, Artificial Sequence
  chemically synthesized
tacccatcttggacaccagttc

SEQ ID NO: 888145 - DNA, 22 bp, Artificial Sequence
  chemically synthesized
tttacccatcttggacaccagt

SEQ ID NO: 888146 - DNA, 22 bp, Artificial Sequence
  chemically synthesized
atctctttacccatcttggaca

SEQ ID NO: 888147 - DNA, 22 bp, Artificial Sequence
  chemically synthesized
taatctctttacccatcttgga

SEQ ID NO: 888148 - DNA, 22 bp, Artificial Sequence
  chemically synthesized
ctaatctctttacccatcttgg

SEQ ID NO: 888149 - DNA, 22 bp, Artificial Sequence
  chemically synthesized
tctaatctctttacccatcttg

SEQ ID NO: 888150 - DNA, 22 bp, Artificial Sequence
  chemically synthesized
gtgtccaagatgggtaaagaga

SEQ ID NO: 888151 - DNA, 22 bp, Artificial Sequence
  chemically synthesized
ggggctttctaatctctttacc

SEQ ID NO: 888152 - DNA, 22 bp, Artificial Sequence
  chemically synthesized
agcagctgggggctttctaatc

SEQ ID NO: 888153 - DNA, 22 bp, Artificial Sequence
  chemically synthesized
tgagcagctgggggctttctaa

SEQ ID NO: 888154 - DNA, 22 bp, Artificial Sequence
  chemically synthesized
attctgagcagctgggggcttt

SEQ ID NO: 888155 - DNA, 22 bp, Artificial Sequence
  chemically synthesized
gaaagcccccagctgctcagaa

SEQ ID NO: 888156 - DNA, 22 bp, Artificial Sequence
  chemically synthesized
catcaagagagttaattctgag

SEQ ID NO: 888157 - DNA, 22 bp, Artificial Sequence
  chemically synthesized
tctgcatcaagagagttaattc

SEQ ID NO: 888158 - DNA, 22 bp, Artificial Sequence
  chemically synthesized
atctgcatcaagagagttaatt

SEQ ID NO: 888159 - DNA, 22 bp, Artificial Sequence
  chemically synthesized
ctcagaattaactctcttgatg

SEQ ID NO: 888160 - DNA, 22 bp, Artificial Sequence
  chemically synthesized
agaattaactctcttgatgcag

SEQ ID NO: 888161 - DNA, 22 bp, Artificial Sequence
  chemically synthesized
agatgtaatttatctgcatcaa

SEQ ID NO: 888162 - DNA, 22 bp, Artificial Sequence
  chemically synthesized
actctcttgatgcagataaatt

SEQ ID NO: 888163 - DNA, 22 bp, Artificial Sequence
  chemically synthesized
gcatactgagatgtaatttatc

SEQ ID NO: 888164 - DNA, 22 bp, Artificial Sequence
  chemically synthesized
tcttgatgcagataaattacat

SEQ ID NO: 888165 - DNA, 22 bp, Artificial Sequence
  chemically synthesized
ttgatgcagataaattacatct

SEQ ID NO: 888166 - DNA, 22 bp, Artificial Sequence
  chemically synthesized
tattagcatactgagatgtaat

SEQ ID NO: 888167 - DNA, 22 bp, Artificial Sequence
  chemically synthesized
gatgcagataaattacatctca

SEQ ID NO: 888168 - DNA, 22 bp, Artificial Sequence
  chemically synthesized
atgcagataaattacatctcag

SEQ ID NO: 888169 - DNA, 22 bp, Artificial Sequence
  chemically synthesized
ccagttgtattagcatactgag

SEQ ID NO: 888170 - DNA, 22 bp, Artificial Sequence
  chemically synthesized
gccagttgtattagcatactga

SEQ ID NO: 888171 - DNA, 22 bp, Artificial Sequence
  chemically synthesized
acttgccagttgtattagcata

SEQ ID NO: 888172 - DNA, 22 bp, Artificial Sequence
  chemically synthesized
gacttgccagttgtattagcat

SEQ ID NO: 888173 - DNA, 22 bp, Artificial Sequence
  chemically synthesized
catctcagtatgctaatacaac

SEQ ID NO: 888174 - DNA, 22 bp, Artificial Sequence
  chemically synthesized
ccatttgacttgccagttgtat

SEQ ID NO: 888175 - DNA, 22 bp, Artificial Sequence
  chemically synthesized
gccatttgacttgccagttgta

SEQ ID NO: 888176 - DNA, 22 bp, Artificial Sequence
  chemically synthesized
agtatgctaatacaactggcaa

SEQ ID NO: 888177 - DNA, 22 bp, Artificial Sequence
  chemically synthesized
atacaactggcaagtcaaatgg

SEQ ID NO: 888178 - DNA, 22 bp, Artificial Sequence
  chemically synthesized
gcaagtcaaatggcaaaccatt

SEQ ID NO: 888179 - DNA, 22 bp, Artificial Sequence
  chemically synthesized
atgagtaaccacaatggtttgc

SEQ ID NO: 888180 - DNA, 22 bp, Artificial Sequence
  chemically synthesized
catgagtaaccacaatggtttg

SEQ ID NO: 888181 - DNA, 22 bp, Artificial Sequence
  chemically synthesized
ccagtcttcatgagtaaccaca

SEQ ID NO: 888182 - DNA, 22 bp, Artificial Sequence
  chemically synthesized
cccagtcttcatgagtaaccac

SEQ ID NO: 888183 - DNA, 22 bp, Artificial Sequence
  chemically synthesized
tcccagtcttcatgagtaacca

SEQ ID NO: 888184 - DNA, 22 bp, Artificial Sequence
  chemically synthesized
cactttcccagtcttcatgagt

SEQ ID NO: 888185 - DNA, 22 bp, Artificial Sequence
  chemically synthesized
tggttactcatgaagactggga

SEQ ID NO: 888186 - DNA, 22 bp, Artificial Sequence
  chemically synthesized
ctcatgaagactgggaaagtgc

SEQ ID NO: 888187 - DNA, 22 bp, Artificial Sequence
  chemically synthesized
tgaaaatcaaaactgcactttc

SEQ ID NO: 888188 - DNA, 22 bp, Artificial Sequence
  chemically synthesized
atgaagactgggaaagtgcagt

SEQ ID NO: 888189 - DNA, 22 bp, Artificial Sequence
  chemically synthesized
gtgaaaatcaaaactgcacttt

SEQ ID NO: 888190 - DNA, 22 bp, Artificial Sequence
  chemically synthesized
cttgtgaaaatcaaaactgcac

SEQ ID NO: 888191 - DNA, 22 bp, Artificial Sequence
  chemically synthesized
ccttgtgaaaatcaaaactgca

SEQ ID NO: 888192 - DNA, 22 bp, Artificial Sequence
  chemically synthesized
tccttgtgaaaatcaaaactgc

SEQ ID NO: 888193 - DNA, 22 bp, Artificial Sequence
  chemically synthesized
ttccttgtgaaaatcaaaactg

SEQ ID NO: 888194 - DNA, 22 bp, Artificial Sequence
  chemically synthesized
tttttccttgtgaaaatcaaaa

SEQ ID NO: 888195 - DNA, 22 bp, Artificial Sequence
  chemically synthesized
ggaaagtgcagttttgattttc

SEQ ID NO: 888196 - DNA, 22 bp, Artificial Sequence
  chemically synthesized
atttttccttgtgaaaatcaaa

SEQ ID NO: 888197 - DNA, 22 bp, Artificial Sequence
  chemically synthesized
ccacacttatttttccttgtga

SEQ ID NO: 888198 - DNA, 22 bp, Artificial Sequence
  chemically synthesized
ttcccacacttatttttccttg

SEQ ID NO: 888199 - DNA, 22 bp, Artificial Sequence
  chemically synthesized
attcccacacttatttttcctt

SEQ ID NO: 888200 - DNA, 22 bp, Artificial Sequence
  chemically synthesized
tattcccacacttatttttcct

SEQ ID NO: 888201 - DNA, 22 bp, Artificial Sequence
  chemically synthesized
tgattttcacaaggaaaaataa

SEQ ID NO: 888202 - DNA, 22 bp, Artificial Sequence
  chemically synthesized
gattttcacaaggaaaaataag

SEQ ID NO: 888203 - DNA, 22 bp, Artificial Sequence
  chemically synthesized
attttcacaaggaaaaataagt

SEQ ID NO: 888204 - DNA, 22 bp, Artificial Sequence
  chemically synthesized
acattttattcccacacttatt

SEQ ID NO: 888205 - DNA, 22 bp, Artificial Sequence
  chemically synthesized
tcacaaggaaaaataagtgtgg

SEQ ID NO: 888206 - DNA, 22 bp, Artificial Sequence
  chemically synthesized
aacattttattcccacacttat

SEQ ID NO: 888207 - DNA, 22 bp, Artificial Sequence
  chemically synthesized
cacaaggaaaaataagtgtggg

SEQ ID NO: 888208 - DNA, 22 bp, Artificial Sequence
  chemically synthesized
acaaggaaaaataagtgtggga

SEQ ID NO: 888209 - DNA, 22 bp, Artificial Sequence
  chemically synthesized
gaagcttaacattttattccca

SEQ ID NO: 888210 - DNA, 22 bp, Artificial Sequence
  chemically synthesized
tctggaagcttaacattttatt

SEQ ID NO: 888211 - DNA, 22 bp, Artificial Sequence
  chemically synthesized
aaataactatctggaagcttaa

SEQ ID NO: 888212 - DNA, 22 bp, Artificial Sequence
  chemically synthesized
gccaaatctgaaataactatct

SEQ ID NO: 888213 - DNA, 22 bp, Artificial Sequence
  chemically synthesized
tagccaaatctgaaataactat

SEQ ID NO: 888214 - DNA, 22 bp, Artificial Sequence
  chemically synthesized
ctagccaaatctgaaataacta

SEQ ID NO: 888215 - DNA, 22 bp, Artificial Sequence
  chemically synthesized
tctagccaaatctgaaataact

SEQ ID NO: 888216 - DNA, 22 bp, Artificial Sequence
  chemically synthesized
agcttccagatagttatttcag

SEQ ID NO: 888217 - DNA, 22 bp, Artificial Sequence
  chemically synthesized
cattttctagccaaatctgaaa

SEQ ID NO: 888218 - DNA, 22 bp, Artificial Sequence
  chemically synthesized
ccagatagttatttcagatttg

SEQ ID NO: 888219 - DNA, 22 bp, Artificial Sequence
  chemically synthesized
cagatagttatttcagatttgg

SEQ ID NO: 888220 - DNA, 22 bp, Artificial Sequence
  chemically synthesized
cattgcattttctagccaaatc

SEQ ID NO: 888221 - DNA, 22 bp, Artificial Sequence
  chemically synthesized
gcattgcattttctagccaaat

SEQ ID NO: 888222 - DNA, 22 bp, Artificial Sequence
  chemically synthesized
tgcattgcattttctagccaaa

SEQ ID NO: 888223 - DNA, 22 bp, Artificial Sequence
  chemically synthesized
tttgcattgcattttctagcca

SEQ ID NO: 888224 - DNA, 22 bp, Artificial Sequence
  chemically synthesized
tctttgcattgcattttctagc

SEQ ID NO: 888225 - DNA, 22 bp, Artificial Sequence
  chemically synthesized
tttcagatttggctagaaaatg

SEQ ID NO: 888226 - DNA, 22 bp, Artificial Sequence
  chemically synthesized
ctctttgcattgcattttctag

SEQ ID NO: 888227 - DNA, 22 bp, Artificial Sequence
  chemically synthesized
cagatttggctagaaaatgcaa

SEQ ID NO: 888228 - DNA, 22 bp, Artificial Sequence
  chemically synthesized
agatttggctagaaaatgcaat

SEQ ID NO: 888229 - DNA, 22 bp, Artificial Sequence
  chemically synthesized
tggcttctctttgcattgcatt

SEQ ID NO: 888230 - DNA, 22 bp, Artificial Sequence
  chemically synthesized
gtggcttctctttgcattgcat

SEQ ID NO: 888231 - DNA, 22 bp, Artificial Sequence
  chemically synthesized
ggctagaaaatgcaatgcaaag

SEQ ID NO: 888232 - DNA, 22 bp, Artificial Sequence
  chemically synthesized
gctagaaaatgcaatgcaaaga

SEQ ID NO: 888233 - DNA, 22 bp, Artificial Sequence
  chemically synthesized
gaaaatgcaatgcaaagagaag

SEQ ID NO: 888234 - DNA, 22 bp, Artificial Sequence
  chemically synthesized
aagaaggtttgtggcttctctt

SEQ ID NO: 888235 - DNA, 22 bp, Artificial Sequence
  chemically synthesized
cctaaagaaggtttgtggcttc

SEQ ID NO: 888236 - DNA, 22 bp, Artificial Sequence
  chemically synthesized
aaaatacattacctaaagaagg

SEQ ID NO: 888237 - DNA, 22 bp, Artificial Sequence
  chemically synthesized
caaaatacattacctaaagaag

SEQ ID NO: 888238 - DNA, 22 bp, Artificial Sequence
  chemically synthesized
tcaaaatacattacctaaagaa

SEQ ID NO: 888239 - DNA, 22 bp, Artificial Sequence
  chemically synthesized
tttcaaaatacattacctaaag

SEQ ID NO: 888240 - DNA, 22 bp, Artificial Sequence
  chemically synthesized
ccattctttcaaaatacattac

SEQ ID NO: 888241 - DNA, 22 bp, Artificial Sequence
  chemically synthesized
actcccattctttcaaaataca

SEQ ID NO: 888242 - DNA, 22 bp, Artificial Sequence
  chemically synthesized
ctttaggtaatgtattttgaaa

SEQ ID NO: 888243 - DNA, 22 bp, Artificial Sequence
  chemically synthesized
tttaggtaatgtattttgaaag

SEQ ID NO: 888244 - DNA, 22 bp, Artificial Sequence
  chemically synthesized
taggtaatgtattttgaaagaa

SEQ ID NO: 888245 - DNA, 22 bp, Artificial Sequence
  chemically synthesized
aggtaatgtattttgaaagaat

SEQ ID NO: 888246 - DNA, 22 bp, Artificial Sequence
  chemically synthesized
ggtaatgtattttgaaagaatg

SEQ ID NO: 888247 - DNA, 22 bp, Artificial Sequence
  chemically synthesized
tgtcaactgactcccattcttt

SEQ ID NO: 888248 - DNA, 22 bp, Artificial Sequence
  chemically synthesized
tgaaagaatgggagtcagttga

SEQ ID NO: 888249 - DNA, 22 bp, Artificial Sequence
  chemically synthesized
gaaagaatgggagtcagttgac

SEQ ID NO: 888250 - DNA, 22 bp, Artificial Sequence
  chemically synthesized
caaagagcctgtgtcaactgac

SEQ ID NO: 888251 - DNA, 22 bp, Artificial Sequence
  chemically synthesized
aaagaatgggagtcagttgaca

SEQ ID NO: 888252 - DNA, 22 bp, Artificial Sequence
  chemically synthesized
gcaaagagcctgtgtcaactga

SEQ ID NO: 888253 - DNA, 22 bp, Artificial Sequence
  chemically synthesized
tgcaaagagcctgtgtcaactg

SEQ ID NO: 888254 - DNA, 22 bp, Artificial Sequence
  chemically synthesized
tctttgcaaagagcctgtgtca

SEQ ID NO: 888255 - DNA, 22 bp, Artificial Sequence
  chemically synthesized
gtctttgcaaagagcctgtgtc

SEQ ID NO: 888256 - DNA, 22 bp, Artificial Sequence
  chemically synthesized
gaacagggtttgtctttgcaaa

SEQ ID NO: 888257 - DNA, 22 bp, Artificial Sequence
  chemically synthesized
acacaggctctttgcaaagaca

SEQ ID NO: 888258 - DNA, 22 bp, Artificial Sequence
  chemically synthesized
atggctagaacagggtttgtct

SEQ ID NO: 888259 - DNA, 22 bp, Artificial Sequence
  chemically synthesized
tttgcaaagacaaaccctgttc

SEQ ID NO: 888260 - DNA, 22 bp, Artificial Sequence
  chemically synthesized
tgcaaagacaaaccctgttcta

SEQ ID NO: 888261 - DNA, 22 bp, Artificial Sequence
  chemically synthesized
gcaaagacaaaccctgttctag

SEQ ID NO: 888262 - DNA, 22 bp, Artificial Sequence
  chemically synthesized
caaagacaaaccctgttctagc

SEQ ID NO: 888263 - DNA, 22 bp, Artificial Sequence
  chemically synthesized
acaatacattgatggctagaac

SEQ ID NO: 888264 - DNA, 22 bp, Artificial Sequence
  chemically synthesized
tctaacaatacattgatggcta

SEQ ID NO: 888265 - DNA, 22 bp, Artificial Sequence
  chemically synthesized
atctaacaatacattgatggct

SEQ ID NO: 888266 - DNA, 22 bp, Artificial Sequence
  chemically synthesized
tttatctaacaatacattgatg

SEQ ID NO: 888267 - DNA, 22 bp, Artificial Sequence
  chemically synthesized
atttatctaacaatacattgat

SEQ ID NO: 888268 - DNA, 22 bp, Artificial Sequence
  chemically synthesized
ttatttatctaacaatacattg

SEQ ID NO: 888269 - DNA, 22 bp, Artificial Sequence
  chemically synthesized
cttatttatctaacaatacatt

SEQ ID NO: 888270 - DNA, 22 bp, Artificial Sequence
  chemically synthesized
ttctagccatcaatgtattgtt

SEQ ID NO: 888271 - DNA, 22 bp, Artificial Sequence
  chemically synthesized
tcttatttatctaacaatacat

SEQ ID NO: 888272 - DNA, 22 bp, Artificial Sequence
  chemically synthesized
tagccatcaatgtattgttaga

SEQ ID NO: 888273 - DNA, 22 bp, Artificial Sequence
  chemically synthesized
attttcttatttatctaacaat

SEQ ID NO: 888274 - DNA, 22 bp, Artificial Sequence
  chemically synthesized
gccatcaatgtattgttagata

SEQ ID NO: 888275 - DNA, 22 bp, Artificial Sequence
  chemically synthesized
cattttcttatttatctaacaa

SEQ ID NO: 888276 - DNA, 22 bp, Artificial Sequence
  chemically synthesized
tcattttcttatttatctaaca

SEQ ID NO: 888277 - DNA, 22 bp, Artificial Sequence
  chemically synthesized
ctttcattttcttatttatcta

SEQ ID NO: 888278 - DNA, 22 bp, Artificial Sequence
  chemically synthesized
gctttcattttcttatttatct

SEQ ID NO: 888279 - DNA, 22 bp, Artificial Sequence
  chemically synthesized
ttagataaataagaaaatgaaa

SEQ ID NO: 888280 - DNA, 22 bp, Artificial Sequence
  chemically synthesized
gataaataagaaaatgaaagca

SEQ ID NO: 888281 - DNA, 22 bp, Artificial Sequence
  chemically synthesized
atatgtaaatatttgctttcat

SEQ ID NO: 888282 - DNA, 22 bp, Artificial Sequence
  chemically synthesized
actaatatgtaaatatttgctt

SEQ ID NO: 888283 - DNA, 22 bp, Artificial Sequence
  chemically synthesized
aactaatatgtaaatatttgct

SEQ ID NO: 888284 - DNA, 22 bp, Artificial Sequence
  chemically synthesized
taactaatatgtaaatatttgc

SEQ ID NO: 888285 - DNA, 22 bp, Artificial Sequence
  chemically synthesized
ttaactaatatgtaaatatttg

SEQ ID NO: 888286 - DNA, 22 bp, Artificial Sequence
  chemically synthesized
aaaaatttttaactaatatgta

SEQ ID NO: 888287 - DNA, 22 bp, Artificial Sequence
  chemically synthesized
aaaaaatttttaactaatatgt

SEQ ID NO: 888288 - DNA, 22 bp, Artificial Sequence
  chemically synthesized
acatattagttaaaaatttttt

SEQ ID NO: 888289 - DNA, 22 bp, Artificial Sequence
  chemically synthesized
catattagttaaaaatttttta

SEQ ID NO: 888290 - DNA, 22 bp, Artificial Sequence
  chemically synthesized
tagcacaagtagagatttaaaa

SEQ ID NO: 888291 - DNA, 22 bp, Artificial Sequence
  chemically synthesized
gttaaaaattttttaaatctct

SEQ ID NO: 888292 - DNA, 22 bp, Artificial Sequence
  chemically synthesized
aaaattttttaaatctctactt

SEQ ID NO: 888293 - DNA, 22 bp, Artificial Sequence
  chemically synthesized
tttaaatctctacttgtgctac

SEQ ID NO: 888294 - DNA, 22 bp, Artificial Sequence
  chemically synthesized
ttaaatctctacttgtgctaca

SEQ ID NO: 888295 - DNA, 22 bp, Artificial Sequence
  chemically synthesized
taaatctctacttgtgctacaa

SEQ ID NO: 888296 - DNA, 22 bp, Artificial Sequence
  chemically synthesized
aaatctctacttgtgctacaat

SEQ ID NO: 888297 - DNA, 22 bp, Artificial Sequence
  chemically synthesized
aatctctacttgtgctacaatt

SEQ ID NO: 888298 - DNA, 22 bp, Artificial Sequence
  chemically synthesized
aacatgatgacaaattgtagca

SEQ ID NO: 888299 - DNA, 22 bp, Artificial Sequence
  chemically synthesized
tacttgtgctacaatttgtcat

SEQ ID NO: 888300 - DNA, 22 bp, Artificial Sequence
  chemically synthesized
cttgtgctacaatttgtcatca

SEQ ID NO: 888301 - DNA, 22 bp, Artificial Sequence
  chemically synthesized
gtgctacaatttgtcatcatgt

SEQ ID NO: 888302 - DNA, 22 bp, Artificial Sequence
  chemically synthesized
gacagaagttcaacatgatgac

SEQ ID NO: 888303 - DNA, 22 bp, Artificial Sequence
  chemically synthesized
tgctacaatttgtcatcatgtt

SEQ ID NO: 888304 - DNA, 22 bp, Artificial Sequence
  chemically synthesized
caatttgtcatcatgttgaact

SEQ ID NO: 888305 - DNA, 22 bp, Artificial Sequence
  chemically synthesized
gtcatcatgttgaacttctgtc

SEQ ID NO: 888306 - DNA, 22 bp, Artificial Sequence
  chemically synthesized
tcatcatgttgaacttctgtcc

SEQ ID NO: 888307 - DNA, 22 bp, Artificial Sequence
  chemically synthesized
gccatcaatcctggacagaagt

SEQ ID NO: 888308 - DNA, 22 bp, Artificial Sequence
  chemically synthesized
agccatcaatcctggacagaag

SEQ ID NO: 888309 - DNA, 22 bp, Artificial Sequence
  chemically synthesized
ttagccatcaatcctggacaga

SEQ ID NO: 888310 - DNA, 22 bp, Artificial Sequence
  chemically synthesized
cttagccatcaatcctggacag

SEQ ID NO: 888311 - DNA, 22 bp, Artificial Sequence
  chemically synthesized
ttcttagccatcaatcctggac

SEQ ID NO: 888312 - DNA, 22 bp, Artificial Sequence
  chemically synthesized
ctcttcttagccatcaatcctg

SEQ ID NO: 888313 - DNA, 22 bp, Artificial Sequence
  chemically synthesized
gctcttcttagccatcaatcct

SEQ ID NO: 888314 - DNA, 22 bp, Artificial Sequence
  chemically synthesized
aacttctgtccaggattgatgg

SEQ ID NO: 888315 - DNA, 22 bp, Artificial Sequence
  chemically synthesized
tgctcttcttagccatcaatcc

SEQ ID NO: 888316 - DNA, 22 bp, Artificial Sequence
  chemically synthesized
ctgtccaggattgatggctaag

SEQ ID NO: 888317 - DNA, 22 bp, Artificial Sequence
  chemically synthesized
tgtccaggattgatggctaaga

SEQ ID NO: 888318 - DNA, 22 bp, Artificial Sequence
  chemically synthesized
tccaggattgatggctaagaag

SEQ ID NO: 888319 - DNA, 22 bp, Artificial Sequence
  chemically synthesized
cataggaatggtctttgctctt

SEQ ID NO: 888320 - DNA, 22 bp, Artificial Sequence
  chemically synthesized
atggctaagaagagcaaagacc

SEQ ID NO: 888321 - DNA, 22 bp, Artificial Sequence
  chemically synthesized
aattgcataggaatggtctttg

SEQ ID NO: 888322 - DNA, 22 bp, Artificial Sequence
  chemically synthesized
gaattgcataggaatggtcttt

SEQ ID NO: 888323 - DNA, 22 bp, Artificial Sequence
  chemically synthesized
tgaattgcataggaatggtctt

SEQ ID NO: 888324 - DNA, 22 bp, Artificial Sequence
  chemically synthesized
agaagagcaaagaccattccta

SEQ ID NO: 888325 - DNA, 22 bp, Artificial Sequence
  chemically synthesized
acctttgaattgcataggaatg

SEQ ID NO: 888326 - DNA, 22 bp, Artificial Sequence
  chemically synthesized
aaaacatcaaaactaacctttg

SEQ ID NO: 888327 - DNA, 22 bp, Artificial Sequence
  chemically synthesized
ctatgcaattcaaaggttagtt

SEQ ID NO: 888328 - DNA, 22 bp, Artificial Sequence
  chemically synthesized
tgcaattcaaaggttagttttg

SEQ ID NO: 888329 - DNA, 22 bp, Artificial Sequence
  chemically synthesized
taacctgaaaacatcaaaacta

SEQ ID NO: 888330 - DNA, 22 bp, Artificial Sequence
  chemically synthesized
aaaggttagttttgatgttttc

SEQ ID NO: 888331 - DNA, 22 bp, Artificial Sequence
  chemically synthesized
aggttataacctgaaaacatca

SEQ ID NO: 888332 - DNA, 22 bp, Artificial Sequence
  chemically synthesized
aaggttataacctgaaaacatc

SEQ ID NO: 888333 - DNA, 22 bp, Artificial Sequence
  chemically synthesized
gtcttaaggttataacctgaaa

SEQ ID NO: 888334 - DNA, 22 bp, Artificial Sequence
  chemically synthesized
gttttgatgttttcaggttata

SEQ ID NO: 888335 - DNA, 22 bp, Artificial Sequence
  chemically synthesized
tagtcttaaggttataacctga

SEQ ID NO: 888336 - DNA, 22 bp, Artificial Sequence
  chemically synthesized
tgatgttttcaggttataacct

SEQ ID NO: 888337 - DNA, 22 bp, Artificial Sequence
  chemically synthesized
gatgttttcaggttataacctt

SEQ ID NO: 888338 - DNA, 22 bp, Artificial Sequence
  chemically synthesized
atgttttcaggttataacctta

SEQ ID NO: 888339 - DNA, 22 bp, Artificial Sequence
  chemically synthesized
tcaggttataaccttaagacta

SEQ ID NO: 888340 - DNA, 22 bp, Artificial Sequence
  chemically synthesized
caggttataaccttaagactag

SEQ ID NO: 888341 - DNA, 22 bp, Artificial Sequence
  chemically synthesized
aggttataaccttaagactaga

SEQ ID NO: 888342 - DNA, 22 bp, Artificial Sequence
  chemically synthesized
caacagacagattctagtctta

SEQ ID NO: 888343 - DNA, 22 bp, Artificial Sequence
  chemically synthesized
tacaacagacagattctagtct

SEQ ID NO: 888344 - DNA, 22 bp, Artificial Sequence
  chemically synthesized
ctacaacagacagattctagtc

SEQ ID NO: 888345 - DNA, 22 bp, Artificial Sequence
  chemically synthesized
tctacaacagacagattctagt

SEQ ID NO: 888346 - DNA, 22 bp, Artificial Sequence
  chemically synthesized
taaccttaagactagaatctgt

SEQ ID NO: 888347 - DNA, 22 bp, Artificial Sequence
  chemically synthesized
aagactagaatctgtctgttgt

SEQ ID NO: 888348 - DNA, 22 bp, Artificial Sequence
  chemically synthesized
agactagaatctgtctgttgta

SEQ ID NO: 888349 - DNA, 22 bp, Artificial Sequence
  chemically synthesized
atgaatgttttctacaacagac

SEQ ID NO: 888350 - DNA, 22 bp, Artificial Sequence
  chemically synthesized
aatgaatgttttctacaacaga

SEQ ID NO: 888351 - DNA, 22 bp, Artificial Sequence
  chemically synthesized
taatgaatgttttctacaacag

SEQ ID NO: 888352 - DNA, 22 bp, Artificial Sequence
  chemically synthesized
gaatctgtctgttgtagaaaac

SEQ ID NO: 888353 - DNA, 22 bp, Artificial Sequence
  chemically synthesized
tctgttgtagaaaacattcatt

SEQ ID NO: 888354 - DNA, 22 bp, Artificial Sequence
  chemically synthesized
tgataaaggttttaatgaatgt

SEQ ID NO: 888355 - DNA, 22 bp, Artificial Sequence
  chemically synthesized
tatgataaaggttttaatgaat

SEQ ID NO: 888356 - DNA, 22 bp, Artificial Sequence
  chemically synthesized
ttgtagaaaacattcattaaaa

SEQ ID NO: 888357 - DNA, 22 bp, Artificial Sequence
  chemically synthesized
ctatgataaaggttttaatgaa

SEQ ID NO: 888358 - DNA, 22 bp, Artificial Sequence
  chemically synthesized
tctatgataaaggttttaatga

SEQ ID NO: 888359 - DNA, 22 bp, Artificial Sequence
  chemically synthesized
tagaaaacattcattaaaacct

SEQ ID NO: 888360 - DNA, 22 bp, Artificial Sequence
  chemically synthesized
attaaaacctttatcatagaaa

SEQ ID NO: 888361 - DNA, 22 bp, Artificial Sequence
  chemically synthesized
aagtaaaaacatggttttctat

SEQ ID NO: 888362 - DNA, 22 bp, Artificial Sequence
  chemically synthesized
aaacctttatcatagaaaacca

SEQ ID NO: 888363 - DNA, 22 bp, Artificial Sequence
  chemically synthesized
gaagtaaaaacatggttttcta

SEQ ID NO: 888364 - DNA, 22 bp, Artificial Sequence
  chemically synthesized
caacttgaagtaaaaacatggt

SEQ ID NO: 888365 - DNA, 22 bp, Artificial Sequence
  chemically synthesized
tatcatagaaaaccatgttttt

SEQ ID NO: 888366 - DNA, 22 bp, Artificial Sequence
  chemically synthesized
acaacttgaagtaaaaacatgg

SEQ ID NO: 888367 - DNA, 22 bp, Artificial Sequence
  chemically synthesized
atcatagaaaaccatgttttta

SEQ ID NO: 888368 - DNA, 22 bp, Artificial Sequence
  chemically synthesized
tcatagaaaaccatgtttttac

SEQ ID NO: 888369 - DNA, 22 bp, Artificial Sequence
  chemically synthesized
aggcaaatatagtttacaactt

SEQ ID NO: 888370 - DNA, 22 bp, Artificial Sequence
  chemically synthesized
ctaaggcaaatatagtttacaa

SEQ ID NO: 888371 - DNA, 22 bp, Artificial Sequence
  chemically synthesized
actaaggcaaatatagtttaca

SEQ ID NO: 888372 - DNA, 22 bp, Artificial Sequence
  chemically synthesized
ttacttcaagttgtaaactata

SEQ ID NO: 888373 - DNA, 22 bp, Artificial Sequence
  chemically synthesized
tacttcaagttgtaaactatat

SEQ ID NO: 888374 - DNA, 22 bp, Artificial Sequence
  chemically synthesized
ttactaaggcaaatatagttta

SEQ ID NO: 888375 - DNA, 22 bp, Artificial Sequence
  chemically synthesized
acttcaagttgtaaactatatt

SEQ ID NO: 888376 - DNA, 22 bp, Artificial Sequence
  chemically synthesized
cttactaaggcaaatatagttt

SEQ ID NO: 888377 - DNA, 22 bp, Artificial Sequence
  chemically synthesized
cttcaagttgtaaactatattt

SEQ ID NO: 888378 - DNA, 22 bp, Artificial Sequence
  chemically synthesized
tcttactaaggcaaatatagtt

SEQ ID NO: 888379 - DNA, 22 bp, Artificial Sequence
  chemically synthesized
tttcttactaaggcaaatatag

SEQ ID NO: 888380 - DNA, 22 bp, Artificial Sequence
  chemically synthesized
caagttgtaaactatatttgcc

SEQ ID NO: 888381 - DNA, 22 bp, Artificial Sequence
  chemically synthesized
aagttgtaaactatatttgcct

SEQ ID NO: 888382 - DNA, 22 bp, Artificial Sequence
  chemically synthesized
gtctctttcttactaaggcaaa

SEQ ID NO: 888383 - DNA, 22 bp, Artificial Sequence
  chemically synthesized
taaactatatttgccttagtaa

SEQ ID NO: 888384 - DNA, 22 bp, Artificial Sequence
  chemically synthesized
ttggtctctttcttactaaggc

SEQ ID NO: 888385 - DNA, 22 bp, Artificial Sequence
  chemically synthesized
ggttattggtctctttcttact

SEQ ID NO: 888386 - DNA, 22 bp, Artificial Sequence
  chemically synthesized
gggttattggtctctttcttac

SEQ ID NO: 888387 - DNA, 22 bp, Artificial Sequence
  chemically synthesized
tatttgccttagtaagaaagag

SEQ ID NO: 888388 - DNA, 22 bp, Artificial Sequence
  chemically synthesized
tgggttattggtctctttctta

SEQ ID NO: 888389 - DNA, 22 bp, Artificial Sequence
  chemically synthesized
ttgggttattggtctctttctt

SEQ ID NO: 888390 - DNA, 22 bp, Artificial Sequence
  chemically synthesized
ttttgggttattggtctctttc

SEQ ID NO: 888391 - DNA, 22 bp, Artificial Sequence
  chemically synthesized
gccttagtaagaaagagaccaa

SEQ ID NO: 888392 - DNA, 22 bp, Artificial Sequence
  chemically synthesized
tcttttgggttattggtctctt

SEQ ID NO: 888393 - DNA, 22 bp, Artificial Sequence
  chemically synthesized
ccttagtaagaaagagaccaat

SEQ ID NO: 888394 - DNA, 22 bp, Artificial Sequence
  chemically synthesized
agtaagaaagagaccaataacc

SEQ ID NO: 888395 - DNA, 22 bp, Artificial Sequence
  chemically synthesized
gtaagaaagagaccaataaccc

SEQ ID NO: 888396 - DNA, 22 bp, Artificial Sequence
  chemically synthesized
ccaatgttctcttttgggttat

SEQ ID NO: 888397 - DNA, 22 bp, Artificial Sequence
  chemically synthesized
gccaatgttctcttttgggtta

SEQ ID NO: 888398 - DNA, 22 bp, Artificial Sequence
  chemically synthesized
tgccaatgttctcttttgggtt

SEQ ID NO: 888399 - DNA, 22 bp, Artificial Sequence
  chemically synthesized
ttgccaatgttctcttttgggt

SEQ ID NO: 888400 - DNA, 22 bp, Artificial Sequence
  chemically synthesized
tttgccaatgttctcttttggg

SEQ ID NO: 888401 - DNA, 22 bp, Artificial Sequence
  chemically synthesized
ttttttgccaatgttctctttt

SEQ ID NO: 888402 - DNA, 22 bp, Artificial Sequence
  chemically synthesized
gttttttgccaatgttctcttt

SEQ ID NO: 888403 - DNA, 22 bp, Artificial Sequence
  chemically synthesized
tgttttttgccaatgttctctt

SEQ ID NO: 888404 - DNA, 22 bp, Artificial Sequence
  chemically synthesized
ttgttttttgccaatgttctct

SEQ ID NO: 888405 - DNA, 22 bp, Artificial Sequence
  chemically synthesized
tttgttttttgccaatgttctc

SEQ ID NO: 888406 - DNA, 22 bp, Artificial Sequence
  chemically synthesized
ttttgttttttgccaatgttct

SEQ ID NO: 888407 - DNA, 22 bp, Artificial Sequence
  chemically synthesized
cttttttgttttttgccaatgt

SEQ ID NO: 888408 - DNA, 22 bp, Artificial Sequence
  chemically synthesized
ctacttttttgttttttgccaa

SEQ ID NO: 888409 - DNA, 22 bp, Artificial Sequence
  chemically synthesized
gctacttttttgttttttgcca

SEQ ID NO: 888410 - DNA, 22 bp, Artificial Sequence
  chemically synthesized
tttgctacttttttgttttttg

SEQ ID NO: 888411 - DNA, 22 bp, Artificial Sequence
  chemically synthesized
tgcactgtttgctacttttttg

SEQ ID NO: 888412 - DNA, 22 bp, Artificial Sequence
  chemically synthesized
tatgcactgtttgctacttttt

SEQ ID NO: 888413 - DNA, 22 bp, Artificial Sequence
  chemically synthesized
ctatgcactgtttgctactttt

SEQ ID NO: 888414 - DNA, 22 bp, Artificial Sequence
  chemically synthesized
gcaaaaaacaaaaaagtagcaa

SEQ ID NO: 888415 - DNA, 22 bp, Artificial Sequence
  chemically synthesized
tctatgcactgtttgctacttt

SEQ ID NO: 888416 - DNA, 22 bp, Artificial Sequence
  chemically synthesized
ttctatgcactgtttgctactt

SEQ ID NO: 888417 - DNA, 22 bp, Artificial Sequence
  chemically synthesized
cttttctatgcactgtttgcta

SEQ ID NO: 888418 - DNA, 22 bp, Artificial Sequence
  chemically synthesized
ccttttctatgcactgtttgct

SEQ ID NO: 888419 - DNA, 22 bp, Artificial Sequence
  chemically synthesized
tttccttttctatgcactgttt

SEQ ID NO: 888420 - DNA, 22 bp, Artificial Sequence
  chemically synthesized
atttccttttctatgcactgtt

SEQ ID NO: 888421 - DNA, 22 bp, Artificial Sequence
  chemically synthesized
tatttccttttctatgcactgt

SEQ ID NO: 888422 - DNA, 22 bp, Artificial Sequence
  chemically synthesized
ttatttccttttctatgcactg

SEQ ID NO: 888423 - DNA, 22 bp, Artificial Sequence
  chemically synthesized
cagaatcatttttatttccttt

SEQ ID NO: 888424 - DNA, 22 bp, Artificial Sequence
  chemically synthesized
atgtgttgcagaatcattttta

SEQ ID NO: 888425 - DNA, 22 bp, Artificial Sequence
  chemically synthesized
catgtgttgcagaatcattttt

SEQ ID NO: 888426 - DNA, 22 bp, Artificial Sequence
  chemically synthesized
tcatgtgttgcagaatcatttt

SEQ ID NO: 888427 - DNA, 22 bp, Artificial Sequence
  chemically synthesized
ttcatgtgttgcagaatcattt

SEQ ID NO: 888428 - DNA, 22 bp, Artificial Sequence
  chemically synthesized
tttcatgtgttgcagaatcatt

SEQ ID NO: 888429 - DNA, 22 bp, Artificial Sequence
  chemically synthesized
aattttttcatgtgttgcagaa

SEQ ID NO: 888430 - DNA, 22 bp, Artificial Sequence
  chemically synthesized
gaattttttcatgtgttgcaga

SEQ ID NO: 888431 - DNA, 22 bp, Artificial Sequence
  chemically synthesized
tgagtgaatttgaattttttca

SEQ ID NO: 888432 - DNA, 22 bp, Artificial Sequence
  chemically synthesized
gtgagtgaatttgaattttttc

SEQ ID NO: 888433 - DNA, 22 bp, Artificial Sequence
  chemically synthesized
tgtgagtgaatttgaatttttt

SEQ ID NO: 888434 - DNA, 22 bp, Artificial Sequence
  chemically synthesized
tgcaacacatgaaaaaattcaa

SEQ ID NO: 888435 - DNA, 22 bp, Artificial Sequence
  chemically synthesized
caacacatgaaaaaattcaaat

SEQ ID NO: 888436 - DNA, 22 bp, Artificial Sequence
  chemically synthesized
attttgtgagtgaatttgaatt

SEQ ID NO: 888437 - DNA, 22 bp, Artificial Sequence
  chemically synthesized
ttcattttgtgagtgaatttga

SEQ ID NO: 888438 - DNA, 22 bp, Artificial Sequence
  chemically synthesized
attcattttgtgagtgaatttg

SEQ ID NO: 888439 - DNA, 22 bp, Artificial Sequence
  chemically synthesized
tattcattttgtgagtgaattt

SEQ ID NO: 888440 - DNA, 22 bp, Artificial Sequence
  chemically synthesized
tttattcattttgtgagtgaat

SEQ ID NO: 888441 - DNA, 22 bp, Artificial Sequence
  chemically synthesized
aattctttattcattttgtgag

SEQ ID NO: 888442 - DNA, 22 bp, Artificial Sequence
  chemically synthesized
gaattctttattcattttgtga

SEQ ID NO: 888443 - DNA, 22 bp, Artificial Sequence
  chemically synthesized
aaattcactcacaaaatgaata

SEQ ID NO: 888444 - DNA, 22 bp, Artificial Sequence
  chemically synthesized
atttgaattctttattcatttt

SEQ ID NO: 888445 - DNA, 22 bp, Artificial Sequence
  chemically synthesized
aatttgaattctttattcattt

SEQ ID NO: 888446 - DNA, 22 bp, Artificial Sequence
  chemically synthesized
taatttgaattctttattcatt

SEQ ID NO: 888447 - DNA, 22 bp, Artificial Sequence
  chemically synthesized
actcacaaaatgaataaagaat

SEQ ID NO: 888448 - DNA, 22 bp, Artificial Sequence
  chemically synthesized
tcattttaatttgaattcttta

SEQ ID NO: 888449 - DNA, 22 bp, Artificial Sequence
  chemically synthesized
acaaaatgaataaagaattcaa

SEQ ID NO: 888450 - DNA, 22 bp, Artificial Sequence
  chemically synthesized
aaattaaaatgacagatatcac

SEQ ID NO: 888451 - DNA, 22 bp, Artificial Sequence
  chemically synthesized
aacaagaaaaatggtgatatct

SEQ ID NO: 888452 - DNA, 22 bp, Artificial Sequence
  chemically synthesized
taaacaagaaaaatggtgatat

SEQ ID NO: 888453 - DNA, 22 bp, Artificial Sequence
  chemically synthesized
ctaaacaagaaaaatggtgata

SEQ ID NO: 888454 - DNA, 22 bp, Artificial Sequence
  chemically synthesized
aaatgacagatatcaccatttt

SEQ ID NO: 888455 - DNA, 22 bp, Artificial Sequence
  chemically synthesized
atcttctaaacaagaaaaatgg

SEQ ID NO: 888456 - DNA, 22 bp, Artificial Sequence
  chemically synthesized
gatcttctaaacaagaaaaatg

SEQ ID NO: 888457 - DNA, 22 bp, Artificial Sequence
  chemically synthesized
tgatcttctaaacaagaaaaat

SEQ ID NO: 888458 - DNA, 22 bp, Artificial Sequence
  chemically synthesized
ttgatcttctaaacaagaaaaa

SEQ ID NO: 888459 - DNA, 22 bp, Artificial Sequence
  chemically synthesized
tttgatcttctaaacaagaaaa

SEQ ID NO: 888460 - DNA, 22 bp, Artificial Sequence
  chemically synthesized
tcaacctttttgatcttctaaa

SEQ ID NO: 888461 - DNA, 22 bp, Artificial Sequence
  chemically synthesized
ttcttgtttagaagatcaaaaa

SEQ ID NO: 888462 - DNA, 22 bp, Artificial Sequence
  chemically synthesized
tcttgtttagaagatcaaaaag

SEQ ID NO: 888463 - DNA, 22 bp, Artificial Sequence
  chemically synthesized
cttgtttagaagatcaaaaagg

SEQ ID NO: 888464 - DNA, 22 bp, Artificial Sequence
  chemically synthesized
ttgtttagaagatcaaaaaggt

SEQ ID NO: 888465 - DNA, 22 bp, Artificial Sequence
  chemically synthesized
agtgtgttatcaacctttttga

SEQ ID NO: 888466 - DNA, 22 bp, Artificial Sequence
  chemically synthesized
gtttagaagatcaaaaaggttg

SEQ ID NO: 888467 - DNA, 22 bp, Artificial Sequence
  chemically synthesized
tttagaagatcaaaaaggttga

SEQ ID NO: 888468 - DNA, 22 bp, Artificial Sequence
  chemically synthesized
agaagatcaaaaaggttgataa

SEQ ID NO: 888469 - DNA, 22 bp, Artificial Sequence
  chemically synthesized
gaagatcaaaaaggttgataac

SEQ ID NO: 888470 - DNA, 22 bp, Artificial Sequence
  chemically synthesized
cccatacccgtgcccactcagt

SEQ ID NO: 888471 - DNA, 22 bp, Artificial Sequence
  chemically synthesized
ccccatacccgtgcccactcag

SEQ ID NO: 888472 - DNA, 22 bp, Artificial Sequence
  chemically synthesized
tccccatacccgtgcccactca

SEQ ID NO: 888473 - DNA, 22 bp, Artificial Sequence
  chemically synthesized
ttccccatacccgtgcccactc

SEQ ID NO: 888474 - DNA, 22 bp, Artificial Sequence
  chemically synthesized
ataacacactgagtgggcacgg

SEQ ID NO: 888475 - DNA, 22 bp, Artificial Sequence
  chemically synthesized
ttttccccatacccgtgcccac

SEQ ID NO: 888476 - DNA, 22 bp, Artificial Sequence
  chemically synthesized
cttttccccatacccgtgccca

SEQ ID NO: 888477 - DNA, 22 bp, Artificial Sequence
  chemically synthesized
agtgggcacgggtatggggaaa

SEQ ID NO: 888478 - DNA, 22 bp, Artificial Sequence
  chemically synthesized
ggaaaggtttcttttccccata

SEQ ID NO: 888479 - DNA, 22 bp, Artificial Sequence
  chemically synthesized
gtcagtattaggaaaggtttct

SEQ ID NO: 888480 - DNA, 22 bp, Artificial Sequence
  chemically synthesized
atagaacatctcgtcagtatta

SEQ ID NO: 888481 - DNA, 22 bp, Artificial Sequence
  chemically synthesized
catagaacatctcgtcagtatt

SEQ ID NO: 888482 - DNA, 22 bp, Artificial Sequence
  chemically synthesized
ttcatagaacatctcgtcagta

SEQ ID NO: 888483 - DNA, 22 bp, Artificial Sequence
  chemically synthesized
ctcttcatagaacatctcgtca

SEQ ID NO: 888484 - DNA, 22 bp, Artificial Sequence
  chemically synthesized
tcctaatactgacgagatgttc

SEQ ID NO: 888485 - DNA, 22 bp, Artificial Sequence
  chemically synthesized
cctaatactgacgagatgttct

SEQ ID NO: 888486 - DNA, 22 bp, Artificial Sequence
  chemically synthesized
ctaatactgacgagatgttcta

SEQ ID NO: 888487 - DNA, 22 bp, Artificial Sequence
  chemically synthesized
atactgacgagatgttctatga

SEQ ID NO: 888488 - DNA, 22 bp, Artificial Sequence
  chemically synthesized
ccaaattgctcttcatagaaca

SEQ ID NO: 888489 - DNA, 22 bp, Artificial Sequence
  chemically synthesized
gccaaattgctcttcatagaac

SEQ ID NO: 888490 - DNA, 22 bp, Artificial Sequence
  chemically synthesized
tgccaaattgctcttcatagaa

SEQ ID NO: 888491 - DNA, 22 bp, Artificial Sequence
  chemically synthesized
acgagatgttctatgaagagca

SEQ ID NO: 888492 - DNA, 22 bp, Artificial Sequence
  chemically synthesized
gtacattttgccaaattgctct

SEQ ID NO: 888493 - DNA, 22 bp, Artificial Sequence
  chemically synthesized
ttagtacattttgccaaattgc

SEQ ID NO: 888494 - DNA, 22 bp, Artificial Sequence
  chemically synthesized
gttagtacattttgccaaattg

SEQ ID NO: 888495 - DNA, 22 bp, Artificial Sequence
  chemically synthesized
tatgaagagcaatttggcaaaa

SEQ ID NO: 888496 - DNA, 22 bp, Artificial Sequence
  chemically synthesized
tcttgttagtacattttgccaa

SEQ ID NO: 888497 - DNA, 22 bp, Artificial Sequence
  chemically synthesized
tgaagagcaatttggcaaaatg

SEQ ID NO: 888498 - DNA, 22 bp, Artificial Sequence
  chemically synthesized
gtcttgttagtacattttgcca

SEQ ID NO: 888499 - DNA, 22 bp, Artificial Sequence
  chemically synthesized
gcatttgtcttgttagtacatt

SEQ ID NO: 888500 - DNA, 22 bp, Artificial Sequence
  chemically synthesized
ggcaaaatgtactaacaagaca

SEQ ID NO: 888501 - DNA, 22 bp, Artificial Sequence
  chemically synthesized
gcaaaatgtactaacaagacaa

SEQ ID NO: 888502 - DNA, 22 bp, Artificial Sequence
  chemically synthesized
cgtcaaactggcatttgtcttg

SEQ ID NO: 888503 - DNA, 22 bp, Artificial Sequence
  chemically synthesized
acaagacaaatgccagtttgac

SEQ ID NO: 888504 - DNA, 22 bp, Artificial Sequence
  chemically synthesized
gccgtcgaatggctgcgtcaaa

SEQ ID NO: 888505 - DNA, 22 bp, Artificial Sequence
  chemically synthesized
ctagccgtcgaatggctgcgtc

SEQ ID NO: 888506 - DNA, 22 bp, Artificial Sequence
  chemically synthesized
gacgcagccattcgacggctag

SEQ ID NO: 888507 - DNA, 22 bp, Artificial Sequence
  chemically synthesized
tgtgataaattcctagccgtcg

SEQ ID NO: 888508 - DNA, 22 bp, Artificial Sequence
  chemically synthesized
acgcagccattcgacggctagg

SEQ ID NO: 888509 - DNA, 22 bp, Artificial Sequence
  chemically synthesized
caaatatatctatgtgataaat

SEQ ID NO: 888510 - DNA, 22 bp, Artificial Sequence
  chemically synthesized
gacggctaggaatttatcacat

SEQ ID NO: 888511 - DNA, 22 bp, Artificial Sequence
  chemically synthesized
cacgttgcaaatatatctatgt

SEQ ID NO: 888512 - DNA, 22 bp, Artificial Sequence
  chemically synthesized
acacgttgcaaatatatctatg

SEQ ID NO: 888513 - DNA, 22 bp, Artificial Sequence
  chemically synthesized
ggaatttatcacatagatatat

SEQ ID NO: 888514 - DNA, 22 bp, Artificial Sequence
  chemically synthesized
tacacgttgcaaatatatctat

SEQ ID NO: 888515 - DNA, 22 bp, Artificial Sequence
  chemically synthesized
atcacatagatatatttgcaac

SEQ ID NO: 888516 - DNA, 22 bp, Artificial Sequence
  chemically synthesized
tcacatagatatatttgcaacg

SEQ ID NO: 888517 - DNA, 22 bp, Artificial Sequence
  chemically synthesized
tgcacatcattttacacgttgc

SEQ ID NO: 888518 - DNA, 22 bp, Artificial Sequence
  chemically synthesized
gtgcacatcattttacacgttg

SEQ ID NO: 888519 - DNA, 22 bp, Artificial Sequence
  chemically synthesized
tgtgcacatcattttacacgtt

SEQ ID NO: 888520 - DNA, 22 bp, Artificial Sequence
  chemically synthesized
gcaacgtgtaaaatgatgtgca

SEQ ID NO: 888521 - DNA, 22 bp, Artificial Sequence
  chemically synthesized
caacgtgtaaaatgatgtgcac

SEQ ID NO: 888522 - DNA, 22 bp, Artificial Sequence
  chemically synthesized
agataagaaaatgtataacttt

SEQ ID NO: 888523 - DNA, 22 bp, Artificial Sequence
  chemically synthesized
gctaagataagaaaatgtataa

SEQ ID NO: 888524 - DNA, 22 bp, Artificial Sequence
  chemically synthesized
ggctaagataagaaaatgtata

SEQ ID NO: 888525 - DNA, 22 bp, Artificial Sequence
  chemically synthesized
tggctaagataagaaaatgtat

SEQ ID NO: 888526 - DNA, 22 bp, Artificial Sequence
  chemically synthesized
ttggctaagataagaaaatgta

SEQ ID NO: 888527 - DNA, 22 bp, Artificial Sequence
  chemically synthesized
gacttttggctaagataagaaa

SEQ ID NO: 888528 - DNA, 22 bp, Artificial Sequence
  chemically synthesized
cgacttttggctaagataagaa

SEQ ID NO: 888529 - DNA, 22 bp, Artificial Sequence
  chemically synthesized
tttcgacttttggctaagataa

SEQ ID NO: 888530 - DNA, 22 bp, Artificial Sequence
  chemically synthesized
gtttcgacttttggctaagata

SEQ ID NO: 888531 - DNA, 22 bp, Artificial Sequence
  chemically synthesized
tacattttcttatcttagccaa

SEQ ID NO: 888532 - DNA, 22 bp, Artificial Sequence
  chemically synthesized
gtttgtttcgacttttggctaa

SEQ ID NO: 888533 - DNA, 22 bp, Artificial Sequence
  chemically synthesized
agtttgtttcgacttttggcta

SEQ ID NO: 888534 - DNA, 22 bp, Artificial Sequence
  chemically synthesized
tagtttgtttcgacttttggct

SEQ ID NO: 888535 - DNA, 22 bp, Artificial Sequence
  chemically synthesized
tcttatcttagccaaaagtcga

SEQ ID NO: 888536 - DNA, 22 bp, Artificial Sequence
  chemically synthesized
cttatcttagccaaaagtcgaa

SEQ ID NO: 888537 - DNA, 22 bp, Artificial Sequence
  chemically synthesized
ttatcttagccaaaagtcgaaa

SEQ ID NO: 888538 - DNA, 22 bp, Artificial Sequence
  chemically synthesized
atcttagccaaaagtcgaaaca

SEQ ID NO: 888539 - DNA, 22 bp, Artificial Sequence
  chemically synthesized
tcttagccaaaagtcgaaacaa

SEQ ID NO: 888540 - DNA, 22 bp, Artificial Sequence
  chemically synthesized
gtgagcctttagtttgtttcga

SEQ ID NO: 888541 - DNA, 22 bp, Artificial Sequence
  chemically synthesized
agccaaaagtcgaaacaaacta

SEQ ID NO: 888542 - DNA, 22 bp, Artificial Sequence
  chemically synthesized
gccaaaagtcgaaacaaactaa

SEQ ID NO: 888543 - DNA, 22 bp, Artificial Sequence
  chemically synthesized
caattagtgagcctttagtttg

SEQ ID NO: 888544 - DNA, 22 bp, Artificial Sequence
  chemically synthesized
agcagcactccaattagtgagc

SEQ ID NO: 888545 - DNA, 22 bp, Artificial Sequence
  chemically synthesized
aagcagcactccaattagtgag

SEQ ID NO: 888546 - DNA, 22 bp, Artificial Sequence
  chemically synthesized
acttaagcagcactccaattag

SEQ ID NO: 888547 - DNA, 22 bp, Artificial Sequence
  chemically synthesized
aaggctcactaattggagtgct

SEQ ID NO: 888548 - DNA, 22 bp, Artificial Sequence
  chemically synthesized
actaattggagtgctgcttaag

SEQ ID NO: 888549 - DNA, 22 bp, Artificial Sequence
  chemically synthesized
attggagtgctgcttaagtgaa

SEQ ID NO: 888550 - DNA, 22 bp, Artificial Sequence
  chemically synthesized
aggatataccataattcactta

SEQ ID NO: 888551 - DNA, 22 bp, Artificial Sequence
  chemically synthesized
gagtgctgcttaagtgaattat

SEQ ID NO: 888552 - DNA, 22 bp, Artificial Sequence
  chemically synthesized
taaggatataccataattcact

SEQ ID NO: 888553 - DNA, 22 bp, Artificial Sequence
  chemically synthesized
ttctaaggatataccataattc

SEQ ID NO: 888554 - DNA, 22 bp, Artificial Sequence
  chemically synthesized
tgttctaaggatataccataat

SEQ ID NO: 888555 - DNA, 22 bp, Artificial Sequence
  chemically synthesized
cttaagtgaattatggtatatc

SEQ ID NO: 888556 - DNA, 22 bp, Artificial Sequence
  chemically synthesized
ttctgttctaaggatataccat

SEQ ID NO: 888557 - DNA, 22 bp, Artificial Sequence
  chemically synthesized
aagtgaattatggtatatcctt

SEQ ID NO: 888558 - DNA, 22 bp, Artificial Sequence
  chemically synthesized
agtgaattatggtatatcctta

SEQ ID NO: 888559 - DNA, 22 bp, Artificial Sequence
  chemically synthesized
catactattctgttctaaggat

SEQ ID NO: 888560 - DNA, 22 bp, Artificial Sequence
  chemically synthesized
tggtatatccttagaacagaat

SEQ ID NO: 888561 - DNA, 22 bp, Artificial Sequence
  chemically synthesized
cagttgcatactattctgttct

SEQ ID NO: 888562 - DNA, 22 bp, Artificial Sequence
  chemically synthesized
acagttgcatactattctgttc

SEQ ID NO: 888563 - DNA, 22 bp, Artificial Sequence
  chemically synthesized
tacagttgcatactattctgtt

SEQ ID NO: 888564 - DNA, 22 bp, Artificial Sequence
  chemically synthesized
ttacagttgcatactattctgt

SEQ ID NO: 888565 - DNA, 22 bp, Artificial Sequence
  chemically synthesized
tttacagttgcatactattctg

SEQ ID NO: 888566 - DNA, 22 bp, Artificial Sequence
  chemically synthesized
ttttacagttgcatactattct

SEQ ID NO: 888567 - DNA, 22 bp, Artificial Sequence
  chemically synthesized
tttttacagttgcatactattc

SEQ ID NO: 888568 - DNA, 22 bp, Artificial Sequence
  chemically synthesized
ttttttacagttgcatactatt

SEQ ID NO: 888569 - DNA, 22 bp, Artificial Sequence
  chemically synthesized
tttttttacagttgcatactat

SEQ ID NO: 888570 - DNA, 22 bp, Artificial Sequence
  chemically synthesized
ttttttttacagttgcatacta

SEQ ID NO: 888571 - DNA, 22 bp, Artificial Sequence
  chemically synthesized
tttttttttacagttgcatact

SEQ ID NO: 888572 - DNA, 22 bp, Artificial Sequence
  chemically synthesized
ttttttttttacagttgcatac

SEQ ID NO: 888573 - DNA, 22 bp, Artificial Sequence
  chemically synthesized
agaacagaatagtatgcaactg

SEQ ID NO: 888574 - DNA, 22 bp, Artificial Sequence
  chemically synthesized
tttttttttttacagttgcata

SEQ ID NO: 888575 - DNA, 22 bp, Artificial Sequence
  chemically synthesized
gaacagaatagtatgcaactgt

SEQ ID NO: 888576 - DNA, 22 bp, Artificial Sequence
  chemically synthesized
ttttttttttttacagttgcat

SEQ ID NO: 888577 - DNA, 22 bp, Artificial Sequence
  chemically synthesized
tttttttttttttacagttgca

SEQ ID NO: 888578 - DNA, 22 bp, Artificial Sequence
  chemically synthesized
tttttttttttttttacagttg

SEQ ID NO: 888579 - DNA, 22 bp, Artificial Sequence
  chemically synthesized
tctctttttttttttttttaca

SEQ ID NO: 888580 - DNA, 22 bp, Artificial Sequence
  chemically synthesized
aagaactgtctctttttttttt

SEQ ID NO: 888581 - DNA, 22 bp, Artificial Sequence
  chemically synthesized
taaaaaaaaaaaaaaagagaca

SEQ ID NO: 888582 - DNA, 22 bp, Artificial Sequence
  chemically synthesized
gtagttaaagaactgtctcttt

SEQ ID NO: 888583 - DNA, 22 bp, Artificial Sequence
  chemically synthesized
tattagtagttaaagaactgtc

SEQ ID NO: 888584 - DNA, 22 bp, Artificial Sequence
  chemically synthesized
tgtattagtagttaaagaactg

SEQ ID NO: 888585 - DNA, 22 bp, Artificial Sequence
  chemically synthesized
ctgtattagtagttaaagaact

SEQ ID NO: 888586 - DNA, 22 bp, Artificial Sequence
  chemically synthesized
tctgtattagtagttaaagaac

SEQ ID NO: 888587 - DNA, 22 bp, Artificial Sequence
  chemically synthesized
ttttctgtattagtagttaaag

SEQ ID NO: 888588 - DNA, 22 bp, Artificial Sequence
  chemically synthesized
tttaactactaatacagaaaat

SEQ ID NO: 888589 - DNA, 22 bp, Artificial Sequence
  chemically synthesized
taactactaatacagaaaataa

SEQ ID NO: 888590 - DNA, 22 bp, Artificial Sequence
  chemically synthesized
aactactaatacagaaaataat

SEQ ID NO: 888591 - DNA, 22 bp, Artificial Sequence
  chemically synthesized
actactaatacagaaaataatc

SEQ ID NO: 888592 - DNA, 22 bp, Artificial Sequence
  chemically synthesized
ctaatacagaaaataatcacct

SEQ ID NO: 888593 - DNA, 22 bp, Artificial Sequence
  chemically synthesized
atacagaaaataatcacctgtg

SEQ ID NO: 888594 - DNA, 22 bp, Artificial Sequence
  chemically synthesized
tgtgtgtgtgtgtgtgtgtgtg

SEQ ID NO: 888595 - DNA, 22 bp, Artificial Sequence
  chemically synthesized
tgtgtgtgtgtgtatatatata

SEQ ID NO: 888596 - DNA, 22 bp, Artificial Sequence
  chemically synthesized
taagaaagggaagagtaaaatg

SEQ ID NO: 888597 - DNA, 22 bp, Artificial Sequence
  chemically synthesized
ataagaaagggaagagtaaaat

SEQ ID NO: 888598 - DNA, 22 bp, Artificial Sequence
  chemically synthesized
ccttataagaaagggaagagta

SEQ ID NO: 888599 - DNA, 22 bp, Artificial Sequence
  chemically synthesized
cctcccttataagaaagggaag

SEQ ID NO: 888600 - DNA, 22 bp, Artificial Sequence
  chemically synthesized
tccctcccttataagaaaggga

SEQ ID NO: 888601 - DNA, 22 bp, Artificial Sequence
  chemically synthesized
ctccctcccttataagaaaggg

SEQ ID NO: 888602 - DNA, 22 bp, Artificial Sequence
  chemically synthesized
ttctccctcccttataagaaag

SEQ ID NO: 888603 - DNA, 22 bp, Artificial Sequence
  chemically synthesized
tactcttccctttcttataagg

SEQ ID NO: 888604 - DNA, 22 bp, Artificial Sequence
  chemically synthesized
actcttccctttcttataaggg

SEQ ID NO: 888605 - DNA, 22 bp, Artificial Sequence
  chemically synthesized
ctcttccctttcttataaggga

SEQ ID NO: 888606 - DNA, 22 bp, Artificial Sequence
  chemically synthesized
ttccctttcttataagggaggg

SEQ ID NO: 888607 - DNA, 22 bp, Artificial Sequence
  chemically synthesized
ccctttcttataagggagggag

SEQ ID NO: 888608 - DNA, 22 bp, Artificial Sequence
  chemically synthesized
cctttcttataagggagggaga

SEQ ID NO: 888609 - DNA, 22 bp, Artificial Sequence
  chemically synthesized
tcttataagggagggagaagag

SEQ ID NO: 888610 - DNA, 22 bp, Artificial Sequence
  chemically synthesized
cttataagggagggagaagagt

SEQ ID NO: 888611 - DNA, 22 bp, Artificial Sequence
  chemically synthesized
ttataagggagggagaagagtg

SEQ ID NO: 888612 - DNA, 22 bp, Artificial Sequence
  chemically synthesized
ataagggagggagaagagtgct

SEQ ID NO: 888613 - DNA, 22 bp, Artificial Sequence
  chemically synthesized
taagggagggagaagagtgcta

SEQ ID NO: 888614 - DNA, 22 bp, Artificial Sequence
  chemically synthesized
tacacacacacacacacacaca

SEQ ID NO: 888615 - DNA, 22 bp, Artificial Sequence
  chemically synthesized
tgtgtgtgtgtgtgtgtgtgtg

SEQ ID NO: 888616 - DNA, 22 bp, Artificial Sequence
  chemically synthesized
aaatgcctgtgtgtgtgtgtgt

SEQ ID NO: 888617 - DNA, 22 bp, Artificial Sequence
  chemically synthesized
ataagaaaggaaagactaaaat

SEQ ID NO: 888618 - DNA, 22 bp, Artificial Sequence
  chemically synthesized
cataagaaaggaaagactaaaa

SEQ ID NO: 888619 - DNA, 22 bp, Artificial Sequence
  chemically synthesized
cttcataagaaaggaaagacta

SEQ ID NO: 888620 - DNA, 22 bp, Artificial Sequence
  chemically synthesized
ctccttcataagaaaggaaaga

SEQ ID NO: 888621 - DNA, 22 bp, Artificial Sequence
  chemically synthesized
cctccttcataagaaaggaaag

SEQ ID NO: 888622 - DNA, 22 bp, Artificial Sequence
  chemically synthesized
ttcctccttcataagaaaggaa

SEQ ID NO: 888623 - DNA, 22 bp, Artificial Sequence
  chemically synthesized
cttcctccttcataagaaagga

SEQ ID NO: 888624 - DNA, 22 bp, Artificial Sequence
  chemically synthesized
ttcttcctccttcataagaaag

SEQ ID NO: 888625 - DNA, 22 bp, Artificial Sequence
  chemically synthesized
tagtctttcctttcttatgaag

SEQ ID NO: 888626 - DNA, 22 bp, Artificial Sequence
  chemically synthesized
agtctttcctttcttatgaagg

SEQ ID NO: 888627 - DNA, 22 bp, Artificial Sequence
  chemically synthesized
gtctttcctttcttatgaagga

SEQ ID NO: 888628 - DNA, 22 bp, Artificial Sequence
  chemically synthesized
tcctttcttatgaaggaggaag

SEQ ID NO: 888629 - DNA, 22 bp, Artificial Sequence
  chemically synthesized
cctttcttatgaaggaggaaga

SEQ ID NO: 888630 - DNA, 22 bp, Artificial Sequence
  chemically synthesized
ctttcttatgaaggaggaagaa

SEQ ID NO: 888631 - DNA, 22 bp, Artificial Sequence
  chemically synthesized
tcttatgaaggaggaagaagag

SEQ ID NO: 888632 - DNA, 22 bp, Artificial Sequence
  chemically synthesized
cttatgaaggaggaagaagagt

SEQ ID NO: 888633 - DNA, 22 bp, Artificial Sequence
  chemically synthesized
ttatgaaggaggaagaagagtg

SEQ ID NO: 888634 - DNA, 22 bp, Artificial Sequence
  chemically synthesized
atgaaggaggaagaagagtgct

SEQ ID NO: 888635 - DNA, 22 bp, Artificial Sequence
  chemically synthesized
tgaaggaggaagaagagtgctt

SEQ ID NO: 888636 - DNA, 22 bp, Artificial Sequence
  chemically synthesized
gcgagggcagaaggaaaagcac

SEQ ID NO: 888637 - DNA, 22 bp, Artificial Sequence
  chemically synthesized
ggcgagggcagaaggaaaagca

SEQ ID NO: 888638 - DNA, 22 bp, Artificial Sequence
  chemically synthesized
gcttggcgagggcagaaggaaa

SEQ ID NO: 888639 - DNA, 22 bp, Artificial Sequence
  chemically synthesized
ggcttggcgagggcagaaggaa

SEQ ID NO: 888640 - DNA, 22 bp, Artificial Sequence
  chemically synthesized
cttggcttggcgagggcagaag

SEQ ID NO: 888641 - DNA, 22 bp, Artificial Sequence
  chemically synthesized
ccttggcttggcgagggcagaa

SEQ ID NO: 888642 - DNA, 22 bp, Artificial Sequence
  chemically synthesized
tccttggcttggcgagggcaga

SEQ ID NO: 888643 - DNA, 22 bp, Artificial Sequence
  chemically synthesized
ttccttggcttggcgagggcag

SEQ ID NO: 888644 - DNA, 22 bp, Artificial Sequence
  chemically synthesized
ttccttctgccctcgccaagcc

SEQ ID NO: 888645 - DNA, 22 bp, Artificial Sequence
  chemically synthesized
tccttctgccctcgccaagcca

SEQ ID NO: 888646 - DNA, 22 bp, Artificial Sequence
  chemically synthesized
ccttctgccctcgccaagccaa

SEQ ID NO: 888647 - DNA, 22 bp, Artificial Sequence
  chemically synthesized
aagcccttttccttggcttggc

SEQ ID NO: 888648 - DNA, 22 bp, Artificial Sequence
  chemically synthesized
cttctgccctcgccaagccaag

SEQ ID NO: 888649 - DNA, 22 bp, Artificial Sequence
  chemically synthesized
gaagcccttttccttggcttgg

SEQ ID NO: 888650 - DNA, 22 bp, Artificial Sequence
  chemically synthesized
tgaagcccttttccttggcttg

SEQ ID NO: 888651 - DNA, 22 bp, Artificial Sequence
  chemically synthesized
ttgaagcccttttccttggctt

SEQ ID NO: 888652 - DNA, 22 bp, Artificial Sequence
  chemically synthesized
ctgccctcgccaagccaaggaa

SEQ ID NO: 888653 - DNA, 22 bp, Artificial Sequence
  chemically synthesized
tgccctcgccaagccaaggaaa

SEQ ID NO: 888654 - DNA, 22 bp, Artificial Sequence
  chemically synthesized
ttttgaagcccttttccttggc

SEQ ID NO: 888655 - DNA, 22 bp, Artificial Sequence
  chemically synthesized
ccctcgccaagccaaggaaaag

SEQ ID NO: 888656 - DNA, 22 bp, Artificial Sequence
  chemically synthesized
gccaagccaaggaaaagggctt

SEQ ID NO: 888657 - DNA, 22 bp, Artificial Sequence
  chemically synthesized
aaaagatggttcttttgaagcc

SEQ ID NO: 888658 - DNA, 22 bp, Artificial Sequence
  chemically synthesized
caaaagatggttcttttgaagc

SEQ ID NO: 888659 - DNA, 22 bp, Artificial Sequence
  chemically synthesized
catccttcaaaagatggttctt

SEQ ID NO: 888660 - DNA, 22 bp, Artificial Sequence
  chemically synthesized
tgcatccttcaaaagatggttc

SEQ ID NO: 888661 - DNA, 22 bp, Artificial Sequence
  chemically synthesized
ctgcatccttcaaaagatggtt

SEQ ID NO: 888662 - DNA, 22 bp, Artificial Sequence
  chemically synthesized
tttctgcatccttcaaaagatg

SEQ ID NO: 888663 - DNA, 22 bp, Artificial Sequence
  chemically synthesized
caaaagaaccatcttttgaagg

SEQ ID NO: 888664 - DNA, 22 bp, Artificial Sequence
  chemically synthesized
aaaagaaccatcttttgaagga

SEQ ID NO: 888665 - DNA, 22 bp, Artificial Sequence
  chemically synthesized
taaatactgtttctgcatcctt

SEQ ID NO: 888666 - DNA, 22 bp, Artificial Sequence
  chemically synthesized
gaatactataaatactgtttct

SEQ ID NO: 888667 - DNA, 22 bp, Artificial Sequence
  chemically synthesized
ttgaaggatgcagaaacagtat

SEQ ID NO: 888668 - DNA, 22 bp, Artificial Sequence
  chemically synthesized
tgaaggatgcagaaacagtatt

SEQ ID NO: 888669 - DNA, 22 bp, Artificial Sequence
  chemically synthesized
gaaggatgcagaaacagtattt

SEQ ID NO: 888670 - DNA, 22 bp, Artificial Sequence
  chemically synthesized
ttagaatactataaatactgtt

SEQ ID NO: 888671 - DNA, 22 bp, Artificial Sequence
  chemically synthesized
aaggatgcagaaacagtattta

SEQ ID NO: 888672 - DNA, 22 bp, Artificial Sequence
  chemically synthesized
aaataaagccagctgttagaat

SEQ ID NO: 888673 - DNA, 22 bp, Artificial Sequence
  chemically synthesized
aaaataaagccagctgttagaa

SEQ ID NO: 888674 - DNA, 22 bp, Artificial Sequence
  chemically synthesized
ttaaaataaagccagctgttag

SEQ ID NO: 888675 - DNA, 22 bp, Artificial Sequence
  chemically synthesized
atagtattctaacagctggctt

SEQ ID NO: 888676 - DNA, 22 bp, Artificial Sequence
  chemically synthesized
tagtattctaacagctggcttt

SEQ ID NO: 888677 - DNA, 22 bp, Artificial Sequence
  chemically synthesized
tcctcttaaaataaagccagct

SEQ ID NO: 888678 - DNA, 22 bp, Artificial Sequence
  chemically synthesized
gtcctcttaaaataaagccagc

SEQ ID NO: 888679 - DNA, 22 bp, Artificial Sequence
  chemically synthesized
ttgtcctcttaaaataaagcca

SEQ ID NO: 888680 - DNA, 22 bp, Artificial Sequence
  chemically synthesized
ctcttgtcctcttaaaataaag

SEQ ID NO: 888681 - DNA, 22 bp, Artificial Sequence
  chemically synthesized
taacagctggctttattttaag

SEQ ID NO: 888682 - DNA, 22 bp, Artificial Sequence
  chemically synthesized
tactcttgtcctcttaaaataa

SEQ ID NO: 888683 - DNA, 22 bp, Artificial Sequence
  chemically synthesized
ctactcttgtcctcttaaaata

SEQ ID NO: 888684 - DNA, 22 bp, Artificial Sequence
  chemically synthesized
acagctggctttattttaagag

SEQ ID NO: 888685 - DNA, 22 bp, Artificial Sequence
  chemically synthesized
tctactcttgtcctcttaaaat

SEQ ID NO: 888686 - DNA, 22 bp, Artificial Sequence
  chemically synthesized
ttttctactcttgtcctcttaa

SEQ ID NO: 888687 - DNA, 22 bp, Artificial Sequence
  chemically synthesized
gctttattttaagaggacaaga

SEQ ID NO: 888688 - DNA, 22 bp, Artificial Sequence
  chemically synthesized
tattttaagaggacaagagtag

SEQ ID NO: 888689 - DNA, 22 bp, Artificial Sequence
  chemically synthesized
attttaagaggacaagagtaga

SEQ ID NO: 888690 - DNA, 22 bp, Artificial Sequence
  chemically synthesized
ttttaagaggacaagagtagaa

SEQ ID NO: 888691 - DNA, 22 bp, Artificial Sequence
  chemically synthesized
taagaggacaagagtagaaaat

SEQ ID NO: 888692 - DNA, 22 bp, Artificial Sequence
  chemically synthesized
aagaggacaagagtagaaaata

SEQ ID NO: 888693 - DNA, 22 bp, Artificial Sequence
  chemically synthesized
agaggacaagagtagaaaataa

SEQ ID NO: 888694 - DNA, 22 bp, Artificial Sequence
  chemically synthesized
caagaataggatgtaggtgtgt

SEQ ID NO: 888695 - DNA, 22 bp, Artificial Sequence
  chemically synthesized
ccaagaataggatgtaggtgtg

SEQ ID NO: 888696 - DNA, 22 bp, Artificial Sequence
  chemically synthesized
ggtagccttccaagaataggat

SEQ ID NO: 888697 - DNA, 22 bp, Artificial Sequence
  chemically synthesized
ctgggtagccttccaagaatag

SEQ ID NO: 888698 - DNA, 22 bp, Artificial Sequence
  chemically synthesized
cctgggtagccttccaagaata

SEQ ID NO: 888699 - DNA, 22 bp, Artificial Sequence
  chemically synthesized
agtttcctgggtagccttccaa

SEQ ID NO: 888700 - DNA, 22 bp, Artificial Sequence
  chemically synthesized
cagtttcctgggtagccttcca

SEQ ID NO: 888701 - DNA, 22 bp, Artificial Sequence
  chemically synthesized
catcctattcttggaaggctac

SEQ ID NO: 888702 - DNA, 22 bp, Artificial Sequence
  chemically synthesized
tcagtttcctgggtagccttcc

SEQ ID NO: 888703 - DNA, 22 bp, Artificial Sequence
  chemically synthesized
ttcttggaaggctacccaggaa

SEQ ID NO: 888704 - DNA, 22 bp, Artificial Sequence
  chemically synthesized
ccaaggttttcagtttcctggg

SEQ ID NO: 888705 - DNA, 22 bp, Artificial Sequence
  chemically synthesized
ttggaaggctacccaggaaact

SEQ ID NO: 888706 - DNA, 22 bp, Artificial Sequence
  chemically synthesized
ggaaggctacccaggaaactga

SEQ ID NO: 888707 - DNA, 22 bp, Artificial Sequence
  chemically synthesized
gaaggctacccaggaaactgaa

SEQ ID NO: 888708 - DNA, 22 bp, Artificial Sequence
  chemically synthesized
cccatgtgctgccaaggttttc

SEQ ID NO: 888709 - DNA, 22 bp, Artificial Sequence
  chemically synthesized
cccaggaaactgaaaaccttgg

SEQ ID NO: 888710 - DNA, 22 bp, Artificial Sequence
  chemically synthesized
tccccatgtgctgccaaggttt

SEQ ID NO: 888711 - DNA, 22 bp, Artificial Sequence
  chemically synthesized
tctccccatgtgctgccaaggt

SEQ ID NO: 888712 - DNA, 22 bp, Artificial Sequence
  chemically synthesized
ctctccccatgtgctgccaagg

SEQ ID NO: 888713 - DNA, 22 bp, Artificial Sequence
  chemically synthesized
aaaaccttggcagcacatgggg

SEQ ID NO: 888714 - DNA, 22 bp, Artificial Sequence
  chemically synthesized
agccacacagtttctctcccca

SEQ ID NO: 888715 - DNA, 22 bp, Artificial Sequence
  chemically synthesized
cagccacacagtttctctcccc

SEQ ID NO: 888716 - DNA, 22 bp, Artificial Sequence
  chemically synthesized
tcagccacacagtttctctccc

SEQ ID NO: 888717 - DNA, 22 bp, Artificial Sequence
  chemically synthesized
ggcagcacatggggagagaaac

SEQ ID NO: 888718 - DNA, 22 bp, Artificial Sequence
  chemically synthesized
gcagcacatggggagagaaact

SEQ ID NO: 888719 - DNA, 22 bp, Artificial Sequence
  chemically synthesized
tctttcagccacacagtttctc

SEQ ID NO: 888720 - DNA, 22 bp, Artificial Sequence
  chemically synthesized
ttgtctttcagccacacagttt

SEQ ID NO: 888721 - DNA, 22 bp, Artificial Sequence
  chemically synthesized
cattgttgtctttcagccacac

SEQ ID NO: 888722 - DNA, 22 bp, Artificial Sequence
  chemically synthesized
ttgcattgttgtctttcagcca

SEQ ID NO: 888723 - DNA, 22 bp, Artificial Sequence
  chemically synthesized
tgttgcattgttgtctttcagc

SEQ ID NO: 888724 - DNA, 22 bp, Artificial Sequence
  chemically synthesized
tgtggctgaaagacaacaatgc

SEQ ID NO: 888725 - DNA, 22 bp, Artificial Sequence
  chemically synthesized
aaatcctctgttgcattgttgt

SEQ ID NO: 888726 - DNA, 22 bp, Artificial Sequence
  chemically synthesized
aaagacaacaatgcaacagagg

SEQ ID NO: 888727 - DNA, 22 bp, Artificial Sequence
  chemically synthesized
aaaagcattgaaatcctctgtt

SEQ ID NO: 888728 - DNA, 22 bp, Artificial Sequence
  chemically synthesized
cagtacaaaattcaaaagcatt

SEQ ID NO: 888729 - DNA, 22 bp, Artificial Sequence
  chemically synthesized
ccagtacaaaattcaaaagcat

SEQ ID NO: 888730 - DNA, 22 bp, Artificial Sequence
  chemically synthesized
ttccagtacaaaattcaaaagc

SEQ ID NO: 888731 - DNA, 22 bp, Artificial Sequence
  chemically synthesized
cttccagtacaaaattcaaaag

SEQ ID NO: 888732 - DNA, 22 bp, Artificial Sequence
  chemically synthesized
tcttccagtacaaaattcaaaa

SEQ ID NO: 888733 - DNA, 22 bp, Artificial Sequence
  chemically synthesized
caatgcttttgaattttgtact

SEQ ID NO: 888734 - DNA, 22 bp, Artificial Sequence
  chemically synthesized
aatgcttttgaattttgtactg

SEQ ID NO: 888735 - DNA, 22 bp, Artificial Sequence
  chemically synthesized
aatagatactttcttccagtac

SEQ ID NO: 888736 - DNA, 22 bp, Artificial Sequence
  chemically synthesized
ttgaattttgtactggaagaaa

SEQ ID NO: 888737 - DNA, 22 bp, Artificial Sequence
  chemically synthesized
ttgaatagatactttcttccag

SEQ ID NO: 888738 - DNA, 22 bp, Artificial Sequence
  chemically synthesized
tgaattttgtactggaagaaag

SEQ ID NO: 888739 - DNA, 22 bp, Artificial Sequence
  chemically synthesized
attgaatagatactttcttcca

SEQ ID NO: 888740 - DNA, 22 bp, Artificial Sequence
  chemically synthesized
gaattttgtactggaagaaagt

SEQ ID NO: 888741 - DNA, 22 bp, Artificial Sequence
  chemically synthesized
aattttgtactggaagaaagta

SEQ ID NO: 888742 - DNA, 22 bp, Artificial Sequence
  chemically synthesized
tttattgaatagatactttctt

SEQ ID NO: 888743 - DNA, 22 bp, Artificial Sequence
  chemically synthesized
atttattgaatagatactttct

SEQ ID NO: 888744 - DNA, 22 bp, Artificial Sequence
  chemically synthesized
tgtactggaagaaagtatctat

SEQ ID NO: 888745 - DNA, 22 bp, Artificial Sequence
  chemically synthesized
tttatttattgaatagatactt

SEQ ID NO: 888746 - DNA, 22 bp, Artificial Sequence
  chemically synthesized
gtactggaagaaagtatctatt

SEQ ID NO: 888747 - DNA, 22 bp, Artificial Sequence
  chemically synthesized
gtttatttattgaatagatact

SEQ ID NO: 888748 - DNA, 22 bp, Artificial Sequence
  chemically synthesized
tactggaagaaagtatctattc

SEQ ID NO: 888749 - DNA, 22 bp, Artificial Sequence
  chemically synthesized
tgtttatttattgaatagatac

SEQ ID NO: 888750 - DNA, 22 bp, Artificial Sequence
  chemically synthesized
gaagaaagtatctattcaataa

SEQ ID NO: 888751 - DNA, 22 bp, Artificial Sequence
  chemically synthesized
ttcaataaataaacaaaattat

SEQ ID NO: 888752 - DNA, 22 bp, Artificial Sequence
  chemically synthesized
ataataataataataattttgt

SEQ ID NO: 888753 - DNA, 22 bp, Artificial Sequence
  chemically synthesized
aataataataataataattttg

SEQ ID NO: 888754 - DNA, 22 bp, Artificial Sequence
  chemically synthesized
taataataataataataatttt

SEQ ID NO: 888755 - DNA, 22 bp, Artificial Sequence
  chemically synthesized
aataaataaacaaaattattat

SEQ ID NO: 888756 - DNA, 22 bp, Artificial Sequence
  chemically synthesized
catctttaataataataataat

SEQ ID NO: 888757 - DNA, 22 bp, Artificial Sequence
  chemically synthesized
ttattattattattaaagatgg

SEQ ID NO: 888758 - DNA, 22 bp, Artificial Sequence
  chemically synthesized
ttattattattaaagatggagt

SEQ ID NO: 888759 - DNA, 22 bp, Artificial Sequence
  chemically synthesized
ggtgacagagcaagactccatc

SEQ ID NO: 888760 - DNA, 22 bp, Artificial Sequence
  chemically synthesized
ttattattaaagatggagtctt

SEQ ID NO: 888761 - DNA, 22 bp, Artificial Sequence
  chemically synthesized
ttattaaagatggagtcttgct

SEQ ID NO: 888762 - DNA, 22 bp, Artificial Sequence
  chemically synthesized
gcctgggtgacagagcaagact

SEQ ID NO: 888763 - DNA, 22 bp, Artificial Sequence
  chemically synthesized
ttaaagatggagtcttgctctg

SEQ ID NO: 888764 - DNA, 22 bp, Artificial Sequence
  chemically synthesized
tagcctgggtgacagagcaaga

SEQ ID NO: 888765 - DNA, 22 bp, Artificial Sequence
  chemically synthesized
aagatggagtcttgctctgtca

SEQ ID NO: 888766 - DNA, 22 bp, Artificial Sequence
  chemically synthesized
cactctagcctgggtgacagag

SEQ ID NO: 888767 - DNA, 22 bp, Artificial Sequence
  chemically synthesized
caccactgcactctagcctggg

SEQ ID NO: 888768 - DNA, 22 bp, Artificial Sequence
  chemically synthesized
gctctgtcacccaggctagagt

SEQ ID NO: 888769 - DNA, 22 bp, Artificial Sequence
  chemically synthesized
ctctgtcacccaggctagagtg

SEQ ID NO: 888770 - DNA, 22 bp, Artificial Sequence
  chemically synthesized
tgtcacccaggctagagtgcag

SEQ ID NO: 888771 - DNA, 22 bp, Artificial Sequence
  chemically synthesized
tcacccaggctagagtgcagtg

SEQ ID NO: 888772 - DNA, 22 bp, Artificial Sequence
  chemically synthesized
cagtgagccgagattgcaccac

SEQ ID NO: 888773 - DNA, 22 bp, Artificial Sequence
  chemically synthesized
gagtgcagtggtgcaatctcgg

SEQ ID NO: 888774 - DNA, 22 bp, Artificial Sequence
  chemically synthesized
gaggcggaggttgcagtgagcc

SEQ ID NO: 888775 - DNA, 22 bp, Artificial Sequence
  chemically synthesized
aacctggaggcggaggttgcag

SEQ ID NO: 888776 - DNA, 22 bp, Artificial Sequence
  chemically synthesized
gaacctggaggcggaggttgca

SEQ ID NO: 888777 - DNA, 22 bp, Artificial Sequence
  chemically synthesized
ggctcactgcaacctccgcctc

SEQ ID NO: 888778 - DNA, 22 bp, Artificial Sequence
  chemically synthesized
actgcaacctccgcctccaggt

SEQ ID NO: 888779 - DNA, 22 bp, Artificial Sequence
  chemically synthesized
caacctccgcctccaggttcaa

SEQ ID NO: 888780 - DNA, 22 bp, Artificial Sequence
  chemically synthesized
aggcaggagaatcccttgaacc

SEQ ID NO: 888781 - DNA, 22 bp, Artificial Sequence
  chemically synthesized
cgcctccaggttcaagggattc

SEQ ID NO: 888782 - DNA, 22 bp, Artificial Sequence
  chemically synthesized
gggaggctgaggcaggagaatc

SEQ ID NO: 888783 - DNA, 22 bp, Artificial Sequence
  chemically synthesized
caggttcaagggattctcctgc

SEQ ID NO: 888784 - DNA, 22 bp, Artificial Sequence
  chemically synthesized
ctcgggaggctgaggcaggaga

SEQ ID NO: 888785 - DNA, 22 bp, Artificial Sequence
  chemically synthesized
aagggattctcctgcctcagcc

SEQ ID NO: 888786 - DNA, 22 bp, Artificial Sequence
  chemically synthesized
atcccagctactcgggaggctg

SEQ ID NO: 888787 - DNA, 22 bp, Artificial Sequence
  chemically synthesized
taatcccagctactcgggaggc

SEQ ID NO: 888788 - DNA, 22 bp, Artificial Sequence
  chemically synthesized
tcctgcctcagcctcccgagta

SEQ ID NO: 888789 - DNA, 22 bp, Artificial Sequence
  chemically synthesized
ctgcctcagcctcccgagtagc

SEQ ID NO: 888790 - DNA, 22 bp, Artificial Sequence
  chemically synthesized
cctcagcctcccgagtagctgg

SEQ ID NO: 888791 - DNA, 22 bp, Artificial Sequence
  chemically synthesized
agcctcccgagtagctgggatt

SEQ ID NO: 888792 - DNA, 22 bp, Artificial Sequence
  chemically synthesized
ccgagtagctgggattagaggc

SEQ ID NO: 888793 - DNA, 22 bp, Artificial Sequence
  chemically synthesized
ggcatggtggtgagtgcctcta

SEQ ID NO: 888794 - DNA, 22 bp, Artificial Sequence
  chemically synthesized
gctgggcatggtggtgagtgcc

SEQ ID NO: 888795 - DNA, 22 bp, Artificial Sequence
  chemically synthesized
ggattagaggcactcaccacca

SEQ ID NO: 888796 - DNA, 22 bp, Artificial Sequence
  chemically synthesized
gaggcactcaccaccatgccca

SEQ ID NO: 888797 - DNA, 22 bp, Artificial Sequence
  chemically synthesized
aaaatacaaaaattagctgggc

SEQ ID NO: 888798 - DNA, 22 bp, Artificial Sequence
  chemically synthesized
accaccatgcccagctaatttt

SEQ ID NO: 888799 - DNA, 22 bp, Artificial Sequence
  chemically synthesized
cactaaaaatacaaaaattagc

SEQ ID NO: 888800 - DNA, 22 bp, Artificial Sequence
  chemically synthesized
atttttgtatttttagtggaga

SEQ ID NO: 888801 - DNA, 22 bp, Artificial Sequence
  chemically synthesized
ttgtatttttagtggagacggg

SEQ ID NO: 888802 - DNA, 22 bp, Artificial Sequence
  chemically synthesized
tgtatttttagtggagacgggg

SEQ ID NO: 888803 - DNA, 22 bp, Artificial Sequence
  chemically synthesized
gtatttttagtggagacggggt

SEQ ID NO: 888804 - DNA, 22 bp, Artificial Sequence
  chemically synthesized
tatttttagtggagacggggtt

SEQ ID NO: 888805 - DNA, 22 bp, Artificial Sequence
  chemically synthesized
gccaaggtgatgaaaccccgtc

SEQ ID NO: 888806 - DNA, 22 bp, Artificial Sequence
  chemically synthesized
ttagtggagacggggtttcatc

SEQ ID NO: 888807 - DNA, 22 bp, Artificial Sequence
  chemically synthesized
tagtggagacggggtttcatca

SEQ ID NO: 888808 - DNA, 22 bp, Artificial Sequence
  chemically synthesized
agtggagacggggtttcatcac

SEQ ID NO: 888809 - DNA, 22 bp, Artificial Sequence
  chemically synthesized
gtggagacggggtttcatcacc

SEQ ID NO: 888810 - DNA, 22 bp, Artificial Sequence
  chemically synthesized
cagaccagcctggccaaggtga

SEQ ID NO: 888811 - DNA, 22 bp, Artificial Sequence
  chemically synthesized
catcaccttggccaggctggtc

SEQ ID NO: 888812 - DNA, 22 bp, Artificial Sequence
  chemically synthesized
atcaccttggccaggctggtct

SEQ ID NO: 888813 - DNA, 22 bp, Artificial Sequence
  chemically synthesized
ggccaggctggtctggaactcc

SEQ ID NO: 888814 - DNA, 22 bp, Artificial Sequence
  chemically synthesized
gccaggctggtctggaactcct

SEQ ID NO: 888815 - DNA, 22 bp, Artificial Sequence
  chemically synthesized
gtctggaactcctgacctcgtg

SEQ ID NO: 888816 - DNA, 22 bp, Artificial Sequence
  chemically synthesized
aggcaggtggatcacgaggtca

SEQ ID NO: 888817 - DNA, 22 bp, Artificial Sequence
  chemically synthesized
gaactcctgacctcgtgatcca

SEQ ID NO: 888818 - DNA, 22 bp, Artificial Sequence
  chemically synthesized
ggaggctgaggcaggtggatca

SEQ ID NO: 888819 - DNA, 22 bp, Artificial Sequence
  chemically synthesized
gggaggctgaggcaggtggatc

SEQ ID NO: 888820 - DNA, 22 bp, Artificial Sequence
  chemically synthesized
tgggaggctgaggcaggtggat

SEQ ID NO: 888821 - DNA, 22 bp, Artificial Sequence
  chemically synthesized
ctgacctcgtgatccacctgcc

SEQ ID NO: 888822 - DNA, 22 bp, Artificial Sequence
  chemically synthesized
acctcgtgatccacctgcctca

SEQ ID NO: 888823 - DNA, 22 bp, Artificial Sequence
  chemically synthesized
gtgatccacctgcctcagcctc

SEQ ID NO: 888824 - DNA, 22 bp, Artificial Sequence
  chemically synthesized
ccagcactttgggaggctgagg

SEQ ID NO: 888825 - DNA, 22 bp, Artificial Sequence
  chemically synthesized
tactcccagcactttgggaggc

SEQ ID NO: 888826 - DNA, 22 bp, Artificial Sequence
  chemically synthesized
cctcagcctcccaaagtgctgg

SEQ ID NO: 888827 - DNA, 22 bp, Artificial Sequence
  chemically synthesized
acacctgtactcccagcacttt

SEQ ID NO: 888828 - DNA, 22 bp, Artificial Sequence
  chemically synthesized
agcctcccaaagtgctgggagt

SEQ ID NO: 888829 - DNA, 22 bp, Artificial Sequence
  chemically synthesized
ccaaagtgctgggagtacaggt

SEQ ID NO: 888830 - DNA, 22 bp, Artificial Sequence
  chemically synthesized
ggagtacaggtgtgagccattg

SEQ ID NO: 888831 - DNA, 22 bp, Artificial Sequence
  chemically synthesized
aagataatataaataggccagg

SEQ ID NO: 888832 - DNA, 22 bp, Artificial Sequence
  chemically synthesized
aaagataatataaataggccag

SEQ ID NO: 888833 - DNA, 22 bp, Artificial Sequence
  chemically synthesized
taaagataatataaataggcca

SEQ ID NO: 888834 - DNA, 22 bp, Artificial Sequence
  chemically synthesized
cgcctggcctatttatattatc

SEQ ID NO: 888835 - DNA, 22 bp, Artificial Sequence
  chemically synthesized
tataacagactttaaagataat

SEQ ID NO: 888836 - DNA, 22 bp, Artificial Sequence
  chemically synthesized
gcctatttatattatctttaaa

SEQ ID NO: 888837 - DNA, 22 bp, Artificial Sequence
  chemically synthesized
tccctgtataacagactttaaa

SEQ ID NO: 888838 - DNA, 22 bp, Artificial Sequence
  chemically synthesized
tttatattatctttaaagtctg

SEQ ID NO: 888839 - DNA, 22 bp, Artificial Sequence
  chemically synthesized
atccctgtataacagactttaa

SEQ ID NO: 888840 - DNA, 22 bp, Artificial Sequence
  chemically synthesized
atattatctttaaagtctgtta

SEQ ID NO: 888841 - DNA, 22 bp, Artificial Sequence
  chemically synthesized
tattatctttaaagtctgttat

SEQ ID NO: 888842 - DNA, 22 bp, Artificial Sequence
  chemically synthesized
tctttaaagtctgttatacagg

SEQ ID NO: 888843 - DNA, 22 bp, Artificial Sequence
  chemically synthesized
ggggtaaatttatccctgtata

SEQ ID NO: 888844 - DNA, 22 bp, Artificial Sequence
  chemically synthesized
taaagtctgttatacagggata

SEQ ID NO: 888845 - DNA, 22 bp, Artificial Sequence
  chemically synthesized
aaagtctgttatacagggataa

SEQ ID NO: 888846 - DNA, 22 bp, Artificial Sequence
  chemically synthesized
aagtctgttatacagggataaa

SEQ ID NO: 888847 - DNA, 22 bp, Artificial Sequence
  chemically synthesized
caaagttgggggtaaatttatc

SEQ ID NO: 888848 - DNA, 22 bp, Artificial Sequence
  chemically synthesized
ttatacagggataaatttaccc

SEQ ID NO: 888849 - DNA, 22 bp, Artificial Sequence
  chemically synthesized
ttacaaagttgggggtaaattt

SEQ ID NO: 888850 - DNA, 22 bp, Artificial Sequence
  chemically synthesized
tacagggataaatttaccccca

SEQ ID NO: 888851 - DNA, 22 bp, Artificial Sequence
  chemically synthesized
attattacaaagttgggggtaa

SEQ ID NO: 888852 - DNA, 22 bp, Artificial Sequence
  chemically synthesized
ggttaattattacaaagttggg

SEQ ID NO: 888853 - DNA, 22 bp, Artificial Sequence
  chemically synthesized
acccccaactttgtaataatta

SEQ ID NO: 888854 - DNA, 22 bp, Artificial Sequence
  chemically synthesized
cccccaactttgtaataattaa

SEQ ID NO: 888855 - DNA, 22 bp, Artificial Sequence
  chemically synthesized
tatcagtgatgtcatactgggt

SEQ ID NO: 888856 - DNA, 22 bp, Artificial Sequence
  chemically synthesized
tgtaataattaacccagtatga

SEQ ID NO: 888857 - DNA, 22 bp, Artificial Sequence
  chemically synthesized
gtaataattaacccagtatgac

SEQ ID NO: 888858 - DNA, 22 bp, Artificial Sequence
  chemically synthesized
taataattaacccagtatgaca

SEQ ID NO: 888859 - DNA, 22 bp, Artificial Sequence
  chemically synthesized
gtactgtatcagtgatgtcata

SEQ ID NO: 888860 - DNA, 22 bp, Artificial Sequence
  chemically synthesized
attagtactgtatcagtgatgt

SEQ ID NO: 888861 - DNA, 22 bp, Artificial Sequence
  chemically synthesized
acccagtatgacatcactgata

SEQ ID NO: 888862 - DNA, 22 bp, Artificial Sequence
  chemically synthesized
tagaaaatgagttaattagtac

SEQ ID NO: 888863 - DNA, 22 bp, Artificial Sequence
  chemically synthesized
atagaaaatgagttaattagta

SEQ ID NO: 888864 - DNA, 22 bp, Artificial Sequence
  chemically synthesized
tatagaaaatgagttaattagt

SEQ ID NO: 888865 - DNA, 22 bp, Artificial Sequence
  chemically synthesized
atacagtactaattaactcatt

SEQ ID NO: 888866 - DNA, 22 bp, Artificial Sequence
  chemically synthesized
cacagttttatagaaaatgagt

SEQ ID NO: 888867 - DNA, 22 bp, Artificial Sequence
  chemically synthesized
attaactcattttctataaaac

SEQ ID NO: 888868 - DNA, 22 bp, Artificial Sequence
  chemically synthesized
agataatctgcacagttttata

SEQ ID NO: 888869 - DNA, 22 bp, Artificial Sequence
  chemically synthesized
aagataatctgcacagttttat

SEQ ID NO: 888870 - DNA, 22 bp, Artificial Sequence
  chemically synthesized
actcattttctataaaactgtg

SEQ ID NO: 888871 - DNA, 22 bp, Artificial Sequence
  chemically synthesized
taagataatctgcacagtttta

SEQ ID NO: 888872 - DNA, 22 bp, Artificial Sequence
  chemically synthesized
attttctataaaactgtgcaga

SEQ ID NO: 888873 - DNA, 22 bp, Artificial Sequence
  chemically synthesized
gaattttaagataatctgcaca

SEQ ID NO: 888874 - DNA, 22 bp, Artificial Sequence
  chemically synthesized
cgaattttaagataatctgcac

SEQ ID NO: 888875 - DNA, 22 bp, Artificial Sequence
  chemically synthesized
tctataaaactgtgcagattat

SEQ ID NO: 888876 - DNA, 22 bp, Artificial Sequence
  chemically synthesized
ctataaaactgtgcagattatc

SEQ ID NO: 888877 - DNA, 22 bp, Artificial Sequence
  chemically synthesized
tataaaactgtgcagattatct

SEQ ID NO: 888878 - DNA, 22 bp, Artificial Sequence
  chemically synthesized
tttcgaattttaagataatctg

SEQ ID NO: 888879 - DNA, 22 bp, Artificial Sequence
  chemically synthesized
gtttcgaattttaagataatct

SEQ ID NO: 888880 - DNA, 22 bp, Artificial Sequence
  chemically synthesized
taaaactgtgcagattatctta

SEQ ID NO: 888881 - DNA, 22 bp, Artificial Sequence
  chemically synthesized
tgtttcgaattttaagataatc

SEQ ID NO: 888882 - DNA, 22 bp, Artificial Sequence
  chemically synthesized
ttgtttcgaattttaagataat

SEQ ID NO: 888883 - DNA, 22 bp, Artificial Sequence
  chemically synthesized
atttttgtttcgaattttaaga

SEQ ID NO: 888884 - DNA, 22 bp, Artificial Sequence
  chemically synthesized
catttttgtttcgaattttaag

SEQ ID NO: 888885 - DNA, 22 bp, Artificial Sequence
  chemically synthesized
tgcagattatcttaaaattcga

SEQ ID NO: 888886 - DNA, 22 bp, Artificial Sequence
  chemically synthesized
tacttcatttttgtttcgaatt

SEQ ID NO: 888887 - DNA, 22 bp, Artificial Sequence
  chemically synthesized
tattgtacttcatttttgtttc

SEQ ID NO: 888888 - DNA, 22 bp, Artificial Sequence
  chemically synthesized
tcttaaaattcgaaacaaaaat

SEQ ID NO: 888889 - DNA, 22 bp, Artificial Sequence
  chemically synthesized
gtattgtacttcatttttgttt

SEQ ID NO: 888890 - DNA, 22 bp, Artificial Sequence
  chemically synthesized
aaaattcgaaacaaaaatgaag

SEQ ID NO: 888891 - DNA, 22 bp, Artificial Sequence
  chemically synthesized
aaattcgaaacaaaaatgaagt

SEQ ID NO: 888892 - DNA, 22 bp, Artificial Sequence
  chemically synthesized
tcatttgtattgtacttcattt

SEQ ID NO: 888893 - DNA, 22 bp, Artificial Sequence
  chemically synthesized
ttatcatttgtattgtacttca

SEQ ID NO: 888894 - DNA, 22 bp, Artificial Sequence
  chemically synthesized
gaaacaaaaatgaagtacaata

SEQ ID NO: 888895 - DNA, 22 bp, Artificial Sequence
  chemically synthesized
ttgttatcatttgtattgtact

SEQ ID NO: 888896 - DNA, 22 bp, Artificial Sequence
  chemically synthesized
gaactgttgttatcatttgtat

SEQ ID NO: 888897 - DNA, 22 bp, Artificial Sequence
  chemically synthesized
tggaactgttgttatcatttgt

SEQ ID NO: 888898 - DNA, 22 bp, Artificial Sequence
  chemically synthesized
ctggaactgttgttatcatttg

SEQ ID NO: 888899 - DNA, 22 bp, Artificial Sequence
  chemically synthesized
tctggaactgttgttatcattt

SEQ ID NO: 888900 - DNA, 22 bp, Artificial Sequence
  chemically synthesized
ttttctggaactgttgttatca

SEQ ID NO: 888901 - DNA, 22 bp, Artificial Sequence
  chemically synthesized
agtgttgttttctggaactgtt

SEQ ID NO: 888902 - DNA, 22 bp, Artificial Sequence
  chemically synthesized
aagtgttgttttctggaactgt

SEQ ID NO: 888903 - DNA, 22 bp, Artificial Sequence
  chemically synthesized
cgtgtggtatgcttaagtgttg

SEQ ID NO: 888904 - DNA, 22 bp, Artificial Sequence
  chemically synthesized
cagaaaacaacacttaagcata

SEQ ID NO: 888905 - DNA, 22 bp, Artificial Sequence
  chemically synthesized
tgttacgtgtggtatgcttaag

SEQ ID NO: 888906 - DNA, 22 bp, Artificial Sequence
  chemically synthesized
cattgtgttacgtgtggtatgc

SEQ ID NO: 888907 - DNA, 22 bp, Artificial Sequence
  chemically synthesized
ttacattgtgttacgtgtggta

SEQ ID NO: 888908 - DNA, 22 bp, Artificial Sequence
  chemically synthesized
aagcataccacacgtaacacaa

SEQ ID NO: 888909 - DNA, 22 bp, Artificial Sequence
  chemically synthesized
agcataccacacgtaacacaat

SEQ ID NO: 888910 - DNA, 22 bp, Artificial Sequence
  chemically synthesized
cgttatattctttggtacccta

SEQ ID NO: 888911 - DNA, 22 bp, Artificial Sequence
  chemically synthesized
tattctttggtaccctatgcta

SEQ ID NO: 888912 - DNA, 22 bp, Artificial Sequence
  chemically synthesized
tttggtaccctatgctatctta

SEQ ID NO: 888913 - DNA, 22 bp, Artificial Sequence
  chemically synthesized
tggtaccctatgctatcttatt

SEQ ID NO: 888914 - DNA, 22 bp, Artificial Sequence
  chemically synthesized
ggtaccctatgctatcttattc

SEQ ID NO: 888915 - DNA, 22 bp, Artificial Sequence
  chemically synthesized
gtaccctatgctatcttattct

SEQ ID NO: 888916 - DNA, 22 bp, Artificial Sequence
  chemically synthesized
atgggtaaaataaaatagaata

SEQ ID NO: 888917 - DNA, 22 bp, Artificial Sequence
  chemically synthesized
aatgggtaaaataaaatagaat

SEQ ID NO: 888918 - DNA, 22 bp, Artificial Sequence
  chemically synthesized
tgctatcttattctattttatt

SEQ ID NO: 888919 - DNA, 22 bp, Artificial Sequence
  chemically synthesized
tcttattctattttattttacc

SEQ ID NO: 888920 - DNA, 22 bp, Artificial Sequence
  chemically synthesized
attctattttattttacccatt

SEQ ID NO: 888921 - DNA, 22 bp, Artificial Sequence
  chemically synthesized
tgaaatccatttaatgggtaaa

SEQ ID NO: 888922 - DNA, 22 bp, Artificial Sequence
  chemically synthesized
ttctattttattttacccatta

SEQ ID NO: 888923 - DNA, 22 bp, Artificial Sequence
  chemically synthesized
tattttattttacccattaaat

SEQ ID NO: 888924 - DNA, 22 bp, Artificial Sequence
  chemically synthesized
ttttattttacccattaaatgg

SEQ ID NO: 888925 - DNA, 22 bp, Artificial Sequence
  chemically synthesized
atgagttatgaaatccatttaa

SEQ ID NO: 888926 - DNA, 22 bp, Artificial Sequence
  chemically synthesized
tattttacccattaaatggatt

SEQ ID NO: 888927 - DNA, 22 bp, Artificial Sequence
  chemically synthesized
attttacccattaaatggattt

SEQ ID NO: 888928 - DNA, 22 bp, Artificial Sequence
  chemically synthesized
ttttacccattaaatggatttc

SEQ ID NO: 888929 - DNA, 22 bp, Artificial Sequence
  chemically synthesized
tacccattaaatggatttcata

SEQ ID NO: 888930 - DNA, 22 bp, Artificial Sequence
  chemically synthesized
acccattaaatggatttcataa

SEQ ID NO: 888931 - DNA, 22 bp, Artificial Sequence
  chemically synthesized
cccattaaatggatttcataac

SEQ ID NO: 888932 - DNA, 22 bp, Artificial Sequence
  chemically synthesized
caacccactgatgagttatgaa

SEQ ID NO: 888933 - DNA, 22 bp, Artificial Sequence
  chemically synthesized
acaacccactgatgagttatga

SEQ ID NO: 888934 - DNA, 22 bp, Artificial Sequence
  chemically synthesized
aatggatttcataactcatcag

SEQ ID NO: 888935 - DNA, 22 bp, Artificial Sequence
  chemically synthesized
cataactcatcagtgggttgta

SEQ ID NO: 888936 - DNA, 22 bp, Artificial Sequence
  chemically synthesized
ataactcatcagtgggttgtaa

SEQ ID NO: 888937 - DNA, 22 bp, Artificial Sequence
  chemically synthesized
aggcccgggagagaatcttaca

SEQ ID NO: 888938 - DNA, 22 bp, Artificial Sequence
  chemically synthesized
caggcccgggagagaatcttac

SEQ ID NO: 888939 - DNA, 22 bp, Artificial Sequence
  chemically synthesized
atcagtgggttgtaagattctc

SEQ ID NO: 888940 - DNA, 22 bp, Artificial Sequence
  chemically synthesized
tcaggcccgggagagaatctta

SEQ ID NO: 888941 - DNA, 22 bp, Artificial Sequence
  chemically synthesized
agctttcaggcccgggagagaa

SEQ ID NO: 888942 - DNA, 22 bp, Artificial Sequence
  chemically synthesized
aagctttcaggcccgggagaga

SEQ ID NO: 888943 - DNA, 22 bp, Artificial Sequence
  chemically synthesized
cttaagctttcaggcccgggag

SEQ ID NO: 888944 - DNA, 22 bp, Artificial Sequence
  chemically synthesized
taagattctctcccgggcctga

SEQ ID NO: 888945 - DNA, 22 bp, Artificial Sequence
  chemically synthesized
atctccttaagctttcaggccc

SEQ ID NO: 888946 - DNA, 22 bp, Artificial Sequence
  chemically synthesized
ctcatctccttaagctttcagg

SEQ ID NO: 888947 - DNA, 22 bp, Artificial Sequence
  chemically synthesized
tctcccgggcctgaaagcttaa

SEQ ID NO: 888948 - DNA, 22 bp, Artificial Sequence
  chemically synthesized
tcccgggcctgaaagcttaagg

SEQ ID NO: 888949 - DNA, 22 bp, Artificial Sequence
  chemically synthesized
ccgggcctgaaagcttaaggag

SEQ ID NO: 888950 - DNA, 22 bp, Artificial Sequence
  chemically synthesized
agaaaggaggagttactcatct

SEQ ID NO: 888951 - DNA, 22 bp, Artificial Sequence
  chemically synthesized
aaagcttaaggagatgagtaac

SEQ ID NO: 888952 - DNA, 22 bp, Artificial Sequence
  chemically synthesized
aaggagatgagtaactcctcct

SEQ ID NO: 888953 - DNA, 22 bp, Artificial Sequence
  chemically synthesized
aggagatgagtaactcctcctt

SEQ ID NO: 888954 - DNA, 22 bp, Artificial Sequence
  chemically synthesized
ggaatgggcctgagaaaggagg

SEQ ID NO: 888955 - DNA, 22 bp, Artificial Sequence
  chemically synthesized
aggaatgggcctgagaaaggag

SEQ ID NO: 888956 - DNA, 22 bp, Artificial Sequence
  chemically synthesized
tgccttaggaatgggcctgaga

SEQ ID NO: 888957 - DNA, 22 bp, Artificial Sequence
  chemically synthesized
gtgccttaggaatgggcctgag

SEQ ID NO: 888958 - DNA, 22 bp, Artificial Sequence
  chemically synthesized
ctcctttctcaggcccattcct

SEQ ID NO: 888959 - DNA, 22 bp, Artificial Sequence
  chemically synthesized
ctttctcaggcccattcctaag

SEQ ID NO: 888960 - DNA, 22 bp, Artificial Sequence
  chemically synthesized
tctcaggcccattcctaaggca

SEQ ID NO: 888961 - DNA, 22 bp, Artificial Sequence
  chemically synthesized
ctcaggcccattcctaaggcac

SEQ ID NO: 888962 - DNA, 22 bp, Artificial Sequence
  chemically synthesized
tcaggcccattcctaaggcaca

SEQ ID NO: 888963 - DNA, 22 bp, Artificial Sequence
  chemically synthesized
aggcaagtagccttgtgcctta

SEQ ID NO: 888964 - DNA, 22 bp, Artificial Sequence
  chemically synthesized
aggcccattcctaaggcacaag

SEQ ID NO: 888965 - DNA, 22 bp, Artificial Sequence
  chemically synthesized
ctcaggcaagtagccttgtgcc

SEQ ID NO: 888966 - DNA, 22 bp, Artificial Sequence
  chemically synthesized
ctaaggcacaaggctacttgcc

SEQ ID NO: 888967 - DNA, 22 bp, Artificial Sequence
  chemically synthesized
aggcacaaggctacttgcctga

SEQ ID NO: 888968 - DNA, 22 bp, Artificial Sequence
  chemically synthesized
gccggtgcatgctgctcaggca

SEQ ID NO: 888969 - DNA, 22 bp, Artificial Sequence
  chemically synthesized
cgccggtgcatgctgctcaggc

SEQ ID NO: 888970 - DNA, 22 bp, Artificial Sequence
  chemically synthesized
tttcgccggtgcatgctgctca

SEQ ID NO: 888971 - DNA, 22 bp, Artificial Sequence
  chemically synthesized
ctatttcgccggtgcatgctgc

SEQ ID NO: 888972 - DNA, 22 bp, Artificial Sequence
  chemically synthesized
tgctatttcgccggtgcatgct

SEQ ID NO: 888973 - DNA, 22 bp, Artificial Sequence
  chemically synthesized
cttgcctgagcagcatgcaccg

SEQ ID NO: 888974 - DNA, 22 bp, Artificial Sequence
  chemically synthesized
ctgctatttcgccggtgcatgc

SEQ ID NO: 888975 - DNA, 22 bp, Artificial Sequence
  chemically synthesized
gcctgagcagcatgcaccggcg

SEQ ID NO: 888976 - DNA, 22 bp, Artificial Sequence
  chemically synthesized
cttctgctatttcgccggtgca

SEQ ID NO: 888977 - DNA, 22 bp, Artificial Sequence
  chemically synthesized
cctgagcagcatgcaccggcga

SEQ ID NO: 888978 - DNA, 22 bp, Artificial Sequence
  chemically synthesized
ctgcttctgctatttcgccggt

SEQ ID NO: 888979 - DNA, 22 bp, Artificial Sequence
  chemically synthesized
cctgcttctgctatttcgccgg

SEQ ID NO: 888980 - DNA, 22 bp, Artificial Sequence
  chemically synthesized
agcagcatgcaccggcgaaata

SEQ ID NO: 888981 - DNA, 22 bp, Artificial Sequence
  chemically synthesized
ttcctgcttctgctatttcgcc

SEQ ID NO: 888982 - DNA, 22 bp, Artificial Sequence
  chemically synthesized
tcttcctgcttctgctatttcg

SEQ ID NO: 888983 - DNA, 22 bp, Artificial Sequence
  chemically synthesized
gccggctctcttcctgcttctg

SEQ ID NO: 888984 - DNA, 22 bp, Artificial Sequence
  chemically synthesized
tggccggctctcttcctgcttc

SEQ ID NO: 888985 - DNA, 22 bp, Artificial Sequence
  chemically synthesized
ctggccggctctcttcctgctt

SEQ ID NO: 888986 - DNA, 22 bp, Artificial Sequence
  chemically synthesized
tcttctggccggctctcttcct

SEQ ID NO: 888987 - DNA, 22 bp, Artificial Sequence
  chemically synthesized
gtcttctggccggctctcttcc

SEQ ID NO: 888988 - DNA, 22 bp, Artificial Sequence
  chemically synthesized
agaggtacttgtcttctggccg

SEQ ID NO: 888989 - DNA, 22 bp, Artificial Sequence
  chemically synthesized
cagaggtacttgtcttctggcc

SEQ ID NO: 888990 - DNA, 22 bp, Artificial Sequence
  chemically synthesized
gatcttcagaggtacttgtctt

SEQ ID NO: 888991 - DNA, 22 bp, Artificial Sequence
  chemically synthesized
tcgatcttcagaggtacttgtc

SEQ ID NO: 888992 - DNA, 22 bp, Artificial Sequence
  chemically synthesized
ctcgatcttcagaggtacttgt

SEQ ID NO: 888993 - DNA, 22 bp, Artificial Sequence
  chemically synthesized
tctcgatcttcagaggtacttg

SEQ ID NO: 888994 - DNA, 22 bp, Artificial Sequence
  chemically synthesized
tttctcgatcttcagaggtact

SEQ ID NO: 888995 - DNA, 22 bp, Artificial Sequence
  chemically synthesized
tacccggatggcctctttctcg

SEQ ID NO: 888996 - DNA, 22 bp, Artificial Sequence
  chemically synthesized
tgaagatcgagaaagaggccat

SEQ ID NO: 888997 - DNA, 22 bp, Artificial Sequence
  chemically synthesized
cattgtacccggatggcctctt

SEQ ID NO: 888998 - DNA, 22 bp, Artificial Sequence
  chemically synthesized
aagatcgagaaagaggccatcc

SEQ ID NO: 888999 - DNA, 22 bp, Artificial Sequence
  chemically synthesized
ctgcattgtacccggatggcct

SEQ ID NO: 889000 - DNA, 22 bp, Artificial Sequence
  chemically synthesized
acgtaactgctgcattgtaccc

SEQ ID NO: 889001 - DNA, 22 bp, Artificial Sequence
  chemically synthesized
gcctgacgtaactgctgcattg

SEQ ID NO: 889002 - DNA, 22 bp, Artificial Sequence
  chemically synthesized
ctggcctgacgtaactgctgca

SEQ ID NO: 889003 - DNA, 22 bp, Artificial Sequence
  chemically synthesized
taaacaggaagtctcctggcct

SEQ ID NO: 889004 - DNA, 22 bp, Artificial Sequence
  chemically synthesized
ctgtaaacaggaagtctcctgg

SEQ ID NO: 889005 - DNA, 22 bp, Artificial Sequence
  chemically synthesized
cgtcaggccaggagacttcctg

SEQ ID NO: 889006 - DNA, 22 bp, Artificial Sequence
  chemically synthesized
tagtctcctgtaaacaggaagt

SEQ ID NO: 889007 - DNA, 22 bp, Artificial Sequence
  chemically synthesized
atagtctcctgtaaacaggaag

SEQ ID NO: 889008 - DNA, 22 bp, Artificial Sequence
  chemically synthesized
tatagtctcctgtaaacaggaa

SEQ ID NO: 889009 - DNA, 22 bp, Artificial Sequence
  chemically synthesized
gacaaaggttttatagtctcct

SEQ ID NO: 889010 - DNA, 22 bp, Artificial Sequence
  chemically synthesized
cctgtttacaggagactataaa

SEQ ID NO: 889011 - DNA, 22 bp, Artificial Sequence
  chemically synthesized
ctgtttacaggagactataaaa

SEQ ID NO: 889012 - DNA, 22 bp, Artificial Sequence
  chemically synthesized
tttacaggagactataaaacct

SEQ ID NO: 889013 - DNA, 22 bp, Artificial Sequence
  chemically synthesized
acaggagactataaaacctttg

SEQ ID NO: 889014 - DNA, 22 bp, Artificial Sequence
  chemically synthesized
caggagactataaaacctttgt

SEQ ID NO: 889015 - DNA, 22 bp, Artificial Sequence
  chemically synthesized
gccccaagtgaggactggacaa

SEQ ID NO: 889016 - DNA, 22 bp, Artificial Sequence
  chemically synthesized
taaaacctttgtccagtcctca

SEQ ID NO: 889017 - DNA, 22 bp, Artificial Sequence
  chemically synthesized
aaatggcgttagccccaagtga

SEQ ID NO: 889018 - DNA, 22 bp, Artificial Sequence
  chemically synthesized
tgtccagtcctcacttggggct

SEQ ID NO: 889019 - DNA, 22 bp, Artificial Sequence
  chemically synthesized
gtccagtcctcacttggggcta

SEQ ID NO: 889020 - DNA, 22 bp, Artificial Sequence
  chemically synthesized
tccagtcctcacttggggctaa

SEQ ID NO: 889021 - DNA, 22 bp, Artificial Sequence
  chemically synthesized
aggcctaaaatggcgttagccc

SEQ ID NO: 889022 - DNA, 22 bp, Artificial Sequence
  chemically synthesized
acttggggctaacgccatttta

SEQ ID NO: 889023 - DNA, 22 bp, Artificial Sequence
  chemically synthesized
ggggctaacgccattttaggcc

SEQ ID NO: 889024 - DNA, 22 bp, Artificial Sequence
  chemically synthesized
gggctaacgccattttaggcct

SEQ ID NO: 889025 - DNA, 22 bp, Artificial Sequence
  chemically synthesized
ggtgcgggcagcctcaggccta

SEQ ID NO: 889026 - DNA, 22 bp, Artificial Sequence
  chemically synthesized
acgccattttaggcctgaggct

SEQ ID NO: 889027 - DNA, 22 bp, Artificial Sequence
  chemically synthesized
atgagcgcctgggtgcgggcag

SEQ ID NO: 889028 - DNA, 22 bp, Artificial Sequence
  chemically synthesized
taggcctgaggctgcccgcacc

SEQ ID NO: 889029 - DNA, 22 bp, Artificial Sequence
  chemically synthesized
aatgagcgcctgggtgcgggca

SEQ ID NO: 889030 - DNA, 22 bp, Artificial Sequence
  chemically synthesized
aggcctgaggctgcccgcaccc

SEQ ID NO: 889031 - DNA, 22 bp, Artificial Sequence
  chemically synthesized
taatgagcgcctgggtgcgggc

SEQ ID NO: 889032 - DNA, 22 bp, Artificial Sequence
  chemically synthesized
ggcctgaggctgcccgcaccca

SEQ ID NO: 889033 - DNA, 22 bp, Artificial Sequence
  chemically synthesized
ttttaatgagcgcctgggtgcg

SEQ ID NO: 889034 - DNA, 22 bp, Artificial Sequence
  chemically synthesized
aggctgcccgcacccaggcgct

SEQ ID NO: 889035 - DNA, 22 bp, Artificial Sequence
  chemically synthesized
cccgcacccaggcgctcattaa

SEQ ID NO: 889036 - DNA, 22 bp, Artificial Sequence
  chemically synthesized
acccggccgcaacatgctgttt

SEQ ID NO: 889037 - DNA, 22 bp, Artificial Sequence
  chemically synthesized
attaaaacagcatgttgcggcc

SEQ ID NO: 889038 - DNA, 22 bp, Artificial Sequence
  chemically synthesized
aaacagcatgttgcggccgggt

SEQ ID NO: 889039 - DNA, 22 bp, Artificial Sequence
  chemically synthesized
caggcgtgagccacctcacccg

SEQ ID NO: 889040 - DNA, 22 bp, Artificial Sequence
  chemically synthesized
ggattacaggcgtgagccacct

SEQ ID NO: 889041 - DNA, 22 bp, Artificial Sequence
  chemically synthesized
cggccgggtgaggtggctcacg

SEQ ID NO: 889042 - DNA, 22 bp, Artificial Sequence
  chemically synthesized
ccagagtgctgggattacaggc

SEQ ID NO: 889043 - DNA, 22 bp, Artificial Sequence
  chemically synthesized
ggcctcccagagtgctgggatt

SEQ ID NO: 889044 - DNA, 22 bp, Artificial Sequence
  chemically synthesized
acgcctgtaatcccagcactct

SEQ ID NO: 889045 - DNA, 22 bp, Artificial Sequence
  chemically synthesized
cccgcctcggcctcccagagtg

SEQ ID NO: 889046 - DNA, 22 bp, Artificial Sequence
  chemically synthesized
taatcccagcactctgggaggc

SEQ ID NO: 889047 - DNA, 22 bp, Artificial Sequence
  chemically synthesized
atgatctgcccgcctcggcctc

SEQ ID NO: 889048 - DNA, 22 bp, Artificial Sequence
  chemically synthesized
acctcatgatctgcccgcctcg

SEQ ID NO: 889049 - DNA, 22 bp, Artificial Sequence
  chemically synthesized
ctgacctcatgatctgcccgcc

SEQ ID NO: 889050 - DNA, 22 bp, Artificial Sequence
  chemically synthesized
tgggaggccgaggcgggcagat

SEQ ID NO: 889051 - DNA, 22 bp, Artificial Sequence
  chemically synthesized
ggaggccgaggcgggcagatca

SEQ ID NO: 889052 - DNA, 22 bp, Artificial Sequence
  chemically synthesized
gatctcctgacctcatgatctg

SEQ ID NO: 889053 - DNA, 22 bp, Artificial Sequence
  chemically synthesized
gccaggatggtctcgatctcct

SEQ ID NO: 889054 - DNA, 22 bp, Artificial Sequence
  chemically synthesized
accatgttagccaggatggtct

SEQ ID NO: 889055 - DNA, 22 bp, Artificial Sequence
  chemically synthesized
caccatgttagccaggatggtc

SEQ ID NO: 889056 - DNA, 22 bp, Artificial Sequence
  chemically synthesized
gtagaggcggggtttcaccatg

SEQ ID NO: 889057 - DNA, 22 bp, Artificial Sequence
  chemically synthesized
agtagaggcggggtttcaccat

SEQ ID NO: 889058 - DNA, 22 bp, Artificial Sequence
  chemically synthesized
tagtagaggcggggtttcacca

SEQ ID NO: 889059 - DNA, 22 bp, Artificial Sequence
  chemically synthesized
ttagtagaggcggggtttcacc

SEQ ID NO: 889060 - DNA, 22 bp, Artificial Sequence
  chemically synthesized
gctaacatggtgaaaccccgcc

SEQ ID NO: 889061 - DNA, 22 bp, Artificial Sequence
  chemically synthesized
tgtatttttagtagaggcgggg

SEQ ID NO: 889062 - DNA, 22 bp, Artificial Sequence
  chemically synthesized
acatggtgaaaccccgcctcta

SEQ ID NO: 889063 - DNA, 22 bp, Artificial Sequence
  chemically synthesized
gtgtatttttagtagaggcggg

SEQ ID NO: 889064 - DNA, 22 bp, Artificial Sequence
  chemically synthesized
tgtgtatttttagtagaggcgg

SEQ ID NO: 889065 - DNA, 22 bp, Artificial Sequence
  chemically synthesized
attttgtgtatttttagtagag

SEQ ID NO: 889066 - DNA, 22 bp, Artificial Sequence
  chemically synthesized
tactaaaaatacacaaaattag

SEQ ID NO: 889067 - DNA, 22 bp, Artificial Sequence
  chemically synthesized
ctaaaaatacacaaaattagcc

SEQ ID NO: 889068 - DNA, 22 bp, Artificial Sequence
  chemically synthesized
aaaatacacaaaattagccggg

SEQ ID NO: 889069 - DNA, 22 bp, Artificial Sequence
  chemically synthesized
caggcgcccgccaccacgcccg

SEQ ID NO: 889070 - DNA, 22 bp, Artificial Sequence
  chemically synthesized
ggactacaggcgcccgccacca

SEQ ID NO: 889071 - DNA, 22 bp, Artificial Sequence
  chemically synthesized
gccgggcgtggtggcgggcgcc

SEQ ID NO: 889072 - DNA, 22 bp, Artificial Sequence
  chemically synthesized
ccgagcagctgggactacaggc

SEQ ID NO: 889073 - DNA, 22 bp, Artificial Sequence
  chemically synthesized
cgtcatcctcccgagcagctgg

SEQ ID NO: 889074 - DNA, 22 bp, Artificial Sequence
  chemically synthesized
ctgcgtcatcctcccgagcagc

SEQ ID NO: 889075 - DNA, 22 bp, Artificial Sequence
  chemically synthesized
tcctgcgtcatcctcccgagca

SEQ ID NO: 889076 - DNA, 22 bp, Artificial Sequence
  chemically synthesized
tagtcccagctgctcgggagga

SEQ ID NO: 889077 - DNA, 22 bp, Artificial Sequence
  chemically synthesized
acgccattctcctgcgtcatcc

SEQ ID NO: 889078 - DNA, 22 bp, Artificial Sequence
  chemically synthesized
ctcgggaggatgacgcaggaga

SEQ ID NO: 889079 - DNA, 22 bp, Artificial Sequence
  chemically synthesized
ggttcacgccattctcctgcgt

SEQ ID NO: 889080 - DNA, 22 bp, Artificial Sequence
  chemically synthesized
gggaggatgacgcaggagaatg

SEQ ID NO: 889081 - DNA, 22 bp, Artificial Sequence
  chemically synthesized
ctgggttcacgccattctcctg

SEQ ID NO: 889082 - DNA, 22 bp, Artificial Sequence
  chemically synthesized
cgcctcctgggttcacgccatt

SEQ ID NO: 889083 - DNA, 22 bp, Artificial Sequence
  chemically synthesized
caagctccgcctcctgggttca

SEQ ID NO: 889084 - DNA, 22 bp, Artificial Sequence
  chemically synthesized
actgcaagctccgcctcctggg

SEQ ID NO: 889085 - DNA, 22 bp, Artificial Sequence
  chemically synthesized
agctcactgcaagctccgcctc

SEQ ID NO: 889086 - DNA, 22 bp, Artificial Sequence
  chemically synthesized
gagtgcagtggcgtgatctcag

SEQ ID NO: 889087 - DNA, 22 bp, Artificial Sequence
  chemically synthesized
gcagtgagctgagatcacgcca

SEQ ID NO: 889088 - DNA, 22 bp, Artificial Sequence
  chemically synthesized
cagtgagctgagatcacgccac

SEQ ID NO: 889089 - DNA, 22 bp, Artificial Sequence
  chemically synthesized
agtcgcccaggctggagtgcag

SEQ ID NO: 889090 - DNA, 22 bp, Artificial Sequence
  chemically synthesized
agatcacgccactgcactccag

SEQ ID NO: 889091 - DNA, 22 bp, Artificial Sequence
  chemically synthesized
ctcagtcgcccaggctggagtg

SEQ ID NO: 889092 - DNA, 22 bp, Artificial Sequence
  chemically synthesized
gctcagtcgcccaggctggagt

SEQ ID NO: 889093 - DNA, 22 bp, Artificial Sequence
  chemically synthesized
cactccagcctgggcgactgag

SEQ ID NO: 889094 - DNA, 22 bp, Artificial Sequence
  chemically synthesized
agacggagtcttgctcagtcgc

SEQ ID NO: 889095 - DNA, 22 bp, Artificial Sequence
  chemically synthesized
gagacggagtcttgctcagtcg

SEQ ID NO: 889096 - DNA, 22 bp, Artificial Sequence
  chemically synthesized
cagcctgggcgactgagcaaga

SEQ ID NO: 889097 - DNA, 22 bp, Artificial Sequence
  chemically synthesized
tttgagacggagtcttgctcag

SEQ ID NO: 889098 - DNA, 22 bp, Artificial Sequence
  chemically synthesized
gtttgagacggagtcttgctca

SEQ ID NO: 889099 - DNA, 22 bp, Artificial Sequence
  chemically synthesized
tttgtttgagacggagtcttgc

SEQ ID NO: 889100 - DNA, 22 bp, Artificial Sequence
  chemically synthesized
gtttgtttgagacggagtcttg

SEQ ID NO: 889101 - DNA, 22 bp, Artificial Sequence
  chemically synthesized
ggcgactgagcaagactccgtc

SEQ ID NO: 889102 - DNA, 22 bp, Artificial Sequence
  chemically synthesized
tttgtttgtttgagacggagtc

SEQ ID NO: 889103 - DNA, 22 bp, Artificial Sequence
  chemically synthesized
gtttgtttgtttgagacggagt

SEQ ID NO: 889104 - DNA, 22 bp, Artificial Sequence
  chemically synthesized
tgtttgtttgtttgagacggag

SEQ ID NO: 889105 - DNA, 22 bp, Artificial Sequence
  chemically synthesized
ttgtttgtttgtttgagacgga

SEQ ID NO: 889106 - DNA, 22 bp, Artificial Sequence
  chemically synthesized
tttgtttgtttgtttgagacgg

SEQ ID NO: 889107 - DNA, 22 bp, Artificial Sequence
  chemically synthesized
ttttgtttgtttgtttgagacg

SEQ ID NO: 889108 - DNA, 22 bp, Artificial Sequence
  chemically synthesized
tttttgtttgtttgtttgagac

SEQ ID NO: 889109 - DNA, 22 bp, Artificial Sequence
  chemically synthesized
agcaagactccgtctcaaacaa

SEQ ID NO: 889110 - DNA, 22 bp, Artificial Sequence
  chemically synthesized
ttttttgtttgtttgtttgaga

SEQ ID NO: 889111 - DNA, 22 bp, Artificial Sequence
  chemically synthesized
cgtctcaaacaaacaaacaaaa

SEQ ID NO: 889112 - DNA, 22 bp, Artificial Sequence
  chemically synthesized
aaacaaacaaacaaaaaaaaga

SEQ ID NO: 889113 - DNA, 22 bp, Artificial Sequence
  chemically synthesized
ccacaggaacaaatccagtcaa

SEQ ID NO: 889114 - DNA, 22 bp, Artificial Sequence
  chemically synthesized
gactggatttgttcctgtggta

SEQ ID NO: 889115 - DNA, 22 bp, Artificial Sequence
  chemically synthesized
gaatgaagtgcctaccacagga

SEQ ID NO: 889116 - DNA, 22 bp, Artificial Sequence
  chemically synthesized
actggatttgttcctgtggtag

SEQ ID NO: 889117 - DNA, 22 bp, Artificial Sequence
  chemically synthesized
gatttgttcctgtggtaggcac

SEQ ID NO: 889118 - DNA, 22 bp, Artificial Sequence
  chemically synthesized
gttcctgtggtaggcacttcat

SEQ ID NO: 889119 - DNA, 22 bp, Artificial Sequence
  chemically synthesized
ttcctgtggtaggcacttcatt

SEQ ID NO: 889120 - DNA, 22 bp, Artificial Sequence
  chemically synthesized
ctgtggtaggcacttcattcca

SEQ ID NO: 889121 - DNA, 22 bp, Artificial Sequence
  chemically synthesized
tggtaggcacttcattccaatt

SEQ ID NO: 889122 - DNA, 22 bp, Artificial Sequence
  chemically synthesized
accaaaaagtgggcaagaaaat

SEQ ID NO: 889123 - DNA, 22 bp, Artificial Sequence
  chemically synthesized
cattccaattttcttgcccact

SEQ ID NO: 889124 - DNA, 22 bp, Artificial Sequence
  chemically synthesized
attccaattttcttgcccactt

SEQ ID NO: 889125 - DNA, 22 bp, Artificial Sequence
  chemically synthesized
tcattaaccaaaaagtgggcaa

SEQ ID NO: 889126 - DNA, 22 bp, Artificial Sequence
  chemically synthesized
caattttcttgcccactttttg

SEQ ID NO: 889127 - DNA, 22 bp, Artificial Sequence
  chemically synthesized
tcttgcccactttttggttaat

SEQ ID NO: 889128 - DNA, 22 bp, Artificial Sequence
  chemically synthesized
cttgcccactttttggttaatg

SEQ ID NO: 889129 - DNA, 22 bp, Artificial Sequence
  chemically synthesized
ttgcccactttttggttaatga

SEQ ID NO: 889130 - DNA, 22 bp, Artificial Sequence
  chemically synthesized
gcccactttttggttaatgaca

SEQ ID NO: 889131 - DNA, 22 bp, Artificial Sequence
  chemically synthesized
cccactttttggttaatgacag

SEQ ID NO: 889132 - DNA, 22 bp, Artificial Sequence
  chemically synthesized
taaagcggaagaaagtctgtca

SEQ ID NO: 889133 - DNA, 22 bp, Artificial Sequence
  chemically synthesized
gtaaagcggaagaaagtctgtc

SEQ ID NO: 889134 - DNA, 22 bp, Artificial Sequence
  chemically synthesized
tgtaaagcggaagaaagtctgt

SEQ ID NO: 889135 - DNA, 22 bp, Artificial Sequence
  chemically synthesized
tttggttaatgacagactttct

SEQ ID NO: 889136 - DNA, 22 bp, Artificial Sequence
  chemically synthesized
ttggttaatgacagactttctt

SEQ ID NO: 889137 - DNA, 22 bp, Artificial Sequence
  chemically synthesized
tggttaatgacagactttcttc

SEQ ID NO: 889138 - DNA, 22 bp, Artificial Sequence
  chemically synthesized
ttttgtaaagcggaagaaagtc

SEQ ID NO: 889139 - DNA, 22 bp, Artificial Sequence
  chemically synthesized
ggttaatgacagactttcttcc

SEQ ID NO: 889140 - DNA, 22 bp, Artificial Sequence
  chemically synthesized
attttgtaaagcggaagaaagt

SEQ ID NO: 889141 - DNA, 22 bp, Artificial Sequence
  chemically synthesized
gttaatgacagactttcttccg

SEQ ID NO: 889142 - DNA, 22 bp, Artificial Sequence
  chemically synthesized
tattttgtaaagcggaagaaag

SEQ ID NO: 889143 - DNA, 22 bp, Artificial Sequence
  chemically synthesized
ttattttgtaaagcggaagaaa

SEQ ID NO: 889144 - DNA, 22 bp, Artificial Sequence
  chemically synthesized
atgacagactttcttccgcttt

SEQ ID NO: 889145 - DNA, 22 bp, Artificial Sequence
  chemically synthesized
tcttccgctttacaaaataaaa

SEQ ID NO: 889146 - DNA, 22 bp, Artificial Sequence
  chemically synthesized
cttccgctttacaaaataaaag

SEQ ID NO: 889147 - DNA, 22 bp, Artificial Sequence
  chemically synthesized
ttccgctttacaaaataaaagc

SEQ ID NO: 889148 - DNA, 22 bp, Artificial Sequence
  chemically synthesized
ccgctttacaaaataaaagcac

SEQ ID NO: 889149 - DNA, 22 bp, Artificial Sequence
  chemically synthesized
cgctttacaaaataaaagcaca

SEQ ID NO: 889150 - DNA, 22 bp, Artificial Sequence
  chemically synthesized
tacaaaataaaagcacacctct

SEQ ID NO: 889151 - DNA, 22 bp, Artificial Sequence
  chemically synthesized
acaaaataaaagcacacctctc

SEQ ID NO: 889152 - DNA, 22 bp, Artificial Sequence
  chemically synthesized
caaaataaaagcacacctctct

SEQ ID NO: 889153 - DNA, 22 bp, Artificial Sequence
  chemically synthesized
caatgcaccagtgggataggtc

SEQ ID NO: 889154 - DNA, 22 bp, Artificial Sequence
  chemically synthesized
actacaatgcaccagtgggata

SEQ ID NO: 889155 - DNA, 22 bp, Artificial Sequence
  chemically synthesized
gactacaatgcaccagtgggat

SEQ ID NO: 889156 - DNA, 22 bp, Artificial Sequence
  chemically synthesized
tctgacctatcccactggtgca

SEQ ID NO: 889157 - DNA, 22 bp, Artificial Sequence
  chemically synthesized
tgacctatcccactggtgcatt

SEQ ID NO: 889158 - DNA, 22 bp, Artificial Sequence
  chemically synthesized
acctatcccactggtgcattgt

SEQ ID NO: 889159 - DNA, 22 bp, Artificial Sequence
  chemically synthesized
tcccactggtgcattgtagtca

SEQ ID NO: 889160 - DNA, 22 bp, Artificial Sequence
  chemically synthesized
gcataaatgtatcttgactaca

SEQ ID NO: 889161 - DNA, 22 bp, Artificial Sequence
  chemically synthesized
ggcataaatgtatcttgactac

SEQ ID NO: 889162 - DNA, 22 bp, Artificial Sequence
  chemically synthesized
tttggcataaatgtatcttgac

SEQ ID NO: 889163 - DNA, 22 bp, Artificial Sequence
  chemically synthesized
atttggcataaatgtatcttga

SEQ ID NO: 889164 - DNA, 22 bp, Artificial Sequence
  chemically synthesized
gtgcattgtagtcaagatacat

SEQ ID NO: 889165 - DNA, 22 bp, Artificial Sequence
  chemically synthesized
tatttggcataaatgtatcttg

SEQ ID NO: 889166 - DNA, 22 bp, Artificial Sequence
  chemically synthesized
ttatttggcataaatgtatctt

SEQ ID NO: 889167 - DNA, 22 bp, Artificial Sequence
  chemically synthesized
tacttttatttggcataaatgt

SEQ ID NO: 889168 - DNA, 22 bp, Artificial Sequence
  chemically synthesized
tagtcaagatacatttatgcca

SEQ ID NO: 889169 - DNA, 22 bp, Artificial Sequence
  chemically synthesized
aattgtacttttatttggcata

SEQ ID NO: 889170 - DNA, 22 bp, Artificial Sequence
  chemically synthesized
gaattgtacttttatttggcat

SEQ ID NO: 889171 - DNA, 22 bp, Artificial Sequence
  chemically synthesized
tgaattgtacttttatttggca

SEQ ID NO: 889172 - DNA, 22 bp, Artificial Sequence
  chemically synthesized
atattttgaattgtacttttat

SEQ ID NO: 889173 - DNA, 22 bp, Artificial Sequence
  chemically synthesized
atgccaaataaaagtacaattc

SEQ ID NO: 889174 - DNA, 22 bp, Artificial Sequence
  chemically synthesized
tgccaaataaaagtacaattca

SEQ ID NO: 889175 - DNA, 22 bp, Artificial Sequence
  chemically synthesized
agtcgctaatattttgaattgt

SEQ ID NO: 889176 - DNA, 22 bp, Artificial Sequence
  chemically synthesized
cagtcgctaatattttgaattg

SEQ ID NO: 889177 - DNA, 22 bp, Artificial Sequence
  chemically synthesized
agtaaagaaggatttcagtcgc

SEQ ID NO: 889178 - DNA, 22 bp, Artificial Sequence
  chemically synthesized
gagtaaagaaggatttcagtcg

SEQ ID NO: 889179 - DNA, 22 bp, Artificial Sequence
  chemically synthesized
aaaatattagcgactgaaatcc

SEQ ID NO: 889180 - DNA, 22 bp, Artificial Sequence
  chemically synthesized
atggtaccttgagtaaagaagg

SEQ ID NO: 889181 - DNA, 22 bp, Artificial Sequence
  chemically synthesized
gcgactgaaatccttctttact

SEQ ID NO: 889182 - DNA, 22 bp, Artificial Sequence
  chemically synthesized
gatggtaccttgagtaaagaag

SEQ ID NO: 889183 - DNA, 22 bp, Artificial Sequence
  chemically synthesized
aaatccttctttactcaaggta

SEQ ID NO: 889184 - DNA, 22 bp, Artificial Sequence
  chemically synthesized
ctttactcaaggtaccatcaaa

SEQ ID NO: 889185 - DNA, 22 bp, Artificial Sequence
  chemically synthesized
tttactcaaggtaccatcaaat

SEQ ID NO: 889186 - DNA, 22 bp, Artificial Sequence
  chemically synthesized
tactcaaggtaccatcaaatac

SEQ ID NO: 889187 - DNA, 22 bp, Artificial Sequence
  chemically synthesized
tgagatggatgggtatttgatg

SEQ ID NO: 889188 - DNA, 22 bp, Artificial Sequence
  chemically synthesized
actcaaggtaccatcaaatacc

SEQ ID NO: 889189 - DNA, 22 bp, Artificial Sequence
  chemically synthesized
ctcaaggtaccatcaaataccc

SEQ ID NO: 889190 - DNA, 22 bp, Artificial Sequence
  chemically synthesized
ttatgagatggatgggtatttg

SEQ ID NO: 889191 - DNA, 22 bp, Artificial Sequence
  chemically synthesized
aaggtaccatcaaatacccatc

SEQ ID NO: 889192 - DNA, 22 bp, Artificial Sequence
  chemically synthesized
aaaatgaatctattatgagatg

SEQ ID NO: 889193 - DNA, 22 bp, Artificial Sequence
  chemically synthesized
ttgaaaatgaatctattatgag

SEQ ID NO: 889194 - DNA, 22 bp, Artificial Sequence
  chemically synthesized
agtggatagttattgaaaatga

SEQ ID NO: 889195 - DNA, 22 bp, Artificial Sequence
  chemically synthesized
ataatagattcattttcaataa

SEQ ID NO: 889196 - DNA, 22 bp, Artificial Sequence
  chemically synthesized
aacatactcagtggatagttat

SEQ ID NO: 889197 - DNA, 22 bp, Artificial Sequence
  chemically synthesized
ttaaacatactcagtggatagt

SEQ ID NO: 889198 - DNA, 22 bp, Artificial Sequence
  chemically synthesized
attttcaataactatccactga

SEQ ID NO: 889199 - DNA, 22 bp, Artificial Sequence
  chemically synthesized
tcaataactatccactgagtat

SEQ ID NO: 889200 - DNA, 22 bp, Artificial Sequence
  chemically synthesized
caataactatccactgagtatg

SEQ ID NO: 889201 - DNA, 22 bp, Artificial Sequence
  chemically synthesized
aataactatccactgagtatgt

SEQ ID NO: 889202 - DNA, 22 bp, Artificial Sequence
  chemically synthesized
ataaataattattaaacatact

SEQ ID NO: 889203 - DNA, 22 bp, Artificial Sequence
  chemically synthesized
gataaataattattaaacatac

SEQ ID NO: 889204 - DNA, 22 bp, Artificial Sequence
  chemically synthesized
tgataaataattattaaacata

SEQ ID NO: 889205 - DNA, 22 bp, Artificial Sequence
  chemically synthesized
ttgataaataattattaaacat

SEQ ID NO: 889206 - DNA, 22 bp, Artificial Sequence
  chemically synthesized
tccactgagtatgtttaataat

SEQ ID NO: 889207 - DNA, 22 bp, Artificial Sequence
  chemically synthesized
agtatgtttaataattatttat

SEQ ID NO: 889208 - DNA, 22 bp, Artificial Sequence
  chemically synthesized
aatatatgtaccttttgataaa

SEQ ID NO: 889209 - DNA, 22 bp, Artificial Sequence
  chemically synthesized
aataattatttatcaaaaggta

SEQ ID NO: 889210 - DNA, 22 bp, Artificial Sequence
  chemically synthesized
ataattatttatcaaaaggtac

SEQ ID NO: 889211 - DNA, 22 bp, Artificial Sequence
  chemically synthesized
tttatcaaaaggtacatatatt

SEQ ID NO: 889212 - DNA, 22 bp, Artificial Sequence
  chemically synthesized
atcaaaaggtacatatatttag

SEQ ID NO: 889213 - DNA, 22 bp, Artificial Sequence
  chemically synthesized
tcaaaaggtacatatatttagg

SEQ ID NO: 889214 - DNA, 22 bp, Artificial Sequence
  chemically synthesized
gtaataaccaaataacctaaat

SEQ ID NO: 889215 - DNA, 22 bp, Artificial Sequence
  chemically synthesized
agtaataaccaaataacctaaa

SEQ ID NO: 889216 - DNA, 22 bp, Artificial Sequence
  chemically synthesized
aggttatttggttattactaag

SEQ ID NO: 889217 - DNA, 22 bp, Artificial Sequence
  chemically synthesized
ataataaatacacttagtaata

SEQ ID NO: 889218 - DNA, 22 bp, Artificial Sequence
  chemically synthesized
ggttatttggttattactaagt

SEQ ID NO: 889219 - DNA, 22 bp, Artificial Sequence
  chemically synthesized
tttggttattactaagtgtatt

SEQ ID NO: 889220 - DNA, 22 bp, Artificial Sequence
  chemically synthesized
aagtattaataataaatacact

SEQ ID NO: 889221 - DNA, 22 bp, Artificial Sequence
  chemically synthesized
ggttattactaagtgtatttat

SEQ ID NO: 889222 - DNA, 22 bp, Artificial Sequence
  chemically synthesized
aaagtattaataataaatacac

SEQ ID NO: 889223 - DNA, 22 bp, Artificial Sequence
  chemically synthesized
gttattactaagtgtatttatt

SEQ ID NO: 889224 - DNA, 22 bp, Artificial Sequence
  chemically synthesized
ttactaagtgtatttattatta

SEQ ID NO: 889225 - DNA, 22 bp, Artificial Sequence
  chemically synthesized
ctaagtgtatttattattaata

SEQ ID NO: 889226 - DNA, 22 bp, Artificial Sequence
  chemically synthesized
agtagtatttaaagtattaata

SEQ ID NO: 889227 - DNA, 22 bp, Artificial Sequence
  chemically synthesized
agtgtatttattattaatactt

SEQ ID NO: 889228 - DNA, 22 bp, Artificial Sequence
  chemically synthesized
gattgagtagtatttaaagtat

SEQ ID NO: 889229 - DNA, 22 bp, Artificial Sequence
  chemically synthesized
tagattgagtagtatttaaagt

SEQ ID NO: 889230 - DNA, 22 bp, Artificial Sequence
  chemically synthesized
tctagattgagtagtatttaaa

SEQ ID NO: 889231 - DNA, 22 bp, Artificial Sequence
  chemically synthesized
attattaatactttaaatacta

SEQ ID NO: 889232 - DNA, 22 bp, Artificial Sequence
  chemically synthesized
ttattaatactttaaatactac

SEQ ID NO: 889233 - DNA, 22 bp, Artificial Sequence
  chemically synthesized
ttaatactttaaatactactca

SEQ ID NO: 889234 - DNA, 22 bp, Artificial Sequence
  chemically synthesized
aaattctctagattgagtagta

SEQ ID NO: 889235 - DNA, 22 bp, Artificial Sequence
  chemically synthesized
aaaattctctagattgagtagt

SEQ ID NO: 889236 - DNA, 22 bp, Artificial Sequence
  chemically synthesized
atactttaaatactactcaatc

SEQ ID NO: 889237 - DNA, 22 bp, Artificial Sequence
  chemically synthesized
taaaattctctagattgagtag

SEQ ID NO: 889238 - DNA, 22 bp, Artificial Sequence
  chemically synthesized
ttaaaattctctagattgagta

SEQ ID NO: 889239 - DNA, 22 bp, Artificial Sequence
  chemically synthesized
taaatactactcaatctagaga

SEQ ID NO: 889240 - DNA, 22 bp, Artificial Sequence
  chemically synthesized
aaatactactcaatctagagaa

SEQ ID NO: 889241 - DNA, 22 bp, Artificial Sequence
  chemically synthesized
aatactactcaatctagagaat

SEQ ID NO: 889242 - DNA, 22 bp, Artificial Sequence
  chemically synthesized
agtatttttaaaattctctaga

SEQ ID NO: 889243 - DNA, 22 bp, Artificial Sequence
  chemically synthesized
taagtatttttaaaattctcta

SEQ ID NO: 889244 - DNA, 22 bp, Artificial Sequence
  chemically synthesized
ctcaatctagagaattttaaaa

SEQ ID NO: 889245 - DNA, 22 bp, Artificial Sequence
  chemically synthesized
aatctagagaattttaaaaata

SEQ ID NO: 889246 - DNA, 22 bp, Artificial Sequence
  chemically synthesized
caaggctctaagtatttttaaa

SEQ ID NO: 889247 - DNA, 22 bp, Artificial Sequence
  chemically synthesized
gagaattttaaaaatacttaga

SEQ ID NO: 889248 - DNA, 22 bp, Artificial Sequence
  chemically synthesized
tgactacaaggctctaagtatt

SEQ ID NO: 889249 - DNA, 22 bp, Artificial Sequence
  chemically synthesized
ctgtgactacaaggctctaagt

SEQ ID NO: 889250 - DNA, 22 bp, Artificial Sequence
  chemically synthesized
cctgtgactacaaggctctaag

SEQ ID NO: 889251 - DNA, 22 bp, Artificial Sequence
  chemically synthesized
taaaaatacttagagccttgta

SEQ ID NO: 889252 - DNA, 22 bp, Artificial Sequence
  chemically synthesized
aaaaatacttagagccttgtag

SEQ ID NO: 889253 - DNA, 22 bp, Artificial Sequence
  chemically synthesized
aaaatacttagagccttgtagt

SEQ ID NO: 889254 - DNA, 22 bp, Artificial Sequence
  chemically synthesized
aaaacaatttcctgtgactaca

SEQ ID NO: 889255 - DNA, 22 bp, Artificial Sequence
  chemically synthesized
aaaaacaatttcctgtgactac

SEQ ID NO: 889256 - DNA, 22 bp, Artificial Sequence
  chemically synthesized
taaaaacaatttcctgtgacta

SEQ ID NO: 889257 - DNA, 22 bp, Artificial Sequence
  chemically synthesized
ttaaaaacaatttcctgtgact

SEQ ID NO: 889258 - DNA, 22 bp, Artificial Sequence
  chemically synthesized
agagccttgtagtcacaggaaa

SEQ ID NO: 889259 - DNA, 22 bp, Artificial Sequence
  chemically synthesized
gagccttgtagtcacaggaaat

SEQ ID NO: 889260 - DNA, 22 bp, Artificial Sequence
  chemically synthesized
aatttttaaaaacaatttcctg

SEQ ID NO: 889261 - DNA, 22 bp, Artificial Sequence
  chemically synthesized
gtagtcacaggaaattgttttt

SEQ ID NO: 889262 - DNA, 22 bp, Artificial Sequence
  chemically synthesized
aattcaatttttaaaaacaatt

SEQ ID NO: 889263 - DNA, 22 bp, Artificial Sequence
  chemically synthesized
tagtcacaggaaattgttttta

SEQ ID NO: 889264 - DNA, 22 bp, Artificial Sequence
  chemically synthesized
aaattcaatttttaaaaacaat

SEQ ID NO: 889265 - DNA, 22 bp, Artificial Sequence
  chemically synthesized
tgtggacttaaattcaattttt

SEQ ID NO: 889266 - DNA, 22 bp, Artificial Sequence
  chemically synthesized
atgtggacttaaattcaatttt

SEQ ID NO: 889267 - DNA, 22 bp, Artificial Sequence
  chemically synthesized
tatttatgtggacttaaattca

SEQ ID NO: 889268 - DNA, 22 bp, Artificial Sequence
  chemically synthesized
tttttaaaaattgaatttaagt

SEQ ID NO: 889269 - DNA, 22 bp, Artificial Sequence
  chemically synthesized
ttaaaaattgaatttaagtcca

SEQ ID NO: 889270 - DNA, 22 bp, Artificial Sequence
  chemically synthesized
taaaaattgaatttaagtccac

SEQ ID NO: 889271 - DNA, 22 bp, Artificial Sequence
  chemically synthesized
aaaaattgaatttaagtccaca

SEQ ID NO: 889272 - DNA, 22 bp, Artificial Sequence
  chemically synthesized
aaaattgaatttaagtccacat

SEQ ID NO: 889273 - DNA, 22 bp, Artificial Sequence
  chemically synthesized
taaaattatatttatgtggact

SEQ ID NO: 889274 - DNA, 22 bp, Artificial Sequence
  chemically synthesized
ataaaattatatttatgtggac

SEQ ID NO: 889275 - DNA, 22 bp, Artificial Sequence
  chemically synthesized
tataaaattatatttatgtgga

SEQ ID NO: 889276 - DNA, 22 bp, Artificial Sequence
  chemically synthesized
tttataaaattatatttatgtg

SEQ ID NO: 889277 - DNA, 22 bp, Artificial Sequence
  chemically synthesized
aatttaagtccacataaatata

SEQ ID NO: 889278 - DNA, 22 bp, Artificial Sequence
  chemically synthesized
aagtccacataaatataatttt

SEQ ID NO: 889279 - DNA, 22 bp, Artificial Sequence
  chemically synthesized
agtccacataaatataatttta

SEQ ID NO: 889280 - DNA, 22 bp, Artificial Sequence
  chemically synthesized
tcataattctttataaaattat

SEQ ID NO: 889281 - DNA, 22 bp, Artificial Sequence
  chemically synthesized
tatcataattctttataaaatt

SEQ ID NO: 889282 - DNA, 22 bp, Artificial Sequence
  chemically synthesized
gccactctatcataattcttta

SEQ ID NO: 889283 - DNA, 22 bp, Artificial Sequence
  chemically synthesized
ttagccactctatcataattct

SEQ ID NO: 889284 - DNA, 22 bp, Artificial Sequence
  chemically synthesized
attagccactctatcataattc

SEQ ID NO: 889285 - DNA, 22 bp, Artificial Sequence
  chemically synthesized
tattagccactctatcataatt

SEQ ID NO: 889286 - DNA, 22 bp, Artificial Sequence
  chemically synthesized
tataaagaattatgatagagtg

SEQ ID NO: 889287 - DNA, 22 bp, Artificial Sequence
  chemically synthesized
ataaagaattatgatagagtgg

SEQ ID NO: 889288 - DNA, 22 bp, Artificial Sequence
  chemically synthesized
taaagaattatgatagagtggc

SEQ ID NO: 889289 - DNA, 22 bp, Artificial Sequence
  chemically synthesized
taaagttttattagccactcta

SEQ ID NO: 889290 - DNA, 22 bp, Artificial Sequence
  chemically synthesized
tgctataaagttttattagcca

SEQ ID NO: 889291 - DNA, 22 bp, Artificial Sequence
  chemically synthesized
atgctataaagttttattagcc

SEQ ID NO: 889292 - DNA, 22 bp, Artificial Sequence
  chemically synthesized
tgatagagtggctaataaaact

SEQ ID NO: 889293 - DNA, 22 bp, Artificial Sequence
  chemically synthesized
ataaaactttatagcataaata

SEQ ID NO: 889294 - DNA, 22 bp, Artificial Sequence
  chemically synthesized
tatagcataaatatgtatcaca

SEQ ID NO: 889295 - DNA, 22 bp, Artificial Sequence
  chemically synthesized
atgtgataaatatgtgatacat

SEQ ID NO: 889296 - DNA, 22 bp, Artificial Sequence
  chemically synthesized
atagcataaatatgtatcacat

SEQ ID NO: 889297 - DNA, 22 bp, Artificial Sequence
  chemically synthesized
tagcataaatatgtatcacata

SEQ ID NO: 889298 - DNA, 22 bp, Artificial Sequence
  chemically synthesized
taatgtgataaatatgtgatac

SEQ ID NO: 889299 - DNA, 22 bp, Artificial Sequence
  chemically synthesized
tattctaatgtgataaatatgt

SEQ ID NO: 889300 - DNA, 22 bp, Artificial Sequence
  chemically synthesized
cccaatgaattgtattctaatg

SEQ ID NO: 889301 - DNA, 22 bp, Artificial Sequence
  chemically synthesized
ccccaatgaattgtattctaat

SEQ ID NO: 889302 - DNA, 22 bp, Artificial Sequence
  chemically synthesized
aacttccccaatgaattgtatt

SEQ ID NO: 889303 - DNA, 22 bp, Artificial Sequence
  chemically synthesized
caacttccccaatgaattgtat

SEQ ID NO: 889304 - DNA, 22 bp, Artificial Sequence
  chemically synthesized
atcacattagaatacaattcat

SEQ ID NO: 889305 - DNA, 22 bp, Artificial Sequence
  chemically synthesized
tcaacttccccaatgaattgta

SEQ ID NO: 889306 - DNA, 22 bp, Artificial Sequence
  chemically synthesized
tcacattagaatacaattcatt

SEQ ID NO: 889307 - DNA, 22 bp, Artificial Sequence
  chemically synthesized
ttcaacttccccaatgaattgt

SEQ ID NO: 889308 - DNA, 22 bp, Artificial Sequence
  chemically synthesized
gaatacaattcattggggaagt

SEQ ID NO: 889309 - DNA, 22 bp, Artificial Sequence
  chemically synthesized
aatcatatttttcaacttcccc

SEQ ID NO: 889310 - DNA, 22 bp, Artificial Sequence
  chemically synthesized
aaatcatatttttcaacttccc

SEQ ID NO: 889311 - DNA, 22 bp, Artificial Sequence
  chemically synthesized
tttaaatcatatttttcaactt

SEQ ID NO: 889312 - DNA, 22 bp, Artificial Sequence
  chemically synthesized
atttaaatcatatttttcaact

SEQ ID NO: 889313 - DNA, 22 bp, Artificial Sequence
  chemically synthesized
tatttaaatcatatttttcaac

SEQ ID NO: 889314 - DNA, 22 bp, Artificial Sequence
  chemically synthesized
ttatttaaatcatatttttcaa

SEQ ID NO: 889315 - DNA, 22 bp, Artificial Sequence
  chemically synthesized
tttatttaaatcatatttttca

SEQ ID NO: 889316 - DNA, 22 bp, Artificial Sequence
  chemically synthesized
attggggaagttgaaaaatatg

SEQ ID NO: 889317 - DNA, 22 bp, Artificial Sequence
  chemically synthesized
ctttttatttaaatcatatttt

SEQ ID NO: 889318 - DNA, 22 bp, Artificial Sequence
  chemically synthesized
gggaagttgaaaaatatgattt

SEQ ID NO: 889319 - DNA, 22 bp, Artificial Sequence
  chemically synthesized
ttcctttttatttaaatcatat

SEQ ID NO: 889320 - DNA, 22 bp, Artificial Sequence
  chemically synthesized
tattattcctttttatttaaat

SEQ ID NO: 889321 - DNA, 22 bp, Artificial Sequence
  chemically synthesized
atattattcctttttatttaaa

SEQ ID NO: 889322 - DNA, 22 bp, Artificial Sequence
  chemically synthesized
tatattattcctttttatttaa

SEQ ID NO: 889323 - DNA, 22 bp, Artificial Sequence
  chemically synthesized
aaaaatatgatttaaataaaaa

SEQ ID NO: 889324 - DNA, 22 bp, Artificial Sequence
  chemically synthesized
aaataaaaaggaataatataaa

SEQ ID NO: 889325 - DNA, 22 bp, Artificial Sequence
  chemically synthesized
ataaatagaagttttatattat

SEQ ID NO: 889326 - DNA, 22 bp, Artificial Sequence
  chemically synthesized
aataaaaaggaataatataaaa

SEQ ID NO: 889327 - DNA, 22 bp, Artificial Sequence
  chemically synthesized
aataaatagaagttttatatta

SEQ ID NO: 889328 - DNA, 22 bp, Artificial Sequence
  chemically synthesized
atatttaataaatagaagtttt

SEQ ID NO: 889329 - DNA, 22 bp, Artificial Sequence
  chemically synthesized
ctatttattaaatatgagcttt

SEQ ID NO: 889330 - DNA, 22 bp, Artificial Sequence
  chemically synthesized
aaaatacatgaaaaagctcata

SEQ ID NO: 889331 - DNA, 22 bp, Artificial Sequence
  chemically synthesized
tatttattaaatatgagctttt

SEQ ID NO: 889332 - DNA, 22 bp, Artificial Sequence
  chemically synthesized
aaaaatacatgaaaaagctcat

SEQ ID NO: 889333 - DNA, 22 bp, Artificial Sequence
  chemically synthesized
tttattaaatatgagctttttc

SEQ ID NO: 889334 - DNA, 22 bp, Artificial Sequence
  chemically synthesized
attaaatatgagctttttcatg

SEQ ID NO: 889335 - DNA, 22 bp, Artificial Sequence
  chemically synthesized
ttaaatatgagctttttcatgt

SEQ ID NO: 889336 - DNA, 22 bp, Artificial Sequence
  chemically synthesized
aatatgagctttttcatgtatt

SEQ ID NO: 889337 - DNA, 22 bp, Artificial Sequence
  chemically synthesized
ccatcatatacttaaaaataca

SEQ ID NO: 889338 - DNA, 22 bp, Artificial Sequence
  chemically synthesized
tttcatgtatttttaagtatat

SEQ ID NO: 889339 - DNA, 22 bp, Artificial Sequence
  chemically synthesized
ttcatgtatttttaagtatatg

SEQ ID NO: 889340 - DNA, 22 bp, Artificial Sequence
  chemically synthesized
tcatgtatttttaagtatatga

SEQ ID NO: 889341 - DNA, 22 bp, Artificial Sequence
  chemically synthesized
catgtatttttaagtatatgat

SEQ ID NO: 889342 - DNA, 22 bp, Artificial Sequence
  chemically synthesized
atgtatttttaagtatatgatg

SEQ ID NO: 889343 - DNA, 22 bp, Artificial Sequence
  chemically synthesized
caatataatgtctaccatcata

SEQ ID NO: 889344 - DNA, 22 bp, Artificial Sequence
  chemically synthesized
ttaagtatatgatggtagacat

SEQ ID NO: 889345 - DNA, 22 bp, Artificial Sequence
  chemically synthesized
taagtatatgatggtagacatt

SEQ ID NO: 889346 - DNA, 22 bp, Artificial Sequence
  chemically synthesized
aagtatatgatggtagacatta

SEQ ID NO: 889347 - DNA, 22 bp, Artificial Sequence
  chemically synthesized
agtatatgatggtagacattat

SEQ ID NO: 889348 - DNA, 22 bp, Artificial Sequence
  chemically synthesized
tattgcaatggtatttggattc

SEQ ID NO: 889349 - DNA, 22 bp, Artificial Sequence
  chemically synthesized
gaatgtatcccgtggaatccaa

SEQ ID NO: 889350 - DNA, 22 bp, Artificial Sequence
  chemically synthesized
agaatgtatcccgtggaatcca

SEQ ID NO: 889351 - DNA, 22 bp, Artificial Sequence
  chemically synthesized
caatggtatttggattccacgg

SEQ ID NO: 889352 - DNA, 22 bp, Artificial Sequence
  chemically synthesized
tagtacagtttagaatgtatcc

SEQ ID NO: 889353 - DNA, 22 bp, Artificial Sequence
  chemically synthesized
atagtacagtttagaatgtatc

SEQ ID NO: 889354 - DNA, 22 bp, Artificial Sequence
  chemically synthesized
ggattccacgggatacattcta

SEQ ID NO: 889355 - DNA, 22 bp, Artificial Sequence
  chemically synthesized
gattccacgggatacattctaa

SEQ ID NO: 889356 - DNA, 22 bp, Artificial Sequence
  chemically synthesized
cacgggatacattctaaactgt

SEQ ID NO: 889357 - DNA, 22 bp, Artificial Sequence
  chemically synthesized
aaagggtttatagtacagttta

SEQ ID NO: 889358 - DNA, 22 bp, Artificial Sequence
  chemically synthesized
aaaagggtttatagtacagttt

SEQ ID NO: 889359 - DNA, 22 bp, Artificial Sequence
  chemically synthesized
taaaagggtttatagtacagtt

SEQ ID NO: 889360 - DNA, 22 bp, Artificial Sequence
  chemically synthesized
acattttaaaagggtttatagt

SEQ ID NO: 889361 - DNA, 22 bp, Artificial Sequence
  chemically synthesized
taaactgtactataaacccttt

SEQ ID NO: 889362 - DNA, 22 bp, Artificial Sequence
  chemically synthesized
aactgtactataaaccctttta

SEQ ID NO: 889363 - DNA, 22 bp, Artificial Sequence
  chemically synthesized
tactataaacccttttaaaatg

SEQ ID NO: 889364 - DNA, 22 bp, Artificial Sequence
  chemically synthesized
taaacccttttaaaatgtcaat

SEQ ID NO: 889365 - DNA, 22 bp, Artificial Sequence
  chemically synthesized
ggatacagtaaatattgacatt

SEQ ID NO: 889366 - DNA, 22 bp, Artificial Sequence
  chemically synthesized
gggatacagtaaatattgacat

SEQ ID NO: 889367 - DNA, 22 bp, Artificial Sequence
  chemically synthesized
cccttgggatacagtaaatatt

SEQ ID NO: 889368 - DNA, 22 bp, Artificial Sequence
  chemically synthesized
ttaaaatgtcaatatttactgt

SEQ ID NO: 889369 - DNA, 22 bp, Artificial Sequence
  chemically synthesized
tgcccttgggatacagtaaata

SEQ ID NO: 889370 - DNA, 22 bp, Artificial Sequence
  chemically synthesized
taaaatgtcaatatttactgta

SEQ ID NO: 889371 - DNA, 22 bp, Artificial Sequence
  chemically synthesized
ctgcccttgggatacagtaaat

SEQ ID NO: 889372 - DNA, 22 bp, Artificial Sequence
  chemically synthesized
aaaatgtcaatatttactgtat

SEQ ID NO: 889373 - DNA, 22 bp, Artificial Sequence
  chemically synthesized
tctgcccttgggatacagtaaa

SEQ ID NO: 889374 - DNA, 22 bp, Artificial Sequence
  chemically synthesized
aaatgtcaatatttactgtatc

SEQ ID NO: 889375 - DNA, 22 bp, Artificial Sequence
  chemically synthesized
ttttctgcccttgggatacagt

SEQ ID NO: 889376 - DNA, 22 bp, Artificial Sequence
  chemically synthesized
actgtatcccaagggcagaaaa

SEQ ID NO: 889377 - DNA, 22 bp, Artificial Sequence
  chemically synthesized
ctgtatcccaagggcagaaaat

SEQ ID NO: 889378 - DNA, 22 bp, Artificial Sequence
  chemically synthesized
aagatgacatctattttctgcc

SEQ ID NO: 889379 - DNA, 22 bp, Artificial Sequence
  chemically synthesized
aaagatgacatctattttctgc

SEQ ID NO: 889380 - DNA, 22 bp, Artificial Sequence
  chemically synthesized
taaagatgacatctattttctg

SEQ ID NO: 889381 - DNA, 22 bp, Artificial Sequence
  chemically synthesized
tatcccaagggcagaaaataga

SEQ ID NO: 889382 - DNA, 22 bp, Artificial Sequence
  chemically synthesized
cacattttaaagatgacatcta

SEQ ID NO: 889383 - DNA, 22 bp, Artificial Sequence
  chemically synthesized
gcacattttaaagatgacatct

SEQ ID NO: 889384 - DNA, 22 bp, Artificial Sequence
  chemically synthesized
cttgcacattttaaagatgaca

SEQ ID NO: 889385 - DNA, 22 bp, Artificial Sequence
  chemically synthesized
aatatctgcttgcacattttaa

SEQ ID NO: 889386 - DNA, 22 bp, Artificial Sequence
  chemically synthesized
gaaaattgaatatctgcttgca

SEQ ID NO: 889387 - DNA, 22 bp, Artificial Sequence
  chemically synthesized
agaaaattgaatatctgcttgc

SEQ ID NO: 889388 - DNA, 22 bp, Artificial Sequence
  chemically synthesized
tagaaaattgaatatctgcttg

SEQ ID NO: 889389 - DNA, 22 bp, Artificial Sequence
  chemically synthesized
taaaatgtgcaagcagatattc

SEQ ID NO: 889390 - DNA, 22 bp, Artificial Sequence
  chemically synthesized
aaaatgtgcaagcagatattca

SEQ ID NO: 889391 - DNA, 22 bp, Artificial Sequence
  chemically synthesized
aaatgtgcaagcagatattcaa

SEQ ID NO: 889392 - DNA, 22 bp, Artificial Sequence
  chemically synthesized
taaaaaataaaaatattttaga

SEQ ID NO: 889393 - DNA, 22 bp, Artificial Sequence
  chemically synthesized
ataaaaaataaaaatattttag

SEQ ID NO: 889394 - DNA, 22 bp, Artificial Sequence
  chemically synthesized
tatttataaaaaataaaaatat

SEQ ID NO: 889395 - DNA, 22 bp, Artificial Sequence
  chemically synthesized
aattttctaaaatatttttatt

SEQ ID NO: 889396 - DNA, 22 bp, Artificial Sequence
  chemically synthesized
tctaaaatatttttatttttta

SEQ ID NO: 889397 - DNA, 22 bp, Artificial Sequence
  chemically synthesized
ctaaaatatttttattttttat

SEQ ID NO: 889398 - DNA, 22 bp, Artificial Sequence
  chemically synthesized
taaaatatttttattttttata

SEQ ID NO: 889399 - DNA, 22 bp, Artificial Sequence
  chemically synthesized
agaccattgtatttataaaaaa

SEQ ID NO: 889400 - DNA, 22 bp, Artificial Sequence
  chemically synthesized
aaatatttttattttttataaa

SEQ ID NO: 889401 - DNA, 22 bp, Artificial Sequence
  chemically synthesized
ttattttttataaatacaatgg

SEQ ID NO: 889402 - DNA, 22 bp, Artificial Sequence
  chemically synthesized
tattttttataaatacaatggt

SEQ ID NO: 889403 - DNA, 22 bp, Artificial Sequence
  chemically synthesized
attttttataaatacaatggtc

SEQ ID NO: 889404 - DNA, 22 bp, Artificial Sequence
  chemically synthesized
tagtggcattcagaccattgta

SEQ ID NO: 889405 - DNA, 22 bp, Artificial Sequence
  chemically synthesized
ttttttataaatacaatggtct

SEQ ID NO: 889406 - DNA, 22 bp, Artificial Sequence
  chemically synthesized
ttatagtggcattcagaccatt

SEQ ID NO: 889407 - DNA, 22 bp, Artificial Sequence
  chemically synthesized
tttataaatacaatggtctgaa

SEQ ID NO: 889408 - DNA, 22 bp, Artificial Sequence
  chemically synthesized
ttataaatacaatggtctgaat

SEQ ID NO: 889409 - DNA, 22 bp, Artificial Sequence
  chemically synthesized
tattatagtggcattcagacca

SEQ ID NO: 889410 - DNA, 22 bp, Artificial Sequence
  chemically synthesized
tataaatacaatggtctgaatg

SEQ ID NO: 889411 - DNA, 22 bp, Artificial Sequence
  chemically synthesized
ataaatacaatggtctgaatgc

SEQ ID NO: 889412 - DNA, 22 bp, Artificial Sequence
  chemically synthesized
taaatacaatggtctgaatgcc

SEQ ID NO: 889413 - DNA, 22 bp, Artificial Sequence
  chemically synthesized
aaagaacctctattatagtggc

SEQ ID NO: 889414 - DNA, 22 bp, Artificial Sequence
  chemically synthesized
caaagaacctctattatagtgg

SEQ ID NO: 889415 - DNA, 22 bp, Artificial Sequence
  chemically synthesized
aatgccactataatagaggttc
